United States Patent 11,254,933 (CRISPR/CAS TRANSCRIPTIONAL MODULATION) - sequence listing, part 12

SEQ ID NO: 511986 - DNA, 20 bp, mouse
gtaacactcaccaaactcac

SEQ ID NO: 511987 - DNA, 20 bp, mouse
gcactcaccaaactcacagg

SEQ ID NO: 511988 - DNA, 20 bp, mouse
gtagggctgtaggctcccaa

SEQ ID NO: 511989 - DNA, 20 bp, mouse
ggctactgggttcttagtta

SEQ ID NO: 511990 - DNA, 20 bp, mouse
gcttctccctcctgtgagtt

SEQ ID NO: 511991 - DNA, 20 bp, mouse
ggccaaagttgaagagtgag

SEQ ID NO: 511992 - DNA, 20 bp, mouse
gaaccttcaaggaagcaggt

SEQ ID NO: 511993 - DNA, 20 bp, mouse
gtaggctagaacaatataaa

SEQ ID NO: 511994 - DNA, 20 bp, mouse
gggagctctcaggttgagta

SEQ ID NO: 511995 - DNA, 20 bp, mouse
ggaagcaggtaggtgtgcag

SEQ ID NO: 511996 - DNA, 20 bp, mouse
gaggtcggtcagtcgctcgg

SEQ ID NO: 511997 - DNA, 20 bp, mouse
gggtgctgggcgcgtcgtgg

SEQ ID NO: 511998 - DNA, 20 bp, mouse
gtcgggacgcgcgtggaggt

SEQ ID NO: 511999 - DNA, 20 bp, mouse
ggcgggctgaggaagaccag

SEQ ID NO: 512000 - DNA, 20 bp, mouse
gaagaccagtgggtactcgc

SEQ ID NO: 512001 - DNA, 20 bp, mouse
gtcagtcgctcggaggtgct

SEQ ID NO: 512002 - DNA, 20 bp, mouse
gagttcccgcgagtacccac

SEQ ID NO: 512003 - DNA, 20 bp, mouse
gggaggtgctgggcgcgtcg

SEQ ID NO: 512004 - DNA, 20 bp, mouse
gtggaggtcggtcagtcgct

SEQ ID NO: 512005 - DNA, 20 bp, mouse
ggcccggcggaggactagga

SEQ ID NO: 512006 - DNA, 20 bp, mouse
gccacagggccgtgcctcac

SEQ ID NO: 512007 - DNA, 20 bp, mouse
gtggccccagaggtgcttct

SEQ ID NO: 512008 - DNA, 20 bp, mouse
gtggactcggagtactacag

SEQ ID NO: 512009 - DNA, 20 bp, mouse
ggtcgccgggacacctgagg

SEQ ID NO: 512010 - DNA, 20 bp, mouse
ggccaggaaggacgtgacgg

SEQ ID NO: 512011 - DNA, 20 bp, mouse
ggccgggacacctgaggagg

SEQ ID NO: 512012 - DNA, 20 bp, mouse
gctcgcccgagactccggag

SEQ ID NO: 512013 - DNA, 20 bp, mouse
gagggccgtgcctcaccggc

SEQ ID NO: 512014 - DNA, 20 bp, mouse
gggtccaggaaggtctacca

SEQ ID NO: 512015 - DNA, 20 bp, mouse
gcaggtgtcccggcgacgag

SEQ ID NO: 512016 - DNA, 20 bp, mouse
gacaactgctaccaagactg

SEQ ID NO: 512017 - DNA, 20 bp, mouse
gaaagccctgggcaccgcag

SEQ ID NO: 512018 - DNA, 20 bp, mouse
gaagcgcacacattccaggt

SEQ ID NO: 512019 - DNA, 20 bp, mouse
gtttctcctcaccccagtct

SEQ ID NO: 512020 - DNA, 20 bp, mouse
gcatggtctgaagtccgacc

SEQ ID NO: 512021 - DNA, 20 bp, mouse
gagcaaggatggtcatctca

SEQ ID NO: 512022 - DNA, 20 bp, mouse
ggtagcagttgtctgtatct

SEQ ID NO: 512023 - DNA, 20 bp, mouse
gaagaaggtaacaacccctg

SEQ ID NO: 512024 - DNA, 20 bp, mouse
ggtctgtatcttggttgtat

SEQ ID NO: 512025 - DNA, 20 bp, mouse
gaccatcgcaaacacatgca

SEQ ID NO: 512026 - DNA, 20 bp, mouse
gtactctccccagtcttcca

SEQ ID NO: 512027 - DNA, 20 bp, mouse
ggactggggagagtaattta

SEQ ID NO: 512028 - DNA, 20 bp, mouse
ggcttcacccagctcagtcc

SEQ ID NO: 512029 - DNA, 20 bp, mouse
gagccatcctccagtctctg

SEQ ID NO: 512030 - DNA, 20 bp, mouse
gctaagagtaaggttttcct

SEQ ID NO: 512031 - DNA, 20 bp, mouse
gaggttttccttggaagact

SEQ ID NO: 512032 - DNA, 20 bp, mouse
gtttctcacgactaagagta

SEQ ID NO: 512033 - DNA, 20 bp, mouse
gcctaagagtcaggaaataa

SEQ ID NO: 512034 - DNA, 20 bp, mouse
gccaggtagcagcacttgag

SEQ ID NO: 512035 - DNA, 20 bp, mouse
gggggatgaccggtgactct

SEQ ID NO: 512036 - DNA, 20 bp, mouse
ggagctccagtagcactgac

SEQ ID NO: 512037 - DNA, 20 bp, mouse
gcaggcagccccatgccccg

SEQ ID NO: 512038 - DNA, 20 bp, mouse
gaggccacacaaaagcacca

SEQ ID NO: 512039 - DNA, 20 bp, mouse
gtgggcggccccggggcatg

SEQ ID NO: 512040 - DNA, 20 bp, mouse
gcactgactggtcgcactgc

SEQ ID NO: 512041 - DNA, 20 bp, mouse
gtggccctggtgcttttgtg

SEQ ID NO: 512042 - DNA, 20 bp, mouse
gggctaactctaagacaggt

SEQ ID NO: 512043 - DNA, 20 bp, mouse
ggtgcgtagggaagaggccc

SEQ ID NO: 512044 - DNA, 20 bp, mouse
gccagaagggaggccctgtc

SEQ ID NO: 512045 - DNA, 20 bp, mouse
gccacgactgcagaccagaa

SEQ ID NO: 512046 - DNA, 20 bp, mouse
gtccagcagttccctctctc

SEQ ID NO: 512047 - DNA, 20 bp, mouse
gtccagagagagggaactgc

SEQ ID NO: 512048 - DNA, 20 bp, mouse
gtgaaaacagaagtacccat

SEQ ID NO: 512049 - DNA, 20 bp, mouse
gaaactactgaagatcctta

SEQ ID NO: 512050 - DNA, 20 bp, mouse
gagggaatctcatttcccta

SEQ ID NO: 512051 - DNA, 20 bp, mouse
gaccccatgaaaggctgcta

SEQ ID NO: 512052 - DNA, 20 bp, mouse
gaaggaaatgggagacctat

SEQ ID NO: 512053 - DNA, 20 bp, mouse
ggccaagacaacctgtgttg

SEQ ID NO: 512054 - DNA, 20 bp, mouse
gagggttagggcaaggaaat

SEQ ID NO: 512055 - DNA, 20 bp, mouse
gctactggacaggcaacata

SEQ ID NO: 512056 - DNA, 20 bp, mouse
gtcggggcctggccaggtag

SEQ ID NO: 512057 - DNA, 20 bp, mouse
gagcggcggaacccattcca

SEQ ID NO: 512058 - DNA, 20 bp, mouse
gccagccgcgcaccaaccaa

SEQ ID NO: 512059 - DNA, 20 bp, mouse
gagcggggcgggaccagagt

SEQ ID NO: 512060 - DNA, 20 bp, mouse
ggcggaaccaggcctgggac

SEQ ID NO: 512061 - DNA, 20 bp, mouse
gtgggacaggagtctaatcg

SEQ ID NO: 512062 - DNA, 20 bp, mouse
gtgggcggtaccaggcctgt

SEQ ID NO: 512063 - DNA, 20 bp, mouse
gtggccctgctgttgtttct

SEQ ID NO: 512064 - DNA, 20 bp, mouse
ggctggcggcgccgatgttt

SEQ ID NO: 512065 - DNA, 20 bp, mouse
gcgcgggaggcaccgttggt

SEQ ID NO: 512066 - DNA, 20 bp, mouse
ggaacgcgcggctcttgaaa

SEQ ID NO: 512067 - DNA, 20 bp, mouse
ggggcgagcagaagactcag

SEQ ID NO: 512068 - DNA, 20 bp, mouse
gcatgaaacgcggggaggga

SEQ ID NO: 512069 - DNA, 20 bp, mouse
ggctcgcagggcacagagca

SEQ ID NO: 512070 - DNA, 20 bp, mouse
gtcatgcagctgatctgaaa

SEQ ID NO: 512071 - DNA, 20 bp, mouse
gcggccggcgagctaggctc

SEQ ID NO: 512072 - DNA, 20 bp, mouse
ggtgccctgcgagccaaggt

SEQ ID NO: 512073 - DNA, 20 bp, mouse
gtcgtgcatgctccaatcca

SEQ ID NO: 512074 - DNA, 20 bp, mouse
gccggctctaatatactccg

SEQ ID NO: 512075 - DNA, 20 bp, mouse
ggcaccagcgctagcagcgg

SEQ ID NO: 512076 - DNA, 20 bp, mouse
gcaccgcagccaacaagttc

SEQ ID NO: 512077 - DNA, 20 bp, mouse
gcccggcggcgcacaggcgg

SEQ ID NO: 512078 - DNA, 20 bp, mouse
gcccggctcccacccggcgg

SEQ ID NO: 512079 - DNA, 20 bp, mouse
ggcccgccctccgagcccgg

SEQ ID NO: 512080 - DNA, 20 bp, mouse
gcggtccggagccctaggaa

SEQ ID NO: 512081 - DNA, 20 bp, mouse
gagtctcgtcccgaacttgt

SEQ ID NO: 512082 - DNA, 20 bp, mouse
gtactgcagccgctctccgg

SEQ ID NO: 512083 - DNA, 20 bp, mouse
gtccgagcccggcggcgcac

SEQ ID NO: 512084 - DNA, 20 bp, mouse
ggcttactgcagccgctctc

SEQ ID NO: 512085 - DNA, 20 bp, mouse
gcgccgccgggctcggaggg

SEQ ID NO: 512086 - DNA, 20 bp, mouse
gagcagggaaggggttcgca

SEQ ID NO: 512087 - DNA, 20 bp, mouse
gggccgaggtagcagggaag

SEQ ID NO: 512088 - DNA, 20 bp, mouse
gaagccgggccgaggtagca

SEQ ID NO: 512089 - DNA, 20 bp, mouse
gtgtagtgaaagccgggccg

SEQ ID NO: 512090 - DNA, 20 bp, mouse
gggcggagcctgcagatcct

SEQ ID NO: 512091 - DNA, 20 bp, mouse
gcagtcctcccaggatagag

SEQ ID NO: 512092 - DNA, 20 bp, mouse
ggcgacagcgtgaggaccac

SEQ ID NO: 512093 - DNA, 20 bp, mouse
gcgcgagcggccggcaccga

SEQ ID NO: 512094 - DNA, 20 bp, mouse
gacgccgtgtagtgaaagcc

SEQ ID NO: 512095 - DNA, 20 bp, mouse
ggagaggccggaagttctcc

SEQ ID NO: 512096 - DNA, 20 bp, mouse
ggacacccgcggctaaggag

SEQ ID NO: 512097 - DNA, 20 bp, mouse
ggctaaggagaggcaccgaa

SEQ ID NO: 512098 - DNA, 20 bp, mouse
gggaccccgcggcgcgtcag

SEQ ID NO: 512099 - DNA, 20 bp, mouse
ggcggctgccggctactccg

SEQ ID NO: 512100 - DNA, 20 bp, mouse
gggtccggcgtggacacccg

SEQ ID NO: 512101 - DNA, 20 bp, mouse
gcgaaaggacgagcgaggct

SEQ ID NO: 512102 - DNA, 20 bp, mouse
gggcaccgaaaggacgagcg

SEQ ID NO: 512103 - DNA, 20 bp, mouse
gagtggtgagtgtcccggtg

SEQ ID NO: 512104 - DNA, 20 bp, mouse
gagctcggggaccgtgagag

SEQ ID NO: 512105 - DNA, 20 bp, mouse
ggtccccgagctggccacgg

SEQ ID NO: 512106 - DNA, 20 bp, mouse
ggcgagctcgcccagagcgg

SEQ ID NO: 512107 - DNA, 20 bp, mouse
ggccgcgctgacaggctggg

SEQ ID NO: 512108 - DNA, 20 bp, mouse
gagccctcgccgggacggac

SEQ ID NO: 512109 - DNA, 20 bp, mouse
gcgcgcgagctcgcccagag

SEQ ID NO: 512110 - DNA, 20 bp, mouse
gtcgggcgggccgaggtcta

SEQ ID NO: 512111 - DNA, 20 bp, mouse
gggcctcccgccgcgctgac

SEQ ID NO: 512112 - DNA, 20 bp, mouse
gcgcgcgggagggcccccga

SEQ ID NO: 512113 - DNA, 20 bp, mouse
gcgccaggctgggccctcgg

SEQ ID NO: 512114 - DNA, 20 bp, mouse
gcgaggtctagggagccccc

SEQ ID NO: 512115 - DNA, 20 bp, mouse
gccgcactcacatcccgcag

SEQ ID NO: 512116 - DNA, 20 bp, mouse
gccgaggcaaaggacagccg

SEQ ID NO: 512117 - DNA, 20 bp, mouse
gagctgcaggtaggagcgcg

SEQ ID NO: 512118 - DNA, 20 bp, mouse
gtgcagctgtgccgaggcaa

SEQ ID NO: 512119 - DNA, 20 bp, mouse
gcctacctgcagctgtgccg

SEQ ID NO: 512120 - DNA, 20 bp, mouse
gagcgcggggcacaggttca

SEQ ID NO: 512121 - DNA, 20 bp, mouse
gggacagccgaggctgcgac

SEQ ID NO: 512122 - DNA, 20 bp, mouse
ggctcaggggccgcacagga

SEQ ID NO: 512123 - DNA, 20 bp, mouse
gaagccagcagggctacgga

SEQ ID NO: 512124 - DNA, 20 bp, mouse
ggactttcctgtcgcagcct

SEQ ID NO: 512125 - DNA, 20 bp, mouse
gtcctagaacagggagggtg

SEQ ID NO: 512126 - DNA, 20 bp, mouse
gtcgcacacgggttccccac

SEQ ID NO: 512127 - DNA, 20 bp, mouse
gacctggaccgtagccgagg

SEQ ID NO: 512128 - DNA, 20 bp, mouse
gcgaggaggctcggcccgtg

SEQ ID NO: 512129 - DNA, 20 bp, mouse
gcccgtgtgcgatgcgggaa

SEQ ID NO: 512130 - DNA, 20 bp, mouse
ggtgtgcgatgcgggaacgg

SEQ ID NO: 512131 - DNA, 20 bp, mouse
gctagcggctgcagatcggt

SEQ ID NO: 512132 - DNA, 20 bp, mouse
ggaccggcgccgcacgctag

SEQ ID NO: 512133 - DNA, 20 bp, mouse
gatctgcagccgctagcgtg

SEQ ID NO: 512134 - DNA, 20 bp, mouse
ggtcggagcgtcaagcaggt

SEQ ID NO: 512135 - DNA, 20 bp, mouse
ggaccgtagccgaggaggct

SEQ ID NO: 512136 - DNA, 20 bp, mouse
gtctggccgtggaggttgaa

SEQ ID NO: 512137 - DNA, 20 bp, mouse
gatttacagagtgctccctg

SEQ ID NO: 512138 - DNA, 20 bp, mouse
gcgtggaggttgaaaggctg

SEQ ID NO: 512139 - DNA, 20 bp, mouse
gcaacctccacggccagagg

SEQ ID NO: 512140 - DNA, 20 bp, mouse
gttgcctcctctggccgtgg

SEQ ID NO: 512141 - DNA, 20 bp, mouse
gagctacagcacctgccgca

SEQ ID NO: 512142 - DNA, 20 bp, mouse
ggaaagaggctgggagacca

SEQ ID NO: 512143 - DNA, 20 bp, mouse
gggatgtaacagccactgaa

SEQ ID NO: 512144 - DNA, 20 bp, mouse
ggatttgcctcctctggccg

SEQ ID NO: 512145 - DNA, 20 bp, mouse
gaacagccaggaagcctcgg

SEQ ID NO: 512146 - DNA, 20 bp, mouse
gagagtaccagcagtagagg

SEQ ID NO: 512147 - DNA, 20 bp, mouse
gacaccatcctccaagaggg

SEQ ID NO: 512148 - DNA, 20 bp, mouse
gactagagtaccagcagtag

SEQ ID NO: 512149 - DNA, 20 bp, mouse
gctcacaccatcctccaaga

SEQ ID NO: 512150 - DNA, 20 bp, mouse
gacttgagcctcctccctct

SEQ ID NO: 512151 - DNA, 20 bp, mouse
ggagagaggaaggttgtccg

SEQ ID NO: 512152 - DNA, 20 bp, mouse
gagagggaggggaaaaatcc

SEQ ID NO: 512153 - DNA, 20 bp, mouse
gttgcagcagacacctcctc

SEQ ID NO: 512154 - DNA, 20 bp, mouse
gactctagtggagctggaaa

SEQ ID NO: 512155 - DNA, 20 bp, mouse
gggcagccgcagctgatgtt

SEQ ID NO: 512156 - DNA, 20 bp, mouse
ggcctacgagggactatccg

SEQ ID NO: 512157 - DNA, 20 bp, mouse
gaccacggatagtccctcgt

SEQ ID NO: 512158 - DNA, 20 bp, mouse
gcagggccacgcgcctacga

SEQ ID NO: 512159 - DNA, 20 bp, mouse
ggcgcccgcgagttgcacgt

SEQ ID NO: 512160 - DNA, 20 bp, mouse
ggggtgagtgattcctacca

SEQ ID NO: 512161 - DNA, 20 bp, mouse
gcacatccagcacgcaatga

SEQ ID NO: 512162 - DNA, 20 bp, mouse
ggcctgatcgaggggaacct

SEQ ID NO: 512163 - DNA, 20 bp, mouse
gaactcgcgggcgctgctca

SEQ ID NO: 512164 - DNA, 20 bp, mouse
gatctggggaagccaagggg

SEQ ID NO: 512165 - DNA, 20 bp, mouse
gtccggaccccggatcacca

SEQ ID NO: 512166 - DNA, 20 bp, mouse
gctgcaggcgagggtcccgg

SEQ ID NO: 512167 - DNA, 20 bp, mouse
gctcccagcacttcgcccgg

SEQ ID NO: 512168 - DNA, 20 bp, mouse
gtagctgagggtccccctgc

SEQ ID NO: 512169 - DNA, 20 bp, mouse
gcccggcggcggagcagagg

SEQ ID NO: 512170 - DNA, 20 bp, mouse
gtcgcccggcggcggagcag

SEQ ID NO: 512171 - DNA, 20 bp, mouse
gaggagcgcgacaggcggct

SEQ ID NO: 512172 - DNA, 20 bp, mouse
gcagctggctgcctagctga

SEQ ID NO: 512173 - DNA, 20 bp, mouse
gctggtatagccagaccgga

SEQ ID NO: 512174 - DNA, 20 bp, mouse
gcgcctgtcgcgctcctgca

SEQ ID NO: 512175 - DNA, 20 bp, mouse
gcgctggagacaccccagac

SEQ ID NO: 512176 - DNA, 20 bp, mouse
ggtccggccgagaagctgag

SEQ ID NO: 512177 - DNA, 20 bp, mouse
gcctcacattcccctcgaca

SEQ ID NO: 512178 - DNA, 20 bp, mouse
gcggccggacctggagtcgt

SEQ ID NO: 512179 - DNA, 20 bp, mouse
gaccgtggcagatgcctcac

SEQ ID NO: 512180 - DNA, 20 bp, mouse
ggaggggctcaggctcggag

SEQ ID NO: 512181 - DNA, 20 bp, mouse
gcagtcgaagtcgcagccgc

SEQ ID NO: 512182 - DNA, 20 bp, mouse
ggtgtggtacccagaagtcg

SEQ ID NO: 512183 - DNA, 20 bp, mouse
gggcctctgcgggagcgtgg

SEQ ID NO: 512184 - DNA, 20 bp, mouse
gcggccctctagaaggaccg

SEQ ID NO: 512185 - DNA, 20 bp, mouse
gcgaggctccgtgagcggtc

SEQ ID NO: 512186 - DNA, 20 bp, mouse
ggaagagtcaactccagcgg

SEQ ID NO: 512187 - DNA, 20 bp, mouse
gtttagtaaaacactcataa

SEQ ID NO: 512188 - DNA, 20 bp, mouse
gtgtctgttgtatgtttcgg

SEQ ID NO: 512189 - DNA, 20 bp, mouse
gaactacagatcagatacta

SEQ ID NO: 512190 - DNA, 20 bp, mouse
gtgtttgcttcgctcgtctt

SEQ ID NO: 512191 - DNA, 20 bp, mouse
gttgcaaaaaaatatcctgg

SEQ ID NO: 512192 - DNA, 20 bp, mouse
gctcttaacaacacatcctt

SEQ ID NO: 512193 - DNA, 20 bp, mouse
gctacatcagcgaaacgtga

SEQ ID NO: 512194 - DNA, 20 bp, mouse
gaaggcgaatctggttttgg

SEQ ID NO: 512195 - DNA, 20 bp, mouse
gttgtgtctgttgtatgttt

SEQ ID NO: 512196 - DNA, 20 bp, mouse
gtcgcagagccgactccggg

SEQ ID NO: 512197 - DNA, 20 bp, mouse
ggagtccgcagcccccgaag

SEQ ID NO: 512198 - DNA, 20 bp, mouse
gatcgagagccccccggagt

SEQ ID NO: 512199 - DNA, 20 bp, mouse
ggcgctcgcagagccgactc

SEQ ID NO: 512200 - DNA, 20 bp, mouse
gctcgatgtagcaccatgac

SEQ ID NO: 512201 - DNA, 20 bp, mouse
gcggcaggtgttggagaaga

SEQ ID NO: 512202 - DNA, 20 bp, mouse
ggcccgggacggaggagagg

SEQ ID NO: 512203 - DNA, 20 bp, mouse
ggcggcggcgatgcctgtca

SEQ ID NO: 512204 - DNA, 20 bp, mouse
gcccccgaagcggcaggtgt

SEQ ID NO: 512205 - DNA, 20 bp, mouse
gacatcggtgaggcccgggt

SEQ ID NO: 512206 - DNA, 20 bp, mouse
gagcctgcgggagggacact

SEQ ID NO: 512207 - DNA, 20 bp, mouse
gccgccagcgccccccgtcg

SEQ ID NO: 512208 - DNA, 20 bp, mouse
gcactcggcggccgcgacgg

SEQ ID NO: 512209 - DNA, 20 bp, mouse
gcagccggggaaccaccggt

SEQ ID NO: 512210 - DNA, 20 bp, mouse
gcccgccacagcctgcggga

SEQ ID NO: 512211 - DNA, 20 bp, mouse
gagggcccgctatatagccg

SEQ ID NO: 512212 - DNA, 20 bp, mouse
gtccctcccgcaggctgtgg

SEQ ID NO: 512213 - DNA, 20 bp, mouse
gggacactcggcggccgcga

SEQ ID NO: 512214 - DNA, 20 bp, mouse
gcgccgcccgccacagcctg

SEQ ID NO: 512215 - DNA, 20 bp, mouse
gaccgtgcagaagccgctgg

SEQ ID NO: 512216 - DNA, 20 bp, mouse
ggccgaggcccgacccggag

SEQ ID NO: 512217 - DNA, 20 bp, mouse
gagggaggcgcaggcggcag

SEQ ID NO: 512218 - DNA, 20 bp, mouse
gcggtgaccgcaggcgacgg

SEQ ID NO: 512219 - DNA, 20 bp, mouse
gaagatggccggagcggcgg

SEQ ID NO: 512220 - DNA, 20 bp, mouse
gaccgaccccgctgccgcgg

SEQ ID NO: 512221 - DNA, 20 bp, mouse
gggtcggtgaccgcaggcga

SEQ ID NO: 512222 - DNA, 20 bp, mouse
gttaaagatggccggagcgg

SEQ ID NO: 512223 - DNA, 20 bp, mouse
ggcgacggcggtgggactga

SEQ ID NO: 512224 - DNA, 20 bp, mouse
gcgctccagtcagcgagcgg

SEQ ID NO: 512225 - DNA, 20 bp, mouse
ggcgcgagcgagcaaggtcg

SEQ ID NO: 512226 - DNA, 20 bp, mouse
gctgatccccggcttctcag

SEQ ID NO: 512227 - DNA, 20 bp, mouse
ggttcggacccgctgatccc

SEQ ID NO: 512228 - DNA, 20 bp, mouse
gaggttcccctgagaagccg

SEQ ID NO: 512229 - DNA, 20 bp, mouse
gttctcaggggaacctagtg

SEQ ID NO: 512230 - DNA, 20 bp, mouse
gcgctgtggcccggatgttc

SEQ ID NO: 512231 - DNA, 20 bp, mouse
gagtgtggccaatgggtaag

SEQ ID NO: 512232 - DNA, 20 bp, mouse
gccgggagaagtcagtgcct

SEQ ID NO: 512233 - DNA, 20 bp, mouse
gggagcggctgagagcgctg

SEQ ID NO: 512234 - DNA, 20 bp, mouse
gtaatcgaccacttacccat

SEQ ID NO: 512235 - DNA, 20 bp, mouse
ggagcctctgagctcaaacc

SEQ ID NO: 512236 - DNA, 20 bp, mouse
ggggccgcgcgtgaggtcgt

SEQ ID NO: 512237 - DNA, 20 bp, mouse
gccgcgcgtgaggtcgtggg

SEQ ID NO: 512238 - DNA, 20 bp, mouse
gcgggtcgtcgagcgtgcag

SEQ ID NO: 512239 - DNA, 20 bp, mouse
gggcccacaggcaaactgac

SEQ ID NO: 512240 - DNA, 20 bp, mouse
ggacctcacgcgcggcccac

SEQ ID NO: 512241 - DNA, 20 bp, mouse
gctcgccggccgccacgcac

SEQ ID NO: 512242 - DNA, 20 bp, mouse
gcccggcgcagtggcggcca

SEQ ID NO: 512243 - DNA, 20 bp, mouse
gatgccgaggagccgaccgc

SEQ ID NO: 512244 - DNA, 20 bp, mouse
gtgcctgtgggccgcgcgtg

SEQ ID NO: 512245 - DNA, 20 bp, mouse
gtcgcctgcggtcggctcct

SEQ ID NO: 512246 - DNA, 20 bp, mouse
ggcccggaacgaaaagccac

SEQ ID NO: 512247 - DNA, 20 bp, mouse
gtgctggaatgtcgcacctg

SEQ ID NO: 512248 - DNA, 20 bp, mouse
gcaccccaaatagggaccgg

SEQ ID NO: 512249 - DNA, 20 bp, mouse
ggctagggactgggtctcgg

SEQ ID NO: 512250 - DNA, 20 bp, mouse
ggacattccagcaggaacgc

SEQ ID NO: 512251 - DNA, 20 bp, mouse
gcgccaccgccgctagggac

SEQ ID NO: 512252 - DNA, 20 bp, mouse
gccggggccggacagactag

SEQ ID NO: 512253 - DNA, 20 bp, mouse
gtctgcagcagaagtatggt

SEQ ID NO: 512254 - DNA, 20 bp, mouse
gtgaccccagaggcccagtc

SEQ ID NO: 512255 - DNA, 20 bp, mouse
ggagacccagtccctagcgg

SEQ ID NO: 512256 - DNA, 20 bp, mouse
ggcccaacccaaagctccgg

SEQ ID NO: 512257 - DNA, 20 bp, mouse
gggcgccgggccggagcgaa

SEQ ID NO: 512258 - DNA, 20 bp, mouse
gcaacccaaagctccggtgg

SEQ ID NO: 512259 - DNA, 20 bp, mouse
gggcgcgggaccccacacga

SEQ ID NO: 512260 - DNA, 20 bp, mouse
gcggagcgaagggcgtctcg

SEQ ID NO: 512261 - DNA, 20 bp, mouse
gggactcgctcgactggacc

SEQ ID NO: 512262 - DNA, 20 bp, mouse
ggcacggccgcggggttcag

SEQ ID NO: 512263 - DNA, 20 bp, mouse
ggacgcccttcgctccggcc

SEQ ID NO: 512264 - DNA, 20 bp, mouse
gaaagctccggtggcggctg

SEQ ID NO: 512265 - DNA, 20 bp, mouse
ggggtcggggcggaaccgga

SEQ ID NO: 512266 - DNA, 20 bp, mouse
ggctctggaggcagttcgga

SEQ ID NO: 512267 - DNA, 20 bp, mouse
ggcgttgcaagagttcccgg

SEQ ID NO: 512268 - DNA, 20 bp, mouse
gtgtcccgcggccgtcatgg

SEQ ID NO: 512269 - DNA, 20 bp, mouse
ggtcatggcggaggcggctc

SEQ ID NO: 512270 - DNA, 20 bp, mouse
ggcggtgagtgcactctcac

SEQ ID NO: 512271 - DNA, 20 bp, mouse
ggatcctggagcggaaatag

SEQ ID NO: 512272 - DNA, 20 bp, mouse
gtcttgtcccgcggccgtca

SEQ ID NO: 512273 - DNA, 20 bp, mouse
ggcggccgtcatggcggagg

SEQ ID NO: 512274 - DNA, 20 bp, mouse
gagggcgttgcaagagttcc

SEQ ID NO: 512275 - DNA, 20 bp, mouse
gggcgtgcgatcctgagcta

SEQ ID NO: 512276 - DNA, 20 bp, mouse
ggccatgagaccaagtccac

SEQ ID NO: 512277 - DNA, 20 bp, mouse
gatgggagcccagtgctcta

SEQ ID NO: 512278 - DNA, 20 bp, mouse
ggggagctccacatagtcag

SEQ ID NO: 512279 - DNA, 20 bp, mouse
gtaaggctccatagagcact

SEQ ID NO: 512280 - DNA, 20 bp, mouse
gagccaccaggccctggatg

SEQ ID NO: 512281 - DNA, 20 bp, mouse
gggggagccaagtcagaaat

SEQ ID NO: 512282 - DNA, 20 bp, mouse
gctgcctggaacctattccc

SEQ ID NO: 512283 - DNA, 20 bp, mouse
gggtatgtggggagccccag

SEQ ID NO: 512284 - DNA, 20 bp, mouse
gaccaaaaggaagggccagg

SEQ ID NO: 512285 - DNA, 20 bp, mouse
gctccccatccagggcctgg

SEQ ID NO: 512286 - DNA, 20 bp, mouse
ggccgccgccatgaacatac

SEQ ID NO: 512287 - DNA, 20 bp, mouse
gtgcacccgtatgttcatgg

SEQ ID NO: 512288 - DNA, 20 bp, mouse
ggcagcagcagtaatggagg

SEQ ID NO: 512289 - DNA, 20 bp, mouse
ggaggaggagcgttgcacag

SEQ ID NO: 512290 - DNA, 20 bp, mouse
gcaccatcccccttcgccag

SEQ ID NO: 512291 - DNA, 20 bp, mouse
gacccgtatgttcatggcgg

SEQ ID NO: 512292 - DNA, 20 bp, mouse
gatcccccttcgccagaggc

SEQ ID NO: 512293 - DNA, 20 bp, mouse
gggaattgcagcagcagtaa

SEQ ID NO: 512294 - DNA, 20 bp, mouse
gcgttgcacagtggagcgtc

SEQ ID NO: 512295 - DNA, 20 bp, mouse
gtgcctgcctctggcgaagg

SEQ ID NO: 512296 - DNA, 20 bp, mouse
gccacgagggacgtaaacac

SEQ ID NO: 512297 - DNA, 20 bp, mouse
ggacgtctgcggctccacga

SEQ ID NO: 512298 - DNA, 20 bp, mouse
gcattcggctgtgacgtctg

SEQ ID NO: 512299 - DNA, 20 bp, mouse
gcagccgaatggcaacattg

SEQ ID NO: 512300 - DNA, 20 bp, mouse
gacgtaaacacgggcacgtg

SEQ ID NO: 512301 - DNA, 20 bp, mouse
gcggcacgctgctgacgcgg

SEQ ID NO: 512302 - DNA, 20 bp, mouse
gggcccagggccctgcgctg

SEQ ID NO: 512303 - DNA, 20 bp, mouse
gtgccgcagcgcagggccct

SEQ ID NO: 512304 - DNA, 20 bp, mouse
gggctgcaggcgccccgcaa

SEQ ID NO: 512305 - DNA, 20 bp, mouse
gccccgcaagggtgagctgg

SEQ ID NO: 512306 - DNA, 20 bp, mouse
gccacgcgcggacaagcagg

SEQ ID NO: 512307 - DNA, 20 bp, mouse
gtgtccgcgcgtgggccagg

SEQ ID NO: 512308 - DNA, 20 bp, mouse
ggtcacgtgaggccagtccc

SEQ ID NO: 512309 - DNA, 20 bp, mouse
ggcggcccgcaagctccagg

SEQ ID NO: 512310 - DNA, 20 bp, mouse
gggagccgcggaaaggggaa

SEQ ID NO: 512311 - DNA, 20 bp, mouse
gcacctgagcccgacgtcag

SEQ ID NO: 512312 - DNA, 20 bp, mouse
gagcaggcggcggagcgggc

SEQ ID NO: 512313 - DNA, 20 bp, mouse
gctccgaagaccgggttggg

SEQ ID NO: 512314 - DNA, 20 bp, mouse
ggtggcggcccgcaagctcc

SEQ ID NO: 512315 - DNA, 20 bp, mouse
gagagctagcgaggatcgga

SEQ ID NO: 512316 - DNA, 20 bp, mouse
gtccctaggcagcgaccggg

SEQ ID NO: 512317 - DNA, 20 bp, mouse
gcagtcagcgtgctaccacc

SEQ ID NO: 512318 - DNA, 20 bp, mouse
gcattccctaggcagcgacc

SEQ ID NO: 512319 - DNA, 20 bp, mouse
ggaccgctttcgcattccct

SEQ ID NO: 512320 - DNA, 20 bp, mouse
gggtagcacgctgactgagc

SEQ ID NO: 512321 - DNA, 20 bp, mouse
gattcccgaaggcctccgta

SEQ ID NO: 512322 - DNA, 20 bp, mouse
gctcgttgccaggtgaaggg

SEQ ID NO: 512323 - DNA, 20 bp, mouse
gaccacccggtcgctgccta

SEQ ID NO: 512324 - DNA, 20 bp, mouse
gcgctgactgagcaggcgaa

SEQ ID NO: 512325 - DNA, 20 bp, mouse
ggccttcgggaatcgcagtt

SEQ ID NO: 512326 - DNA, 20 bp, mouse
gctcgtgggggcacaaacgt

SEQ ID NO: 512327 - DNA, 20 bp, mouse
gggcgacggcgaaagaggag

SEQ ID NO: 512328 - DNA, 20 bp, mouse
ggccccggcgcgctcctcgt

SEQ ID NO: 512329 - DNA, 20 bp, mouse
gggccagcgccgcgcgcgag

SEQ ID NO: 512330 - DNA, 20 bp, mouse
gaaagtccgctctggagact

SEQ ID NO: 512331 - DNA, 20 bp, mouse
gaccccggagctacaccctg

SEQ ID NO: 512332 - DNA, 20 bp, mouse
gggcagagctgggcaccgca

SEQ ID NO: 512333 - DNA, 20 bp, mouse
gcttccgcccgtcattcggg

SEQ ID NO: 512334 - DNA, 20 bp, mouse
gctgccccccgaatgacggg

SEQ ID NO: 512335 - DNA, 20 bp, mouse
gagcagctgaaagtccgctc

SEQ ID NO: 512336 - DNA, 20 bp, mouse
gccagcggctgcttcagggt

SEQ ID NO: 512337 - DNA, 20 bp, mouse
gcggtttagcagcccagccg

SEQ ID NO: 512338 - DNA, 20 bp, mouse
gccttctcatccaccccagt

SEQ ID NO: 512339 - DNA, 20 bp, mouse
gagcccggtggtgagtctag

SEQ ID NO: 512340 - DNA, 20 bp, mouse
gcgacaatttagcctcggct

SEQ ID NO: 512341 - DNA, 20 bp, mouse
gggggccagcggctgcttca

SEQ ID NO: 512342 - DNA, 20 bp, mouse
gggtggcgacaatttagcct

SEQ ID NO: 512343 - DNA, 20 bp, mouse
gctacgcccaagctggagga

SEQ ID NO: 512344 - DNA, 20 bp, mouse
gttcaaagagggacagttcc

SEQ ID NO: 512345 - DNA, 20 bp, mouse
gcttgttggggtgactgagg

SEQ ID NO: 512346 - DNA, 20 bp, mouse
gggaccgggcagcggcactg

SEQ ID NO: 512347 - DNA, 20 bp, mouse
gccgggcagcggcactgcgg

SEQ ID NO: 512348 - DNA, 20 bp, mouse
gcaccgatcccggccggacc

SEQ ID NO: 512349 - DNA, 20 bp, mouse
gctcccgctggagacaggac

SEQ ID NO: 512350 - DNA, 20 bp, mouse
gtcccggccggaccgggcag

SEQ ID NO: 512351 - DNA, 20 bp, mouse
gcgctggagacaggaccggg

SEQ ID NO: 512352 - DNA, 20 bp, mouse
gcgcgcggccgcctggagag

SEQ ID NO: 512353 - DNA, 20 bp, mouse
gcgcgcggctgcaccgatcc

SEQ ID NO: 512354 - DNA, 20 bp, mouse
gacaggaccgggaggaggcg

SEQ ID NO: 512355 - DNA, 20 bp, mouse
gacgatggagggtcctactg

SEQ ID NO: 512356 - DNA, 20 bp, mouse
gggctcagagacccccacgg

SEQ ID NO: 512357 - DNA, 20 bp, mouse
gagggagaaggcaggcggag

SEQ ID NO: 512358 - DNA, 20 bp, mouse
gccacggtggaaagaaaccg

SEQ ID NO: 512359 - DNA, 20 bp, mouse
ggccttctccctcacctcag

SEQ ID NO: 512360 - DNA, 20 bp, mouse
ggttcgctacccctgaggtg

SEQ ID NO: 512361 - DNA, 20 bp, mouse
ggggtggtgcgaggatgctc

SEQ ID NO: 512362 - DNA, 20 bp, mouse
ggggccaggcagatttaaag

SEQ ID NO: 512363 - DNA, 20 bp, mouse
gtccaaacccagcatcaagg

SEQ ID NO: 512364 - DNA, 20 bp, mouse
ggaaagaaaccgtggcatgc

SEQ ID NO: 512365 - DNA, 20 bp, mouse
gacccagagaaggaaggtgg

SEQ ID NO: 512366 - DNA, 20 bp, mouse
ggagcctccaagtcagtcgg

SEQ ID NO: 512367 - DNA, 20 bp, mouse
gcgtttccggccggtagcgg

SEQ ID NO: 512368 - DNA, 20 bp, mouse
gagtgggagaagctcctaag

SEQ ID NO: 512369 - DNA, 20 bp, mouse
gcagcccagacgacacacgg

SEQ ID NO: 512370 - DNA, 20 bp, mouse
gcctccaagtcagtcggcgg

SEQ ID NO: 512371 - DNA, 20 bp, mouse
gtggcgtttccggccggtag

SEQ ID NO: 512372 - DNA, 20 bp, mouse
ggcggcggcacggggtccgc

SEQ ID NO: 512373 - DNA, 20 bp, mouse
ggaccccgtgccgccgctac

SEQ ID NO: 512374 - DNA, 20 bp, mouse
gaaggccgagaagagcgggc

SEQ ID NO: 512375 - DNA, 20 bp, mouse
ggggccggtggagagctgcg

SEQ ID NO: 512376 - DNA, 20 bp, mouse
ggggctgcagaggctgaaac

SEQ ID NO: 512377 - DNA, 20 bp, mouse
gctctgcagcccagacgctg

SEQ ID NO: 512378 - DNA, 20 bp, mouse
gccctgacatggtgagaatc

SEQ ID NO: 512379 - DNA, 20 bp, mouse
gaacaggtcgagtgttctta

SEQ ID NO: 512380 - DNA, 20 bp, mouse
gcgcttccgcttccctgaca

SEQ ID NO: 512381 - DNA, 20 bp, mouse
gtcagggaagcggaagcgtg

SEQ ID NO: 512382 - DNA, 20 bp, mouse
gccttgctagcctcagcgtc

SEQ ID NO: 512383 - DNA, 20 bp, mouse
gattggtgaaacaacagtca

SEQ ID NO: 512384 - DNA, 20 bp, mouse
gtaaagaaacttgaagatgg

SEQ ID NO: 512385 - DNA, 20 bp, mouse
ggggcaaggcagaaggtgac

SEQ ID NO: 512386 - DNA, 20 bp, mouse
gcggaggctgtcgggtaaga

SEQ ID NO: 512387 - DNA, 20 bp, mouse
gtgagagacaagatagtgga

SEQ ID NO: 512388 - DNA, 20 bp, mouse
ggacaagatagtggacggag

SEQ ID NO: 512389 - DNA, 20 bp, mouse
gacccgacagcctccgagct

SEQ ID NO: 512390 - DNA, 20 bp, mouse
gagcccagctcggaggctgt

SEQ ID NO: 512391 - DNA, 20 bp, mouse
gtgtcgggtaagaggggctg

SEQ ID NO: 512392 - DNA, 20 bp, mouse
gaagatagtggacggagggg

SEQ ID NO: 512393 - DNA, 20 bp, mouse
gaggaactggagacccttat

SEQ ID NO: 512394 - DNA, 20 bp, mouse
ggcctgggatggacaggaac

SEQ ID NO: 512395 - DNA, 20 bp, mouse
gagacccttatgggcatcag

SEQ ID NO: 512396 - DNA, 20 bp, mouse
ggagagcacccgggaagagt

SEQ ID NO: 512397 - DNA, 20 bp, mouse
gtcgcggaggctcctggtcc

SEQ ID NO: 512398 - DNA, 20 bp, mouse
gggcgacgccgactcttccc

SEQ ID NO: 512399 - DNA, 20 bp, mouse
gcaaacagacgagagcaccc

SEQ ID NO: 512400 - DNA, 20 bp, mouse
gtggcccagactgagaactc

SEQ ID NO: 512401 - DNA, 20 bp, mouse
gggagcctccgcgagcaaga

SEQ ID NO: 512402 - DNA, 20 bp, mouse
gagtcggcgtcgccagtgcc

SEQ ID NO: 512403 - DNA, 20 bp, mouse
gggagcggccatcttgctcg

SEQ ID NO: 512404 - DNA, 20 bp, mouse
ggcggccatcttgctcgcgg

SEQ ID NO: 512405 - DNA, 20 bp, mouse
gtcggcctcggtctcgggag

SEQ ID NO: 512406 - DNA, 20 bp, mouse
ggcctggcaggagagcgctc

SEQ ID NO: 512407 - DNA, 20 bp, mouse
gctcagagttgcactgagtg

SEQ ID NO: 512408 - DNA, 20 bp, mouse
gctgctgacagcatcgagag

SEQ ID NO: 512409 - DNA, 20 bp, mouse
gccggagtccgcggccgacc

SEQ ID NO: 512410 - DNA, 20 bp, mouse
gagaagaagctcacaagtcc

SEQ ID NO: 512411 - DNA, 20 bp, mouse
gcgcacaggcggctgaagtt

SEQ ID NO: 512412 - DNA, 20 bp, mouse
gcccgaccgcgcgaggaaat

SEQ ID NO: 512413 - DNA, 20 bp, mouse
gatgaacagtccggagtccg

SEQ ID NO: 512414 - DNA, 20 bp, mouse
gggcgctggatccaagcagt

SEQ ID NO: 512415 - DNA, 20 bp, mouse
ggttgagctcaggctggata

SEQ ID NO: 512416 - DNA, 20 bp, mouse
ggccagcgtaggatcctgct

SEQ ID NO: 512417 - DNA, 20 bp, mouse
ggctgggagcggggaactga

SEQ ID NO: 512418 - DNA, 20 bp, mouse
ggaaagcaggcgcaccacgg

SEQ ID NO: 512419 - DNA, 20 bp, mouse
gcgagaaagcaggcgcacca

SEQ ID NO: 512420 - DNA, 20 bp, mouse
gtcccagcaggatcctacgc

SEQ ID NO: 512421 - DNA, 20 bp, mouse
ggaagcgacgccgagaaagc

SEQ ID NO: 512422 - DNA, 20 bp, mouse
gtggggctggggccgagcac

SEQ ID NO: 512423 - DNA, 20 bp, mouse
ggacccttgagaccccgata

SEQ ID NO: 512424 - DNA, 20 bp, mouse
ggcccggggcggcccttcag

SEQ ID NO: 512425 - DNA, 20 bp, mouse
ggcgagcggcgagctgtcct

SEQ ID NO: 512426 - DNA, 20 bp, mouse
gcatcggagccggtctgtac

SEQ ID NO: 512427 - DNA, 20 bp, mouse
ggtccgctgcccgtacagac

SEQ ID NO: 512428 - DNA, 20 bp, mouse
ggtgctactggggcccccgg

SEQ ID NO: 512429 - DNA, 20 bp, mouse
gccccgacggcgcccccgac

SEQ ID NO: 512430 - DNA, 20 bp, mouse
gtctagagggaagtaaagag

SEQ ID NO: 512431 - DNA, 20 bp, mouse
ggggcatacggggccccccg

SEQ ID NO: 512432 - DNA, 20 bp, mouse
gacagaagtgccagagacag

SEQ ID NO: 512433 - DNA, 20 bp, mouse
ggcgcctcctcgccatagaa

SEQ ID NO: 512434 - DNA, 20 bp, mouse
ggaagccagcagcccgtcgg

SEQ ID NO: 512435 - DNA, 20 bp, mouse
gagccggtctgtacgggcag

SEQ ID NO: 512436 - DNA, 20 bp, mouse
gtgagctcggcgcactcggg

SEQ ID NO: 512437 - DNA, 20 bp, mouse
gaactgagctcggcgcactc

SEQ ID NO: 512438 - DNA, 20 bp, mouse
gctgctccggactctggcca

SEQ ID NO: 512439 - DNA, 20 bp, mouse
ggcgggcagcgaactgagct

SEQ ID NO: 512440 - DNA, 20 bp, mouse
gcggcggctgctccggactc

SEQ ID NO: 512441 - DNA, 20 bp, mouse
ggcggtttcagggcaggtga

SEQ ID NO: 512442 - DNA, 20 bp, mouse
gcaggtgagggcgggtgtca

SEQ ID NO: 512443 - DNA, 20 bp, mouse
ggccgggaggctggttccag

SEQ ID NO: 512444 - DNA, 20 bp, mouse
ggcgagctctggggccctgg

SEQ ID NO: 512445 - DNA, 20 bp, mouse
ggccagacccgaccccgatt

SEQ ID NO: 512446 - DNA, 20 bp, mouse
gagcgcaccggggctctcgt

SEQ ID NO: 512447 - DNA, 20 bp, mouse
gaggcaggcgcagcgcaccg

SEQ ID NO: 512448 - DNA, 20 bp, mouse
gcccgaggattacccaacgg

SEQ ID NO: 512449 - DNA, 20 bp, mouse
gcgatgtccgggaagagcgg

SEQ ID NO: 512450 - DNA, 20 bp, mouse
gcgtagagctgaacgtggga

SEQ ID NO: 512451 - DNA, 20 bp, mouse
gctacgatgtccgggaagag

SEQ ID NO: 512452 - DNA, 20 bp, mouse
gctctggcggacagcacccg

SEQ ID NO: 512453 - DNA, 20 bp, mouse
gagctggcccgggacagcaa

SEQ ID NO: 512454 - DNA, 20 bp, mouse
ggcccccgttgggtaatcct

SEQ ID NO: 512455 - DNA, 20 bp, mouse
gtgcgctccgggaagtagtc

SEQ ID NO: 512456 - DNA, 20 bp, mouse
gggcaggcgggaacaggacc

SEQ ID NO: 512457 - DNA, 20 bp, mouse
gggcggtgctggaacttaca

SEQ ID NO: 512458 - DNA, 20 bp, mouse
gaggctggcgggactgagaa

SEQ ID NO: 512459 - DNA, 20 bp, mouse
ggaggacggcaggcgggaac

SEQ ID NO: 512460 - DNA, 20 bp, mouse
gcagcccaaagagggacctc

SEQ ID NO: 512461 - DNA, 20 bp, mouse
gcgggactgagaagggaacg

SEQ ID NO: 512462 - DNA, 20 bp, mouse
gcagggagttgggccacctt

SEQ ID NO: 512463 - DNA, 20 bp, mouse
ggctgttgcttcccttgtag

SEQ ID NO: 512464 - DNA, 20 bp, mouse
gttccagcaccgccggggtg

SEQ ID NO: 512465 - DNA, 20 bp, mouse
gcttcccttgtagaggtgag

SEQ ID NO: 512466 - DNA, 20 bp, mouse
gcggcgctggaggtgagtag

SEQ ID NO: 512467 - DNA, 20 bp, mouse
gtcaccgctggcgctcgagg

SEQ ID NO: 512468 - DNA, 20 bp, mouse
gcagggtagagtcggagttc

SEQ ID NO: 512469 - DNA, 20 bp, mouse
ggtgaggctgggcaccctgt

SEQ ID NO: 512470 - DNA, 20 bp, mouse
ggccccagatcgtccctgca

SEQ ID NO: 512471 - DNA, 20 bp, mouse
ggcgccaagagtgtgaggct

SEQ ID NO: 512472 - DNA, 20 bp, mouse
ggagcgccagcggtgatccc

SEQ ID NO: 512473 - DNA, 20 bp, mouse
gcccaggcgactgctagcca

SEQ ID NO: 512474 - DNA, 20 bp, mouse
gtccagattcgcggcgctgg

SEQ ID NO: 512475 - DNA, 20 bp, mouse
gtgtgccagctccagattcg

SEQ ID NO: 512476 - DNA, 20 bp, mouse
gtcgagcgtgccaggcgagt

SEQ ID NO: 512477 - DNA, 20 bp, mouse
gaagcttgcggcgactgagg

SEQ ID NO: 512478 - DNA, 20 bp, mouse
gaggacgcctgggacggcgg

SEQ ID NO: 512479 - DNA, 20 bp, mouse
gtgggacggagggctgatcg

SEQ ID NO: 512480 - DNA, 20 bp, mouse
gtgcggcgactgaggcggag

SEQ ID NO: 512481 - DNA, 20 bp, mouse
gcgcaagcttgcggcgactg

SEQ ID NO: 512482 - DNA, 20 bp, mouse
ggacggagggctgatcgggg

SEQ ID NO: 512483 - DNA, 20 bp, mouse
gggcgcccgggagactggag

SEQ ID NO: 512484 - DNA, 20 bp, mouse
ggccctccgtcccactcgcc

SEQ ID NO: 512485 - DNA, 20 bp, mouse
ggccggaccaggcccctcag

SEQ ID NO: 512486 - DNA, 20 bp, mouse
gcccgtgcggagcttcgagg

SEQ ID NO: 512487 - DNA, 20 bp, mouse
ggagtcctggaggggaacag

SEQ ID NO: 512488 - DNA, 20 bp, mouse
gaaccacgcgagtcctggag

SEQ ID NO: 512489 - DNA, 20 bp, mouse
gttacctgaatgagaagccc

SEQ ID NO: 512490 - DNA, 20 bp, mouse
gccatccaggacctaaccag

SEQ ID NO: 512491 - DNA, 20 bp, mouse
gtaaagccgaccggagaggg

SEQ ID NO: 512492 - DNA, 20 bp, mouse
gatctagggtcccccctctc

SEQ ID NO: 512493 - DNA, 20 bp, mouse
gacacccctcccggacactt

SEQ ID NO: 512494 - DNA, 20 bp, mouse
gggggggaccctagattatt

SEQ ID NO: 512495 - DNA, 20 bp, mouse
ggtcctggatggccatgtgg

SEQ ID NO: 512496 - DNA, 20 bp, mouse
ggtgcaccccgaagccgggt

SEQ ID NO: 512497 - DNA, 20 bp, mouse
ggcagctgcacggtcttcag

SEQ ID NO: 512498 - DNA, 20 bp, mouse
ggccgggacgcactagctgt

SEQ ID NO: 512499 - DNA, 20 bp, mouse
ggcccagcccggcgacctga

SEQ ID NO: 512500 - DNA, 20 bp, mouse
ggcccacagctagtgcgtcc

SEQ ID NO: 512501 - DNA, 20 bp, mouse
ggtcccgcagctggcgcggt

SEQ ID NO: 512502 - DNA, 20 bp, mouse
gcccgggcgcgcacaccctc

SEQ ID NO: 512503 - DNA, 20 bp, mouse
ggcttcctgccagaaccccg

SEQ ID NO: 512504 - DNA, 20 bp, mouse
gccggacgcggacggtgcag

SEQ ID NO: 512505 - DNA, 20 bp, mouse
gcctgagccgggagtccgga

SEQ ID NO: 512506 - DNA, 20 bp, mouse
gagacgagtcggcttcgcta

SEQ ID NO: 512507 - DNA, 20 bp, mouse
gggcggcactgggaaaatgg

SEQ ID NO: 512508 - DNA, 20 bp, mouse
ggccgccccccaagccgccg

SEQ ID NO: 512509 - DNA, 20 bp, mouse
gtgcccaggccgggtcggaa

SEQ ID NO: 512510 - DNA, 20 bp, mouse
gccccccgcccggaaagtca

SEQ ID NO: 512511 - DNA, 20 bp, mouse
gccaggccgggtcggaacgg

SEQ ID NO: 512512 - DNA, 20 bp, mouse
gggcggcggcactgggaaaa

SEQ ID NO: 512513 - DNA, 20 bp, mouse
gtccgcttcagattaaaggg

SEQ ID NO: 512514 - DNA, 20 bp, mouse
ggccgggtcggaacggagga

SEQ ID NO: 512515 - DNA, 20 bp, mouse
gcgccgtgcccaggccgggt

SEQ ID NO: 512516 - DNA, 20 bp, mouse
gcgggcggactgttaaaccg

SEQ ID NO: 512517 - DNA, 20 bp, mouse
ggcggactgttaaaccgcgg

SEQ ID NO: 512518 - DNA, 20 bp, mouse
ggcgcgctctggagacgagt

SEQ ID NO: 512519 - DNA, 20 bp, mouse
gcgctctggagacgagtcgg

SEQ ID NO: 512520 - DNA, 20 bp, mouse
gcggcggcggagggcagcca

SEQ ID NO: 512521 - DNA, 20 bp, mouse
gcgagtggccggcgtcgcag

SEQ ID NO: 512522 - DNA, 20 bp, mouse
ggccggggcccgcagtccaa

SEQ ID NO: 512523 - DNA, 20 bp, mouse
ggactgttaaaccgcggcgg

SEQ ID NO: 512524 - DNA, 20 bp, mouse
gcacggccggaccgaaggtg

SEQ ID NO: 512525 - DNA, 20 bp, mouse
gagcccgcgagtccacccgg

SEQ ID NO: 512526 - DNA, 20 bp, mouse
ggagcagcgcctaacagcaa

SEQ ID NO: 512527 - DNA, 20 bp, mouse
gagcaggcggagcagccaga

SEQ ID NO: 512528 - DNA, 20 bp, mouse
gacagcaaaggagaagcgcc

SEQ ID NO: 512529 - DNA, 20 bp, mouse
gcgcggtgggggaggtaaga

SEQ ID NO: 512530 - DNA, 20 bp, mouse
gagccagagggcaagctgcg

SEQ ID NO: 512531 - DNA, 20 bp, mouse
gcgggagccgtgggacaaga

SEQ ID NO: 512532 - DNA, 20 bp, mouse
gcaagctgcgcggtgccgcg

SEQ ID NO: 512533 - DNA, 20 bp, mouse
gaggtaagatggcgccgtgc

SEQ ID NO: 512534 - DNA, 20 bp, mouse
gcaccgcgcagcttgccctc

SEQ ID NO: 512535 - DNA, 20 bp, mouse
gccacgcggcaccactgcaa

SEQ ID NO: 512536 - DNA, 20 bp, mouse
gagcgcgcggccgacaactg

SEQ ID NO: 512537 - DNA, 20 bp, mouse
ggacaactgcgggtgagacg

SEQ ID NO: 512538 - DNA, 20 bp, mouse
gcccaacgcctggaacccca

SEQ ID NO: 512539 - DNA, 20 bp, mouse
gccgaggagggccccgggag

SEQ ID NO: 512540 - DNA, 20 bp, mouse
gcgaggcgcgaggccgagga

SEQ ID NO: 512541 - DNA, 20 bp, mouse
gcccaaggcgccgggaggta

SEQ ID NO: 512542 - DNA, 20 bp, mouse
ggcgcattggggtccggctc

SEQ ID NO: 512543 - DNA, 20 bp, mouse
gcatgcccgcggagccccga

SEQ ID NO: 512544 - DNA, 20 bp, mouse
ggcgcacgcgcattggggtc

SEQ ID NO: 512545 - DNA, 20 bp, mouse
ggagcccgccgcccaacgcc

SEQ ID NO: 512546 - DNA, 20 bp, mouse
ggttaaggcaaccagtgaac

SEQ ID NO: 512547 - DNA, 20 bp, mouse
gaaagcatcatgctttagta

SEQ ID NO: 512548 - DNA, 20 bp, mouse
gtcatgctttagtagggtta

SEQ ID NO: 512549 - DNA, 20 bp, mouse
gacagaagacagtgatcacc

SEQ ID NO: 512550 - DNA, 20 bp, mouse
ggccaggtcaaatattatca

SEQ ID NO: 512551 - DNA, 20 bp, mouse
ggtcttctgtggtctgactg

SEQ ID NO: 512552 - DNA, 20 bp, mouse
ggttcgtgtggaaatgggtg

SEQ ID NO: 512553 - DNA, 20 bp, mouse
gcatacctaattctgacagg

SEQ ID NO: 512554 - DNA, 20 bp, mouse
gtgactgaagcccacttcac

SEQ ID NO: 512555 - DNA, 20 bp, mouse
ggagtgattgagctatgatt

SEQ ID NO: 512556 - DNA, 20 bp, mouse
gtcctcctggggcatcctgg

SEQ ID NO: 512557 - DNA, 20 bp, mouse
gctggaggctgtaggttcta

SEQ ID NO: 512558 - DNA, 20 bp, mouse
gcccaggaggatcaactgcg

SEQ ID NO: 512559 - DNA, 20 bp, mouse
ggtagggacgagcataccta

SEQ ID NO: 512560 - DNA, 20 bp, mouse
gcggtgggtgagcacatgct

SEQ ID NO: 512561 - DNA, 20 bp, mouse
ggccttggcgggaaaactcc

SEQ ID NO: 512562 - DNA, 20 bp, mouse
gaaaagacaagagggacccc

SEQ ID NO: 512563 - DNA, 20 bp, mouse
gaggacttagagccacgacc

SEQ ID NO: 512564 - DNA, 20 bp, mouse
gaactccaggcacttcccat

SEQ ID NO: 512565 - DNA, 20 bp, mouse
ggtccctacggctaggacca

SEQ ID NO: 512566 - DNA, 20 bp, mouse
ggccatggcctcccccgcag

SEQ ID NO: 512567 - DNA, 20 bp, mouse
gggcctcccccgcagcggag

SEQ ID NO: 512568 - DNA, 20 bp, mouse
ggcctgggaaggttccgcca

SEQ ID NO: 512569 - DNA, 20 bp, mouse
ggcgcggcgccgctccgctg

SEQ ID NO: 512570 - DNA, 20 bp, mouse
gcccagccctagggccgcat

SEQ ID NO: 512571 - DNA, 20 bp, mouse
gcgccgcgctcccagcccta

SEQ ID NO: 512572 - DNA, 20 bp, mouse
gggttgcccatgcggcccta

SEQ ID NO: 512573 - DNA, 20 bp, mouse
ggcccatgcggccctagggc

SEQ ID NO: 512574 - DNA, 20 bp, mouse
gcaggccccaaacccggtcc

SEQ ID NO: 512575 - DNA, 20 bp, mouse
gcagcgcgctagccagagga

SEQ ID NO: 512576 - DNA, 20 bp, mouse
gggacgccagcagcgcaggg

SEQ ID NO: 512577 - DNA, 20 bp, mouse
gcgcagggcggcaggtgcct

SEQ ID NO: 512578 - DNA, 20 bp, mouse
ggccagggcccgtaggtgac

SEQ ID NO: 512579 - DNA, 20 bp, mouse
gaccggcgacccgcgagacc

SEQ ID NO: 512580 - DNA, 20 bp, mouse
gccgcccgccgggagcgcca

SEQ ID NO: 512581 - DNA, 20 bp, mouse
gcgggtcgccggtcacctac

SEQ ID NO: 512582 - DNA, 20 bp, mouse
gtccccgcgggcgctggtgg

SEQ ID NO: 512583 - DNA, 20 bp, mouse
gtgcagcggcccggtctcgc

SEQ ID NO: 512584 - DNA, 20 bp, mouse
ggcacggccgagggaccggg

SEQ ID NO: 512585 - DNA, 20 bp, mouse
ggatgctgtgcaagccgcag

SEQ ID NO: 512586 - DNA, 20 bp, mouse
ggccagggtcggctactggg

SEQ ID NO: 512587 - DNA, 20 bp, mouse
ggcgggtccaaggaacctga

SEQ ID NO: 512588 - DNA, 20 bp, mouse
ggaagtgacgtctcccagag

SEQ ID NO: 512589 - DNA, 20 bp, mouse
gccaggacaacgaagatgag

SEQ ID NO: 512590 - DNA, 20 bp, mouse
ggaggggccggaagtggcag

SEQ ID NO: 512591 - DNA, 20 bp, mouse
ggtgagtccggtgcccgggg

SEQ ID NO: 512592 - DNA, 20 bp, mouse
gggcggggcggagggagcca

SEQ ID NO: 512593 - DNA, 20 bp, mouse
gcccagggggagataatcga

SEQ ID NO: 512594 - DNA, 20 bp, mouse
ggacagcgcggcgccagggt

SEQ ID NO: 512595 - DNA, 20 bp, mouse
ggtggtgagtccggtgcccg

SEQ ID NO: 512596 - DNA, 20 bp, mouse
gaagacagccgggatcccgg

SEQ ID NO: 512597 - DNA, 20 bp, mouse
ggagatgccccaaactgaca

SEQ ID NO: 512598 - DNA, 20 bp, mouse
ggagctcactgtctccaaga

SEQ ID NO: 512599 - DNA, 20 bp, mouse
ggagacagtgagctccgact

SEQ ID NO: 512600 - DNA, 20 bp, mouse
ggcccctcggctccttacct

SEQ ID NO: 512601 - DNA, 20 bp, mouse
gctggcgcagagcagcgggg

SEQ ID NO: 512602 - DNA, 20 bp, mouse
gggcagctgggagcgaccgg

SEQ ID NO: 512603 - DNA, 20 bp, mouse
gtggcggccgtgtcagtttg

SEQ ID NO: 512604 - DNA, 20 bp, mouse
gtcagtttggggcatctccg

SEQ ID NO: 512605 - DNA, 20 bp, mouse
gccccaggtaaggagccgag

SEQ ID NO: 512606 - DNA, 20 bp, mouse
gtgtcaacgacaacaacagg

SEQ ID NO: 512607 - DNA, 20 bp, mouse
gtgccgccgccgccaggggt

SEQ ID NO: 512608 - DNA, 20 bp, mouse
gtagctcctacccctggcgg

SEQ ID NO: 512609 - DNA, 20 bp, mouse
gacagggggacacaaaatgg

SEQ ID NO: 512610 - DNA, 20 bp, mouse
gttcccagggggaggagact

SEQ ID NO: 512611 - DNA, 20 bp, mouse
ggcggggctcaggaatggaa

SEQ ID NO: 512612 - DNA, 20 bp, mouse
ggcagcggtggcgggcgcta

SEQ ID NO: 512613 - DNA, 20 bp, mouse
gcaccccgcgcgttcccagg

SEQ ID NO: 512614 - DNA, 20 bp, mouse
ggcggggcagagggattcta

SEQ ID NO: 512615 - DNA, 20 bp, mouse
gtacggctgccgcctggagg

SEQ ID NO: 512616 - DNA, 20 bp, mouse
gcggctggcaaaggacgagg

SEQ ID NO: 512617 - DNA, 20 bp, mouse
ggggcggctggcaaaggacg

SEQ ID NO: 512618 - DNA, 20 bp, mouse
ggcggcgctgcggacccggg

SEQ ID NO: 512619 - DNA, 20 bp, mouse
gcccggtctgcagcaacaaa

SEQ ID NO: 512620 - DNA, 20 bp, mouse
ggaggctgaggaaggcagcg

SEQ ID NO: 512621 - DNA, 20 bp, mouse
gtagtcgcccgggacaggac

SEQ ID NO: 512622 - DNA, 20 bp, mouse
gtccgtatgggatggcgaag

SEQ ID NO: 512623 - DNA, 20 bp, mouse
ggcctcttcgccatcccata

SEQ ID NO: 512624 - DNA, 20 bp, mouse
ggcttgctccccctccgtat

SEQ ID NO: 512625 - DNA, 20 bp, mouse
gtcgccatcccatacggagg

SEQ ID NO: 512626 - DNA, 20 bp, mouse
ggaaggctctagacgctgag

SEQ ID NO: 512627 - DNA, 20 bp, mouse
ggctctagacgctgagaggt

SEQ ID NO: 512628 - DNA, 20 bp, mouse
ggcagcaccagcaggaacgg

SEQ ID NO: 512629 - DNA, 20 bp, mouse
gacagctacagaggccgcca

SEQ ID NO: 512630 - DNA, 20 bp, mouse
gtgagaggtaggaggcactt

SEQ ID NO: 512631 - DNA, 20 bp, mouse
ggggtttgggacagctacag

SEQ ID NO: 512632 - DNA, 20 bp, mouse
gtgggatcgtccgcagggtt

SEQ ID NO: 512633 - DNA, 20 bp, mouse
ggtagctaggctaggttcgg

SEQ ID NO: 512634 - DNA, 20 bp, mouse
gaggccgccacggagcccgc

SEQ ID NO: 512635 - DNA, 20 bp, mouse
ggcacttgggatcgtccgca

SEQ ID NO: 512636 - DNA, 20 bp, mouse
gacttccggcacagcaatgg

SEQ ID NO: 512637 - DNA, 20 bp, mouse
ggtcacttccggcacagcaa

SEQ ID NO: 512638 - DNA, 20 bp, mouse
gcttcaggaactgtagggga

SEQ ID NO: 512639 - DNA, 20 bp, mouse
gctctctggccggtcacttc

SEQ ID NO: 512640 - DNA, 20 bp, mouse
gcaacaacttcaggaactgt

SEQ ID NO: 512641 - DNA, 20 bp, mouse
gggcacagcaatggcggcac

SEQ ID NO: 512642 - DNA, 20 bp, mouse
gcggatagcacctggcgtga

SEQ ID NO: 512643 - DNA, 20 bp, mouse
ggagggagagcccggcccgg

SEQ ID NO: 512644 - DNA, 20 bp, mouse
gcgccacgcgccggagtcgg

SEQ ID NO: 512645 - DNA, 20 bp, mouse
gtaggaatgggcgctctgtg

SEQ ID NO: 512646 - DNA, 20 bp, mouse
gacccgccgcagctccgggt

SEQ ID NO: 512647 - DNA, 20 bp, mouse
gcgtagagcacgcacttccg

SEQ ID NO: 512648 - DNA, 20 bp, mouse
gcgggaaagcccctcttaaa

SEQ ID NO: 512649 - DNA, 20 bp, mouse
gaactctgggaccctcgtaa

SEQ ID NO: 512650 - DNA, 20 bp, mouse
ggagctgcggcgggtagcct

SEQ ID NO: 512651 - DNA, 20 bp, mouse
gaggatagttcccgcaccgg

SEQ ID NO: 512652 - DNA, 20 bp, mouse
gtcccgacccggagctgcgg

SEQ ID NO: 512653 - DNA, 20 bp, mouse
gccctggtcgggtgtcgcgg

SEQ ID NO: 512654 - DNA, 20 bp, mouse
gaaaaggatagttcccgcac

SEQ ID NO: 512655 - DNA, 20 bp, mouse
gcaccggcggggacacgccc

SEQ ID NO: 512656 - DNA, 20 bp, mouse
gcgcggccggcgcgaagagg

SEQ ID NO: 512657 - DNA, 20 bp, mouse
ggaactaacggactccgggc

SEQ ID NO: 512658 - DNA, 20 bp, mouse
gcgcgccggccgcgaactaa

SEQ ID NO: 512659 - DNA, 20 bp, mouse
gccgcgaactaacggactcc

SEQ ID NO: 512660 - DNA, 20 bp, mouse
ggggctgtcaaggaacgggg

SEQ ID NO: 512661 - DNA, 20 bp, mouse
gcgctcccccggaggagaag

SEQ ID NO: 512662 - DNA, 20 bp, mouse
ggcgaagaggcggtggctca

SEQ ID NO: 512663 - DNA, 20 bp, mouse
gaccagtcgcagggtatcat

SEQ ID NO: 512664 - DNA, 20 bp, mouse
gagccaccgcctcttcgcgc

SEQ ID NO: 512665 - DNA, 20 bp, mouse
ggttcgcggccggcgcgaag

SEQ ID NO: 512666 - DNA, 20 bp, mouse
ggcagcaggcacaggtccgt

SEQ ID NO: 512667 - DNA, 20 bp, mouse
ggcaggcacaggtccgttgg

SEQ ID NO: 512668 - DNA, 20 bp, mouse
gtccattagacactgggcca

SEQ ID NO: 512669 - DNA, 20 bp, mouse
gaagagtagcacgccaccaa

SEQ ID NO: 512670 - DNA, 20 bp, mouse
gctctggccaatcccgaagg

SEQ ID NO: 512671 - DNA, 20 bp, mouse
gacagaggcggccgcccaag

SEQ ID NO: 512672 - DNA, 20 bp, mouse
gagaaagctccattagacac

SEQ ID NO: 512673 - DNA, 20 bp, mouse
ggcgcaagcgcagtagctct

SEQ ID NO: 512674 - DNA, 20 bp, mouse
gtccgatttgcagcaggcac

SEQ ID NO: 512675 - DNA, 20 bp, mouse
gtagaggggcgaactgtgga

SEQ ID NO: 512676 - DNA, 20 bp, mouse
ggctgtagctctggaggcca

SEQ ID NO: 512677 - DNA, 20 bp, mouse
gcctgcagctgtagctctgg

SEQ ID NO: 512678 - DNA, 20 bp, mouse
ggctacagctgcaggtagag

SEQ ID NO: 512679 - DNA, 20 bp, mouse
gcgcgcctggagggaagcct

SEQ ID NO: 512680 - DNA, 20 bp, mouse
gctggagccagtgcccctca

SEQ ID NO: 512681 - DNA, 20 bp, mouse
ggaccaatcagggcaaagga

SEQ ID NO: 512682 - DNA, 20 bp, mouse
gagtgggggtcgcgcctgga

SEQ ID NO: 512683 - DNA, 20 bp, mouse
ggcccctcaaggcagacggg

SEQ ID NO: 512684 - DNA, 20 bp, mouse
ggcaaaggatggaggcaagt

SEQ ID NO: 512685 - DNA, 20 bp, mouse
gggaggctctcggccaggac

SEQ ID NO: 512686 - DNA, 20 bp, mouse
ggcgcgcggcggtgtttgaa

SEQ ID NO: 512687 - DNA, 20 bp, mouse
gggcagctcggagcgtccct

SEQ ID NO: 512688 - DNA, 20 bp, mouse
gtgtgagtggggcccggctg

SEQ ID NO: 512689 - DNA, 20 bp, mouse
gtgtgctgatgaaccgctcc

SEQ ID NO: 512690 - DNA, 20 bp, mouse
ggtccctcggatccccagcc

SEQ ID NO: 512691 - DNA, 20 bp, mouse
ggcccacggggtagctatcc

SEQ ID NO: 512692 - DNA, 20 bp, mouse
gaatggctgtgagtggggcc

SEQ ID NO: 512693 - DNA, 20 bp, mouse
ggccgggatagctaccccgt

SEQ ID NO: 512694 - DNA, 20 bp, mouse
gagcagcgaaggccccaacc

SEQ ID NO: 512695 - DNA, 20 bp, mouse
gcgcggcagcggcctttccg

SEQ ID NO: 512696 - DNA, 20 bp, mouse
gctgttaagggcctagtcca

SEQ ID NO: 512697 - DNA, 20 bp, mouse
ggggcctagtccaaggcact

SEQ ID NO: 512698 - DNA, 20 bp, mouse
gaaggcactaggtgagtcgc

SEQ ID NO: 512699 - DNA, 20 bp, mouse
gtcacctagtgccttggact

SEQ ID NO: 512700 - DNA, 20 bp, mouse
ggtggcaccctgccaggaga

SEQ ID NO: 512701 - DNA, 20 bp, mouse
gtggaaatcccagctgttaa

SEQ ID NO: 512702 - DNA, 20 bp, mouse
gggtgtgtgcatccctgcat

SEQ ID NO: 512703 - DNA, 20 bp, mouse
ggaagcctggtgattcccag

SEQ ID NO: 512704 - DNA, 20 bp, mouse
ggactaggcccttaacagct

SEQ ID NO: 512705 - DNA, 20 bp, mouse
ggatgtaaaaacttcaggtt

SEQ ID NO: 512706 - DNA, 20 bp, mouse
gccgagcgccgggcactccg

SEQ ID NO: 512707 - DNA, 20 bp, mouse
ggagtgcccggcgctcggtg

SEQ ID NO: 512708 - DNA, 20 bp, mouse
gcggcgcgatcctctcacgt

SEQ ID NO: 512709 - DNA, 20 bp, mouse
gccgccgcaccggaggaatc

SEQ ID NO: 512710 - DNA, 20 bp, mouse
gtccgcggccgccgcaccgg

SEQ ID NO: 512711 - DNA, 20 bp, mouse
ggaacaactccagatcctgg

SEQ ID NO: 512712 - DNA, 20 bp, mouse
gcactccgcggccgccgcac

SEQ ID NO: 512713 - DNA, 20 bp, mouse
gggagttgttcccacgtgag

SEQ ID NO: 512714 - DNA, 20 bp, mouse
gtctctggccgggagcgcgt

SEQ ID NO: 512715 - DNA, 20 bp, mouse
gggatcgcgccggattcctc

SEQ ID NO: 512716 - DNA, 20 bp, mouse
gcgcgtgccaacctccgggt

SEQ ID NO: 512717 - DNA, 20 bp, mouse
gtcagtcgctgccaacccgg

SEQ ID NO: 512718 - DNA, 20 bp, mouse
gtcgctgccaacccggaggt

SEQ ID NO: 512719 - DNA, 20 bp, mouse
gccggaggttggcacgcgtg

SEQ ID NO: 512720 - DNA, 20 bp, mouse
gggctcgggtgggtttgcag

SEQ ID NO: 512721 - DNA, 20 bp, mouse
gccgatgccgggaacgcgcc

SEQ ID NO: 512722 - DNA, 20 bp, mouse
gtactcagtcgctgccaacc

SEQ ID NO: 512723 - DNA, 20 bp, mouse
ggcacgcgtgcggaggagcc

SEQ ID NO: 512724 - DNA, 20 bp, mouse
ggcgcgtcctgggctcgggt

SEQ ID NO: 512725 - DNA, 20 bp, mouse
ggagagcggcgagctgcgag

SEQ ID NO: 512726 - DNA, 20 bp, mouse
gagcagcagcgagtaagtag

SEQ ID NO: 512727 - DNA, 20 bp, mouse
gtaagtaggggcctagagag

SEQ ID NO: 512728 - DNA, 20 bp, mouse
gcctagtcacggcgccatgg

SEQ ID NO: 512729 - DNA, 20 bp, mouse
gaccggccggccgaccgagg

SEQ ID NO: 512730 - DNA, 20 bp, mouse
gccccgcgtgtgcctagtca

SEQ ID NO: 512731 - DNA, 20 bp, mouse
gtgccgcagggagaccggag

SEQ ID NO: 512732 - DNA, 20 bp, mouse
ggcggccgctgaccccacac

SEQ ID NO: 512733 - DNA, 20 bp, mouse
gagtcacggcgccatggcgg

SEQ ID NO: 512734 - DNA, 20 bp, mouse
ggtcccagcgaggacgagga

SEQ ID NO: 512735 - DNA, 20 bp, mouse
gggcacacgcggggtcggga

SEQ ID NO: 512736 - DNA, 20 bp, mouse
ggcaaatctaggccccccag

SEQ ID NO: 512737 - DNA, 20 bp, mouse
ggcatgatgagccagagggg

SEQ ID NO: 512738 - DNA, 20 bp, mouse
gggggcatgatgagccagag

SEQ ID NO: 512739 - DNA, 20 bp, mouse
gggaggctgctgccgctggg

SEQ ID NO: 512740 - DNA, 20 bp, mouse
ggcagcagcctccacccctc

SEQ ID NO: 512741 - DNA, 20 bp, mouse
gagtggcccctggcaaatct

SEQ ID NO: 512742 - DNA, 20 bp, mouse
ggaggtcccagtgcaggtgt

SEQ ID NO: 512743 - DNA, 20 bp, mouse
gccaggggccactgactctg

SEQ ID NO: 512744 - DNA, 20 bp, mouse
gtgactctggggctaccccg

SEQ ID NO: 512745 - DNA, 20 bp, mouse
ggcgcccaggcgcacctccg

SEQ ID NO: 512746 - DNA, 20 bp, mouse
gccggtggggcagaggaaaa

SEQ ID NO: 512747 - DNA, 20 bp, mouse
ggcggtgagctgggcgaccg

SEQ ID NO: 512748 - DNA, 20 bp, mouse
gcgcgaggaagcggaagcgg

SEQ ID NO: 512749 - DNA, 20 bp, mouse
gcccaggaggcgcgaggaag

SEQ ID NO: 512750 - DNA, 20 bp, mouse
ggcggccgcacgcacggcgg

SEQ ID NO: 512751 - DNA, 20 bp, mouse
gggtgagccagatgaaggcg

SEQ ID NO: 512752 - DNA, 20 bp, mouse
gagcggctctgcgggctccc

SEQ ID NO: 512753 - DNA, 20 bp, mouse
gcgcaggcgcgggaaggaaa

SEQ ID NO: 512754 - DNA, 20 bp, mouse
gccgccgggctgcactcacg

SEQ ID NO: 512755 - DNA, 20 bp, mouse
ggctggaccccgccttcatc

SEQ ID NO: 512756 - DNA, 20 bp, mouse
gaccgactgcagttgcaggt

SEQ ID NO: 512757 - DNA, 20 bp, mouse
ggagctgtgcggtttgaggg

SEQ ID NO: 512758 - DNA, 20 bp, mouse
gctgcacagggagttctata

SEQ ID NO: 512759 - DNA, 20 bp, mouse
gggcttggaccggcttggac

SEQ ID NO: 512760 - DNA, 20 bp, mouse
gaggtctgcggagggcccat

SEQ ID NO: 512761 - DNA, 20 bp, mouse
ggggaggagtgggcttggac

SEQ ID NO: 512762 - DNA, 20 bp, mouse
gaggcccagcctgtaaactc

SEQ ID NO: 512763 - DNA, 20 bp, mouse
gggtgagctgtgcggtttga

SEQ ID NO: 512764 - DNA, 20 bp, mouse
ggtcggtgaagtctccaccc

SEQ ID NO: 512765 - DNA, 20 bp, mouse
gacccacctgcaactgcagt

SEQ ID NO: 512766 - DNA, 20 bp, mouse
gtagggctacgtacacctca

SEQ ID NO: 512767 - DNA, 20 bp, mouse
gtgagccctggcatgaaagg

SEQ ID NO: 512768 - DNA, 20 bp, mouse
gtcatgccagggctcagatc

SEQ ID NO: 512769 - DNA, 20 bp, mouse
gcgcaggtggggaaaccgtg

SEQ ID NO: 512770 - DNA, 20 bp, mouse
gcctccgctgtaccgagata

SEQ ID NO: 512771 - DNA, 20 bp, mouse
ggcaggtaagaaagacccgc

SEQ ID NO: 512772 - DNA, 20 bp, mouse
gtaagaaagacccgcaggtg

SEQ ID NO: 512773 - DNA, 20 bp, mouse
ggatacctcctttcatgcca

SEQ ID NO: 512774 - DNA, 20 bp, mouse
gggtgtacgtagccctatct

SEQ ID NO: 512775 - DNA, 20 bp, mouse
gtagccctatctcggtacag

SEQ ID NO: 512776 - DNA, 20 bp, mouse
gctcctgcggctagacccca

SEQ ID NO: 512777 - DNA, 20 bp, mouse
gagaccccagggtcgtgtga

SEQ ID NO: 512778 - DNA, 20 bp, mouse
gtcaccctcacacgaccctg

SEQ ID NO: 512779 - DNA, 20 bp, mouse
ggtcgtgtgagggtgagcta

SEQ ID NO: 512780 - DNA, 20 bp, mouse
gaggagcagcttctgccgag

SEQ ID NO: 512781 - DNA, 20 bp, mouse
gtgggaagagtagttcgtcc

SEQ ID NO: 512782 - DNA, 20 bp, mouse
gggcgcgcgaaaggcaacct

SEQ ID NO: 512783 - DNA, 20 bp, mouse
ggaccctggggtctagccgc

SEQ ID NO: 512784 - DNA, 20 bp, mouse
gttctgccgagcgggcgaga

SEQ ID NO: 512785 - DNA, 20 bp, mouse
gggcgagacgggtagatgcc

SEQ ID NO: 512786 - DNA, 20 bp, mouse
ggacgcggccattactacag

SEQ ID NO: 512787 - DNA, 20 bp, mouse
ggccggggcccctgtagtaa

SEQ ID NO: 512788 - DNA, 20 bp, mouse
gaatggccgcgtcggcaggt

SEQ ID NO: 512789 - DNA, 20 bp, mouse
ggcggaggcgaggatgaatg

SEQ ID NO: 512790 - DNA, 20 bp, mouse
gggagccgagagctcaacaa

SEQ ID NO: 512791 - DNA, 20 bp, mouse
gcggccgcccgcagtgtcgg

SEQ ID NO: 512792 - DNA, 20 bp, mouse
gcctcctccgacactgcggg

SEQ ID NO: 512793 - DNA, 20 bp, mouse
gcgggacggaaggctcccga

SEQ ID NO: 512794 - DNA, 20 bp, mouse
gcggcgcgcccgcgaagatg

SEQ ID NO: 512795 - DNA, 20 bp, mouse
gccgagggcagcgcgatcga

SEQ ID NO: 512796 - DNA, 20 bp, mouse
gccgagcccgggagtcgagt

SEQ ID NO: 512797 - DNA, 20 bp, mouse
gcgactcccactcgactccc

SEQ ID NO: 512798 - DNA, 20 bp, mouse
ggagtcgagtgggagtcggc

SEQ ID NO: 512799 - DNA, 20 bp, mouse
ggccgaggcccaagcggtgg

SEQ ID NO: 512800 - DNA, 20 bp, mouse
ggagtcggccggccgggcgc

SEQ ID NO: 512801 - DNA, 20 bp, mouse
gggtgccccgctgccctcgg

SEQ ID NO: 512802 - DNA, 20 bp, mouse
gcccgagagtgaccgagtca

SEQ ID NO: 512803 - DNA, 20 bp, mouse
ggagtgggagtcggccggcc

SEQ ID NO: 512804 - DNA, 20 bp, mouse
gccaggaggcgggtccgacg

SEQ ID NO: 512805 - DNA, 20 bp, mouse
ggggtaggccgaggcccaag

SEQ ID NO: 512806 - DNA, 20 bp, mouse
gatacaggctgcaccggagg

SEQ ID NO: 512807 - DNA, 20 bp, mouse
gctcctcagaggctccgcag

SEQ ID NO: 512808 - DNA, 20 bp, mouse
gtccgcagcggtggaaggac

SEQ ID NO: 512809 - DNA, 20 bp, mouse
gtggatacaggctgcaccgg

SEQ ID NO: 512810 - DNA, 20 bp, mouse
gacctggatacaggctgcac

SEQ ID NO: 512811 - DNA, 20 bp, mouse
gtgccgctgcacctggatac

SEQ ID NO: 512812 - DNA, 20 bp, mouse
gacagtggcagtctgagcaa

SEQ ID NO: 512813 - DNA, 20 bp, mouse
gtccaggtgcagcggcactg

SEQ ID NO: 512814 - DNA, 20 bp, mouse
gattcttgggggctcctcag

SEQ ID NO: 512815 - DNA, 20 bp, mouse
gcggcagagggccactgggt

SEQ ID NO: 512816 - DNA, 20 bp, mouse
gtagcactcaccagcaggag

SEQ ID NO: 512817 - DNA, 20 bp, mouse
ggtggtgtctcggacccagt

SEQ ID NO: 512818 - DNA, 20 bp, mouse
gtcagctggccatagcagat

SEQ ID NO: 512819 - DNA, 20 bp, mouse
gagactggcagggaggatcc

SEQ ID NO: 512820 - DNA, 20 bp, mouse
gaccagcaggagtggtgtct

SEQ ID NO: 512821 - DNA, 20 bp, mouse
gctggagtgtgaggatgtag

SEQ ID NO: 512822 - DNA, 20 bp, mouse
gcagcacatcccatctgcta

SEQ ID NO: 512823 - DNA, 20 bp, mouse
gcacaggaagactggcaggg

SEQ ID NO: 512824 - DNA, 20 bp, mouse
gggtccacaggaagactggc

SEQ ID NO: 512825 - DNA, 20 bp, mouse
gggaagggagccagcttggc

SEQ ID NO: 512826 - DNA, 20 bp, mouse
ggcccgcgggactgcagagt

SEQ ID NO: 512827 - DNA, 20 bp, mouse
ggcagaacccggacagcggg

SEQ ID NO: 512828 - DNA, 20 bp, mouse
gtcaggccgacatcaagggt

SEQ ID NO: 512829 - DNA, 20 bp, mouse
gagccagcacaggcagaacc

SEQ ID NO: 512830 - DNA, 20 bp, mouse
gtaggggctgcagggtacca

SEQ ID NO: 512831 - DNA, 20 bp, mouse
gccggctgcagcgcccatag

SEQ ID NO: 512832 - DNA, 20 bp, mouse
ggtaccacggtagtctgggt

SEQ ID NO: 512833 - DNA, 20 bp, mouse
gggactgcagagtcggctcc

SEQ ID NO: 512834 - DNA, 20 bp, mouse
gggctgcgtgggacttaagg

SEQ ID NO: 512835 - DNA, 20 bp, mouse
gcgctgcagccggtcaggga

SEQ ID NO: 512836 - DNA, 20 bp, mouse
gcggcggggccgggctcgta

SEQ ID NO: 512837 - DNA, 20 bp, mouse
gcagcccagacagagcctcg

SEQ ID NO: 512838 - DNA, 20 bp, mouse
gggccgggctcgtagggcag

SEQ ID NO: 512839 - DNA, 20 bp, mouse
gctgccgcgaggctctgtct

SEQ ID NO: 512840 - DNA, 20 bp, mouse
ggccccgccgcctgttgctg

SEQ ID NO: 512841 - DNA, 20 bp, mouse
gcaccggaccccgcaggagg

SEQ ID NO: 512842 - DNA, 20 bp, mouse
gtcgcggcagccgcagcaac

SEQ ID NO: 512843 - DNA, 20 bp, mouse
ggcaccacggtcatgtctgg

SEQ ID NO: 512844 - DNA, 20 bp, mouse
gcgggcaccacggtcatgtc

SEQ ID NO: 512845 - DNA, 20 bp, mouse
gctgcaccggaccccgcagg

SEQ ID NO: 512846 - DNA, 20 bp, mouse
gctagagagcaagactggga

SEQ ID NO: 512847 - DNA, 20 bp, mouse
gagttcggcacagcagacat

SEQ ID NO: 512848 - DNA, 20 bp, mouse
gctgggatggatactggaga

SEQ ID NO: 512849 - DNA, 20 bp, mouse
gagcccagaggtggagattg

SEQ ID NO: 512850 - DNA, 20 bp, mouse
ggtccccaatctccacctct

SEQ ID NO: 512851 - DNA, 20 bp, mouse
gctgctgtgccgaactccag

SEQ ID NO: 512852 - DNA, 20 bp, mouse
gggaggatcccaaatatcca

SEQ ID NO: 512853 - DNA, 20 bp, mouse
gggaggggcagaatcattgg

SEQ ID NO: 512854 - DNA, 20 bp, mouse
gcctctgggctccagtaacg

SEQ ID NO: 512855 - DNA, 20 bp, mouse
ggaggaaccagaaatctccg

SEQ ID NO: 512856 - DNA, 20 bp, mouse
ggcacaggctggggttactg

SEQ ID NO: 512857 - DNA, 20 bp, mouse
ggataagaatctagaatata

SEQ ID NO: 512858 - DNA, 20 bp, mouse
gtgtccccacctgctgatgg

SEQ ID NO: 512859 - DNA, 20 bp, mouse
ggtttggacagacacttgta

SEQ ID NO: 512860 - DNA, 20 bp, mouse
gtctgagaccagcacaggct

SEQ ID NO: 512861 - DNA, 20 bp, mouse
gtattgggagtctagagtgt

SEQ ID NO: 512862 - DNA, 20 bp, mouse
ggtcagtactgtgacagctg

SEQ ID NO: 512863 - DNA, 20 bp, mouse
gaggtcctttacatcataca

SEQ ID NO: 512864 - DNA, 20 bp, mouse
gtggtgttgccaggagctct

SEQ ID NO: 512865 - DNA, 20 bp, mouse
gatcatacatggaaagaggc

SEQ ID NO: 512866 - DNA, 20 bp, mouse
gtctggcgcttaggtaccag

SEQ ID NO: 512867 - DNA, 20 bp, mouse
gggagaagcgcagtaggacc

SEQ ID NO: 512868 - DNA, 20 bp, mouse
gggaggcggaggccgagccc

SEQ ID NO: 512869 - DNA, 20 bp, mouse
gcgggccccaccctaaagga

SEQ ID NO: 512870 - DNA, 20 bp, mouse
gttggccagacctagttcgg

SEQ ID NO: 512871 - DNA, 20 bp, mouse
gtagttcggtggtggacgta

SEQ ID NO: 512872 - DNA, 20 bp, mouse
gtggtgagagccagcaggtc

SEQ ID NO: 512873 - DNA, 20 bp, mouse
gctcgatggtgcctaaaact

SEQ ID NO: 512874 - DNA, 20 bp, mouse
gtcacttggagagtgtgtta

SEQ ID NO: 512875 - DNA, 20 bp, mouse
gcttggagagtgtgttaagg

SEQ ID NO: 512876 - DNA, 20 bp, mouse
gccgggcaatccgaaggatg

SEQ ID NO: 512877 - DNA, 20 bp, mouse
gtgtcacccgggcaatccga

SEQ ID NO: 512878 - DNA, 20 bp, mouse
gtgctgcagatagtctcggg

SEQ ID NO: 512879 - DNA, 20 bp, mouse
gtgatgctgcagatagtctc

SEQ ID NO: 512880 - DNA, 20 bp, mouse
gcgcggtcagcttaaatgac

SEQ ID NO: 512881 - DNA, 20 bp, mouse
gtaagctgaccgcgaacttg

SEQ ID NO: 512882 - DNA, 20 bp, mouse
ggacaccggacacccgactg

SEQ ID NO: 512883 - DNA, 20 bp, mouse
gggaaagctcaagagatcca

SEQ ID NO: 512884 - DNA, 20 bp, mouse
gcagcttaaatgacaggctg

SEQ ID NO: 512885 - DNA, 20 bp, mouse
gaagtccggccagggcgcgg

SEQ ID NO: 512886 - DNA, 20 bp, mouse
gcctgcctggagccagtccg

SEQ ID NO: 512887 - DNA, 20 bp, mouse
ggcattcaggcacctcggac

SEQ ID NO: 512888 - DNA, 20 bp, mouse
gccgaggtgcctgaatgcag

SEQ ID NO: 512889 - DNA, 20 bp, mouse
gccagatccatgtggtcagg

SEQ ID NO: 512890 - DNA, 20 bp, mouse
gcagccagatccatgtggtc

SEQ ID NO: 512891 - DNA, 20 bp, mouse
gcagcctgggaagattggag

SEQ ID NO: 512892 - DNA, 20 bp, mouse
gggcacctcggactggctcc

SEQ ID NO: 512893 - DNA, 20 bp, mouse
gcagagggtgagcagttggg

SEQ ID NO: 512894 - DNA, 20 bp, mouse
gccttcctggatgccttcag

SEQ ID NO: 512895 - DNA, 20 bp, mouse
ggccaagctggaagttgcct

SEQ ID NO: 512896 - DNA, 20 bp, mouse
gcggagcgagcgggattcgg

SEQ ID NO: 512897 - DNA, 20 bp, mouse
ggggggtgctaaagtcgcaa

SEQ ID NO: 512898 - DNA, 20 bp, mouse
gtgctaaagtcgcaagggca

SEQ ID NO: 512899 - DNA, 20 bp, mouse
ggaggtgagaacgacagcgg

SEQ ID NO: 512900 - DNA, 20 bp, mouse
gaaagtcgcaagggcagggc

SEQ ID NO: 512901 - DNA, 20 bp, mouse
ggaggtaaagatgctgcggg

SEQ ID NO: 512902 - DNA, 20 bp, mouse
gcggaacctgccggagcgag

SEQ ID NO: 512903 - DNA, 20 bp, mouse
gcaggaaggaagatccggaa

SEQ ID NO: 512904 - DNA, 20 bp, mouse
ggaggaggtgagaacgacag

SEQ ID NO: 512905 - DNA, 20 bp, mouse
gtgccggagcgagcgggatt

SEQ ID NO: 512906 - DNA, 20 bp, mouse
gcaaggaccacgggcccaac

SEQ ID NO: 512907 - DNA, 20 bp, mouse
gtgcatgcctccaaggacca

SEQ ID NO: 512908 - DNA, 20 bp, mouse
gtggagctcctgaataccca

SEQ ID NO: 512909 - DNA, 20 bp, mouse
ggctgaactgcatgcctcca

SEQ ID NO: 512910 - DNA, 20 bp, mouse
ggctgcaccaacttcctgtt

SEQ ID NO: 512911 - DNA, 20 bp, mouse
gacacaaggaacctagggtg

SEQ ID NO: 512912 - DNA, 20 bp, mouse
ggttggtgcagcaagcgcca

SEQ ID NO: 512913 - DNA, 20 bp, mouse
gggagccactaggagatcag

SEQ ID NO: 512914 - DNA, 20 bp, mouse
gggagctccaagcttgccca

SEQ ID NO: 512915 - DNA, 20 bp, mouse
gagggctgtgccggctccct

SEQ ID NO: 512916 - DNA, 20 bp, mouse
ggatagctacccaggaacaa

SEQ ID NO: 512917 - DNA, 20 bp, mouse
ggagcacagcggtcccgcag

SEQ ID NO: 512918 - DNA, 20 bp, mouse
gacaaggggtagcaaaagac

SEQ ID NO: 512919 - DNA, 20 bp, mouse
gtcttcaaggatagctaccc

SEQ ID NO: 512920 - DNA, 20 bp, mouse
gacttcagctggaaccgctg

SEQ ID NO: 512921 - DNA, 20 bp, mouse
gagggagccgggaagtccga

SEQ ID NO: 512922 - DNA, 20 bp, mouse
gtaaggataaagaaaagtcg

SEQ ID NO: 512923 - DNA, 20 bp, mouse
ggatcgcagggagagcggga

SEQ ID NO: 512924 - DNA, 20 bp, mouse
gagacgggtgccacttcagc

SEQ ID NO: 512925 - DNA, 20 bp, mouse
gtttgctaccccttgttcct

SEQ ID NO: 512926 - DNA, 20 bp, mouse
ggaagtgcgggacagaatcg

SEQ ID NO: 512927 - DNA, 20 bp, mouse
gtgcgcgagatcaacaagtc

SEQ ID NO: 512928 - DNA, 20 bp, mouse
ggagccggagcccgaggtgg

SEQ ID NO: 512929 - DNA, 20 bp, mouse
ggcgcggcccgggcgatcgg

SEQ ID NO: 512930 - DNA, 20 bp, mouse
gcgggaggcggccaccctgg

SEQ ID NO: 512931 - DNA, 20 bp, mouse
ggggctccggctcggctcgg

SEQ ID NO: 512932 - DNA, 20 bp, mouse
ggatctcgcgcaggcagccg

SEQ ID NO: 512933 - DNA, 20 bp, mouse
gagcgcggcgagtggcaccg

SEQ ID NO: 512934 - DNA, 20 bp, mouse
gccggagcccgaggtggagg

SEQ ID NO: 512935 - DNA, 20 bp, mouse
gtcgccgcgctccgaagtgc

SEQ ID NO: 512936 - DNA, 20 bp, mouse
ggccactagggtagagacct

SEQ ID NO: 512937 - DNA, 20 bp, mouse
ggacctaggatgacagtaca

SEQ ID NO: 512938 - DNA, 20 bp, mouse
ggcccaggtctgggccacta

SEQ ID NO: 512939 - DNA, 20 bp, mouse
ggtgctaggagcccaggtct

SEQ ID NO: 512940 - DNA, 20 bp, mouse
gtggacagcagatccatgtt

SEQ ID NO: 512941 - DNA, 20 bp, mouse
ggataccgtgctaggagccc

SEQ ID NO: 512942 - DNA, 20 bp, mouse
gtgaccagatatcaagtatt

SEQ ID NO: 512943 - DNA, 20 bp, mouse
gtaccctagtggcccagacc

SEQ ID NO: 512944 - DNA, 20 bp, mouse
gcaccgtgtactgtcatcct

SEQ ID NO: 512945 - DNA, 20 bp, mouse
gtcctaggtctctaccctag

SEQ ID NO: 512946 - DNA, 20 bp, mouse
gcccgcggctctccggacac

SEQ ID NO: 512947 - DNA, 20 bp, mouse
gcccggaggcagcagcggcg

SEQ ID NO: 512948 - DNA, 20 bp, mouse
ggtgcggggcgcagagacac

SEQ ID NO: 512949 - DNA, 20 bp, mouse
ggcggtccgcgtccagcccg

SEQ ID NO: 512950 - DNA, 20 bp, mouse
gcgcctaccgggcccgacct

SEQ ID NO: 512951 - DNA, 20 bp, mouse
gtgaagggacagctcccgga

SEQ ID NO: 512952 - DNA, 20 bp, mouse
ggagtcccaacgcagcccag

SEQ ID NO: 512953 - DNA, 20 bp, mouse
gcgtccagcccgcggctctc

SEQ ID NO: 512954 - DNA, 20 bp, mouse
gcgcgccgtgtgcccgtgtc

SEQ ID NO: 512955 - DNA, 20 bp, mouse
ggcccgtgtccggagagccg

SEQ ID NO: 512956 - DNA, 20 bp, mouse
ggagggagttacatttgctg

SEQ ID NO: 512957 - DNA, 20 bp, mouse
gagcagtgttgagtgggagg

SEQ ID NO: 512958 - DNA, 20 bp, mouse
gcaacttagcagtgttgagt

SEQ ID NO: 512959 - DNA, 20 bp, mouse
gaaatgtaactccctcatgg

SEQ ID NO: 512960 - DNA, 20 bp, mouse
gcaggcagctggggcactcc

SEQ ID NO: 512961 - DNA, 20 bp, mouse
gtgttgagtgggaggaggcc

SEQ ID NO: 512962 - DNA, 20 bp, mouse
gaggttggaccagggtatgc

SEQ ID NO: 512963 - DNA, 20 bp, mouse
gcaaaggcgggtagaaaaaa

SEQ ID NO: 512964 - DNA, 20 bp, mouse
gggaggagcgcttggagcaa

SEQ ID NO: 512965 - DNA, 20 bp, mouse
gcctgggccagggatgcgag

SEQ ID NO: 512966 - DNA, 20 bp, mouse
ggcggctgcggcgttggcac

SEQ ID NO: 512967 - DNA, 20 bp, mouse
ggcggcgttggcaccggctg

SEQ ID NO: 512968 - DNA, 20 bp, mouse
gtccgcgggcgccaggggac

SEQ ID NO: 512969 - DNA, 20 bp, mouse
gactcaggcggctgcggcgt

SEQ ID NO: 512970 - DNA, 20 bp, mouse
gctgctgcttgccggtcccc

SEQ ID NO: 512971 - DNA, 20 bp, mouse
ggtcgttccgcgggcgccag

SEQ ID NO: 512972 - DNA, 20 bp, mouse
gctgaactgagcattggaca

SEQ ID NO: 512973 - DNA, 20 bp, mouse
gagcattggacagggaggcg

SEQ ID NO: 512974 - DNA, 20 bp, mouse
ggccggtcccctggcgcccg

SEQ ID NO: 512975 - DNA, 20 bp, mouse
ggtaagatcgtgatcaacgt

SEQ ID NO: 512976 - DNA, 20 bp, mouse
ggacccagcctagctagagg

SEQ ID NO: 512977 - DNA, 20 bp, mouse
ggggagggcacgagctgatt

SEQ ID NO: 512978 - DNA, 20 bp, mouse
gtccgacccagcctagctag

SEQ ID NO: 512979 - DNA, 20 bp, mouse
gcacctcctctagctaggct

SEQ ID NO: 512980 - DNA, 20 bp, mouse
gtggatgggagggtgtgatt

SEQ ID NO: 512981 - DNA, 20 bp, mouse
ggtcggagtctgcctagccg

SEQ ID NO: 512982 - DNA, 20 bp, mouse
ggaggaggcgatgaatggat

SEQ ID NO: 512983 - DNA, 20 bp, mouse
gagcattggacagggaggcg

SEQ ID NO: 512984 - DNA, 20 bp, mouse
gctgaactgagcattggaca

SEQ ID NO: 512985 - DNA, 20 bp, mouse
ggggcggggcccgggtagag

SEQ ID NO: 512986 - DNA, 20 bp, mouse
ggcaaggcgggtgcccggta

SEQ ID NO: 512987 - DNA, 20 bp, mouse
gggcagcggccgccccaagc

SEQ ID NO: 512988 - DNA, 20 bp, mouse
ggacgctgcctccttgggaa

SEQ ID NO: 512989 - DNA, 20 bp, mouse
ggttctgacgctgcctcctt

SEQ ID NO: 512990 - DNA, 20 bp, mouse
gccttgggaagggtgtttgg

SEQ ID NO: 512991 - DNA, 20 bp, mouse
ggcaccctgcgcaccctacc

SEQ ID NO: 512992 - DNA, 20 bp, mouse
ggatcataagaagcgctgcg

SEQ ID NO: 512993 - DNA, 20 bp, mouse
ggcgctgcggggctccggct

SEQ ID NO: 512994 - DNA, 20 bp, mouse
gcccgacttgcgcccgcggt

SEQ ID NO: 512995 - DNA, 20 bp, mouse
gaggcagcgtcagaacgggg

SEQ ID NO: 512996 - DNA, 20 bp, mouse
gggctgggggtaccaaatac

SEQ ID NO: 512997 - DNA, 20 bp, mouse
gaactccggcagctctgcag

SEQ ID NO: 512998 - DNA, 20 bp, mouse
gctcccgacaagctccagag

SEQ ID NO: 512999 - DNA, 20 bp, mouse
ggcaacagcgttggggctgg

SEQ ID NO: 513000 - DNA, 20 bp, mouse
gggccaggagctccggtatt

SEQ ID NO: 513001 - DNA, 20 bp, mouse
gaggtgaggacagccctgtg

SEQ ID NO: 513002 - DNA, 20 bp, mouse
gactgttccaggatggacta

SEQ ID NO: 513003 - DNA, 20 bp, mouse
gaggtccagtgggacccctg

SEQ ID NO: 513004 - DNA, 20 bp, mouse
gcatcctggaacagtcccca

SEQ ID NO: 513005 - DNA, 20 bp, mouse
gaggaggctctagaaggaca

SEQ ID NO: 513006 - DNA, 20 bp, mouse
gcctggcaaagtgcgcaccg

SEQ ID NO: 513007 - DNA, 20 bp, mouse
gctcgcccgcggtacatacc

SEQ ID NO: 513008 - DNA, 20 bp, mouse
gcttgtacccggaaagggaa

SEQ ID NO: 513009 - DNA, 20 bp, mouse
ggcagaacgcgcctcgcccg

SEQ ID NO: 513010 - DNA, 20 bp, mouse
gcgaggcgcgttctgcgcgg

SEQ ID NO: 513011 - DNA, 20 bp, mouse
gggcggccagcggactccaa

SEQ ID NO: 513012 - DNA, 20 bp, mouse
ggtcgccttgtacccggaaa

SEQ ID NO: 513013 - DNA, 20 bp, mouse
gctttgccaggtatgtaccg

SEQ ID NO: 513014 - DNA, 20 bp, mouse
gtccaagggacgcgggacag

SEQ ID NO: 513015 - DNA, 20 bp, mouse
gacgctctcggctagcgcag

SEQ ID NO: 513016 - DNA, 20 bp, mouse
gcgcgtgtgccggcgagggt

SEQ ID NO: 513017 - DNA, 20 bp, mouse
ggaggtggtagtggagtgtg

SEQ ID NO: 513018 - DNA, 20 bp, mouse
gaatcctagggtgtgcctgg

SEQ ID NO: 513019 - DNA, 20 bp, mouse
gagccgccggagggtgccca

SEQ ID NO: 513020 - DNA, 20 bp, mouse
gccacctccaggcacaccct

SEQ ID NO: 513021 - DNA, 20 bp, mouse
gtgagcgcgtgtgccggcga

SEQ ID NO: 513022 - DNA, 20 bp, mouse
ggccccatgcccaccctcgc

SEQ ID NO: 513023 - DNA, 20 bp, mouse
ggtgcgtctccccaggagag

SEQ ID NO: 513024 - DNA, 20 bp, mouse
gcgccctgggcaccctccgg

SEQ ID NO: 513025 - DNA, 20 bp, mouse
ggagcagagcggccaggctg

SEQ ID NO: 513026 - DNA, 20 bp, mouse
gctagacccaggtaagtcag

SEQ ID NO: 513027 - DNA, 20 bp, mouse
ggtcctagaccccggctcac

SEQ ID NO: 513028 - DNA, 20 bp, mouse
gaggagcccctgacttacct

SEQ ID NO: 513029 - DNA, 20 bp, mouse
gtgcacacaccaggttccct

SEQ ID NO: 513030 - DNA, 20 bp, mouse
gagcagggtacctgttgcag

SEQ ID NO: 513031 - DNA, 20 bp, mouse
gctaggaccgacaagcccag

SEQ ID NO: 513032 - DNA, 20 bp, mouse
gtacctgggtctagaagcca

SEQ ID NO: 513033 - DNA, 20 bp, mouse
gggctcccgctgcacacacc

SEQ ID NO: 513034 - DNA, 20 bp, mouse
ggcttgtcggtcctagaccc

SEQ ID NO: 513035 - DNA, 20 bp, mouse
gtcccttggcttctagaccc

SEQ ID NO: 513036 - DNA, 20 bp, mouse
gagagacttcgacagcgagg

SEQ ID NO: 513037 - DNA, 20 bp, mouse
gtcggaaccggcccgagcat

SEQ ID NO: 513038 - DNA, 20 bp, mouse
gtgctggagctgcaccatcg

SEQ ID NO: 513039 - DNA, 20 bp, mouse
gagtcactgagcgcctgccg

SEQ ID NO: 513040 - DNA, 20 bp, mouse
ggaactgcagcgagagccaa

SEQ ID NO: 513041 - DNA, 20 bp, mouse
gcgcctcgcggcccacgaaa

SEQ ID NO: 513042 - DNA, 20 bp, mouse
gaccatcgtggcaacgccag

SEQ ID NO: 513043 - DNA, 20 bp, mouse
gtgcagagacttcgacagcg

SEQ ID NO: 513044 - DNA, 20 bp, mouse
gcagcaacacaggccagggg

SEQ ID NO: 513045 - DNA, 20 bp, mouse
gctgttggagagtggcacgg

SEQ ID NO: 513046 - DNA, 20 bp, mouse
gatgtaaatctcagcaggct

SEQ ID NO: 513047 - DNA, 20 bp, mouse
gctctgcccctcttcaggac

SEQ ID NO: 513048 - DNA, 20 bp, mouse
gagaaggtgggcacgcatgg

SEQ ID NO: 513049 - DNA, 20 bp, mouse
gactggatgtaaatctcagc

SEQ ID NO: 513050 - DNA, 20 bp, mouse
gggagagacagaaagtgggc

SEQ ID NO: 513051 - DNA, 20 bp, mouse
ggagagaaggtgggcacgca

SEQ ID NO: 513052 - DNA, 20 bp, mouse
ggcagagcctggctttctga

SEQ ID NO: 513053 - DNA, 20 bp, mouse
gtgcctggagtctgcaatgc

SEQ ID NO: 513054 - DNA, 20 bp, mouse
gaggcacttacttgaagaaa

SEQ ID NO: 513055 - DNA, 20 bp, mouse
gcattgctcacataccacac

SEQ ID NO: 513056 - DNA, 20 bp, mouse
gcaccggagacagatcgtag

SEQ ID NO: 513057 - DNA, 20 bp, mouse
ggagagcactgagcgcatct

SEQ ID NO: 513058 - DNA, 20 bp, mouse
gcgcctctacgatctgtctc

SEQ ID NO: 513059 - DNA, 20 bp, mouse
gcagatcgtagaggcgggta

SEQ ID NO: 513060 - DNA, 20 bp, mouse
gaggcgggtaaggcgctaca

SEQ ID NO: 513061 - DNA, 20 bp, mouse
ggcattattgcagtgttcac

SEQ ID NO: 513062 - DNA, 20 bp, mouse
ggggtaaggcgctacagggt

SEQ ID NO: 513063 - DNA, 20 bp, mouse
gcagtggagtagaatgggta

SEQ ID NO: 513064 - DNA, 20 bp, mouse
gcgccgagggctggtcacag

SEQ ID NO: 513065 - DNA, 20 bp, mouse
ggtagagcaagactgactcc

SEQ ID NO: 513066 - DNA, 20 bp, mouse
gccctgtcaggagtgctctg

SEQ ID NO: 513067 - DNA, 20 bp, mouse
gtcctcagagcactcctgac

SEQ ID NO: 513068 - DNA, 20 bp, mouse
ggaggaccttgactgaacca

SEQ ID NO: 513069 - DNA, 20 bp, mouse
gaggtggtggtgacccactc

SEQ ID NO: 513070 - DNA, 20 bp, mouse
gactttgcattcttgacata

SEQ ID NO: 513071 - DNA, 20 bp, mouse
gtggttgtgagatcctagat

SEQ ID NO: 513072 - DNA, 20 bp, mouse
gctccctcttttcctagttt

SEQ ID NO: 513073 - DNA, 20 bp, mouse
gggtaataggccatacagct

SEQ ID NO: 513074 - DNA, 20 bp, mouse
gacttgccttggttcagtca

SEQ ID NO: 513075 - DNA, 20 bp, mouse
ggcaaagttcttcccaaact

SEQ ID NO: 513076 - DNA, 20 bp, mouse
gtcttaaacggccaaatctg

SEQ ID NO: 513077 - DNA, 20 bp, mouse
gcaagtgtggaactcttaaa

SEQ ID NO: 513078 - DNA, 20 bp, mouse
gtgacagtttgtcccaagtg

SEQ ID NO: 513079 - DNA, 20 bp, mouse
gtcttcggagacatgcaagg

SEQ ID NO: 513080 - DNA, 20 bp, mouse
gagagaaacatcctcagatt

SEQ ID NO: 513081 - DNA, 20 bp, mouse
gaaagcatcttaaaattgaa

SEQ ID NO: 513082 - DNA, 20 bp, mouse
gagacagacaggtgatcgat

SEQ ID NO: 513083 - DNA, 20 bp, mouse
gagaccatataaggattcat

SEQ ID NO: 513084 - DNA, 20 bp, mouse
ggatgtttctcttctctgtc

SEQ ID NO: 513085 - DNA, 20 bp, mouse
gccatataaggattcatggg

SEQ ID NO: 513086 - DNA, 20 bp, mouse
gccggttgagcggcagaggt

SEQ ID NO: 513087 - DNA, 20 bp, mouse
gtcctccttccccggttgag

SEQ ID NO: 513088 - DNA, 20 bp, mouse
gaagggagccatgcacccag

SEQ ID NO: 513089 - DNA, 20 bp, mouse
ggccgctcaaccggggaagg

SEQ ID NO: 513090 - DNA, 20 bp, mouse
gcccgagagctgcgcgatcc

SEQ ID NO: 513091 - DNA, 20 bp, mouse
gccaggcagccaggactccg

SEQ ID NO: 513092 - DNA, 20 bp, mouse
ggttagctctctatacagcc

SEQ ID NO: 513093 - DNA, 20 bp, mouse
gtctgccgctcaaccgggga

SEQ ID NO: 513094 - DNA, 20 bp, mouse
gggagccatgcacccagtgg

SEQ ID NO: 513095 - DNA, 20 bp, mouse
gaggctggggcgcgccgcaa

SEQ ID NO: 513096 - DNA, 20 bp, mouse
gccaggaggcggaggcggga

SEQ ID NO: 513097 - DNA, 20 bp, mouse
ggcggaggcgggacggtcag

SEQ ID NO: 513098 - DNA, 20 bp, mouse
gcgcgacgggaacttaaggt

SEQ ID NO: 513099 - DNA, 20 bp, mouse
gacgccgcgacgggaactta

SEQ ID NO: 513100 - DNA, 20 bp, mouse
ggcgcaggacagcggccctg

SEQ ID NO: 513101 - DNA, 20 bp, mouse
gggcccggctagctcctagg

SEQ ID NO: 513102 - DNA, 20 bp, mouse
gtgcaagtgcgccggcaacg

SEQ ID NO: 513103 - DNA, 20 bp, mouse
ggcgcggcagcagctgaggg

SEQ ID NO: 513104 - DNA, 20 bp, mouse
gatacctaggagccccggag

SEQ ID NO: 513105 - DNA, 20 bp, mouse
gtgcggcccggctagctcct

SEQ ID NO: 513106 - DNA, 20 bp, mouse
gtgggtagttagtagagcct

SEQ ID NO: 513107 - DNA, 20 bp, mouse
gggaaggaacttggtgactt

SEQ ID NO: 513108 - DNA, 20 bp, mouse
gcaggcctaatccaggacag

SEQ ID NO: 513109 - DNA, 20 bp, mouse
ggcgatccttcctatgacag

SEQ ID NO: 513110 - DNA, 20 bp, mouse
gaccagaggcctcccgccac

SEQ ID NO: 513111 - DNA, 20 bp, mouse
ggggctctaaatccaatgaa

SEQ ID NO: 513112 - DNA, 20 bp, mouse
gctggagcacggcttcggag

SEQ ID NO: 513113 - DNA, 20 bp, mouse
gtgggaccatggagggacaa

SEQ ID NO: 513114 - DNA, 20 bp, mouse
gggtcgtcatacaatcacat

SEQ ID NO: 513115 - DNA, 20 bp, mouse
ggtgacacagtagccaccag

SEQ ID NO: 513116 - DNA, 20 bp, mouse
gacgttagccgaggcaccgt

SEQ ID NO: 513117 - DNA, 20 bp, mouse
gcagccccgccgccgtccag

SEQ ID NO: 513118 - DNA, 20 bp, mouse
ggtggcgccggtctcccaga

SEQ ID NO: 513119 - DNA, 20 bp, mouse
ggccgccgtccagaggcgaa

SEQ ID NO: 513120 - DNA, 20 bp, mouse
ggcctttcgcctctggacgg

SEQ ID NO: 513121 - DNA, 20 bp, mouse
ggaccgggcagacctgccca

SEQ ID NO: 513122 - DNA, 20 bp, mouse
gtttgcctttcgcctctgga

SEQ ID NO: 513123 - DNA, 20 bp, mouse
gagagggcgaacgttagccg

SEQ ID NO: 513124 - DNA, 20 bp, mouse
gcctcggtggtgctgaacgt

SEQ ID NO: 513125 - DNA, 20 bp, mouse
gcggggcccgagctcccccg

SEQ ID NO: 513126 - DNA, 20 bp, mouse
ggcaaggtggctctctagaa

SEQ ID NO: 513127 - DNA, 20 bp, mouse
ggaagagcagaggcgcaagg

SEQ ID NO: 513128 - DNA, 20 bp, mouse
gttgcgcctctgctcttctg

SEQ ID NO: 513129 - DNA, 20 bp, mouse
gttctgctctgtagaggaag

SEQ ID NO: 513130 - DNA, 20 bp, mouse
gttcctggtcagtgagacat

SEQ ID NO: 513131 - DNA, 20 bp, mouse
gagggttgtgacagagaggt

SEQ ID NO: 513132 - DNA, 20 bp, mouse
gcaagcggtgagttgaactt

SEQ ID NO: 513133 - DNA, 20 bp, mouse
gagacagggttgtgacagag

SEQ ID NO: 513134 - DNA, 20 bp, mouse
gcggaccttcggcttccagg

SEQ ID NO: 513135 - DNA, 20 bp, mouse
ggcggtgagttgaacttggg

SEQ ID NO: 513136 - DNA, 20 bp, mouse
ggaggtgcggagcgcagcga

SEQ ID NO: 513137 - DNA, 20 bp, mouse
gggcactcgagcgcacaccc

SEQ ID NO: 513138 - DNA, 20 bp, mouse
gacacccgggcgggccgcag

SEQ ID NO: 513139 - DNA, 20 bp, mouse
gactcgagcgcacacccggg

SEQ ID NO: 513140 - DNA, 20 bp, mouse
ggcagtcgggaggatgacca

SEQ ID NO: 513141 - DNA, 20 bp, mouse
ggccggacgcccccagagtc

SEQ ID NO: 513142 - DNA, 20 bp, mouse
ggctccgcacctccccgctg

SEQ ID NO: 513143 - DNA, 20 bp, mouse
gccgcggcgcaccgagcccg

SEQ ID NO: 513144 - DNA, 20 bp, mouse
gcgcctgctgcggtgagaca

SEQ ID NO: 513145 - DNA, 20 bp, mouse
gctggtgccaacagatgcgg

SEQ ID NO: 513146 - DNA, 20 bp, mouse
gcgagccgcgggcgctggag

SEQ ID NO: 513147 - DNA, 20 bp, mouse
gcagcgcctgcggcttggtc

SEQ ID NO: 513148 - DNA, 20 bp, mouse
gacagccgctccagcgcccg

SEQ ID NO: 513149 - DNA, 20 bp, mouse
ggcggctcgggcagcgcctg

SEQ ID NO: 513150 - DNA, 20 bp, mouse
ggctggagcggctgtcggcg

SEQ ID NO: 513151 - DNA, 20 bp, mouse
gcgcctgcggcttggtccgg

SEQ ID NO: 513152 - DNA, 20 bp, mouse
gagccgccggaccaagccgc

SEQ ID NO: 513153 - DNA, 20 bp, mouse
gggattcccgctctgcttag

SEQ ID NO: 513154 - DNA, 20 bp, mouse
gggcggctgaagggttaatg

SEQ ID NO: 513155 - DNA, 20 bp, mouse
gtcaggcccggcccagggtc

SEQ ID NO: 513156 - DNA, 20 bp, mouse
gtgtgggccccccactacca

SEQ ID NO: 513157 - DNA, 20 bp, mouse
ggagcacagcaccctggtag

SEQ ID NO: 513158 - DNA, 20 bp, mouse
gcacagcaccctggtagtgg

SEQ ID NO: 513159 - DNA, 20 bp, mouse
ggcacatggccccttggtgt

SEQ ID NO: 513160 - DNA, 20 bp, mouse
ggccagcccagcacccgcgg

SEQ ID NO: 513161 - DNA, 20 bp, mouse
gtagtggggggcccacacca

SEQ ID NO: 513162 - DNA, 20 bp, mouse
gcttgctgcacatggcccct

SEQ ID NO: 513163 - DNA, 20 bp, mouse
gcagcccaaggctggccgac

SEQ ID NO: 513164 - DNA, 20 bp, mouse
gaggccccagggcccggcca

SEQ ID NO: 513165 - DNA, 20 bp, mouse
gtgattggcctaaggcccca

SEQ ID NO: 513166 - DNA, 20 bp, mouse
gtccgtctgtcggggagaag

SEQ ID NO: 513167 - DNA, 20 bp, mouse
gcagctgccggcgcacaagg

SEQ ID NO: 513168 - DNA, 20 bp, mouse
gacagacggagggagctgcg

SEQ ID NO: 513169 - DNA, 20 bp, mouse
ggccgcttctccccgacaga

SEQ ID NO: 513170 - DNA, 20 bp, mouse
ggccatgcgcccagccccga

SEQ ID NO: 513171 - DNA, 20 bp, mouse
gcagctccctccgtctgtcg

SEQ ID NO: 513172 - DNA, 20 bp, mouse
gggagggagctgcggggacc

SEQ ID NO: 513173 - DNA, 20 bp, mouse
gccccgacggctactctagg

SEQ ID NO: 513174 - DNA, 20 bp, mouse
gggagccgcgggcggaccaa

SEQ ID NO: 513175 - DNA, 20 bp, mouse
gcggggtaaccatggagacg

SEQ ID NO: 513176 - DNA, 20 bp, mouse
gtaacaggttcagagcacac

SEQ ID NO: 513177 - DNA, 20 bp, mouse
gctggatgtggtgagatcag

SEQ ID NO: 513178 - DNA, 20 bp, mouse
gagtctccttgggacagggt

SEQ ID NO: 513179 - DNA, 20 bp, mouse
gaggaggcaggccggcgcat

SEQ ID NO: 513180 - DNA, 20 bp, mouse
gagcagagcttagaactaac

SEQ ID NO: 513181 - DNA, 20 bp, mouse
gtgaagcgccgagggtggag

SEQ ID NO: 513182 - DNA, 20 bp, mouse
gcagcgcggcctggccggag

SEQ ID NO: 513183 - DNA, 20 bp, mouse
ggccggggcgccccatgcgc

SEQ ID NO: 513184 - DNA, 20 bp, mouse
gcggcacgcgtgagttgggc

SEQ ID NO: 513185 - DNA, 20 bp, mouse
gcacctcaagcctggatggt

SEQ ID NO: 513186 - DNA, 20 bp, mouse
gctggggctgagatgcaaga

SEQ ID NO: 513187 - DNA, 20 bp, mouse
gcctactcggcgcacagtct

SEQ ID NO: 513188 - DNA, 20 bp, mouse
gccggaggactcgggtcctg

SEQ ID NO: 513189 - DNA, 20 bp, mouse
gcagcagctccggaggactc

SEQ ID NO: 513190 - DNA, 20 bp, mouse
ggaaaccccagcagctccgg

SEQ ID NO: 513191 - DNA, 20 bp, mouse
gtccgaaaccccagcagctc

SEQ ID NO: 513192 - DNA, 20 bp, mouse
ggggtgggctaggagaccaa

SEQ ID NO: 513193 - DNA, 20 bp, mouse
ggcgccgagtaggaagtgac

SEQ ID NO: 513194 - DNA, 20 bp, mouse
gctgctggggtttcggacag

SEQ ID NO: 513195 - DNA, 20 bp, mouse
gaggctttgcgagcgcctag

SEQ ID NO: 513196 - DNA, 20 bp, mouse
gacggagacgccagaagcca

SEQ ID NO: 513197 - DNA, 20 bp, mouse
gcaacgtggcccctgcggac

SEQ ID NO: 513198 - DNA, 20 bp, mouse
gaccggtcactcccagcaag

SEQ ID NO: 513199 - DNA, 20 bp, mouse
gacgccagaagccagggcac

SEQ ID NO: 513200 - DNA, 20 bp, mouse
ggaaagatgccagtccgcag

SEQ ID NO: 513201 - DNA, 20 bp, mouse
ggggagcaacgtggcccctg

SEQ ID NO: 513202 - DNA, 20 bp, mouse
gaccacttgctgggagtgac

SEQ ID NO: 513203 - DNA, 20 bp, mouse
gatggtctggaggggtaagt

SEQ ID NO: 513204 - DNA, 20 bp, mouse
gggcgtctccgtcagtcctg

SEQ ID NO: 513205 - DNA, 20 bp, mouse
gctgggagtgaccggtgccc

SEQ ID NO: 513206 - DNA, 20 bp, mouse
ggtgcgaggccccctccgga

SEQ ID NO: 513207 - DNA, 20 bp, mouse
ggaaggtgagcgggatggat

SEQ ID NO: 513208 - DNA, 20 bp, mouse
ggccccctccggaaggtgag

SEQ ID NO: 513209 - DNA, 20 bp, mouse
gcatcccgctcaccttccgg

SEQ ID NO: 513210 - DNA, 20 bp, mouse
gcccgctcaccttccggagg

SEQ ID NO: 513211 - DNA, 20 bp, mouse
gagcgctcggcgaagacccg

SEQ ID NO: 513212 - DNA, 20 bp, mouse
ggaacgcgggtgtctcgaag

SEQ ID NO: 513213 - DNA, 20 bp, mouse
ggggatggattggacttcgg

SEQ ID NO: 513214 - DNA, 20 bp, mouse
gccggcctgcgtcgagtgag

SEQ ID NO: 513215 - DNA, 20 bp, mouse
gcgtcgagtgagaggcttgg

SEQ ID NO: 513216 - DNA, 20 bp, mouse
gttgtggacaaactttgatg

SEQ ID NO: 513217 - DNA, 20 bp, mouse
gtcctacagagccatccttg

SEQ ID NO: 513218 - DNA, 20 bp, mouse
gattgcgcggatggaaacag

SEQ ID NO: 513219 - DNA, 20 bp, mouse
gcctggctaccctgacatga

SEQ ID NO: 513220 - DNA, 20 bp, mouse
gcacagcgctggaaaaatgc

SEQ ID NO: 513221 - DNA, 20 bp, mouse
ggccaccaggagcgtgatga

SEQ ID NO: 513222 - DNA, 20 bp, mouse
gaggagcgtgatgacggcag

SEQ ID NO: 513223 - DNA, 20 bp, mouse
gccggttatgaaaggattac

SEQ ID NO: 513224 - DNA, 20 bp, mouse
gcgaagagaaacccatccta

SEQ ID NO: 513225 - DNA, 20 bp, mouse
gctagggaaacgggcaactc

SEQ ID NO: 513226 - DNA, 20 bp, mouse
gcggccccgtgtccaacatc

SEQ ID NO: 513227 - DNA, 20 bp, mouse
gcggcgtgcccgcacggccg

SEQ ID NO: 513228 - DNA, 20 bp, mouse
ggcacatgcactgactccca

SEQ ID NO: 513229 - DNA, 20 bp, mouse
gcgggcctcggagaagccag

SEQ ID NO: 513230 - DNA, 20 bp, mouse
gctccctgcagaccaaacaa

SEQ ID NO: 513231 - DNA, 20 bp, mouse
gctgcctgatgttggacacg

SEQ ID NO: 513232 - DNA, 20 bp, mouse
ggcagctcccgcaccgcacg

SEQ ID NO: 513233 - DNA, 20 bp, mouse
gcgggccactggcttctccg

SEQ ID NO: 513234 - DNA, 20 bp, mouse
gggctcgcgggagccttcac

SEQ ID NO: 513235 - DNA, 20 bp, mouse
gctcggcagcctcggccgtg

SEQ ID NO: 513236 - DNA, 20 bp, mouse
gggcccacctcagagtcccg

SEQ ID NO: 513237 - DNA, 20 bp, mouse
gctcctgccccgggactctg

SEQ ID NO: 513238 - DNA, 20 bp, mouse
gagcggagcagaaggcagcg

SEQ ID NO: 513239 - DNA, 20 bp, mouse
ggcgccgggtggccaggata

SEQ ID NO: 513240 - DNA, 20 bp, mouse
gtgccccgggactctgaggt

SEQ ID NO: 513241 - DNA, 20 bp, mouse
ggcataagggccaagccagg

SEQ ID NO: 513242 - DNA, 20 bp, mouse
ggggcggaggagaggcggct

SEQ ID NO: 513243 - DNA, 20 bp, mouse
gtcacccgtaagctggtcat

SEQ ID NO: 513244 - DNA, 20 bp, mouse
gatgcggggccaaggccgaa

SEQ ID NO: 513245 - DNA, 20 bp, mouse
ggtggctcaggggtcctggg

SEQ ID NO: 513246 - DNA, 20 bp, mouse
gcaggtgccggagcccgttg

SEQ ID NO: 513247 - DNA, 20 bp, mouse
gcgggctccggcacctgcga

SEQ ID NO: 513248 - DNA, 20 bp, mouse
gggcagggctctgggatgag

SEQ ID NO: 513249 - DNA, 20 bp, mouse
gcgggattggagccttacag

SEQ ID NO: 513250 - DNA, 20 bp, mouse
gccggcacctgcgagggcag

SEQ ID NO: 513251 - DNA, 20 bp, mouse
gccgagctgcctgccccaac

SEQ ID NO: 513252 - DNA, 20 bp, mouse
gagggcagcggttcatggct

SEQ ID NO: 513253 - DNA, 20 bp, mouse
gtgcctgccccaacgggctc

SEQ ID NO: 513254 - DNA, 20 bp, mouse
gcagtgacccagtcaccaac

SEQ ID NO: 513255 - DNA, 20 bp, mouse
ggctcggtctctctaccagt

SEQ ID NO: 513256 - DNA, 20 bp, mouse
ggccgccccaggctccatcg

SEQ ID NO: 513257 - DNA, 20 bp, mouse
gcaagggacgagtcccagag

SEQ ID NO: 513258 - DNA, 20 bp, mouse
gggagccgcgatggagcctg

SEQ ID NO: 513259 - DNA, 20 bp, mouse
gtaggcgcagcgaccactct

SEQ ID NO: 513260 - DNA, 20 bp, mouse
ggccgcgatggagcctgggg

SEQ ID NO: 513261 - DNA, 20 bp, mouse
gtggcaaggaggggccgcaa

SEQ ID NO: 513262 - DNA, 20 bp, mouse
gtcccgcccggcctcagggg

SEQ ID NO: 513263 - DNA, 20 bp, mouse
gaccaaacttcgaggcgcgg

SEQ ID NO: 513264 - DNA, 20 bp, mouse
ggctggctcacactgatccc

SEQ ID NO: 513265 - DNA, 20 bp, mouse
gtggggccgggaccccgtgg

SEQ ID NO: 513266 - DNA, 20 bp, mouse
gggctacagctggagaaggg

SEQ ID NO: 513267 - DNA, 20 bp, mouse
ggaggaggagagcggtagag

SEQ ID NO: 513268 - DNA, 20 bp, mouse
gtgagaagcgctcctcaccc

SEQ ID NO: 513269 - DNA, 20 bp, mouse
gggctttacaaagaaagcca

SEQ ID NO: 513270 - DNA, 20 bp, mouse
gccattaaactacattaaga

SEQ ID NO: 513271 - DNA, 20 bp, mouse
gtaaattattggaacagttt

SEQ ID NO: 513272 - DNA, 20 bp, mouse
ggagcgcttctcagtggctg

SEQ ID NO: 513273 - DNA, 20 bp, mouse
gtgattgaagcaggtttaga

SEQ ID NO: 513274 - DNA, 20 bp, mouse
gcccgagaaatgttattctg

SEQ ID NO: 513275 - DNA, 20 bp, mouse
gcagaaaagcaggtttctcc

SEQ ID NO: 513276 - DNA, 20 bp, mouse
gggtccccaagagagcagtc

SEQ ID NO: 513277 - DNA, 20 bp, mouse
gctgtgaagtggccgagggt

SEQ ID NO: 513278 - DNA, 20 bp, mouse
gcacccgagggataagagtg

SEQ ID NO: 513279 - DNA, 20 bp, mouse
ggcacctgactgctctcttg

SEQ ID NO: 513280 - DNA, 20 bp, mouse
gatccaaactctcgaatcaa

SEQ ID NO: 513281 - DNA, 20 bp, mouse
gtctcgaatcaaaggtgcaa

SEQ ID NO: 513282 - DNA, 20 bp, mouse
gacataaaacccaaggtact

SEQ ID NO: 513283 - DNA, 20 bp, mouse
gccagcagatcccaggcgag

SEQ ID NO: 513284 - DNA, 20 bp, mouse
gcctgcaaccagcagatccc

SEQ ID NO: 513285 - DNA, 20 bp, mouse
gggagctgtgaagtggccga

SEQ ID NO: 513286 - DNA, 20 bp, mouse
gcgggacagatgaacagacg

SEQ ID NO: 513287 - DNA, 20 bp, mouse
ggacagatgaacagacgggg

SEQ ID NO: 513288 - DNA, 20 bp, mouse
ggctgctctgataaatcgcg

SEQ ID NO: 513289 - DNA, 20 bp, mouse
gccttggctcgaaggtgaag

SEQ ID NO: 513290 - DNA, 20 bp, mouse
ggcgagcggagctgtgcgac

SEQ ID NO: 513291 - DNA, 20 bp, mouse
gcagggccagagtcttacct

SEQ ID NO: 513292 - DNA, 20 bp, mouse
gcggagctggaatcagataa

SEQ ID NO: 513293 - DNA, 20 bp, mouse
gggcgggcaggagcggcgag

SEQ ID NO: 513294 - DNA, 20 bp, mouse
gatgaacagacggggcgggc

SEQ ID NO: 513295 - DNA, 20 bp, mouse
ggaactgccaagactgaagg

SEQ ID NO: 513296 - DNA, 20 bp, mouse
gcgggtcggtgcctgaggac

SEQ ID NO: 513297 - DNA, 20 bp, mouse
gggagtgagcaacccggagt

SEQ ID NO: 513298 - DNA, 20 bp, mouse
gcggccgggagtgagcaacc

SEQ ID NO: 513299 - DNA, 20 bp, mouse
gtgagcaacccggagtggga

SEQ ID NO: 513300 - DNA, 20 bp, mouse
gccgcgacgcggagccactg

SEQ ID NO: 513301 - DNA, 20 bp, mouse
gacccccaccgcgcacgggt

SEQ ID NO: 513302 - DNA, 20 bp, mouse
gaggcggggtgggaacggag

SEQ ID NO: 513303 - DNA, 20 bp, mouse
ggggtgggatgggaaatccg

SEQ ID NO: 513304 - DNA, 20 bp, mouse
gagacacacgccagggaagc

SEQ ID NO: 513305 - DNA, 20 bp, mouse
gctgtccccggtcccctcca

SEQ ID NO: 513306 - DNA, 20 bp, mouse
gttaccgagaagggctactg

SEQ ID NO: 513307 - DNA, 20 bp, mouse
gacggggaacgaggaatgga

SEQ ID NO: 513308 - DNA, 20 bp, mouse
gcgaggaatggagggcgagg

SEQ ID NO: 513309 - DNA, 20 bp, mouse
gcggcgtggagcgctcccag

SEQ ID NO: 513310 - DNA, 20 bp, mouse
gttggaggagttaccgagaa

SEQ ID NO: 513311 - DNA, 20 bp, mouse
ggcccgggatcagataactg

SEQ ID NO: 513312 - DNA, 20 bp, mouse
gaagggctactgtggcagcg

SEQ ID NO: 513313 - DNA, 20 bp, mouse
ggccgcagttatctgatccc

SEQ ID NO: 513314 - DNA, 20 bp, mouse
ggcgtggccgggggaagacg

SEQ ID NO: 513315 - DNA, 20 bp, mouse
ggaacgaggaatggagggcg

SEQ ID NO: 513316 - DNA, 20 bp, mouse
gggaagctgacagcagatag

SEQ ID NO: 513317 - DNA, 20 bp, mouse
gaccgggtcaaaaagacaag

SEQ ID NO: 513318 - DNA, 20 bp, mouse
gcactacaggttaaaaccac

SEQ ID NO: 513319 - DNA, 20 bp, mouse
ggcttccttaagaccttctt

SEQ ID NO: 513320 - DNA, 20 bp, mouse
gaacctacaaacgacactac

SEQ ID NO: 513321 - DNA, 20 bp, mouse
gacctagatagtcagaacta

SEQ ID NO: 513322 - DNA, 20 bp, mouse
gcgtttgtaggttctcctct

SEQ ID NO: 513323 - DNA, 20 bp, mouse
ggcctcttgtctttttgacc

SEQ ID NO: 513324 - DNA, 20 bp, mouse
ggctggccccacaaaggaac

SEQ ID NO: 513325 - DNA, 20 bp, mouse
gccttaagaccttctttggt

SEQ ID NO: 513326 - DNA, 20 bp, mouse
gaacacattagcacccacag

SEQ ID NO: 513327 - DNA, 20 bp, mouse
gtccgctggagctcagaggt

SEQ ID NO: 513328 - DNA, 20 bp, mouse
gaggttgggtgccccggctc

SEQ ID NO: 513329 - DNA, 20 bp, mouse
ggctcagaggttgggtgccc

SEQ ID NO: 513330 - DNA, 20 bp, mouse
gcggatcagggcctgaacag

SEQ ID NO: 513331 - DNA, 20 bp, mouse
gacttctggatagaacatca

SEQ ID NO: 513332 - DNA, 20 bp, mouse
ggacaaagaccaggcagggg

SEQ ID NO: 513333 - DNA, 20 bp, mouse
gcagaggaacccccagtgca

SEQ ID NO: 513334 - DNA, 20 bp, mouse
gactgggggttcctctgctc

SEQ ID NO: 513335 - DNA, 20 bp, mouse
ggctagagtgggaagacttc

SEQ ID NO: 513336 - DNA, 20 bp, mouse
gacaggtgcccggagaactg

SEQ ID NO: 513337 - DNA, 20 bp, mouse
gtctacagaccggcacaggg

SEQ ID NO: 513338 - DNA, 20 bp, mouse
gggcacagggcggcttggaa

SEQ ID NO: 513339 - DNA, 20 bp, mouse
gaaggactccccagttctcc

SEQ ID NO: 513340 - DNA, 20 bp, mouse
gagaccggcacagggcggct

SEQ ID NO: 513341 - DNA, 20 bp, mouse
gtttaaggaaatctacagac

SEQ ID NO: 513342 - DNA, 20 bp, mouse
gaaatctacagaccggcaca

SEQ ID NO: 513343 - DNA, 20 bp, mouse
gcaggcaaggaagtgatcca

SEQ ID NO: 513344 - DNA, 20 bp, mouse
gcagggtgccttgcaaaggt

SEQ ID NO: 513345 - DNA, 20 bp, mouse
gtgggtgggaaattaagacc

SEQ ID NO: 513346 - DNA, 20 bp, mouse
gagcagctcctacctccctg

SEQ ID NO: 513347 - DNA, 20 bp, mouse
gcactcttccacagggaggt

SEQ ID NO: 513348 - DNA, 20 bp, mouse
gcattcactcttccacaggg

SEQ ID NO: 513349 - DNA, 20 bp, mouse
ggcttgctctcagcttgcaa

SEQ ID NO: 513350 - DNA, 20 bp, mouse
gggcaagagtgggaccttca

SEQ ID NO: 513351 - DNA, 20 bp, mouse
ggtgggatcaacatgatatg

SEQ ID NO: 513352 - DNA, 20 bp, mouse
gaattaaagtgatttaataa

SEQ ID NO: 513353 - DNA, 20 bp, mouse
ggtggggggagggcaagagt

SEQ ID NO: 513354 - DNA, 20 bp, mouse
gatcatgttgatcccacctg

SEQ ID NO: 513355 - DNA, 20 bp, mouse
ggctcgttagttaataataa

SEQ ID NO: 513356 - DNA, 20 bp, mouse
gcaccggcaagcagtgtctt

SEQ ID NO: 513357 - DNA, 20 bp, mouse
gcggagcagccggagctgta

SEQ ID NO: 513358 - DNA, 20 bp, mouse
gctgcttgccggtgctggga

SEQ ID NO: 513359 - DNA, 20 bp, mouse
ggctgtagggtagaggactg

SEQ ID NO: 513360 - DNA, 20 bp, mouse
gctgtaccagcaacaggtaa

SEQ ID NO: 513361 - DNA, 20 bp, mouse
gaggctatcgcagagcgcac

SEQ ID NO: 513362 - DNA, 20 bp, mouse
ggaaggctgcgcgctggcca

SEQ ID NO: 513363 - DNA, 20 bp, mouse
ggcgctctgcgatagcctgg

SEQ ID NO: 513364 - DNA, 20 bp, mouse
gtgctgggaaggctgcgcgc

SEQ ID NO: 513365 - DNA, 20 bp, mouse
gccggaggtgcccagttgtc

SEQ ID NO: 513366 - DNA, 20 bp, mouse
ggtgcagacataatacggag

SEQ ID NO: 513367 - DNA, 20 bp, mouse
gtcggagtgcagacataata

SEQ ID NO: 513368 - DNA, 20 bp, mouse
gggtagtgaagaggtccgaa

SEQ ID NO: 513369 - DNA, 20 bp, mouse
ggccagattcaaacacgaag

SEQ ID NO: 513370 - DNA, 20 bp, mouse
gatgtgcagcatggtaacct

SEQ ID NO: 513371 - DNA, 20 bp, mouse
gagattcaaacacgaagcgg

SEQ ID NO: 513372 - DNA, 20 bp, mouse
gagcaccaataaggaggtgg

SEQ ID NO: 513373 - DNA, 20 bp, mouse
gagcggttcgtggacaagaa

SEQ ID NO: 513374 - DNA, 20 bp, mouse
gaagagccaggccacggtgt

SEQ ID NO: 513375 - DNA, 20 bp, mouse
gcaaaccagcaccaataagg

SEQ ID NO: 513376 - DNA, 20 bp, mouse
gggatgcaaggctcaagcgg

SEQ ID NO: 513377 - DNA, 20 bp, mouse
gtccatccgggacaagcaaa

SEQ ID NO: 513378 - DNA, 20 bp, mouse
ggcttgtcccggatggatgg

SEQ ID NO: 513379 - DNA, 20 bp, mouse
gatccgggacaagcaaaggg

SEQ ID NO: 513380 - DNA, 20 bp, mouse
ggacaagcaaagggcggaca

SEQ ID NO: 513381 - DNA, 20 bp, mouse
gcaaagggcggacatggaat

SEQ ID NO: 513382 - DNA, 20 bp, mouse
ggcactgtcgcctggaaaga

SEQ ID NO: 513383 - DNA, 20 bp, mouse
gacatggaataggagatcga

SEQ ID NO: 513384 - DNA, 20 bp, mouse
gcagtgcgactgctgaacgg

SEQ ID NO: 513385 - DNA, 20 bp, mouse
gggaataggagatcgaagga

SEQ ID NO: 513386 - DNA, 20 bp, mouse
gcgcgctccggcccctgccc

SEQ ID NO: 513387 - DNA, 20 bp, mouse
gagaaggacacagccggccg

SEQ ID NO: 513388 - DNA, 20 bp, mouse
gctcgggtcgaggggtccag

SEQ ID NO: 513389 - DNA, 20 bp, mouse
gaggcggcaccggggcacag

SEQ ID NO: 513390 - DNA, 20 bp, mouse
ggagaccccgagacccacag

SEQ ID NO: 513391 - DNA, 20 bp, mouse
ggaacaacgagagggtcgtg

SEQ ID NO: 513392 - DNA, 20 bp, mouse
ggacccctcgacccgagccc

SEQ ID NO: 513393 - DNA, 20 bp, mouse
gtaaggtccgaggagggtct

SEQ ID NO: 513394 - DNA, 20 bp, mouse
gcggcagcatcgtggagccc

SEQ ID NO: 513395 - DNA, 20 bp, mouse
gtgggtaacagcgggcagtg

SEQ ID NO: 513396 - DNA, 20 bp, mouse
gtcgcaggtccagctagcag

SEQ ID NO: 513397 - DNA, 20 bp, mouse
ggcgaggcagaccggtgaag

SEQ ID NO: 513398 - DNA, 20 bp, mouse
gctctctagatagaagggcg

SEQ ID NO: 513399 - DNA, 20 bp, mouse
gaggcagaccggtgaagggg

SEQ ID NO: 513400 - DNA, 20 bp, mouse
gctgttctctctagatagaa

SEQ ID NO: 513401 - DNA, 20 bp, mouse
gatagaagggcgaggcagac

SEQ ID NO: 513402 - DNA, 20 bp, mouse
gtcaggcattgcctacggac

SEQ ID NO: 513403 - DNA, 20 bp, mouse
gaaacctcccgccccttcac

SEQ ID NO: 513404 - DNA, 20 bp, mouse
gatctagagagaacagcggg

SEQ ID NO: 513405 - DNA, 20 bp, mouse
gagaccggtgaaggggcggg

SEQ ID NO: 513406 - DNA, 20 bp, mouse
ggtctcctgaaagcctgccg

SEQ ID NO: 513407 - DNA, 20 bp, mouse
ggactccattctgctgctag

SEQ ID NO: 513408 - DNA, 20 bp, mouse
gtccgcgggaaccggcgagt

SEQ ID NO: 513409 - DNA, 20 bp, mouse
ggctcgaggatcctaggaca

SEQ ID NO: 513410 - DNA, 20 bp, mouse
gggcagaggagtgcgcgtgt

SEQ ID NO: 513411 - DNA, 20 bp, mouse
gcattctgctgctagcggtt

SEQ ID NO: 513412 - DNA, 20 bp, mouse
gccggttgcgaggaaactgg

SEQ ID NO: 513413 - DNA, 20 bp, mouse
gccgagagaggcgatcagga

SEQ ID NO: 513414 - DNA, 20 bp, mouse
gccgaaggctcgaggatcct

SEQ ID NO: 513415 - DNA, 20 bp, mouse
ggcacctggctggagaggtt

SEQ ID NO: 513416 - DNA, 20 bp, mouse
gtcccgaagtgcagatccgg

SEQ ID NO: 513417 - DNA, 20 bp, mouse
gctggaggaccaacatcccc

SEQ ID NO: 513418 - DNA, 20 bp, mouse
gagtcttaactcagttctgg

SEQ ID NO: 513419 - DNA, 20 bp, mouse
gacctcccgaagtgcagatc

SEQ ID NO: 513420 - DNA, 20 bp, mouse
gtagagtcttaactcagttc

SEQ ID NO: 513421 - DNA, 20 bp, mouse
ggcacagctcgagccaatct

SEQ ID NO: 513422 - DNA, 20 bp, mouse
ggtgcagatccgggggatgt

SEQ ID NO: 513423 - DNA, 20 bp, mouse
ggcccaaagccaaacagtca

SEQ ID NO: 513424 - DNA, 20 bp, mouse
gatcccccggatctgcactt

SEQ ID NO: 513425 - DNA, 20 bp, mouse
gtcgggaggtctctgctccc

SEQ ID NO: 513426 - DNA, 20 bp, mouse
gtcaggagaaacagcagtgt

SEQ ID NO: 513427 - DNA, 20 bp, mouse
gggagaaacagcagtgtcgg

SEQ ID NO: 513428 - DNA, 20 bp, mouse
gctaggttccctctgagatt

SEQ ID NO: 513429 - DNA, 20 bp, mouse
gctgtttctcctgaatgtaa

SEQ ID NO: 513430 - DNA, 20 bp, mouse
gcggcggctcccaatctcag

SEQ ID NO: 513431 - DNA, 20 bp, mouse
ggagggaacctagggtactg

SEQ ID NO: 513432 - DNA, 20 bp, mouse
gccatctcccccagtaccct

SEQ ID NO: 513433 - DNA, 20 bp, mouse
ggagcgctggccagtacagg

SEQ ID NO: 513434 - DNA, 20 bp, mouse
gtgggtggagctgctcccag

SEQ ID NO: 513435 - DNA, 20 bp, mouse
ggccagcgctctctagaggg

SEQ ID NO: 513436 - DNA, 20 bp, mouse
ggccgaagcaccaggccgaa

SEQ ID NO: 513437 - DNA, 20 bp, mouse
gagctcgtgcgtgcgcctgg

SEQ ID NO: 513438 - DNA, 20 bp, mouse
gagggactgcagcatcttcc

SEQ ID NO: 513439 - DNA, 20 bp, mouse
gtccacggacgagaagacca

SEQ ID NO: 513440 - DNA, 20 bp, mouse
gcgaacggtgccgctccacc

SEQ ID NO: 513441 - DNA, 20 bp, mouse
gggagctgcgcaagctgaag

SEQ ID NO: 513442 - DNA, 20 bp, mouse
ggagcaggtagcccagcacc

SEQ ID NO: 513443 - DNA, 20 bp, mouse
gaccaggaagccgaagcacc

SEQ ID NO: 513444 - DNA, 20 bp, mouse
gaggcgcacgcacgagctgc

SEQ ID NO: 513445 - DNA, 20 bp, mouse
gtcctcataaggcagctcca

SEQ ID NO: 513446 - DNA, 20 bp, mouse
gacacaggcgcgcgcacacc

SEQ ID NO: 513447 - DNA, 20 bp, mouse
gtgtgtggatgcgagagagg

SEQ ID NO: 513448 - DNA, 20 bp, mouse
gagcgcggtaggcagatgcg

SEQ ID NO: 513449 - DNA, 20 bp, mouse
gtgctgagggtggttccgag

SEQ ID NO: 513450 - DNA, 20 bp, mouse
ggcttctgcaaaagcgcggt

SEQ ID NO: 513451 - DNA, 20 bp, mouse
ggcgtccctcgggtccccaa

SEQ ID NO: 513452 - DNA, 20 bp, mouse
gctctgtgctcagacgagcg

SEQ ID NO: 513453 - DNA, 20 bp, mouse
gtaagatcggatgctgaggg

SEQ ID NO: 513454 - DNA, 20 bp, mouse
gacccgagggacgctgcggt

SEQ ID NO: 513455 - DNA, 20 bp, mouse
ggagcactgaagtggctcgt

SEQ ID NO: 513456 - DNA, 20 bp, mouse
ggcggtagcagggaaaggaa

SEQ ID NO: 513457 - DNA, 20 bp, mouse
ggtgtcgggtagctcttcag

SEQ ID NO: 513458 - DNA, 20 bp, mouse
gcttcagcggtagcagggaa

SEQ ID NO: 513459 - DNA, 20 bp, mouse
ggaagggagcgcttccccgg

SEQ ID NO: 513460 - DNA, 20 bp, mouse
gagcgcttccccggaggaca

SEQ ID NO: 513461 - DNA, 20 bp, mouse
gagagctacccgacacggag

SEQ ID NO: 513462 - DNA, 20 bp, mouse
gagcccagccttgtcctccg

SEQ ID NO: 513463 - DNA, 20 bp, mouse
gaaggaagggagcgcttccc

SEQ ID NO: 513464 - DNA, 20 bp, mouse
gttccccggaggacaaggct

SEQ ID NO: 513465 - DNA, 20 bp, mouse
gcctaggcgtccggactcta

SEQ ID NO: 513466 - DNA, 20 bp, mouse
gctctcagccccactgggca

SEQ ID NO: 513467 - DNA, 20 bp, mouse
ggggcaaggccacttgagaa

SEQ ID NO: 513468 - DNA, 20 bp, mouse
gggagtgcagatccctggag

SEQ ID NO: 513469 - DNA, 20 bp, mouse
gctgtggaacaggttcagga

SEQ ID NO: 513470 - DNA, 20 bp, mouse
gtggccttgccctgcccagt

SEQ ID NO: 513471 - DNA, 20 bp, mouse
gaggtccaggcgagcgccag

SEQ ID NO: 513472 - DNA, 20 bp, mouse
gtgagacgcgaaggcgacgg

SEQ ID NO: 513473 - DNA, 20 bp, mouse
gtccaggcgagcgccagcgg

SEQ ID NO: 513474 - DNA, 20 bp, mouse
ggtagttcttgcgcagtcag

SEQ ID NO: 513475 - DNA, 20 bp, mouse
gctctgggtgggcgccccag

SEQ ID NO: 513476 - DNA, 20 bp, mouse
gaagcagagcgcgcgcacgg

SEQ ID NO: 513477 - DNA, 20 bp, mouse
ggagcgggagagccgcgatg

SEQ ID NO: 513478 - DNA, 20 bp, mouse
gacccaccagcaggtaggac

SEQ ID NO: 513479 - DNA, 20 bp, mouse
gcggaaaccggcactcggag

SEQ ID NO: 513480 - DNA, 20 bp, mouse
gtccagcgcatcgaaaacag

SEQ ID NO: 513481 - DNA, 20 bp, mouse
ggcagaggggaggctccgga

SEQ ID NO: 513482 - DNA, 20 bp, mouse
gtccagctcgcggtagtcgt

SEQ ID NO: 513483 - DNA, 20 bp, mouse
ggctgtaggcacccacacaa

SEQ ID NO: 513484 - DNA, 20 bp, mouse
gagctcgcggtagtcgtcgg

SEQ ID NO: 513485 - DNA, 20 bp, mouse
gcgtcggggcgcacggaaac

SEQ ID NO: 513486 - DNA, 20 bp, mouse
ggactctgcagcagctgtca

SEQ ID NO: 513487 - DNA, 20 bp, mouse
gcagccgcagaccccagcac

SEQ ID NO: 513488 - DNA, 20 bp, mouse
gacctgtgcggtggaggaca

SEQ ID NO: 513489 - DNA, 20 bp, mouse
gcacggggcatgatgtggcc

SEQ ID NO: 513490 - DNA, 20 bp, mouse
gagcagtaggtagcagatat

SEQ ID NO: 513491 - DNA, 20 bp, mouse
ggctgtgaaagagttggaag

SEQ ID NO: 513492 - DNA, 20 bp, mouse
gctccagggcctgctggtct

SEQ ID NO: 513493 - DNA, 20 bp, mouse
ggccctggagcagtttgtac

SEQ ID NO: 513494 - DNA, 20 bp, mouse
ggatggtggccccaagcagt

SEQ ID NO: 513495 - DNA, 20 bp, mouse
gcagaagcaggggcaatact

SEQ ID NO: 513496 - DNA, 20 bp, mouse
ggagcagctgagggcaggac

SEQ ID NO: 513497 - DNA, 20 bp, mouse
gtcagggcggccctcgacag

SEQ ID NO: 513498 - DNA, 20 bp, mouse
gaggctggagcatacagcct

SEQ ID NO: 513499 - DNA, 20 bp, mouse
gcatcctcttggagcagctg

SEQ ID NO: 513500 - DNA, 20 bp, mouse
gggcacctccgaggcagtaa

SEQ ID NO: 513501 - DNA, 20 bp, mouse
gcaccagcgcataggtcacc

SEQ ID NO: 513502 - DNA, 20 bp, mouse
ggcctcgggacagcatctcc

SEQ ID NO: 513503 - DNA, 20 bp, mouse
ggagtggccggagaatggcc

SEQ ID NO: 513504 - DNA, 20 bp, mouse
gcatcccctggccttcccca

SEQ ID NO: 513505 - DNA, 20 bp, mouse
gagcatctcctggcctcagg

SEQ ID NO: 513506 - DNA, 20 bp, mouse
gcccgtgcggccgagcaccc

SEQ ID NO: 513507 - DNA, 20 bp, mouse
gcgctccgagctgcacgggt

SEQ ID NO: 513508 - DNA, 20 bp, mouse
gggcgcctcacaaagacatg

SEQ ID NO: 513509 - DNA, 20 bp, mouse
gccgcggcacaaagacaccc

SEQ ID NO: 513510 - DNA, 20 bp, mouse
gacaccagcggtggcaggct

SEQ ID NO: 513511 - DNA, 20 bp, mouse
ggcccgcgcgggaccccagg

SEQ ID NO: 513512 - DNA, 20 bp, mouse
gtgcggagaggggctgcaca

SEQ ID NO: 513513 - DNA, 20 bp, mouse
gctgcaggaggtgagaccct

SEQ ID NO: 513514 - DNA, 20 bp, mouse
ggcgaggccgaggccaagtt

SEQ ID NO: 513515 - DNA, 20 bp, mouse
gaaggagaggacaccagcgg

SEQ ID NO: 513516 - DNA, 20 bp, mouse
gcccgggagggacgatgaag

SEQ ID NO: 513517 - DNA, 20 bp, mouse
ggctccgcggcggccggcag

SEQ ID NO: 513518 - DNA, 20 bp, mouse
gtgaagggacagctccgcgg

SEQ ID NO: 513519 - DNA, 20 bp, mouse
ggccgctgctgccccggagg

SEQ ID NO: 513520 - DNA, 20 bp, mouse
gggagggccggcgaggaccc

SEQ ID NO: 513521 - DNA, 20 bp, mouse
gcgctcgcggatctccacgc

SEQ ID NO: 513522 - DNA, 20 bp, mouse
ggctgccgctcgatcatctc

SEQ ID NO: 513523 - DNA, 20 bp, mouse
gcgcgctacaacctcagcga

SEQ ID NO: 513524 - DNA, 20 bp, mouse
gcgcgggccggagacgccgg

SEQ ID NO: 513525 - DNA, 20 bp, mouse
gccggaggcggcctggggca

SEQ ID NO: 513526 - DNA, 20 bp, mouse
gccagctgatgtccaggtta

SEQ ID NO: 513527 - DNA, 20 bp, mouse
gctggacatcagctggcccg

SEQ ID NO: 513528 - DNA, 20 bp, mouse
gctcatgggcggagaaacga

SEQ ID NO: 513529 - DNA, 20 bp, mouse
ggtaagggctgggttcaagg

SEQ ID NO: 513530 - DNA, 20 bp, mouse
gagccgccacactcatctcc

SEQ ID NO: 513531 - DNA, 20 bp, mouse
gagggagacgcagctctggt

SEQ ID NO: 513532 - DNA, 20 bp, mouse
gccccaacgctgccctaacc

SEQ ID NO: 513533 - DNA, 20 bp, mouse
gggttaagctcccaaggagg

SEQ ID NO: 513534 - DNA, 20 bp, mouse
gagcccgcacaccctcgagg

SEQ ID NO: 513535 - DNA, 20 bp, mouse
ggaggctgcaggtgcaggta

SEQ ID NO: 513536 - DNA, 20 bp, mouse
gactgtcgcgcgcgcagagg

SEQ ID NO: 513537 - DNA, 20 bp, mouse
gctctcgatcctgaagggta

SEQ ID NO: 513538 - DNA, 20 bp, mouse
gccaatctctcgatcctgaa

SEQ ID NO: 513539 - DNA, 20 bp, mouse
gcacacgtgtctgctggtgt

SEQ ID NO: 513540 - DNA, 20 bp, mouse
gcgtactgtcgcgcgcgcag

SEQ ID NO: 513541 - DNA, 20 bp, mouse
ggaagggtagggtgaaactc

SEQ ID NO: 513542 - DNA, 20 bp, mouse
gtgcttaaagagccctgcgg

SEQ ID NO: 513543 - DNA, 20 bp, mouse
ggtgagcgcacatcaaaagg

SEQ ID NO: 513544 - DNA, 20 bp, mouse
gcaagcaactgtcccgggag

SEQ ID NO: 513545 - DNA, 20 bp, mouse
gaggcggcacacgtgtctgc

SEQ ID NO: 513546 - DNA, 20 bp, mouse
ggagctcccggaactaaaag

SEQ ID NO: 513547 - DNA, 20 bp, mouse
gggccaccgacgccccgaag

SEQ ID NO: 513548 - DNA, 20 bp, mouse
gcgctccacgaaggcatcca

SEQ ID NO: 513549 - DNA, 20 bp, mouse
gactaaaagcggacctcggg

SEQ ID NO: 513550 - DNA, 20 bp, mouse
ggccacgtcagcgggtgtcg

SEQ ID NO: 513551 - DNA, 20 bp, mouse
gccggctgcgggcagaactg

SEQ ID NO: 513552 - DNA, 20 bp, mouse
gggaactaaaagcggacctc

SEQ ID NO: 513553 - DNA, 20 bp, mouse
gggcgtgagccgccacgcac

SEQ ID NO: 513554 - DNA, 20 bp, mouse
ggcgggtgtcggggctgtac

SEQ ID NO: 513555 - DNA, 20 bp, mouse
ggggctgtacgggcaccatg

SEQ ID NO: 513556 - DNA, 20 bp, mouse
gcagcaggtgggccataagc

SEQ ID NO: 513557 - DNA, 20 bp, mouse
ggactcagtgccatgctatg

SEQ ID NO: 513558 - DNA, 20 bp, mouse
ggtgggccataagcaggagc

SEQ ID NO: 513559 - DNA, 20 bp, mouse
gcataagcaggagcaggtat

SEQ ID NO: 513560 - DNA, 20 bp, mouse
gcccaggctggaaactccat

SEQ ID NO: 513561 - DNA, 20 bp, mouse
gcgagctggagggccctcca

SEQ ID NO: 513562 - DNA, 20 bp, mouse
gcatcctcaccaccaccggt

SEQ ID NO: 513563 - DNA, 20 bp, mouse
gttgccacctgaggccctgg

SEQ ID NO: 513564 - DNA, 20 bp, mouse
gtttcagactccccatagca

SEQ ID NO: 513565 - DNA, 20 bp, mouse
gtatggggagtctgaaacca

SEQ ID NO: 513566 - DNA, 20 bp, mouse
ggagtccggggagcccggtg

SEQ ID NO: 513567 - DNA, 20 bp, mouse
ggcagaatccgcagagtccg

SEQ ID NO: 513568 - DNA, 20 bp, mouse
gtgggactcaacgacctcac

SEQ ID NO: 513569 - DNA, 20 bp, mouse
ggtacaggcgatcaaggaca

SEQ ID NO: 513570 - DNA, 20 bp, mouse
gccgggctcgagggagacac

SEQ ID NO: 513571 - DNA, 20 bp, mouse
gaaggctgaggggtctcccc

SEQ ID NO: 513572 - DNA, 20 bp, mouse
ggaacttcaccaccacctga

SEQ ID NO: 513573 - DNA, 20 bp, mouse
gcttcttcgcggccatgaag

SEQ ID NO: 513574 - DNA, 20 bp, mouse
gtctccctcgagcccggtgg

SEQ ID NO: 513575 - DNA, 20 bp, mouse
gagcaggtaggtgaaggtac

SEQ ID NO: 513576 - DNA, 20 bp, mouse
gccagtggacgaaaaagagg

SEQ ID NO: 513577 - DNA, 20 bp, mouse
ggatggtactctcaagccag

SEQ ID NO: 513578 - DNA, 20 bp, mouse
gaggtggtggcagccgaggt

SEQ ID NO: 513579 - DNA, 20 bp, mouse
gaagccagtggacgaaaaag

SEQ ID NO: 513580 - DNA, 20 bp, mouse
ggatgtcatccagccgacct

SEQ ID NO: 513581 - DNA, 20 bp, mouse
gagaccacctcatataggag

SEQ ID NO: 513582 - DNA, 20 bp, mouse
gccctggcccctcctatatg

SEQ ID NO: 513583 - DNA, 20 bp, mouse
gataaacaatggctccagcc

SEQ ID NO: 513584 - DNA, 20 bp, mouse
gtatccgcccagacactgac

SEQ ID NO: 513585 - DNA, 20 bp, mouse
ggtgagtggccagtgctcca

SEQ ID NO: 513586 - DNA, 20 bp, mouse
ggctacatcccagagagctt

SEQ ID NO: 513587 - DNA, 20 bp, mouse
gccggtgccagaactctgat

SEQ ID NO: 513588 - DNA, 20 bp, mouse
ggtagcactcacagttctct

SEQ ID NO: 513589 - DNA, 20 bp, mouse
gcagttctctgggtctccgc

SEQ ID NO: 513590 - DNA, 20 bp, mouse
gctaggaagccggggctgag

SEQ ID NO: 513591 - DNA, 20 bp, mouse
gctctgatgggcatcaggag

SEQ ID NO: 513592 - DNA, 20 bp, mouse
ggagcttgggaagggcttct

SEQ ID NO: 513593 - DNA, 20 bp, mouse
gaagggcttctaggaagccg

SEQ ID NO: 513594 - DNA, 20 bp, mouse
gtacatcaggaccctgagga

SEQ ID NO: 513595 - DNA, 20 bp, mouse
gtctctgggtctccgctggc

SEQ ID NO: 513596 - DNA, 20 bp, mouse
ggaaggacaataggagtgac

SEQ ID NO: 513597 - DNA, 20 bp, mouse
gaccggcttccacagagctt

SEQ ID NO: 513598 - DNA, 20 bp, mouse
ggctgtgtggaggactacac

SEQ ID NO: 513599 - DNA, 20 bp, mouse
ggcagccaggtgctacagag

SEQ ID NO: 513600 - DNA, 20 bp, mouse
gggagaactaatcttaagca

SEQ ID NO: 513601 - DNA, 20 bp, mouse
gcaaaatgtctgcaagagtt

SEQ ID NO: 513602 - DNA, 20 bp, mouse
gttagttctccgaagctctg

SEQ ID NO: 513603 - DNA, 20 bp, mouse
gtgtgacaactcctgaaggt

SEQ ID NO: 513604 - DNA, 20 bp, mouse
gagcgagggtgtgacatcaa

SEQ ID NO: 513605 - DNA, 20 bp, mouse
ggcaatccctgaccgaccac

SEQ ID NO: 513606 - DNA, 20 bp, mouse
gctgatgggagattcaggtg

SEQ ID NO: 513607 - DNA, 20 bp, mouse
gtccaaatcacgctacaggg

SEQ ID NO: 513608 - DNA, 20 bp, mouse
ggggtggccggaggcgccaa

SEQ ID NO: 513609 - DNA, 20 bp, mouse
gggccagtgtggctacaatg

SEQ ID NO: 513610 - DNA, 20 bp, mouse
gctgtagcgtgatttggaca

SEQ ID NO: 513611 - DNA, 20 bp, mouse
gcacgctacagggtggccgg

SEQ ID NO: 513612 - DNA, 20 bp, mouse
gactggccttgattagcagg

SEQ ID NO: 513613 - DNA, 20 bp, mouse
ggcacactgatgggagattc

SEQ ID NO: 513614 - DNA, 20 bp, mouse
gttagcaggaggcacactga

SEQ ID NO: 513615 - DNA, 20 bp, mouse
gaatcacgctacagggtggc

SEQ ID NO: 513616 - DNA, 20 bp, mouse
gcccgacgctgggagcgact

SEQ ID NO: 513617 - DNA, 20 bp, mouse
gggcgcgcgcgagaacaaag

SEQ ID NO: 513618 - DNA, 20 bp, mouse
gaggccggcgacgcccccgg

SEQ ID NO: 513619 - DNA, 20 bp, mouse
gctcgctcaacgcggagcca

SEQ ID NO: 513620 - DNA, 20 bp, mouse
ggcccagtcgctcccagcgt

SEQ ID NO: 513621 - DNA, 20 bp, mouse
gcgcccgcctgccatcgccg

SEQ ID NO: 513622 - DNA, 20 bp, mouse
ggccagccgtggagagtggg

SEQ ID NO: 513623 - DNA, 20 bp, mouse
gggagcagcctcgctcaacg

SEQ ID NO: 513624 - DNA, 20 bp, mouse
gcctgtggcaccgactgcag

SEQ ID NO: 513625 - DNA, 20 bp, mouse
gcgcgcgacagcaggggagt

SEQ ID NO: 513626 - DNA, 20 bp, mouse
ggagccacctcagaatggac

SEQ ID NO: 513627 - DNA, 20 bp, mouse
gttggagagccacctcagaa

SEQ ID NO: 513628 - DNA, 20 bp, mouse
gtctccagtccattctgagg

SEQ ID NO: 513629 - DNA, 20 bp, mouse
gcccctaacggcggatgcag

SEQ ID NO: 513630 - DNA, 20 bp, mouse
gtctccaaaactgaatttgt

SEQ ID NO: 513631 - DNA, 20 bp, mouse
ggtcccccctgcgcccctaa

SEQ ID NO: 513632 - DNA, 20 bp, mouse
gccccctgcgcccctaacgg

SEQ ID NO: 513633 - DNA, 20 bp, mouse
gctagccaagatcaccacaa

SEQ ID NO: 513634 - DNA, 20 bp, mouse
ggagcgggaaagcagagcct

SEQ ID NO: 513635 - DNA, 20 bp, mouse
ggggcagggaagggtcgaga

SEQ ID NO: 513636 - DNA, 20 bp, mouse
gccgagaccggccagggagg

SEQ ID NO: 513637 - DNA, 20 bp, mouse
gtattggcgagaggaagcgg

SEQ ID NO: 513638 - DNA, 20 bp, mouse
gggtccccgcccgcaggtat

SEQ ID NO: 513639 - DNA, 20 bp, mouse
gccaaggcgccgctcatacg

SEQ ID NO: 513640 - DNA, 20 bp, mouse
gtcctctcgccaatacctgc

SEQ ID NO: 513641 - DNA, 20 bp, mouse
gaggcgccgctcatacgggg

SEQ ID NO: 513642 - DNA, 20 bp, mouse
gtccctggccggtctcggcg

SEQ ID NO: 513643 - DNA, 20 bp, mouse
gcggcgctgctccccctccc

SEQ ID NO: 513644 - DNA, 20 bp, mouse
gcggggacgcgctggcacga

SEQ ID NO: 513645 - DNA, 20 bp, mouse
ggtgagggaagattgcgagt

SEQ ID NO: 513646 - DNA, 20 bp, mouse
gtgaccttgaggctaccgag

SEQ ID NO: 513647 - DNA, 20 bp, mouse
gcgggagagcactggtggac

SEQ ID NO: 513648 - DNA, 20 bp, mouse
ggacaaccctgatcagtcgg

SEQ ID NO: 513649 - DNA, 20 bp, mouse
gccaggccccggctgcccac

SEQ ID NO: 513650 - DNA, 20 bp, mouse
gacacccctcggtagcctca

SEQ ID NO: 513651 - DNA, 20 bp, mouse
ggacttgcaccttcaccagt

SEQ ID NO: 513652 - DNA, 20 bp, mouse
gggggacccccgactgatca

SEQ ID NO: 513653 - DNA, 20 bp, mouse
gaagcctgtccccaaaggtg

SEQ ID NO: 513654 - DNA, 20 bp, mouse
ggagagcactggtggacggg

SEQ ID NO: 513655 - DNA, 20 bp, mouse
gggaggaagtcccccagtgg

SEQ ID NO: 513656 - DNA, 20 bp, mouse
gctgcttcatacactcctag

SEQ ID NO: 513657 - DNA, 20 bp, mouse
gattctgaaggcggtcctct

SEQ ID NO: 513658 - DNA, 20 bp, mouse
ggaaaagaactctattctga

SEQ ID NO: 513659 - DNA, 20 bp, mouse
gatataacagtgtcaggagg

SEQ ID NO: 513660 - DNA, 20 bp, mouse
gaagaactctattctgaagg

SEQ ID NO: 513661 - DNA, 20 bp, mouse
ggctgcagcaagggtcccgg

SEQ ID NO: 513662 - DNA, 20 bp, mouse
gcgaagctattgagccagcg

SEQ ID NO: 513663 - DNA, 20 bp, mouse
ggagccaagacacttctggt

SEQ ID NO: 513664 - DNA, 20 bp, mouse
gccccaagatggacacttct

SEQ ID NO: 513665 - DNA, 20 bp, mouse
ggggtcccggaggctgctgg

SEQ ID NO: 513666 - DNA, 20 bp, mouse
gggcctgttctgctcactct

SEQ ID NO: 513667 - DNA, 20 bp, mouse
ggcagttaccactccccaga

SEQ ID NO: 513668 - DNA, 20 bp, mouse
gccactccccagagggcaca

SEQ ID NO: 513669 - DNA, 20 bp, mouse
ggctggcctggaagccaagc

SEQ ID NO: 513670 - DNA, 20 bp, mouse
ggagaagagggtggccggct

SEQ ID NO: 513671 - DNA, 20 bp, mouse
gccttccaccgagcagggaa

SEQ ID NO: 513672 - DNA, 20 bp, mouse
gaccgagcagggaagggacg

SEQ ID NO: 513673 - DNA, 20 bp, mouse
gagtgagcagaacaggccgc

SEQ ID NO: 513674 - DNA, 20 bp, mouse
gacgcaaatggcagccagct

SEQ ID NO: 513675 - DNA, 20 bp, mouse
gccatttgcgtactgagagg

SEQ ID NO: 513676 - DNA, 20 bp, mouse
gccccaggcggagcagacag

SEQ ID NO: 513677 - DNA, 20 bp, mouse
gccgctgctcctcggagctg

SEQ ID NO: 513678 - DNA, 20 bp, mouse
ggaaggcagcgcagagcgca

SEQ ID NO: 513679 - DNA, 20 bp, mouse
gctgccagcccagccacggg

SEQ ID NO: 513680 - DNA, 20 bp, mouse
gccctgaccccgctgctcct

SEQ ID NO: 513681 - DNA, 20 bp, mouse
gagcagacagcggccccccg

SEQ ID NO: 513682 - DNA, 20 bp, mouse
gcggccagctccagtgagaa

SEQ ID NO: 513683 - DNA, 20 bp, mouse
gagagcgcagggcgcagcgc

SEQ ID NO: 513684 - DNA, 20 bp, mouse
gacactggggtcgacatggg

SEQ ID NO: 513685 - DNA, 20 bp, mouse
gacagcggccccccgtggct

SEQ ID NO: 513686 - DNA, 20 bp, mouse
gccagcccaggcctccggtc

SEQ ID NO: 513687 - DNA, 20 bp, mouse
gcggcagccgcatggcgagg

SEQ ID NO: 513688 - DNA, 20 bp, mouse
ggcgcgcggccgggccaggt

SEQ ID NO: 513689 - DNA, 20 bp, mouse
gccgcatggcgaggcggctg

SEQ ID NO: 513690 - DNA, 20 bp, mouse
gtagggcgccgcaggcacca

SEQ ID NO: 513691 - DNA, 20 bp, mouse
ggtccggcagccgcatggcg

SEQ ID NO: 513692 - DNA, 20 bp, mouse
gtgcagaagtcgcgcaacgg

SEQ ID NO: 513693 - DNA, 20 bp, mouse
ggcggctctgcgttcctacc

SEQ ID NO: 513694 - DNA, 20 bp, mouse
gcatgcggctgccggaccgg

SEQ ID NO: 513695 - DNA, 20 bp, mouse
gtcgcgggccacttacacgt

SEQ ID NO: 513696 - DNA, 20 bp, mouse
gcgaagctccagggaggcgg

SEQ ID NO: 513697 - DNA, 20 bp, mouse
ggcctggcaccgaagctcca

SEQ ID NO: 513698 - DNA, 20 bp, mouse
ggcaaaggcgggcctcccgg

SEQ ID NO: 513699 - DNA, 20 bp, mouse
gggcggcgacggcggcaccc

SEQ ID NO: 513700 - DNA, 20 bp, mouse
gtaaactgcgatgctgtctc

SEQ ID NO: 513701 - DNA, 20 bp, mouse
ggggccagaggaggtcgggt

SEQ ID NO: 513702 - DNA, 20 bp, mouse
gcgggaggacggctggcaca

SEQ ID NO: 513703 - DNA, 20 bp, mouse
ggcccctccgggtcccacag

SEQ ID NO: 513704 - DNA, 20 bp, mouse
gacctcctctggcccccggg

SEQ ID NO: 513705 - DNA, 20 bp, mouse
gtcccacagaggacccgctc

SEQ ID NO: 513706 - DNA, 20 bp, mouse
ggagcgcgtaataagagagt

SEQ ID NO: 513707 - DNA, 20 bp, mouse
gcccgcttccccggcgactg

SEQ ID NO: 513708 - DNA, 20 bp, mouse
gcggcaggtggaaaggcgag

SEQ ID NO: 513709 - DNA, 20 bp, mouse
gggaagcgggcggtcagtac

SEQ ID NO: 513710 - DNA, 20 bp, mouse
ggcttccccggcgactgggg

SEQ ID NO: 513711 - DNA, 20 bp, mouse
gagagccgccccagtcgccg

SEQ ID NO: 513712 - DNA, 20 bp, mouse
gcatgtgagcggcgcgccgg

SEQ ID NO: 513713 - DNA, 20 bp, mouse
gcggccgtgcagagtgaaca

SEQ ID NO: 513714 - DNA, 20 bp, mouse
gccagaaggccgaggcgacg

SEQ ID NO: 513715 - DNA, 20 bp, mouse
gcatggctcgaaccccgggc

SEQ ID NO: 513716 - DNA, 20 bp, mouse
gtgcaggctggattgagtcg

SEQ ID NO: 513717 - DNA, 20 bp, mouse
ggacacacccggagagagcc

SEQ ID NO: 513718 - DNA, 20 bp, mouse
gtgagtcgcgggaagctgct

SEQ ID NO: 513719 - DNA, 20 bp, mouse
gtagccaaaacctggagggt

SEQ ID NO: 513720 - DNA, 20 bp, mouse
gctcctcacccagagcccgg

SEQ ID NO: 513721 - DNA, 20 bp, mouse
gaccaggcgcggcatagcag

SEQ ID NO: 513722 - DNA, 20 bp, mouse
gacccgaggatggcaggacc

SEQ ID NO: 513723 - DNA, 20 bp, mouse
gaggctagccaaaacctgga

SEQ ID NO: 513724 - DNA, 20 bp, mouse
gaagctgctgggtccctgcc

SEQ ID NO: 513725 - DNA, 20 bp, mouse
gctgcaccccggcagaatac

SEQ ID NO: 513726 - DNA, 20 bp, mouse
gctgcctagcttcacactag

SEQ ID NO: 513727 - DNA, 20 bp, mouse
gtagccactagtgtgaagct

SEQ ID NO: 513728 - DNA, 20 bp, mouse
gctaggcaggatgagtggtc

SEQ ID NO: 513729 - DNA, 20 bp, mouse
ggcttggcaggcatgttaga

SEQ ID NO: 513730 - DNA, 20 bp, mouse
ggaggcagggaactgcttga

SEQ ID NO: 513731 - DNA, 20 bp, mouse
gaacatgcctgccaagcgag

SEQ ID NO: 513732 - DNA, 20 bp, mouse
ggcctgccaagcgagaggca

SEQ ID NO: 513733 - DNA, 20 bp, mouse
gggactttgcagaccatcat

SEQ ID NO: 513734 - DNA, 20 bp, mouse
gcgtcactttgaatgtggga

SEQ ID NO: 513735 - DNA, 20 bp, mouse
gcatcataggcttcagagag

SEQ ID NO: 513736 - DNA, 20 bp, mouse
gacaagcgcgctggaatccc

SEQ ID NO: 513737 - DNA, 20 bp, mouse
ggtccagggcggcgacttga

SEQ ID NO: 513738 - DNA, 20 bp, mouse
gaatccctggagaccaatac

SEQ ID NO: 513739 - DNA, 20 bp, mouse
gtccgtgtgtgaggagctca

SEQ ID NO: 513740 - DNA, 20 bp, mouse
gctggagaccaatacaggta

SEQ ID NO: 513741 - DNA, 20 bp, mouse
gccgcagtagtgaggcgcag

SEQ ID NO: 513742 - DNA, 20 bp, mouse
gtgaggcgcagcggggcctc

SEQ ID NO: 513743 - DNA, 20 bp, mouse
gctgtctgagggcctctcgg

SEQ ID NO: 513744 - DNA, 20 bp, mouse
gcggggcctccgcagtagtg

SEQ ID NO: 513745 - DNA, 20 bp, mouse
ggtccctcaagtcgccgccc

SEQ ID NO: 513746 - DNA, 20 bp, mouse
gctgctggcaagcatcaccg

SEQ ID NO: 513747 - DNA, 20 bp, mouse
gcactcgcgcagccagccaa

SEQ ID NO: 513748 - DNA, 20 bp, mouse
gctggcaagcatcaccgcgg

SEQ ID NO: 513749 - DNA, 20 bp, mouse
gcagccaacggcgtccaccg

SEQ ID NO: 513750 - DNA, 20 bp, mouse
gtcaccgcggtggacgccgt

SEQ ID NO: 513751 - DNA, 20 bp, mouse
gcgcaaggcgagctccggga

SEQ ID NO: 513752 - DNA, 20 bp, mouse
gctgggtgcacgggagcccg

SEQ ID NO: 513753 - DNA, 20 bp, mouse
gacatccgcgagaggctcac

SEQ ID NO: 513754 - DNA, 20 bp, mouse
gccttgaaggctggagatct

SEQ ID NO: 513755 - DNA, 20 bp, mouse
gtggctgcgcgagtgcgcgc

SEQ ID NO: 513756 - DNA, 20 bp, mouse
gcggactcggcgacccgtgc

SEQ ID NO: 513757 - DNA, 20 bp, mouse
gtgggtgagccagggaaagg

SEQ ID NO: 513758 - DNA, 20 bp, mouse
gagagcgggctagcccgcac

SEQ ID NO: 513759 - DNA, 20 bp, mouse
gtccctgcagcacggacagg

SEQ ID NO: 513760 - DNA, 20 bp, mouse
gcggtcccgcccgcctcccg

SEQ ID NO: 513761 - DNA, 20 bp, mouse
ggggaggtggagacccgatc

SEQ ID NO: 513762 - DNA, 20 bp, mouse
ggaggcacccagctccggcc

SEQ ID NO: 513763 - DNA, 20 bp, mouse
gcctgagagccattggggac

SEQ ID NO: 513764 - DNA, 20 bp, mouse
gcacgacctgagagccattg

SEQ ID NO: 513765 - DNA, 20 bp, mouse
ggactgcccaaagcaagcgt

SEQ ID NO: 513766 - DNA, 20 bp, mouse
gagcccgtgtggctcctcag

SEQ ID NO: 513767 - DNA, 20 bp, mouse
ggacccgccttgccctcgga

SEQ ID NO: 513768 - DNA, 20 bp, mouse
gtcgccgtccgagggcaagg

SEQ ID NO: 513769 - DNA, 20 bp, mouse
gtgccgcgctcgccgtccga

SEQ ID NO: 513770 - DNA, 20 bp, mouse
gcttggcccgcgccatcctg

SEQ ID NO: 513771 - DNA, 20 bp, mouse
ggccaagcgctcccgcagga

SEQ ID NO: 513772 - DNA, 20 bp, mouse
gtgccctcggacggcgagcg

SEQ ID NO: 513773 - DNA, 20 bp, mouse
gtacaggcaacgccaggcgg

SEQ ID NO: 513774 - DNA, 20 bp, mouse
gcgagggcaaggcgggtccg

SEQ ID NO: 513775 - DNA, 20 bp, mouse
ggcgctcccgcaggatggcg

SEQ ID NO: 513776 - DNA, 20 bp, mouse
ggagggcgcgggcggtgagg

SEQ ID NO: 513777 - DNA, 20 bp, mouse
ggtctgcgcgcgaccggcga

SEQ ID NO: 513778 - DNA, 20 bp, mouse
gggccgggaagggctcgcag

SEQ ID NO: 513779 - DNA, 20 bp, mouse
gctgcaggcgaccctgctca

SEQ ID NO: 513780 - DNA, 20 bp, mouse
ggaccctgctcagggaaagt

SEQ ID NO: 513781 - DNA, 20 bp, mouse
gaacgacgataggtaagtgg

SEQ ID NO: 513782 - DNA, 20 bp, mouse
ggcaggggtctgcgcgcgac

SEQ ID NO: 513783 - DNA, 20 bp, mouse
gcgcgcgaccggcgagggcg

SEQ ID NO: 513784 - DNA, 20 bp, mouse
gtaagtggcggagctgtccg

SEQ ID NO: 513785 - DNA, 20 bp, mouse
gccgaacgacgataggtaag

SEQ ID NO: 513786 - DNA, 20 bp, mouse
gggaccagagcctcccacta

SEQ ID NO: 513787 - DNA, 20 bp, mouse
gccggggatgccctagtggg

SEQ ID NO: 513788 - DNA, 20 bp, mouse
gcggtgcctagaaagagggt

SEQ ID NO: 513789 - DNA, 20 bp, mouse
ggtggccggggatgccctag

SEQ ID NO: 513790 - DNA, 20 bp, mouse
gcgcagggagtgcaagcact

SEQ ID NO: 513791 - DNA, 20 bp, mouse
gggctaggcactttcctgaa

SEQ ID NO: 513792 - DNA, 20 bp, mouse
gatgccctagtgggaggctc

SEQ ID NO: 513793 - DNA, 20 bp, mouse
gtgagcaccgcgtgatggct

SEQ ID NO: 513794 - DNA, 20 bp, mouse
gcgcgcggtgcctagaaaga

SEQ ID NO: 513795 - DNA, 20 bp, mouse
gggtagcaagcactgcggag

SEQ ID NO: 513796 - DNA, 20 bp, mouse
gacccggcaacagtcccagg

SEQ ID NO: 513797 - DNA, 20 bp, mouse
gcacatgggtgtcccagaca

SEQ ID NO: 513798 - DNA, 20 bp, mouse
gttaaatcagaaggagttga

SEQ ID NO: 513799 - DNA, 20 bp, mouse
ggtcacccggcaacagtccc

SEQ ID NO: 513800 - DNA, 20 bp, mouse
gcccccgaagaaagtcgcca

SEQ ID NO: 513801 - DNA, 20 bp, mouse
gaatacgtcaaggggccaag

SEQ ID NO: 513802 - DNA, 20 bp, mouse
ggaagttggaaatacgtcaa

SEQ ID NO: 513803 - DNA, 20 bp, mouse
gccgaagaaagtcgccaagg

SEQ ID NO: 513804 - DNA, 20 bp, mouse
ggcctcctgggactgttgcc

SEQ ID NO: 513805 - DNA, 20 bp, mouse
gctagacagtttaaatcaga

SEQ ID NO: 513806 - DNA, 20 bp, mouse
gctgaaggcactgggaagtt

SEQ ID NO: 513807 - DNA, 20 bp, mouse
gaggcgctggatggaagcgt

SEQ ID NO: 513808 - DNA, 20 bp, mouse
ggtgccacggcccctgctgg

SEQ ID NO: 513809 - DNA, 20 bp, mouse
gaagttgggaaggcgctgga

SEQ ID NO: 513810 - DNA, 20 bp, mouse
gaagctggtggaaagagtag

SEQ ID NO: 513811 - DNA, 20 bp, mouse
gagcagtcccccagagccaa

SEQ ID NO: 513812 - DNA, 20 bp, mouse
gttgctgcgagagcacgaag

SEQ ID NO: 513813 - DNA, 20 bp, mouse
gtgggaagttgggaaggcgc

SEQ ID NO: 513814 - DNA, 20 bp, mouse
ggcggtgccacggcccctgc

SEQ ID NO: 513815 - DNA, 20 bp, mouse
gggatctcccaggttcccga

SEQ ID NO: 513816 - DNA, 20 bp, mouse
gtgccagatctgaatactag

SEQ ID NO: 513817 - DNA, 20 bp, mouse
gtgccactagtattcagatc

SEQ ID NO: 513818 - DNA, 20 bp, mouse
gctctccaggggccatagac

SEQ ID NO: 513819 - DNA, 20 bp, mouse
ggaaggaagagcagctttga

SEQ ID NO: 513820 - DNA, 20 bp, mouse
ggctttgagggtaatgccta

SEQ ID NO: 513821 - DNA, 20 bp, mouse
ggctgaaacagagcaacgag

SEQ ID NO: 513822 - DNA, 20 bp, mouse
gtcgcaccacaatggaccga

SEQ ID NO: 513823 - DNA, 20 bp, mouse
ggccatccaggaggcttgtg

SEQ ID NO: 513824 - DNA, 20 bp, mouse
gcagggcagtgtactctcca

SEQ ID NO: 513825 - DNA, 20 bp, mouse
gtgaggatgtgcccaacact

SEQ ID NO: 513826 - DNA, 20 bp, mouse
gggtcgagcgagcatggcgg

SEQ ID NO: 513827 - DNA, 20 bp, mouse
ggcgggtcgagcgagcatgg

SEQ ID NO: 513828 - DNA, 20 bp, mouse
ggaggcgggtcgagcgagca

SEQ ID NO: 513829 - DNA, 20 bp, mouse
ggcacagacctaaagcgagg

SEQ ID NO: 513830 - DNA, 20 bp, mouse
gtgagcacagacctaaagcg

SEQ ID NO: 513831 - DNA, 20 bp, mouse
gcgcccaccgacggggagga

SEQ ID NO: 513832 - DNA, 20 bp, mouse
gggccagcgccaggctcccg

SEQ ID NO: 513833 - DNA, 20 bp, mouse
gtgctcgcccaccgacgggg

SEQ ID NO: 513834 - DNA, 20 bp, mouse
gggccagcgacgcgcaaccc

SEQ ID NO: 513835 - DNA, 20 bp, mouse
ggccaaggagtcctaagtag

SEQ ID NO: 513836 - DNA, 20 bp, mouse
gtggcagggagacggcaata

SEQ ID NO: 513837 - DNA, 20 bp, mouse
gccctgcccgaggactggca

SEQ ID NO: 513838 - DNA, 20 bp, mouse
gatgcgccctgcccgaggac

SEQ ID NO: 513839 - DNA, 20 bp, mouse
gcgtctccctgccagtcctc

SEQ ID NO: 513840 - DNA, 20 bp, mouse
gactgtaacaccagcgcggg

SEQ ID NO: 513841 - DNA, 20 bp, mouse
gcaggaggtgcagataacgg

SEQ ID NO: 513842 - DNA, 20 bp, mouse
ggcaatatggcgagaatgcc

SEQ ID NO: 513843 - DNA, 20 bp, mouse
ggcgagaatgcctggcagcg

SEQ ID NO: 513844 - DNA, 20 bp, mouse
gtgcagcgcgggcgaggagg

SEQ ID NO: 513845 - DNA, 20 bp, mouse
ggggactgtaacaccagcgc

SEQ ID NO: 513846 - DNA, 20 bp, mouse
gcctcaccatgaaaagtcgg

SEQ ID NO: 513847 - DNA, 20 bp, mouse
gccgccccgaagctccccga

SEQ ID NO: 513848 - DNA, 20 bp, mouse
gtctccaaatccggactgag

SEQ ID NO: 513849 - DNA, 20 bp, mouse
gcgccctcaccatgaaaagt

SEQ ID NO: 513850 - DNA, 20 bp, mouse
gacgccggagtctccaaatc

SEQ ID NO: 513851 - DNA, 20 bp, mouse
gctgcctctcagtccggatt

SEQ ID NO: 513852 - DNA, 20 bp, mouse
gagtccggatttggagactc

SEQ ID NO: 513853 - DNA, 20 bp, mouse
gccccgaagctccccgacgg

SEQ ID NO: 513854 - DNA, 20 bp, mouse
ggtggtggggatctgcgaag

SEQ ID NO: 513855 - DNA, 20 bp, mouse
gatgaaaagtcggaggacgc

SEQ ID NO: 513856 - DNA, 20 bp, mouse
gggtagccagcagttctgta

SEQ ID NO: 513857 - DNA, 20 bp, mouse
gagtgtcccgggactctgtt

SEQ ID NO: 513858 - DNA, 20 bp, mouse
ggttctgtatggcttgggag

SEQ ID NO: 513859 - DNA, 20 bp, mouse
gctgttcccaacagagtccc

SEQ ID NO: 513860 - DNA, 20 bp, mouse
gctgctgcgacaacccagga

SEQ ID NO: 513861 - DNA, 20 bp, mouse
gcagcagttctgtatggctt

SEQ ID NO: 513862 - DNA, 20 bp, mouse
gaggtgacggtggtgagcac

SEQ ID NO: 513863 - DNA, 20 bp, mouse
gctgcgacaacccaggaagg

SEQ ID NO: 513864 - DNA, 20 bp, mouse
gagatggaggcgcaactgat

SEQ ID NO: 513865 - DNA, 20 bp, mouse
gaggtcctcggaacccgacg

SEQ ID NO: 513866 - DNA, 20 bp, mouse
gtgagggctcacctccacag

SEQ ID NO: 513867 - DNA, 20 bp, mouse
ggaaaggcattcctctgtgg

SEQ ID NO: 513868 - DNA, 20 bp, mouse
ggtgagccctcacagcactg

SEQ ID NO: 513869 - DNA, 20 bp, mouse
gagcaccaaaacacacagca

SEQ ID NO: 513870 - DNA, 20 bp, mouse
gcaggcactgaagctcgatt

SEQ ID NO: 513871 - DNA, 20 bp, mouse
gatgtcatagcagaggagga

SEQ ID NO: 513872 - DNA, 20 bp, mouse
ggtcaagtatgtcatagcag

SEQ ID NO: 513873 - DNA, 20 bp, mouse
ggtacctggctcgagactca

SEQ ID NO: 513874 - DNA, 20 bp, mouse
gctactgtgaagcctgagac

SEQ ID NO: 513875 - DNA, 20 bp, mouse
gaattccagaagcgatggac

SEQ ID NO: 513876 - DNA, 20 bp, mouse
ggtggagagagcgcgcgatg

SEQ ID NO: 513877 - DNA, 20 bp, mouse
ggagagagcgcgcgatgggg

SEQ ID NO: 513878 - DNA, 20 bp, mouse
ggggcggctggtggacgtcg

SEQ ID NO: 513879 - DNA, 20 bp, mouse
ggccaggctccacactcgag

SEQ ID NO: 513880 - DNA, 20 bp, mouse
gggacgtcgcggagtagctg

SEQ ID NO: 513881 - DNA, 20 bp, mouse
gcggccgacatgccagtgag

SEQ ID NO: 513882 - DNA, 20 bp, mouse
gggcttcagactgtacgagg

SEQ ID NO: 513883 - DNA, 20 bp, mouse
ggcggagtagctgtggagag

SEQ ID NO: 513884 - DNA, 20 bp, mouse
gagggcagcacgtgtaccgg

SEQ ID NO: 513885 - DNA, 20 bp, mouse
gctggagtcgcgggatctca

SEQ ID NO: 513886 - DNA, 20 bp, mouse
gggaatgtgggccccactgg

SEQ ID NO: 513887 - DNA, 20 bp, mouse
gtccctccgctccccccagt

SEQ ID NO: 513888 - DNA, 20 bp, mouse
gccccactggggggagcgga

SEQ ID NO: 513889 - DNA, 20 bp, mouse
gtccgtagcatagactatgg

SEQ ID NO: 513890 - DNA, 20 bp, mouse
ggactgtgtaggcctctgag

SEQ ID NO: 513891 - DNA, 20 bp, mouse
gtgggccccactggggggag

SEQ ID NO: 513892 - DNA, 20 bp, mouse
gatggaggtacagcacacct

SEQ ID NO: 513893 - DNA, 20 bp, mouse
ggtgccctgctgcacaagac

SEQ ID NO: 513894 - DNA, 20 bp, mouse
gagccctgcgcttccatggg

SEQ ID NO: 513895 - DNA, 20 bp, mouse
gttctccgtagcatagacta

SEQ ID NO: 513896 - DNA, 20 bp, mouse
gtttgcgggcaggctcatcc

SEQ ID NO: 513897 - DNA, 20 bp, mouse
gctgcccgcaaaccagatca

SEQ ID NO: 513898 - DNA, 20 bp, mouse
gacggctctcagctctcgtt

SEQ ID NO: 513899 - DNA, 20 bp, mouse
gcttgccgggctccttgatc

SEQ ID NO: 513900 - DNA, 20 bp, mouse
ggtgtgtgcgggactaatag

SEQ ID NO: 513901 - DNA, 20 bp, mouse
gccagagcagcggccacgca

SEQ ID NO: 513902 - DNA, 20 bp, mouse
gacttacgatggccgggtca

SEQ ID NO: 513903 - DNA, 20 bp, mouse
gtccggagaagagcgtggag

SEQ ID NO: 513904 - DNA, 20 bp, mouse
ggggactaatagaggatagg

SEQ ID NO: 513905 - DNA, 20 bp, mouse
gcgggctgagactgcttgcc

SEQ ID NO: 513906 - DNA, 20 bp, mouse
gcagcttgggatacactgtt

SEQ ID NO: 513907 - DNA, 20 bp, mouse
gggtggatggggctaaaaga

SEQ ID NO: 513908 - DNA, 20 bp, mouse
gctgaaacatgtctgagaag

SEQ ID NO: 513909 - DNA, 20 bp, mouse
gtgctatgtagccaagaata

SEQ ID NO: 513910 - DNA, 20 bp, mouse
gggatacactgttgggttca

SEQ ID NO: 513911 - DNA, 20 bp, mouse
gtttaacacataacattgca

SEQ ID NO: 513912 - DNA, 20 bp, mouse
gtcaacatcatccttattct

SEQ ID NO: 513913 - DNA, 20 bp, mouse
gaagatcctgatgtgagcgc

SEQ ID NO: 513914 - DNA, 20 bp, mouse
gttctgagcactcaaggagg

SEQ ID NO: 513915 - DNA, 20 bp, mouse
ggttttctgagcactcaagg

SEQ ID NO: 513916 - DNA, 20 bp, mouse
gcatcgagcgctaggcgacg

SEQ ID NO: 513917 - DNA, 20 bp, mouse
gtgcgccgggcgcccgacac

SEQ ID NO: 513918 - DNA, 20 bp, mouse
ggccgggcgcccgacaccgg

SEQ ID NO: 513919 - DNA, 20 bp, mouse
gagtaactccaggacgagac

SEQ ID NO: 513920 - DNA, 20 bp, mouse
gccccgcagccgccggtgtc

SEQ ID NO: 513921 - DNA, 20 bp, mouse
gggtcgctccggtctcgtcc

SEQ ID NO: 513922 - DNA, 20 bp, mouse
gggagccggagcagtggatc

SEQ ID NO: 513923 - DNA, 20 bp, mouse
gcgagagagaaagtaactcc

SEQ ID NO: 513924 - DNA, 20 bp, mouse
gtccgaggtaagcccagcac

SEQ ID NO: 513925 - DNA, 20 bp, mouse
gcgatgcgcgcgggtcgctc

SEQ ID NO: 513926 - DNA, 20 bp, mouse
gcgcggcgcgatggagacgg

SEQ ID NO: 513927 - DNA, 20 bp, mouse
ggagcagctaggggcattct

SEQ ID NO: 513928 - DNA, 20 bp, mouse
ggccgagacccggggagaga

SEQ ID NO: 513929 - DNA, 20 bp, mouse
gcggcggccaaaggtccctg

SEQ ID NO: 513930 - DNA, 20 bp, mouse
gtccgcgccgcagggacctt

SEQ ID NO: 513931 - DNA, 20 bp, mouse
ggcagcgggggagcagctag

SEQ ID NO: 513932 - DNA, 20 bp, mouse
ggccgcgctcgtccaggaaa

SEQ ID NO: 513933 - DNA, 20 bp, mouse
gcagccggggccgagacccg

SEQ ID NO: 513934 - DNA, 20 bp, mouse
gctggacgagcgcggcgcga

SEQ ID NO: 513935 - DNA, 20 bp, mouse
gggccactcgcgccatttcc

SEQ ID NO: 513936 - DNA, 20 bp, mouse
gctggtcccgaggataataa

SEQ ID NO: 513937 - DNA, 20 bp, mouse
gatctagccaaggactccaa

SEQ ID NO: 513938 - DNA, 20 bp, mouse
gagctctatgacttcaggga

SEQ ID NO: 513939 - DNA, 20 bp, mouse
gagggacaatggctctaagt

SEQ ID NO: 513940 - DNA, 20 bp, mouse
ggagatagtccagaatataa

SEQ ID NO: 513941 - DNA, 20 bp, mouse
gcagcagccccctggtcccg

SEQ ID NO: 513942 - DNA, 20 bp, mouse
gatgacttcagggaaggagt

SEQ ID NO: 513943 - DNA, 20 bp, mouse
gggcatcttcgaagtcactg

SEQ ID NO: 513944 - DNA, 20 bp, mouse
gtctggactatctcagggac

SEQ ID NO: 513945 - DNA, 20 bp, mouse
gactgtggcagaactcatcc

SEQ ID NO: 513946 - DNA, 20 bp, mouse
gcggccggcgatgaggatgg

SEQ ID NO: 513947 - DNA, 20 bp, mouse
gggccgcccgcccccaccgg

SEQ ID NO: 513948 - DNA, 20 bp, mouse
ggccggggaggcagcgccac

SEQ ID NO: 513949 - DNA, 20 bp, mouse
gacgcggccggcgatgagga

SEQ ID NO: 513950 - DNA, 20 bp, mouse
ggggaggcagcgccaccggt

SEQ ID NO: 513951 - DNA, 20 bp, mouse
ggacaacgcggccggcgatg

SEQ ID NO: 513952 - DNA, 20 bp, mouse
ggggaaggatgcagacaacg

SEQ ID NO: 513953 - DNA, 20 bp, mouse
gcccgcggcgtgcggaggga

SEQ ID NO: 513954 - DNA, 20 bp, mouse
gcggcctccatcctcatcgc

SEQ ID NO: 513955 - DNA, 20 bp, mouse
gaggaagcgtcccggatctg

SEQ ID NO: 513956 - DNA, 20 bp, mouse
gtccacaccggcgggcggag

SEQ ID NO: 513957 - DNA, 20 bp, mouse
gggctgcgcccagggactgg

SEQ ID NO: 513958 - DNA, 20 bp, mouse
ggcgactgcttactgacctg

SEQ ID NO: 513959 - DNA, 20 bp, mouse
ggaggaaccgggctccgggt

SEQ ID NO: 513960 - DNA, 20 bp, mouse
gcctgcggccgccagtccct

SEQ ID NO: 513961 - DNA, 20 bp, mouse
gcgctggcccaggaagactt

SEQ ID NO: 513962 - DNA, 20 bp, mouse
gcgggcccggctgcgttggg

SEQ ID NO: 513963 - DNA, 20 bp, mouse
gaatcgtggagcatccgagt

SEQ ID NO: 513964 - DNA, 20 bp, mouse
ggacaaaaccgggaaagatg

SEQ ID NO: 513965 - DNA, 20 bp, mouse
gacgcagccgggcccggacg

SEQ ID NO: 513966 - DNA, 20 bp, mouse
gaccatagtcctaaattccg

SEQ ID NO: 513967 - DNA, 20 bp, mouse
gggagggcttgtctgagaag

SEQ ID NO: 513968 - DNA, 20 bp, mouse
gtgacgcccttctcagggac

SEQ ID NO: 513969 - DNA, 20 bp, mouse
gatggagcccgtccctgaga

SEQ ID NO: 513970 - DNA, 20 bp, mouse
gggttttgacgcccttctca

SEQ ID NO: 513971 - DNA, 20 bp, mouse
gtagggaccgttagagggac

SEQ ID NO: 513972 - DNA, 20 bp, mouse
gcgcgggccttggttctcta

SEQ ID NO: 513973 - DNA, 20 bp, mouse
gtcgtgaccggtccctctaa

SEQ ID NO: 513974 - DNA, 20 bp, mouse
gcagacgacagactcgtgac

SEQ ID NO: 513975 - DNA, 20 bp, mouse
gacgagtctgtcgtctgcca

SEQ ID NO: 513976 - DNA, 20 bp, mouse
ggggcagcggcggcccaaga

SEQ ID NO: 513977 - DNA, 20 bp, mouse
ggctggacccggcagtggcg

SEQ ID NO: 513978 - DNA, 20 bp, mouse
ggcagtgcgatgggcgacgg

SEQ ID NO: 513979 - DNA, 20 bp, mouse
ggacctccggagcggacggg

SEQ ID NO: 513980 - DNA, 20 bp, mouse
ggaggagtcggccggcccgg

SEQ ID NO: 513981 - DNA, 20 bp, mouse
ggggccggccgactcctcgg

SEQ ID NO: 513982 - DNA, 20 bp, mouse
ggcagcagtgcgatgggcga

SEQ ID NO: 513983 - DNA, 20 bp, mouse
gcgggcccggacctccggag

SEQ ID NO: 513984 - DNA, 20 bp, mouse
gtgtctggtggtcacgaagt

SEQ ID NO: 513985 - DNA, 20 bp, mouse
gaatgggtcccaacacccgg

SEQ ID NO: 513986 - DNA, 20 bp, mouse
ggagtgccgagtgacagggt

SEQ ID NO: 513987 - DNA, 20 bp, mouse
gcgcggtggccggagcttgg

SEQ ID NO: 513988 - DNA, 20 bp, mouse
ggggccgggtgactcaaccg

SEQ ID NO: 513989 - DNA, 20 bp, mouse
gccaccggtagcccaggctg

SEQ ID NO: 513990 - DNA, 20 bp, mouse
ggcatgggatgacaacagag

SEQ ID NO: 513991 - DNA, 20 bp, mouse
gtgactcaaccggggatccg

SEQ ID NO: 513992 - DNA, 20 bp, mouse
gtggcttcggggctcggtgt

SEQ ID NO: 513993 - DNA, 20 bp, mouse
gcctgtcactcggcactcac

SEQ ID NO: 513994 - DNA, 20 bp, mouse
gaccaaccacgcagggccac

SEQ ID NO: 513995 - DNA, 20 bp, mouse
gcgccctggccgcggatccc

SEQ ID NO: 513996 - DNA, 20 bp, mouse
gaggggaggctgccgagcga

SEQ ID NO: 513997 - DNA, 20 bp, mouse
ggaagctgcgctggctggag

SEQ ID NO: 513998 - DNA, 20 bp, mouse
ggggagggctctggacccag

SEQ ID NO: 513999 - DNA, 20 bp, mouse
ggtagaccgaaccacctgag

SEQ ID NO: 514000 - DNA, 20 bp, mouse
gcccacctcctgccctcgct

SEQ ID NO: 514001 - DNA, 20 bp, mouse
gagccagcgcagcttcgcta

SEQ ID NO: 514002 - DNA, 20 bp, mouse
gtgcgcaggggtttcgggga

SEQ ID NO: 514003 - DNA, 20 bp, mouse
ggcggtgcgcaggggtttcg

SEQ ID NO: 514004 - DNA, 20 bp, mouse
gcggttccagagctgaggag

SEQ ID NO: 514005 - DNA, 20 bp, mouse
gtccagccccgcccctcagg

SEQ ID NO: 514006 - DNA, 20 bp, mouse
gagcccactcgcctccatgg

SEQ ID NO: 514007 - DNA, 20 bp, mouse
gggccgccatggaggcgagt

SEQ ID NO: 514008 - DNA, 20 bp, mouse
gggcggcctccagccacgag

SEQ ID NO: 514009 - DNA, 20 bp, mouse
gcagagcccactcgcctcca

SEQ ID NO: 514010 - DNA, 20 bp, mouse
gggccgccacaaccatctgg

SEQ ID NO: 514011 - DNA, 20 bp, mouse
gggcggccgccacaaccatc

SEQ ID NO: 514012 - DNA, 20 bp, mouse
ggttgtggcggccgccatgg

SEQ ID NO: 514013 - DNA, 20 bp, mouse
ggctcccgccgcagacatgg

SEQ ID NO: 514014 - DNA, 20 bp, mouse
gtctgaggagaggccgggct

SEQ ID NO: 514015 - DNA, 20 bp, mouse
ggagccggagccaggagcgg

SEQ ID NO: 514016 - DNA, 20 bp, mouse
gtagatcgggtcagaatcct

SEQ ID NO: 514017 - DNA, 20 bp, mouse
gtagctacatcacaaccagg

SEQ ID NO: 514018 - DNA, 20 bp, mouse
gctctagctacatcacaacc

SEQ ID NO: 514019 - DNA, 20 bp, mouse
gaaccaggcggctagttccg

SEQ ID NO: 514020 - DNA, 20 bp, mouse
gttatttcaaaagtctagat

SEQ ID NO: 514021 - DNA, 20 bp, mouse
ggagttggaatcatccttaa

SEQ ID NO: 514022 - DNA, 20 bp, mouse
gggagtgatttgtgaataag

SEQ ID NO: 514023 - DNA, 20 bp, mouse
gatctcagatccttaaggtt

SEQ ID NO: 514024 - DNA, 20 bp, mouse
gccctttcatttcttaatag

SEQ ID NO: 514025 - DNA, 20 bp, mouse
gctagaagttgttctggggt

SEQ ID NO: 514026 - DNA, 20 bp, mouse
ggggcttgttaggatcatgg

SEQ ID NO: 514027 - DNA, 20 bp, mouse
ggcggggcttgttaggatca

SEQ ID NO: 514028 - DNA, 20 bp, mouse
gtatgggcgggacaactcag

SEQ ID NO: 514029 - DNA, 20 bp, mouse
gcgctgtggcggggcttgtt

SEQ ID NO: 514030 - DNA, 20 bp, mouse
gttccggcgaagggccgctg

SEQ ID NO: 514031 - DNA, 20 bp, mouse
gccggctccgagcggcctcg

SEQ ID NO: 514032 - DNA, 20 bp, mouse
ggggcctcgcgggtcagcag

SEQ ID NO: 514033 - DNA, 20 bp, mouse
gcgcctggcacaagcggtac

SEQ ID NO: 514034 - DNA, 20 bp, mouse
gcatcccagcgctgcagcgg

SEQ ID NO: 514035 - DNA, 20 bp, mouse
gcagcgtctgccgggtggtg

SEQ ID NO: 514036 - DNA, 20 bp, mouse
ggagccggagcccggagttg

SEQ ID NO: 514037 - DNA, 20 bp, mouse
ggtcgggctgaggagaacgg

SEQ ID NO: 514038 - DNA, 20 bp, mouse
ggcagctggagccgcaactc

SEQ ID NO: 514039 - DNA, 20 bp, mouse
ggaagtcgggctgaggagaa

SEQ ID NO: 514040 - DNA, 20 bp, mouse
ggagccgcaactccgggctc

SEQ ID NO: 514041 - DNA, 20 bp, mouse
ggccccgcgccgccgatagg

SEQ ID NO: 514042 - DNA, 20 bp, mouse
gagaaggcgccgcccgcgcc

SEQ ID NO: 514043 - DNA, 20 bp, mouse
gggacgagtgagccggagcc

SEQ ID NO: 514044 - DNA, 20 bp, mouse
gcgccttctcagcagagtcg

SEQ ID NO: 514045 - DNA, 20 bp, mouse
gcggagcccaaagcccgagg

SEQ ID NO: 514046 - DNA, 20 bp, mouse
gtggtcgttagactgttgga

SEQ ID NO: 514047 - DNA, 20 bp, mouse
gcgaggacctgcaagcagtt

SEQ ID NO: 514048 - DNA, 20 bp, mouse
gggctccaggaagtcgtctt

SEQ ID NO: 514049 - DNA, 20 bp, mouse
gcggcgggcgctagacgccg

SEQ ID NO: 514050 - DNA, 20 bp, mouse
gagtgtaggagtggcatcag

SEQ ID NO: 514051 - DNA, 20 bp, mouse
gcgactaactgtaggcgcgt

SEQ ID NO: 514052 - DNA, 20 bp, mouse
gcggcttcgggtaggcgggt

SEQ ID NO: 514053 - DNA, 20 bp, mouse
ggcgttggtcgttagactgt

SEQ ID NO: 514054 - DNA, 20 bp, mouse
ggggaggatacacctagtgt

SEQ ID NO: 514055 - DNA, 20 bp, mouse
gtcggcttcggagctggaca

SEQ ID NO: 514056 - DNA, 20 bp, mouse
gaggcgcccaagctccatcg

SEQ ID NO: 514057 - DNA, 20 bp, mouse
gccatcggggagagactctc

SEQ ID NO: 514058 - DNA, 20 bp, mouse
gggacctccgcgagcgagca

SEQ ID NO: 514059 - DNA, 20 bp, mouse
gttgcagtcggtcaccctaa

SEQ ID NO: 514060 - DNA, 20 bp, mouse
gacttggagaggaggttcgg

SEQ ID NO: 514061 - DNA, 20 bp, mouse
gctgtgcgagagacttggag

SEQ ID NO: 514062 - DNA, 20 bp, mouse
gtgaaggacacgggcagcgg

SEQ ID NO: 514063 - DNA, 20 bp, mouse
ggagcagccgtgctcgctcg

SEQ ID NO: 514064 - DNA, 20 bp, mouse
gctctgggaagcactccgtg

SEQ ID NO: 514065 - DNA, 20 bp, mouse
gacctcggggaagggcgacg

SEQ ID NO: 514066 - DNA, 20 bp, mouse
gaagggcggagagtccgggt

SEQ ID NO: 514067 - DNA, 20 bp, mouse
ggtgcgtgcgtgaggagtgt

SEQ ID NO: 514068 - DNA, 20 bp, mouse
gagtgtggggccgaccagga

SEQ ID NO: 514069 - DNA, 20 bp, mouse
gccccggggtgtgggactga

SEQ ID NO: 514070 - DNA, 20 bp, mouse
gtgaacggcagcccgagcaa

SEQ ID NO: 514071 - DNA, 20 bp, mouse
gggaggatcggccaaccccg

SEQ ID NO: 514072 - DNA, 20 bp, mouse
ggaggagtgtggggccgacc

SEQ ID NO: 514073 - DNA, 20 bp, mouse
ggggtcacgctgttcttgaa

SEQ ID NO: 514074 - DNA, 20 bp, mouse
gtggcgaagggcggagagtc

SEQ ID NO: 514075 - DNA, 20 bp, mouse
gccgccggcagagcagcccc

SEQ ID NO: 514076 - DNA, 20 bp, mouse
gccagaccggcggagagagg

SEQ ID NO: 514077 - DNA, 20 bp, mouse
gtcccaaagtgatgctctag

SEQ ID NO: 514078 - DNA, 20 bp, mouse
gccaggttcagcagaacgtg

SEQ ID NO: 514079 - DNA, 20 bp, mouse
gtgtcattgtccggagaaag

SEQ ID NO: 514080 - DNA, 20 bp, mouse
gcgggcggtggatacctcag

SEQ ID NO: 514081 - DNA, 20 bp, mouse
ggaacctggttaagaaccgc

SEQ ID NO: 514082 - DNA, 20 bp, mouse
ggagcctgcggttcttaacc

SEQ ID NO: 514083 - DNA, 20 bp, mouse
gtgggtaggtaggaggacgg

SEQ ID NO: 514084 - DNA, 20 bp, mouse
gcggtggcatgtccaggaga

SEQ ID NO: 514085 - DNA, 20 bp, mouse
gaatgtcacaacccgagcgg

SEQ ID NO: 514086 - DNA, 20 bp, mouse
gccagctcctccctggccag

SEQ ID NO: 514087 - DNA, 20 bp, mouse
ggcccccgccgccaccagca

SEQ ID NO: 514088 - DNA, 20 bp, mouse
gtcagctccgctggccaggg

SEQ ID NO: 514089 - DNA, 20 bp, mouse
gcatgcaggccctgccgctg

SEQ ID NO: 514090 - DNA, 20 bp, mouse
ggggccgaggggacacccga

SEQ ID NO: 514091 - DNA, 20 bp, mouse
ggcagggcctgcatggtcgc

SEQ ID NO: 514092 - DNA, 20 bp, mouse
gtgagagccggcgaccatgc

SEQ ID NO: 514093 - DNA, 20 bp, mouse
gcgcccggtgacagatgtaa

SEQ ID NO: 514094 - DNA, 20 bp, mouse
gtggggagatggccacgtgt

SEQ ID NO: 514095 - DNA, 20 bp, mouse
gtcctccctgacacccacgg

SEQ ID NO: 514096 - DNA, 20 bp, mouse
gccttccagagccccttccc

SEQ ID NO: 514097 - DNA, 20 bp, mouse
gggctctggaaggtgagccg

SEQ ID NO: 514098 - DNA, 20 bp, mouse
ggggcgggagagaagccctt

SEQ ID NO: 514099 - DNA, 20 bp, mouse
gggtgagccgaggccggagc

SEQ ID NO: 514100 - DNA, 20 bp, mouse
gttaccaccagctccggcct

SEQ ID NO: 514101 - DNA, 20 bp, mouse
gaaagctggctgggagaaaa

SEQ ID NO: 514102 - DNA, 20 bp, mouse
ggaggtgggagaggtctccc

SEQ ID NO: 514103 - DNA, 20 bp, mouse
gaggagggccgaggtgggaa

SEQ ID NO: 514104 - DNA, 20 bp, mouse
gggtgctgctgggttgaggg

SEQ ID NO: 514105 - DNA, 20 bp, mouse
gcagcagcaccgcagctccg

SEQ ID NO: 514106 - DNA, 20 bp, mouse
ggacgcggcgacagcagccc

SEQ ID NO: 514107 - DNA, 20 bp, mouse
gcggagctaggcagcgactc

SEQ ID NO: 514108 - DNA, 20 bp, mouse
gtaggcagcgactcgggacg

SEQ ID NO: 514109 - DNA, 20 bp, mouse
gaggaagcggcgaaagatgg

SEQ ID NO: 514110 - DNA, 20 bp, mouse
ggagaggaagcggcgaaaga

SEQ ID NO: 514111 - DNA, 20 bp, mouse
ggcacagcggcaccggagct

SEQ ID NO: 514112 - DNA, 20 bp, mouse
gcggcgaaagatggcgggag

SEQ ID NO: 514113 - DNA, 20 bp, mouse
ggaacgaccgagagccgaat

SEQ ID NO: 514114 - DNA, 20 bp, mouse
gcggcgcggcacagcggcac

SEQ ID NO: 514115 - DNA, 20 bp, mouse
ggaccaagcgcagaactggg

SEQ ID NO: 514116 - DNA, 20 bp, mouse
gaccgcgaggagcagggacg

SEQ ID NO: 514117 - DNA, 20 bp, mouse
gtgtcgcgcagaacttccca

SEQ ID NO: 514118 - DNA, 20 bp, mouse
ggcgggaccggaccatggtg

SEQ ID NO: 514119 - DNA, 20 bp, mouse
ggcgcgccagcaaggaggcg

SEQ ID NO: 514120 - DNA, 20 bp, mouse
gtggggcaccgcgaggagca

SEQ ID NO: 514121 - DNA, 20 bp, mouse
ggcgcaacagaaagttccct

SEQ ID NO: 514122 - DNA, 20 bp, mouse
gtccccgtccctgctcctcg

SEQ ID NO: 514123 - DNA, 20 bp, mouse
gtgggcagctggcagtatca

SEQ ID NO: 514124 - DNA, 20 bp, mouse
ggcggggcgggaccggacca

SEQ ID NO: 514125 - DNA, 20 bp, mouse
ggaggcgcggcaccggcctg

SEQ ID NO: 514126 - DNA, 20 bp, mouse
gcggctgcggacccacggag

SEQ ID NO: 514127 - DNA, 20 bp, mouse
ggcacggagcgtgagaggtg

SEQ ID NO: 514128 - DNA, 20 bp, mouse
ggcttcgcacggagcgtgag

SEQ ID NO: 514129 - DNA, 20 bp, mouse
gtgagaggtgcggggcggag

SEQ ID NO: 514130 - DNA, 20 bp, mouse
gaccgaggccgggtccgggg

SEQ ID NO: 514131 - DNA, 20 bp, mouse
ggtcttgagccggggacaag

SEQ ID NO: 514132 - DNA, 20 bp, mouse
gcgaggcggctgcggaccca

SEQ ID NO: 514133 - DNA, 20 bp, mouse
ggcggcccgagatgttgtct

SEQ ID NO: 514134 - DNA, 20 bp, mouse
gcggcgggcggtgccgagaa

SEQ ID NO: 514135 - DNA, 20 bp, mouse
ggctcggctaggcccccggg

SEQ ID NO: 514136 - DNA, 20 bp, mouse
gggtcacggcgtgatagggg

SEQ ID NO: 514137 - DNA, 20 bp, mouse
gccgggtcacggcgtgatag

SEQ ID NO: 514138 - DNA, 20 bp, mouse
gtgcaccgggctgcaccgga

SEQ ID NO: 514139 - DNA, 20 bp, mouse
gggcgtgataggggcggaag

SEQ ID NO: 514140 - DNA, 20 bp, mouse
gtcacgccgtgacccggagt

SEQ ID NO: 514141 - DNA, 20 bp, mouse
ggtgataggggcggaagcgg

SEQ ID NO: 514142 - DNA, 20 bp, mouse
gcagtgcggatcaggccgtc

SEQ ID NO: 514143 - DNA, 20 bp, mouse
gtggccagcgctctgaggta

SEQ ID NO: 514144 - DNA, 20 bp, mouse
gctcctcccactccgggtca

SEQ ID NO: 514145 - DNA, 20 bp, mouse
gagcccagcgcgggaagccc

SEQ ID NO: 514146 - DNA, 20 bp, mouse
gctgggtgcaggcaaggtct

SEQ ID NO: 514147 - DNA, 20 bp, mouse
ggcaaggtctgggtgacccc

SEQ ID NO: 514148 - DNA, 20 bp, mouse
gattccaagtgggttgtagt

SEQ ID NO: 514149 - DNA, 20 bp, mouse
gcaacccacttggaatcctg

SEQ ID NO: 514150 - DNA, 20 bp, mouse
ggtgaccccaggattccaag

SEQ ID NO: 514151 - DNA, 20 bp, mouse
gctgaggcagaactgctgct

SEQ ID NO: 514152 - DNA, 20 bp, mouse
gccattagctctggatcccc

SEQ ID NO: 514153 - DNA, 20 bp, mouse
ggctcctactacaacccact

SEQ ID NO: 514154 - DNA, 20 bp, mouse
gctcacgtataagctagatg

SEQ ID NO: 514155 - DNA, 20 bp, mouse
gtacctgaccttactctctg

SEQ ID NO: 514156 - DNA, 20 bp, mouse
gtctgacgggttcaaaatgg

SEQ ID NO: 514157 - DNA, 20 bp, mouse
ggaatctgacgggttcaaaa

SEQ ID NO: 514158 - DNA, 20 bp, mouse
gagcggatcctcctgtgtga

SEQ ID NO: 514159 - DNA, 20 bp, mouse
gatggcggcggctgcttcag

SEQ ID NO: 514160 - DNA, 20 bp, mouse
gagcagaggagggactccgg

SEQ ID NO: 514161 - DNA, 20 bp, mouse
ggacgggttcaaaatggcgg

SEQ ID NO: 514162 - DNA, 20 bp, mouse
ggggaaacaacacccctccc

SEQ ID NO: 514163 - DNA, 20 bp, mouse
gtgtgtatgtgagaatctga

SEQ ID NO: 514164 - DNA, 20 bp, mouse
gcaacacccctccccggcag

SEQ ID NO: 514165 - DNA, 20 bp, mouse
ggccggctgagggtaccgag

SEQ ID NO: 514166 - DNA, 20 bp, mouse
ggtcgacggagcccagccag

SEQ ID NO: 514167 - DNA, 20 bp, mouse
gagcgggctccggacgtcga

SEQ ID NO: 514168 - DNA, 20 bp, mouse
gaactgccctgagcgcagtt

SEQ ID NO: 514169 - DNA, 20 bp, mouse
gatccacgacggctcagggg

SEQ ID NO: 514170 - DNA, 20 bp, mouse
gcgggccgcccctaacccca

SEQ ID NO: 514171 - DNA, 20 bp, mouse
gagccgcccgacgggcaagc

SEQ ID NO: 514172 - DNA, 20 bp, mouse
gggctcgacagccgcccgac

SEQ ID NO: 514173 - DNA, 20 bp, mouse
gagcagcccaactgcgctca

SEQ ID NO: 514174 - DNA, 20 bp, mouse
gcgagtcggggcacccccca

SEQ ID NO: 514175 - DNA, 20 bp, mouse
gcgcgcgagggtcagcgatg

SEQ ID NO: 514176 - DNA, 20 bp, mouse
gaagggagcctgggacgcac

SEQ ID NO: 514177 - DNA, 20 bp, mouse
gaccgcagccgtaggaggtg

SEQ ID NO: 514178 - DNA, 20 bp, mouse
gcggggaccgcagccgtagg

SEQ ID NO: 514179 - DNA, 20 bp, mouse
gtaggaggtgtggggccaga

SEQ ID NO: 514180 - DNA, 20 bp, mouse
gggtctcagacacttaagtg

SEQ ID NO: 514181 - DNA, 20 bp, mouse
gtgtcggggaccgcagccgt

SEQ ID NO: 514182 - DNA, 20 bp, mouse
gccctccgccaaaatgcagg

SEQ ID NO: 514183 - DNA, 20 bp, mouse
gacagcgcccggtgcgtccc

SEQ ID NO: 514184 - DNA, 20 bp, mouse
gggttcgcctgggatctggg

SEQ ID NO: 514185 - DNA, 20 bp, mouse
ggcgtcgacgtcataatccc

SEQ ID NO: 514186 - DNA, 20 bp, mouse
gggtctcagacacttaagtg

SEQ ID NO: 514187 - DNA, 20 bp, mouse
ggctagtgcaagaagaggag

SEQ ID NO: 514188 - DNA, 20 bp, mouse
ggcgcgctcgtggggagatg

SEQ ID NO: 514189 - DNA, 20 bp, mouse
ggagcctcacaagagactgg

SEQ ID NO: 514190 - DNA, 20 bp, mouse
gagggccggcggcattacta

SEQ ID NO: 514191 - DNA, 20 bp, mouse
gggcgtggaagggactgagc

SEQ ID NO: 514192 - DNA, 20 bp, mouse
ggggaggaggcaacgccgaa

SEQ ID NO: 514193 - DNA, 20 bp, mouse
gggttcgcctgggatctggg

SEQ ID NO: 514194 - DNA, 20 bp, mouse
gagacacttaagtggggagg

SEQ ID NO: 514195 - DNA, 20 bp, mouse
gaccaggctcccagtcgagt

SEQ ID NO: 514196 - DNA, 20 bp, mouse
gagagctagagtcggctggg

SEQ ID NO: 514197 - DNA, 20 bp, mouse
gcctgagtcacccacgacgg

SEQ ID NO: 514198 - DNA, 20 bp, mouse
gctccctgagtcacccacga

SEQ ID NO: 514199 - DNA, 20 bp, mouse
gcgagtcgcgagcgagtcca

SEQ ID NO: 514200 - DNA, 20 bp, mouse
ggtcgcgagcgagtccacgg

SEQ ID NO: 514201 - DNA, 20 bp, mouse
ggctctgttgccgccgtcgt

SEQ ID NO: 514202 - DNA, 20 bp, mouse
gtcggcggcccggaagcggg

SEQ ID NO: 514203 - DNA, 20 bp, mouse
ggccgactctagctctgact

SEQ ID NO: 514204 - DNA, 20 bp, mouse
gcgggccctaggcactaaga

SEQ ID NO: 514205 - DNA, 20 bp, mouse
gtcggttcaaggctcaggac

SEQ ID NO: 514206 - DNA, 20 bp, mouse
ggaggccttgcgggtggatc

SEQ ID NO: 514207 - DNA, 20 bp, mouse
gggtagtgagcggagatcct

SEQ ID NO: 514208 - DNA, 20 bp, mouse
gtggatcgggcgcttggcgg

SEQ ID NO: 514209 - DNA, 20 bp, mouse
ggccgcgtccgccatcgcca

SEQ ID NO: 514210 - DNA, 20 bp, mouse
gtcggcctcggcccccacgg

SEQ ID NO: 514211 - DNA, 20 bp, mouse
ggggagcggaggctcaacca

SEQ ID NO: 514212 - DNA, 20 bp, mouse
ggggcgcttggcggcggagg

SEQ ID NO: 514213 - DNA, 20 bp, mouse
gcgtccggccctggcgatgg

SEQ ID NO: 514214 - DNA, 20 bp, mouse
gctgcgcactcgggcctgga

SEQ ID NO: 514215 - DNA, 20 bp, mouse
gacgcggcggcctccccggt

SEQ ID NO: 514216 - DNA, 20 bp, mouse
gcagagtcagactttaaagg

SEQ ID NO: 514217 - DNA, 20 bp, mouse
gtcgggcctgagccctgcta

SEQ ID NO: 514218 - DNA, 20 bp, mouse
gccccgcggcatccctccaa

SEQ ID NO: 514219 - DNA, 20 bp, mouse
gcgccctcaagaaagacagt

SEQ ID NO: 514220 - DNA, 20 bp, mouse
gagacagtgggatcggcgag

SEQ ID NO: 514221 - DNA, 20 bp, mouse
gtcaagaaagacagtgggat

SEQ ID NO: 514222 - DNA, 20 bp, mouse
gtggccgtgagctccagtgg

SEQ ID NO: 514223 - DNA, 20 bp, mouse
ggcgcagagtcagactttaa

SEQ ID NO: 514224 - DNA, 20 bp, mouse
gcccggtaagcactccataa

SEQ ID NO: 514225 - DNA, 20 bp, mouse
gagtggcgacaacagcaatc

SEQ ID NO: 514226 - DNA, 20 bp, mouse
gcgagcgagcgaaccatcga

SEQ ID NO: 514227 - DNA, 20 bp, mouse
gggcgaagctcggagcccag

SEQ ID NO: 514228 - DNA, 20 bp, mouse
gctcgctcgccccggccact

SEQ ID NO: 514229 - DNA, 20 bp, mouse
gcgcgcggcggcccaaggtg

SEQ ID NO: 514230 - DNA, 20 bp, mouse
ggtgagtgtgcgatccgtgg

SEQ ID NO: 514231 - DNA, 20 bp, mouse
ggccgcgcggccccccaaag

SEQ ID NO: 514232 - DNA, 20 bp, mouse
gccgccctgaggagccgagt

SEQ ID NO: 514233 - DNA, 20 bp, mouse
gccgcagacagcaggctgag

SEQ ID NO: 514234 - DNA, 20 bp, mouse
gcctcagcaagagcccgggg

SEQ ID NO: 514235 - DNA, 20 bp, mouse
gagctcggagcccagtggcc

SEQ ID NO: 514236 - DNA, 20 bp, mouse
ggaacagctgtcacccagtg

SEQ ID NO: 514237 - DNA, 20 bp, mouse
gaaagtgcggcctcccctga

SEQ ID NO: 514238 - DNA, 20 bp, mouse
gttcccaaaaccctcagggg

SEQ ID NO: 514239 - DNA, 20 bp, mouse
gagattcccaaaaccctcag

SEQ ID NO: 514240 - DNA, 20 bp, mouse
ggcgcggcggagggattccg

SEQ ID NO: 514241 - DNA, 20 bp, mouse
gcggcggagggattccgtgg

SEQ ID NO: 514242 - DNA, 20 bp, mouse
gagacgccacccgaatgaaa

SEQ ID NO: 514243 - DNA, 20 bp, mouse
ggggccagaatggactgtca

SEQ ID NO: 514244 - DNA, 20 bp, mouse
gggaagacttgttccgcact

SEQ ID NO: 514245 - DNA, 20 bp, mouse
gtcggcgccccagaccacac

SEQ ID NO: 514246 - DNA, 20 bp, mouse
gcagcgaacgagtctgggag

SEQ ID NO: 514247 - DNA, 20 bp, mouse
gcagtagaccccgcagccta

SEQ ID NO: 514248 - DNA, 20 bp, mouse
gttaagtaattggttcgcaa

SEQ ID NO: 514249 - DNA, 20 bp, mouse
gtgccaactgaccgacccaa

SEQ ID NO: 514250 - DNA, 20 bp, mouse
gcggagccaaggcagcttag

SEQ ID NO: 514251 - DNA, 20 bp, mouse
ggcaagagagattaagtaat

SEQ ID NO: 514252 - DNA, 20 bp, mouse
ggccaaggcagcttaggggg

SEQ ID NO: 514253 - DNA, 20 bp, mouse
gaaccgcagcgaacgagtct

SEQ ID NO: 514254 - DNA, 20 bp, mouse
gaggaaaaaagatgatattt

SEQ ID NO: 514255 - DNA, 20 bp, mouse
gaaggcgcaaataagtacgg

SEQ ID NO: 514256 - DNA, 20 bp, mouse
gggcgccgcgacctctctcg

SEQ ID NO: 514257 - DNA, 20 bp, mouse
gcgcgacctctctcgaggag

SEQ ID NO: 514258 - DNA, 20 bp, mouse
gctctctcgaggagaggcga

SEQ ID NO: 514259 - DNA, 20 bp, mouse
gccgggtgcgcggcccctca

SEQ ID NO: 514260 - DNA, 20 bp, mouse
ggaggtcgcggcgccttgag

SEQ ID NO: 514261 - DNA, 20 bp, mouse
gaagacccgactagacgtgg

SEQ ID NO: 514262 - DNA, 20 bp, mouse
ggacgagaacgagtcctcac

SEQ ID NO: 514263 - DNA, 20 bp, mouse
gggagcgtcctgcccctgag

SEQ ID NO: 514264 - DNA, 20 bp, mouse
ggcgcgcgttccaccttgcg

SEQ ID NO: 514265 - DNA, 20 bp, mouse
gcaaacgagcggagggagag

SEQ ID NO: 514266 - DNA, 20 bp, mouse
gagggcaggctccgcaaccg

SEQ ID NO: 514267 - DNA, 20 bp, mouse
gcgtctgcacgggtttcgga

SEQ ID NO: 514268 - DNA, 20 bp, mouse
gccgtgcagacgcacagctc

SEQ ID NO: 514269 - DNA, 20 bp, mouse
gctagcaacggcaacaccta

SEQ ID NO: 514270 - DNA, 20 bp, mouse
gatcaccgcgacctgggcag

SEQ ID NO: 514271 - DNA, 20 bp, mouse
ggcacgggtttcggacggag

SEQ ID NO: 514272 - DNA, 20 bp, mouse
gcagccgcgagcaggatccg

SEQ ID NO: 514273 - DNA, 20 bp, mouse
gtcgaagaccggacactcgg

SEQ ID NO: 514274 - DNA, 20 bp, mouse
gagcggcaagacgtcgtcgg

SEQ ID NO: 514275 - DNA, 20 bp, mouse
ggcccatagccgagcagact

SEQ ID NO: 514276 - DNA, 20 bp, mouse
gtacagttaagtcccagtcg

SEQ ID NO: 514277 - DNA, 20 bp, mouse
gcgctgacaaaccaagatgg

SEQ ID NO: 514278 - DNA, 20 bp, mouse
gtgacaaaccaagatggcgg

SEQ ID NO: 514279 - DNA, 20 bp, mouse
gggtgaaacctgccgcgact

SEQ ID NO: 514280 - DNA, 20 bp, mouse
ggctgggccagagatcggga

SEQ ID NO: 514281 - DNA, 20 bp, mouse
ggacttaactgtagtagtga

SEQ ID NO: 514282 - DNA, 20 bp, mouse
gagacgctgacaaaccaaga

SEQ ID NO: 514283 - DNA, 20 bp, mouse
ggagggctgggccagagatc

SEQ ID NO: 514284 - DNA, 20 bp, mouse
gttgttgtggtgaggtacag

SEQ ID NO: 514285 - DNA, 20 bp, mouse
ggtacctcggtttcagacag

SEQ ID NO: 514286 - DNA, 20 bp, mouse
gatggtggaaccgaacgagg

SEQ ID NO: 514287 - DNA, 20 bp, mouse
gaaaatggtggaaccgaacg

SEQ ID NO: 514288 - DNA, 20 bp, mouse
gtgggtgccacgcagtgagt

SEQ ID NO: 514289 - DNA, 20 bp, mouse
gacacagggcactcaggcgg

SEQ ID NO: 514290 - DNA, 20 bp, mouse
gcattgtgatctaaaaatgg

SEQ ID NO: 514291 - DNA, 20 bp, mouse
ggctcaaacacagggcactc

SEQ ID NO: 514292 - DNA, 20 bp, mouse
gccaactgggctcaaacaca

SEQ ID NO: 514293 - DNA, 20 bp, mouse
gtcacattgtgatctaaaaa

SEQ ID NO: 514294 - DNA, 20 bp, mouse
gtatatagccaagaggatcg

SEQ ID NO: 514295 - DNA, 20 bp, mouse
gcgcggaattccgcccaact

SEQ ID NO: 514296 - DNA, 20 bp, mouse
gagctctgggggggattcgt

SEQ ID NO: 514297 - DNA, 20 bp, mouse
gcctctcgcggcagaggagg

SEQ ID NO: 514298 - DNA, 20 bp, mouse
gtaggagacacaaacttccc

SEQ ID NO: 514299 - DNA, 20 bp, mouse
gcctaacgcggtagaggtga

SEQ ID NO: 514300 - DNA, 20 bp, mouse
gcatcgcggggatgggaagg

SEQ ID NO: 514301 - DNA, 20 bp, mouse
gggaaccactgggtccggag

SEQ ID NO: 514302 - DNA, 20 bp, mouse
ggtcgccgctccggacccag

SEQ ID NO: 514303 - DNA, 20 bp, mouse
gcagccacaggcagggtcgg

SEQ ID NO: 514304 - DNA, 20 bp, mouse
gcaggcagggtcggcgggaa

SEQ ID NO: 514305 - DNA, 20 bp, mouse
gctgacagcggaggagaggg

SEQ ID NO: 514306 - DNA, 20 bp, mouse
ggagcagagttcagaggtcg

SEQ ID NO: 514307 - DNA, 20 bp, mouse
gctgaactctgctctctcta

SEQ ID NO: 514308 - DNA, 20 bp, mouse
gctctaaggtcacttccggg

SEQ ID NO: 514309 - DNA, 20 bp, mouse
gtgcctgccacccgtccccc

SEQ ID NO: 514310 - DNA, 20 bp, mouse
gtcacttccggggggacggg

SEQ ID NO: 514311 - DNA, 20 bp, mouse
gagagttcagaggtcgcgga

SEQ ID NO: 514312 - DNA, 20 bp, mouse
ggcaagaggcgaggacatgg

SEQ ID NO: 514313 - DNA, 20 bp, mouse
gaggctgcaagtggagaaag

SEQ ID NO: 514314 - DNA, 20 bp, mouse
ggatgctgctggtgaaacgc

SEQ ID NO: 514315 - DNA, 20 bp, mouse
gggggtgtggagccaagccc

SEQ ID NO: 514316 - DNA, 20 bp, mouse
gcgtccgggcgaagattctt

SEQ ID NO: 514317 - DNA, 20 bp, mouse
ggcgacgactggttccgtcc

SEQ ID NO: 514318 - DNA, 20 bp, mouse
ggcagctcccaggcctccca

SEQ ID NO: 514319 - DNA, 20 bp, mouse
gtcgatgctctcggtgtagt

SEQ ID NO: 514320 - DNA, 20 bp, mouse
gctgactcggctgatcgcga

SEQ ID NO: 514321 - DNA, 20 bp, mouse
gcagaagtgatcgatgctct

SEQ ID NO: 514322 - DNA, 20 bp, mouse
ggagctccaactaacctctc

SEQ ID NO: 514323 - DNA, 20 bp, mouse
ggattgctccgcgttcctct

SEQ ID NO: 514324 - DNA, 20 bp, mouse
ggatcgcgacgggtgcctag

SEQ ID NO: 514325 - DNA, 20 bp, mouse
gaccgaagcctaaaagggaa

SEQ ID NO: 514326 - DNA, 20 bp, mouse
gcggctgcgggacacagtct

SEQ ID NO: 514327 - DNA, 20 bp, mouse
gtagcggtccgcgcgatcta

SEQ ID NO: 514328 - DNA, 20 bp, mouse
ggatcgcgcggaccgctacc

SEQ ID NO: 514329 - DNA, 20 bp, mouse
gcccagcgcgaggtgcagga

SEQ ID NO: 514330 - DNA, 20 bp, mouse
gggcacagagcccagttctc

SEQ ID NO: 514331 - DNA, 20 bp, mouse
ggattccctgccccacacta

SEQ ID NO: 514332 - DNA, 20 bp, mouse
gggcttcttacccacagagg

SEQ ID NO: 514333 - DNA, 20 bp, mouse
gcgggtcagccaggttatcc

SEQ ID NO: 514334 - DNA, 20 bp, mouse
gtagggtgcgggcggagagt

SEQ ID NO: 514335 - DNA, 20 bp, mouse
gcccccgcagcgcaagaccg

SEQ ID NO: 514336 - DNA, 20 bp, mouse
ggagcggcgacaccatgtag

SEQ ID NO: 514337 - DNA, 20 bp, mouse
gaaggccacgaggccggcag

SEQ ID NO: 514338 - DNA, 20 bp, mouse
ggagcagcacgaaggccacg

SEQ ID NO: 514339 - DNA, 20 bp, mouse
gtctctgccgagcgactact

SEQ ID NO: 514340 - DNA, 20 bp, mouse
gccacggtcccggaaaggaa

SEQ ID NO: 514341 - DNA, 20 bp, mouse
gatgtagaggagcagcacga

SEQ ID NO: 514342 - DNA, 20 bp, mouse
gaagccggccaagcagtcct

SEQ ID NO: 514343 - DNA, 20 bp, mouse
gcgagaccacggtcccggaa

SEQ ID NO: 514344 - DNA, 20 bp, mouse
gtgatctcccagtagtcgct

SEQ ID NO: 514345 - DNA, 20 bp, mouse
gtgtagcccggcgccttgga

SEQ ID NO: 514346 - DNA, 20 bp, mouse
gggtcccgggcggcacgcgt

SEQ ID NO: 514347 - DNA, 20 bp, mouse
gacgggcggcgggtacgcag

SEQ ID NO: 514348 - DNA, 20 bp, mouse
ggcgggagggcggaaacggg

SEQ ID NO: 514349 - DNA, 20 bp, mouse
gggtgctgcggggtcccggg

SEQ ID NO: 514350 - DNA, 20 bp, mouse
gcggcacgcgtgggaggagc

SEQ ID NO: 514351 - DNA, 20 bp, mouse
gccgcggcgagtagaggtag

SEQ ID NO: 514352 - DNA, 20 bp, mouse
gaggagggggaccggagtgg

SEQ ID NO: 514353 - DNA, 20 bp, mouse
gcctacagagacacccgggg

SEQ ID NO: 514354 - DNA, 20 bp, mouse
gcccgggcggcacgcgtggg

SEQ ID NO: 514355 - DNA, 20 bp, mouse
ggggtggagggctcggatcg

SEQ ID NO: 514356 - DNA, 20 bp, mouse
ggatacggagttataggtaa

SEQ ID NO: 514357 - DNA, 20 bp, mouse
gtgtgtggatacggagttat

SEQ ID NO: 514358 - DNA, 20 bp, mouse
gtctgaggaagctctctgtg

SEQ ID NO: 514359 - DNA, 20 bp, mouse
ggggaatcagcgttcttctg

SEQ ID NO: 514360 - DNA, 20 bp, mouse
gctgcttgttctttgttctg

SEQ ID NO: 514361 - DNA, 20 bp, mouse
gttccatggtgcacattagt

SEQ ID NO: 514362 - DNA, 20 bp, mouse
gtctttccctcatactaggt

SEQ ID NO: 514363 - DNA, 20 bp, mouse
gtacctactaatgtgcacca

SEQ ID NO: 514364 - DNA, 20 bp, mouse
ggagtatagggcagctttag

SEQ ID NO: 514365 - DNA, 20 bp, mouse
ggggtgactatacaatgcac

SEQ ID NO: 514366 - DNA, 20 bp, mouse
gccagggccactgggactag

SEQ ID NO: 514367 - DNA, 20 bp, mouse
gtcccagtggccctggagaa

SEQ ID NO: 514368 - DNA, 20 bp, mouse
gactgggactaggggcaaaa

SEQ ID NO: 514369 - DNA, 20 bp, mouse
gaagagttgccccttctcca

SEQ ID NO: 514370 - DNA, 20 bp, mouse
ggggactaggggcaaaaggg

SEQ ID NO: 514371 - DNA, 20 bp, mouse
ggccaccctaacccccaact

SEQ ID NO: 514372 - DNA, 20 bp, mouse
gtcctctctagcacttgttg

SEQ ID NO: 514373 - DNA, 20 bp, mouse
gtcctgaagtgactagagga

SEQ ID NO: 514374 - DNA, 20 bp, mouse
gtggagacagagcctagttg

SEQ ID NO: 514375 - DNA, 20 bp, mouse
gaggccaacagtacacattt

SEQ ID NO: 514376 - DNA, 20 bp, mouse
gaaatgaaaagtaggatgac

SEQ ID NO: 514377 - DNA, 20 bp, mouse
gatcctgaagcctgtcagag

SEQ ID NO: 514378 - DNA, 20 bp, mouse
ggtattgtttccactctgac

SEQ ID NO: 514379 - DNA, 20 bp, mouse
gtgcagaatgctcctctgga

SEQ ID NO: 514380 - DNA, 20 bp, mouse
gagcagacctggactttaat

SEQ ID NO: 514381 - DNA, 20 bp, mouse
gagctaaaataagttgatgg

SEQ ID NO: 514382 - DNA, 20 bp, mouse
gagacctggactttaatggg

SEQ ID NO: 514383 - DNA, 20 bp, mouse
gaatataccgttgagtcctg

SEQ ID NO: 514384 - DNA, 20 bp, mouse
gggagcattctgcagccaga

SEQ ID NO: 514385 - DNA, 20 bp, mouse
gctttaatgggaggaattaa

SEQ ID NO: 514386 - DNA, 20 bp, mouse
gggagtagagaagtcgctgg

SEQ ID NO: 514387 - DNA, 20 bp, mouse
gcagcctggtctatttaatg

SEQ ID NO: 514388 - DNA, 20 bp, mouse
gtggggaggaatgaaagagc

SEQ ID NO: 514389 - DNA, 20 bp, mouse
gcatggagtagagaagtcgc

SEQ ID NO: 514390 - DNA, 20 bp, mouse
gactcattcctgtcttctga

SEQ ID NO: 514391 - DNA, 20 bp, mouse
gaagtcgctggaggctgggg

SEQ ID NO: 514392 - DNA, 20 bp, mouse
gtttcgaagggagaacttag

SEQ ID NO: 514393 - DNA, 20 bp, mouse
ggaacctcattaaatagacc

SEQ ID NO: 514394 - DNA, 20 bp, mouse
gtaatcacagggagtttcga

SEQ ID NO: 514395 - DNA, 20 bp, mouse
gagagaagtcgctggaggct

SEQ ID NO: 514396 - DNA, 20 bp, mouse
gggagtagaaaagtccctgg

SEQ ID NO: 514397 - DNA, 20 bp, mouse
gcattcctcaccagcctcca

SEQ ID NO: 514398 - DNA, 20 bp, mouse
gcatggagtagaaaagtccc

SEQ ID NO: 514399 - DNA, 20 bp, mouse
gtttcgaagagagaagctag

SEQ ID NO: 514400 - DNA, 20 bp, mouse
ggtaggcgtctacaggagac

SEQ ID NO: 514401 - DNA, 20 bp, mouse
gaaggcaagtaggcgtctac

SEQ ID NO: 514402 - DNA, 20 bp, mouse
gatgttgagtcttcacttga

SEQ ID NO: 514403 - DNA, 20 bp, mouse
gggttttccctccttgaaac

SEQ ID NO: 514404 - DNA, 20 bp, mouse
gaagtccctggaggctggtg

SEQ ID NO: 514405 - DNA, 20 bp, mouse
gtggtgaggaatgaatgagc

SEQ ID NO: 514406 - DNA, 20 bp, mouse
gggtctacttaatgaggtct

SEQ ID NO: 514407 - DNA, 20 bp, mouse
gcatggagtagagaagtcgt

SEQ ID NO: 514408 - DNA, 20 bp, mouse
gggagtagagaagtcgttgg

SEQ ID NO: 514409 - DNA, 20 bp, mouse
ggtaggatccttcagaacac

SEQ ID NO: 514410 - DNA, 20 bp, mouse
gtttcgaagggagaacttag

SEQ ID NO: 514411 - DNA, 20 bp, mouse
gaagtcgttggaggctgggg

SEQ ID NO: 514412 - DNA, 20 bp, mouse
ggagaagtcgttggaggctg

SEQ ID NO: 514413 - DNA, 20 bp, mouse
gaatgaggtctgggcagcca

SEQ ID NO: 514414 - DNA, 20 bp, mouse
gtaatcacagggagtttcga

SEQ ID NO: 514415 - DNA, 20 bp, mouse
gactcattcctgtgttctga

SEQ ID NO: 514416 - DNA, 20 bp, mouse
gcggtgaaacgggtacacta

SEQ ID NO: 514417 - DNA, 20 bp, mouse
gagtttgcataggcttcctg

SEQ ID NO: 514418 - DNA, 20 bp, mouse
gaggcttcctgcggtgaaac

SEQ ID NO: 514419 - DNA, 20 bp, mouse
ggtctgaaacctcttcagag

SEQ ID NO: 514420 - DNA, 20 bp, mouse
gtaccttgtttgtgatccag

SEQ ID NO: 514421 - DNA, 20 bp, mouse
gtgcccctggatcacaaaca

SEQ ID NO: 514422 - DNA, 20 bp, mouse
gaagactgtacgtggaacct

SEQ ID NO: 514423 - DNA, 20 bp, mouse
ggaacgtgtggggccctgaa

SEQ ID NO: 514424 - DNA, 20 bp, mouse
gctgcagtcaaggtgtatac

SEQ ID NO: 514425 - DNA, 20 bp, mouse
gggctactggaaatcatgtt

SEQ ID NO: 514426 - DNA, 20 bp, mouse
ggagcgaggaagcgacgcgg

SEQ ID NO: 514427 - DNA, 20 bp, mouse
gcccgagcggcggttggcgg

SEQ ID NO: 514428 - DNA, 20 bp, mouse
gaacgagcgaggaagcgacg

SEQ ID NO: 514429 - DNA, 20 bp, mouse
gctcgctgggtcgctcgggt

SEQ ID NO: 514430 - DNA, 20 bp, mouse
gttggcgggggtggaagaac

SEQ ID NO: 514431 - DNA, 20 bp, mouse
gctgaggcccgagcggcggt

SEQ ID NO: 514432 - DNA, 20 bp, mouse
gcggggtcagacgcaccgag

SEQ ID NO: 514433 - DNA, 20 bp, mouse
ggtcagacgcaccgaggggt

SEQ ID NO: 514434 - DNA, 20 bp, mouse
gctctctcgctgggtcgctc

SEQ ID NO: 514435 - DNA, 20 bp, mouse
gaccgtcgcgtcgggaccag

SEQ ID NO: 514436 - DNA, 20 bp, mouse
gggagaggcaggtaccagcg

SEQ ID NO: 514437 - DNA, 20 bp, mouse
gagcgcagctctagcgcctg

SEQ ID NO: 514438 - DNA, 20 bp, mouse
gctagagctgcgctctacgg

SEQ ID NO: 514439 - DNA, 20 bp, mouse
ggcgctagagctgcgctcta

SEQ ID NO: 514440 - DNA, 20 bp, mouse
ggtggaagaacggttcccgg

SEQ ID NO: 514441 - DNA, 20 bp, mouse
ggcgctctacggtggaagaa

SEQ ID NO: 514442 - DNA, 20 bp, mouse
ggccgtggcctcagctggag

SEQ ID NO: 514443 - DNA, 20 bp, mouse
gcttggtccctggctccccc

SEQ ID NO: 514444 - DNA, 20 bp, mouse
ggccccggcaaggcgaagtt

SEQ ID NO: 514445 - DNA, 20 bp, mouse
gggggctgcgcagaccgcgc

SEQ ID NO: 514446 - DNA, 20 bp, mouse
ggcgggatgagcgaagagag

SEQ ID NO: 514447 - DNA, 20 bp, mouse
gcgcagccggcgagcaagac

SEQ ID NO: 514448 - DNA, 20 bp, mouse
gatgagcgaagagagcgggc

SEQ ID NO: 514449 - DNA, 20 bp, mouse
gctggaaagccgaggagcgc

SEQ ID NO: 514450 - DNA, 20 bp, mouse
gaagactggccagcgctcct

SEQ ID NO: 514451 - DNA, 20 bp, mouse
gaccccgccaggcgcctcgg

SEQ ID NO: 514452 - DNA, 20 bp, mouse
gtacctgccggagctgatgg

SEQ ID NO: 514453 - DNA, 20 bp, mouse
gcagggcgtgcgtgaaggag

SEQ ID NO: 514454 - DNA, 20 bp, mouse
gtggcgcgcggggcgggtcg

SEQ ID NO: 514455 - DNA, 20 bp, mouse
gagcaaggcatcgtcgcagc

SEQ ID NO: 514456 - DNA, 20 bp, mouse
gtcctacccgcaagcagagg

SEQ ID NO: 514457 - DNA, 20 bp, mouse
gcggtcctccagtagataag

SEQ ID NO: 514458 - DNA, 20 bp, mouse
ggtgctggacatcatcaatg

SEQ ID NO: 514459 - DNA, 20 bp, mouse
ggcttgcgggtaggaagctt

SEQ ID NO: 514460 - DNA, 20 bp, mouse
gcaccaccagccccacgcac

SEQ ID NO: 514461 - DNA, 20 bp, mouse
gaccccctctgcttgcgggt

SEQ ID NO: 514462 - DNA, 20 bp, mouse
gctaatcggctgctaaacca

SEQ ID NO: 514463 - DNA, 20 bp, mouse
gggagacagagggctatccc

SEQ ID NO: 514464 - DNA, 20 bp, mouse
ggcttcctacccgcaagcag

SEQ ID NO: 514465 - DNA, 20 bp, mouse
ggaagcagatcctgtgcgtg

SEQ ID NO: 514466 - DNA, 20 bp, mouse
ggggctgggagcccgaatct

SEQ ID NO: 514467 - DNA, 20 bp, mouse
gtgggagcccgaatctggga

SEQ ID NO: 514468 - DNA, 20 bp, mouse
gagaaggccctcccagattc

SEQ ID NO: 514469 - DNA, 20 bp, mouse
gttgggtgaaggatccgaga

SEQ ID NO: 514470 - DNA, 20 bp, mouse
gagaagtctaggttgggtga

SEQ ID NO: 514471 - DNA, 20 bp, mouse
gttgttgacgagagaagtct

SEQ ID NO: 514472 - DNA, 20 bp, mouse
gcatcccacccggggcccag

SEQ ID NO: 514473 - DNA, 20 bp, mouse
gcgtttctcccgcgccccag

SEQ ID NO: 514474 - DNA, 20 bp, mouse
gccgcgggcacctagaggag

SEQ ID NO: 514475 - DNA, 20 bp, mouse
gatgcccctgggccccgggt

SEQ ID NO: 514476 - DNA, 20 bp, mouse
gcttcaagctgaggaggcgg

SEQ ID NO: 514477 - DNA, 20 bp, mouse
gggcggcggcggctcaacgc

SEQ ID NO: 514478 - DNA, 20 bp, mouse
gcacggccgcggagcacgat

SEQ ID NO: 514479 - DNA, 20 bp, mouse
gggtcgcgggagggtcacgt

SEQ ID NO: 514480 - DNA, 20 bp, mouse
ggcggctcaacgcgggaaca

SEQ ID NO: 514481 - DNA, 20 bp, mouse
gccgccgggcgcgggagacc

SEQ ID NO: 514482 - DNA, 20 bp, mouse
ggccaccgggaggctgtgag

SEQ ID NO: 514483 - DNA, 20 bp, mouse
gggcggggacgggcttggtg

SEQ ID NO: 514484 - DNA, 20 bp, mouse
gaggaacagccagtagtata

SEQ ID NO: 514485 - DNA, 20 bp, mouse
ggcctcgctccacacggccg

SEQ ID NO: 514486 - DNA, 20 bp, mouse
gtggccgccgggcgtggtgc

SEQ ID NO: 514487 - DNA, 20 bp, mouse
gagggagacgagtctgtcgg

SEQ ID NO: 514488 - DNA, 20 bp, mouse
ggctatgcccgcaccacgcc

SEQ ID NO: 514489 - DNA, 20 bp, mouse
gctgtcagttcctgactcct

SEQ ID NO: 514490 - DNA, 20 bp, mouse
gtcctaggaagatggccgcc

SEQ ID NO: 514491 - DNA, 20 bp, mouse
gggcagagcgacagtgtccg

SEQ ID NO: 514492 - DNA, 20 bp, mouse
gggcgtcttgtcctctgaca

SEQ ID NO: 514493 - DNA, 20 bp, mouse
ggaaggcaggcgctccggtg

SEQ ID NO: 514494 - DNA, 20 bp, mouse
ggaggcggagaggtcgggtg

SEQ ID NO: 514495 - DNA, 20 bp, mouse
ggtcggtggcaccggagagg

SEQ ID NO: 514496 - DNA, 20 bp, mouse
gcgccccgcaaaagccggac

SEQ ID NO: 514497 - DNA, 20 bp, mouse
gcagctccggaaacccgatg

SEQ ID NO: 514498 - DNA, 20 bp, mouse
gggaggaggttcgtcctgtc

SEQ ID NO: 514499 - DNA, 20 bp, mouse
ggccgccgccccgcaaaagc

SEQ ID NO: 514500 - DNA, 20 bp, mouse
gggcagcaccgggtgaggag

SEQ ID NO: 514501 - DNA, 20 bp, mouse
ggcggcacgcgaggcatcat

SEQ ID NO: 514502 - DNA, 20 bp, mouse
ggcgtccccgaggtccacgc

SEQ ID NO: 514503 - DNA, 20 bp, mouse
ggctgatttcggagcagagg

SEQ ID NO: 514504 - DNA, 20 bp, mouse
ggttgctgatttcggagcag

SEQ ID NO: 514505 - DNA, 20 bp, mouse
ggtcctgtccggcttttgcg

SEQ ID NO: 514506 - DNA, 20 bp, mouse
gtcatgctgtggtgagggta

SEQ ID NO: 514507 - DNA, 20 bp, mouse
gagggtaaggcatattagaa

SEQ ID NO: 514508 - DNA, 20 bp, mouse
gtaagtatgggtccactagg

SEQ ID NO: 514509 - DNA, 20 bp, mouse
gtgtccactacaagacatgg

SEQ ID NO: 514510 - DNA, 20 bp, mouse
gggaacgtgggtctcccgat

SEQ ID NO: 514511 - DNA, 20 bp, mouse
ggaacagtcatgctgtggtg

SEQ ID NO: 514512 - DNA, 20 bp, mouse
gtggccacagagacccagca

SEQ ID NO: 514513 - DNA, 20 bp, mouse
gcccagaggacagcgactaa

SEQ ID NO: 514514 - DNA, 20 bp, mouse
ggtggtgctcaggtaagtat

SEQ ID NO: 514515 - DNA, 20 bp, mouse
gagcacggaacctggagcaa

SEQ ID NO: 514516 - DNA, 20 bp, mouse
gtgcgtctcggagctctcgg

SEQ ID NO: 514517 - DNA, 20 bp, mouse
gaggcgcgcgggccatcccg

SEQ ID NO: 514518 - DNA, 20 bp, mouse
gctcggagctctcggcggag

SEQ ID NO: 514519 - DNA, 20 bp, mouse
gggagctctcggcggagcgg

SEQ ID NO: 514520 - DNA, 20 bp, mouse
gtccggcccatgaaccgaag

SEQ ID NO: 514521 - DNA, 20 bp, mouse
ggctccgagacgcagcgccg

SEQ ID NO: 514522 - DNA, 20 bp, mouse
gcgctgcgtctcggagctct

SEQ ID NO: 514523 - DNA, 20 bp, mouse
ggcgcctcggcgctgcgtct

SEQ ID NO: 514524 - DNA, 20 bp, mouse
gggcgcgcgtggctcagtcc

SEQ ID NO: 514525 - DNA, 20 bp, mouse
gccccgcgtcgcgctccccc

SEQ ID NO: 514526 - DNA, 20 bp, mouse
gcggtggccgaggtagacgg

SEQ ID NO: 514527 - DNA, 20 bp, mouse
gaccccggcggtagcacgat

SEQ ID NO: 514528 - DNA, 20 bp, mouse
ggtccggtggccgaggtaga

SEQ ID NO: 514529 - DNA, 20 bp, mouse
ggactccaaagtgaaagtgg

SEQ ID NO: 514530 - DNA, 20 bp, mouse
gtggcctcggagagtttgtc

SEQ ID NO: 514531 - DNA, 20 bp, mouse
gcctcggagagtttgtccgg

SEQ ID NO: 514532 - DNA, 20 bp, mouse
gtcccatcgtgctaccgccg

SEQ ID NO: 514533 - DNA, 20 bp, mouse
gtccggccaatgaaccgacg

SEQ ID NO: 514534 - DNA, 20 bp, mouse
gggacaagcgctcacctcgt

SEQ ID NO: 514535 - DNA, 20 bp, mouse
gctctccgaggccaacccgg

SEQ ID NO: 514536 - DNA, 20 bp, mouse
gctgtgaagaagaaacctcc

SEQ ID NO: 514537 - DNA, 20 bp, mouse
gcacaacatcggaagcctgg

SEQ ID NO: 514538 - DNA, 20 bp, mouse
gcggctggaactgcacttga

SEQ ID NO: 514539 - DNA, 20 bp, mouse
gagactgagcctccagagaa

SEQ ID NO: 514540 - DNA, 20 bp, mouse
ggaagtgtgtactgacatct

SEQ ID NO: 514541 - DNA, 20 bp, mouse
gctcagtctccgggggtcag

SEQ ID NO: 514542 - DNA, 20 bp, mouse
gcagagaagggctacttgtg

SEQ ID NO: 514543 - DNA, 20 bp, mouse
gctggaggctcagtctccgg

SEQ ID NO: 514544 - DNA, 20 bp, mouse
gcagttccagccggctgctg

SEQ ID NO: 514545 - DNA, 20 bp, mouse
gtctgtcctcgatgcctggg

SEQ ID NO: 514546 - DNA, 20 bp, mouse
gcttgaagggaggattctgg

SEQ ID NO: 514547 - DNA, 20 bp, mouse
gcgtaagcgaatctcggacg

SEQ ID NO: 514548 - DNA, 20 bp, mouse
gaatctgcggccatcttgaa

SEQ ID NO: 514549 - DNA, 20 bp, mouse
gtcctggcgtaagcgaatct

SEQ ID NO: 514550 - DNA, 20 bp, mouse
gctgagggtaggccaccgaa

SEQ ID NO: 514551 - DNA, 20 bp, mouse
gctgcggccatcttgaaggg

SEQ ID NO: 514552 - DNA, 20 bp, mouse
gcatcttgaagggaggattc

SEQ ID NO: 514553 - DNA, 20 bp, mouse
gcagcggcgatgagttcacc

SEQ ID NO: 514554 - DNA, 20 bp, mouse
gagagcgctcgggtgtaggg

SEQ ID NO: 514555 - DNA, 20 bp, mouse
ggggaggattctggtggtcc

SEQ ID NO: 514556 - DNA, 20 bp, mouse
ggccgggccgggatgagcta

SEQ ID NO: 514557 - DNA, 20 bp, mouse
gcagtcgctggagtggccgg

SEQ ID NO: 514558 - DNA, 20 bp, mouse
gtggccttggcggtcctgaa

SEQ ID NO: 514559 - DNA, 20 bp, mouse
gacgggcacagtcgctggag

SEQ ID NO: 514560 - DNA, 20 bp, mouse
gcgggcacgggcacagtcgc

SEQ ID NO: 514561 - DNA, 20 bp, mouse
ggtgagagggaagtgggcgg

SEQ ID NO: 514562 - DNA, 20 bp, mouse
gggcctgttggaagcccccg

SEQ ID NO: 514563 - DNA, 20 bp, mouse
ggctatggcatcggtcaagg

SEQ ID NO: 514564 - DNA, 20 bp, mouse
gccaacaggcctgcgccccg

SEQ ID NO: 514565 - DNA, 20 bp, mouse
ggccactggcacggccaggt

SEQ ID NO: 514566 - DNA, 20 bp, mouse
gagctgtgagacctgccagg

SEQ ID NO: 514567 - DNA, 20 bp, mouse
gtgagacctgccaggaggcg

SEQ ID NO: 514568 - DNA, 20 bp, mouse
gcagcgctaggttctcggag

SEQ ID NO: 514569 - DNA, 20 bp, mouse
gagcggtggtgagtgctcct

SEQ ID NO: 514570 - DNA, 20 bp, mouse
ggctcctgggaaccctccgg

SEQ ID NO: 514571 - DNA, 20 bp, mouse
gggcgggccccgcgctgggt

SEQ ID NO: 514572 - DNA, 20 bp, mouse
ggcttcggcccagcccccgg

SEQ ID NO: 514573 - DNA, 20 bp, mouse
ggccccggcgccagaaaggg

SEQ ID NO: 514574 - DNA, 20 bp, mouse
gtagatttcgggaagaacag

SEQ ID NO: 514575 - DNA, 20 bp, mouse
gagtgctcctgggaaccctc

SEQ ID NO: 514576 - DNA, 20 bp, mouse
gagaagtgaccgtcacaact

SEQ ID NO: 514577 - DNA, 20 bp, mouse
gtgtgacggtcacttcttgt

SEQ ID NO: 514578 - DNA, 20 bp, mouse
gctaccgagtgtgcatgaca

SEQ ID NO: 514579 - DNA, 20 bp, mouse
gttcttgtaggtgagtgagg

SEQ ID NO: 514580 - DNA, 20 bp, mouse
gcgtcacaacttggcagagt

SEQ ID NO: 514581 - DNA, 20 bp, mouse
ggcttcccctcggggttcag

SEQ ID NO: 514582 - DNA, 20 bp, mouse
ggtggcgaagcctagaacct

SEQ ID NO: 514583 - DNA, 20 bp, mouse
gtgcaggtcgagggtcccct

SEQ ID NO: 514584 - DNA, 20 bp, mouse
gcacttcttgtaggtgagtg

SEQ ID NO: 514585 - DNA, 20 bp, mouse
ggctgtgtctggggacgcgt

SEQ ID NO: 514586 - DNA, 20 bp, mouse
gagctctctcctgaatccga

SEQ ID NO: 514587 - DNA, 20 bp, mouse
gtcggtggaatcgggtgtgg

SEQ ID NO: 514588 - DNA, 20 bp, mouse
gcgagggctcctgtccgagg

SEQ ID NO: 514589 - DNA, 20 bp, mouse
gcgccgcgccggaagaaggt

SEQ ID NO: 514590 - DNA, 20 bp, mouse
gcgccggaagaaggttggtt

SEQ ID NO: 514591 - DNA, 20 bp, mouse
gatccgagggctcctgtccg

SEQ ID NO: 514592 - DNA, 20 bp, mouse
gggttcggtggaatcgggtg

SEQ ID NO: 514593 - DNA, 20 bp, mouse
gaggtcagggacgagtagga

SEQ ID NO: 514594 - DNA, 20 bp, mouse
ggcgtccctccgcctcggac

SEQ ID NO: 514595 - DNA, 20 bp, mouse
ggggcaggtcagggacgagt

SEQ ID NO: 514596 - DNA, 20 bp, mouse
gtccgaggaggtgaccatag

SEQ ID NO: 514597 - DNA, 20 bp, mouse
ggcggaagagcgatccgagg

SEQ ID NO: 514598 - DNA, 20 bp, mouse
ggaggcggaagagcgatccg

SEQ ID NO: 514599 - DNA, 20 bp, mouse
gctgagacgcacctccacta

SEQ ID NO: 514600 - DNA, 20 bp, mouse
gtccactatggtcacctcct

SEQ ID NO: 514601 - DNA, 20 bp, mouse
gcaggccgcgacagctggca

SEQ ID NO: 514602 - DNA, 20 bp, mouse
gcccaaagaaggctgaactt

SEQ ID NO: 514603 - DNA, 20 bp, mouse
gtctcagtggccagaaggga

SEQ ID NO: 514604 - DNA, 20 bp, mouse
gagcctcaggccgcgacagc

SEQ ID NO: 514605 - DNA, 20 bp, mouse
gaaggacagcggtgactcaa

SEQ ID NO: 514606 - DNA, 20 bp, mouse
gactggggatagccgtgcat

SEQ ID NO: 514607 - DNA, 20 bp, mouse
gatgggcactggcaccgggg

SEQ ID NO: 514608 - DNA, 20 bp, mouse
ggatagccgtgcatgggcac

SEQ ID NO: 514609 - DNA, 20 bp, mouse
gcaggatcggggaccctccc

SEQ ID NO: 514610 - DNA, 20 bp, mouse
gcagtgacgcctgagaggta

SEQ ID NO: 514611 - DNA, 20 bp, mouse
gtgcatgggcactggcaccg

SEQ ID NO: 514612 - DNA, 20 bp, mouse
gagcatcagttccaggatcg

SEQ ID NO: 514613 - DNA, 20 bp, mouse
gctgcagaggagctacccag

SEQ ID NO: 514614 - DNA, 20 bp, mouse
gcgggctgcgacaaggacat

SEQ ID NO: 514615 - DNA, 20 bp, mouse
ggctcctggtgctgtgacga

SEQ ID NO: 514616 - DNA, 20 bp, mouse
gagacggcagtggtcccggg

SEQ ID NO: 514617 - DNA, 20 bp, mouse
gcggtgtagtcagacggcag

SEQ ID NO: 514618 - DNA, 20 bp, mouse
ggcgtcgcggtgtagtcaga

SEQ ID NO: 514619 - DNA, 20 bp, mouse
ggaggcgacagctcggatcc

SEQ ID NO: 514620 - DNA, 20 bp, mouse
gggcgcggctgtggatgcgg

SEQ ID NO: 514621 - DNA, 20 bp, mouse
gcggggcgcggctgtggatg

SEQ ID NO: 514622 - DNA, 20 bp, mouse
gagtttggcgagcagcgtcg

SEQ ID NO: 514623 - DNA, 20 bp, mouse
gaagacgccgaggcgcgcag

SEQ ID NO: 514624 - DNA, 20 bp, mouse
ggccgagtcagaagacgccg

SEQ ID NO: 514625 - DNA, 20 bp, mouse
gagccgcgctgcggacagac

SEQ ID NO: 514626 - DNA, 20 bp, mouse
ggcggatcgcgccccggggg

SEQ ID NO: 514627 - DNA, 20 bp, mouse
gggctcgccgggcagagaca

SEQ ID NO: 514628 - DNA, 20 bp, mouse
gcagcggccggcgcccgccc

SEQ ID NO: 514629 - DNA, 20 bp, mouse
gtcgtcgcggcaggactccc

SEQ ID NO: 514630 - DNA, 20 bp, mouse
gtcgcggcaggactccccgg

SEQ ID NO: 514631 - DNA, 20 bp, mouse
gccggcgagggagagaccgg

SEQ ID NO: 514632 - DNA, 20 bp, mouse
gccctcgccgggtccccggg

SEQ ID NO: 514633 - DNA, 20 bp, mouse
gaccggctctcacctcgtcg

SEQ ID NO: 514634 - DNA, 20 bp, mouse
gatggccgcccagagaggac

SEQ ID NO: 514635 - DNA, 20 bp, mouse
ggcttctgctgccgcccccg

SEQ ID NO: 514636 - DNA, 20 bp, mouse
gccgcgcagcaagactcctg

SEQ ID NO: 514637 - DNA, 20 bp, mouse
gggagtcttgctgcgcgggt

SEQ ID NO: 514638 - DNA, 20 bp, mouse
gggaaggccacgctctacag

SEQ ID NO: 514639 - DNA, 20 bp, mouse
gtgggatcagagaagcggcg

SEQ ID NO: 514640 - DNA, 20 bp, mouse
gcggcgaggcagacagtctt

SEQ ID NO: 514641 - DNA, 20 bp, mouse
gtcttcgggtgagtgaagtt

SEQ ID NO: 514642 - DNA, 20 bp, mouse
gtgcgcgggtgggtagaagc

SEQ ID NO: 514643 - DNA, 20 bp, mouse
ggaacaaagctgttcctcgt

SEQ ID NO: 514644 - DNA, 20 bp, mouse
gaggccacgctctacagagg

SEQ ID NO: 514645 - DNA, 20 bp, mouse
gaagcagcagctgataaccg

SEQ ID NO: 514646 - DNA, 20 bp, mouse
ggaagtggaattctgcaggt

SEQ ID NO: 514647 - DNA, 20 bp, mouse
gtggaattctgcaggtgggg

SEQ ID NO: 514648 - DNA, 20 bp, mouse
gtgcggggctgctgaaggtg

SEQ ID NO: 514649 - DNA, 20 bp, mouse
ggccttgaggcggaagactt

SEQ ID NO: 514650 - DNA, 20 bp, mouse
gagcgagttaagccttgagg

SEQ ID NO: 514651 - DNA, 20 bp, mouse
gggaggaagtggaattctgc

SEQ ID NO: 514652 - DNA, 20 bp, mouse
gtttgaatttgaaaaccggg

SEQ ID NO: 514653 - DNA, 20 bp, mouse
gtctaggttgagtccagtgg

SEQ ID NO: 514654 - DNA, 20 bp, mouse
ggcaggtggggaggcgtgca

SEQ ID NO: 514655 - DNA, 20 bp, mouse
gtttgaaaaccgggaggaag

SEQ ID NO: 514656 - DNA, 20 bp, mouse
ggccgtgctccagccatgtt

SEQ ID NO: 514657 - DNA, 20 bp, mouse
ggttgggcgactgaatggaa

SEQ ID NO: 514658 - DNA, 20 bp, mouse
ggccatgttgggcgactgaa

SEQ ID NO: 514659 - DNA, 20 bp, mouse
gcgcggagcctggcgagtgg

SEQ ID NO: 514660 - DNA, 20 bp, mouse
gaccggccacggctgacgca

SEQ ID NO: 514661 - DNA, 20 bp, mouse
gaggtgagctgcgggtggac

SEQ ID NO: 514662 - DNA, 20 bp, mouse
gtcgcatcgctgcttctcgg

SEQ ID NO: 514663 - DNA, 20 bp, mouse
gcttctcgggggaacagcag

SEQ ID NO: 514664 - DNA, 20 bp, mouse
ggggcggccgcaggcatgtt

SEQ ID NO: 514665 - DNA, 20 bp, mouse
ggggagggggcggtgactca

SEQ ID NO: 514666 - DNA, 20 bp, mouse
gtcctccagccatcgcgcgg

SEQ ID NO: 514667 - DNA, 20 bp, mouse
gatggctggaggagacgcat

SEQ ID NO: 514668 - DNA, 20 bp, mouse
gacctccgcgcgatggctgg

SEQ ID NO: 514669 - DNA, 20 bp, mouse
gagccgcggccggccccacg

SEQ ID NO: 514670 - DNA, 20 bp, mouse
ggtctcctccagccatcgcg

SEQ ID NO: 514671 - DNA, 20 bp, mouse
ggggtctgggcgcggatcag

SEQ ID NO: 514672 - DNA, 20 bp, mouse
gctgcggctgcagaaggcgg

SEQ ID NO: 514673 - DNA, 20 bp, mouse
gctcgcaggaggcggcagag

SEQ ID NO: 514674 - DNA, 20 bp, mouse
gccgcgctgtagggagctgc

SEQ ID NO: 514675 - DNA, 20 bp, mouse
ggtctgcagtccaggaggag

SEQ ID NO: 514676 - DNA, 20 bp, mouse
gagagaagcgggccgaagaa

SEQ ID NO: 514677 - DNA, 20 bp, mouse
gctcccggcccgcgtacctg

SEQ ID NO: 514678 - DNA, 20 bp, mouse
gcagcgacgggagatggcgt

SEQ ID NO: 514679 - DNA, 20 bp, mouse
ggggaaggctatgagcttaa

SEQ ID NO: 514680 - DNA, 20 bp, mouse
gtgtccgcagcgacgggaga

SEQ ID NO: 514681 - DNA, 20 bp, mouse
gcgccgaaggcagcgaatag

SEQ ID NO: 514682 - DNA, 20 bp, mouse
ggccttcggcggtgtagagg

SEQ ID NO: 514683 - DNA, 20 bp, mouse
gtagcgctcaggctctagac

SEQ ID NO: 514684 - DNA, 20 bp, mouse
gaagacgtgtccgcagcgac

SEQ ID NO: 514685 - DNA, 20 bp, mouse
gtagacaggagctggagcct

SEQ ID NO: 514686 - DNA, 20 bp, mouse
gaactaagccgagcaaacca

SEQ ID NO: 514687 - DNA, 20 bp, mouse
gggagggcgccggcacacca

SEQ ID NO: 514688 - DNA, 20 bp, mouse
gcgggacgtcgggctccgac

SEQ ID NO: 514689 - DNA, 20 bp, mouse
ggattgagtcctggtccccg

SEQ ID NO: 514690 - DNA, 20 bp, mouse
ggacgcgcgcgcgggacgtc

SEQ ID NO: 514691 - DNA, 20 bp, mouse
gtggcaacccgaggaggtgg

SEQ ID NO: 514692 - DNA, 20 bp, mouse
gcgggctcagaggactggga

SEQ ID NO: 514693 - DNA, 20 bp, mouse
gtgagtccgtagtacagtgt

SEQ ID NO: 514694 - DNA, 20 bp, mouse
gtcgggctccgacaggagca

SEQ ID NO: 514695 - DNA, 20 bp, mouse
gagtcagcgtgagtactggt

SEQ ID NO: 514696 - DNA, 20 bp, mouse
ggcctggcggacacctaagg

SEQ ID NO: 514697 - DNA, 20 bp, mouse
ggaggaccgaagaaatagtg

SEQ ID NO: 514698 - DNA, 20 bp, mouse
gcggtgaggagaaagcccta

SEQ ID NO: 514699 - DNA, 20 bp, mouse
gacacctaaggcgggttgac

SEQ ID NO: 514700 - DNA, 20 bp, mouse
ggccgggctagcagagcgtc

SEQ ID NO: 514701 - DNA, 20 bp, mouse
gaggagaaagccctaaggcc

SEQ ID NO: 514702 - DNA, 20 bp, mouse
ggtggcctggcggacaccta

SEQ ID NO: 514703 - DNA, 20 bp, mouse
ggccctgaggtgagaaacgg

SEQ ID NO: 514704 - DNA, 20 bp, mouse
gcgtccggtcaacccgcctt

SEQ ID NO: 514705 - DNA, 20 bp, mouse
gctctgctagcccggcctta

SEQ ID NO: 514706 - DNA, 20 bp, mouse
gagtggcggagagcacgctg

SEQ ID NO: 514707 - DNA, 20 bp, mouse
gcggcccaggggcaccccca

SEQ ID NO: 514708 - DNA, 20 bp, mouse
gagcctgtcccggagcaagc

SEQ ID NO: 514709 - DNA, 20 bp, mouse
ggcagcaggcctggccatgg

SEQ ID NO: 514710 - DNA, 20 bp, mouse
gagcacgctgtggacgcgac

SEQ ID NO: 514711 - DNA, 20 bp, mouse
ggcccccgcccagcctgtcc

SEQ ID NO: 514712 - DNA, 20 bp, mouse
ggttggctctcggggtacag

SEQ ID NO: 514713 - DNA, 20 bp, mouse
gcgcaaggccctgctaggag

SEQ ID NO: 514714 - DNA, 20 bp, mouse
gggctgcaccgcacacaagg

SEQ ID NO: 514715 - DNA, 20 bp, mouse
ggcgggcggctgggctcgac

SEQ ID NO: 514716 - DNA, 20 bp, mouse
gccgaaacggaggaggacgg

SEQ ID NO: 514717 - DNA, 20 bp, mouse
gggacggcggcgaggacgca

SEQ ID NO: 514718 - DNA, 20 bp, mouse
ggaggacgcgtggctggagg

SEQ ID NO: 514719 - DNA, 20 bp, mouse
ggccgagccgagccggcggt

SEQ ID NO: 514720 - DNA, 20 bp, mouse
gtctagcggggccgaaacgg

SEQ ID NO: 514721 - DNA, 20 bp, mouse
gaactcagttagcgagctcg

SEQ ID NO: 514722 - DNA, 20 bp, mouse
gtcctctagcggggccgaaa

SEQ ID NO: 514723 - DNA, 20 bp, mouse
gagcggggccgaaacggagg

SEQ ID NO: 514724 - DNA, 20 bp, mouse
gcaagttcccaccgccggct

SEQ ID NO: 514725 - DNA, 20 bp, mouse
gtggatgtgaccgcgaagag

SEQ ID NO: 514726 - DNA, 20 bp, mouse
ggcagagcagaggtctgatt

SEQ ID NO: 514727 - DNA, 20 bp, mouse
ggaagaaataccaataaaag

SEQ ID NO: 514728 - DNA, 20 bp, mouse
gccatcggaggaggccatgt

SEQ ID NO: 514729 - DNA, 20 bp, mouse
gcgatgagcgacagcactag

SEQ ID NO: 514730 - DNA, 20 bp, mouse
gttgtctcagctaagtcggg

SEQ ID NO: 514731 - DNA, 20 bp, mouse
gtttattggtatttcttcca

SEQ ID NO: 514732 - DNA, 20 bp, mouse
gctgggaaaacatacaccat

SEQ ID NO: 514733 - DNA, 20 bp, mouse
gggaaaacatacaccatcgg

SEQ ID NO: 514734 - DNA, 20 bp, mouse
gtcagctaagtcgggaggca

SEQ ID NO: 514735 - DNA, 20 bp, mouse
gtaatcatcaagtctgtgtg

SEQ ID NO: 514736 - DNA, 20 bp, mouse
ggggcgtccgggtgaagcga

SEQ ID NO: 514737 - DNA, 20 bp, mouse
ggccatcacctcatccggag

SEQ ID NO: 514738 - DNA, 20 bp, mouse
ggagggccgcagccgtgagg

SEQ ID NO: 514739 - DNA, 20 bp, mouse
ggccgctccggatgaggtga

SEQ ID NO: 514740 - DNA, 20 bp, mouse
gcggcaccgagagacccgac

SEQ ID NO: 514741 - DNA, 20 bp, mouse
gggcaggcgggcgaaacagg

SEQ ID NO: 514742 - DNA, 20 bp, mouse
gagcgagggccgcagccgtg

SEQ ID NO: 514743 - DNA, 20 bp, mouse
gccggtaaaaggcagagtag

SEQ ID NO: 514744 - DNA, 20 bp, mouse
ggcgcgcacgccgggcgtcc

SEQ ID NO: 514745 - DNA, 20 bp, mouse
gctgcggccctcgcttcacc

SEQ ID NO: 514746 - DNA, 20 bp, mouse
gatggtgagtggagttacca

SEQ ID NO: 514747 - DNA, 20 bp, mouse
gctgttgtgccaacgccaag

SEQ ID NO: 514748 - DNA, 20 bp, mouse
gtttctgagcctcttggcgt

SEQ ID NO: 514749 - DNA, 20 bp, mouse
gtcctgggtcacagtagagt

SEQ ID NO: 514750 - DNA, 20 bp, mouse
gttcaggctggcttggactc

SEQ ID NO: 514751 - DNA, 20 bp, mouse
ggctgtacgctggtctccaa

SEQ ID NO: 514752 - DNA, 20 bp, mouse
gaggctcagaaaacgagccc

SEQ ID NO: 514753 - DNA, 20 bp, mouse
ggggttgctggggatcatca

SEQ ID NO: 514754 - DNA, 20 bp, mouse
gctacagacactgggcgcag

SEQ ID NO: 514755 - DNA, 20 bp, mouse
gtagatggtactacagacac

SEQ ID NO: 514756 - DNA, 20 bp, mouse
gtggactcaggaacaacaac

SEQ ID NO: 514757 - DNA, 20 bp, mouse
gcgcagtattagcagagtcg

SEQ ID NO: 514758 - DNA, 20 bp, mouse
gcaaggggacgacccaagag

SEQ ID NO: 514759 - DNA, 20 bp, mouse
ggacatggaccccctcagtg

SEQ ID NO: 514760 - DNA, 20 bp, mouse
gttcaacgcagcaatggtga

SEQ ID NO: 514761 - DNA, 20 bp, mouse
gcgcgggatttaaactgcag

SEQ ID NO: 514762 - DNA, 20 bp, mouse
ggcagggtcttgaggccaag

SEQ ID NO: 514763 - DNA, 20 bp, mouse
gggttatctgaatctccgtg

SEQ ID NO: 514764 - DNA, 20 bp, mouse
gcagtcggtgtcccctacac

SEQ ID NO: 514765 - DNA, 20 bp, mouse
gaggaggccgaggaagccgc

SEQ ID NO: 514766 - DNA, 20 bp, mouse
gtgggcccagtagaaaatgt

SEQ ID NO: 514767 - DNA, 20 bp, mouse
gtgtaggtagacttagggtt

SEQ ID NO: 514768 - DNA, 20 bp, mouse
gtgactgggaagaagtctct

SEQ ID NO: 514769 - DNA, 20 bp, mouse
gagaaaatgtaggtagactt

SEQ ID NO: 514770 - DNA, 20 bp, mouse
ggaccacccaagatcgatgg

SEQ ID NO: 514771 - DNA, 20 bp, mouse
ggccagcaagaagtgctcag

SEQ ID NO: 514772 - DNA, 20 bp, mouse
gtcaaaatggagggcccctt

SEQ ID NO: 514773 - DNA, 20 bp, mouse
gacagcagacctacaccact

SEQ ID NO: 514774 - DNA, 20 bp, mouse
gctgcaagggcaataagtct

SEQ ID NO: 514775 - DNA, 20 bp, mouse
gttgctggctgacacgaagg

SEQ ID NO: 514776 - DNA, 20 bp, mouse
gctgtgtgagccgcagtctc

SEQ ID NO: 514777 - DNA, 20 bp, mouse
gcgcagtctctggagcgcta

SEQ ID NO: 514778 - DNA, 20 bp, mouse
gctggagcgctaaggtgttg

SEQ ID NO: 514779 - DNA, 20 bp, mouse
gccaacaacaccgggtttgg

SEQ ID NO: 514780 - DNA, 20 bp, mouse
gggatgcagcccaacaacac

SEQ ID NO: 514781 - DNA, 20 bp, mouse
gtcgtgtcggccctgctcgg

SEQ ID NO: 514782 - DNA, 20 bp, mouse
ggcggctcacacagctacag

SEQ ID NO: 514783 - DNA, 20 bp, mouse
gaaggtgttgcggtcgcctg

SEQ ID NO: 514784 - DNA, 20 bp, mouse
gtgggggcgaggctggccac

SEQ ID NO: 514785 - DNA, 20 bp, mouse
gggccagagcgtagactctg

SEQ ID NO: 514786 - DNA, 20 bp, mouse
gggccgcagccgagagcggg

SEQ ID NO: 514787 - DNA, 20 bp, mouse
gcatccggggcagctgggaa

SEQ ID NO: 514788 - DNA, 20 bp, mouse
gctgcggccgcagccgagag

SEQ ID NO: 514789 - DNA, 20 bp, mouse
gcccggatggggagagaccg

SEQ ID NO: 514790 - DNA, 20 bp, mouse
ggggcggcggcggcgaaccc

SEQ ID NO: 514791 - DNA, 20 bp, mouse
gagcatctcgaactcacctg

SEQ ID NO: 514792 - DNA, 20 bp, mouse
gggccgtgaggagcgagcac

SEQ ID NO: 514793 - DNA, 20 bp, mouse
gtgaggtccgagcctcaggg

SEQ ID NO: 514794 - DNA, 20 bp, mouse
gcgtgaggagcgagcacggg

SEQ ID NO: 514795 - DNA, 20 bp, mouse
gcgccgcccgctctcggctg

SEQ ID NO: 514796 - DNA, 20 bp, mouse
gaaaggatggggcggaacag

SEQ ID NO: 514797 - DNA, 20 bp, mouse
gaacccgggccgcagcgcag

SEQ ID NO: 514798 - DNA, 20 bp, mouse
gggatggggcggaacagcgg

SEQ ID NO: 514799 - DNA, 20 bp, mouse
gcagacgggagacctaaccc

SEQ ID NO: 514800 - DNA, 20 bp, mouse
gcccttcccctagggatcca

SEQ ID NO: 514801 - DNA, 20 bp, mouse
gccccgccatggatccctag

SEQ ID NO: 514802 - DNA, 20 bp, mouse
gagtctggagaggtagaatt

SEQ ID NO: 514803 - DNA, 20 bp, mouse
gcagcttgcgcggtaaccta

SEQ ID NO: 514804 - DNA, 20 bp, mouse
gggagcaagagtgagcgcta

SEQ ID NO: 514805 - DNA, 20 bp, mouse
ggcccttgggcgagggacag

SEQ ID NO: 514806 - DNA, 20 bp, mouse
gacagggcgccagggaaggt

SEQ ID NO: 514807 - DNA, 20 bp, mouse
gccagggaaggtcggtgaga

SEQ ID NO: 514808 - DNA, 20 bp, mouse
gcggttggaacagggcgcca

SEQ ID NO: 514809 - DNA, 20 bp, mouse
gcgcagaatcggagctaacg

SEQ ID NO: 514810 - DNA, 20 bp, mouse
ggtgagagggacgtttagtt

SEQ ID NO: 514811 - DNA, 20 bp, mouse
gttagtttggtgagttaccc

SEQ ID NO: 514812 - DNA, 20 bp, mouse
gcggagctaacgcggtgccc

SEQ ID NO: 514813 - DNA, 20 bp, mouse
gctctcccaggagcccccgg

SEQ ID NO: 514814 - DNA, 20 bp, mouse
ggagtggaaaggcccttctc

SEQ ID NO: 514815 - DNA, 20 bp, mouse
gcactcctgccagcctccgg

SEQ ID NO: 514816 - DNA, 20 bp, mouse
ggcgagaggaccagacgccc

SEQ ID NO: 514817 - DNA, 20 bp, mouse
ggagcagctggaacgcctcg

SEQ ID NO: 514818 - DNA, 20 bp, mouse
gtgtcctgcggcactggatg

SEQ ID NO: 514819 - DNA, 20 bp, mouse
gatgagctttcggtgtcctg

SEQ ID NO: 514820 - DNA, 20 bp, mouse
gcactggatgcgggcgacct

SEQ ID NO: 514821 - DNA, 20 bp, mouse
gtcgtcgtcgaccaccatgg

SEQ ID NO: 514822 - DNA, 20 bp, mouse
gtgagctgctgcaggatgac

SEQ ID NO: 514823 - DNA, 20 bp, mouse
gggtggtcgacgacgacgag

SEQ ID NO: 514824 - DNA, 20 bp, mouse
gggggcggagaggcacagcg

SEQ ID NO: 514825 - DNA, 20 bp, mouse
gggagcgtctccgactgcaa

SEQ ID NO: 514826 - DNA, 20 bp, mouse
ggggcactaaggcctttgga

SEQ ID NO: 514827 - DNA, 20 bp, mouse
gtgacgcgcgcaccctccaa

SEQ ID NO: 514828 - DNA, 20 bp, mouse
ggctgccgggacaggatagt

SEQ ID NO: 514829 - DNA, 20 bp, mouse
gtcggcccactatcctgtcc

SEQ ID NO: 514830 - DNA, 20 bp, mouse
gcccaggccggcggcaaact

SEQ ID NO: 514831 - DNA, 20 bp, mouse
gtccatcatggcggccaagg

SEQ ID NO: 514832 - DNA, 20 bp, mouse
gaggccggcggcaaactggg

SEQ ID NO: 514833 - DNA, 20 bp, mouse
gagcctgtggaggccggtga

SEQ ID NO: 514834 - DNA, 20 bp, mouse
gatcatggcggccaaggcgg

SEQ ID NO: 514835 - DNA, 20 bp, mouse
ggagacgccgaggagcatcg

SEQ ID NO: 514836 - DNA, 20 bp, mouse
gtggaggtgccggagcacgg

SEQ ID NO: 514837 - DNA, 20 bp, mouse
gctcgggccgcagcaggagg

SEQ ID NO: 514838 - DNA, 20 bp, mouse
gagcccgggaggtctgagcc

SEQ ID NO: 514839 - DNA, 20 bp, mouse
gtcagggagcaatccccgcc

SEQ ID NO: 514840 - DNA, 20 bp, mouse
gacgctgctctccttcccgg

SEQ ID NO: 514841 - DNA, 20 bp, mouse
gaccacgaggcgggcggact

SEQ ID NO: 514842 - DNA, 20 bp, mouse
ggcctggaggtgccggagca

SEQ ID NO: 514843 - DNA, 20 bp, mouse
gacgtcaccgtgccgaggcg

SEQ ID NO: 514844 - DNA, 20 bp, mouse
gcatcagcaccaccgtgctc

SEQ ID NO: 514845 - DNA, 20 bp, mouse
ggcggactaggcgatgctca

SEQ ID NO: 514846 - DNA, 20 bp, mouse
gagcggtgtctgcgggaggt

SEQ ID NO: 514847 - DNA, 20 bp, mouse
gaggtggtccggactcggaa

SEQ ID NO: 514848 - DNA, 20 bp, mouse
gccggactcggaaaggtcaa

SEQ ID NO: 514849 - DNA, 20 bp, mouse
ggctagggcagcggtgtctg

SEQ ID NO: 514850 - DNA, 20 bp, mouse
gcacacggagctcccaacag

SEQ ID NO: 514851 - DNA, 20 bp, mouse
gtctttggttactgttgcta

SEQ ID NO: 514852 - DNA, 20 bp, mouse
ggggcagcggtgtctgcggg

SEQ ID NO: 514853 - DNA, 20 bp, mouse
gcgggctccgtcctccctcg

SEQ ID NO: 514854 - DNA, 20 bp, mouse
gcacactgcagccccgaggg

SEQ ID NO: 514855 - DNA, 20 bp, mouse
ggataggaggcgggaacccg

SEQ ID NO: 514856 - DNA, 20 bp, mouse
gcgaagggccaccctcacgg

SEQ ID NO: 514857 - DNA, 20 bp, mouse
ggctgaggaggcccccgtga

SEQ ID NO: 514858 - DNA, 20 bp, mouse
gactcgaagggccaccctca

SEQ ID NO: 514859 - DNA, 20 bp, mouse
ggagggagtgggcatctcct

SEQ ID NO: 514860 - DNA, 20 bp, mouse
gcagcaatgggcgaactcga

SEQ ID NO: 514861 - DNA, 20 bp, mouse
gcaaagaaagcctcgaggag

SEQ ID NO: 514862 - DNA, 20 bp, mouse
gcagctccttgggcagcaat

SEQ ID NO: 514863 - DNA, 20 bp, mouse
gtagctgctgtccttcaaga

SEQ ID NO: 514864 - DNA, 20 bp, mouse
ggaccatgcagcagctcctt

SEQ ID NO: 514865 - DNA, 20 bp, mouse
ggcggggtcgaatcaccctg

SEQ ID NO: 514866 - DNA, 20 bp, mouse
ggcaagtcgtgggacctcag

SEQ ID NO: 514867 - DNA, 20 bp, mouse
gtgccccgcgaggtgagcag

SEQ ID NO: 514868 - DNA, 20 bp, mouse
gcaagttgctgcagttctag

SEQ ID NO: 514869 - DNA, 20 bp, mouse
ggacctcagtggagactcgt

SEQ ID NO: 514870 - DNA, 20 bp, mouse
gtcgcggggcagtggcgctc

SEQ ID NO: 514871 - DNA, 20 bp, mouse
ggccagtcggctagctgtcc

SEQ ID NO: 514872 - DNA, 20 bp, mouse
gttgaaaggagcatctccag

SEQ ID NO: 514873 - DNA, 20 bp, mouse
gagaggaaaaccctctagag

SEQ ID NO: 514874 - DNA, 20 bp, mouse
gtccgtctaaggcaagtcgt

SEQ ID NO: 514875 - DNA, 20 bp, mouse
gaagctgcgaccaggttgaa

SEQ ID NO: 514876 - DNA, 20 bp, mouse
gggcggcgcagcggttacca

SEQ ID NO: 514877 - DNA, 20 bp, mouse
gcaaggcctgcaaggcgggg

SEQ ID NO: 514878 - DNA, 20 bp, mouse
gtcccaaggcctgcaaggcg

SEQ ID NO: 514879 - DNA, 20 bp, mouse
gctgaccatgggatgtccag

SEQ ID NO: 514880 - DNA, 20 bp, mouse
ggttaccacggtgaacccgc

SEQ ID NO: 514881 - DNA, 20 bp, mouse
ggcagcggcgtggggagaat

SEQ ID NO: 514882 - DNA, 20 bp, mouse
gggagccggcgggttcaccg

SEQ ID NO: 514883 - DNA, 20 bp, mouse
gtgggagtgtctgagaatct

SEQ ID NO: 514884 - DNA, 20 bp, mouse
gctcctgggccccaaaacac

SEQ ID NO: 514885 - DNA, 20 bp, mouse
gggggcccaggagcagtggg

SEQ ID NO: 514886 - DNA, 20 bp, mouse
gccgcacagaaagggtgcaa

SEQ ID NO: 514887 - DNA, 20 bp, mouse
gcgccgaagccaggctgtcc

SEQ ID NO: 514888 - DNA, 20 bp, mouse
ggacctcgcgccaagatcgg

SEQ ID NO: 514889 - DNA, 20 bp, mouse
ggccgcaaaacgccgaagcc

SEQ ID NO: 514890 - DNA, 20 bp, mouse
ggacgacctcgcgccaagat

SEQ ID NO: 514891 - DNA, 20 bp, mouse
gggttgaaattcaaaagtgg

SEQ ID NO: 514892 - DNA, 20 bp, mouse
gggcctgcgtcctccgatct

SEQ ID NO: 514893 - DNA, 20 bp, mouse
gaattcaaaagtggcgggtg

SEQ ID NO: 514894 - DNA, 20 bp, mouse
gcgggtgtggctgattggcc

SEQ ID NO: 514895 - DNA, 20 bp, mouse
ggcctggcttcggcgttttg

SEQ ID NO: 514896 - DNA, 20 bp, mouse
ggcgggcgggtgcagagacc

SEQ ID NO: 514897 - DNA, 20 bp, mouse
gagcatgcgcatgggcactg

SEQ ID NO: 514898 - DNA, 20 bp, mouse
gcgggtgcagagacctggtg

SEQ ID NO: 514899 - DNA, 20 bp, mouse
ggacctggtgcggggacgcg

SEQ ID NO: 514900 - DNA, 20 bp, mouse
ggagtaaaaggcgtacatgg

SEQ ID NO: 514901 - DNA, 20 bp, mouse
gccgccgcgagcatgcgcat

SEQ ID NO: 514902 - DNA, 20 bp, mouse
ggtctgggcggggctatcga

SEQ ID NO: 514903 - DNA, 20 bp, mouse
ggcggagtgggcctgcatca

SEQ ID NO: 514904 - DNA, 20 bp, mouse
gatgcgcatgggcactgcgg

SEQ ID NO: 514905 - DNA, 20 bp, mouse
ggagcatgaggtgcaagtga

SEQ ID NO: 514906 - DNA, 20 bp, mouse
ggatcaggccccaagagacc

SEQ ID NO: 514907 - DNA, 20 bp, mouse
gtgacccgcagctcccaggt

SEQ ID NO: 514908 - DNA, 20 bp, mouse
gacccgactcaccggcctag

SEQ ID NO: 514909 - DNA, 20 bp, mouse
gctgccgggacccgactcac

SEQ ID NO: 514910 - DNA, 20 bp, mouse
gtccggttggaccaatacag

SEQ ID NO: 514911 - DNA, 20 bp, mouse
ggcctgatcgcaacacccac

SEQ ID NO: 514912 - DNA, 20 bp, mouse
gaggccggtgagtcgggtcc

SEQ ID NO: 514913 - DNA, 20 bp, mouse
ggggctcggcccgctccggc

SEQ ID NO: 514914 - DNA, 20 bp, mouse
gtggagctgcctcgcgcggg

SEQ ID NO: 514915 - DNA, 20 bp, mouse
gcaccgggtcggggaaagag

SEQ ID NO: 514916 - DNA, 20 bp, mouse
gggctcgcgccgcaaaacgt

SEQ ID NO: 514917 - DNA, 20 bp, mouse
gagtgactggtgtggcggat

SEQ ID NO: 514918 - DNA, 20 bp, mouse
gggcctggcgccaatagcgg

SEQ ID NO: 514919 - DNA, 20 bp, mouse
gtcaaaagtgactggtgtgg

SEQ ID NO: 514920 - DNA, 20 bp, mouse
gaattcaaaagtgactggtg

SEQ ID NO: 514921 - DNA, 20 bp, mouse
ggacggcctggcgccaatag

SEQ ID NO: 514922 - DNA, 20 bp, mouse
ggccaattcgccaggccaat

SEQ ID NO: 514923 - DNA, 20 bp, mouse
gggagccaggccaattcgcc

SEQ ID NO: 514924 - DNA, 20 bp, mouse
ggccgattggcctggcgaat

SEQ ID NO: 514925 - DNA, 20 bp, mouse
gggcctgcgtcctccgctat

SEQ ID NO: 514926 - DNA, 20 bp, mouse
gtagcgctcagggtcgccat

SEQ ID NO: 514927 - DNA, 20 bp, mouse
gagggtcgccatgggcaagt

SEQ ID NO: 514928 - DNA, 20 bp, mouse
ggagcgctacaactacaaag

SEQ ID NO: 514929 - DNA, 20 bp, mouse
gcctttggacttaattctat

SEQ ID NO: 514930 - DNA, 20 bp, mouse
gtgaccgaccgaccccacca

SEQ ID NO: 514931 - DNA, 20 bp, mouse
gagggcttcgcgccgagctg

SEQ ID NO: 514932 - DNA, 20 bp, mouse
ggctacaactacaaagcggt

SEQ ID NO: 514933 - DNA, 20 bp, mouse
gctggccgcgacccctccct

SEQ ID NO: 514934 - DNA, 20 bp, mouse
gcctccagctccacgagaag

SEQ ID NO: 514935 - DNA, 20 bp, mouse
ggggctccaagccgagggag

SEQ ID NO: 514936 - DNA, 20 bp, mouse
ggaactcaccagaacacacg

SEQ ID NO: 514937 - DNA, 20 bp, mouse
gagaggatgtcagcacactt

SEQ ID NO: 514938 - DNA, 20 bp, mouse
gtccctaaaacatgaagtta

SEQ ID NO: 514939 - DNA, 20 bp, mouse
gaccagaacacacgaggctg

SEQ ID NO: 514940 - DNA, 20 bp, mouse
ggttctggtgagttctgctg

SEQ ID NO: 514941 - DNA, 20 bp, mouse
gctgaggaaccagagcagca

SEQ ID NO: 514942 - DNA, 20 bp, mouse
gggaaccagagcagcatggc

SEQ ID NO: 514943 - DNA, 20 bp, mouse
gtgaaaagtgtgaaataaca

SEQ ID NO: 514944 - DNA, 20 bp, mouse
gagggtagaattatcatctt

SEQ ID NO: 514945 - DNA, 20 bp, mouse
gtctggactaggaagaaacc

SEQ ID NO: 514946 - DNA, 20 bp, mouse
gtgagtccgtccctaaaaca

SEQ ID NO: 514947 - DNA, 20 bp, mouse
ggtctgtcctggatactccc

SEQ ID NO: 514948 - DNA, 20 bp, mouse
ggaactcaccagaacacatg

SEQ ID NO: 514949 - DNA, 20 bp, mouse
gcagaggatgtcagcacacg

SEQ ID NO: 514950 - DNA, 20 bp, mouse
gtccctaaaacatggagtta

SEQ ID NO: 514951 - DNA, 20 bp, mouse
gaccagaacacatgaggctg

SEQ ID NO: 514952 - DNA, 20 bp, mouse
ggttctggtgagttctgctg

SEQ ID NO: 514953 - DNA, 20 bp, mouse
gtgaaaagtgtgaaataaca

SEQ ID NO: 514954 - DNA, 20 bp, mouse
ggtatccaggacagactgag

SEQ ID NO: 514955 - DNA, 20 bp, mouse
gagggtagaattatcatctt

SEQ ID NO: 514956 - DNA, 20 bp, mouse
ggaacattcttcttcgtcag

SEQ ID NO: 514957 - DNA, 20 bp, mouse
ggctcggttctggggtgcgc

SEQ ID NO: 514958 - DNA, 20 bp, mouse
gcaagcttatgggttcccag

SEQ ID NO: 514959 - DNA, 20 bp, mouse
gtgtcttgccaccctcaggg

SEQ ID NO: 514960 - DNA, 20 bp, mouse
gagcagttgaacctccctga

SEQ ID NO: 514961 - DNA, 20 bp, mouse
gggttcaactgctcacctct

SEQ ID NO: 514962 - DNA, 20 bp, mouse
gagttgaacctccctgaggg

SEQ ID NO: 514963 - DNA, 20 bp, mouse
gtgcagcaggagacagactt

SEQ ID NO: 514964 - DNA, 20 bp, mouse
gagggatcccagacgcaggt

SEQ ID NO: 514965 - DNA, 20 bp, mouse
gatctgtcttgccaccctca

SEQ ID NO: 514966 - DNA, 20 bp, mouse
ggaggagagagagccagcgg

SEQ ID NO: 514967 - DNA, 20 bp, mouse
gagcgagccggcggctagag

SEQ ID NO: 514968 - DNA, 20 bp, mouse
gcttgtgtgcaagggcggga

SEQ ID NO: 514969 - DNA, 20 bp, mouse
ggtgtgcgccttgtgtgcaa

SEQ ID NO: 514970 - DNA, 20 bp, mouse
gccgcgggctagggagtcca

SEQ ID NO: 514971 - DNA, 20 bp, mouse
gcccgccgctgggccccagt

SEQ ID NO: 514972 - DNA, 20 bp, mouse
gagtttccgggagaacaccg

SEQ ID NO: 514973 - DNA, 20 bp, mouse
ggctagggagtccagggaac

SEQ ID NO: 514974 - DNA, 20 bp, mouse
gacgcaggcttcctaagatg

SEQ ID NO: 514975 - DNA, 20 bp, mouse
ggcgccttgtgtgcaagggc

SEQ ID NO: 514976 - DNA, 20 bp, mouse
gcttgagcggtagagaacac

SEQ ID NO: 514977 - DNA, 20 bp, mouse
gtagagaacaccggagactg

SEQ ID NO: 514978 - DNA, 20 bp, mouse
gtagggttgcaacccttgag

SEQ ID NO: 514979 - DNA, 20 bp, mouse
gtgggtccctcgcagtccta

SEQ ID NO: 514980 - DNA, 20 bp, mouse
gggactgcgagggacccact

SEQ ID NO: 514981 - DNA, 20 bp, mouse
gctggctcatccgcagtctc

SEQ ID NO: 514982 - DNA, 20 bp, mouse
gctgcgagggacccactagg

SEQ ID NO: 514983 - DNA, 20 bp, mouse
gagttccctgagccctccgg

SEQ ID NO: 514984 - DNA, 20 bp, mouse
gcagcaaaggaaaacgagga

SEQ ID NO: 514985 - DNA, 20 bp, mouse
gaagaggccgggactctagg

SEQ ID NO: 514986 - DNA, 20 bp, mouse
gtgtgggaggagcccgccag

SEQ ID NO: 514987 - DNA, 20 bp, mouse
gtagctcgttcgctcgctgt

SEQ ID NO: 514988 - DNA, 20 bp, mouse
gcgagacctaagcggaccag

SEQ ID NO: 514989 - DNA, 20 bp, mouse
ggcacacggcttcctctggc

SEQ ID NO: 514990 - DNA, 20 bp, mouse
gcgagtgacgagtgacagaa

SEQ ID NO: 514991 - DNA, 20 bp, mouse
ggaatggatctgctccgagt

SEQ ID NO: 514992 - DNA, 20 bp, mouse
gctcgttcgctcgctgtggg

SEQ ID NO: 514993 - DNA, 20 bp, mouse
gtcggagcagatccattctc

SEQ ID NO: 514994 - DNA, 20 bp, mouse
gctctggttcttggcatccc

SEQ ID NO: 514995 - DNA, 20 bp, mouse
gctccgccgccggtcctcca

SEQ ID NO: 514996 - DNA, 20 bp, mouse
ggccaccctggaacatgctc

SEQ ID NO: 514997 - DNA, 20 bp, mouse
gtgctcaggctcggtcctct

SEQ ID NO: 514998 - DNA, 20 bp, mouse
gcgagcctgagcatgttcca

SEQ ID NO: 514999 - DNA, 20 bp, mouse
ggaccaggaaggcccccccg

SEQ ID NO: 515000 - DNA, 20 bp, mouse
gactagccagctgaccagga

SEQ ID NO: 515001 - DNA, 20 bp, mouse
gatcatgcttcagtccacgg

SEQ ID NO: 515002 - DNA, 20 bp, mouse
gctccactagccagctgacc

SEQ ID NO: 515003 - DNA, 20 bp, mouse
gtgccaagggtcagccaccc

SEQ ID NO: 515004 - DNA, 20 bp, mouse
ggacctctggagccagcggt

SEQ ID NO: 515005 - DNA, 20 bp, mouse
gctccagaggtcacatctgt

SEQ ID NO: 515006 - DNA, 20 bp, mouse
gtgacaccgccccatgtcta

SEQ ID NO: 515007 - DNA, 20 bp, mouse
ggcttctagcccagcaaccg

SEQ ID NO: 515008 - DNA, 20 bp, mouse
gcccggggcggggacagtct

SEQ ID NO: 515009 - DNA, 20 bp, mouse
gcctctccgtagacatgggg

SEQ ID NO: 515010 - DNA, 20 bp, mouse
ggacagtctaggaacagccg

SEQ ID NO: 515011 - DNA, 20 bp, mouse
gtcagccagcacgtcctggt

SEQ ID NO: 515012 - DNA, 20 bp, mouse
gagccccgcgaacagtccca

SEQ ID NO: 515013 - DNA, 20 bp, mouse
ggtcctcagccagcacgtcc

SEQ ID NO: 515014 - DNA, 20 bp, mouse
gagtctgcagcggcccgggg

SEQ ID NO: 515015 - DNA, 20 bp, mouse
gaggaacagccgcggttgct

SEQ ID NO: 515016 - DNA, 20 bp, mouse
gcgagagctgtagcagagag

SEQ ID NO: 515017 - DNA, 20 bp, mouse
ggcgcagccaccgcgatgag

SEQ ID NO: 515018 - DNA, 20 bp, mouse
gcgagcgcctctcatcgcgg

SEQ ID NO: 515019 - DNA, 20 bp, mouse
gccgcgagcgcctctcatcg

SEQ ID NO: 515020 - DNA, 20 bp, mouse
gcacctgggtgcgtccggag

SEQ ID NO: 515021 - DNA, 20 bp, mouse
gccgcctaccaccttcgagg

SEQ ID NO: 515022 - DNA, 20 bp, mouse
gtccgggaggggtgccacct

SEQ ID NO: 515023 - DNA, 20 bp, mouse
gccttcgaggtggtaggcat

SEQ ID NO: 515024 - DNA, 20 bp, mouse
ggctccgtggccagacaggt

SEQ ID NO: 515025 - DNA, 20 bp, mouse
gcgtccggagtggtagctgt

SEQ ID NO: 515026 - DNA, 20 bp, mouse
gaaagcaacggccaaggacg

SEQ ID NO: 515027 - DNA, 20 bp, mouse
ggagtgccgcgggaaagcaa

SEQ ID NO: 515028 - DNA, 20 bp, mouse
gcccgcggcactctcggtcc

SEQ ID NO: 515029 - DNA, 20 bp, mouse
gaccgggaccgagagtgccg

SEQ ID NO: 515030 - DNA, 20 bp, mouse
gtccagcccaggcagcggtg

SEQ ID NO: 515031 - DNA, 20 bp, mouse
gaagcttccgagctcctccc

SEQ ID NO: 515032 - DNA, 20 bp, mouse
ggaacgcagcgccccgtcct

SEQ ID NO: 515033 - DNA, 20 bp, mouse
ggaggctccggaagggaagg

SEQ ID NO: 515034 - DNA, 20 bp, mouse
gcccttccggagcctcgggg

SEQ ID NO: 515035 - DNA, 20 bp, mouse
gaagtgagtagggcacgccc

SEQ ID NO: 515036 - DNA, 20 bp, mouse
gcatgctgcgggagccggga

SEQ ID NO: 515037 - DNA, 20 bp, mouse
gaacggagcagcaccagccg

SEQ ID NO: 515038 - DNA, 20 bp, mouse
ggcggggcgcgggcatatag

SEQ ID NO: 515039 - DNA, 20 bp, mouse
gccgccctcggtctgatagg

SEQ ID NO: 515040 - DNA, 20 bp, mouse
ggagcagcaccagccgcggc

SEQ ID NO: 515041 - DNA, 20 bp, mouse
ggcgccgcctatcagaccga

SEQ ID NO: 515042 - DNA, 20 bp, mouse
gaccgcccagaggaaaccgt

SEQ ID NO: 515043 - DNA, 20 bp, mouse
gcgtctaccgcgacacagag

SEQ ID NO: 515044 - DNA, 20 bp, mouse
gcatctccagtggaggacag

SEQ ID NO: 515045 - DNA, 20 bp, mouse
gcagccgccctcggtctgat

SEQ ID NO: 515046 - DNA, 20 bp, mouse
gctgtgcagcagggtctccg

SEQ ID NO: 515047 - DNA, 20 bp, mouse
gcacacctgagaggtgtcaa

SEQ ID NO: 515048 - DNA, 20 bp, mouse
ggaagacaggctgtgcagca

SEQ ID NO: 515049 - DNA, 20 bp, mouse
gcggagacgggaaagcaata

SEQ ID NO: 515050 - DNA, 20 bp, mouse
gagcctggatcgggagactt

SEQ ID NO: 515051 - DNA, 20 bp, mouse
gtccaggctaatcattgaca

SEQ ID NO: 515052 - DNA, 20 bp, mouse
ggacagggctttacaatcac

SEQ ID NO: 515053 - DNA, 20 bp, mouse
gatagaggaacagctgactt

SEQ ID NO: 515054 - DNA, 20 bp, mouse
gagaaaatccattcattccc

SEQ ID NO: 515055 - DNA, 20 bp, mouse
gggaagaggaccctcgatct

SEQ ID NO: 515056 - DNA, 20 bp, mouse
gcggagcgcgggtcagggtg

SEQ ID NO: 515057 - DNA, 20 bp, mouse
ggggtgaggatgctgcgggg

SEQ ID NO: 515058 - DNA, 20 bp, mouse
gtcagggtgaggatgctgcg

SEQ ID NO: 515059 - DNA, 20 bp, mouse
gccggcgacgccattttcgg

SEQ ID NO: 515060 - DNA, 20 bp, mouse
gcagccgcctcagcagcaag

SEQ ID NO: 515061 - DNA, 20 bp, mouse
gaagagaccggagcacggag

SEQ ID NO: 515062 - DNA, 20 bp, mouse
ggaagggccgggtgcagatg

SEQ ID NO: 515063 - DNA, 20 bp, mouse
ggatgcggcggtggacggaa

SEQ ID NO: 515064 - DNA, 20 bp, mouse
gcattttcggcggcggaggg

SEQ ID NO: 515065 - DNA, 20 bp, mouse
gactactggcgcgcaggcag

SEQ ID NO: 515066 - DNA, 20 bp, mouse
gaggcagcgagacgagctca

SEQ ID NO: 515067 - DNA, 20 bp, mouse
gagctcacggtcgaggatcc

SEQ ID NO: 515068 - DNA, 20 bp, mouse
gcgagacgagctcacggtcg

SEQ ID NO: 515069 - DNA, 20 bp, mouse
ggtcgaggatccgggtgaag

SEQ ID NO: 515070 - DNA, 20 bp, mouse
gcctagaggaggagtcgtcg

SEQ ID NO: 515071 - DNA, 20 bp, mouse
ggccggtcgggtcctcccac

SEQ ID NO: 515072 - DNA, 20 bp, mouse
gtccgacgccgccgaggtag

SEQ ID NO: 515073 - DNA, 20 bp, mouse
gcaagccggacagtgaggag

SEQ ID NO: 515074 - DNA, 20 bp, mouse
gggactgctgggaaggccgg

SEQ ID NO: 515075 - DNA, 20 bp, mouse
gttgcaggtcggcctagagg

SEQ ID NO: 515076 - DNA, 20 bp, mouse
gggtggcacctccggtccca

SEQ ID NO: 515077 - DNA, 20 bp, mouse
ggcccctcagcccgcagagg

SEQ ID NO: 515078 - DNA, 20 bp, mouse
gccaagacgggcggacaagg

SEQ ID NO: 515079 - DNA, 20 bp, mouse
gctgtccccagggtttacaa

SEQ ID NO: 515080 - DNA, 20 bp, mouse
gggctgggaagctctgtgct

SEQ ID NO: 515081 - DNA, 20 bp, mouse
gctggtgcggcagacacgac

SEQ ID NO: 515082 - DNA, 20 bp, mouse
ggtcgagggagtcaccatct

SEQ ID NO: 515083 - DNA, 20 bp, mouse
gctgccgcaccagctcctcg

SEQ ID NO: 515084 - DNA, 20 bp, mouse
gtttgtgatggaaagggatc

SEQ ID NO: 515085 - DNA, 20 bp, mouse
gaccggaggtgccacctctg

SEQ ID NO: 515086 - DNA, 20 bp, mouse
gccctcaggagcctccggga

SEQ ID NO: 515087 - DNA, 20 bp, mouse
ggcctcgctgcgcggagacc

SEQ ID NO: 515088 - DNA, 20 bp, mouse
gtcaggagcctccgggaagg

SEQ ID NO: 515089 - DNA, 20 bp, mouse
gggagcctccgggaaggcgg

SEQ ID NO: 515090 - DNA, 20 bp, mouse
gccgcgcagcgggagcagcc

SEQ ID NO: 515091 - DNA, 20 bp, mouse
ggcggccgccgccttcccgg

SEQ ID NO: 515092 - DNA, 20 bp, mouse
gggccgtcaggtgggcacgg

SEQ ID NO: 515093 - DNA, 20 bp, mouse
gcgcagcgaggcggctcggg

SEQ ID NO: 515094 - DNA, 20 bp, mouse
gaaggcggcggccgcgcagc

SEQ ID NO: 515095 - DNA, 20 bp, mouse
ggcggcctgcgcacctgcgg

SEQ ID NO: 515096 - DNA, 20 bp, mouse
gtctgctctgtaagcaggta

SEQ ID NO: 515097 - DNA, 20 bp, mouse
gagcaggtaaggagacttca

SEQ ID NO: 515098 - DNA, 20 bp, mouse
gacggaggcggtagccggac

SEQ ID NO: 515099 - DNA, 20 bp, mouse
gcggctcccaggccagagcc

SEQ ID NO: 515100 - DNA, 20 bp, mouse
ggtctttgggagtacccctg

SEQ ID NO: 515101 - DNA, 20 bp, mouse
gagctcgaggtcacagtcag

SEQ ID NO: 515102 - DNA, 20 bp, mouse
gtcaggtcagagtttcttcc

SEQ ID NO: 515103 - DNA, 20 bp, mouse
gaggagatcagcaggttggg

SEQ ID NO: 515104 - DNA, 20 bp, mouse
gcttcaggctgcatcagcaa

SEQ ID NO: 515105 - DNA, 20 bp, mouse
ggagacttcagggatgagtt

SEQ ID NO: 515106 - DNA, 20 bp, mouse
gtggtgagtgtactgatgga

SEQ ID NO: 515107 - DNA, 20 bp, mouse
gcctagcctcatagcccatg

SEQ ID NO: 515108 - DNA, 20 bp, mouse
ggtgtccaggaactgtccca

SEQ ID NO: 515109 - DNA, 20 bp, mouse
gagggtggtgagtgtactga

SEQ ID NO: 515110 - DNA, 20 bp, mouse
gggtgtccaccctggacctc

SEQ ID NO: 515111 - DNA, 20 bp, mouse
gcatagggcatagtgcttag

SEQ ID NO: 515112 - DNA, 20 bp, mouse
ggggcaggtggtcttgcata

SEQ ID NO: 515113 - DNA, 20 bp, mouse
gttctgcctcatgggctatg

SEQ ID NO: 515114 - DNA, 20 bp, mouse
gagggcatagtgcttagggg

SEQ ID NO: 515115 - DNA, 20 bp, mouse
gactaggctcatagagacaa

SEQ ID NO: 515116 - DNA, 20 bp, mouse
ggctacctgcacggggaggg

SEQ ID NO: 515117 - DNA, 20 bp, mouse
gctgcttagttagccacaga

SEQ ID NO: 515118 - DNA, 20 bp, mouse
gcgctgcagcctgggttctc

SEQ ID NO: 515119 - DNA, 20 bp, mouse
gctggctcccctacactgac

SEQ ID NO: 515120 - DNA, 20 bp, mouse
gcaggctggaatatcatcga

SEQ ID NO: 515121 - DNA, 20 bp, mouse
ggagacaaggaggactctca

SEQ ID NO: 515122 - DNA, 20 bp, mouse
gaactaagcagccagcagcc

SEQ ID NO: 515123 - DNA, 20 bp, mouse
gccgcaggtcgcgagctgcc

SEQ ID NO: 515124 - DNA, 20 bp, mouse
gagcctgggacctggaccag

SEQ ID NO: 515125 - DNA, 20 bp, mouse
gagcggctacctgcacgggg

SEQ ID NO: 515126 - DNA, 20 bp, mouse
gagccgcgcggcaaggaagg

SEQ ID NO: 515127 - DNA, 20 bp, mouse
gcgcgcggcaaggaaggcgg

SEQ ID NO: 515128 - DNA, 20 bp, mouse
gcagagccgcgcggcaagga

SEQ ID NO: 515129 - DNA, 20 bp, mouse
ggcgccgggaacagacgctc

SEQ ID NO: 515130 - DNA, 20 bp, mouse
gtgagcgcgggacgagacgg

SEQ ID NO: 515131 - DNA, 20 bp, mouse
ggaggcaggagccctgcgtg

SEQ ID NO: 515132 - DNA, 20 bp, mouse
ggggcgcgcggtaagtgacg

SEQ ID NO: 515133 - DNA, 20 bp, mouse
ggcgcggaggcagagccgcg

SEQ ID NO: 515134 - DNA, 20 bp, mouse
ggaggcagagccgcgcggca

SEQ ID NO: 515135 - DNA, 20 bp, mouse
gggaggctgcacgtgtgcgg

SEQ ID NO: 515136 - DNA, 20 bp, mouse
ggacacttctggtgcagaca

SEQ ID NO: 515137 - DNA, 20 bp, mouse
gagaggaaaaccataaaggt

SEQ ID NO: 515138 - DNA, 20 bp, mouse
gggtgagtaaccaaccttta

SEQ ID NO: 515139 - DNA, 20 bp, mouse
gcaggcagagaaatgctctt

SEQ ID NO: 515140 - DNA, 20 bp, mouse
gaatgaatatccatatgaag

SEQ ID NO: 515141 - DNA, 20 bp, mouse
gctaaatgaactcaaggcag

SEQ ID NO: 515142 - DNA, 20 bp, mouse
gtgtcactattctcttgagt

SEQ ID NO: 515143 - DNA, 20 bp, mouse
gggccagccttcgacacatg

SEQ ID NO: 515144 - DNA, 20 bp, mouse
gccgagcaggaccttcagct

SEQ ID NO: 515145 - DNA, 20 bp, mouse
gaatatctgcaaatatctgt

SEQ ID NO: 515146 - DNA, 20 bp, mouse
gcgcctgccacaatgcacgg

SEQ ID NO: 515147 - DNA, 20 bp, mouse
ggtcgagcggaggcgacgtt

SEQ ID NO: 515148 - DNA, 20 bp, mouse
ggcacgacccctgcaagttg

SEQ ID NO: 515149 - DNA, 20 bp, mouse
gtcttagggacgtcgagcgg

SEQ ID NO: 515150 - DNA, 20 bp, mouse
gctgcgaccacaacttgcag

SEQ ID NO: 515151 - DNA, 20 bp, mouse
gcgcctggccgggcactgga

SEQ ID NO: 515152 - DNA, 20 bp, mouse
gatggacacgaggcactcgg

SEQ ID NO: 515153 - DNA, 20 bp, mouse
ggcgcgggtgacggcagaag

SEQ ID NO: 515154 - DNA, 20 bp, mouse
gccagcccagccggagaaga

SEQ ID NO: 515155 - DNA, 20 bp, mouse
gctctcgcaggagtcgtcag

SEQ ID NO: 515156 - DNA, 20 bp, mouse
gcgcgggccggagagtcccc

SEQ ID NO: 515157 - DNA, 20 bp, mouse
gctggctccaagcggcggga

SEQ ID NO: 515158 - DNA, 20 bp, mouse
ggacgctcccggggactctc

SEQ ID NO: 515159 - DNA, 20 bp, mouse
gctcgtctggctccaagcgg

SEQ ID NO: 515160 - DNA, 20 bp, mouse
gggcgggacggacgctcccg

SEQ ID NO: 515161 - DNA, 20 bp, mouse
gcccgaaggcgcgagcgcag

SEQ ID NO: 515162 - DNA, 20 bp, mouse
gaggctcagagcccccagta

SEQ ID NO: 515163 - DNA, 20 bp, mouse
gtagtccaggcaagccacgg

SEQ ID NO: 515164 - DNA, 20 bp, mouse
gggcgcgcaacggaccccga

SEQ ID NO: 515165 - DNA, 20 bp, mouse
gtagggctggagcaccaggt

SEQ ID NO: 515166 - DNA, 20 bp, mouse
ggctcggccgcagggagtgc

SEQ ID NO: 515167 - DNA, 20 bp, mouse
gccgcagcccgcactccctg

SEQ ID NO: 515168 - DNA, 20 bp, mouse
gggcgacgcggagtccaggt

SEQ ID NO: 515169 - DNA, 20 bp, mouse
gctggacgcgcggccgcata

SEQ ID NO: 515170 - DNA, 20 bp, mouse
gtgcggcccggctccgtatg

SEQ ID NO: 515171 - DNA, 20 bp, mouse
ggacggcccgtgatccccaa

SEQ ID NO: 515172 - DNA, 20 bp, mouse
ggagcggcgagcgcccagct

SEQ ID NO: 515173 - DNA, 20 bp, mouse
gaggcccggcgcgctcacgg

SEQ ID NO: 515174 - DNA, 20 bp, mouse
ggccaggagcgctggacgcg

SEQ ID NO: 515175 - DNA, 20 bp, mouse
gccccaagggaggacccacg

SEQ ID NO: 515176 - DNA, 20 bp, mouse
gggcgggagagaagcggagg

SEQ ID NO: 515177 - DNA, 20 bp, mouse
ggctgctagagtgcgggagg

SEQ ID NO: 515178 - DNA, 20 bp, mouse
gggcagcggctgctagagtg

SEQ ID NO: 515179 - DNA, 20 bp, mouse
ggcggctgctagagtgcggg

SEQ ID NO: 515180 - DNA, 20 bp, mouse
gggacgcggagacacggaat

SEQ ID NO: 515181 - DNA, 20 bp, mouse
gggaggtgacgatccgggaa

SEQ ID NO: 515182 - DNA, 20 bp, mouse
ggacatgccgggcaaggacg

SEQ ID NO: 515183 - DNA, 20 bp, mouse
ggtggcgcgcacatccagac

SEQ ID NO: 515184 - DNA, 20 bp, mouse
gggagacacggaatcggcgg

SEQ ID NO: 515185 - DNA, 20 bp, mouse
gacgccgccggggacccctg

SEQ ID NO: 515186 - DNA, 20 bp, mouse
gcaacacctgcgccacccta

SEQ ID NO: 515187 - DNA, 20 bp, mouse
gggcatggagcaggacaata

SEQ ID NO: 515188 - DNA, 20 bp, mouse
ggctatgcaccagcctccca

SEQ ID NO: 515189 - DNA, 20 bp, mouse
gtggaccaaagactcaccat

SEQ ID NO: 515190 - DNA, 20 bp, mouse
gcacctgcgccaccctaggg

SEQ ID NO: 515191 - DNA, 20 bp, mouse
ggagagagggcacagcccaa

SEQ ID NO: 515192 - DNA, 20 bp, mouse
ggtctcagccggcatggagc

SEQ ID NO: 515193 - DNA, 20 bp, mouse
gtctttggtccaccctaggg

SEQ ID NO: 515194 - DNA, 20 bp, mouse
gacttgggtctcagccggca

SEQ ID NO: 515195 - DNA, 20 bp, mouse
gcgcaggtgttggtgaagaa

SEQ ID NO: 515196 - DNA, 20 bp, mouse
ggggctggcgaaagtggcaa

SEQ ID NO: 515197 - DNA, 20 bp, mouse
gctggaggccgcgctcgcac

SEQ ID NO: 515198 - DNA, 20 bp, mouse
gtggcaaaggacggcaagat

SEQ ID NO: 515199 - DNA, 20 bp, mouse
gcgcggcctccaggaggtga

SEQ ID NO: 515200 - DNA, 20 bp, mouse
gcgctgccctcacctcctgg

SEQ ID NO: 515201 - DNA, 20 bp, mouse
gtcgcacgggctggcgaaag

SEQ ID NO: 515202 - DNA, 20 bp, mouse
ggcgcctataaggcctgggt

SEQ ID NO: 515203 - DNA, 20 bp, mouse
gggcttgaggagcgcagtcc

SEQ ID NO: 515204 - DNA, 20 bp, mouse
gcagggtgctgaccgcctca

SEQ ID NO: 515205 - DNA, 20 bp, mouse
ggaagtctaactccctgagg

SEQ ID NO: 515206 - DNA, 20 bp, mouse
ggctccttggcaccaactct

SEQ ID NO: 515207 - DNA, 20 bp, mouse
gtcatgtgactgcccagagt

SEQ ID NO: 515208 - DNA, 20 bp, mouse
ggggaggctcgcagagcgag

SEQ ID NO: 515209 - DNA, 20 bp, mouse
ggttggtgccaaggagccag

SEQ ID NO: 515210 - DNA, 20 bp, mouse
gcgctctgcgagcctccccg

SEQ ID NO: 515211 - DNA, 20 bp, mouse
ggggctggcggggtaagtag

SEQ ID NO: 515212 - DNA, 20 bp, mouse
ggcgcaggacggcaaggtga

SEQ ID NO: 515213 - DNA, 20 bp, mouse
gctgggcagtcacatgacgc

SEQ ID NO: 515214 - DNA, 20 bp, mouse
gctgcccagagttggtgcca

SEQ ID NO: 515215 - DNA, 20 bp, mouse
gcgcagcggccaagaaaccc

SEQ ID NO: 515216 - DNA, 20 bp, mouse
gggcgcgcggggagcagagg

SEQ ID NO: 515217 - DNA, 20 bp, mouse
gggcggggaggggcactcgg

SEQ ID NO: 515218 - DNA, 20 bp, mouse
ggcggccgccggcagttccc

SEQ ID NO: 515219 - DNA, 20 bp, mouse
ggcgccgccgacagccacag

SEQ ID NO: 515220 - DNA, 20 bp, mouse
gcggcgccgccaggtgagaa

SEQ ID NO: 515221 - DNA, 20 bp, mouse
gcaggtgagaatggccgcgg

SEQ ID NO: 515222 - DNA, 20 bp, mouse
gctcttggccggggaactgc

SEQ ID NO: 515223 - DNA, 20 bp, mouse
ggcgctcgctctcttggccg

SEQ ID NO: 515224 - DNA, 20 bp, mouse
gcgcggggtgcggagtcctg

SEQ ID NO: 515225 - DNA, 20 bp, mouse
gcgcggaactgcgagctggg

SEQ ID NO: 515226 - DNA, 20 bp, mouse
gggcaggtacgcgctctctt

SEQ ID NO: 515227 - DNA, 20 bp, mouse
gcgctctcttaggttgctgg

SEQ ID NO: 515228 - DNA, 20 bp, mouse
gaggttgctggtggagcttg

SEQ ID NO: 515229 - DNA, 20 bp, mouse
gcgctcgctcaccctctcgc

SEQ ID NO: 515230 - DNA, 20 bp, mouse
gcgtcaccgccgaggtcctc

SEQ ID NO: 515231 - DNA, 20 bp, mouse
gggagcgggttccggcgaga

SEQ ID NO: 515232 - DNA, 20 bp, mouse
gcgctcgggctggcacggga

SEQ ID NO: 515233 - DNA, 20 bp, mouse
ggtgtcagtagtcgcggggc

SEQ ID NO: 515234 - DNA, 20 bp, mouse
gcgtcaagtgtcagtagtcg

SEQ ID NO: 515235 - DNA, 20 bp, mouse
gccggagttgggtgaaatag

SEQ ID NO: 515236 - DNA, 20 bp, mouse
gctgcgggagggtccggacc

SEQ ID NO: 515237 - DNA, 20 bp, mouse
gtgcgggctgcgggagggtc

SEQ ID NO: 515238 - DNA, 20 bp, mouse
gctgtttgcaaatattgcgt

SEQ ID NO: 515239 - DNA, 20 bp, mouse
gtgcaatcggacgccgggtc

SEQ ID NO: 515240 - DNA, 20 bp, mouse
gttgggagcacatccatgtc

SEQ ID NO: 515241 - DNA, 20 bp, mouse
gcctggaagatgctacacat

SEQ ID NO: 515242 - DNA, 20 bp, mouse
gggcagcggagctttgaata

SEQ ID NO: 515243 - DNA, 20 bp, mouse
ggccgtccctggaggaatat

SEQ ID NO: 515244 - DNA, 20 bp, mouse
gcgctgtcgggaaaacaggg

SEQ ID NO: 515245 - DNA, 20 bp, mouse
ggagcacatccatgtcgggt

SEQ ID NO: 515246 - DNA, 20 bp, mouse
gacagcgctgcagatataga

SEQ ID NO: 515247 - DNA, 20 bp, mouse
gtccagcgcgtggatcagga

SEQ ID NO: 515248 - DNA, 20 bp, mouse
ggagaggaagtgcctcacaa

SEQ ID NO: 515249 - DNA, 20 bp, mouse
gaagtcactgaggaccaatg

SEQ ID NO: 515250 - DNA, 20 bp, mouse
gtccgcagcgcgccaatcgg

SEQ ID NO: 515251 - DNA, 20 bp, mouse
ggagtaacaattcccttcca

SEQ ID NO: 515252 - DNA, 20 bp, mouse
gagcagcagcatggacgtgt

SEQ ID NO: 515253 - DNA, 20 bp, mouse
gtggggaagaagggtagcaa

SEQ ID NO: 515254 - DNA, 20 bp, mouse
ggcactcggagaggaccatg

SEQ ID NO: 515255 - DNA, 20 bp, mouse
gggagcagccggtagagcgg

SEQ ID NO: 515256 - DNA, 20 bp, mouse
gggacgctcgtgcgaatgag

SEQ ID NO: 515257 - DNA, 20 bp, mouse
gagttagccggtggcgggag

SEQ ID NO: 515258 - DNA, 20 bp, mouse
gtccttgcagcccctgccag

SEQ ID NO: 515259 - DNA, 20 bp, mouse
gtcgggccagaggtagggag

SEQ ID NO: 515260 - DNA, 20 bp, mouse
ggcgagacagaagggtataa

SEQ ID NO: 515261 - DNA, 20 bp, mouse
gatcttaaggcgagacagaa

SEQ ID NO: 515262 - DNA, 20 bp, mouse
gcagcttcgggccagaggta

SEQ ID NO: 515263 - DNA, 20 bp, mouse
gaatccttaacgctgggcga

SEQ ID NO: 515264 - DNA, 20 bp, mouse
gccaggggcagcgcacgcac

SEQ ID NO: 515265 - DNA, 20 bp, mouse
gcagctgggagaaaccaaaa

SEQ ID NO: 515266 - DNA, 20 bp, mouse
gcgcggcgcggcaggaccag

SEQ ID NO: 515267 - DNA, 20 bp, mouse
ggcgggaagaagtgtctcgt

SEQ ID NO: 515268 - DNA, 20 bp, mouse
ggagctggagaatgccggag

SEQ ID NO: 515269 - DNA, 20 bp, mouse
gctgccgcgccgcgcctctc

SEQ ID NO: 515270 - DNA, 20 bp, mouse
gggagagatgccacacgtgg

SEQ ID NO: 515271 - DNA, 20 bp, mouse
gttactgagctggagaatgc

SEQ ID NO: 515272 - DNA, 20 bp, mouse
gctcggagagatgccacacg

SEQ ID NO: 515273 - DNA, 20 bp, mouse
gccgagtacgcggacgaggg

SEQ ID NO: 515274 - DNA, 20 bp, mouse
gaggagggcgcgcccatcgt

SEQ ID NO: 515275 - DNA, 20 bp, mouse
gttcttcccgcgtccgccga

SEQ ID NO: 515276 - DNA, 20 bp, mouse
ggagctggctgggccccgga

SEQ ID NO: 515277 - DNA, 20 bp, mouse
gcggccacgcagaacgcctg

SEQ ID NO: 515278 - DNA, 20 bp, mouse
gcgccgagctggctgggccc

SEQ ID NO: 515279 - DNA, 20 bp, mouse
gctgggccccggagggcgga

SEQ ID NO: 515280 - DNA, 20 bp, mouse
gacgcgaggagggtccagat

SEQ ID NO: 515281 - DNA, 20 bp, mouse
gggcgacgcagcactcccac

SEQ ID NO: 515282 - DNA, 20 bp, mouse
gggccccggagggcggatgg

SEQ ID NO: 515283 - DNA, 20 bp, mouse
gttgggagcgggagcgatgt

SEQ ID NO: 515284 - DNA, 20 bp, mouse
ggcgtggccgaggagcgcag

SEQ ID NO: 515285 - DNA, 20 bp, mouse
gggtccgccatccgccctcc

SEQ ID NO: 515286 - DNA, 20 bp, mouse
gggctcggctcgcgctgccg

SEQ ID NO: 515287 - DNA, 20 bp, mouse
ggcaggggcttgccgggacc

SEQ ID NO: 515288 - DNA, 20 bp, mouse
ggctgccggcgagaaggtgg

SEQ ID NO: 515289 - DNA, 20 bp, mouse
gtcccgagagctgcacgaat

SEQ ID NO: 515290 - DNA, 20 bp, mouse
gcgggtctcttgaggagccc

SEQ ID NO: 515291 - DNA, 20 bp, mouse
ggtggcgttgaggtcaggag

SEQ ID NO: 515292 - DNA, 20 bp, mouse
gaccccggcccccgtctccc

SEQ ID NO: 515293 - DNA, 20 bp, mouse
ggccgcacctgccaggtgag

SEQ ID NO: 515294 - DNA, 20 bp, mouse
gctgtgtcgacagctcgggg

SEQ ID NO: 515295 - DNA, 20 bp, mouse
gcagccctgggcagccgaca

SEQ ID NO: 515296 - DNA, 20 bp, mouse
gccccgcagacgggagacaa

SEQ ID NO: 515297 - DNA, 20 bp, mouse
gagcgggagagcggccgacg

SEQ ID NO: 515298 - DNA, 20 bp, mouse
ggccgggtcctggctcagag

SEQ ID NO: 515299 - DNA, 20 bp, mouse
gctggggcgcgcgccgacag

SEQ ID NO: 515300 - DNA, 20 bp, mouse
gggcggctacaaggtcagta

SEQ ID NO: 515301 - DNA, 20 bp, mouse
ggccccagcgctcgtcccgg

SEQ ID NO: 515302 - DNA, 20 bp, mouse
gggcataaacaaggccccgg

SEQ ID NO: 515303 - DNA, 20 bp, mouse
gcggaggcgtagcgcaggac

SEQ ID NO: 515304 - DNA, 20 bp, mouse
gggcgtagcgcaggacaggc

SEQ ID NO: 515305 - DNA, 20 bp, mouse
gaaggtcagtagggcggagt

SEQ ID NO: 515306 - DNA, 20 bp, mouse
gtggggaccgaggaatcggt

SEQ ID NO: 515307 - DNA, 20 bp, mouse
gccgccggaaggacgaagtc

SEQ ID NO: 515308 - DNA, 20 bp, mouse
gtcgttggggaccgaggaat

SEQ ID NO: 515309 - DNA, 20 bp, mouse
gctggcagcgcgaggacccg

SEQ ID NO: 515310 - DNA, 20 bp, mouse
gggcagtgtttatctcgttg

SEQ ID NO: 515311 - DNA, 20 bp, mouse
ggaccgaggaatcggttggc

SEQ ID NO: 515312 - DNA, 20 bp, mouse
gcgtcccgctgcccgccgga

SEQ ID NO: 515313 - DNA, 20 bp, mouse
gtgcccgccaaccgattcct

SEQ ID NO: 515314 - DNA, 20 bp, mouse
ggagacgggtgggagagacc

SEQ ID NO: 515315 - DNA, 20 bp, mouse
gaccccagggccgaaagatg

SEQ ID NO: 515316 - DNA, 20 bp, mouse
ggcgcccgggagacaaccgg

SEQ ID NO: 515317 - DNA, 20 bp, mouse
ggcggcgcccgggagacaac

SEQ ID NO: 515318 - DNA, 20 bp, mouse
gcgagagaggagaggcccgg

SEQ ID NO: 515319 - DNA, 20 bp, mouse
gtcggcgcgatgggcaagaa

SEQ ID NO: 515320 - DNA, 20 bp, mouse
gcatcgcgccgattcggaag

SEQ ID NO: 515321 - DNA, 20 bp, mouse
gctgccgggccggaaacgag

SEQ ID NO: 515322 - DNA, 20 bp, mouse
gcgattcggaagcggcgccc

SEQ ID NO: 515323 - DNA, 20 bp, mouse
gctgcaaagggacccgagag

SEQ ID NO: 515324 - DNA, 20 bp, mouse
gagaaggagaagaagggccg

SEQ ID NO: 515325 - DNA, 20 bp, mouse
gcgatcgcgggcgggagacc

SEQ ID NO: 515326 - DNA, 20 bp, mouse
gcccttggcagggtccccgg

SEQ ID NO: 515327 - DNA, 20 bp, mouse
gcttccaggaggctccaccg

SEQ ID NO: 515328 - DNA, 20 bp, mouse
gggacaacttgccttccagg

SEQ ID NO: 515329 - DNA, 20 bp, mouse
gtggaaggcaagttgtccca

SEQ ID NO: 515330 - DNA, 20 bp, mouse
gaaggctctgatgaaagtca

SEQ ID NO: 515331 - DNA, 20 bp, mouse
gcctggccaccacagggagg

SEQ ID NO: 515332 - DNA, 20 bp, mouse
ggtctgcctgaggagctcgt

SEQ ID NO: 515333 - DNA, 20 bp, mouse
gcgtcttcgaccccttggca

SEQ ID NO: 515334 - DNA, 20 bp, mouse
ggtccagacctgccccagtc

SEQ ID NO: 515335 - DNA, 20 bp, mouse
gacgcaggaaggccagcaag

SEQ ID NO: 515336 - DNA, 20 bp, mouse
gagaatacggaatctaatgt

SEQ ID NO: 515337 - DNA, 20 bp, mouse
gggttcagagagcctagctg

SEQ ID NO: 515338 - DNA, 20 bp, mouse
ggcccaaggtagtgccccaa

SEQ ID NO: 515339 - DNA, 20 bp, mouse
gccacaggctctgcagccgg

SEQ ID NO: 515340 - DNA, 20 bp, mouse
gttctggggagctcttggag

SEQ ID NO: 515341 - DNA, 20 bp, mouse
gaagatggcgccttcagagg

SEQ ID NO: 515342 - DNA, 20 bp, mouse
gttgtcctggaggctgaaga

SEQ ID NO: 515343 - DNA, 20 bp, mouse
gtggggcaatttaattacta

SEQ ID NO: 515344 - DNA, 20 bp, mouse
gaagtaggcggtacaggacc

SEQ ID NO: 515345 - DNA, 20 bp, mouse
gctgaagatggcgccttcag

SEQ ID NO: 515346 - DNA, 20 bp, mouse
ggggcgaccagggcgagcga

SEQ ID NO: 515347 - DNA, 20 bp, mouse
gcgtcagccccgggcgacca

SEQ ID NO: 515348 - DNA, 20 bp, mouse
gaccagggcgagcgagggca

SEQ ID NO: 515349 - DNA, 20 bp, mouse
gagggcctgcagtgtctaca

SEQ ID NO: 515350 - DNA, 20 bp, mouse
gagccgggtgcccagatgac

SEQ ID NO: 515351 - DNA, 20 bp, mouse
gcctgcagtgtctacagggt

SEQ ID NO: 515352 - DNA, 20 bp, mouse
ggccctgccctcgctcgccc

SEQ ID NO: 515353 - DNA, 20 bp, mouse
gcgtcacccgcgcaggagag

SEQ ID NO: 515354 - DNA, 20 bp, mouse
gctacagggtcggagacagc

SEQ ID NO: 515355 - DNA, 20 bp, mouse
gcaggagcccacgcgccccg

SEQ ID NO: 515356 - DNA, 20 bp, mouse
gccctagccggagccagcgg

SEQ ID NO: 515357 - DNA, 20 bp, mouse
gtagccggagccagcggagg

SEQ ID NO: 515358 - DNA, 20 bp, mouse
gggaggcggaggcggaacag

SEQ ID NO: 515359 - DNA, 20 bp, mouse
gtggatctcaaatgtcgcca

SEQ ID NO: 515360 - DNA, 20 bp, mouse
gagtagggcgcaccgaccca

SEQ ID NO: 515361 - DNA, 20 bp, mouse
gtccggctagggctgaagct

SEQ ID NO: 515362 - DNA, 20 bp, mouse
gtctgggtacaatcagccag

SEQ ID NO: 515363 - DNA, 20 bp, mouse
gtaaatcccgggactgagag

SEQ ID NO: 515364 - DNA, 20 bp, mouse
gaacagcggaccccgtgccc

SEQ ID NO: 515365 - DNA, 20 bp, mouse
ggcccagcttcagccctagc

SEQ ID NO: 515366 - DNA, 20 bp, mouse
ggcgacggcggtggagagaa

SEQ ID NO: 515367 - DNA, 20 bp, mouse
gacctgtgctgttattggag

SEQ ID NO: 515368 - DNA, 20 bp, mouse
gtcccctccaataacagcac

SEQ ID NO: 515369 - DNA, 20 bp, mouse
gtggagagaaggggtggttt

SEQ ID NO: 515370 - DNA, 20 bp, mouse
gagtgctgggcccttcgtga

SEQ ID NO: 515371 - DNA, 20 bp, mouse
gaggctcaacctggacctgg

SEQ ID NO: 515372 - DNA, 20 bp, mouse
gtgcagtggttgctgggcga

SEQ ID NO: 515373 - DNA, 20 bp, mouse
gggtcgcactccttcacgaa

SEQ ID NO: 515374 - DNA, 20 bp, mouse
gggttgctgggcgacggcgg

SEQ ID NO: 515375 - DNA, 20 bp, mouse
gtgagaggcgagtgcaggtg

SEQ ID NO: 515376 - DNA, 20 bp, mouse
gggaccttgacagctttcct

SEQ ID NO: 515377 - DNA, 20 bp, mouse
gacccccccggaggaaagag

SEQ ID NO: 515378 - DNA, 20 bp, mouse
gagtgcaccccccaaccctt

SEQ ID NO: 515379 - DNA, 20 bp, mouse
gctctcctcagctccagagg

SEQ ID NO: 515380 - DNA, 20 bp, mouse
ggacccgcctaagggttggg

SEQ ID NO: 515381 - DNA, 20 bp, mouse
gtctcaccaggagaccacac

SEQ ID NO: 515382 - DNA, 20 bp, mouse
ggccaaagaaaagcccgccc

SEQ ID NO: 515383 - DNA, 20 bp, mouse
gggtgcacagacccgcctaa

SEQ ID NO: 515384 - DNA, 20 bp, mouse
gtcctgggcgggcttttctt

SEQ ID NO: 515385 - DNA, 20 bp, mouse
gcacagacccgcctaagggt

SEQ ID NO: 515386 - DNA, 20 bp, mouse
ggagagaggctgctctcctg

SEQ ID NO: 515387 - DNA, 20 bp, mouse
gggagcgacagctggctaaa

SEQ ID NO: 515388 - DNA, 20 bp, mouse
ggcccaagttccagaatcct

SEQ ID NO: 515389 - DNA, 20 bp, mouse
gctgctctcctggggtgttg

SEQ ID NO: 515390 - DNA, 20 bp, mouse
gacgtggtcatcaaagtcaa

SEQ ID NO: 515391 - DNA, 20 bp, mouse
gtgaggctggtggaaccggg

SEQ ID NO: 515392 - DNA, 20 bp, mouse
gagggaaaaggagcgacagc

SEQ ID NO: 515393 - DNA, 20 bp, mouse
ggccgtgtctcccatcactg

SEQ ID NO: 515394 - DNA, 20 bp, mouse
gcctccggtgtacctaaagt

SEQ ID NO: 515395 - DNA, 20 bp, mouse
gccctggtcccaaggagcca

SEQ ID NO: 515396 - DNA, 20 bp, mouse
gtacggcggcgtcaagatgg

SEQ ID NO: 515397 - DNA, 20 bp, mouse
ggaagctgagggggccggta

SEQ ID NO: 515398 - DNA, 20 bp, mouse
gcggtacggcggcgtcaaga

SEQ ID NO: 515399 - DNA, 20 bp, mouse
gcaccgttcggaagctgagg

SEQ ID NO: 515400 - DNA, 20 bp, mouse
gaagggcgtgaagtactcgg

SEQ ID NO: 515401 - DNA, 20 bp, mouse
ggctgagggggccggtacgg

SEQ ID NO: 515402 - DNA, 20 bp, mouse
gccgcaccgttcggaagctg

SEQ ID NO: 515403 - DNA, 20 bp, mouse
gccgctgaggtccgaggcag

SEQ ID NO: 515404 - DNA, 20 bp, mouse
gaggctcgcggaaccggcga

SEQ ID NO: 515405 - DNA, 20 bp, mouse
gctcccgcccgtgtcgacga

SEQ ID NO: 515406 - DNA, 20 bp, mouse
gcacggagactgctccgcag

SEQ ID NO: 515407 - DNA, 20 bp, mouse
gcggctggtccgggcggcag

SEQ ID NO: 515408 - DNA, 20 bp, mouse
gccgcccggaccagccgctg

SEQ ID NO: 515409 - DNA, 20 bp, mouse
ggctccgcagcggctggtcc

SEQ ID NO: 515410 - DNA, 20 bp, mouse
gggtcgccgtactccgagac

SEQ ID NO: 515411 - DNA, 20 bp, mouse
gtccctctgccctcagccgg

SEQ ID NO: 515412 - DNA, 20 bp, mouse
gccgggagaaggtttaacct

SEQ ID NO: 515413 - DNA, 20 bp, mouse
gccgtggtaaactccagtct

SEQ ID NO: 515414 - DNA, 20 bp, mouse
ggagactgctccgcagcggc

SEQ ID NO: 515415 - DNA, 20 bp, mouse
gcgctactgcctaccttcgg

SEQ ID NO: 515416 - DNA, 20 bp, mouse
gcaacactttcctaacgagg

SEQ ID NO: 515417 - DNA, 20 bp, mouse
ggtgtcagtacactgtggaa

SEQ ID NO: 515418 - DNA, 20 bp, mouse
gctgccgtgtggcaaactgt

SEQ ID NO: 515419 - DNA, 20 bp, mouse
gcaatggcatgttgtcacca

SEQ ID NO: 515420 - DNA, 20 bp, mouse
gctgctgtgtcagtacactg

SEQ ID NO: 515421 - DNA, 20 bp, mouse
ggcactattgttgagttgga

SEQ ID NO: 515422 - DNA, 20 bp, mouse
gggtggcactattgttgagt

SEQ ID NO: 515423 - DNA, 20 bp, mouse
gacaatagtgccacctcgtt

SEQ ID NO: 515424 - DNA, 20 bp, mouse
gggacaggacgatttaaagg

SEQ ID NO: 515425 - DNA, 20 bp, mouse
ggtggaatggaagtgttagt

SEQ ID NO: 515426 - DNA, 20 bp, mouse
gtcactgtggctggggtcga

SEQ ID NO: 515427 - DNA, 20 bp, mouse
gctgtggctggggtcgaagg

SEQ ID NO: 515428 - DNA, 20 bp, mouse
gctgtccccggatctggaca

SEQ ID NO: 515429 - DNA, 20 bp, mouse
gcggtctcaacctgctgtgg

SEQ ID NO: 515430 - DNA, 20 bp, mouse
gaaggtggaggtcctgtccc

SEQ ID NO: 515431 - DNA, 20 bp, mouse
gtccagggagagggtcacgt

SEQ ID NO: 515432 - DNA, 20 bp, mouse
gctcgccatgtccagatccg

SEQ ID NO: 515433 - DNA, 20 bp, mouse
gacagtgacaacctgctgca

SEQ ID NO: 515434 - DNA, 20 bp, mouse
ggcacggtctcaacctgctg

SEQ ID NO: 515435 - DNA, 20 bp, mouse
ggcaggttgtcactgtggct

SEQ ID NO: 515436 - DNA, 20 bp, mouse
gggacagctgagggggccga

SEQ ID NO: 515437 - DNA, 20 bp, mouse
gaactgggggacagctgagg

SEQ ID NO: 515438 - DNA, 20 bp, mouse
gggagacgccgtcgtgtatg

SEQ ID NO: 515439 - DNA, 20 bp, mouse
gcccggcgtgggtgatcccg

SEQ ID NO: 515440 - DNA, 20 bp, mouse
gccccccgagaaacagtcct

SEQ ID NO: 515441 - DNA, 20 bp, mouse
gaccaactgggggacagctg

SEQ ID NO: 515442 - DNA, 20 bp, mouse
gctgtccagcctctagtgga

SEQ ID NO: 515443 - DNA, 20 bp, mouse
ggaggctccgcgcgctttgg

SEQ ID NO: 515444 - DNA, 20 bp, mouse
ggtggcgagtccaaacagtt

SEQ ID NO: 515445 - DNA, 20 bp, mouse
ggcgactcaggaccaccaac

SEQ ID NO: 515446 - DNA, 20 bp, mouse
gaagccgcgaccctgatgga

SEQ ID NO: 515447 - DNA, 20 bp, mouse
gcgaccctgatggacggatt

SEQ ID NO: 515448 - DNA, 20 bp, mouse
gcgtcccaatccgtccatca

SEQ ID NO: 515449 - DNA, 20 bp, mouse
ggccaaagccgcgaccctga

SEQ ID NO: 515450 - DNA, 20 bp, mouse
gagcgcccgagtggagcgag

SEQ ID NO: 515451 - DNA, 20 bp, mouse
gctggagttatgcagccccg

SEQ ID NO: 515452 - DNA, 20 bp, mouse
gtagtgcccaggccactcat

SEQ ID NO: 515453 - DNA, 20 bp, mouse
gcgggcggcgccgagaaaca

SEQ ID NO: 515454 - DNA, 20 bp, mouse
gccggccgctcgctccactc

SEQ ID NO: 515455 - DNA, 20 bp, mouse
gcgacgggcgagcgcccgag

SEQ ID NO: 515456 - DNA, 20 bp, mouse
gcgactaggcaactccgaca

SEQ ID NO: 515457 - DNA, 20 bp, mouse
gaagatggtggaggacggcg

SEQ ID NO: 515458 - DNA, 20 bp, mouse
gggactgagcgggaagaaaa

SEQ ID NO: 515459 - DNA, 20 bp, mouse
ggagtggtccagccgactgt

SEQ ID NO: 515460 - DNA, 20 bp, mouse
gtgacgccgtagccgcgact

SEQ ID NO: 515461 - DNA, 20 bp, mouse
gcctgctcttagggcgtcag

SEQ ID NO: 515462 - DNA, 20 bp, mouse
gatggtggaggacggcgcgg

SEQ ID NO: 515463 - DNA, 20 bp, mouse
gtgcgcagttgcggcggccg

SEQ ID NO: 515464 - DNA, 20 bp, mouse
ggggtggagaaaggttagag

SEQ ID NO: 515465 - DNA, 20 bp, mouse
gttggtgcatttctccgtgt

SEQ ID NO: 515466 - DNA, 20 bp, mouse
gggccgggagaacccggaag

SEQ ID NO: 515467 - DNA, 20 bp, mouse
ggtcgccgcccggcactcgg

SEQ ID NO: 515468 - DNA, 20 bp, mouse
gcgctcccccgagtgccggg

SEQ ID NO: 515469 - DNA, 20 bp, mouse
gagcccgcgaggagccacaa

SEQ ID NO: 515470 - DNA, 20 bp, mouse
ggccagcaccataccagccg

SEQ ID NO: 515471 - DNA, 20 bp, mouse
gcgttccatccgccccgagg

SEQ ID NO: 515472 - DNA, 20 bp, mouse
gcgcgcggcggagggctgta

SEQ ID NO: 515473 - DNA, 20 bp, mouse
gccgcagcgcccgcccgtca

SEQ ID NO: 515474 - DNA, 20 bp, mouse
gagcgggcgagcgtgctgct

SEQ ID NO: 515475 - DNA, 20 bp, mouse
ggcgctgcgccccctcgggg

SEQ ID NO: 515476 - DNA, 20 bp, mouse
gctagcggctccagaggtgg

SEQ ID NO: 515477 - DNA, 20 bp, mouse
ggcgctagcggctccagagg

SEQ ID NO: 515478 - DNA, 20 bp, mouse
gcgctagcgcaggcaggatg

SEQ ID NO: 515479 - DNA, 20 bp, mouse
gcagtcgtgcctctaaggga

SEQ ID NO: 515480 - DNA, 20 bp, mouse
ggtgcctctaagggacggta

SEQ ID NO: 515481 - DNA, 20 bp, mouse
gccttagaggcacgactgac

SEQ ID NO: 515482 - DNA, 20 bp, mouse
ggaactgcccggcggggtca

SEQ ID NO: 515483 - DNA, 20 bp, mouse
ggaaccctaccgtcccttag

SEQ ID NO: 515484 - DNA, 20 bp, mouse
gcgcagcctggagccctgaa

SEQ ID NO: 515485 - DNA, 20 bp, mouse
gtctgggcgggtgcagggaa

SEQ ID NO: 515486 - DNA, 20 bp, mouse
gcgtgcgcgggatcggagaa

SEQ ID NO: 515487 - DNA, 20 bp, mouse
ggcagctccgcgtcatggag

SEQ ID NO: 515488 - DNA, 20 bp, mouse
gcgccggccgctccatgacg

SEQ ID NO: 515489 - DNA, 20 bp, mouse
gcttagggcgtgcgcgggat

SEQ ID NO: 515490 - DNA, 20 bp, mouse
ggcagcacagccaaaggcgc

SEQ ID NO: 515491 - DNA, 20 bp, mouse
gcgcggagctgcgggtcaca

SEQ ID NO: 515492 - DNA, 20 bp, mouse
ggacccgcagctccgcgtca

SEQ ID NO: 515493 - DNA, 20 bp, mouse
ggcgcggaagtagggactag

SEQ ID NO: 515494 - DNA, 20 bp, mouse
gctcggcgcgcagttgactg

SEQ ID NO: 515495 - DNA, 20 bp, mouse
gagctacaccggcagagtgg

SEQ ID NO: 515496 - DNA, 20 bp, mouse
gctggtgctgccgcaagctg

SEQ ID NO: 515497 - DNA, 20 bp, mouse
gctgcgaggcatgtaccgtg

SEQ ID NO: 515498 - DNA, 20 bp, mouse
gaaggcctgccgggcccgca

SEQ ID NO: 515499 - DNA, 20 bp, mouse
gcgctctcgcagcaggcggg

SEQ ID NO: 515500 - DNA, 20 bp, mouse
gggcatgtaccgtgcgggcc

SEQ ID NO: 515501 - DNA, 20 bp, mouse
gacatgcctcgcagctgacc

SEQ ID NO: 515502 - DNA, 20 bp, mouse
gcccgcgtgcagcacaagct

SEQ ID NO: 515503 - DNA, 20 bp, mouse
gctcggcgaagaaggcctgc

SEQ ID NO: 515504 - DNA, 20 bp, mouse
ggcccgcgccggacgcccgg

SEQ ID NO: 515505 - DNA, 20 bp, mouse
gggccgctctcgcagcaggc

SEQ ID NO: 515506 - DNA, 20 bp, mouse
gttcctgcgcgctctgctgg

SEQ ID NO: 515507 - DNA, 20 bp, mouse
gagagaagaaggcgaaacta

SEQ ID NO: 515508 - DNA, 20 bp, mouse
gcgcgcaggaaggagctttg

SEQ ID NO: 515509 - DNA, 20 bp, mouse
ggccggcaagaggacagaga

SEQ ID NO: 515510 - DNA, 20 bp, mouse
gagctacttgtggcatttga

SEQ ID NO: 515511 - DNA, 20 bp, mouse
gaaactacggtcttctatta

SEQ ID NO: 515512 - DNA, 20 bp, mouse
gggtcgcggcaaaccaggac

SEQ ID NO: 515513 - DNA, 20 bp, mouse
gtcctagcaggcagtgcgat

SEQ ID NO: 515514 - DNA, 20 bp, mouse
gtccccagccaacgccggag

SEQ ID NO: 515515 - DNA, 20 bp, mouse
ggcacgccaagggccagggc

SEQ ID NO: 515516 - DNA, 20 bp, mouse
gacgccggcgcagcagggac

SEQ ID NO: 515517 - DNA, 20 bp, mouse
gcggtggctcgaggagacgc

SEQ ID NO: 515518 - DNA, 20 bp, mouse
gcctgcgccgagaggtacca

SEQ ID NO: 515519 - DNA, 20 bp, mouse
gaggagacgccggcgcagca

SEQ ID NO: 515520 - DNA, 20 bp, mouse
gagagactggcggtggctcg

SEQ ID NO: 515521 - DNA, 20 bp, mouse
gcggccaccctggtacctct

SEQ ID NO: 515522 - DNA, 20 bp, mouse
ggtccgaggccgaaacactc

SEQ ID NO: 515523 - DNA, 20 bp, mouse
gggcctcgggcgtggggaca

SEQ ID NO: 515524 - DNA, 20 bp, mouse
gccagggtggccgctccaag

SEQ ID NO: 515525 - DNA, 20 bp, mouse
gcgaccgcggcgctgatccc

SEQ ID NO: 515526 - DNA, 20 bp, mouse
gtggcagcgcccgtgcggtt

SEQ ID NO: 515527 - DNA, 20 bp, mouse
gacgggatcgcggccgggac

SEQ ID NO: 515528 - DNA, 20 bp, mouse
gtcccgtagccgaaccgcac

SEQ ID NO: 515529 - DNA, 20 bp, mouse
gcctcaccgtgcggccccac

SEQ ID NO: 515530 - DNA, 20 bp, mouse
gcggttcggctacgggatcg

SEQ ID NO: 515531 - DNA, 20 bp, mouse
gcgcacggtgaggatcaggt

SEQ ID NO: 515532 - DNA, 20 bp, mouse
gcgcccgtgcggttcggcta

SEQ ID NO: 515533 - DNA, 20 bp, mouse
gcggctacgggatcgcggcc

SEQ ID NO: 515534 - DNA, 20 bp, mouse
ggccggagaaactagtttgt

SEQ ID NO: 515535 - DNA, 20 bp, mouse
ggaccgcaggcccagttcac

SEQ ID NO: 515536 - DNA, 20 bp, mouse
ggcgcgcccgagcgatgggg

SEQ ID NO: 515537 - DNA, 20 bp, mouse
gcggagtccggtggcagcag

SEQ ID NO: 515538 - DNA, 20 bp, mouse
ggccgcgcgcccgagcgatg

SEQ ID NO: 515539 - DNA, 20 bp, mouse
gggaagatggcggagtccgg

SEQ ID NO: 515540 - DNA, 20 bp, mouse
ggcgcgccgccccatcgctc

SEQ ID NO: 515541 - DNA, 20 bp, mouse
gtcgggcgcgcggcggaaga

SEQ ID NO: 515542 - DNA, 20 bp, mouse
gctagagccgctgctgccac

SEQ ID NO: 515543 - DNA, 20 bp, mouse
gggcggaagatggcggagtc

SEQ ID NO: 515544 - DNA, 20 bp, mouse
gagctatggcgtaggcctga

SEQ ID NO: 515545 - DNA, 20 bp, mouse
gaagtggtgcatgccaacag

SEQ ID NO: 515546 - DNA, 20 bp, mouse
gcaagagaggatcccatccc

SEQ ID NO: 515547 - DNA, 20 bp, mouse
gggtttgacgggagcaagag

SEQ ID NO: 515548 - DNA, 20 bp, mouse
gaggaggagccacggaaaac

SEQ ID NO: 515549 - DNA, 20 bp, mouse
gccacggaaaactggaaccc

SEQ ID NO: 515550 - DNA, 20 bp, mouse
gcataagagttgaggtttga

SEQ ID NO: 515551 - DNA, 20 bp, mouse
gaccccacccataagagttg

SEQ ID NO: 515552 - DNA, 20 bp, mouse
gagaatgcgaggcaaagaac

SEQ ID NO: 515553 - DNA, 20 bp, mouse
gccccaggagccagaatgcg

SEQ ID NO: 515554 - DNA, 20 bp, mouse
ggaataacacctgcagcaac

SEQ ID NO: 515555 - DNA, 20 bp, mouse
gaaacctcaactcttatggg

SEQ ID NO: 515556 - DNA, 20 bp, mouse
gagagctgctgctagatcgg

SEQ ID NO: 515557 - DNA, 20 bp, mouse
gaagcagacggtacccggag

SEQ ID NO: 515558 - DNA, 20 bp, mouse
ggctgctgctagatcggcgg

SEQ ID NO: 515559 - DNA, 20 bp, mouse
gcagcccagggaggatgccc

SEQ ID NO: 515560 - DNA, 20 bp, mouse
gcggagaggagcgagccaga

SEQ ID NO: 515561 - DNA, 20 bp, mouse
gggcgcggctctcatcgagg

SEQ ID NO: 515562 - DNA, 20 bp, mouse
ggttagagctgctgctagat

SEQ ID NO: 515563 - DNA, 20 bp, mouse
gcggggaccatgctcccttc

SEQ ID NO: 515564 - DNA, 20 bp, mouse
gggagagcaggaacgagagg

SEQ ID NO: 515565 - DNA, 20 bp, mouse
gggcggcgcggggattggcg

SEQ ID NO: 515566 - DNA, 20 bp, mouse
gcgctgtagtgcagcctagg

SEQ ID NO: 515567 - DNA, 20 bp, mouse
gctgcactacagcggatcag

SEQ ID NO: 515568 - DNA, 20 bp, mouse
gtggggtgggctagtcgcta

SEQ ID NO: 515569 - DNA, 20 bp, mouse
ggtagtgcagcctaggaggc

SEQ ID NO: 515570 - DNA, 20 bp, mouse
gaggagaagccagcctgcgg

SEQ ID NO: 515571 - DNA, 20 bp, mouse
gttctctgttagcgttagag

SEQ ID NO: 515572 - DNA, 20 bp, mouse
gggcggcggcggcgacccaa

SEQ ID NO: 515573 - DNA, 20 bp, mouse
gctgccgcgagtaagtcaag

SEQ ID NO: 515574 - DNA, 20 bp, mouse
gcctgccgggcctcccacaa

SEQ ID NO: 515575 - DNA, 20 bp, mouse
gtctcccagcagacccgtga

SEQ ID NO: 515576 - DNA, 20 bp, mouse
gtctcagcaaggagccctaa

SEQ ID NO: 515577 - DNA, 20 bp, mouse
ggctgagaccatagaccaaa

SEQ ID NO: 515578 - DNA, 20 bp, mouse
gctgttagtagactccctta

SEQ ID NO: 515579 - DNA, 20 bp, mouse
gggagttcagagtcttacca

SEQ ID NO: 515580 - DNA, 20 bp, mouse
gcaggacttaggctgaagtg

SEQ ID NO: 515581 - DNA, 20 bp, mouse
gctgccctgtagccccacgg

SEQ ID NO: 515582 - DNA, 20 bp, mouse
gagaccatagaccaaagggc

SEQ ID NO: 515583 - DNA, 20 bp, mouse
gctactaacaggtaagacca

SEQ ID NO: 515584 - DNA, 20 bp, mouse
gagtcctgccctttggtcta

SEQ ID NO: 515585 - DNA, 20 bp, mouse
ggaccaggggttctataagg

SEQ ID NO: 515586 - DNA, 20 bp, mouse
gtgagagcccgctggtaatg

SEQ ID NO: 515587 - DNA, 20 bp, mouse
gcctttggggaggtgatctg

SEQ ID NO: 515588 - DNA, 20 bp, mouse
gagcccgctggtaatgggga

SEQ ID NO: 515589 - DNA, 20 bp, mouse
gccagctggagataccctgt

SEQ ID NO: 515590 - DNA, 20 bp, mouse
gggctctcacttcacaccac

SEQ ID NO: 515591 - DNA, 20 bp, mouse
gacacaccctaggatccagt

SEQ ID NO: 515592 - DNA, 20 bp, mouse
gggatccagtcggcacgagt

SEQ ID NO: 515593 - DNA, 20 bp, mouse
ggccgcctgacaaaccctag

SEQ ID NO: 515594 - DNA, 20 bp, mouse
ggtgtgaagtgagagcccgc

SEQ ID NO: 515595 - DNA, 20 bp, mouse
gtcgtgccgactggatccta

SEQ ID NO: 515596 - DNA, 20 bp, mouse
ggcggagcggctgtgagggg

SEQ ID NO: 515597 - DNA, 20 bp, mouse
gctggagaccggctgctggg

SEQ ID NO: 515598 - DNA, 20 bp, mouse
gcactgctgcagcccgggca

SEQ ID NO: 515599 - DNA, 20 bp, mouse
gggagcgcgcaccggcagga

SEQ ID NO: 515600 - DNA, 20 bp, mouse
gagggcggagcggctgtgag

SEQ ID NO: 515601 - DNA, 20 bp, mouse
ggagagggaccgggatgtgt

SEQ ID NO: 515602 - DNA, 20 bp, mouse
ggctgctgggagggtagagc

SEQ ID NO: 515603 - DNA, 20 bp, mouse
ggcctcccaccctctcccat

SEQ ID NO: 515604 - DNA, 20 bp, mouse
gaggctggagaccggctgct

SEQ ID NO: 515605 - DNA, 20 bp, mouse
gcagtttccccagggtcgag

SEQ ID NO: 515606 - DNA, 20 bp, mouse
ggtgggatgagggagtccca

SEQ ID NO: 515607 - DNA, 20 bp, mouse
gtgactgaggaggtaatcgt

SEQ ID NO: 515608 - DNA, 20 bp, mouse
gacgaggagtctcaggtctt

SEQ ID NO: 515609 - DNA, 20 bp, mouse
ggccaggggcctcaatcata

SEQ ID NO: 515610 - DNA, 20 bp, mouse
gtctcgaacaactccagtgt

SEQ ID NO: 515611 - DNA, 20 bp, mouse
gtggggccatgcttctgagt

SEQ ID NO: 515612 - DNA, 20 bp, mouse
gaaaagaaacgaggagtctc

SEQ ID NO: 515613 - DNA, 20 bp, mouse
gagtgtaggcaaaagaaacg

SEQ ID NO: 515614 - DNA, 20 bp, mouse
gcaaagctaggcaaagggcg

SEQ ID NO: 515615 - DNA, 20 bp, mouse
gagcaggcaggtgactgagg

SEQ ID NO: 515616 - DNA, 20 bp, mouse
gtcctggggcacccacaata

SEQ ID NO: 515617 - DNA, 20 bp, mouse
gaggatggtggctctgatcg

SEQ ID NO: 515618 - DNA, 20 bp, mouse
ggtggatgtggccctattgt

SEQ ID NO: 515619 - DNA, 20 bp, mouse
gcatcacctggagaggtcga

SEQ ID NO: 515620 - DNA, 20 bp, mouse
gcggactgtgcgagtgtcta

SEQ ID NO: 515621 - DNA, 20 bp, mouse
gctccagaaggccagatgcg

SEQ ID NO: 515622 - DNA, 20 bp, mouse
ggtgggtgccccaggacagc

SEQ ID NO: 515623 - DNA, 20 bp, mouse
ggcccctggtgtgcaagtgt

SEQ ID NO: 515624 - DNA, 20 bp, mouse
gagggtactgaatctccaga

SEQ ID NO: 515625 - DNA, 20 bp, mouse
gagctggacagcggaggtgg

SEQ ID NO: 515626 - DNA, 20 bp, mouse
ggcaagcggcaggcacagac

SEQ ID NO: 515627 - DNA, 20 bp, mouse
gctgccagagaagcagtccc

SEQ ID NO: 515628 - DNA, 20 bp, mouse
gcctcagcctaggacagagg

SEQ ID NO: 515629 - DNA, 20 bp, mouse
gggcagagctggcaagcggc

SEQ ID NO: 515630 - DNA, 20 bp, mouse
gcctaggctgagggaactgt

SEQ ID NO: 515631 - DNA, 20 bp, mouse
gctcaggctgcaaggcaagc

SEQ ID NO: 515632 - DNA, 20 bp, mouse
gcggggtaagagcaggatag

SEQ ID NO: 515633 - DNA, 20 bp, mouse
gcctggccacgccctcttcc

SEQ ID NO: 515634 - DNA, 20 bp, mouse
gacaggctgagactctgaga

SEQ ID NO: 515635 - DNA, 20 bp, mouse
gtcccagacgatagactcca

SEQ ID NO: 515636 - DNA, 20 bp, mouse
ggaggcgagcgagaaggcgg

SEQ ID NO: 515637 - DNA, 20 bp, mouse
gagggaggcgagcgagaagg

SEQ ID NO: 515638 - DNA, 20 bp, mouse
gcgtcgcagcgccagactgt

SEQ ID NO: 515639 - DNA, 20 bp, mouse
gcggccgcagcgctcggcca

SEQ ID NO: 515640 - DNA, 20 bp, mouse
ggaaggcctggcgcagcacg

SEQ ID NO: 515641 - DNA, 20 bp, mouse
gctgcgcgccgccaacagtc

SEQ ID NO: 515642 - DNA, 20 bp, mouse
gagtaggcgggcgccagcag

SEQ ID NO: 515643 - DNA, 20 bp, mouse
gctgcgccaggccttcgtgg

SEQ ID NO: 515644 - DNA, 20 bp, mouse
gcaggcgcacgtgctccagg

SEQ ID NO: 515645 - DNA, 20 bp, mouse
gcctgcgcgcgcttcctcga

SEQ ID NO: 515646 - DNA, 20 bp, mouse
ggcacttccttgcagaggga

SEQ ID NO: 515647 - DNA, 20 bp, mouse
gaccagagcagcgcacactg

SEQ ID NO: 515648 - DNA, 20 bp, mouse
gggctcgcacttccttgcag

SEQ ID NO: 515649 - DNA, 20 bp, mouse
gagccagcacggagcccagg

SEQ ID NO: 515650 - DNA, 20 bp, mouse
gcgcacactgcggggctacc

SEQ ID NO: 515651 - DNA, 20 bp, mouse
ggagcctacactgtcaatgg

SEQ ID NO: 515652 - DNA, 20 bp, mouse
ggacatggtccgggagacta

SEQ ID NO: 515653 - DNA, 20 bp, mouse
ggggatggctgcgcttcggg

SEQ ID NO: 515654 - DNA, 20 bp, mouse
gtgcgagcctacactgtcaa

SEQ ID NO: 515655 - DNA, 20 bp, mouse
ggtgtgcgctgctctggtag

SEQ ID NO: 515656 - DNA, 20 bp, mouse
gctctgtcctcggagagttc

SEQ ID NO: 515657 - DNA, 20 bp, mouse
gcaccaaggctagaattcga

SEQ ID NO: 515658 - DNA, 20 bp, mouse
gagagaacttgccaacggaa

SEQ ID NO: 515659 - DNA, 20 bp, mouse
gtgtacaagggctgccgggc

SEQ ID NO: 515660 - DNA, 20 bp, mouse
ggctctgtacaagggctgcc

SEQ ID NO: 515661 - DNA, 20 bp, mouse
ggatctagatagaagactct

SEQ ID NO: 515662 - DNA, 20 bp, mouse
gagaagtgatggggtcacag

SEQ ID NO: 515663 - DNA, 20 bp, mouse
ggtttctagagctctgtaca

SEQ ID NO: 515664 - DNA, 20 bp, mouse
ggagggttagttgctcacca

SEQ ID NO: 515665 - DNA, 20 bp, mouse
gtctggtcacagaagtgatg

SEQ ID NO: 515666 - DNA, 20 bp, mouse
ggagaaacaagagataacaa

SEQ ID NO: 515667 - DNA, 20 bp, mouse
gaggttgaagaaccactcac

SEQ ID NO: 515668 - DNA, 20 bp, mouse
gtatgagcatagagggaccc

SEQ ID NO: 515669 - DNA, 20 bp, mouse
gatagagggaccccggtgca

SEQ ID NO: 515670 - DNA, 20 bp, mouse
gtactggcgtcagtatatcg

SEQ ID NO: 515671 - DNA, 20 bp, mouse
gtttgttagttctacacaag

SEQ ID NO: 515672 - DNA, 20 bp, mouse
gctcaaggatcgccgaacac

SEQ ID NO: 515673 - DNA, 20 bp, mouse
gttctgaaggactctttgat

SEQ ID NO: 515674 - DNA, 20 bp, mouse
gtggcgtcagtatatcgtgg

SEQ ID NO: 515675 - DNA, 20 bp, mouse
gggaaggatatgagcataga

SEQ ID NO: 515676 - DNA, 20 bp, mouse
gcagccccacaagacagcag

SEQ ID NO: 515677 - DNA, 20 bp, mouse
gcagcaagtctgtgtatcga

SEQ ID NO: 515678 - DNA, 20 bp, mouse
ggaagcgcgcgcggaagtag

SEQ ID NO: 515679 - DNA, 20 bp, mouse
gggagccgcaccatgacgct

SEQ ID NO: 515680 - DNA, 20 bp, mouse
gacacctctgctgtcttgtg

SEQ ID NO: 515681 - DNA, 20 bp, mouse
gtgctccaagcccagcgtca

SEQ ID NO: 515682 - DNA, 20 bp, mouse
ggtctggcgacacctcctcc

SEQ ID NO: 515683 - DNA, 20 bp, mouse
gcacgcgcactacacagtct

SEQ ID NO: 515684 - DNA, 20 bp, mouse
gtagcaccaggcggtggcac

SEQ ID NO: 515685 - DNA, 20 bp, mouse
gtcaaggacatgctggacca

SEQ ID NO: 515686 - DNA, 20 bp, mouse
ggctagacctgtgtgcaacc

SEQ ID NO: 515687 - DNA, 20 bp, mouse
gtccattctgtgaggaacct

SEQ ID NO: 515688 - DNA, 20 bp, mouse
gttcgctcctggttgcacac

SEQ ID NO: 515689 - DNA, 20 bp, mouse
gtcccagcgggagcttgcag

SEQ ID NO: 515690 - DNA, 20 bp, mouse
gagccgatagtatcagtctg

SEQ ID NO: 515691 - DNA, 20 bp, mouse
ggctgggaatccattctgtg

SEQ ID NO: 515692 - DNA, 20 bp, mouse
gacccaggttcctcacagaa

SEQ ID NO: 515693 - DNA, 20 bp, mouse
gcactgagggtcttcgctcc

SEQ ID NO: 515694 - DNA, 20 bp, mouse
gtcctctgcaagctcccgct

SEQ ID NO: 515695 - DNA, 20 bp, mouse
gaaaatactcacggaagtaa

SEQ ID NO: 515696 - DNA, 20 bp, mouse
gcgcagcggcccagccatgt

SEQ ID NO: 515697 - DNA, 20 bp, mouse
gaggagcctgagcggccgag

SEQ ID NO: 515698 - DNA, 20 bp, mouse
ggccatgtcggccgaggaga

SEQ ID NO: 515699 - DNA, 20 bp, mouse
gaccatctcctcggccgaca

SEQ ID NO: 515700 - DNA, 20 bp, mouse
ggtagcagcggtcttccagg

SEQ ID NO: 515701 - DNA, 20 bp, mouse
gcttgctcaccgggtagcag

SEQ ID NO: 515702 - DNA, 20 bp, mouse
ggagatggtgcagatccgcc

SEQ ID NO: 515703 - DNA, 20 bp, mouse
ggcggaggctgtgcgcccgg

SEQ ID NO: 515704 - DNA, 20 bp, mouse
gcctgagcggccgagcggcg

SEQ ID NO: 515705 - DNA, 20 bp, mouse
gggcccagccatgtcggccg

SEQ ID NO: 515706 - DNA, 20 bp, mouse
gtgcccgcccgccccctcag

SEQ ID NO: 515707 - DNA, 20 bp, mouse
gcgcgcgcgggagtgagtgg

SEQ ID NO: 515708 - DNA, 20 bp, mouse
gttgtcccgcagcccctgag

SEQ ID NO: 515709 - DNA, 20 bp, mouse
gcggccgcgccgggactaac

SEQ ID NO: 515710 - DNA, 20 bp, mouse
gccgggccggctcctaaggt

SEQ ID NO: 515711 - DNA, 20 bp, mouse
gcccgcgcagcggccctccc

SEQ ID NO: 515712 - DNA, 20 bp, mouse
gggagtggctcggcccggga

SEQ ID NO: 515713 - DNA, 20 bp, mouse
gcgagccactcctctccgtc

SEQ ID NO: 515714 - DNA, 20 bp, mouse
ggcacgcgcgcgggagtgag

SEQ ID NO: 515715 - DNA, 20 bp, mouse
ggagaggagtggctcggccc

SEQ ID NO: 515716 - DNA, 20 bp, mouse
ggcctgcaccatgagcgatg

SEQ ID NO: 515717 - DNA, 20 bp, mouse
gcatgagcgatgtggtagag

SEQ ID NO: 515718 - DNA, 20 bp, mouse
gcgttgatggcaggacaaag

SEQ ID NO: 515719 - DNA, 20 bp, mouse
ggtgtgacctccccgaaact

SEQ ID NO: 515720 - DNA, 20 bp, mouse
gtgcagcaagcaccactcga

SEQ ID NO: 515721 - DNA, 20 bp, mouse
ggagctgccaagtttcgggg

SEQ ID NO: 515722 - DNA, 20 bp, mouse
gaccacatcgctcatggtgc

SEQ ID NO: 515723 - DNA, 20 bp, mouse
gcctttagtctagacgttga

SEQ ID NO: 515724 - DNA, 20 bp, mouse
gacaagtcctcccagaaaag

SEQ ID NO: 515725 - DNA, 20 bp, mouse
gaaggagctgccaagtttcg

SEQ ID NO: 515726 - DNA, 20 bp, mouse
gactgcgggaaagccgaagg

SEQ ID NO: 515727 - DNA, 20 bp, mouse
ggcttcgtctcgtcctcctt

SEQ ID NO: 515728 - DNA, 20 bp, mouse
ggcggagctcggagaactgc

SEQ ID NO: 515729 - DNA, 20 bp, mouse
gagaactgcgggaaagccga

SEQ ID NO: 515730 - DNA, 20 bp, mouse
gcttgcaaccgtggccgagt

SEQ ID NO: 515731 - DNA, 20 bp, mouse
ggcagtctggagcacggctt

SEQ ID NO: 515732 - DNA, 20 bp, mouse
ggacgaagccaactcggcca

SEQ ID NO: 515733 - DNA, 20 bp, mouse
gcacgcggcagtctggagca

SEQ ID NO: 515734 - DNA, 20 bp, mouse
gtggagcacggcttcggcgg

SEQ ID NO: 515735 - DNA, 20 bp, mouse
gggacgagacgaagccaact

SEQ ID NO: 515736 - DNA, 20 bp, mouse
ggccccgcttggacaccccg

SEQ ID NO: 515737 - DNA, 20 bp, mouse
ggccggtgagcgcgtccccg

SEQ ID NO: 515738 - DNA, 20 bp, mouse
gcacgagcgagcggtcgggc

SEQ ID NO: 515739 - DNA, 20 bp, mouse
gcgggcacgagcgagcggtc

SEQ ID NO: 515740 - DNA, 20 bp, mouse
gtccccggggtgtccaagcg

SEQ ID NO: 515741 - DNA, 20 bp, mouse
gaccccggggacgcgctcac

SEQ ID NO: 515742 - DNA, 20 bp, mouse
gaagagcgctcggccgagcc

SEQ ID NO: 515743 - DNA, 20 bp, mouse
gcgcgcgcgggataacgcag

SEQ ID NO: 515744 - DNA, 20 bp, mouse
gtcggtgaggagctgccggg

SEQ ID NO: 515745 - DNA, 20 bp, mouse
gcgggccgcgctgtcctgag

SEQ ID NO: 515746 - DNA, 20 bp, mouse
gtcccgacttgggcctagaa

SEQ ID NO: 515747 - DNA, 20 bp, mouse
gcgacttgggcctagaacgg

SEQ ID NO: 515748 - DNA, 20 bp, mouse
gccagcccgaccttccggaa

SEQ ID NO: 515749 - DNA, 20 bp, mouse
ggggcctggaatcccgactt

SEQ ID NO: 515750 - DNA, 20 bp, mouse
gggatcccccgggctaggag

SEQ ID NO: 515751 - DNA, 20 bp, mouse
gaaggacgacagcccgggac

SEQ ID NO: 515752 - DNA, 20 bp, mouse
gcagaatcccaggatccccc

SEQ ID NO: 515753 - DNA, 20 bp, mouse
gtctgcctttccggaaggtc

SEQ ID NO: 515754 - DNA, 20 bp, mouse
gtccggaaaggcagaatccc

SEQ ID NO: 515755 - DNA, 20 bp, mouse
gcccggggccgccgaaccaa

SEQ ID NO: 515756 - DNA, 20 bp, mouse
ggagaagctcagaaatgatc

SEQ ID NO: 515757 - DNA, 20 bp, mouse
gagcgacatctgaggtccta

SEQ ID NO: 515758 - DNA, 20 bp, mouse
gaactgcctaaggtgctatt

SEQ ID NO: 515759 - DNA, 20 bp, mouse
gcattcctttttcccaggaa

SEQ ID NO: 515760 - DNA, 20 bp, mouse
gttggtgagataagggaagg

SEQ ID NO: 515761 - DNA, 20 bp, mouse
gaagggatgtctagggccaa

SEQ ID NO: 515762 - DNA, 20 bp, mouse
ggctggggtgaggggcaagg

SEQ ID NO: 515763 - DNA, 20 bp, mouse
gtggaaaatgggaaggaaca

SEQ ID NO: 515764 - DNA, 20 bp, mouse
ggtgaggggcaagggggaaa

SEQ ID NO: 515765 - DNA, 20 bp, mouse
gaagggggaaagggatgtct

SEQ ID NO: 515766 - DNA, 20 bp, mouse
gcctctgaccagggacccct

SEQ ID NO: 515767 - DNA, 20 bp, mouse
gggtgcaacccgcttcacct

SEQ ID NO: 515768 - DNA, 20 bp, mouse
ggttaggaagaggttcccac

SEQ ID NO: 515769 - DNA, 20 bp, mouse
ggtttgcagcccacactgca

SEQ ID NO: 515770 - DNA, 20 bp, mouse
gtggcgactcccaggtgaag

SEQ ID NO: 515771 - DNA, 20 bp, mouse
gccatccaccccaatagggt

SEQ ID NO: 515772 - DNA, 20 bp, mouse
gaaagggaaggtctgcccag

SEQ ID NO: 515773 - DNA, 20 bp, mouse
gctcgccatccaccccaata

SEQ ID NO: 515774 - DNA, 20 bp, mouse
gaggatgggtggagaccctc

SEQ ID NO: 515775 - DNA, 20 bp, mouse
gcttcttactggcgactccc

SEQ ID NO: 515776 - DNA, 20 bp, mouse
gacatctgactagggaagta

SEQ ID NO: 515777 - DNA, 20 bp, mouse
gcctagtcagatgtgggaca

SEQ ID NO: 515778 - DNA, 20 bp, mouse
gtcagatgtgggacaaggcg

SEQ ID NO: 515779 - DNA, 20 bp, mouse
gtagggtttgaggccacagt

SEQ ID NO: 515780 - DNA, 20 bp, mouse
gtgggcagtgaagaccaggg

SEQ ID NO: 515781 - DNA, 20 bp, mouse
gatgtgggacaaggcggggt

SEQ ID NO: 515782 - DNA, 20 bp, mouse
ggtaaggcgaaggaggccca

SEQ ID NO: 515783 - DNA, 20 bp, mouse
ggacaaggcggggtaggccc

SEQ ID NO: 515784 - DNA, 20 bp, mouse
gtagggaagtaaggcgaagg

SEQ ID NO: 515785 - DNA, 20 bp, mouse
ggactagggaagtaaggcga

SEQ ID NO: 515786 - DNA, 20 bp, mouse
ggcctagatccaagccactc

SEQ ID NO: 515787 - DNA, 20 bp, mouse
ggattggtgtgagaaccagg

SEQ ID NO: 515788 - DNA, 20 bp, mouse
gagaaccaggaggttcccct

SEQ ID NO: 515789 - DNA, 20 bp, mouse
gaagccttgtgcttccagag

SEQ ID NO: 515790 - DNA, 20 bp, mouse
gcctggcctggagtagggca

SEQ ID NO: 515791 - DNA, 20 bp, mouse
gatgagtcggagaatcatcc

SEQ ID NO: 515792 - DNA, 20 bp, mouse
gttcccccaggggaacctcc

SEQ ID NO: 515793 - DNA, 20 bp, mouse
gagcacaaggcttttcttac

SEQ ID NO: 515794 - DNA, 20 bp, mouse
gatcaagtgggactaagagg

SEQ ID NO: 515795 - DNA, 20 bp, mouse
gtctggtaacaggtacggtg

SEQ ID NO: 515796 - DNA, 20 bp, mouse
gaggtggccagcagatgaaa

SEQ ID NO: 515797 - DNA, 20 bp, mouse
gggctggaaggtaggtgaac

SEQ ID NO: 515798 - DNA, 20 bp, mouse
gagcagatgaaagggctgga

SEQ ID NO: 515799 - DNA, 20 bp, mouse
gacagtagaagtgactctca

SEQ ID NO: 515800 - DNA, 20 bp, mouse
gtcatggtgggctccctcca

SEQ ID NO: 515801 - DNA, 20 bp, mouse
ggaatgctgaacctcatggt

SEQ ID NO: 515802 - DNA, 20 bp, mouse
gcagttaaccaggttccagg

SEQ ID NO: 515803 - DNA, 20 bp, mouse
gtgagaggcggaagccatga

SEQ ID NO: 515804 - DNA, 20 bp, mouse
ggtggggcatcatgtgtgac

SEQ ID NO: 515805 - DNA, 20 bp, mouse
gacagcgagacaggctgaac

SEQ ID NO: 515806 - DNA, 20 bp, mouse
gtcaggaagagtctgagcct

SEQ ID NO: 515807 - DNA, 20 bp, mouse
ggagtgtatcaagtgcccct

SEQ ID NO: 515808 - DNA, 20 bp, mouse
gtcttcctgacaggagccca

SEQ ID NO: 515809 - DNA, 20 bp, mouse
gcgaatggcgaggagtatgg

SEQ ID NO: 515810 - DNA, 20 bp, mouse
gctggaggtgagactcccac

SEQ ID NO: 515811 - DNA, 20 bp, mouse
gcatcaactctgctccagaa

SEQ ID NO: 515812 - DNA, 20 bp, mouse
gtagttcaaactactttccc

SEQ ID NO: 515813 - DNA, 20 bp, mouse
ggggcacttgatacactctt

SEQ ID NO: 515814 - DNA, 20 bp, mouse
ggatggctatctgggagctg

SEQ ID NO: 515815 - DNA, 20 bp, mouse
gccaagacacacgccaccat

SEQ ID NO: 515816 - DNA, 20 bp, mouse
gaaagtgactggatcctggt

SEQ ID NO: 515817 - DNA, 20 bp, mouse
ggcaagcttgaaagagggag

SEQ ID NO: 515818 - DNA, 20 bp, mouse
gagccaaagtgactggatcc

SEQ ID NO: 515819 - DNA, 20 bp, mouse
ggaggtgtagatggcagagt

SEQ ID NO: 515820 - DNA, 20 bp, mouse
gtagatggcagagttggaga

SEQ ID NO: 515821 - DNA, 20 bp, mouse
gatcagaacagaggtgtaga

SEQ ID NO: 515822 - DNA, 20 bp, mouse
gtcttttcttcacagtctgg

SEQ ID NO: 515823 - DNA, 20 bp, mouse
gtgcagagagcaagtggaag

SEQ ID NO: 515824 - DNA, 20 bp, mouse
ggaagagttccagagggtct

SEQ ID NO: 515825 - DNA, 20 bp, mouse
gatcagtagaaggaacattc

SEQ ID NO: 515826 - DNA, 20 bp, mouse
ggctggtgtctgcaggtgag

SEQ ID NO: 515827 - DNA, 20 bp, mouse
gtaaggtgcagatactctgg

SEQ ID NO: 515828 - DNA, 20 bp, mouse
gggtgaggggcaccaaagtc

SEQ ID NO: 515829 - DNA, 20 bp, mouse
ggggcaccaaagtcaggtac

SEQ ID NO: 515830 - DNA, 20 bp, mouse
ggtactggtctgatcaaata

SEQ ID NO: 515831 - DNA, 20 bp, mouse
gtcagaccagtacctgactt

SEQ ID NO: 515832 - DNA, 20 bp, mouse
gtggtggctcaggtagaaat

SEQ ID NO: 515833 - DNA, 20 bp, mouse
gtcctaaggtgcagatactc

SEQ ID NO: 515834 - DNA, 20 bp, mouse
gtatgggttagcaggtccta

SEQ ID NO: 515835 - DNA, 20 bp, mouse
gcacattgcagaagaaggtc

SEQ ID NO: 515836 - DNA, 20 bp, mouse
gccagggcctaagtaagcag

SEQ ID NO: 515837 - DNA, 20 bp, mouse
gggttatgtgtccaaggaag

SEQ ID NO: 515838 - DNA, 20 bp, mouse
gcattccttgctcccgggac

SEQ ID NO: 515839 - DNA, 20 bp, mouse
gaaggaagaggagaaattac

SEQ ID NO: 515840 - DNA, 20 bp, mouse
gctcactcccctgcttactt

SEQ ID NO: 515841 - DNA, 20 bp, mouse
gagagatggttatgtgtcca

SEQ ID NO: 515842 - DNA, 20 bp, mouse
ggttgaagcgtggcagttag

SEQ ID NO: 515843 - DNA, 20 bp, mouse
gacttagagtttgtgttatg

SEQ ID NO: 515844 - DNA, 20 bp, mouse
ggcagttagaggatttaagc

SEQ ID NO: 515845 - DNA, 20 bp, mouse
gccctcacattccttgctcc

SEQ ID NO: 515846 - DNA, 20 bp, mouse
gactcaggcttagggctatg

SEQ ID NO: 515847 - DNA, 20 bp, mouse
gagcctctgactcaggctta

SEQ ID NO: 515848 - DNA, 20 bp, mouse
gggagcttttgaggctcttc

SEQ ID NO: 515849 - DNA, 20 bp, mouse
ggagggatggccagggtcaa

SEQ ID NO: 515850 - DNA, 20 bp, mouse
ggagaaggaggagcaggtga

SEQ ID NO: 515851 - DNA, 20 bp, mouse
gcttgctctcaggacagatg

SEQ ID NO: 515852 - DNA, 20 bp, mouse
gggtgagcttggagcttttg

SEQ ID NO: 515853 - DNA, 20 bp, mouse
gggaaaaacaatatactgta

SEQ ID NO: 515854 - DNA, 20 bp, mouse
gaatttctggaaagtgggat

SEQ ID NO: 515855 - DNA, 20 bp, mouse
gtcatgatgtagctggggtc

SEQ ID NO: 515856 - DNA, 20 bp, mouse
ggagaaggccagagataatc

SEQ ID NO: 515857 - DNA, 20 bp, mouse
gacagctctgactctcctgc

SEQ ID NO: 515858 - DNA, 20 bp, mouse
gctaagatttgtaagagttt

SEQ ID NO: 515859 - DNA, 20 bp, mouse
ggagcttcagggagtgaggt

SEQ ID NO: 515860 - DNA, 20 bp, mouse
gggcagtgtgcaggcagaga

SEQ ID NO: 515861 - DNA, 20 bp, mouse
gtaaacttgaaggacatctg

SEQ ID NO: 515862 - DNA, 20 bp, mouse
gggccagggccagagccagc

SEQ ID NO: 515863 - DNA, 20 bp, mouse
gatcaggtgtctaaggaaga

SEQ ID NO: 515864 - DNA, 20 bp, mouse
gatagcccaaccccttaatc

SEQ ID NO: 515865 - DNA, 20 bp, mouse
gggaaaaacaataaacttga

SEQ ID NO: 515866 - DNA, 20 bp, mouse
gcaagtctctgactcaaggt

SEQ ID NO: 515867 - DNA, 20 bp, mouse
gggcagctctggacagccta

SEQ ID NO: 515868 - DNA, 20 bp, mouse
gaaccccccactaaaacctt

SEQ ID NO: 515869 - DNA, 20 bp, mouse
gagaggaaggctggcagctc

SEQ ID NO: 515870 - DNA, 20 bp, mouse
gagcctaaggttttagtggg

SEQ ID NO: 515871 - DNA, 20 bp, mouse
gccctgtccctaggagagat

SEQ ID NO: 515872 - DNA, 20 bp, mouse
gatctcaccaatctctccta

SEQ ID NO: 515873 - DNA, 20 bp, mouse
gacaggtgtccaggttccgc

SEQ ID NO: 515874 - DNA, 20 bp, mouse
gtagctgcgctgaggagaga

SEQ ID NO: 515875 - DNA, 20 bp, mouse
ggttccgcaggcagtgagct

SEQ ID NO: 515876 - DNA, 20 bp, mouse
gcgatcactgcataaggcag

SEQ ID NO: 515877 - DNA, 20 bp, mouse
gaaggtccgatcactgcata

SEQ ID NO: 515878 - DNA, 20 bp, mouse
ggagaagcccagagacggtc

SEQ ID NO: 515879 - DNA, 20 bp, mouse
ggtgagatacgggaagggga

SEQ ID NO: 515880 - DNA, 20 bp, mouse
gcaatagcatcaggagagtc

SEQ ID NO: 515881 - DNA, 20 bp, mouse
gtcaacacctgaccgtctct

SEQ ID NO: 515882 - DNA, 20 bp, mouse
gccaccctctttctaaactt

SEQ ID NO: 515883 - DNA, 20 bp, mouse
gatgtggaaaacatatctga

SEQ ID NO: 515884 - DNA, 20 bp, mouse
gaggtcctaagtttagaaag

SEQ ID NO: 515885 - DNA, 20 bp, mouse
ggagaaaaaggagatagttc

SEQ ID NO: 515886 - DNA, 20 bp, mouse
gattaaggggttaggctacg

SEQ ID NO: 515887 - DNA, 20 bp, mouse
gtggccagggccaaagcagc

SEQ ID NO: 515888 - DNA, 20 bp, mouse
gtctcctgctgctttggccc

SEQ ID NO: 515889 - DNA, 20 bp, mouse
gggattggtgagatgaggaa

SEQ ID NO: 515890 - DNA, 20 bp, mouse
gggtgagatgaggaaggggg

SEQ ID NO: 515891 - DNA, 20 bp, mouse
gaggtcctaagatttttaag

SEQ ID NO: 515892 - DNA, 20 bp, mouse
gctaagatttttaagaggtt

SEQ ID NO: 515893 - DNA, 20 bp, mouse
gtttaggcaattcttgatta

SEQ ID NO: 515894 - DNA, 20 bp, mouse
gacaggtgtccaggaactgc

SEQ ID NO: 515895 - DNA, 20 bp, mouse
gagcagcaggagagtcaggg

SEQ ID NO: 515896 - DNA, 20 bp, mouse
ggttcactgcctgtggaacc

SEQ ID NO: 515897 - DNA, 20 bp, mouse
gtaggcaagcctccgacaca

SEQ ID NO: 515898 - DNA, 20 bp, mouse
gaacccaaaccttgtgtcgg

SEQ ID NO: 515899 - DNA, 20 bp, mouse
gcataacccaaaccttgtgt

SEQ ID NO: 515900 - DNA, 20 bp, mouse
gaagcctccgacacaaggtt

SEQ ID NO: 515901 - DNA, 20 bp, mouse
gggaaaaagaatgtactgta

SEQ ID NO: 515902 - DNA, 20 bp, mouse
gacaggtgtccaggttccac

SEQ ID NO: 515903 - DNA, 20 bp, mouse
gtggagctgttgaggatcct

SEQ ID NO: 515904 - DNA, 20 bp, mouse
gcagcctaaggttctattgg

SEQ ID NO: 515905 - DNA, 20 bp, mouse
gggacagcctaaggttctat

SEQ ID NO: 515906 - DNA, 20 bp, mouse
gggtcagctatctaaggaag

SEQ ID NO: 515907 - DNA, 20 bp, mouse
ggtagaacacagctgaaaga

SEQ ID NO: 515908 - DNA, 20 bp, mouse
gatgtcctaagatcggtaag

SEQ ID NO: 515909 - DNA, 20 bp, mouse
gtaggcaatccctgattcag

SEQ ID NO: 515910 - DNA, 20 bp, mouse
gtaacacagcccctgaatca

SEQ ID NO: 515911 - DNA, 20 bp, mouse
gggaaaaacaatgaattcta

SEQ ID NO: 515912 - DNA, 20 bp, mouse
gacatctgatgtcctaagat

SEQ ID NO: 515913 - DNA, 20 bp, mouse
gattcaggggctgtgttatg

SEQ ID NO: 515914 - DNA, 20 bp, mouse
gccaacctcttaccgatctt

SEQ ID NO: 515915 - DNA, 20 bp, mouse
gaatctcacactattgtcac

SEQ ID NO: 515916 - DNA, 20 bp, mouse
gtgagtggaaaggacagggg

SEQ ID NO: 515917 - DNA, 20 bp, mouse
gggtcagcatctgagtggaa

SEQ ID NO: 515918 - DNA, 20 bp, mouse
ggactggagaaaccaagaga

SEQ ID NO: 515919 - DNA, 20 bp, mouse
gagaaaccaagagatggtca

SEQ ID NO: 515920 - DNA, 20 bp, mouse
gtaggtcttaacttttgtaa

SEQ ID NO: 515921 - DNA, 20 bp, mouse
ggtagaaagttctgtaaaat

SEQ ID NO: 515922 - DNA, 20 bp, mouse
ggggaagtatgctcggtgca

SEQ ID NO: 515923 - DNA, 20 bp, mouse
gatctgagtggaaaggacag

SEQ ID NO: 515924 - DNA, 20 bp, mouse
ggtcagcacgaacagagctt

SEQ ID NO: 515925 - DNA, 20 bp, mouse
gtagtcccctgaccatctct

SEQ ID NO: 515926 - DNA, 20 bp, mouse
gtgggagcaaggactgtgag

SEQ ID NO: 515927 - DNA, 20 bp, mouse
ggattccacagtagcacctt

SEQ ID NO: 515928 - DNA, 20 bp, mouse
gagggacatgccaggaccta

SEQ ID NO: 515929 - DNA, 20 bp, mouse
gacatgccaggacctaaggt

SEQ ID NO: 515930 - DNA, 20 bp, mouse
gggtcagatatctaaggtag

SEQ ID NO: 515931 - DNA, 20 bp, mouse
gtcttaccaaccttaggtcc

SEQ ID NO: 515932 - DNA, 20 bp, mouse
gactcaggggttgggctatt

SEQ ID NO: 515933 - DNA, 20 bp, mouse
gaggcaagcccctgactcag

SEQ ID NO: 515934 - DNA, 20 bp, mouse
gtagcccaacccctgagtca

SEQ ID NO: 515935 - DNA, 20 bp, mouse
gaaaaaaacaatgaacttga

SEQ ID NO: 515936 - DNA, 20 bp, mouse
gcaggcagtgagcttggagc

SEQ ID NO: 515937 - DNA, 20 bp, mouse
gacactgtcaagtcactcac

SEQ ID NO: 515938 - DNA, 20 bp, mouse
gggtgaacacggctgagggg

SEQ ID NO: 515939 - DNA, 20 bp, mouse
gtgtggtgaacacggctgag

SEQ ID NO: 515940 - DNA, 20 bp, mouse
ggagtgacttgacagtgtgc

SEQ ID NO: 515941 - DNA, 20 bp, mouse
gtgaactgtagtgaaacctg

SEQ ID NO: 515942 - DNA, 20 bp, mouse
gactcagggattgagctata

SEQ ID NO: 515943 - DNA, 20 bp, mouse
gaggtcttaagtttagtaag

SEQ ID NO: 515944 - DNA, 20 bp, mouse
gtgtcatcatgtggtgaaca

SEQ ID NO: 515945 - DNA, 20 bp, mouse
gggagctggtgaggttcctt

SEQ ID NO: 515946 - DNA, 20 bp, mouse
ggactggagaagcctagagg

SEQ ID NO: 515947 - DNA, 20 bp, mouse
ggagaagcctagaggtggtg

SEQ ID NO: 515948 - DNA, 20 bp, mouse
gaaagactggagaagcctag

SEQ ID NO: 515949 - DNA, 20 bp, mouse
gcttaccaaccttagtgctt

SEQ ID NO: 515950 - DNA, 20 bp, mouse
gtcagcatctggctgccaca

SEQ ID NO: 515951 - DNA, 20 bp, mouse
gcatctggctgccacagggc

SEQ ID NO: 515952 - DNA, 20 bp, mouse
gtagacacctcaccacctct

SEQ ID NO: 515953 - DNA, 20 bp, mouse
gacatcccaagcactaaggt

SEQ ID NO: 515954 - DNA, 20 bp, mouse
gagagacatcccaagcacta

SEQ ID NO: 515955 - DNA, 20 bp, mouse
gcagggttttagtcagcatc

SEQ ID NO: 515956 - DNA, 20 bp, mouse
gtggttggaggcagtctgag

SEQ ID NO: 515957 - DNA, 20 bp, mouse
gacccacaggggcccctatg

SEQ ID NO: 515958 - DNA, 20 bp, mouse
gcagatgaaagaccccgaca

SEQ ID NO: 515959 - DNA, 20 bp, mouse
gcagatagaagaccctgaca

SEQ ID NO: 515960 - DNA, 20 bp, mouse
ggaggcatagatcttcactt

SEQ ID NO: 515961 - DNA, 20 bp, mouse
gccccgacagggcttcactt

SEQ ID NO: 515962 - DNA, 20 bp, mouse
gagactgcctccaaccagat

SEQ ID NO: 515963 - DNA, 20 bp, mouse
ggagctggtttgctacccac

SEQ ID NO: 515964 - DNA, 20 bp, mouse
ggccccataggggcccctgt

SEQ ID NO: 515965 - DNA, 20 bp, mouse
gggcaagggagagagatcat

SEQ ID NO: 515966 - DNA, 20 bp, mouse
gccctgagcggtgggtggtg

SEQ ID NO: 515967 - DNA, 20 bp, mouse
gagaagtctgaagctatatt

SEQ ID NO: 515968 - DNA, 20 bp, mouse
gctcagggaccggcagtgga

SEQ ID NO: 515969 - DNA, 20 bp, mouse
gtccctgagtgctaatggtg

SEQ ID NO: 515970 - DNA, 20 bp, mouse
gaagtgtggacagcaaagag

SEQ ID NO: 515971 - DNA, 20 bp, mouse
gtcagggaacaggggcaaag

SEQ ID NO: 515972 - DNA, 20 bp, mouse
gagcactcagggaccggcag

SEQ ID NO: 515973 - DNA, 20 bp, mouse
ggcccctgttccctgagcgg

SEQ ID NO: 515974 - DNA, 20 bp, mouse
gggcagggtctcagcaggta

SEQ ID NO: 515975 - DNA, 20 bp, mouse
gtgcacctggtaagaaataa

SEQ ID NO: 515976 - DNA, 20 bp, mouse
gcacagagggacttacaggt

SEQ ID NO: 515977 - DNA, 20 bp, mouse
gcactctccttgggacacgg

SEQ ID NO: 515978 - DNA, 20 bp, mouse
gccctgaccccactgaacct

SEQ ID NO: 515979 - DNA, 20 bp, mouse
ggtcagctcccactctcctt

SEQ ID NO: 515980 - DNA, 20 bp, mouse
gaccagctgcccaggttcag

SEQ ID NO: 515981 - DNA, 20 bp, mouse
ggagtgaagggtaaggatgt

SEQ ID NO: 515982 - DNA, 20 bp, mouse
gactggctaacctgggaacg

SEQ ID NO: 515983 - DNA, 20 bp, mouse
ggaagctgcaggatccccag

SEQ ID NO: 515984 - DNA, 20 bp, mouse
gtgaagacctccgtgtccca

SEQ ID NO: 515985 - DNA, 20 bp, mouse
gccaccagcaggtgagtgaa

SEQ ID NO: 515986 - DNA, 20 bp, mouse
ggcctcgccaagtcactccc

SEQ ID NO: 515987 - DNA, 20 bp, mouse
ggtgtctccagccttctata

SEQ ID NO: 515988 - DNA, 20 bp, mouse
gtggagccccagtctccagg

SEQ ID NO: 515989 - DNA, 20 bp, mouse
ggatctgagggagaaggcca

SEQ ID NO: 515990 - DNA, 20 bp, mouse
gacctgggagtgacttggcg

SEQ ID NO: 515991 - DNA, 20 bp, mouse
gcccagagagaggagacctg

SEQ ID NO: 515992 - DNA, 20 bp, mouse
gaaagggccagccctataga

SEQ ID NO: 515993 - DNA, 20 bp, mouse
gggctggagacactggtctc

SEQ ID NO: 515994 - DNA, 20 bp, mouse
ggacactggtctccggatca

SEQ ID NO: 515995 - DNA, 20 bp, mouse
gcaattccccctggagactg

SEQ ID NO: 515996 - DNA, 20 bp, mouse
gcttcctcagaggccaccat

SEQ ID NO: 515997 - DNA, 20 bp, mouse
gcggctggattgcacagggt

SEQ ID NO: 515998 - DNA, 20 bp, mouse
gagtagagatagcaactcag

SEQ ID NO: 515999 - DNA, 20 bp, mouse
gccccactgaaggccctggg

SEQ ID NO: 516000 - DNA, 20 bp, mouse
gcttctgttcatgggagcgt

SEQ ID NO: 516001 - DNA, 20 bp, mouse
gcgtcccatggtggcctctg

SEQ ID NO: 516002 - DNA, 20 bp, mouse
ggttccaccctcttcctcag

SEQ ID NO: 516003 - DNA, 20 bp, mouse
gatccacggctggattgcac

SEQ ID NO: 516004 - DNA, 20 bp, mouse
gtgttcatgggagcgtgggc

SEQ ID NO: 516005 - DNA, 20 bp, mouse
gagatagcaactcagtggtg

SEQ ID NO: 516006 - DNA, 20 bp, mouse
gtgcccaaggacatgaagct

SEQ ID NO: 516007 - DNA, 20 bp, mouse
gatgaagctgggactcacct

SEQ ID NO: 516008 - DNA, 20 bp, mouse
gggtgcggtggagggcacag

SEQ ID NO: 516009 - DNA, 20 bp, mouse
gtccttgggcacaggtcctt

SEQ ID NO: 516010 - DNA, 20 bp, mouse
gtggcctagggtgcggtgga

SEQ ID NO: 516011 - DNA, 20 bp, mouse
gaggccaggcgcccagtagc

SEQ ID NO: 516012 - DNA, 20 bp, mouse
gaccgcaccctaggccactg

SEQ ID NO: 516013 - DNA, 20 bp, mouse
gggtcctttggcctgctact

SEQ ID NO: 516014 - DNA, 20 bp, mouse
ggagttgcgtacgcattccc

SEQ ID NO: 516015 - DNA, 20 bp, mouse
ggccaaaggacctgtgccca

SEQ ID NO: 516016 - DNA, 20 bp, mouse
gggtcacgttgtggttctgg

SEQ ID NO: 516017 - DNA, 20 bp, mouse
gtagaaagcagctacctgga

SEQ ID NO: 516018 - DNA, 20 bp, mouse
gtggaaggatggtcacgttg

SEQ ID NO: 516019 - DNA, 20 bp, mouse
gaagcagctacctggaagga

SEQ ID NO: 516020 - DNA, 20 bp, mouse
gccctcggtgccatattcag

SEQ ID NO: 516021 - DNA, 20 bp, mouse
gccggtagaaagcagctacc

SEQ ID NO: 516022 - DNA, 20 bp, mouse
ggggagtcttcacatgaaga

SEQ ID NO: 516023 - DNA, 20 bp, mouse
gtcttcaagccctctgaata

SEQ ID NO: 516024 - DNA, 20 bp, mouse
gccctctgaatatggcaccg

SEQ ID NO: 516025 - DNA, 20 bp, mouse
ggatggtcacgttgtggttc

SEQ ID NO: 516026 - DNA, 20 bp, mouse
gagcataatacaggaggtaa

SEQ ID NO: 516027 - DNA, 20 bp, mouse
gttaccagctaataaaacac

SEQ ID NO: 516028 - DNA, 20 bp, mouse
gaagcacagcataatacagg

SEQ ID NO: 516029 - DNA, 20 bp, mouse
gctgtgtcaacataaagttg

SEQ ID NO: 516030 - DNA, 20 bp, mouse
ggcacatatatttatttcac

SEQ ID NO: 516031 - DNA, 20 bp, mouse
gtctcctgtgttttattagc

SEQ ID NO: 516032 - DNA, 20 bp, mouse
gatgatagtactacagtcca

SEQ ID NO: 516033 - DNA, 20 bp, mouse
gattttcgtatgtttatgtg

SEQ ID NO: 516034 - DNA, 20 bp, mouse
gtacagtccaagggtgtgac

SEQ ID NO: 516035 - DNA, 20 bp, mouse
gccaaagcacagcataatac

SEQ ID NO: 516036 - DNA, 20 bp, mouse
ggatggaccaatatactttt

SEQ ID NO: 516037 - DNA, 20 bp, mouse
gtttctacctaaaagtatat

SEQ ID NO: 516038 - DNA, 20 bp, mouse
ggttttataaataaacaatc

SEQ ID NO: 516039 - DNA, 20 bp, mouse
gagggttgcagaaactagta

SEQ ID NO: 516040 - DNA, 20 bp, mouse
gcctccagctcactcatcgt

SEQ ID NO: 516041 - DNA, 20 bp, mouse
gtaaggcatgaggagactca

SEQ ID NO: 516042 - DNA, 20 bp, mouse
gcttggttatgcacaaggat

SEQ ID NO: 516043 - DNA, 20 bp, mouse
gcagaaactagtaaggcatg

SEQ ID NO: 516044 - DNA, 20 bp, mouse
gatattggtccatctcatcg

SEQ ID NO: 516045 - DNA, 20 bp, mouse
gtaaccaagccccgatgaga

SEQ ID NO: 516046 - DNA, 20 bp, mouse
gatagatcctgcagttatgg

SEQ ID NO: 516047 - DNA, 20 bp, mouse
gctctaccctgaagagattc

SEQ ID NO: 516048 - DNA, 20 bp, mouse
gcttcaccagaatctcttca

SEQ ID NO: 516049 - DNA, 20 bp, mouse
ggttgtgttagatcagctaa

SEQ ID NO: 516050 - DNA, 20 bp, mouse
gcatggtgtgacatgagatc

SEQ ID NO: 516051 - DNA, 20 bp, mouse
gaataagagccagataagat

SEQ ID NO: 516052 - DNA, 20 bp, mouse
gttctctaacacgtacatga

SEQ ID NO: 516053 - DNA, 20 bp, mouse
gattgatgcagaagctctgt

SEQ ID NO: 516054 - DNA, 20 bp, mouse
gggggaaaagttgtctttcc

SEQ ID NO: 516055 - DNA, 20 bp, mouse
gtgttagatcagctaaaggc

SEQ ID NO: 516056 - DNA, 20 bp, mouse
ggaattaatccactaactga

SEQ ID NO: 516057 - DNA, 20 bp, mouse
gcactaactgagggacaagt

SEQ ID NO: 516058 - DNA, 20 bp, mouse
gctctaccaggaagtaattc

SEQ ID NO: 516059 - DNA, 20 bp, mouse
gaggaagtaattctggtgaa

SEQ ID NO: 516060 - DNA, 20 bp, mouse
gtacttcctggtagagacac

SEQ ID NO: 516061 - DNA, 20 bp, mouse
gagagcttcaagaagaatga

SEQ ID NO: 516062 - DNA, 20 bp, mouse
gaattatgggcgaggatcta

SEQ ID NO: 516063 - DNA, 20 bp, mouse
gactaggagccaggtaagat

SEQ ID NO: 516064 - DNA, 20 bp, mouse
gcatatggacccatcttacc

SEQ ID NO: 516065 - DNA, 20 bp, mouse
gtcgggcagtatgtgaaaat

SEQ ID NO: 516066 - DNA, 20 bp, mouse
gtgaagtccagggatcaaat

SEQ ID NO: 516067 - DNA, 20 bp, mouse
gagtccagggatcaaatagg

SEQ ID NO: 516068 - DNA, 20 bp, mouse
ggtcggaactaaatttccac

SEQ ID NO: 516069 - DNA, 20 bp, mouse
ggtatatttgatcatttggt

SEQ ID NO: 516070 - DNA, 20 bp, mouse
gtgaccacctatttgatccc

SEQ ID NO: 516071 - DNA, 20 bp, mouse
gcctggacttcacatgaagc

SEQ ID NO: 516072 - DNA, 20 bp, mouse
ggagtttcaaaattgaaagt

SEQ ID NO: 516073 - DNA, 20 bp, mouse
gtctaccggagtgatgctgg

SEQ ID NO: 516074 - DNA, 20 bp, mouse
ggtctctaccggagtgatgc

SEQ ID NO: 516075 - DNA, 20 bp, mouse
gcatgaggttgagtatcacc

SEQ ID NO: 516076 - DNA, 20 bp, mouse
gacgtgagaggatgattgat

SEQ ID NO: 516077 - DNA, 20 bp, mouse
gtcatatggtgtgacgtgag

SEQ ID NO: 516078 - DNA, 20 bp, mouse
gttaaactcaggtattcgtt

SEQ ID NO: 516079 - DNA, 20 bp, mouse
gtttaatccctgtaaataaa

SEQ ID NO: 516080 - DNA, 20 bp, mouse
gattatcacatctttcaaaa

SEQ ID NO: 516081 - DNA, 20 bp, mouse
gccactttccttttatttac

SEQ ID NO: 516082 - DNA, 20 bp, mouse
gactctacctgaagtgaggt

SEQ ID NO: 516083 - DNA, 20 bp, mouse
ggtgaggtgggtagaaggaa

SEQ ID NO: 516084 - DNA, 20 bp, mouse
gctggtgtgtatccccttag

SEQ ID NO: 516085 - DNA, 20 bp, mouse
gggcccacattaccccaaca

SEQ ID NO: 516086 - DNA, 20 bp, mouse
gtctggtggagggaaaagtt

SEQ ID NO: 516087 - DNA, 20 bp, mouse
ggaaaagttgggtgaaaagt

SEQ ID NO: 516088 - DNA, 20 bp, mouse
ggattgatggggaagcacac

SEQ ID NO: 516089 - DNA, 20 bp, mouse
gaggggtgtgatatgagatc

SEQ ID NO: 516090 - DNA, 20 bp, mouse
gtaatcaagagaatttcaag

SEQ ID NO: 516091 - DNA, 20 bp, mouse
gcctggacttcacatgaatg

SEQ ID NO: 516092 - DNA, 20 bp, mouse
ggaccacctagtttgatccc

SEQ ID NO: 516093 - DNA, 20 bp, mouse
gcactgggttgtgttagatc

SEQ ID NO: 516094 - DNA, 20 bp, mouse
gtcatttttgaaactcgtag

SEQ ID NO: 516095 - DNA, 20 bp, mouse
gtgctaagaaattaaagtag

SEQ ID NO: 516096 - DNA, 20 bp, mouse
ggttgtagtcaccaggccac

SEQ ID NO: 516097 - DNA, 20 bp, mouse
gagaatgactaataaaccag

SEQ ID NO: 516098 - DNA, 20 bp, mouse
gtgtctcaacataaaggatt

SEQ ID NO: 516099 - DNA, 20 bp, mouse
gaaaacctgttgtagtcacc

SEQ ID NO: 516100 - DNA, 20 bp, mouse
gatgatagctctacagtcca

SEQ ID NO: 516101 - DNA, 20 bp, mouse
gagtcttttacaagaaaacc

SEQ ID NO: 516102 - DNA, 20 bp, mouse
gcctgtcccaggctgaggtg

SEQ ID NO: 516103 - DNA, 20 bp, mouse
ggtcaccaggccacaggaaa

SEQ ID NO: 516104 - DNA, 20 bp, mouse
gcttttcctgtcccaggctg

SEQ ID NO: 516105 - DNA, 20 bp, mouse
gagtgatcaaccctttcctg

SEQ ID NO: 516106 - DNA, 20 bp, mouse
ggtccacggatcaaattacg

SEQ ID NO: 516107 - DNA, 20 bp, mouse
ggaccacgtaatttgatccg

SEQ ID NO: 516108 - DNA, 20 bp, mouse
gttgagtatatttgatcgtt

SEQ ID NO: 516109 - DNA, 20 bp, mouse
gaaatgtaataatatgatcc

SEQ ID NO: 516110 - DNA, 20 bp, mouse
ggaaaatttgtctgtagagt

SEQ ID NO: 516111 - DNA, 20 bp, mouse
gatattattacattttcaga

SEQ ID NO: 516112 - DNA, 20 bp, mouse
gtccctcaccagaatcactc

SEQ ID NO: 516113 - DNA, 20 bp, mouse
gaccggagtgattctggtga

SEQ ID NO: 516114 - DNA, 20 bp, mouse
gtcatttttgaaacttgtag

SEQ ID NO: 516115 - DNA, 20 bp, mouse
gcttcacatgaaggtagagt

SEQ ID NO: 516116 - DNA, 20 bp, mouse
gcagaaactagtgaggactg

SEQ ID NO: 516117 - DNA, 20 bp, mouse
gaaggttgcagaaactagtg

SEQ ID NO: 516118 - DNA, 20 bp, mouse
ggaggactgaggagcctcaa

SEQ ID NO: 516119 - DNA, 20 bp, mouse
gaacagcaacaaactcctag

SEQ ID NO: 516120 - DNA, 20 bp, mouse
gtccaaatctaacttttcaa

SEQ ID NO: 516121 - DNA, 20 bp, mouse
gcctctgtagcaagcttctc

SEQ ID NO: 516122 - DNA, 20 bp, mouse
ggaaaacagtattggttaaa

SEQ ID NO: 516123 - DNA, 20 bp, mouse
ggatcgatctcattggggct

SEQ ID NO: 516124 - DNA, 20 bp, mouse
gtatactaaagaaatcagat

SEQ ID NO: 516125 - DNA, 20 bp, mouse
ggttatgcacaagtacaaga

SEQ ID NO: 516126 - DNA, 20 bp, mouse
ggtgatgccggtagaaagaa

SEQ ID NO: 516127 - DNA, 20 bp, mouse
gaggggatacagaccagtaa

SEQ ID NO: 516128 - DNA, 20 bp, mouse
ggcctcaattggggtaatgt

SEQ ID NO: 516129 - DNA, 20 bp, mouse
gctggtctgtatcccctaag

SEQ ID NO: 516130 - DNA, 20 bp, mouse
ggcccacattaccccaattg

SEQ ID NO: 516131 - DNA, 20 bp, mouse
gtaccggcatcacttcaggg

SEQ ID NO: 516132 - DNA, 20 bp, mouse
gttctaccggcatcacttca

SEQ ID NO: 516133 - DNA, 20 bp, mouse
gaggcatccattctttctac

SEQ ID NO: 516134 - DNA, 20 bp, mouse
gctccaccctgaagtgatgc

SEQ ID NO: 516135 - DNA, 20 bp, mouse
gaagaatggatgcctcaatt

SEQ ID NO: 516136 - DNA, 20 bp, mouse
gaatagtatccagataaaat

SEQ ID NO: 516137 - DNA, 20 bp, mouse
ggaccacctaatgtgatccc

SEQ ID NO: 516138 - DNA, 20 bp, mouse
gtgaaaagttggcgtttttc

SEQ ID NO: 516139 - DNA, 20 bp, mouse
gatttagtagaaaaataaaa

SEQ ID NO: 516140 - DNA, 20 bp, mouse
gggaggggcagaaaatcacg

SEQ ID NO: 516141 - DNA, 20 bp, mouse
gtttcaattttgaaactcat

SEQ ID NO: 516142 - DNA, 20 bp, mouse
gtactcaagagactttcagg

SEQ ID NO: 516143 - DNA, 20 bp, mouse
ggaaaatttgtctgaaaagt

SEQ ID NO: 516144 - DNA, 20 bp, mouse
gatatactcaagagactttc

SEQ ID NO: 516145 - DNA, 20 bp, mouse
gattgatggggaagcacttt

SEQ ID NO: 516146 - DNA, 20 bp, mouse
gcacctgagccctctggtct

SEQ ID NO: 516147 - DNA, 20 bp, mouse
gaaatttagccgagaccaga

SEQ ID NO: 516148 - DNA, 20 bp, mouse
gacttaccttgggggagaga

SEQ ID NO: 516149 - DNA, 20 bp, mouse
gttaattcagcatagagcac

SEQ ID NO: 516150 - DNA, 20 bp, mouse
gtggtgcatccattagagat

SEQ ID NO: 516151 - DNA, 20 bp, mouse
gaataaagccacttaccttg

SEQ ID NO: 516152 - DNA, 20 bp, mouse
gttacatctcccatctctaa

SEQ ID NO: 516153 - DNA, 20 bp, mouse
ggtgagatggatgattcctc

SEQ ID NO: 516154 - DNA, 20 bp, mouse
gtcttcccaccaaaggcatt

SEQ ID NO: 516155 - DNA, 20 bp, mouse
gcaattcccaatgcctttgg

SEQ ID NO: 516156 - DNA, 20 bp, mouse
gaggagatgcatcactgaac

SEQ ID NO: 516157 - DNA, 20 bp, mouse
gcacttcaccccaaaggcct

SEQ ID NO: 516158 - DNA, 20 bp, mouse
ggtcagtgtgaaacttgggt

SEQ ID NO: 516159 - DNA, 20 bp, mouse
gacacagcaagggtctactt

SEQ ID NO: 516160 - DNA, 20 bp, mouse
gatcactgaactggtgagca

SEQ ID NO: 516161 - DNA, 20 bp, mouse
gtttgctcacttcaccccaa

SEQ ID NO: 516162 - DNA, 20 bp, mouse
gcatctacaaggagaaagta

SEQ ID NO: 516163 - DNA, 20 bp, mouse
gagctacgggccctgaagaa

SEQ ID NO: 516164 - DNA, 20 bp, mouse
ggcccgtagctaaagacaaa

SEQ ID NO: 516165 - DNA, 20 bp, mouse
ggggcaaactccaaggcctt

SEQ ID NO: 516166 - DNA, 20 bp, mouse
ggacaccggcctcgtgaaca

SEQ ID NO: 516167 - DNA, 20 bp, mouse
gcaagtccctccatctacaa

SEQ ID NO: 516168 - DNA, 20 bp, mouse
gtgaatccattgtagatgga

SEQ ID NO: 516169 - DNA, 20 bp, mouse
gcacagcacagcatacccag

SEQ ID NO: 516170 - DNA, 20 bp, mouse
gacaatggattcaacaacac

SEQ ID NO: 516171 - DNA, 20 bp, mouse
gttggctcatttcacctcac

SEQ ID NO: 516172 - DNA, 20 bp, mouse
ggaagcaagctgcttacctg

SEQ ID NO: 516173 - DNA, 20 bp, mouse
gactcccatgagccaagggg

SEQ ID NO: 516174 - DNA, 20 bp, mouse
ggaggtgaaatgagccaaaa

SEQ ID NO: 516175 - DNA, 20 bp, mouse
gttgtccctgttcacgaggc

SEQ ID NO: 516176 - DNA, 20 bp, mouse
gcctgggtggctttaaaccg

SEQ ID NO: 516177 - DNA, 20 bp, mouse
gacacagcaagtatctacct

SEQ ID NO: 516178 - DNA, 20 bp, mouse
gaggagatgcaacacttaac

SEQ ID NO: 516179 - DNA, 20 bp, mouse
gagatgcaacacttaactgg

SEQ ID NO: 516180 - DNA, 20 bp, mouse
gcttgctgtgtccatttcac

SEQ ID NO: 516181 - DNA, 20 bp, mouse
gtgccaagcccccagtgtcc

SEQ ID NO: 516182 - DNA, 20 bp, mouse
gttaaagccacccaggacac

SEQ ID NO: 516183 - DNA, 20 bp, mouse
gggaaagagattcttctggc

SEQ ID NO: 516184 - DNA, 20 bp, mouse
gtatttcacctcaaaggcct

SEQ ID NO: 516185 - DNA, 20 bp, mouse
ggtcagtgtgaaacttgagc

SEQ ID NO: 516186 - DNA, 20 bp, mouse
gtataccctggacacctaaa

SEQ ID NO: 516187 - DNA, 20 bp, mouse
gtccattgtagacaggagat

SEQ ID NO: 516188 - DNA, 20 bp, mouse
gtcccatctcctgtctacaa

SEQ ID NO: 516189 - DNA, 20 bp, mouse
gaagatgcttgcttataccc

SEQ ID NO: 516190 - DNA, 20 bp, mouse
gtgatgtgtccattgtagac

SEQ ID NO: 516191 - DNA, 20 bp, mouse
gacaactggagcaaaagtag

SEQ ID NO: 516192 - DNA, 20 bp, mouse
gtacaactctaaaataatgg

SEQ ID NO: 516193 - DNA, 20 bp, mouse
gaatagtgagatgacttatt

SEQ ID NO: 516194 - DNA, 20 bp, mouse
gacttacctggggagaaaga

SEQ ID NO: 516195 - DNA, 20 bp, mouse
gaaagccatttaggtgtcca

SEQ ID NO: 516196 - DNA, 20 bp, mouse
gcagggccatgaagaggtgt

SEQ ID NO: 516197 - DNA, 20 bp, mouse
gtggagctgcgaggacccct

SEQ ID NO: 516198 - DNA, 20 bp, mouse
ggaactcaaggaaccagcac

SEQ ID NO: 516199 - DNA, 20 bp, mouse
ggagaagagccggggatcag

SEQ ID NO: 516200 - DNA, 20 bp, mouse
ggaaccagcacaggaaacca

SEQ ID NO: 516201 - DNA, 20 bp, mouse
gataggtcaagtgagaacta

SEQ ID NO: 516202 - DNA, 20 bp, mouse
ggccctggcatcgcagtgca

SEQ ID NO: 516203 - DNA, 20 bp, mouse
gccctgcaaaggtgagccac

SEQ ID NO: 516204 - DNA, 20 bp, mouse
gtcctgctcgatgactgaaa

SEQ ID NO: 516205 - DNA, 20 bp, mouse
gctctgcccacacctcttca

SEQ ID NO: 516206 - DNA, 20 bp, mouse
gacttgcattataactgcat

SEQ ID NO: 516207 - DNA, 20 bp, mouse
gggtgccagcaagcatgcag

SEQ ID NO: 516208 - DNA, 20 bp, mouse
gcagaattgatatcactcac

SEQ ID NO: 516209 - DNA, 20 bp, mouse
gtctcggcataaccattcta

SEQ ID NO: 516210 - DNA, 20 bp, mouse
gcacctgcttggaactgaac

SEQ ID NO: 516211 - DNA, 20 bp, mouse
gggcctgttcagttccaagc

SEQ ID NO: 516212 - DNA, 20 bp, mouse
gtgaacaggcctcagaaccc

SEQ ID NO: 516213 - DNA, 20 bp, mouse
gatctgaaggccagcaggca

SEQ ID NO: 516214 - DNA, 20 bp, mouse
gagacctcttcaggaaggaa

SEQ ID NO: 516215 - DNA, 20 bp, mouse
gcagcatagagcagagcctg

SEQ ID NO: 516216 - DNA, 20 bp, mouse
gaacttgcattataattgca

SEQ ID NO: 516217 - DNA, 20 bp, mouse
gggtgccagcaagcatgcag

SEQ ID NO: 516218 - DNA, 20 bp, mouse
gcacctgcttggaactgaac

SEQ ID NO: 516219 - DNA, 20 bp, mouse
gtgaacaggcctcagaaccc

SEQ ID NO: 516220 - DNA, 20 bp, mouse
gtctcggcataaccattcta

SEQ ID NO: 516221 - DNA, 20 bp, mouse
gggcctgttcagttccaagc

SEQ ID NO: 516222 - DNA, 20 bp, mouse
gaaagccacaaagaaaaccc

SEQ ID NO: 516223 - DNA, 20 bp, mouse
ggtggctttcctgggttctg

SEQ ID NO: 516224 - DNA, 20 bp, mouse
gagacctcttcaggaaggaa

SEQ ID NO: 516225 - DNA, 20 bp, mouse
gcagaattgatatcactcac

SEQ ID NO: 516226 - DNA, 20 bp, mouse
gctattacatctgctgacag

SEQ ID NO: 516227 - DNA, 20 bp, mouse
gcttggaacatcacttctca

SEQ ID NO: 516228 - DNA, 20 bp, mouse
gcacatctctgcaccatcct

SEQ ID NO: 516229 - DNA, 20 bp, mouse
gaagaacggtgtggaccaca

SEQ ID NO: 516230 - DNA, 20 bp, mouse
gtagtgataaaataataacc

SEQ ID NO: 516231 - DNA, 20 bp, mouse
ggaacatcacttctcatggc

SEQ ID NO: 516232 - DNA, 20 bp, mouse
gtattaactaacttcaagga

SEQ ID NO: 516233 - DNA, 20 bp, mouse
gcaaagatggccaaatataa

SEQ ID NO: 516234 - DNA, 20 bp, mouse
gagacagtaagcattaaaag

SEQ ID NO: 516235 - DNA, 20 bp, mouse
gtgaagttagttaatacaag

SEQ ID NO: 516236 - DNA, 20 bp, mouse
gaagactgaactgggaacag

SEQ ID NO: 516237 - DNA, 20 bp, mouse
gtgtgctaatcagcagggtc

SEQ ID NO: 516238 - DNA, 20 bp, mouse
ggaagcaaagagggaattcc

SEQ ID NO: 516239 - DNA, 20 bp, mouse
gggatatgtaagactgaact

SEQ ID NO: 516240 - DNA, 20 bp, mouse
gaccaatacgcataagataa

SEQ ID NO: 516241 - DNA, 20 bp, mouse
ggcatgggatagcctggatg

SEQ ID NO: 516242 - DNA, 20 bp, mouse
gggcaactacaagagcgcat

SEQ ID NO: 516243 - DNA, 20 bp, mouse
gggggaataaatctccctca

SEQ ID NO: 516244 - DNA, 20 bp, mouse
ggtgttctgggatgttcact

SEQ ID NO: 516245 - DNA, 20 bp, mouse
gagacatacctgaagcaaag

SEQ ID NO: 516246 - DNA, 20 bp, mouse
gtcaacactagagctgccgg

SEQ ID NO: 516247 - DNA, 20 bp, mouse
gtcagtgtggagtgcagcta

SEQ ID NO: 516248 - DNA, 20 bp, mouse
ggagttgggatcacagaagt

SEQ ID NO: 516249 - DNA, 20 bp, mouse
gcttccatctggactcatct

SEQ ID NO: 516250 - DNA, 20 bp, mouse
gtattcaacactagagctgc

SEQ ID NO: 516251 - DNA, 20 bp, mouse
gggaatgtgggctgtaagtg

SEQ ID NO: 516252 - DNA, 20 bp, mouse
gcactgaagacgtgccaagg

SEQ ID NO: 516253 - DNA, 20 bp, mouse
gcacactcagtggggaatgt

SEQ ID NO: 516254 - DNA, 20 bp, mouse
gtcccctcacctctcctcct

SEQ ID NO: 516255 - DNA, 20 bp, mouse
gggtgaggggaattacaggg

SEQ ID NO: 516256 - DNA, 20 bp, mouse
gcgcacggcgagtctcgagt

SEQ ID NO: 516257 - DNA, 20 bp, mouse
ggaacgacccgaaacttctg

SEQ ID NO: 516258 - DNA, 20 bp, mouse
ggtcggcgcggaggacggag

SEQ ID NO: 516259 - DNA, 20 bp, mouse
ggagcgtcgcgttctaggct

SEQ ID NO: 516260 - DNA, 20 bp, mouse
ggcggaggcgccccaaccca

SEQ ID NO: 516261 - DNA, 20 bp, mouse
gagacagcccgaggccggag

SEQ ID NO: 516262 - DNA, 20 bp, mouse
gaggccggagcggaccgggt

SEQ ID NO: 516263 - DNA, 20 bp, mouse
gaagcgtctagaggaggcca

SEQ ID NO: 516264 - DNA, 20 bp, mouse
gggcgagtctcgagtcggcg

SEQ ID NO: 516265 - DNA, 20 bp, mouse
ggctgggtccccagaagttt

SEQ ID NO: 516266 - DNA, 20 bp, mouse
gatgtgcatgtgattctatg

SEQ ID NO: 516267 - DNA, 20 bp, mouse
gaagcaaacatttctaacaa

SEQ ID NO: 516268 - DNA, 20 bp, mouse
gctcttcacatagcactaca

SEQ ID NO: 516269 - DNA, 20 bp, mouse
ggtgaagagcagctaaaata

SEQ ID NO: 516270 - DNA, 20 bp, mouse
gttagcaagagtcttcccag

SEQ ID NO: 516271 - DNA, 20 bp, mouse
ggaagacatgtaagtctcca

SEQ ID NO: 516272 - DNA, 20 bp, mouse
gttctgtttcacttcagtct

SEQ ID NO: 516273 - DNA, 20 bp, mouse
gacacaacacagaatcctct

SEQ ID NO: 516274 - DNA, 20 bp, mouse
ggacaagaggattaagatta

SEQ ID NO: 516275 - DNA, 20 bp, mouse
gtaggtattctgtgcttcca

SEQ ID NO: 516276 - DNA, 20 bp, mouse
ggcaagttaccaagactgag

SEQ ID NO: 516277 - DNA, 20 bp, mouse
gccaggacaggattcgatgt

SEQ ID NO: 516278 - DNA, 20 bp, mouse
gagaccagagatctactgtg

SEQ ID NO: 516279 - DNA, 20 bp, mouse
gtccacccccagcccaggac

SEQ ID NO: 516280 - DNA, 20 bp, mouse
gagagaagaacagaaaaaac

SEQ ID NO: 516281 - DNA, 20 bp, mouse
gagcaggagattattaacat

SEQ ID NO: 516282 - DNA, 20 bp, mouse
gcgaatcctgtcctgggctg

SEQ ID NO: 516283 - DNA, 20 bp, mouse
gcaggattcgatgtgggcaa

SEQ ID NO: 516284 - DNA, 20 bp, mouse
gggatagtgtcacaatctaa

SEQ ID NO: 516285 - DNA, 20 bp, mouse
ggatctcaattcttgcatgt

SEQ ID NO: 516286 - DNA, 20 bp, mouse
gtgtaaatctgaggtagcca

SEQ ID NO: 516287 - DNA, 20 bp, mouse
gacgaggcaatgataaacat

SEQ ID NO: 516288 - DNA, 20 bp, mouse
ggtgtatctctctgcagcca

SEQ ID NO: 516289 - DNA, 20 bp, mouse
gcctcgtagagatagatgct

SEQ ID NO: 516290 - DNA, 20 bp, mouse
gatgggttggaataatgaaa

SEQ ID NO: 516291 - DNA, 20 bp, mouse
gttacttcagaaactgatcc

SEQ ID NO: 516292 - DNA, 20 bp, mouse
ggttataaatgatttcacag

SEQ ID NO: 516293 - DNA, 20 bp, mouse
gatcatttataacataggat

SEQ ID NO: 516294 - DNA, 20 bp, mouse
ggtagacatatacattcata

SEQ ID NO: 516295 - DNA, 20 bp, mouse
gtctcataattctcacataa

SEQ ID NO: 516296 - DNA, 20 bp, mouse
gagaggtgttctggaagcta

SEQ ID NO: 516297 - DNA, 20 bp, mouse
gagagttccgacctgaacag

SEQ ID NO: 516298 - DNA, 20 bp, mouse
ggacctgaacagaggtgttc

SEQ ID NO: 516299 - DNA, 20 bp, mouse
gcaaagagcagtaaacgcct

SEQ ID NO: 516300 - DNA, 20 bp, mouse
gtggcatcgtctgatactca

SEQ ID NO: 516301 - DNA, 20 bp, mouse
gtgtgggagacggaagagtg

SEQ ID NO: 516302 - DNA, 20 bp, mouse
gtcgcaaaacatcagcatgt

SEQ ID NO: 516303 - DNA, 20 bp, mouse
gaaagagtggctgttattgg

SEQ ID NO: 516304 - DNA, 20 bp, mouse
gttccagaacacctctgttc

SEQ ID NO: 516305 - DNA, 20 bp, mouse
ggagtggctgttattggcgg

SEQ ID NO: 516306 - DNA, 20 bp, mouse
gcatggcgcacagctgtcgg

SEQ ID NO: 516307 - DNA, 20 bp, mouse
ggaacatggcgcacagctgt

SEQ ID NO: 516308 - DNA, 20 bp, mouse
gcccgacccgggaccaccgg

SEQ ID NO: 516309 - DNA, 20 bp, mouse
gcgtaagtgaagcagcgaga

SEQ ID NO: 516310 - DNA, 20 bp, mouse
ggggagaggcgacaacacag

SEQ ID NO: 516311 - DNA, 20 bp, mouse
gttcacttacggggcgaaca

SEQ ID NO: 516312 - DNA, 20 bp, mouse
gagcggggctggggttccag

SEQ ID NO: 516313 - DNA, 20 bp, mouse
gcggcagcggagaggtaagg

SEQ ID NO: 516314 - DNA, 20 bp, mouse
ggcccccggtggtcccgggt

SEQ ID NO: 516315 - DNA, 20 bp, mouse
gagcagggccggccctgagg

SEQ ID NO: 516316 - DNA, 20 bp, mouse
gtctcacggtgccaagatgg

SEQ ID NO: 516317 - DNA, 20 bp, mouse
ggcctccccggcccctctca

SEQ ID NO: 516318 - DNA, 20 bp, mouse
gccctctcacggtgccaaga

SEQ ID NO: 516319 - DNA, 20 bp, mouse
gcccgggaagcggccccgtg

SEQ ID NO: 516320 - DNA, 20 bp, mouse
gtcgcgcaccagcccacagg

SEQ ID NO: 516321 - DNA, 20 bp, mouse
gcccgggcctggctccgcac

SEQ ID NO: 516322 - DNA, 20 bp, mouse
gcgcccccgccggaaccccg

SEQ ID NO: 516323 - DNA, 20 bp, mouse
ggtgtctctagcgccgggta

SEQ ID NO: 516324 - DNA, 20 bp, mouse
gccgggaggagccgagcccg

SEQ ID NO: 516325 - DNA, 20 bp, mouse
gcgcaccagcccacaggcgg

SEQ ID NO: 516326 - DNA, 20 bp, mouse
gcagcagcaggtaccgggag

SEQ ID NO: 516327 - DNA, 20 bp, mouse
gcagcaggtaccgggagagg

SEQ ID NO: 516328 - DNA, 20 bp, mouse
gaccgggagaggcggcaaca

SEQ ID NO: 516329 - DNA, 20 bp, mouse
gggaggagccccccaggagg

SEQ ID NO: 516330 - DNA, 20 bp, mouse
ggatgtcgtcggaggaggac

SEQ ID NO: 516331 - DNA, 20 bp, mouse
ggcggcaacatggagctagc

SEQ ID NO: 516332 - DNA, 20 bp, mouse
gctggtgactaggatgtcgt

SEQ ID NO: 516333 - DNA, 20 bp, mouse
ggtgactaggatgtcgtcgg

SEQ ID NO: 516334 - DNA, 20 bp, mouse
gtgctcgagttgctcctccc

SEQ ID NO: 516335 - DNA, 20 bp, mouse
gactaggatgtcgtcggagg

SEQ ID NO: 516336 - DNA, 20 bp, mouse
gggcttagggagaccaagaa

SEQ ID NO: 516337 - DNA, 20 bp, mouse
gagccgccccccactcgggg

SEQ ID NO: 516338 - DNA, 20 bp, mouse
gaagggtgaccactccgacc

SEQ ID NO: 516339 - DNA, 20 bp, mouse
ggcacagccgccccccactc

SEQ ID NO: 516340 - DNA, 20 bp, mouse
gcctaagcccccccgagtgg

SEQ ID NO: 516341 - DNA, 20 bp, mouse
ggaccaagaacggtaaatcc

SEQ ID NO: 516342 - DNA, 20 bp, mouse
gaagaacggtaaatccaggt

SEQ ID NO: 516343 - DNA, 20 bp, mouse
gcggtaaatccaggtcggag

SEQ ID NO: 516344 - DNA, 20 bp, mouse
gccagaaagggttggactag

SEQ ID NO: 516345 - DNA, 20 bp, mouse
gctccctaagcccccccgag

SEQ ID NO: 516346 - DNA, 20 bp, mouse
gtcgagcctgcgttcgggag

SEQ ID NO: 516347 - DNA, 20 bp, mouse
gtgacactgagcgggcgcag

SEQ ID NO: 516348 - DNA, 20 bp, mouse
ggcaggctcgatctccgact

SEQ ID NO: 516349 - DNA, 20 bp, mouse
ggagaagcagtgacactgag

SEQ ID NO: 516350 - DNA, 20 bp, mouse
gtctcgctctgggaaaatgg

SEQ ID NO: 516351 - DNA, 20 bp, mouse
gggccacggcaggaatgacg

SEQ ID NO: 516352 - DNA, 20 bp, mouse
gccgcagtggctgtcgtcgg

SEQ ID NO: 516353 - DNA, 20 bp, mouse
gggagatcgagcctgcgttc

SEQ ID NO: 516354 - DNA, 20 bp, mouse
gcgttcgggagcggcagcag

SEQ ID NO: 516355 - DNA, 20 bp, mouse
gcagtgggaacccaagagtc

SEQ ID NO: 516356 - DNA, 20 bp, mouse
ggccagggttctagtgacgt

SEQ ID NO: 516357 - DNA, 20 bp, mouse
gcccagctccctgagatcct

SEQ ID NO: 516358 - DNA, 20 bp, mouse
ggctgtcacctaggatctca

SEQ ID NO: 516359 - DNA, 20 bp, mouse
gtgttgggacgccacaccca

SEQ ID NO: 516360 - DNA, 20 bp, mouse
gtgacgtgggtctgcctcat

SEQ ID NO: 516361 - DNA, 20 bp, mouse
gtgggacgccacacccaggg

SEQ ID NO: 516362 - DNA, 20 bp, mouse
gtggccggcagcatcatcat

SEQ ID NO: 516363 - DNA, 20 bp, mouse
gtccatgcaggtctaccctg

SEQ ID NO: 516364 - DNA, 20 bp, mouse
gcctctgtcagctgtcacct

SEQ ID NO: 516365 - DNA, 20 bp, mouse
ggcagcagcagccttggaca

SEQ ID NO: 516366 - DNA, 20 bp, mouse
ggccgggcgcgcgtagctgg

SEQ ID NO: 516367 - DNA, 20 bp, mouse
gccgcagtgtcgccaaacgg

SEQ ID NO: 516368 - DNA, 20 bp, mouse
gagcgggcgcgttgccatgg

SEQ ID NO: 516369 - DNA, 20 bp, mouse
gggcgcagggtgcaccccgg

SEQ ID NO: 516370 - DNA, 20 bp, mouse
ggcctcccggggcttctacg

SEQ ID NO: 516371 - DNA, 20 bp, mouse
ggcgtccccgcgccaccgtt

SEQ ID NO: 516372 - DNA, 20 bp, mouse
gggcagatcccggtccaagc

SEQ ID NO: 516373 - DNA, 20 bp, mouse
gctctggcgggtcctttccc

SEQ ID NO: 516374 - DNA, 20 bp, mouse
gcagaccggagctctgtcca

SEQ ID NO: 516375 - DNA, 20 bp, mouse
ggcaggcgcagggtgcaccc

SEQ ID NO: 516376 - DNA, 20 bp, mouse
gtgttgcaccgagtgatcga

SEQ ID NO: 516377 - DNA, 20 bp, mouse
gcactcggtgcaacatatac

SEQ ID NO: 516378 - DNA, 20 bp, mouse
ggtgatcgagggcactaaaa

SEQ ID NO: 516379 - DNA, 20 bp, mouse
gctgaagcagtttaaccctg

SEQ ID NO: 516380 - DNA, 20 bp, mouse
gggttgccactttttacccc

SEQ ID NO: 516381 - DNA, 20 bp, mouse
gagagctgacattattgcct

SEQ ID NO: 516382 - DNA, 20 bp, mouse
gttaaccctggggtaaaaag

SEQ ID NO: 516383 - DNA, 20 bp, mouse
gccctcctgggatgaataca

SEQ ID NO: 516384 - DNA, 20 bp, mouse
gtaagggagagttccctcct

SEQ ID NO: 516385 - DNA, 20 bp, mouse
gacaggcagtgctagatact

SEQ ID NO: 516386 - DNA, 20 bp, mouse
ggcattaagcttcttcagag

SEQ ID NO: 516387 - DNA, 20 bp, mouse
gttaatgctaggttacaaag

SEQ ID NO: 516388 - DNA, 20 bp, mouse
gcactcggtacaacacaaac

SEQ ID NO: 516389 - DNA, 20 bp, mouse
gcttgagatccagccaggta

SEQ ID NO: 516390 - DNA, 20 bp, mouse
gctctgcttgagatccagcc

SEQ ID NO: 516391 - DNA, 20 bp, mouse
gaatgctcttgttccatacc

SEQ ID NO: 516392 - DNA, 20 bp, mouse
ggtgaccaagcgcgctaaaa

SEQ ID NO: 516393 - DNA, 20 bp, mouse
gctcttgttccatacctggc

SEQ ID NO: 516394 - DNA, 20 bp, mouse
gaacaagagcattgcaacat

SEQ ID NO: 516395 - DNA, 20 bp, mouse
gctcaccattttagcgcgct

SEQ ID NO: 516396 - DNA, 20 bp, mouse
gtagcgaaccaggtgagtgc

SEQ ID NO: 516397 - DNA, 20 bp, mouse
gagccgtcccgccttggagt

SEQ ID NO: 516398 - DNA, 20 bp, mouse
gcttggcctgctagcgaacc

SEQ ID NO: 516399 - DNA, 20 bp, mouse
ggcgtgcagcaccttcctcg

SEQ ID NO: 516400 - DNA, 20 bp, mouse
gggaaggtgctgcacgctgg

SEQ ID NO: 516401 - DNA, 20 bp, mouse
gctagcaagcagcctgcggt

SEQ ID NO: 516402 - DNA, 20 bp, mouse
ggctgcgcggctgctcacgc

SEQ ID NO: 516403 - DNA, 20 bp, mouse
ggtaggcatggggatgatcc

SEQ ID NO: 516404 - DNA, 20 bp, mouse
gggatcagatctgcgagggt

SEQ ID NO: 516405 - DNA, 20 bp, mouse
gcggcttggagagaaaccga

SEQ ID NO: 516406 - DNA, 20 bp, mouse
ggcggcggcagactctaacg

SEQ ID NO: 516407 - DNA, 20 bp, mouse
ggcagactctaacgaggact

SEQ ID NO: 516408 - DNA, 20 bp, mouse
gtgcggagcattatttgaaa

SEQ ID NO: 516409 - DNA, 20 bp, mouse
gagcggagagaacggcggat

SEQ ID NO: 516410 - DNA, 20 bp, mouse
gatcccgcagagcttaaccc

SEQ ID NO: 516411 - DNA, 20 bp, mouse
gcgcagctcggcatcgagtg

SEQ ID NO: 516412 - DNA, 20 bp, mouse
gatgggagcagccggcaccg

SEQ ID NO: 516413 - DNA, 20 bp, mouse
gcagagcttaaccccggtgc

SEQ ID NO: 516414 - DNA, 20 bp, mouse
gacgatggccagtgctaaga

SEQ ID NO: 516415 - DNA, 20 bp, mouse
gaacggcggatgggagcagc

SEQ ID NO: 516416 - DNA, 20 bp, mouse
ggggaaggtaaaatgagtag

SEQ ID NO: 516417 - DNA, 20 bp, mouse
gaaggtaaaatgagtagggg

SEQ ID NO: 516418 - DNA, 20 bp, mouse
gtcccgccaattcaaatcag

SEQ ID NO: 516419 - DNA, 20 bp, mouse
ggtctcacacttcttcccga

SEQ ID NO: 516420 - DNA, 20 bp, mouse
gaggggcggttgtgtccgtc

SEQ ID NO: 516421 - DNA, 20 bp, mouse
gttcaaatcagtggcaggga

SEQ ID NO: 516422 - DNA, 20 bp, mouse
gatcgatctctagatgatgg

SEQ ID NO: 516423 - DNA, 20 bp, mouse
ggaaagtgtagtcttaaacg

SEQ ID NO: 516424 - DNA, 20 bp, mouse
gctggtgaaagagagcaaac

SEQ ID NO: 516425 - DNA, 20 bp, mouse
gccttgcggctcgatgggag

SEQ ID NO: 516426 - DNA, 20 bp, mouse
gggtctcgcggctctgtgag

SEQ ID NO: 516427 - DNA, 20 bp, mouse
ggaccagccggcgcgcacca

SEQ ID NO: 516428 - DNA, 20 bp, mouse
gtcccggtgccactacgaag

SEQ ID NO: 516429 - DNA, 20 bp, mouse
ggcgaggtgcccccactcac

SEQ ID NO: 516430 - DNA, 20 bp, mouse
gagcgtctccctcttcgtag

SEQ ID NO: 516431 - DNA, 20 bp, mouse
ggcggctctgtgagcggcag

SEQ ID NO: 516432 - DNA, 20 bp, mouse
gggcctggtgagcgccgccg

SEQ ID NO: 516433 - DNA, 20 bp, mouse
gggacccgagggaggccccg

SEQ ID NO: 516434 - DNA, 20 bp, mouse
gccccgaccggcgttcctca

SEQ ID NO: 516435 - DNA, 20 bp, mouse
gacgcaccggagcgacgcga

SEQ ID NO: 516436 - DNA, 20 bp, mouse
ggcacgaggcacaaaatctg

SEQ ID NO: 516437 - DNA, 20 bp, mouse
ggccacgccggggtcagggt

SEQ ID NO: 516438 - DNA, 20 bp, mouse
ggcgttgccaaccctgaccc

SEQ ID NO: 516439 - DNA, 20 bp, mouse
gacccgccccgaggcctggt

SEQ ID NO: 516440 - DNA, 20 bp, mouse
gaagctgcgtctcctccccg

SEQ ID NO: 516441 - DNA, 20 bp, mouse
gccggctgtacaggtaggaa

SEQ ID NO: 516442 - DNA, 20 bp, mouse
gctgctccgaccaggcctcg

SEQ ID NO: 516443 - DNA, 20 bp, mouse
gctccgaccaggcctcgggg

SEQ ID NO: 516444 - DNA, 20 bp, mouse
gcgggtcaagggcttaactg

SEQ ID NO: 516445 - DNA, 20 bp, mouse
gagccggtcctgagcagtaa

SEQ ID NO: 516446 - DNA, 20 bp, mouse
gccgcaggagcagacgcctc

SEQ ID NO: 516447 - DNA, 20 bp, mouse
ggagcgggaggggacgaagg

SEQ ID NO: 516448 - DNA, 20 bp, mouse
ggccagccggcgagagccag

SEQ ID NO: 516449 - DNA, 20 bp, mouse
ggcggtggttctccaagccg

SEQ ID NO: 516450 - DNA, 20 bp, mouse
gcggcggcggcgagtcgagc

SEQ ID NO: 516451 - DNA, 20 bp, mouse
ggcggcgagtcgagcgggag

SEQ ID NO: 516452 - DNA, 20 bp, mouse
gccatggctgcgcgcggctc

SEQ ID NO: 516453 - DNA, 20 bp, mouse
gaagccggggttctcggcca

SEQ ID NO: 516454 - DNA, 20 bp, mouse
gtctcggccatggctgcgcg

SEQ ID NO: 516455 - DNA, 20 bp, mouse
gccgcgcgggaggacggacc

SEQ ID NO: 516456 - DNA, 20 bp, mouse
gtgtgctgccggctgagagg

SEQ ID NO: 516457 - DNA, 20 bp, mouse
ggctctggcgaagacgactg

SEQ ID NO: 516458 - DNA, 20 bp, mouse
gaagccgggccctcagatcg

SEQ ID NO: 516459 - DNA, 20 bp, mouse
gtcgggtaccacagcagctc

SEQ ID NO: 516460 - DNA, 20 bp, mouse
gaagacgactgcggggccag

SEQ ID NO: 516461 - DNA, 20 bp, mouse
gactgcggggccagcggcgg

SEQ ID NO: 516462 - DNA, 20 bp, mouse
ggctgcctccccctctcagc

SEQ ID NO: 516463 - DNA, 20 bp, mouse
gggaggcagcctcgatctga

SEQ ID NO: 516464 - DNA, 20 bp, mouse
ggaatgtgctgccggctgag

SEQ ID NO: 516465 - DNA, 20 bp, mouse
ggctgccggctgagaggggg

SEQ ID NO: 516466 - DNA, 20 bp, mouse
ggccgcagcggtagcttcag

SEQ ID NO: 516467 - DNA, 20 bp, mouse
ggagcgagcggagccgcgat

SEQ ID NO: 516468 - DNA, 20 bp, mouse
gaccgctgaagctaccgctg

SEQ ID NO: 516469 - DNA, 20 bp, mouse
ggtagcctcggcagacaata

SEQ ID NO: 516470 - DNA, 20 bp, mouse
gtccgctcgctcggacttgg

SEQ ID NO: 516471 - DNA, 20 bp, mouse
ggctcgctcggacttggcgg

SEQ ID NO: 516472 - DNA, 20 bp, mouse
gcggcaggcgcagggcgaga

SEQ ID NO: 516473 - DNA, 20 bp, mouse
ggtagcttcagcggtagcct

SEQ ID NO: 516474 - DNA, 20 bp, mouse
gccgcttcactcacccatcg

SEQ ID NO: 516475 - DNA, 20 bp, mouse
gagccctaaactggcccgag

SEQ ID NO: 516476 - DNA, 20 bp, mouse
gcagcagcgtccacagggac

SEQ ID NO: 516477 - DNA, 20 bp, mouse
gccccacagcagcgtccaca

SEQ ID NO: 516478 - DNA, 20 bp, mouse
gaatgccctcaggagagagt

SEQ ID NO: 516479 - DNA, 20 bp, mouse
gctcttaggaccctctgtca

SEQ ID NO: 516480 - DNA, 20 bp, mouse
gataggagcccagttagtca

SEQ ID NO: 516481 - DNA, 20 bp, mouse
ggactactctgagaaaacct

SEQ ID NO: 516482 - DNA, 20 bp, mouse
gctgctgtgggggagatatc

SEQ ID NO: 516483 - DNA, 20 bp, mouse
gctgtcaaggcttgaaaaaa

SEQ ID NO: 516484 - DNA, 20 bp, mouse
gtaagagcccagacagttac

SEQ ID NO: 516485 - DNA, 20 bp, mouse
gtaatgagtagtaaggatct

SEQ ID NO: 516486 - DNA, 20 bp, mouse
gagcgcggctgctgctcggg

SEQ ID NO: 516487 - DNA, 20 bp, mouse
ggcgctccgagctgcccccg

SEQ ID NO: 516488 - DNA, 20 bp, mouse
gatctgccgggagagatggg

SEQ ID NO: 516489 - DNA, 20 bp, mouse
ggccctcctaatgtgctagg

SEQ ID NO: 516490 - DNA, 20 bp, mouse
gtccatggcggaggtgacgg

SEQ ID NO: 516491 - DNA, 20 bp, mouse
gcggctccgactggggatgg

SEQ ID NO: 516492 - DNA, 20 bp, mouse
ggccgcctagcacattagga

SEQ ID NO: 516493 - DNA, 20 bp, mouse
gccagaggcagccggtgaat

SEQ ID NO: 516494 - DNA, 20 bp, mouse
gggcggcccggcctgtcggg

SEQ ID NO: 516495 - DNA, 20 bp, mouse
gcgggcggcggctccgactg

SEQ ID NO: 516496 - DNA, 20 bp, mouse
gctgctgaggagggtgagtc

SEQ ID NO: 516497 - DNA, 20 bp, mouse
gaagctgggtcctgggatca

SEQ ID NO: 516498 - DNA, 20 bp, mouse
gagtctggaagctgggtcct

SEQ ID NO: 516499 - DNA, 20 bp, mouse
ggagggtgagtctggaagct

SEQ ID NO: 516500 - DNA, 20 bp, mouse
gatccatcacccatgatccc

SEQ ID NO: 516501 - DNA, 20 bp, mouse
ggtcctgggatcatgggtga

SEQ ID NO: 516502 - DNA, 20 bp, mouse
gagcaggcacaaagtcattc

SEQ ID NO: 516503 - DNA, 20 bp, mouse
ggatacctggagaaaagacc

SEQ ID NO: 516504 - DNA, 20 bp, mouse
ggcagagggacatcagtctg

SEQ ID NO: 516505 - DNA, 20 bp, mouse
gcacaaagtcattcaggcta

SEQ ID NO: 516506 - DNA, 20 bp, mouse
gtcgcggagggccaggatgg

SEQ ID NO: 516507 - DNA, 20 bp, mouse
gctccgcgatcggtcccaga

SEQ ID NO: 516508 - DNA, 20 bp, mouse
gggccatctgggaccgatcg

SEQ ID NO: 516509 - DNA, 20 bp, mouse
gcgatcgcggagggccagga

SEQ ID NO: 516510 - DNA, 20 bp, mouse
gcatcagtatgcgctagtgg

SEQ ID NO: 516511 - DNA, 20 bp, mouse
gctagtggaggtttcctgac

SEQ ID NO: 516512 - DNA, 20 bp, mouse
gacggccgcctcccccatcc

SEQ ID NO: 516513 - DNA, 20 bp, mouse
gggacaaggtccctctgcca

SEQ ID NO: 516514 - DNA, 20 bp, mouse
gtggggagcatcaggccatc

SEQ ID NO: 516515 - DNA, 20 bp, mouse
gctgtcggaggtcttgatag

SEQ ID NO: 516516 - DNA, 20 bp, mouse
gcgcggcgcggagagaggta

SEQ ID NO: 516517 - DNA, 20 bp, mouse
gggcgcgggagcgggactcc

SEQ ID NO: 516518 - DNA, 20 bp, mouse
ggcgcactccgggctcgatt

SEQ ID NO: 516519 - DNA, 20 bp, mouse
gcgcggcgcgggcctgaagg

SEQ ID NO: 516520 - DNA, 20 bp, mouse
gggctcgattcggcaggcgg

SEQ ID NO: 516521 - DNA, 20 bp, mouse
ggctcgctccgggtccgaaa

SEQ ID NO: 516522 - DNA, 20 bp, mouse
ggccgcgccgagctccgcac

SEQ ID NO: 516523 - DNA, 20 bp, mouse
ggaatgaagccggctcgggg

SEQ ID NO: 516524 - DNA, 20 bp, mouse
ggagcccaggagagcgaggg

SEQ ID NO: 516525 - DNA, 20 bp, mouse
gcggatgccgggtgcagcag

SEQ ID NO: 516526 - DNA, 20 bp, mouse
gaagcgggaccacccctccc

SEQ ID NO: 516527 - DNA, 20 bp, mouse
ggcgcttcgcatcccgggag

SEQ ID NO: 516528 - DNA, 20 bp, mouse
gccgcagagttggctcgtct

SEQ ID NO: 516529 - DNA, 20 bp, mouse
gcttcgcatcccgggagggg

SEQ ID NO: 516530 - DNA, 20 bp, mouse
gtggctcgtctgggtcggtc

SEQ ID NO: 516531 - DNA, 20 bp, mouse
gagagttggctcgtctgggt

SEQ ID NO: 516532 - DNA, 20 bp, mouse
ggccgcaccggaagctgggt

SEQ ID NO: 516533 - DNA, 20 bp, mouse
gggcgttcgtcggtccgcaa

SEQ ID NO: 516534 - DNA, 20 bp, mouse
gacaccgagaaccgcagagt

SEQ ID NO: 516535 - DNA, 20 bp, mouse
gccgtgtgtcctgggagaag

SEQ ID NO: 516536 - DNA, 20 bp, mouse
gaggaagccgaggtccgagg

SEQ ID NO: 516537 - DNA, 20 bp, mouse
gaacgccggccgggggtcag

SEQ ID NO: 516538 - DNA, 20 bp, mouse
gcgccaacaacgccggccgg

SEQ ID NO: 516539 - DNA, 20 bp, mouse
gaccaggccgcgggagttga

SEQ ID NO: 516540 - DNA, 20 bp, mouse
gccatggccgagggacctca

SEQ ID NO: 516541 - DNA, 20 bp, mouse
gggagacctgacttcctgag

SEQ ID NO: 516542 - DNA, 20 bp, mouse
gagtcagccgcgggtggtgg

SEQ ID NO: 516543 - DNA, 20 bp, mouse
ggggttctgaggagagagtc

SEQ ID NO: 516544 - DNA, 20 bp, mouse
gctgtccagtcagccgcggg

SEQ ID NO: 516545 - DNA, 20 bp, mouse
gaactcccgcggcctggtga

SEQ ID NO: 516546 - DNA, 20 bp, mouse
gccgtcagtgcgggaccccc

SEQ ID NO: 516547 - DNA, 20 bp, mouse
gggcgcggcccggggcagag

SEQ ID NO: 516548 - DNA, 20 bp, mouse
ggcggagagcagcgcgagac

SEQ ID NO: 516549 - DNA, 20 bp, mouse
ggcgccatgggccgtcagtg

SEQ ID NO: 516550 - DNA, 20 bp, mouse
ggacccccgggcgcggcccg

SEQ ID NO: 516551 - DNA, 20 bp, mouse
gagtagtctgcactcggtac

SEQ ID NO: 516552 - DNA, 20 bp, mouse
gtggccgagagcaccacctc

SEQ ID NO: 516553 - DNA, 20 bp, mouse
ggaggcaaggaagggcgtgt

SEQ ID NO: 516554 - DNA, 20 bp, mouse
gagttagaagccggcactcg

SEQ ID NO: 516555 - DNA, 20 bp, mouse
gacgcgcgagagagggcgag

SEQ ID NO: 516556 - DNA, 20 bp, mouse
gcttagtccacgacaggcag

SEQ ID NO: 516557 - DNA, 20 bp, mouse
gctgatcgcgggagacagac

SEQ ID NO: 516558 - DNA, 20 bp, mouse
ggggagacagacaggaatcg

SEQ ID NO: 516559 - DNA, 20 bp, mouse
gtctcccgcgatcagggtca

SEQ ID NO: 516560 - DNA, 20 bp, mouse
gcagctgcccctgcctgtcg

SEQ ID NO: 516561 - DNA, 20 bp, mouse
gcactccctgaccctgatcg

SEQ ID NO: 516562 - DNA, 20 bp, mouse
gacctctagaggaccctaac

SEQ ID NO: 516563 - DNA, 20 bp, mouse
gccctaacgggagagttaca

SEQ ID NO: 516564 - DNA, 20 bp, mouse
ggtctccccaggtcccgccg

SEQ ID NO: 516565 - DNA, 20 bp, mouse
gcacccagtcaaaaggacac

SEQ ID NO: 516566 - DNA, 20 bp, mouse
gttcacctttaggcacccag

SEQ ID NO: 516567 - DNA, 20 bp, mouse
ggaggcgcgcggttccggca

SEQ ID NO: 516568 - DNA, 20 bp, mouse
gcgcgcctctgggtgcctaa

SEQ ID NO: 516569 - DNA, 20 bp, mouse
gtcatcgctggagtcagact

SEQ ID NO: 516570 - DNA, 20 bp, mouse
ggctatggagatccggacgt

SEQ ID NO: 516571 - DNA, 20 bp, mouse
gaaacgctgcgttcaccttt

SEQ ID NO: 516572 - DNA, 20 bp, mouse
ggcgcgcggttccggcatgg

SEQ ID NO: 516573 - DNA, 20 bp, mouse
gttcctcacgctcgcggtaa

SEQ ID NO: 516574 - DNA, 20 bp, mouse
gctggagtcagactcggaac

SEQ ID NO: 516575 - DNA, 20 bp, mouse
gatggagatccggacgtcgg

SEQ ID NO: 516576 - DNA, 20 bp, mouse
ggagcccgaagctggtggag

SEQ ID NO: 516577 - DNA, 20 bp, mouse
gaccagcttcgggctcccaa

SEQ ID NO: 516578 - DNA, 20 bp, mouse
gtggggtgggcctcctagat

SEQ ID NO: 516579 - DNA, 20 bp, mouse
gtattgcccggcgccggtag

SEQ ID NO: 516580 - DNA, 20 bp, mouse
gtgcccggcgccggtagcgg

SEQ ID NO: 516581 - DNA, 20 bp, mouse
ggcggtgggatggcgagctg

SEQ ID NO: 516582 - DNA, 20 bp, mouse
gagacgccggctggagccaa

SEQ ID NO: 516583 - DNA, 20 bp, mouse
gagggagaggaaggacggtg

SEQ ID NO: 516584 - DNA, 20 bp, mouse
gggcggcagtcgaaggatgg

SEQ ID NO: 516585 - DNA, 20 bp, mouse
gtgaagggttcctggagccg

SEQ ID NO: 516586 - DNA, 20 bp, mouse
gaagcgtgagacccaaggtg

SEQ ID NO: 516587 - DNA, 20 bp, mouse
gtttgcgatggcaacttctg

SEQ ID NO: 516588 - DNA, 20 bp, mouse
ggccggaagcagttttgcga

SEQ ID NO: 516589 - DNA, 20 bp, mouse
gaacagaagcgtgagaccca

SEQ ID NO: 516590 - DNA, 20 bp, mouse
ggcactgcacagcctaaaag

SEQ ID NO: 516591 - DNA, 20 bp, mouse
gtcacgtttttgagcttctt

SEQ ID NO: 516592 - DNA, 20 bp, mouse
ggaggatgcggatcaggatc

SEQ ID NO: 516593 - DNA, 20 bp, mouse
ggtctcgcactgcctcacct

SEQ ID NO: 516594 - DNA, 20 bp, mouse
gcggctaccccggctaccgc

SEQ ID NO: 516595 - DNA, 20 bp, mouse
gcgagggttgcgggtgttga

SEQ ID NO: 516596 - DNA, 20 bp, mouse
gctcatgatgccttagagag

SEQ ID NO: 516597 - DNA, 20 bp, mouse
gttgctctcacctctctcta

SEQ ID NO: 516598 - DNA, 20 bp, mouse
gccaccgcggcacagggacc

SEQ ID NO: 516599 - DNA, 20 bp, mouse
gtctgtgggagttctggtag

SEQ ID NO: 516600 - DNA, 20 bp, mouse
gctatgcgccgcagcggtgg

SEQ ID NO: 516601 - DNA, 20 bp, mouse
gtctgcgctggaagctgact

SEQ ID NO: 516602 - DNA, 20 bp, mouse
ggctccaggtccctgtgccg

SEQ ID NO: 516603 - DNA, 20 bp, mouse
gagagtcttatgaaccttgg

SEQ ID NO: 516604 - DNA, 20 bp, mouse
ggcagctctatgcgccgcag

SEQ ID NO: 516605 - DNA, 20 bp, mouse
ggctctatgcgccgcagcgg

SEQ ID NO: 516606 - DNA, 20 bp, mouse
ggagctgtatagaacagaca

SEQ ID NO: 516607 - DNA, 20 bp, mouse
gggtggtgtagtgtagccca

SEQ ID NO: 516608 - DNA, 20 bp, mouse
gagttctcttcctcccgcag

SEQ ID NO: 516609 - DNA, 20 bp, mouse
gttggtagcaggcactccct

SEQ ID NO: 516610 - DNA, 20 bp, mouse
gtctcttcctcccgcagtgg

SEQ ID NO: 516611 - DNA, 20 bp, mouse
gctggtgctggaaaccctga

SEQ ID NO: 516612 - DNA, 20 bp, mouse
gaaaggctcggcactgtcct

SEQ ID NO: 516613 - DNA, 20 bp, mouse
ggtggattcggaggagatgg

SEQ ID NO: 516614 - DNA, 20 bp, mouse
gggcggtggtggatccgtca

SEQ ID NO: 516615 - DNA, 20 bp, mouse
gcttcctcccgcagtggagg

SEQ ID NO: 516616 - DNA, 20 bp, mouse
gcagcactgcggtctctctt

SEQ ID NO: 516617 - DNA, 20 bp, mouse
gttctgtgaggaagacctcc

SEQ ID NO: 516618 - DNA, 20 bp, mouse
gcataggcagagccaagccc

SEQ ID NO: 516619 - DNA, 20 bp, mouse
gaggtcttcctcacagaatg

SEQ ID NO: 516620 - DNA, 20 bp, mouse
gcgacatgctgttgctggag

SEQ ID NO: 516621 - DNA, 20 bp, mouse
gcctgccgccccattctgtg

SEQ ID NO: 516622 - DNA, 20 bp, mouse
gagtgctggtatgccagaag

SEQ ID NO: 516623 - DNA, 20 bp, mouse
ggagcgaaccttacccaggt

SEQ ID NO: 516624 - DNA, 20 bp, mouse
gggatagctggaagctcggg

SEQ ID NO: 516625 - DNA, 20 bp, mouse
gtagagagcgaaccttaccc

SEQ ID NO: 516626 - DNA, 20 bp, mouse
gtggaagcggcagctcatgg

SEQ ID NO: 516627 - DNA, 20 bp, mouse
gcatggaggaactctggaag

SEQ ID NO: 516628 - DNA, 20 bp, mouse
gtcagctggaggctatggag

SEQ ID NO: 516629 - DNA, 20 bp, mouse
ggagggtcagctggaggcta

SEQ ID NO: 516630 - DNA, 20 bp, mouse
gccacctccatagctcatgg

SEQ ID NO: 516631 - DNA, 20 bp, mouse
gtcgatggtggcctcctctc

SEQ ID NO: 516632 - DNA, 20 bp, mouse
gcatagtcttctcttggcct

SEQ ID NO: 516633 - DNA, 20 bp, mouse
gaaaccacctccatagctca

SEQ ID NO: 516634 - DNA, 20 bp, mouse
gcaaggcgcgcaccttatcc

SEQ ID NO: 516635 - DNA, 20 bp, mouse
ggagcccagctagtccagag

SEQ ID NO: 516636 - DNA, 20 bp, mouse
gagcaagtgagcgagtgagt

SEQ ID NO: 516637 - DNA, 20 bp, mouse
ggtggccatggctttgagag

SEQ ID NO: 516638 - DNA, 20 bp, mouse
gtagccacctccaatcccac

SEQ ID NO: 516639 - DNA, 20 bp, mouse
gagggctcttgtggtatcgg

SEQ ID NO: 516640 - DNA, 20 bp, mouse
ggtaaccgacatgcccccgt

SEQ ID NO: 516641 - DNA, 20 bp, mouse
gagcacctacgggggcatgt

SEQ ID NO: 516642 - DNA, 20 bp, mouse
gggatgatagtgctttatag

SEQ ID NO: 516643 - DNA, 20 bp, mouse
gtgaagggctcttgtggtat

SEQ ID NO: 516644 - DNA, 20 bp, mouse
gtggcggctgcaggtggcca

SEQ ID NO: 516645 - DNA, 20 bp, mouse
gctcacctctctcaaagcca

SEQ ID NO: 516646 - DNA, 20 bp, mouse
gtgtctgcagatggctgata

SEQ ID NO: 516647 - DNA, 20 bp, mouse
ggctatgtagggattcttag

SEQ ID NO: 516648 - DNA, 20 bp, mouse
gtttcccacagcagcctgag

SEQ ID NO: 516649 - DNA, 20 bp, mouse
gatgccccatgggcttagaa

SEQ ID NO: 516650 - DNA, 20 bp, mouse
ggaatgcgtgtgtctgcaga

SEQ ID NO: 516651 - DNA, 20 bp, mouse
ggagcaggattcaaagtcct

SEQ ID NO: 516652 - DNA, 20 bp, mouse
gctcaggagatgagaagaac

SEQ ID NO: 516653 - DNA, 20 bp, mouse
gcggttaaacgaatatctgt

SEQ ID NO: 516654 - DNA, 20 bp, mouse
gaagagagaagggccagtgc

SEQ ID NO: 516655 - DNA, 20 bp, mouse
gctgtgtggggttgcctctc

SEQ ID NO: 516656 - DNA, 20 bp, mouse
ggagtctctcctgcttgcta

SEQ ID NO: 516657 - DNA, 20 bp, mouse
ggtggagggagtctctatgg

SEQ ID NO: 516658 - DNA, 20 bp, mouse
gtctcctgcttgctagggac

SEQ ID NO: 516659 - DNA, 20 bp, mouse
gtaggggcaacaggcactgc

SEQ ID NO: 516660 - DNA, 20 bp, mouse
gataaggagtcccaggctag

SEQ ID NO: 516661 - DNA, 20 bp, mouse
ggctaggtttgtctcctcgg

SEQ ID NO: 516662 - DNA, 20 bp, mouse
gtcagtgttggcctgctcta

SEQ ID NO: 516663 - DNA, 20 bp, mouse
ggtagagctgcctccaaaag

SEQ ID NO: 516664 - DNA, 20 bp, mouse
gctagcaagagtgtctgagc

SEQ ID NO: 516665 - DNA, 20 bp, mouse
gcttcctgtccctagcaagc

SEQ ID NO: 516666 - DNA, 20 bp, mouse
gagggctcctgtggcatcgg

SEQ ID NO: 516667 - DNA, 20 bp, mouse
ggagccaccaccgatgccac

SEQ ID NO: 516668 - DNA, 20 bp, mouse
gtgaagggctcctgtggcat

SEQ ID NO: 516669 - DNA, 20 bp, mouse
ggtaactgacatgcccccgc

SEQ ID NO: 516670 - DNA, 20 bp, mouse
gctgaggaactggagagtgt

SEQ ID NO: 516671 - DNA, 20 bp, mouse
gagagagaactgctcagtgg

SEQ ID NO: 516672 - DNA, 20 bp, mouse
gagaagagagaactgctcag

SEQ ID NO: 516673 - DNA, 20 bp, mouse
gggtggccatgctgaggaac

SEQ ID NO: 516674 - DNA, 20 bp, mouse
gagagtgtgggcaagtgagc

SEQ ID NO: 516675 - DNA, 20 bp, mouse
gtgagggtgcctcagactcc

SEQ ID NO: 516676 - DNA, 20 bp, mouse
gtggcagcgggcaacggatg

SEQ ID NO: 516677 - DNA, 20 bp, mouse
gtcatggtggcagcgggcaa

SEQ ID NO: 516678 - DNA, 20 bp, mouse
ggagcccttgatagagctgg

SEQ ID NO: 516679 - DNA, 20 bp, mouse
ggcactggcagtggttatgg

SEQ ID NO: 516680 - DNA, 20 bp, mouse
ggaggtaaactggcggatgg

SEQ ID NO: 516681 - DNA, 20 bp, mouse
gcccagcgcagcacgcatct

SEQ ID NO: 516682 - DNA, 20 bp, mouse
gcctcctccagctctatcaa

SEQ ID NO: 516683 - DNA, 20 bp, mouse
ggtaaactggcggatggtgg

SEQ ID NO: 516684 - DNA, 20 bp, mouse
gtggcctgggtagtgctctt

SEQ ID NO: 516685 - DNA, 20 bp, mouse
ggaggagcccttgatagagc

SEQ ID NO: 516686 - DNA, 20 bp, mouse
gcagaacaggagttccgccg

SEQ ID NO: 516687 - DNA, 20 bp, mouse
gcccgcggcgatataacaac

SEQ ID NO: 516688 - DNA, 20 bp, mouse
gggagttccgccgcggaggg

SEQ ID NO: 516689 - DNA, 20 bp, mouse
gagagccaccccagacagag

SEQ ID NO: 516690 - DNA, 20 bp, mouse
gcaggcctggcgggaatggg

SEQ ID NO: 516691 - DNA, 20 bp, mouse
gatcgccgcgggaggaggta

SEQ ID NO: 516692 - DNA, 20 bp, mouse
gcaggtaaggggcctaaggg

SEQ ID NO: 516693 - DNA, 20 bp, mouse
gccgtgtcccgctctgtctg

SEQ ID NO: 516694 - DNA, 20 bp, mouse
gacaggagttccgccgcgga

SEQ ID NO: 516695 - DNA, 20 bp, mouse
ggcgatataacaacaggtcg

SEQ ID NO: 516696 - DNA, 20 bp, mouse
ggaccagagcgaaggaaaaa

SEQ ID NO: 516697 - DNA, 20 bp, mouse
ggaggtctggcgatagctat

SEQ ID NO: 516698 - DNA, 20 bp, mouse
gtaggaagtcatgatgagga

SEQ ID NO: 516699 - DNA, 20 bp, mouse
gactccgccatagctcccgg

SEQ ID NO: 516700 - DNA, 20 bp, mouse
ggcgcacccagcatccacgg

SEQ ID NO: 516701 - DNA, 20 bp, mouse
ggacgaggtcacgaagcggg

SEQ ID NO: 516702 - DNA, 20 bp, mouse
gacgaagcgggtggaggaca

SEQ ID NO: 516703 - DNA, 20 bp, mouse
gggccttgtcactcctcctg

SEQ ID NO: 516704 - DNA, 20 bp, mouse
gcgtcctccgggagctatgg

SEQ ID NO: 516705 - DNA, 20 bp, mouse
ggcgaaggaaaaagggacgc

SEQ ID NO: 516706 - DNA, 20 bp, mouse
ggtctcccgacagcacactt

SEQ ID NO: 516707 - DNA, 20 bp, mouse
gatattcctgagcagatccg

SEQ ID NO: 516708 - DNA, 20 bp, mouse
ggcataagccgccacggtgg

SEQ ID NO: 516709 - DNA, 20 bp, mouse
gtgctgtcgggagactcaca

SEQ ID NO: 516710 - DNA, 20 bp, mouse
gtcctgagcagatccgaggc

SEQ ID NO: 516711 - DNA, 20 bp, mouse
ggcggaggcggcggattcag

SEQ ID NO: 516712 - DNA, 20 bp, mouse
ggcctcctctgccaccaccg

SEQ ID NO: 516713 - DNA, 20 bp, mouse
ggcaacagtggtggctacgg

SEQ ID NO: 516714 - DNA, 20 bp, mouse
gcctgcataagccgccacgg

SEQ ID NO: 516715 - DNA, 20 bp, mouse
ggattcaggggcttcagtag

SEQ ID NO: 516716 - DNA, 20 bp, mouse
gatccatctgggatgtaggg

SEQ ID NO: 516717 - DNA, 20 bp, mouse
gtgaggaggaactcagactt

SEQ ID NO: 516718 - DNA, 20 bp, mouse
gcaggctgtgctccaagtcc

SEQ ID NO: 516719 - DNA, 20 bp, mouse
ggaaatccatctgggatgta

SEQ ID NO: 516720 - DNA, 20 bp, mouse
gacagcagcccgagacagac

SEQ ID NO: 516721 - DNA, 20 bp, mouse
gagtgctgggccttgtgagg

SEQ ID NO: 516722 - DNA, 20 bp, mouse
gtgacgactgaaatccatct

SEQ ID NO: 516723 - DNA, 20 bp, mouse
gaagccgtaatgagctacgg

SEQ ID NO: 516724 - DNA, 20 bp, mouse
ggcacccagcgtctatggtg

SEQ ID NO: 516725 - DNA, 20 bp, mouse
gtgctccaagtccaggctac

SEQ ID NO: 516726 - DNA, 20 bp, mouse
ggtccagttagccaaggtgg

SEQ ID NO: 516727 - DNA, 20 bp, mouse
ggcgatgggatgagccgctg

SEQ ID NO: 516728 - DNA, 20 bp, mouse
ggttagccaaggtggaggat

SEQ ID NO: 516729 - DNA, 20 bp, mouse
gaaggtccagttagccaagg

SEQ ID NO: 516730 - DNA, 20 bp, mouse
ggtggaggatgggaaaagaa

SEQ ID NO: 516731 - DNA, 20 bp, mouse
ggcggctcatcccatcgcta

SEQ ID NO: 516732 - DNA, 20 bp, mouse
gagaggccgggacaggaatc

SEQ ID NO: 516733 - DNA, 20 bp, mouse
gacctcagagaggccgggac

SEQ ID NO: 516734 - DNA, 20 bp, mouse
gtcctgtcccggcctctctg

SEQ ID NO: 516735 - DNA, 20 bp, mouse
gagggcaggctctgccgcag

SEQ ID NO: 516736 - DNA, 20 bp, mouse
gctgtggacagaggccgagt

SEQ ID NO: 516737 - DNA, 20 bp, mouse
gccctgctccatacacagat

SEQ ID NO: 516738 - DNA, 20 bp, mouse
gtcatggtcccatctgtgta

SEQ ID NO: 516739 - DNA, 20 bp, mouse
gcagcctcggaagcacccgg

SEQ ID NO: 516740 - DNA, 20 bp, mouse
ggacagaggccgagtaggtc

SEQ ID NO: 516741 - DNA, 20 bp, mouse
gacccccatgatcctccagg

SEQ ID NO: 516742 - DNA, 20 bp, mouse
gcctggcgtggtgaaggaaa

SEQ ID NO: 516743 - DNA, 20 bp, mouse
gaaggtgcgggctctagagg

SEQ ID NO: 516744 - DNA, 20 bp, mouse
gtcagctctctgacgctcac

SEQ ID NO: 516745 - DNA, 20 bp, mouse
gtgccattgccacctagcag

SEQ ID NO: 516746 - DNA, 20 bp, mouse
ggcttctgcggtgataggaa

SEQ ID NO: 516747 - DNA, 20 bp, mouse
gccggaggaggagactcggg

SEQ ID NO: 516748 - DNA, 20 bp, mouse
gacagctggagcctgagtgg

SEQ ID NO: 516749 - DNA, 20 bp, mouse
ggcctgagtgggggatctaa

SEQ ID NO: 516750 - DNA, 20 bp, mouse
ggcagaacatgatgccttca

SEQ ID NO: 516751 - DNA, 20 bp, mouse
ggaccctccaccgtagctag

SEQ ID NO: 516752 - DNA, 20 bp, mouse
gtggcggtgggagcagctgt

SEQ ID NO: 516753 - DNA, 20 bp, mouse
gactgagcttctgcggtgat

SEQ ID NO: 516754 - DNA, 20 bp, mouse
gtcggcagctgctcagtaag

SEQ ID NO: 516755 - DNA, 20 bp, mouse
gacccttagatcccccactc

SEQ ID NO: 516756 - DNA, 20 bp, mouse
ggcgaagagacatgatctca

SEQ ID NO: 516757 - DNA, 20 bp, mouse
gtaggacctcctggatccac

SEQ ID NO: 516758 - DNA, 20 bp, mouse
gtccacaggaggaaacacgg

SEQ ID NO: 516759 - DNA, 20 bp, mouse
ggggcgagcataggacctcc

SEQ ID NO: 516760 - DNA, 20 bp, mouse
gccagcacagggtcgctcag

SEQ ID NO: 516761 - DNA, 20 bp, mouse
gcctgtgctggggcgagcat

SEQ ID NO: 516762 - DNA, 20 bp, mouse
ggtgaagccagcacaggagt

SEQ ID NO: 516763 - DNA, 20 bp, mouse
gcttcactgtgaatgagggg

SEQ ID NO: 516764 - DNA, 20 bp, mouse
gcctgtggagctgcccccga

SEQ ID NO: 516765 - DNA, 20 bp, mouse
gcaaaaccatcggggttaga

SEQ ID NO: 516766 - DNA, 20 bp, mouse
gttggcttcggacctctctg

SEQ ID NO: 516767 - DNA, 20 bp, mouse
gcccgaaaaccgaaaagaca

SEQ ID NO: 516768 - DNA, 20 bp, mouse
gaaccgaaaagacatggcga

SEQ ID NO: 516769 - DNA, 20 bp, mouse
gtgccagcgaggggtcaggt

SEQ ID NO: 516770 - DNA, 20 bp, mouse
gacctggagaagaagatcga

SEQ ID NO: 516771 - DNA, 20 bp, mouse
gcgttcccagagaagagtcc

SEQ ID NO: 516772 - DNA, 20 bp, mouse
gccccgtggagaataaaatt

SEQ ID NO: 516773 - DNA, 20 bp, mouse
gcggttttcggggcgatcca

SEQ ID NO: 516774 - DNA, 20 bp, mouse
gaggaagctttgccagcgag

SEQ ID NO: 516775 - DNA, 20 bp, mouse
gcaggtaggggaagtagcat

SEQ ID NO: 516776 - DNA, 20 bp, mouse
gccagggacattcaccgttg

SEQ ID NO: 516777 - DNA, 20 bp, mouse
ggatgcggaagaaaagcgaa

SEQ ID NO: 516778 - DNA, 20 bp, mouse
gctcacagagcccagccgtc

SEQ ID NO: 516779 - DNA, 20 bp, mouse
ggaagaaaagcgaacggaca

SEQ ID NO: 516780 - DNA, 20 bp, mouse
gcttccgcatccagacggct

SEQ ID NO: 516781 - DNA, 20 bp, mouse
gagcgcgggagcagccttgg

SEQ ID NO: 516782 - DNA, 20 bp, mouse
gctctgcagtgctgccccaa

SEQ ID NO: 516783 - DNA, 20 bp, mouse
gtggcaggggggctcggtat

SEQ ID NO: 516784 - DNA, 20 bp, mouse
ggagtgccgggcatcggaag

SEQ ID NO: 516785 - DNA, 20 bp, mouse
gtctgtgaggctctccagcg

SEQ ID NO: 516786 - DNA, 20 bp, mouse
gacagctgcccacggaccag

SEQ ID NO: 516787 - DNA, 20 bp, mouse
gaaacgttccgctggtccgt

SEQ ID NO: 516788 - DNA, 20 bp, mouse
gcctggatccgccagaaaac

SEQ ID NO: 516789 - DNA, 20 bp, mouse
gcactgggcagtgctcctgg

SEQ ID NO: 516790 - DNA, 20 bp, mouse
gaagaacccacaagcaggtg

SEQ ID NO: 516791 - DNA, 20 bp, mouse
gctggcggatccaggcacgt

SEQ ID NO: 516792 - DNA, 20 bp, mouse
ggctcaaagaacccacaagc

SEQ ID NO: 516793 - DNA, 20 bp, mouse
gaccagcggaacgtttggct

SEQ ID NO: 516794 - DNA, 20 bp, mouse
ggatccctcaggccgcccag

SEQ ID NO: 516795 - DNA, 20 bp, mouse
ggcttggcaccatgtctctc

SEQ ID NO: 516796 - DNA, 20 bp, mouse
gccggcaggcagcaattgta

SEQ ID NO: 516797 - DNA, 20 bp, mouse
ggcttataaagtctcaccaa

SEQ ID NO: 516798 - DNA, 20 bp, mouse
gtcacaccgagtcttcagcc

SEQ ID NO: 516799 - DNA, 20 bp, mouse
gaagccttctacagagggtg

SEQ ID NO: 516800 - DNA, 20 bp, mouse
gtgtccacaccctctgtaga

SEQ ID NO: 516801 - DNA, 20 bp, mouse
gtcttgttctgtctaagtaa

SEQ ID NO: 516802 - DNA, 20 bp, mouse
gagggagggagagaggtacc

SEQ ID NO: 516803 - DNA, 20 bp, mouse
gaggtacctggctgaagact

SEQ ID NO: 516804 - DNA, 20 bp, mouse
ggttgcagcagaaggtgagt

SEQ ID NO: 516805 - DNA, 20 bp, mouse
gctttataagccttctacag

SEQ ID NO: 516806 - DNA, 20 bp, mouse
ggagatccagggaactgctg

SEQ ID NO: 516807 - DNA, 20 bp, mouse
gcggctggcagacataaccc

SEQ ID NO: 516808 - DNA, 20 bp, mouse
gagagatgctgatgaggtgt

SEQ ID NO: 516809 - DNA, 20 bp, mouse
gtggcaagagctggacaagt

SEQ ID NO: 516810 - DNA, 20 bp, mouse
gcagagggcatgcactgcag

SEQ ID NO: 516811 - DNA, 20 bp, mouse
gatgttactggaacagacgg

SEQ ID NO: 516812 - DNA, 20 bp, mouse
gtggctggcctgtaggtggt

SEQ ID NO: 516813 - DNA, 20 bp, mouse
gcagctggctggcctgtagg

SEQ ID NO: 516814 - DNA, 20 bp, mouse
gagggaactgctggggggaa

SEQ ID NO: 516815 - DNA, 20 bp, mouse
ggtggtcggcatgcagacag

SEQ ID NO: 516816 - DNA, 20 bp, mouse
gggatataaaagctcaccag

SEQ ID NO: 516817 - DNA, 20 bp, mouse
gacacacctcatcttcagcc

SEQ ID NO: 516818 - DNA, 20 bp, mouse
gttcctagcaggaagttctc

SEQ ID NO: 516819 - DNA, 20 bp, mouse
ggtccccacccaatttggag

SEQ ID NO: 516820 - DNA, 20 bp, mouse
gatccactccaaattgggtg

SEQ ID NO: 516821 - DNA, 20 bp, mouse
gctcctgagaacttcctgct

SEQ ID NO: 516822 - DNA, 20 bp, mouse
gatgacatgaactcttggcg

SEQ ID NO: 516823 - DNA, 20 bp, mouse
gaggtgcctggctgaagatg

SEQ ID NO: 516824 - DNA, 20 bp, mouse
gaaaagctcaccagaggaag

SEQ ID NO: 516825 - DNA, 20 bp, mouse
gtttatatccactccaaatt

SEQ ID NO: 516826 - DNA, 20 bp, mouse
gctaccagacacaggacatc

SEQ ID NO: 516827 - DNA, 20 bp, mouse
gagcgggacgggcaccctag

SEQ ID NO: 516828 - DNA, 20 bp, mouse
gcaggccttctaccagacac

SEQ ID NO: 516829 - DNA, 20 bp, mouse
gacgcctgatgtcctgtgtc

SEQ ID NO: 516830 - DNA, 20 bp, mouse
gtagaaggcctggtcctctt

SEQ ID NO: 516831 - DNA, 20 bp, mouse
gactcattcaactgccacta

SEQ ID NO: 516832 - DNA, 20 bp, mouse
gggaatgtaagatccaagag

SEQ ID NO: 516833 - DNA, 20 bp, mouse
gctgctgctggttcctctct

SEQ ID NO: 516834 - DNA, 20 bp, mouse
gcgggcaggcagcagttgta

SEQ ID NO: 516835 - DNA, 20 bp, mouse
gagcagaaggtgagcgggac

SEQ ID NO: 516836 - DNA, 20 bp, mouse
ggcagtgagctgctgcaggt

SEQ ID NO: 516837 - DNA, 20 bp, mouse
gagctgctgcaggtaggtct

SEQ ID NO: 516838 - DNA, 20 bp, mouse
gagactcacaggacatggtt

SEQ ID NO: 516839 - DNA, 20 bp, mouse
gctgctgctgcatctgagat

SEQ ID NO: 516840 - DNA, 20 bp, mouse
gataaaaagaccacgaagga

SEQ ID NO: 516841 - DNA, 20 bp, mouse
gtgagtctctccttccttcg

SEQ ID NO: 516842 - DNA, 20 bp, mouse
gcacacagaatctgaaacaa

SEQ ID NO: 516843 - DNA, 20 bp, mouse
ggcgggcaggcaagactcac

SEQ ID NO: 516844 - DNA, 20 bp, mouse
gaggcaagactcacaggaca

SEQ ID NO: 516845 - DNA, 20 bp, mouse
gatggtttggggagaagtga

SEQ ID NO: 516846 - DNA, 20 bp, mouse
gagctctactgcttacacct

SEQ ID NO: 516847 - DNA, 20 bp, mouse
gggccaaccaacacccactg

SEQ ID NO: 516848 - DNA, 20 bp, mouse
gctggggagaggcaattaca

SEQ ID NO: 516849 - DNA, 20 bp, mouse
gcccaggccagcggaacaca

SEQ ID NO: 516850 - DNA, 20 bp, mouse
ggggctcttcagagatcctg

SEQ ID NO: 516851 - DNA, 20 bp, mouse
gctctctgcctcccaacggg

SEQ ID NO: 516852 - DNA, 20 bp, mouse
ggggctccacgggaagggct

SEQ ID NO: 516853 - DNA, 20 bp, mouse
gggtaatcggggcacatata

SEQ ID NO: 516854 - DNA, 20 bp, mouse
gactccgggctccacgggaa

SEQ ID NO: 516855 - DNA, 20 bp, mouse
ggcacgggtggaggttggtt

SEQ ID NO: 516856 - DNA, 20 bp, mouse
ggacccagcagagaaggtcg

SEQ ID NO: 516857 - DNA, 20 bp, mouse
ggccatgatgctagcgagga

SEQ ID NO: 516858 - DNA, 20 bp, mouse
gggaaggttgctgaataggt

SEQ ID NO: 516859 - DNA, 20 bp, mouse
ggcctggcaagcagctccca

SEQ ID NO: 516860 - DNA, 20 bp, mouse
gcctggagaatccacaacct

SEQ ID NO: 516861 - DNA, 20 bp, mouse
gggtctgccaagggcctctg

SEQ ID NO: 516862 - DNA, 20 bp, mouse
ggctgaataggtaggatccc

SEQ ID NO: 516863 - DNA, 20 bp, mouse
gtctctgctgggtctgccaa

SEQ ID NO: 516864 - DNA, 20 bp, mouse
gggtggccatgatgctagcg

SEQ ID NO: 516865 - DNA, 20 bp, mouse
ggcgaggaaggttgctgaat

SEQ ID NO: 516866 - DNA, 20 bp, mouse
gtggttgagggtgcttcggg

SEQ ID NO: 516867 - DNA, 20 bp, mouse
ggtagagcccttggtatcca

SEQ ID NO: 516868 - DNA, 20 bp, mouse
ggtaatgagggcatcgataa

SEQ ID NO: 516869 - DNA, 20 bp, mouse
gggcttggttgagggtgctt

SEQ ID NO: 516870 - DNA, 20 bp, mouse
gagggcatcgataaaggcaa

SEQ ID NO: 516871 - DNA, 20 bp, mouse
ggtgctctacaaactcccca

SEQ ID NO: 516872 - DNA, 20 bp, mouse
gggttcttatcaagtaatga

SEQ ID NO: 516873 - DNA, 20 bp, mouse
gggtagtcaggacacaggat

SEQ ID NO: 516874 - DNA, 20 bp, mouse
gtggcatttgggcttggttg

SEQ ID NO: 516875 - DNA, 20 bp, mouse
gatcgtcactgtagagccct

SEQ ID NO: 516876 - DNA, 20 bp, mouse
gcttgactgtctggcgatca

SEQ ID NO: 516877 - DNA, 20 bp, mouse
gaaagccccgggaggctccg

SEQ ID NO: 516878 - DNA, 20 bp, mouse
gccactgctaaagccccggg

SEQ ID NO: 516879 - DNA, 20 bp, mouse
gtagaacagaagcgaagcaa

SEQ ID NO: 516880 - DNA, 20 bp, mouse
gacctccagcaggacagact

SEQ ID NO: 516881 - DNA, 20 bp, mouse
gtataagccacaagggccga

SEQ ID NO: 516882 - DNA, 20 bp, mouse
ggtgtccgcggagcctcccg

SEQ ID NO: 516883 - DNA, 20 bp, mouse
ggagccactgctaaagcccc

SEQ ID NO: 516884 - DNA, 20 bp, mouse
gccacaagggccgagggttc

SEQ ID NO: 516885 - DNA, 20 bp, mouse
gccgcggacacttgactgtc

SEQ ID NO: 516886 - DNA, 20 bp, mouse
gcagcagctaggggagccat

SEQ ID NO: 516887 - DNA, 20 bp, mouse
gctcagaagagcagcagcta

SEQ ID NO: 516888 - DNA, 20 bp, mouse
gggtctcgcctagtctccaa

SEQ ID NO: 516889 - DNA, 20 bp, mouse
gtaatcggggcagaccagag

SEQ ID NO: 516890 - DNA, 20 bp, mouse
gacaggatgtagtattgctt

SEQ ID NO: 516891 - DNA, 20 bp, mouse
gagccaagtagcacggtgag

SEQ ID NO: 516892 - DNA, 20 bp, mouse
gagccggaagcccctgcaca

SEQ ID NO: 516893 - DNA, 20 bp, mouse
ggccctgcagaggaagcttg

SEQ ID NO: 516894 - DNA, 20 bp, mouse
ggaagtaccgctgataatcg

SEQ ID NO: 516895 - DNA, 20 bp, mouse
gcggtgagaggcaacaggct

SEQ ID NO: 516896 - DNA, 20 bp, mouse
gaactggcggacactggtag

SEQ ID NO: 516897 - DNA, 20 bp, mouse
gggagccagaagttgaaaac

SEQ ID NO: 516898 - DNA, 20 bp, mouse
ggcttgacctgaggataaca

SEQ ID NO: 516899 - DNA, 20 bp, mouse
gggagcacaaaggcccttaa

SEQ ID NO: 516900 - DNA, 20 bp, mouse
ggccagaagttgaaaactgg

SEQ ID NO: 516901 - DNA, 20 bp, mouse
gtcccatgccgggagcacaa

SEQ ID NO: 516902 - DNA, 20 bp, mouse
gatcctcaggtcaagcaaca

SEQ ID NO: 516903 - DNA, 20 bp, mouse
gtggactagatggagaccct

SEQ ID NO: 516904 - DNA, 20 bp, mouse
gcaggtcaagcaacagggtc

SEQ ID NO: 516905 - DNA, 20 bp, mouse
gtggaagccatgttatcctc

SEQ ID NO: 516906 - DNA, 20 bp, mouse
ggaggtgctggcgaggtcag

SEQ ID NO: 516907 - DNA, 20 bp, mouse
gctggaggagcaagaacact

SEQ ID NO: 516908 - DNA, 20 bp, mouse
ggaacactgggcgctggtgg

SEQ ID NO: 516909 - DNA, 20 bp, mouse
gttcaacaggacgctgtggg

SEQ ID NO: 516910 - DNA, 20 bp, mouse
gcaagaacactgggcgctgg

SEQ ID NO: 516911 - DNA, 20 bp, mouse
gctggactggcgagacatga

SEQ ID NO: 516912 - DNA, 20 bp, mouse
ggagacatgatggttcctgg

SEQ ID NO: 516913 - DNA, 20 bp, mouse
gccacttcggaaggacacac

SEQ ID NO: 516914 - DNA, 20 bp, mouse
gggctccacaagcaccccca

SEQ ID NO: 516915 - DNA, 20 bp, mouse
ggaggtcagcggcgttcaac

SEQ ID NO: 516916 - DNA, 20 bp, mouse
gtcctggagatgagaaggct

SEQ ID NO: 516917 - DNA, 20 bp, mouse
ggggaagtagagaaacggca

SEQ ID NO: 516918 - DNA, 20 bp, mouse
gctgggcagccgcttatata

SEQ ID NO: 516919 - DNA, 20 bp, mouse
ggatgagtgtgttgagctct

SEQ ID NO: 516920 - DNA, 20 bp, mouse
gttgcaggttcaggggtgtg

SEQ ID NO: 516921 - DNA, 20 bp, mouse
gaggctgggaagtagagaaa

SEQ ID NO: 516922 - DNA, 20 bp, mouse
gatggttcctggagatgaga

SEQ ID NO: 516923 - DNA, 20 bp, mouse
gtggctggtttgacttttga

SEQ ID NO: 516924 - DNA, 20 bp, mouse
ggatggtggggtcaatttgc

SEQ ID NO: 516925 - DNA, 20 bp, mouse
ggctggcactgtagccacgg

SEQ ID NO: 516926 - DNA, 20 bp, mouse
ggacatggttccgtgagctg

SEQ ID NO: 516927 - DNA, 20 bp, mouse
gcagatgagaagtttagaaa

SEQ ID NO: 516928 - DNA, 20 bp, mouse
ggagaagtttagaaatggca

SEQ ID NO: 516929 - DNA, 20 bp, mouse
gagctgaacagatgagtgtg

SEQ ID NO: 516930 - DNA, 20 bp, mouse
gtctgctgctcctcagctca

SEQ ID NO: 516931 - DNA, 20 bp, mouse
gtgtgtggagctctggactg

SEQ ID NO: 516932 - DNA, 20 bp, mouse
gctggactgtggcttatata

SEQ ID NO: 516933 - DNA, 20 bp, mouse
ggacctcttggatgcctcca

SEQ ID NO: 516934 - DNA, 20 bp, mouse
gtcccggtgtgcccccctgg

SEQ ID NO: 516935 - DNA, 20 bp, mouse
gagagtcaaactagccaccg

SEQ ID NO: 516936 - DNA, 20 bp, mouse
gctgaagtggatggacatag

SEQ ID NO: 516937 - DNA, 20 bp, mouse
gccgcggcccgggtaagcag

SEQ ID NO: 516938 - DNA, 20 bp, mouse
gggacacagctggctggacg

SEQ ID NO: 516939 - DNA, 20 bp, mouse
ggagcgagagctgaagtgga

SEQ ID NO: 516940 - DNA, 20 bp, mouse
gcagctggctggacgaggcg

SEQ ID NO: 516941 - DNA, 20 bp, mouse
ggatcgatgtccacactcag

SEQ ID NO: 516942 - DNA, 20 bp, mouse
ggcgcgaactccctgacctc

SEQ ID NO: 516943 - DNA, 20 bp, mouse
gtgatgagcccaggccatag

SEQ ID NO: 516944 - DNA, 20 bp, mouse
gcccaccgggcccccataag

SEQ ID NO: 516945 - DNA, 20 bp, mouse
gtcgcagactgcctgaggtc

SEQ ID NO: 516946 - DNA, 20 bp, mouse
gtgagggtctaacaagagct

SEQ ID NO: 516947 - DNA, 20 bp, mouse
gcacacagacaaaagtacct

SEQ ID NO: 516948 - DNA, 20 bp, mouse
gtgtgtgtggtggttatagg

SEQ ID NO: 516949 - DNA, 20 bp, mouse
gactgcatggagccagaggt

SEQ ID NO: 516950 - DNA, 20 bp, mouse
ggctagtgcgctgacctgga

SEQ ID NO: 516951 - DNA, 20 bp, mouse
gggagactccctacccctca

SEQ ID NO: 516952 - DNA, 20 bp, mouse
gtacctgggcacttcagtcc

SEQ ID NO: 516953 - DNA, 20 bp, mouse
ggagaaggagctcttggtgt

SEQ ID NO: 516954 - DNA, 20 bp, mouse
gtctcactgcatggagccag

SEQ ID NO: 516955 - DNA, 20 bp, mouse
gtgttagaccctcatcctga

SEQ ID NO: 516956 - DNA, 20 bp, mouse
gcagccagcacaaccttcgt

SEQ ID NO: 516957 - DNA, 20 bp, mouse
gtggcggctcatgttggtag

SEQ ID NO: 516958 - DNA, 20 bp, mouse
ggtgaattggcggctcatgt

SEQ ID NO: 516959 - DNA, 20 bp, mouse
ggaggatggagtaaaggtgc

SEQ ID NO: 516960 - DNA, 20 bp, mouse
ggtggcagcgggaagaacgg

SEQ ID NO: 516961 - DNA, 20 bp, mouse
gggaaggtagattcccacga

SEQ ID NO: 516962 - DNA, 20 bp, mouse
gattcccacgaaggttgtgc

SEQ ID NO: 516963 - DNA, 20 bp, mouse
gaagtctggagccagcaaca

SEQ ID NO: 516964 - DNA, 20 bp, mouse
gtcactcttaacatggctag

SEQ ID NO: 516965 - DNA, 20 bp, mouse
ggatgctcctgccacctccc

SEQ ID NO: 516966 - DNA, 20 bp, mouse
ggctggcagcgggcaaggac

SEQ ID NO: 516967 - DNA, 20 bp, mouse
gcgggcaaggactggcagga

SEQ ID NO: 516968 - DNA, 20 bp, mouse
ggggatagagggtcaactgg

SEQ ID NO: 516969 - DNA, 20 bp, mouse
gcggtccgagctggagtcaa

SEQ ID NO: 516970 - DNA, 20 bp, mouse
gtccgggatagagggtcaac

SEQ ID NO: 516971 - DNA, 20 bp, mouse
gtcaactggcggctcatggc

SEQ ID NO: 516972 - DNA, 20 bp, mouse
gaccgggagggcacactgat

SEQ ID NO: 516973 - DNA, 20 bp, mouse
ggcagcgggcaaggactggc

SEQ ID NO: 516974 - DNA, 20 bp, mouse
gccaagcaggactatttaag

SEQ ID NO: 516975 - DNA, 20 bp, mouse
gttcacgctgggccacggag

SEQ ID NO: 516976 - DNA, 20 bp, mouse
gcggggaacagtcagtctct

SEQ ID NO: 516977 - DNA, 20 bp, mouse
gccggcaaagggctcagtgg

SEQ ID NO: 516978 - DNA, 20 bp, mouse
gcagccgctgaagcccctgt

SEQ ID NO: 516979 - DNA, 20 bp, mouse
gacagtcagtctcttggcga

SEQ ID NO: 516980 - DNA, 20 bp, mouse
gttgccaacaggggcttcag

SEQ ID NO: 516981 - DNA, 20 bp, mouse
gcattgaaggagatgctcct

SEQ ID NO: 516982 - DNA, 20 bp, mouse
gtcttgtctcattctgtctg

SEQ ID NO: 516983 - DNA, 20 bp, mouse
gaacctggagttgccaacag

SEQ ID NO: 516984 - DNA, 20 bp, mouse
gggaagaccaagatcacaag

SEQ ID NO: 516985 - DNA, 20 bp, mouse
gagcagcagcgggcgcacag

SEQ ID NO: 516986 - DNA, 20 bp, mouse
gtcaggtcatgcagtgacaa

SEQ ID NO: 516987 - DNA, 20 bp, mouse
gtatctgctctaccatgagt

SEQ ID NO: 516988 - DNA, 20 bp, mouse
ggtggtgtcaaggaacccat

SEQ ID NO: 516989 - DNA, 20 bp, mouse
ggagcctctacagtcttgga

SEQ ID NO: 516990 - DNA, 20 bp, mouse
gtggcaggtggcagtgctcg

SEQ ID NO: 516991 - DNA, 20 bp, mouse
gtagagcagatagagcgtgc

SEQ ID NO: 516992 - DNA, 20 bp, mouse
gcagcatacttcctacaatg

SEQ ID NO: 516993 - DNA, 20 bp, mouse
gctgccacctgccacattgt

SEQ ID NO: 516994 - DNA, 20 bp, mouse
gacacagctggccacaggac

SEQ ID NO: 516995 - DNA, 20 bp, mouse
ggctggagctgaagaaagac

SEQ ID NO: 516996 - DNA, 20 bp, mouse
gaggcagcacaggagctccg

SEQ ID NO: 516997 - DNA, 20 bp, mouse
gtggattgccgggacatgat

SEQ ID NO: 516998 - DNA, 20 bp, mouse
gctgccggagtggaaggtga

SEQ ID NO: 516999 - DNA, 20 bp, mouse
ggggacatgatgggcgaaga

SEQ ID NO: 517000 - DNA, 20 bp, mouse
gggtcccccctaggttgtag

SEQ ID NO: 517001 - DNA, 20 bp, mouse
gcgaatctacgaatctacct

SEQ ID NO: 517002 - DNA, 20 bp, mouse
ggcccctgcggctgccggag

SEQ ID NO: 517003 - DNA, 20 bp, mouse
ggattcgtagattcgtgaag

SEQ ID NO: 517004 - DNA, 20 bp, mouse
gcagcctctacaacctaggg

SEQ ID NO: 517005 - DNA, 20 bp, mouse
gcgctcctcaggaaacagtg

SEQ ID NO: 517006 - DNA, 20 bp, mouse
gctgctcatagtgaggagtg

SEQ ID NO: 517007 - DNA, 20 bp, mouse
gagtaacttagcagagcaaa

SEQ ID NO: 517008 - DNA, 20 bp, mouse
gtctggggcagccagtggag

SEQ ID NO: 517009 - DNA, 20 bp, mouse
gactgccacccaggctgtag

SEQ ID NO: 517010 - DNA, 20 bp, mouse
gccttcagttgtgggagcca

SEQ ID NO: 517011 - DNA, 20 bp, mouse
ggtcacagcctctacagcct

SEQ ID NO: 517012 - DNA, 20 bp, mouse
ggggcttgtgggttccggag

SEQ ID NO: 517013 - DNA, 20 bp, mouse
ggagaggatggcgattgcag

SEQ ID NO: 517014 - DNA, 20 bp, mouse
gcacttcctggattccacca

SEQ ID NO: 517015 - DNA, 20 bp, mouse
gctcgctctggggcagccag

SEQ ID NO: 517016 - DNA, 20 bp, mouse
gcaaggactcagctgaaagc

SEQ ID NO: 517017 - DNA, 20 bp, mouse
gtgagtcagtcgaggaggta

SEQ ID NO: 517018 - DNA, 20 bp, mouse
ggtcagtcgaggaggtatgg

SEQ ID NO: 517019 - DNA, 20 bp, mouse
gagactgagaactaaactgg

SEQ ID NO: 517020 - DNA, 20 bp, mouse
gggtatggcggtgattatgg

SEQ ID NO: 517021 - DNA, 20 bp, mouse
gtcctcctggccctctactc

SEQ ID NO: 517022 - DNA, 20 bp, mouse
ggagggagctgcgactctct

SEQ ID NO: 517023 - DNA, 20 bp, mouse
ggtctgtgagtcagtcgagg

SEQ ID NO: 517024 - DNA, 20 bp, mouse
gctactctggcagaaaccac

SEQ ID NO: 517025 - DNA, 20 bp, mouse
gcccagactgtagagactcc

SEQ ID NO: 517026 - DNA, 20 bp, mouse
ggacagactggagatggtca

SEQ ID NO: 517027 - DNA, 20 bp, mouse
gctccatgccgggcccagag

SEQ ID NO: 517028 - DNA, 20 bp, mouse
gcccgcagcttcagacagac

SEQ ID NO: 517029 - DNA, 20 bp, mouse
ggggggcagagaccaggcaa

SEQ ID NO: 517030 - DNA, 20 bp, mouse
gtgcttggatgccccctgga

SEQ ID NO: 517031 - DNA, 20 bp, mouse
gagagaccaggcaagggata

SEQ ID NO: 517032 - DNA, 20 bp, mouse
gcaggcaagggatacggttt

SEQ ID NO: 517033 - DNA, 20 bp, mouse
ggcatctcctggaggaacta

SEQ ID NO: 517034 - DNA, 20 bp, mouse
gctgccccgagcccctgaaa

SEQ ID NO: 517035 - DNA, 20 bp, mouse
ggctgaagcccctctgggcc

SEQ ID NO: 517036 - DNA, 20 bp, mouse
ggtggctcagtagctcactc

SEQ ID NO: 517037 - DNA, 20 bp, mouse
gggagcctctacaacttggg

SEQ ID NO: 517038 - DNA, 20 bp, mouse
ggccggagcctctacaactt

SEQ ID NO: 517039 - DNA, 20 bp, mouse
ggagctgaagcctcctttag

SEQ ID NO: 517040 - DNA, 20 bp, mouse
gagagcaggagggaatcagc

SEQ ID NO: 517041 - DNA, 20 bp, mouse
gcctctggccgggcactagg

SEQ ID NO: 517042 - DNA, 20 bp, mouse
gcgagaaagcagctgagagc

SEQ ID NO: 517043 - DNA, 20 bp, mouse
ggctctgggtccagctccgg

SEQ ID NO: 517044 - DNA, 20 bp, mouse
ggaggccctcccacatcctg

SEQ ID NO: 517045 - DNA, 20 bp, mouse
gggccagtctgtcctcccgg

SEQ ID NO: 517046 - DNA, 20 bp, mouse
ggcagcttccggggaagcat

SEQ ID NO: 517047 - DNA, 20 bp, mouse
gagcagctgcttctagacgg

SEQ ID NO: 517048 - DNA, 20 bp, mouse
gcggttagtcgggaagagag

SEQ ID NO: 517049 - DNA, 20 bp, mouse
gtccggggaagcatgggcac

SEQ ID NO: 517050 - DNA, 20 bp, mouse
ggccggtgcccatgcttccc

SEQ ID NO: 517051 - DNA, 20 bp, mouse
ggaagcatgggcaccggcgt

SEQ ID NO: 517052 - DNA, 20 bp, mouse
ggtgggacagcgcccagcga

SEQ ID NO: 517053 - DNA, 20 bp, mouse
ggagcgcaggacggttagtc

SEQ ID NO: 517054 - DNA, 20 bp, mouse
gttggcggggctggtgtcgg

SEQ ID NO: 517055 - DNA, 20 bp, mouse
gtttataaagggccttcgct

SEQ ID NO: 517056 - DNA, 20 bp, mouse
gcggccctggatgtgacagg

SEQ ID NO: 517057 - DNA, 20 bp, mouse
gagggctcaccagtgagcta

SEQ ID NO: 517058 - DNA, 20 bp, mouse
gccagtgagctagggagatt

SEQ ID NO: 517059 - DNA, 20 bp, mouse
gcctgggcctgggagccgga

SEQ ID NO: 517060 - DNA, 20 bp, mouse
gagccggccctggatgtgac

SEQ ID NO: 517061 - DNA, 20 bp, mouse
gtagggagatttggagttgg

SEQ ID NO: 517062 - DNA, 20 bp, mouse
gcagcctgggacctcaggat

SEQ ID NO: 517063 - DNA, 20 bp, mouse
gctcagtccccagccggccc

SEQ ID NO: 517064 - DNA, 20 bp, mouse
ggccgcctcctgtcacatcc

SEQ ID NO: 517065 - DNA, 20 bp, mouse
gacgcaggagcggtaggcca

SEQ ID NO: 517066 - DNA, 20 bp, mouse
ggatgagctgccctgtgaca

SEQ ID NO: 517067 - DNA, 20 bp, mouse
ggacagggagccccacctcg

SEQ ID NO: 517068 - DNA, 20 bp, mouse
ggttgggggaccccgaggtg

SEQ ID NO: 517069 - DNA, 20 bp, mouse
gctgtccagggaacccagtg

SEQ ID NO: 517070 - DNA, 20 bp, mouse
gaggtggggctccctgtcac

SEQ ID NO: 517071 - DNA, 20 bp, mouse
gtgggttccctggacaggtt

SEQ ID NO: 517072 - DNA, 20 bp, mouse
gtggtggctgaggtcgaagg

SEQ ID NO: 517073 - DNA, 20 bp, mouse
ggccctggaatgtctcataa

SEQ ID NO: 517074 - DNA, 20 bp, mouse
gaggtcatcgggtgccacac

SEQ ID NO: 517075 - DNA, 20 bp, mouse
gagggtactgagtaggtcat

SEQ ID NO: 517076 - DNA, 20 bp, mouse
gggagctgccaccaggacta

SEQ ID NO: 517077 - DNA, 20 bp, mouse
ggggagctccgtagtcctgg

SEQ ID NO: 517078 - DNA, 20 bp, mouse
gtgggctgaagcgttctgga

SEQ ID NO: 517079 - DNA, 20 bp, mouse
gaatcctgatccacaggtca

SEQ ID NO: 517080 - DNA, 20 bp, mouse
gcctgtggatcaggattctg

SEQ ID NO: 517081 - DNA, 20 bp, mouse
ggatgggagctccgtagtcc

SEQ ID NO: 517082 - DNA, 20 bp, mouse
gaagatgggctgaagcgttc

SEQ ID NO: 517083 - DNA, 20 bp, mouse
gggtgcctggactagcacat

SEQ ID NO: 517084 - DNA, 20 bp, mouse
gagctccaatgtgctagtcc

SEQ ID NO: 517085 - DNA, 20 bp, mouse
gggcaccggggtcctattta

SEQ ID NO: 517086 - DNA, 20 bp, mouse
gggcatgacatgactttggg

SEQ ID NO: 517087 - DNA, 20 bp, mouse
gggaggcagaggtggatccc

SEQ ID NO: 517088 - DNA, 20 bp, mouse
gactccggttgccacatctg

SEQ ID NO: 517089 - DNA, 20 bp, mouse
ggacgggactgaccgcaccg

SEQ ID NO: 517090 - DNA, 20 bp, mouse
gcccgtgtggcctccagatg

SEQ ID NO: 517091 - DNA, 20 bp, mouse
gctcggagcctgtgcaacgt

SEQ ID NO: 517092 - DNA, 20 bp, mouse
gcatagtgggtgaccatccg

SEQ ID NO: 517093 - DNA, 20 bp, mouse
gttcggcatgacatgacttt

SEQ ID NO: 517094 - DNA, 20 bp, mouse
ggcacaggctccgagagcca

SEQ ID NO: 517095 - DNA, 20 bp, mouse
ggagcagccagggtgggacg

SEQ ID NO: 517096 - DNA, 20 bp, mouse
gcccacaggaggctccgagg

SEQ ID NO: 517097 - DNA, 20 bp, mouse
gaaggcgcggaccccacagg

SEQ ID NO: 517098 - DNA, 20 bp, mouse
gctgaaggcgcggaccccac

SEQ ID NO: 517099 - DNA, 20 bp, mouse
ggaccccacaggaggctccg

SEQ ID NO: 517100 - DNA, 20 bp, mouse
gagagtcaggctggaccccg

SEQ ID NO: 517101 - DNA, 20 bp, mouse
gcaggaggctccgaggcggg

SEQ ID NO: 517102 - DNA, 20 bp, mouse
gtcagaggcgatacagagtc

SEQ ID NO: 517103 - DNA, 20 bp, mouse
gcacaggagccagagcggaa

SEQ ID NO: 517104 - DNA, 20 bp, mouse
ggaagggcccgcagacgctg

SEQ ID NO: 517105 - DNA, 20 bp, mouse
ggtcctcaggtgccaagaag

SEQ ID NO: 517106 - DNA, 20 bp, mouse
gtaggagcggcaagacatgg

SEQ ID NO: 517107 - DNA, 20 bp, mouse
gctgtaggagcggcaagaca

SEQ ID NO: 517108 - DNA, 20 bp, mouse
gcggccagagctgactctgt

SEQ ID NO: 517109 - DNA, 20 bp, mouse
gagcggggtgagctggagct

SEQ ID NO: 517110 - DNA, 20 bp, mouse
gtgaggagcaatgtggagcg

SEQ ID NO: 517111 - DNA, 20 bp, mouse
ggctttgtagacggtagctg

SEQ ID NO: 517112 - DNA, 20 bp, mouse
gagcatccaactgctatccg

SEQ ID NO: 517113 - DNA, 20 bp, mouse
gtcagctctggccgtcgggt

SEQ ID NO: 517114 - DNA, 20 bp, mouse
gactgaagcttcccacccga

SEQ ID NO: 517115 - DNA, 20 bp, mouse
gagccaactccacagcggac

SEQ ID NO: 517116 - DNA, 20 bp, mouse
gtctgaaactggagacgtcc

SEQ ID NO: 517117 - DNA, 20 bp, mouse
gactggagacgtccaggtgg

SEQ ID NO: 517118 - DNA, 20 bp, mouse
ggtccactttaccctccacc

SEQ ID NO: 517119 - DNA, 20 bp, mouse
ggaaactggagacgtccagg

SEQ ID NO: 517120 - DNA, 20 bp, mouse
gcagtaggatccgcaagtca

SEQ ID NO: 517121 - DNA, 20 bp, mouse
gcgcaagtcatggttattta

SEQ ID NO: 517122 - DNA, 20 bp, mouse
gcggccgggcctgggcccac

SEQ ID NO: 517123 - DNA, 20 bp, mouse
gaaggccaacaaacctaaag

SEQ ID NO: 517124 - DNA, 20 bp, mouse
ggcacagcatgtcacagcca

SEQ ID NO: 517125 - DNA, 20 bp, mouse
gattcagtgtttacctcttt

SEQ ID NO: 517126 - DNA, 20 bp, mouse
ggagctctgtctgcaactca

SEQ ID NO: 517127 - DNA, 20 bp, mouse
gtagccaggaagcggtctca

SEQ ID NO: 517128 - DNA, 20 bp, mouse
gagaggatgtagccaggaag

SEQ ID NO: 517129 - DNA, 20 bp, mouse
gcctggctacatcctctggc

SEQ ID NO: 517130 - DNA, 20 bp, mouse
gctagctatggtggagggta

SEQ ID NO: 517131 - DNA, 20 bp, mouse
gtatggtggagggtatggag

SEQ ID NO: 517132 - DNA, 20 bp, mouse
gcttccagtggctttagcgg

SEQ ID NO: 517133 - DNA, 20 bp, mouse
gcaaccctgagaccgcttcc

SEQ ID NO: 517134 - DNA, 20 bp, mouse
gccacccccgctaaagccac

SEQ ID NO: 517135 - DNA, 20 bp, mouse
gaagcggtctcagggttgct

SEQ ID NO: 517136 - DNA, 20 bp, mouse
gaggttggcagcaactggat

SEQ ID NO: 517137 - DNA, 20 bp, mouse
ggtgccaccagtggaacatg

SEQ ID NO: 517138 - DNA, 20 bp, mouse
ggaagttttttgaatttgtg

SEQ ID NO: 517139 - DNA, 20 bp, mouse
ggctttcccacatgttccac

SEQ ID NO: 517140 - DNA, 20 bp, mouse
gcagcaaggttggcagcaac

SEQ ID NO: 517141 - DNA, 20 bp, mouse
gagaagttgatctgtgctga

SEQ ID NO: 517142 - DNA, 20 bp, mouse
gtgccagttccacagcagct

SEQ ID NO: 517143 - DNA, 20 bp, mouse
gggtctgggagcagcaaggt

SEQ ID NO: 517144 - DNA, 20 bp, mouse
gagatcaacttctgacacca

SEQ ID NO: 517145 - DNA, 20 bp, mouse
gcatctaacacggcagctca

SEQ ID NO: 517146 - DNA, 20 bp, mouse
gatggtgtctggagtcaatt

SEQ ID NO: 517147 - DNA, 20 bp, mouse
ggaaccacatgtgccgccag

SEQ ID NO: 517148 - DNA, 20 bp, mouse
ggactgggtgcaggtggatt

SEQ ID NO: 517149 - DNA, 20 bp, mouse
ggctccactggcggcacatg

SEQ ID NO: 517150 - DNA, 20 bp, mouse
ggaggagaagtttctgagtt

SEQ ID NO: 517151 - DNA, 20 bp, mouse
gggtttgtgtcttcctcacc

SEQ ID NO: 517152 - DNA, 20 bp, mouse
gcgcagcaggccatggtgtc

SEQ ID NO: 517153 - DNA, 20 bp, mouse
gggttggcagcagctggatt

SEQ ID NO: 517154 - DNA, 20 bp, mouse
ggctgcgctactagtttctg

SEQ ID NO: 517155 - DNA, 20 bp, mouse
ggccctgactgccgtgtgga

SEQ ID NO: 517156 - DNA, 20 bp, mouse
gcacagcaggccatgttgtc

SEQ ID NO: 517157 - DNA, 20 bp, mouse
gaggccatgttgtcaggagt

SEQ ID NO: 517158 - DNA, 20 bp, mouse
gagttggttggatgttgagt

SEQ ID NO: 517159 - DNA, 20 bp, mouse
gcatgttgtcaggagttggt

SEQ ID NO: 517160 - DNA, 20 bp, mouse
gggttggatgttgagtaggt

SEQ ID NO: 517161 - DNA, 20 bp, mouse
gggacaggctatggcattgg

SEQ ID NO: 517162 - DNA, 20 bp, mouse
gtataaaaggccccatgctc

SEQ ID NO: 517163 - DNA, 20 bp, mouse
ggtgggacaggctatggcat

SEQ ID NO: 517164 - DNA, 20 bp, mouse
gactgctccagagttggtta

SEQ ID NO: 517165 - DNA, 20 bp, mouse
ggcatctccttaaccaactc

SEQ ID NO: 517166 - DNA, 20 bp, mouse
ggagcagttgaaagacatga

SEQ ID NO: 517167 - DNA, 20 bp, mouse
gacgttggctggcagacagt

SEQ ID NO: 517168 - DNA, 20 bp, mouse
gctggaagagcaatttcttg

SEQ ID NO: 517169 - DNA, 20 bp, mouse
ggggcaagtagaggccactc

SEQ ID NO: 517170 - DNA, 20 bp, mouse
gtggctcctggaccattgtc

SEQ ID NO: 517171 - DNA, 20 bp, mouse
gtaacgtcctccaactggcc

SEQ ID NO: 517172 - DNA, 20 bp, mouse
gaagttctctggtagcacgt

SEQ ID NO: 517173 - DNA, 20 bp, mouse
ggctcttccaggccagttgg

SEQ ID NO: 517174 - DNA, 20 bp, mouse
gctgtggtaactgggcccac

SEQ ID NO: 517175 - DNA, 20 bp, mouse
gaatgctacttcaggaccct

SEQ ID NO: 517176 - DNA, 20 bp, mouse
gaggcttgcagaccagagtg

SEQ ID NO: 517177 - DNA, 20 bp, mouse
ggactagacacacaacagga

SEQ ID NO: 517178 - DNA, 20 bp, mouse
ggcctgatcaacagcaagag

SEQ ID NO: 517179 - DNA, 20 bp, mouse
gcagggactagacacacaac

SEQ ID NO: 517180 - DNA, 20 bp, mouse
gtgtgtgtctagtccctgcc

SEQ ID NO: 517181 - DNA, 20 bp, mouse
gcaagtgtgtcccatctgtc

SEQ ID NO: 517182 - DNA, 20 bp, mouse
gacccctcttgctgttgatc

SEQ ID NO: 517183 - DNA, 20 bp, mouse
gtgtcccatctgtcaggatc

SEQ ID NO: 517184 - DNA, 20 bp, mouse
gcaaaccagatcctgacaga

SEQ ID NO: 517185 - DNA, 20 bp, mouse
gcagtgggcccacagctcac

SEQ ID NO: 517186 - DNA, 20 bp, mouse
gtgtagaccatgttgagagg

SEQ ID NO: 517187 - DNA, 20 bp, mouse
gagctgtagaccatgttgag

SEQ ID NO: 517188 - DNA, 20 bp, mouse
ggtagcagggcttcgggcag

SEQ ID NO: 517189 - DNA, 20 bp, mouse
gagggcttcgggcaggggct

SEQ ID NO: 517190 - DNA, 20 bp, mouse
gcctcagcctcctctcaaca

SEQ ID NO: 517191 - DNA, 20 bp, mouse
gcagtgggctgtggatccag

SEQ ID NO: 517192 - DNA, 20 bp, mouse
gcttctagagccatagccca

SEQ ID NO: 517193 - DNA, 20 bp, mouse
gcagctccacaccctgccag

SEQ ID NO: 517194 - DNA, 20 bp, mouse
gccagaagctgcagttccct

SEQ ID NO: 517195 - DNA, 20 bp, mouse
ggctgcagttccctgggcta

SEQ ID NO: 517196 - DNA, 20 bp, mouse
gcagccgtaggacatgttga

SEQ ID NO: 517197 - DNA, 20 bp, mouse
gctgccatcaacatgtccta

SEQ ID NO: 517198 - DNA, 20 bp, mouse
ggttctgctgacagccactg

SEQ ID NO: 517199 - DNA, 20 bp, mouse
gagagccacaagaggagtga

SEQ ID NO: 517200 - DNA, 20 bp, mouse
gtttccagaatagcagccgt

SEQ ID NO: 517201 - DNA, 20 bp, mouse
gagaggagtgagggtagctc

SEQ ID NO: 517202 - DNA, 20 bp, mouse
gccccaggaacctgccatct

SEQ ID NO: 517203 - DNA, 20 bp, mouse
gtctatagggcacataggat

SEQ ID NO: 517204 - DNA, 20 bp, mouse
gaggtgatctccactggagc

SEQ ID NO: 517205 - DNA, 20 bp, mouse
gatagggcacataggatggg

SEQ ID NO: 517206 - DNA, 20 bp, mouse
gtgttgcaggacatgttgag

SEQ ID NO: 517207 - DNA, 20 bp, mouse
gcagggtctggagaccacat

SEQ ID NO: 517208 - DNA, 20 bp, mouse
gaggctgtctggcagttggt

SEQ ID NO: 517209 - DNA, 20 bp, mouse
gtaaggagaatgttcagagt

SEQ ID NO: 517210 - DNA, 20 bp, mouse
gcagttggcccccaaaggac

SEQ ID NO: 517211 - DNA, 20 bp, mouse
gtactgcagttggcccccaa

SEQ ID NO: 517212 - DNA, 20 bp, mouse
gggagaccacataggctgtc

SEQ ID NO: 517213 - DNA, 20 bp, mouse
ggctgtggctacccatccca

SEQ ID NO: 517214 - DNA, 20 bp, mouse
gtgtcctgcaacagctgctc

SEQ ID NO: 517215 - DNA, 20 bp, mouse
gcagttggtgggctcacaga

SEQ ID NO: 517216 - DNA, 20 bp, mouse
ggagctatctccaccatgtc

SEQ ID NO: 517217 - DNA, 20 bp, mouse
gaactgctcacggaacacga

SEQ ID NO: 517218 - DNA, 20 bp, mouse
gctcctgccggagccagacg

SEQ ID NO: 517219 - DNA, 20 bp, mouse
gagtgagtgctgcctgagtg

SEQ ID NO: 517220 - DNA, 20 bp, mouse
ggctctactgaggtgagctg

SEQ ID NO: 517221 - DNA, 20 bp, mouse
ggaacaagagggctcacaaa

SEQ ID NO: 517222 - DNA, 20 bp, mouse
gcagctgccacgtctggctc

SEQ ID NO: 517223 - DNA, 20 bp, mouse
gctactgaggtgagctgtgg

SEQ ID NO: 517224 - DNA, 20 bp, mouse
gtgacttgcgaggacagctg

SEQ ID NO: 517225 - DNA, 20 bp, mouse
gaactgcccatagagcagga

SEQ ID NO: 517226 - DNA, 20 bp, mouse
gacgcggccgagcttcccct

SEQ ID NO: 517227 - DNA, 20 bp, mouse
ggccggtcaggtctcaggtc

SEQ ID NO: 517228 - DNA, 20 bp, mouse
gaggtctcaggtcaggaacg

SEQ ID NO: 517229 - DNA, 20 bp, mouse
gtctcccgggcagcatccca

SEQ ID NO: 517230 - DNA, 20 bp, mouse
gttcctgggagcagcaattg

SEQ ID NO: 517231 - DNA, 20 bp, mouse
gtcccagccggtcaggtctc

SEQ ID NO: 517232 - DNA, 20 bp, mouse
gctggccactgtcagaccta

SEQ ID NO: 517233 - DNA, 20 bp, mouse
gacctgaccggctgggacca

SEQ ID NO: 517234 - DNA, 20 bp, mouse
gggaccatgggatgctgccc

SEQ ID NO: 517235 - DNA, 20 bp, mouse
gcttcccctaggtctgacag

SEQ ID NO: 517236 - DNA, 20 bp, mouse
gtggaataagagcgaaaaac

SEQ ID NO: 517237 - DNA, 20 bp, mouse
gctgtaattagaagtaaaca

SEQ ID NO: 517238 - DNA, 20 bp, mouse
gtcgttttttcttgtgtttg

SEQ ID NO: 517239 - DNA, 20 bp, mouse
gtagaagtaaacacgggact

SEQ ID NO: 517240 - DNA, 20 bp, mouse
gttttgggaatgtgttgtag

SEQ ID NO: 517241 - DNA, 20 bp, mouse
gatggatatggctctgacta

SEQ ID NO: 517242 - DNA, 20 bp, mouse
gcaattcactcagtagaagt

SEQ ID NO: 517243 - DNA, 20 bp, mouse
gacatcaatttatacaattt

SEQ ID NO: 517244 - DNA, 20 bp, mouse
ggatatggctctgactatgg

SEQ ID NO: 517245 - DNA, 20 bp, mouse
ggctatggaggctatggatg

SEQ ID NO: 517246 - DNA, 20 bp, mouse
ggtgagcatcagcacctaca

SEQ ID NO: 517247 - DNA, 20 bp, mouse
gtgtagtagctcatgatttt

SEQ ID NO: 517248 - DNA, 20 bp, mouse
gtagctcatgattttaggag

SEQ ID NO: 517249 - DNA, 20 bp, mouse
gtccacagcatgaagagcgg

SEQ ID NO: 517250 - DNA, 20 bp, mouse
gtcctccacagcatgaagag

SEQ ID NO: 517251 - DNA, 20 bp, mouse
gactacagcggctactccgg

SEQ ID NO: 517252 - DNA, 20 bp, mouse
gtagccgtagcccaggcctc

SEQ ID NO: 517253 - DNA, 20 bp, mouse
ggcggctactccggaggcct

SEQ ID NO: 517254 - DNA, 20 bp, mouse
ggaggctacggatacggctc

SEQ ID NO: 517255 - DNA, 20 bp, mouse
ggcagcagctttggaggcct

SEQ ID NO: 517256 - DNA, 20 bp, mouse
gtccatagtagctgctgtag

SEQ ID NO: 517257 - DNA, 20 bp, mouse
gtagctgctgtagtggctca

SEQ ID NO: 517258 - DNA, 20 bp, mouse
gaggtttgagctgttgtaca

SEQ ID NO: 517259 - DNA, 20 bp, mouse
gacagcatccgcagactggt

SEQ ID NO: 517260 - DNA, 20 bp, mouse
ggctacggctatggcagctt

SEQ ID NO: 517261 - DNA, 20 bp, mouse
gtagcactatcaaagcttca

SEQ ID NO: 517262 - DNA, 20 bp, mouse
gacggctatggcagctttgg

SEQ ID NO: 517263 - DNA, 20 bp, mouse
gtaagcttgggcactaagag

SEQ ID NO: 517264 - DNA, 20 bp, mouse
ggactggtgggctttggctc

SEQ ID NO: 517265 - DNA, 20 bp, mouse
gaatgctgagttactggaac

SEQ ID NO: 517266 - DNA, 20 bp, mouse
gtaactcatggtgtctgagg

SEQ ID NO: 517267 - DNA, 20 bp, mouse
ggtgtctgaggtggagagct

SEQ ID NO: 517268 - DNA, 20 bp, mouse
gtagctgttgtagtaactca

SEQ ID NO: 517269 - DNA, 20 bp, mouse
ggctatggaggcttcagctc

SEQ ID NO: 517270 - DNA, 20 bp, mouse
ggagcttggtatgctgttca

SEQ ID NO: 517271 - DNA, 20 bp, mouse
gatatcccccataggaaagg

SEQ ID NO: 517272 - DNA, 20 bp, mouse
ggcacaaatgtcctcacggg

SEQ ID NO: 517273 - DNA, 20 bp, mouse
gtcagcctttcagtagaagg

SEQ ID NO: 517274 - DNA, 20 bp, mouse
gaggcttcggatatggctac

SEQ ID NO: 517275 - DNA, 20 bp, mouse
ggtttccgcagactgggcta

SEQ ID NO: 517276 - DNA, 20 bp, mouse
gtagctcatggtgtcaagac

SEQ ID NO: 517277 - DNA, 20 bp, mouse
gtagctgccgtagtagctca

SEQ ID NO: 517278 - DNA, 20 bp, mouse
ggtgagtgtgaggctgttca

SEQ ID NO: 517279 - DNA, 20 bp, mouse
gatatcctccataataaagg

SEQ ID NO: 517280 - DNA, 20 bp, mouse
gttatggtttgctgttcaag

SEQ ID NO: 517281 - DNA, 20 bp, mouse
ggatctggctatggcagata

SEQ ID NO: 517282 - DNA, 20 bp, mouse
gctactgaaatgcattccag

SEQ ID NO: 517283 - DNA, 20 bp, mouse
gacccaggttcccaaagcct

SEQ ID NO: 517284 - DNA, 20 bp, mouse
gtcctccataataaaggggg

SEQ ID NO: 517285 - DNA, 20 bp, mouse
gtccgaggctttgggaacct

SEQ ID NO: 517286 - DNA, 20 bp, mouse
ggtgaggtcctggagaatgg

SEQ ID NO: 517287 - DNA, 20 bp, mouse
gacacaatgagctactatca

SEQ ID NO: 517288 - DNA, 20 bp, mouse
gggacttggtgtgatgttga

SEQ ID NO: 517289 - DNA, 20 bp, mouse
ggtgtctgagatttgggact

SEQ ID NO: 517290 - DNA, 20 bp, mouse
gcctacagcctagcaggtta

SEQ ID NO: 517291 - DNA, 20 bp, mouse
gagtatctgccatagaaaga

SEQ ID NO: 517292 - DNA, 20 bp, mouse
gggaaccatagccacagctc

SEQ ID NO: 517293 - DNA, 20 bp, mouse
gtccttgcctacagcctagc

SEQ ID NO: 517294 - DNA, 20 bp, mouse
gtatgtatgagattgtgttt

SEQ ID NO: 517295 - DNA, 20 bp, mouse
gggaggtgaccttctgctcc

SEQ ID NO: 517296 - DNA, 20 bp, mouse
gacacaatgagctactacta

SEQ ID NO: 517297 - DNA, 20 bp, mouse
ggtgttagcagctgaggacc

SEQ ID NO: 517298 - DNA, 20 bp, mouse
gctcattgtgttagcagctg

SEQ ID NO: 517299 - DNA, 20 bp, mouse
gtcaccttcaacctcacacc

SEQ ID NO: 517300 - DNA, 20 bp, mouse
ggtaatgcgatccctatcca

SEQ ID NO: 517301 - DNA, 20 bp, mouse
gagaaggtaccaccatgcta

SEQ ID NO: 517302 - DNA, 20 bp, mouse
gaaacagcaccatagcatgg

SEQ ID NO: 517303 - DNA, 20 bp, mouse
gtggtgctgtttgaatccat

SEQ ID NO: 517304 - DNA, 20 bp, mouse
gggcacttaggtccctggat

SEQ ID NO: 517305 - DNA, 20 bp, mouse
ggctttggtggcctgggata

SEQ ID NO: 517306 - DNA, 20 bp, mouse
gggagtggagagttcagctg

SEQ ID NO: 517307 - DNA, 20 bp, mouse
gagtttataggcaacattct

SEQ ID NO: 517308 - DNA, 20 bp, mouse
gggatgtcacaatctaccaa

SEQ ID NO: 517309 - DNA, 20 bp, mouse
gcataatccagttgaaggtg

SEQ ID NO: 517310 - DNA, 20 bp, mouse
gttatgccctcaccttcaac

SEQ ID NO: 517311 - DNA, 20 bp, mouse
gtcaaatatgactctcaacc

SEQ ID NO: 517312 - DNA, 20 bp, mouse
gtagctgccatagtaacaca

SEQ ID NO: 517313 - DNA, 20 bp, mouse
ggagagttcagctgaggaat

SEQ ID NO: 517314 - DNA, 20 bp, mouse
gggagtgtgtttctttagtt

SEQ ID NO: 517315 - DNA, 20 bp, mouse
gtatgtgagcacttatagtt

SEQ ID NO: 517316 - DNA, 20 bp, mouse
gtagtagttgcagcacatgg

SEQ ID NO: 517317 - DNA, 20 bp, mouse
gcctgtggaggctgtggata

SEQ ID NO: 517318 - DNA, 20 bp, mouse
gactacggaaactcctgtgg

SEQ ID NO: 517319 - DNA, 20 bp, mouse
gccgtagtagttgcagcaca

SEQ ID NO: 517320 - DNA, 20 bp, mouse
gctacccagagactaagcag

SEQ ID NO: 517321 - DNA, 20 bp, mouse
gggtacagactagcagcaag

SEQ ID NO: 517322 - DNA, 20 bp, mouse
gtctctgggtagagaattta

SEQ ID NO: 517323 - DNA, 20 bp, mouse
gtcttccactgcttagtctc

SEQ ID NO: 517324 - DNA, 20 bp, mouse
ggaatgtcaaccagtctgcc

SEQ ID NO: 517325 - DNA, 20 bp, mouse
gtggttgtggatatggctcc

SEQ ID NO: 517326 - DNA, 20 bp, mouse
gcatgggcgataggtactgt

SEQ ID NO: 517327 - DNA, 20 bp, mouse
gttcctgacagcatgtgcta

SEQ ID NO: 517328 - DNA, 20 bp, mouse
gcccagggcactgatatgta

SEQ ID NO: 517329 - DNA, 20 bp, mouse
gtgtgctacggaaactactt

SEQ ID NO: 517330 - DNA, 20 bp, mouse
gttccgtagcacatgctgtc

SEQ ID NO: 517331 - DNA, 20 bp, mouse
ggtctgctgctaaccaggtg

SEQ ID NO: 517332 - DNA, 20 bp, mouse
ggctacggaaactactttgg

SEQ ID NO: 517333 - DNA, 20 bp, mouse
gcctatcgcccatgctgcta

SEQ ID NO: 517334 - DNA, 20 bp, mouse
ggttatggctatggtggtct

SEQ ID NO: 517335 - DNA, 20 bp, mouse
ggctatggtagcctgggtta

SEQ ID NO: 517336 - DNA, 20 bp, mouse
gggatagccccgaagagaca

SEQ ID NO: 517337 - DNA, 20 bp, mouse
gagctgcgccatacacacgt

SEQ ID NO: 517338 - DNA, 20 bp, mouse
gcagctaccaaggcaatctc

SEQ ID NO: 517339 - DNA, 20 bp, mouse
gcgtcacggggatgtagcag

SEQ ID NO: 517340 - DNA, 20 bp, mouse
gatgtagcactgcaaagcct

SEQ ID NO: 517341 - DNA, 20 bp, mouse
gagtccgtgggatcacaact

SEQ ID NO: 517342 - DNA, 20 bp, mouse
gatgtagcagtggtttctat

SEQ ID NO: 517343 - DNA, 20 bp, mouse
gcggactccatgtctcttcg

SEQ ID NO: 517344 - DNA, 20 bp, mouse
gaaggcacacaggagtccgt

SEQ ID NO: 517345 - DNA, 20 bp, mouse
gtgcttcacagtaggagtct

SEQ ID NO: 517346 - DNA, 20 bp, mouse
gggtctaagagcagctggga

SEQ ID NO: 517347 - DNA, 20 bp, mouse
ggaacttgagagagtggtag

SEQ ID NO: 517348 - DNA, 20 bp, mouse
gcatagtgaacttgagagag

SEQ ID NO: 517349 - DNA, 20 bp, mouse
ggagctgcagttgccggagg

SEQ ID NO: 517350 - DNA, 20 bp, mouse
gagctgggagggagcacgtc

SEQ ID NO: 517351 - DNA, 20 bp, mouse
gaaagggagaagacgaatga

SEQ ID NO: 517352 - DNA, 20 bp, mouse
gcacccagccgtgaagccag

SEQ ID NO: 517353 - DNA, 20 bp, mouse
gccctctgctctacaaacat

SEQ ID NO: 517354 - DNA, 20 bp, mouse
gcacaggcctgtaggatgct

SEQ ID NO: 517355 - DNA, 20 bp, mouse
ggatccagagctgcagttgc

SEQ ID NO: 517356 - DNA, 20 bp, mouse
ggctcctgaatgactggcaa

SEQ ID NO: 517357 - DNA, 20 bp, mouse
gtttaactaacttcaattaa

SEQ ID NO: 517358 - DNA, 20 bp, mouse
gcaggtagaagtttcactgt

SEQ ID NO: 517359 - DNA, 20 bp, mouse
gtaacttcaattaaaggttt

SEQ ID NO: 517360 - DNA, 20 bp, mouse
gaggtttgagaagcactctc

SEQ ID NO: 517361 - DNA, 20 bp, mouse
gctgtccacaattggctggt

SEQ ID NO: 517362 - DNA, 20 bp, mouse
gggtttcttgaaagttgtcc

SEQ ID NO: 517363 - DNA, 20 bp, mouse
gacaggggtccactttgcac

SEQ ID NO: 517364 - DNA, 20 bp, mouse
gttcttctgtgacaactgct

SEQ ID NO: 517365 - DNA, 20 bp, mouse
gggattagagttgtgtgtga

SEQ ID NO: 517366 - DNA, 20 bp, mouse
gctggctagtaggaacacca

SEQ ID NO: 517367 - DNA, 20 bp, mouse
ggactcccagcctggctagt

SEQ ID NO: 517368 - DNA, 20 bp, mouse
gtggagcatgtagagatggt

SEQ ID NO: 517369 - DNA, 20 bp, mouse
gtgttcctactagccaggct

SEQ ID NO: 517370 - DNA, 20 bp, mouse
gtagagatggtgggcacagt

SEQ ID NO: 517371 - DNA, 20 bp, mouse
ggcacagttggaacagctgt

SEQ ID NO: 517372 - DNA, 20 bp, mouse
gagctaactgggacactgtc

SEQ ID NO: 517373 - DNA, 20 bp, mouse
gttcttgcagactcccagcc

SEQ ID NO: 517374 - DNA, 20 bp, mouse
gttcctgccggtgtaggaca

SEQ ID NO: 517375 - DNA, 20 bp, mouse
gaggccatgtgtgaacctat

SEQ ID NO: 517376 - DNA, 20 bp, mouse
gtgggagttgggttgtggta

SEQ ID NO: 517377 - DNA, 20 bp, mouse
ggggttgtggtaaggttgag

SEQ ID NO: 517378 - DNA, 20 bp, mouse
gactcaggccgggagttggg

SEQ ID NO: 517379 - DNA, 20 bp, mouse
gggcaggggtcacagcaagt

SEQ ID NO: 517380 - DNA, 20 bp, mouse
gcaggaggctgatctcatgt

SEQ ID NO: 517381 - DNA, 20 bp, mouse
gacacagcaagccatggctt

SEQ ID NO: 517382 - DNA, 20 bp, mouse
gtcacagccgggctgcacgt

SEQ ID NO: 517383 - DNA, 20 bp, mouse
gcagacaggccactgaacct

SEQ ID NO: 517384 - DNA, 20 bp, mouse
gaggttggcacgtacacttc

SEQ ID NO: 517385 - DNA, 20 bp, mouse
gacagcaagtgggctgcagg

SEQ ID NO: 517386 - DNA, 20 bp, mouse
gagtatgaggcgtcaagcaa

SEQ ID NO: 517387 - DNA, 20 bp, mouse
ggctggagtctgcttggctt

SEQ ID NO: 517388 - DNA, 20 bp, mouse
gtggtggttgggcagttcct

SEQ ID NO: 517389 - DNA, 20 bp, mouse
gaataaaagtagggtttcca

SEQ ID NO: 517390 - DNA, 20 bp, mouse
gcaaatgtgtcctctcagtc

SEQ ID NO: 517391 - DNA, 20 bp, mouse
gaggcagatgacctaagcca

SEQ ID NO: 517392 - DNA, 20 bp, mouse
ggcctcatactgaaaacccc

SEQ ID NO: 517393 - DNA, 20 bp, mouse
ggcccttaaaaataaaagta

SEQ ID NO: 517394 - DNA, 20 bp, mouse
gaactattgagacaagcagg

SEQ ID NO: 517395 - DNA, 20 bp, mouse
gtcctggggttttcagtatg

SEQ ID NO: 517396 - DNA, 20 bp, mouse
gagtatgaggcgtcaagcaa

SEQ ID NO: 517397 - DNA, 20 bp, mouse
ggctggagtctgcttggctt

SEQ ID NO: 517398 - DNA, 20 bp, mouse
gtggtggttgggcagttcct

SEQ ID NO: 517399 - DNA, 20 bp, mouse
gaataaaagtagggtttcca

SEQ ID NO: 517400 - DNA, 20 bp, mouse
gcaaatgtgtcctctcagtc

SEQ ID NO: 517401 - DNA, 20 bp, mouse
gaggcagatgacctaagcca

SEQ ID NO: 517402 - DNA, 20 bp, mouse
ggcctcatactgaaaacccc

SEQ ID NO: 517403 - DNA, 20 bp, mouse
ggcccttaaaaataaaagta

SEQ ID NO: 517404 - DNA, 20 bp, mouse
gaactattgagacaagcagg

SEQ ID NO: 517405 - DNA, 20 bp, mouse
gtcctggggttttcagtatg

SEQ ID NO: 517406 - DNA, 20 bp, mouse
gacacaggagggtttaaagg

SEQ ID NO: 517407 - DNA, 20 bp, mouse
gcattgtgtaaaactcatct

SEQ ID NO: 517408 - DNA, 20 bp, mouse
gtgggtcatggtgtctggag

SEQ ID NO: 517409 - DNA, 20 bp, mouse
gggctaggctggcagcaggt

SEQ ID NO: 517410 - DNA, 20 bp, mouse
gggtgtgctgcaccaacttg

SEQ ID NO: 517411 - DNA, 20 bp, mouse
gatcacacaggagggtttaa

SEQ ID NO: 517412 - DNA, 20 bp, mouse
gctgcaagaccgcctcctgc

SEQ ID NO: 517413 - DNA, 20 bp, mouse
gaaccaatgatcacacagga

SEQ ID NO: 517414 - DNA, 20 bp, mouse
gcaggagggtttaaaggagg

SEQ ID NO: 517415 - DNA, 20 bp, mouse
gaagaggctaggctggcagc

SEQ ID NO: 517416 - DNA, 20 bp, mouse
ggtcatggtgtcaggagagg

SEQ ID NO: 517417 - DNA, 20 bp, mouse
gagggtgatagtctattccc

SEQ ID NO: 517418 - DNA, 20 bp, mouse
gcattgtgtaaaactcacct

SEQ ID NO: 517419 - DNA, 20 bp, mouse
gcaggagggtttaaaggaga

SEQ ID NO: 517420 - DNA, 20 bp, mouse
gggctaggctggcagcaggt

SEQ ID NO: 517421 - DNA, 20 bp, mouse
gggtgtgctgcaccaacttg

SEQ ID NO: 517422 - DNA, 20 bp, mouse
gctgcaagaccacctcctgc

SEQ ID NO: 517423 - DNA, 20 bp, mouse
gatcacacaggagggtttaa

SEQ ID NO: 517424 - DNA, 20 bp, mouse
gaagaggctaggctggcagc

SEQ ID NO: 517425 - DNA, 20 bp, mouse
gcagcatggctgacaggtgt

SEQ ID NO: 517426 - DNA, 20 bp, mouse
gatctccacctctgacacaa

SEQ ID NO: 517427 - DNA, 20 bp, mouse
ggctgctgtcgaccttcctg

SEQ ID NO: 517428 - DNA, 20 bp, mouse
gctgagagagtgaagatgtt

SEQ ID NO: 517429 - DNA, 20 bp, mouse
ggagttgaccattgtgtcag

SEQ ID NO: 517430 - DNA, 20 bp, mouse
gtgtcagaggtggagattct

SEQ ID NO: 517431 - DNA, 20 bp, mouse
gtggtctcagacagcaacag

SEQ ID NO: 517432 - DNA, 20 bp, mouse
gagagtgaagatgttgggtt

SEQ ID NO: 517433 - DNA, 20 bp, mouse
ggctggaaatgcagcaactg

SEQ ID NO: 517434 - DNA, 20 bp, mouse
gcagaggtggagattctggg

SEQ ID NO: 517435 - DNA, 20 bp, mouse
gcaatggtcaactcttgttg

SEQ ID NO: 517436 - DNA, 20 bp, mouse
gaccatgatgtcagagatgg

SEQ ID NO: 517437 - DNA, 20 bp, mouse
gagcaggtggtctggcaggt

SEQ ID NO: 517438 - DNA, 20 bp, mouse
gttgaccatgatgtcagaga

SEQ ID NO: 517439 - DNA, 20 bp, mouse
ggggctggccgcagctctcc

SEQ ID NO: 517440 - DNA, 20 bp, mouse
gtgtgatcaaagtccctgcc

SEQ ID NO: 517441 - DNA, 20 bp, mouse
gcggcagcaggtggtctggc

SEQ ID NO: 517442 - DNA, 20 bp, mouse
gggccgcagctctcctggca

SEQ ID NO: 517443 - DNA, 20 bp, mouse
gacctccatctctgacatca

SEQ ID NO: 517444 - DNA, 20 bp, mouse
gtcatggtcaactcctgttg

SEQ ID NO: 517445 - DNA, 20 bp, mouse
ggctggggcggcaggtggtt

SEQ ID NO: 517446 - DNA, 20 bp, mouse
ggagccacaagagctgacca

SEQ ID NO: 517447 - DNA, 20 bp, mouse
gtgggtaggcttacaagatg

SEQ ID NO: 517448 - DNA, 20 bp, mouse
gaaaaagcaggagacagcaa

SEQ ID NO: 517449 - DNA, 20 bp, mouse
gcaaaggaagagactagaca

SEQ ID NO: 517450 - DNA, 20 bp, mouse
gacaggggcggcagcagggt

SEQ ID NO: 517451 - DNA, 20 bp, mouse
gggtcctacagcaggtggtt

SEQ ID NO: 517452 - DNA, 20 bp, mouse
gggggcggcagcaggtcggc

SEQ ID NO: 517453 - DNA, 20 bp, mouse
gacaccatggtcagctcttg

SEQ ID NO: 517454 - DNA, 20 bp, mouse
gcagcagctggagctaccac

SEQ ID NO: 517455 - DNA, 20 bp, mouse
ggcagggtcggcagcaggga

SEQ ID NO: 517456 - DNA, 20 bp, mouse
gacaggggcggcagcaaggg

SEQ ID NO: 517457 - DNA, 20 bp, mouse
gtgaggatctgaaggtctcc

SEQ ID NO: 517458 - DNA, 20 bp, mouse
gagaaccaccacaagatggt

SEQ ID NO: 517459 - DNA, 20 bp, mouse
ggatctgaaggtctccgggc

SEQ ID NO: 517460 - DNA, 20 bp, mouse
ggagtgatttgaggatctga

SEQ ID NO: 517461 - DNA, 20 bp, mouse
gtttctgagagagtgatttg

SEQ ID NO: 517462 - DNA, 20 bp, mouse
gcaagatggttggcagcagc

SEQ ID NO: 517463 - DNA, 20 bp, mouse
gtagaggtggaggttctggg

SEQ ID NO: 517464 - DNA, 20 bp, mouse
gctgaggagggctgtagcca

SEQ ID NO: 517465 - DNA, 20 bp, mouse
ggggctggcagcacgcagac

SEQ ID NO: 517466 - DNA, 20 bp, mouse
gtcagaggagcaggtggtga

SEQ ID NO: 517467 - DNA, 20 bp, mouse
gggttctggttattggttgg

SEQ ID NO: 517468 - DNA, 20 bp, mouse
gtctggttattggttggagg

SEQ ID NO: 517469 - DNA, 20 bp, mouse
ggtgtggtgacctctcctcc

SEQ ID NO: 517470 - DNA, 20 bp, mouse
gcatggttctggttattggt

SEQ ID NO: 517471 - DNA, 20 bp, mouse
gtattggttggaggtggaac

SEQ ID NO: 517472 - DNA, 20 bp, mouse
ggctgctgtggctgttgtgg

SEQ ID NO: 517473 - DNA, 20 bp, mouse
gagctcatggttctggttat

SEQ ID NO: 517474 - DNA, 20 bp, mouse
gtgagctgctgtggctgttg

SEQ ID NO: 517475 - DNA, 20 bp, mouse
gtggaggtggaacaggtcag

SEQ ID NO: 517476 - DNA, 20 bp, mouse
gaacagtagaggaagaaccg

SEQ ID NO: 517477 - DNA, 20 bp, mouse
ggtatcacacaaaacagtag

SEQ ID NO: 517478 - DNA, 20 bp, mouse
gagaaggcttagaatatatg

SEQ ID NO: 517479 - DNA, 20 bp, mouse
ggaatatatgaggtgaagaa

SEQ ID NO: 517480 - DNA, 20 bp, mouse
gactactattgaagacacca

SEQ ID NO: 517481 - DNA, 20 bp, mouse
gtgttcagtaactaagcaga

SEQ ID NO: 517482 - DNA, 20 bp, mouse
gaaaatttgttgtaaaaagt

SEQ ID NO: 517483 - DNA, 20 bp, mouse
gaattttcaaaacgattgat

SEQ ID NO: 517484 - DNA, 20 bp, mouse
gagaacatattagaaatctg

SEQ ID NO: 517485 - DNA, 20 bp, mouse
ggtcctgaaattacagttag

SEQ ID NO: 517486 - DNA, 20 bp, mouse
gactacagaggatactacgg

SEQ ID NO: 517487 - DNA, 20 bp, mouse
ggaagtagactattcagttg

SEQ ID NO: 517488 - DNA, 20 bp, mouse
ggtactatggcttctactga

SEQ ID NO: 517489 - DNA, 20 bp, mouse
gtggtctagtcaatattata

SEQ ID NO: 517490 - DNA, 20 bp, mouse
gcatttgcaggtggaatgtg

SEQ ID NO: 517491 - DNA, 20 bp, mouse
gaacattatacacaactctg

SEQ ID NO: 517492 - DNA, 20 bp, mouse
gactagaccaagattctgtg

SEQ ID NO: 517493 - DNA, 20 bp, mouse
gtaatcacatgtcttcacac

SEQ ID NO: 517494 - DNA, 20 bp, mouse
gtgatttccccacagaatct

SEQ ID NO: 517495 - DNA, 20 bp, mouse
gcgacatctgctcagtctat

SEQ ID NO: 517496 - DNA, 20 bp, mouse
ggatgtaagagcctataaga

SEQ ID NO: 517497 - DNA, 20 bp, mouse
gtctgagctcacattcaagg

SEQ ID NO: 517498 - DNA, 20 bp, mouse
gatatttgaaggtcattaaa

SEQ ID NO: 517499 - DNA, 20 bp, mouse
ggatttggctactactactg

SEQ ID NO: 517500 - DNA, 20 bp, mouse
gaaagggcatatcttcaaca

SEQ ID NO: 517501 - DNA, 20 bp, mouse
gtcagagaaacaaaaccctc

SEQ ID NO: 517502 - DNA, 20 bp, mouse
gatttctgagctcacattca

SEQ ID NO: 517503 - DNA, 20 bp, mouse
gcttcaaatataagacctga

SEQ ID NO: 517504 - DNA, 20 bp, mouse
gaaaacatgcagttcagaat

SEQ ID NO: 517505 - DNA, 20 bp, mouse
gaggaggtgagagtcttcca

SEQ ID NO: 517506 - DNA, 20 bp, mouse
gcgagtcatggtggcagatg

SEQ ID NO: 517507 - DNA, 20 bp, mouse
gtccatagcagggataccct

SEQ ID NO: 517508 - DNA, 20 bp, mouse
gcagcagaaatagcgagtca

SEQ ID NO: 517509 - DNA, 20 bp, mouse
gagagccccatggcctgtag

SEQ ID NO: 517510 - DNA, 20 bp, mouse
gtgggctcccccctgaacca

SEQ ID NO: 517511 - DNA, 20 bp, mouse
gctgcggaaactacttccca

SEQ ID NO: 517512 - DNA, 20 bp, mouse
gaagttgcgggagctgtaca

SEQ ID NO: 517513 - DNA, 20 bp, mouse
gccgcagccatggttcaggg

SEQ ID NO: 517514 - DNA, 20 bp, mouse
ggctcccgcaacttctgcta

SEQ ID NO: 517515 - DNA, 20 bp, mouse
gggtggctctgtaggtccca

SEQ ID NO: 517516 - DNA, 20 bp, mouse
ggctgccccagtagcatcct

SEQ ID NO: 517517 - DNA, 20 bp, mouse
gtgtactacaccggcgctga

SEQ ID NO: 517518 - DNA, 20 bp, mouse
gcggtgtagtacatgatgtc

SEQ ID NO: 517519 - DNA, 20 bp, mouse
gcagctatggctaccctctg

SEQ ID NO: 517520 - DNA, 20 bp, mouse
ggccttggctatggctacaa

SEQ ID NO: 517521 - DNA, 20 bp, mouse
ggccaacactgtaccccaga

SEQ ID NO: 517522 - DNA, 20 bp, mouse
gatccaggaaaggcagagta

SEQ ID NO: 517523 - DNA, 20 bp, mouse
ggtcttcccaggatgctact

SEQ ID NO: 517524 - DNA, 20 bp, mouse
gcggggcttacagaagatac

SEQ ID NO: 517525 - DNA, 20 bp, mouse
gaggaagatgaagggtggtg

SEQ ID NO: 517526 - DNA, 20 bp, mouse
gcaactcaacggtaacacaa

SEQ ID NO: 517527 - DNA, 20 bp, mouse
gaaaaggctcttggtaggat

SEQ ID NO: 517528 - DNA, 20 bp, mouse
gtgagagctgtgtagttgag

SEQ ID NO: 517529 - DNA, 20 bp, mouse
ggccttctggcaagaatctt

SEQ ID NO: 517530 - DNA, 20 bp, mouse
gtgtagttgagaggagtttc

SEQ ID NO: 517531 - DNA, 20 bp, mouse
ggagaggagtttctggattc

SEQ ID NO: 517532 - DNA, 20 bp, mouse
gagccagtctcgcaacagct

SEQ ID NO: 517533 - DNA, 20 bp, mouse
gtgccagcccagctgttgtg

SEQ ID NO: 517534 - DNA, 20 bp, mouse
gagccaagctgttgcgagac

SEQ ID NO: 517535 - DNA, 20 bp, mouse
gttacctgtcgcagagtgac

SEQ ID NO: 517536 - DNA, 20 bp, mouse
ggtcatggtgtcaagatggt

SEQ ID NO: 517537 - DNA, 20 bp, mouse
ggcaaccaagctgactgcaa

SEQ ID NO: 517538 - DNA, 20 bp, mouse
ggttggtcatggtgtcaaga

SEQ ID NO: 517539 - DNA, 20 bp, mouse
gaggaaactcacctgttaac

SEQ ID NO: 517540 - DNA, 20 bp, mouse
ggttggaggttcctgttaac

SEQ ID NO: 517541 - DNA, 20 bp, mouse
gggactgcaactggtcacat

SEQ ID NO: 517542 - DNA, 20 bp, mouse
gtgcaactggtcacataggt

SEQ ID NO: 517543 - DNA, 20 bp, mouse
gagcagctgtttatactggt

SEQ ID NO: 517544 - DNA, 20 bp, mouse
gcagattggcttatagcagg

SEQ ID NO: 517545 - DNA, 20 bp, mouse
gagctgggctggtagcggga

SEQ ID NO: 517546 - DNA, 20 bp, mouse
gtggctcccctctttctcca

SEQ ID NO: 517547 - DNA, 20 bp, mouse
ggaaagaggggagccaaagc

SEQ ID NO: 517548 - DNA, 20 bp, mouse
gtgaatggtgagccactcgg

SEQ ID NO: 517549 - DNA, 20 bp, mouse
gcacggattggaccacggac

SEQ ID NO: 517550 - DNA, 20 bp, mouse
gagggacacggattggacca

SEQ ID NO: 517551 - DNA, 20 bp, mouse
ggcgtgatgggtaaccgcac

SEQ ID NO: 517552 - DNA, 20 bp, mouse
gcgcctttggagaaccacgt

SEQ ID NO: 517553 - DNA, 20 bp, mouse
gtttctccagggacacggat

SEQ ID NO: 517554 - DNA, 20 bp, mouse
gagcagcccgggcatcccgc

SEQ ID NO: 517555 - DNA, 20 bp, mouse
gtccggacaggcgggaactt

SEQ ID NO: 517556 - DNA, 20 bp, mouse
gaggtccaggtagagcctat

SEQ ID NO: 517557 - DNA, 20 bp, mouse
gcggaagcggcgcttgaggt

SEQ ID NO: 517558 - DNA, 20 bp, mouse
gctctactccctccgcccat

SEQ ID NO: 517559 - DNA, 20 bp, mouse
ggagtagagcggccacgatg

SEQ ID NO: 517560 - DNA, 20 bp, mouse
gtccgcccataggctctacc

SEQ ID NO: 517561 - DNA, 20 bp, mouse
gagccgcctgggccctcggg

SEQ ID NO: 517562 - DNA, 20 bp, mouse
gacgccgcagcacctcatcg

SEQ ID NO: 517563 - DNA, 20 bp, mouse
gtcggcgtcgggacaaagcc

SEQ ID NO: 517564 - DNA, 20 bp, mouse
gtgccgcccgagggcccagg

SEQ ID NO: 517565 - DNA, 20 bp, mouse
gcggcgcttgaggtcggcgt

SEQ ID NO: 517566 - DNA, 20 bp, mouse
ggagagaggagagccacgac

SEQ ID NO: 517567 - DNA, 20 bp, mouse
ggagccacgacgggaagaat

SEQ ID NO: 517568 - DNA, 20 bp, mouse
gtgattaccgggtatatcgt

SEQ ID NO: 517569 - DNA, 20 bp, mouse
gtggatgggcaacactgagg

SEQ ID NO: 517570 - DNA, 20 bp, mouse
gacttctccacagaatggat

SEQ ID NO: 517571 - DNA, 20 bp, mouse
ggcctcagagcagcccaaac

SEQ ID NO: 517572 - DNA, 20 bp, mouse
ggggagccggaagctgaggt

SEQ ID NO: 517573 - DNA, 20 bp, mouse
ggtgttgcccatccattctg

SEQ ID NO: 517574 - DNA, 20 bp, mouse
gccatccgaaagctactcag

SEQ ID NO: 517575 - DNA, 20 bp, mouse
gggcagccggggtctaaaaa

SEQ ID NO: 517576 - DNA, 20 bp, mouse
ggcgggaggaggagcggact

SEQ ID NO: 517577 - DNA, 20 bp, mouse
gcacagccgtcgggtagtgg

SEQ ID NO: 517578 - DNA, 20 bp, mouse
gtcctcctcccgcccagacg

SEQ ID NO: 517579 - DNA, 20 bp, mouse
ggaaagcctccactacccga

SEQ ID NO: 517580 - DNA, 20 bp, mouse
gcgatgggcgagaaaaagga

SEQ ID NO: 517581 - DNA, 20 bp, mouse
ggccgcgtctgggcgggagg

SEQ ID NO: 517582 - DNA, 20 bp, mouse
gctgcactaggagcgcccct

SEQ ID NO: 517583 - DNA, 20 bp, mouse
gaaccacagccgtcgggtag

SEQ ID NO: 517584 - DNA, 20 bp, mouse
gctttgccgccgcgtctggg

SEQ ID NO: 517585 - DNA, 20 bp, mouse
gtgccgaggcatggatagag

SEQ ID NO: 517586 - DNA, 20 bp, mouse
gccgccgccgggctccaggg

SEQ ID NO: 517587 - DNA, 20 bp, mouse
ggacaggcaagatgtcggtg

SEQ ID NO: 517588 - DNA, 20 bp, mouse
gtgattgacaggcaagatgt

SEQ ID NO: 517589 - DNA, 20 bp, mouse
gcgccgggctccagggggga

SEQ ID NO: 517590 - DNA, 20 bp, mouse
gttgccgccgccgggctcca

SEQ ID NO: 517591 - DNA, 20 bp, mouse
gaagatgtcggtgtggagcg

SEQ ID NO: 517592 - DNA, 20 bp, mouse
gaccccgcccagtgattgac

SEQ ID NO: 517593 - DNA, 20 bp, mouse
ggtcaccgcgaccaggaggg

SEQ ID NO: 517594 - DNA, 20 bp, mouse
gagccgtcccccctggagcc

SEQ ID NO: 517595 - DNA, 20 bp, mouse
ggtctgtacacttagagagg

SEQ ID NO: 517596 - DNA, 20 bp, mouse
gcgagcggcatgatctccag

SEQ ID NO: 517597 - DNA, 20 bp, mouse
ggcccgcaaaccacgacgag

SEQ ID NO: 517598 - DNA, 20 bp, mouse
ggtccagcggcaagagccag

SEQ ID NO: 517599 - DNA, 20 bp, mouse
gagcggcaagagccagcgga

SEQ ID NO: 517600 - DNA, 20 bp, mouse
ggaggcagtacagctcgtag

SEQ ID NO: 517601 - DNA, 20 bp, mouse
ggagatcatgccgctcgtcg

SEQ ID NO: 517602 - DNA, 20 bp, mouse
gggcaagagccagcggacgg

SEQ ID NO: 517603 - DNA, 20 bp, mouse
gtttgcgggctgccgtccag

SEQ ID NO: 517604 - DNA, 20 bp, mouse
ggccaggtcccggttctcgg

SEQ ID NO: 517605 - DNA, 20 bp, mouse
gcgcaggacccgactgtgta

SEQ ID NO: 517606 - DNA, 20 bp, mouse
gccaggccgggacgatgcag

SEQ ID NO: 517607 - DNA, 20 bp, mouse
gtgggagcgcgctgaccagg

SEQ ID NO: 517608 - DNA, 20 bp, mouse
ggacggcacctgagctactg

SEQ ID NO: 517609 - DNA, 20 bp, mouse
gcggcgcgagctctacctcc

SEQ ID NO: 517610 - DNA, 20 bp, mouse
gggccccgccgcagtagctc

SEQ ID NO: 517611 - DNA, 20 bp, mouse
gcgcagccgggtaccaggcc

SEQ ID NO: 517612 - DNA, 20 bp, mouse
ggcctgggagcgcgctgacc

SEQ ID NO: 517613 - DNA, 20 bp, mouse
gagcagggccggggactcca

SEQ ID NO: 517614 - DNA, 20 bp, mouse
gcacctgagctactgcggcg

SEQ ID NO: 517615 - DNA, 20 bp, mouse
gttcctgcggggcggcgcga

SEQ ID NO: 517616 - DNA, 20 bp, mouse
ggccagatgtgcaggtgccg

SEQ ID NO: 517617 - DNA, 20 bp, mouse
gcgggcagggcgggaactcg

SEQ ID NO: 517618 - DNA, 20 bp, mouse
ggcctcggcacctgcacatc

SEQ ID NO: 517619 - DNA, 20 bp, mouse
ggccaggccgccagatgtgc

SEQ ID NO: 517620 - DNA, 20 bp, mouse
gaagcgctagggcgccctcc

SEQ ID NO: 517621 - DNA, 20 bp, mouse
ggctccaggtcacacaacta

SEQ ID NO: 517622 - DNA, 20 bp, mouse
ggtcagcctgacattcctgg

SEQ ID NO: 517623 - DNA, 20 bp, mouse
ggggcgtcaggaggccacgg

SEQ ID NO: 517624 - DNA, 20 bp, mouse
gacctgcacatctggcggcc

SEQ ID NO: 517625 - DNA, 20 bp, mouse
gtcaggaggccacggagggg

SEQ ID NO: 517626 - DNA, 20 bp, mouse
gcgggagggaggcggcacca

SEQ ID NO: 517627 - DNA, 20 bp, mouse
gccccggcgagaggacccgg

SEQ ID NO: 517628 - DNA, 20 bp, mouse
gcctcccggcccgcgcgcag

SEQ ID NO: 517629 - DNA, 20 bp, mouse
ggctgctcgcgaggctgcct

SEQ ID NO: 517630 - DNA, 20 bp, mouse
gggcaccatggagctgaaga

SEQ ID NO: 517631 - DNA, 20 bp, mouse
gcagcggtctgggagaggtt

SEQ ID NO: 517632 - DNA, 20 bp, mouse
ggtctgggagaggttcggag

SEQ ID NO: 517633 - DNA, 20 bp, mouse
gaggctgcctaggctgcaaa

SEQ ID NO: 517634 - DNA, 20 bp, mouse
ggccccccggcgagaggacc

SEQ ID NO: 517635 - DNA, 20 bp, mouse
gacggggccatttgcagcct

SEQ ID NO: 517636 - DNA, 20 bp, mouse
ggtcttcagtaccttctcag

SEQ ID NO: 517637 - DNA, 20 bp, mouse
gggtactgaagactactgtc

SEQ ID NO: 517638 - DNA, 20 bp, mouse
gggtaagcagagaagaggtc

SEQ ID NO: 517639 - DNA, 20 bp, mouse
gccaggctagagagaacgaa

SEQ ID NO: 517640 - DNA, 20 bp, mouse
ggcagttctttggctagctg

SEQ ID NO: 517641 - DNA, 20 bp, mouse
gctactgtctggatctgagc

SEQ ID NO: 517642 - DNA, 20 bp, mouse
gctctctagcctgggtttcg

SEQ ID NO: 517643 - DNA, 20 bp, mouse
gttcgaggcacaggctttaa

SEQ ID NO: 517644 - DNA, 20 bp, mouse
ggaggcacaggctttaaggg

SEQ ID NO: 517645 - DNA, 20 bp, mouse
gctttaagggaggtcatgcc

SEQ ID NO: 517646 - DNA, 20 bp, mouse
gagcagcagcaacatcgcgt

SEQ ID NO: 517647 - DNA, 20 bp, mouse
gtgggtggcaggtccgaggt

SEQ ID NO: 517648 - DNA, 20 bp, mouse
gtcgctgggtggcaggtccg

SEQ ID NO: 517649 - DNA, 20 bp, mouse
gcggcagcggcatcgctggg

SEQ ID NO: 517650 - DNA, 20 bp, mouse
gtgatcggcgcaggtaaggt

SEQ ID NO: 517651 - DNA, 20 bp, mouse
gagcaacatcgcgtcggcag

SEQ ID NO: 517652 - DNA, 20 bp, mouse
gcgtcggcagcggcatcgct

SEQ ID NO: 517653 - DNA, 20 bp, mouse
gtctctgtgcacgccgacct

SEQ ID NO: 517654 - DNA, 20 bp, mouse
gagccctgcgatctggaatg

SEQ ID NO: 517655 - DNA, 20 bp, mouse
gcctcaggctcagagggagt

SEQ ID NO: 517656 - DNA, 20 bp, mouse
gacctcgtggctctcaggta

SEQ ID NO: 517657 - DNA, 20 bp, mouse
gagaaacacggggacatctg

SEQ ID NO: 517658 - DNA, 20 bp, mouse
gacctcagggctgcacctcg

SEQ ID NO: 517659 - DNA, 20 bp, mouse
ggccacgaggtgcagccctg

SEQ ID NO: 517660 - DNA, 20 bp, mouse
gaggcggaggtgagctagag

SEQ ID NO: 517661 - DNA, 20 bp, mouse
gcagagcagggtgagaaaca

SEQ ID NO: 517662 - DNA, 20 bp, mouse
ggctgcacctcgtggctctc

SEQ ID NO: 517663 - DNA, 20 bp, mouse
ggagagtgccgtgacagtgg

SEQ ID NO: 517664 - DNA, 20 bp, mouse
gggacaatgagacagcgggg

SEQ ID NO: 517665 - DNA, 20 bp, mouse
ggcctggccggccctggggt

SEQ ID NO: 517666 - DNA, 20 bp, mouse
gcaacctgaacggactctaa

SEQ ID NO: 517667 - DNA, 20 bp, mouse
gccagcacccgcaacctgaa

SEQ ID NO: 517668 - DNA, 20 bp, mouse
gcgcctacgtagcgcagggt

SEQ ID NO: 517669 - DNA, 20 bp, mouse
gggccgaccctgcgctacgt

SEQ ID NO: 517670 - DNA, 20 bp, mouse
gctatggcgcacaaacgcag

SEQ ID NO: 517671 - DNA, 20 bp, mouse
gacaccgcctacgtagcgca

SEQ ID NO: 517672 - DNA, 20 bp, mouse
gcgagtcgggggacacagac

SEQ ID NO: 517673 - DNA, 20 bp, mouse
ggctacgtaggcggtgtctg

SEQ ID NO: 517674 - DNA, 20 bp, mouse
gcgtttgtgcgccataggaa

SEQ ID NO: 517675 - DNA, 20 bp, mouse
ggacagagacatcgagtcgg

SEQ ID NO: 517676 - DNA, 20 bp, mouse
gagagttagactcccaacag

SEQ ID NO: 517677 - DNA, 20 bp, mouse
ggcgtccggaatcttagact

SEQ ID NO: 517678 - DNA, 20 bp, mouse
ggcgacaggacagggagcgt

SEQ ID NO: 517679 - DNA, 20 bp, mouse
ggagcctgggcgacaggaca

SEQ ID NO: 517680 - DNA, 20 bp, mouse
gccctggacgcagacaatgg

SEQ ID NO: 517681 - DNA, 20 bp, mouse
gagtccctggacgcagacaa

SEQ ID NO: 517682 - DNA, 20 bp, mouse
gtcacccagcgaccagcgtc

SEQ ID NO: 517683 - DNA, 20 bp, mouse
gtgggcgcgcccgagctagc

SEQ ID NO: 517684 - DNA, 20 bp, mouse
gtcccaacaggggcgagcct

SEQ ID NO: 517685 - DNA, 20 bp, mouse
ggagaaagcgccaaacccaa

SEQ ID NO: 517686 - DNA, 20 bp, mouse
gagccatgcaggtaagaacg

SEQ ID NO: 517687 - DNA, 20 bp, mouse
ggcaccgagcgaccgaccgt

SEQ ID NO: 517688 - DNA, 20 bp, mouse
gcgaccgtgggagcctggtg

SEQ ID NO: 517689 - DNA, 20 bp, mouse
ggcgccgcaccaggctccca

SEQ ID NO: 517690 - DNA, 20 bp, mouse
gcggcaaccgctagccatgc

SEQ ID NO: 517691 - DNA, 20 bp, mouse
ggtcggtcgctcggtgcggg

SEQ ID NO: 517692 - DNA, 20 bp, mouse
ggcatccagagcggtaggga

SEQ ID NO: 517693 - DNA, 20 bp, mouse
ggcaggtaagaacggggcag

SEQ ID NO: 517694 - DNA, 20 bp, mouse
gagaacggggcagtggtctc

SEQ ID NO: 517695 - DNA, 20 bp, mouse
gttcttacctgcatggctag

SEQ ID NO: 517696 - DNA, 20 bp, mouse
ggagagcggcgagggcaata

SEQ ID NO: 517697 - DNA, 20 bp, mouse
gggcttcctgcacctggtga

SEQ ID NO: 517698 - DNA, 20 bp, mouse
gtgagcacactctcggagag

SEQ ID NO: 517699 - DNA, 20 bp, mouse
gctcaaccgtcaccaggtgc

SEQ ID NO: 517700 - DNA, 20 bp, mouse
gcactctcggagagcggcga

SEQ ID NO: 517701 - DNA, 20 bp, mouse
gctcttacctcagtgccccg

SEQ ID NO: 517702 - DNA, 20 bp, mouse
ggagaaaccgcggggcactg

SEQ ID NO: 517703 - DNA, 20 bp, mouse
ggtatcatggagaaaccgcg

SEQ ID NO: 517704 - DNA, 20 bp, mouse
gtctggtgacgaaggaagga

SEQ ID NO: 517705 - DNA, 20 bp, mouse
gcttccacgcgggaagtgaa

SEQ ID NO: 517706 - DNA, 20 bp, mouse
ggtcaggactactcgtgaga

SEQ ID NO: 517707 - DNA, 20 bp, mouse
gcagccctggaccatttgtc

SEQ ID NO: 517708 - DNA, 20 bp, mouse
ggcatgtgcgcgtagagtca

SEQ ID NO: 517709 - DNA, 20 bp, mouse
ggtcttgggaaagagatcag

SEQ ID NO: 517710 - DNA, 20 bp, mouse
gcccagaggcgcagagaagt

SEQ ID NO: 517711 - DNA, 20 bp, mouse
gggaagcgcaccctcgtctt

SEQ ID NO: 517712 - DNA, 20 bp, mouse
gcacgagtagtcctgacaaa

SEQ ID NO: 517713 - DNA, 20 bp, mouse
gttgggaaagagatcagggg

SEQ ID NO: 517714 - DNA, 20 bp, mouse
gtctgagacctagagaggga

SEQ ID NO: 517715 - DNA, 20 bp, mouse
ggcgcgtagagtcagggctg

SEQ ID NO: 517716 - DNA, 20 bp, mouse
ggccagccgccggccggagg

SEQ ID NO: 517717 - DNA, 20 bp, mouse
gccagccagccgccggccgg

SEQ ID NO: 517718 - DNA, 20 bp, mouse
gcagccagccagccgccggc

SEQ ID NO: 517719 - DNA, 20 bp, mouse
gggcaaacttgagagcggcg

SEQ ID NO: 517720 - DNA, 20 bp, mouse
gccaggggcgcactggcgga

SEQ ID NO: 517721 - DNA, 20 bp, mouse
ggtttgcctcctcctccggc

SEQ ID NO: 517722 - DNA, 20 bp, mouse
gttgagagcggcggggccag

SEQ ID NO: 517723 - DNA, 20 bp, mouse
gaaatcagcggggaaaggag

SEQ ID NO: 517724 - DNA, 20 bp, mouse
gtgcctcctcctccggccgg

SEQ ID NO: 517725 - DNA, 20 bp, mouse
ggacagacagacaccacggc

SEQ ID NO: 517726 - DNA, 20 bp, mouse
gcagctgctgcgggacactg

SEQ ID NO: 517727 - DNA, 20 bp, mouse
gggccggtgcacctcacccg

SEQ ID NO: 517728 - DNA, 20 bp, mouse
ggcagggtgcgcgcccgagt

SEQ ID NO: 517729 - DNA, 20 bp, mouse
gcgggacactggggtaagca

SEQ ID NO: 517730 - DNA, 20 bp, mouse
ggtgcagctggaccgaccgg

SEQ ID NO: 517731 - DNA, 20 bp, mouse
gtcacccgcggcagctgctg

SEQ ID NO: 517732 - DNA, 20 bp, mouse
ggaccccgggtggatggtca

SEQ ID NO: 517733 - DNA, 20 bp, mouse
gggcgctcaaagccaggaag

SEQ ID NO: 517734 - DNA, 20 bp, mouse
ggagcgaagccatgcaaagt

SEQ ID NO: 517735 - DNA, 20 bp, mouse
ggcatgcgcgtgcgcggtgg

SEQ ID NO: 517736 - DNA, 20 bp, mouse
gtggagcaaaaggaatgtca

SEQ ID NO: 517737 - DNA, 20 bp, mouse
ggctgctgccctatgagaaa

SEQ ID NO: 517738 - DNA, 20 bp, mouse
ggctgaggctggtccctgtc

SEQ ID NO: 517739 - DNA, 20 bp, mouse
gttgatgtgcataggatcca

SEQ ID NO: 517740 - DNA, 20 bp, mouse
ggcagcgtccatggagcaaa

SEQ ID NO: 517741 - DNA, 20 bp, mouse
gtagctctccctttctcata

SEQ ID NO: 517742 - DNA, 20 bp, mouse
gagaggcagtacagacagtc

SEQ ID NO: 517743 - DNA, 20 bp, mouse
gagatagcagagtcatctca

SEQ ID NO: 517744 - DNA, 20 bp, mouse
ggactctgctatctttgtgt

SEQ ID NO: 517745 - DNA, 20 bp, mouse
gacccaaaacaccaaagcag

SEQ ID NO: 517746 - DNA, 20 bp, mouse
ggcgtccccgggcctcccgg

SEQ ID NO: 517747 - DNA, 20 bp, mouse
gctcggcgctcgaaccccag

SEQ ID NO: 517748 - DNA, 20 bp, mouse
ggccgtgcaggcgacctcgg

SEQ ID NO: 517749 - DNA, 20 bp, mouse
gtggcgggaacacccaaacc

SEQ ID NO: 517750 - DNA, 20 bp, mouse
ggaggcccggggacgcggtg

SEQ ID NO: 517751 - DNA, 20 bp, mouse
gtcccgtgaggcgcccggaa

SEQ ID NO: 517752 - DNA, 20 bp, mouse
gccacggcccgcggggagag

SEQ ID NO: 517753 - DNA, 20 bp, mouse
gtctccagggcgccacctcg

SEQ ID NO: 517754 - DNA, 20 bp, mouse
gcagccctgcggtgagtccc

SEQ ID NO: 517755 - DNA, 20 bp, mouse
gcggtgagtcccgggcggag

SEQ ID NO: 517756 - DNA, 20 bp, mouse
gcggagcgcagagtaaccaa

SEQ ID NO: 517757 - DNA, 20 bp, mouse
gccctgtacggagctcaaga

SEQ ID NO: 517758 - DNA, 20 bp, mouse
gtgtacggagctcaagatgg

SEQ ID NO: 517759 - DNA, 20 bp, mouse
gagagtaaccaagggcgacc

SEQ ID NO: 517760 - DNA, 20 bp, mouse
ggcccaccggaaggcgtgaa

SEQ ID NO: 517761 - DNA, 20 bp, mouse
gcgcgcgcagccggctgact

SEQ ID NO: 517762 - DNA, 20 bp, mouse
ggctgggagggatcagacag

SEQ ID NO: 517763 - DNA, 20 bp, mouse
ggtaaccaagggcgaccagg

SEQ ID NO: 517764 - DNA, 20 bp, mouse
ggcagccggctgactgggag

SEQ ID NO: 517765 - DNA, 20 bp, mouse
gtccaggcctgggttacctg

SEQ ID NO: 517766 - DNA, 20 bp, mouse
gctgcggaggcaacatgtac

SEQ ID NO: 517767 - DNA, 20 bp, mouse
ggaggcagccggctctgcgg

SEQ ID NO: 517768 - DNA, 20 bp, mouse
gcaagccggagcaagctagg

SEQ ID NO: 517769 - DNA, 20 bp, mouse
gtaggaggcagccggctctg

SEQ ID NO: 517770 - DNA, 20 bp, mouse
gggccaagccggagcaagct

SEQ ID NO: 517771 - DNA, 20 bp, mouse
gtgtcacgcttgacaggagc

SEQ ID NO: 517772 - DNA, 20 bp, mouse
gaggcccagcctgggacgga

SEQ ID NO: 517773 - DNA, 20 bp, mouse
ggagcaagctaggaggcagc

SEQ ID NO: 517774 - DNA, 20 bp, mouse
gcccagcctgggacggaggg

SEQ ID NO: 517775 - DNA, 20 bp, mouse
gccgagctgtcacgcttgac

SEQ ID NO: 517776 - DNA, 20 bp, mouse
gtgctcgatgcgctgcagag

SEQ ID NO: 517777 - DNA, 20 bp, mouse
gtatctacctcggtgaccgc

SEQ ID NO: 517778 - DNA, 20 bp, mouse
ggccatctctctatctacct

SEQ ID NO: 517779 - DNA, 20 bp, mouse
gcgcagcacgctgagtgact

SEQ ID NO: 517780 - DNA, 20 bp, mouse
ggagcagctgtccagtcggg

SEQ ID NO: 517781 - DNA, 20 bp, mouse
gacctcaggctcggagggca

SEQ ID NO: 517782 - DNA, 20 bp, mouse
gtccagtgtttggaacgcag

SEQ ID NO: 517783 - DNA, 20 bp, mouse
ggtggcagggaggcagcgag

SEQ ID NO: 517784 - DNA, 20 bp, mouse
gcgctgagtgacttggaatt

SEQ ID NO: 517785 - DNA, 20 bp, mouse
ggtgactgcgtgagctgcgg

SEQ ID NO: 517786 - DNA, 20 bp, mouse
gggaagacccttgaaacaca

SEQ ID NO: 517787 - DNA, 20 bp, mouse
gctcaggcaaacctgaagga

SEQ ID NO: 517788 - DNA, 20 bp, mouse
gatgagggccacatctgtca

SEQ ID NO: 517789 - DNA, 20 bp, mouse
gggtttgcctgagatagaag

SEQ ID NO: 517790 - DNA, 20 bp, mouse
gtacttccagaaggatctaa

SEQ ID NO: 517791 - DNA, 20 bp, mouse
gtcacggctgctggcagttt

SEQ ID NO: 517792 - DNA, 20 bp, mouse
gaggatagtcctggacaatc

SEQ ID NO: 517793 - DNA, 20 bp, mouse
gggttgaaagagctgaattg

SEQ ID NO: 517794 - DNA, 20 bp, mouse
gccgggatccctgtgtttca

SEQ ID NO: 517795 - DNA, 20 bp, mouse
ggggaaggagctggaattag

SEQ ID NO: 517796 - DNA, 20 bp, mouse
ggtggggctcggcagcatgt

SEQ ID NO: 517797 - DNA, 20 bp, mouse
gcagggagctcggcacgcgg

SEQ ID NO: 517798 - DNA, 20 bp, mouse
gtgggagaggagatccgaag

SEQ ID NO: 517799 - DNA, 20 bp, mouse
ggtcggtcagcagaaaggac

SEQ ID NO: 517800 - DNA, 20 bp, mouse
gagcggcggagcagggagct

SEQ ID NO: 517801 - DNA, 20 bp, mouse
gtcggcacgcggcggccgtg

SEQ ID NO: 517802 - DNA, 20 bp, mouse
ggagcagggagctcggcacg

SEQ ID NO: 517803 - DNA, 20 bp, mouse
gacgcggcggccgtggggct

SEQ ID NO: 517804 - DNA, 20 bp, mouse
gacccgctctgtcacctagg

SEQ ID NO: 517805 - DNA, 20 bp, mouse
gtgcactcacctggacagcg

SEQ ID NO: 517806 - DNA, 20 bp, mouse
gcaggatggataatgatcag

SEQ ID NO: 517807 - DNA, 20 bp, mouse
ggggacccagagcagagtgc

SEQ ID NO: 517808 - DNA, 20 bp, mouse
gatgatcagaggcccgggct

SEQ ID NO: 517809 - DNA, 20 bp, mouse
gaagaggacgccccaggagt

SEQ ID NO: 517810 - DNA, 20 bp, mouse
gagttctagctagctgcagt

SEQ ID NO: 517811 - DNA, 20 bp, mouse
ggaagcagaaggactgggtc

SEQ ID NO: 517812 - DNA, 20 bp, mouse
gggataatgatcagaggccc

SEQ ID NO: 517813 - DNA, 20 bp, mouse
gtctgctctgggtcccagcc

SEQ ID NO: 517814 - DNA, 20 bp, mouse
ggttctacaaggaggaggtg

SEQ ID NO: 517815 - DNA, 20 bp, mouse
gagtggggactggagacagc

SEQ ID NO: 517816 - DNA, 20 bp, mouse
ggagcttccggaggataagg

SEQ ID NO: 517817 - DNA, 20 bp, mouse
ggcggagcttccggaggata

SEQ ID NO: 517818 - DNA, 20 bp, mouse
gcgaggggcggagcttccgg

SEQ ID NO: 517819 - DNA, 20 bp, mouse
gcagcggctagtctgaccat

SEQ ID NO: 517820 - DNA, 20 bp, mouse
gagggaagcgggtagtctgg

SEQ ID NO: 517821 - DNA, 20 bp, mouse
gcagaacccgccttatcctc

SEQ ID NO: 517822 - DNA, 20 bp, mouse
gaagcgggtagtctggagga

SEQ ID NO: 517823 - DNA, 20 bp, mouse
gcaggccataccccaatcag

SEQ ID NO: 517824 - DNA, 20 bp, mouse
gctgcgggatgcttgaaaca

SEQ ID NO: 517825 - DNA, 20 bp, mouse
ggaagctccgcccctcgcac

SEQ ID NO: 517826 - DNA, 20 bp, mouse
ggctctgaccagacctggta

SEQ ID NO: 517827 - DNA, 20 bp, mouse
gtcttccaagtaggacgtgg

SEQ ID NO: 517828 - DNA, 20 bp, mouse
gaggctccagcaaccttacc

SEQ ID NO: 517829 - DNA, 20 bp, mouse
gccagcaaccttaccaggtc

SEQ ID NO: 517830 - DNA, 20 bp, mouse
gcgattctggagcccctggg

SEQ ID NO: 517831 - DNA, 20 bp, mouse
gcaagcaccagcaggataac

SEQ ID NO: 517832 - DNA, 20 bp, mouse
gtaaggttccccacatggag

SEQ ID NO: 517833 - DNA, 20 bp, mouse
gcctctgcagacttattgtt

SEQ ID NO: 517834 - DNA, 20 bp, mouse
ggcagaggtatcttccaagt

SEQ ID NO: 517835 - DNA, 20 bp, mouse
gtccccacatggagaggaag

SEQ ID NO: 517836 - DNA, 20 bp, mouse
gggtacgagaccacaccacg

SEQ ID NO: 517837 - DNA, 20 bp, mouse
ggagcggtgtctgcattaca

SEQ ID NO: 517838 - DNA, 20 bp, mouse
gtgtctgcattacaaggtcc

SEQ ID NO: 517839 - DNA, 20 bp, mouse
gtaaaagcagatgaagtgag

SEQ ID NO: 517840 - DNA, 20 bp, mouse
ggtcaagacagaacaagaag

SEQ ID NO: 517841 - DNA, 20 bp, mouse
gcaacgacaaaatacacacc

SEQ ID NO: 517842 - DNA, 20 bp, mouse
gcatttcgttcctttgttcc

SEQ ID NO: 517843 - DNA, 20 bp, mouse
gaagacatagatggctatca

SEQ ID NO: 517844 - DNA, 20 bp, mouse
gaggccagacaatgggagac

SEQ ID NO: 517845 - DNA, 20 bp, mouse
gtagccatctatgtctttaa

SEQ ID NO: 517846 - DNA, 20 bp, mouse
gccaggagcgcagggagcgg

SEQ ID NO: 517847 - DNA, 20 bp, mouse
gtccccaggagcgcagggag

SEQ ID NO: 517848 - DNA, 20 bp, mouse
ggcggcggcgacaacatgcg

SEQ ID NO: 517849 - DNA, 20 bp, mouse
gcacgggcgagaccttcccc

SEQ ID NO: 517850 - DNA, 20 bp, mouse
gaccaggccagggtcgagct

SEQ ID NO: 517851 - DNA, 20 bp, mouse
gctcgcccgtgctcgctcac

SEQ ID NO: 517852 - DNA, 20 bp, mouse
gggcgctcggggctgtggat

SEQ ID NO: 517853 - DNA, 20 bp, mouse
ggaccttccccaggagcgca

SEQ ID NO: 517854 - DNA, 20 bp, mouse
ggcagccagcgtcctcaggg

SEQ ID NO: 517855 - DNA, 20 bp, mouse
gggagcagccagcgtcctca

SEQ ID NO: 517856 - DNA, 20 bp, mouse
gcccgaggctgcaactccgt

SEQ ID NO: 517857 - DNA, 20 bp, mouse
gaggagcaagaggatcccgg

SEQ ID NO: 517858 - DNA, 20 bp, mouse
gggagcagatccactcctcc

SEQ ID NO: 517859 - DNA, 20 bp, mouse
gtttcagctgggtggacccg

SEQ ID NO: 517860 - DNA, 20 bp, mouse
ggcggtggccgcaggcatcc

SEQ ID NO: 517861 - DNA, 20 bp, mouse
gagcaggagcaagaggatcc

SEQ ID NO: 517862 - DNA, 20 bp, mouse
gtggccgcaggcatcctggc

SEQ ID NO: 517863 - DNA, 20 bp, mouse
gaacagagaggtacagtcca

SEQ ID NO: 517864 - DNA, 20 bp, mouse
gctgcaactccgtgggctcc

SEQ ID NO: 517865 - DNA, 20 bp, mouse
gctggagcgctgctcctaac

SEQ ID NO: 517866 - DNA, 20 bp, mouse
gtgctccgcggtgctaccct

SEQ ID NO: 517867 - DNA, 20 bp, mouse
gggtagcaccgcggagcagg

SEQ ID NO: 517868 - DNA, 20 bp, mouse
gtgtgcccagggtagcaccg

SEQ ID NO: 517869 - DNA, 20 bp, mouse
gcagagccaccgccatcccg

SEQ ID NO: 517870 - DNA, 20 bp, mouse
gagggcgccgcccactcccg

SEQ ID NO: 517871 - DNA, 20 bp, mouse
gacccagcgccgcgggatgg

SEQ ID NO: 517872 - DNA, 20 bp, mouse
gcagcgccgcgggatggcgg

SEQ ID NO: 517873 - DNA, 20 bp, mouse
ggcccaggcggcgagaatct

SEQ ID NO: 517874 - DNA, 20 bp, mouse
gatggcggtggctctgggca

SEQ ID NO: 517875 - DNA, 20 bp, mouse
gggcaggagacccagcgccg

SEQ ID NO: 517876 - DNA, 20 bp, mouse
gacctcagtcccagccgcca

SEQ ID NO: 517877 - DNA, 20 bp, mouse
ggagcagactggcatgagcg

SEQ ID NO: 517878 - DNA, 20 bp, mouse
ggcgccctgtgaacatcaaa

SEQ ID NO: 517879 - DNA, 20 bp, mouse
gtgtgaacatcaaaaggcag

SEQ ID NO: 517880 - DNA, 20 bp, mouse
gccagggagaggaggtggcc

SEQ ID NO: 517881 - DNA, 20 bp, mouse
gcctggagtgaaggacctgg

SEQ ID NO: 517882 - DNA, 20 bp, mouse
ggagggagtgagagtcagcg

SEQ ID NO: 517883 - DNA, 20 bp, mouse
gtctgggacttacagatgga

SEQ ID NO: 517884 - DNA, 20 bp, mouse
gtatctgcagagagatgggt

SEQ ID NO: 517885 - DNA, 20 bp, mouse
ggctgggactgaggtcggcg

SEQ ID NO: 517886 - DNA, 20 bp, mouse
ggaaaatggcgaagcgcgga

SEQ ID NO: 517887 - DNA, 20 bp, mouse
gtagacttgccgggctcctg

SEQ ID NO: 517888 - DNA, 20 bp, mouse
ggtgctggggagagtaagta

SEQ ID NO: 517889 - DNA, 20 bp, mouse
ggcagtagaggtcctcggtg

SEQ ID NO: 517890 - DNA, 20 bp, mouse
gtagagccgcagcccccagc

SEQ ID NO: 517891 - DNA, 20 bp, mouse
gccgccctacttcaacctgg

SEQ ID NO: 517892 - DNA, 20 bp, mouse
ggagcccctacgagatgtct

SEQ ID NO: 517893 - DNA, 20 bp, mouse
ggcaggaaaatggcgaagcg

SEQ ID NO: 517894 - DNA, 20 bp, mouse
ggaacccagacatctcgtag

SEQ ID NO: 517895 - DNA, 20 bp, mouse
ggcctcctcgccgcaggtcg

SEQ ID NO: 517896 - DNA, 20 bp, mouse
gagcccaccggcccaaagaa

SEQ ID NO: 517897 - DNA, 20 bp, mouse
ggaagacccgaagaaaagac

SEQ ID NO: 517898 - DNA, 20 bp, mouse
gtcgcctagggaggaaccga

SEQ ID NO: 517899 - DNA, 20 bp, mouse
gttgttctcctcacccggct

SEQ ID NO: 517900 - DNA, 20 bp, mouse
gtccagtcctcgcagacgag

SEQ ID NO: 517901 - DNA, 20 bp, mouse
gcgagcgctcaacccgctcc

SEQ ID NO: 517902 - DNA, 20 bp, mouse
gcctcgcagacgaggggacg

SEQ ID NO: 517903 - DNA, 20 bp, mouse
gttcccttctttgggccggt

SEQ ID NO: 517904 - DNA, 20 bp, mouse
gcctagggaggaaccgaggg

SEQ ID NO: 517905 - DNA, 20 bp, mouse
gtctgcgaggactggacatg

SEQ ID NO: 517906 - DNA, 20 bp, mouse
ggatgctgacccgaccgtgt

SEQ ID NO: 517907 - DNA, 20 bp, mouse
gccgaccctggacagattga

SEQ ID NO: 517908 - DNA, 20 bp, mouse
gcctcaggagaaccagggag

SEQ ID NO: 517909 - DNA, 20 bp, mouse
gtgactgctaggtccgaccc

SEQ ID NO: 517910 - DNA, 20 bp, mouse
ggacagattgagggcctgga

SEQ ID NO: 517911 - DNA, 20 bp, mouse
ggtgggcctcaggagaacca

SEQ ID NO: 517912 - DNA, 20 bp, mouse
gttgtggaggagtgactgct

SEQ ID NO: 517913 - DNA, 20 bp, mouse
gactgggctggtgtccctcc

SEQ ID NO: 517914 - DNA, 20 bp, mouse
gcagccccaagggaggtggt

SEQ ID NO: 517915 - DNA, 20 bp, mouse
gggcccaagcgaagttccca

SEQ ID NO: 517916 - DNA, 20 bp, mouse
gccagccagggagtctccag

SEQ ID NO: 517917 - DNA, 20 bp, mouse
gtcccagggagctctccgag

SEQ ID NO: 517918 - DNA, 20 bp, mouse
gcacccccacaggacaggta

SEQ ID NO: 517919 - DNA, 20 bp, mouse
gccccacaggacaggtaagg

SEQ ID NO: 517920 - DNA, 20 bp, mouse
gccctctcggagagctccct

SEQ ID NO: 517921 - DNA, 20 bp, mouse
gcaggggagcataggagctc

SEQ ID NO: 517922 - DNA, 20 bp, mouse
gcagggagtctccagaggtg

SEQ ID NO: 517923 - DNA, 20 bp, mouse
gttctcaggtgagctcccag

SEQ ID NO: 517924 - DNA, 20 bp, mouse
gctgctccatccacccccac

SEQ ID NO: 517925 - DNA, 20 bp, mouse
ggaggtctcagggccactga

SEQ ID NO: 517926 - DNA, 20 bp, mouse
ggcgcaccgggaggtagcgg

SEQ ID NO: 517927 - DNA, 20 bp, mouse
ggctgcgcaccgggaggtag

SEQ ID NO: 517928 - DNA, 20 bp, mouse
ggtgcgcgctcggaagtcgg

SEQ ID NO: 517929 - DNA, 20 bp, mouse
ggtgcaggctgcgcaccggg

SEQ ID NO: 517930 - DNA, 20 bp, mouse
gggacgcagagccgatgggt

SEQ ID NO: 517931 - DNA, 20 bp, mouse
gcgctgcctccgctacctcc

SEQ ID NO: 517932 - DNA, 20 bp, mouse
gcacagtgcaggctgcgcac

SEQ ID NO: 517933 - DNA, 20 bp, mouse
gggctcggacgcccacccat

SEQ ID NO: 517934 - DNA, 20 bp, mouse
gagccggacgcagagccgat

SEQ ID NO: 517935 - DNA, 20 bp, mouse
gagcggaggcagcgcgatct

SEQ ID NO: 517936 - DNA, 20 bp, mouse
gggaccaccccgggagagaa

SEQ ID NO: 517937 - DNA, 20 bp, mouse
ggaagaggatcgatcctgtt

SEQ ID NO: 517938 - DNA, 20 bp, mouse
gaaacacaggcaaattaacc

SEQ ID NO: 517939 - DNA, 20 bp, mouse
gaggaggacccaaccctccg

SEQ ID NO: 517940 - DNA, 20 bp, mouse
ggcaaattaaccaggctgag

SEQ ID NO: 517941 - DNA, 20 bp, mouse
gcgccgagggcgtggtactg

SEQ ID NO: 517942 - DNA, 20 bp, mouse
gagagaacggctgtgtgtag

SEQ ID NO: 517943 - DNA, 20 bp, mouse
gccttcctcaaaaccggagg

SEQ ID NO: 517944 - DNA, 20 bp, mouse
gaggggcgtccaactgtgac

SEQ ID NO: 517945 - DNA, 20 bp, mouse
gacacagccgttctctcccg

SEQ ID NO: 517946 - DNA, 20 bp, mouse
gcccggagcagtgcagagcg

SEQ ID NO: 517947 - DNA, 20 bp, mouse
gcgcagcgtagagtggatcc

SEQ ID NO: 517948 - DNA, 20 bp, mouse
gcagagcggggcgaggacca

SEQ ID NO: 517949 - DNA, 20 bp, mouse
gcgcagaccgcagcgtagag

SEQ ID NO: 517950 - DNA, 20 bp, mouse
gccccgatgacagcacctgg

SEQ ID NO: 517951 - DNA, 20 bp, mouse
gcaccgttgccaggagggac

SEQ ID NO: 517952 - DNA, 20 bp, mouse
gaggggccagtggagcgcag

SEQ ID NO: 517953 - DNA, 20 bp, mouse
gggaacccgacggcatctga

SEQ ID NO: 517954 - DNA, 20 bp, mouse
gctggcaacggtggcatcga

SEQ ID NO: 517955 - DNA, 20 bp, mouse
ggccccgctctgcactgctc

SEQ ID NO: 517956 - DNA, 20 bp, mouse
gcggcacggagaggaccctg

SEQ ID NO: 517957 - DNA, 20 bp, mouse
ggctgcggggcctctcgagt

SEQ ID NO: 517958 - DNA, 20 bp, mouse
gtgggtgagcccgagaggga

SEQ ID NO: 517959 - DNA, 20 bp, mouse
gctgctgggtgagcccgaga

SEQ ID NO: 517960 - DNA, 20 bp, mouse
ggcggggcctctcgagtcgg

SEQ ID NO: 517961 - DNA, 20 bp, mouse
ggcgcgtccaccgactcgag

SEQ ID NO: 517962 - DNA, 20 bp, mouse
gagccgaggccggaggacgg

SEQ ID NO: 517963 - DNA, 20 bp, mouse
gcgcagctgcggcgccggca

SEQ ID NO: 517964 - DNA, 20 bp, mouse
gtcggtgtctcgggacggac

SEQ ID NO: 517965 - DNA, 20 bp, mouse
gcggggtcggtgtctcggga

SEQ ID NO: 517966 - DNA, 20 bp, mouse
gaccaccgaccgaggcaccc

SEQ ID NO: 517967 - DNA, 20 bp, mouse
gcacgagagaccaccgaccg

SEQ ID NO: 517968 - DNA, 20 bp, mouse
gggtgcctgggtgcctcggt

SEQ ID NO: 517969 - DNA, 20 bp, mouse
gcagctgaagcggcgagtcc

SEQ ID NO: 517970 - DNA, 20 bp, mouse
ggggctgcgaggggattcgt

SEQ ID NO: 517971 - DNA, 20 bp, mouse
ggcctgggtgcctcggtcgg

SEQ ID NO: 517972 - DNA, 20 bp, mouse
ggctggagtcataagaccag

SEQ ID NO: 517973 - DNA, 20 bp, mouse
ggcttccgcagggctgcgag

SEQ ID NO: 517974 - DNA, 20 bp, mouse
gctcctggcgggccatccca

SEQ ID NO: 517975 - DNA, 20 bp, mouse
gcccaggcaccgcaaaagcc

SEQ ID NO: 517976 - DNA, 20 bp, mouse
gagactcaagcacacaacag

SEQ ID NO: 517977 - DNA, 20 bp, mouse
gctactgcagagatctgccc

SEQ ID NO: 517978 - DNA, 20 bp, mouse
ggtgtgcttgagtcttctgt

SEQ ID NO: 517979 - DNA, 20 bp, mouse
gtgaagcagggagggctata

SEQ ID NO: 517980 - DNA, 20 bp, mouse
gtgtaggtgtcctggaccaa

SEQ ID NO: 517981 - DNA, 20 bp, mouse
gtcacttaccagtcagggac

SEQ ID NO: 517982 - DNA, 20 bp, mouse
gaccaaaggtgaagcaggga

SEQ ID NO: 517983 - DNA, 20 bp, mouse
gctgttatcttacataggtg

SEQ ID NO: 517984 - DNA, 20 bp, mouse
gctggaccaaaggtgaagca

SEQ ID NO: 517985 - DNA, 20 bp, mouse
gatggccaccacagcaaatg

SEQ ID NO: 517986 - DNA, 20 bp, mouse
gagtctgtctccaccaagaa

SEQ ID NO: 517987 - DNA, 20 bp, mouse
gggtccccagacgctactca

SEQ ID NO: 517988 - DNA, 20 bp, mouse
gctactcacggaagaacatt

SEQ ID NO: 517989 - DNA, 20 bp, mouse
gctggttcgcggcaacagca

SEQ ID NO: 517990 - DNA, 20 bp, mouse
gaccaagaagggttcttact

SEQ ID NO: 517991 - DNA, 20 bp, mouse
gaacacatctgcctggttcg

SEQ ID NO: 517992 - DNA, 20 bp, mouse
gtggccggtagagtgagcta

SEQ ID NO: 517993 - DNA, 20 bp, mouse
gtacaggtgtgtggctctct

SEQ ID NO: 517994 - DNA, 20 bp, mouse
gcgcgctccctaaaccccca

SEQ ID NO: 517995 - DNA, 20 bp, mouse
gtagagtgagctaagggagg

SEQ ID NO: 517996 - DNA, 20 bp, mouse
gcccggcccgaccccgccat

SEQ ID NO: 517997 - DNA, 20 bp, mouse
gcctaggcagaagtaagact

SEQ ID NO: 517998 - DNA, 20 bp, mouse
ggacggacgccgtccctcct

SEQ ID NO: 517999 - DNA, 20 bp, mouse
gctcggaccaggtgcgacag

SEQ ID NO: 518000 - DNA, 20 bp, mouse
gccgagtacggaggcctgga

SEQ ID NO: 518001 - DNA, 20 bp, mouse
gcagccgcgggtcatgtgac

SEQ ID NO: 518002 - DNA, 20 bp, mouse
gggaccaggtgcgacagcgg

SEQ ID NO: 518003 - DNA, 20 bp, mouse
gcccagtctgaggattcgag

SEQ ID NO: 518004 - DNA, 20 bp, mouse
ggcaggctcaccgagtacgg

SEQ ID NO: 518005 - DNA, 20 bp, mouse
gactgcaggctcaccgagta

SEQ ID NO: 518006 - DNA, 20 bp, mouse
gcaagaggctgcgactgtag

SEQ ID NO: 518007 - DNA, 20 bp, mouse
gggccaccggaagcgactga

SEQ ID NO: 518008 - DNA, 20 bp, mouse
gtgcgactgtaggggtgtgt

SEQ ID NO: 518009 - DNA, 20 bp, mouse
ggcacctgcgtcaaagcctt

SEQ ID NO: 518010 - DNA, 20 bp, mouse
gggtcagggttaagagacgc

SEQ ID NO: 518011 - DNA, 20 bp, mouse
ggctgtctgcagtaggggta

SEQ ID NO: 518012 - DNA, 20 bp, mouse
gctctggactcctccagtgt

SEQ ID NO: 518013 - DNA, 20 bp, mouse
ggcaggcatgctgcgtccca

SEQ ID NO: 518014 - DNA, 20 bp, mouse
gggaagagccctacgccggg

SEQ ID NO: 518015 - DNA, 20 bp, mouse
ggcgcggctgtctgcagtag

SEQ ID NO: 518016 - DNA, 20 bp, mouse
gaagttccgagtcccggtac

SEQ ID NO: 518017 - DNA, 20 bp, mouse
gctcccttgacggagatcca

SEQ ID NO: 518018 - DNA, 20 bp, mouse
gagccctggatctccgtcaa

SEQ ID NO: 518019 - DNA, 20 bp, mouse
ggctcggggacagagtgggt

SEQ ID NO: 518020 - DNA, 20 bp, mouse
gttccgagtcccggtactgg

SEQ ID NO: 518021 - DNA, 20 bp, mouse
gggaacttccggggagaccc

SEQ ID NO: 518022 - DNA, 20 bp, mouse
gaccgggactcggaacttcc

SEQ ID NO: 518023 - DNA, 20 bp, mouse
gtctcagctcggggacagag

SEQ ID NO: 518024 - DNA, 20 bp, mouse
gctccgtcaagggagtgggg

SEQ ID NO: 518025 - DNA, 20 bp, mouse
gtcgggtgcgggggaagtca

SEQ ID NO: 518026 - DNA, 20 bp, mouse
ggagccggaaactacctatc

SEQ ID NO: 518027 - DNA, 20 bp, mouse
gcactcaccatcgcagccgt

SEQ ID NO: 518028 - DNA, 20 bp, mouse
gtgtaagcagtctgccggat

SEQ ID NO: 518029 - DNA, 20 bp, mouse
gactgcacctacggctgcga

SEQ ID NO: 518030 - DNA, 20 bp, mouse
ggctgcagaacacccggtag

SEQ ID NO: 518031 - DNA, 20 bp, mouse
gagatgggagggaagcgaca

SEQ ID NO: 518032 - DNA, 20 bp, mouse
gtgagtgtggacgcatgcgc

SEQ ID NO: 518033 - DNA, 20 bp, mouse
gtgcagtgtaagcagtctgc

SEQ ID NO: 518034 - DNA, 20 bp, mouse
gaccgggtgttctgcagcgg

SEQ ID NO: 518035 - DNA, 20 bp, mouse
gggcataaggggactggagt

SEQ ID NO: 518036 - DNA, 20 bp, mouse
gactaccacaggaccagtga

SEQ ID NO: 518037 - DNA, 20 bp, mouse
gaaggcatagctactaccac

SEQ ID NO: 518038 - DNA, 20 bp, mouse
ggtccgcgctctttacgaaa

SEQ ID NO: 518039 - DNA, 20 bp, mouse
gatcgaaagccagccatcac

SEQ ID NO: 518040 - DNA, 20 bp, mouse
ggcctggacggcgtctccag

SEQ ID NO: 518041 - DNA, 20 bp, mouse
gtaacgagcggcccggccgt

SEQ ID NO: 518042 - DNA, 20 bp, mouse
gagagggacgaaattcagcg

SEQ ID NO: 518043 - DNA, 20 bp, mouse
ggcgtttggggcactcgggg

SEQ ID NO: 518044 - DNA, 20 bp, mouse
gaccgaggcgggcgcctgga

SEQ ID NO: 518045 - DNA, 20 bp, mouse
gatggctggctttcgattgg

SEQ ID NO: 518046 - DNA, 20 bp, mouse
gaacccgcacgcctctccag

SEQ ID NO: 518047 - DNA, 20 bp, mouse
gcccacgagtggggagcaca

SEQ ID NO: 518048 - DNA, 20 bp, mouse
gacgtcccacgcccacgagt

SEQ ID NO: 518049 - DNA, 20 bp, mouse
gggctccgcaaaccgcgcag

SEQ ID NO: 518050 - DNA, 20 bp, mouse
gagccgctggagaggcgtgc

SEQ ID NO: 518051 - DNA, 20 bp, mouse
ggtgggacgtgggtgaacaa

SEQ ID NO: 518052 - DNA, 20 bp, mouse
gaagcgaacctgcagaacag

SEQ ID NO: 518053 - DNA, 20 bp, mouse
ggcggcgacaataacagatg

SEQ ID NO: 518054 - DNA, 20 bp, mouse
gggccaggcctacaggaagt

SEQ ID NO: 518055 - DNA, 20 bp, mouse
gtccgtgtgctccccactcg

SEQ ID NO: 518056 - DNA, 20 bp, mouse
gcatctccgcctctcctagg

SEQ ID NO: 518057 - DNA, 20 bp, mouse
gcggcttcatagtctgggaa

SEQ ID NO: 518058 - DNA, 20 bp, mouse
gggcggcggcttcatagtct

SEQ ID NO: 518059 - DNA, 20 bp, mouse
gaagttccacctaggagagg

SEQ ID NO: 518060 - DNA, 20 bp, mouse
gccagcggcgagccctgcgg

SEQ ID NO: 518061 - DNA, 20 bp, mouse
gcttccagcggcgagccctg

SEQ ID NO: 518062 - DNA, 20 bp, mouse
ggtttcctccgcacttccag

SEQ ID NO: 518063 - DNA, 20 bp, mouse
ggaccgccggacgctaccat

SEQ ID NO: 518064 - DNA, 20 bp, mouse
gagggaaagcgcgcggacat

SEQ ID NO: 518065 - DNA, 20 bp, mouse
gccctaacgggaaggtgagt

SEQ ID NO: 518066 - DNA, 20 bp, mouse
ggctgcggcagcgcaagagg

SEQ ID NO: 518067 - DNA, 20 bp, mouse
gtcacacgttcccctcccag

SEQ ID NO: 518068 - DNA, 20 bp, mouse
gcagctctgaggctctccaa

SEQ ID NO: 518069 - DNA, 20 bp, mouse
ggcgaggagggtgagacggg

SEQ ID NO: 518070 - DNA, 20 bp, mouse
ggagggcgcggcctctggga

SEQ ID NO: 518071 - DNA, 20 bp, mouse
gagcgcaagagggggcggtt

SEQ ID NO: 518072 - DNA, 20 bp, mouse
gctgcctgaggagatcacct

SEQ ID NO: 518073 - DNA, 20 bp, mouse
gctgccgcgaggctccgggg

SEQ ID NO: 518074 - DNA, 20 bp, mouse
gagagctgcggcagcgcaag

SEQ ID NO: 518075 - DNA, 20 bp, mouse
gcaggcgcaaggagggatca

SEQ ID NO: 518076 - DNA, 20 bp, mouse
gcagtctcttccagacctgg

SEQ ID NO: 518077 - DNA, 20 bp, mouse
gggaccatggccaagaagag

SEQ ID NO: 518078 - DNA, 20 bp, mouse
ggccaagaagagtggtaagt

SEQ ID NO: 518079 - DNA, 20 bp, mouse
gagaaggtcgaggcagagtg

SEQ ID NO: 518080 - DNA, 20 bp, mouse
ggtaaagagagttagaactg

SEQ ID NO: 518081 - DNA, 20 bp, mouse
gggtctggataagaaggtcg

SEQ ID NO: 518082 - DNA, 20 bp, mouse
gtcctccagatccatctcca

SEQ ID NO: 518083 - DNA, 20 bp, mouse
gtccgtggagatggatctgg

SEQ ID NO: 518084 - DNA, 20 bp, mouse
gcgcatgagtttcaggacca

SEQ ID NO: 518085 - DNA, 20 bp, mouse
ggcttcttcataaagagaag

SEQ ID NO: 518086 - DNA, 20 bp, mouse
gtccgccgcctgggagtgag

SEQ ID NO: 518087 - DNA, 20 bp, mouse
gacatgacgaaggtgagtgg

SEQ ID NO: 518088 - DNA, 20 bp, mouse
ggagacctctcactcccagg

SEQ ID NO: 518089 - DNA, 20 bp, mouse
gactcgcgcggcagccggaa

SEQ ID NO: 518090 - DNA, 20 bp, mouse
gccagagacctctcactccc

SEQ ID NO: 518091 - DNA, 20 bp, mouse
gtgagaggtctctgggatcg

SEQ ID NO: 518092 - DNA, 20 bp, mouse
ggaggcggctcgctctcggg

SEQ ID NO: 518093 - DNA, 20 bp, mouse
gaccttcgtcatgtctgcgg

SEQ ID NO: 518094 - DNA, 20 bp, mouse
gcagacatgacgaaggtgag

SEQ ID NO: 518095 - DNA, 20 bp, mouse
ggagtcgcgctccgccgcct

SEQ ID NO: 518096 - DNA, 20 bp, mouse
ggagcacgaatacgtcacgt

SEQ ID NO: 518097 - DNA, 20 bp, mouse
gcagcgggcacggagatttt

SEQ ID NO: 518098 - DNA, 20 bp, mouse
gtggctgggctcgctgtcgg

SEQ ID NO: 518099 - DNA, 20 bp, mouse
gtgaaacaagacggagttgg

SEQ ID NO: 518100 - DNA, 20 bp, mouse
ggagctccgcaaggaggaga

SEQ ID NO: 518101 - DNA, 20 bp, mouse
gagcgcaggcgcacaggagt

SEQ ID NO: 518102 - DNA, 20 bp, mouse
gccagacgagctccgcaagg

SEQ ID NO: 518103 - DNA, 20 bp, mouse
ggggtgaaacaagacggagt

SEQ ID NO: 518104 - DNA, 20 bp, mouse
gcccgcaggcacgccccgac

SEQ ID NO: 518105 - DNA, 20 bp, mouse
gcttctgattggagaagatg

SEQ ID NO: 518106 - DNA, 20 bp, mouse
ggccgctgcgacgggacact

SEQ ID NO: 518107 - DNA, 20 bp, mouse
gacactgggctcgaagaccg

SEQ ID NO: 518108 - DNA, 20 bp, mouse
gtcggggcggccaaggagag

SEQ ID NO: 518109 - DNA, 20 bp, mouse
ggcccagtgtcccgtcgcag

SEQ ID NO: 518110 - DNA, 20 bp, mouse
gagaccgcggcgacgctagg

SEQ ID NO: 518111 - DNA, 20 bp, mouse
gtcccgtcgcagcggccact

SEQ ID NO: 518112 - DNA, 20 bp, mouse
ggcgcgcgtggggaccccgg

SEQ ID NO: 518113 - DNA, 20 bp, mouse
gtccgagtggccgctgcgac

SEQ ID NO: 518114 - DNA, 20 bp, mouse
ggggcaggccacgtgaccca

SEQ ID NO: 518115 - DNA, 20 bp, mouse
gggtcgggcgagcggtccga

SEQ ID NO: 518116 - DNA, 20 bp, mouse
gtggtgcgcagtcccctctt

SEQ ID NO: 518117 - DNA, 20 bp, mouse
gtgcgcagtcccctcttcgg

SEQ ID NO: 518118 - DNA, 20 bp, mouse
gactcagagcctccgaagag

SEQ ID NO: 518119 - DNA, 20 bp, mouse
gggcgctgcacgggaggcca

SEQ ID NO: 518120 - DNA, 20 bp, mouse
gggtcccacagacaagtaat

SEQ ID NO: 518121 - DNA, 20 bp, mouse
gtgtctgaccggcgctgcac

SEQ ID NO: 518122 - DNA, 20 bp, mouse
gtaaggcccagagtagcaca

SEQ ID NO: 518123 - DNA, 20 bp, mouse
gccacagcagaacaaaaaag

SEQ ID NO: 518124 - DNA, 20 bp, mouse
gtaggtagcaatcccccagt

SEQ ID NO: 518125 - DNA, 20 bp, mouse
gctaccgtctgagggcaagg

SEQ ID NO: 518126 - DNA, 20 bp, mouse
gttagagcgtcgggctcgtt

SEQ ID NO: 518127 - DNA, 20 bp, mouse
gcgacgctctaagcacgcgg

SEQ ID NO: 518128 - DNA, 20 bp, mouse
ggcccgacgctctaagcacg

SEQ ID NO: 518129 - DNA, 20 bp, mouse
gcgtccgctgcagacgctgt

SEQ ID NO: 518130 - DNA, 20 bp, mouse
gttcccggagcgctcaggtt

SEQ ID NO: 518131 - DNA, 20 bp, mouse
gagccggcgcgtctccaagg

SEQ ID NO: 518132 - DNA, 20 bp, mouse
ggtcatgtctgtgcagctgg

SEQ ID NO: 518133 - DNA, 20 bp, mouse
gagcgtctgcagcggacgag

SEQ ID NO: 518134 - DNA, 20 bp, mouse
gcgctctaagcacgcggcgg

SEQ ID NO: 518135 - DNA, 20 bp, mouse
gggcagcctggagccgcgaa

SEQ ID NO: 518136 - DNA, 20 bp, mouse
gtggtgcggacggccagggg

SEQ ID NO: 518137 - DNA, 20 bp, mouse
gagccagaccacgcgatccg

SEQ ID NO: 518138 - DNA, 20 bp, mouse
gcggacggccagggggggag

SEQ ID NO: 518139 - DNA, 20 bp, mouse
gacggcggcggagagcccga

SEQ ID NO: 518140 - DNA, 20 bp, mouse
gctccgcgccgctccccccc

SEQ ID NO: 518141 - DNA, 20 bp, mouse
gagaccacgcgatccgcggc

SEQ ID NO: 518142 - DNA, 20 bp, mouse
gccgcccgccgcggatcgcg

SEQ ID NO: 518143 - DNA, 20 bp, mouse
gagtcgggcccgggtgacgg

SEQ ID NO: 518144 - DNA, 20 bp, mouse
ggcagtggtgcggacggcca

SEQ ID NO: 518145 - DNA, 20 bp, mouse
ggcggcggagagcccgacgg

SEQ ID NO: 518146 - DNA, 20 bp, mouse
gaacgtgatactctagaggg

SEQ ID NO: 518147 - DNA, 20 bp, mouse
gcctcaggctggttctccaa

SEQ ID NO: 518148 - DNA, 20 bp, mouse
ggactcgtcttcctctttcg

SEQ ID NO: 518149 - DNA, 20 bp, mouse
ggccaagaccaccctctgtc

SEQ ID NO: 518150 - DNA, 20 bp, mouse
ggcaaccaggtacctgacag

SEQ ID NO: 518151 - DNA, 20 bp, mouse
gtctttagagtccacgaaag

SEQ ID NO: 518152 - DNA, 20 bp, mouse
ggatggagtccagggaccat

SEQ ID NO: 518153 - DNA, 20 bp, mouse
gcgcaggagagacctcaggc

SEQ ID NO: 518154 - DNA, 20 bp, mouse
gctcttcagaaaacctgaag

SEQ ID NO: 518155 - DNA, 20 bp, mouse
ggagttggtttgcggtcaga

SEQ ID NO: 518156 - DNA, 20 bp, mouse
gggccccggtcggtaggata

SEQ ID NO: 518157 - DNA, 20 bp, mouse
gcgcggcagcgtgaacgatc

SEQ ID NO: 518158 - DNA, 20 bp, mouse
gcgccgcggagcccgacgag

SEQ ID NO: 518159 - DNA, 20 bp, mouse
gacgctgccgcgactccaac

SEQ ID NO: 518160 - DNA, 20 bp, mouse
gggcccgggccccggtcggt

SEQ ID NO: 518161 - DNA, 20 bp, mouse
gtgtgggtcgaggcccccgg

SEQ ID NO: 518162 - DNA, 20 bp, mouse
gcgtgaacgatcgggccgag

SEQ ID NO: 518163 - DNA, 20 bp, mouse
gggcctggaaagtcacatgg

SEQ ID NO: 518164 - DNA, 20 bp, mouse
ggaggagccgagggagccga

SEQ ID NO: 518165 - DNA, 20 bp, mouse
ggacggcctggaaagtcaca

SEQ ID NO: 518166 - DNA, 20 bp, mouse
gcgaacgggaaggagcgttg

SEQ ID NO: 518167 - DNA, 20 bp, mouse
gtgttctcatgcgaacggga

SEQ ID NO: 518168 - DNA, 20 bp, mouse
gttggggatctggagtctcg

SEQ ID NO: 518169 - DNA, 20 bp, mouse
gggacggccgaggagggaga

SEQ ID NO: 518170 - DNA, 20 bp, mouse
gggcccgaaaaaggaaggat

SEQ ID NO: 518171 - DNA, 20 bp, mouse
gtccgcagggccccggaagt

SEQ ID NO: 518172 - DNA, 20 bp, mouse
gggaaggagcgttggggatc

SEQ ID NO: 518173 - DNA, 20 bp, mouse
gggcgcggacttggcagcga

SEQ ID NO: 518174 - DNA, 20 bp, mouse
gacgcggggacggccgagga

SEQ ID NO: 518175 - DNA, 20 bp, mouse
ggggagacggcaagaaaagg

SEQ ID NO: 518176 - DNA, 20 bp, mouse
ggcgcgatcgtcgctatcga

SEQ ID NO: 518177 - DNA, 20 bp, mouse
gcgccgagctgggccatggt

SEQ ID NO: 518178 - DNA, 20 bp, mouse
ggatagcgacgatcgcgcgt

SEQ ID NO: 518179 - DNA, 20 bp, mouse
gctggcctggcctcgcgaca

SEQ ID NO: 518180 - DNA, 20 bp, mouse
gagctgggccatggttggca

SEQ ID NO: 518181 - DNA, 20 bp, mouse
gtgttcgccgagctgggcca

SEQ ID NO: 518182 - DNA, 20 bp, mouse
gcagccgggactgaggtacc

SEQ ID NO: 518183 - DNA, 20 bp, mouse
gacggagaccctgccaacca

SEQ ID NO: 518184 - DNA, 20 bp, mouse
gcagcccggtacctcagtcc

SEQ ID NO: 518185 - DNA, 20 bp, mouse
gccgagccgcgggcacaggt

SEQ ID NO: 518186 - DNA, 20 bp, mouse
ggtcgggagaaggaaagcgt

SEQ ID NO: 518187 - DNA, 20 bp, mouse
ggagcctctcagacccgtag

SEQ ID NO: 518188 - DNA, 20 bp, mouse
gacgcacggcgccaaaccaa

SEQ ID NO: 518189 - DNA, 20 bp, mouse
gcataggcggagcatctcgg

SEQ ID NO: 518190 - DNA, 20 bp, mouse
ggtgctcgtccccagatcca

SEQ ID NO: 518191 - DNA, 20 bp, mouse
gagcgctgaccgtggatctg

SEQ ID NO: 518192 - DNA, 20 bp, mouse
gctcaggagacccgactgag

SEQ ID NO: 518193 - DNA, 20 bp, mouse
gtcggagctcagtacagagg

SEQ ID NO: 518194 - DNA, 20 bp, mouse
gctctcagacccgtagaggt

SEQ ID NO: 518195 - DNA, 20 bp, mouse
gttctcccgacccctgcggt

SEQ ID NO: 518196 - DNA, 20 bp, mouse
gaggctagacttccacgagt

SEQ ID NO: 518197 - DNA, 20 bp, mouse
gtgtgctttggtgtcttgag

SEQ ID NO: 518198 - DNA, 20 bp, mouse
gcccagctggtagggaactc

SEQ ID NO: 518199 - DNA, 20 bp, mouse
gtcctggaacccagctggta

SEQ ID NO: 518200 - DNA, 20 bp, mouse
gatgaacccctcagagatgt

SEQ ID NO: 518201 - DNA, 20 bp, mouse
gccatggcggtgagtttggg

SEQ ID NO: 518202 - DNA, 20 bp, mouse
ggctgtccgagagacatacc

SEQ ID NO: 518203 - DNA, 20 bp, mouse
ggctgcctgtcgctgagaaa

SEQ ID NO: 518204 - DNA, 20 bp, mouse
gtagacttccacgagtggga

SEQ ID NO: 518205 - DNA, 20 bp, mouse
gttggacctacatctctgag

SEQ ID NO: 518206 - DNA, 20 bp, mouse
gtggcggcgcccagagtgac

SEQ ID NO: 518207 - DNA, 20 bp, mouse
gagacccagccagtcactct

SEQ ID NO: 518208 - DNA, 20 bp, mouse
ggcgcccagagtgactggct

SEQ ID NO: 518209 - DNA, 20 bp, mouse
ggtgtaatgcttggggaacg

SEQ ID NO: 518210 - DNA, 20 bp, mouse
ggagtccggagctgtcaaca

SEQ ID NO: 518211 - DNA, 20 bp, mouse
ggaagatccaggcacccggg

SEQ ID NO: 518212 - DNA, 20 bp, mouse
gtctgcgctcaggctctgtc

SEQ ID NO: 518213 - DNA, 20 bp, mouse
gcggagctgaaggtgcggac

SEQ ID NO: 518214 - DNA, 20 bp, mouse
gtgttgttttgccaacatgg

SEQ ID NO: 518215 - DNA, 20 bp, mouse
gcgttctccgagcaagagtc

SEQ ID NO: 518216 - DNA, 20 bp, mouse
gttgaggttgggaatccggg

SEQ ID NO: 518217 - DNA, 20 bp, mouse
gcagttgaggttgggaatcc

SEQ ID NO: 518218 - DNA, 20 bp, mouse
ggacctgctcttggctccca

SEQ ID NO: 518219 - DNA, 20 bp, mouse
gccacacgcgatccatgccc

SEQ ID NO: 518220 - DNA, 20 bp, mouse
ggcgcacttcagttgaggtt

SEQ ID NO: 518221 - DNA, 20 bp, mouse
gccgggcggagacctgctct

SEQ ID NO: 518222 - DNA, 20 bp, mouse
gcgtgtggcgtgcgtgggac

SEQ ID NO: 518223 - DNA, 20 bp, mouse
gggtgtgccgtttggagcaa

SEQ ID NO: 518224 - DNA, 20 bp, mouse
gccaggcaggagggttgacc

SEQ ID NO: 518225 - DNA, 20 bp, mouse
gatgctgcgcacttcagttg

SEQ ID NO: 518226 - DNA, 20 bp, mouse
ggctgcaactgtgcaggcga

SEQ ID NO: 518227 - DNA, 20 bp, mouse
ggcggcggctgcaactgtgc

SEQ ID NO: 518228 - DNA, 20 bp, mouse
gtagtgcagctctccatcag

SEQ ID NO: 518229 - DNA, 20 bp, mouse
gtggagagctgcactagcac

SEQ ID NO: 518230 - DNA, 20 bp, mouse
gggaagagcccgcaaagacc

SEQ ID NO: 518231 - DNA, 20 bp, mouse
gagggaacgcgcgcgaatac

SEQ ID NO: 518232 - DNA, 20 bp, mouse
gattaggggaaggagggcgg

SEQ ID NO: 518233 - DNA, 20 bp, mouse
gcccgggccgggagtgagag

SEQ ID NO: 518234 - DNA, 20 bp, mouse
gatggttccggggaaagact

SEQ ID NO: 518235 - DNA, 20 bp, mouse
gagcagccaccgctggagat

SEQ ID NO: 518236 - DNA, 20 bp, mouse
gtgagcaggagaggcaggcg

SEQ ID NO: 518237 - DNA, 20 bp, mouse
gccaggagcgtgaccaagaa

SEQ ID NO: 518238 - DNA, 20 bp, mouse
gatcgtgcagctggtagctg

SEQ ID NO: 518239 - DNA, 20 bp, mouse
ggcagcccctcgagacagag

SEQ ID NO: 518240 - DNA, 20 bp, mouse
gagcttcctgtcgcacgcgg

SEQ ID NO: 518241 - DNA, 20 bp, mouse
gctactgccgggcggatccc

SEQ ID NO: 518242 - DNA, 20 bp, mouse
ggtcgcacgcggtggtgagc

SEQ ID NO: 518243 - DNA, 20 bp, mouse
gctccagcctgggatccgcc

SEQ ID NO: 518244 - DNA, 20 bp, mouse
ggcaggtacagctgggcacg

SEQ ID NO: 518245 - DNA, 20 bp, mouse
gcagagtggcagcaggggta

SEQ ID NO: 518246 - DNA, 20 bp, mouse
ggtggtgttggcatcagctt

SEQ ID NO: 518247 - DNA, 20 bp, mouse
gtcaccagagtcagtggtgt

SEQ ID NO: 518248 - DNA, 20 bp, mouse
gatgccaacaccactgactc

SEQ ID NO: 518249 - DNA, 20 bp, mouse
gctctggtgagcagtgggca

SEQ ID NO: 518250 - DNA, 20 bp, mouse
gatcagcttgggcaggtgtg

SEQ ID NO: 518251 - DNA, 20 bp, mouse
gcccttagggatagacggag

SEQ ID NO: 518252 - DNA, 20 bp, mouse
gtgtgcggcacaagatgaag

SEQ ID NO: 518253 - DNA, 20 bp, mouse
gagatgaaggggccatggtg

SEQ ID NO: 518254 - DNA, 20 bp, mouse
gcactgactctggtgagcag

SEQ ID NO: 518255 - DNA, 20 bp, mouse
gctgggaaaggcttacctga

SEQ ID NO: 518256 - DNA, 20 bp, mouse
gcggcggcggcgacacggag

SEQ ID NO: 518257 - DNA, 20 bp, mouse
ggtggaaggcaaaatggcgg

SEQ ID NO: 518258 - DNA, 20 bp, mouse
gacgcggggtcgcgaggacc

SEQ ID NO: 518259 - DNA, 20 bp, mouse
gtccgtgcggagccagaacg

SEQ ID NO: 518260 - DNA, 20 bp, mouse
gcacggagtggaaggcaaaa

SEQ ID NO: 518261 - DNA, 20 bp, mouse
ggtgcggagccagaacgtgg

SEQ ID NO: 518262 - DNA, 20 bp, mouse
gcggccagcgcggcccgacg

SEQ ID NO: 518263 - DNA, 20 bp, mouse
gcgccgcagggagagcccgg

SEQ ID NO: 518264 - DNA, 20 bp, mouse
gggcggcgacacggagtgga

SEQ ID NO: 518265 - DNA, 20 bp, mouse
gcccacatccgggaaacccg

SEQ ID NO: 518266 - DNA, 20 bp, mouse
gcggcggctccatcttcccg

SEQ ID NO: 518267 - DNA, 20 bp, mouse
gtccgaagcgcagacccgag

SEQ ID NO: 518268 - DNA, 20 bp, mouse
gaccgcggcgtgagcgcccc

SEQ ID NO: 518269 - DNA, 20 bp, mouse
gtgtagcgaatgtcccgctc

SEQ ID NO: 518270 - DNA, 20 bp, mouse
gggtctgcgcttcggaaccg

SEQ ID NO: 518271 - DNA, 20 bp, mouse
gcgtgagcgccccgggaaga

SEQ ID NO: 518272 - DNA, 20 bp, mouse
ggcacccgcccgggacccag

SEQ ID NO: 518273 - DNA, 20 bp, mouse
gcccgctcgggtctgcgctt

SEQ ID NO: 518274 - DNA, 20 bp, mouse
gtcccggggcgctcacgccg

SEQ ID NO: 518275 - DNA, 20 bp, mouse
ggagcgctctacaccctcgg

SEQ ID NO: 518276 - DNA, 20 bp, mouse
gctaggcccttaaaacccac

SEQ ID NO: 518277 - DNA, 20 bp, mouse
gcctccattctactctccag

SEQ ID NO: 518278 - DNA, 20 bp, mouse
gctattggggaaccatgtgg

SEQ ID NO: 518279 - DNA, 20 bp, mouse
ggtagaatggaggttggagc

SEQ ID NO: 518280 - DNA, 20 bp, mouse
gctttcgttcgagtttagtg

SEQ ID NO: 518281 - DNA, 20 bp, mouse
gactctccagtgggttttaa

SEQ ID NO: 518282 - DNA, 20 bp, mouse
gttccagtccacagaaggag

SEQ ID NO: 518283 - DNA, 20 bp, mouse
ggttgtaaatagcctgccct

SEQ ID NO: 518284 - DNA, 20 bp, mouse
gggagttgagggatgtgtaa

SEQ ID NO: 518285 - DNA, 20 bp, mouse
gaagctattggggaaccatg

SEQ ID NO: 518286 - DNA, 20 bp, mouse
gactgggagcacagacagct

SEQ ID NO: 518287 - DNA, 20 bp, mouse
gatcagagttggtctactgg

SEQ ID NO: 518288 - DNA, 20 bp, mouse
ggacaggaagcaccctccac

SEQ ID NO: 518289 - DNA, 20 bp, mouse
gaaacatgaggggcctgtgg

SEQ ID NO: 518290 - DNA, 20 bp, mouse
gagagcacggctcctgcagt

SEQ ID NO: 518291 - DNA, 20 bp, mouse
gtgaaaacagcaaaccactc

SEQ ID NO: 518292 - DNA, 20 bp, mouse
gctcccagtgtgaagcagta

SEQ ID NO: 518293 - DNA, 20 bp, mouse
gtgttttcacactgccctgg

SEQ ID NO: 518294 - DNA, 20 bp, mouse
gcttattagcacaccggtgg

SEQ ID NO: 518295 - DNA, 20 bp, mouse
gtggccctactgcttcacac

SEQ ID NO: 518296 - DNA, 20 bp, mouse
gttagtcccagggtgtcggg

SEQ ID NO: 518297 - DNA, 20 bp, mouse
gcagtgcctcccgacaccct

SEQ ID NO: 518298 - DNA, 20 bp, mouse
gtgccttagtcccagggtgt

SEQ ID NO: 518299 - DNA, 20 bp, mouse
ggtttgagcaactgcaacca

SEQ ID NO: 518300 - DNA, 20 bp, mouse
gcgaagggtcgcctgctgag

SEQ ID NO: 518301 - DNA, 20 bp, mouse
ggcggtgagtgtgtgtcctg

SEQ ID NO: 518302 - DNA, 20 bp, mouse
ggcgctcaaggggcactcac

SEQ ID NO: 518303 - DNA, 20 bp, mouse
gcactgggcggagtccggga

SEQ ID NO: 518304 - DNA, 20 bp, mouse
gctagggtggccccaggaac

SEQ ID NO: 518305 - DNA, 20 bp, mouse
ggcgttgcggatacctaggg

SEQ ID NO: 518306 - DNA, 20 bp, mouse
gtgtgggacccggagatcgg

SEQ ID NO: 518307 - DNA, 20 bp, mouse
ggcctcgctgccaacggcgt

SEQ ID NO: 518308 - DNA, 20 bp, mouse
gagacatgaagtcctagggg

SEQ ID NO: 518309 - DNA, 20 bp, mouse
gcccggagatcggtggagag

SEQ ID NO: 518310 - DNA, 20 bp, mouse
ggcgtgggtcagcctcccct

SEQ ID NO: 518311 - DNA, 20 bp, mouse
gcagcgaggctgtctccgga

SEQ ID NO: 518312 - DNA, 20 bp, mouse
gtacagacatgaagtcctag

SEQ ID NO: 518313 - DNA, 20 bp, mouse
gctgtctccggaaggcggac

SEQ ID NO: 518314 - DNA, 20 bp, mouse
gacccggagccggcactagg

SEQ ID NO: 518315 - DNA, 20 bp, mouse
ggcagccgagagcgggtact

SEQ ID NO: 518316 - DNA, 20 bp, mouse
gcatcctggatgctccgtgg

SEQ ID NO: 518317 - DNA, 20 bp, mouse
gccaggatgaaggctgggac

SEQ ID NO: 518318 - DNA, 20 bp, mouse
gactcccccacggagcatcc

SEQ ID NO: 518319 - DNA, 20 bp, mouse
gggcacagcctggatgtgaa

SEQ ID NO: 518320 - DNA, 20 bp, mouse
gcaggtagcagtgggcagat

SEQ ID NO: 518321 - DNA, 20 bp, mouse
ggccagttccctgtatggac

SEQ ID NO: 518322 - DNA, 20 bp, mouse
gtggagagtgaccagccaga

SEQ ID NO: 518323 - DNA, 20 bp, mouse
ggccaaggaggcgggacacc

SEQ ID NO: 518324 - DNA, 20 bp, mouse
gagtgaggactgtgacagag

SEQ ID NO: 518325 - DNA, 20 bp, mouse
gacaccgccagttccctgta

SEQ ID NO: 518326 - DNA, 20 bp, mouse
gcgggaactccagccactcc

SEQ ID NO: 518327 - DNA, 20 bp, mouse
gagcgcggccaggtgagcgt

SEQ ID NO: 518328 - DNA, 20 bp, mouse
gcgtccgagacggggatcgg

SEQ ID NO: 518329 - DNA, 20 bp, mouse
gtccgagggccgggaagccg

SEQ ID NO: 518330 - DNA, 20 bp, mouse
ggcactcaggaggcccggat

SEQ ID NO: 518331 - DNA, 20 bp, mouse
gtcgcgcgcggagtcgccgc

SEQ ID NO: 518332 - DNA, 20 bp, mouse
gcggagtcgccgctggctgc

SEQ ID NO: 518333 - DNA, 20 bp, mouse
gtggccctcgaagctgctgg

SEQ ID NO: 518334 - DNA, 20 bp, mouse
gtcccgcgccgacgctcacc

SEQ ID NO: 518335 - DNA, 20 bp, mouse
gcgctaggggcgggacctcg

SEQ ID NO: 518336 - DNA, 20 bp, mouse
ggtagagaaggagagggacg

SEQ ID NO: 518337 - DNA, 20 bp, mouse
ggatcccggactgcgagggg

SEQ ID NO: 518338 - DNA, 20 bp, mouse
gatgcaggcggctctaagtt

SEQ ID NO: 518339 - DNA, 20 bp, mouse
ggcggcagttggaagaaccg

SEQ ID NO: 518340 - DNA, 20 bp, mouse
gtcctggcccggggtcctgg

SEQ ID NO: 518341 - DNA, 20 bp, mouse
ggctggacggtgcgagagga

SEQ ID NO: 518342 - DNA, 20 bp, mouse
ggcgaaactggagcccggcg

SEQ ID NO: 518343 - DNA, 20 bp, mouse
ggtgtcaggtggctccgccg

SEQ ID NO: 518344 - DNA, 20 bp, mouse
gccgggcttgctggaaaccc

SEQ ID NO: 518345 - DNA, 20 bp, mouse
gccggccgggcccccaaacg

SEQ ID NO: 518346 - DNA, 20 bp, mouse
gagccaagcgcagcagaagg

SEQ ID NO: 518347 - DNA, 20 bp, mouse
ggtacacgccagccaagtag

SEQ ID NO: 518348 - DNA, 20 bp, mouse
gggatgtctgcgatactaaa

SEQ ID NO: 518349 - DNA, 20 bp, mouse
gcgctgatgtacagagttca

SEQ ID NO: 518350 - DNA, 20 bp, mouse
ggacgagagagtgaagcggg

SEQ ID NO: 518351 - DNA, 20 bp, mouse
gtgagcgctgggggcctagg

SEQ ID NO: 518352 - DNA, 20 bp, mouse
gtacagagttcatggcaagc

SEQ ID NO: 518353 - DNA, 20 bp, mouse
gtgcgatactaaagggtgtc

SEQ ID NO: 518354 - DNA, 20 bp, mouse
gtgaagccaagcgcagcaga

SEQ ID NO: 518355 - DNA, 20 bp, mouse
ggctggcgtgtaccttcaga

SEQ ID NO: 518356 - DNA, 20 bp, mouse
gacccggacgctgcagactg

SEQ ID NO: 518357 - DNA, 20 bp, mouse
gactgtagggaccacggctg

SEQ ID NO: 518358 - DNA, 20 bp, mouse
ggagccgccgcccgcagccg

SEQ ID NO: 518359 - DNA, 20 bp, mouse
ggggcctcggatgagagagg

SEQ ID NO: 518360 - DNA, 20 bp, mouse
ggtccgagacctagagtacc

SEQ ID NO: 518361 - DNA, 20 bp, mouse
ggtttgaactcactcactgt

SEQ ID NO: 518362 - DNA, 20 bp, mouse
gggcgggcctcggatgagag

SEQ ID NO: 518363 - DNA, 20 bp, mouse
gcaggaggtgccagcttgga

SEQ ID NO: 518364 - DNA, 20 bp, mouse
gctcggcggcttcggctcct

SEQ ID NO: 518365 - DNA, 20 bp, mouse
ggcgaggcggggctgatcgg

SEQ ID NO: 518366 - DNA, 20 bp, mouse
gtccagggtggaggcagctg

SEQ ID NO: 518367 - DNA, 20 bp, mouse
ggccaggtcggaggatagag

SEQ ID NO: 518368 - DNA, 20 bp, mouse
gccgcgcttccttaagtcca

SEQ ID NO: 518369 - DNA, 20 bp, mouse
gcccgcagctgcctccaccc

SEQ ID NO: 518370 - DNA, 20 bp, mouse
gagaccaccactgctggggg

SEQ ID NO: 518371 - DNA, 20 bp, mouse
gtgatcagcgatcccaccgg

SEQ ID NO: 518372 - DNA, 20 bp, mouse
gtgcctccaccctggactta

SEQ ID NO: 518373 - DNA, 20 bp, mouse
gaggccccgcgtggtttcca

SEQ ID NO: 518374 - DNA, 20 bp, mouse
gagcggacggagagaacccg

SEQ ID NO: 518375 - DNA, 20 bp, mouse
gcgccgaggcaaggccaggt

SEQ ID NO: 518376 - DNA, 20 bp, mouse
gtgtatcaggggcctagtgg

SEQ ID NO: 518377 - DNA, 20 bp, mouse
gaacagcacccgctgccatg

SEQ ID NO: 518378 - DNA, 20 bp, mouse
ggctcgtgagggctcatggt

SEQ ID NO: 518379 - DNA, 20 bp, mouse
ggactgcctcatctgtcagt

SEQ ID NO: 518380 - DNA, 20 bp, mouse
gacccccggagaagacaact

SEQ ID NO: 518381 - DNA, 20 bp, mouse
gctcatctgtcagtaggcac

SEQ ID NO: 518382 - DNA, 20 bp, mouse
ggggctgtgatggggctgcc

SEQ ID NO: 518383 - DNA, 20 bp, mouse
gggggctgcctggctcccca

SEQ ID NO: 518384 - DNA, 20 bp, mouse
gagcgggtgctgttgctgtt

SEQ ID NO: 518385 - DNA, 20 bp, mouse
gtcctcggtaagcccccact

SEQ ID NO: 518386 - DNA, 20 bp, mouse
gacctcggaaggtgagtgaa

SEQ ID NO: 518387 - DNA, 20 bp, mouse
gtcggaaggtgagtgaatgg

SEQ ID NO: 518388 - DNA, 20 bp, mouse
ggccatgttcccaatcccaa

SEQ ID NO: 518389 - DNA, 20 bp, mouse
gtccaggtacacaagatctt

SEQ ID NO: 518390 - DNA, 20 bp, mouse
ggatctttggatacctcgga

SEQ ID NO: 518391 - DNA, 20 bp, mouse
ggggcacttaccaagattcc

SEQ ID NO: 518392 - DNA, 20 bp, mouse
ggtaagtgcccattgggatt

SEQ ID NO: 518393 - DNA, 20 bp, mouse
gggactctaaaactcatggg

SEQ ID NO: 518394 - DNA, 20 bp, mouse
ggtaggaatggtagagtcca

SEQ ID NO: 518395 - DNA, 20 bp, mouse
ggaacatggcctatactaga

SEQ ID NO: 518396 - DNA, 20 bp, mouse
ggaacacttaccaagatgac

SEQ ID NO: 518397 - DNA, 20 bp, mouse
gtcttggtaagtgttcactg

SEQ ID NO: 518398 - DNA, 20 bp, mouse
gaagctaagaggagatctgg

SEQ ID NO: 518399 - DNA, 20 bp, mouse
gcaagatccttgggcacctc

SEQ ID NO: 518400 - DNA, 20 bp, mouse
ggtaccagaaggaagctaag

SEQ ID NO: 518401 - DNA, 20 bp, mouse
gcacagccctgggataactt

SEQ ID NO: 518402 - DNA, 20 bp, mouse
gggtaggcttcaggaggaag

SEQ ID NO: 518403 - DNA, 20 bp, mouse
gactgacgaacatagaacat

SEQ ID NO: 518404 - DNA, 20 bp, mouse
gtggagtaacccttcaggaa

SEQ ID NO: 518405 - DNA, 20 bp, mouse
ggaaagcagtagaaggagct

SEQ ID NO: 518406 - DNA, 20 bp, mouse
gtaaggtgggccagaatgat

SEQ ID NO: 518407 - DNA, 20 bp, mouse
gaccatgctcttgctcccaa

SEQ ID NO: 518408 - DNA, 20 bp, mouse
ggatctgtagccacttcagg

SEQ ID NO: 518409 - DNA, 20 bp, mouse
gccatccagtcctcctgaag

SEQ ID NO: 518410 - DNA, 20 bp, mouse
ggccctggcctagcattcaa

SEQ ID NO: 518411 - DNA, 20 bp, mouse
gagagcatggtctgtactag

SEQ ID NO: 518412 - DNA, 20 bp, mouse
ggtactagaggaaagctgag

SEQ ID NO: 518413 - DNA, 20 bp, mouse
gcatcttggtaagtgtccat

SEQ ID NO: 518414 - DNA, 20 bp, mouse
gcttacagaggacttaaggt

SEQ ID NO: 518415 - DNA, 20 bp, mouse
gtgactgcttatgcctccta

SEQ ID NO: 518416 - DNA, 20 bp, mouse
gaagtgtctactacaggtaa

SEQ ID NO: 518417 - DNA, 20 bp, mouse
gccgtggttctgagagacat

SEQ ID NO: 518418 - DNA, 20 bp, mouse
gtctctcagaaccacggctg

SEQ ID NO: 518419 - DNA, 20 bp, mouse
ggggtttctcagccagtgag

SEQ ID NO: 518420 - DNA, 20 bp, mouse
gcttggtaagtgtctactac

SEQ ID NO: 518421 - DNA, 20 bp, mouse
gagccagactagagatagac

SEQ ID NO: 518422 - DNA, 20 bp, mouse
gtctgtgtatggggctccat

SEQ ID NO: 518423 - DNA, 20 bp, mouse
gcaaacactagccacagccg

SEQ ID NO: 518424 - DNA, 20 bp, mouse
gccaatgaaaagctaaggac

SEQ ID NO: 518425 - DNA, 20 bp, mouse
ggaaactaggaagaattcct

SEQ ID NO: 518426 - DNA, 20 bp, mouse
ggtggacgcctcaggagaag

SEQ ID NO: 518427 - DNA, 20 bp, mouse
ggccatgctattgcccccag

SEQ ID NO: 518428 - DNA, 20 bp, mouse
gtaggggagaccagaatgat

SEQ ID NO: 518429 - DNA, 20 bp, mouse
gacgcctcaggagaagtgga

SEQ ID NO: 518430 - DNA, 20 bp, mouse
gacaggtaattcaagatctg

SEQ ID NO: 518431 - DNA, 20 bp, mouse
gtcttggtaagtatccactg

SEQ ID NO: 518432 - DNA, 20 bp, mouse
gggatacttaccaagacgac

SEQ ID NO: 518433 - DNA, 20 bp, mouse
gtccactgggggcaatagca

SEQ ID NO: 518434 - DNA, 20 bp, mouse
gaatgatgggtagaaaaaaa

SEQ ID NO: 518435 - DNA, 20 bp, mouse
gcctccatccacttctcctg

SEQ ID NO: 518436 - DNA, 20 bp, mouse
ggtggaggcttaccaaaata

SEQ ID NO: 518437 - DNA, 20 bp, mouse
gacccagtgagtggatggta

SEQ ID NO: 518438 - DNA, 20 bp, mouse
ggccctaccatccactcact

SEQ ID NO: 518439 - DNA, 20 bp, mouse
gtggtatctcacccagtgag

SEQ ID NO: 518440 - DNA, 20 bp, mouse
ggccccagctttggtttgag

SEQ ID NO: 518441 - DNA, 20 bp, mouse
gtgttataggacaacttagg

SEQ ID NO: 518442 - DNA, 20 bp, mouse
ggtaaagctagactagagct

SEQ ID NO: 518443 - DNA, 20 bp, mouse
gcttgtgctactccttattt

SEQ ID NO: 518444 - DNA, 20 bp, mouse
gtatagatccagaataatca

SEQ ID NO: 518445 - DNA, 20 bp, mouse
ggctcttcatcgtcagagag

SEQ ID NO: 518446 - DNA, 20 bp, mouse
gtaagtgtccacaggaggta

SEQ ID NO: 518447 - DNA, 20 bp, mouse
gtggacacttaccaagactg

SEQ ID NO: 518448 - DNA, 20 bp, mouse
ggtaagggcagagacttcag

SEQ ID NO: 518449 - DNA, 20 bp, mouse
gagggcagccagaccagaac

SEQ ID NO: 518450 - DNA, 20 bp, mouse
gtcagtgttaatggcgtgga

SEQ ID NO: 518451 - DNA, 20 bp, mouse
gcctagaaacctgtccaaca

SEQ ID NO: 518452 - DNA, 20 bp, mouse
gaagatcagtgttaatggcg

SEQ ID NO: 518453 - DNA, 20 bp, mouse
ggctcttcattggccgggga

SEQ ID NO: 518454 - DNA, 20 bp, mouse
gaatgtgagggacaaggcaa

SEQ ID NO: 518455 - DNA, 20 bp, mouse
gcaagcacagagagccgtgt

SEQ ID NO: 518456 - DNA, 20 bp, mouse
gtaagtgtttactgaaggta

SEQ ID NO: 518457 - DNA, 20 bp, mouse
ggtagagccggatagactct

SEQ ID NO: 518458 - DNA, 20 bp, mouse
ggggtatctcagccagtgaa

SEQ ID NO: 518459 - DNA, 20 bp, mouse
ggagccggatagactctggg

SEQ ID NO: 518460 - DNA, 20 bp, mouse
gttagagtctcataatacca

SEQ ID NO: 518461 - DNA, 20 bp, mouse
gaggtaactagccacagcct

SEQ ID NO: 518462 - DNA, 20 bp, mouse
gagccaaactgagaacatgt

SEQ ID NO: 518463 - DNA, 20 bp, mouse
ggctttgggtactttgtccc

SEQ ID NO: 518464 - DNA, 20 bp, mouse
gaagtagtcctagaaattga

SEQ ID NO: 518465 - DNA, 20 bp, mouse
gtctcataataccaaggctg

SEQ ID NO: 518466 - DNA, 20 bp, mouse
gaagtgtttactggagctaa

SEQ ID NO: 518467 - DNA, 20 bp, mouse
gtctcttagtatcaatggtg

SEQ ID NO: 518468 - DNA, 20 bp, mouse
gactagagctggattgactc

SEQ ID NO: 518469 - DNA, 20 bp, mouse
gcgtctagtcaggttaccaa

SEQ ID NO: 518470 - DNA, 20 bp, mouse
gagccaaactgagacactgt

SEQ ID NO: 518471 - DNA, 20 bp, mouse
gtgaacagatcccagaaaca

SEQ ID NO: 518472 - DNA, 20 bp, mouse
gcaggttaccaagggtaatt

SEQ ID NO: 518473 - DNA, 20 bp, mouse
ggcactgaagaaatagagca

SEQ ID NO: 518474 - DNA, 20 bp, mouse
gaagcattcctataaactga

SEQ ID NO: 518475 - DNA, 20 bp, mouse
gagccaacagtgtctcagtt

SEQ ID NO: 518476 - DNA, 20 bp, mouse
gagtctctgcccttacctcc

SEQ ID NO: 518477 - DNA, 20 bp, mouse
gatctcagtcagagagtgga

SEQ ID NO: 518478 - DNA, 20 bp, mouse
gtacttcccagagtctatca

SEQ ID NO: 518479 - DNA, 20 bp, mouse
gtctcatagtatcaaggctg

SEQ ID NO: 518480 - DNA, 20 bp, mouse
ggataactgtgcatctagag

SEQ ID NO: 518481 - DNA, 20 bp, mouse
gtcagattctcatagtatca

SEQ ID NO: 518482 - DNA, 20 bp, mouse
ggctttgggtactttgactc

SEQ ID NO: 518483 - DNA, 20 bp, mouse
gtatatcaatgtggtcagaa

SEQ ID NO: 518484 - DNA, 20 bp, mouse
gctagtccatgatagactct

SEQ ID NO: 518485 - DNA, 20 bp, mouse
ggtctatcatggactagtcc

SEQ ID NO: 518486 - DNA, 20 bp, mouse
ggctgtagctctggtggcgg

SEQ ID NO: 518487 - DNA, 20 bp, mouse
gttttggaggacacttggca

SEQ ID NO: 518488 - DNA, 20 bp, mouse
ggacattttgggggacactt

SEQ ID NO: 518489 - DNA, 20 bp, mouse
gatctcagctgtgagtattc

SEQ ID NO: 518490 - DNA, 20 bp, mouse
gacagcaggaagacacaggg

SEQ ID NO: 518491 - DNA, 20 bp, mouse
gctgggtgctgtagcagtgg

SEQ ID NO: 518492 - DNA, 20 bp, mouse
gggctacagcaggaagacac

SEQ ID NO: 518493 - DNA, 20 bp, mouse
gagatctgtggtgtctgtgg

SEQ ID NO: 518494 - DNA, 20 bp, mouse
ggctgctgtagctctggtgg

SEQ ID NO: 518495 - DNA, 20 bp, mouse
gatggcgatggagagatctg

SEQ ID NO: 518496 - DNA, 20 bp, mouse
gccctctggtaagtgtccac

SEQ ID NO: 518497 - DNA, 20 bp, mouse
ggacagaagttcactctgtc

SEQ ID NO: 518498 - DNA, 20 bp, mouse
gtctgtccactcacatcttg

SEQ ID NO: 518499 - DNA, 20 bp, mouse
gttgaggacacaggtattgg

SEQ ID NO: 518500 - DNA, 20 bp, mouse
gtgtctactagattattcag

SEQ ID NO: 518501 - DNA, 20 bp, mouse
ggtattgaggacacaggtat

SEQ ID NO: 518502 - DNA, 20 bp, mouse
gaatgaaactgagaagacta

SEQ ID NO: 518503 - DNA, 20 bp, mouse
gagattattcaggggaacac

SEQ ID NO: 518504 - DNA, 20 bp, mouse
gcaacattccaaaaccctgt

SEQ ID NO: 518505 - DNA, 20 bp, mouse
ggtcagcaggaagactgatg

SEQ ID NO: 518506 - DNA, 20 bp, mouse
gggactggtggacctagcac

SEQ ID NO: 518507 - DNA, 20 bp, mouse
gaactggtaacgctgaggac

SEQ ID NO: 518508 - DNA, 20 bp, mouse
gtggtaacgctgaggactgg

SEQ ID NO: 518509 - DNA, 20 bp, mouse
gccagaacttcttggaagga

SEQ ID NO: 518510 - DNA, 20 bp, mouse
gggagagagccagaacttct

SEQ ID NO: 518511 - DNA, 20 bp, mouse
gcctgaaactggtaacgctg

SEQ ID NO: 518512 - DNA, 20 bp, mouse
gagagccagaacttcttgga

SEQ ID NO: 518513 - DNA, 20 bp, mouse
gtcttggtctggttaacacc

SEQ ID NO: 518514 - DNA, 20 bp, mouse
gagagaggacagcgtctcac

SEQ ID NO: 518515 - DNA, 20 bp, mouse
gcttgttgagcagaagaagc

SEQ ID NO: 518516 - DNA, 20 bp, mouse
gtgatctactccagtgcctg

SEQ ID NO: 518517 - DNA, 20 bp, mouse
ggagatgttctacctgcctc

SEQ ID NO: 518518 - DNA, 20 bp, mouse
gttctacctgcctcaggcac

SEQ ID NO: 518519 - DNA, 20 bp, mouse
gactagcatcagagtctctc

SEQ ID NO: 518520 - DNA, 20 bp, mouse
ggctgacaggacatctccaa

SEQ ID NO: 518521 - DNA, 20 bp, mouse
gctctgcaagtgaaaggtaa

SEQ ID NO: 518522 - DNA, 20 bp, mouse
gactttacagtgaatttatt

SEQ ID NO: 518523 - DNA, 20 bp, mouse
ggggctctggttggaactga

SEQ ID NO: 518524 - DNA, 20 bp, mouse
gactctgatgctagttttct

SEQ ID NO: 518525 - DNA, 20 bp, mouse
gaggggaaaagagggttagg

SEQ ID NO: 518526 - DNA, 20 bp, mouse
gtaccagatgggaaggtgat

SEQ ID NO: 518527 - DNA, 20 bp, mouse
ggtctagaagagatcagata

SEQ ID NO: 518528 - DNA, 20 bp, mouse
gatgcgcttaccagatggga

SEQ ID NO: 518529 - DNA, 20 bp, mouse
gagacatgcgcttaccagat

SEQ ID NO: 518530 - DNA, 20 bp, mouse
ggatgaggaatccagagtaa

SEQ ID NO: 518531 - DNA, 20 bp, mouse
gctattctgggcctcttcct

SEQ ID NO: 518532 - DNA, 20 bp, mouse
gagaagagatcagatatggc

SEQ ID NO: 518533 - DNA, 20 bp, mouse
ggtaggatagaaacattata

SEQ ID NO: 518534 - DNA, 20 bp, mouse
gcccagaataggccatggtg

SEQ ID NO: 518535 - DNA, 20 bp, mouse
gtcttctagaccctaggaag

SEQ ID NO: 518536 - DNA, 20 bp, mouse
gggatactcactagattcaa

SEQ ID NO: 518537 - DNA, 20 bp, mouse
ggaatctagtgagtatccag

SEQ ID NO: 518538 - DNA, 20 bp, mouse
ggccaaagcatcctcagaca

SEQ ID NO: 518539 - DNA, 20 bp, mouse
gagtgagtatccagcggggt

SEQ ID NO: 518540 - DNA, 20 bp, mouse
gtccgtgtctgaggatgctt

SEQ ID NO: 518541 - DNA, 20 bp, mouse
gcttccaaggcccaccccgc

SEQ ID NO: 518542 - DNA, 20 bp, mouse
gagtaggtcagtatttaaac

SEQ ID NO: 518543 - DNA, 20 bp, mouse
gtcccttccaacttcttcca

SEQ ID NO: 518544 - DNA, 20 bp, mouse
ggggtagccaatagaagggg

SEQ ID NO: 518545 - DNA, 20 bp, mouse
gagacagaagtccgtgtctg

SEQ ID NO: 518546 - DNA, 20 bp, mouse
gtactcaccagatacagcaa

SEQ ID NO: 518547 - DNA, 20 bp, mouse
ggctcctgaggtaaccacaa

SEQ ID NO: 518548 - DNA, 20 bp, mouse
ggctgtggctgaatggttca

SEQ ID NO: 518549 - DNA, 20 bp, mouse
gttacacagggtcttatctg

SEQ ID NO: 518550 - DNA, 20 bp, mouse
gcaccagatacagcaaaggc

SEQ ID NO: 518551 - DNA, 20 bp, mouse
gctcctgcctttgctgtatc

SEQ ID NO: 518552 - DNA, 20 bp, mouse
gtgacaagctggactagact

SEQ ID NO: 518553 - DNA, 20 bp, mouse
gcagacccccatcatagtag

SEQ ID NO: 518554 - DNA, 20 bp, mouse
gagaggcagtgctgagatcc

SEQ ID NO: 518555 - DNA, 20 bp, mouse
gttagaaactggaattgatt

SEQ ID NO: 518556 - DNA, 20 bp, mouse
ggtctgtgtagaagaagctg

SEQ ID NO: 518557 - DNA, 20 bp, mouse
ggttcctgatgtacccacag

SEQ ID NO: 518558 - DNA, 20 bp, mouse
gcaccagataccgcaaagtc

SEQ ID NO: 518559 - DNA, 20 bp, mouse
gaccaaggtgaaagaagcaa

SEQ ID NO: 518560 - DNA, 20 bp, mouse
gaccctatggcgaatcctct

SEQ ID NO: 518561 - DNA, 20 bp, mouse
gctcacagggaccaagagac

SEQ ID NO: 518562 - DNA, 20 bp, mouse
ggcaggaagtggacctcaca

SEQ ID NO: 518563 - DNA, 20 bp, mouse
gaatggacaagagcctctgt

SEQ ID NO: 518564 - DNA, 20 bp, mouse
ggagcctctgtgggtacatc

SEQ ID NO: 518565 - DNA, 20 bp, mouse
ggagctattcatcaacccag

SEQ ID NO: 518566 - DNA, 20 bp, mouse
ggagtacctaactagggaca

SEQ ID NO: 518567 - DNA, 20 bp, mouse
gaaacctctcagcagagtgg

SEQ ID NO: 518568 - DNA, 20 bp, mouse
ggacagggcctccgctaaga

SEQ ID NO: 518569 - DNA, 20 bp, mouse
ggtgctgagagctaggactc

SEQ ID NO: 518570 - DNA, 20 bp, mouse
gcatctcaacaccttcttag

SEQ ID NO: 518571 - DNA, 20 bp, mouse
ggccagggggcaagaagaca

SEQ ID NO: 518572 - DNA, 20 bp, mouse
gaggaagagcacctgccagg

SEQ ID NO: 518573 - DNA, 20 bp, mouse
ggatcctgatatacctagag

SEQ ID NO: 518574 - DNA, 20 bp, mouse
gctcaacaccttcttagcgg

SEQ ID NO: 518575 - DNA, 20 bp, mouse
ggaagcaggggtgtctagta

SEQ ID NO: 518576 - DNA, 20 bp, mouse
gtactcaccaggttctgcaa

SEQ ID NO: 518577 - DNA, 20 bp, mouse
gcaccaggttctgcaaaggt

SEQ ID NO: 518578 - DNA, 20 bp, mouse
gccctagttaggtactcacc

SEQ ID NO: 518579 - DNA, 20 bp, mouse
ggataggaactcatcttaga

SEQ ID NO: 518580 - DNA, 20 bp, mouse
gctcctacctttgcagaacc

SEQ ID NO: 518581 - DNA, 20 bp, mouse
gagcatggtgtccagtgtga

SEQ ID NO: 518582 - DNA, 20 bp, mouse
ggacagtgaggaaaatagac

SEQ ID NO: 518583 - DNA, 20 bp, mouse
gcagaaagtggacctgccag

SEQ ID NO: 518584 - DNA, 20 bp, mouse
gaaacctctcagtagaatag

SEQ ID NO: 518585 - DNA, 20 bp, mouse
gagaacaacgaggtttacaa

SEQ ID NO: 518586 - DNA, 20 bp, mouse
gaaaacctcaggctcctctt

SEQ ID NO: 518587 - DNA, 20 bp, mouse
gtcaccctaagaggagcctg

SEQ ID NO: 518588 - DNA, 20 bp, mouse
gctcatcttcctggaaggta

SEQ ID NO: 518589 - DNA, 20 bp, mouse
ggtctactcatcttcctgga

SEQ ID NO: 518590 - DNA, 20 bp, mouse
gacttgtctactcatcttcc

SEQ ID NO: 518591 - DNA, 20 bp, mouse
gttggagtgaataggcactt

SEQ ID NO: 518592 - DNA, 20 bp, mouse
gtcttccctctagaccctgt

SEQ ID NO: 518593 - DNA, 20 bp, mouse
gaggctattttggagtgaat

SEQ ID NO: 518594 - DNA, 20 bp, mouse
gcagcagagacataccacat

SEQ ID NO: 518595 - DNA, 20 bp, mouse
gacagacccacagggtctag

SEQ ID NO: 518596 - DNA, 20 bp, mouse
gtcagctcagaggcccccat

SEQ ID NO: 518597 - DNA, 20 bp, mouse
ggacagaagcgctgaatcgt

SEQ ID NO: 518598 - DNA, 20 bp, mouse
ggcctctgagctgacgatct

SEQ ID NO: 518599 - DNA, 20 bp, mouse
gttctgtctgcggccaatgg

SEQ ID NO: 518600 - DNA, 20 bp, mouse
gcccgagatcgtcagctcag

SEQ ID NO: 518601 - DNA, 20 bp, mouse
gcagtgggactatgggatag

SEQ ID NO: 518602 - DNA, 20 bp, mouse
gtgctgtccagtgggactat

SEQ ID NO: 518603 - DNA, 20 bp, mouse
ggattcagcgcttctgtctg

SEQ ID NO: 518604 - DNA, 20 bp, mouse
gtgggattcaagctcctgac

SEQ ID NO: 518605 - DNA, 20 bp, mouse
gaaccctgaagatgactgga

SEQ ID NO: 518606 - DNA, 20 bp, mouse
gagacaggtggtgactacga

SEQ ID NO: 518607 - DNA, 20 bp, mouse
gcggcgaggggagctgacac

SEQ ID NO: 518608 - DNA, 20 bp, mouse
ggtgggcgcgaggagacagg

SEQ ID NO: 518609 - DNA, 20 bp, mouse
gggaagtcagggtggaacgt

SEQ ID NO: 518610 - DNA, 20 bp, mouse
ggggagctgacaccgggtcc

SEQ ID NO: 518611 - DNA, 20 bp, mouse
gtcccaggctgggcaggtaa

SEQ ID NO: 518612 - DNA, 20 bp, mouse
gtggtgactacgacggcgag

SEQ ID NO: 518613 - DNA, 20 bp, mouse
gaacgtgggcgcgaggagac

SEQ ID NO: 518614 - DNA, 20 bp, mouse
ggctcagacaacctccagga

SEQ ID NO: 518615 - DNA, 20 bp, mouse
gaataggccagaaggctccc

SEQ ID NO: 518616 - DNA, 20 bp, mouse
gcgagacagcgactccacgg

SEQ ID NO: 518617 - DNA, 20 bp, mouse
gccgcttcgggatgaattag

SEQ ID NO: 518618 - DNA, 20 bp, mouse
gcgacgtcgcggggacactg

SEQ ID NO: 518619 - DNA, 20 bp, mouse
gccggagggacgcattacta

SEQ ID NO: 518620 - DNA, 20 bp, mouse
gtccacgggggtcacaacct

SEQ ID NO: 518621 - DNA, 20 bp, mouse
gaattcatcccgaagcgggg

SEQ ID NO: 518622 - DNA, 20 bp, mouse
gcttcggcgcgggaacatgg

SEQ ID NO: 518623 - DNA, 20 bp, mouse
ggctcgacgcctccccgctt

SEQ ID NO: 518624 - DNA, 20 bp, mouse
gcttcgggatgaattagcgg

SEQ ID NO: 518625 - DNA, 20 bp, mouse
gtcccaggttgtgacccccg

SEQ ID NO: 518626 - DNA, 20 bp, mouse
gacggggaaacgagcagtgg

SEQ ID NO: 518627 - DNA, 20 bp, mouse
ggaaacggggaaacgagcag

SEQ ID NO: 518628 - DNA, 20 bp, mouse
ggctagagggccactgacca

SEQ ID NO: 518629 - DNA, 20 bp, mouse
gtggggtgcggcacccacca

SEQ ID NO: 518630 - DNA, 20 bp, mouse
gatgtgcgtgggatgttctg

SEQ ID NO: 518631 - DNA, 20 bp, mouse
gctggtgtcccgagcctagg

SEQ ID NO: 518632 - DNA, 20 bp, mouse
ggagctggtgtcccgagcct

SEQ ID NO: 518633 - DNA, 20 bp, mouse
gaagtgcacggagcagggag

SEQ ID NO: 518634 - DNA, 20 bp, mouse
gttatctttgcagctttagt

SEQ ID NO: 518635 - DNA, 20 bp, mouse
gacgctaggacactgggaag

SEQ ID NO: 518636 - DNA, 20 bp, mouse
gtcgcgggcccatgacgaga

SEQ ID NO: 518637 - DNA, 20 bp, mouse
ggaagtgacgcacccagaag

SEQ ID NO: 518638 - DNA, 20 bp, mouse
ggcacccagaagcggatgag

SEQ ID NO: 518639 - DNA, 20 bp, mouse
gggagcctgagcccaaggac

SEQ ID NO: 518640 - DNA, 20 bp, mouse
ggcactggagggctccaagt

SEQ ID NO: 518641 - DNA, 20 bp, mouse
gaatagccgcggtggataag

SEQ ID NO: 518642 - DNA, 20 bp, mouse
ggacgtgtctcggctcaagg

SEQ ID NO: 518643 - DNA, 20 bp, mouse
gtgggcggcccaggcaatga

SEQ ID NO: 518644 - DNA, 20 bp, mouse
ggcgctagtgagttcgagga

SEQ ID NO: 518645 - DNA, 20 bp, mouse
ggggaagtccacctcccaga

SEQ ID NO: 518646 - DNA, 20 bp, mouse
ggtccaggacaccacagcca

SEQ ID NO: 518647 - DNA, 20 bp, mouse
gcagggctagagctatggat

SEQ ID NO: 518648 - DNA, 20 bp, mouse
gacagccagggctagagcta

SEQ ID NO: 518649 - DNA, 20 bp, mouse
gaactgacctgcccgagcta

SEQ ID NO: 518650 - DNA, 20 bp, mouse
gctaaggatgaagttagaga

SEQ ID NO: 518651 - DNA, 20 bp, mouse
gggccatggtgggagagaat

SEQ ID NO: 518652 - DNA, 20 bp, mouse
ggtgtctgtgaagggtccca

SEQ ID NO: 518653 - DNA, 20 bp, mouse
ggagagtctgggcctcctta

SEQ ID NO: 518654 - DNA, 20 bp, mouse
ggcacagtcacagagttctt

SEQ ID NO: 518655 - DNA, 20 bp, mouse
gctggtggctagtggctcag

SEQ ID NO: 518656 - DNA, 20 bp, mouse
ggcatgagcactcacaatgt

SEQ ID NO: 518657 - DNA, 20 bp, mouse
gtcacaatgtgggtacacag

SEQ ID NO: 518658 - DNA, 20 bp, mouse
gaaggaggctcagactacag

SEQ ID NO: 518659 - DNA, 20 bp, mouse
gagcctggacccaataggat

SEQ ID NO: 518660 - DNA, 20 bp, mouse
gctgtagtggggctttaagg

SEQ ID NO: 518661 - DNA, 20 bp, mouse
gttctactgctgctgagtgt

SEQ ID NO: 518662 - DNA, 20 bp, mouse
gggtacacagaggctccaac

SEQ ID NO: 518663 - DNA, 20 bp, mouse
gggcttgaccagctgtagtg

SEQ ID NO: 518664 - DNA, 20 bp, mouse
ggactcagagacactctatc

SEQ ID NO: 518665 - DNA, 20 bp, mouse
gttcctctgctgtgtcttct

SEQ ID NO: 518666 - DNA, 20 bp, mouse
gacacagcctgcccgaggag

SEQ ID NO: 518667 - DNA, 20 bp, mouse
gcagcagccgctcctcgggc

SEQ ID NO: 518668 - DNA, 20 bp, mouse
ggaaggacacagcctgcccg

SEQ ID NO: 518669 - DNA, 20 bp, mouse
gtcaccagcagccgctcctc

SEQ ID NO: 518670 - DNA, 20 bp, mouse
gctcagggccctggccacgt

SEQ ID NO: 518671 - DNA, 20 bp, mouse
gcagggtcccggcttgtgga

SEQ ID NO: 518672 - DNA, 20 bp, mouse
ggccaaggccaccttctacc

SEQ ID NO: 518673 - DNA, 20 bp, mouse
ggtcccggcttgtggaggga

SEQ ID NO: 518674 - DNA, 20 bp, mouse
ggtgtccttctggagcctgg

SEQ ID NO: 518675 - DNA, 20 bp, mouse
ggctaggacctctccttagg

SEQ ID NO: 518676 - DNA, 20 bp, mouse
gctctgcaggaccccaagca

SEQ ID NO: 518677 - DNA, 20 bp, mouse
ggatcaggtaggaccctgaa

SEQ ID NO: 518678 - DNA, 20 bp, mouse
gacatcagacctagtagctg

SEQ ID NO: 518679 - DNA, 20 bp, mouse
ggcccagacacatgacactc

SEQ ID NO: 518680 - DNA, 20 bp, mouse
gagtgaggaggactccccag

SEQ ID NO: 518681 - DNA, 20 bp, mouse
gacttccggagcgatcaggt

SEQ ID NO: 518682 - DNA, 20 bp, mouse
gtaggtctgatgtgtgctgg

SEQ ID NO: 518683 - DNA, 20 bp, mouse
ggagaagccaaaggtttcac

SEQ ID NO: 518684 - DNA, 20 bp, mouse
ggcgctgcccgtgaaacctt

SEQ ID NO: 518685 - DNA, 20 bp, mouse
ggcccataaaaagcccgctg

SEQ ID NO: 518686 - DNA, 20 bp, mouse
gcagacagaagctaatgatc

SEQ ID NO: 518687 - DNA, 20 bp, mouse
ggccaggaatgaagagtcct

SEQ ID NO: 518688 - DNA, 20 bp, mouse
gcagggttctggattcaggg

SEQ ID NO: 518689 - DNA, 20 bp, mouse
gtgcacccctgagcacaggg

SEQ ID NO: 518690 - DNA, 20 bp, mouse
gcagccaaccaacaggtagc

SEQ ID NO: 518691 - DNA, 20 bp, mouse
gtagaatgggcagacatgaa

SEQ ID NO: 518692 - DNA, 20 bp, mouse
gctgtgacacaagtcagatt

SEQ ID NO: 518693 - DNA, 20 bp, mouse
gggaggcctgaacatgcatg

SEQ ID NO: 518694 - DNA, 20 bp, mouse
gttactggtgcaagaagacc

SEQ ID NO: 518695 - DNA, 20 bp, mouse
gtgcctgaccaccctccctg

SEQ ID NO: 518696 - DNA, 20 bp, mouse
ggtcaggagcaggctcttca

SEQ ID NO: 518697 - DNA, 20 bp, mouse
ggagcaggctcttcatggtc

SEQ ID NO: 518698 - DNA, 20 bp, mouse
gcactgtgttggctcctcag

SEQ ID NO: 518699 - DNA, 20 bp, mouse
gcagtgtgacagtcaggagc

SEQ ID NO: 518700 - DNA, 20 bp, mouse
gatgaagggaaggtcatcat

SEQ ID NO: 518701 - DNA, 20 bp, mouse
ggtcacactgtctagtctag

SEQ ID NO: 518702 - DNA, 20 bp, mouse
gccagagctagtaatcctga

SEQ ID NO: 518703 - DNA, 20 bp, mouse
gtccaagtctgaggaccagg

SEQ ID NO: 518704 - DNA, 20 bp, mouse
gaccaggaggccctgtatgc

SEQ ID NO: 518705 - DNA, 20 bp, mouse
gctcagaagaagataaagtg

SEQ ID NO: 518706 - DNA, 20 bp, mouse
gaaaagctatggcttctggt

SEQ ID NO: 518707 - DNA, 20 bp, mouse
gagtagtaaagggttctaca

SEQ ID NO: 518708 - DNA, 20 bp, mouse
gacccatgtgctcagttgct

SEQ ID NO: 518709 - DNA, 20 bp, mouse
gccttgctgggactgtgtgt

SEQ ID NO: 518710 - DNA, 20 bp, mouse
gagtactgaaagttgactct

SEQ ID NO: 518711 - DNA, 20 bp, mouse
gtacggcttggcacacaagg

SEQ ID NO: 518712 - DNA, 20 bp, mouse
gccgtatgcacccatcttgg

SEQ ID NO: 518713 - DNA, 20 bp, mouse
gccaggacctgagaccctgg

SEQ ID NO: 518714 - DNA, 20 bp, mouse
gtagaaagatctagtagtaa

SEQ ID NO: 518715 - DNA, 20 bp, mouse
gaggtagtcacagttacggt

SEQ ID NO: 518716 - DNA, 20 bp, mouse
gtgtacctctcggagaatga

SEQ ID NO: 518717 - DNA, 20 bp, mouse
ggccacactgcctgcaacca

SEQ ID NO: 518718 - DNA, 20 bp, mouse
ggtagtgtgcctgtacctct

SEQ ID NO: 518719 - DNA, 20 bp, mouse
gccagggaccgaggagctag

SEQ ID NO: 518720 - DNA, 20 bp, mouse
gccacagccaggacatacca

SEQ ID NO: 518721 - DNA, 20 bp, mouse
gactgctgctcttcttgctt

SEQ ID NO: 518722 - DNA, 20 bp, mouse
gatcaccttcattctccgag

SEQ ID NO: 518723 - DNA, 20 bp, mouse
gctggaccctaagcaggtaa

SEQ ID NO: 518724 - DNA, 20 bp, mouse
ggcaccgtccccggagggag

SEQ ID NO: 518725 - DNA, 20 bp, mouse
ggagtcagtctgtaaaagtg

SEQ ID NO: 518726 - DNA, 20 bp, mouse
gaggccctgagatggaagct

SEQ ID NO: 518727 - DNA, 20 bp, mouse
gctacaagctgagtctacca

SEQ ID NO: 518728 - DNA, 20 bp, mouse
gggatggaggccccaagagt

SEQ ID NO: 518729 - DNA, 20 bp, mouse
gtctggtacaagctccaccc

SEQ ID NO: 518730 - DNA, 20 bp, mouse
gcaacaggagttagatggaa

SEQ ID NO: 518731 - DNA, 20 bp, mouse
gcaagctgagtctaccaggg

SEQ ID NO: 518732 - DNA, 20 bp, mouse
ggttgcagcctagctgtcag

SEQ ID NO: 518733 - DNA, 20 bp, mouse
gggtctggcccctgacagct

SEQ ID NO: 518734 - DNA, 20 bp, mouse
gagacctcagaggtctacta

SEQ ID NO: 518735 - DNA, 20 bp, mouse
gcaaggtgggagcttatatt

SEQ ID NO: 518736 - DNA, 20 bp, mouse
ggtagtagtaccattctctc

SEQ ID NO: 518737 - DNA, 20 bp, mouse
gtagccatgatggcaaccag

SEQ ID NO: 518738 - DNA, 20 bp, mouse
gtgcaggttgaactgcgcag

SEQ ID NO: 518739 - DNA, 20 bp, mouse
gcaacctgcatactgctgtg

SEQ ID NO: 518740 - DNA, 20 bp, mouse
gtagaaggctcggcccaccc

SEQ ID NO: 518741 - DNA, 20 bp, mouse
gggccaagcagtcccagagg

SEQ ID NO: 518742 - DNA, 20 bp, mouse
gatcatggctaggaatgtga

SEQ ID NO: 518743 - DNA, 20 bp, mouse
ggagggccaagcagtcccag

SEQ ID NO: 518744 - DNA, 20 bp, mouse
gtctccgcacagcagtatgc

SEQ ID NO: 518745 - DNA, 20 bp, mouse
gatggtactactactagtcc

SEQ ID NO: 518746 - DNA, 20 bp, mouse
ggaagatggcgagggtgtgt

SEQ ID NO: 518747 - DNA, 20 bp, mouse
gcgaaagccgcgtctctcaa

SEQ ID NO: 518748 - DNA, 20 bp, mouse
ggggcggcagaagatggcga

SEQ ID NO: 518749 - DNA, 20 bp, mouse
gccgcggcggaggcagggcc

SEQ ID NO: 518750 - DNA, 20 bp, mouse
ggagggcctcacctacacag

SEQ ID NO: 518751 - DNA, 20 bp, mouse
gaatgctccgttgagagacg

SEQ ID NO: 518752 - DNA, 20 bp, mouse
gtcggcaagaactggactcg

SEQ ID NO: 518753 - DNA, 20 bp, mouse
gccagcgcgccgggacgcac

SEQ ID NO: 518754 - DNA, 20 bp, mouse
gcgcgcggcctctcccccag

SEQ ID NO: 518755 - DNA, 20 bp, mouse
gcgcggggcgagggcaggtg

SEQ ID NO: 518756 - DNA, 20 bp, mouse
gcgagggctccggcactgag

SEQ ID NO: 518757 - DNA, 20 bp, mouse
ggcgggacgcagatggacaa

SEQ ID NO: 518758 - DNA, 20 bp, mouse
gctccggcactgagcggcag

SEQ ID NO: 518759 - DNA, 20 bp, mouse
gcgccgcgcaccgagggctc

SEQ ID NO: 518760 - DNA, 20 bp, mouse
gtggagagccgcggtgacag

SEQ ID NO: 518761 - DNA, 20 bp, mouse
gcgggcgccgaggagtttcg

SEQ ID NO: 518762 - DNA, 20 bp, mouse
gcgggctcggcgccacggtg

SEQ ID NO: 518763 - DNA, 20 bp, mouse
gggagaggagaggattccgg

SEQ ID NO: 518764 - DNA, 20 bp, mouse
gcgcggggtgctcggagagt

SEQ ID NO: 518765 - DNA, 20 bp, mouse
gcctcagccacaaactcctc

SEQ ID NO: 518766 - DNA, 20 bp, mouse
gggcagcgcaggatgcccgg

SEQ ID NO: 518767 - DNA, 20 bp, mouse
gctgaagtggtggagccggg

SEQ ID NO: 518768 - DNA, 20 bp, mouse
gctccaccacttcagcctcc

SEQ ID NO: 518769 - DNA, 20 bp, mouse
ggcgggcagcgcaggatgcc

SEQ ID NO: 518770 - DNA, 20 bp, mouse
gccttccgtacagctacacg

SEQ ID NO: 518771 - DNA, 20 bp, mouse
gctgcccgcagcagaattag

SEQ ID NO: 518772 - DNA, 20 bp, mouse
gggctccacgtgtagctgta

SEQ ID NO: 518773 - DNA, 20 bp, mouse
ggtgggaaccgagagctgta

SEQ ID NO: 518774 - DNA, 20 bp, mouse
gctaaggtggcgaaatcagt

SEQ ID NO: 518775 - DNA, 20 bp, mouse
gacaccggtgtctggagact

SEQ ID NO: 518776 - DNA, 20 bp, mouse
gggctccagaggaagtagac

SEQ ID NO: 518777 - DNA, 20 bp, mouse
gtccagaggaagtagacagg

SEQ ID NO: 518778 - DNA, 20 bp, mouse
gtgaagggaaagggctccag

SEQ ID NO: 518779 - DNA, 20 bp, mouse
ggaggaagtagacaggaggc

SEQ ID NO: 518780 - DNA, 20 bp, mouse
gcacatttgtttctgcgggg

SEQ ID NO: 518781 - DNA, 20 bp, mouse
ggaaatctggagcctgtatc

SEQ ID NO: 518782 - DNA, 20 bp, mouse
gtgtgcaaagatcaacagac

SEQ ID NO: 518783 - DNA, 20 bp, mouse
gcggtctctgtagaaaggtg

SEQ ID NO: 518784 - DNA, 20 bp, mouse
gtatcgacttcgccagatac

SEQ ID NO: 518785 - DNA, 20 bp, mouse
ggagacataaccgagatacc

SEQ ID NO: 518786 - DNA, 20 bp, mouse
ggccagatccccaaaagcag

SEQ ID NO: 518787 - DNA, 20 bp, mouse
ggacataccagaccaaccaa

SEQ ID NO: 518788 - DNA, 20 bp, mouse
gaggccatggctgctctaca

SEQ ID NO: 518789 - DNA, 20 bp, mouse
ggcgatgcagccatgaacag

SEQ ID NO: 518790 - DNA, 20 bp, mouse
ggggagaggctcacaaactg

SEQ ID NO: 518791 - DNA, 20 bp, mouse
gaggctcacaaactgaggag

SEQ ID NO: 518792 - DNA, 20 bp, mouse
gaggaacacccttgttgaag

SEQ ID NO: 518793 - DNA, 20 bp, mouse
gagaccatatttgttcacag

SEQ ID NO: 518794 - DNA, 20 bp, mouse
gggtatgtctttggttgggt

SEQ ID NO: 518795 - DNA, 20 bp, mouse
gcaaggacacctcagagctc

SEQ ID NO: 518796 - DNA, 20 bp, mouse
gctggcatgaaagacccagg

SEQ ID NO: 518797 - DNA, 20 bp, mouse
gagtactgaggcaagaagga

SEQ ID NO: 518798 - DNA, 20 bp, mouse
gtcctcagtaccttcctcct

SEQ ID NO: 518799 - DNA, 20 bp, mouse
gcatgaaagacccaggagga

SEQ ID NO: 518800 - DNA, 20 bp, mouse
gtcatgccaggggaatgact

SEQ ID NO: 518801 - DNA, 20 bp, mouse
gagattcccagtcattcccc

SEQ ID NO: 518802 - DNA, 20 bp, mouse
gtctagcagttccttgacca

SEQ ID NO: 518803 - DNA, 20 bp, mouse
ggaagactgctgaagtactg

SEQ ID NO: 518804 - DNA, 20 bp, mouse
ggcaccatccagagagacgg

SEQ ID NO: 518805 - DNA, 20 bp, mouse
gaccatccgctgggaaagca

SEQ ID NO: 518806 - DNA, 20 bp, mouse
gggacagagggccctagata

SEQ ID NO: 518807 - DNA, 20 bp, mouse
ggtctctctgaatgactcct

SEQ ID NO: 518808 - DNA, 20 bp, mouse
gccaccaaagcagaacctac

SEQ ID NO: 518809 - DNA, 20 bp, mouse
gtagaggattccatgcctgt

SEQ ID NO: 518810 - DNA, 20 bp, mouse
gtacaggctacacagttggg

SEQ ID NO: 518811 - DNA, 20 bp, mouse
gctgctttggtggggagtgt

SEQ ID NO: 518812 - DNA, 20 bp, mouse
gctgacaacagtggccctgg

SEQ ID NO: 518813 - DNA, 20 bp, mouse
gtcagccctcgacaccccca

SEQ ID NO: 518814 - DNA, 20 bp, mouse
gagatcacacccctgactag

SEQ ID NO: 518815 - DNA, 20 bp, mouse
gccatacaggctacacagtt

SEQ ID NO: 518816 - DNA, 20 bp, mouse
gcccgcgcgtacacacgcag

SEQ ID NO: 518817 - DNA, 20 bp, mouse
gggcccctcgctgcaggcag

SEQ ID NO: 518818 - DNA, 20 bp, mouse
gtgtcaggcgcggagcagac

SEQ ID NO: 518819 - DNA, 20 bp, mouse
gctgcagcgaggggcctgtc

SEQ ID NO: 518820 - DNA, 20 bp, mouse
ggcgaggggcctgtcaggcg

SEQ ID NO: 518821 - DNA, 20 bp, mouse
ggactcggctgggcccccag

SEQ ID NO: 518822 - DNA, 20 bp, mouse
gccctcgctgcaggcagggg

SEQ ID NO: 518823 - DNA, 20 bp, mouse
ggttagggggccgaaaggga

SEQ ID NO: 518824 - DNA, 20 bp, mouse
gggcgatgtgaagatgtcag

SEQ ID NO: 518825 - DNA, 20 bp, mouse
gaggcaggggcggcccgcac

SEQ ID NO: 518826 - DNA, 20 bp, mouse
gtcctcagggaccctggcaa

SEQ ID NO: 518827 - DNA, 20 bp, mouse
ggccaccgggcccctctgca

SEQ ID NO: 518828 - DNA, 20 bp, mouse
gccgggcccctctgcagggg

SEQ ID NO: 518829 - DNA, 20 bp, mouse
gtggaggcagaggcagcgag

SEQ ID NO: 518830 - DNA, 20 bp, mouse
ggcaagggtgaggactaagg

SEQ ID NO: 518831 - DNA, 20 bp, mouse
gctggcaagggtgaggacta

SEQ ID NO: 518832 - DNA, 20 bp, mouse
ggagcgcctgggagtcctca

SEQ ID NO: 518833 - DNA, 20 bp, mouse
gcagcccgcccgccctccct

SEQ ID NO: 518834 - DNA, 20 bp, mouse
gcgagtgggacaggccggtc

SEQ ID NO: 518835 - DNA, 20 bp, mouse
gccgccctccctaggccacc

SEQ ID NO: 518836 - DNA, 20 bp, mouse
ggagccctctatagcgagag

SEQ ID NO: 518837 - DNA, 20 bp, mouse
gacgtccatgcagagcacat

SEQ ID NO: 518838 - DNA, 20 bp, mouse
gactctggctgtaccatgta

SEQ ID NO: 518839 - DNA, 20 bp, mouse
gaggagacatacaccataca

SEQ ID NO: 518840 - DNA, 20 bp, mouse
gccaccagctactatcacgt

SEQ ID NO: 518841 - DNA, 20 bp, mouse
gagactgcagtctcgtacag

SEQ ID NO: 518842 - DNA, 20 bp, mouse
gtcctttcggcccattttat

SEQ ID NO: 518843 - DNA, 20 bp, mouse
gtcctataaaatgggccgaa

SEQ ID NO: 518844 - DNA, 20 bp, mouse
gtgtatgtctcctataaaat

SEQ ID NO: 518845 - DNA, 20 bp, mouse
gtctcatagattcggtactc

SEQ ID NO: 518846 - DNA, 20 bp, mouse
gttacccgggagatagtgag

SEQ ID NO: 518847 - DNA, 20 bp, mouse
ggggccaggaccagagatag

SEQ ID NO: 518848 - DNA, 20 bp, mouse
ggacatactggtgctgacag

SEQ ID NO: 518849 - DNA, 20 bp, mouse
gaggcagcaaggaacgcagc

SEQ ID NO: 518850 - DNA, 20 bp, mouse
gctattcttaggagcctccc

SEQ ID NO: 518851 - DNA, 20 bp, mouse
ggcaaggaacgcagcaggca

SEQ ID NO: 518852 - DNA, 20 bp, mouse
ggaggctcctaagaatagct

SEQ ID NO: 518853 - DNA, 20 bp, mouse
gccaggctgtgcagagctcc

SEQ ID NO: 518854 - DNA, 20 bp, mouse
ggaatcgggcaagagccctg

SEQ ID NO: 518855 - DNA, 20 bp, mouse
ggcaggcaaggccaggggtt

SEQ ID NO: 518856 - DNA, 20 bp, mouse
gaagcagcgtggcccgagct

SEQ ID NO: 518857 - DNA, 20 bp, mouse
gtgtaaagaggactaagggg

SEQ ID NO: 518858 - DNA, 20 bp, mouse
gccgtgtaaagaggactaag

SEQ ID NO: 518859 - DNA, 20 bp, mouse
ggtgcactagcggtacggtt

SEQ ID NO: 518860 - DNA, 20 bp, mouse
gccatcgtgcactagcggta

SEQ ID NO: 518861 - DNA, 20 bp, mouse
ggttgggagccaccgaacgg

SEQ ID NO: 518862 - DNA, 20 bp, mouse
gtgcacgatgggggggcgac

SEQ ID NO: 518863 - DNA, 20 bp, mouse
gagccactgtcgccgagctc

SEQ ID NO: 518864 - DNA, 20 bp, mouse
gccgtaactcgagcccatgg

SEQ ID NO: 518865 - DNA, 20 bp, mouse
gcggcgagacccgtgtaaag

SEQ ID NO: 518866 - DNA, 20 bp, mouse
ggagcagagggcgccaataa

SEQ ID NO: 518867 - DNA, 20 bp, mouse
ggccacaaggtgcgacccca

SEQ ID NO: 518868 - DNA, 20 bp, mouse
ggccttggggtcgcaccttg

SEQ ID NO: 518869 - DNA, 20 bp, mouse
gtagagcgccaagttgctcc

SEQ ID NO: 518870 - DNA, 20 bp, mouse
gggcgccaataacggccaca

SEQ ID NO: 518871 - DNA, 20 bp, mouse
gaatagccagcgccagggtg

SEQ ID NO: 518872 - DNA, 20 bp, mouse
gcgcaccttgtggccgttat

SEQ ID NO: 518873 - DNA, 20 bp, mouse
gggtacttcctggagcaact

SEQ ID NO: 518874 - DNA, 20 bp, mouse
gagcacgttgctatgccttg

SEQ ID NO: 518875 - DNA, 20 bp, mouse
ggacttggtgagtatacctt

SEQ ID NO: 518876 - DNA, 20 bp, mouse
gctccggctctacaagaagg

SEQ ID NO: 518877 - DNA, 20 bp, mouse
gctctgcggatcgcagactc

SEQ ID NO: 518878 - DNA, 20 bp, mouse
gagactccggctctacaaga

SEQ ID NO: 518879 - DNA, 20 bp, mouse
gtggcaagccgagcgagcag

SEQ ID NO: 518880 - DNA, 20 bp, mouse
gcagcctggggcgcaagcca

SEQ ID NO: 518881 - DNA, 20 bp, mouse
gaccaaggtgcagaccgagt

SEQ ID NO: 518882 - DNA, 20 bp, mouse
gccacaaagaagaaataggt

SEQ ID NO: 518883 - DNA, 20 bp, mouse
ggtgcagaggtgttattgtt

SEQ ID NO: 518884 - DNA, 20 bp, mouse
ggagcctcctcttttctggt

SEQ ID NO: 518885 - DNA, 20 bp, mouse
gacgggtctatccctcccct

SEQ ID NO: 518886 - DNA, 20 bp, mouse
gtgctgcggagtcagcagta

SEQ ID NO: 518887 - DNA, 20 bp, mouse
gtcggcctccccagaggaag

SEQ ID NO: 518888 - DNA, 20 bp, mouse
ggtgttttcggcctccccag

SEQ ID NO: 518889 - DNA, 20 bp, mouse
gccagctcacaggcctacaa

SEQ ID NO: 518890 - DNA, 20 bp, mouse
gcacctgtctaggaactcta

SEQ ID NO: 518891 - DNA, 20 bp, mouse
ggcagcacaggtaagaaacc

SEQ ID NO: 518892 - DNA, 20 bp, mouse
gagaaaccaggataactgtt

SEQ ID NO: 518893 - DNA, 20 bp, mouse
gggaggagcctgaatggagg

SEQ ID NO: 518894 - DNA, 20 bp, mouse
gctggacccaacagttatcc

SEQ ID NO: 518895 - DNA, 20 bp, mouse
ggccttctctagctagagtg

SEQ ID NO: 518896 - DNA, 20 bp, mouse
gccttcgggtggccacccag

SEQ ID NO: 518897 - DNA, 20 bp, mouse
gtggagcagaaactcctcca

SEQ ID NO: 518898 - DNA, 20 bp, mouse
gcagggagacagcctctggg

SEQ ID NO: 518899 - DNA, 20 bp, mouse
ggccgggtgggaagaatgag

SEQ ID NO: 518900 - DNA, 20 bp, mouse
gcctccagggagacagcctc

SEQ ID NO: 518901 - DNA, 20 bp, mouse
gagctaaggggagaataact

SEQ ID NO: 518902 - DNA, 20 bp, mouse
gtagccagaccgcagctaag

SEQ ID NO: 518903 - DNA, 20 bp, mouse
gcagggacctcagcagatca

SEQ ID NO: 518904 - DNA, 20 bp, mouse
gatggccatgctccttcggg

SEQ ID NO: 518905 - DNA, 20 bp, mouse
gggagaataactaggcggag

SEQ ID NO: 518906 - DNA, 20 bp, mouse
ggtgtctcggctgcgaatct

SEQ ID NO: 518907 - DNA, 20 bp, mouse
gttcgcagccgagacaccgt

SEQ ID NO: 518908 - DNA, 20 bp, mouse
gcgcgggccccacggtgtct

SEQ ID NO: 518909 - DNA, 20 bp, mouse
gcgcaagcctcacggtgtcc

SEQ ID NO: 518910 - DNA, 20 bp, mouse
gtagtactgggaatgactct

SEQ ID NO: 518911 - DNA, 20 bp, mouse
ggacggctgcccctgacccc

SEQ ID NO: 518912 - DNA, 20 bp, mouse
gcactggatcgcgggcccca

SEQ ID NO: 518913 - DNA, 20 bp, mouse
ggggctctccgagttcagga

SEQ ID NO: 518914 - DNA, 20 bp, mouse
gtgcgccaggagcctgcccg

SEQ ID NO: 518915 - DNA, 20 bp, mouse
ggacttgggagagcacccac

SEQ ID NO: 518916 - DNA, 20 bp, mouse
gagttcctggagatgagtgt

SEQ ID NO: 518917 - DNA, 20 bp, mouse
gcaagagtcagttcagaccc

SEQ ID NO: 518918 - DNA, 20 bp, mouse
gcaggtggagcgagtcccca

SEQ ID NO: 518919 - DNA, 20 bp, mouse
gacccaggcagcttttacct

SEQ ID NO: 518920 - DNA, 20 bp, mouse
gccccaggtaaaagctgcct

SEQ ID NO: 518921 - DNA, 20 bp, mouse
gacagtgccctaacacccct

SEQ ID NO: 518922 - DNA, 20 bp, mouse
gtgaagcccaggatgagcgt

SEQ ID NO: 518923 - DNA, 20 bp, mouse
gaggacacctaggggtgtta

SEQ ID NO: 518924 - DNA, 20 bp, mouse
gcacagcccacgctcatcct

SEQ ID NO: 518925 - DNA, 20 bp, mouse
gggttccaacactcatctcc

SEQ ID NO: 518926 - DNA, 20 bp, mouse
ggcgtgtgcccggagacctg

SEQ ID NO: 518927 - DNA, 20 bp, mouse
gtgcggcgacggcagtgacc

SEQ ID NO: 518928 - DNA, 20 bp, mouse
ggctgtggaggtcagtgatc

SEQ ID NO: 518929 - DNA, 20 bp, mouse
gacatggacaactgcggcga

SEQ ID NO: 518930 - DNA, 20 bp, mouse
ggtcagtgatcgggatcacg

SEQ ID NO: 518931 - DNA, 20 bp, mouse
gtgagggtcagtgcagcgga

SEQ ID NO: 518932 - DNA, 20 bp, mouse
gccacagctggctgggggac

SEQ ID NO: 518933 - DNA, 20 bp, mouse
gtggcagggcctgggtagag

SEQ ID NO: 518934 - DNA, 20 bp, mouse
gaggggaccgaggagtcacg

SEQ ID NO: 518935 - DNA, 20 bp, mouse
ggagggaggagcgtctagtc

SEQ ID NO: 518936 - DNA, 20 bp, mouse
gacgtcgctgggcagcggag

SEQ ID NO: 518937 - DNA, 20 bp, mouse
gtcgctgggcagcggagcgg

SEQ ID NO: 518938 - DNA, 20 bp, mouse
gcgcggagcagggacgatcg

SEQ ID NO: 518939 - DNA, 20 bp, mouse
gagcactgcgggtgagtggg

SEQ ID NO: 518940 - DNA, 20 bp, mouse
ggagcggcggccgcgccatg

SEQ ID NO: 518941 - DNA, 20 bp, mouse
gagcagcactgcgggtgagt

SEQ ID NO: 518942 - DNA, 20 bp, mouse
ggcggggcagcaacgtcgct

SEQ ID NO: 518943 - DNA, 20 bp, mouse
ggagaggcggggtctgaccg

SEQ ID NO: 518944 - DNA, 20 bp, mouse
gctggccgggaccccgcgag

SEQ ID NO: 518945 - DNA, 20 bp, mouse
gtggccggcgccgagaggcg

SEQ ID NO: 518946 - DNA, 20 bp, mouse
gctccggctgacgggaagga

SEQ ID NO: 518947 - DNA, 20 bp, mouse
gggagagcgccggtgctgtc

SEQ ID NO: 518948 - DNA, 20 bp, mouse
ggagtcccgccaccgcgcag

SEQ ID NO: 518949 - DNA, 20 bp, mouse
ggacagacccggcctctgcg

SEQ ID NO: 518950 - DNA, 20 bp, mouse
gggctgagttgagacagacc

SEQ ID NO: 518951 - DNA, 20 bp, mouse
gtcccctccggctgacggga

SEQ ID NO: 518952 - DNA, 20 bp, mouse
ggtcccgctcgcccatccag

SEQ ID NO: 518953 - DNA, 20 bp, mouse
ggggatcccctccggctgac

SEQ ID NO: 518954 - DNA, 20 bp, mouse
gcgctccgggtggcgcgaca

SEQ ID NO: 518955 - DNA, 20 bp, mouse
gcctgccgcagcccctggat

SEQ ID NO: 518956 - DNA, 20 bp, mouse
ggcggtagcggcgtcagtgg

SEQ ID NO: 518957 - DNA, 20 bp, mouse
ggcggcggcgacaaccggag

SEQ ID NO: 518958 - DNA, 20 bp, mouse
ggccatggacgcgctcaagt

SEQ ID NO: 518959 - DNA, 20 bp, mouse
ggcgcgtccatggcccgctc

SEQ ID NO: 518960 - DNA, 20 bp, mouse
gcgacaaccggagcgggcca

SEQ ID NO: 518961 - DNA, 20 bp, mouse
gcctggaggagttttggcgg

SEQ ID NO: 518962 - DNA, 20 bp, mouse
ggcccggcggaaagttttcc

SEQ ID NO: 518963 - DNA, 20 bp, mouse
gcgtccagaggggaccctgt

SEQ ID NO: 518964 - DNA, 20 bp, mouse
gggagttttggcggcggtag

SEQ ID NO: 518965 - DNA, 20 bp, mouse
gcgggccaaggtggactggg

SEQ ID NO: 518966 - DNA, 20 bp, mouse
gaggaagtgcgggtcctcag

SEQ ID NO: 518967 - DNA, 20 bp, mouse
gcagtctcggatcggctcca

SEQ ID NO: 518968 - DNA, 20 bp, mouse
ggcctctctgtgcagctccg

SEQ ID NO: 518969 - DNA, 20 bp, mouse
gcagggtccgcactcctctg

SEQ ID NO: 518970 - DNA, 20 bp, mouse
gctcggtctcagtctcggat

SEQ ID NO: 518971 - DNA, 20 bp, mouse
gcgctaaaccgtgaggggta

SEQ ID NO: 518972 - DNA, 20 bp, mouse
gtcggtctcggtctcagtct

SEQ ID NO: 518973 - DNA, 20 bp, mouse
gacagctcggtggacatacc

SEQ ID NO: 518974 - DNA, 20 bp, mouse
ggcgggtcctcagaggagtg

SEQ ID NO: 518975 - DNA, 20 bp, mouse
gagggcaccggacagctcgg

SEQ ID NO: 518976 - DNA, 20 bp, mouse
gcgagagcgagcggtctcta

SEQ ID NO: 518977 - DNA, 20 bp, mouse
gcgctgggaacctggcaact

SEQ ID NO: 518978 - DNA, 20 bp, mouse
ggaacctggcaactgggcca

SEQ ID NO: 518979 - DNA, 20 bp, mouse
gcgctgccaagatggcccga

SEQ ID NO: 518980 - DNA, 20 bp, mouse
gtagacggccgctgggaacc

SEQ ID NO: 518981 - DNA, 20 bp, mouse
ggcgcccggcctgtacgtca

SEQ ID NO: 518982 - DNA, 20 bp, mouse
ggcaggcgcggccagctaga

SEQ ID NO: 518983 - DNA, 20 bp, mouse
gatctgagcgctggcaccag

SEQ ID NO: 518984 - DNA, 20 bp, mouse
gccgctgctccgagagcgag

SEQ ID NO: 518985 - DNA, 20 bp, mouse
gctcgaccctcgggccatct

SEQ ID NO: 518986 - DNA, 20 bp, mouse
gcagcagcagcaggcaagtc

SEQ ID NO: 518987 - DNA, 20 bp, mouse
gctgctgggtcaggtaagga

SEQ ID NO: 518988 - DNA, 20 bp, mouse
ggaggctgtgcagcagaggg

SEQ ID NO: 518989 - DNA, 20 bp, mouse
gcttggcaaaagaatgatgt

SEQ ID NO: 518990 - DNA, 20 bp, mouse
gtctgaggctgtgcagcaga

SEQ ID NO: 518991 - DNA, 20 bp, mouse
gggaaacgggaactgccccc

SEQ ID NO: 518992 - DNA, 20 bp, mouse
gcccggcacgaggcaccaat

SEQ ID NO: 518993 - DNA, 20 bp, mouse
gctattgacctgtagagcaa

SEQ ID NO: 518994 - DNA, 20 bp, mouse
gggcatactcactttagctg

SEQ ID NO: 518995 - DNA, 20 bp, mouse
gtctggtccaccctgtacct

SEQ ID NO: 518996 - DNA, 20 bp, mouse
gcccaggaggtactcaccgg

SEQ ID NO: 518997 - DNA, 20 bp, mouse
gggacccaggaggtactcac

SEQ ID NO: 518998 - DNA, 20 bp, mouse
gcattcgttgtagggacaag

SEQ ID NO: 518999 - DNA, 20 bp, mouse
gggtacagaggatccaccac

SEQ ID NO: 519000 - DNA, 20 bp, mouse
gacgtcctcaggccctacca

SEQ ID NO: 519001 - DNA, 20 bp, mouse
gcagagggtgcagtactagg

SEQ ID NO: 519002 - DNA, 20 bp, mouse
gagagaccccggcttcctgt

SEQ ID NO: 519003 - DNA, 20 bp, mouse
gtgctgctgctgttgtacag

SEQ ID NO: 519004 - DNA, 20 bp, mouse
gagttcctatcaccatggta

SEQ ID NO: 519005 - DNA, 20 bp, mouse
gcctagggaagagtctgcta

SEQ ID NO: 519006 - DNA, 20 bp, mouse
gatggagcaggtctaactag

SEQ ID NO: 519007 - DNA, 20 bp, mouse
gatgcacacagggtcacccc

SEQ ID NO: 519008 - DNA, 20 bp, mouse
ggaagattcactcattccgg

SEQ ID NO: 519009 - DNA, 20 bp, mouse
ggacctgctccatgcacaca

SEQ ID NO: 519010 - DNA, 20 bp, mouse
gattgttgtgggaatcatct

SEQ ID NO: 519011 - DNA, 20 bp, mouse
gtccttgttggacttaccag

SEQ ID NO: 519012 - DNA, 20 bp, mouse
gctgaagtcaggggtaaatt

SEQ ID NO: 519013 - DNA, 20 bp, mouse
gtgtgtctcttactagatct

SEQ ID NO: 519014 - DNA, 20 bp, mouse
gtcctctggtaagtccaaca

SEQ ID NO: 519015 - DNA, 20 bp, mouse
ggggatcagacagctctcca

SEQ ID NO: 519016 - DNA, 20 bp, mouse
gtaggcgcggcgaggagaag

SEQ ID NO: 519017 - DNA, 20 bp, mouse
gcgcggcgaggagaagcggt

SEQ ID NO: 519018 - DNA, 20 bp, mouse
ggcgctgccccgcaggtgag

SEQ ID NO: 519019 - DNA, 20 bp, mouse
gaggcgcaaccgctcacctg

SEQ ID NO: 519020 - DNA, 20 bp, mouse
gaagcgcagcccggtccctc

SEQ ID NO: 519021 - DNA, 20 bp, mouse
gcagcgcgcaccggagggac

SEQ ID NO: 519022 - DNA, 20 bp, mouse
gggaggagccgaggggccac

SEQ ID NO: 519023 - DNA, 20 bp, mouse
gttgcagcgccggctaggcg

SEQ ID NO: 519024 - DNA, 20 bp, mouse
gcggggcagcgcgcaccgga

SEQ ID NO: 519025 - DNA, 20 bp, mouse
gcgggaatgtccgaatgcca

SEQ ID NO: 519026 - DNA, 20 bp, mouse
gtacgcatctgggaaggctg

SEQ ID NO: 519027 - DNA, 20 bp, mouse
gcaggggtgagtacgcatct

SEQ ID NO: 519028 - DNA, 20 bp, mouse
gggtgagtacgcatctggga

SEQ ID NO: 519029 - DNA, 20 bp, mouse
gttctctgtcccgatggcag

SEQ ID NO: 519030 - DNA, 20 bp, mouse
ggttaccttctctgtcccga

SEQ ID NO: 519031 - DNA, 20 bp, mouse
ggagagccccggaagatgta

SEQ ID NO: 519032 - DNA, 20 bp, mouse
ggggctgattccaaaatata

SEQ ID NO: 519033 - DNA, 20 bp, mouse
gcgtactcacccctgccatc

SEQ ID NO: 519034 - DNA, 20 bp, mouse
gagagagggtccttatattt

SEQ ID NO: 519035 - DNA, 20 bp, mouse
gaagaggctactctacagtc

SEQ ID NO: 519036 - DNA, 20 bp, mouse
gagagtttcataacagtcag

SEQ ID NO: 519037 - DNA, 20 bp, mouse
ggactatgggtaagcattgt

SEQ ID NO: 519038 - DNA, 20 bp, mouse
gtcagttgtttcctttgcta

SEQ ID NO: 519039 - DNA, 20 bp, mouse
gcgaaattgagagacaaatg

SEQ ID NO: 519040 - DNA, 20 bp, mouse
gtgcttacccatagtccttg

SEQ ID NO: 519041 - DNA, 20 bp, mouse
gtgaatattggatatttatg

SEQ ID NO: 519042 - DNA, 20 bp, mouse
gaaacccactgccgtagcaa

SEQ ID NO: 519043 - DNA, 20 bp, mouse
ggtttcctttgctacggcag

SEQ ID NO: 519044 - DNA, 20 bp, mouse
gtagtatttatttagttctt

SEQ ID NO: 519045 - DNA, 20 bp, mouse
gaaaggaaacaactgaatat

SEQ ID NO: 519046 - DNA, 20 bp, mouse
gtatatccacgattcctcct

SEQ ID NO: 519047 - DNA, 20 bp, mouse
gagccctcagcagaccgtct

SEQ ID NO: 519048 - DNA, 20 bp, mouse
gacatactgggacctcacgt

SEQ ID NO: 519049 - DNA, 20 bp, mouse
gcgctgcccaggaggaatcg

SEQ ID NO: 519050 - DNA, 20 bp, mouse
gaaagttcttgggacctaga

SEQ ID NO: 519051 - DNA, 20 bp, mouse
ggggtctacatcaccagagt

SEQ ID NO: 519052 - DNA, 20 bp, mouse
ggacctagacggtctgctga

SEQ ID NO: 519053 - DNA, 20 bp, mouse
gctgcagcagggccacatac

SEQ ID NO: 519054 - DNA, 20 bp, mouse
gcttcatggcgctgcccagg

SEQ ID NO: 519055 - DNA, 20 bp, mouse
gaccctggacagcgcggatg

SEQ ID NO: 519056 - DNA, 20 bp, mouse
ggcggtcgcccgggagacca

SEQ ID NO: 519057 - DNA, 20 bp, mouse
ggactccgcagggtgtaaaa

SEQ ID NO: 519058 - DNA, 20 bp, mouse
gcctagcccgggactccgca

SEQ ID NO: 519059 - DNA, 20 bp, mouse
gggagtcccgggctaggtga

SEQ ID NO: 519060 - DNA, 20 bp, mouse
gccgccgaccgggtcctctg

SEQ ID NO: 519061 - DNA, 20 bp, mouse
gcatgaccctcacctagccc

SEQ ID NO: 519062 - DNA, 20 bp, mouse
gacgtgcagcgcggtcgccc

SEQ ID NO: 519063 - DNA, 20 bp, mouse
gagtcctcagaggacccggt

SEQ ID NO: 519064 - DNA, 20 bp, mouse
ggggccagcgcagtccggtc

SEQ ID NO: 519065 - DNA, 20 bp, mouse
ggtcaggccaacgtgcagcg

SEQ ID NO: 519066 - DNA, 20 bp, mouse
gagcagtctactgaggtgga

SEQ ID NO: 519067 - DNA, 20 bp, mouse
gactgacaagcagtctactg

SEQ ID NO: 519068 - DNA, 20 bp, mouse
gatactgagtagagctggga

SEQ ID NO: 519069 - DNA, 20 bp, mouse
gtggatggtaaagctgtgct

SEQ ID NO: 519070 - DNA, 20 bp, mouse
ggtttcactaccaacagaaa

SEQ ID NO: 519071 - DNA, 20 bp, mouse
ggcaactcacccctttctgt

SEQ ID NO: 519072 - DNA, 20 bp, mouse
gagttgatacagctatattt

SEQ ID NO: 519073 - DNA, 20 bp, mouse
gttaaatgaaactctaaaat

SEQ ID NO: 519074 - DNA, 20 bp, mouse
gaaaattggtatgactctct

SEQ ID NO: 519075 - DNA, 20 bp, mouse
gtgcatctggacaatgatta

SEQ ID NO: 519076 - DNA, 20 bp, mouse
gtctcggctgtagcttccag

SEQ ID NO: 519077 - DNA, 20 bp, mouse
ggccgagaatcagaccggga

SEQ ID NO: 519078 - DNA, 20 bp, mouse
gtccctcccggtctgattct

SEQ ID NO: 519079 - DNA, 20 bp, mouse
gtacagccgagaatcagacc

SEQ ID NO: 519080 - DNA, 20 bp, mouse
gcccaacccggcccgcagag

SEQ ID NO: 519081 - DNA, 20 bp, mouse
ggccgggaaccgccaaggac

SEQ ID NO: 519082 - DNA, 20 bp, mouse
gggagtcggcgacccctctg

SEQ ID NO: 519083 - DNA, 20 bp, mouse
gaagcagagacgccagtcct

SEQ ID NO: 519084 - DNA, 20 bp, mouse
gggcagcagcggggcagatc

SEQ ID NO: 519085 - DNA, 20 bp, mouse
gcagagacgccagtccttgg

SEQ ID NO: 519086 - DNA, 20 bp, mouse
gcctgtcggacctggagttg

SEQ ID NO: 519087 - DNA, 20 bp, mouse
gccggcggggaaggcgacag

SEQ ID NO: 519088 - DNA, 20 bp, mouse
gctcgcggcccagggagagg

SEQ ID NO: 519089 - DNA, 20 bp, mouse
gcaggcggcgcagcttgttg

SEQ ID NO: 519090 - DNA, 20 bp, mouse
gtccgagcgcaggacgctgg

SEQ ID NO: 519091 - DNA, 20 bp, mouse
gcagctctcgccgcaactcc

SEQ ID NO: 519092 - DNA, 20 bp, mouse
ggggaaggcgacagcggcca

SEQ ID NO: 519093 - DNA, 20 bp, mouse
gccggctgcgcgacgacgag

SEQ ID NO: 519094 - DNA, 20 bp, mouse
gatggccggcctgtcggacc

SEQ ID NO: 519095 - DNA, 20 bp, mouse
gccccatcaccgacaccacg

SEQ ID NO: 519096 - DNA, 20 bp, mouse
ggggccgcggcaacaagacg

SEQ ID NO: 519097 - DNA, 20 bp, mouse
gacccggagataagccgtaa

SEQ ID NO: 519098 - DNA, 20 bp, mouse
gcggagcttgtaaaacaccc

SEQ ID NO: 519099 - DNA, 20 bp, mouse
gcctcagcagctctcggatg

SEQ ID NO: 519100 - DNA, 20 bp, mouse
gtcggctgccgagagccccg

SEQ ID NO: 519101 - DNA, 20 bp, mouse
gtctagttcagggtctaggg

SEQ ID NO: 519102 - DNA, 20 bp, mouse
gcgggaaggcgccacctgag

SEQ ID NO: 519103 - DNA, 20 bp, mouse
gcggagataagccgtaacgg

SEQ ID NO: 519104 - DNA, 20 bp, mouse
gagcagcagcaccgggcggg

SEQ ID NO: 519105 - DNA, 20 bp, mouse
gccgtggcaggaggctccgg

SEQ ID NO: 519106 - DNA, 20 bp, mouse
ggggcatctctgagagagaa

SEQ ID NO: 519107 - DNA, 20 bp, mouse
gtggaggccagtgcctcgaa

SEQ ID NO: 519108 - DNA, 20 bp, mouse
gggaactgctggattaatgg

SEQ ID NO: 519109 - DNA, 20 bp, mouse
gctctcagagatgcccttcg

SEQ ID NO: 519110 - DNA, 20 bp, mouse
gatctctgagagagaagggc

SEQ ID NO: 519111 - DNA, 20 bp, mouse
gggcagactctcaggaggtg

SEQ ID NO: 519112 - DNA, 20 bp, mouse
gtggtgtcaggggtgacagg

SEQ ID NO: 519113 - DNA, 20 bp, mouse
ggctgaggagagattcccca

SEQ ID NO: 519114 - DNA, 20 bp, mouse
gccctcccctccccacctga

SEQ ID NO: 519115 - DNA, 20 bp, mouse
gggtgtggctgcagcttctg

SEQ ID NO: 519116 - DNA, 20 bp, mouse
gggacgtgccagctcttctt

SEQ ID NO: 519117 - DNA, 20 bp, mouse
ggacagtccgaggtcggcac

SEQ ID NO: 519118 - DNA, 20 bp, mouse
ggggcctgacagtccgaggt

SEQ ID NO: 519119 - DNA, 20 bp, mouse
ggagtgggcctgacagtccg

SEQ ID NO: 519120 - DNA, 20 bp, mouse
gtatcttgccgaagaagagc

SEQ ID NO: 519121 - DNA, 20 bp, mouse
gttcttcggcaagatattca

SEQ ID NO: 519122 - DNA, 20 bp, mouse
gagctggcacgtccggaaca

SEQ ID NO: 519123 - DNA, 20 bp, mouse
gggcaacattgtccttgttc

SEQ ID NO: 519124 - DNA, 20 bp, mouse
gatggctccagtgccgacct

SEQ ID NO: 519125 - DNA, 20 bp, mouse
ggaacacacagacccgctcc

SEQ ID NO: 519126 - DNA, 20 bp, mouse
gaccggctggctctagtctg

SEQ ID NO: 519127 - DNA, 20 bp, mouse
gcaagacagcgctcagtcac

SEQ ID NO: 519128 - DNA, 20 bp, mouse
gcccagggccagtagcagag

SEQ ID NO: 519129 - DNA, 20 bp, mouse
gcgctcccgggactcgttac

SEQ ID NO: 519130 - DNA, 20 bp, mouse
gactcgttaccggcggtcca

SEQ ID NO: 519131 - DNA, 20 bp, mouse
gcccgcaaggggtgcgtcta

SEQ ID NO: 519132 - DNA, 20 bp, mouse
ggagcggtcctagtgagtgt

SEQ ID NO: 519133 - DNA, 20 bp, mouse
gacagcgctcagtcaccggc

SEQ ID NO: 519134 - DNA, 20 bp, mouse
ggacgcgcacgcgcacgtag

SEQ ID NO: 519135 - DNA, 20 bp, mouse
ggggtcaatggagcccgcaa

SEQ ID NO: 519136 - DNA, 20 bp, mouse
ggaggccaaaggaccaggca

SEQ ID NO: 519137 - DNA, 20 bp, mouse
gagggcgtcagaatgtaaca

SEQ ID NO: 519138 - DNA, 20 bp, mouse
ggaacccctcccgcctcagg

SEQ ID NO: 519139 - DNA, 20 bp, mouse
gccctcccgcctcaggtgga

SEQ ID NO: 519140 - DNA, 20 bp, mouse
ggcggccctctaggaagaag

SEQ ID NO: 519141 - DNA, 20 bp, mouse
gtcccgcctcaggtggaagg

SEQ ID NO: 519142 - DNA, 20 bp, mouse
ggcgcgcaccgaagcgacag

SEQ ID NO: 519143 - DNA, 20 bp, mouse
gggccccgggatgtggctga

SEQ ID NO: 519144 - DNA, 20 bp, mouse
ggaagcgacagcggccctct

SEQ ID NO: 519145 - DNA, 20 bp, mouse
gggcctccttccacctgagg

SEQ ID NO: 519146 - DNA, 20 bp, mouse
ggctcgagccgagcaagcca

SEQ ID NO: 519147 - DNA, 20 bp, mouse
ggccgcggaccaagctgcta

SEQ ID NO: 519148 - DNA, 20 bp, mouse
gcaagctgctatggcggaca

SEQ ID NO: 519149 - DNA, 20 bp, mouse
ggctgctatggcggacatgg

SEQ ID NO: 519150 - DNA, 20 bp, mouse
gcggacatggaggacctctt

SEQ ID NO: 519151 - DNA, 20 bp, mouse
ggcggaccaagctgctatgg

SEQ ID NO: 519152 - DNA, 20 bp, mouse
gtggccatgtatgcacggag

SEQ ID NO: 519153 - DNA, 20 bp, mouse
gagagcgaggccgagcgcaa

SEQ ID NO: 519154 - DNA, 20 bp, mouse
gggtaacgccccgtgtgaaa

SEQ ID NO: 519155 - DNA, 20 bp, mouse
gggccggtccctgatcctcc

SEQ ID NO: 519156 - DNA, 20 bp, mouse
gctccagcagctgcaaggta

SEQ ID NO: 519157 - DNA, 20 bp, mouse
gcagctgcaaggtaaggccc

SEQ ID NO: 519158 - DNA, 20 bp, mouse
gtggagcagggatccctccg

SEQ ID NO: 519159 - DNA, 20 bp, mouse
ggcaggcatggagccccgga

SEQ ID NO: 519160 - DNA, 20 bp, mouse
gcgagggactctgcagacag

SEQ ID NO: 519161 - DNA, 20 bp, mouse
gctattagaaagactggtgg

SEQ ID NO: 519162 - DNA, 20 bp, mouse
ggaacaggttggtgccctgt

SEQ ID NO: 519163 - DNA, 20 bp, mouse
gggggtgctattagaaagac

SEQ ID NO: 519164 - DNA, 20 bp, mouse
gcaaggctggacgtgtagtg

SEQ ID NO: 519165 - DNA, 20 bp, mouse
gtcaggaaggcggaaagctg

SEQ ID NO: 519166 - DNA, 20 bp, mouse
gggtatgttgaggccatcta

SEQ ID NO: 519167 - DNA, 20 bp, mouse
gtctaaggcactgggtgtcg

SEQ ID NO: 519168 - DNA, 20 bp, mouse
ggcagaacgattcctcggtc

SEQ ID NO: 519169 - DNA, 20 bp, mouse
gaaaaaaccagacccgaccg

SEQ ID NO: 519170 - DNA, 20 bp, mouse
gtagcacctgggttcagctg

SEQ ID NO: 519171 - DNA, 20 bp, mouse
ggatttgcagaacgattcct

SEQ ID NO: 519172 - DNA, 20 bp, mouse
gcggggcgcgacgctactcg

SEQ ID NO: 519173 - DNA, 20 bp, mouse
gtgcctgcagaggagttctt

SEQ ID NO: 519174 - DNA, 20 bp, mouse
ggtttccgatttatcttcag

SEQ ID NO: 519175 - DNA, 20 bp, mouse
gcaagaaacccatggaggtt

SEQ ID NO: 519176 - DNA, 20 bp, mouse
gtggaggagcaaggccatgg

SEQ ID NO: 519177 - DNA, 20 bp, mouse
ggagcagtcccgttaagtgg

SEQ ID NO: 519178 - DNA, 20 bp, mouse
gcatggcggtgagcgaaagg

SEQ ID NO: 519179 - DNA, 20 bp, mouse
gggcgagcagtcccgttaag

SEQ ID NO: 519180 - DNA, 20 bp, mouse
gagctagagggtcctccaca

SEQ ID NO: 519181 - DNA, 20 bp, mouse
gggccatggcggtgagcgaa

SEQ ID NO: 519182 - DNA, 20 bp, mouse
gtccgccgcaacccgtaagg

SEQ ID NO: 519183 - DNA, 20 bp, mouse
ggccgcaacccgtaaggcgg

SEQ ID NO: 519184 - DNA, 20 bp, mouse
ggactccgccgcaacccgta

SEQ ID NO: 519185 - DNA, 20 bp, mouse
gtactgctgggagaccctag

SEQ ID NO: 519186 - DNA, 20 bp, mouse
gctgtcgcgcagcgggatca

SEQ ID NO: 519187 - DNA, 20 bp, mouse
gcgctgccggcggtcacctg

SEQ ID NO: 519188 - DNA, 20 bp, mouse
ggctcgctagccctcggagt

SEQ ID NO: 519189 - DNA, 20 bp, mouse
gagcgggatcacggcaggat

SEQ ID NO: 519190 - DNA, 20 bp, mouse
gtggcgtagagcaggtcgaa

SEQ ID NO: 519191 - DNA, 20 bp, mouse
gcgcgcagcgggatcacggc

SEQ ID NO: 519192 - DNA, 20 bp, mouse
ggacagccccaggtgaccgc

SEQ ID NO: 519193 - DNA, 20 bp, mouse
gggcagcgctgcggtcctgg

SEQ ID NO: 519194 - DNA, 20 bp, mouse
gtcgaacgtgagttgcggtg

SEQ ID NO: 519195 - DNA, 20 bp, mouse
gctagccctcggagttggag

SEQ ID NO: 519196 - DNA, 20 bp, mouse
gccaccgccgaagggaaatg

SEQ ID NO: 519197 - DNA, 20 bp, mouse
ggagcatggtgccagagtcg

SEQ ID NO: 519198 - DNA, 20 bp, mouse
gaaccgcaggagccggagca

SEQ ID NO: 519199 - DNA, 20 bp, mouse
ggaggctcgggggaccccgg

SEQ ID NO: 519200 - DNA, 20 bp, mouse
gaagcaacaaccgcaggagc

SEQ ID NO: 519201 - DNA, 20 bp, mouse
gtccgcgtagagcaagtcgg

SEQ ID NO: 519202 - DNA, 20 bp, mouse
gtctccgcatttcccttcgg

SEQ ID NO: 519203 - DNA, 20 bp, mouse
gccgtctccgcatttccctt

SEQ ID NO: 519204 - DNA, 20 bp, mouse
ggctgctgcgagaggcgctg

SEQ ID NO: 519205 - DNA, 20 bp, mouse
ggggaaatgcggagacggga

SEQ ID NO: 519206 - DNA, 20 bp, mouse
gcgagctggctggagcccga

SEQ ID NO: 519207 - DNA, 20 bp, mouse
gggagcagccggcgaccgtc

SEQ ID NO: 519208 - DNA, 20 bp, mouse
gcatggctcgcggggcgtgg

SEQ ID NO: 519209 - DNA, 20 bp, mouse
ggagagcgcgcgctacctgg

SEQ ID NO: 519210 - DNA, 20 bp, mouse
ggacccagcaggagctccgg

SEQ ID NO: 519211 - DNA, 20 bp, mouse
gggctgctccgtaagcctcc

SEQ ID NO: 519212 - DNA, 20 bp, mouse
gaagcctccgggcgcggtgc

SEQ ID NO: 519213 - DNA, 20 bp, mouse
ggcccggacggcgaccacga

SEQ ID NO: 519214 - DNA, 20 bp, mouse
ggctgggctggagcccgagc

SEQ ID NO: 519215 - DNA, 20 bp, mouse
gcagctgccgcggtgggtaa

SEQ ID NO: 519216 - DNA, 20 bp, mouse
gcccccgcctgggaactgac

SEQ ID NO: 519217 - DNA, 20 bp, mouse
gccctggctagtctgggtgt

SEQ ID NO: 519218 - DNA, 20 bp, mouse
ggagacatggcgggcgttaa

SEQ ID NO: 519219 - DNA, 20 bp, mouse
gacactgcgaccctcgcccg

SEQ ID NO: 519220 - DNA, 20 bp, mouse
ggaccccacccactagccgc

SEQ ID NO: 519221 - DNA, 20 bp, mouse
gacccactagccgcgggcga

SEQ ID NO: 519222 - DNA, 20 bp, mouse
gaccctcgcccgcggctagt

SEQ ID NO: 519223 - DNA, 20 bp, mouse
gtggctagtctgggtgtggg

SEQ ID NO: 519224 - DNA, 20 bp, mouse
gacgggagaagcccccgcct

SEQ ID NO: 519225 - DNA, 20 bp, mouse
gtgtggaacgtacagcccac

SEQ ID NO: 519226 - DNA, 20 bp, mouse
gggagacccgagacgcgcgg

SEQ ID NO: 519227 - DNA, 20 bp, mouse
gccgggagacccgagacgcg

SEQ ID NO: 519228 - DNA, 20 bp, mouse
ggacccgagacgcgcggcgg

SEQ ID NO: 519229 - DNA, 20 bp, mouse
ggcggcggccagacaacacc

SEQ ID NO: 519230 - DNA, 20 bp, mouse
gccgcccctggaccagaacg

SEQ ID NO: 519231 - DNA, 20 bp, mouse
gcctggctccacgacccggg

SEQ ID NO: 519232 - DNA, 20 bp, mouse
gcgctcctggctccacgacc

SEQ ID NO: 519233 - DNA, 20 bp, mouse
gggctccacgacccgggcgg

SEQ ID NO: 519234 - DNA, 20 bp, mouse
gaggagcgacgtcaccgcca

SEQ ID NO: 519235 - DNA, 20 bp, mouse
gccgccatggcgggcatcaa

SEQ ID NO: 519236 - DNA, 20 bp, mouse
gatccgcagcggccatgtcc

SEQ ID NO: 519237 - DNA, 20 bp, mouse
gtgacggcagaggttggctc

SEQ ID NO: 519238 - DNA, 20 bp, mouse
gaaggacccggcatccgcag

SEQ ID NO: 519239 - DNA, 20 bp, mouse
gagatccgccgaggaagctg

SEQ ID NO: 519240 - DNA, 20 bp, mouse
gtcccggcacaaacgtccgt

SEQ ID NO: 519241 - DNA, 20 bp, mouse
gagcccgcgcggacggttga

SEQ ID NO: 519242 - DNA, 20 bp, mouse
gtgccgggacatggccgctg

SEQ ID NO: 519243 - DNA, 20 bp, mouse
gcgcggacggttgacggcag

SEQ ID NO: 519244 - DNA, 20 bp, mouse
gaacgtccgtaggcgcgggg

SEQ ID NO: 519245 - DNA, 20 bp, mouse
gcccgcggggaggcggcccg

SEQ ID NO: 519246 - DNA, 20 bp, mouse
gggccttagtcacctcgcag

SEQ ID NO: 519247 - DNA, 20 bp, mouse
ggggagagatcggggttgac

SEQ ID NO: 519248 - DNA, 20 bp, mouse
ggtcacctcgcagcggacaa

SEQ ID NO: 519249 - DNA, 20 bp, mouse
gcagcggacaagggctccct

SEQ ID NO: 519250 - DNA, 20 bp, mouse
gggttgacgggagacgccga

SEQ ID NO: 519251 - DNA, 20 bp, mouse
ggggaggaattgggaaggta

SEQ ID NO: 519252 - DNA, 20 bp, mouse
gaagtttaggggagagatcg

SEQ ID NO: 519253 - DNA, 20 bp, mouse
ggtggggtcaggtacaccgt

SEQ ID NO: 519254 - DNA, 20 bp, mouse
ggtccgctgcgaggtgacta

SEQ ID NO: 519255 - DNA, 20 bp, mouse
ggagaatgtccaaagtttag

SEQ ID NO: 519256 - DNA, 20 bp, mouse
gcgggtgacaaagggtccag

SEQ ID NO: 519257 - DNA, 20 bp, mouse
gcaaggcaggggatcccgag

SEQ ID NO: 519258 - DNA, 20 bp, mouse
ggcgctgtccagggtgtgct

SEQ ID NO: 519259 - DNA, 20 bp, mouse
ggtgaagatggcgctgtcca

SEQ ID NO: 519260 - DNA, 20 bp, mouse
gccatcttcacagcagggga

SEQ ID NO: 519261 - DNA, 20 bp, mouse
gggcaggggatcccgagagg

SEQ ID NO: 519262 - DNA, 20 bp, mouse
gtgcggggcgcactctgacc

SEQ ID NO: 519263 - DNA, 20 bp, mouse
gagcgccatcttcacagcag

SEQ ID NO: 519264 - DNA, 20 bp, mouse
ggttagggttggtatgagag

SEQ ID NO: 519265 - DNA, 20 bp, mouse
ggtggacacggagtacggag

SEQ ID NO: 519266 - DNA, 20 bp, mouse
gctcgggcagccggaccagt

SEQ ID NO: 519267 - DNA, 20 bp, mouse
gccgcaccgctggagcatgg

SEQ ID NO: 519268 - DNA, 20 bp, mouse
gcagccggaccagttggcac

SEQ ID NO: 519269 - DNA, 20 bp, mouse
gagaggcgcgcagctggacc

SEQ ID NO: 519270 - DNA, 20 bp, mouse
ggctggagcatggtggccgg

SEQ ID NO: 519271 - DNA, 20 bp, mouse
gctgggatagatattacgtg

SEQ ID NO: 519272 - DNA, 20 bp, mouse
gccggcttcagggtccaggg

SEQ ID NO: 519273 - DNA, 20 bp, mouse
gcggccgcaccgctggagca

SEQ ID NO: 519274 - DNA, 20 bp, mouse
ggcctggcgggctcctctgg

SEQ ID NO: 519275 - DNA, 20 bp, mouse
gtaagagttcctgaagcgag

SEQ ID NO: 519276 - DNA, 20 bp, mouse
gtgctggtggagcaggtctc

SEQ ID NO: 519277 - DNA, 20 bp, mouse
ggagggtcccgcactcacac

SEQ ID NO: 519278 - DNA, 20 bp, mouse
gctggggcccgtctctcggg

SEQ ID NO: 519279 - DNA, 20 bp, mouse
gggcctggggcccgtctctc

SEQ ID NO: 519280 - DNA, 20 bp, mouse
gcccctagaccttggaacag

SEQ ID NO: 519281 - DNA, 20 bp, mouse
gggccacccggggaaaaggg

SEQ ID NO: 519282 - DNA, 20 bp, mouse
gggactgagcagaagcagat

SEQ ID NO: 519283 - DNA, 20 bp, mouse
ggaagactccacccgagaga

SEQ ID NO: 519284 - DNA, 20 bp, mouse
gtgctcagtcccctagacct

SEQ ID NO: 519285 - DNA, 20 bp, mouse
gttctgactgctggtggagc

SEQ ID NO: 519286 - DNA, 20 bp, mouse
gcttcagcggatagtaggaa

SEQ ID NO: 519287 - DNA, 20 bp, mouse
gtgggccttcagcggatagt

SEQ ID NO: 519288 - DNA, 20 bp, mouse
gggccggctcatttcagcga

SEQ ID NO: 519289 - DNA, 20 bp, mouse
gcttggagccgacctgggag

SEQ ID NO: 519290 - DNA, 20 bp, mouse
gttgctggaatcaggatcag

SEQ ID NO: 519291 - DNA, 20 bp, mouse
gtcaccgggtggaagactgg

SEQ ID NO: 519292 - DNA, 20 bp, mouse
gtgctgtaccatcatagcgg

SEQ ID NO: 519293 - DNA, 20 bp, mouse
gtgcttcttggagccgacct

SEQ ID NO: 519294 - DNA, 20 bp, mouse
ggaaactcccgcgcgtccag

SEQ ID NO: 519295 - DNA, 20 bp, mouse
gaagcacttggccacttcaa

SEQ ID NO: 519296 - DNA, 20 bp, mouse
gccaggagctgtcaccatgt

SEQ ID NO: 519297 - DNA, 20 bp, mouse
ggccagcatcctcaccgaca

SEQ ID NO: 519298 - DNA, 20 bp, mouse
gaccttgagcacaaacctct

SEQ ID NO: 519299 - DNA, 20 bp, mouse
gctctcccagttgctcctag

SEQ ID NO: 519300 - DNA, 20 bp, mouse
gaccatgtcggtgaggatgc

SEQ ID NO: 519301 - DNA, 20 bp, mouse
ggaccccagaagccgggtgg

SEQ ID NO: 519302 - DNA, 20 bp, mouse
gacaaacctctaggagcaac

SEQ ID NO: 519303 - DNA, 20 bp, mouse
gttataagcctgaccaagag

SEQ ID NO: 519304 - DNA, 20 bp, mouse
gatggaccccagaagccggg

SEQ ID NO: 519305 - DNA, 20 bp, mouse
gaagagaagggtggcaataa

SEQ ID NO: 519306 - DNA, 20 bp, mouse
gggcgggtggagcactaatc

SEQ ID NO: 519307 - DNA, 20 bp, mouse
ggctctgacagctagcggag

SEQ ID NO: 519308 - DNA, 20 bp, mouse
gggagcactaatcaggtgag

SEQ ID NO: 519309 - DNA, 20 bp, mouse
gggcacagagagcactaccc

SEQ ID NO: 519310 - DNA, 20 bp, mouse
ggcccagctctgacagctag

SEQ ID NO: 519311 - DNA, 20 bp, mouse
gctgacagctagcggagcgg

SEQ ID NO: 519312 - DNA, 20 bp, mouse
gacccgcaggagagccaagg

SEQ ID NO: 519313 - DNA, 20 bp, mouse
gctctcctgcgggtaactct

SEQ ID NO: 519314 - DNA, 20 bp, mouse
gctaggggccagctacaagg

SEQ ID NO: 519315 - DNA, 20 bp, mouse
gctacaaggtggatctccgt

SEQ ID NO: 519316 - DNA, 20 bp, mouse
gtacaaaggcattctaacta

SEQ ID NO: 519317 - DNA, 20 bp, mouse
ggcacagccagcagggttag

SEQ ID NO: 519318 - DNA, 20 bp, mouse
gtctaactagggcagcgcgc

SEQ ID NO: 519319 - DNA, 20 bp, mouse
gcagctctgcacagccagca

SEQ ID NO: 519320 - DNA, 20 bp, mouse
ggagctgagtgtgttggatc

SEQ ID NO: 519321 - DNA, 20 bp, mouse
ggggcagggtggccaagagt

SEQ ID NO: 519322 - DNA, 20 bp, mouse
gaagcttgatgaaacttggg

SEQ ID NO: 519323 - DNA, 20 bp, mouse
gaaaggaatgatacttgggt

SEQ ID NO: 519324 - DNA, 20 bp, mouse
gagcttagactggctaaagc

SEQ ID NO: 519325 - DNA, 20 bp, mouse
ggttagaatgcctttgtagc

SEQ ID NO: 519326 - DNA, 20 bp, mouse
gcagtggctgaaggcagtcc

SEQ ID NO: 519327 - DNA, 20 bp, mouse
ggtactgaatgagccagcat

SEQ ID NO: 519328 - DNA, 20 bp, mouse
ggcagcgaggcagtggctga

SEQ ID NO: 519329 - DNA, 20 bp, mouse
gcacaggagccaatacagtt

SEQ ID NO: 519330 - DNA, 20 bp, mouse
gactcacctgggagcaagag

SEQ ID NO: 519331 - DNA, 20 bp, mouse
gaacagctgaaggggtgagt

SEQ ID NO: 519332 - DNA, 20 bp, mouse
gctgctgaacagtctacaga

SEQ ID NO: 519333 - DNA, 20 bp, mouse
gttatccccggccccctcct

SEQ ID NO: 519334 - DNA, 20 bp, mouse
ggctgtccactggatgacag

SEQ ID NO: 519335 - DNA, 20 bp, mouse
gagtaggtaggtttagtcct

SEQ ID NO: 519336 - DNA, 20 bp, mouse
gtagcccggtgctggaacat

SEQ ID NO: 519337 - DNA, 20 bp, mouse
gctggagagaagagatgtgt

SEQ ID NO: 519338 - DNA, 20 bp, mouse
gatctcaccggattgtaggt

SEQ ID NO: 519339 - DNA, 20 bp, mouse
ggctcaggtgggcatctcac

SEQ ID NO: 519340 - DNA, 20 bp, mouse
gaccaggtgaagagcctcag

SEQ ID NO: 519341 - DNA, 20 bp, mouse
gctgggatgggtctcttgta

SEQ ID NO: 519342 - DNA, 20 bp, mouse
ggcgggggagatgagactta

SEQ ID NO: 519343 - DNA, 20 bp, mouse
gtgtaggtgggctggtagcc

SEQ ID NO: 519344 - DNA, 20 bp, mouse
gaggcgaaggcccctccctg

SEQ ID NO: 519345 - DNA, 20 bp, mouse
gtctgggctgatagcttgcc

SEQ ID NO: 519346 - DNA, 20 bp, mouse
ggtatacttacagacatggc

SEQ ID NO: 519347 - DNA, 20 bp, mouse
ggggatgcagattaacggag

SEQ ID NO: 519348 - DNA, 20 bp, mouse
gagtatactggggcccaagc

SEQ ID NO: 519349 - DNA, 20 bp, mouse
gtgcctcagggcgtccgcgt

SEQ ID NO: 519350 - DNA, 20 bp, mouse
gcaagagggatgcagattaa

SEQ ID NO: 519351 - DNA, 20 bp, mouse
gagcctgtaagaattgggtg

SEQ ID NO: 519352 - DNA, 20 bp, mouse
gcaatgtggccagtcgctgt

SEQ ID NO: 519353 - DNA, 20 bp, mouse
gcagcaatacagcaacaatg

SEQ ID NO: 519354 - DNA, 20 bp, mouse
ggtggccagtcgctgtggga

SEQ ID NO: 519355 - DNA, 20 bp, mouse
gggaccaggcagaaaccaag

SEQ ID NO: 519356 - DNA, 20 bp, mouse
gcagtcgccaggactcaccc

SEQ ID NO: 519357 - DNA, 20 bp, mouse
gtcgccaggactcaccccgg

SEQ ID NO: 519358 - DNA, 20 bp, mouse
gtccgtcaggggacacaagt

SEQ ID NO: 519359 - DNA, 20 bp, mouse
gggacaccgggagcgatcgt

SEQ ID NO: 519360 - DNA, 20 bp, mouse
ggattccggtccgggaacag

SEQ ID NO: 519361 - DNA, 20 bp, mouse
gctaccaccggggtgagtcc

SEQ ID NO: 519362 - DNA, 20 bp, mouse
gaccggacggcgtccgtcag

SEQ ID NO: 519363 - DNA, 20 bp, mouse
gaaagcgcttactaccaccg

SEQ ID NO: 519364 - DNA, 20 bp, mouse
gtggcaggtgagccgccgag

SEQ ID NO: 519365 - DNA, 20 bp, mouse
gactgcgggctcagggacat

SEQ ID NO: 519366 - DNA, 20 bp, mouse
gtgtcgtccaccatcgagtg

SEQ ID NO: 519367 - DNA, 20 bp, mouse
ggccatctcttctatctcag

SEQ ID NO: 519368 - DNA, 20 bp, mouse
gtctcttcctcactcgatgg

SEQ ID NO: 519369 - DNA, 20 bp, mouse
gtgctctcttcctcactcga

SEQ ID NO: 519370 - DNA, 20 bp, mouse
gcagaactctgcgcagggca

SEQ ID NO: 519371 - DNA, 20 bp, mouse
gtcccctgagatagaagaga

SEQ ID NO: 519372 - DNA, 20 bp, mouse
ggtggcacagatagagggtg

SEQ ID NO: 519373 - DNA, 20 bp, mouse
gagctaacggccacatccag

SEQ ID NO: 519374 - DNA, 20 bp, mouse
ggacgacagaactctgcgca

SEQ ID NO: 519375 - DNA, 20 bp, mouse
gctgtggggaaacaacggag

SEQ ID NO: 519376 - DNA, 20 bp, mouse
ggccgctgcactcaccacca

SEQ ID NO: 519377 - DNA, 20 bp, mouse
ggccgacagcgacgccgtgg

SEQ ID NO: 519378 - DNA, 20 bp, mouse
ggccgtggtggtgagtgcag

SEQ ID NO: 519379 - DNA, 20 bp, mouse
gggcgctcgctgcaggaaca

SEQ ID NO: 519380 - DNA, 20 bp, mouse
gtcgctgcaggaacatggcg

SEQ ID NO: 519381 - DNA, 20 bp, mouse
gtgcaggaacatggcggggt

SEQ ID NO: 519382 - DNA, 20 bp, mouse
gggcggcgcggagatcgcgg

SEQ ID NO: 519383 - DNA, 20 bp, mouse
ggtggccgacagcgacgccg

SEQ ID NO: 519384 - DNA, 20 bp, mouse
gaggaacatggcggggtcgg

SEQ ID NO: 519385 - DNA, 20 bp, mouse
ggcgaggcgggtagctcaga

SEQ ID NO: 519386 - DNA, 20 bp, mouse
gagaagccctgttcatgtgt

SEQ ID NO: 519387 - DNA, 20 bp, mouse
gtctttgctacaagtacaca

SEQ ID NO: 519388 - DNA, 20 bp, mouse
gattgtcttgctctaagaac

SEQ ID NO: 519389 - DNA, 20 bp, mouse
ggctacaagtacacacggca

SEQ ID NO: 519390 - DNA, 20 bp, mouse
gaatatccccacacatgaac

SEQ ID NO: 519391 - DNA, 20 bp, mouse
gacagtgagataacatcagg

SEQ ID NO: 519392 - DNA, 20 bp, mouse
gtacacacggcagggcattt

SEQ ID NO: 519393 - DNA, 20 bp, mouse
gttagtgctgtcaaatggtc

SEQ ID NO: 519394 - DNA, 20 bp, mouse
gcggataatgtccagggtgg

SEQ ID NO: 519395 - DNA, 20 bp, mouse
gcttacagtgagataacatc

SEQ ID NO: 519396 - DNA, 20 bp, mouse
gcccagcgccgcagcagacg

SEQ ID NO: 519397 - DNA, 20 bp, mouse
gagcagcgctggcggccgat

SEQ ID NO: 519398 - DNA, 20 bp, mouse
gctggcggccgatcggcaag

SEQ ID NO: 519399 - DNA, 20 bp, mouse
ggctcggcctcccacacccg

SEQ ID NO: 519400 - DNA, 20 bp, mouse
ggcgctgctggcgaggacgc

SEQ ID NO: 519401 - DNA, 20 bp, mouse
ggcggcacccgcgtctgctg

SEQ ID NO: 519402 - DNA, 20 bp, mouse
gctgcgcgctcggcgggatg

SEQ ID NO: 519403 - DNA, 20 bp, mouse
gcccgccgagcgcgcaggtg

SEQ ID NO: 519404 - DNA, 20 bp, mouse
ggccgagcgcgcaggtgagg

SEQ ID NO: 519405 - DNA, 20 bp, mouse
gccggcatggcgctatggag

SEQ ID NO: 519406 - DNA, 20 bp, mouse
gcgaggtcaggaggaatagg

SEQ ID NO: 519407 - DNA, 20 bp, mouse
ggcagcgctccggagctgaa

SEQ ID NO: 519408 - DNA, 20 bp, mouse
gatcagcgcccgaggtcagg

SEQ ID NO: 519409 - DNA, 20 bp, mouse
gctggtgccacccgctctct

SEQ ID NO: 519410 - DNA, 20 bp, mouse
ggaactgggaccgcaactac

SEQ ID NO: 519411 - DNA, 20 bp, mouse
ggtggcgcctagagagcggg

SEQ ID NO: 519412 - DNA, 20 bp, mouse
gtaggtggcgcctagagagc

SEQ ID NO: 519413 - DNA, 20 bp, mouse
ggcaatcagcgcccgaggtc

SEQ ID NO: 519414 - DNA, 20 bp, mouse
gggactgcaatcagcgcccg

SEQ ID NO: 519415 - DNA, 20 bp, mouse
gccagttccgcgcagcgctc

SEQ ID NO: 519416 - DNA, 20 bp, mouse
gatgtgcctagcagaagggt

SEQ ID NO: 519417 - DNA, 20 bp, mouse
gcaagtgagatcagtgtggg

SEQ ID NO: 519418 - DNA, 20 bp, mouse
gcttctgctaggcacatccc

SEQ ID NO: 519419 - DNA, 20 bp, mouse
gctgccaaggctgccaccct

SEQ ID NO: 519420 - DNA, 20 bp, mouse
gagtgggaaggatgtcccca

SEQ ID NO: 519421 - DNA, 20 bp, mouse
gatagaataatagaaagata

SEQ ID NO: 519422 - DNA, 20 bp, mouse
gggcagagatcacagaggat

SEQ ID NO: 519423 - DNA, 20 bp, mouse
gaagatcgagaggcatccca

SEQ ID NO: 519424 - DNA, 20 bp, mouse
gccccagggtggagaccaga

SEQ ID NO: 519425 - DNA, 20 bp, mouse
gaaccccagttggggagagt

SEQ ID NO: 519426 - DNA, 20 bp, mouse
ggcggtgactgcagaaccgt

SEQ ID NO: 519427 - DNA, 20 bp, mouse
ggcgacgcccggaattccca

SEQ ID NO: 519428 - DNA, 20 bp, mouse
gacagcggggcggactctag

SEQ ID NO: 519429 - DNA, 20 bp, mouse
gcctgggcgggtgatcgccg

SEQ ID NO: 519430 - DNA, 20 bp, mouse
ggcagaaccgtgggaattcc

SEQ ID NO: 519431 - DNA, 20 bp, mouse
gccggggtccccgattacct

SEQ ID NO: 519432 - DNA, 20 bp, mouse
ggccctggagggcgaaactg

SEQ ID NO: 519433 - DNA, 20 bp, mouse
ggggtccccgattacctggg

SEQ ID NO: 519434 - DNA, 20 bp, mouse
ggtaatcggggaccccgggg

SEQ ID NO: 519435 - DNA, 20 bp, mouse
gaggacccgcgccccatgag

SEQ ID NO: 519436 - DNA, 20 bp, mouse
gcgagcgtgcaaccctagaa

SEQ ID NO: 519437 - DNA, 20 bp, mouse
ggtccgcgctctccccgagg

SEQ ID NO: 519438 - DNA, 20 bp, mouse
ggggagagcgcggacaacca

SEQ ID NO: 519439 - DNA, 20 bp, mouse
gcggagcgggagccgcctcg

SEQ ID NO: 519440 - DNA, 20 bp, mouse
ggttgtccgcgctctccccg

SEQ ID NO: 519441 - DNA, 20 bp, mouse
gcggcggccaggggctcccg

SEQ ID NO: 519442 - DNA, 20 bp, mouse
ggggaaaaggacgcgcggag

SEQ ID NO: 519443 - DNA, 20 bp, mouse
gtagaagggaaaaggacgcg

SEQ ID NO: 519444 - DNA, 20 bp, mouse
gcagccgctctgggccgggt

SEQ ID NO: 519445 - DNA, 20 bp, mouse
gagggttgcacgctcgcctc

SEQ ID NO: 519446 - DNA, 20 bp, mouse
gtgcggcgacttcagagaga

SEQ ID NO: 519447 - DNA, 20 bp, mouse
gacaacgctcacagccactg

SEQ ID NO: 519448 - DNA, 20 bp, mouse
gttcagagagagggctcccg

SEQ ID NO: 519449 - DNA, 20 bp, mouse
gcagcagcgccagcaaggac

SEQ ID NO: 519450 - DNA, 20 bp, mouse
gccccggcgctgccctctac

SEQ ID NO: 519451 - DNA, 20 bp, mouse
ggagggctcccgaggccggt

SEQ ID NO: 519452 - DNA, 20 bp, mouse
ggggaccgcgcagagaatcg

SEQ ID NO: 519453 - DNA, 20 bp, mouse
gcagagaatcgtggtcccac

SEQ ID NO: 519454 - DNA, 20 bp, mouse
ggagagagggctcccgaggc

SEQ ID NO: 519455 - DNA, 20 bp, mouse
ggtccatggtgcccgagact

SEQ ID NO: 519456 - DNA, 20 bp, mouse
gcccaagccaagtcgagcgg

SEQ ID NO: 519457 - DNA, 20 bp, mouse
ggccacagcgccaggagccc

SEQ ID NO: 519458 - DNA, 20 bp, mouse
ggggacggtgcagtcagaga

SEQ ID NO: 519459 - DNA, 20 bp, mouse
gccgagctcggagcagtcag

SEQ ID NO: 519460 - DNA, 20 bp, mouse
gccagcaggtgagtactcac

SEQ ID NO: 519461 - DNA, 20 bp, mouse
gcgacttggcttgggcgcgg

SEQ ID NO: 519462 - DNA, 20 bp, mouse
gcgagatgcacagcccgcct

SEQ ID NO: 519463 - DNA, 20 bp, mouse
gtccgagctcgggctctcag

SEQ ID NO: 519464 - DNA, 20 bp, mouse
ggcgcccaagccaagtcgag

SEQ ID NO: 519465 - DNA, 20 bp, mouse
ggcaacgcccccgctcgact

SEQ ID NO: 519466 - DNA, 20 bp, mouse
ggaagggagtgtggatgcca

SEQ ID NO: 519467 - DNA, 20 bp, mouse
ggacgaaggggacctcgcac

SEQ ID NO: 519468 - DNA, 20 bp, mouse
ggaaggggacctcgcacagg

SEQ ID NO: 519469 - DNA, 20 bp, mouse
gccctgaagccattgctgaa

SEQ ID NO: 519470 - DNA, 20 bp, mouse
ggttgacatgaccgacgaag

SEQ ID NO: 519471 - DNA, 20 bp, mouse
ggtgggaatgagggcacggt

SEQ ID NO: 519472 - DNA, 20 bp, mouse
gttcttacataaatcagccg

SEQ ID NO: 519473 - DNA, 20 bp, mouse
ggcttcctacctcctgtgcg

SEQ ID NO: 519474 - DNA, 20 bp, mouse
gtcactagatgcaagctcca

SEQ ID NO: 519475 - DNA, 20 bp, mouse
gatcagtgggaatgagggca

SEQ ID NO: 519476 - DNA, 20 bp, mouse
gggcccatatcgaagagcta

SEQ ID NO: 519477 - DNA, 20 bp, mouse
gttcagaaatgggagaccaa

SEQ ID NO: 519478 - DNA, 20 bp, mouse
ggaaccctagctcttcgata

SEQ ID NO: 519479 - DNA, 20 bp, mouse
gctctgggaagccaagaaac

SEQ ID NO: 519480 - DNA, 20 bp, mouse
gtcttcgatatgggccccct

SEQ ID NO: 519481 - DNA, 20 bp, mouse
ggctagggttcgacctgcca

SEQ ID NO: 519482 - DNA, 20 bp, mouse
ggagcctggataccaggagt

SEQ ID NO: 519483 - DNA, 20 bp, mouse
ggcctactctccaggtgaga

SEQ ID NO: 519484 - DNA, 20 bp, mouse
ggccggtgggatccagtggt

SEQ ID NO: 519485 - DNA, 20 bp, mouse
gaggaaagaagactagggtt

SEQ ID NO: 519486 - DNA, 20 bp, mouse
gggctccaggtaagatggta

SEQ ID NO: 519487 - DNA, 20 bp, mouse
gaagccaggtgcccaaggta

SEQ ID NO: 519488 - DNA, 20 bp, mouse
gcaggtgcccaaggtaggga

SEQ ID NO: 519489 - DNA, 20 bp, mouse
gggagaggctccaggtaaga

SEQ ID NO: 519490 - DNA, 20 bp, mouse
ggaaggtatcaagaatggag

SEQ ID NO: 519491 - DNA, 20 bp, mouse
gggtaagatggtagggccca

SEQ ID NO: 519492 - DNA, 20 bp, mouse
gcacaaggctgtccatctat

SEQ ID NO: 519493 - DNA, 20 bp, mouse
gtgggattgggaagtaccct

SEQ ID NO: 519494 - DNA, 20 bp, mouse
gctatgggtttggtgggatt

SEQ ID NO: 519495 - DNA, 20 bp, mouse
ggtccatctatgggtttggt

SEQ ID NO: 519496 - DNA, 20 bp, mouse
gaggctggcgggccatgggg

SEQ ID NO: 519497 - DNA, 20 bp, mouse
gctcaggctggcgggccatg

SEQ ID NO: 519498 - DNA, 20 bp, mouse
ggcctgagtgtgagctccgg

SEQ ID NO: 519499 - DNA, 20 bp, mouse
gccggctctgagacagctgc

SEQ ID NO: 519500 - DNA, 20 bp, mouse
gagcatactggcctagccac

SEQ ID NO: 519501 - DNA, 20 bp, mouse
gaggagtgagaagttgacca

SEQ ID NO: 519502 - DNA, 20 bp, mouse
ggccgggacccgccgcccca

SEQ ID NO: 519503 - DNA, 20 bp, mouse
gtacgggcgggccccccggg

SEQ ID NO: 519504 - DNA, 20 bp, mouse
gtcgcccgactgtgagtaca

SEQ ID NO: 519505 - DNA, 20 bp, mouse
ggcgccctgtactcacagtc

SEQ ID NO: 519506 - DNA, 20 bp, mouse
ggtgcggcccgggaacacgg

SEQ ID NO: 519507 - DNA, 20 bp, mouse
gaggcgagtctggagagctg

SEQ ID NO: 519508 - DNA, 20 bp, mouse
ggccgtgcggcccgggaaca

SEQ ID NO: 519509 - DNA, 20 bp, mouse
ggccggcgggctctccgggt

SEQ ID NO: 519510 - DNA, 20 bp, mouse
gactatcccgacggagatcg

SEQ ID NO: 519511 - DNA, 20 bp, mouse
gcgcagccggcgggctctcc

SEQ ID NO: 519512 - DNA, 20 bp, mouse
gcctggacgcgcgagagtgg

SEQ ID NO: 519513 - DNA, 20 bp, mouse
gtccgtcgggatagtggcaa

SEQ ID NO: 519514 - DNA, 20 bp, mouse
gcggcatccaccgtgttccc

SEQ ID NO: 519515 - DNA, 20 bp, mouse
gcgcctgccaaagctggagc

SEQ ID NO: 519516 - DNA, 20 bp, mouse
gcagcttgtcagacagggat

SEQ ID NO: 519517 - DNA, 20 bp, mouse
gtctcacagcttgtcagaca

SEQ ID NO: 519518 - DNA, 20 bp, mouse
gatcactgcaaagagcaact

SEQ ID NO: 519519 - DNA, 20 bp, mouse
gaggacaggaagcctgagaa

SEQ ID NO: 519520 - DNA, 20 bp, mouse
gactacagcaggctgccctt

SEQ ID NO: 519521 - DNA, 20 bp, mouse
gaaatctgaaccaggcgaaa

SEQ ID NO: 519522 - DNA, 20 bp, mouse
gaggttaccaagtcccttgg

SEQ ID NO: 519523 - DNA, 20 bp, mouse
gaggcaaacaaccaactatg

SEQ ID NO: 519524 - DNA, 20 bp, mouse
gacaaggtttgaagacctaa

SEQ ID NO: 519525 - DNA, 20 bp, mouse
gctgatcccctcataagact

SEQ ID NO: 519526 - DNA, 20 bp, mouse
ggatcgaggctgcagcgagg

SEQ ID NO: 519527 - DNA, 20 bp, mouse
ggtccgccggggccagatcg

SEQ ID NO: 519528 - DNA, 20 bp, mouse
gccagatcgaggctgcagcg

SEQ ID NO: 519529 - DNA, 20 bp, mouse
gcggcacagagagcccggct

SEQ ID NO: 519530 - DNA, 20 bp, mouse
gcgagggcgggagcagacga

SEQ ID NO: 519531 - DNA, 20 bp, mouse
gacgcgcccgggccagagcg

SEQ ID NO: 519532 - DNA, 20 bp, mouse
gggccccggcggacccgcag

SEQ ID NO: 519533 - DNA, 20 bp, mouse
gagcctcgatctggccccgg

SEQ ID NO: 519534 - DNA, 20 bp, mouse
gtaacgccccgctctggccc

SEQ ID NO: 519535 - DNA, 20 bp, mouse
gcgcccctgcgggtccgccg

SEQ ID NO: 519536 - DNA, 20 bp, mouse
gaggtccgggaaggaagtct

SEQ ID NO: 519537 - DNA, 20 bp, mouse
ggtagcgaggaggtccggga

SEQ ID NO: 519538 - DNA, 20 bp, mouse
ggagggtccagagcatcgag

SEQ ID NO: 519539 - DNA, 20 bp, mouse
gggtcgctcagtccggtccg

SEQ ID NO: 519540 - DNA, 20 bp, mouse
gtgcttctgctgcctcggac

SEQ ID NO: 519541 - DNA, 20 bp, mouse
ggggaaggaagtctcggcga

SEQ ID NO: 519542 - DNA, 20 bp, mouse
ggtaagtagcgaggaggtcc

SEQ ID NO: 519543 - DNA, 20 bp, mouse
gcggcgagggtcgctcagtc

SEQ ID NO: 519544 - DNA, 20 bp, mouse
gagcagtgaggtctggatcc

SEQ ID NO: 519545 - DNA, 20 bp, mouse
gggaaagccaagacccgcag

SEQ ID NO: 519546 - DNA, 20 bp, mouse
gtgctcgatgctcctaacag

SEQ ID NO: 519547 - DNA, 20 bp, mouse
ggaggacgccgcctgggcca

SEQ ID NO: 519548 - DNA, 20 bp, mouse
ggcggttgccttggcccagg

SEQ ID NO: 519549 - DNA, 20 bp, mouse
ggagccgctgggcccgggta

SEQ ID NO: 519550 - DNA, 20 bp, mouse
gccaggcggcgtcctctgcg

SEQ ID NO: 519551 - DNA, 20 bp, mouse
gggccaaggcaaccgctgtt

SEQ ID NO: 519552 - DNA, 20 bp, mouse
gcttgctccggctctccccg

SEQ ID NO: 519553 - DNA, 20 bp, mouse
gaccggcagggctcaagctc

SEQ ID NO: 519554 - DNA, 20 bp, mouse
gagaagccggggctgaatgt

SEQ ID NO: 519555 - DNA, 20 bp, mouse
ggggacggctgatccgggac

SEQ ID NO: 519556 - DNA, 20 bp, mouse
gaccctggccgacctagagg

SEQ ID NO: 519557 - DNA, 20 bp, mouse
gagcccatcctggtcagaac

SEQ ID NO: 519558 - DNA, 20 bp, mouse
gtgcccgttctgaccaggat

SEQ ID NO: 519559 - DNA, 20 bp, mouse
gggcagactcgagcccatcc

SEQ ID NO: 519560 - DNA, 20 bp, mouse
gagaacgggcacattcatct

SEQ ID NO: 519561 - DNA, 20 bp, mouse
gcagaccctggccgacctag

SEQ ID NO: 519562 - DNA, 20 bp, mouse
gaggccgctggactaggacg

SEQ ID NO: 519563 - DNA, 20 bp, mouse
gttgggagtgcagcaggcca

SEQ ID NO: 519564 - DNA, 20 bp, mouse
ggtgcaggtctacagctcta

SEQ ID NO: 519565 - DNA, 20 bp, mouse
gtaggacggggacactggct

SEQ ID NO: 519566 - DNA, 20 bp, mouse
ggatggccgcatgggctgag

SEQ ID NO: 519567 - DNA, 20 bp, mouse
gctggacacgatggccgcat

SEQ ID NO: 519568 - DNA, 20 bp, mouse
gcggctgtgtcaactaccgg

SEQ ID NO: 519569 - DNA, 20 bp, mouse
ggtggagctagcactcgaga

SEQ ID NO: 519570 - DNA, 20 bp, mouse
ggcagcggcgacgccgagtt

SEQ ID NO: 519571 - DNA, 20 bp, mouse
ggagctagcactcgagaagg

SEQ ID NO: 519572 - DNA, 20 bp, mouse
gccagctataaatccgaact

SEQ ID NO: 519573 - DNA, 20 bp, mouse
ggatttatagctggacacga

SEQ ID NO: 519574 - DNA, 20 bp, mouse
ggtgctgcttgacatctccg

SEQ ID NO: 519575 - DNA, 20 bp, mouse
gccaggcaaccccgcgcggg

SEQ ID NO: 519576 - DNA, 20 bp, mouse
gagactgggccaggagacta

SEQ ID NO: 519577 - DNA, 20 bp, mouse
ggagagacgcgcggaagact

SEQ ID NO: 519578 - DNA, 20 bp, mouse
gccaggagactagggaccga

SEQ ID NO: 519579 - DNA, 20 bp, mouse
ggaccgagccgctggagctg

SEQ ID NO: 519580 - DNA, 20 bp, mouse
gtaaggcgagggggcttcca

SEQ ID NO: 519581 - DNA, 20 bp, mouse
gggtcaacgcgagaagccag

SEQ ID NO: 519582 - DNA, 20 bp, mouse
gacacaggcagcgggatcgt

SEQ ID NO: 519583 - DNA, 20 bp, mouse
gcaacgcgagaagccagggg

SEQ ID NO: 519584 - DNA, 20 bp, mouse
ggactgtggggccggaacac

SEQ ID NO: 519585 - DNA, 20 bp, mouse
gcggcccgcgggttccttgt

SEQ ID NO: 519586 - DNA, 20 bp, mouse
gcaaaggcgaactggagtag

SEQ ID NO: 519587 - DNA, 20 bp, mouse
ggttgggaacacaccccggg

SEQ ID NO: 519588 - DNA, 20 bp, mouse
gggggtgtgttcccaaccaa

SEQ ID NO: 519589 - DNA, 20 bp, mouse
ggccactgggagaattgaag

SEQ ID NO: 519590 - DNA, 20 bp, mouse
gcgcccagggcgcaaatcag

SEQ ID NO: 519591 - DNA, 20 bp, mouse
gtcctcttcaattctcccag

SEQ ID NO: 519592 - DNA, 20 bp, mouse
gagaggtcggcgcccgctgt

SEQ ID NO: 519593 - DNA, 20 bp, mouse
gtgcacgtctcttccccccg

SEQ ID NO: 519594 - DNA, 20 bp, mouse
gaacagctaggtgcccgcgg

SEQ ID NO: 519595 - DNA, 20 bp, mouse
ggcctcccgccgaggcgtgg

SEQ ID NO: 519596 - DNA, 20 bp, mouse
ggcgcccagaggcctcccgt

SEQ ID NO: 519597 - DNA, 20 bp, mouse
gcagctcggagtccctgcaa

SEQ ID NO: 519598 - DNA, 20 bp, mouse
ggtggcctcgccagacccag

SEQ ID NO: 519599 - DNA, 20 bp, mouse
gagggactccgagctggcgt

SEQ ID NO: 519600 - DNA, 20 bp, mouse
gctcggagtccctgcaacgg

SEQ ID NO: 519601 - DNA, 20 bp, mouse
gaggtgggtgcccgacggag

SEQ ID NO: 519602 - DNA, 20 bp, mouse
gccgaccctgaacttcccct

SEQ ID NO: 519603 - DNA, 20 bp, mouse
gtggcgaggccaccgttgca

SEQ ID NO: 519604 - DNA, 20 bp, mouse
gcctgaacttcccctgggtc

SEQ ID NO: 519605 - DNA, 20 bp, mouse
ggaagttcagggtcggaggg

SEQ ID NO: 519606 - DNA, 20 bp, mouse
gcagcgccagcccagcgagt

SEQ ID NO: 519607 - DNA, 20 bp, mouse
gcagagggcagaagctccag

SEQ ID NO: 519608 - DNA, 20 bp, mouse
gatggcagtcactaatccag

SEQ ID NO: 519609 - DNA, 20 bp, mouse
gcagcccagcgagtgggcca

SEQ ID NO: 519610 - DNA, 20 bp, mouse
gaggccttggcccactcgct

SEQ ID NO: 519611 - DNA, 20 bp, mouse
ggcctggcatggagacttgt

SEQ ID NO: 519612 - DNA, 20 bp, mouse
gggggtgttcctggaagtgc

SEQ ID NO: 519613 - DNA, 20 bp, mouse
gagtcctgctgaaggtacag

SEQ ID NO: 519614 - DNA, 20 bp, mouse
gaaagaggtccagcacttcc

SEQ ID NO: 519615 - DNA, 20 bp, mouse
gggagacttgtaggttgcaa

SEQ ID NO: 519616 - DNA, 20 bp, mouse
ggtcctcccggagacgcgga

SEQ ID NO: 519617 - DNA, 20 bp, mouse
gtggagtcctcccggagacg

SEQ ID NO: 519618 - DNA, 20 bp, mouse
gagccctccgcgtctccggg

SEQ ID NO: 519619 - DNA, 20 bp, mouse
gccagcttgtggagtcctcc

SEQ ID NO: 519620 - DNA, 20 bp, mouse
gcggcacaccgagcatctcc

SEQ ID NO: 519621 - DNA, 20 bp, mouse
gcccgggagagcgagatcaa

SEQ ID NO: 519622 - DNA, 20 bp, mouse
gctgttcgtggagggcccaa

SEQ ID NO: 519623 - DNA, 20 bp, mouse
gaggggctcccggagatgct

SEQ ID NO: 519624 - DNA, 20 bp, mouse
ggtgacttcagcggcctggt

SEQ ID NO: 519625 - DNA, 20 bp, mouse
gccgcggagggggctgtcaa

SEQ ID NO: 519626 - DNA, 20 bp, mouse
gttcgagcaggtgtcctcgg

SEQ ID NO: 519627 - DNA, 20 bp, mouse
gcgggaccgcttgaaagtgg

SEQ ID NO: 519628 - DNA, 20 bp, mouse
ggcgccaggccggagagcgt

SEQ ID NO: 519629 - DNA, 20 bp, mouse
gggcgagcggctttcccggt

SEQ ID NO: 519630 - DNA, 20 bp, mouse
gcggctgctggcttcggcac

SEQ ID NO: 519631 - DNA, 20 bp, mouse
ggatcgggaccgcttgaaag

SEQ ID NO: 519632 - DNA, 20 bp, mouse
ggccagacaaagatgaggat

SEQ ID NO: 519633 - DNA, 20 bp, mouse
gagcttcgagcaggtgtcct

SEQ ID NO: 519634 - DNA, 20 bp, mouse
gtgaaagtgggggaaagtgc

SEQ ID NO: 519635 - DNA, 20 bp, mouse
gcccagagtggcgtggaggg

SEQ ID NO: 519636 - DNA, 20 bp, mouse
gttgtcgggaccttcttcag

SEQ ID NO: 519637 - DNA, 20 bp, mouse
gggaccttcttcagaggcag

SEQ ID NO: 519638 - DNA, 20 bp, mouse
gaggactgcgctcaggccgg

SEQ ID NO: 519639 - DNA, 20 bp, mouse
gggaggccaggactgcgctc

SEQ ID NO: 519640 - DNA, 20 bp, mouse
gtcttcagaggcagtggtgc

SEQ ID NO: 519641 - DNA, 20 bp, mouse
gtgggagagctggagaaccg

SEQ ID NO: 519642 - DNA, 20 bp, mouse
gcgctcccgggcccatgtac

SEQ ID NO: 519643 - DNA, 20 bp, mouse
gggtgagcaagcaggcgagt

SEQ ID NO: 519644 - DNA, 20 bp, mouse
gaggggtgctgagtgagccc

SEQ ID NO: 519645 - DNA, 20 bp, mouse
gccggcaaccggcagccctc

SEQ ID NO: 519646 - DNA, 20 bp, mouse
gtggctgggccatcacctgg

SEQ ID NO: 519647 - DNA, 20 bp, mouse
ggagggaatgcaggcgacgg

SEQ ID NO: 519648 - DNA, 20 bp, mouse
gaacgagaggcggctcctat

SEQ ID NO: 519649 - DNA, 20 bp, mouse
gctgggccatcacctggggg

SEQ ID NO: 519650 - DNA, 20 bp, mouse
ggcgacggcggctgctgaac

SEQ ID NO: 519651 - DNA, 20 bp, mouse
gggaccgaaaggactcacca

SEQ ID NO: 519652 - DNA, 20 bp, mouse
gaccaaggctcaacgagagg

SEQ ID NO: 519653 - DNA, 20 bp, mouse
ggtcccttcgagacagcggg

SEQ ID NO: 519654 - DNA, 20 bp, mouse
gagcggtcccttcgagacag

SEQ ID NO: 519655 - DNA, 20 bp, mouse
gtcgctttgcagccggaccc

SEQ ID NO: 519656 - DNA, 20 bp, mouse
ggccttagtgtggctgagag

SEQ ID NO: 519657 - DNA, 20 bp, mouse
ggtgggtcagagagtggtta

SEQ ID NO: 519658 - DNA, 20 bp, mouse
gtcctctctcagccacacta

SEQ ID NO: 519659 - DNA, 20 bp, mouse
gcgcctgcggggccatgtat

SEQ ID NO: 519660 - DNA, 20 bp, mouse
gagagtggttacggtcactg

SEQ ID NO: 519661 - DNA, 20 bp, mouse
gttggaacaagacacactgg

SEQ ID NO: 519662 - DNA, 20 bp, mouse
gaccagctccagagggtcag

SEQ ID NO: 519663 - DNA, 20 bp, mouse
gaacagatcccgcccggtgt

SEQ ID NO: 519664 - DNA, 20 bp, mouse
gaggtaagcgagcctacacc

SEQ ID NO: 519665 - DNA, 20 bp, mouse
gctggagacgaggcagtgac

SEQ ID NO: 519666 - DNA, 20 bp, mouse
gtcctcgagtcgcccgctgg

SEQ ID NO: 519667 - DNA, 20 bp, mouse
gtgaagggcgcgcacgaggg

SEQ ID NO: 519668 - DNA, 20 bp, mouse
gtcgagtcgcccgctggcgg

SEQ ID NO: 519669 - DNA, 20 bp, mouse
gggccagcgcgcagcctccc

SEQ ID NO: 519670 - DNA, 20 bp, mouse
ggcccagggaggctgcgcgc

SEQ ID NO: 519671 - DNA, 20 bp, mouse
gcagtgccccgggctcatgt

SEQ ID NO: 519672 - DNA, 20 bp, mouse
ggccccaccgcgctcttgaa

SEQ ID NO: 519673 - DNA, 20 bp, mouse
gtcttgaagggcgcgcacga

SEQ ID NO: 519674 - DNA, 20 bp, mouse
gccgcgagagcgggaaggca

SEQ ID NO: 519675 - DNA, 20 bp, mouse
ggagcccgggcgcagctggc

SEQ ID NO: 519676 - DNA, 20 bp, mouse
gagtccccaacgcaacctac

SEQ ID NO: 519677 - DNA, 20 bp, mouse
ggcaagttcccagtgcctgt

SEQ ID NO: 519678 - DNA, 20 bp, mouse
gtgctagattcagcggtccc

SEQ ID NO: 519679 - DNA, 20 bp, mouse
ggtgcctgtaggttgcgttg

SEQ ID NO: 519680 - DNA, 20 bp, mouse
gtgggaacttgcaggcagcc

SEQ ID NO: 519681 - DNA, 20 bp, mouse
ggggaggaaaacaaaatcta

SEQ ID NO: 519682 - DNA, 20 bp, mouse
gccgaggcaaaagaacgacg

SEQ ID NO: 519683 - DNA, 20 bp, mouse
gcgcggacggagggaaaagc

SEQ ID NO: 519684 - DNA, 20 bp, mouse
gaacaaattggacacagctc

SEQ ID NO: 519685 - DNA, 20 bp, mouse
gcttgagagggaaaagaccg

SEQ ID NO: 519686 - DNA, 20 bp, mouse
gaggagtgtcaagggatcga

SEQ ID NO: 519687 - DNA, 20 bp, mouse
gatcgagggaacagcacccc

SEQ ID NO: 519688 - DNA, 20 bp, mouse
gggaacagcacccccggcac

SEQ ID NO: 519689 - DNA, 20 bp, mouse
gctcctgagacctaaaagag

SEQ ID NO: 519690 - DNA, 20 bp, mouse
ggactcaagcgacgagttgt

SEQ ID NO: 519691 - DNA, 20 bp, mouse
gtaggttagaaaaccttagt

SEQ ID NO: 519692 - DNA, 20 bp, mouse
gttggacgcgtccggtgccg

SEQ ID NO: 519693 - DNA, 20 bp, mouse
ggtgaaagaaccgtaagtca

SEQ ID NO: 519694 - DNA, 20 bp, mouse
gttaaaagccccgacagctg

SEQ ID NO: 519695 - DNA, 20 bp, mouse
gggatacagctcgcagcctg

SEQ ID NO: 519696 - DNA, 20 bp, mouse
gggactccagagggccttgg

SEQ ID NO: 519697 - DNA, 20 bp, mouse
gattatgggctggactccag

SEQ ID NO: 519698 - DNA, 20 bp, mouse
ggcatctaaggtctcctcca

SEQ ID NO: 519699 - DNA, 20 bp, mouse
gtgaaaacggcctgcatcta

SEQ ID NO: 519700 - DNA, 20 bp, mouse
gggagtccagcccataatga

SEQ ID NO: 519701 - DNA, 20 bp, mouse
gcagcccataatgaaggtct

SEQ ID NO: 519702 - DNA, 20 bp, mouse
ggcccgccggaggcgctggg

SEQ ID NO: 519703 - DNA, 20 bp, mouse
gcggcgcatggatttacctg

SEQ ID NO: 519704 - DNA, 20 bp, mouse
ggcggtgcccggaccatgtg

SEQ ID NO: 519705 - DNA, 20 bp, mouse
gggtctcctccaaggccctc

SEQ ID NO: 519706 - DNA, 20 bp, mouse
gcagcgccaggcgacgataa

SEQ ID NO: 519707 - DNA, 20 bp, mouse
gagtctgcgccggagcgtct

SEQ ID NO: 519708 - DNA, 20 bp, mouse
gcgccggagcgtctcggcag

SEQ ID NO: 519709 - DNA, 20 bp, mouse
gtcctgaaggagcagtccgg

SEQ ID NO: 519710 - DNA, 20 bp, mouse
gtctagcggccaccgacgac

SEQ ID NO: 519711 - DNA, 20 bp, mouse
ggactgggatggcaagatag

SEQ ID NO: 519712 - DNA, 20 bp, mouse
gtcgtcgcctggcgctgcgg

SEQ ID NO: 519713 - DNA, 20 bp, mouse
gccggcctgcaaggggacag

SEQ ID NO: 519714 - DNA, 20 bp, mouse
gcagactgcgcgcccggagg

SEQ ID NO: 519715 - DNA, 20 bp, mouse
gcaggcgacgataacggccg

SEQ ID NO: 519716 - DNA, 20 bp, mouse
gagtgcgcgcgaaatctgtg

SEQ ID NO: 519717 - DNA, 20 bp, mouse
gcgcgcactttggcgggagg

SEQ ID NO: 519718 - DNA, 20 bp, mouse
gcggagacgagcaagggcgg

SEQ ID NO: 519719 - DNA, 20 bp, mouse
ggatttcgcgcgcactttgg

SEQ ID NO: 519720 - DNA, 20 bp, mouse
gagcctccgggcgatagttg

SEQ ID NO: 519721 - DNA, 20 bp, mouse
ggggcggagacgagcaaggg

SEQ ID NO: 519722 - DNA, 20 bp, mouse
gtctgtgtggcgcgaatttg

SEQ ID NO: 519723 - DNA, 20 bp, mouse
gtcgcgcgcactttggcggg

SEQ ID NO: 519724 - DNA, 20 bp, mouse
gtgcggcacgcgctactcgc

SEQ ID NO: 519725 - DNA, 20 bp, mouse
gaccaaggccgcaggagttt

SEQ ID NO: 519726 - DNA, 20 bp, mouse
gccaggcgcccacaaggcca

SEQ ID NO: 519727 - DNA, 20 bp, mouse
ggtgcggagcgtcagagcca

SEQ ID NO: 519728 - DNA, 20 bp, mouse
gccgcacgagccaccggacc

SEQ ID NO: 519729 - DNA, 20 bp, mouse
gaccggaccaggcgcccaca

SEQ ID NO: 519730 - DNA, 20 bp, mouse
ggccttgtgggcgcctggtc

SEQ ID NO: 519731 - DNA, 20 bp, mouse
gaagggcaggatgccagagt

SEQ ID NO: 519732 - DNA, 20 bp, mouse
ggcgggacccgtggccttgt

SEQ ID NO: 519733 - DNA, 20 bp, mouse
gccgcggccgcgcaacaagg

SEQ ID NO: 519734 - DNA, 20 bp, mouse
gctcccgtgggctcccgtgg

SEQ ID NO: 519735 - DNA, 20 bp, mouse
ggacgctccgcacgagccac

SEQ ID NO: 519736 - DNA, 20 bp, mouse
gtgacgctgggacaaagcac

SEQ ID NO: 519737 - DNA, 20 bp, mouse
gcaggtcccaggtagctagg

SEQ ID NO: 519738 - DNA, 20 bp, mouse
ggctgggacaaagcacggga

SEQ ID NO: 519739 - DNA, 20 bp, mouse
gggaaggacgcagcctccct

SEQ ID NO: 519740 - DNA, 20 bp, mouse
gagcaagtggtgtggcgggt

SEQ ID NO: 519741 - DNA, 20 bp, mouse
gctgcaccgtggaaggcggg

SEQ ID NO: 519742 - DNA, 20 bp, mouse
gcaggtagctaggtggcagg

SEQ ID NO: 519743 - DNA, 20 bp, mouse
gctgccgaatgaaggagctg

SEQ ID NO: 519744 - DNA, 20 bp, mouse
gcggcagggttggggttcac

SEQ ID NO: 519745 - DNA, 20 bp, mouse
ggagccggctgcaccgtgga

SEQ ID NO: 519746 - DNA, 20 bp, mouse
gtcatggcactttctctcag

SEQ ID NO: 519747 - DNA, 20 bp, mouse
gagcacagctgtgaagacga

SEQ ID NO: 519748 - DNA, 20 bp, mouse
gtcccgagtgaggagcgatc

SEQ ID NO: 519749 - DNA, 20 bp, mouse
gtggctgcaattgtactttt

SEQ ID NO: 519750 - DNA, 20 bp, mouse
ggcgcttaggtaggtgttag

SEQ ID NO: 519751 - DNA, 20 bp, mouse
ggacaaatatcacaaagtat

SEQ ID NO: 519752 - DNA, 20 bp, mouse
gagctgaaggctgagatcga

SEQ ID NO: 519753 - DNA, 20 bp, mouse
gctggctgaacactaagggt

SEQ ID NO: 519754 - DNA, 20 bp, mouse
gctcgagccccactgagcgg

SEQ ID NO: 519755 - DNA, 20 bp, mouse
gagcgaaagagcgcttaggt

SEQ ID NO: 519756 - DNA, 20 bp, mouse
gacccacagactcacacagg

SEQ ID NO: 519757 - DNA, 20 bp, mouse
gaccacctgtgtgagtctgt

SEQ ID NO: 519758 - DNA, 20 bp, mouse
ggaccctggcatttcctctt

SEQ ID NO: 519759 - DNA, 20 bp, mouse
ggtagaaacatctcagaccc

SEQ ID NO: 519760 - DNA, 20 bp, mouse
ggtggtccaagtgtggacta

SEQ ID NO: 519761 - DNA, 20 bp, mouse
gtcacccaagaggaaatgcc

SEQ ID NO: 519762 - DNA, 20 bp, mouse
ggagtctgtgggtggcggga

SEQ ID NO: 519763 - DNA, 20 bp, mouse
gggtcaccttagtccacact

SEQ ID NO: 519764 - DNA, 20 bp, mouse
ggtgtgagtctgtgggtggc

SEQ ID NO: 519765 - DNA, 20 bp, mouse
gagaaggggaggggaaactg

SEQ ID NO: 519766 - DNA, 20 bp, mouse
ggagccagaatggatcccct

SEQ ID NO: 519767 - DNA, 20 bp, mouse
gtcctcaaaatggtgatggg

SEQ ID NO: 519768 - DNA, 20 bp, mouse
gcatcctaggggatccattc

SEQ ID NO: 519769 - DNA, 20 bp, mouse
gctgtgattacctggtgtca

SEQ ID NO: 519770 - DNA, 20 bp, mouse
ggtatacatctgtgattacc

SEQ ID NO: 519771 - DNA, 20 bp, mouse
ggagtgtctccagccatccc

SEQ ID NO: 519772 - DNA, 20 bp, mouse
gacgcagcgatcacagagcc

SEQ ID NO: 519773 - DNA, 20 bp, mouse
gtgaaaaagcactgagaaaa

SEQ ID NO: 519774 - DNA, 20 bp, mouse
gttcacattgagagccagaa

SEQ ID NO: 519775 - DNA, 20 bp, mouse
gctaataatgtcttgttcca

SEQ ID NO: 519776 - DNA, 20 bp, mouse
ggaaccagagggcatcccct

SEQ ID NO: 519777 - DNA, 20 bp, mouse
gcatcctaggggatgccctc

SEQ ID NO: 519778 - DNA, 20 bp, mouse
gttttcacattgagaaccag

SEQ ID NO: 519779 - DNA, 20 bp, mouse
ggggctaatgtcttgttcca

SEQ ID NO: 519780 - DNA, 20 bp, mouse
gtgggttccagaataagagc

SEQ ID NO: 519781 - DNA, 20 bp, mouse
ggtctgaaggaagatgttct

SEQ ID NO: 519782 - DNA, 20 bp, mouse
ggagtgaagaatcaaattct

SEQ ID NO: 519783 - DNA, 20 bp, mouse
gtgaaaaagctttgagaaaa

SEQ ID NO: 519784 - DNA, 20 bp, mouse
gtggcgatcatggtgagtcc

SEQ ID NO: 519785 - DNA, 20 bp, mouse
gactgtgagcatggcgatca

SEQ ID NO: 519786 - DNA, 20 bp, mouse
gcggctcagtatccacagag

SEQ ID NO: 519787 - DNA, 20 bp, mouse
gatgctggtgcttacctgag

SEQ ID NO: 519788 - DNA, 20 bp, mouse
gcttgggagtccagacttgt

SEQ ID NO: 519789 - DNA, 20 bp, mouse
gacagaggggctgtggcaga

SEQ ID NO: 519790 - DNA, 20 bp, mouse
gcctcaccaagagccaatag

SEQ ID NO: 519791 - DNA, 20 bp, mouse
gattggctcttggtgaggaa

SEQ ID NO: 519792 - DNA, 20 bp, mouse
ggggatttgggggaaccacg

SEQ ID NO: 519793 - DNA, 20 bp, mouse
gcttgtgggtagggggctgt

SEQ ID NO: 519794 - DNA, 20 bp, mouse
gaatagacttacgggtctaa

SEQ ID NO: 519795 - DNA, 20 bp, mouse
gggctagagactggattctt

SEQ ID NO: 519796 - DNA, 20 bp, mouse
gcagttgcgacaggtgcgct

SEQ ID NO: 519797 - DNA, 20 bp, mouse
ggtgcagcgccgagccccga

SEQ ID NO: 519798 - DNA, 20 bp, mouse
gcctgactagaaagccgtcg

SEQ ID NO: 519799 - DNA, 20 bp, mouse
gcgctgggcagacagagcgc

SEQ ID NO: 519800 - DNA, 20 bp, mouse
ggctcggcgctgcacggcca

SEQ ID NO: 519801 - DNA, 20 bp, mouse
gagaagggagggcggagcat

SEQ ID NO: 519802 - DNA, 20 bp, mouse
gcctccaacgtggaccccaa

SEQ ID NO: 519803 - DNA, 20 bp, mouse
gttggacttcccagaaggga

SEQ ID NO: 519804 - DNA, 20 bp, mouse
gctgcggagggcgaggcgag

SEQ ID NO: 519805 - DNA, 20 bp, mouse
gcaccccttggggtccacgt

SEQ ID NO: 519806 - DNA, 20 bp, mouse
ggaggtggttcgggctgcag

SEQ ID NO: 519807 - DNA, 20 bp, mouse
ggaggctgtgctcatcccgg

SEQ ID NO: 519808 - DNA, 20 bp, mouse
ggacttccagaccgagagcg

SEQ ID NO: 519809 - DNA, 20 bp, mouse
gtgcgaagcccggcgagtac

SEQ ID NO: 519810 - DNA, 20 bp, mouse
ggagcgctccagtactcgcc

SEQ ID NO: 519811 - DNA, 20 bp, mouse
gcgaaggcaggctccggagg

SEQ ID NO: 519812 - DNA, 20 bp, mouse
gcggcgaaggcaggctccgg

SEQ ID NO: 519813 - DNA, 20 bp, mouse
gcaggctccggaggtggttc

SEQ ID NO: 519814 - DNA, 20 bp, mouse
gagatggcttgccccgctct

SEQ ID NO: 519815 - DNA, 20 bp, mouse
ggcaagccatctgcgaagcc

SEQ ID NO: 519816 - DNA, 20 bp, mouse
gccggggagcgtccacgtgg

SEQ ID NO: 519817 - DNA, 20 bp, mouse
ggccgccgccatcggacaat

SEQ ID NO: 519818 - DNA, 20 bp, mouse
gcgcgcggcccattgtccga

SEQ ID NO: 519819 - DNA, 20 bp, mouse
ggcagagctcactgcagccg

SEQ ID NO: 519820 - DNA, 20 bp, mouse
ggcggcccattgtccgatgg

SEQ ID NO: 519821 - DNA, 20 bp, mouse
ggacaatgggccgcgcgccg

SEQ ID NO: 519822 - DNA, 20 bp, mouse
ggccaccggccccaggccag

SEQ ID NO: 519823 - DNA, 20 bp, mouse
ggcccattgtccgatggcgg

SEQ ID NO: 519824 - DNA, 20 bp, mouse
gaggtttcaggtccagccta

SEQ ID NO: 519825 - DNA, 20 bp, mouse
gggcctgaaggcctcaactc

SEQ ID NO: 519826 - DNA, 20 bp, mouse
ggcgccacttgcacccgagg

SEQ ID NO: 519827 - DNA, 20 bp, mouse
ggctcggggaccactggcag

SEQ ID NO: 519828 - DNA, 20 bp, mouse
gccgggcccggtgagaccca

SEQ ID NO: 519829 - DNA, 20 bp, mouse
ggctgccgctcggggaccac

SEQ ID NO: 519830 - DNA, 20 bp, mouse
gagaccccgcctgggatgaa

SEQ ID NO: 519831 - DNA, 20 bp, mouse
gggaccgcctcgggtgcaag

SEQ ID NO: 519832 - DNA, 20 bp, mouse
gggcccggtgagacccacgg

SEQ ID NO: 519833 - DNA, 20 bp, mouse
gcgtagggccggctcgtggt

SEQ ID NO: 519834 - DNA, 20 bp, mouse
gggctcgcgtcggtcccgta

SEQ ID NO: 519835 - DNA, 20 bp, mouse
ggggtcctaagggtgggtgt

SEQ ID NO: 519836 - DNA, 20 bp, mouse
gttcctggctgtcctagaca

SEQ ID NO: 519837 - DNA, 20 bp, mouse
gttgctgcttggccctgtct

SEQ ID NO: 519838 - DNA, 20 bp, mouse
gccaagcagcaaatccccgg

SEQ ID NO: 519839 - DNA, 20 bp, mouse
gtggcccaggataaagggtg

SEQ ID NO: 519840 - DNA, 20 bp, mouse
ggcacttaccgaggccaccg

SEQ ID NO: 519841 - DNA, 20 bp, mouse
gggggctggcccaggataaa

SEQ ID NO: 519842 - DNA, 20 bp, mouse
gctgttcaggcttggagtgt

SEQ ID NO: 519843 - DNA, 20 bp, mouse
gggtgaacaacagccttctg

SEQ ID NO: 519844 - DNA, 20 bp, mouse
gggccctgtctaggacagcc

SEQ ID NO: 519845 - DNA, 20 bp, mouse
gggtgagggagcacttaccg

SEQ ID NO: 519846 - DNA, 20 bp, mouse
gcaccaggcttgagggacac

SEQ ID NO: 519847 - DNA, 20 bp, mouse
gcccgctgcactcccacacc

SEQ ID NO: 519848 - DNA, 20 bp, mouse
gactcccacaccaggcttga

SEQ ID NO: 519849 - DNA, 20 bp, mouse
gagcatcgccgaacccggag

SEQ ID NO: 519850 - DNA, 20 bp, mouse
gctgcctgagaagcgcggag

SEQ ID NO: 519851 - DNA, 20 bp, mouse
gcctggagggaagaacgtat

SEQ ID NO: 519852 - DNA, 20 bp, mouse
gttctcaggcagcggcaacg

SEQ ID NO: 519853 - DNA, 20 bp, mouse
gcggcctgcgggcttcggaa

SEQ ID NO: 519854 - DNA, 20 bp, mouse
gccgcccctccgcgcttctc

SEQ ID NO: 519855 - DNA, 20 bp, mouse
ggggcaggcgcatccctagg

SEQ ID NO: 519856 - DNA, 20 bp, mouse
gcgcctgcggtctagagaag

SEQ ID NO: 519857 - DNA, 20 bp, mouse
gtccagggcgcggacaacac

SEQ ID NO: 519858 - DNA, 20 bp, mouse
gtcaggtccgcgcccgcctg

SEQ ID NO: 519859 - DNA, 20 bp, mouse
gcctcccagggcgccgtagg

SEQ ID NO: 519860 - DNA, 20 bp, mouse
gcgtaggcggtgcatccttc

SEQ ID NO: 519861 - DNA, 20 bp, mouse
gtccgcgccctggaccatgg

SEQ ID NO: 519862 - DNA, 20 bp, mouse
ggggcgcggacaacacagga

SEQ ID NO: 519863 - DNA, 20 bp, mouse
ggacctgaggcgctgctgcc

SEQ ID NO: 519864 - DNA, 20 bp, mouse
gctcctggctaaggaagccg

SEQ ID NO: 519865 - DNA, 20 bp, mouse
gccctgccaggctctcgctg

SEQ ID NO: 519866 - DNA, 20 bp, mouse
ggaagagggtgcggccgccg

SEQ ID NO: 519867 - DNA, 20 bp, mouse
ggcctcagtccccgccgcgg

SEQ ID NO: 519868 - DNA, 20 bp, mouse
ggtgcggcctaggggtgtaa

SEQ ID NO: 519869 - DNA, 20 bp, mouse
gacaccgcccaagcccgagg

SEQ ID NO: 519870 - DNA, 20 bp, mouse
gccctcttccctcgctgcgg

SEQ ID NO: 519871 - DNA, 20 bp, mouse
gctgctcgccgccgcagcga

SEQ ID NO: 519872 - DNA, 20 bp, mouse
gcatctccgcggtccacgcc

SEQ ID NO: 519873 - DNA, 20 bp, mouse
gggcacagactgacccggcg

SEQ ID NO: 519874 - DNA, 20 bp, mouse
gcggcgagcagtcgatttga

SEQ ID NO: 519875 - DNA, 20 bp, mouse
gcccaagcccgaggcgggag

SEQ ID NO: 519876 - DNA, 20 bp, mouse
gaggcgcgcggccaccatga

SEQ ID NO: 519877 - DNA, 20 bp, mouse
gcagcgagtggactgctgac

SEQ ID NO: 519878 - DNA, 20 bp, mouse
ggtggccgcgcgcctagcac

SEQ ID NO: 519879 - DNA, 20 bp, mouse
gctgtcaggaacacagcgag

SEQ ID NO: 519880 - DNA, 20 bp, mouse
gcgcggccaccatgacggga

SEQ ID NO: 519881 - DNA, 20 bp, mouse
gaagcccacacactccctag

SEQ ID NO: 519882 - DNA, 20 bp, mouse
gctcggggagacccagacca

SEQ ID NO: 519883 - DNA, 20 bp, mouse
gacagcctcacggggcacag

SEQ ID NO: 519884 - DNA, 20 bp, mouse
gctctgggactgagagggtc

SEQ ID NO: 519885 - DNA, 20 bp, mouse
gtgttaccttcccgtcatgg

SEQ ID NO: 519886 - DNA, 20 bp, mouse
gtggccccagagaagtccgg

SEQ ID NO: 519887 - DNA, 20 bp, mouse
gccccgggccccaggtcggg

SEQ ID NO: 519888 - DNA, 20 bp, mouse
ggccagcagccgcccgacct

SEQ ID NO: 519889 - DNA, 20 bp, mouse
gacctggggcccggggccac

SEQ ID NO: 519890 - DNA, 20 bp, mouse
gtggttggacaccgagccca

SEQ ID NO: 519891 - DNA, 20 bp, mouse
gttgcctccggacttctctg

SEQ ID NO: 519892 - DNA, 20 bp, mouse
gaagtccggaggcaaagggg

SEQ ID NO: 519893 - DNA, 20 bp, mouse
gcagcagacgaccatgggct

SEQ ID NO: 519894 - DNA, 20 bp, mouse
ggaacctgcaaactgctggt

SEQ ID NO: 519895 - DNA, 20 bp, mouse
gggaggccatagggacttgg

SEQ ID NO: 519896 - DNA, 20 bp, mouse
ggtgctcaggggccagaaac

SEQ ID NO: 519897 - DNA, 20 bp, mouse
gcagagtcacgtgtgctcag

SEQ ID NO: 519898 - DNA, 20 bp, mouse
ggccccacggcactctaagg

SEQ ID NO: 519899 - DNA, 20 bp, mouse
gccagccccttaaggatccg

SEQ ID NO: 519900 - DNA, 20 bp, mouse
ggagggccggtggggcaaca

SEQ ID NO: 519901 - DNA, 20 bp, mouse
gttgaagctgagggccggtg

SEQ ID NO: 519902 - DNA, 20 bp, mouse
gcccagtattagggtaatgg

SEQ ID NO: 519903 - DNA, 20 bp, mouse
ggaaggggtgaaaaactacg

SEQ ID NO: 519904 - DNA, 20 bp, mouse
gccaagttgtgaatcagtgt

SEQ ID NO: 519905 - DNA, 20 bp, mouse
gtcttgctactaattcacct

SEQ ID NO: 519906 - DNA, 20 bp, mouse
gccaatgacgcggctcggag

SEQ ID NO: 519907 - DNA, 20 bp, mouse
gcgagcctcggcctgacgca

SEQ ID NO: 519908 - DNA, 20 bp, mouse
gggcggcgtgggggcccgag

SEQ ID NO: 519909 - DNA, 20 bp, mouse
gcgagccctgcgtcaggccg

SEQ ID NO: 519910 - DNA, 20 bp, mouse
gggcaggtgtgcgcgagcct

SEQ ID NO: 519911 - DNA, 20 bp, mouse
gctgtgcgcgccgagtgcca

SEQ ID NO: 519912 - DNA, 20 bp, mouse
gccccacgccgcccggtccc

SEQ ID NO: 519913 - DNA, 20 bp, mouse
gcacgaccatgaggccgcgg

SEQ ID NO: 519914 - DNA, 20 bp, mouse
gtcgacccgagccctgcgtc

SEQ ID NO: 519915 - DNA, 20 bp, mouse
gcagcacgaccatgaggccg

SEQ ID NO: 519916 - DNA, 20 bp, mouse
ggtggccgccaaggcagtcg

SEQ ID NO: 519917 - DNA, 20 bp, mouse
gtcgcggctggacagtgctc

SEQ ID NO: 519918 - DNA, 20 bp, mouse
gagaagggaagtggccgcca

SEQ ID NO: 519919 - DNA, 20 bp, mouse
gagggtcccgcctacagaag

SEQ ID NO: 519920 - DNA, 20 bp, mouse
gtgcagccgtgaggaaacgg

SEQ ID NO: 519921 - DNA, 20 bp, mouse
gtggacagtgctcaggcccg

SEQ ID NO: 519922 - DNA, 20 bp, mouse
gtgtccagccgcgactgcct

SEQ ID NO: 519923 - DNA, 20 bp, mouse
gccagccgcgactgccttgg

SEQ ID NO: 519924 - DNA, 20 bp, mouse
gttagaggatcctgtcatat

SEQ ID NO: 519925 - DNA, 20 bp, mouse
ggccagtgaggattgattca

SEQ ID NO: 519926 - DNA, 20 bp, mouse
ggccggctcttaccgtctgt

SEQ ID NO: 519927 - DNA, 20 bp, mouse
gtggttacgtcacgtgacat

SEQ ID NO: 519928 - DNA, 20 bp, mouse
gtacgtcacgtgacatgggc

SEQ ID NO: 519929 - DNA, 20 bp, mouse
gagcagccccacccacggag

SEQ ID NO: 519930 - DNA, 20 bp, mouse
gacgtgacgtaaccaaccgt

SEQ ID NO: 519931 - DNA, 20 bp, mouse
gcgggctgtgagctaaggat

SEQ ID NO: 519932 - DNA, 20 bp, mouse
gtaggaaggagtccatcaac

SEQ ID NO: 519933 - DNA, 20 bp, mouse
gcatcaaccggagtccctat

SEQ ID NO: 519934 - DNA, 20 bp, mouse
gaagcaaataatgatactac

SEQ ID NO: 519935 - DNA, 20 bp, mouse
gctctctgccggctcggtag

SEQ ID NO: 519936 - DNA, 20 bp, mouse
ggcctccgaaacacagaccc

SEQ ID NO: 519937 - DNA, 20 bp, mouse
gatgggatgcggcggtggaa

SEQ ID NO: 519938 - DNA, 20 bp, mouse
gcccggcgtattatgggatg

SEQ ID NO: 519939 - DNA, 20 bp, mouse
ggtattatgggatgcggcgg

SEQ ID NO: 519940 - DNA, 20 bp, mouse
gggcgtattatgggatgcgg

SEQ ID NO: 519941 - DNA, 20 bp, mouse
ggggcggcccggcgtattat

SEQ ID NO: 519942 - DNA, 20 bp, mouse
gacccgggtctgtgtttcgg

SEQ ID NO: 519943 - DNA, 20 bp, mouse
ggcgctcgggaggaagggct

SEQ ID NO: 519944 - DNA, 20 bp, mouse
ggcggcggtggaatggcgct

SEQ ID NO: 519945 - DNA, 20 bp, mouse
gctcgggaggaagggctggg

SEQ ID NO: 519946 - DNA, 20 bp, mouse
ggccgcctctggtatgtcag

SEQ ID NO: 519947 - DNA, 20 bp, mouse
gccggcctctgacataccag

SEQ ID NO: 519948 - DNA, 20 bp, mouse
ggatgacgaggtgaaaatgg

SEQ ID NO: 519949 - DNA, 20 bp, mouse
gggtgatgacgaggtgaaaa

SEQ ID NO: 519950 - DNA, 20 bp, mouse
ggctggggctcggctgtcgg

SEQ ID NO: 519951 - DNA, 20 bp, mouse
gaagcagctggacagagcta

SEQ ID NO: 519952 - DNA, 20 bp, mouse
gccttctcctctacctccag

SEQ ID NO: 519953 - DNA, 20 bp, mouse
ggagcccgctcggagccgga

SEQ ID NO: 519954 - DNA, 20 bp, mouse
gagaaagcggcagcctctgg

SEQ ID NO: 519955 - DNA, 20 bp, mouse
gggctccgagcgggctccag

SEQ ID NO: 519956 - DNA, 20 bp, mouse
gcggagagcgcagcaagaag

SEQ ID NO: 519957 - DNA, 20 bp, mouse
ggacatggcgacattgacag

SEQ ID NO: 519958 - DNA, 20 bp, mouse
gtacctctgtccagagtaag

SEQ ID NO: 519959 - DNA, 20 bp, mouse
gtcggctcccacggcagaca

SEQ ID NO: 519960 - DNA, 20 bp, mouse
gagcgtcacttcggctccca

SEQ ID NO: 519961 - DNA, 20 bp, mouse
ggtggtccagccgcttactc

SEQ ID NO: 519962 - DNA, 20 bp, mouse
ggtgactggaggttgaagag

SEQ ID NO: 519963 - DNA, 20 bp, mouse
gccgggcgcgaaaccctcct

SEQ ID NO: 519964 - DNA, 20 bp, mouse
gctgaagccgagcgtcactt

SEQ ID NO: 519965 - DNA, 20 bp, mouse
gatgtcgccatgtctgccgt

SEQ ID NO: 519966 - DNA, 20 bp, mouse
gtcgcggggaccccaaccct

SEQ ID NO: 519967 - DNA, 20 bp, mouse
gccctgggcgaggtgttggt

SEQ ID NO: 519968 - DNA, 20 bp, mouse
ggcttgcattagaggcgata

SEQ ID NO: 519969 - DNA, 20 bp, mouse
gagaggcgatatggctgcac

SEQ ID NO: 519970 - DNA, 20 bp, mouse
gggaccgcgagagcatacgc

SEQ ID NO: 519971 - DNA, 20 bp, mouse
gtgcactggtggagccgctg

SEQ ID NO: 519972 - DNA, 20 bp, mouse
gcggagcccagagcccggac

SEQ ID NO: 519973 - DNA, 20 bp, mouse
gctcctcgctggcgcctggg

SEQ ID NO: 519974 - DNA, 20 bp, mouse
ggcagtctgagggcgtggga

SEQ ID NO: 519975 - DNA, 20 bp, mouse
ggcctgcagtctgagggcgt

SEQ ID NO: 519976 - DNA, 20 bp, mouse
gaacctgtccggctggaaag

SEQ ID NO: 519977 - DNA, 20 bp, mouse
gggcgctgggcgaacctgtc

SEQ ID NO: 519978 - DNA, 20 bp, mouse
gtgcacctccgaagagaaga

SEQ ID NO: 519979 - DNA, 20 bp, mouse
gttcggaggtgcagacccac

SEQ ID NO: 519980 - DNA, 20 bp, mouse
gcgacccgccccacccaccg

SEQ ID NO: 519981 - DNA, 20 bp, mouse
gtgcccgccgccagcctcaa

SEQ ID NO: 519982 - DNA, 20 bp, mouse
ggccgggcgctgctcgcggg

SEQ ID NO: 519983 - DNA, 20 bp, mouse
ggagccccggaagccctcgg

SEQ ID NO: 519984 - DNA, 20 bp, mouse
gcgcccgtgcctacagccgt

SEQ ID NO: 519985 - DNA, 20 bp, mouse
gacagtgccgggctgcgtgg

SEQ ID NO: 519986 - DNA, 20 bp, mouse
ggggcaaccggcgggaagga

SEQ ID NO: 519987 - DNA, 20 bp, mouse
gcggcgcggctcgttcaaga

SEQ ID NO: 519988 - DNA, 20 bp, mouse
ggccggtgcgaccccgggac

SEQ ID NO: 519989 - DNA, 20 bp, mouse
gcgcggctcgttcaagatgg

SEQ ID NO: 519990 - DNA, 20 bp, mouse
ggacgctacttactctcgtc

SEQ ID NO: 519991 - DNA, 20 bp, mouse
gggacgggcaaccggcggga

SEQ ID NO: 519992 - DNA, 20 bp, mouse
gccccgggacgggcaaccgg

SEQ ID NO: 519993 - DNA, 20 bp, mouse
gaggcccggggcaccaagag

SEQ ID NO: 519994 - DNA, 20 bp, mouse
gactcggccggtgcgacccc

SEQ ID NO: 519995 - DNA, 20 bp, mouse
gcgaccccgggacgggcaac

SEQ ID NO: 519996 - DNA, 20 bp, mouse
ggggagcccagtcgactcta

SEQ ID NO: 519997 - DNA, 20 bp, mouse
gcccacgccgcggcagagcg

SEQ ID NO: 519998 - DNA, 20 bp, mouse
gggccagggctgggaccggt

SEQ ID NO: 519999 - DNA, 20 bp, mouse
gaccctcatggggctatgta

SEQ ID NO: 520000 - DNA, 20 bp, mouse
ggtcttggccgagcccgagt

SEQ ID NO: 520001 - DNA, 20 bp, mouse
gccggccccagcggtagagg

SEQ ID NO: 520002 - DNA, 20 bp, mouse
gaccccggccccagcggtag

SEQ ID NO: 520003 - DNA, 20 bp, mouse
gcctgagctgccgcccgctc

SEQ ID NO: 520004 - DNA, 20 bp, mouse
gcgcgctccgggaccgggac

SEQ ID NO: 520005 - DNA, 20 bp, mouse
gcgggctccgcgctctgccg

SEQ ID NO: 520006 - DNA, 20 bp, mouse
ggcgctgtcactcacctggg

SEQ ID NO: 520007 - DNA, 20 bp, mouse
gcatgtagaggagcacctgg

SEQ ID NO: 520008 - DNA, 20 bp, mouse
gcacctgggcggctcctcct

SEQ ID NO: 520009 - DNA, 20 bp, mouse
gcagagcctaggggatcgag

SEQ ID NO: 520010 - DNA, 20 bp, mouse
gccgccaccagccgccgcca

SEQ ID NO: 520011 - DNA, 20 bp, mouse
gcctcctcggacggcgcgag

SEQ ID NO: 520012 - DNA, 20 bp, mouse
gtgggcggctcctcctcgga

SEQ ID NO: 520013 - DNA, 20 bp, mouse
ggacgcgcacggcggagccc

SEQ ID NO: 520014 - DNA, 20 bp, mouse
ggatcgaggggcgcatgtag

SEQ ID NO: 520015 - DNA, 20 bp, mouse
gtggctggcgggggatctca

SEQ ID NO: 520016 - DNA, 20 bp, mouse
gtataaagaatggcacaagt

SEQ ID NO: 520017 - DNA, 20 bp, mouse
gttagctgagggagaatctt

SEQ ID NO: 520018 - DNA, 20 bp, mouse
gcagggcaagcatgtatcct

SEQ ID NO: 520019 - DNA, 20 bp, mouse
gggtgcagggcacacatgtc

SEQ ID NO: 520020 - DNA, 20 bp, mouse
gatctgagcaccagtctccc

SEQ ID NO: 520021 - DNA, 20 bp, mouse
ggtgcttgtacaagggtgca

SEQ ID NO: 520022 - DNA, 20 bp, mouse
gtgcctgcgtgcttgtacaa

SEQ ID NO: 520023 - DNA, 20 bp, mouse
gagctctctagctccccagg

SEQ ID NO: 520024 - DNA, 20 bp, mouse
gcacccttgtacaagcacgc

SEQ ID NO: 520025 - DNA, 20 bp, mouse
gtagctccccaggaggaacc

SEQ ID NO: 520026 - DNA, 20 bp, mouse
ggagtacggtggcctggagt

SEQ ID NO: 520027 - DNA, 20 bp, mouse
gtccaggccaccgtactcca

SEQ ID NO: 520028 - DNA, 20 bp, mouse
gggccttccgtggagtacgg

SEQ ID NO: 520029 - DNA, 20 bp, mouse
gcagccacccagctcaacct

SEQ ID NO: 520030 - DNA, 20 bp, mouse
gcaaggccttccgtggagta

SEQ ID NO: 520031 - DNA, 20 bp, mouse
gggcacgagtggccgggcga

SEQ ID NO: 520032 - DNA, 20 bp, mouse
ggggccacgcagccatcgcc

SEQ ID NO: 520033 - DNA, 20 bp, mouse
ggcagagcgacgacgagtag

SEQ ID NO: 520034 - DNA, 20 bp, mouse
ggggccggcaaggccttccg

SEQ ID NO: 520035 - DNA, 20 bp, mouse
gtctacgcctgctgagggag

SEQ ID NO: 520036 - DNA, 20 bp, mouse
gtagtgggcactgcttctgg

SEQ ID NO: 520037 - DNA, 20 bp, mouse
gcctcccaccaagtaggtgt

SEQ ID NO: 520038 - DNA, 20 bp, mouse
ggtaggtgtaggcaccaggt

SEQ ID NO: 520039 - DNA, 20 bp, mouse
gagcagtcactcaccgggag

SEQ ID NO: 520040 - DNA, 20 bp, mouse
gagcagtgcccactacaagc

SEQ ID NO: 520041 - DNA, 20 bp, mouse
gctccgccctcccaccaagt

SEQ ID NO: 520042 - DNA, 20 bp, mouse
gcaagctcgcctgcttgtag

SEQ ID NO: 520043 - DNA, 20 bp, mouse
gcaggcgagcttggccaacc

SEQ ID NO: 520044 - DNA, 20 bp, mouse
ggagctaagagtaaggtcgt

SEQ ID NO: 520045 - DNA, 20 bp, mouse
gaggtcgtgggagagctaac

SEQ ID NO: 520046 - DNA, 20 bp, mouse
gagacctcagaccccaggtg

SEQ ID NO: 520047 - DNA, 20 bp, mouse
gcaagaagacctcagacccc

SEQ ID NO: 520048 - DNA, 20 bp, mouse
gtgagcaccaagaagcactc

SEQ ID NO: 520049 - DNA, 20 bp, mouse
ggccacactgcccgttacag

SEQ ID NO: 520050 - DNA, 20 bp, mouse
ggtgcttgtggacaaggcgt

SEQ ID NO: 520051 - DNA, 20 bp, mouse
gaggggatttcccatgtctc

SEQ ID NO: 520052 - DNA, 20 bp, mouse
gcatgaagtggttctatgag

SEQ ID NO: 520053 - DNA, 20 bp, mouse
ggaggaaagaagacctggcg

SEQ ID NO: 520054 - DNA, 20 bp, mouse
gtgttgcagagattgacatt

SEQ ID NO: 520055 - DNA, 20 bp, mouse
ggataaagatgcagaacacc

SEQ ID NO: 520056 - DNA, 20 bp, mouse
gctccagtcggaagaggcca

SEQ ID NO: 520057 - DNA, 20 bp, mouse
gcagtcggaagaggccaggg

SEQ ID NO: 520058 - DNA, 20 bp, mouse
ggcctgcactcacccctccc

SEQ ID NO: 520059 - DNA, 20 bp, mouse
gcgactggagctccccaagc

SEQ ID NO: 520060 - DNA, 20 bp, mouse
gagctggcacagcaggtctg

SEQ ID NO: 520061 - DNA, 20 bp, mouse
ggtccctaccaaagtgtcaa

SEQ ID NO: 520062 - DNA, 20 bp, mouse
ggccctagacttccagaggg

SEQ ID NO: 520063 - DNA, 20 bp, mouse
gcgctggaagaagatcacaa

SEQ ID NO: 520064 - DNA, 20 bp, mouse
ggggcaacttatccaagatg

SEQ ID NO: 520065 - DNA, 20 bp, mouse
gctagtgccagtagcagcct

SEQ ID NO: 520066 - DNA, 20 bp, mouse
gcccacgggcgccgattcca

SEQ ID NO: 520067 - DNA, 20 bp, mouse
gttgggccccgcgccaggac

SEQ ID NO: 520068 - DNA, 20 bp, mouse
gtggaggcctgggcccccac

SEQ ID NO: 520069 - DNA, 20 bp, mouse
gctaggattgactctaagag

SEQ ID NO: 520070 - DNA, 20 bp, mouse
gcggcagtggatcagtccac

SEQ ID NO: 520071 - DNA, 20 bp, mouse
gcccacgcgcaggacggcag

SEQ ID NO: 520072 - DNA, 20 bp, mouse
ggaacttgatcgctggaatt

SEQ ID NO: 520073 - DNA, 20 bp, mouse
gacgagggggaagagacccg

SEQ ID NO: 520074 - DNA, 20 bp, mouse
gatggagccggccgtggaat

SEQ ID NO: 520075 - DNA, 20 bp, mouse
ggaattgatggagccggccg

SEQ ID NO: 520076 - DNA, 20 bp, mouse
gactgtccattagctaaagt

SEQ ID NO: 520077 - DNA, 20 bp, mouse
gttacagtgccttcagaaac

SEQ ID NO: 520078 - DNA, 20 bp, mouse
gagttggagggtggattaag

SEQ ID NO: 520079 - DNA, 20 bp, mouse
gtgttaagatttggtatata

SEQ ID NO: 520080 - DNA, 20 bp, mouse
gggttgcctactttagctaa

SEQ ID NO: 520081 - DNA, 20 bp, mouse
gacaagcacgatcttgtaag

SEQ ID NO: 520082 - DNA, 20 bp, mouse
gacaaaattaattgaaatat

SEQ ID NO: 520083 - DNA, 20 bp, mouse
ggagagtgaatgatcatttc

SEQ ID NO: 520084 - DNA, 20 bp, mouse
gagcagaatcctgtttctga

SEQ ID NO: 520085 - DNA, 20 bp, mouse
gcatgtggagacaggggttg

SEQ ID NO: 520086 - DNA, 20 bp, mouse
gctctgggagaggacaggtc

SEQ ID NO: 520087 - DNA, 20 bp, mouse
ggcgagtcccgacttcgcag

SEQ ID NO: 520088 - DNA, 20 bp, mouse
gggagaggacaggtcgggct

SEQ ID NO: 520089 - DNA, 20 bp, mouse
gcccagcgcagaaaagaagg

SEQ ID NO: 520090 - DNA, 20 bp, mouse
gggagttcgcggtgtgacag

SEQ ID NO: 520091 - DNA, 20 bp, mouse
gacaccgcgaactccaggag

SEQ ID NO: 520092 - DNA, 20 bp, mouse
gttcgcagcggctctgggag

SEQ ID NO: 520093 - DNA, 20 bp, mouse
gtgtcggccagaaggtgatg

SEQ ID NO: 520094 - DNA, 20 bp, mouse
ggaccgggaaagcgagcgtg

SEQ ID NO: 520095 - DNA, 20 bp, mouse
ggggaaagcgagcgtgtgga

SEQ ID NO: 520096 - DNA, 20 bp, mouse
ggacaacaggaagtccccga

SEQ ID NO: 520097 - DNA, 20 bp, mouse
gagggtgggacgcgggaacg

SEQ ID NO: 520098 - DNA, 20 bp, mouse
gagacttcagggtgggacgc

SEQ ID NO: 520099 - DNA, 20 bp, mouse
gtcgcactccgcacagagcc

SEQ ID NO: 520100 - DNA, 20 bp, mouse
ggcgggaacgcgggaacgcc

SEQ ID NO: 520101 - DNA, 20 bp, mouse
ggggccacagagcctccctc

SEQ ID NO: 520102 - DNA, 20 bp, mouse
gcgagtgagtccgtgacaac

SEQ ID NO: 520103 - DNA, 20 bp, mouse
gaacaggaagtccccgaggg

SEQ ID NO: 520104 - DNA, 20 bp, mouse
gtgtctttaagaagtattag

SEQ ID NO: 520105 - DNA, 20 bp, mouse
gatttgaggccaggagctat

SEQ ID NO: 520106 - DNA, 20 bp, mouse
gagattgctatcatgaaggt

SEQ ID NO: 520107 - DNA, 20 bp, mouse
gtgataggattgtctcagtc

SEQ ID NO: 520108 - DNA, 20 bp, mouse
gaaaaatgtatattctcatt

SEQ ID NO: 520109 - DNA, 20 bp, mouse
gaaatttctgcaattcgtta

SEQ ID NO: 520110 - DNA, 20 bp, mouse
ggcctgtaaaataattaata

SEQ ID NO: 520111 - DNA, 20 bp, mouse
ggacaagattgctatcatga

SEQ ID NO: 520112 - DNA, 20 bp, mouse
gtaagtttttcaaactatca

SEQ ID NO: 520113 - DNA, 20 bp, mouse
gatagtttgaaaaacttact

SEQ ID NO: 520114 - DNA, 20 bp, mouse
ggaaaaacttactaggatta

SEQ ID NO: 520115 - DNA, 20 bp, mouse
gaaaaagtaattaaggagta

SEQ ID NO: 520116 - DNA, 20 bp, mouse
ggctgataggaaactctgga

SEQ ID NO: 520117 - DNA, 20 bp, mouse
gtggtatgttagtgagacat

SEQ ID NO: 520118 - DNA, 20 bp, mouse
gcactgagtagagagttact

SEQ ID NO: 520119 - DNA, 20 bp, mouse
ggtatttacaggcatcccaa

SEQ ID NO: 520120 - DNA, 20 bp, mouse
ggagacatgggaggtcttat

SEQ ID NO: 520121 - DNA, 20 bp, mouse
ggggatataactttaaatat

SEQ ID NO: 520122 - DNA, 20 bp, mouse
gcaacatcttctgaatcgtt

SEQ ID NO: 520123 - DNA, 20 bp, mouse
gagagagagaactacttcag

SEQ ID NO: 520124 - DNA, 20 bp, mouse
gcagagcatgttgcgctgat

SEQ ID NO: 520125 - DNA, 20 bp, mouse
gggaaatgggttacattgct

SEQ ID NO: 520126 - DNA, 20 bp, mouse
ggaatgaaagaacacggtgt

SEQ ID NO: 520127 - DNA, 20 bp, mouse
gttacaggaatgaaagaaca

SEQ ID NO: 520128 - DNA, 20 bp, mouse
gtctttagtggggttttcag

SEQ ID NO: 520129 - DNA, 20 bp, mouse
gtatctgaagcagattaaac

SEQ ID NO: 520130 - DNA, 20 bp, mouse
gttcgcacagagtggagata

SEQ ID NO: 520131 - DNA, 20 bp, mouse
gagtcagaagaagaacctgt

SEQ ID NO: 520132 - DNA, 20 bp, mouse
gctggatccgcagctttcgt

SEQ ID NO: 520133 - DNA, 20 bp, mouse
gttctgacatggtccaacat

SEQ ID NO: 520134 - DNA, 20 bp, mouse
gtggactgtttcgcacagag

SEQ ID NO: 520135 - DNA, 20 bp, mouse
gtcccgagttcacatttctt

SEQ ID NO: 520136 - DNA, 20 bp, mouse
ggtgagcgtcacctgcccag

SEQ ID NO: 520137 - DNA, 20 bp, mouse
gcaggtaacaggtctaggaa

SEQ ID NO: 520138 - DNA, 20 bp, mouse
gtgacatcagtctgaagctt

SEQ ID NO: 520139 - DNA, 20 bp, mouse
ggatgtcaaaagcaaaagtt

SEQ ID NO: 520140 - DNA, 20 bp, mouse
gaggtgacgctcacctaacg

SEQ ID NO: 520141 - DNA, 20 bp, mouse
ggagtggacatcaggtgcag

SEQ ID NO: 520142 - DNA, 20 bp, mouse
gtcacctaacgaggtaagaa

SEQ ID NO: 520143 - DNA, 20 bp, mouse
gaagttacattacttaaata

SEQ ID NO: 520144 - DNA, 20 bp, mouse
ggacacttacgatctgccca

SEQ ID NO: 520145 - DNA, 20 bp, mouse
gcaaaagttcggaagtcctc

SEQ ID NO: 520146 - DNA, 20 bp, mouse
gtcagcagcggcgtctgcac

SEQ ID NO: 520147 - DNA, 20 bp, mouse
ggagttgttaggataaccag

SEQ ID NO: 520148 - DNA, 20 bp, mouse
gtaagtaagctgctcggtgg

SEQ ID NO: 520149 - DNA, 20 bp, mouse
gagcgcggagaaccccgcag

SEQ ID NO: 520150 - DNA, 20 bp, mouse
gcagtaagtaagctgctcgg

SEQ ID NO: 520151 - DNA, 20 bp, mouse
ggcccagtaagtaagctgct

SEQ ID NO: 520152 - DNA, 20 bp, mouse
gcctgggcagaacgtcccct

SEQ ID NO: 520153 - DNA, 20 bp, mouse
gtcagctaggccgctgacag

SEQ ID NO: 520154 - DNA, 20 bp, mouse
ggagacaagggtggggacac

SEQ ID NO: 520155 - DNA, 20 bp, mouse
gggcctcagtcacccctgcg

SEQ ID NO: 520156 - DNA, 20 bp, mouse
gagcgcggagaaccccgcag

SEQ ID NO: 520157 - DNA, 20 bp, mouse
gtaagtaagctgctcggtgg

SEQ ID NO: 520158 - DNA, 20 bp, mouse
gtcagctaggccgctgacag

SEQ ID NO: 520159 - DNA, 20 bp, mouse
gaccgagcagcttacttact

SEQ ID NO: 520160 - DNA, 20 bp, mouse
gcccaaaagaaatccagctg

SEQ ID NO: 520161 - DNA, 20 bp, mouse
ggagacaagggtggggacac

SEQ ID NO: 520162 - DNA, 20 bp, mouse
ggcccagtaagtaagctgct

SEQ ID NO: 520163 - DNA, 20 bp, mouse
ggagttgttaggacaaccag

SEQ ID NO: 520164 - DNA, 20 bp, mouse
gcctgggcagaacgtcccct

SEQ ID NO: 520165 - DNA, 20 bp, mouse
gggcctcagtcacccctgcg

SEQ ID NO: 520166 - DNA, 20 bp, mouse
gtcagcagcggcgtctgcac

SEQ ID NO: 520167 - DNA, 20 bp, mouse
ggagttgttaggataaccag

SEQ ID NO: 520168 - DNA, 20 bp, mouse
gtaagtaagctgctcggtgg

SEQ ID NO: 520169 - DNA, 20 bp, mouse
gagcgcggagaaccccgcag

SEQ ID NO: 520170 - DNA, 20 bp, mouse
gcagtaagtaagctgctcgg

SEQ ID NO: 520171 - DNA, 20 bp, mouse
ggcccagtaagtaagctgct

SEQ ID NO: 520172 - DNA, 20 bp, mouse
gcctgggcagaacgtcccct

SEQ ID NO: 520173 - DNA, 20 bp, mouse
gtcagctaggccgctgacag

SEQ ID NO: 520174 - DNA, 20 bp, mouse
ggagacaagggtggggacac

SEQ ID NO: 520175 - DNA, 20 bp, mouse
gggcctcagtcacccctgcg

SEQ ID NO: 520176 - DNA, 20 bp, mouse
gagaggaggtcaggccccgt

SEQ ID NO: 520177 - DNA, 20 bp, mouse
gtggggtggatggttaaggt

SEQ ID NO: 520178 - DNA, 20 bp, mouse
gccgggatgaggatcaagtt

SEQ ID NO: 520179 - DNA, 20 bp, mouse
gtccagggtcagatcagttg

SEQ ID NO: 520180 - DNA, 20 bp, mouse
ggcctcaactgatctgaccc

SEQ ID NO: 520181 - DNA, 20 bp, mouse
gaatgtgtaattccgggatg

SEQ ID NO: 520182 - DNA, 20 bp, mouse
gggcttctggtcttcccacg

SEQ ID NO: 520183 - DNA, 20 bp, mouse
gtgggatggggaactgtcag

SEQ ID NO: 520184 - DNA, 20 bp, mouse
gctcttagagatggggcagg

SEQ ID NO: 520185 - DNA, 20 bp, mouse
gagtgttggagagatttcca

SEQ ID NO: 520186 - DNA, 20 bp, mouse
gagtgttctgggttccacgt

SEQ ID NO: 520187 - DNA, 20 bp, mouse
gcccagcaactgcgtctaga

SEQ ID NO: 520188 - DNA, 20 bp, mouse
ggagcacgcgtgcgtcccat

SEQ ID NO: 520189 - DNA, 20 bp, mouse
gctgcgggcgcgaccggaag

SEQ ID NO: 520190 - DNA, 20 bp, mouse
gtcccatgggcccctcctat

SEQ ID NO: 520191 - DNA, 20 bp, mouse
gtctagagggctgagtgttc

SEQ ID NO: 520192 - DNA, 20 bp, mouse
gggaaggtaggcctgtagtt

SEQ ID NO: 520193 - DNA, 20 bp, mouse
gcaacccgcaaagaattcac

SEQ ID NO: 520194 - DNA, 20 bp, mouse
gctttcagaaccaataggag

SEQ ID NO: 520195 - DNA, 20 bp, mouse
gaattctttgcgggttgtgg

SEQ ID NO: 520196 - DNA, 20 bp, mouse
ggccaaacgagccggaccac

SEQ ID NO: 520197 - DNA, 20 bp, mouse
gcttggtcgggtgcactact

SEQ ID NO: 520198 - DNA, 20 bp, mouse
gcggctcgtttggcttggtc

SEQ ID NO: 520199 - DNA, 20 bp, mouse
ggacacccgaggagactacg

SEQ ID NO: 520200 - DNA, 20 bp, mouse
gccgcaagtcaagcaccggg

SEQ ID NO: 520201 - DNA, 20 bp, mouse
ggcaggagcattggctacgg

SEQ ID NO: 520202 - DNA, 20 bp, mouse
ggttgcaggagcattggcta

SEQ ID NO: 520203 - DNA, 20 bp, mouse
ggccagacgccagtgtaggg

SEQ ID NO: 520204 - DNA, 20 bp, mouse
gcagcggggcccgtatacac

SEQ ID NO: 520205 - DNA, 20 bp, mouse
gacaggcagcgacatcgcgc

SEQ ID NO: 520206 - DNA, 20 bp, mouse
gccccaccgggcacccagca

SEQ ID NO: 520207 - DNA, 20 bp, mouse
ggacctcccggctcgactgg

SEQ ID NO: 520208 - DNA, 20 bp, mouse
ggaatctggtgttccccacc

SEQ ID NO: 520209 - DNA, 20 bp, mouse
gcggtgagtgcggccctgct

SEQ ID NO: 520210 - DNA, 20 bp, mouse
ggatgtcgtgggacccgggg

SEQ ID NO: 520211 - DNA, 20 bp, mouse
gcgccgccagtcgagccggg

SEQ ID NO: 520212 - DNA, 20 bp, mouse
ggcagacctcccggctcgac

SEQ ID NO: 520213 - DNA, 20 bp, mouse
ggtgcccagcgccccgaatc

SEQ ID NO: 520214 - DNA, 20 bp, mouse
ggggcacggggcggcaacag

SEQ ID NO: 520215 - DNA, 20 bp, mouse
gcgagccgggaggtctgctc

SEQ ID NO: 520216 - DNA, 20 bp, mouse
gccctcagggccctcctctc

SEQ ID NO: 520217 - DNA, 20 bp, mouse
gccaaagccgggtctctgtg

SEQ ID NO: 520218 - DNA, 20 bp, mouse
gctcgagatggacagaacct

SEQ ID NO: 520219 - DNA, 20 bp, mouse
gccagaatctaaagaccctc

SEQ ID NO: 520220 - DNA, 20 bp, mouse
gtttaacagaacgaagccat

SEQ ID NO: 520221 - DNA, 20 bp, mouse
ggcctgtcagccagcctttc

SEQ ID NO: 520222 - DNA, 20 bp, mouse
gaggcatgaggagactgtgc

SEQ ID NO: 520223 - DNA, 20 bp, mouse
gcatgaggagactgtgcagg

SEQ ID NO: 520224 - DNA, 20 bp, mouse
gtgattggcagatgttaaaa

SEQ ID NO: 520225 - DNA, 20 bp, mouse
gcctacgcccacaagactct

SEQ ID NO: 520226 - DNA, 20 bp, mouse
gtgccagcctggcgagctaa

SEQ ID NO: 520227 - DNA, 20 bp, mouse
ggctccgccggccaccggga

SEQ ID NO: 520228 - DNA, 20 bp, mouse
gccctggctcttgctcactg

SEQ ID NO: 520229 - DNA, 20 bp, mouse
gccccagccagaagcagcgg

SEQ ID NO: 520230 - DNA, 20 bp, mouse
gggagacgatgcgagcacag

SEQ ID NO: 520231 - DNA, 20 bp, mouse
gggcaccgccctcaatcccc

SEQ ID NO: 520232 - DNA, 20 bp, mouse
ggctcgcatcgtctccatcc

SEQ ID NO: 520233 - DNA, 20 bp, mouse
ggaccgttagctcgccaggc

SEQ ID NO: 520234 - DNA, 20 bp, mouse
ggccaagcggagccactgtg

SEQ ID NO: 520235 - DNA, 20 bp, mouse
gagcggctgcagcccggtgt

SEQ ID NO: 520236 - DNA, 20 bp, mouse
gccgccccgcgcctcaggac

SEQ ID NO: 520237 - DNA, 20 bp, mouse
gacaccgggagagatatcag

SEQ ID NO: 520238 - DNA, 20 bp, mouse
gggccgggcgcatcccgcgg

SEQ ID NO: 520239 - DNA, 20 bp, mouse
gcggggccgggcgcatcccg

SEQ ID NO: 520240 - DNA, 20 bp, mouse
ggcagcccgacaccccaacc

SEQ ID NO: 520241 - DNA, 20 bp, mouse
gaactagggaccccaaggta

SEQ ID NO: 520242 - DNA, 20 bp, mouse
gagcctggtgagaaaagtgg

SEQ ID NO: 520243 - DNA, 20 bp, mouse
gacggaggcgcgggacgcca

SEQ ID NO: 520244 - DNA, 20 bp, mouse
gcgcggcgctcgcagggcag

SEQ ID NO: 520245 - DNA, 20 bp, mouse
gttgtctggcgagcaagggg

SEQ ID NO: 520246 - DNA, 20 bp, mouse
gccggagcagggaacccgag

SEQ ID NO: 520247 - DNA, 20 bp, mouse
gagcagggaacccgagtggt

SEQ ID NO: 520248 - DNA, 20 bp, mouse
gaggcctcggcgtccctcag

SEQ ID NO: 520249 - DNA, 20 bp, mouse
gcggccgccctgcagcccgt

SEQ ID NO: 520250 - DNA, 20 bp, mouse
gcagcccgtgggccggagca

SEQ ID NO: 520251 - DNA, 20 bp, mouse
ggaacccgagtggtgggtga

SEQ ID NO: 520252 - DNA, 20 bp, mouse
gcggcccacgggctgcaggg

SEQ ID NO: 520253 - DNA, 20 bp, mouse
ggttccctgctccggcccac

SEQ ID NO: 520254 - DNA, 20 bp, mouse
gctccggcccacgggctgca

SEQ ID NO: 520255 - DNA, 20 bp, mouse
ggcggccgtcacccaccact

SEQ ID NO: 520256 - DNA, 20 bp, mouse
ggcattagagcatcaaccac

SEQ ID NO: 520257 - DNA, 20 bp, mouse
ggtgaggccttggttcctgg

SEQ ID NO: 520258 - DNA, 20 bp, mouse
gttcccattatggtaactgg

SEQ ID NO: 520259 - DNA, 20 bp, mouse
ggagacaggcccagacctcc

SEQ ID NO: 520260 - DNA, 20 bp, mouse
ggctgggcctggacaactgt

SEQ ID NO: 520261 - DNA, 20 bp, mouse
gatcaaccacggggagagac

SEQ ID NO: 520262 - DNA, 20 bp, mouse
gtgccaccagttaccataat

SEQ ID NO: 520263 - DNA, 20 bp, mouse
gaatgggaacaggagaaact

SEQ ID NO: 520264 - DNA, 20 bp, mouse
ggaggttcccggcctggcag

SEQ ID NO: 520265 - DNA, 20 bp, mouse
gtgtaggcctgggtgatcct

SEQ ID NO: 520266 - DNA, 20 bp, mouse
gctgtgcgctggcccctgaa

SEQ ID NO: 520267 - DNA, 20 bp, mouse
gggacgccaaccggaagtac

SEQ ID NO: 520268 - DNA, 20 bp, mouse
gaagcgcctgtacttccggt

SEQ ID NO: 520269 - DNA, 20 bp, mouse
gctcggtgcggggctcggga

SEQ ID NO: 520270 - DNA, 20 bp, mouse
gacaggtcacgagaaccgtg

SEQ ID NO: 520271 - DNA, 20 bp, mouse
gtctctcaggtgagttgcgt

SEQ ID NO: 520272 - DNA, 20 bp, mouse
ggagcgtcagcaatcaccag

SEQ ID NO: 520273 - DNA, 20 bp, mouse
gggtcacgagaaccgtgggg

SEQ ID NO: 520274 - DNA, 20 bp, mouse
gtgtacggtgtgcagcagag

SEQ ID NO: 520275 - DNA, 20 bp, mouse
ggcatgccgggatccttgag

SEQ ID NO: 520276 - DNA, 20 bp, mouse
gtccaggcggagggttcccc

SEQ ID NO: 520277 - DNA, 20 bp, mouse
ggtcccagaatccaagatgg

SEQ ID NO: 520278 - DNA, 20 bp, mouse
gtccccgcgtgggcccaaaa

SEQ ID NO: 520279 - DNA, 20 bp, mouse
gcaagatggcggtgtccagg

SEQ ID NO: 520280 - DNA, 20 bp, mouse
ggatggcggtgtccaggcgg

SEQ ID NO: 520281 - DNA, 20 bp, mouse
gacgaccgcgctccagcctg

SEQ ID NO: 520282 - DNA, 20 bp, mouse
gtggctgaaagacagcagca

SEQ ID NO: 520283 - DNA, 20 bp, mouse
ggacagaccgaggagacgaa

SEQ ID NO: 520284 - DNA, 20 bp, mouse
gatccaagatggcggtgtcc

SEQ ID NO: 520285 - DNA, 20 bp, mouse
ggcactggggagacagaccg

SEQ ID NO: 520286 - DNA, 20 bp, mouse
gtggctgtgaggccaacgat

SEQ ID NO: 520287 - DNA, 20 bp, mouse
ggcgtcctatagcccatcgt

SEQ ID NO: 520288 - DNA, 20 bp, mouse
gtcacagccaggatccgtcc

SEQ ID NO: 520289 - DNA, 20 bp, mouse
gtggtttctgggcacctgga

SEQ ID NO: 520290 - DNA, 20 bp, mouse
gaaccagcaacagggaaagg

SEQ ID NO: 520291 - DNA, 20 bp, mouse
gctccatggtggctccagaa

SEQ ID NO: 520292 - DNA, 20 bp, mouse
ggacgccacgcagtcaggcc

SEQ ID NO: 520293 - DNA, 20 bp, mouse
gtgggcacctggacggatcc

SEQ ID NO: 520294 - DNA, 20 bp, mouse
ggaggccaacgatgggctat

SEQ ID NO: 520295 - DNA, 20 bp, mouse
gtataggacgccacgcagtc

SEQ ID NO: 520296 - DNA, 20 bp, mouse
gaggaagcccaggcctccct

SEQ ID NO: 520297 - DNA, 20 bp, mouse
gggaagtggccgagagaaca

SEQ ID NO: 520298 - DNA, 20 bp, mouse
gcagcgccaaagccaggcct

SEQ ID NO: 520299 - DNA, 20 bp, mouse
gggaagtcttagggcggaag

SEQ ID NO: 520300 - DNA, 20 bp, mouse
gggcctccctcaccttggta

SEQ ID NO: 520301 - DNA, 20 bp, mouse
ggaaggcggaagtcttaggg

SEQ ID NO: 520302 - DNA, 20 bp, mouse
gtgccttggaagtcccagag

SEQ ID NO: 520303 - DNA, 20 bp, mouse
gtggctgcggatatcaccga

SEQ ID NO: 520304 - DNA, 20 bp, mouse
gccggaaggcggaagtctta

SEQ ID NO: 520305 - DNA, 20 bp, mouse
gtgaggacgcgggccgaagt

SEQ ID NO: 520306 - DNA, 20 bp, mouse
gaccctcctggtggcagcgg

SEQ ID NO: 520307 - DNA, 20 bp, mouse
ggggccggcggtgggaaaga

SEQ ID NO: 520308 - DNA, 20 bp, mouse
gggcggcttcgagaccctcc

SEQ ID NO: 520309 - DNA, 20 bp, mouse
gcgctgtcgaagccctacca

SEQ ID NO: 520310 - DNA, 20 bp, mouse
gcgggcgcctcaccctggta

SEQ ID NO: 520311 - DNA, 20 bp, mouse
gcgaggtggtcgtgcaggga

SEQ ID NO: 520312 - DNA, 20 bp, mouse
ggcgcgcgtgggctcgggac

SEQ ID NO: 520313 - DNA, 20 bp, mouse
gtcgaagccctaccagggtg

SEQ ID NO: 520314 - DNA, 20 bp, mouse
gcggcccagaccccaacaga

SEQ ID NO: 520315 - DNA, 20 bp, mouse
ggtcagggcgggtcaagcgg

SEQ ID NO: 520316 - DNA, 20 bp, mouse
gacctagaccgcagcaggat

SEQ ID NO: 520317 - DNA, 20 bp, mouse
ggaaaacgccgcctgagctc

SEQ ID NO: 520318 - DNA, 20 bp, mouse
gaagcggttcaagatacaag

SEQ ID NO: 520319 - DNA, 20 bp, mouse
gaacgcgcggcgcagcacca

SEQ ID NO: 520320 - DNA, 20 bp, mouse
ggccctgcggtgggtatgaa

SEQ ID NO: 520321 - DNA, 20 bp, mouse
gagccaagtgcgagagtcca

SEQ ID NO: 520322 - DNA, 20 bp, mouse
gtccgatcctgctgcggtct

SEQ ID NO: 520323 - DNA, 20 bp, mouse
gccgcccgcgggcaatggtg

SEQ ID NO: 520324 - DNA, 20 bp, mouse
ggaagggcaggacgaggtgt

SEQ ID NO: 520325 - DNA, 20 bp, mouse
gaggatggaagggcaggacg

SEQ ID NO: 520326 - DNA, 20 bp, mouse
gcgtcacgggcagcgaggag

SEQ ID NO: 520327 - DNA, 20 bp, mouse
ggcagcgaggagaggcgctt

SEQ ID NO: 520328 - DNA, 20 bp, mouse
gggaaactcaaggtaatctg

SEQ ID NO: 520329 - DNA, 20 bp, mouse
ggaggagaggcgcttaggct

SEQ ID NO: 520330 - DNA, 20 bp, mouse
gtcgccaggaacgcccacgg

SEQ ID NO: 520331 - DNA, 20 bp, mouse
gtgcccgtgacggaaactca

SEQ ID NO: 520332 - DNA, 20 bp, mouse
gcgtgagtccgggacctggg

SEQ ID NO: 520333 - DNA, 20 bp, mouse
gtaccttgagtttccgtcac

SEQ ID NO: 520334 - DNA, 20 bp, mouse
ggctgggtccgggtgcttgg

SEQ ID NO: 520335 - DNA, 20 bp, mouse
gcacgggggtggagtagaag

SEQ ID NO: 520336 - DNA, 20 bp, mouse
gggaccggaagcgaagatgg

SEQ ID NO: 520337 - DNA, 20 bp, mouse
gcggcggccgagctggtgat

SEQ ID NO: 520338 - DNA, 20 bp, mouse
gtccggaccggaagcgaaga

SEQ ID NO: 520339 - DNA, 20 bp, mouse
gggtccgcgagggtctccgg

SEQ ID NO: 520340 - DNA, 20 bp, mouse
gcctttgggcttatccggac

SEQ ID NO: 520341 - DNA, 20 bp, mouse
gtctccggaggaaggcgaag

SEQ ID NO: 520342 - DNA, 20 bp, mouse
ggttaggaaggagaccgcgg

SEQ ID NO: 520343 - DNA, 20 bp, mouse
ggaagttaggaaggagaccg

SEQ ID NO: 520344 - DNA, 20 bp, mouse
gtcggagcgcctcccctacc

SEQ ID NO: 520345 - DNA, 20 bp, mouse
ggagttctcccagggtgagg

SEQ ID NO: 520346 - DNA, 20 bp, mouse
gaagtgggtggagctccggc

SEQ ID NO: 520347 - DNA, 20 bp, mouse
gcccgaaggcccgtgagctc

SEQ ID NO: 520348 - DNA, 20 bp, mouse
ggaaatgtcagccgattgac

SEQ ID NO: 520349 - DNA, 20 bp, mouse
gcgtggcggtgatcacccga

SEQ ID NO: 520350 - DNA, 20 bp, mouse
gggacgcgtgaggtgcgtca

SEQ ID NO: 520351 - DNA, 20 bp, mouse
ggcccgtgagctccgggaaa

SEQ ID NO: 520352 - DNA, 20 bp, mouse
gcagccgattgactgggagc

SEQ ID NO: 520353 - DNA, 20 bp, mouse
ggaggacaggcaggcggaag

SEQ ID NO: 520354 - DNA, 20 bp, mouse
gtggcggacatagacttggg

SEQ ID NO: 520355 - DNA, 20 bp, mouse
gaccccggagatgggcctgg

SEQ ID NO: 520356 - DNA, 20 bp, mouse
gagagccgccggctgcacac

SEQ ID NO: 520357 - DNA, 20 bp, mouse
gcctggacagcgctgctgaa

SEQ ID NO: 520358 - DNA, 20 bp, mouse
gttctcaggcaggggccaga

SEQ ID NO: 520359 - DNA, 20 bp, mouse
gctgctgaatggccaagttc

SEQ ID NO: 520360 - DNA, 20 bp, mouse
gtcagacgcactgagtacct

SEQ ID NO: 520361 - DNA, 20 bp, mouse
gccagagggagcgcgcagcc

SEQ ID NO: 520362 - DNA, 20 bp, mouse
gtttgcctgtgtgcagccgg

SEQ ID NO: 520363 - DNA, 20 bp, mouse
gtggctaaggacctcaaccc

SEQ ID NO: 520364 - DNA, 20 bp, mouse
gcagcatcaataaagaacta

SEQ ID NO: 520365 - DNA, 20 bp, mouse
gggttggagggtacaggcaa

SEQ ID NO: 520366 - DNA, 20 bp, mouse
gcgcccagacagcctagtaa

SEQ ID NO: 520367 - DNA, 20 bp, mouse
gagtaatggctgcgcccgag

SEQ ID NO: 520368 - DNA, 20 bp, mouse
ggggtcgctgagaaaacgga

SEQ ID NO: 520369 - DNA, 20 bp, mouse
gcgaggggtcgctgagaaaa

SEQ ID NO: 520370 - DNA, 20 bp, mouse
gctgagaaaacggaaggtcg

SEQ ID NO: 520371 - DNA, 20 bp, mouse
ggctaagtggggctgtggag

SEQ ID NO: 520372 - DNA, 20 bp, mouse
gctccagctcggctgcacac

SEQ ID NO: 520373 - DNA, 20 bp, mouse
gggcaacagcccgctcccac

SEQ ID NO: 520374 - DNA, 20 bp, mouse
gctgggcgcatgagcacaaa

SEQ ID NO: 520375 - DNA, 20 bp, mouse
gggcgcatgagcacaaaggg

SEQ ID NO: 520376 - DNA, 20 bp, mouse
ggggcagctaggagactaga

SEQ ID NO: 520377 - DNA, 20 bp, mouse
gtgggtgtagagggacgcaa

SEQ ID NO: 520378 - DNA, 20 bp, mouse
gtggagctcagtgacccgac

SEQ ID NO: 520379 - DNA, 20 bp, mouse
gagtgacccgaccggactga

SEQ ID NO: 520380 - DNA, 20 bp, mouse
gtggttagcggtgagttctt

SEQ ID NO: 520381 - DNA, 20 bp, mouse
gagactagagggcactactt

SEQ ID NO: 520382 - DNA, 20 bp, mouse
gggaatccgtcagtccggtc

SEQ ID NO: 520383 - DNA, 20 bp, mouse
gaaggcgaacaagtagacag

SEQ ID NO: 520384 - DNA, 20 bp, mouse
gcagccggaatccgtcagtc

SEQ ID NO: 520385 - DNA, 20 bp, mouse
gctctctgcgcgggattaag

SEQ ID NO: 520386 - DNA, 20 bp, mouse
ggacgccggcccgaagatgg

SEQ ID NO: 520387 - DNA, 20 bp, mouse
gaacgacgccggcccgaaga

SEQ ID NO: 520388 - DNA, 20 bp, mouse
gtggcggccgctgggtctgg

SEQ ID NO: 520389 - DNA, 20 bp, mouse
gagcgggcggcccgggacca

SEQ ID NO: 520390 - DNA, 20 bp, mouse
ggcctcgcggccctggtccc

SEQ ID NO: 520391 - DNA, 20 bp, mouse
gctgggtctggaggagcggg

SEQ ID NO: 520392 - DNA, 20 bp, mouse
ggaggaggcgtcgcactcca

SEQ ID NO: 520393 - DNA, 20 bp, mouse
gagtggctggagtaacgtgg

SEQ ID NO: 520394 - DNA, 20 bp, mouse
gcgggtccggcggaggacga

SEQ ID NO: 520395 - DNA, 20 bp, mouse
gagatggcggccgctgggtc

SEQ ID NO: 520396 - DNA, 20 bp, mouse
gctggcaggcgtggagatct

SEQ ID NO: 520397 - DNA, 20 bp, mouse
gcgcacctcgggatctgggt

SEQ ID NO: 520398 - DNA, 20 bp, mouse
gtgggcaggggtcccgagaa

SEQ ID NO: 520399 - DNA, 20 bp, mouse
gatccgagtgggcgacagtg

SEQ ID NO: 520400 - DNA, 20 bp, mouse
ggcagccgggtgatccgagt

SEQ ID NO: 520401 - DNA, 20 bp, mouse
ggccaggcagaggctctaat

SEQ ID NO: 520402 - DNA, 20 bp, mouse
gcggccggccggcaccaggg

SEQ ID NO: 520403 - DNA, 20 bp, mouse
gagccggcgaagctcgctcc

SEQ ID NO: 520404 - DNA, 20 bp, mouse
gcaggcgtggagatctgggc

SEQ ID NO: 520405 - DNA, 20 bp, mouse
gctgggcgctggcgcacctc

SEQ ID NO: 520406 - DNA, 20 bp, mouse
gcgcgcgcgggaagaggcca

SEQ ID NO: 520407 - DNA, 20 bp, mouse
gggcagccgggagacgcaga

SEQ ID NO: 520408 - DNA, 20 bp, mouse
gttcggcggcggtcacgtgg

SEQ ID NO: 520409 - DNA, 20 bp, mouse
gcacaaagagcgaagcggga

SEQ ID NO: 520410 - DNA, 20 bp, mouse
ggtgcgtgtacactcacaaa

SEQ ID NO: 520411 - DNA, 20 bp, mouse
ggccgcgctccgcaacatgg

SEQ ID NO: 520412 - DNA, 20 bp, mouse
gcaggccggtgaggatcgag

SEQ ID NO: 520413 - DNA, 20 bp, mouse
gactcacaaagggcgtctgg

SEQ ID NO: 520414 - DNA, 20 bp, mouse
ggtgaccgccgccgaaccaa

SEQ ID NO: 520415 - DNA, 20 bp, mouse
gaggtccgctcgatcctcac

SEQ ID NO: 520416 - DNA, 20 bp, mouse
gggcggcgggagaatcacct

SEQ ID NO: 520417 - DNA, 20 bp, mouse
gagagacgccatggcggagg

SEQ ID NO: 520418 - DNA, 20 bp, mouse
gggcggcagagacgccatgg

SEQ ID NO: 520419 - DNA, 20 bp, mouse
gtggggcggcagagacgcca

SEQ ID NO: 520420 - DNA, 20 bp, mouse
gggcagagacgccatggcgg

SEQ ID NO: 520421 - DNA, 20 bp, mouse
gcacctcggttgcccgaatg

SEQ ID NO: 520422 - DNA, 20 bp, mouse
ggcggcggcgccatcttccg

SEQ ID NO: 520423 - DNA, 20 bp, mouse
gcggatctccgagaaggagg

SEQ ID NO: 520424 - DNA, 20 bp, mouse
gacagacgcgtgggcgacag

SEQ ID NO: 520425 - DNA, 20 bp, mouse
ggcagccgagacagacgcgt

SEQ ID NO: 520426 - DNA, 20 bp, mouse
gctcatacattgagggagaa

SEQ ID NO: 520427 - DNA, 20 bp, mouse
gagagatgggggaatctcgg

SEQ ID NO: 520428 - DNA, 20 bp, mouse
gattatattcaaagagatgg

SEQ ID NO: 520429 - DNA, 20 bp, mouse
gtgcaaacctcatacattga

SEQ ID NO: 520430 - DNA, 20 bp, mouse
ggtagttccttgcaattctg

SEQ ID NO: 520431 - DNA, 20 bp, mouse
ggccgaagcgcgcccggagt

SEQ ID NO: 520432 - DNA, 20 bp, mouse
gaattctgaggcacaaaagt

SEQ ID NO: 520433 - DNA, 20 bp, mouse
ggaaattatattcaaagaga

SEQ ID NO: 520434 - DNA, 20 bp, mouse
ggattcagattaaatccgag

SEQ ID NO: 520435 - DNA, 20 bp, mouse
gcggtcctccggcagcaagc

SEQ ID NO: 520436 - DNA, 20 bp, mouse
gtctgtagtgacgattggag

SEQ ID NO: 520437 - DNA, 20 bp, mouse
gcaatcgtcactacagatgc

SEQ ID NO: 520438 - DNA, 20 bp, mouse
gggcctaatgaccctaacct

SEQ ID NO: 520439 - DNA, 20 bp, mouse
gtgtggcgaggacttccctg

SEQ ID NO: 520440 - DNA, 20 bp, mouse
gcttctttccagaaaatgtc

SEQ ID NO: 520441 - DNA, 20 bp, mouse
gctgatctcactggccctgg

SEQ ID NO: 520442 - DNA, 20 bp, mouse
gtagtgacgattggagaggc

SEQ ID NO: 520443 - DNA, 20 bp, mouse
gagtgctgtggcaccaggca

SEQ ID NO: 520444 - DNA, 20 bp, mouse
gagaaggcaagagttgagtc

SEQ ID NO: 520445 - DNA, 20 bp, mouse
gagccagtcttccaagtgtg

SEQ ID NO: 520446 - DNA, 20 bp, mouse
ggacagtgcggctctgctgg

SEQ ID NO: 520447 - DNA, 20 bp, mouse
gtgcgatgcccgagacagtg

SEQ ID NO: 520448 - DNA, 20 bp, mouse
gagcagagccgcactgtctc

SEQ ID NO: 520449 - DNA, 20 bp, mouse
gcacagcttgcgcccctctc

SEQ ID NO: 520450 - DNA, 20 bp, mouse
gtgcgactgctctccagaga

SEQ ID NO: 520451 - DNA, 20 bp, mouse
gggtcccaagtccacagtcg

SEQ ID NO: 520452 - DNA, 20 bp, mouse
gtcgcagagcaccacgactg

SEQ ID NO: 520453 - DNA, 20 bp, mouse
gggattagcaatccaaatag

SEQ ID NO: 520454 - DNA, 20 bp, mouse
ggctagcgcgcgctcgtctc

SEQ ID NO: 520455 - DNA, 20 bp, mouse
gtcctgctggaacgggcgag

SEQ ID NO: 520456 - DNA, 20 bp, mouse
gccgaggcgctgtaataact

SEQ ID NO: 520457 - DNA, 20 bp, mouse
gttacagcgcctcggagccc

SEQ ID NO: 520458 - DNA, 20 bp, mouse
gcataatacagcccaagaaa

SEQ ID NO: 520459 - DNA, 20 bp, mouse
gaactgggtgaccttttctt

SEQ ID NO: 520460 - DNA, 20 bp, mouse
ggatctgacaggcgctgcct

SEQ ID NO: 520461 - DNA, 20 bp, mouse
ggatccgccaagtaccagtg

SEQ ID NO: 520462 - DNA, 20 bp, mouse
gaaatactcttaaatcggaa

SEQ ID NO: 520463 - DNA, 20 bp, mouse
ggctcgcatgcggtccacac

SEQ ID NO: 520464 - DNA, 20 bp, mouse
gtattatgtctggctgggaa

SEQ ID NO: 520465 - DNA, 20 bp, mouse
gttaggcaactgcagtccgg

SEQ ID NO: 520466 - DNA, 20 bp, mouse
gcgcagaagcaggaaagggg

SEQ ID NO: 520467 - DNA, 20 bp, mouse
gtccctcggccgggcccgcg

SEQ ID NO: 520468 - DNA, 20 bp, mouse
ggtgtcaagtctcagcccga

SEQ ID NO: 520469 - DNA, 20 bp, mouse
ggagggagccccacgctaag

SEQ ID NO: 520470 - DNA, 20 bp, mouse
gggtcccggtcctcagcccc

SEQ ID NO: 520471 - DNA, 20 bp, mouse
gaaggggaggagggggctaa

SEQ ID NO: 520472 - DNA, 20 bp, mouse
ggcgggcccggaggggacga

SEQ ID NO: 520473 - DNA, 20 bp, mouse
ggccgcgcgggcccggccga

SEQ ID NO: 520474 - DNA, 20 bp, mouse
gagctgcaggctccctcggc

SEQ ID NO: 520475 - DNA, 20 bp, mouse
gccgggagcgctggaccgat

SEQ ID NO: 520476 - DNA, 20 bp, mouse
ggcctgactggagcaggagg

SEQ ID NO: 520477 - DNA, 20 bp, mouse
gagaaggagccgggactcct

SEQ ID NO: 520478 - DNA, 20 bp, mouse
gtcagcctgactggagcagg

SEQ ID NO: 520479 - DNA, 20 bp, mouse
gccatgtctagggcaagaga

SEQ ID NO: 520480 - DNA, 20 bp, mouse
gacctcctcctgctccagtc

SEQ ID NO: 520481 - DNA, 20 bp, mouse
gggctcaagttcagcctgac

SEQ ID NO: 520482 - DNA, 20 bp, mouse
ggcggggctactgtcgaggg

SEQ ID NO: 520483 - DNA, 20 bp, mouse
ggcggtgtgcagaaggagcc

SEQ ID NO: 520484 - DNA, 20 bp, mouse
ggcagaggctcagagatggg

SEQ ID NO: 520485 - DNA, 20 bp, mouse
gtcttgccctagacatggaa

SEQ ID NO: 520486 - DNA, 20 bp, mouse
gtgtactacaggtgctccgg

SEQ ID NO: 520487 - DNA, 20 bp, mouse
gcaagcagggtccactagca

SEQ ID NO: 520488 - DNA, 20 bp, mouse
ggagcacctgtagtacagca

SEQ ID NO: 520489 - DNA, 20 bp, mouse
gcaaagtagctaagtaccgg

SEQ ID NO: 520490 - DNA, 20 bp, mouse
gtagtaggcagggaagggac

SEQ ID NO: 520491 - DNA, 20 bp, mouse
gtgcagtgctcacctagctg

SEQ ID NO: 520492 - DNA, 20 bp, mouse
gttgctggttagaccaagca

SEQ ID NO: 520493 - DNA, 20 bp, mouse
gttgggccctgctgtactac

SEQ ID NO: 520494 - DNA, 20 bp, mouse
ggtccaaagtagctaagtac

SEQ ID NO: 520495 - DNA, 20 bp, mouse
gcaagcccaccacacttggt

SEQ ID NO: 520496 - DNA, 20 bp, mouse
gcagcagctggtgtgaggag

SEQ ID NO: 520497 - DNA, 20 bp, mouse
ggagcgagcgtcaggctggt

SEQ ID NO: 520498 - DNA, 20 bp, mouse
gagggaggcgagcgagcgtc

SEQ ID NO: 520499 - DNA, 20 bp, mouse
gaggcgagcgagcgtcaggc

SEQ ID NO: 520500 - DNA, 20 bp, mouse
gagcgtcaggctggtcgggc

SEQ ID NO: 520501 - DNA, 20 bp, mouse
gttaaagaaccaggcattca

SEQ ID NO: 520502 - DNA, 20 bp, mouse
gcccaagagcttaaagaacc

SEQ ID NO: 520503 - DNA, 20 bp, mouse
ggctcttggggagtctgaca

SEQ ID NO: 520504 - DNA, 20 bp, mouse
gcgctcttaaaaggttcctg

SEQ ID NO: 520505 - DNA, 20 bp, mouse
gcaagacgatgggcacagat

SEQ ID NO: 520506 - DNA, 20 bp, mouse
ggagtgagaaaatctctcaa

SEQ ID NO: 520507 - DNA, 20 bp, mouse
gtgagaaaatctctcaaggg

SEQ ID NO: 520508 - DNA, 20 bp, mouse
gaaatctctcaagggtgggt

SEQ ID NO: 520509 - DNA, 20 bp, mouse
gtcatcgagctcctcactaa

SEQ ID NO: 520510 - DNA, 20 bp, mouse
gtctaattaacaaatatctt

SEQ ID NO: 520511 - DNA, 20 bp, mouse
gagctcttcaggggataagt

SEQ ID NO: 520512 - DNA, 20 bp, mouse
gtcggggcacagcaggaatt

SEQ ID NO: 520513 - DNA, 20 bp, mouse
gaaaaaagtaaactatgtcg

SEQ ID NO: 520514 - DNA, 20 bp, mouse
ggtaatcaacgagagactta

SEQ ID NO: 520515 - DNA, 20 bp, mouse
gaggtaaccagggatctgtg

SEQ ID NO: 520516 - DNA, 20 bp, mouse
gcacatgacgcagcccatca

SEQ ID NO: 520517 - DNA, 20 bp, mouse
gcgcccctcaacagcagcaa

SEQ ID NO: 520518 - DNA, 20 bp, mouse
ggcgctcccgccgccatgat

SEQ ID NO: 520519 - DNA, 20 bp, mouse
gagcaacggcgcccagcctg

SEQ ID NO: 520520 - DNA, 20 bp, mouse
gggagcagcaggagcatcgg

SEQ ID NO: 520521 - DNA, 20 bp, mouse
ggggctgaccgactgactga

SEQ ID NO: 520522 - DNA, 20 bp, mouse
ggtcatgtgacgtagagctg

SEQ ID NO: 520523 - DNA, 20 bp, mouse
gctgaccgactgactgaagg

SEQ ID NO: 520524 - DNA, 20 bp, mouse
gcctgggcccgcggctccgc

SEQ ID NO: 520525 - DNA, 20 bp, mouse
gccgagagccggccccgtgg

SEQ ID NO: 520526 - DNA, 20 bp, mouse
gagggaggtggaggaatcgg

SEQ ID NO: 520527 - DNA, 20 bp, mouse
ggaagggatggagaggcgga

SEQ ID NO: 520528 - DNA, 20 bp, mouse
ggggcgggagatgcaggaca

SEQ ID NO: 520529 - DNA, 20 bp, mouse
ggtctgtcctttcgaggagg

SEQ ID NO: 520530 - DNA, 20 bp, mouse
gagccggggttgctggggta

SEQ ID NO: 520531 - DNA, 20 bp, mouse
gtccgtctgtcctttcgagg

SEQ ID NO: 520532 - DNA, 20 bp, mouse
gtggggagccggggttgctg

SEQ ID NO: 520533 - DNA, 20 bp, mouse
gcgcagtccctggggaccaa

SEQ ID NO: 520534 - DNA, 20 bp, mouse
gagcgggtccccatggctgg

SEQ ID NO: 520535 - DNA, 20 bp, mouse
gagggttgagcgggtcccca

SEQ ID NO: 520536 - DNA, 20 bp, mouse
gctcggcgaggatgtctcca

SEQ ID NO: 520537 - DNA, 20 bp, mouse
ggagacatcctcgccgaggg

SEQ ID NO: 520538 - DNA, 20 bp, mouse
gctggtccagcctcattgag

SEQ ID NO: 520539 - DNA, 20 bp, mouse
gcaggggataggcagaggta

SEQ ID NO: 520540 - DNA, 20 bp, mouse
ggcagacacacccggaagcg

SEQ ID NO: 520541 - DNA, 20 bp, mouse
ggcgactcgtcccctcaatg

SEQ ID NO: 520542 - DNA, 20 bp, mouse
ggaggatgtctccatggtcc

SEQ ID NO: 520543 - DNA, 20 bp, mouse
gctcggggtcccaccctacg

SEQ ID NO: 520544 - DNA, 20 bp, mouse
ggacgagtcgcaggtattcc

SEQ ID NO: 520545 - DNA, 20 bp, mouse
ggcgcagcacggctcactgg

SEQ ID NO: 520546 - DNA, 20 bp, mouse
ggagccgtccgagcagttca

SEQ ID NO: 520547 - DNA, 20 bp, mouse
gccgtccgagcagttcacgg

SEQ ID NO: 520548 - DNA, 20 bp, mouse
ggacaagggaaatgtaaggt

SEQ ID NO: 520549 - DNA, 20 bp, mouse
gcgacaagaatgagcctaga

SEQ ID NO: 520550 - DNA, 20 bp, mouse
gaagggaaatgtaaggtggg

SEQ ID NO: 520551 - DNA, 20 bp, mouse
ggccaggaggacctgtagag

SEQ ID NO: 520552 - DNA, 20 bp, mouse
gtgtctggactctaccctct

SEQ ID NO: 520553 - DNA, 20 bp, mouse
gttggacggcctgaagatgg

SEQ ID NO: 520554 - DNA, 20 bp, mouse
ggacctgtagagcggaggaa

SEQ ID NO: 520555 - DNA, 20 bp, mouse
gaggaggacctgtagagcgg

SEQ ID NO: 520556 - DNA, 20 bp, mouse
gctgctgcagccgggacccg

SEQ ID NO: 520557 - DNA, 20 bp, mouse
ggggctgacaagcaggtgac

SEQ ID NO: 520558 - DNA, 20 bp, mouse
ggcgagtagccggtagagag

SEQ ID NO: 520559 - DNA, 20 bp, mouse
gcccgcgcgccgctctctac

SEQ ID NO: 520560 - DNA, 20 bp, mouse
gtcccggctgcagcagcggg

SEQ ID NO: 520561 - DNA, 20 bp, mouse
ggcgcgtggctgcgagtagc

SEQ ID NO: 520562 - DNA, 20 bp, mouse
gcccagcagcacccccaggg

SEQ ID NO: 520563 - DNA, 20 bp, mouse
ggcttgtcagccccgggtcc

SEQ ID NO: 520564 - DNA, 20 bp, mouse
gtgcagcggagcgggcggac

SEQ ID NO: 520565 - DNA, 20 bp, mouse
gtcacccagcagcaccccca

SEQ ID NO: 520566 - DNA, 20 bp, mouse
gctccagaggctctacgcgg

SEQ ID NO: 520567 - DNA, 20 bp, mouse
gggcccagcgctctatctgt

SEQ ID NO: 520568 - DNA, 20 bp, mouse
gctgctccagaggctctacg

SEQ ID NO: 520569 - DNA, 20 bp, mouse
gctctacgcggtggcgaccc

SEQ ID NO: 520570 - DNA, 20 bp, mouse
gcgccaccgcgtagagcctc

SEQ ID NO: 520571 - DNA, 20 bp, mouse
gcggcctgggcgtccactcg

SEQ ID NO: 520572 - DNA, 20 bp, mouse
gcgtccactcggggaagcct

SEQ ID NO: 520573 - DNA, 20 bp, mouse
gcgacccaggcttccccgag

SEQ ID NO: 520574 - DNA, 20 bp, mouse
gagaacaccggcctcagggg

SEQ ID NO: 520575 - DNA, 20 bp, mouse
gggcgatccacgagagaagg

SEQ ID NO: 520576 - DNA, 20 bp, mouse
gctgggctggtaaggacccg

SEQ ID NO: 520577 - DNA, 20 bp, mouse
gggctggtaaggacccgcgg

SEQ ID NO: 520578 - DNA, 20 bp, mouse
gccgcttcggctctcggagt

SEQ ID NO: 520579 - DNA, 20 bp, mouse
gctctcggagtaggaagctt

SEQ ID NO: 520580 - DNA, 20 bp, mouse
gtcagtcgtcaggaccgctt

SEQ ID NO: 520581 - DNA, 20 bp, mouse
ggggtccagagggtcagatg

SEQ ID NO: 520582 - DNA, 20 bp, mouse
gcgaagggcgacaacccctc

SEQ ID NO: 520583 - DNA, 20 bp, mouse
ggaggggccagggtcggctg

SEQ ID NO: 520584 - DNA, 20 bp, mouse
gcctctggcgacagcatcac

SEQ ID NO: 520585 - DNA, 20 bp, mouse
gcgggctagccactcaccat

SEQ ID NO: 520586 - DNA, 20 bp, mouse
ggcttctggcacagggatgg

SEQ ID NO: 520587 - DNA, 20 bp, mouse
ggacgcttctggcacaggga

SEQ ID NO: 520588 - DNA, 20 bp, mouse
gcctgtgccagaagcgtcta

SEQ ID NO: 520589 - DNA, 20 bp, mouse
gaggcggccctagacgcttc

SEQ ID NO: 520590 - DNA, 20 bp, mouse
ggggccgcctgagctgtgac

SEQ ID NO: 520591 - DNA, 20 bp, mouse
gtctggactgagccagtaag

SEQ ID NO: 520592 - DNA, 20 bp, mouse
gcacagggatggaggctggc

SEQ ID NO: 520593 - DNA, 20 bp, mouse
gagaccggtcacagctcagg

SEQ ID NO: 520594 - DNA, 20 bp, mouse
ggggccagaggtctaaagag

SEQ ID NO: 520595 - DNA, 20 bp, mouse
gtgtacaccgaagttgagac

SEQ ID NO: 520596 - DNA, 20 bp, mouse
gcttctcgccaggaaatcgg

SEQ ID NO: 520597 - DNA, 20 bp, mouse
gcggcggcggcgagtcccag

SEQ ID NO: 520598 - DNA, 20 bp, mouse
ggcggcgagtcccagcggag

SEQ ID NO: 520599 - DNA, 20 bp, mouse
gctcgccaggaaatcggcgg

SEQ ID NO: 520600 - DNA, 20 bp, mouse
gcggttgagaagtaaagtct

SEQ ID NO: 520601 - DNA, 20 bp, mouse
ggacagcacgcggcccccag

SEQ ID NO: 520602 - DNA, 20 bp, mouse
gggcgcgcagacctgcatcg

SEQ ID NO: 520603 - DNA, 20 bp, mouse
gctcgccgccgccgatttcc

SEQ ID NO: 520604 - DNA, 20 bp, mouse
gcgctcgccccctaggggaa

SEQ ID NO: 520605 - DNA, 20 bp, mouse
gaggcgaagtaactcactga

SEQ ID NO: 520606 - DNA, 20 bp, mouse
gcgagcggcgtgctttccag

SEQ ID NO: 520607 - DNA, 20 bp, mouse
gcgccgctcgcgttgacagg

SEQ ID NO: 520608 - DNA, 20 bp, mouse
ggggccacagacacttggag

SEQ ID NO: 520609 - DNA, 20 bp, mouse
gtcgcgttgacaggaggctc

SEQ ID NO: 520610 - DNA, 20 bp, mouse
ggaggtgaggcaccgacctg

SEQ ID NO: 520611 - DNA, 20 bp, mouse
gacaccggtgcggggaggtg

SEQ ID NO: 520612 - DNA, 20 bp, mouse
gacacagagggcctgcaccg

SEQ ID NO: 520613 - DNA, 20 bp, mouse
gcagcaacaccggtgcgggg

SEQ ID NO: 520614 - DNA, 20 bp, mouse
gcagagggcctgcaccgggg

SEQ ID NO: 520615 - DNA, 20 bp, mouse
gcgatctgaacgcctcaggt

SEQ ID NO: 520616 - DNA, 20 bp, mouse
gggcgagcacaggctacgtg

SEQ ID NO: 520617 - DNA, 20 bp, mouse
gtagcagagcaggggagcgg

SEQ ID NO: 520618 - DNA, 20 bp, mouse
gcagtatggctgttccatgg

SEQ ID NO: 520619 - DNA, 20 bp, mouse
gcgtcagtatggctgttcca

SEQ ID NO: 520620 - DNA, 20 bp, mouse
gtgcgggtgatggcgatgag

SEQ ID NO: 520621 - DNA, 20 bp, mouse
ggcggtgctgggttctgcgg

SEQ ID NO: 520622 - DNA, 20 bp, mouse
ggtgcggtgcgccgtcagta

SEQ ID NO: 520623 - DNA, 20 bp, mouse
ggcagcgacgagacctccga

SEQ ID NO: 520624 - DNA, 20 bp, mouse
ggaccccgccgggaagaacg

SEQ ID NO: 520625 - DNA, 20 bp, mouse
gtcttcccggcggggtccag

SEQ ID NO: 520626 - DNA, 20 bp, mouse
gcactggtcgtcaacaccag

SEQ ID NO: 520627 - DNA, 20 bp, mouse
gtgcggagccgcttgctcaa

SEQ ID NO: 520628 - DNA, 20 bp, mouse
gaagtgtagagttcgtactt

SEQ ID NO: 520629 - DNA, 20 bp, mouse
gggagtcctcctgacacctc

SEQ ID NO: 520630 - DNA, 20 bp, mouse
gatctggatggggctcacgg

SEQ ID NO: 520631 - DNA, 20 bp, mouse
gtctcgtgggtcaacagcag

SEQ ID NO: 520632 - DNA, 20 bp, mouse
gcaccgcagccgtcactcga

SEQ ID NO: 520633 - DNA, 20 bp, mouse
ggctgcggtgcgttcggcga

SEQ ID NO: 520634 - DNA, 20 bp, mouse
gatggggctcacggaggaca

SEQ ID NO: 520635 - DNA, 20 bp, mouse
gggcggctggggatctggat

SEQ ID NO: 520636 - DNA, 20 bp, mouse
gggcggggcctacagaggag

SEQ ID NO: 520637 - DNA, 20 bp, mouse
gtccaggaggggctcagaaa

SEQ ID NO: 520638 - DNA, 20 bp, mouse
gaggccggccgcatgtcggg

SEQ ID NO: 520639 - DNA, 20 bp, mouse
gcggccagctctggtgaact

SEQ ID NO: 520640 - DNA, 20 bp, mouse
gaggaggccggccgcatgtc

SEQ ID NO: 520641 - DNA, 20 bp, mouse
gaggccgggcgcagaagcca

SEQ ID NO: 520642 - DNA, 20 bp, mouse
gcgcccggcctcccgacatg

SEQ ID NO: 520643 - DNA, 20 bp, mouse
gggaggttcccggaccgtgg

SEQ ID NO: 520644 - DNA, 20 bp, mouse
ggggaccagccggccagctc

SEQ ID NO: 520645 - DNA, 20 bp, mouse
gacgcggccggcgagcaggg

SEQ ID NO: 520646 - DNA, 20 bp, mouse
gccacgcgagacgggcccgg

SEQ ID NO: 520647 - DNA, 20 bp, mouse
gccgtctcgcgtggtcccca

SEQ ID NO: 520648 - DNA, 20 bp, mouse
gagcgcacgcggcccagccc

SEQ ID NO: 520649 - DNA, 20 bp, mouse
gggaccacgcgagacgggcc

SEQ ID NO: 520650 - DNA, 20 bp, mouse
gaccgggtgctgccagccgt

SEQ ID NO: 520651 - DNA, 20 bp, mouse
gcaggccggccagcagcgag

SEQ ID NO: 520652 - DNA, 20 bp, mouse
ggcgtggctgacggtgaaga

SEQ ID NO: 520653 - DNA, 20 bp, mouse
gctcgctggcgactacgaag

SEQ ID NO: 520654 - DNA, 20 bp, mouse
ggctgcgctgcgcttcctcc

SEQ ID NO: 520655 - DNA, 20 bp, mouse
gtcgccagcgaggaaggccg

SEQ ID NO: 520656 - DNA, 20 bp, mouse
gagccggcatggagctcggg

SEQ ID NO: 520657 - DNA, 20 bp, mouse
gggctgcgcgagcgagaagg

SEQ ID NO: 520658 - DNA, 20 bp, mouse
gggcagccggcatggagctc

SEQ ID NO: 520659 - DNA, 20 bp, mouse
ggcgggctgcgcgagcgaga

SEQ ID NO: 520660 - DNA, 20 bp, mouse
ggaggagccggggacatcag

SEQ ID NO: 520661 - DNA, 20 bp, mouse
gcgcctcccgagctccatgc

SEQ ID NO: 520662 - DNA, 20 bp, mouse
gggagtgaggagaggcgtct

SEQ ID NO: 520663 - DNA, 20 bp, mouse
gaactagcaggaaagagcgg

SEQ ID NO: 520664 - DNA, 20 bp, mouse
gacagttattaggcagcgcg

SEQ ID NO: 520665 - DNA, 20 bp, mouse
ggggaactagcaggaaagag

SEQ ID NO: 520666 - DNA, 20 bp, mouse
gacacttacctgaagcacca

SEQ ID NO: 520667 - DNA, 20 bp, mouse
gagagtggtaagctggtgct

SEQ ID NO: 520668 - DNA, 20 bp, mouse
gctgaatacactatcaggaa

SEQ ID NO: 520669 - DNA, 20 bp, mouse
ggctgtctggtctctccagt

SEQ ID NO: 520670 - DNA, 20 bp, mouse
gtcatcttccctggtgcttc

SEQ ID NO: 520671 - DNA, 20 bp, mouse
ggctgggcagatgatgtgtc

SEQ ID NO: 520672 - DNA, 20 bp, mouse
gctgcagtggcaggcctcca

SEQ ID NO: 520673 - DNA, 20 bp, mouse
gtcagcttgcagagaggtta

SEQ ID NO: 520674 - DNA, 20 bp, mouse
gaggttcatccagcccatgg

SEQ ID NO: 520675 - DNA, 20 bp, mouse
gatgatgtgtctggtcttct

SEQ ID NO: 520676 - DNA, 20 bp, mouse
ggagctgcgcacgaaggtct

SEQ ID NO: 520677 - DNA, 20 bp, mouse
gccagccctggaaggcgacg

SEQ ID NO: 520678 - DNA, 20 bp, mouse
gagctccccgtcgccttcca

SEQ ID NO: 520679 - DNA, 20 bp, mouse
ggccttccagggctgggaaa

SEQ ID NO: 520680 - DNA, 20 bp, mouse
gcccaggctgccgtcggacg

SEQ ID NO: 520681 - DNA, 20 bp, mouse
gtgggaaagcgcacagagtc

SEQ ID NO: 520682 - DNA, 20 bp, mouse
gcgggactcagatcccacga

SEQ ID NO: 520683 - DNA, 20 bp, mouse
gctggcgccagacaatccaa

SEQ ID NO: 520684 - DNA, 20 bp, mouse
ggagacctctccgagcaggg

SEQ ID NO: 520685 - DNA, 20 bp, mouse
gtggcgccaggcaccagggg

SEQ ID NO: 520686 - DNA, 20 bp, mouse
gacggtggcagagaagggct

SEQ ID NO: 520687 - DNA, 20 bp, mouse
ggcctatagggtcccagaag

SEQ ID NO: 520688 - DNA, 20 bp, mouse
ggaaagaagaaaacaggacg

SEQ ID NO: 520689 - DNA, 20 bp, mouse
gagagcgctgcgttaggctg

SEQ ID NO: 520690 - DNA, 20 bp, mouse
ggccggcagagcgctgcgtt

SEQ ID NO: 520691 - DNA, 20 bp, mouse
ggcctcttctgggaccctat

SEQ ID NO: 520692 - DNA, 20 bp, mouse
gagtgagagacagaggtcca

SEQ ID NO: 520693 - DNA, 20 bp, mouse
gggcccagaagaagaagcgg

SEQ ID NO: 520694 - DNA, 20 bp, mouse
gacaggacggggtgcggggc

SEQ ID NO: 520695 - DNA, 20 bp, mouse
ggtgaaccggtgagcctata

SEQ ID NO: 520696 - DNA, 20 bp, mouse
ggcgagcagccagccagtgt

SEQ ID NO: 520697 - DNA, 20 bp, mouse
gccttctgcagaggccgggt

SEQ ID NO: 520698 - DNA, 20 bp, mouse
gtgtggggctggccatgtaa

SEQ ID NO: 520699 - DNA, 20 bp, mouse
gggacgggcaggacctcctg

SEQ ID NO: 520700 - DNA, 20 bp, mouse
ggccatgtaagggccccagg

SEQ ID NO: 520701 - DNA, 20 bp, mouse
gagcaagcgcagccaggaca

SEQ ID NO: 520702 - DNA, 20 bp, mouse
gctctgcagaagggccacta

SEQ ID NO: 520703 - DNA, 20 bp, mouse
gcacggcctcgaggacagga

SEQ ID NO: 520704 - DNA, 20 bp, mouse
gctgcacgaggctttccgta

SEQ ID NO: 520705 - DNA, 20 bp, mouse
gtttccgtagggcacgggac

SEQ ID NO: 520706 - DNA, 20 bp, mouse
gggctggtagccaagagttt

SEQ ID NO: 520707 - DNA, 20 bp, mouse
gtttcaaaaaccaaaactct

SEQ ID NO: 520708 - DNA, 20 bp, mouse
ggaaggggcttcggaaagtt

SEQ ID NO: 520709 - DNA, 20 bp, mouse
ggggcttcggaaagttgggc

SEQ ID NO: 520710 - DNA, 20 bp, mouse
gaggcgcgcgctacagctgg

SEQ ID NO: 520711 - DNA, 20 bp, mouse
ggagctggcccaagggagga

SEQ ID NO: 520712 - DNA, 20 bp, mouse
gtggcagctgggctccgtgg

SEQ ID NO: 520713 - DNA, 20 bp, mouse
gccctcccgccaagaagccg

SEQ ID NO: 520714 - DNA, 20 bp, mouse
gtggtggccaggctgggact

SEQ ID NO: 520715 - DNA, 20 bp, mouse
gctggcccgagctggcccaa

SEQ ID NO: 520716 - DNA, 20 bp, mouse
gcgactaggcacaactccag

SEQ ID NO: 520717 - DNA, 20 bp, mouse
gaactcccctaccttcgact

SEQ ID NO: 520718 - DNA, 20 bp, mouse
gggaagcagagtcctggtcc

SEQ ID NO: 520719 - DNA, 20 bp, mouse
gtaggcacaactccagaggc

SEQ ID NO: 520720 - DNA, 20 bp, mouse
ggaaagtaatctccaggacc

SEQ ID NO: 520721 - DNA, 20 bp, mouse
gtgtgcctagtcgaaggtag

SEQ ID NO: 520722 - DNA, 20 bp, mouse
gggccctacgctgaacacca

SEQ ID NO: 520723 - DNA, 20 bp, mouse
gtggagggccccccttactg

SEQ ID NO: 520724 - DNA, 20 bp, mouse
gcagggactccaggagacct

SEQ ID NO: 520725 - DNA, 20 bp, mouse
gagccctggtgttcagcgta

SEQ ID NO: 520726 - DNA, 20 bp, mouse
gctcgtgtgcgtctaaaggg

SEQ ID NO: 520727 - DNA, 20 bp, mouse
gactctgccttctccctggt

SEQ ID NO: 520728 - DNA, 20 bp, mouse
gctgcccgagaggccctgag

SEQ ID NO: 520729 - DNA, 20 bp, mouse
gaggctcgtgtgcgtctaaa

SEQ ID NO: 520730 - DNA, 20 bp, mouse
gcccatgcgggcaccactca

SEQ ID NO: 520731 - DNA, 20 bp, mouse
gtggcatgtctctcttctac

SEQ ID NO: 520732 - DNA, 20 bp, mouse
ggcaccactcagggcctctc

SEQ ID NO: 520733 - DNA, 20 bp, mouse
gggaagaccagggagattgt

SEQ ID NO: 520734 - DNA, 20 bp, mouse
gccctcaccctgccccatgc

SEQ ID NO: 520735 - DNA, 20 bp, mouse
gaggactccataccttccca

SEQ ID NO: 520736 - DNA, 20 bp, mouse
ggctcaccggcaggatctgg

SEQ ID NO: 520737 - DNA, 20 bp, mouse
gggagctcaccggcaggatc

SEQ ID NO: 520738 - DNA, 20 bp, mouse
ggcagacaggagatcgcaac

SEQ ID NO: 520739 - DNA, 20 bp, mouse
gcagacagcaagaggcagac

SEQ ID NO: 520740 - DNA, 20 bp, mouse
gggatctggaggtcggggct

SEQ ID NO: 520741 - DNA, 20 bp, mouse
gcccgacctccagatcctgc

SEQ ID NO: 520742 - DNA, 20 bp, mouse
gcaggcaggagctcaccggc

SEQ ID NO: 520743 - DNA, 20 bp, mouse
gcagcgctaacgggcctccc

SEQ ID NO: 520744 - DNA, 20 bp, mouse
gcaggcctctagaagctcag

SEQ ID NO: 520745 - DNA, 20 bp, mouse
gataagtcagcccagtgggt

SEQ ID NO: 520746 - DNA, 20 bp, mouse
gctcccgggctgagttccac

SEQ ID NO: 520747 - DNA, 20 bp, mouse
gagccggtggaactcagccc

SEQ ID NO: 520748 - DNA, 20 bp, mouse
gggcctcccgcaccagccgg

SEQ ID NO: 520749 - DNA, 20 bp, mouse
ggctgcggcgacttccctcc

SEQ ID NO: 520750 - DNA, 20 bp, mouse
gaaggtcgggagggccgccc

SEQ ID NO: 520751 - DNA, 20 bp, mouse
ggtcgggagggccgcccggg

SEQ ID NO: 520752 - DNA, 20 bp, mouse
gccgcgggcccggagtgggt

SEQ ID NO: 520753 - DNA, 20 bp, mouse
gtgagttccaccggctggtg

SEQ ID NO: 520754 - DNA, 20 bp, mouse
gacctggccaaaggtcggga

SEQ ID NO: 520755 - DNA, 20 bp, mouse
gttccaccggctggtgcggg

SEQ ID NO: 520756 - DNA, 20 bp, mouse
gtccagtcaagcggcagatg

SEQ ID NO: 520757 - DNA, 20 bp, mouse
gccatggccgggcaaccgag

SEQ ID NO: 520758 - DNA, 20 bp, mouse
gaggactgagacccatggcc

SEQ ID NO: 520759 - DNA, 20 bp, mouse
gccgggggctccaggaacac

SEQ ID NO: 520760 - DNA, 20 bp, mouse
ggatggggctggctcgcggt

SEQ ID NO: 520761 - DNA, 20 bp, mouse
ggtcaagcggcagatggggc

SEQ ID NO: 520762 - DNA, 20 bp, mouse
gctcccgcctcctcagccgg

SEQ ID NO: 520763 - DNA, 20 bp, mouse
ggctcgcggtgggttgaagc

SEQ ID NO: 520764 - DNA, 20 bp, mouse
gggcagatggggctggctcg

SEQ ID NO: 520765 - DNA, 20 bp, mouse
gacgctgctgcgcaaccgct

SEQ ID NO: 520766 - DNA, 20 bp, mouse
gcagccagcagcggaagacg

SEQ ID NO: 520767 - DNA, 20 bp, mouse
ggcagcggaagacgcggagc

SEQ ID NO: 520768 - DNA, 20 bp, mouse
ggcctgctctccagcgtccg

SEQ ID NO: 520769 - DNA, 20 bp, mouse
gacgctggagagcaggcgct

SEQ ID NO: 520770 - DNA, 20 bp, mouse
gaaaaagccccggcccgcag

SEQ ID NO: 520771 - DNA, 20 bp, mouse
gactgacgggccgggagcag

SEQ ID NO: 520772 - DNA, 20 bp, mouse
gcgctgtcgcatgccctcgg

SEQ ID NO: 520773 - DNA, 20 bp, mouse
gcaactttgctaggacgagg

SEQ ID NO: 520774 - DNA, 20 bp, mouse
ggtgcgcagcgcgggatggg

SEQ ID NO: 520775 - DNA, 20 bp, mouse
gcaaagttgcccgggactcc

SEQ ID NO: 520776 - DNA, 20 bp, mouse
ggcgggctccagcattaaag

SEQ ID NO: 520777 - DNA, 20 bp, mouse
ggagggctagtccttaacaa

SEQ ID NO: 520778 - DNA, 20 bp, mouse
gtcggctccagcaagacttt

SEQ ID NO: 520779 - DNA, 20 bp, mouse
gcttgtgtcctgtttgttaa

SEQ ID NO: 520780 - DNA, 20 bp, mouse
ggactagccctctttaatgc

SEQ ID NO: 520781 - DNA, 20 bp, mouse
gaaactggcaactcgcactt

SEQ ID NO: 520782 - DNA, 20 bp, mouse
gggccgccgggggaactctt

SEQ ID NO: 520783 - DNA, 20 bp, mouse
gccgcatgcctttaacaaac

SEQ ID NO: 520784 - DNA, 20 bp, mouse
gttattagctaactatctac

SEQ ID NO: 520785 - DNA, 20 bp, mouse
gagctaataaacgtgtaaac

SEQ ID NO: 520786 - DNA, 20 bp, mouse
gaggaagagcaaccgatcac

SEQ ID NO: 520787 - DNA, 20 bp, mouse
ggagcaaccgatcacaggta

SEQ ID NO: 520788 - DNA, 20 bp, mouse
gacccagcccagagtgtcag

SEQ ID NO: 520789 - DNA, 20 bp, mouse
gtatggggaggtgacaaatg

SEQ ID NO: 520790 - DNA, 20 bp, mouse
gcctaaggtggcccacagtg

SEQ ID NO: 520791 - DNA, 20 bp, mouse
gtgtcagcggaagcaggctt

SEQ ID NO: 520792 - DNA, 20 bp, mouse
ggctggaccaccagaagtgg

SEQ ID NO: 520793 - DNA, 20 bp, mouse
gcatgcctgagacacctgat

SEQ ID NO: 520794 - DNA, 20 bp, mouse
gctgcttccgctgacactct

SEQ ID NO: 520795 - DNA, 20 bp, mouse
gcaatgtcccccacttctgg

SEQ ID NO: 520796 - DNA, 20 bp, mouse
gcagaggtcccaagaaggta

SEQ ID NO: 520797 - DNA, 20 bp, mouse
gagcccccagatgtgcacat

SEQ ID NO: 520798 - DNA, 20 bp, mouse
gctgtgttccttaccttctt

SEQ ID NO: 520799 - DNA, 20 bp, mouse
gggttcccatgtgcacatct

SEQ ID NO: 520800 - DNA, 20 bp, mouse
ggaaaccacagacaccatag

SEQ ID NO: 520801 - DNA, 20 bp, mouse
ggctgctctaaactgagata

SEQ ID NO: 520802 - DNA, 20 bp, mouse
gtaagggagcgagcggggca

SEQ ID NO: 520803 - DNA, 20 bp, mouse
gtcctgttgccctctgagct

SEQ ID NO: 520804 - DNA, 20 bp, mouse
gcaagattatctcaggccac

SEQ ID NO: 520805 - DNA, 20 bp, mouse
gactgagataagggagcgag

SEQ ID NO: 520806 - DNA, 20 bp, mouse
ggaatggagaggcctttcgg

SEQ ID NO: 520807 - DNA, 20 bp, mouse
gacagctggcaacctccgaa

SEQ ID NO: 520808 - DNA, 20 bp, mouse
gtcgcgcttgctgaatggag

SEQ ID NO: 520809 - DNA, 20 bp, mouse
gcatgttcgcgcttgctgaa

SEQ ID NO: 520810 - DNA, 20 bp, mouse
gagcaagcgcgaacatgctt

SEQ ID NO: 520811 - DNA, 20 bp, mouse
gaagctggtttggaccctgg

SEQ ID NO: 520812 - DNA, 20 bp, mouse
gagaagtacccgaggacgac

SEQ ID NO: 520813 - DNA, 20 bp, mouse
ggccagctgtattgtgagat

SEQ ID NO: 520814 - DNA, 20 bp, mouse
gcgacgggcggacggacgca

SEQ ID NO: 520815 - DNA, 20 bp, mouse
gagtacccgaggacgacggg

SEQ ID NO: 520816 - DNA, 20 bp, mouse
gcgctgcggagaacccacct

SEQ ID NO: 520817 - DNA, 20 bp, mouse
gcagagctagcagagcgcgc

SEQ ID NO: 520818 - DNA, 20 bp, mouse
gggagagggcctaggatgcg

SEQ ID NO: 520819 - DNA, 20 bp, mouse
gcggctcacggaggaccggg

SEQ ID NO: 520820 - DNA, 20 bp, mouse
gtcgcctgccccagagctgg

SEQ ID NO: 520821 - DNA, 20 bp, mouse
gtcgcagctcgtgcacgaag

SEQ ID NO: 520822 - DNA, 20 bp, mouse
gccgcggccccgcagcctca

SEQ ID NO: 520823 - DNA, 20 bp, mouse
gatgcgctcgggatgcggtg

SEQ ID NO: 520824 - DNA, 20 bp, mouse
gccgggcggccgcgcatcct

SEQ ID NO: 520825 - DNA, 20 bp, mouse
ggtgcggctcacggaggacc

SEQ ID NO: 520826 - DNA, 20 bp, mouse
gagcggggacccgaagagag

SEQ ID NO: 520827 - DNA, 20 bp, mouse
gtcccgaaggctgcaggtaa

SEQ ID NO: 520828 - DNA, 20 bp, mouse
ggtgcccgacccgagcaaag

SEQ ID NO: 520829 - DNA, 20 bp, mouse
gacgcctggcgaggtaccat

SEQ ID NO: 520830 - DNA, 20 bp, mouse
gcgtagtctgctggacgaag

SEQ ID NO: 520831 - DNA, 20 bp, mouse
gtccccgctttgctcgggtc

SEQ ID NO: 520832 - DNA, 20 bp, mouse
gtgaattcggccgctctctt

SEQ ID NO: 520833 - DNA, 20 bp, mouse
gaagccgggagcggcgcctg

SEQ ID NO: 520834 - DNA, 20 bp, mouse
gtcgggtccccgctttgctc

SEQ ID NO: 520835 - DNA, 20 bp, mouse
ggtgtcagaggagatcacag

SEQ ID NO: 520836 - DNA, 20 bp, mouse
ggtaacaaacatgcatggta

SEQ ID NO: 520837 - DNA, 20 bp, mouse
gtgttctcacatctttaagt

SEQ ID NO: 520838 - DNA, 20 bp, mouse
ggtcttgtaacaaacatgca

SEQ ID NO: 520839 - DNA, 20 bp, mouse
gcgaggactgcaggaaacaa

SEQ ID NO: 520840 - DNA, 20 bp, mouse
gtaagcaagatggatctccg

SEQ ID NO: 520841 - DNA, 20 bp, mouse
ggggttagccctactacaag

SEQ ID NO: 520842 - DNA, 20 bp, mouse
gaggtgccaacattacacaa

SEQ ID NO: 520843 - DNA, 20 bp, mouse
gtagccctactacaagagga

SEQ ID NO: 520844 - DNA, 20 bp, mouse
gtccgtggaagacctcttcc

SEQ ID NO: 520845 - DNA, 20 bp, mouse
gcagtgcagcatggtccgga

SEQ ID NO: 520846 - DNA, 20 bp, mouse
gagctccgcgccccgaatgt

SEQ ID NO: 520847 - DNA, 20 bp, mouse
gtccttgggactccacgagg

SEQ ID NO: 520848 - DNA, 20 bp, mouse
ggaatgtgggcagaacgcgg

SEQ ID NO: 520849 - DNA, 20 bp, mouse
gcccgaatgtgggcagaacg

SEQ ID NO: 520850 - DNA, 20 bp, mouse
gtaactgcgggcgccccccg

SEQ ID NO: 520851 - DNA, 20 bp, mouse
gctacagcggacggggacat

SEQ ID NO: 520852 - DNA, 20 bp, mouse
ggtagacgccatcttaactg

SEQ ID NO: 520853 - DNA, 20 bp, mouse
ggttaagatggcgtctacag

SEQ ID NO: 520854 - DNA, 20 bp, mouse
gggcaggagggtccttaccc

SEQ ID NO: 520855 - DNA, 20 bp, mouse
gcggagctgggggtccccgg

SEQ ID NO: 520856 - DNA, 20 bp, mouse
ggctcgtgcggcactggcag

SEQ ID NO: 520857 - DNA, 20 bp, mouse
ggagggttaaggtaaggtgt

SEQ ID NO: 520858 - DNA, 20 bp, mouse
gctgctctgcagagccggac

SEQ ID NO: 520859 - DNA, 20 bp, mouse
ggtgggagaaggtcgagcga

SEQ ID NO: 520860 - DNA, 20 bp, mouse
gggacgtgtggaagactggt

SEQ ID NO: 520861 - DNA, 20 bp, mouse
gccggctctgcagagcagcg

SEQ ID NO: 520862 - DNA, 20 bp, mouse
gcctccagagggttaaggta

SEQ ID NO: 520863 - DNA, 20 bp, mouse
gagcgcggctcgtgcggcac

SEQ ID NO: 520864 - DNA, 20 bp, mouse
ggacttccctggctcatggt

SEQ ID NO: 520865 - DNA, 20 bp, mouse
gcagagccggaccgggagcg

SEQ ID NO: 520866 - DNA, 20 bp, mouse
gggcagccgcgaggggacta

SEQ ID NO: 520867 - DNA, 20 bp, mouse
gaggcgcggtggggactcag

SEQ ID NO: 520868 - DNA, 20 bp, mouse
ggtccgcaggcagccgcgag

SEQ ID NO: 520869 - DNA, 20 bp, mouse
ggcccgccgaggaggatacc

SEQ ID NO: 520870 - DNA, 20 bp, mouse
gggccgaggggagccctctg

SEQ ID NO: 520871 - DNA, 20 bp, mouse
gcgcccggctgaggaggctc

SEQ ID NO: 520872 - DNA, 20 bp, mouse
ggggcgccctagtcccctcg

SEQ ID NO: 520873 - DNA, 20 bp, mouse
gctcggccaggtatcctcct

SEQ ID NO: 520874 - DNA, 20 bp, mouse
gtgcggacagaggcgcggtg

SEQ ID NO: 520875 - DNA, 20 bp, mouse
gctgtggagagcccgctgag

SEQ ID NO: 520876 - DNA, 20 bp, mouse
ggtgggcaccgcaggactcg

SEQ ID NO: 520877 - DNA, 20 bp, mouse
gcaggactcgcggagcgagc

SEQ ID NO: 520878 - DNA, 20 bp, mouse
gggccgcgcgggcccaggag

SEQ ID NO: 520879 - DNA, 20 bp, mouse
gcctgctccggccaccccgg

SEQ ID NO: 520880 - DNA, 20 bp, mouse
ggcccggcagcgccgagagc

SEQ ID NO: 520881 - DNA, 20 bp, mouse
gccatccgccggggcgtctc

SEQ ID NO: 520882 - DNA, 20 bp, mouse
gctgggcccgtgggcaccgc

SEQ ID NO: 520883 - DNA, 20 bp, mouse
gcggtcggcgcgggagcagt

SEQ ID NO: 520884 - DNA, 20 bp, mouse
gagcgggcgaagggttaacg

SEQ ID NO: 520885 - DNA, 20 bp, mouse
gccgtctgccggagacgccc

SEQ ID NO: 520886 - DNA, 20 bp, mouse
gctgcagaatgcgaagtctg

SEQ ID NO: 520887 - DNA, 20 bp, mouse
gtatttaaagggatcaataa

SEQ ID NO: 520888 - DNA, 20 bp, mouse
ggtttctcaccgagtacaga

SEQ ID NO: 520889 - DNA, 20 bp, mouse
gagacccttcaggttctcct

SEQ ID NO: 520890 - DNA, 20 bp, mouse
gaaagcagctaagacccttc

SEQ ID NO: 520891 - DNA, 20 bp, mouse
gtctttcatactgcagagtg

SEQ ID NO: 520892 - DNA, 20 bp, mouse
gggctaaagtgcaaggattg

SEQ ID NO: 520893 - DNA, 20 bp, mouse
gttcattctttctaaaaccc

SEQ ID NO: 520894 - DNA, 20 bp, mouse
gtgttctgttattttaagaa

SEQ ID NO: 520895 - DNA, 20 bp, mouse
gattcaagttttctggaata

SEQ ID NO: 520896 - DNA, 20 bp, mouse
gacaggcagcgtgagcgcag

SEQ ID NO: 520897 - DNA, 20 bp, mouse
gccccgccagaggctcactc

SEQ ID NO: 520898 - DNA, 20 bp, mouse
ggtagcagctgcgggagcgg

SEQ ID NO: 520899 - DNA, 20 bp, mouse
gcgctcacgctgcctgtctg

SEQ ID NO: 520900 - DNA, 20 bp, mouse
gggcggtcgcgcccgcagac

SEQ ID NO: 520901 - DNA, 20 bp, mouse
ggtccgcgagatgccagcag

SEQ ID NO: 520902 - DNA, 20 bp, mouse
gggcgagtcacaggcggtgg

SEQ ID NO: 520903 - DNA, 20 bp, mouse
gcgagcgctgcgggccgagc

SEQ ID NO: 520904 - DNA, 20 bp, mouse
gcgaggcccgagtgagcctc

SEQ ID NO: 520905 - DNA, 20 bp, mouse
gggcccgagtgagcctctgg

SEQ ID NO: 520906 - DNA, 20 bp, mouse
gagcgggagctattaacatg

SEQ ID NO: 520907 - DNA, 20 bp, mouse
gtgcagccggtggacccaag

SEQ ID NO: 520908 - DNA, 20 bp, mouse
ggtgaagcgaggaaacgtaa

SEQ ID NO: 520909 - DNA, 20 bp, mouse
gcgcagagacgacaggaggg

SEQ ID NO: 520910 - DNA, 20 bp, mouse
gccctggggcgtgtgaagcg

SEQ ID NO: 520911 - DNA, 20 bp, mouse
gtacacagccatggagaaag

SEQ ID NO: 520912 - DNA, 20 bp, mouse
gcgccccaggggggcaaaag

SEQ ID NO: 520913 - DNA, 20 bp, mouse
gggttcaaatgtctctctca

SEQ ID NO: 520914 - DNA, 20 bp, mouse
gtgtctctcgctgcagccgg

SEQ ID NO: 520915 - DNA, 20 bp, mouse
gctccgcttttgcccccctg

SEQ ID NO: 520916 - DNA, 20 bp, mouse
ggcccgctgtttgcatacaa

SEQ ID NO: 520917 - DNA, 20 bp, mouse
ggagcaggcgcgcacgcgtg

SEQ ID NO: 520918 - DNA, 20 bp, mouse
gtgcaaacagcgggccggag

SEQ ID NO: 520919 - DNA, 20 bp, mouse
ggcctgctcgtgaatcctct

SEQ ID NO: 520920 - DNA, 20 bp, mouse
gaccaagaggattcacgagc

SEQ ID NO: 520921 - DNA, 20 bp, mouse
gcccattgctactcaccaag

SEQ ID NO: 520922 - DNA, 20 bp, mouse
ggcggctgtcagctaaagca

SEQ ID NO: 520923 - DNA, 20 bp, mouse
gcccgtggcggtccgagacc

SEQ ID NO: 520924 - DNA, 20 bp, mouse
ggaagcttgcagggaccccg

SEQ ID NO: 520925 - DNA, 20 bp, mouse
ggcttgcagggaccccgtgg

SEQ ID NO: 520926 - DNA, 20 bp, mouse
gcccgccgggcctcatgaat

SEQ ID NO: 520927 - DNA, 20 bp, mouse
gcctcatgaatgggacgcgg

SEQ ID NO: 520928 - DNA, 20 bp, mouse
gtagcccgcggcttcggagg

SEQ ID NO: 520929 - DNA, 20 bp, mouse
gctgtagcccgcggcttcgg

SEQ ID NO: 520930 - DNA, 20 bp, mouse
ggggatgccccaagaagcgg

SEQ ID NO: 520931 - DNA, 20 bp, mouse
gtctgcggagaccctcacgt

SEQ ID NO: 520932 - DNA, 20 bp, mouse
gcatgaatgggacgcggcgg

SEQ ID NO: 520933 - DNA, 20 bp, mouse
gccaagaagcgggggagcag

SEQ ID NO: 520934 - DNA, 20 bp, mouse
gtcccattcatgaggcccgg

SEQ ID NO: 520935 - DNA, 20 bp, mouse
ggcgtcccattcatgaggcc

SEQ ID NO: 520936 - DNA, 20 bp, mouse
gctgtacgcagaggttccac

SEQ ID NO: 520937 - DNA, 20 bp, mouse
gaacctctgcgtacaggtag

SEQ ID NO: 520938 - DNA, 20 bp, mouse
gctatccagggagctcgcag

SEQ ID NO: 520939 - DNA, 20 bp, mouse
ggcagaggttccacaggtaa

SEQ ID NO: 520940 - DNA, 20 bp, mouse
ggtctcagtggtcctcggga

SEQ ID NO: 520941 - DNA, 20 bp, mouse
gctctgcgtacaggtagagg

SEQ ID NO: 520942 - DNA, 20 bp, mouse
gcagagaccacagggagcta

SEQ ID NO: 520943 - DNA, 20 bp, mouse
gagtggagaccggatctcac

SEQ ID NO: 520944 - DNA, 20 bp, mouse
gagtgagagccgcacctggt

SEQ ID NO: 520945 - DNA, 20 bp, mouse
gtcaagggacagagaccaca

SEQ ID NO: 520946 - DNA, 20 bp, mouse
gaattcctcggaggaggagt

SEQ ID NO: 520947 - DNA, 20 bp, mouse
gaaggggcagaattcctcgg

SEQ ID NO: 520948 - DNA, 20 bp, mouse
ggagggcagaacagttacaa

SEQ ID NO: 520949 - DNA, 20 bp, mouse
gtacaaggggcagaattcct

SEQ ID NO: 520950 - DNA, 20 bp, mouse
gagcgcggtggagcgccgta

SEQ ID NO: 520951 - DNA, 20 bp, mouse
gggcaagtcaacctttaaag

SEQ ID NO: 520952 - DNA, 20 bp, mouse
ggcaggaggcgcaagaggac

SEQ ID NO: 520953 - DNA, 20 bp, mouse
gagtcaacctttaaagggga

SEQ ID NO: 520954 - DNA, 20 bp, mouse
ggtcgccgtagcgtgatggg

SEQ ID NO: 520955 - DNA, 20 bp, mouse
gcaagaggactggagcgcgg

SEQ ID NO: 520956 - DNA, 20 bp, mouse
gtggctgccacgggaggtca

SEQ ID NO: 520957 - DNA, 20 bp, mouse
gagtgtgccttgacctcccg

SEQ ID NO: 520958 - DNA, 20 bp, mouse
gggtcctgcctggtttgcag

SEQ ID NO: 520959 - DNA, 20 bp, mouse
gagtcatcccctaaaggaca

SEQ ID NO: 520960 - DNA, 20 bp, mouse
gagtaaggtgtccctgtcgt

SEQ ID NO: 520961 - DNA, 20 bp, mouse
gtggtttgcaggggcagaaa

SEQ ID NO: 520962 - DNA, 20 bp, mouse
ggatgatgaaatcccaagac

SEQ ID NO: 520963 - DNA, 20 bp, mouse
ggaccctggacacctgtctt

SEQ ID NO: 520964 - DNA, 20 bp, mouse
ggggacaccttactacagtg

SEQ ID NO: 520965 - DNA, 20 bp, mouse
ggacccaagacaggtgtcca

SEQ ID NO: 520966 - DNA, 20 bp, mouse
gacccctgccatctttgggg

SEQ ID NO: 520967 - DNA, 20 bp, mouse
gcagacacccctgccatctt

SEQ ID NO: 520968 - DNA, 20 bp, mouse
ggatggcaggggtgtctgga

SEQ ID NO: 520969 - DNA, 20 bp, mouse
gcccctccccaaagatggca

SEQ ID NO: 520970 - DNA, 20 bp, mouse
gacacacaccaggcgttcag

SEQ ID NO: 520971 - DNA, 20 bp, mouse
ggagcatgccctgtgaggtc

SEQ ID NO: 520972 - DNA, 20 bp, mouse
ggtgatcatagctcttgtcc

SEQ ID NO: 520973 - DNA, 20 bp, mouse
gtgcttcacacttctcttac

SEQ ID NO: 520974 - DNA, 20 bp, mouse
gtctatgggatacagctgct

SEQ ID NO: 520975 - DNA, 20 bp, mouse
ggaggacaatgacgatctat

SEQ ID NO: 520976 - DNA, 20 bp, mouse
gccttcgctacgatacctgg

SEQ ID NO: 520977 - DNA, 20 bp, mouse
gtcgctacgatacctggggg

SEQ ID NO: 520978 - DNA, 20 bp, mouse
ggggcaggcgaggcaaagag

SEQ ID NO: 520979 - DNA, 20 bp, mouse
gcgatacctgggggaggagg

SEQ ID NO: 520980 - DNA, 20 bp, mouse
gcctccgcctccagccgtcg

SEQ ID NO: 520981 - DNA, 20 bp, mouse
ggtccccggccgggaagcgg

SEQ ID NO: 520982 - DNA, 20 bp, mouse
gttcagcagcaggccgggag

SEQ ID NO: 520983 - DNA, 20 bp, mouse
gcgaccccccgaccccccgg

SEQ ID NO: 520984 - DNA, 20 bp, mouse
ggccccctgggcacccagaa

SEQ ID NO: 520985 - DNA, 20 bp, mouse
ggccgggccgggacaatggg

SEQ ID NO: 520986 - DNA, 20 bp, mouse
ggtgaagaagaggaccacaa

SEQ ID NO: 520987 - DNA, 20 bp, mouse
gcatcgcaggtataggacaa

SEQ ID NO: 520988 - DNA, 20 bp, mouse
gttcgagactagagcatcgc

SEQ ID NO: 520989 - DNA, 20 bp, mouse
gcagcttggagatatgatac

SEQ ID NO: 520990 - DNA, 20 bp, mouse
ggtctcattcagttccgttg

SEQ ID NO: 520991 - DNA, 20 bp, mouse
gagatgctctaaggaagtgg

SEQ ID NO: 520992 - DNA, 20 bp, mouse
ggtgtggtctagtcaaactg

SEQ ID NO: 520993 - DNA, 20 bp, mouse
gtataggacaatggaagagc

SEQ ID NO: 520994 - DNA, 20 bp, mouse
gggaggaactatcattgttg

SEQ ID NO: 520995 - DNA, 20 bp, mouse
gatagggcagctctacagct

SEQ ID NO: 520996 - DNA, 20 bp, mouse
ggaagaggtagtgtgcctgg

SEQ ID NO: 520997 - DNA, 20 bp, mouse
ggaaaggaagtagtgtcggt

SEQ ID NO: 520998 - DNA, 20 bp, mouse
gtcctaaggcaaccaaccac

SEQ ID NO: 520999 - DNA, 20 bp, mouse
gagtgcagggggtcaaagaa

SEQ ID NO: 521000 - DNA, 20 bp, mouse
gcacctgcggagcaccgctg

SEQ ID NO: 521001 - DNA, 20 bp, mouse
gtcttcagctcctcaagcgc

SEQ ID NO: 521002 - DNA, 20 bp, mouse
gcacccagagcaccgccccc

SEQ ID NO: 521003 - DNA, 20 bp, mouse
gagtagtgtcggtcggctgt

SEQ ID NO: 521004 - DNA, 20 bp, mouse
gacagtggcacccgcgcttg

SEQ ID NO: 521005 - DNA, 20 bp, mouse
gctgtacgaggtgagctctc

SEQ ID NO: 521006 - DNA, 20 bp, mouse
gaggtggcggcggagatcca

SEQ ID NO: 521007 - DNA, 20 bp, mouse
gcgcagcgagacggaggtgg

SEQ ID NO: 521008 - DNA, 20 bp, mouse
ggggcgcagcgagacggagg

SEQ ID NO: 521009 - DNA, 20 bp, mouse
gggacgaggccggagtctcc

SEQ ID NO: 521010 - DNA, 20 bp, mouse
gtctcgctgcgccccggcgg

SEQ ID NO: 521011 - DNA, 20 bp, mouse
gcctcctcacccggagactc

SEQ ID NO: 521012 - DNA, 20 bp, mouse
gctcgtcctcacccccgccg

SEQ ID NO: 521013 - DNA, 20 bp, mouse
gcgatggagcccgggaggag

SEQ ID NO: 521014 - DNA, 20 bp, mouse
ggccctcggcgctgtcatgg

SEQ ID NO: 521015 - DNA, 20 bp, mouse
gccgtctcgctgcgccccgg

SEQ ID NO: 521016 - DNA, 20 bp, mouse
gttccagccgggggagccaa

SEQ ID NO: 521017 - DNA, 20 bp, mouse
ggcggcaagcggcgcagagg

SEQ ID NO: 521018 - DNA, 20 bp, mouse
gcgcgagcacgagcagacac

SEQ ID NO: 521019 - DNA, 20 bp, mouse
gctcccccggctggaaacct

SEQ ID NO: 521020 - DNA, 20 bp, mouse
gggcagcagttcgatcgcca

SEQ ID NO: 521021 - DNA, 20 bp, mouse
gccgcagcccttggctcccc

SEQ ID NO: 521022 - DNA, 20 bp, mouse
gcgccaaggtttccagccgg

SEQ ID NO: 521023 - DNA, 20 bp, mouse
gaggaggcggccaactctgg

SEQ ID NO: 521024 - DNA, 20 bp, mouse
gagggcggttaccgagagag

SEQ ID NO: 521025 - DNA, 20 bp, mouse
ggatcgccaaggtttccagc

SEQ ID NO: 521026 - DNA, 20 bp, mouse
ggactcgccgccatgttcct

SEQ ID NO: 521027 - DNA, 20 bp, mouse
gagggaggcggtgggaacag

SEQ ID NO: 521028 - DNA, 20 bp, mouse
gaggctccgagtattgtcgg

SEQ ID NO: 521029 - DNA, 20 bp, mouse
gaccgtggcggtgcccatcc

SEQ ID NO: 521030 - DNA, 20 bp, mouse
gacggctgaccgaaaagagt

SEQ ID NO: 521031 - DNA, 20 bp, mouse
ggcctgggccgcgagtggag

SEQ ID NO: 521032 - DNA, 20 bp, mouse
gcccaggctccgagtattgt

SEQ ID NO: 521033 - DNA, 20 bp, mouse
gaaagagtcggtaccgggat

SEQ ID NO: 521034 - DNA, 20 bp, mouse
ggcagccgcagcacacggtg

SEQ ID NO: 521035 - DNA, 20 bp, mouse
gtggaggaggcggggaactc

SEQ ID NO: 521036 - DNA, 20 bp, mouse
gaccacagccaccaagcccg

SEQ ID NO: 521037 - DNA, 20 bp, mouse
gtagcggctgcggagtactc

SEQ ID NO: 521038 - DNA, 20 bp, mouse
ggtcgaccgagccctggaag

SEQ ID NO: 521039 - DNA, 20 bp, mouse
gaggaccagggcccaaccca

SEQ ID NO: 521040 - DNA, 20 bp, mouse
ggaccgagccctggaagagg

SEQ ID NO: 521041 - DNA, 20 bp, mouse
ggcaccggagaggtttcccc

SEQ ID NO: 521042 - DNA, 20 bp, mouse
gatggcggccgcgggcttgg

SEQ ID NO: 521043 - DNA, 20 bp, mouse
gcccacaggtcgcaccggag

SEQ ID NO: 521044 - DNA, 20 bp, mouse
gccgggacccgtggagtggg

SEQ ID NO: 521045 - DNA, 20 bp, mouse
gagccgacaactctccggcc

SEQ ID NO: 521046 - DNA, 20 bp, mouse
gagccgccgagagcggatgg

SEQ ID NO: 521047 - DNA, 20 bp, mouse
gcggatggcggcagcagtag

SEQ ID NO: 521048 - DNA, 20 bp, mouse
gtgccgccatccgctctcgg

SEQ ID NO: 521049 - DNA, 20 bp, mouse
ggcagcttcctcacccccgg

SEQ ID NO: 521050 - DNA, 20 bp, mouse
gcaggtagaccaggagaccc

SEQ ID NO: 521051 - DNA, 20 bp, mouse
ggctccccctgcctgactga

SEQ ID NO: 521052 - DNA, 20 bp, mouse
gggtgccgtcagtcaggcag

SEQ ID NO: 521053 - DNA, 20 bp, mouse
gcgggcccactcgccgccgg

SEQ ID NO: 521054 - DNA, 20 bp, mouse
gctcacccccggcggcgagt

SEQ ID NO: 521055 - DNA, 20 bp, mouse
ggacttgtcagacatcaccc

SEQ ID NO: 521056 - DNA, 20 bp, mouse
gagcagacccaggtcccagg

SEQ ID NO: 521057 - DNA, 20 bp, mouse
ggagaagccccctgggacct

SEQ ID NO: 521058 - DNA, 20 bp, mouse
gccaagagcaggtagaagtg

SEQ ID NO: 521059 - DNA, 20 bp, mouse
gaagcaggtgaacaaaaccc

SEQ ID NO: 521060 - DNA, 20 bp, mouse
gggtggagccaatatctgac

SEQ ID NO: 521061 - DNA, 20 bp, mouse
gtctagggagggaaagaaac

SEQ ID NO: 521062 - DNA, 20 bp, mouse
gctgaccggagaagccccct

SEQ ID NO: 521063 - DNA, 20 bp, mouse
gcaaaacccgggtgtttcag

SEQ ID NO: 521064 - DNA, 20 bp, mouse
gccgatcccctgaaacaccc

SEQ ID NO: 521065 - DNA, 20 bp, mouse
gagcagcagacccaggtccc

SEQ ID NO: 521066 - DNA, 20 bp, mouse
gcagcgtggcaggtactcaa

SEQ ID NO: 521067 - DNA, 20 bp, mouse
ggtggcaggtactcaatggg

SEQ ID NO: 521068 - DNA, 20 bp, mouse
gactggcggggagatcagcg

SEQ ID NO: 521069 - DNA, 20 bp, mouse
ggcacagagcgcgcctagac

SEQ ID NO: 521070 - DNA, 20 bp, mouse
gcagagcgcgcctagactgg

SEQ ID NO: 521071 - DNA, 20 bp, mouse
gaagcagagggggtctcggt

SEQ ID NO: 521072 - DNA, 20 bp, mouse
gtagggatcagggatcactt

SEQ ID NO: 521073 - DNA, 20 bp, mouse
ggcaggtactcaatgggagg

SEQ ID NO: 521074 - DNA, 20 bp, mouse
gctgatctccccgccagtct

SEQ ID NO: 521075 - DNA, 20 bp, mouse
gacgttcactgtgcccgaga

SEQ ID NO: 521076 - DNA, 20 bp, mouse
gccacgctcacccagcccgg

SEQ ID NO: 521077 - DNA, 20 bp, mouse
gcctcgcgccgcgccatggt

SEQ ID NO: 521078 - DNA, 20 bp, mouse
gcacgcccggatggccacac

SEQ ID NO: 521079 - DNA, 20 bp, mouse
gcgcgccgcgccatggtggg

SEQ ID NO: 521080 - DNA, 20 bp, mouse
gccctccccccaccatggcg

SEQ ID NO: 521081 - DNA, 20 bp, mouse
gggaccagggcgctctgcag

SEQ ID NO: 521082 - DNA, 20 bp, mouse
gccggggcgccggatctggg

SEQ ID NO: 521083 - DNA, 20 bp, mouse
gcgctcacccagcccggggg

SEQ ID NO: 521084 - DNA, 20 bp, mouse
ggcgtcgccgccgcaagggg

SEQ ID NO: 521085 - DNA, 20 bp, mouse
ggggtgagcgtggcccacgg

SEQ ID NO: 521086 - DNA, 20 bp, mouse
gcaagaggctgcaggttcct

SEQ ID NO: 521087 - DNA, 20 bp, mouse
gccttgttgaagaacccccc

SEQ ID NO: 521088 - DNA, 20 bp, mouse
ggaacccccctggcatcccc

SEQ ID NO: 521089 - DNA, 20 bp, mouse
gcttctaggaagatgagggt

SEQ ID NO: 521090 - DNA, 20 bp, mouse
ggttcctggggatgccaggg

SEQ ID NO: 521091 - DNA, 20 bp, mouse
ggcaagaagaaggggcggga

SEQ ID NO: 521092 - DNA, 20 bp, mouse
gatcccttctaggaagatga

SEQ ID NO: 521093 - DNA, 20 bp, mouse
gagcgaaggcaggcagatgg

SEQ ID NO: 521094 - DNA, 20 bp, mouse
gcagcgacagccactcacct

SEQ ID NO: 521095 - DNA, 20 bp, mouse
gagctgcagcgatccagcga

SEQ ID NO: 521096 - DNA, 20 bp, mouse
gcctcctcgccgggaaccca

SEQ ID NO: 521097 - DNA, 20 bp, mouse
gccgggtccgggtgctcccg

SEQ ID NO: 521098 - DNA, 20 bp, mouse
ggttcccggcgaggaggccg

SEQ ID NO: 521099 - DNA, 20 bp, mouse
ggggcagccgggcagctcta

SEQ ID NO: 521100 - DNA, 20 bp, mouse
gggtaccggcccagggtctg

SEQ ID NO: 521101 - DNA, 20 bp, mouse
ggagacaggcccagaaagag

SEQ ID NO: 521102 - DNA, 20 bp, mouse
ggtctgctgtggcgggtggg

SEQ ID NO: 521103 - DNA, 20 bp, mouse
gggcatcgcaacgcaggtgg

SEQ ID NO: 521104 - DNA, 20 bp, mouse
gccagggtctggggcagcaa

SEQ ID NO: 521105 - DNA, 20 bp, mouse
gtccgagtcttagggttcca

SEQ ID NO: 521106 - DNA, 20 bp, mouse
ggccgcggcgcccgcctgag

SEQ ID NO: 521107 - DNA, 20 bp, mouse
gctggttgtctgcagagccg

SEQ ID NO: 521108 - DNA, 20 bp, mouse
gccgggagccgagagagccg

SEQ ID NO: 521109 - DNA, 20 bp, mouse
gaagcatcctgcaaccgctc

SEQ ID NO: 521110 - DNA, 20 bp, mouse
gatcctgcaaccgctcaggc

SEQ ID NO: 521111 - DNA, 20 bp, mouse
ggtgactgggcgccacccgt

SEQ ID NO: 521112 - DNA, 20 bp, mouse
gggatgcttgggcgccaggg

SEQ ID NO: 521113 - DNA, 20 bp, mouse
gaccgctcaggcgggcgccg

SEQ ID NO: 521114 - DNA, 20 bp, mouse
gtgggcgccagggtggccga

SEQ ID NO: 521115 - DNA, 20 bp, mouse
gtggtaaagaggcctagagc

SEQ ID NO: 521116 - DNA, 20 bp, mouse
ggcctgctcgcaccacgctg

SEQ ID NO: 521117 - DNA, 20 bp, mouse
ggctccgcgctgcagcatgg

SEQ ID NO: 521118 - DNA, 20 bp, mouse
gtccccagcgtggtgcgagc

SEQ ID NO: 521119 - DNA, 20 bp, mouse
gggctctcccaggcctgccg

SEQ ID NO: 521120 - DNA, 20 bp, mouse
gtggtgcgagcaggcaacgc

SEQ ID NO: 521121 - DNA, 20 bp, mouse
gcgctgcagcatggaggcgg

SEQ ID NO: 521122 - DNA, 20 bp, mouse
ggctggggagcggctctccc

SEQ ID NO: 521123 - DNA, 20 bp, mouse
ggggaagctgcagtccgggc

SEQ ID NO: 521124 - DNA, 20 bp, mouse
ggggcctcagccagcgggag

SEQ ID NO: 521125 - DNA, 20 bp, mouse
ggagctgaggactcgtccca

SEQ ID NO: 521126 - DNA, 20 bp, mouse
ggtcttgaggacagacatag

SEQ ID NO: 521127 - DNA, 20 bp, mouse
gggtctgcccagaactggtc

SEQ ID NO: 521128 - DNA, 20 bp, mouse
gtggcagcatcaaggaaggt

SEQ ID NO: 521129 - DNA, 20 bp, mouse
gaggagcagctatggtctct

SEQ ID NO: 521130 - DNA, 20 bp, mouse
gtgtcctcaagaccccagga

SEQ ID NO: 521131 - DNA, 20 bp, mouse
gagacatagaggagcagcta

SEQ ID NO: 521132 - DNA, 20 bp, mouse
gaggccccctgagcaggaat

SEQ ID NO: 521133 - DNA, 20 bp, mouse
ggccctcagaggcctgtcgg

SEQ ID NO: 521134 - DNA, 20 bp, mouse
gtgtctgtcctcaagacccc

SEQ ID NO: 521135 - DNA, 20 bp, mouse
ggggcctctggcagtctgtc

SEQ ID NO: 521136 - DNA, 20 bp, mouse
ggaaatccctcgagatggaa

SEQ ID NO: 521137 - DNA, 20 bp, mouse
ggccatgacgtcagtctcct

SEQ ID NO: 521138 - DNA, 20 bp, mouse
ggcctgggctgcaatgcgag

SEQ ID NO: 521139 - DNA, 20 bp, mouse
ggcccaaaccccgcctgaaa

SEQ ID NO: 521140 - DNA, 20 bp, mouse
gcgagcgaaatccctcgaga

SEQ ID NO: 521141 - DNA, 20 bp, mouse
ggcaacgcgtataaacaaga

SEQ ID NO: 521142 - DNA, 20 bp, mouse
gagagcggtggatgagctgg

SEQ ID NO: 521143 - DNA, 20 bp, mouse
gctgaggcagccaggttgag

SEQ ID NO: 521144 - DNA, 20 bp, mouse
ggggtgcctttccatctcga

SEQ ID NO: 521145 - DNA, 20 bp, mouse
gacgcgtataaacaagatgg

SEQ ID NO: 521146 - DNA, 20 bp, mouse
gccagagcacgggtgtggaa

SEQ ID NO: 521147 - DNA, 20 bp, mouse
gtaggcgcgaaccagagcac

SEQ ID NO: 521148 - DNA, 20 bp, mouse
gctgaggcgagcgaacagaa

SEQ ID NO: 521149 - DNA, 20 bp, mouse
gggggacagcgtccccaagt

SEQ ID NO: 521150 - DNA, 20 bp, mouse
gggcgggcgcctgaagaact

SEQ ID NO: 521151 - DNA, 20 bp, mouse
gatagggcagtgaatactgg

SEQ ID NO: 521152 - DNA, 20 bp, mouse
gtctggttcgcgcctacttg

SEQ ID NO: 521153 - DNA, 20 bp, mouse
ggcgaacagaagggtgtgac

SEQ ID NO: 521154 - DNA, 20 bp, mouse
gtgacgggagatagttgaga

SEQ ID NO: 521155 - DNA, 20 bp, mouse
gaacctaagtcacagggtgt

SEQ ID NO: 521156 - DNA, 20 bp, mouse
ggcgcctgcccgtcccggag

SEQ ID NO: 521157 - DNA, 20 bp, mouse
gcagcgctgcgaacaatcag

SEQ ID NO: 521158 - DNA, 20 bp, mouse
gcgggcgggcatctcactga

SEQ ID NO: 521159 - DNA, 20 bp, mouse
gggcaggcgcgtggggtcca

SEQ ID NO: 521160 - DNA, 20 bp, mouse
gtgttcgcagcgctgaggca

SEQ ID NO: 521161 - DNA, 20 bp, mouse
gcccacgcgcctgcccgtcc

SEQ ID NO: 521162 - DNA, 20 bp, mouse
gcggcgggaaggacgagcag

SEQ ID NO: 521163 - DNA, 20 bp, mouse
gccgcgcgcggcgaactctg

SEQ ID NO: 521164 - DNA, 20 bp, mouse
gcgggaaggacgagcagcgg

SEQ ID NO: 521165 - DNA, 20 bp, mouse
gcggccgctccgggacgggc

SEQ ID NO: 521166 - DNA, 20 bp, mouse
ggacgctaccgcaggggagg

SEQ ID NO: 521167 - DNA, 20 bp, mouse
gggaaacgacgctaccgcag

SEQ ID NO: 521168 - DNA, 20 bp, mouse
gtagctcagagagtcggctg

SEQ ID NO: 521169 - DNA, 20 bp, mouse
gggacgagcggtgtctgtca

SEQ ID NO: 521170 - DNA, 20 bp, mouse
ggctgaggagagatgcccgg

SEQ ID NO: 521171 - DNA, 20 bp, mouse
gaaaccgccacccggagccc

SEQ ID NO: 521172 - DNA, 20 bp, mouse
gcccggccaggggaagatgg

SEQ ID NO: 521173 - DNA, 20 bp, mouse
gtcggctgaggagagatgcc

SEQ ID NO: 521174 - DNA, 20 bp, mouse
gctgtgagtagagggtccca

SEQ ID NO: 521175 - DNA, 20 bp, mouse
gccgcggcatctgggagcag

SEQ ID NO: 521176 - DNA, 20 bp, mouse
gagagccagcagcggaggac

SEQ ID NO: 521177 - DNA, 20 bp, mouse
ggcggcgtccgagaacggga

SEQ ID NO: 521178 - DNA, 20 bp, mouse
gacggtgaaggcagcccgag

SEQ ID NO: 521179 - DNA, 20 bp, mouse
gagcggaggaccggcagcca

SEQ ID NO: 521180 - DNA, 20 bp, mouse
gcccgagcggcgtccgagaa

SEQ ID NO: 521181 - DNA, 20 bp, mouse
ggcgggagagccagcagcgg

SEQ ID NO: 521182 - DNA, 20 bp, mouse
gtggctctcccgctgtgcag

SEQ ID NO: 521183 - DNA, 20 bp, mouse
gctcgcatgcccctgcacag

SEQ ID NO: 521184 - DNA, 20 bp, mouse
gcccaggccgggagaggatc

SEQ ID NO: 521185 - DNA, 20 bp, mouse
gcggcgtgccatcccgttct

SEQ ID NO: 521186 - DNA, 20 bp, mouse
gtcctcttgggcccaggcag

SEQ ID NO: 521187 - DNA, 20 bp, mouse
gaagcaggacagagcacctc

SEQ ID NO: 521188 - DNA, 20 bp, mouse
gtgagcaagtgggtagccgt

SEQ ID NO: 521189 - DNA, 20 bp, mouse
ggggccacccacatgacttc

SEQ ID NO: 521190 - DNA, 20 bp, mouse
ggcccctgcctgggcccaag

SEQ ID NO: 521191 - DNA, 20 bp, mouse
gatgacttctggctcctctt

SEQ ID NO: 521192 - DNA, 20 bp, mouse
gtctggctcctcttgggccc

SEQ ID NO: 521193 - DNA, 20 bp, mouse
ggggtagccgttggacttac

SEQ ID NO: 521194 - DNA, 20 bp, mouse
gttggacttactggacaagc

SEQ ID NO: 521195 - DNA, 20 bp, mouse
ggtatgacactaacagatgt

SEQ ID NO: 521196 - DNA, 20 bp, mouse
gtacactctggcagacagaa

SEQ ID NO: 521197 - DNA, 20 bp, mouse
gcctctgaacaggtacactc

SEQ ID NO: 521198 - DNA, 20 bp, mouse
gtgtgtggtttgggtaggta

SEQ ID NO: 521199 - DNA, 20 bp, mouse
ggattccagagggtgatgtg

SEQ ID NO: 521200 - DNA, 20 bp, mouse
gtgtaggcaaataccttgtg

SEQ ID NO: 521201 - DNA, 20 bp, mouse
gttgcaagttctggtctctt

SEQ ID NO: 521202 - DNA, 20 bp, mouse
ggaaatcagctaaatcccat

SEQ ID NO: 521203 - DNA, 20 bp, mouse
gaaatgatatggagtgacac

SEQ ID NO: 521204 - DNA, 20 bp, mouse
gatgctgacaggattccaga

SEQ ID NO: 521205 - DNA, 20 bp, mouse
gcaactaaaatgaatcccat

SEQ ID NO: 521206 - DNA, 20 bp, mouse
ggagccacatagctccagag

SEQ ID NO: 521207 - DNA, 20 bp, mouse
ggggcctaaacaagaacatg

SEQ ID NO: 521208 - DNA, 20 bp, mouse
gggctggcggcgggcattcg

SEQ ID NO: 521209 - DNA, 20 bp, mouse
gagtatcacggcagacatga

SEQ ID NO: 521210 - DNA, 20 bp, mouse
ggagtggctctctgaacaaa

SEQ ID NO: 521211 - DNA, 20 bp, mouse
ggctctctgaacaaaaggtg

SEQ ID NO: 521212 - DNA, 20 bp, mouse
ggcttcctgggaggagtgaa

SEQ ID NO: 521213 - DNA, 20 bp, mouse
gcccgtgtgaggcttctgag

SEQ ID NO: 521214 - DNA, 20 bp, mouse
gagtgctcctgtgagtatca

SEQ ID NO: 521215 - DNA, 20 bp, mouse
ggagccactctggagctatg

SEQ ID NO: 521216 - DNA, 20 bp, mouse
gttgcttctagggactctct

SEQ ID NO: 521217 - DNA, 20 bp, mouse
gctctctgggtggaaggatc

SEQ ID NO: 521218 - DNA, 20 bp, mouse
gtcagggaaatgataagcgt

SEQ ID NO: 521219 - DNA, 20 bp, mouse
gtagggactctctgggtgga

SEQ ID NO: 521220 - DNA, 20 bp, mouse
gcatgtcgcccaggatgagg

SEQ ID NO: 521221 - DNA, 20 bp, mouse
gaaagcttaagttgcttcta

SEQ ID NO: 521222 - DNA, 20 bp, mouse
ggcgctggatgcttgttctt

SEQ ID NO: 521223 - DNA, 20 bp, mouse
gcaattctgtttgcacgggc

SEQ ID NO: 521224 - DNA, 20 bp, mouse
gtctgcaattctgtttgcac

SEQ ID NO: 521225 - DNA, 20 bp, mouse
gacctgtgcatatgggtcag

SEQ ID NO: 521226 - DNA, 20 bp, mouse
gggagcgaggagtaaagcag

SEQ ID NO: 521227 - DNA, 20 bp, mouse
gccagaggcggctccgagat

SEQ ID NO: 521228 - DNA, 20 bp, mouse
gtgtgagcttcgccctggga

SEQ ID NO: 521229 - DNA, 20 bp, mouse
ggaagctcacagccccatct

SEQ ID NO: 521230 - DNA, 20 bp, mouse
ggcatttttgcagccagagg

SEQ ID NO: 521231 - DNA, 20 bp, mouse
ggataagaatagaagagtcg

SEQ ID NO: 521232 - DNA, 20 bp, mouse
gcccgcggcacttcagtcag

SEQ ID NO: 521233 - DNA, 20 bp, mouse
ggggctgtgagcttcgccct

SEQ ID NO: 521234 - DNA, 20 bp, mouse
gacagcagaggcctgactgg

SEQ ID NO: 521235 - DNA, 20 bp, mouse
gcttaagcaaagcgaaccag

SEQ ID NO: 521236 - DNA, 20 bp, mouse
gcggtccccgcggcccttag

SEQ ID NO: 521237 - DNA, 20 bp, mouse
gcttcggccggggtccgctg

SEQ ID NO: 521238 - DNA, 20 bp, mouse
gacagctcgcggtgccccag

SEQ ID NO: 521239 - DNA, 20 bp, mouse
gcccagcagccggcgacgag

SEQ ID NO: 521240 - DNA, 20 bp, mouse
gcaaagccgccgtcccctaa

SEQ ID NO: 521241 - DNA, 20 bp, mouse
ggcggtgccccagcggaccc

SEQ ID NO: 521242 - DNA, 20 bp, mouse
gacgcacggcggagaggaac

SEQ ID NO: 521243 - DNA, 20 bp, mouse
ggccagggctggacgcacgg

SEQ ID NO: 521244 - DNA, 20 bp, mouse
gggcggctttgcacagctcg

SEQ ID NO: 521245 - DNA, 20 bp, mouse
gagcatcctgggttgaacag

SEQ ID NO: 521246 - DNA, 20 bp, mouse
gccggtgctgatccacgtag

SEQ ID NO: 521247 - DNA, 20 bp, mouse
gagcgcaccgggacgacgag

SEQ ID NO: 521248 - DNA, 20 bp, mouse
gacgacgagcggcctctacg

SEQ ID NO: 521249 - DNA, 20 bp, mouse
gccggccgcggaagcgcacc

SEQ ID NO: 521250 - DNA, 20 bp, mouse
gtagaggccgctcgtcgtcc

SEQ ID NO: 521251 - DNA, 20 bp, mouse
gctcgtgccatggccacaag

SEQ ID NO: 521252 - DNA, 20 bp, mouse
ggtgccatggccacaagggg

SEQ ID NO: 521253 - DNA, 20 bp, mouse
gtcgtcccggtgcgcttccg

SEQ ID NO: 521254 - DNA, 20 bp, mouse
gggtgcttctatcttcgctc

SEQ ID NO: 521255 - DNA, 20 bp, mouse
gcgagtgtgccggcttcgag

SEQ ID NO: 521256 - DNA, 20 bp, mouse
gcagcgacgggccataccca

SEQ ID NO: 521257 - DNA, 20 bp, mouse
gcatacccacggcagatgga

SEQ ID NO: 521258 - DNA, 20 bp, mouse
ggagcacaaaagagtctcag

SEQ ID NO: 521259 - DNA, 20 bp, mouse
gccccccgggcctccaggac

SEQ ID NO: 521260 - DNA, 20 bp, mouse
gagcgcgcagggagcagcca

SEQ ID NO: 521261 - DNA, 20 bp, mouse
ggcgccagccgcaggcgaca

SEQ ID NO: 521262 - DNA, 20 bp, mouse
gcatcgctccgaaggatcgg

SEQ ID NO: 521263 - DNA, 20 bp, mouse
gacggcagatggagggagcg

SEQ ID NO: 521264 - DNA, 20 bp, mouse
ggggccatacccacggcaga

SEQ ID NO: 521265 - DNA, 20 bp, mouse
gcggcaacccaggtctcccc

SEQ ID NO: 521266 - DNA, 20 bp, mouse
gtgctcctggcagagcaagg

SEQ ID NO: 521267 - DNA, 20 bp, mouse
ggcgctcgcacgctctccgc

SEQ ID NO: 521268 - DNA, 20 bp, mouse
gctggcagagcaaggcggac

SEQ ID NO: 521269 - DNA, 20 bp, mouse
gtggctggacccaccgacca

SEQ ID NO: 521270 - DNA, 20 bp, mouse
gaatcccgagagagtaagga

SEQ ID NO: 521271 - DNA, 20 bp, mouse
gtgtgcgctagcatcctggg

SEQ ID NO: 521272 - DNA, 20 bp, mouse
ggagcgtgcgagcgccagcc

SEQ ID NO: 521273 - DNA, 20 bp, mouse
gtgattgtgggagccaacca

SEQ ID NO: 521274 - DNA, 20 bp, mouse
gtcctgctcctggcagagca

SEQ ID NO: 521275 - DNA, 20 bp, mouse
gaaagccgaaggaggaaacg

SEQ ID NO: 521276 - DNA, 20 bp, mouse
gagcagtcgctggctcctag

SEQ ID NO: 521277 - DNA, 20 bp, mouse
gcaagactcctgttccggag

SEQ ID NO: 521278 - DNA, 20 bp, mouse
gagctccgcagcgactatgg

SEQ ID NO: 521279 - DNA, 20 bp, mouse
gcaggcaggttactccgctc

SEQ ID NO: 521280 - DNA, 20 bp, mouse
gaggtgggcgcgcgtcgcag

SEQ ID NO: 521281 - DNA, 20 bp, mouse
gggttactccgctccggaac

SEQ ID NO: 521282 - DNA, 20 bp, mouse
gatgcctcaggcgccgggac

SEQ ID NO: 521283 - DNA, 20 bp, mouse
gagaggcagaaagccggtcc

SEQ ID NO: 521284 - DNA, 20 bp, mouse
gcctgcctggcgccagtcag

SEQ ID NO: 521285 - DNA, 20 bp, mouse
gcgcgcgtcgcagcgggcac

SEQ ID NO: 521286 - DNA, 20 bp, mouse
ggggttgaaggagtccaggt

SEQ ID NO: 521287 - DNA, 20 bp, mouse
gctctcagcttaggccaacc

SEQ ID NO: 521288 - DNA, 20 bp, mouse
gtgtaggggccacctcattt

SEQ ID NO: 521289 - DNA, 20 bp, mouse
ggactccttcaacccaaatg

SEQ ID NO: 521290 - DNA, 20 bp, mouse
gtccttcaacccaaatgagg

SEQ ID NO: 521291 - DNA, 20 bp, mouse
gctgttaaggaagaacacat

SEQ ID NO: 521292 - DNA, 20 bp, mouse
ggtcgctgctcctgtcacgg

SEQ ID NO: 521293 - DNA, 20 bp, mouse
gtcctcccgggaaagcacca

SEQ ID NO: 521294 - DNA, 20 bp, mouse
gcaggagcagcgactgtgag

SEQ ID NO: 521295 - DNA, 20 bp, mouse
gacagtcgctgctcctgtca

SEQ ID NO: 521296 - DNA, 20 bp, mouse
gtgcaggctagatctcccag

SEQ ID NO: 521297 - DNA, 20 bp, mouse
gaacgcacctccggatcccc

SEQ ID NO: 521298 - DNA, 20 bp, mouse
gtgagcaggcgactgctcct

SEQ ID NO: 521299 - DNA, 20 bp, mouse
ggcatcagtgaacgcacctc

SEQ ID NO: 521300 - DNA, 20 bp, mouse
ggcgactgctcctggggatc

SEQ ID NO: 521301 - DNA, 20 bp, mouse
gctgctcacctagctgcagg

SEQ ID NO: 521302 - DNA, 20 bp, mouse
gtgtccccgggagttcagag

SEQ ID NO: 521303 - DNA, 20 bp, mouse
gttaagagtttgctggagac

SEQ ID NO: 521304 - DNA, 20 bp, mouse
gctggccggtaagaatgcaa

SEQ ID NO: 521305 - DNA, 20 bp, mouse
gcagctcagagggctcgagc

SEQ ID NO: 521306 - DNA, 20 bp, mouse
ggcctgcgcaccgagacctc

SEQ ID NO: 521307 - DNA, 20 bp, mouse
gccgagcgacgcaccctcgt

SEQ ID NO: 521308 - DNA, 20 bp, mouse
gagccgcagtggcgctgaca

SEQ ID NO: 521309 - DNA, 20 bp, mouse
gcaccctcgtaggcaccgtg

SEQ ID NO: 521310 - DNA, 20 bp, mouse
gcgcgcccgccgagccgcag

SEQ ID NO: 521311 - DNA, 20 bp, mouse
gctccggcgcgcccatgccc

SEQ ID NO: 521312 - DNA, 20 bp, mouse
gatgggcgcgccggaggtct

SEQ ID NO: 521313 - DNA, 20 bp, mouse
gcagcgccactgcggctcgg

SEQ ID NO: 521314 - DNA, 20 bp, mouse
gggccggccgggaggacgga

SEQ ID NO: 521315 - DNA, 20 bp, mouse
ggcagggcgcgccggggcat

SEQ ID NO: 521316 - DNA, 20 bp, mouse
ggaggcagcagcagcccgga

SEQ ID NO: 521317 - DNA, 20 bp, mouse
gccggggcggagagaatcag

SEQ ID NO: 521318 - DNA, 20 bp, mouse
gtcaactccggcagtacagg

SEQ ID NO: 521319 - DNA, 20 bp, mouse
ggcccggagggcgacttgca

SEQ ID NO: 521320 - DNA, 20 bp, mouse
ggccctgcaagtcgccctcc

SEQ ID NO: 521321 - DNA, 20 bp, mouse
gggcggggcggcttcaactc

SEQ ID NO: 521322 - DNA, 20 bp, mouse
ggcttcaactccggcagtac

SEQ ID NO: 521323 - DNA, 20 bp, mouse
gatcagcggagggttccccc

SEQ ID NO: 521324 - DNA, 20 bp, mouse
gcccgggttgaaaagcgtcc

SEQ ID NO: 521325 - DNA, 20 bp, mouse
gaagcgtcccgggtccagct

SEQ ID NO: 521326 - DNA, 20 bp, mouse
gcggcggcggtggatcctcg

SEQ ID NO: 521327 - DNA, 20 bp, mouse
ggccgcggcccaagacgacg

SEQ ID NO: 521328 - DNA, 20 bp, mouse
gtccccgccgcgggtaaggt

SEQ ID NO: 521329 - DNA, 20 bp, mouse
gggcgggagcaagaggcgcc

SEQ ID NO: 521330 - DNA, 20 bp, mouse
gggctccatggcgcgcgcgg

SEQ ID NO: 521331 - DNA, 20 bp, mouse
gcggcccaagacgacgcggg

SEQ ID NO: 521332 - DNA, 20 bp, mouse
gcgcgctcactcgggctcca

SEQ ID NO: 521333 - DNA, 20 bp, mouse
ggccccggcgggagagacaa

SEQ ID NO: 521334 - DNA, 20 bp, mouse
gggtggatcctcgcggctcc

SEQ ID NO: 521335 - DNA, 20 bp, mouse
gcctcctcccgcgtcgtctt

SEQ ID NO: 521336 - DNA, 20 bp, mouse
ggcgccgctgcgagaggaag

SEQ ID NO: 521337 - DNA, 20 bp, mouse
ggagaggaagaggctgaatg

SEQ ID NO: 521338 - DNA, 20 bp, mouse
gcggcggccaggggacgcgc

SEQ ID NO: 521339 - DNA, 20 bp, mouse
gcagcctcttcctctcgcag

SEQ ID NO: 521340 - DNA, 20 bp, mouse
gaagaaaagggcgcacgtca

SEQ ID NO: 521341 - DNA, 20 bp, mouse
ggcgccccacgtcccccgcg

SEQ ID NO: 521342 - DNA, 20 bp, mouse
gctgcactcggggcagaaag

SEQ ID NO: 521343 - DNA, 20 bp, mouse
gatccctgcgccgctgcgag

SEQ ID NO: 521344 - DNA, 20 bp, mouse
gtagcgcgccgctccggccc

SEQ ID NO: 521345 - DNA, 20 bp, mouse
gggcgccgcgcgggggacgt

SEQ ID NO: 521346 - DNA, 20 bp, mouse
gaaatgcagccggggagccg

SEQ ID NO: 521347 - DNA, 20 bp, mouse
gctatgggccgcccagaact

SEQ ID NO: 521348 - DNA, 20 bp, mouse
ggcagccggggagccggggc

SEQ ID NO: 521349 - DNA, 20 bp, mouse
gcggcgccgcggcaaggact

SEQ ID NO: 521350 - DNA, 20 bp, mouse
ggcccgccaagtccttgccg

SEQ ID NO: 521351 - DNA, 20 bp, mouse
gcccggcagcggatccgctg

SEQ ID NO: 521352 - DNA, 20 bp, mouse
gaagagggtgcccggagctg

SEQ ID NO: 521353 - DNA, 20 bp, mouse
ggaggtccaaggcaaatcca

SEQ ID NO: 521354 - DNA, 20 bp, mouse
ggagcgcgcccagttctggg

SEQ ID NO: 521355 - DNA, 20 bp, mouse
ggcaacagcaacagcgccag

SEQ ID NO: 521356 - DNA, 20 bp, mouse
ggctggggcacaagcatcag

SEQ ID NO: 521357 - DNA, 20 bp, mouse
ggcactagcagttggagccg

SEQ ID NO: 521358 - DNA, 20 bp, mouse
gatggcgcctcgaagagaga

SEQ ID NO: 521359 - DNA, 20 bp, mouse
ggagaagctgaaccagctat

SEQ ID NO: 521360 - DNA, 20 bp, mouse
gcagtctgctagcgcttcag

SEQ ID NO: 521361 - DNA, 20 bp, mouse
gtccatgcggaactcctccc

SEQ ID NO: 521362 - DNA, 20 bp, mouse
ggccaagcgcgagtccgggg

SEQ ID NO: 521363 - DNA, 20 bp, mouse
ggctagcagactgacaggac

SEQ ID NO: 521364 - DNA, 20 bp, mouse
ggaagcgctagcagactgac

SEQ ID NO: 521365 - DNA, 20 bp, mouse
gaggtgtccacagctaggaa

SEQ ID NO: 521366 - DNA, 20 bp, mouse
gagcgtacccaaggcaggat

SEQ ID NO: 521367 - DNA, 20 bp, mouse
gcaacgcgcgggtctcagca

SEQ ID NO: 521368 - DNA, 20 bp, mouse
gggtctcagcagggctgcca

SEQ ID NO: 521369 - DNA, 20 bp, mouse
gggcggagccgacctctagt

SEQ ID NO: 521370 - DNA, 20 bp, mouse
gggtagagcccactagaggt

SEQ ID NO: 521371 - DNA, 20 bp, mouse
gccggctgcagggtgagtac

SEQ ID NO: 521372 - DNA, 20 bp, mouse
ggagccggggcgctggacaa

SEQ ID NO: 521373 - DNA, 20 bp, mouse
gcgcagccagtcaggaggaa

SEQ ID NO: 521374 - DNA, 20 bp, mouse
gccccgagcagccaacgcgc

SEQ ID NO: 521375 - DNA, 20 bp, mouse
ggtgcatcctatcctgcctt

SEQ ID NO: 521376 - DNA, 20 bp, mouse
gatgaggctgccctgcgagg

SEQ ID NO: 521377 - DNA, 20 bp, mouse
gaggctgccctgcgaggtgg

SEQ ID NO: 521378 - DNA, 20 bp, mouse
gtacggacctccacctcgca

SEQ ID NO: 521379 - DNA, 20 bp, mouse
ggcgacttagctgcaagatg

SEQ ID NO: 521380 - DNA, 20 bp, mouse
gaagatgaggctgccctgcg

SEQ ID NO: 521381 - DNA, 20 bp, mouse
gggctcaagagccgaggcaa

SEQ ID NO: 521382 - DNA, 20 bp, mouse
gccttagggctcaagagccg

SEQ ID NO: 521383 - DNA, 20 bp, mouse
gtgggtgctcaagacgctgg

SEQ ID NO: 521384 - DNA, 20 bp, mouse
gggtctccaccatgaaggac

SEQ ID NO: 521385 - DNA, 20 bp, mouse
ggaagccagcagctaaagta

SEQ ID NO: 521386 - DNA, 20 bp, mouse
ggacgcggcgagggttcccg

SEQ ID NO: 521387 - DNA, 20 bp, mouse
gttcctcagaacgttcggga

SEQ ID NO: 521388 - DNA, 20 bp, mouse
ggaggggacgctcgcgactg

SEQ ID NO: 521389 - DNA, 20 bp, mouse
gaacgttctgaggaagccgc

SEQ ID NO: 521390 - DNA, 20 bp, mouse
gggcggccgcgagtaggaag

SEQ ID NO: 521391 - DNA, 20 bp, mouse
gcaccgtcccgaacgttctg

SEQ ID NO: 521392 - DNA, 20 bp, mouse
ggcgactgtggcgaaggcgc

SEQ ID NO: 521393 - DNA, 20 bp, mouse
gagtaggaagcggagcgcgg

SEQ ID NO: 521394 - DNA, 20 bp, mouse
gacgctcgcgactgtggcga

SEQ ID NO: 521395 - DNA, 20 bp, mouse
ggtgcgcggcggccgcgagt

SEQ ID NO: 521396 - DNA, 20 bp, mouse
ggcccactccctgacagagt

SEQ ID NO: 521397 - DNA, 20 bp, mouse
gctgcccaccaactctgtca

SEQ ID NO: 521398 - DNA, 20 bp, mouse
gcactccctgacagagttgg

SEQ ID NO: 521399 - DNA, 20 bp, mouse
gcaaggtacacaccacccgg

SEQ ID NO: 521400 - DNA, 20 bp, mouse
gcttgcagcccgtttcacat

SEQ ID NO: 521401 - DNA, 20 bp, mouse
gactctggcagcggtcggtg

SEQ ID NO: 521402 - DNA, 20 bp, mouse
ggatccaccatcctgtccag

SEQ ID NO: 521403 - DNA, 20 bp, mouse
ggagatgcccctggacagga

SEQ ID NO: 521404 - DNA, 20 bp, mouse
ggtgaaggtggttgtcgctg

SEQ ID NO: 521405 - DNA, 20 bp, mouse
gatgcccctggacaggatgg

SEQ ID NO: 521406 - DNA, 20 bp, mouse
ggccgtgccgagccgagagg

SEQ ID NO: 521407 - DNA, 20 bp, mouse
ggccagtcggcctccggcgg

SEQ ID NO: 521408 - DNA, 20 bp, mouse
gccagccagtcggcctccgg

SEQ ID NO: 521409 - DNA, 20 bp, mouse
gaagggcgggtggccgaacg

SEQ ID NO: 521410 - DNA, 20 bp, mouse
gggccggggcccgtgaccat

SEQ ID NO: 521411 - DNA, 20 bp, mouse
gactccagccagtcggcctc

SEQ ID NO: 521412 - DNA, 20 bp, mouse
gcgagaggaggcgcccgcct

SEQ ID NO: 521413 - DNA, 20 bp, mouse
gccgaggagcagctgcgcag

SEQ ID NO: 521414 - DNA, 20 bp, mouse
gcgggtggccgaacgcggtg

SEQ ID NO: 521415 - DNA, 20 bp, mouse
gggccgaacgcggtgcgggg

SEQ ID NO: 521416 - DNA, 20 bp, mouse
gaggcttgctgggcgaggaa

SEQ ID NO: 521417 - DNA, 20 bp, mouse
ggagctgggcgaggcttgct

SEQ ID NO: 521418 - DNA, 20 bp, mouse
gcaggccttggtagtcgggg

SEQ ID NO: 521419 - DNA, 20 bp, mouse
gttgcaggccttggtagtcg

SEQ ID NO: 521420 - DNA, 20 bp, mouse
gtccgcctccccgactacca

SEQ ID NO: 521421 - DNA, 20 bp, mouse
ggcaagcgaagggagaccta

SEQ ID NO: 521422 - DNA, 20 bp, mouse
ggccttggtagtcggggagg

SEQ ID NO: 521423 - DNA, 20 bp, mouse
ggcgaagggagacctagggg

SEQ ID NO: 521424 - DNA, 20 bp, mouse
gctgtcataagaggaaccgg

SEQ ID NO: 521425 - DNA, 20 bp, mouse
ggggatgggccgcaagcgaa

SEQ ID NO: 521426 - DNA, 20 bp, mouse
gacagcgccactctgaccag

SEQ ID NO: 521427 - DNA, 20 bp, mouse
gtctgaccaggggcacgatg

SEQ ID NO: 521428 - DNA, 20 bp, mouse
gcactttgggaagaacatcg

SEQ ID NO: 521429 - DNA, 20 bp, mouse
gtggggtgcccagctgaaca

SEQ ID NO: 521430 - DNA, 20 bp, mouse
gtcccactcccagctggtcc

SEQ ID NO: 521431 - DNA, 20 bp, mouse
gaggttctcctggaccagct

SEQ ID NO: 521432 - DNA, 20 bp, mouse
gacgatcacgcaggtcttca

SEQ ID NO: 521433 - DNA, 20 bp, mouse
gagaagtgggtagaggttgt

SEQ ID NO: 521434 - DNA, 20 bp, mouse
gaccggcatccaggacgtac

SEQ ID NO: 521435 - DNA, 20 bp, mouse
ggcctggaggcctgtatgca

SEQ ID NO: 521436 - DNA, 20 bp, mouse
gaggaggcggaggaccggac

SEQ ID NO: 521437 - DNA, 20 bp, mouse
gggctgccgggtcaataaga

SEQ ID NO: 521438 - DNA, 20 bp, mouse
gtgccgggtcaataagaagg

SEQ ID NO: 521439 - DNA, 20 bp, mouse
gcgggagaccagatccacaa

SEQ ID NO: 521440 - DNA, 20 bp, mouse
gcacagctagacactaggac

SEQ ID NO: 521441 - DNA, 20 bp, mouse
gaggatcccgagactctaca

SEQ ID NO: 521442 - DNA, 20 bp, mouse
gctgcagtcttgagccggtc

SEQ ID NO: 521443 - DNA, 20 bp, mouse
gacttaccagcagctccacg

SEQ ID NO: 521444 - DNA, 20 bp, mouse
gagtcaaggaaagcgaaaca

SEQ ID NO: 521445 - DNA, 20 bp, mouse
ggcgtgcctgggatgctctg

SEQ ID NO: 521446 - DNA, 20 bp, mouse
gcagcttgcaaggaaagagt

SEQ ID NO: 521447 - DNA, 20 bp, mouse
ggcagcggggcgttgatcca

SEQ ID NO: 521448 - DNA, 20 bp, mouse
gtcctcgcggaaacattaaa

SEQ ID NO: 521449 - DNA, 20 bp, mouse
gtgcgggcgcgcggcaacct

SEQ ID NO: 521450 - DNA, 20 bp, mouse
gatctgcgtggagtccccca

SEQ ID NO: 521451 - DNA, 20 bp, mouse
gaaggaaagagtgggccggc

SEQ ID NO: 521452 - DNA, 20 bp, mouse
ggaggaagccgcagcttgca

SEQ ID NO: 521453 - DNA, 20 bp, mouse
gagagcgcggagactgcgag

SEQ ID NO: 521454 - DNA, 20 bp, mouse
ggatcaacgccccgctgctc

SEQ ID NO: 521455 - DNA, 20 bp, mouse
gtgggcgtaggtgaagcgga

SEQ ID NO: 521456 - DNA, 20 bp, mouse
gcggagcccgctcccgtcag

SEQ ID NO: 521457 - DNA, 20 bp, mouse
ggagccgggactagcatgtg

SEQ ID NO: 521458 - DNA, 20 bp, mouse
ggctagtcccggctccggca

SEQ ID NO: 521459 - DNA, 20 bp, mouse
ggcgccgcacatgctagtcc

SEQ ID NO: 521460 - DNA, 20 bp, mouse
gcagagctcagtagccgggg

SEQ ID NO: 521461 - DNA, 20 bp, mouse
gcagccgcccctgacgggag

SEQ ID NO: 521462 - DNA, 20 bp, mouse
gtcgcgcagccgcccctgac

SEQ ID NO: 521463 - DNA, 20 bp, mouse
gacccggtgtccggagatga

SEQ ID NO: 521464 - DNA, 20 bp, mouse
gatgtgcggcgcctctcggg

SEQ ID NO: 521465 - DNA, 20 bp, mouse
gagcatgtgcggcgcctctc

SEQ ID NO: 521466 - DNA, 20 bp, mouse
gcagcattagtgcaacatga

SEQ ID NO: 521467 - DNA, 20 bp, mouse
gattagtgcaacatgagggc

SEQ ID NO: 521468 - DNA, 20 bp, mouse
gtcggcagtaagccagactg

SEQ ID NO: 521469 - DNA, 20 bp, mouse
gagagaagactgagactggg

SEQ ID NO: 521470 - DNA, 20 bp, mouse
gtaagttgtggaagtacctg

SEQ ID NO: 521471 - DNA, 20 bp, mouse
gagcacagaacactctgctg

SEQ ID NO: 521472 - DNA, 20 bp, mouse
ggccgaaagttcaccgacaa

SEQ ID NO: 521473 - DNA, 20 bp, mouse
gctctctgccccatcgcccc

SEQ ID NO: 521474 - DNA, 20 bp, mouse
gaacttacagaacctcagtc

SEQ ID NO: 521475 - DNA, 20 bp, mouse
ggtcttctctgtcctgcagc

SEQ ID NO: 521476 - DNA, 20 bp, mouse
gtcatcggctatgagctcca

SEQ ID NO: 521477 - DNA, 20 bp, mouse
gtggtggtaacagaaaggat

SEQ ID NO: 521478 - DNA, 20 bp, mouse
gagccgatgatctagaggaa

SEQ ID NO: 521479 - DNA, 20 bp, mouse
gttctctggtggtaacagaa

SEQ ID NO: 521480 - DNA, 20 bp, mouse
gctcatagccgatgatctag

SEQ ID NO: 521481 - DNA, 20 bp, mouse
gtaatggcgtctttctctgg

SEQ ID NO: 521482 - DNA, 20 bp, mouse
gagaaaggatgggtcttcct

SEQ ID NO: 521483 - DNA, 20 bp, mouse
gtggtaatggcgtctttctc

SEQ ID NO: 521484 - DNA, 20 bp, mouse
gagacgccattaccaaatgg

SEQ ID NO: 521485 - DNA, 20 bp, mouse
gtcttaccaccatttggtaa

SEQ ID NO: 521486 - DNA, 20 bp, mouse
gactgctctcagatacaaaa

SEQ ID NO: 521487 - DNA, 20 bp, mouse
gaaacctacgaaacaggcaa

SEQ ID NO: 521488 - DNA, 20 bp, mouse
ggagccgttgcctgtttcgt

SEQ ID NO: 521489 - DNA, 20 bp, mouse
gaaatgagaccttctgacac

SEQ ID NO: 521490 - DNA, 20 bp, mouse
gaggggagtaaagcgggtag

SEQ ID NO: 521491 - DNA, 20 bp, mouse
gtaatataaacctacgaaac

SEQ ID NO: 521492 - DNA, 20 bp, mouse
gtagaaaagcctgtgtcaga

SEQ ID NO: 521493 - DNA, 20 bp, mouse
gcagtgggaaaatatgatca

SEQ ID NO: 521494 - DNA, 20 bp, mouse
gtatttctgcagtagacagt

SEQ ID NO: 521495 - DNA, 20 bp, mouse
gctctgctctttagcactaa

SEQ ID NO: 521496 - DNA, 20 bp, mouse
gctcaggtcatccgagactg

SEQ ID NO: 521497 - DNA, 20 bp, mouse
gccgagactgcggctcttac

SEQ ID NO: 521498 - DNA, 20 bp, mouse
gggatgacctgagtagagca

SEQ ID NO: 521499 - DNA, 20 bp, mouse
gagataaccctgctctactc

SEQ ID NO: 521500 - DNA, 20 bp, mouse
ggggacatcagggattttcc

SEQ ID NO: 521501 - DNA, 20 bp, mouse
ggggtggaacccctttggaa

SEQ ID NO: 521502 - DNA, 20 bp, mouse
ggttatctggatgtgcttgt

SEQ ID NO: 521503 - DNA, 20 bp, mouse
gacccctttggaagggaggt

SEQ ID NO: 521504 - DNA, 20 bp, mouse
gcttgtgggtggaacccctt

SEQ ID NO: 521505 - DNA, 20 bp, mouse
gtttggaagggaggtaggta

SEQ ID NO: 521506 - DNA, 20 bp, mouse
gacgctcccgcggcgaccga

SEQ ID NO: 521507 - DNA, 20 bp, mouse
gccgctggaggcagcactta

SEQ ID NO: 521508 - DNA, 20 bp, mouse
gccgcgggagcgtgagtgct

SEQ ID NO: 521509 - DNA, 20 bp, mouse
gaacttgcaccgggtgccgt

SEQ ID NO: 521510 - DNA, 20 bp, mouse
gtcgggctcagaacttgcac

SEQ ID NO: 521511 - DNA, 20 bp, mouse
gaagttctgagcccgagggg

SEQ ID NO: 521512 - DNA, 20 bp, mouse
ggcgatagtccatgacctct

SEQ ID NO: 521513 - DNA, 20 bp, mouse
gcaccgcccgagccatgact

SEQ ID NO: 521514 - DNA, 20 bp, mouse
gcgtcccacgctgccagggg

SEQ ID NO: 521515 - DNA, 20 bp, mouse
gacctggtagcaccgagtca

SEQ ID NO: 521516 - DNA, 20 bp, mouse
ggctcctctagaagtagtta

SEQ ID NO: 521517 - DNA, 20 bp, mouse
gggaagggaacccaacccgg

SEQ ID NO: 521518 - DNA, 20 bp, mouse
ggaggctccgagcagagact

SEQ ID NO: 521519 - DNA, 20 bp, mouse
gggtctgcgcccacttctga

SEQ ID NO: 521520 - DNA, 20 bp, mouse
gccagttcgccttcagaagt

SEQ ID NO: 521521 - DNA, 20 bp, mouse
gtcttccaaaaaaacagtct

SEQ ID NO: 521522 - DNA, 20 bp, mouse
gggaacccaacccggaggtg

SEQ ID NO: 521523 - DNA, 20 bp, mouse
gggtggaagggaacccaacc

SEQ ID NO: 521524 - DNA, 20 bp, mouse
gccaacccggaggtgaggtg

SEQ ID NO: 521525 - DNA, 20 bp, mouse
ggaaggcgaactgggttgga

SEQ ID NO: 521526 - DNA, 20 bp, mouse
gagtggcgagcgactccccg

SEQ ID NO: 521527 - DNA, 20 bp, mouse
gtctaggcgggaagagggtg

SEQ ID NO: 521528 - DNA, 20 bp, mouse
gccccaagcccggtgacctt

SEQ ID NO: 521529 - DNA, 20 bp, mouse
gtgcagccgcaagcaccgcg

SEQ ID NO: 521530 - DNA, 20 bp, mouse
gcgcagaggtgagcccaggg

SEQ ID NO: 521531 - DNA, 20 bp, mouse
gccggtgtaagggttagagg

SEQ ID NO: 521532 - DNA, 20 bp, mouse
gagtcgctcgccactggagc

SEQ ID NO: 521533 - DNA, 20 bp, mouse
gaggctcggacccactggaa

SEQ ID NO: 521534 - DNA, 20 bp, mouse
ggccgagagaggacctctgt

SEQ ID NO: 521535 - DNA, 20 bp, mouse
gtaaaagcgccggatcgcag

SEQ ID NO: 521536 - DNA, 20 bp, mouse
gggaagacgggaagacgagt

SEQ ID NO: 521537 - DNA, 20 bp, mouse
gcgggaagacgagtaggtgt

SEQ ID NO: 521538 - DNA, 20 bp, mouse
gcgagtaggtgtaggagtgg

SEQ ID NO: 521539 - DNA, 20 bp, mouse
gagcctcaggctctcacgag

SEQ ID NO: 521540 - DNA, 20 bp, mouse
gcgtaagcctcagggtccta

SEQ ID NO: 521541 - DNA, 20 bp, mouse
gctcaggctctcacgagagg

SEQ ID NO: 521542 - DNA, 20 bp, mouse
gggccaggaggtgagactca

SEQ ID NO: 521543 - DNA, 20 bp, mouse
ggcaggcgtggattaacagg

SEQ ID NO: 521544 - DNA, 20 bp, mouse
gggctctcacgagaggagga

SEQ ID NO: 521545 - DNA, 20 bp, mouse
gcccgcaggcgtggattaac

SEQ ID NO: 521546 - DNA, 20 bp, mouse
gtgaggctgagacggctttg

SEQ ID NO: 521547 - DNA, 20 bp, mouse
gcattggcgaaggcacccgg

SEQ ID NO: 521548 - DNA, 20 bp, mouse
ggttaatacttgtgcaggtg

SEQ ID NO: 521549 - DNA, 20 bp, mouse
ggcagcagagagagttgcgg

SEQ ID NO: 521550 - DNA, 20 bp, mouse
ggcccgaagccgcacatgcg

SEQ ID NO: 521551 - DNA, 20 bp, mouse
gggagagttaatacttgtgc

SEQ ID NO: 521552 - DNA, 20 bp, mouse
ggacagaaactgttgtgtta

SEQ ID NO: 521553 - DNA, 20 bp, mouse
ggccaccggggatttagaag

SEQ ID NO: 521554 - DNA, 20 bp, mouse
gaaaaagaaccccgcatgtg

SEQ ID NO: 521555 - DNA, 20 bp, mouse
ggcgctgcctgcggtaccag

SEQ ID NO: 521556 - DNA, 20 bp, mouse
gcggctgccccgcctccgag

SEQ ID NO: 521557 - DNA, 20 bp, mouse
gtggtgcctgagcctctcgg

SEQ ID NO: 521558 - DNA, 20 bp, mouse
gtgcctgagcctctcggagg

SEQ ID NO: 521559 - DNA, 20 bp, mouse
gcgactccgccctgacacgt

SEQ ID NO: 521560 - DNA, 20 bp, mouse
gccccgcctccgagaggctc

SEQ ID NO: 521561 - DNA, 20 bp, mouse
gcgcagctcgctggtttgtt

SEQ ID NO: 521562 - DNA, 20 bp, mouse
gcggggcagccgacgtgtca

SEQ ID NO: 521563 - DNA, 20 bp, mouse
gaggtggtgcctgagcctct

SEQ ID NO: 521564 - DNA, 20 bp, mouse
gggcagccgacgtgtcaggg

SEQ ID NO: 521565 - DNA, 20 bp, mouse
gtggagacgctgctgcggta

SEQ ID NO: 521566 - DNA, 20 bp, mouse
gcccgctgaccggcactcag

SEQ ID NO: 521567 - DNA, 20 bp, mouse
gcggctcaggctgcgctggt

SEQ ID NO: 521568 - DNA, 20 bp, mouse
gggagaccggacactcacct

SEQ ID NO: 521569 - DNA, 20 bp, mouse
gcacctcggcgcccgctgac

SEQ ID NO: 521570 - DNA, 20 bp, mouse
ggacctgtgagcctggagac

SEQ ID NO: 521571 - DNA, 20 bp, mouse
gcagtctaaaaacacaggga

SEQ ID NO: 521572 - DNA, 20 bp, mouse
gggagggcggggctacgggg

SEQ ID NO: 521573 - DNA, 20 bp, mouse
ggaccggcactcagcggctc

SEQ ID NO: 521574 - DNA, 20 bp, mouse
ggccgctgagtgccggtcag

SEQ ID NO: 521575 - DNA, 20 bp, mouse
gtaggcagtctaaaaacaca

SEQ ID NO: 521576 - DNA, 20 bp, mouse
ggcggactcgctgcctctgg

SEQ ID NO: 521577 - DNA, 20 bp, mouse
gggagacggcagaactgcga

SEQ ID NO: 521578 - DNA, 20 bp, mouse
ggacggcagaactgcgatgg

SEQ ID NO: 521579 - DNA, 20 bp, mouse
gccttgcgtgggggcggaga

SEQ ID NO: 521580 - DNA, 20 bp, mouse
ggtccccgaccaaggcctga

SEQ ID NO: 521581 - DNA, 20 bp, mouse
gcccagaaaaccttgcgtgg

SEQ ID NO: 521582 - DNA, 20 bp, mouse
gccaatgggtaaagagggaa

SEQ ID NO: 521583 - DNA, 20 bp, mouse
ggagggaacggccatctcaa

SEQ ID NO: 521584 - DNA, 20 bp, mouse
gaagctcgggaccccgaagg

SEQ ID NO: 521585 - DNA, 20 bp, mouse
gccaaagctcgggaccccga

SEQ ID NO: 521586 - DNA, 20 bp, mouse
gcgccgggaggactctggtc

SEQ ID NO: 521587 - DNA, 20 bp, mouse
gccgctcggtgggcacgggg

SEQ ID NO: 521588 - DNA, 20 bp, mouse
gaggctccgggaagctcgga

SEQ ID NO: 521589 - DNA, 20 bp, mouse
gcagccgggccgcacgcagg

SEQ ID NO: 521590 - DNA, 20 bp, mouse
ggctatgggtgggtgaccag

SEQ ID NO: 521591 - DNA, 20 bp, mouse
gtctttactggccgctcggt

SEQ ID NO: 521592 - DNA, 20 bp, mouse
gtggctcgcacagatcgaga

SEQ ID NO: 521593 - DNA, 20 bp, mouse
gaggccacgcgggcggatgg

SEQ ID NO: 521594 - DNA, 20 bp, mouse
gagcggccagtaaagaaggg

SEQ ID NO: 521595 - DNA, 20 bp, mouse
gtagctggggacacaagtct

SEQ ID NO: 521596 - DNA, 20 bp, mouse
gctcccaacgtcagactggt

SEQ ID NO: 521597 - DNA, 20 bp, mouse
ggtaggcagtggcagtgtgg

SEQ ID NO: 521598 - DNA, 20 bp, mouse
gctccttcaaggttagatgt

SEQ ID NO: 521599 - DNA, 20 bp, mouse
gctgcctaccagtctgacgt

SEQ ID NO: 521600 - DNA, 20 bp, mouse
gtgagctcccaacgtcagac

SEQ ID NO: 521601 - DNA, 20 bp, mouse
ggaccaacatctaaccttga

SEQ ID NO: 521602 - DNA, 20 bp, mouse
ggagttctcccgcctgaggt

SEQ ID NO: 521603 - DNA, 20 bp, mouse
gtggactgtttggtccccat

SEQ ID NO: 521604 - DNA, 20 bp, mouse
ggctcttggggaaggaccca

SEQ ID NO: 521605 - DNA, 20 bp, mouse
gacaggggatcatagcgtgg

SEQ ID NO: 521606 - DNA, 20 bp, mouse
gtcagtgtgttcaggaggag

SEQ ID NO: 521607 - DNA, 20 bp, mouse
gggcttcaggaggaattgtc

SEQ ID NO: 521608 - DNA, 20 bp, mouse
gacactgactccaactccca

SEQ ID NO: 521609 - DNA, 20 bp, mouse
gttcaggaggaattgtcagg

SEQ ID NO: 521610 - DNA, 20 bp, mouse
gcaattcctcctgaagccct

SEQ ID NO: 521611 - DNA, 20 bp, mouse
gaggtggcgtaccagagtgc

SEQ ID NO: 521612 - DNA, 20 bp, mouse
gaagattgtggacagggagg

SEQ ID NO: 521613 - DNA, 20 bp, mouse
ggagttcaccagagtctcgt

SEQ ID NO: 521614 - DNA, 20 bp, mouse
gcgtaccagagtgcaggcat

SEQ ID NO: 521615 - DNA, 20 bp, mouse
gccggtagagacaagcctgg

SEQ ID NO: 521616 - DNA, 20 bp, mouse
gtcctggccatgctgaccct

SEQ ID NO: 521617 - DNA, 20 bp, mouse
ggagcaagtgccctgtagga

SEQ ID NO: 521618 - DNA, 20 bp, mouse
gtcgagagcaagtgccctgt

SEQ ID NO: 521619 - DNA, 20 bp, mouse
gctgagagatagccaggccc

SEQ ID NO: 521620 - DNA, 20 bp, mouse
gtgtgtcttaccgtcctaca

SEQ ID NO: 521621 - DNA, 20 bp, mouse
gctcatggctctgcctaggg

SEQ ID NO: 521622 - DNA, 20 bp, mouse
gggacggtaagacacagtgc

SEQ ID NO: 521623 - DNA, 20 bp, mouse
gtggctcatggctctgccta

SEQ ID NO: 521624 - DNA, 20 bp, mouse
gtcgacgctgagagatagcc

SEQ ID NO: 521625 - DNA, 20 bp, mouse
ggcccagggtcagcatggcc

SEQ ID NO: 521626 - DNA, 20 bp, mouse
gtagtgggccgagccctgtg

SEQ ID NO: 521627 - DNA, 20 bp, mouse
gctaaagaggaaggccgccg

SEQ ID NO: 521628 - DNA, 20 bp, mouse
gcggacctcgacctctaaag

SEQ ID NO: 521629 - DNA, 20 bp, mouse
gtggttactggactcgtagt

SEQ ID NO: 521630 - DNA, 20 bp, mouse
gaagggcgcctccatacctg

SEQ ID NO: 521631 - DNA, 20 bp, mouse
gctgtgggtagtctagaagt

SEQ ID NO: 521632 - DNA, 20 bp, mouse
gcctcgacctctaaagagga

SEQ ID NO: 521633 - DNA, 20 bp, mouse
ggcagagcctcccctccccg

SEQ ID NO: 521634 - DNA, 20 bp, mouse
ggcagaagccccaggtatgg

SEQ ID NO: 521635 - DNA, 20 bp, mouse
gcctgtcttcgtgaggagag

SEQ ID NO: 521636 - DNA, 20 bp, mouse
gcatctggaggcgaaagcca

SEQ ID NO: 521637 - DNA, 20 bp, mouse
gggacggctcggtcatctgg

SEQ ID NO: 521638 - DNA, 20 bp, mouse
gtctcttagaggtggaaaaa

SEQ ID NO: 521639 - DNA, 20 bp, mouse
gttagaggtggaaaaaaggt

SEQ ID NO: 521640 - DNA, 20 bp, mouse
gcagaaaaccatgtttgcgg

SEQ ID NO: 521641 - DNA, 20 bp, mouse
gagccgtccgtgacagcgag

SEQ ID NO: 521642 - DNA, 20 bp, mouse
gagagttctgctggaaaacg

SEQ ID NO: 521643 - DNA, 20 bp, mouse
gcagccaaaggaaactctac

SEQ ID NO: 521644 - DNA, 20 bp, mouse
ggtttaaaaacaggtctata

SEQ ID NO: 521645 - DNA, 20 bp, mouse
gtaatacatgccttgagttc

SEQ ID NO: 521646 - DNA, 20 bp, mouse
gcagttgccaaggctccctg

SEQ ID NO: 521647 - DNA, 20 bp, mouse
gggaaaggcccgtcacctca

SEQ ID NO: 521648 - DNA, 20 bp, mouse
gcaaggctccctgaggtgac

SEQ ID NO: 521649 - DNA, 20 bp, mouse
gccgcaatactggagtgcgc

SEQ ID NO: 521650 - DNA, 20 bp, mouse
ggacatgacacgtagtatgg

SEQ ID NO: 521651 - DNA, 20 bp, mouse
gccggtgaggagaagacttg

SEQ ID NO: 521652 - DNA, 20 bp, mouse
ggaggagcccaggtaatcaa

SEQ ID NO: 521653 - DNA, 20 bp, mouse
gtctgggtgagacgccacag

SEQ ID NO: 521654 - DNA, 20 bp, mouse
gcggggtggggagaacatct

SEQ ID NO: 521655 - DNA, 20 bp, mouse
gtggaggttatccgcaatac

SEQ ID NO: 521656 - DNA, 20 bp, mouse
ggcacaggtggagatcgtgg

SEQ ID NO: 521657 - DNA, 20 bp, mouse
ggtcgcacagacctggccag

SEQ ID NO: 521658 - DNA, 20 bp, mouse
gcagagcgaccccactcggg

SEQ ID NO: 521659 - DNA, 20 bp, mouse
gagcccagagcgaccccact

SEQ ID NO: 521660 - DNA, 20 bp, mouse
gccacttccccgcccgagtg

SEQ ID NO: 521661 - DNA, 20 bp, mouse
gaaagcacaggtggagatcg

SEQ ID NO: 521662 - DNA, 20 bp, mouse
ggggacctgtcgcacagacc

SEQ ID NO: 521663 - DNA, 20 bp, mouse
ggccctgcgccgctgccctg

SEQ ID NO: 521664 - DNA, 20 bp, mouse
gcggggcgccgagagcccca

SEQ ID NO: 521665 - DNA, 20 bp, mouse
gcggcccgagcagcaccaag

SEQ ID NO: 521666 - DNA, 20 bp, mouse
gtcagctagaatcagatcca

SEQ ID NO: 521667 - DNA, 20 bp, mouse
gaggagctaaaattagaagt

SEQ ID NO: 521668 - DNA, 20 bp, mouse
gcctgtgtcccagaggacga

SEQ ID NO: 521669 - DNA, 20 bp, mouse
ggtgtgtcaatgacacggtg

SEQ ID NO: 521670 - DNA, 20 bp, mouse
gagtcatttggagccacact

SEQ ID NO: 521671 - DNA, 20 bp, mouse
gcctctgggacacaggagat

SEQ ID NO: 521672 - DNA, 20 bp, mouse
gtggctgcagcaacccccta

SEQ ID NO: 521673 - DNA, 20 bp, mouse
gctgagaatcagggagctct

SEQ ID NO: 521674 - DNA, 20 bp, mouse
gtgaccacagcccccttaca

SEQ ID NO: 521675 - DNA, 20 bp, mouse
gcaaatgactaaaactctgt

SEQ ID NO: 521676 - DNA, 20 bp, mouse
gggagacaaagatgcgaggg

SEQ ID NO: 521677 - DNA, 20 bp, mouse
ggactgagccgcctgcacgt

SEQ ID NO: 521678 - DNA, 20 bp, mouse
gggaggagacaaagatgcga

SEQ ID NO: 521679 - DNA, 20 bp, mouse
gggcggctcagtcactagag

SEQ ID NO: 521680 - DNA, 20 bp, mouse
gctactcgccaacgtgcagg

SEQ ID NO: 521681 - DNA, 20 bp, mouse
ggggccgcaccctcactcgg

SEQ ID NO: 521682 - DNA, 20 bp, mouse
gaagctactcgccaacgtgc

SEQ ID NO: 521683 - DNA, 20 bp, mouse
gcgctccggagcgaccgccg

SEQ ID NO: 521684 - DNA, 20 bp, mouse
gggccgctgcagaccctgtg

SEQ ID NO: 521685 - DNA, 20 bp, mouse
gtcctcctccagtgaggttc

SEQ ID NO: 521686 - DNA, 20 bp, mouse
gacgatgagcccagctctcg

SEQ ID NO: 521687 - DNA, 20 bp, mouse
gccttccgaggtaggtgaca

SEQ ID NO: 521688 - DNA, 20 bp, mouse
gcctacctcggaaggaaagc

SEQ ID NO: 521689 - DNA, 20 bp, mouse
gctctcgtggagaaagctta

SEQ ID NO: 521690 - DNA, 20 bp, mouse
gtaggtgacagggaattggg

SEQ ID NO: 521691 - DNA, 20 bp, mouse
gaattccctgtcacctacct

SEQ ID NO: 521692 - DNA, 20 bp, mouse
ggcgccgtgaggtagacgac

SEQ ID NO: 521693 - DNA, 20 bp, mouse
gtagacgacgggaagcagga

SEQ ID NO: 521694 - DNA, 20 bp, mouse
ggtggggatggtcgcaacgt

SEQ ID NO: 521695 - DNA, 20 bp, mouse
ggggtgggctggtagatgag

SEQ ID NO: 521696 - DNA, 20 bp, mouse
ggcacgagggtcaaacctag

SEQ ID NO: 521697 - DNA, 20 bp, mouse
gacgcggagggcaaggacag

SEQ ID NO: 521698 - DNA, 20 bp, mouse
gcgcgtggaatcccgcacga

SEQ ID NO: 521699 - DNA, 20 bp, mouse
gtcgctgtgagatagaggat

SEQ ID NO: 521700 - DNA, 20 bp, mouse
gacaccggaagccccgacca

SEQ ID NO: 521701 - DNA, 20 bp, mouse
ggtgcgggattccacgcgga

SEQ ID NO: 521702 - DNA, 20 bp, mouse
gaggaacctcggggaaggtg

SEQ ID NO: 521703 - DNA, 20 bp, mouse
gtccgtggccctgctaagac

SEQ ID NO: 521704 - DNA, 20 bp, mouse
gcatattcaaaagctcacac

SEQ ID NO: 521705 - DNA, 20 bp, mouse
gaacgtcacagccgtggtcg

SEQ ID NO: 521706 - DNA, 20 bp, mouse
gaccatggaggccacgtccc

SEQ ID NO: 521707 - DNA, 20 bp, mouse
gatggaggccacgtcccggg

SEQ ID NO: 521708 - DNA, 20 bp, mouse
gccgaggccgagctcttcgc

SEQ ID NO: 521709 - DNA, 20 bp, mouse
ggcggcagcaacgaccatgg

SEQ ID NO: 521710 - DNA, 20 bp, mouse
gcgcccgcacagctcgaaca

SEQ ID NO: 521711 - DNA, 20 bp, mouse
ggcagtgagcgcccatatgg

SEQ ID NO: 521712 - DNA, 20 bp, mouse
gtgctggttctgtgaggtag

SEQ ID NO: 521713 - DNA, 20 bp, mouse
gcacagctcgaacagggcgg

SEQ ID NO: 521714 - DNA, 20 bp, mouse
ggccagggccctagcgacgg

SEQ ID NO: 521715 - DNA, 20 bp, mouse
gcggagtgaggggcgacctc

SEQ ID NO: 521716 - DNA, 20 bp, mouse
gtaggccacaaagcccgtga

SEQ ID NO: 521717 - DNA, 20 bp, mouse
gccacaaagcccgtgagggt

SEQ ID NO: 521718 - DNA, 20 bp, mouse
gtgctggtacctcagtcccg

SEQ ID NO: 521719 - DNA, 20 bp, mouse
gacctggcgccgcgggactg

SEQ ID NO: 521720 - DNA, 20 bp, mouse
gcacacagagggtggcaaga

SEQ ID NO: 521721 - DNA, 20 bp, mouse
ggcgagcggctgcacctcac

SEQ ID NO: 521722 - DNA, 20 bp, mouse
gccggtcagccgctcagtgg

SEQ ID NO: 521723 - DNA, 20 bp, mouse
gactgaggtaccagcaggga

SEQ ID NO: 521724 - DNA, 20 bp, mouse
gagcggctgcacctcactgg

SEQ ID NO: 521725 - DNA, 20 bp, mouse
gctacctgtgcccctgcccg

SEQ ID NO: 521726 - DNA, 20 bp, mouse
ggcgactacagacagaccga

SEQ ID NO: 521727 - DNA, 20 bp, mouse
gacagacagaccgagggcga

SEQ ID NO: 521728 - DNA, 20 bp, mouse
gcgagggcgagggtgtaccg

SEQ ID NO: 521729 - DNA, 20 bp, mouse
ggagctgtcctcgcacagca

SEQ ID NO: 521730 - DNA, 20 bp, mouse
gacaccctcgccctcgccct

SEQ ID NO: 521731 - DNA, 20 bp, mouse
gcggggactgggactaagaa

SEQ ID NO: 521732 - DNA, 20 bp, mouse
gtcgctagtgctggactcgc

SEQ ID NO: 521733 - DNA, 20 bp, mouse
ggggaaggatccagcagggg

SEQ ID NO: 521734 - DNA, 20 bp, mouse
gggttctctcacgacaaggt

SEQ ID NO: 521735 - DNA, 20 bp, mouse
gtgtctgtagtcgctagtgc

SEQ ID NO: 521736 - DNA, 20 bp, mouse
gtagcctcgggtcgctggtg

SEQ ID NO: 521737 - DNA, 20 bp, mouse
gtcgctggtgtggcaggacg

SEQ ID NO: 521738 - DNA, 20 bp, mouse
ggggccacagggccagacta

SEQ ID NO: 521739 - DNA, 20 bp, mouse
ggccctcgcgacgtagcctc

SEQ ID NO: 521740 - DNA, 20 bp, mouse
ggtggtgcgccgggaaggat

SEQ ID NO: 521741 - DNA, 20 bp, mouse
gctgccacaccagcgacccg

SEQ ID NO: 521742 - DNA, 20 bp, mouse
gtcctcgcgcctcagtatcc

SEQ ID NO: 521743 - DNA, 20 bp, mouse
ggctggccctatataagggg

SEQ ID NO: 521744 - DNA, 20 bp, mouse
gacccgaggctacgtcgcga

SEQ ID NO: 521745 - DNA, 20 bp, mouse
gtgagctggccctatataag

SEQ ID NO: 521746 - DNA, 20 bp, mouse
ggacgcgagacctcaaggaa

SEQ ID NO: 521747 - DNA, 20 bp, mouse
gacgaaggatctggagttag

SEQ ID NO: 521748 - DNA, 20 bp, mouse
gtaggagtaaatgggaacga

SEQ ID NO: 521749 - DNA, 20 bp, mouse
gtaaatgggaacgaaggatc

SEQ ID NO: 521750 - DNA, 20 bp, mouse
ggcaacgacgcgagacctca

SEQ ID NO: 521751 - DNA, 20 bp, mouse
ggaggcaggtagatggacga

SEQ ID NO: 521752 - DNA, 20 bp, mouse
gtgccaggagacgagcagga

SEQ ID NO: 521753 - DNA, 20 bp, mouse
gttactggccttaaactgaa

SEQ ID NO: 521754 - DNA, 20 bp, mouse
gcagagaagcttagacggtt

SEQ ID NO: 521755 - DNA, 20 bp, mouse
gtgggggtgcggtggaaaat

SEQ ID NO: 521756 - DNA, 20 bp, mouse
gcactccggaagcggcgcac

SEQ ID NO: 521757 - DNA, 20 bp, mouse
gtccagctccggccaggcct

SEQ ID NO: 521758 - DNA, 20 bp, mouse
gtccggaagcggcgcacggg

SEQ ID NO: 521759 - DNA, 20 bp, mouse
gccgctgctgcactacctgg

SEQ ID NO: 521760 - DNA, 20 bp, mouse
gtggcgccgcactccggaag

SEQ ID NO: 521761 - DNA, 20 bp, mouse
gtccggccaggcctcggaca

SEQ ID NO: 521762 - DNA, 20 bp, mouse
gacctggaggtgagcggctg

SEQ ID NO: 521763 - DNA, 20 bp, mouse
ggaagtgtggcgccgcactc

SEQ ID NO: 521764 - DNA, 20 bp, mouse
gacgggcggcgcgatggcgg

SEQ ID NO: 521765 - DNA, 20 bp, mouse
ggccgtgtccgaggcctggc

SEQ ID NO: 521766 - DNA, 20 bp, mouse
gccccttagcaaccaagtgg

SEQ ID NO: 521767 - DNA, 20 bp, mouse
gggggagacagtccttagga

SEQ ID NO: 521768 - DNA, 20 bp, mouse
ggcaaggggagacagtcctt

SEQ ID NO: 521769 - DNA, 20 bp, mouse
gacgaagcgtctactgcaag

SEQ ID NO: 521770 - DNA, 20 bp, mouse
gcttccccttagcaaccaag

SEQ ID NO: 521771 - DNA, 20 bp, mouse
gcttgattcttaccttccta

SEQ ID NO: 521772 - DNA, 20 bp, mouse
gacgcttcgtttggttgctg

SEQ ID NO: 521773 - DNA, 20 bp, mouse
gcagatgagacgggtcaggt

SEQ ID NO: 521774 - DNA, 20 bp, mouse
ggtcaagcgataaatatcct

SEQ ID NO: 521775 - DNA, 20 bp, mouse
gcttgtactgagacttaatc

SEQ ID NO: 521776 - DNA, 20 bp, mouse
gtgtaggattacctcgaagg

SEQ ID NO: 521777 - DNA, 20 bp, mouse
gagctgtaggattacctcga

SEQ ID NO: 521778 - DNA, 20 bp, mouse
ggaaggaggattgaacatcc

SEQ ID NO: 521779 - DNA, 20 bp, mouse
ggcccgagctccccagaagg

SEQ ID NO: 521780 - DNA, 20 bp, mouse
gcgatattttccgggaatca

SEQ ID NO: 521781 - DNA, 20 bp, mouse
gattttccgggaatcatggc

SEQ ID NO: 521782 - DNA, 20 bp, mouse
gattgaggctagggtttcct

SEQ ID NO: 521783 - DNA, 20 bp, mouse
ggacaagactactatcggaa

SEQ ID NO: 521784 - DNA, 20 bp, mouse
gtcccaggcaacccgctcag

SEQ ID NO: 521785 - DNA, 20 bp, mouse
ggtaatacagcccatcacct

SEQ ID NO: 521786 - DNA, 20 bp, mouse
gagacagagtcggggagctg

SEQ ID NO: 521787 - DNA, 20 bp, mouse
gaattgtaatcgcagagaaa

SEQ ID NO: 521788 - DNA, 20 bp, mouse
gctgggagcctggctcagtc

SEQ ID NO: 521789 - DNA, 20 bp, mouse
ggggagacaagacagagtcg

SEQ ID NO: 521790 - DNA, 20 bp, mouse
gggggacacaggaccacagg

SEQ ID NO: 521791 - DNA, 20 bp, mouse
gccaggctcccctagagggt

SEQ ID NO: 521792 - DNA, 20 bp, mouse
gcagcaatgacagactgaca

SEQ ID NO: 521793 - DNA, 20 bp, mouse
gaggaggacagaccgacaag

SEQ ID NO: 521794 - DNA, 20 bp, mouse
ggggaagcagtaggaagctg

SEQ ID NO: 521795 - DNA, 20 bp, mouse
gtcgccctccccaccctcta

SEQ ID NO: 521796 - DNA, 20 bp, mouse
gggagtgagtcaatcagcag

SEQ ID NO: 521797 - DNA, 20 bp, mouse
gttccggattcgtgtcccca

SEQ ID NO: 521798 - DNA, 20 bp, mouse
gtgccttggggacacgaatc

SEQ ID NO: 521799 - DNA, 20 bp, mouse
gaaggcagatgtatcaagcc

SEQ ID NO: 521800 - DNA, 20 bp, mouse
gataaccttgccataatccg

SEQ ID NO: 521801 - DNA, 20 bp, mouse
gagctcacagcacctcttgg

SEQ ID NO: 521802 - DNA, 20 bp, mouse
gcaaagacgaaaggagccgg

SEQ ID NO: 521803 - DNA, 20 bp, mouse
ggaagcaggcacccacacgc

SEQ ID NO: 521804 - DNA, 20 bp, mouse
gtgcacggtgccccggatta

SEQ ID NO: 521805 - DNA, 20 bp, mouse
ggtcagtagtaacctccaag

SEQ ID NO: 521806 - DNA, 20 bp, mouse
gcgttcaactgagccgtcta

SEQ ID NO: 521807 - DNA, 20 bp, mouse
ggtctagggcgtgttgacta

SEQ ID NO: 521808 - DNA, 20 bp, mouse
ggactaaggtagttgctatg

SEQ ID NO: 521809 - DNA, 20 bp, mouse
gcactcgtgaagaggaacga

SEQ ID NO: 521810 - DNA, 20 bp, mouse
ggtgagacgctgaagccgga

SEQ ID NO: 521811 - DNA, 20 bp, mouse
ggccggagggtaagcgactg

SEQ ID NO: 521812 - DNA, 20 bp, mouse
gcccgcagtcgcttaccctc

SEQ ID NO: 521813 - DNA, 20 bp, mouse
ggacgctagagctctctgaa

SEQ ID NO: 521814 - DNA, 20 bp, mouse
gaagcgactgcgggtgagtt

SEQ ID NO: 521815 - DNA, 20 bp, mouse
ggtgagttgggagggagaac

SEQ ID NO: 521816 - DNA, 20 bp, mouse
gactgactcggcttaactct

SEQ ID NO: 521817 - DNA, 20 bp, mouse
gctgcggtccacaactgact

SEQ ID NO: 521818 - DNA, 20 bp, mouse
gagttaagccgagtcagttg

SEQ ID NO: 521819 - DNA, 20 bp, mouse
gattctggagactatgactg

SEQ ID NO: 521820 - DNA, 20 bp, mouse
gggttctcagagtacgattc

SEQ ID NO: 521821 - DNA, 20 bp, mouse
gtcatctggaaaataggaat

SEQ ID NO: 521822 - DNA, 20 bp, mouse
gggctgaagccagactccca

SEQ ID NO: 521823 - DNA, 20 bp, mouse
gctattgtggagttgcaaga

SEQ ID NO: 521824 - DNA, 20 bp, mouse
ggggcaagtcctttaccctt

SEQ ID NO: 521825 - DNA, 20 bp, mouse
ggagtagaaagcagtgtgga

SEQ ID NO: 521826 - DNA, 20 bp, mouse
gagccaccaagccggcagca

SEQ ID NO: 521827 - DNA, 20 bp, mouse
gtgccctgctgccggcttgg

SEQ ID NO: 521828 - DNA, 20 bp, mouse
gaggcccagtgccctgctgc

SEQ ID NO: 521829 - DNA, 20 bp, mouse
gtgctcagtccgagtgctgt

SEQ ID NO: 521830 - DNA, 20 bp, mouse
gcttgtacccgccctcagga

SEQ ID NO: 521831 - DNA, 20 bp, mouse
gacctttcagagctgccaag

SEQ ID NO: 521832 - DNA, 20 bp, mouse
gtgttggaagctcgcccact

SEQ ID NO: 521833 - DNA, 20 bp, mouse
gcagtgccctgctgccggct

SEQ ID NO: 521834 - DNA, 20 bp, mouse
gcggcagccttcagatcaga

SEQ ID NO: 521835 - DNA, 20 bp, mouse
gtctgaaggctgccgagggg

SEQ ID NO: 521836 - DNA, 20 bp, mouse
gcccaggtgtcacccatctt

SEQ ID NO: 521837 - DNA, 20 bp, mouse
gtggcagcagcagtgctgta

SEQ ID NO: 521838 - DNA, 20 bp, mouse
gagtggactgcagcaaccag

SEQ ID NO: 521839 - DNA, 20 bp, mouse
gccatgagagcggtgtccct

SEQ ID NO: 521840 - DNA, 20 bp, mouse
gtgtccattggcaggtccgg

SEQ ID NO: 521841 - DNA, 20 bp, mouse
gaacttgactgttggaccta

SEQ ID NO: 521842 - DNA, 20 bp, mouse
gggcctgagtctggaaggtg

SEQ ID NO: 521843 - DNA, 20 bp, mouse
gacatgtcgtaaccaagtag

SEQ ID NO: 521844 - DNA, 20 bp, mouse
ggtccaacagtcaagttaca

SEQ ID NO: 521845 - DNA, 20 bp, mouse
gtgaggttgcgggtgtccat

SEQ ID NO: 521846 - DNA, 20 bp, mouse
gcgcggacgcggaataacag

SEQ ID NO: 521847 - DNA, 20 bp, mouse
gttctctccggagaaatccc

SEQ ID NO: 521848 - DNA, 20 bp, mouse
ggagtgcaggacccaagttc

SEQ ID NO: 521849 - DNA, 20 bp, mouse
ggtctgtctcttctgcacct

SEQ ID NO: 521850 - DNA, 20 bp, mouse
ggggctcgtaagcacggtct

SEQ ID NO: 521851 - DNA, 20 bp, mouse
gtacgagcccgggatttctc

SEQ ID NO: 521852 - DNA, 20 bp, mouse
ggaaggcagtgccggaactt

SEQ ID NO: 521853 - DNA, 20 bp, mouse
gtcggggacagtcagcaccg

SEQ ID NO: 521854 - DNA, 20 bp, mouse
ggccagaagcctctcacgga

SEQ ID NO: 521855 - DNA, 20 bp, mouse
gaggcccaaaggcccacgag

SEQ ID NO: 521856 - DNA, 20 bp, mouse
gactccgccagggaacaccg

SEQ ID NO: 521857 - DNA, 20 bp, mouse
ggccccagggaagtagggat

SEQ ID NO: 521858 - DNA, 20 bp, mouse
ggcgggtccccggtgttccc

SEQ ID NO: 521859 - DNA, 20 bp, mouse
gtgcaaagaagactccgcca

SEQ ID NO: 521860 - DNA, 20 bp, mouse
gagccctgggagcgcgtctc

SEQ ID NO: 521861 - DNA, 20 bp, mouse
ggagtcttctttgcactgag

SEQ ID NO: 521862 - DNA, 20 bp, mouse
ggatagctgctgccggaaca

SEQ ID NO: 521863 - DNA, 20 bp, mouse
gctttgcactgagcggtagg

SEQ ID NO: 521864 - DNA, 20 bp, mouse
gcgcctgagacgcgctccca

SEQ ID NO: 521865 - DNA, 20 bp, mouse
gagcgcgtctcaggcgagcg

SEQ ID NO: 521866 - DNA, 20 bp, mouse
gccgggcccgcgagccgagg

SEQ ID NO: 521867 - DNA, 20 bp, mouse
ggagccgaggcggcgcgccc

SEQ ID NO: 521868 - DNA, 20 bp, mouse
gcgccgcgccacttccgacg

SEQ ID NO: 521869 - DNA, 20 bp, mouse
gtcgcgggcccgggatccgg

SEQ ID NO: 521870 - DNA, 20 bp, mouse
ggcgagcgccgcgtcggaag

SEQ ID NO: 521871 - DNA, 20 bp, mouse
ggcgacgtcaggcggttgta

SEQ ID NO: 521872 - DNA, 20 bp, mouse
gcgcgcgcgaggctctcctg

SEQ ID NO: 521873 - DNA, 20 bp, mouse
ggcgctcgctttaggttccg

SEQ ID NO: 521874 - DNA, 20 bp, mouse
gatcccgggcccgcgagccg

SEQ ID NO: 521875 - DNA, 20 bp, mouse
gtgagcgcccgggccgtacc

SEQ ID NO: 521876 - DNA, 20 bp, mouse
gtcgtcgcggcggcaccggt

SEQ ID NO: 521877 - DNA, 20 bp, mouse
gcccagggccccgctcccac

SEQ ID NO: 521878 - DNA, 20 bp, mouse
gggcggcggaggcctcgcag

SEQ ID NO: 521879 - DNA, 20 bp, mouse
ggaagtggtcgtcgtcgcgg

SEQ ID NO: 521880 - DNA, 20 bp, mouse
ggtgcggcgggcgagcggac

SEQ ID NO: 521881 - DNA, 20 bp, mouse
gtgaccaaggccggtagcaa

SEQ ID NO: 521882 - DNA, 20 bp, mouse
gggtgacgtggacacggaag

SEQ ID NO: 521883 - DNA, 20 bp, mouse
gcctgggctgggagtgcggc

SEQ ID NO: 521884 - DNA, 20 bp, mouse
gtcggcggactcacacccaa

SEQ ID NO: 521885 - DNA, 20 bp, mouse
gacctccgcgacaagctgga

SEQ ID NO: 521886 - DNA, 20 bp, mouse
gctgagaggcgcagctgcta

SEQ ID NO: 521887 - DNA, 20 bp, mouse
gatctctggtcagggaaaca

SEQ ID NO: 521888 - DNA, 20 bp, mouse
ggctgcgcctctcagagtgt

SEQ ID NO: 521889 - DNA, 20 bp, mouse
gttgcgtcccacactctgag

SEQ ID NO: 521890 - DNA, 20 bp, mouse
ggggaaacagggagaccggc

SEQ ID NO: 521891 - DNA, 20 bp, mouse
ggtgcagctgaggcacctgg

SEQ ID NO: 521892 - DNA, 20 bp, mouse
gagggaatctgaggagtact

SEQ ID NO: 521893 - DNA, 20 bp, mouse
ggcgcagctgctagggctga

SEQ ID NO: 521894 - DNA, 20 bp, mouse
ggcagacccagaaggaccta

SEQ ID NO: 521895 - DNA, 20 bp, mouse
gggacgcaatccgggagtca

SEQ ID NO: 521896 - DNA, 20 bp, mouse
gaccaagaggctgtgattgt

SEQ ID NO: 521897 - DNA, 20 bp, mouse
gcctttcgcaggttccgggt

SEQ ID NO: 521898 - DNA, 20 bp, mouse
gtaatgtctcctggccacca

SEQ ID NO: 521899 - DNA, 20 bp, mouse
gcaatcgcggccggtgaggt

SEQ ID NO: 521900 - DNA, 20 bp, mouse
gagggcgtggccactaaccg

SEQ ID NO: 521901 - DNA, 20 bp, mouse
gacctgcgaaaggccggaag

SEQ ID NO: 521902 - DNA, 20 bp, mouse
gggccaggagacattaggat

SEQ ID NO: 521903 - DNA, 20 bp, mouse
ggctatgtgagctcagaaga

SEQ ID NO: 521904 - DNA, 20 bp, mouse
ggcagccgtagagaaaaagg

SEQ ID NO: 521905 - DNA, 20 bp, mouse
gttggtatacataacaacaa

SEQ ID NO: 521906 - DNA, 20 bp, mouse
gggcttggggatgctgctaa

SEQ ID NO: 521907 - DNA, 20 bp, mouse
ggacctcgctagacagtcac

SEQ ID NO: 521908 - DNA, 20 bp, mouse
ggcgtaattcggctgtagca

SEQ ID NO: 521909 - DNA, 20 bp, mouse
gtctagcgaggtctccagtt

SEQ ID NO: 521910 - DNA, 20 bp, mouse
ggctgcgtccagcacaaaca

SEQ ID NO: 521911 - DNA, 20 bp, mouse
gtcggctgtagcagggcttg

SEQ ID NO: 521912 - DNA, 20 bp, mouse
ggcttgaaggcagggtccgt

SEQ ID NO: 521913 - DNA, 20 bp, mouse
gtgggcacgtcgggaactag

SEQ ID NO: 521914 - DNA, 20 bp, mouse
gcccggcaggcagggaaccc

SEQ ID NO: 521915 - DNA, 20 bp, mouse
gtggacacttggggactggg

SEQ ID NO: 521916 - DNA, 20 bp, mouse
gaggctggaggatactggga

SEQ ID NO: 521917 - DNA, 20 bp, mouse
gtcactagagagcagaccac

SEQ ID NO: 521918 - DNA, 20 bp, mouse
gggtaaggctttggtcaatg

SEQ ID NO: 521919 - DNA, 20 bp, mouse
gacagagctgaggctttggc

SEQ ID NO: 521920 - DNA, 20 bp, mouse
ggtggatttcatgaagacag

SEQ ID NO: 521921 - DNA, 20 bp, mouse
gactgtagactaagatgaca

SEQ ID NO: 521922 - DNA, 20 bp, mouse
gtcccgagtaccagaggaat

SEQ ID NO: 521923 - DNA, 20 bp, mouse
gtgacacggtgcacgcttaa

SEQ ID NO: 521924 - DNA, 20 bp, mouse
gcttcaatcccgagtaccag

SEQ ID NO: 521925 - DNA, 20 bp, mouse
gaaagcaaagacctgtaact

SEQ ID NO: 521926 - DNA, 20 bp, mouse
gtacctaaggaccctcaggt

SEQ ID NO: 521927 - DNA, 20 bp, mouse
gaaactacctaaggaccctc

SEQ ID NO: 521928 - DNA, 20 bp, mouse
ggctccgggggcctacctga

SEQ ID NO: 521929 - DNA, 20 bp, mouse
gaccagttagaaactaccta

SEQ ID NO: 521930 - DNA, 20 bp, mouse
gctccagctgatccagccag

SEQ ID NO: 521931 - DNA, 20 bp, mouse
gggaccctcaggtaggcccc

SEQ ID NO: 521932 - DNA, 20 bp, mouse
ggcagcgtcctgcccttcct

SEQ ID NO: 521933 - DNA, 20 bp, mouse
gagggcaggacgctgctccg

SEQ ID NO: 521934 - DNA, 20 bp, mouse
gacaaacgggagaactccag

SEQ ID NO: 521935 - DNA, 20 bp, mouse
gagaagcccttccggaaatg

SEQ ID NO: 521936 - DNA, 20 bp, mouse
gtattggtaacagcactgaa

SEQ ID NO: 521937 - DNA, 20 bp, mouse
ggaagaggtgaccattatgg

SEQ ID NO: 521938 - DNA, 20 bp, mouse
gaaggaccttgacccaggtg

SEQ ID NO: 521939 - DNA, 20 bp, mouse
gctaagatcctgactttgaa

SEQ ID NO: 521940 - DNA, 20 bp, mouse
gtccagtgtcgagggcatct

SEQ ID NO: 521941 - DNA, 20 bp, mouse
gtagcttagggcattacaca

SEQ ID NO: 521942 - DNA, 20 bp, mouse
gtagctctctggagacaata

SEQ ID NO: 521943 - DNA, 20 bp, mouse
ggctctgaggttcctcacct

SEQ ID NO: 521944 - DNA, 20 bp, mouse
gggtctagagtcttcagatt

SEQ ID NO: 521945 - DNA, 20 bp, mouse
gcctcttgccattcaaagtc

SEQ ID NO: 521946 - DNA, 20 bp, mouse
gccaagccgcggcaccacgg

SEQ ID NO: 521947 - DNA, 20 bp, mouse
ggcacctgtgcgccaagccg

SEQ ID NO: 521948 - DNA, 20 bp, mouse
gcccggaacggggtcctccg

SEQ ID NO: 521949 - DNA, 20 bp, mouse
ggcgcctcgtctgccaatcc

SEQ ID NO: 521950 - DNA, 20 bp, mouse
gcccggggcgcagcaagcac

SEQ ID NO: 521951 - DNA, 20 bp, mouse
ggcccagggttggcccggaa

SEQ ID NO: 521952 - DNA, 20 bp, mouse
gcccgttccgggccaaccct

SEQ ID NO: 521953 - DNA, 20 bp, mouse
gggccgcgacgcctctgaag

SEQ ID NO: 521954 - DNA, 20 bp, mouse
ggagaggagaggcgcccctg

SEQ ID NO: 521955 - DNA, 20 bp, mouse
gcgggctcccggctccccag

SEQ ID NO: 521956 - DNA, 20 bp, mouse
gggtagaagtaagaacaatg

SEQ ID NO: 521957 - DNA, 20 bp, mouse
gttgttcttacttctacccc

SEQ ID NO: 521958 - DNA, 20 bp, mouse
gggattttacctgttgcctg

SEQ ID NO: 521959 - DNA, 20 bp, mouse
gtacttctaccccaggcaac

SEQ ID NO: 521960 - DNA, 20 bp, mouse
gtatacattttttaacaata

SEQ ID NO: 521961 - DNA, 20 bp, mouse
gtacaggaccattattctta

SEQ ID NO: 521962 - DNA, 20 bp, mouse
gtaatggtcctgtaaatagc

SEQ ID NO: 521963 - DNA, 20 bp, mouse
gttctgtttaaattcactac

SEQ ID NO: 521964 - DNA, 20 bp, mouse
gcagctcgtgagaatatgca

SEQ ID NO: 521965 - DNA, 20 bp, mouse
ggaagtaagaacaatggggc

SEQ ID NO: 521966 - DNA, 20 bp, mouse
gggctgagtggagatcctag

SEQ ID NO: 521967 - DNA, 20 bp, mouse
gtccgcgactgccctctcca

SEQ ID NO: 521968 - DNA, 20 bp, mouse
ggccctggagagggcagtcg

SEQ ID NO: 521969 - DNA, 20 bp, mouse
gaggctgggttgccctggag

SEQ ID NO: 521970 - DNA, 20 bp, mouse
ggggcagtcgcggagtcgct

SEQ ID NO: 521971 - DNA, 20 bp, mouse
ggctcgtcctctcccaccgg

SEQ ID NO: 521972 - DNA, 20 bp, mouse
gagatgaaacgggactctgt

SEQ ID NO: 521973 - DNA, 20 bp, mouse
gagggcaacccagcctgatt

SEQ ID NO: 521974 - DNA, 20 bp, mouse
ggcggagtcgcttggctgag

SEQ ID NO: 521975 - DNA, 20 bp, mouse
gcaagcaccctgcccccggt

SEQ ID NO: 521976 - DNA, 20 bp, mouse
gggcagaggggtggatctca

SEQ ID NO: 521977 - DNA, 20 bp, mouse
gaaggcaaggagaaggatcc

SEQ ID NO: 521978 - DNA, 20 bp, mouse
gaagatagactcggaagacg

SEQ ID NO: 521979 - DNA, 20 bp, mouse
gagtagagctggaaagtgga

SEQ ID NO: 521980 - DNA, 20 bp, mouse
gagggtattaaagatagact

SEQ ID NO: 521981 - DNA, 20 bp, mouse
ggctcgtgtgagatagacaa

SEQ ID NO: 521982 - DNA, 20 bp, mouse
gtctccttgccttttgtcaa

SEQ ID NO: 521983 - DNA, 20 bp, mouse
gaggctaacgggagagacgg

SEQ ID NO: 521984 - DNA, 20 bp, mouse
gagtctctgcctttgacaaa

SEQ ID NO: 521985 - DNA, 20 bp, mouse
gagaaggctaacgggagaga

SEQ ID NO: 521986 - DNA, 20 bp, mouse
gctctcggggacagccgggg

SEQ ID NO: 521987 - DNA, 20 bp, mouse
gcggctctcggggacagccg

SEQ ID NO: 521988 - DNA, 20 bp, mouse
gcccggcagcacggctctcg

SEQ ID NO: 521989 - DNA, 20 bp, mouse
gagcaggcggcgagttccta

SEQ ID NO: 521990 - DNA, 20 bp, mouse
gcggaggcgcggaagagaag

SEQ ID NO: 521991 - DNA, 20 bp, mouse
ggcgctggtcctctccctcg

SEQ ID NO: 521992 - DNA, 20 bp, mouse
gtcggaagcggaggcaacgg

SEQ ID NO: 521993 - DNA, 20 bp, mouse
gggcccggggcccggcagca

SEQ ID NO: 521994 - DNA, 20 bp, mouse
ggaggctgagtcggaagcgg

SEQ ID NO: 521995 - DNA, 20 bp, mouse
ggcacctcggcgcctgacag

SEQ ID NO: 521996 - DNA, 20 bp, mouse
gggcgggcggccggactggg

SEQ ID NO: 521997 - DNA, 20 bp, mouse
gaggcagagtggtgcagtga

SEQ ID NO: 521998 - DNA, 20 bp, mouse
gcggccggactgggaggtgg

SEQ ID NO: 521999 - DNA, 20 bp, mouse
ggcctgcgggcggctgcgag

SEQ ID NO: 522000 - DNA, 20 bp, mouse
gagccccgcagaacttgaag

SEQ ID NO: 522001 - DNA, 20 bp, mouse
gggcggcgggcggccggact

SEQ ID NO: 522002 - DNA, 20 bp, mouse
ggagctgtcaagagaacccc

SEQ ID NO: 522003 - DNA, 20 bp, mouse
ggaactgtaagagctggtgg

SEQ ID NO: 522004 - DNA, 20 bp, mouse
gcgccgccgcacggcctgga

SEQ ID NO: 522005 - DNA, 20 bp, mouse
gtccgctcgcagccgcccgc

SEQ ID NO: 522006 - DNA, 20 bp, mouse
gcaatggagcggctccgggg

SEQ ID NO: 522007 - DNA, 20 bp, mouse
ggcgccgcgtcacaatggag

SEQ ID NO: 522008 - DNA, 20 bp, mouse
ggcagcgggagacccaggtg

SEQ ID NO: 522009 - DNA, 20 bp, mouse
ggccggcgcccgcactccgg

SEQ ID NO: 522010 - DNA, 20 bp, mouse
gtcacaatggagcggctccg

SEQ ID NO: 522011 - DNA, 20 bp, mouse
gtccggcggctgcggctcag

SEQ ID NO: 522012 - DNA, 20 bp, mouse
gcgcgcgcgccgcgtcacaa

SEQ ID NO: 522013 - DNA, 20 bp, mouse
gtgcccgcagcgggagaccc

SEQ ID NO: 522014 - DNA, 20 bp, mouse
ggcggccggcgcccgcactc

SEQ ID NO: 522015 - DNA, 20 bp, mouse
gtcagccgtagggacaacga

SEQ ID NO: 522016 - DNA, 20 bp, mouse
ggggcgcgcccagagaaccg

SEQ ID NO: 522017 - DNA, 20 bp, mouse
ggcgaagaagacgaggaccg

SEQ ID NO: 522018 - DNA, 20 bp, mouse
gagagcccgcgaagaagacg

SEQ ID NO: 522019 - DNA, 20 bp, mouse
gcccagagaaccgaggctag

SEQ ID NO: 522020 - DNA, 20 bp, mouse
ggaggaccgaggcgccgccg

SEQ ID NO: 522021 - DNA, 20 bp, mouse
gcagcggcggcaagcgaccg

SEQ ID NO: 522022 - DNA, 20 bp, mouse
ggaacagggctgcggagctg

SEQ ID NO: 522023 - DNA, 20 bp, mouse
gggtggacgggtccaggctg

SEQ ID NO: 522024 - DNA, 20 bp, mouse
gcgaacgagggagggtggac

SEQ ID NO: 522025 - DNA, 20 bp, mouse
gccggggacccgcggaggga

SEQ ID NO: 522026 - DNA, 20 bp, mouse
ggcgcgtgcgggagcttagg

SEQ ID NO: 522027 - DNA, 20 bp, mouse
gggaggagccggggcacccc

SEQ ID NO: 522028 - DNA, 20 bp, mouse
gcacatgactctgtaacgag

SEQ ID NO: 522029 - DNA, 20 bp, mouse
ggaggcggcggcatcacctg

SEQ ID NO: 522030 - DNA, 20 bp, mouse
gcgtgcgggagcttaggcgg

SEQ ID NO: 522031 - DNA, 20 bp, mouse
gcctccgccgcgcttagagg

SEQ ID NO: 522032 - DNA, 20 bp, mouse
gagagctgcggcgcctgcac

SEQ ID NO: 522033 - DNA, 20 bp, mouse
gtccgtgcgcgcgaacgcag

SEQ ID NO: 522034 - DNA, 20 bp, mouse
gacctgcgccctcccggcca

SEQ ID NO: 522035 - DNA, 20 bp, mouse
gctgccacctctaagcgcgg

SEQ ID NO: 522036 - DNA, 20 bp, mouse
gtccgggtcgatctactccc

SEQ ID NO: 522037 - DNA, 20 bp, mouse
ggcctgggagtagatcgacc

SEQ ID NO: 522038 - DNA, 20 bp, mouse
ggctcagggatggaactccg

SEQ ID NO: 522039 - DNA, 20 bp, mouse
gggccagagagggtgagtca

SEQ ID NO: 522040 - DNA, 20 bp, mouse
ggcccaacttctagatgcct

SEQ ID NO: 522041 - DNA, 20 bp, mouse
gggcccgcccgggaactctg

SEQ ID NO: 522042 - DNA, 20 bp, mouse
ggggaactctgcgggagtcc

SEQ ID NO: 522043 - DNA, 20 bp, mouse
gctcccaggcatctagaagt

SEQ ID NO: 522044 - DNA, 20 bp, mouse
gttcccgggcgggccagaga

SEQ ID NO: 522045 - DNA, 20 bp, mouse
ggagggagtcgctcaggtgt

SEQ ID NO: 522046 - DNA, 20 bp, mouse
gctgggaccgaggccatcag

SEQ ID NO: 522047 - DNA, 20 bp, mouse
gcagctgcaggaagggattt

SEQ ID NO: 522048 - DNA, 20 bp, mouse
ggagcccggtgagcccccaa

SEQ ID NO: 522049 - DNA, 20 bp, mouse
gtcagtacacagcaggcccg

SEQ ID NO: 522050 - DNA, 20 bp, mouse
gacaggggagggacacctag

SEQ ID NO: 522051 - DNA, 20 bp, mouse
gcctagacaaccgcagtggg

SEQ ID NO: 522052 - DNA, 20 bp, mouse
gctgacccagaggtcaaggg

SEQ ID NO: 522053 - DNA, 20 bp, mouse
gggtcaggggacctatgtga

SEQ ID NO: 522054 - DNA, 20 bp, mouse
gggaccgaggccatcagcgg

SEQ ID NO: 522055 - DNA, 20 bp, mouse
ggctggtgtcagctgcagga

SEQ ID NO: 522056 - DNA, 20 bp, mouse
gcccgtcgcgggtaccatgg

SEQ ID NO: 522057 - DNA, 20 bp, mouse
gacggggagtgggtgttaac

SEQ ID NO: 522058 - DNA, 20 bp, mouse
gggtacccgcgacggggagt

SEQ ID NO: 522059 - DNA, 20 bp, mouse
ggtcgcgggtaccatggagg

SEQ ID NO: 522060 - DNA, 20 bp, mouse
gtccccgctcccgcttttgg

SEQ ID NO: 522061 - DNA, 20 bp, mouse
ggggagcggggagtgagcaa

SEQ ID NO: 522062 - DNA, 20 bp, mouse
ggccaacccgaggtccaacc

SEQ ID NO: 522063 - DNA, 20 bp, mouse
ggcggggagtgagcaagggg

SEQ ID NO: 522064 - DNA, 20 bp, mouse
gacgcctccaaaagcgggag

SEQ ID NO: 522065 - DNA, 20 bp, mouse
gtgctcacgcctccaaaagc

SEQ ID NO: 522066 - DNA, 20 bp, mouse
ggctccacgggactgatcta

SEQ ID NO: 522067 - DNA, 20 bp, mouse
ggtcccgtggagcctctctg

SEQ ID NO: 522068 - DNA, 20 bp, mouse
gcgggaaaagaacctagcct

SEQ ID NO: 522069 - DNA, 20 bp, mouse
gatgcccgagatgcgggatg

SEQ ID NO: 522070 - DNA, 20 bp, mouse
gctctgtggctctccgaagt

SEQ ID NO: 522071 - DNA, 20 bp, mouse
gggtgggctgggagcatgaa

SEQ ID NO: 522072 - DNA, 20 bp, mouse
gcctccgcatcccgcatctc

SEQ ID NO: 522073 - DNA, 20 bp, mouse
ggcgtgccccctgcccactt

SEQ ID NO: 522074 - DNA, 20 bp, mouse
gagtccttagatcagtcccg

SEQ ID NO: 522075 - DNA, 20 bp, mouse
gttgcgagatgcccgagatg

SEQ ID NO: 522076 - DNA, 20 bp, mouse
gggatccaggaaagccgtcc

SEQ ID NO: 522077 - DNA, 20 bp, mouse
ggccggccgcaccccagcta

SEQ ID NO: 522078 - DNA, 20 bp, mouse
gcaccccagctagggaacct

SEQ ID NO: 522079 - DNA, 20 bp, mouse
gtccgagcgtgtgcgcccag

SEQ ID NO: 522080 - DNA, 20 bp, mouse
ggctcggacgcccaactccg

SEQ ID NO: 522081 - DNA, 20 bp, mouse
gagctagggaacctcggagt

SEQ ID NO: 522082 - DNA, 20 bp, mouse
ggaactttcaacgatcccct

SEQ ID NO: 522083 - DNA, 20 bp, mouse
gtcccctgggcgcacacgct

SEQ ID NO: 522084 - DNA, 20 bp, mouse
gaccaactgagggacccagg

SEQ ID NO: 522085 - DNA, 20 bp, mouse
gtgctggagtagaggcgagt

SEQ ID NO: 522086 - DNA, 20 bp, mouse
gcgccgtggccgatggacat

SEQ ID NO: 522087 - DNA, 20 bp, mouse
gacgagcgcggctccaagac

SEQ ID NO: 522088 - DNA, 20 bp, mouse
gtgcccatgtccatcggcca

SEQ ID NO: 522089 - DNA, 20 bp, mouse
gcatgggcacgcagggatcg

SEQ ID NO: 522090 - DNA, 20 bp, mouse
gcctgcgtgcccatgtccat

SEQ ID NO: 522091 - DNA, 20 bp, mouse
ggccgtcagccgctcccggt

SEQ ID NO: 522092 - DNA, 20 bp, mouse
gcgcaagcggctccccaacc

SEQ ID NO: 522093 - DNA, 20 bp, mouse
ggctgctgcgggaccggtct

SEQ ID NO: 522094 - DNA, 20 bp, mouse
ggcggctccccaaccgggag

SEQ ID NO: 522095 - DNA, 20 bp, mouse
gccgcagcagctgtgcgccg

SEQ ID NO: 522096 - DNA, 20 bp, mouse
ggacacagcgaacgcgaccc

SEQ ID NO: 522097 - DNA, 20 bp, mouse
gtccaggcgctgcccagtgg

SEQ ID NO: 522098 - DNA, 20 bp, mouse
gccgcgccacacgcaggtaa

SEQ ID NO: 522099 - DNA, 20 bp, mouse
gcgagcagcggctgcagctg

SEQ ID NO: 522100 - DNA, 20 bp, mouse
gagccgggagaggagagcgc

SEQ ID NO: 522101 - DNA, 20 bp, mouse
ggtctccaggcgctgcccag

SEQ ID NO: 522102 - DNA, 20 bp, mouse
gagtgtggcgccgggagcaa

SEQ ID NO: 522103 - DNA, 20 bp, mouse
gcccctcccgggacagactg

SEQ ID NO: 522104 - DNA, 20 bp, mouse
ggtgtcggccgcggggcgaa

SEQ ID NO: 522105 - DNA, 20 bp, mouse
ggctgcggcgccgcccggaa

SEQ ID NO: 522106 - DNA, 20 bp, mouse
gcaggaagtccagatagcgt

SEQ ID NO: 522107 - DNA, 20 bp, mouse
gtgaggtggggtgcagtcag

SEQ ID NO: 522108 - DNA, 20 bp, mouse
gcggtttgttgagcgtctgt

SEQ ID NO: 522109 - DNA, 20 bp, mouse
ggcagtcagaggagcatgac

SEQ ID NO: 522110 - DNA, 20 bp, mouse
gaccagcgtgaagtagtcta

SEQ ID NO: 522111 - DNA, 20 bp, mouse
gcagtggccgctcagtgacc

SEQ ID NO: 522112 - DNA, 20 bp, mouse
ggtgacctggcgactggact

SEQ ID NO: 522113 - DNA, 20 bp, mouse
gagaacggacagttgaggtg

SEQ ID NO: 522114 - DNA, 20 bp, mouse
gtacatacgggtaaaggggt

SEQ ID NO: 522115 - DNA, 20 bp, mouse
gtaaaagtaggaaaagagta

SEQ ID NO: 522116 - DNA, 20 bp, mouse
gtcctgggcaacgatctgtg

SEQ ID NO: 522117 - DNA, 20 bp, mouse
gcgggttgtcagacacggta

SEQ ID NO: 522118 - DNA, 20 bp, mouse
gcagatgggcgggcacctag

SEQ ID NO: 522119 - DNA, 20 bp, mouse
gaacgatctgtggggcagat

SEQ ID NO: 522120 - DNA, 20 bp, mouse
gcaccgcgggttgtcagaca

SEQ ID NO: 522121 - DNA, 20 bp, mouse
gtgcgcaagcggcgtttcct

SEQ ID NO: 522122 - DNA, 20 bp, mouse
gctagcggggtcgggttgtg

SEQ ID NO: 522123 - DNA, 20 bp, mouse
ggcgggcacctagcggggtc

SEQ ID NO: 522124 - DNA, 20 bp, mouse
ggggaagttggacaactgaa

SEQ ID NO: 522125 - DNA, 20 bp, mouse
gtggtggatccactaatggt

SEQ ID NO: 522126 - DNA, 20 bp, mouse
gcctcgaggcctgaagtggg

SEQ ID NO: 522127 - DNA, 20 bp, mouse
gtaacctcgaggcctgaagt

SEQ ID NO: 522128 - DNA, 20 bp, mouse
gtgtgtaacctagagcggat

SEQ ID NO: 522129 - DNA, 20 bp, mouse
gcagaatgtgtaacctagag

SEQ ID NO: 522130 - DNA, 20 bp, mouse
ggtccctagcccagcagatg

SEQ ID NO: 522131 - DNA, 20 bp, mouse
ggagtaccccgccctcttaa

SEQ ID NO: 522132 - DNA, 20 bp, mouse
gggcggggccaccgttaaga

SEQ ID NO: 522133 - DNA, 20 bp, mouse
gggccaccgttaagagggcg

SEQ ID NO: 522134 - DNA, 20 bp, mouse
ggatcactgcctcccacttc

SEQ ID NO: 522135 - DNA, 20 bp, mouse
gggggtactctataacctcg

SEQ ID NO: 522136 - DNA, 20 bp, mouse
gagcattgcagggcagagta

SEQ ID NO: 522137 - DNA, 20 bp, mouse
ggggcagagtacggtaggac

SEQ ID NO: 522138 - DNA, 20 bp, mouse
gttgcagggcagagtacggt

SEQ ID NO: 522139 - DNA, 20 bp, mouse
ggcggatcggcgacatcaga

SEQ ID NO: 522140 - DNA, 20 bp, mouse
ggggtctggaagccgcggat

SEQ ID NO: 522141 - DNA, 20 bp, mouse
ggtcgctgcgcagcccagag

SEQ ID NO: 522142 - DNA, 20 bp, mouse
ggaggcagcgaagagacccc

SEQ ID NO: 522143 - DNA, 20 bp, mouse
gaagtgcgtctggcccccgg

SEQ ID NO: 522144 - DNA, 20 bp, mouse
gcggcagggtctggaagccg

SEQ ID NO: 522145 - DNA, 20 bp, mouse
ggggcacaagcaggcgacgg

SEQ ID NO: 522146 - DNA, 20 bp, mouse
gggactgcggcgagctggga

SEQ ID NO: 522147 - DNA, 20 bp, mouse
gtggccagtggcgcctgtca

SEQ ID NO: 522148 - DNA, 20 bp, mouse
gcagggctgcgaagaggaag

SEQ ID NO: 522149 - DNA, 20 bp, mouse
gagtccaggacaatcaacag

SEQ ID NO: 522150 - DNA, 20 bp, mouse
gagctcgccgcagtccccgc

SEQ ID NO: 522151 - DNA, 20 bp, mouse
ggtccccgccggctgcacca

SEQ ID NO: 522152 - DNA, 20 bp, mouse
ggcctgtcagggctgcgaag

SEQ ID NO: 522153 - DNA, 20 bp, mouse
ggcattaccgcggtccgagt

SEQ ID NO: 522154 - DNA, 20 bp, mouse
gtccccggcggagttcccag

SEQ ID NO: 522155 - DNA, 20 bp, mouse
gctggccatggtgcagccgg

SEQ ID NO: 522156 - DNA, 20 bp, mouse
gctgcggggagcacaaagcg

SEQ ID NO: 522157 - DNA, 20 bp, mouse
gacaaagcggggcgcacgga

SEQ ID NO: 522158 - DNA, 20 bp, mouse
gcaggcgggaataggaaaga

SEQ ID NO: 522159 - DNA, 20 bp, mouse
gcgacaagcgctgcaaaccg

SEQ ID NO: 522160 - DNA, 20 bp, mouse
gctagccggaggatgaggac

SEQ ID NO: 522161 - DNA, 20 bp, mouse
ggcggcgtcctcccagacag

SEQ ID NO: 522162 - DNA, 20 bp, mouse
gcggccctcgcctggcttca

SEQ ID NO: 522163 - DNA, 20 bp, mouse
gggcagcaagccgtgaagcc

SEQ ID NO: 522164 - DNA, 20 bp, mouse
gaccaggtgcacgccggctg

SEQ ID NO: 522165 - DNA, 20 bp, mouse
ggcttacaccaggtgcacgc

SEQ ID NO: 522166 - DNA, 20 bp, mouse
gcgagcgcgagcagccagga

SEQ ID NO: 522167 - DNA, 20 bp, mouse
gccactcccaggacaagtgt

SEQ ID NO: 522168 - DNA, 20 bp, mouse
gggcggagcagctagtgagg

SEQ ID NO: 522169 - DNA, 20 bp, mouse
gccggagcgccgcgcgtctg

SEQ ID NO: 522170 - DNA, 20 bp, mouse
gggctgggatcgctgctcca

SEQ ID NO: 522171 - DNA, 20 bp, mouse
gcgcggcggagcagctagtg

SEQ ID NO: 522172 - DNA, 20 bp, mouse
gagcagcgatcccagccggg

SEQ ID NO: 522173 - DNA, 20 bp, mouse
ggccgggactgtggactccg

SEQ ID NO: 522174 - DNA, 20 bp, mouse
ggctgctacccaggcccggg

SEQ ID NO: 522175 - DNA, 20 bp, mouse
gggccgcggggacaggatct

SEQ ID NO: 522176 - DNA, 20 bp, mouse
ggtcagtgtgacaactgatc

SEQ ID NO: 522177 - DNA, 20 bp, mouse
gctctcttcacgggattgag

SEQ ID NO: 522178 - DNA, 20 bp, mouse
gtcgtttccatggtggttag

SEQ ID NO: 522179 - DNA, 20 bp, mouse
ggaagagagatcctgctagc

SEQ ID NO: 522180 - DNA, 20 bp, mouse
gttatttctcctcgtttcca

SEQ ID NO: 522181 - DNA, 20 bp, mouse
ggagcaagcaggggcaccgg

SEQ ID NO: 522182 - DNA, 20 bp, mouse
gtgcagggatagccctcctc

SEQ ID NO: 522183 - DNA, 20 bp, mouse
ggctatccctgcatctgcta

SEQ ID NO: 522184 - DNA, 20 bp, mouse
gcaagcaggggcaccggagg

SEQ ID NO: 522185 - DNA, 20 bp, mouse
gttttgactggaactctctc

SEQ ID NO: 522186 - DNA, 20 bp, mouse
gagctgacccgggaggtcac

SEQ ID NO: 522187 - DNA, 20 bp, mouse
gcattcagagctgacccggg

SEQ ID NO: 522188 - DNA, 20 bp, mouse
gtaggaaccagtgacctccc

SEQ ID NO: 522189 - DNA, 20 bp, mouse
gaccaggcagctgtcccagt

SEQ ID NO: 522190 - DNA, 20 bp, mouse
gaaagactgaggacctaaaa

SEQ ID NO: 522191 - DNA, 20 bp, mouse
ggccctaggagccttaatgg

SEQ ID NO: 522192 - DNA, 20 bp, mouse
gagtgttcagcagggagcca

SEQ ID NO: 522193 - DNA, 20 bp, mouse
ggacagctgcctggtaagta

SEQ ID NO: 522194 - DNA, 20 bp, mouse
ggggcgcgccacatcccact

SEQ ID NO: 522195 - DNA, 20 bp, mouse
ggtcagctctgaatgtcaga

SEQ ID NO: 522196 - DNA, 20 bp, mouse
ggatatccgtggctatcagg

SEQ ID NO: 522197 - DNA, 20 bp, mouse
ggatagccacggatatctgg

SEQ ID NO: 522198 - DNA, 20 bp, mouse
gtgtgacgaggcctacccac

SEQ ID NO: 522199 - DNA, 20 bp, mouse
ggtaggcctcgtcacagtga

SEQ ID NO: 522200 - DNA, 20 bp, mouse
gaggcggagaggccactgtc

SEQ ID NO: 522201 - DNA, 20 bp, mouse
gccgtggctatcaggcggag

SEQ ID NO: 522202 - DNA, 20 bp, mouse
gtagcccctcaccagtgggt

SEQ ID NO: 522203 - DNA, 20 bp, mouse
gacagtagcccctcaccagt

SEQ ID NO: 522204 - DNA, 20 bp, mouse
ggtttgcccccagatatccg

SEQ ID NO: 522205 - DNA, 20 bp, mouse
ggcaaaccctcactgtgacg

SEQ ID NO: 522206 - DNA, 20 bp, mouse
ggctcgcgcacactcctcgg

SEQ ID NO: 522207 - DNA, 20 bp, mouse
gcaggctcgcgcacactcct

SEQ ID NO: 522208 - DNA, 20 bp, mouse
gacactcctcggaggaggga

SEQ ID NO: 522209 - DNA, 20 bp, mouse
gcagctgcccgggacacgaa

SEQ ID NO: 522210 - DNA, 20 bp, mouse
ggcgcacactcctcggagga

SEQ ID NO: 522211 - DNA, 20 bp, mouse
gagtgtgcgcgagcctgcac

SEQ ID NO: 522212 - DNA, 20 bp, mouse
gagactgtgacgtggttggg

SEQ ID NO: 522213 - DNA, 20 bp, mouse
gtccaacctggactccaagg

SEQ ID NO: 522214 - DNA, 20 bp, mouse
gcgctccgcaaggcatgagc

SEQ ID NO: 522215 - DNA, 20 bp, mouse
ggcaggaaggcgagaagcac

SEQ ID NO: 522216 - DNA, 20 bp, mouse
gcttgttgatggcagatggg

SEQ ID NO: 522217 - DNA, 20 bp, mouse
gccgagaaacggcacaagaa

SEQ ID NO: 522218 - DNA, 20 bp, mouse
gtgttgcagagaagagcttc

SEQ ID NO: 522219 - DNA, 20 bp, mouse
ggaaaagcttttccgagaaa

SEQ ID NO: 522220 - DNA, 20 bp, mouse
gagccgggagctctgacgat

SEQ ID NO: 522221 - DNA, 20 bp, mouse
gtaacttgttgatggcagat

SEQ ID NO: 522222 - DNA, 20 bp, mouse
gttccagaggaatatcctaa

SEQ ID NO: 522223 - DNA, 20 bp, mouse
gacgatcggcagtaatcagg

SEQ ID NO: 522224 - DNA, 20 bp, mouse
gaccacacagcactgtatat

SEQ ID NO: 522225 - DNA, 20 bp, mouse
ggtgctctgatcccctaaac

SEQ ID NO: 522226 - DNA, 20 bp, mouse
gaccgaagcaacagtccgag

SEQ ID NO: 522227 - DNA, 20 bp, mouse
gagctgcgttggagcccaga

SEQ ID NO: 522228 - DNA, 20 bp, mouse
gcttacagaatgacagtctg

SEQ ID NO: 522229 - DNA, 20 bp, mouse
ggcgttggagcccagaaggc

SEQ ID NO: 522230 - DNA, 20 bp, mouse
ggcagctccgaggctgaact

SEQ ID NO: 522231 - DNA, 20 bp, mouse
gtgagagtgtgcgcggaacc

SEQ ID NO: 522232 - DNA, 20 bp, mouse
gtagtccggcgaacccgtgg

SEQ ID NO: 522233 - DNA, 20 bp, mouse
gttcagcctcggagctgcgt

SEQ ID NO: 522234 - DNA, 20 bp, mouse
gggactatggaatacagatg

SEQ ID NO: 522235 - DNA, 20 bp, mouse
ggcctagaggaatacattat

SEQ ID NO: 522236 - DNA, 20 bp, mouse
gagccttctgaattagacaa

SEQ ID NO: 522237 - DNA, 20 bp, mouse
ggttttgtagctgtgctgag

SEQ ID NO: 522238 - DNA, 20 bp, mouse
gaggaatgccaggtactctg

SEQ ID NO: 522239 - DNA, 20 bp, mouse
gtctgagcaccatcagtctc

SEQ ID NO: 522240 - DNA, 20 bp, mouse
gggaaaatcctcagagtacc

SEQ ID NO: 522241 - DNA, 20 bp, mouse
gcctagaggccctccccctc

SEQ ID NO: 522242 - DNA, 20 bp, mouse
gttcaacctgaccagctaaa

SEQ ID NO: 522243 - DNA, 20 bp, mouse
ggactgatggtgctcagagc

SEQ ID NO: 522244 - DNA, 20 bp, mouse
gagcccttgtctaattcaga

SEQ ID NO: 522245 - DNA, 20 bp, mouse
gggcaaaagcccgcacaata

SEQ ID NO: 522246 - DNA, 20 bp, mouse
gtcttatgggcaggcgtctg

SEQ ID NO: 522247 - DNA, 20 bp, mouse
ggtgagctcgggattcggaa

SEQ ID NO: 522248 - DNA, 20 bp, mouse
ggggcaggcgtctgcggcag

SEQ ID NO: 522249 - DNA, 20 bp, mouse
gtagggtggcactggtacta

SEQ ID NO: 522250 - DNA, 20 bp, mouse
gtggtcgccctgtttcttat

SEQ ID NO: 522251 - DNA, 20 bp, mouse
gactgcagagcttggtctgt

SEQ ID NO: 522252 - DNA, 20 bp, mouse
gagggtgtcgcccagagact

SEQ ID NO: 522253 - DNA, 20 bp, mouse
gacaggttaggagggtacta

SEQ ID NO: 522254 - DNA, 20 bp, mouse
gcgcctgcccataagaaaca

SEQ ID NO: 522255 - DNA, 20 bp, mouse
gggttaggagggtactaggg

SEQ ID NO: 522256 - DNA, 20 bp, mouse
gggcagagaagatcctaggg

SEQ ID NO: 522257 - DNA, 20 bp, mouse
gggaaagtgtcaacctccct

SEQ ID NO: 522258 - DNA, 20 bp, mouse
ggatcaacacacccgggcta

SEQ ID NO: 522259 - DNA, 20 bp, mouse
gcaaaccacataaagaatgt

SEQ ID NO: 522260 - DNA, 20 bp, mouse
ggcggagcctgggccatgaa

SEQ ID NO: 522261 - DNA, 20 bp, mouse
gacccgggctacggcagact

SEQ ID NO: 522262 - DNA, 20 bp, mouse
gctcaggtgggggacttctg

SEQ ID NO: 522263 - DNA, 20 bp, mouse
gatgctacagctgttcacca

SEQ ID NO: 522264 - DNA, 20 bp, mouse
gtcccccacctgagggaagg

SEQ ID NO: 522265 - DNA, 20 bp, mouse
gctttccctgaatccagcat

SEQ ID NO: 522266 - DNA, 20 bp, mouse
gggaggaagacagaccgaag

SEQ ID NO: 522267 - DNA, 20 bp, mouse
gacagaccgaagagggggag

SEQ ID NO: 522268 - DNA, 20 bp, mouse
gaactgaagcgaaagaggga

SEQ ID NO: 522269 - DNA, 20 bp, mouse
gttcagggcagcgggagact

SEQ ID NO: 522270 - DNA, 20 bp, mouse
gggcagaacgcagggatgtc

SEQ ID NO: 522271 - DNA, 20 bp, mouse
ggtccctgcagcgggaggag

SEQ ID NO: 522272 - DNA, 20 bp, mouse
gaacgcagggatgtccggtc

SEQ ID NO: 522273 - DNA, 20 bp, mouse
gtggtctgagcatcaggtcc

SEQ ID NO: 522274 - DNA, 20 bp, mouse
ggacacacgggcagcttggc

SEQ ID NO: 522275 - DNA, 20 bp, mouse
gggatgtccggtctggttca

SEQ ID NO: 522276 - DNA, 20 bp, mouse
gtagcgaccggacttcgtgg

SEQ ID NO: 522277 - DNA, 20 bp, mouse
gcgctgccggggagcccagg

SEQ ID NO: 522278 - DNA, 20 bp, mouse
ggcggcgtgagaggagccat

SEQ ID NO: 522279 - DNA, 20 bp, mouse
gttgttgtgcgccacctcct

SEQ ID NO: 522280 - DNA, 20 bp, mouse
gccttagcgaccggacttcg

SEQ ID NO: 522281 - DNA, 20 bp, mouse
gcccgccagggtggtttgat

SEQ ID NO: 522282 - DNA, 20 bp, mouse
gcccgcgcctccacgaagtc

SEQ ID NO: 522283 - DNA, 20 bp, mouse
gcacgttgcaggagcagttg

SEQ ID NO: 522284 - DNA, 20 bp, mouse
ggaataacccgggcaggagg

SEQ ID NO: 522285 - DNA, 20 bp, mouse
gggcagcgggccttagcgac

SEQ ID NO: 522286 - DNA, 20 bp, mouse
gaggcgactgtcaatggcag

SEQ ID NO: 522287 - DNA, 20 bp, mouse
gatgaggaggcgactgtcaa

SEQ ID NO: 522288 - DNA, 20 bp, mouse
ggcagtctcagtaggaccag

SEQ ID NO: 522289 - DNA, 20 bp, mouse
gaaatgctttaatgatgagg

SEQ ID NO: 522290 - DNA, 20 bp, mouse
gtgcttctctgccagcgtct

SEQ ID NO: 522291 - DNA, 20 bp, mouse
gggacccgcccgagcagcct

SEQ ID NO: 522292 - DNA, 20 bp, mouse
ggggaaaagagactaagcga

SEQ ID NO: 522293 - DNA, 20 bp, mouse
gcaactcgccgaggccacca

SEQ ID NO: 522294 - DNA, 20 bp, mouse
gcgctgctggccacggagag

SEQ ID NO: 522295 - DNA, 20 bp, mouse
gacacggccatcctcaggta

SEQ ID NO: 522296 - DNA, 20 bp, mouse
ggtcggagacgagcgccggg

SEQ ID NO: 522297 - DNA, 20 bp, mouse
gcctgggccgagtacttatc

SEQ ID NO: 522298 - DNA, 20 bp, mouse
gctgctgccggataagtact

SEQ ID NO: 522299 - DNA, 20 bp, mouse
gtgggtcggagacgagcgcc

SEQ ID NO: 522300 - DNA, 20 bp, mouse
gccaggagtcagtatgacgg

SEQ ID NO: 522301 - DNA, 20 bp, mouse
ggcctctctgcgccctgctg

SEQ ID NO: 522302 - DNA, 20 bp, mouse
ggcgcagagaggcttgatac

SEQ ID NO: 522303 - DNA, 20 bp, mouse
ggagacgagcgccgggtggt

SEQ ID NO: 522304 - DNA, 20 bp, mouse
gggttcacagccggagaaac

SEQ ID NO: 522305 - DNA, 20 bp, mouse
ggtcgcgcctgaacagggtt

SEQ ID NO: 522306 - DNA, 20 bp, mouse
gccgtcggcgggacgcggac

SEQ ID NO: 522307 - DNA, 20 bp, mouse
gagtgggcgtccctcgacaa

SEQ ID NO: 522308 - DNA, 20 bp, mouse
ggcgtccagtcgcccgtcgg

SEQ ID NO: 522309 - DNA, 20 bp, mouse
gagggcgtccagtcgcccgt

SEQ ID NO: 522310 - DNA, 20 bp, mouse
gtccgacttgggaacgtgaa

SEQ ID NO: 522311 - DNA, 20 bp, mouse
gttcccccgagggagaggtt

SEQ ID NO: 522312 - DNA, 20 bp, mouse
gacccgctcaaggacagaga

SEQ ID NO: 522313 - DNA, 20 bp, mouse
gctctctgggcccttgtcga

SEQ ID NO: 522314 - DNA, 20 bp, mouse
ggctccgtccgaggctgtga

SEQ ID NO: 522315 - DNA, 20 bp, mouse
gctcagacaccgctagtcgc

SEQ ID NO: 522316 - DNA, 20 bp, mouse
gtgcgccaggggaagaggac

SEQ ID NO: 522317 - DNA, 20 bp, mouse
gtccgcagccagtgcgccag

SEQ ID NO: 522318 - DNA, 20 bp, mouse
gttacgcgcggtgaggagag

SEQ ID NO: 522319 - DNA, 20 bp, mouse
gggcggaaggcatcacgcgg

SEQ ID NO: 522320 - DNA, 20 bp, mouse
ggaaggcggaaggcatcacg

SEQ ID NO: 522321 - DNA, 20 bp, mouse
gaaggcatcacgcggtgggt

SEQ ID NO: 522322 - DNA, 20 bp, mouse
gtcccctggcgcactggctg

SEQ ID NO: 522323 - DNA, 20 bp, mouse
gcaccgcgcgtaaggggttt

SEQ ID NO: 522324 - DNA, 20 bp, mouse
gctgctgcttccaggaccgg

SEQ ID NO: 522325 - DNA, 20 bp, mouse
ggtagcgcgcggaaggcgga

SEQ ID NO: 522326 - DNA, 20 bp, mouse
gcatggaggagcgcgagtgg

SEQ ID NO: 522327 - DNA, 20 bp, mouse
ggagccgagccgccagaggg

SEQ ID NO: 522328 - DNA, 20 bp, mouse
gcccgcaagcagaagccgat

SEQ ID NO: 522329 - DNA, 20 bp, mouse
ggcgggcctttcaaacatgg

SEQ ID NO: 522330 - DNA, 20 bp, mouse
gcttgcgggcctttcaaaca

SEQ ID NO: 522331 - DNA, 20 bp, mouse
ggcaagcagaagccgatggg

SEQ ID NO: 522332 - DNA, 20 bp, mouse
gagtacgagagcttcctgaa

SEQ ID NO: 522333 - DNA, 20 bp, mouse
gaaggagccgagccgccaga

SEQ ID NO: 522334 - DNA, 20 bp, mouse
ggcagaagccgatgggcggg

SEQ ID NO: 522335 - DNA, 20 bp, mouse
gagccagcccgcccagcccg

SEQ ID NO: 522336 - DNA, 20 bp, mouse
gggctgctctcccaagatgg

SEQ ID NO: 522337 - DNA, 20 bp, mouse
gccaagatggcggcacctcc

SEQ ID NO: 522338 - DNA, 20 bp, mouse
gggagagcagccgcggccgg

SEQ ID NO: 522339 - DNA, 20 bp, mouse
gcgctgaagtactcgcccgg

SEQ ID NO: 522340 - DNA, 20 bp, mouse
ggcgtcgcggcgcttgctgg

SEQ ID NO: 522341 - DNA, 20 bp, mouse
gttgggagagcagccgcggc

SEQ ID NO: 522342 - DNA, 20 bp, mouse
gggagctgggccccaactga

SEQ ID NO: 522343 - DNA, 20 bp, mouse
gcccagctcccacaaggggt

SEQ ID NO: 522344 - DNA, 20 bp, mouse
gccgggccggcgtgtaggtg

SEQ ID NO: 522345 - DNA, 20 bp, mouse
gggcagcagcgggcgaaagc

SEQ ID NO: 522346 - DNA, 20 bp, mouse
ggctcgctcgctccctccgt

SEQ ID NO: 522347 - DNA, 20 bp, mouse
ggctgtgaggcgccgacgga

SEQ ID NO: 522348 - DNA, 20 bp, mouse
gggctgctgtgaggcgccga

SEQ ID NO: 522349 - DNA, 20 bp, mouse
gagccgcctcagaaccaaca

SEQ ID NO: 522350 - DNA, 20 bp, mouse
ggcgggggcaccccttacat

SEQ ID NO: 522351 - DNA, 20 bp, mouse
gatcgacaccgagaactcca

SEQ ID NO: 522352 - DNA, 20 bp, mouse
gaggcggagatccgctacga

SEQ ID NO: 522353 - DNA, 20 bp, mouse
ggtagccctcgccaaaggta

SEQ ID NO: 522354 - DNA, 20 bp, mouse
ggcggcggcgccatgagcgg

SEQ ID NO: 522355 - DNA, 20 bp, mouse
gggccgccatgttggttctg

SEQ ID NO: 522356 - DNA, 20 bp, mouse
gccgagtctgaagggagcgg

SEQ ID NO: 522357 - DNA, 20 bp, mouse
ggccacgagcgaaccggaga

SEQ ID NO: 522358 - DNA, 20 bp, mouse
gctgcgggccacgagcgaac

SEQ ID NO: 522359 - DNA, 20 bp, mouse
gcgtccggcaccccgtatct

SEQ ID NO: 522360 - DNA, 20 bp, mouse
ggcccgcaggcccctaggcg

SEQ ID NO: 522361 - DNA, 20 bp, mouse
gcctcgctctgctccctctc

SEQ ID NO: 522362 - DNA, 20 bp, mouse
gccccggccgccgccatgag

SEQ ID NO: 522363 - DNA, 20 bp, mouse
gtggcgggaggccccggatg

SEQ ID NO: 522364 - DNA, 20 bp, mouse
gtcgtggcccgcaggcccct

SEQ ID NO: 522365 - DNA, 20 bp, mouse
gaggcgcagatccgctatga

SEQ ID NO: 522366 - DNA, 20 bp, mouse
ggctcaaagggagcggggta

SEQ ID NO: 522367 - DNA, 20 bp, mouse
gcggggagccgcgaaaacct

SEQ ID NO: 522368 - DNA, 20 bp, mouse
gcggctgaattcaggctcaa

SEQ ID NO: 522369 - DNA, 20 bp, mouse
ggccgagaggaccgccaaac

SEQ ID NO: 522370 - DNA, 20 bp, mouse
gttcaggctcaaagggagcg

SEQ ID NO: 522371 - DNA, 20 bp, mouse
ggaccgccaaaccggtagag

SEQ ID NO: 522372 - DNA, 20 bp, mouse
gcgccaaaccggtagagggg

SEQ ID NO: 522373 - DNA, 20 bp, mouse
ggacgtcacggtacccacca

SEQ ID NO: 522374 - DNA, 20 bp, mouse
gggggtagggcagagccgag

SEQ ID NO: 522375 - DNA, 20 bp, mouse
gtggatcacgcaggcgcacg

SEQ ID NO: 522376 - DNA, 20 bp, mouse
ggggcgcagcgtttgaaaca

SEQ ID NO: 522377 - DNA, 20 bp, mouse
ggttcccgcgagaggtggaa

SEQ ID NO: 522378 - DNA, 20 bp, mouse
gatcaggtaagtttgacctg

SEQ ID NO: 522379 - DNA, 20 bp, mouse
gatggcggacgacgtagatc

SEQ ID NO: 522380 - DNA, 20 bp, mouse
gtgacctgaggcgttcgaag

SEQ ID NO: 522381 - DNA, 20 bp, mouse
gacgagcgcgatgggtagac

SEQ ID NO: 522382 - DNA, 20 bp, mouse
gacagctagctcccagagat

SEQ ID NO: 522383 - DNA, 20 bp, mouse
gagcgcgatgggtagacggg

SEQ ID NO: 522384 - DNA, 20 bp, mouse
gttcctgttcccgcgagagg

SEQ ID NO: 522385 - DNA, 20 bp, mouse
gtcaggagcaggcccggcta

SEQ ID NO: 522386 - DNA, 20 bp, mouse
ggctgcagggaagatggtga

SEQ ID NO: 522387 - DNA, 20 bp, mouse
ggcagcgataacttccgccg

SEQ ID NO: 522388 - DNA, 20 bp, mouse
gagcgcgtgtgtctgtgccg

SEQ ID NO: 522389 - DNA, 20 bp, mouse
ggttatcgctgcagggaaga

SEQ ID NO: 522390 - DNA, 20 bp, mouse
gacacacgcgctcccaccgg

SEQ ID NO: 522391 - DNA, 20 bp, mouse
gcgcgcggtgggccgccggt

SEQ ID NO: 522392 - DNA, 20 bp, mouse
gggaggcctgagcctaaact

SEQ ID NO: 522393 - DNA, 20 bp, mouse
ggcgtgtgtctgtgccgcgg

SEQ ID NO: 522394 - DNA, 20 bp, mouse
gcagacacacgcgctcccac

SEQ ID NO: 522395 - DNA, 20 bp, mouse
gcggtacctacggaacaaga

SEQ ID NO: 522396 - DNA, 20 bp, mouse
ggccatggccacgccggaag

SEQ ID NO: 522397 - DNA, 20 bp, mouse
gtagtggcaggagttgggac

SEQ ID NO: 522398 - DNA, 20 bp, mouse
gcggaagtggctaaggacac

SEQ ID NO: 522399 - DNA, 20 bp, mouse
gcgaccaccgacaggcaaaa

SEQ ID NO: 522400 - DNA, 20 bp, mouse
gaggagttgggacgggttcg

SEQ ID NO: 522401 - DNA, 20 bp, mouse
gaccctcaccgaccaccgac

SEQ ID NO: 522402 - DNA, 20 bp, mouse
gaaccagctgtggaaaaggg

SEQ ID NO: 522403 - DNA, 20 bp, mouse
gtgcctgtcggtggtcggtg

SEQ ID NO: 522404 - DNA, 20 bp, mouse
ggcccagtgacgccaaggac

SEQ ID NO: 522405 - DNA, 20 bp, mouse
gtttacctagtggcaggagt

SEQ ID NO: 522406 - DNA, 20 bp, mouse
gcggcctgggaggaatgaat

SEQ ID NO: 522407 - DNA, 20 bp, mouse
ggcacccattcattcctccc

SEQ ID NO: 522408 - DNA, 20 bp, mouse
gtgagcgcccagggttacgg

SEQ ID NO: 522409 - DNA, 20 bp, mouse
ggcgggcaggcactccgggt

SEQ ID NO: 522410 - DNA, 20 bp, mouse
gagaccagcgagcatctcct

SEQ ID NO: 522411 - DNA, 20 bp, mouse
gcgttctggatccggctgca

SEQ ID NO: 522412 - DNA, 20 bp, mouse
gcaaggtgagcccgcggcct

SEQ ID NO: 522413 - DNA, 20 bp, mouse
gcgcgcgccaccgtaaccct

SEQ ID NO: 522414 - DNA, 20 bp, mouse
ggggtgagcgcccagggtta

SEQ ID NO: 522415 - DNA, 20 bp, mouse
gccgaaaccgcccccggcag

SEQ ID NO: 522416 - DNA, 20 bp, mouse
gggcctttaacatatctgta

SEQ ID NO: 522417 - DNA, 20 bp, mouse
gacaacccgaaccgcctcag

SEQ ID NO: 522418 - DNA, 20 bp, mouse
gtggcgtggattatcgaggt

SEQ ID NO: 522419 - DNA, 20 bp, mouse
gttccttacagatatgttaa

SEQ ID NO: 522420 - DNA, 20 bp, mouse
gcagagctgtttacagagca

SEQ ID NO: 522421 - DNA, 20 bp, mouse
gtctgttgagcacatttaag

SEQ ID NO: 522422 - DNA, 20 bp, mouse
gtaacaaccctgattagaaa

SEQ ID NO: 522423 - DNA, 20 bp, mouse
ggcaggcattttactataag

SEQ ID NO: 522424 - DNA, 20 bp, mouse
gtctgcctctgaggcggttc

SEQ ID NO: 522425 - DNA, 20 bp, mouse
gagaaacattgttcattgac

SEQ ID NO: 522426 - DNA, 20 bp, mouse
ggcctgcgcagagcgacgtg

SEQ ID NO: 522427 - DNA, 20 bp, mouse
gagcagggccgcgggatcga

SEQ ID NO: 522428 - DNA, 20 bp, mouse
gggtgagcatgtctagatcg

SEQ ID NO: 522429 - DNA, 20 bp, mouse
gccgcgggatcgagggtctg

SEQ ID NO: 522430 - DNA, 20 bp, mouse
gatgcagacgcggaacgtgg

SEQ ID NO: 522431 - DNA, 20 bp, mouse
gaccctgtctccctactcta

SEQ ID NO: 522432 - DNA, 20 bp, mouse
ggtctagatcgtggaaagca

SEQ ID NO: 522433 - DNA, 20 bp, mouse
gtgacggacgccctagagta

SEQ ID NO: 522434 - DNA, 20 bp, mouse
gtccgcgttagaaaagggcg

SEQ ID NO: 522435 - DNA, 20 bp, mouse
gatcgtggaaagcagggccg

SEQ ID NO: 522436 - DNA, 20 bp, mouse
gcgtgcacggcagcaactag

SEQ ID NO: 522437 - DNA, 20 bp, mouse
ggcactcagacacctaggat

SEQ ID NO: 522438 - DNA, 20 bp, mouse
gccccatcagagtcctgcta

SEQ ID NO: 522439 - DNA, 20 bp, mouse
gggcgctgccagaagcccgt

SEQ ID NO: 522440 - DNA, 20 bp, mouse
ggactctgatggggaacagg

SEQ ID NO: 522441 - DNA, 20 bp, mouse
gaggtcccagggccaatggc

SEQ ID NO: 522442 - DNA, 20 bp, mouse
gaggcccaaaagaggtccca

SEQ ID NO: 522443 - DNA, 20 bp, mouse
ggtcggggagcgacaccggg

SEQ ID NO: 522444 - DNA, 20 bp, mouse
gccagcgccggggttagcgt

SEQ ID NO: 522445 - DNA, 20 bp, mouse
gagcagtcggggagcgacac

SEQ ID NO: 522446 - DNA, 20 bp, mouse
gtaagagcgaactacagaac

SEQ ID NO: 522447 - DNA, 20 bp, mouse
gctaggaaaccgagcattgg

SEQ ID NO: 522448 - DNA, 20 bp, mouse
gagccacggccacgtatgaa

SEQ ID NO: 522449 - DNA, 20 bp, mouse
gtttctaggaaaccgagcat

SEQ ID NO: 522450 - DNA, 20 bp, mouse
gcgtggccgtggctcactca

SEQ ID NO: 522451 - DNA, 20 bp, mouse
gctgagtagttgtcttttct

SEQ ID NO: 522452 - DNA, 20 bp, mouse
gaaattacctcctgacttgg

SEQ ID NO: 522453 - DNA, 20 bp, mouse
gcaggaatgccgttcatacg

SEQ ID NO: 522454 - DNA, 20 bp, mouse
ggagttcgtagcatacaata

SEQ ID NO: 522455 - DNA, 20 bp, mouse
ggctcacaagtgctcccctg

SEQ ID NO: 522456 - DNA, 20 bp, mouse
gtcctcgcatctgggatcga

SEQ ID NO: 522457 - DNA, 20 bp, mouse
gaccgaagacaccaggccca

SEQ ID NO: 522458 - DNA, 20 bp, mouse
gaagctgcagagggagatag

SEQ ID NO: 522459 - DNA, 20 bp, mouse
gggcctggtgtcttcggtgt

SEQ ID NO: 522460 - DNA, 20 bp, mouse
gtcgatggcagcctccgcca

SEQ ID NO: 522461 - DNA, 20 bp, mouse
ggccatcgatcccagatgcg

SEQ ID NO: 522462 - DNA, 20 bp, mouse
gcacccacaccgaagacacc

SEQ ID NO: 522463 - DNA, 20 bp, mouse
ggatcccagatgcgaggaac

SEQ ID NO: 522464 - DNA, 20 bp, mouse
gggtgtgggtgcacttgtta

SEQ ID NO: 522465 - DNA, 20 bp, mouse
gcagttaggccaagctgcag

SEQ ID NO: 522466 - DNA, 20 bp, mouse
gaaacagggtccagggacag

SEQ ID NO: 522467 - DNA, 20 bp, mouse
gcagggacagtggaagggcc

SEQ ID NO: 522468 - DNA, 20 bp, mouse
ggctcccagatggcagcccc

SEQ ID NO: 522469 - DNA, 20 bp, mouse
gagggcctggggctgccatc

SEQ ID NO: 522470 - DNA, 20 bp, mouse
gccgcccccacgggctggag

SEQ ID NO: 522471 - DNA, 20 bp, mouse
gggcaggcctgcagcatgaa

SEQ ID NO: 522472 - DNA, 20 bp, mouse
gtcagcccctccagcccgtg

SEQ ID NO: 522473 - DNA, 20 bp, mouse
ggctgtgtccccagggccag

SEQ ID NO: 522474 - DNA, 20 bp, mouse
gaagggggctgggggacaaa

SEQ ID NO: 522475 - DNA, 20 bp, mouse
gggtaggtccctcccagccc

SEQ ID NO: 522476 - DNA, 20 bp, mouse
gcgagcaccagggccgagaa

SEQ ID NO: 522477 - DNA, 20 bp, mouse
gaagatcgtggtggccgggt

SEQ ID NO: 522478 - DNA, 20 bp, mouse
ggaaccgcccaggtacacaa

SEQ ID NO: 522479 - DNA, 20 bp, mouse
ggttgtcttcgggaagccga

SEQ ID NO: 522480 - DNA, 20 bp, mouse
gcgccgggtcagttgtcttc

SEQ ID NO: 522481 - DNA, 20 bp, mouse
gcggcgcgcggtggctctct

SEQ ID NO: 522482 - DNA, 20 bp, mouse
gcattcccgggagtgcgcag

SEQ ID NO: 522483 - DNA, 20 bp, mouse
gagacacacgaagatcgtgg

SEQ ID NO: 522484 - DNA, 20 bp, mouse
gctaacctacaaaatgaact

SEQ ID NO: 522485 - DNA, 20 bp, mouse
gtcccccagtgcgaggaaaa

SEQ ID NO: 522486 - DNA, 20 bp, mouse
ggtagtgctgtcatgactga

SEQ ID NO: 522487 - DNA, 20 bp, mouse
ggtaaagggctggcaagcgg

SEQ ID NO: 522488 - DNA, 20 bp, mouse
ggacgccgcagacacctgag

SEQ ID NO: 522489 - DNA, 20 bp, mouse
gaacacccgcgggaagccca

SEQ ID NO: 522490 - DNA, 20 bp, mouse
gcgccagcgggtgagatcgg

SEQ ID NO: 522491 - DNA, 20 bp, mouse
gcacgtgagtcgcggaccct

SEQ ID NO: 522492 - DNA, 20 bp, mouse
gcactaggctgtcaggtaaa

SEQ ID NO: 522493 - DNA, 20 bp, mouse
gcctgggcggagtctaagga

SEQ ID NO: 522494 - DNA, 20 bp, mouse
ggattgcaggcatcccacct

SEQ ID NO: 522495 - DNA, 20 bp, mouse
gacctgaggggaccagcgag

SEQ ID NO: 522496 - DNA, 20 bp, mouse
gtgtcatcagacatagtcca

SEQ ID NO: 522497 - DNA, 20 bp, mouse
gctgagacccggaaacagta

SEQ ID NO: 522498 - DNA, 20 bp, mouse
gcggaggggtccctacttac

SEQ ID NO: 522499 - DNA, 20 bp, mouse
gtcaggagaggtaacccggt

SEQ ID NO: 522500 - DNA, 20 bp, mouse
ggtagggagtgagcatagtc

SEQ ID NO: 522501 - DNA, 20 bp, mouse
gcaggcctgttctcagtccc

SEQ ID NO: 522502 - DNA, 20 bp, mouse
ggagtgagcatagtcaggag

SEQ ID NO: 522503 - DNA, 20 bp, mouse
gccggtaggtgaatctctag

SEQ ID NO: 522504 - DNA, 20 bp, mouse
gctattaagcccagcagaag

SEQ ID NO: 522505 - DNA, 20 bp, mouse
ggtctgggtaatgaatgtgt

SEQ ID NO: 522506 - DNA, 20 bp, mouse
gtgagggatgcctgatacca

SEQ ID NO: 522507 - DNA, 20 bp, mouse
ggcccaggaccccgcacagc

SEQ ID NO: 522508 - DNA, 20 bp, mouse
ggcggaggcggggcacacag

SEQ ID NO: 522509 - DNA, 20 bp, mouse
gcgctcgggtccctttatag

SEQ ID NO: 522510 - DNA, 20 bp, mouse
ggacccgagcgccagcgccc

SEQ ID NO: 522511 - DNA, 20 bp, mouse
gatcagacaatggctaacag

SEQ ID NO: 522512 - DNA, 20 bp, mouse
gaaaggaggtaggatcctga

SEQ ID NO: 522513 - DNA, 20 bp, mouse
ggaggctcacctgctgtgcg

SEQ ID NO: 522514 - DNA, 20 bp, mouse
gtgtctccttgggcttaccc

SEQ ID NO: 522515 - DNA, 20 bp, mouse
gacctgctgtgcggggtcct

SEQ ID NO: 522516 - DNA, 20 bp, mouse
ggctcgcggtgaaagtctgg

SEQ ID NO: 522517 - DNA, 20 bp, mouse
ggtctggcggtagagtgtct

SEQ ID NO: 522518 - DNA, 20 bp, mouse
gctgggtgctggctgacgtg

SEQ ID NO: 522519 - DNA, 20 bp, mouse
gcgggctcgcggtgaaagtc

SEQ ID NO: 522520 - DNA, 20 bp, mouse
gttcaccgcgagcccgagag

SEQ ID NO: 522521 - DNA, 20 bp, mouse
gccgcgagcccgagagcgga

SEQ ID NO: 522522 - DNA, 20 bp, mouse
ggcgctcacggtccagtcac

SEQ ID NO: 522523 - DNA, 20 bp, mouse
ggagagcggccccggagaag

SEQ ID NO: 522524 - DNA, 20 bp, mouse
gagcaagtatccgcgacctc

SEQ ID NO: 522525 - DNA, 20 bp, mouse
gagagcggagggaagctcag

SEQ ID NO: 522526 - DNA, 20 bp, mouse
gagaggcagcccctcccctg

SEQ ID NO: 522527 - DNA, 20 bp, mouse
ggggactgcagggcctgggt

SEQ ID NO: 522528 - DNA, 20 bp, mouse
ggagtctggatggggacacg

SEQ ID NO: 522529 - DNA, 20 bp, mouse
gtggggacacggggactgca

SEQ ID NO: 522530 - DNA, 20 bp, mouse
gagactcagaactaggaccg

SEQ ID NO: 522531 - DNA, 20 bp, mouse
gctagttctgagtctggatg

SEQ ID NO: 522532 - DNA, 20 bp, mouse
gccgcaggatcagggacgtc

SEQ ID NO: 522533 - DNA, 20 bp, mouse
gggctgcaacgggctccaga

SEQ ID NO: 522534 - DNA, 20 bp, mouse
gtccctggtgaccctgttgt

SEQ ID NO: 522535 - DNA, 20 bp, mouse
gataggcactgccaacaaca

SEQ ID NO: 522536 - DNA, 20 bp, mouse
gtagctgacagacctagaag

SEQ ID NO: 522537 - DNA, 20 bp, mouse
gtggcactaagacagattca

SEQ ID NO: 522538 - DNA, 20 bp, mouse
gctctgtggtacttcctctc

SEQ ID NO: 522539 - DNA, 20 bp, mouse
gtgtcttagtgccagggtcc

SEQ ID NO: 522540 - DNA, 20 bp, mouse
gccacagagcagagcaaagg

SEQ ID NO: 522541 - DNA, 20 bp, mouse
gcattcctaggatacttaca

SEQ ID NO: 522542 - DNA, 20 bp, mouse
gtaccttctgatcagcatca

SEQ ID NO: 522543 - DNA, 20 bp, mouse
ggaaaccctgtaagtatcct

SEQ ID NO: 522544 - DNA, 20 bp, mouse
gcacacaccatatcattcct

SEQ ID NO: 522545 - DNA, 20 bp, mouse
ggtgagtgtcagtgtgttat

SEQ ID NO: 522546 - DNA, 20 bp, mouse
gacaggcacggggcaggatt

SEQ ID NO: 522547 - DNA, 20 bp, mouse
gaagccagctgctgtggatg

SEQ ID NO: 522548 - DNA, 20 bp, mouse
gggagaggatgagtcaagaa

SEQ ID NO: 522549 - DNA, 20 bp, mouse
ggggagagaacagcattggg

SEQ ID NO: 522550 - DNA, 20 bp, mouse
gtcctctccgcaaatgtgac

SEQ ID NO: 522551 - DNA, 20 bp, mouse
gggggggcgcagagagattt

SEQ ID NO: 522552 - DNA, 20 bp, mouse
gagagatttaggaaggtgac

SEQ ID NO: 522553 - DNA, 20 bp, mouse
gggtttcttggagagaagag

SEQ ID NO: 522554 - DNA, 20 bp, mouse
gagacagtgactgtctacaa

SEQ ID NO: 522555 - DNA, 20 bp, mouse
gggagagctgcaagaatcca

SEQ ID NO: 522556 - DNA, 20 bp, mouse
ggctctctctctctatccag

SEQ ID NO: 522557 - DNA, 20 bp, mouse
gggttactcactaggagtag

SEQ ID NO: 522558 - DNA, 20 bp, mouse
gccagtggtgtctctgaaac

SEQ ID NO: 522559 - DNA, 20 bp, mouse
ggagagcagcgagcaagagc

SEQ ID NO: 522560 - DNA, 20 bp, mouse
gagagagcccacagccggac

SEQ ID NO: 522561 - DNA, 20 bp, mouse
gggacagttagggaccacgg

SEQ ID NO: 522562 - DNA, 20 bp, mouse
gttctcactaatgagagtgg

SEQ ID NO: 522563 - DNA, 20 bp, mouse
gtcctagtgagtaaccacac

SEQ ID NO: 522564 - DNA, 20 bp, mouse
gagcttaacaaacagaactc

SEQ ID NO: 522565 - DNA, 20 bp, mouse
gcctctgcctgaaacctgtc

SEQ ID NO: 522566 - DNA, 20 bp, mouse
ggcgaaggtgcggcaggctc

SEQ ID NO: 522567 - DNA, 20 bp, mouse
gtccaggggttcctaggtaa

SEQ ID NO: 522568 - DNA, 20 bp, mouse
gtgtatggcgtgagctgccc

SEQ ID NO: 522569 - DNA, 20 bp, mouse
gtcggttccccttcagacgg

SEQ ID NO: 522570 - DNA, 20 bp, mouse
gttcctaggtaagggctgta

SEQ ID NO: 522571 - DNA, 20 bp, mouse
ggcactgccgccgtctgaag

SEQ ID NO: 522572 - DNA, 20 bp, mouse
gcgccatacagcccttacct

SEQ ID NO: 522573 - DNA, 20 bp, mouse
gcggagcagcgagcggtggt

SEQ ID NO: 522574 - DNA, 20 bp, mouse
gatgcatccggagcagcgag

SEQ ID NO: 522575 - DNA, 20 bp, mouse
ggaacccctggacccccaaa

SEQ ID NO: 522576 - DNA, 20 bp, mouse
gaagagctagacttactcac

SEQ ID NO: 522577 - DNA, 20 bp, mouse
gggctgtggtgtcccggatc

SEQ ID NO: 522578 - DNA, 20 bp, mouse
gttactcactggtctgaaag

SEQ ID NO: 522579 - DNA, 20 bp, mouse
gaggggaggctgtggtgtcc

SEQ ID NO: 522580 - DNA, 20 bp, mouse
ggagtcagacactggatcct

SEQ ID NO: 522581 - DNA, 20 bp, mouse
ggccagccaggccagacgag

SEQ ID NO: 522582 - DNA, 20 bp, mouse
gcacagtattgtccagatcc

SEQ ID NO: 522583 - DNA, 20 bp, mouse
ggaagcccagcagggccctg

SEQ ID NO: 522584 - DNA, 20 bp, mouse
gcaggctaacagccggagaa

SEQ ID NO: 522585 - DNA, 20 bp, mouse
ggactcaaaagaacttagta

SEQ ID NO: 522586 - DNA, 20 bp, mouse
ggcgctgcagccatggcggg

SEQ ID NO: 522587 - DNA, 20 bp, mouse
ggcggcgctgcagccatggc

SEQ ID NO: 522588 - DNA, 20 bp, mouse
gctcggggtcggcccagtac

SEQ ID NO: 522589 - DNA, 20 bp, mouse
gctgctctgggtgtcgctat

SEQ ID NO: 522590 - DNA, 20 bp, mouse
gcgcaggccgcacacagcgg

SEQ ID NO: 522591 - DNA, 20 bp, mouse
gtgcgggatggtgctcccaa

SEQ ID NO: 522592 - DNA, 20 bp, mouse
gcgcgcaggtcggggtacag

SEQ ID NO: 522593 - DNA, 20 bp, mouse
gctccgggcactcctccctt

SEQ ID NO: 522594 - DNA, 20 bp, mouse
ggcacgcgaagacgctctcg

SEQ ID NO: 522595 - DNA, 20 bp, mouse
gcgcggccgggcccctcggg

SEQ ID NO: 522596 - DNA, 20 bp, mouse
gccaggccggcgcatcgtgt

SEQ ID NO: 522597 - DNA, 20 bp, mouse
ggcagagtccggctccaaga

SEQ ID NO: 522598 - DNA, 20 bp, mouse
gtcgtgtcgggtgcagagtc

SEQ ID NO: 522599 - DNA, 20 bp, mouse
ggagccgctagcagatgtgg

SEQ ID NO: 522600 - DNA, 20 bp, mouse
ggggctcccagcagatccaa

SEQ ID NO: 522601 - DNA, 20 bp, mouse
gctggagccgctagcagatg

SEQ ID NO: 522602 - DNA, 20 bp, mouse
gccctccagaggggtaggat

SEQ ID NO: 522603 - DNA, 20 bp, mouse
gagcggaggtccctccagag

SEQ ID NO: 522604 - DNA, 20 bp, mouse
gagagggcagtgtgtccagt

SEQ ID NO: 522605 - DNA, 20 bp, mouse
gcaggccgatccggacccac

SEQ ID NO: 522606 - DNA, 20 bp, mouse
gcccggcgctggagccctgg

SEQ ID NO: 522607 - DNA, 20 bp, mouse
gaggcagggtcagctctgga

SEQ ID NO: 522608 - DNA, 20 bp, mouse
gtcagctctggagggcagaa

SEQ ID NO: 522609 - DNA, 20 bp, mouse
gtgggccgacgtgcccccgg

SEQ ID NO: 522610 - DNA, 20 bp, mouse
ggaccgggtggagtcctagg

SEQ ID NO: 522611 - DNA, 20 bp, mouse
gccagaccgggtggagtcct

SEQ ID NO: 522612 - DNA, 20 bp, mouse
gcccgggcctcctctccctg

SEQ ID NO: 522613 - DNA, 20 bp, mouse
gcactcctgctgggactcag

SEQ ID NO: 522614 - DNA, 20 bp, mouse
gcggctcggctgaccagacc

SEQ ID NO: 522615 - DNA, 20 bp, mouse
gacttgctgggaccaggaca

SEQ ID NO: 522616 - DNA, 20 bp, mouse
gtcagacgctggcccaggag

SEQ ID NO: 522617 - DNA, 20 bp, mouse
gcctgtggctggcaacatga

SEQ ID NO: 522618 - DNA, 20 bp, mouse
gccacaggcagaattagctt

SEQ ID NO: 522619 - DNA, 20 bp, mouse
gcagcgtctgagtagcacac

SEQ ID NO: 522620 - DNA, 20 bp, mouse
gccaggctcaggagaaggac

SEQ ID NO: 522621 - DNA, 20 bp, mouse
gggcaacatgaaggacgaag

SEQ ID NO: 522622 - DNA, 20 bp, mouse
gtggctaccgtcaccctcgt

SEQ ID NO: 522623 - DNA, 20 bp, mouse
gctctaaggagtgtctacag

SEQ ID NO: 522624 - DNA, 20 bp, mouse
gtgcaacagaactcccacga

SEQ ID NO: 522625 - DNA, 20 bp, mouse
gtgctggcaggcccaggctc

SEQ ID NO: 522626 - DNA, 20 bp, mouse
ggggcacctgcacttaccaa

SEQ ID NO: 522627 - DNA, 20 bp, mouse
ggtgcaggtgcccagaggta

SEQ ID NO: 522628 - DNA, 20 bp, mouse
gagactgttgggctcagaga

SEQ ID NO: 522629 - DNA, 20 bp, mouse
ggtggtcttgggagacctag

SEQ ID NO: 522630 - DNA, 20 bp, mouse
gcccgcccctccctacctct

SEQ ID NO: 522631 - DNA, 20 bp, mouse
gagcccagaaggaggaaaca

SEQ ID NO: 522632 - DNA, 20 bp, mouse
ggcagtgaactgggactcac

SEQ ID NO: 522633 - DNA, 20 bp, mouse
gcaggtgcccagaggtaggg

SEQ ID NO: 522634 - DNA, 20 bp, mouse
gaggatgcctgggttagatg

SEQ ID NO: 522635 - DNA, 20 bp, mouse
gggtacaaagaagccttctt

SEQ ID NO: 522636 - DNA, 20 bp, mouse
gcagagggagagcggagcct

SEQ ID NO: 522637 - DNA, 20 bp, mouse
ggtcgcctcgacccccagct

SEQ ID NO: 522638 - DNA, 20 bp, mouse
gagcctgggctacccagctg

SEQ ID NO: 522639 - DNA, 20 bp, mouse
gacccccagctgggtagccc

SEQ ID NO: 522640 - DNA, 20 bp, mouse
ggggtcgaggcgacagcacc

SEQ ID NO: 522641 - DNA, 20 bp, mouse
gaggcggcgggaggtcctac

SEQ ID NO: 522642 - DNA, 20 bp, mouse
gatcttccgggtaggtgcac

SEQ ID NO: 522643 - DNA, 20 bp, mouse
ggactcaggccgtccccgag

SEQ ID NO: 522644 - DNA, 20 bp, mouse
gcggcgggaggtcctaccgg

SEQ ID NO: 522645 - DNA, 20 bp, mouse
gccacctccatcttccgggt

SEQ ID NO: 522646 - DNA, 20 bp, mouse
ggggctgccaccgccaccat

SEQ ID NO: 522647 - DNA, 20 bp, mouse
ggcagagccgaagttgacac

SEQ ID NO: 522648 - DNA, 20 bp, mouse
gggcccgcccgtgtcaactt

SEQ ID NO: 522649 - DNA, 20 bp, mouse
gctgccaccgccaccatggg

SEQ ID NO: 522650 - DNA, 20 bp, mouse
gcaccacaggactcaccctg

SEQ ID NO: 522651 - DNA, 20 bp, mouse
gttgttcttcccgcccatgg

SEQ ID NO: 522652 - DNA, 20 bp, mouse
gttcttcccgcccatggtgg

SEQ ID NO: 522653 - DNA, 20 bp, mouse
gggtgtccagagggccgtga

SEQ ID NO: 522654 - DNA, 20 bp, mouse
gaacggagcgcgcccaggga

SEQ ID NO: 522655 - DNA, 20 bp, mouse
gcccgcgggtggacaagtcg

SEQ ID NO: 522656 - DNA, 20 bp, mouse
ggagctgccggcaggtaccg

SEQ ID NO: 522657 - DNA, 20 bp, mouse
gctccacacgtgggtccaca

SEQ ID NO: 522658 - DNA, 20 bp, mouse
ggccgctccccggtacctgc

SEQ ID NO: 522659 - DNA, 20 bp, mouse
gagggcagcacgtcacacga

SEQ ID NO: 522660 - DNA, 20 bp, mouse
ggacaccctctccggaaccg

SEQ ID NO: 522661 - DNA, 20 bp, mouse
ggaggcagggacaccctctc

SEQ ID NO: 522662 - DNA, 20 bp, mouse
gctgccggcagctccacacg

SEQ ID NO: 522663 - DNA, 20 bp, mouse
ggacccacgtgtggagctgc

SEQ ID NO: 522664 - DNA, 20 bp, mouse
ggtaccggggagcggcggtt

SEQ ID NO: 522665 - DNA, 20 bp, mouse
ggccggcaggtaccggggag

SEQ ID NO: 522666 - DNA, 20 bp, mouse
ggaagccgcaaacagcgacg

SEQ ID NO: 522667 - DNA, 20 bp, mouse
ggcggacatggtggccagtg

SEQ ID NO: 522668 - DNA, 20 bp, mouse
gcccatgagctggtccaaca

SEQ ID NO: 522669 - DNA, 20 bp, mouse
ggcttctcggccgtccccac

SEQ ID NO: 522670 - DNA, 20 bp, mouse
gtgcgcctgggcggacatgg

SEQ ID NO: 522671 - DNA, 20 bp, mouse
gtcgctgtttgcggcttctc

SEQ ID NO: 522672 - DNA, 20 bp, mouse
ggaggccgcctggaagcctg

SEQ ID NO: 522673 - DNA, 20 bp, mouse
gctgtcacggccctcacctc

SEQ ID NO: 522674 - DNA, 20 bp, mouse
gcttctctggtcgagttgtg

SEQ ID NO: 522675 - DNA, 20 bp, mouse
gagggcccgcatctgcgcct

SEQ ID NO: 522676 - DNA, 20 bp, mouse
gcagcaagcgagctctgacg

SEQ ID NO: 522677 - DNA, 20 bp, mouse
gcgcgagtagggagtcggag

SEQ ID NO: 522678 - DNA, 20 bp, mouse
ggtcgggaggaggcgagagt

SEQ ID NO: 522679 - DNA, 20 bp, mouse
gcagggctcactctctaggg

SEQ ID NO: 522680 - DNA, 20 bp, mouse
gtcagagctcgcttgctggg

SEQ ID NO: 522681 - DNA, 20 bp, mouse
ggaggggtcgtggagagtcc

SEQ ID NO: 522682 - DNA, 20 bp, mouse
ggtgcgcgctcccgtcgcgg

SEQ ID NO: 522683 - DNA, 20 bp, mouse
gcgggctgcgctcctcacga

SEQ ID NO: 522684 - DNA, 20 bp, mouse
ggcctcgaggcccgcgagta

SEQ ID NO: 522685 - DNA, 20 bp, mouse
gggcgggtgttggtgtcggg

SEQ ID NO: 522686 - DNA, 20 bp, mouse
gtgtcttctcggctcctctc

SEQ ID NO: 522687 - DNA, 20 bp, mouse
ggcttgagagtgggccgagg

SEQ ID NO: 522688 - DNA, 20 bp, mouse
ggcttttcgagcttgagagt

SEQ ID NO: 522689 - DNA, 20 bp, mouse
gcgccgactgaagcacctga

SEQ ID NO: 522690 - DNA, 20 bp, mouse
ggggagctgaagggacccga

SEQ ID NO: 522691 - DNA, 20 bp, mouse
gcgagcttgagagtgggccg

SEQ ID NO: 522692 - DNA, 20 bp, mouse
gacgagagcgtaagtcccgt

SEQ ID NO: 522693 - DNA, 20 bp, mouse
gttgctgcgcttctcatccg

SEQ ID NO: 522694 - DNA, 20 bp, mouse
gcgactgaagcacctgacgg

SEQ ID NO: 522695 - DNA, 20 bp, mouse
gcctgtgccccggggactgg

SEQ ID NO: 522696 - DNA, 20 bp, mouse
gagttcacagcatatgttag

SEQ ID NO: 522697 - DNA, 20 bp, mouse
gtgcctgtttaagaaattaa

SEQ ID NO: 522698 - DNA, 20 bp, mouse
gaaacagtgtcaagagagta

SEQ ID NO: 522699 - DNA, 20 bp, mouse
gaagagctgaggagcgtggg

SEQ ID NO: 522700 - DNA, 20 bp, mouse
gtagtgatggaaagtataat

SEQ ID NO: 522701 - DNA, 20 bp, mouse
ggaggcagttcggtgtgaga

SEQ ID NO: 522702 - DNA, 20 bp, mouse
gccccgattccagagtggaa

SEQ ID NO: 522703 - DNA, 20 bp, mouse
gttccgttaatttcttaaac

SEQ ID NO: 522704 - DNA, 20 bp, mouse
gcccaaccccgattccagag

SEQ ID NO: 522705 - DNA, 20 bp, mouse
gcccaggggatgctgagtct

SEQ ID NO: 522706 - DNA, 20 bp, mouse
gcccaagccagaacaggact

SEQ ID NO: 522707 - DNA, 20 bp, mouse
gaccagggtccggttcccaa

SEQ ID NO: 522708 - DNA, 20 bp, mouse
gggactgggcgaccagggtc

SEQ ID NO: 522709 - DNA, 20 bp, mouse
gcgttcgtagcagagaaggg

SEQ ID NO: 522710 - DNA, 20 bp, mouse
ggaacaggactgggcgacca

SEQ ID NO: 522711 - DNA, 20 bp, mouse
gtccgcggtcccctccatgt

SEQ ID NO: 522712 - DNA, 20 bp, mouse
gggcttgggcccacatggag

SEQ ID NO: 522713 - DNA, 20 bp, mouse
gtgcgagctgggaacctctg

SEQ ID NO: 522714 - DNA, 20 bp, mouse
gggtcctgagaactgagagt

SEQ ID NO: 522715 - DNA, 20 bp, mouse
ggcccacatggaggggaccg

SEQ ID NO: 522716 - DNA, 20 bp, mouse
gacgaggtggccacactccc

SEQ ID NO: 522717 - DNA, 20 bp, mouse
gtgagaccgactaaaaggaa

SEQ ID NO: 522718 - DNA, 20 bp, mouse
gggacactgctgcagcaacc

SEQ ID NO: 522719 - DNA, 20 bp, mouse
gtacaccacacagaataacg

SEQ ID NO: 522720 - DNA, 20 bp, mouse
gaggatcagactatcttaga

SEQ ID NO: 522721 - DNA, 20 bp, mouse
ggcctacaccgcctacacac

SEQ ID NO: 522722 - DNA, 20 bp, mouse
ggtgtggtgtaataccagat

SEQ ID NO: 522723 - DNA, 20 bp, mouse
gaccacacagaataacgagg

SEQ ID NO: 522724 - DNA, 20 bp, mouse
gtcggaggaacacaatgact

SEQ ID NO: 522725 - DNA, 20 bp, mouse
gttgatactgcagagaagaa

SEQ ID NO: 522726 - DNA, 20 bp, mouse
gcgccgccgcctcacctcag

SEQ ID NO: 522727 - DNA, 20 bp, mouse
gagcggagcgccggatcctc

SEQ ID NO: 522728 - DNA, 20 bp, mouse
gggccgcagccgctgaggtg

SEQ ID NO: 522729 - DNA, 20 bp, mouse
gaggcgccggccgctgggag

SEQ ID NO: 522730 - DNA, 20 bp, mouse
gcgcagccgctgaggtgagg

SEQ ID NO: 522731 - DNA, 20 bp, mouse
gctcccgccgccggaggatc

SEQ ID NO: 522732 - DNA, 20 bp, mouse
ggggccagccggagagagtg

SEQ ID NO: 522733 - DNA, 20 bp, mouse
ggccgctgggagcggagcgc

SEQ ID NO: 522734 - DNA, 20 bp, mouse
gggaaggggaggtctccggt

SEQ ID NO: 522735 - DNA, 20 bp, mouse
gcccccagactgacaatgag

SEQ ID NO: 522736 - DNA, 20 bp, mouse
gtccaggtcgctgccctagt

SEQ ID NO: 522737 - DNA, 20 bp, mouse
gcaagtacagctgcctacta

SEQ ID NO: 522738 - DNA, 20 bp, mouse
gtagggcagcgacctggacg

SEQ ID NO: 522739 - DNA, 20 bp, mouse
ggcctactagggcagcgacc

SEQ ID NO: 522740 - DNA, 20 bp, mouse
ggaggaaaggacccgcgtcc

SEQ ID NO: 522741 - DNA, 20 bp, mouse
gcgggtgtagccgctggagg

SEQ ID NO: 522742 - DNA, 20 bp, mouse
ggtgttcaaggcgcacaggg

SEQ ID NO: 522743 - DNA, 20 bp, mouse
gggacgagtgcaggcagcag

SEQ ID NO: 522744 - DNA, 20 bp, mouse
gacagggcgggtgtagccgc

SEQ ID NO: 522745 - DNA, 20 bp, mouse
ggatccgctccagtgcgcac

SEQ ID NO: 522746 - DNA, 20 bp, mouse
ggccgagtgggtgtccaagt

SEQ ID NO: 522747 - DNA, 20 bp, mouse
gtgggtgtccaagtgggtgt

SEQ ID NO: 522748 - DNA, 20 bp, mouse
ggagtgctggccagccgagt

SEQ ID NO: 522749 - DNA, 20 bp, mouse
ggtccaagtgggtgtcggtg

SEQ ID NO: 522750 - DNA, 20 bp, mouse
gcaagtgggtgtcggtgagg

SEQ ID NO: 522751 - DNA, 20 bp, mouse
gctggacgcagcatagtggg

SEQ ID NO: 522752 - DNA, 20 bp, mouse
gtagttcaaagagatcacgg

SEQ ID NO: 522753 - DNA, 20 bp, mouse
ggccctggacgcagcatagt

SEQ ID NO: 522754 - DNA, 20 bp, mouse
gatcacggcgggtgcagcca

SEQ ID NO: 522755 - DNA, 20 bp, mouse
ggtgaagtcagtcggtagct

SEQ ID NO: 522756 - DNA, 20 bp, mouse
gtggtgggtgaagccttctg

SEQ ID NO: 522757 - DNA, 20 bp, mouse
gctctggtggccaggttctg

SEQ ID NO: 522758 - DNA, 20 bp, mouse
gggtgaagccttctgtggtg

SEQ ID NO: 522759 - DNA, 20 bp, mouse
ggcatctggggagaaaaaga

SEQ ID NO: 522760 - DNA, 20 bp, mouse
gtaaagcaccccaccacaga

SEQ ID NO: 522761 - DNA, 20 bp, mouse
ggtatctctgccacagaacc

SEQ ID NO: 522762 - DNA, 20 bp, mouse
gcacataccaaaaggacacg

SEQ ID NO: 522763 - DNA, 20 bp, mouse
gctgcactggcctcccaatc

SEQ ID NO: 522764 - DNA, 20 bp, mouse
gagactctacccttctgcac

SEQ ID NO: 522765 - DNA, 20 bp, mouse
gaccatcaccacataccaaa

SEQ ID NO: 522766 - DNA, 20 bp, mouse
ggcctgcaaccttgtctgag

SEQ ID NO: 522767 - DNA, 20 bp, mouse
gtggcaagttctgtcagatg

SEQ ID NO: 522768 - DNA, 20 bp, mouse
gtcctctcagacaaggttgc

SEQ ID NO: 522769 - DNA, 20 bp, mouse
ggtgattggggtctattaac

SEQ ID NO: 522770 - DNA, 20 bp, mouse
gtagaccccaatcacatccc

SEQ ID NO: 522771 - DNA, 20 bp, mouse
gcatgaccccagcacatctc

SEQ ID NO: 522772 - DNA, 20 bp, mouse
gacaagaagaatgagcacac

SEQ ID NO: 522773 - DNA, 20 bp, mouse
gccagcacatctcgggtact

SEQ ID NO: 522774 - DNA, 20 bp, mouse
gtagaaaatgagagaggggc

SEQ ID NO: 522775 - DNA, 20 bp, mouse
gccttacttcctctcagaca

SEQ ID NO: 522776 - DNA, 20 bp, mouse
gttgggagtgtggaattagg

SEQ ID NO: 522777 - DNA, 20 bp, mouse
gccagcacacctcaggtact

SEQ ID NO: 522778 - DNA, 20 bp, mouse
ggagatgaaaaagggattca

SEQ ID NO: 522779 - DNA, 20 bp, mouse
gggaattaggaggaaaagct

SEQ ID NO: 522780 - DNA, 20 bp, mouse
gaaaagggattcagggttgt

SEQ ID NO: 522781 - DNA, 20 bp, mouse
gggtttcaggaacagtggta

SEQ ID NO: 522782 - DNA, 20 bp, mouse
ggaccaggtttcaggaacag

SEQ ID NO: 522783 - DNA, 20 bp, mouse
ggaggtggataatgagagaa

SEQ ID NO: 522784 - DNA, 20 bp, mouse
gcatgatcccagcacacctc

SEQ ID NO: 522785 - DNA, 20 bp, mouse
gattgtgtgcccagtacctg

SEQ ID NO: 522786 - DNA, 20 bp, mouse
gtggctgtggccactagccc

SEQ ID NO: 522787 - DNA, 20 bp, mouse
gtctgtcctgggcaacacta

SEQ ID NO: 522788 - DNA, 20 bp, mouse
gtaggctcggagaacgctag

SEQ ID NO: 522789 - DNA, 20 bp, mouse
ggtgcttccagatgatgttt

SEQ ID NO: 522790 - DNA, 20 bp, mouse
gggtgagcggctgcacttgg

SEQ ID NO: 522791 - DNA, 20 bp, mouse
gagccgctcacctgggctag

SEQ ID NO: 522792 - DNA, 20 bp, mouse
ggcccaggacagataagagg

SEQ ID NO: 522793 - DNA, 20 bp, mouse
ggaggtggcaaaggcagtaa

SEQ ID NO: 522794 - DNA, 20 bp, mouse
ggagctggagatatcttgag

SEQ ID NO: 522795 - DNA, 20 bp, mouse
ggacagataagaggtggcaa

SEQ ID NO: 522796 - DNA, 20 bp, mouse
gcgagtgaacacctgaggtc

SEQ ID NO: 522797 - DNA, 20 bp, mouse
gccgaaaccttaggtcctgg

SEQ ID NO: 522798 - DNA, 20 bp, mouse
gtgcacccaagcaggcggag

SEQ ID NO: 522799 - DNA, 20 bp, mouse
ggactcacctccgggtgaag

SEQ ID NO: 522800 - DNA, 20 bp, mouse
gtcggggcctcttcacccgg

SEQ ID NO: 522801 - DNA, 20 bp, mouse
gcggagcggagcacagatgg

SEQ ID NO: 522802 - DNA, 20 bp, mouse
gactagagcaggaggctggg

SEQ ID NO: 522803 - DNA, 20 bp, mouse
gcgtgacgagtgaacacctg

SEQ ID NO: 522804 - DNA, 20 bp, mouse
gctcccgggtgcagagtggt

SEQ ID NO: 522805 - DNA, 20 bp, mouse
gccgcagcgtgtaggatctg

SEQ ID NO: 522806 - DNA, 20 bp, mouse
ggagatggcaaactgcctca

SEQ ID NO: 522807 - DNA, 20 bp, mouse
ggatcatcattcacatccct

SEQ ID NO: 522808 - DNA, 20 bp, mouse
gattccttggggaaagctgg

SEQ ID NO: 522809 - DNA, 20 bp, mouse
gtgaatgatgatctaataac

SEQ ID NO: 522810 - DNA, 20 bp, mouse
gtggaaaatgagagatggcc

SEQ ID NO: 522811 - DNA, 20 bp, mouse
gcatctccattttaccctcc

SEQ ID NO: 522812 - DNA, 20 bp, mouse
gggggggggggagtgttgga

SEQ ID NO: 522813 - DNA, 20 bp, mouse
gccttggggaaagctggggg

SEQ ID NO: 522814 - DNA, 20 bp, mouse
gggtggtggatgagagaaat

SEQ ID NO: 522815 - DNA, 20 bp, mouse
gacaagaaggatgagtacac

SEQ ID NO: 522816 - DNA, 20 bp, mouse
ggcaaaatccatcagagaag

SEQ ID NO: 522817 - DNA, 20 bp, mouse
gggagtgctacaattgtatt

SEQ ID NO: 522818 - DNA, 20 bp, mouse
gcttttgtttctcagctcag

SEQ ID NO: 522819 - DNA, 20 bp, mouse
gaagctctacttggagggaa

SEQ ID NO: 522820 - DNA, 20 bp, mouse
ggccttactggctcactgag

SEQ ID NO: 522821 - DNA, 20 bp, mouse
gcttggagggaagggaaacg

SEQ ID NO: 522822 - DNA, 20 bp, mouse
gagtagagcttctctgatgt

SEQ ID NO: 522823 - DNA, 20 bp, mouse
gtgactgcactggcgacata

SEQ ID NO: 522824 - DNA, 20 bp, mouse
gtttatgtctaaggccttac

SEQ ID NO: 522825 - DNA, 20 bp, mouse
gcatgtctggacactggttg

SEQ ID NO: 522826 - DNA, 20 bp, mouse
ggaggcagaatgggtttgac

SEQ ID NO: 522827 - DNA, 20 bp, mouse
gctgaagatcaagaaaggtg

SEQ ID NO: 522828 - DNA, 20 bp, mouse
gtgcctctgaagatcaagaa

SEQ ID NO: 522829 - DNA, 20 bp, mouse
ggaggcacaggtggcaggta

SEQ ID NO: 522830 - DNA, 20 bp, mouse
gctaggcaaggactgatggg

SEQ ID NO: 522831 - DNA, 20 bp, mouse
gtagcgaagggtcttctaag

SEQ ID NO: 522832 - DNA, 20 bp, mouse
gggccacacgaggaagagag

SEQ ID NO: 522833 - DNA, 20 bp, mouse
gttgatcttcagaggcagaa

SEQ ID NO: 522834 - DNA, 20 bp, mouse
gtctgagcagaaactgatgt

SEQ ID NO: 522835 - DNA, 20 bp, mouse
ggaggcaagatcctgaccag

SEQ ID NO: 522836 - DNA, 20 bp, mouse
gtggagtcccaggggcctca

SEQ ID NO: 522837 - DNA, 20 bp, mouse
ggctggtccctgaggcccct

SEQ ID NO: 522838 - DNA, 20 bp, mouse
gcagggaccagctggctgca

SEQ ID NO: 522839 - DNA, 20 bp, mouse
ggttaagaggacagcacaca

SEQ ID NO: 522840 - DNA, 20 bp, mouse
gaggacagcacacaaggctt

SEQ ID NO: 522841 - DNA, 20 bp, mouse
ggggacgccatggagtccca

SEQ ID NO: 522842 - DNA, 20 bp, mouse
gcaaggcttgggggacgcca

SEQ ID NO: 522843 - DNA, 20 bp, mouse
gctctgtagaccaatcctag

SEQ ID NO: 522844 - DNA, 20 bp, mouse
ggggcctgccataaaaagca

SEQ ID NO: 522845 - DNA, 20 bp, mouse
gagttcgaagcctctaggat

SEQ ID NO: 522846 - DNA, 20 bp, mouse
ggagacccagcagtagagta

SEQ ID NO: 522847 - DNA, 20 bp, mouse
gagcaacaggaggtgtttca

SEQ ID NO: 522848 - DNA, 20 bp, mouse
gcagttgacagcagattccc

SEQ ID NO: 522849 - DNA, 20 bp, mouse
gtggggctgtggacattctc

SEQ ID NO: 522850 - DNA, 20 bp, mouse
gagtaggctaggccaataca

SEQ ID NO: 522851 - DNA, 20 bp, mouse
gcagagatatctgatcctgg

SEQ ID NO: 522852 - DNA, 20 bp, mouse
ggcagtagagtagggcagac

SEQ ID NO: 522853 - DNA, 20 bp, mouse
gggcgagactaagccatgta

SEQ ID NO: 522854 - DNA, 20 bp, mouse
ggaatctgctgtcaactgct

SEQ ID NO: 522855 - DNA, 20 bp, mouse
gcaggaggtgtttcatggtg

SEQ ID NO: 522856 - DNA, 20 bp, mouse
ggcgatggcccttctcgagg

SEQ ID NO: 522857 - DNA, 20 bp, mouse
gaggaatgctgaggttgcgg

SEQ ID NO: 522858 - DNA, 20 bp, mouse
gagaggagccacctcgagaa

SEQ ID NO: 522859 - DNA, 20 bp, mouse
gggtgcgatggcccttctcg

SEQ ID NO: 522860 - DNA, 20 bp, mouse
gcagtgttggcacctcaggt

SEQ ID NO: 522861 - DNA, 20 bp, mouse
gtgcggcggcagccatgggc

SEQ ID NO: 522862 - DNA, 20 bp, mouse
gttgctctgtgggacaaaag

SEQ ID NO: 522863 - DNA, 20 bp, mouse
gaggttgcggcggcagccat

SEQ ID NO: 522864 - DNA, 20 bp, mouse
gtgtcccacagagcaaaagg

SEQ ID NO: 522865 - DNA, 20 bp, mouse
gggaagtggtgagacctgtt

SEQ ID NO: 522866 - DNA, 20 bp, mouse
gcgggagggagaggcactac

SEQ ID NO: 522867 - DNA, 20 bp, mouse
gcccagggcaacccctagca

SEQ ID NO: 522868 - DNA, 20 bp, mouse
gagcaggatcccgaccaact

SEQ ID NO: 522869 - DNA, 20 bp, mouse
gctagcttcctccttaccca

SEQ ID NO: 522870 - DNA, 20 bp, mouse
gaacgtgatgaactcccagt

SEQ ID NO: 522871 - DNA, 20 bp, mouse
gggggttgccctgggtaagg

SEQ ID NO: 522872 - DNA, 20 bp, mouse
gtgatgaactcccagttggt

SEQ ID NO: 522873 - DNA, 20 bp, mouse
gccggcccttggaggagtcc

SEQ ID NO: 522874 - DNA, 20 bp, mouse
gctaggggttgccctgggta

SEQ ID NO: 522875 - DNA, 20 bp, mouse
ggcacgcggtgctatgactg

SEQ ID NO: 522876 - DNA, 20 bp, mouse
gggcaggtgtgtctgactcg

SEQ ID NO: 522877 - DNA, 20 bp, mouse
gaggaacaggacgccaagga

SEQ ID NO: 522878 - DNA, 20 bp, mouse
gcgagaggaacaggacgcca

SEQ ID NO: 522879 - DNA, 20 bp, mouse
gaaggcgctggacgggccca

SEQ ID NO: 522880 - DNA, 20 bp, mouse
gcgctggacgggcccatggc

SEQ ID NO: 522881 - DNA, 20 bp, mouse
gcagtgtccccgagaggaac

SEQ ID NO: 522882 - DNA, 20 bp, mouse
ggccaaggaaggcgctggac

SEQ ID NO: 522883 - DNA, 20 bp, mouse
ggacacacctgcccaagaca

SEQ ID NO: 522884 - DNA, 20 bp, mouse
ggcccgtccagcgccttcct

SEQ ID NO: 522885 - DNA, 20 bp, mouse
gtgaggacattgggagtctg

SEQ ID NO: 522886 - DNA, 20 bp, mouse
gggagtgcccacataagaac

SEQ ID NO: 522887 - DNA, 20 bp, mouse
ggtgcccacataagaacagg

SEQ ID NO: 522888 - DNA, 20 bp, mouse
gtagtcctagggagacccag

SEQ ID NO: 522889 - DNA, 20 bp, mouse
gtctttggagcaggggaact

SEQ ID NO: 522890 - DNA, 20 bp, mouse
gggagacccagaggtaccaa

SEQ ID NO: 522891 - DNA, 20 bp, mouse
gtggagcaggggaacttggc

SEQ ID NO: 522892 - DNA, 20 bp, mouse
gattcctcctgttcttatgt

SEQ ID NO: 522893 - DNA, 20 bp, mouse
gccaggctgttgcaggtaag

SEQ ID NO: 522894 - DNA, 20 bp, mouse
gtctggaaacaccagatctt

SEQ ID NO: 522895 - DNA, 20 bp, mouse
gataaaggcccacagttcct

SEQ ID NO: 522896 - DNA, 20 bp, mouse
gggtccgcagggagaccgaa

SEQ ID NO: 522897 - DNA, 20 bp, mouse
gtccctgcggaccggaaccg

SEQ ID NO: 522898 - DNA, 20 bp, mouse
ggcgcgcgcgcggggaccag

SEQ ID NO: 522899 - DNA, 20 bp, mouse
ggtccgcactccgggctcag

SEQ ID NO: 522900 - DNA, 20 bp, mouse
gccggagtgcggacacccca

SEQ ID NO: 522901 - DNA, 20 bp, mouse
ggcgaaagagggaagcggag

SEQ ID NO: 522902 - DNA, 20 bp, mouse
gcgcggggagcgatgccctt

SEQ ID NO: 522903 - DNA, 20 bp, mouse
gaaggcgccgaggccgggta

SEQ ID NO: 522904 - DNA, 20 bp, mouse
ggccccggttccggtccgca

SEQ ID NO: 522905 - DNA, 20 bp, mouse
ggaaagacgaagctgcgccc

SEQ ID NO: 522906 - DNA, 20 bp, mouse
gacctgcagccaggtctgag

SEQ ID NO: 522907 - DNA, 20 bp, mouse
ggtacaatggctatggaaat

SEQ ID NO: 522908 - DNA, 20 bp, mouse
gcagaagggtacaatggcta

SEQ ID NO: 522909 - DNA, 20 bp, mouse
ggacctggctgcaggtacag

SEQ ID NO: 522910 - DNA, 20 bp, mouse
ggagccgtgtgagagcccag

SEQ ID NO: 522911 - DNA, 20 bp, mouse
gggagggagggaatattgga

SEQ ID NO: 522912 - DNA, 20 bp, mouse
gtcctctcagacctggctgc

SEQ ID NO: 522913 - DNA, 20 bp, mouse
gttccactgtacctgcagcc

SEQ ID NO: 522914 - DNA, 20 bp, mouse
gtcagtcaccatgcacacaa

SEQ ID NO: 522915 - DNA, 20 bp, mouse
ggtcaccatgcacacaatgg

SEQ ID NO: 522916 - DNA, 20 bp, mouse
gagtcagacgcagggacccg

SEQ ID NO: 522917 - DNA, 20 bp, mouse
gcgtggacacgctgaggcac

SEQ ID NO: 522918 - DNA, 20 bp, mouse
gacttcgccagtcagacgca

SEQ ID NO: 522919 - DNA, 20 bp, mouse
gtcagcggaacatagagata

SEQ ID NO: 522920 - DNA, 20 bp, mouse
gtggcatccagaccaggaga

SEQ ID NO: 522921 - DNA, 20 bp, mouse
ggcggaacatagagataggg

SEQ ID NO: 522922 - DNA, 20 bp, mouse
gggaccaacggcaccctgta

SEQ ID NO: 522923 - DNA, 20 bp, mouse
gtacagttggtgcagagtaa

SEQ ID NO: 522924 - DNA, 20 bp, mouse
ggcccctagaagatacaata

SEQ ID NO: 522925 - DNA, 20 bp, mouse
gtcggagactcagctagttt

SEQ ID NO: 522926 - DNA, 20 bp, mouse
gaagccggtgcgggcaggag

SEQ ID NO: 522927 - DNA, 20 bp, mouse
gtgggactggagatgcggac

SEQ ID NO: 522928 - DNA, 20 bp, mouse
gctgcccgcaccggcttcag

SEQ ID NO: 522929 - DNA, 20 bp, mouse
gtcaccgctgaagccggtgc

SEQ ID NO: 522930 - DNA, 20 bp, mouse
gtctctggagcagacaagta

SEQ ID NO: 522931 - DNA, 20 bp, mouse
gtagccccgccgccaggccc

SEQ ID NO: 522932 - DNA, 20 bp, mouse
gctggagcagacaagtaggg

SEQ ID NO: 522933 - DNA, 20 bp, mouse
gtcgcgacccgacccgaagg

SEQ ID NO: 522934 - DNA, 20 bp, mouse
gcgccaggcccggggtcacc

SEQ ID NO: 522935 - DNA, 20 bp, mouse
gaggcgtggtgaggccggcg

SEQ ID NO: 522936 - DNA, 20 bp, mouse
ggcagctgcgacaccattca

SEQ ID NO: 522937 - DNA, 20 bp, mouse
gctccgagcagcagtgacca

SEQ ID NO: 522938 - DNA, 20 bp, mouse
gacgaacactgggtgagtat

SEQ ID NO: 522939 - DNA, 20 bp, mouse
gagtcagaatccacacaagg

SEQ ID NO: 522940 - DNA, 20 bp, mouse
gacacggcctgcaacagtgg

SEQ ID NO: 522941 - DNA, 20 bp, mouse
gcgcagctgccctccttgtg

SEQ ID NO: 522942 - DNA, 20 bp, mouse
gggaaattaaagctacacgt

SEQ ID NO: 522943 - DNA, 20 bp, mouse
ggacaccattcatggcgagg

SEQ ID NO: 522944 - DNA, 20 bp, mouse
gacgtgggcaatacgaacac

SEQ ID NO: 522945 - DNA, 20 bp, mouse
gactgggtgagtatgggcga

SEQ ID NO: 522946 - DNA, 20 bp, mouse
gggcggatctaaagagatat

SEQ ID NO: 522947 - DNA, 20 bp, mouse
gaagagatattggtgtgact

SEQ ID NO: 522948 - DNA, 20 bp, mouse
gacacgcggtctctgaggtt

SEQ ID NO: 522949 - DNA, 20 bp, mouse
ggttgcagagtacttaccta

SEQ ID NO: 522950 - DNA, 20 bp, mouse
gcccggaagatagattcttg

SEQ ID NO: 522951 - DNA, 20 bp, mouse
gctctttagatccgccatga

SEQ ID NO: 522952 - DNA, 20 bp, mouse
gtctgctgctgactcattct

SEQ ID NO: 522953 - DNA, 20 bp, mouse
gattggtgtgactgggctct

SEQ ID NO: 522954 - DNA, 20 bp, mouse
gcagagtacttacctaagga

SEQ ID NO: 522955 - DNA, 20 bp, mouse
gttgctacacgcggtctctg

SEQ ID NO: 522956 - DNA, 20 bp, mouse
gaactcgccaggaagaccat

SEQ ID NO: 522957 - DNA, 20 bp, mouse
gaccatcggactcgacagta

SEQ ID NO: 522958 - DNA, 20 bp, mouse
gtcgagtccgatggtcttcc

SEQ ID NO: 522959 - DNA, 20 bp, mouse
gatcggactcgacagtaagg

SEQ ID NO: 522960 - DNA, 20 bp, mouse
gcactgaacctgaagctgga

SEQ ID NO: 522961 - DNA, 20 bp, mouse
gatccgcacccggaagtggt

SEQ ID NO: 522962 - DNA, 20 bp, mouse
gtccagcagtgagcccgctg

SEQ ID NO: 522963 - DNA, 20 bp, mouse
gcctgaaaccgagctccgag

SEQ ID NO: 522964 - DNA, 20 bp, mouse
gcctggcgagtttaaagtat

SEQ ID NO: 522965 - DNA, 20 bp, mouse
gaccgcagcgggctcactgc

SEQ ID NO: 522966 - DNA, 20 bp, mouse
ggcgagcgagtcctcaagga

SEQ ID NO: 522967 - DNA, 20 bp, mouse
gcccgcgcagaactcaatcc

SEQ ID NO: 522968 - DNA, 20 bp, mouse
gtggctgggcgagccggtgg

SEQ ID NO: 522969 - DNA, 20 bp, mouse
ggcgcagaactcaatcccgg

SEQ ID NO: 522970 - DNA, 20 bp, mouse
gttggagccccgggacatgg

SEQ ID NO: 522971 - DNA, 20 bp, mouse
ggctcgagaactaggtccgg

SEQ ID NO: 522972 - DNA, 20 bp, mouse
gcatggaggaagggcgatgg

SEQ ID NO: 522973 - DNA, 20 bp, mouse
ggcccgcgagcgagtcctca

SEQ ID NO: 522974 - DNA, 20 bp, mouse
gaccggccgccgggagcacg

SEQ ID NO: 522975 - DNA, 20 bp, mouse
ggaggctcgagaactaggtc

SEQ ID NO: 522976 - DNA, 20 bp, mouse
gagaggagctgactgaagac

SEQ ID NO: 522977 - DNA, 20 bp, mouse
gtgactgaagacaggtgagt

SEQ ID NO: 522978 - DNA, 20 bp, mouse
gtaagctcagtacaagtcca

SEQ ID NO: 522979 - DNA, 20 bp, mouse
gactgaccgtctctaggaag

SEQ ID NO: 522980 - DNA, 20 bp, mouse
ggacttgtactgagcttact

SEQ ID NO: 522981 - DNA, 20 bp, mouse
gccgagcactgaccgtctct

SEQ ID NO: 522982 - DNA, 20 bp, mouse
gcagctcctcttcctagaga

SEQ ID NO: 522983 - DNA, 20 bp, mouse
gatggtgattagccaaccct

SEQ ID NO: 522984 - DNA, 20 bp, mouse
gttctctcagtgcacatgta

SEQ ID NO: 522985 - DNA, 20 bp, mouse
gttaggatatgctaattgaa

SEQ ID NO: 522986 - DNA, 20 bp, mouse
gtacaggacaaaagtagacg

SEQ ID NO: 522987 - DNA, 20 bp, mouse
gggcaggtgagtgtaggttc

SEQ ID NO: 522988 - DNA, 20 bp, mouse
gttaaaagcttccttctcgg

SEQ ID NO: 522989 - DNA, 20 bp, mouse
gtgtgcctttgccaccgaga

SEQ ID NO: 522990 - DNA, 20 bp, mouse
gccaagggaagagcccatct

SEQ ID NO: 522991 - DNA, 20 bp, mouse
gtacaggttgccaccactaa

SEQ ID NO: 522992 - DNA, 20 bp, mouse
gggacaaaagtagacgaggc

SEQ ID NO: 522993 - DNA, 20 bp, mouse
gtggagactccatcaggcag

SEQ ID NO: 522994 - DNA, 20 bp, mouse
ggcttcagaaaggaaaccaa

SEQ ID NO: 522995 - DNA, 20 bp, mouse
gcctgggagtcacactgtca

SEQ ID NO: 522996 - DNA, 20 bp, mouse
gtgggctcctgagggttggg

SEQ ID NO: 522997 - DNA, 20 bp, mouse
ggcgctgggctcctgagggt

SEQ ID NO: 522998 - DNA, 20 bp, mouse
ggctgggcctgtgcagataa

SEQ ID NO: 522999 - DNA, 20 bp, mouse
ggcgccaaacgtgtgcaaag

SEQ ID NO: 523000 - DNA, 20 bp, mouse
gtttggcgctgggctcctga

SEQ ID NO: 523001 - DNA, 20 bp, mouse
ggaggaagccaggctgtcgg

SEQ ID NO: 523002 - DNA, 20 bp, mouse
ggcgccagcgggtaagaggg

SEQ ID NO: 523003 - DNA, 20 bp, mouse
gaaagctagaccaacctcag

SEQ ID NO: 523004 - DNA, 20 bp, mouse
gtctgcgccagcgggtaaga

SEQ ID NO: 523005 - DNA, 20 bp, mouse
ggctctgaggcccaacggga

SEQ ID NO: 523006 - DNA, 20 bp, mouse
gggctcggtgggagaggaac

SEQ ID NO: 523007 - DNA, 20 bp, mouse
gctcccaccgagccgggcct

SEQ ID NO: 523008 - DNA, 20 bp, mouse
gtagctgcagaacgttggcc

SEQ ID NO: 523009 - DNA, 20 bp, mouse
gcctattagctgcagaacgt

SEQ ID NO: 523010 - DNA, 20 bp, mouse
gtcggggcggcggaactcca

SEQ ID NO: 523011 - DNA, 20 bp, mouse
gcgcccaggcccggctcggt

SEQ ID NO: 523012 - DNA, 20 bp, mouse
gggaagtagctgggacctct

SEQ ID NO: 523013 - DNA, 20 bp, mouse
ggaggcgcccaggcccggct

SEQ ID NO: 523014 - DNA, 20 bp, mouse
gctgcagaacgttggccggg

SEQ ID NO: 523015 - DNA, 20 bp, mouse
gcgtggtggaagtttcgggg

SEQ ID NO: 523016 - DNA, 20 bp, mouse
gcatcgcaggcaggccaagt

SEQ ID NO: 523017 - DNA, 20 bp, mouse
gggccaagtaggctccgccg

SEQ ID NO: 523018 - DNA, 20 bp, mouse
gcagtcgtgagcaggcactg

SEQ ID NO: 523019 - DNA, 20 bp, mouse
gggcggagctccccgagatg

SEQ ID NO: 523020 - DNA, 20 bp, mouse
gtgccccggcggagcctact

SEQ ID NO: 523021 - DNA, 20 bp, mouse
gggtgttggtaccgcatcgc

SEQ ID NO: 523022 - DNA, 20 bp, mouse
gtccctcctgctgtctaact

SEQ ID NO: 523023 - DNA, 20 bp, mouse
gcccgagtctataggcaggg

SEQ ID NO: 523024 - DNA, 20 bp, mouse
gaatctgtacacacttcgtg

SEQ ID NO: 523025 - DNA, 20 bp, mouse
gagggccggcccgagtctat

SEQ ID NO: 523026 - DNA, 20 bp, mouse
gcagcagccaactcctccgg

SEQ ID NO: 523027 - DNA, 20 bp, mouse
gcttggattcgcgctccctg

SEQ ID NO: 523028 - DNA, 20 bp, mouse
gggattcgcgctccctgggg

SEQ ID NO: 523029 - DNA, 20 bp, mouse
gtcagagaccacgaccgcag

SEQ ID NO: 523030 - DNA, 20 bp, mouse
ggccagaacagcctccgctg

SEQ ID NO: 523031 - DNA, 20 bp, mouse
gctgaggcttgaagaactac

SEQ ID NO: 523032 - DNA, 20 bp, mouse
gaccacagctgggcgcactg

SEQ ID NO: 523033 - DNA, 20 bp, mouse
ggggcggagcgcagcgcctc

SEQ ID NO: 523034 - DNA, 20 bp, mouse
ggagaccacgaccgcagcgg

SEQ ID NO: 523035 - DNA, 20 bp, mouse
ggcgcgaatccaaggagcct

SEQ ID NO: 523036 - DNA, 20 bp, mouse
ggaggacctcgaccatgcag

SEQ ID NO: 523037 - DNA, 20 bp, mouse
gtgctgttggcactgatatt

SEQ ID NO: 523038 - DNA, 20 bp, mouse
gtgctcaccaagctccccga

SEQ ID NO: 523039 - DNA, 20 bp, mouse
gatggtcgaggtcctcactc

SEQ ID NO: 523040 - DNA, 20 bp, mouse
gccggtcagaccaccgctgt

SEQ ID NO: 523041 - DNA, 20 bp, mouse
gggctctccgctggcaccta

SEQ ID NO: 523042 - DNA, 20 bp, mouse
gcaggtcccctgcatggtcg

SEQ ID NO: 523043 - DNA, 20 bp, mouse
gagtgccaacagcaccatcc

SEQ ID NO: 523044 - DNA, 20 bp, mouse
gcggccaggcgggcagaagc

SEQ ID NO: 523045 - DNA, 20 bp, mouse
gaagccggcaccaaagccct

SEQ ID NO: 523046 - DNA, 20 bp, mouse
ggaaggtggcacacccaggg

SEQ ID NO: 523047 - DNA, 20 bp, mouse
gctatggatgccgccaggag

SEQ ID NO: 523048 - DNA, 20 bp, mouse
gagcagcaacagccatccgg

SEQ ID NO: 523049 - DNA, 20 bp, mouse
gatccggtggtccacatcac

SEQ ID NO: 523050 - DNA, 20 bp, mouse
gcaggtaagagggcccgggt

SEQ ID NO: 523051 - DNA, 20 bp, mouse
gcccgggcagagggactgta

SEQ ID NO: 523052 - DNA, 20 bp, mouse
gggcagcagcaacagccatc

SEQ ID NO: 523053 - DNA, 20 bp, mouse
ggagggcccgggttggaagg

SEQ ID NO: 523054 - DNA, 20 bp, mouse
gggcacacccaggggggacg

SEQ ID NO: 523055 - DNA, 20 bp, mouse
gcacagctatggatgccgcc

SEQ ID NO: 523056 - DNA, 20 bp, mouse
gttgcgcctgcgcataacct

SEQ ID NO: 523057 - DNA, 20 bp, mouse
gtccgcgcttaggcctcctt

SEQ ID NO: 523058 - DNA, 20 bp, mouse
gctaaacaccaggcatggag

SEQ ID NO: 523059 - DNA, 20 bp, mouse
gttaatggtgggttgaacag

SEQ ID NO: 523060 - DNA, 20 bp, mouse
gctggactactgctatacag

SEQ ID NO: 523061 - DNA, 20 bp, mouse
ggcgcaggcgcaagcgcagt

SEQ ID NO: 523062 - DNA, 20 bp, mouse
ggccgaaggaggcctaagcg

SEQ ID NO: 523063 - DNA, 20 bp, mouse
gatggagggggagccgaagg

SEQ ID NO: 523064 - DNA, 20 bp, mouse
gcgcaggaaccgtggtcctg

SEQ ID NO: 523065 - DNA, 20 bp, mouse
gttgccgcggagaagcgggt

SEQ ID NO: 523066 - DNA, 20 bp, mouse
ggcccaactgcaagccagag

SEQ ID NO: 523067 - DNA, 20 bp, mouse
gcaggcagagcaggctcccg

SEQ ID NO: 523068 - DNA, 20 bp, mouse
gagctccacaggccgccatg

SEQ ID NO: 523069 - DNA, 20 bp, mouse
ggcctatgcaggtacctgtc

SEQ ID NO: 523070 - DNA, 20 bp, mouse
gaagcagtgcaggaaggtcc

SEQ ID NO: 523071 - DNA, 20 bp, mouse
ggcctgacaggtacctgcat

SEQ ID NO: 523072 - DNA, 20 bp, mouse
gggatccccatggcggcctg

SEQ ID NO: 523073 - DNA, 20 bp, mouse
gtccactctggcttgcagtt

SEQ ID NO: 523074 - DNA, 20 bp, mouse
gggagcctgctctgcctgac

SEQ ID NO: 523075 - DNA, 20 bp, mouse
gctgcataggctgaatccaa

SEQ ID NO: 523076 - DNA, 20 bp, mouse
ggagcgcagtaggagaagga

SEQ ID NO: 523077 - DNA, 20 bp, mouse
gccgggagcgcagtaggaga

SEQ ID NO: 523078 - DNA, 20 bp, mouse
ggccccccgcgtgtgcaatg

SEQ ID NO: 523079 - DNA, 20 bp, mouse
gcccgtgccgggagcgcagt

SEQ ID NO: 523080 - DNA, 20 bp, mouse
gggcacgggccgcgcgcagg

SEQ ID NO: 523081 - DNA, 20 bp, mouse
gctcgtgtccctgccgccag

SEQ ID NO: 523082 - DNA, 20 bp, mouse
gccgcagtgttcgtgggatg

SEQ ID NO: 523083 - DNA, 20 bp, mouse
gtccgcattgcacacgcggg

SEQ ID NO: 523084 - DNA, 20 bp, mouse
gggggcgccgcagtgttcgt

SEQ ID NO: 523085 - DNA, 20 bp, mouse
ggagcatcccgggtgagtag

SEQ ID NO: 523086 - DNA, 20 bp, mouse
gcggtcccccatccagatgt

SEQ ID NO: 523087 - DNA, 20 bp, mouse
gggctccagacacccgctcc

SEQ ID NO: 523088 - DNA, 20 bp, mouse
gctcgctcggctcccggcct

SEQ ID NO: 523089 - DNA, 20 bp, mouse
ggggactctccgaaccgcag

SEQ ID NO: 523090 - DNA, 20 bp, mouse
gcggctcccggcgcctcgct

SEQ ID NO: 523091 - DNA, 20 bp, mouse
gccagcccggagcgggtgtc

SEQ ID NO: 523092 - DNA, 20 bp, mouse
gtgcagatcccgcagagcag

SEQ ID NO: 523093 - DNA, 20 bp, mouse
ggagaccacgcagctccccg

SEQ ID NO: 523094 - DNA, 20 bp, mouse
ggagccgggcgagctctgcg

SEQ ID NO: 523095 - DNA, 20 bp, mouse
ggcgccgcagagggaagggc

SEQ ID NO: 523096 - DNA, 20 bp, mouse
gagccagggacactatccgg

SEQ ID NO: 523097 - DNA, 20 bp, mouse
gtccagccagggacactatc

SEQ ID NO: 523098 - DNA, 20 bp, mouse
gtggctggacccagaaggtg

SEQ ID NO: 523099 - DNA, 20 bp, mouse
gcagaaggtgagggactctg

SEQ ID NO: 523100 - DNA, 20 bp, mouse
ggtccctggctggacccaga

SEQ ID NO: 523101 - DNA, 20 bp, mouse
gttcctccggatagtgtccc

SEQ ID NO: 523102 - DNA, 20 bp, mouse
gtccggaggaagatggaact

SEQ ID NO: 523103 - DNA, 20 bp, mouse
ggacactatccggaggaaga

SEQ ID NO: 523104 - DNA, 20 bp, mouse
ggctgtcccgatatccagat

SEQ ID NO: 523105 - DNA, 20 bp, mouse
ggttggagcctgcatcctgg

SEQ ID NO: 523106 - DNA, 20 bp, mouse
gccgccagccggtggatgtg

SEQ ID NO: 523107 - DNA, 20 bp, mouse
gacaacggcgggcatcggag

SEQ ID NO: 523108 - DNA, 20 bp, mouse
gcgggcggccggcacaacgg

SEQ ID NO: 523109 - DNA, 20 bp, mouse
gcgggcgccgccactcaccg

SEQ ID NO: 523110 - DNA, 20 bp, mouse
ggttgttgccgcacatccac

SEQ ID NO: 523111 - DNA, 20 bp, mouse
gttccgggcggccggcacaa

SEQ ID NO: 523112 - DNA, 20 bp, mouse
gcggctggcggacagtgcgt

SEQ ID NO: 523113 - DNA, 20 bp, mouse
ggcccggaaggccaccgccg

SEQ ID NO: 523114 - DNA, 20 bp, mouse
gcagtgcgtcggaagcggaa

SEQ ID NO: 523115 - DNA, 20 bp, mouse
gccggcacaacggcgggcat

SEQ ID NO: 523116 - DNA, 20 bp, mouse
ggtgcctgtgcgggagaaag

SEQ ID NO: 523117 - DNA, 20 bp, mouse
gctggatacctcactcccag

SEQ ID NO: 523118 - DNA, 20 bp, mouse
gagtgggagaccccattgtg

SEQ ID NO: 523119 - DNA, 20 bp, mouse
gagaatcgcccgaacggtct

SEQ ID NO: 523120 - DNA, 20 bp, mouse
gaaggggagaatcgcccgaa

SEQ ID NO: 523121 - DNA, 20 bp, mouse
ggtggcttccgagaccgttc

SEQ ID NO: 523122 - DNA, 20 bp, mouse
gcgaggctgcgagggtcccg

SEQ ID NO: 523123 - DNA, 20 bp, mouse
gtctcccctttctcccgcac

SEQ ID NO: 523124 - DNA, 20 bp, mouse
gaagcctccgccccacaatg

SEQ ID NO: 523125 - DNA, 20 bp, mouse
gtgggttcccgggactggaa

SEQ ID NO: 523126 - DNA, 20 bp, mouse
ggcggcaggtgaacagcgct

SEQ ID NO: 523127 - DNA, 20 bp, mouse
gtggcggaggagagatggca

SEQ ID NO: 523128 - DNA, 20 bp, mouse
gccgtgcaggaagatcagcg

SEQ ID NO: 523129 - DNA, 20 bp, mouse
gaggcactgtgtctcccggt

SEQ ID NO: 523130 - DNA, 20 bp, mouse
ggcgcggccccgtgacgcta

SEQ ID NO: 523131 - DNA, 20 bp, mouse
gttgtgtggtgtccccgacc

SEQ ID NO: 523132 - DNA, 20 bp, mouse
gagcgcccagggtcgcccga

SEQ ID NO: 523133 - DNA, 20 bp, mouse
ggacccgctcgctacagtag

SEQ ID NO: 523134 - DNA, 20 bp, mouse
gggacaccacacaacgcggc

SEQ ID NO: 523135 - DNA, 20 bp, mouse
ggggtcaagcacaccagcga

SEQ ID NO: 523136 - DNA, 20 bp, mouse
gcgaagccgtctccaagtaa

SEQ ID NO: 523137 - DNA, 20 bp, mouse
gtccaagtaagggcaaggcg

SEQ ID NO: 523138 - DNA, 20 bp, mouse
gccgtctccaagtaagggca

SEQ ID NO: 523139 - DNA, 20 bp, mouse
gcaggccgggccaaaccacc

SEQ ID NO: 523140 - DNA, 20 bp, mouse
gtccccgccttgcccttact

SEQ ID NO: 523141 - DNA, 20 bp, mouse
gcttcccagccggctcctgt

SEQ ID NO: 523142 - DNA, 20 bp, mouse
ggccgggccaaaccaccggg

SEQ ID NO: 523143 - DNA, 20 bp, mouse
gtgtatccagcaggtccagt

SEQ ID NO: 523144 - DNA, 20 bp, mouse
ggcccggtgtggccaaggct

SEQ ID NO: 523145 - DNA, 20 bp, mouse
gtctcctagcaaccccacac

SEQ ID NO: 523146 - DNA, 20 bp, mouse
gagtacctgcttcagcgtca

SEQ ID NO: 523147 - DNA, 20 bp, mouse
gcacacaggacacctccgcg

SEQ ID NO: 523148 - DNA, 20 bp, mouse
ggatgccgccatgttgccca

SEQ ID NO: 523149 - DNA, 20 bp, mouse
gtgcttcagcgtcagggctg

SEQ ID NO: 523150 - DNA, 20 bp, mouse
gttgcccacggaagctgctg

SEQ ID NO: 523151 - DNA, 20 bp, mouse
gtagcagctccgccctcggg

SEQ ID NO: 523152 - DNA, 20 bp, mouse
gccctcgggcaccctggtca

SEQ ID NO: 523153 - DNA, 20 bp, mouse
gtgatctctcagccccgcgg

SEQ ID NO: 523154 - DNA, 20 bp, mouse
gagcctcagcctcccgaggg

SEQ ID NO: 523155 - DNA, 20 bp, mouse
gagggggagcgcgaccacac

SEQ ID NO: 523156 - DNA, 20 bp, mouse
gctcctcgggaggacagtcg

SEQ ID NO: 523157 - DNA, 20 bp, mouse
ggtcgcgggctcgaacacca

SEQ ID NO: 523158 - DNA, 20 bp, mouse
gccccgggcggttcgaaagg

SEQ ID NO: 523159 - DNA, 20 bp, mouse
gcccaggctcgctcctcggg

SEQ ID NO: 523160 - DNA, 20 bp, mouse
gcgggcggttcgaaaggcgg

SEQ ID NO: 523161 - DNA, 20 bp, mouse
ggcggttcgaaaggcggagg

SEQ ID NO: 523162 - DNA, 20 bp, mouse
ggcccgcgactgtcctcccg

SEQ ID NO: 523163 - DNA, 20 bp, mouse
gcgcccccgggcggttcgaa

SEQ ID NO: 523164 - DNA, 20 bp, mouse
gggccgagccgtccagcccc

SEQ ID NO: 523165 - DNA, 20 bp, mouse
gtctcggccacgcccccggg

SEQ ID NO: 523166 - DNA, 20 bp, mouse
ggccgcaaagcgctggagtg

SEQ ID NO: 523167 - DNA, 20 bp, mouse
ggcccggaagccctcgccta

SEQ ID NO: 523168 - DNA, 20 bp, mouse
gtggaccccagacctgctgg

SEQ ID NO: 523169 - DNA, 20 bp, mouse
ggtctgagcaagctgtcgtc

SEQ ID NO: 523170 - DNA, 20 bp, mouse
gatggcgccagctcacgact

SEQ ID NO: 523171 - DNA, 20 bp, mouse
gggcatacttcaccaccagc

SEQ ID NO: 523172 - DNA, 20 bp, mouse
gttatagccgaggcccgcca

SEQ ID NO: 523173 - DNA, 20 bp, mouse
gacaaaggcgagctccaaga

SEQ ID NO: 523174 - DNA, 20 bp, mouse
gtggccagatgactccctgg

SEQ ID NO: 523175 - DNA, 20 bp, mouse
gctggacgagcccttcccgg

SEQ ID NO: 523176 - DNA, 20 bp, mouse
gccctcagaggcggagtcag

SEQ ID NO: 523177 - DNA, 20 bp, mouse
gtcagcccgccaaggtgaca

SEQ ID NO: 523178 - DNA, 20 bp, mouse
ggccatgggtcagcccgcca

SEQ ID NO: 523179 - DNA, 20 bp, mouse
gcagcggcgtggggagccat

SEQ ID NO: 523180 - DNA, 20 bp, mouse
gcctcccggccctgtcacct

SEQ ID NO: 523181 - DNA, 20 bp, mouse
gatgctgaggctcaagaccc

SEQ ID NO: 523182 - DNA, 20 bp, mouse
gagggaggcgaccccgaggg

SEQ ID NO: 523183 - DNA, 20 bp, mouse
gaccttggcgggctgaccca

SEQ ID NO: 523184 - DNA, 20 bp, mouse
gtcaagaccccggcaaggga

SEQ ID NO: 523185 - DNA, 20 bp, mouse
gccggccctgtcaccttggc

SEQ ID NO: 523186 - DNA, 20 bp, mouse
ggattcttacatgttgttca

SEQ ID NO: 523187 - DNA, 20 bp, mouse
gaggagataaccctgaggag

SEQ ID NO: 523188 - DNA, 20 bp, mouse
gctgcccccaaagataacaa

SEQ ID NO: 523189 - DNA, 20 bp, mouse
gaaacgcttgtggtagagag

SEQ ID NO: 523190 - DNA, 20 bp, mouse
gtggccctggtcaagtccag

SEQ ID NO: 523191 - DNA, 20 bp, mouse
gacaaaggcctccatttcaa

SEQ ID NO: 523192 - DNA, 20 bp, mouse
gagagaggggaccgttgaaa

SEQ ID NO: 523193 - DNA, 20 bp, mouse
gggggcaggagataaccctg

SEQ ID NO: 523194 - DNA, 20 bp, mouse
gtcttcatttatctttactc

SEQ ID NO: 523195 - DNA, 20 bp, mouse
ggaggggaccgttgaaatgg

SEQ ID NO: 523196 - DNA, 20 bp, mouse
gtggcgtccgccgggaaggc

SEQ ID NO: 523197 - DNA, 20 bp, mouse
gcgctcgcggtgtctccagt

SEQ ID NO: 523198 - DNA, 20 bp, mouse
gcagttggcgtccgccggga

SEQ ID NO: 523199 - DNA, 20 bp, mouse
gggcctcccacgctcctccg

SEQ ID NO: 523200 - DNA, 20 bp, mouse
gcccccgagtccccgcccaa

SEQ ID NO: 523201 - DNA, 20 bp, mouse
gcgcggctcacccgccttcc

SEQ ID NO: 523202 - DNA, 20 bp, mouse
gccgcgctgcgcgggccctt

SEQ ID NO: 523203 - DNA, 20 bp, mouse
gccgcgccgcggaggagcgt

SEQ ID NO: 523204 - DNA, 20 bp, mouse
gctccgcggcgcggcaacta

SEQ ID NO: 523205 - DNA, 20 bp, mouse
gggcgggctggggattaccg

SEQ ID NO: 523206 - DNA, 20 bp, mouse
gaagcgtggaacatcatccc

SEQ ID NO: 523207 - DNA, 20 bp, mouse
gacgcttgcgtcgcgcgaac

SEQ ID NO: 523208 - DNA, 20 bp, mouse
ggcgctggaggcgggtcttc

SEQ ID NO: 523209 - DNA, 20 bp, mouse
gggaaatgcaggccccctca

SEQ ID NO: 523210 - DNA, 20 bp, mouse
gcgcctccagcgccctgagg

SEQ ID NO: 523211 - DNA, 20 bp, mouse
ggaggcgtcagggatctcag

SEQ ID NO: 523212 - DNA, 20 bp, mouse
gatgtggagccggaatttca

SEQ ID NO: 523213 - DNA, 20 bp, mouse
gtggagccggaatttcaggg

SEQ ID NO: 523214 - DNA, 20 bp, mouse
ggcctcgctccacatcagga

SEQ ID NO: 523215 - DNA, 20 bp, mouse
ggatgtggagcgaggcgtca

SEQ ID NO: 523216 - DNA, 20 bp, mouse
gcaggcgagagatccgccat

SEQ ID NO: 523217 - DNA, 20 bp, mouse
gctgcgccggccctgcggga

SEQ ID NO: 523218 - DNA, 20 bp, mouse
gcgagggccggtgcgcacgg

SEQ ID NO: 523219 - DNA, 20 bp, mouse
ggcaccaagacccgctcgta

SEQ ID NO: 523220 - DNA, 20 bp, mouse
ggcggacccggtgctccaca

SEQ ID NO: 523221 - DNA, 20 bp, mouse
gcgatgacgccggcgcccag

SEQ ID NO: 523222 - DNA, 20 bp, mouse
gggcgccgagctcgccaagg

SEQ ID NO: 523223 - DNA, 20 bp, mouse
gagggcatcgcgctcaagta

SEQ ID NO: 523224 - DNA, 20 bp, mouse
gtcgcctgcgccggccctgc

SEQ ID NO: 523225 - DNA, 20 bp, mouse
gcgagcgccatgtggagcac

SEQ ID NO: 523226 - DNA, 20 bp, mouse
gcagaagcggacccagacac

SEQ ID NO: 523227 - DNA, 20 bp, mouse
ggtgcggaaggcggggacgg

SEQ ID NO: 523228 - DNA, 20 bp, mouse
gcgcaggtttgcggacgtgg

SEQ ID NO: 523229 - DNA, 20 bp, mouse
gcggctgtcggtgcggaagg

SEQ ID NO: 523230 - DNA, 20 bp, mouse
gacaccggagaacctagagt

SEQ ID NO: 523231 - DNA, 20 bp, mouse
gcctgctagaggacaggtga

SEQ ID NO: 523232 - DNA, 20 bp, mouse
ggctagaggacaggtgacgg

SEQ ID NO: 523233 - DNA, 20 bp, mouse
gaggcagaatggcccggaaa

SEQ ID NO: 523234 - DNA, 20 bp, mouse
gcgtcatcgcgtagagtagg

SEQ ID NO: 523235 - DNA, 20 bp, mouse
ggtgcgtcatcgcgtagagt

SEQ ID NO: 523236 - DNA, 20 bp, mouse
gggagcgaggtacccgaacc

SEQ ID NO: 523237 - DNA, 20 bp, mouse
gtctgctgggttgacttggg

SEQ ID NO: 523238 - DNA, 20 bp, mouse
gggtacccgaacctggagca

SEQ ID NO: 523239 - DNA, 20 bp, mouse
gcaatcggcgggcgcggtgg

SEQ ID NO: 523240 - DNA, 20 bp, mouse
ggcagaccctgctccaggtt

SEQ ID NO: 523241 - DNA, 20 bp, mouse
gcactgagcccacagtgaca

SEQ ID NO: 523242 - DNA, 20 bp, mouse
ggaccagagggagatacctg

SEQ ID NO: 523243 - DNA, 20 bp, mouse
ggcggtgaagcctgggagcg

SEQ ID NO: 523244 - DNA, 20 bp, mouse
gcgcggtggcggtgaagcct

SEQ ID NO: 523245 - DNA, 20 bp, mouse
ggtgacagggccagaagccc

SEQ ID NO: 523246 - DNA, 20 bp, mouse
gcgcgcggcggaccacagag

SEQ ID NO: 523247 - DNA, 20 bp, mouse
ggcggcggaccacagagcgg

SEQ ID NO: 523248 - DNA, 20 bp, mouse
gggagaatcccgactcacca

SEQ ID NO: 523249 - DNA, 20 bp, mouse
gagtcgggattctcctgcac

SEQ ID NO: 523250 - DNA, 20 bp, mouse
gcctctaaaggagcccgctg

SEQ ID NO: 523251 - DNA, 20 bp, mouse
gccgcgctaagggaacgggg

SEQ ID NO: 523252 - DNA, 20 bp, mouse
ggggattctcctgcaccggc

SEQ ID NO: 523253 - DNA, 20 bp, mouse
gcgagaccctgaccctctaa

SEQ ID NO: 523254 - DNA, 20 bp, mouse
ggcggaggtaaagaccgcag

SEQ ID NO: 523255 - DNA, 20 bp, mouse
gctgctgggaaggaccgggc

SEQ ID NO: 523256 - DNA, 20 bp, mouse
gctacacggaggctacacaa

SEQ ID NO: 523257 - DNA, 20 bp, mouse
gcattgtgcagatccctccg

SEQ ID NO: 523258 - DNA, 20 bp, mouse
gtggctggccacccgcagta

SEQ ID NO: 523259 - DNA, 20 bp, mouse
gagatccctccggggcactg

SEQ ID NO: 523260 - DNA, 20 bp, mouse
gccagccacagtgccccgga

SEQ ID NO: 523261 - DNA, 20 bp, mouse
gtgcctagtggtccaaatag

SEQ ID NO: 523262 - DNA, 20 bp, mouse
gctgtctcccttactgcggg

SEQ ID NO: 523263 - DNA, 20 bp, mouse
gagaggcgaggagtaacacc

SEQ ID NO: 523264 - DNA, 20 bp, mouse
gagggcttgggaagcgtcca

SEQ ID NO: 523265 - DNA, 20 bp, mouse
gcatctgtctcccttactgc

SEQ ID NO: 523266 - DNA, 20 bp, mouse
gcgattgtagaccttggcct

SEQ ID NO: 523267 - DNA, 20 bp, mouse
gcgctcagaacagggacagg

SEQ ID NO: 523268 - DNA, 20 bp, mouse
ggctgcagcatacactatca

SEQ ID NO: 523269 - DNA, 20 bp, mouse
gtcacaacgattgtagacct

SEQ ID NO: 523270 - DNA, 20 bp, mouse
ggtcctgtgttgccttagca

SEQ ID NO: 523271 - DNA, 20 bp, mouse
gatggaatggatggctaccg

SEQ ID NO: 523272 - DNA, 20 bp, mouse
ggtctacaatcgttgtgagt

SEQ ID NO: 523273 - DNA, 20 bp, mouse
gggctaccgtggtgtcaagc

SEQ ID NO: 523274 - DNA, 20 bp, mouse
gtgccatgctaaggcaacac

SEQ ID NO: 523275 - DNA, 20 bp, mouse
gtcagcagaccatgagaaag

SEQ ID NO: 523276 - DNA, 20 bp, mouse
gatcgctcagaacagggaca

SEQ ID NO: 523277 - DNA, 20 bp, mouse
gagactcaacatgagtaagg

SEQ ID NO: 523278 - DNA, 20 bp, mouse
gcatgtcagtccaggatctc

SEQ ID NO: 523279 - DNA, 20 bp, mouse
ggagagtcagccagagatcc

SEQ ID NO: 523280 - DNA, 20 bp, mouse
gactgcagcatacactgtca

SEQ ID NO: 523281 - DNA, 20 bp, mouse
ggaagggacattgtgtgcca

SEQ ID NO: 523282 - DNA, 20 bp, mouse
ggtcttcacttctcttaccg

SEQ ID NO: 523283 - DNA, 20 bp, mouse
gttcagactcaacatgagta

SEQ ID NO: 523284 - DNA, 20 bp, mouse
gtcacaacgttcatagacct

SEQ ID NO: 523285 - DNA, 20 bp, mouse
gatggaatggctggctacta

SEQ ID NO: 523286 - DNA, 20 bp, mouse
ggaatcaggaatggcttcac

SEQ ID NO: 523287 - DNA, 20 bp, mouse
ggaagtcctggagttagtga

SEQ ID NO: 523288 - DNA, 20 bp, mouse
gggcttcacgggattcagga

SEQ ID NO: 523289 - DNA, 20 bp, mouse
gaggctctagggagaagtcc

SEQ ID NO: 523290 - DNA, 20 bp, mouse
gctggcagacagctcaagac

SEQ ID NO: 523291 - DNA, 20 bp, mouse
gcgtgtgccttgtgagaatc

SEQ ID NO: 523292 - DNA, 20 bp, mouse
ggaatggcttcacgggattc

SEQ ID NO: 523293 - DNA, 20 bp, mouse
gttcctttgccaaggctcta

SEQ ID NO: 523294 - DNA, 20 bp, mouse
ggtgatccttcactaactcc

SEQ ID NO: 523295 - DNA, 20 bp, mouse
ggcacagtatatcaccatat

SEQ ID NO: 523296 - DNA, 20 bp, mouse
gcccgcatcggagagccgag

SEQ ID NO: 523297 - DNA, 20 bp, mouse
ggagcccagcgtccccgcat

SEQ ID NO: 523298 - DNA, 20 bp, mouse
gtagctagcgagcatcctct

SEQ ID NO: 523299 - DNA, 20 bp, mouse
gtgcgggcgcggggaacact

SEQ ID NO: 523300 - DNA, 20 bp, mouse
ggaagggccacagctttcca

SEQ ID NO: 523301 - DNA, 20 bp, mouse
gtggccggcgcagctcgtga

SEQ ID NO: 523302 - DNA, 20 bp, mouse
gtcctctcggctctccgatg

SEQ ID NO: 523303 - DNA, 20 bp, mouse
ggagcacagagtcccgctag

SEQ ID NO: 523304 - DNA, 20 bp, mouse
gccctggagccgaagactgg

SEQ ID NO: 523305 - DNA, 20 bp, mouse
ggcggtagactaggaaggag

SEQ ID NO: 523306 - DNA, 20 bp, mouse
gggccagagagtgcttggta

SEQ ID NO: 523307 - DNA, 20 bp, mouse
ggtgcttggtaaggaagagg

SEQ ID NO: 523308 - DNA, 20 bp, mouse
gagagtgcttggtaaggaag

SEQ ID NO: 523309 - DNA, 20 bp, mouse
ggagaactattagccagatg

SEQ ID NO: 523310 - DNA, 20 bp, mouse
gagcactctctggccccatc

SEQ ID NO: 523311 - DNA, 20 bp, mouse
gcccaaagggaatccctgag

SEQ ID NO: 523312 - DNA, 20 bp, mouse
gctgcgagctagggccagag

SEQ ID NO: 523313 - DNA, 20 bp, mouse
ggttctccttcgtctcaaga

SEQ ID NO: 523314 - DNA, 20 bp, mouse
gcagaatgcacctcagagat

SEQ ID NO: 523315 - DNA, 20 bp, mouse
gacatgccttcttgagacga

SEQ ID NO: 523316 - DNA, 20 bp, mouse
gcgcccgctagcggatccca

SEQ ID NO: 523317 - DNA, 20 bp, mouse
gtcccagggtttggaaccag

SEQ ID NO: 523318 - DNA, 20 bp, mouse
gcggaagtgcgcgaatccag

SEQ ID NO: 523319 - DNA, 20 bp, mouse
gcagacgcacgagaaggcaa

SEQ ID NO: 523320 - DNA, 20 bp, mouse
gcggcaggcggggatcggga

SEQ ID NO: 523321 - DNA, 20 bp, mouse
ggctagcggatcccagggtt

SEQ ID NO: 523322 - DNA, 20 bp, mouse
gcatgcggtccgccaggccg

SEQ ID NO: 523323 - DNA, 20 bp, mouse
gccggggagtcaggtaggcg

SEQ ID NO: 523324 - DNA, 20 bp, mouse
gcctacctgactccccggcc

SEQ ID NO: 523325 - DNA, 20 bp, mouse
gtccgccaggccggggagtc

SEQ ID NO: 523326 - DNA, 20 bp, mouse
gccgaccaggacactcacca

SEQ ID NO: 523327 - DNA, 20 bp, mouse
gaccaggacactcaccatgg

SEQ ID NO: 523328 - DNA, 20 bp, mouse
gtgagtgtcctggtcgggag

SEQ ID NO: 523329 - DNA, 20 bp, mouse
ggcggatccgacaggaaaca

SEQ ID NO: 523330 - DNA, 20 bp, mouse
gtggtggcggcggatccgac

SEQ ID NO: 523331 - DNA, 20 bp, mouse
gaccggggcctgaggaacgg

SEQ ID NO: 523332 - DNA, 20 bp, mouse
gggctgggcctctcccgacc

SEQ ID NO: 523333 - DNA, 20 bp, mouse
gaacagggaggccggcaccg

SEQ ID NO: 523334 - DNA, 20 bp, mouse
gaggcccagccggggtgcgg

SEQ ID NO: 523335 - DNA, 20 bp, mouse
ggccgacgtgactccctccc

SEQ ID NO: 523336 - DNA, 20 bp, mouse
ggcctatccagcctgaacaa

SEQ ID NO: 523337 - DNA, 20 bp, mouse
gatccagcctgaacaaggga

SEQ ID NO: 523338 - DNA, 20 bp, mouse
gcgtgagtcctgcaacctgg

SEQ ID NO: 523339 - DNA, 20 bp, mouse
gcaaggccccggacccaatg

SEQ ID NO: 523340 - DNA, 20 bp, mouse
gggccgtgagtcctgcaacc

SEQ ID NO: 523341 - DNA, 20 bp, mouse
gcccggtacgacagtgtaca

SEQ ID NO: 523342 - DNA, 20 bp, mouse
gaccgcccgggcagagccaa

SEQ ID NO: 523343 - DNA, 20 bp, mouse
gcctgaaggcactggtagta

SEQ ID NO: 523344 - DNA, 20 bp, mouse
gagcctgaacaagggatggc

SEQ ID NO: 523345 - DNA, 20 bp, mouse
gcgccctgtgacgaattcgt

SEQ ID NO: 523346 - DNA, 20 bp, mouse
gggccagggacccagcgcaa

SEQ ID NO: 523347 - DNA, 20 bp, mouse
gagagcccgccagctcgtcc

SEQ ID NO: 523348 - DNA, 20 bp, mouse
gccagagcgcccggacgagc

SEQ ID NO: 523349 - DNA, 20 bp, mouse
gagcgcccggacgagctggc

SEQ ID NO: 523350 - DNA, 20 bp, mouse
ggcgcaagggccagagcgcc

SEQ ID NO: 523351 - DNA, 20 bp, mouse
ggctatccccaaggcggagg

SEQ ID NO: 523352 - DNA, 20 bp, mouse
gggtaaggtacgggtaccca

SEQ ID NO: 523353 - DNA, 20 bp, mouse
gtttcggactgtgagcttgt

SEQ ID NO: 523354 - DNA, 20 bp, mouse
gtgtagaccctgcacgaagg

SEQ ID NO: 523355 - DNA, 20 bp, mouse
gagctgtagaccctgcacga

SEQ ID NO: 523356 - DNA, 20 bp, mouse
gggccgccccagcactccac

SEQ ID NO: 523357 - DNA, 20 bp, mouse
gcgagccgggcagctccgag

SEQ ID NO: 523358 - DNA, 20 bp, mouse
ggcgcgcctgtggagtgctg

SEQ ID NO: 523359 - DNA, 20 bp, mouse
ggccctgaggtcagagagtt

SEQ ID NO: 523360 - DNA, 20 bp, mouse
gggccgcgcgcgggctggag

SEQ ID NO: 523361 - DNA, 20 bp, mouse
gcagcccgcgcgcggccact

SEQ ID NO: 523362 - DNA, 20 bp, mouse
gggaaggagcggactattgt

SEQ ID NO: 523363 - DNA, 20 bp, mouse
ggtcaagcaggatccagtct

SEQ ID NO: 523364 - DNA, 20 bp, mouse
gagcagcgcggcggaggtga

SEQ ID NO: 523365 - DNA, 20 bp, mouse
gtgagcatggagcagcgcgg

SEQ ID NO: 523366 - DNA, 20 bp, mouse
ggagaagtagagttctatca

SEQ ID NO: 523367 - DNA, 20 bp, mouse
gtctatcacggcgaagaaat

SEQ ID NO: 523368 - DNA, 20 bp, mouse
ggcgggagccgggccaaaaa

SEQ ID NO: 523369 - DNA, 20 bp, mouse
gcgggccaaaaagggagcag

SEQ ID NO: 523370 - DNA, 20 bp, mouse
gtacttctccagccggctcc

SEQ ID NO: 523371 - DNA, 20 bp, mouse
ggcaggcgaaacaacagcaa

SEQ ID NO: 523372 - DNA, 20 bp, mouse
gggcgaagaaataggcacgc

SEQ ID NO: 523373 - DNA, 20 bp, mouse
gttcccgcaggtcctcactt

SEQ ID NO: 523374 - DNA, 20 bp, mouse
gcgcgtcttgggatgaggaa

SEQ ID NO: 523375 - DNA, 20 bp, mouse
gggtaccctagctgtcccaa

SEQ ID NO: 523376 - DNA, 20 bp, mouse
ggcctctgcgccggactctg

SEQ ID NO: 523377 - DNA, 20 bp, mouse
ggcctcagagtccggcgcag

SEQ ID NO: 523378 - DNA, 20 bp, mouse
gttcgggctgcgccagagag

SEQ ID NO: 523379 - DNA, 20 bp, mouse
gagaacctggaggggcaccc

SEQ ID NO: 523380 - DNA, 20 bp, mouse
gagagcgggacagctagcgc

SEQ ID NO: 523381 - DNA, 20 bp, mouse
ggcccgaagcccgccccaca

SEQ ID NO: 523382 - DNA, 20 bp, mouse
gggtgtctgagcctctgcgc

SEQ ID NO: 523383 - DNA, 20 bp, mouse
ggatgaggccgatgatgtca

SEQ ID NO: 523384 - DNA, 20 bp, mouse
gccaaccgcggagacctctg

SEQ ID NO: 523385 - DNA, 20 bp, mouse
gccgcgccgcgcgccctgtg

SEQ ID NO: 523386 - DNA, 20 bp, mouse
gctataagagaggaactctg

SEQ ID NO: 523387 - DNA, 20 bp, mouse
gacttctgagacggagtggt

SEQ ID NO: 523388 - DNA, 20 bp, mouse
ggggaacttctgagacggag

SEQ ID NO: 523389 - DNA, 20 bp, mouse
ggactcctgaaggaacatga

SEQ ID NO: 523390 - DNA, 20 bp, mouse
gggggaggtccctataagag

SEQ ID NO: 523391 - DNA, 20 bp, mouse
gtgagggtgctacctgaaga

SEQ ID NO: 523392 - DNA, 20 bp, mouse
gtgaggtgaccatatctgag

SEQ ID NO: 523393 - DNA, 20 bp, mouse
gacctcagatgccttcccca

SEQ ID NO: 523394 - DNA, 20 bp, mouse
gcccagaaagagactcctga

SEQ ID NO: 523395 - DNA, 20 bp, mouse
ggaacctaagtcgctcactt

SEQ ID NO: 523396 - DNA, 20 bp, mouse
gcgcatacggggcactggag

SEQ ID NO: 523397 - DNA, 20 bp, mouse
ggcgagtccgcgccgagcat

SEQ ID NO: 523398 - DNA, 20 bp, mouse
ggagctcagagtccgatgct

SEQ ID NO: 523399 - DNA, 20 bp, mouse
gggaggaggcggcgcatacg

SEQ ID NO: 523400 - DNA, 20 bp, mouse
ggagaaggcaggctcaggag

SEQ ID NO: 523401 - DNA, 20 bp, mouse
ggggcactggagcggctggt

SEQ ID NO: 523402 - DNA, 20 bp, mouse
gcagagtccgatgctcggcg

SEQ ID NO: 523403 - DNA, 20 bp, mouse
gtacggggcactggagcggc

SEQ ID NO: 523404 - DNA, 20 bp, mouse
gcggccaccccggcaccccc

SEQ ID NO: 523405 - DNA, 20 bp, mouse
gtgcgcgggtcgcaccgact

SEQ ID NO: 523406 - DNA, 20 bp, mouse
gatcctgctagggagcccta

SEQ ID NO: 523407 - DNA, 20 bp, mouse
gacacgccgcggagtctagt

SEQ ID NO: 523408 - DNA, 20 bp, mouse
gcacggccaagcgagagtcc

SEQ ID NO: 523409 - DNA, 20 bp, mouse
ggagccctagggaggacttg

SEQ ID NO: 523410 - DNA, 20 bp, mouse
gctggctggagatcctgcta

SEQ ID NO: 523411 - DNA, 20 bp, mouse
gcggagaacgccagacttct

SEQ ID NO: 523412 - DNA, 20 bp, mouse
gttgcctcaagtcctcccta

SEQ ID NO: 523413 - DNA, 20 bp, mouse
gcgtgacacgtgagtgttgg

SEQ ID NO: 523414 - DNA, 20 bp, mouse
gctcagagacacattcttgg

SEQ ID NO: 523415 - DNA, 20 bp, mouse
gactgaaggaggtgcggacc

SEQ ID NO: 523416 - DNA, 20 bp, mouse
gccgctcacggccgccgcca

SEQ ID NO: 523417 - DNA, 20 bp, mouse
gtcacggccgccgccaggga

SEQ ID NO: 523418 - DNA, 20 bp, mouse
ggggaactgctagcaatggg

SEQ ID NO: 523419 - DNA, 20 bp, mouse
ggcccgggaactgctagcaa

SEQ ID NO: 523420 - DNA, 20 bp, mouse
gtcctcctggagggaatctc

SEQ ID NO: 523421 - DNA, 20 bp, mouse
ggccagagattccctccagg

SEQ ID NO: 523422 - DNA, 20 bp, mouse
gttgtgcccgggccgagtcg

SEQ ID NO: 523423 - DNA, 20 bp, mouse
gttggccagagattccctcc

SEQ ID NO: 523424 - DNA, 20 bp, mouse
gctgctgacagtcctcctgg

SEQ ID NO: 523425 - DNA, 20 bp, mouse
ggtcccactgcgtccccctt

SEQ ID NO: 523426 - DNA, 20 bp, mouse
gctgctggcgggagggaaaa

SEQ ID NO: 523427 - DNA, 20 bp, mouse
ggccagcagaaaaacagcta

SEQ ID NO: 523428 - DNA, 20 bp, mouse
gttcctggatggtcactgtc

SEQ ID NO: 523429 - DNA, 20 bp, mouse
ggagctaatgtaacctggta

SEQ ID NO: 523430 - DNA, 20 bp, mouse
ggctgtgtacaccgtagcta

SEQ ID NO: 523431 - DNA, 20 bp, mouse
gacccaggcccaatgatcag

SEQ ID NO: 523432 - DNA, 20 bp, mouse
gagagccagagggtttgtcc

SEQ ID NO: 523433 - DNA, 20 bp, mouse
gaaaacagctatgggaggct

SEQ ID NO: 523434 - DNA, 20 bp, mouse
gagctccaggacaaaccctc

SEQ ID NO: 523435 - DNA, 20 bp, mouse
gagaagcacgcagggataag

SEQ ID NO: 523436 - DNA, 20 bp, mouse
ggtgtgcagagtgtgcgtcg

SEQ ID NO: 523437 - DNA, 20 bp, mouse
ggtgtgcaggactgttaatc

SEQ ID NO: 523438 - DNA, 20 bp, mouse
gtaggctgtgggatccaatg

SEQ ID NO: 523439 - DNA, 20 bp, mouse
gctagcgctggagccaactt

SEQ ID NO: 523440 - DNA, 20 bp, mouse
gtgtcagaagaagctgctgt

SEQ ID NO: 523441 - DNA, 20 bp, mouse
ggcgctggagccaacttcgg

SEQ ID NO: 523442 - DNA, 20 bp, mouse
ggctgcagctagtccgagag

SEQ ID NO: 523443 - DNA, 20 bp, mouse
gtagcgggtcttaaagtgaa

SEQ ID NO: 523444 - DNA, 20 bp, mouse
gtctgacacggattctttag

SEQ ID NO: 523445 - DNA, 20 bp, mouse
gactcgtgtggaaattataa

SEQ ID NO: 523446 - DNA, 20 bp, mouse
gcaggccgcagcgcactctg

SEQ ID NO: 523447 - DNA, 20 bp, mouse
gtcccccaaaaggaaagtga

SEQ ID NO: 523448 - DNA, 20 bp, mouse
gctgtacttcgctgctctcc

SEQ ID NO: 523449 - DNA, 20 bp, mouse
gcaaacctcagagtgcgctg

SEQ ID NO: 523450 - DNA, 20 bp, mouse
ggaaggcgtccaaccatcga

SEQ ID NO: 523451 - DNA, 20 bp, mouse
gactaggttaccaagaggct

SEQ ID NO: 523452 - DNA, 20 bp, mouse
gatctctcccgcacaaggag

SEQ ID NO: 523453 - DNA, 20 bp, mouse
gaaaaaactaggttaccaag

SEQ ID NO: 523454 - DNA, 20 bp, mouse
gtagcacgctgagaccgcgc

SEQ ID NO: 523455 - DNA, 20 bp, mouse
ggaccggctgatgatatagc

SEQ ID NO: 523456 - DNA, 20 bp, mouse
gcacgagctttagggagata

SEQ ID NO: 523457 - DNA, 20 bp, mouse
gatacacgcagagaaaagta

SEQ ID NO: 523458 - DNA, 20 bp, mouse
gtctaaggtcagcaggtgag

SEQ ID NO: 523459 - DNA, 20 bp, mouse
ggactgacagacaacagagc

SEQ ID NO: 523460 - DNA, 20 bp, mouse
gcagtctttcggatcaaaga

SEQ ID NO: 523461 - DNA, 20 bp, mouse
gtccctcctggagtaaaact

SEQ ID NO: 523462 - DNA, 20 bp, mouse
gaggcccaaccagtcagact

SEQ ID NO: 523463 - DNA, 20 bp, mouse
ggccttgctcagacatgaac

SEQ ID NO: 523464 - DNA, 20 bp, mouse
ggttcccagtctgactggtt

SEQ ID NO: 523465 - DNA, 20 bp, mouse
ggtgatactcacgagcttta

SEQ ID NO: 523466 - DNA, 20 bp, mouse
gttggtcgaagtagatctga

SEQ ID NO: 523467 - DNA, 20 bp, mouse
gatttctcgtggccaacaat

SEQ ID NO: 523468 - DNA, 20 bp, mouse
gcagtgaaagagcctattgt

SEQ ID NO: 523469 - DNA, 20 bp, mouse
gtaagaaagcacactaatag

SEQ ID NO: 523470 - DNA, 20 bp, mouse
gtacttcgaccaatttctcg

SEQ ID NO: 523471 - DNA, 20 bp, mouse
gaaataattaccagtacata

SEQ ID NO: 523472 - DNA, 20 bp, mouse
gctggttagttacacttgct

SEQ ID NO: 523473 - DNA, 20 bp, mouse
gttttgatagcaccttttag

SEQ ID NO: 523474 - DNA, 20 bp, mouse
gtcagagactagcaaatacc

SEQ ID NO: 523475 - DNA, 20 bp, mouse
gtgattttttgagcgtttcg

SEQ ID NO: 523476 - DNA, 20 bp, mouse
gccgggtgcgagcggactga

SEQ ID NO: 523477 - DNA, 20 bp, mouse
gcggaaacgcgagccgggac

SEQ ID NO: 523478 - DNA, 20 bp, mouse
gcgagcgcgactgccgggcc

SEQ ID NO: 523479 - DNA, 20 bp, mouse
gggaccggcggagcgcgagc

SEQ ID NO: 523480 - DNA, 20 bp, mouse
gaaacgcgagccgggaccgg

SEQ ID NO: 523481 - DNA, 20 bp, mouse
gggagccgagcgcgactgcc

SEQ ID NO: 523482 - DNA, 20 bp, mouse
gtcccggcccagccccgcac

SEQ ID NO: 523483 - DNA, 20 bp, mouse
ggatctgcgtccgtctcgcc

SEQ ID NO: 523484 - DNA, 20 bp, mouse
gatgtgctggagcgctacaa

SEQ ID NO: 523485 - DNA, 20 bp, mouse
gccgccgccgaaccgcacaa

SEQ ID NO: 523486 - DNA, 20 bp, mouse
gcgccgagcggccgggccag

SEQ ID NO: 523487 - DNA, 20 bp, mouse
gggcacagctgcgcgcggcg

SEQ ID NO: 523488 - DNA, 20 bp, mouse
gcgctgcagagccaagtgtc

SEQ ID NO: 523489 - DNA, 20 bp, mouse
gtgccaggcggccggacact

SEQ ID NO: 523490 - DNA, 20 bp, mouse
gccgcgggccacccgccgag

SEQ ID NO: 523491 - DNA, 20 bp, mouse
gatgagcaggcggtgccggg

SEQ ID NO: 523492 - DNA, 20 bp, mouse
gagccaagtgtccggccgcc

SEQ ID NO: 523493 - DNA, 20 bp, mouse
ggaccgcacgcactgccacg

SEQ ID NO: 523494 - DNA, 20 bp, mouse
gttcgcggccatggccaggg

SEQ ID NO: 523495 - DNA, 20 bp, mouse
ggctcgcccagtgccaccag

SEQ ID NO: 523496 - DNA, 20 bp, mouse
gacctagttgacaggctctg

SEQ ID NO: 523497 - DNA, 20 bp, mouse
ggcaccggccgagagagaga

SEQ ID NO: 523498 - DNA, 20 bp, mouse
gcggcggccgcctggcagag

SEQ ID NO: 523499 - DNA, 20 bp, mouse
gctctgaggtgctgctgtgg

SEQ ID NO: 523500 - DNA, 20 bp, mouse
ggccgcctggcagagcgggc

SEQ ID NO: 523501 - DNA, 20 bp, mouse
ggaggcgtgacctagttgac

SEQ ID NO: 523502 - DNA, 20 bp, mouse
gacgcggccgcgggcaggag

SEQ ID NO: 523503 - DNA, 20 bp, mouse
gagagcgggcgggtcgaggg

SEQ ID NO: 523504 - DNA, 20 bp, mouse
gtgaggtgctgctgtggcgg

SEQ ID NO: 523505 - DNA, 20 bp, mouse
gggcagagcgggcgggtcga

SEQ ID NO: 523506 - DNA, 20 bp, mouse
ggcaccgggctcctcaactg

SEQ ID NO: 523507 - DNA, 20 bp, mouse
gactgaggtaagggacccgg

SEQ ID NO: 523508 - DNA, 20 bp, mouse
gggctcctcaactgaggtaa

SEQ ID NO: 523509 - DNA, 20 bp, mouse
ggggtcccttacctcagttg

SEQ ID NO: 523510 - DNA, 20 bp, mouse
gatagacaccggcggagagg

SEQ ID NO: 523511 - DNA, 20 bp, mouse
ggaggtaagggacccggtgg

SEQ ID NO: 523512 - DNA, 20 bp, mouse
gcggccccgggagggagaca

SEQ ID NO: 523513 - DNA, 20 bp, mouse
gtgagcggctgctgcagcac

SEQ ID NO: 523514 - DNA, 20 bp, mouse
ggctctgcagcgggacaccg

SEQ ID NO: 523515 - DNA, 20 bp, mouse
gcgctcgcagatcccgccac

SEQ ID NO: 523516 - DNA, 20 bp, mouse
ggccattagggcgccgtctg

SEQ ID NO: 523517 - DNA, 20 bp, mouse
gaccgcagacggcgccctaa

SEQ ID NO: 523518 - DNA, 20 bp, mouse
ggtgccatcactagatcgaa

SEQ ID NO: 523519 - DNA, 20 bp, mouse
gaatagcttagaagccatta

SEQ ID NO: 523520 - DNA, 20 bp, mouse
ggcgccgtctgcggtgaggt

SEQ ID NO: 523521 - DNA, 20 bp, mouse
ggaaccacggatcctcccgg

SEQ ID NO: 523522 - DNA, 20 bp, mouse
gccgcccccgggaggatccg

SEQ ID NO: 523523 - DNA, 20 bp, mouse
gctaccaacctcaccgcaga

SEQ ID NO: 523524 - DNA, 20 bp, mouse
gctgcgcaccgagcaaccgg

SEQ ID NO: 523525 - DNA, 20 bp, mouse
ggcgcgctaggacggaacca

SEQ ID NO: 523526 - DNA, 20 bp, mouse
gggatcccacgccttacttg

SEQ ID NO: 523527 - DNA, 20 bp, mouse
gactaggctggcagtcgcga

SEQ ID NO: 523528 - DNA, 20 bp, mouse
ggcgatggctgcgtccggtg

SEQ ID NO: 523529 - DNA, 20 bp, mouse
gtcggacatatcctcctcac

SEQ ID NO: 523530 - DNA, 20 bp, mouse
ggcagcagcaggggacagtt

SEQ ID NO: 523531 - DNA, 20 bp, mouse
gcctgctgctgccccaagta

SEQ ID NO: 523532 - DNA, 20 bp, mouse
gtcaggggcagaacacccaa

SEQ ID NO: 523533 - DNA, 20 bp, mouse
ggctgccccaagtaaggcgt

SEQ ID NO: 523534 - DNA, 20 bp, mouse
gatggctgcgtccggtgagg

SEQ ID NO: 523535 - DNA, 20 bp, mouse
gaaccgcaggacgactaggc

SEQ ID NO: 523536 - DNA, 20 bp, mouse
ggggtgtctgtagggactca

SEQ ID NO: 523537 - DNA, 20 bp, mouse
ggggcgtggagggtgtctgt

SEQ ID NO: 523538 - DNA, 20 bp, mouse
ggcgtgagggtggtcatcct

SEQ ID NO: 523539 - DNA, 20 bp, mouse
gtccttggccgcctggggga

SEQ ID NO: 523540 - DNA, 20 bp, mouse
ggtcatccttggccgcctgg

SEQ ID NO: 523541 - DNA, 20 bp, mouse
gtgcgcgaggtctacccggt

SEQ ID NO: 523542 - DNA, 20 bp, mouse
gttgaggtcttggcgcgtga

SEQ ID NO: 523543 - DNA, 20 bp, mouse
gaggtcttggcgcgtgaggg

SEQ ID NO: 523544 - DNA, 20 bp, mouse
gtatgtgcgcgaggtctacc

SEQ ID NO: 523545 - DNA, 20 bp, mouse
ggcttctggaagatgcccac

SEQ ID NO: 523546 - DNA, 20 bp, mouse
gcggcgagcgcagctggcta

SEQ ID NO: 523547 - DNA, 20 bp, mouse
gtgtctgccccgcgccctgg

SEQ ID NO: 523548 - DNA, 20 bp, mouse
gcggcggcgccaaggcctcg

SEQ ID NO: 523549 - DNA, 20 bp, mouse
ggggaaggcgggaccgacag

SEQ ID NO: 523550 - DNA, 20 bp, mouse
ggcagcgcccgcagcgcacg

SEQ ID NO: 523551 - DNA, 20 bp, mouse
gggccaagccccgtgcgctg

SEQ ID NO: 523552 - DNA, 20 bp, mouse
gcgccaaggcctcgggggag

SEQ ID NO: 523553 - DNA, 20 bp, mouse
gggcgatcggcgagcgcagc

SEQ ID NO: 523554 - DNA, 20 bp, mouse
gagcggtggcgcatctggag

SEQ ID NO: 523555 - DNA, 20 bp, mouse
gggccttggcgccgccgcca

SEQ ID NO: 523556 - DNA, 20 bp, mouse
ggccagcaggagggccagga

SEQ ID NO: 523557 - DNA, 20 bp, mouse
gtggtagggtactagggcca

SEQ ID NO: 523558 - DNA, 20 bp, mouse
gtactagggccagggccagc

SEQ ID NO: 523559 - DNA, 20 bp, mouse
ggagagatgaatgggtacaa

SEQ ID NO: 523560 - DNA, 20 bp, mouse
gttgtgaccgccaggggaag

SEQ ID NO: 523561 - DNA, 20 bp, mouse
ggcagtgtacagaccctccc

SEQ ID NO: 523562 - DNA, 20 bp, mouse
gtcctctggcccaggttcct

SEQ ID NO: 523563 - DNA, 20 bp, mouse
gtctgtcttgtgaccgccag

SEQ ID NO: 523564 - DNA, 20 bp, mouse
ggcagaggtaagcagggctg

SEQ ID NO: 523565 - DNA, 20 bp, mouse
gaagcggcttaaataagagt

SEQ ID NO: 523566 - DNA, 20 bp, mouse
gccgccggccgggagacgtc

SEQ ID NO: 523567 - DNA, 20 bp, mouse
gcgggaggagagggtctctg

SEQ ID NO: 523568 - DNA, 20 bp, mouse
ggcgctcgctcgctcctcca

SEQ ID NO: 523569 - DNA, 20 bp, mouse
gcggccgggagacgtcgggt

SEQ ID NO: 523570 - DNA, 20 bp, mouse
gcccggtgcagacgcggaac

SEQ ID NO: 523571 - DNA, 20 bp, mouse
gaactggcgcccgctcgccg

SEQ ID NO: 523572 - DNA, 20 bp, mouse
gagctacctactctcggagg

SEQ ID NO: 523573 - DNA, 20 bp, mouse
ggaggaaaagcggctccggg

SEQ ID NO: 523574 - DNA, 20 bp, mouse
ggcgccccccggtgcagacg

SEQ ID NO: 523575 - DNA, 20 bp, mouse
gggcagcctcctccgagagt

SEQ ID NO: 523576 - DNA, 20 bp, mouse
gctcggccggcccaagatgg

SEQ ID NO: 523577 - DNA, 20 bp, mouse
gaagatggcggtgcaggagt

SEQ ID NO: 523578 - DNA, 20 bp, mouse
gccgctcggccggcccaaga

SEQ ID NO: 523579 - DNA, 20 bp, mouse
gatggcggtgcaggagtcgg

SEQ ID NO: 523580 - DNA, 20 bp, mouse
gcaggagtacccgaccctca

SEQ ID NO: 523581 - DNA, 20 bp, mouse
ggggtactcctgcaccttca

SEQ ID NO: 523582 - DNA, 20 bp, mouse
gcgcctagaacgcaccttga

SEQ ID NO: 523583 - DNA, 20 bp, mouse
gagaacgcaccttgagggtc

SEQ ID NO: 523584 - DNA, 20 bp, mouse
gctgcaccgccatcttgggc

SEQ ID NO: 523585 - DNA, 20 bp, mouse
ggacccctcccaagatgcgg

SEQ ID NO: 523586 - DNA, 20 bp, mouse
gaagggcgggagcccggcaa

SEQ ID NO: 523587 - DNA, 20 bp, mouse
gctccgagctcggttactaa

SEQ ID NO: 523588 - DNA, 20 bp, mouse
gcgagctcggttactaaggg

SEQ ID NO: 523589 - DNA, 20 bp, mouse
gtgcggctggccctgcggtt

SEQ ID NO: 523590 - DNA, 20 bp, mouse
ggcgtctctggagggcgtcg

SEQ ID NO: 523591 - DNA, 20 bp, mouse
gccagtcggccgagcagtag

SEQ ID NO: 523592 - DNA, 20 bp, mouse
gctcggccgactgggcggtg

SEQ ID NO: 523593 - DNA, 20 bp, mouse
gctgcttgctgcgtctctgg

SEQ ID NO: 523594 - DNA, 20 bp, mouse
gtcctgtacgaagaaatagt

SEQ ID NO: 523595 - DNA, 20 bp, mouse
ggggagcccggcaagggcgc

SEQ ID NO: 523596 - DNA, 20 bp, mouse
gctcttctcgctgggatcag

SEQ ID NO: 523597 - DNA, 20 bp, mouse
gggcaaagccgagagcaaaa

SEQ ID NO: 523598 - DNA, 20 bp, mouse
gcatcttggagctgtagctc

SEQ ID NO: 523599 - DNA, 20 bp, mouse
gaagccgagagcaaaagggt

SEQ ID NO: 523600 - DNA, 20 bp, mouse
gcactttgcacggagggaga

SEQ ID NO: 523601 - DNA, 20 bp, mouse
gcgaggtgcaggccggctgg

SEQ ID NO: 523602 - DNA, 20 bp, mouse
ggttggggggagaggccgag

SEQ ID NO: 523603 - DNA, 20 bp, mouse
ggcaagaccgaggtgcaggc

SEQ ID NO: 523604 - DNA, 20 bp, mouse
gcgtgcaaagtgcaagaccg

SEQ ID NO: 523605 - DNA, 20 bp, mouse
gaattgcaagtcctgggcca

SEQ ID NO: 523606 - DNA, 20 bp, mouse
gctggctggtacgatctcgg

SEQ ID NO: 523607 - DNA, 20 bp, mouse
gcgggccgcactgtatccgg

SEQ ID NO: 523608 - DNA, 20 bp, mouse
gtctctggctggtacgatct

SEQ ID NO: 523609 - DNA, 20 bp, mouse
gtacagtgcggcccgagtgg

SEQ ID NO: 523610 - DNA, 20 bp, mouse
ggttaaagtggaccattcag

SEQ ID NO: 523611 - DNA, 20 bp, mouse
ggtacgatctcggcggtccg

SEQ ID NO: 523612 - DNA, 20 bp, mouse
ggtcggtgccgaggtgacgg

SEQ ID NO: 523613 - DNA, 20 bp, mouse
gtcggacgcttgttgttgtc

SEQ ID NO: 523614 - DNA, 20 bp, mouse
gcttgttgttgtcgggtcgg

SEQ ID NO: 523615 - DNA, 20 bp, mouse
gagcagcgcgaggcccgccg

SEQ ID NO: 523616 - DNA, 20 bp, mouse
gcctggcctggagggtgcag

SEQ ID NO: 523617 - DNA, 20 bp, mouse
gaccgcggaggaacagaagg

SEQ ID NO: 523618 - DNA, 20 bp, mouse
ggccggccggcagcgcgggt

SEQ ID NO: 523619 - DNA, 20 bp, mouse
gctccaggccaggaccgcgg

SEQ ID NO: 523620 - DNA, 20 bp, mouse
gttgctgctgcgcccttcgg

SEQ ID NO: 523621 - DNA, 20 bp, mouse
gctctggtcgcgccgccgaa

SEQ ID NO: 523622 - DNA, 20 bp, mouse
gcggggccggccggcagcgc

SEQ ID NO: 523623 - DNA, 20 bp, mouse
gacccgagaggcctggccgg

SEQ ID NO: 523624 - DNA, 20 bp, mouse
ggccgccggccaggcctctc

SEQ ID NO: 523625 - DNA, 20 bp, mouse
gccggccgcgccccgacggg

SEQ ID NO: 523626 - DNA, 20 bp, mouse
gagccctagagccaaagagt

SEQ ID NO: 523627 - DNA, 20 bp, mouse
gcagcctcgggaggactctc

SEQ ID NO: 523628 - DNA, 20 bp, mouse
gtgcaccgccgggctgcgag

SEQ ID NO: 523629 - DNA, 20 bp, mouse
gagagtcggagagcgagcgg

SEQ ID NO: 523630 - DNA, 20 bp, mouse
gcaaagagtcggagagcgag

SEQ ID NO: 523631 - DNA, 20 bp, mouse
ggcgccggagagtcctcccg

SEQ ID NO: 523632 - DNA, 20 bp, mouse
gcagctcaggcagcctcggg

SEQ ID NO: 523633 - DNA, 20 bp, mouse
ggccggcgaggtgcgcgcag

SEQ ID NO: 523634 - DNA, 20 bp, mouse
gctccgactctttggctcta

SEQ ID NO: 523635 - DNA, 20 bp, mouse
gccgccgcgtccccagacaa

SEQ ID NO: 523636 - DNA, 20 bp, mouse
gggagccgcgcgcagttgta

SEQ ID NO: 523637 - DNA, 20 bp, mouse
gcccataacaaaactcggag

SEQ ID NO: 523638 - DNA, 20 bp, mouse
gggcctggcggagagcggta

SEQ ID NO: 523639 - DNA, 20 bp, mouse
gtatggggcaggcggcgaag

SEQ ID NO: 523640 - DNA, 20 bp, mouse
gtcccgatcggagaggagtg

SEQ ID NO: 523641 - DNA, 20 bp, mouse
gcactgagcgccgggcctgg

SEQ ID NO: 523642 - DNA, 20 bp, mouse
gatcgggaccgcagttcact

SEQ ID NO: 523643 - DNA, 20 bp, mouse
ggagcggtaaggacgcgtca

SEQ ID NO: 523644 - DNA, 20 bp, mouse
gactgcggtcccgatcggag

SEQ ID NO: 523645 - DNA, 20 bp, mouse
ggccccactcctctccgatc

SEQ ID NO: 523646 - DNA, 20 bp, mouse
gcgaagcgcgcaggcggaga

SEQ ID NO: 523647 - DNA, 20 bp, mouse
ggtcagtactggggagccgg

SEQ ID NO: 523648 - DNA, 20 bp, mouse
gcccggccgggaccccgaaa

SEQ ID NO: 523649 - DNA, 20 bp, mouse
gggcggagacggcgactaag

SEQ ID NO: 523650 - DNA, 20 bp, mouse
gcggacttctcgttccgact

SEQ ID NO: 523651 - DNA, 20 bp, mouse
gcgacgcgcgatcccggaag

SEQ ID NO: 523652 - DNA, 20 bp, mouse
gtgcgggaggagcaccccga

SEQ ID NO: 523653 - DNA, 20 bp, mouse
gccggaagcggtgtcagtac

SEQ ID NO: 523654 - DNA, 20 bp, mouse
gagtactggggagccggcgg

SEQ ID NO: 523655 - DNA, 20 bp, mouse
gaggccgcgggacccagcct

SEQ ID NO: 523656 - DNA, 20 bp, mouse
ggcccggccagccgagcaga

SEQ ID NO: 523657 - DNA, 20 bp, mouse
gtactgaggcagagagggct

SEQ ID NO: 523658 - DNA, 20 bp, mouse
gtagggtgaaagacccccag

SEQ ID NO: 523659 - DNA, 20 bp, mouse
gtcgggggcgctggacatca

SEQ ID NO: 523660 - DNA, 20 bp, mouse
gctctgcctcagtactcact

SEQ ID NO: 523661 - DNA, 20 bp, mouse
ggggccacttgcttcgaaca

SEQ ID NO: 523662 - DNA, 20 bp, mouse
gcaaccaaagatcttagtgg

SEQ ID NO: 523663 - DNA, 20 bp, mouse
ggcccaagggactgtaagcc

SEQ ID NO: 523664 - DNA, 20 bp, mouse
gatcttagtggaggcagtgg

SEQ ID NO: 523665 - DNA, 20 bp, mouse
gcctggacctacctcatcaa

SEQ ID NO: 523666 - DNA, 20 bp, mouse
gctgcagtattgggtgttac

SEQ ID NO: 523667 - DNA, 20 bp, mouse
ggaaaccatggagacgtcag

SEQ ID NO: 523668 - DNA, 20 bp, mouse
gctgatggagaaagaaaaga

SEQ ID NO: 523669 - DNA, 20 bp, mouse
gcaaataaagtgtatggcag

SEQ ID NO: 523670 - DNA, 20 bp, mouse
gaagcttccatcaaaggatc

SEQ ID NO: 523671 - DNA, 20 bp, mouse
ggactgtcctaggtaacagt

SEQ ID NO: 523672 - DNA, 20 bp, mouse
gttacctaggacagtcataa

SEQ ID NO: 523673 - DNA, 20 bp, mouse
gagtgccacacagggagagt

SEQ ID NO: 523674 - DNA, 20 bp, mouse
gagggagagtaggctctctg

SEQ ID NO: 523675 - DNA, 20 bp, mouse
gtcttggaggctgcagtatt

SEQ ID NO: 523676 - DNA, 20 bp, mouse
gcacctcaacaccgaaagtg

SEQ ID NO: 523677 - DNA, 20 bp, mouse
gaagcggcacacctagcaca

SEQ ID NO: 523678 - DNA, 20 bp, mouse
ggattcagcgccattttgtg

SEQ ID NO: 523679 - DNA, 20 bp, mouse
ggggtaacgtcccactggac

SEQ ID NO: 523680 - DNA, 20 bp, mouse
gtggaccggagagtggcctg

SEQ ID NO: 523681 - DNA, 20 bp, mouse
ggtcccactggaccggagag

SEQ ID NO: 523682 - DNA, 20 bp, mouse
gcgccacactttcggtgttg

SEQ ID NO: 523683 - DNA, 20 bp, mouse
gggcggtctcgccacacttt

SEQ ID NO: 523684 - DNA, 20 bp, mouse
gctccagcatcctcacaaaa

SEQ ID NO: 523685 - DNA, 20 bp, mouse
gtatgtgacagacttggcag

SEQ ID NO: 523686 - DNA, 20 bp, mouse
ggactgtggaagcagttgtt

SEQ ID NO: 523687 - DNA, 20 bp, mouse
gctacttcccacaaagttag

SEQ ID NO: 523688 - DNA, 20 bp, mouse
gtatgctagccttgtaccca

SEQ ID NO: 523689 - DNA, 20 bp, mouse
gtcccagtccactaactttg

SEQ ID NO: 523690 - DNA, 20 bp, mouse
gtttctaaaaaccgcataat

SEQ ID NO: 523691 - DNA, 20 bp, mouse
gcattcctgaggaaaacgta

SEQ ID NO: 523692 - DNA, 20 bp, mouse
gtccatagggacagagtccc

SEQ ID NO: 523693 - DNA, 20 bp, mouse
gtaggattgccatgggtaca

SEQ ID NO: 523694 - DNA, 20 bp, mouse
gtccggggactctgtcccta

SEQ ID NO: 523695 - DNA, 20 bp, mouse
ggaaataccctcataaacag

SEQ ID NO: 523696 - DNA, 20 bp, mouse
gttcgtctggatgaaggctg

SEQ ID NO: 523697 - DNA, 20 bp, mouse
gcgctctgcagtgccagttt

SEQ ID NO: 523698 - DNA, 20 bp, mouse
gcagagcgatctcccatctc

SEQ ID NO: 523699 - DNA, 20 bp, mouse
gtttgggagaagcctgagat

SEQ ID NO: 523700 - DNA, 20 bp, mouse
gggcaagcagatgcaataat

SEQ ID NO: 523701 - DNA, 20 bp, mouse
ggagtcaaaccagtatgtaa

SEQ ID NO: 523702 - DNA, 20 bp, mouse
gagtatgtaagggtgtactg

SEQ ID NO: 523703 - DNA, 20 bp, mouse
gcccagtggggtaaccttgt

SEQ ID NO: 523704 - DNA, 20 bp, mouse
ggccttgctagctcccagtg

SEQ ID NO: 523705 - DNA, 20 bp, mouse
ggagatgaagctgcattatt

SEQ ID NO: 523706 - DNA, 20 bp, mouse
gcgctctgcagtgccagttt

SEQ ID NO: 523707 - DNA, 20 bp, mouse
gcagagcgatctcccatctc

SEQ ID NO: 523708 - DNA, 20 bp, mouse
gtttgggagaagcctgagat

SEQ ID NO: 523709 - DNA, 20 bp, mouse
gggcaagcagatgcaataat

SEQ ID NO: 523710 - DNA, 20 bp, mouse
ggagtcaaaccagtatgtaa

SEQ ID NO: 523711 - DNA, 20 bp, mouse
gagtatgtaagggtgtactg

SEQ ID NO: 523712 - DNA, 20 bp, mouse
gcccagtggggtaaccttgt

SEQ ID NO: 523713 - DNA, 20 bp, mouse
ggccttgctagctcccagtg

SEQ ID NO: 523714 - DNA, 20 bp, mouse
ggagatgaagctgcattatt

SEQ ID NO: 523715 - DNA, 20 bp, mouse
gccgaaattctcacctaaac

SEQ ID NO: 523716 - DNA, 20 bp, mouse
gatcctgcctactattacct

SEQ ID NO: 523717 - DNA, 20 bp, mouse
gctgatggagaaaggataga

SEQ ID NO: 523718 - DNA, 20 bp, mouse
ggagaccatggagacatcag

SEQ ID NO: 523719 - DNA, 20 bp, mouse
ggactgtcctaggtaatagt

SEQ ID NO: 523720 - DNA, 20 bp, mouse
gcattgtgcaacaaatgaag

SEQ ID NO: 523721 - DNA, 20 bp, mouse
gagtgccacacagggagagt

SEQ ID NO: 523722 - DNA, 20 bp, mouse
gagggagagtaggctctctg

SEQ ID NO: 523723 - DNA, 20 bp, mouse
gtgttccaatcacagcaggg

SEQ ID NO: 523724 - DNA, 20 bp, mouse
gggcctgagcactctcttcg

SEQ ID NO: 523725 - DNA, 20 bp, mouse
ggtgtcctccctgctgtgat

SEQ ID NO: 523726 - DNA, 20 bp, mouse
gggcagtgctcggagccaaa

SEQ ID NO: 523727 - DNA, 20 bp, mouse
gcccattactgcagcctcca

SEQ ID NO: 523728 - DNA, 20 bp, mouse
ggccttggaggctgcagtaa

SEQ ID NO: 523729 - DNA, 20 bp, mouse
ggcttccaccaaccaagtag

SEQ ID NO: 523730 - DNA, 20 bp, mouse
gagtatcacaaggggagagg

SEQ ID NO: 523731 - DNA, 20 bp, mouse
ggttcctgaaggcccatctg

SEQ ID NO: 523732 - DNA, 20 bp, mouse
gaacattgtctaactccctt

SEQ ID NO: 523733 - DNA, 20 bp, mouse
gatagctgtggtagatgaag

SEQ ID NO: 523734 - DNA, 20 bp, mouse
gacagaggctagtatcacaa

SEQ ID NO: 523735 - DNA, 20 bp, mouse
gaccttctttgaggtgggag

SEQ ID NO: 523736 - DNA, 20 bp, mouse
gtacctcaactggcacggcg

SEQ ID NO: 523737 - DNA, 20 bp, mouse
gctccccgccgtgccagttg

SEQ ID NO: 523738 - DNA, 20 bp, mouse
gcattcatgaggaaaagata

SEQ ID NO: 523739 - DNA, 20 bp, mouse
ggggagctaggcaggctaaa

SEQ ID NO: 523740 - DNA, 20 bp, mouse
gtaaggagctacttccaaca

SEQ ID NO: 523741 - DNA, 20 bp, mouse
ggtttaaaatgagaggctaa

SEQ ID NO: 523742 - DNA, 20 bp, mouse
gctacttccaacaaggttag

SEQ ID NO: 523743 - DNA, 20 bp, mouse
gggaaaagatatggaacaat

SEQ ID NO: 523744 - DNA, 20 bp, mouse
gtctggggactctatcccta

SEQ ID NO: 523745 - DNA, 20 bp, mouse
gcgcagagtccaaaggaagc

SEQ ID NO: 523746 - DNA, 20 bp, mouse
gtggagattaaattattaca

SEQ ID NO: 523747 - DNA, 20 bp, mouse
gttgctacaaggtaccccag

SEQ ID NO: 523748 - DNA, 20 bp, mouse
gccttctagttgggcgggta

SEQ ID NO: 523749 - DNA, 20 bp, mouse
gattatttgaagagccatga

SEQ ID NO: 523750 - DNA, 20 bp, mouse
ggcaccatttgagagagtct

SEQ ID NO: 523751 - DNA, 20 bp, mouse
gatttgagagagtcttggaa

SEQ ID NO: 523752 - DNA, 20 bp, mouse
gggtgtagctgtggaataac

SEQ ID NO: 523753 - DNA, 20 bp, mouse
gaccaaatgggaagctgtgt

SEQ ID NO: 523754 - DNA, 20 bp, mouse
gtatgtctaagagtctctaa

SEQ ID NO: 523755 - DNA, 20 bp, mouse
ggagcttacctacaccaaat

SEQ ID NO: 523756 - DNA, 20 bp, mouse
gtcatcagagggaggatctc

SEQ ID NO: 523757 - DNA, 20 bp, mouse
gtcctccttgtaacagacat

SEQ ID NO: 523758 - DNA, 20 bp, mouse
gggagcctatgtctgttaca

SEQ ID NO: 523759 - DNA, 20 bp, mouse
ggcctatgtctgttacaagg

SEQ ID NO: 523760 - DNA, 20 bp, mouse
gaaactagctacagatcatc

SEQ ID NO: 523761 - DNA, 20 bp, mouse
gatgaaggagagtgttctgc

SEQ ID NO: 523762 - DNA, 20 bp, mouse
gacaatttgatggttttcaa

SEQ ID NO: 523763 - DNA, 20 bp, mouse
gtaatagtttgctacaggcc

SEQ ID NO: 523764 - DNA, 20 bp, mouse
gattaagatcgattcatgcc

SEQ ID NO: 523765 - DNA, 20 bp, mouse
ggactagagtcatcagaggg

SEQ ID NO: 523766 - DNA, 20 bp, mouse
gaggagccatcaatcctaaa

SEQ ID NO: 523767 - DNA, 20 bp, mouse
gtcctacaaggtaccccact

SEQ ID NO: 523768 - DNA, 20 bp, mouse
gtcccagtggggtaccttgt

SEQ ID NO: 523769 - DNA, 20 bp, mouse
gtcctaaaaggtttcaaagt

SEQ ID NO: 523770 - DNA, 20 bp, mouse
ggacaagactgtattatttg

SEQ ID NO: 523771 - DNA, 20 bp, mouse
gtgaaaccttttaggattga

SEQ ID NO: 523772 - DNA, 20 bp, mouse
ggcagtagctatggaataac

SEQ ID NO: 523773 - DNA, 20 bp, mouse
gtcctcttagagggactaga

SEQ ID NO: 523774 - DNA, 20 bp, mouse
ggagcttacctatatcaaat

SEQ ID NO: 523775 - DNA, 20 bp, mouse
gatcaaatgggcaactgtgt

SEQ ID NO: 523776 - DNA, 20 bp, mouse
ggtagctccttagccctcga

SEQ ID NO: 523777 - DNA, 20 bp, mouse
gctagcataaatatctggac

SEQ ID NO: 523778 - DNA, 20 bp, mouse
ggcataaatatctggaccgg

SEQ ID NO: 523779 - DNA, 20 bp, mouse
gcaagcctagcataaatatc

SEQ ID NO: 523780 - DNA, 20 bp, mouse
gttaactgaaatttgaggag

SEQ ID NO: 523781 - DNA, 20 bp, mouse
gttattttaactgaaatttg

SEQ ID NO: 523782 - DNA, 20 bp, mouse
gtccttagccctcgaaggta

SEQ ID NO: 523783 - DNA, 20 bp, mouse
gagacagtccctaccttcga

SEQ ID NO: 523784 - DNA, 20 bp, mouse
gcctacccccactttatcta

SEQ ID NO: 523785 - DNA, 20 bp, mouse
gtatctggaccggtggatcc

SEQ ID NO: 523786 - DNA, 20 bp, mouse
ggatgaaagaagcagttaca

SEQ ID NO: 523787 - DNA, 20 bp, mouse
ggtagttaacaagaagtata

SEQ ID NO: 523788 - DNA, 20 bp, mouse
ggttacaaggagtgaaatgc

SEQ ID NO: 523789 - DNA, 20 bp, mouse
gagggctgaagtaaaagagc

SEQ ID NO: 523790 - DNA, 20 bp, mouse
gagtaaaagagctggcagac

SEQ ID NO: 523791 - DNA, 20 bp, mouse
gtggcagacaggaatctgga

SEQ ID NO: 523792 - DNA, 20 bp, mouse
gggcatgttgactgtgctca

SEQ ID NO: 523793 - DNA, 20 bp, mouse
ggtagtacagaggtacttac

SEQ ID NO: 523794 - DNA, 20 bp, mouse
gcctgcaccaaaagatccag

SEQ ID NO: 523795 - DNA, 20 bp, mouse
gtgtcgttttgcacgggagc

SEQ ID NO: 523796 - DNA, 20 bp, mouse
gttcggtaaaccagcttcag

SEQ ID NO: 523797 - DNA, 20 bp, mouse
gtcgaagtgacccgctggga

SEQ ID NO: 523798 - DNA, 20 bp, mouse
gaaggcctgatgagacctaa

SEQ ID NO: 523799 - DNA, 20 bp, mouse
gacttggaggcttcagacaa

SEQ ID NO: 523800 - DNA, 20 bp, mouse
gcttcagcggcttttcaaca

SEQ ID NO: 523801 - DNA, 20 bp, mouse
gtgaaagagagaattgtctc

SEQ ID NO: 523802 - DNA, 20 bp, mouse
ggtctcatcaggccttcgct

SEQ ID NO: 523803 - DNA, 20 bp, mouse
gtgattctgcggctgcgaac

SEQ ID NO: 523804 - DNA, 20 bp, mouse
ggtcaagatacaggccccaa

SEQ ID NO: 523805 - DNA, 20 bp, mouse
ggagattctaatctgtgcgg

SEQ ID NO: 523806 - DNA, 20 bp, mouse
gtggtcctgagagatacaag

SEQ ID NO: 523807 - DNA, 20 bp, mouse
gatttagctgggaattttca

SEQ ID NO: 523808 - DNA, 20 bp, mouse
gccatgagaaattattgtct

SEQ ID NO: 523809 - DNA, 20 bp, mouse
ggaaattattgtctaggcac

SEQ ID NO: 523810 - DNA, 20 bp, mouse
gacaggaaacaccaaacaag

SEQ ID NO: 523811 - DNA, 20 bp, mouse
gaaagtaatggcacataaac

SEQ ID NO: 523812 - DNA, 20 bp, mouse
gaaaacaacataagaaacta

SEQ ID NO: 523813 - DNA, 20 bp, mouse
gcatttaagatccaacaaca

SEQ ID NO: 523814 - DNA, 20 bp, mouse
gatactgtaattgcctcgga

SEQ ID NO: 523815 - DNA, 20 bp, mouse
gatatatactgtaattgcct

SEQ ID NO: 523816 - DNA, 20 bp, mouse
gtaccaggtagagaatacct

SEQ ID NO: 523817 - DNA, 20 bp, mouse
gtctctacctggtagtacag

SEQ ID NO: 523818 - DNA, 20 bp, mouse
gtaagtacctctgtactacc

SEQ ID NO: 523819 - DNA, 20 bp, mouse
gcaggtctccattaagtcca

SEQ ID NO: 523820 - DNA, 20 bp, mouse
ggtccaaggtattctctacc

SEQ ID NO: 523821 - DNA, 20 bp, mouse
ggagaataccttggacttaa

SEQ ID NO: 523822 - DNA, 20 bp, mouse
gagtaaaagagctggcagac

SEQ ID NO: 523823 - DNA, 20 bp, mouse
gagggctgaagtaaaagagc

SEQ ID NO: 523824 - DNA, 20 bp, mouse
gtcctagaaagatgttctcc

SEQ ID NO: 523825 - DNA, 20 bp, mouse
gcctgcaccaaaagatccag

SEQ ID NO: 523826 - DNA, 20 bp, mouse
gacctaggaagagaacctcg

SEQ ID NO: 523827 - DNA, 20 bp, mouse
gataggtccaagggcaacag

SEQ ID NO: 523828 - DNA, 20 bp, mouse
gctggtcccggtgctttcgg

SEQ ID NO: 523829 - DNA, 20 bp, mouse
gggttcgcggagtgtccccg

SEQ ID NO: 523830 - DNA, 20 bp, mouse
gcgctctggtgagttcccta

SEQ ID NO: 523831 - DNA, 20 bp, mouse
gtgcggtgcagcaggtcggt

SEQ ID NO: 523832 - DNA, 20 bp, mouse
gcacatcgcgaggaagggaa

SEQ ID NO: 523833 - DNA, 20 bp, mouse
gacgctccgagccccatcgg

SEQ ID NO: 523834 - DNA, 20 bp, mouse
gcatcgggagcgcaaggcac

SEQ ID NO: 523835 - DNA, 20 bp, mouse
gtctggccatcgggagcgca

SEQ ID NO: 523836 - DNA, 20 bp, mouse
ggcggacacagcagcagtgg

SEQ ID NO: 523837 - DNA, 20 bp, mouse
gcaggcggacacagcagcag

SEQ ID NO: 523838 - DNA, 20 bp, mouse
gagtctccacgaggagaagg

SEQ ID NO: 523839 - DNA, 20 bp, mouse
gtccgcctgctctgctgagg

SEQ ID NO: 523840 - DNA, 20 bp, mouse
gggcagtctccacgaggaga

SEQ ID NO: 523841 - DNA, 20 bp, mouse
gatctcgggcagtctccacg

SEQ ID NO: 523842 - DNA, 20 bp, mouse
gtggtggtatgggtgctcgg

SEQ ID NO: 523843 - DNA, 20 bp, mouse
gagtgtgtggaagggcatgg

SEQ ID NO: 523844 - DNA, 20 bp, mouse
gtaaagacgagggataaagg

SEQ ID NO: 523845 - DNA, 20 bp, mouse
gcaggctctggagatggcct

SEQ ID NO: 523846 - DNA, 20 bp, mouse
ggcggacacagcagcagtgg

SEQ ID NO: 523847 - DNA, 20 bp, mouse
gcaggcggacacagcagcag

SEQ ID NO: 523848 - DNA, 20 bp, mouse
gagtctccacgaggagaagg

SEQ ID NO: 523849 - DNA, 20 bp, mouse
gtccgcctgctctgctgagg

SEQ ID NO: 523850 - DNA, 20 bp, mouse
gggcagtctccacgaggaga

SEQ ID NO: 523851 - DNA, 20 bp, mouse
gatctcgggcagtctccacg

SEQ ID NO: 523852 - DNA, 20 bp, mouse
gtggtggtatgggtgctcgg

SEQ ID NO: 523853 - DNA, 20 bp, mouse
gagtgtgtggaagggcatgg

SEQ ID NO: 523854 - DNA, 20 bp, mouse
gtaaagacgagggataaagg

SEQ ID NO: 523855 - DNA, 20 bp, mouse
gcaggctctggagatggcct

SEQ ID NO: 523856 - DNA, 20 bp, mouse
ggaacactacgtttgtccag

SEQ ID NO: 523857 - DNA, 20 bp, mouse
gcatttcttaacactctctg

SEQ ID NO: 523858 - DNA, 20 bp, mouse
gtgaatctatccagatgata

SEQ ID NO: 523859 - DNA, 20 bp, mouse
gctcagtacctggagagatg

SEQ ID NO: 523860 - DNA, 20 bp, mouse
gtccagccttggggagataa

SEQ ID NO: 523861 - DNA, 20 bp, mouse
gtggcctactcattcagttt

SEQ ID NO: 523862 - DNA, 20 bp, mouse
gggatagattcagtgtcctc

SEQ ID NO: 523863 - DNA, 20 bp, mouse
gcatactcactcttcagaag

SEQ ID NO: 523864 - DNA, 20 bp, mouse
ggatgattctccctatcatc

SEQ ID NO: 523865 - DNA, 20 bp, mouse
gccaaggctggagtgataag

SEQ ID NO: 523866 - DNA, 20 bp, mouse
gctggacgcggagagagtgc

SEQ ID NO: 523867 - DNA, 20 bp, mouse
ggactcaagaggatcgggaa

SEQ ID NO: 523868 - DNA, 20 bp, mouse
ggatcgggaatggctctgtc

SEQ ID NO: 523869 - DNA, 20 bp, mouse
ggagtgcgggtgccgagagc

SEQ ID NO: 523870 - DNA, 20 bp, mouse
gttcgcgactcaagaggatc

SEQ ID NO: 523871 - DNA, 20 bp, mouse
ggcggcgagcggggagacac

SEQ ID NO: 523872 - DNA, 20 bp, mouse
ggggagcagggtctgaatcc

SEQ ID NO: 523873 - DNA, 20 bp, mouse
gcgaagaaggaaacagcgaa

SEQ ID NO: 523874 - DNA, 20 bp, mouse
ggaaggacgccgcgccaggg

SEQ ID NO: 523875 - DNA, 20 bp, mouse
gaatggctctgtccggctct

SEQ ID NO: 523876 - DNA, 20 bp, mouse
gggaggctgagacttcgaga

SEQ ID NO: 523877 - DNA, 20 bp, mouse
gcgcatcccagactcactgg

SEQ ID NO: 523878 - DNA, 20 bp, mouse
gtctgcagctctagtccagg

SEQ ID NO: 523879 - DNA, 20 bp, mouse
gctcactggaggacaaggtg

SEQ ID NO: 523880 - DNA, 20 bp, mouse
gcttgtcctccagtgagtct

SEQ ID NO: 523881 - DNA, 20 bp, mouse
gctgtctgcagctctagtcc

SEQ ID NO: 523882 - DNA, 20 bp, mouse
ggaagggttaagggacactg

SEQ ID NO: 523883 - DNA, 20 bp, mouse
ggatccagggacaagaatag

SEQ ID NO: 523884 - DNA, 20 bp, mouse
gcatccagctaggaagggag

SEQ ID NO: 523885 - DNA, 20 bp, mouse
gcagtatctgagtttcggag

SEQ ID NO: 523886 - DNA, 20 bp, mouse
gaggtggtgggcaagaacga

SEQ ID NO: 523887 - DNA, 20 bp, mouse
gcaggagcagaaattagagg

SEQ ID NO: 523888 - DNA, 20 bp, mouse
gccaggcccgagcaagtcgc

SEQ ID NO: 523889 - DNA, 20 bp, mouse
gtgagactagcgttcacagt

SEQ ID NO: 523890 - DNA, 20 bp, mouse
ggaggtgccagggccctcag

SEQ ID NO: 523891 - DNA, 20 bp, mouse
gcggactgcggcagaaggcg

SEQ ID NO: 523892 - DNA, 20 bp, mouse
gcgcattggcccttccaccg

SEQ ID NO: 523893 - DNA, 20 bp, mouse
gacgagggggagaggtatgt

SEQ ID NO: 523894 - DNA, 20 bp, mouse
gggtcctgtcgaccgacgtg

SEQ ID NO: 523895 - DNA, 20 bp, mouse
gggaggccctggaggatctt

SEQ ID NO: 523896 - DNA, 20 bp, mouse
gagtgcgcctgcgtaggatg

SEQ ID NO: 523897 - DNA, 20 bp, mouse
gaagtgagagctggcgagac

SEQ ID NO: 523898 - DNA, 20 bp, mouse
gtggctgttgctgtaatcgg

SEQ ID NO: 523899 - DNA, 20 bp, mouse
gtcgagggctagcatggagg

SEQ ID NO: 523900 - DNA, 20 bp, mouse
ggcggttcgaaagtgagagc

SEQ ID NO: 523901 - DNA, 20 bp, mouse
gtagccctcgaagctcccca

SEQ ID NO: 523902 - DNA, 20 bp, mouse
ggggccctggggagcttcga

SEQ ID NO: 523903 - DNA, 20 bp, mouse
gcgggacccgagtgacatcg

SEQ ID NO: 523904 - DNA, 20 bp, mouse
ggacaggaacgcgaacgcgg

SEQ ID NO: 523905 - DNA, 20 bp, mouse
gttaggctttccttcattgc

SEQ ID NO: 523906 - DNA, 20 bp, mouse
ggcgctacagggagtgcggg

SEQ ID NO: 523907 - DNA, 20 bp, mouse
gcggcgccgccggaacgcaa

SEQ ID NO: 523908 - DNA, 20 bp, mouse
gttggcgctacagggagtgc

SEQ ID NO: 523909 - DNA, 20 bp, mouse
gagccacaaagccctttccc

SEQ ID NO: 523910 - DNA, 20 bp, mouse
ggcctcggggacggaagagt

SEQ ID NO: 523911 - DNA, 20 bp, mouse
gaggcaagctgacttgcgca

SEQ ID NO: 523912 - DNA, 20 bp, mouse
gggcgtgtgcgtggcaggag

SEQ ID NO: 523913 - DNA, 20 bp, mouse
ggtactggaggccttctcca

SEQ ID NO: 523914 - DNA, 20 bp, mouse
ggaatacctgagcggcccgg

SEQ ID NO: 523915 - DNA, 20 bp, mouse
gttgcgcgcttggcgctaca

SEQ ID NO: 523916 - DNA, 20 bp, mouse
gagagctgcggagagaaccg

SEQ ID NO: 523917 - DNA, 20 bp, mouse
gagcacttggctgaaagctg

SEQ ID NO: 523918 - DNA, 20 bp, mouse
gctgcgtggcggagcaagcc

SEQ ID NO: 523919 - DNA, 20 bp, mouse
gggatcctggacagccacgt

SEQ ID NO: 523920 - DNA, 20 bp, mouse
gcactggaggtggatcccag

SEQ ID NO: 523921 - DNA, 20 bp, mouse
gtccagcttgaaggctgaat

SEQ ID NO: 523922 - DNA, 20 bp, mouse
ggagcctgcaagtccactgg

SEQ ID NO: 523923 - DNA, 20 bp, mouse
gagcccgcatcagaaccgta

SEQ ID NO: 523924 - DNA, 20 bp, mouse
ggctctcagcaagcactacc

SEQ ID NO: 523925 - DNA, 20 bp, mouse
gtcagccaagtgctactgcc

SEQ ID NO: 523926 - DNA, 20 bp, mouse
ggcgtgtgtggagagagccg

SEQ ID NO: 523927 - DNA, 20 bp, mouse
gtgtggagagagccgcggag

SEQ ID NO: 523928 - DNA, 20 bp, mouse
gtccgcgcggcggagcgcag

SEQ ID NO: 523929 - DNA, 20 bp, mouse
gacagcacgagcccccggag

SEQ ID NO: 523930 - DNA, 20 bp, mouse
ggcgcagcggccggctggag

SEQ ID NO: 523931 - DNA, 20 bp, mouse
ggggagccctggagacgcga

SEQ ID NO: 523932 - DNA, 20 bp, mouse
gcgccggaacgcggacccgg

SEQ ID NO: 523933 - DNA, 20 bp, mouse
gcggccgctcctcagcgcga

SEQ ID NO: 523934 - DNA, 20 bp, mouse
gcttccctcgcgctgaggag

SEQ ID NO: 523935 - DNA, 20 bp, mouse
ggacgcgagggaagtggccg

SEQ ID NO: 523936 - DNA, 20 bp, mouse
gctggatgtgatggagagaa

SEQ ID NO: 523937 - DNA, 20 bp, mouse
gcctatctggtgggaagggt

SEQ ID NO: 523938 - DNA, 20 bp, mouse
gggagagaggatgtcttcga

SEQ ID NO: 523939 - DNA, 20 bp, mouse
gtctggtgggaagggtcgga

SEQ ID NO: 523940 - DNA, 20 bp, mouse
gccccaggcctgccggaagt

SEQ ID NO: 523941 - DNA, 20 bp, mouse
ggtgggaagggtcggagggt

SEQ ID NO: 523942 - DNA, 20 bp, mouse
ggggaggccgaggccaaggt

SEQ ID NO: 523943 - DNA, 20 bp, mouse
ggggtctgggcctatctggt

SEQ ID NO: 523944 - DNA, 20 bp, mouse
gcgagggagacgcctacttc

SEQ ID NO: 523945 - DNA, 20 bp, mouse
ggcgctgggccgccccccgt

SEQ ID NO: 523946 - DNA, 20 bp, mouse
gtggcagctggggcaggcgt

SEQ ID NO: 523947 - DNA, 20 bp, mouse
gctggaaccgaggctcgtat

SEQ ID NO: 523948 - DNA, 20 bp, mouse
gtccctccggctctcctcag

SEQ ID NO: 523949 - DNA, 20 bp, mouse
ggccgctgaggagagccgga

SEQ ID NO: 523950 - DNA, 20 bp, mouse
gctggggcaggcgttggtct

SEQ ID NO: 523951 - DNA, 20 bp, mouse
gttagtcgctcgctggagcg

SEQ ID NO: 523952 - DNA, 20 bp, mouse
ggccccagctgccaggaaac

SEQ ID NO: 523953 - DNA, 20 bp, mouse
gtccagcgagcgactaagct

SEQ ID NO: 523954 - DNA, 20 bp, mouse
gcctcagcggcccgcgagag

SEQ ID NO: 523955 - DNA, 20 bp, mouse
ggcgggccgctgaggagagc

SEQ ID NO: 523956 - DNA, 20 bp, mouse
ggactctcgcgctgggaaca

SEQ ID NO: 523957 - DNA, 20 bp, mouse
gacctcttctgccccctcta

SEQ ID NO: 523958 - DNA, 20 bp, mouse
gggaacacggcagaccctag

SEQ ID NO: 523959 - DNA, 20 bp, mouse
gtggcctgtggtgaacctgg

SEQ ID NO: 523960 - DNA, 20 bp, mouse
gcagcctggagactataggt

SEQ ID NO: 523961 - DNA, 20 bp, mouse
ggagggggcagaagaggtac

SEQ ID NO: 523962 - DNA, 20 bp, mouse
gttcccagcgcgagagtcca

SEQ ID NO: 523963 - DNA, 20 bp, mouse
gagtccaccaggttcaccac

SEQ ID NO: 523964 - DNA, 20 bp, mouse
gcagtcctggcaatagccag

SEQ ID NO: 523965 - DNA, 20 bp, mouse
gcgcgagagtccatggcctg

SEQ ID NO: 523966 - DNA, 20 bp, mouse
gagacgtagaccgcaggccg

SEQ ID NO: 523967 - DNA, 20 bp, mouse
gtcgcaagggacaaggagga

SEQ ID NO: 523968 - DNA, 20 bp, mouse
gggaacggatgacactacca

SEQ ID NO: 523969 - DNA, 20 bp, mouse
gcactctccatgcctcgcaa

SEQ ID NO: 523970 - DNA, 20 bp, mouse
gccatgcctcgcaagggaca

SEQ ID NO: 523971 - DNA, 20 bp, mouse
gacaaggaggacggaacttt

SEQ ID NO: 523972 - DNA, 20 bp, mouse
gagtataagacgtagaccgc

SEQ ID NO: 523973 - DNA, 20 bp, mouse
gatgacactaccacggcctg

SEQ ID NO: 523974 - DNA, 20 bp, mouse
gatgtggcgaagcgaagcaa

SEQ ID NO: 523975 - DNA, 20 bp, mouse
gtcttatactggcgtaatgg

SEQ ID NO: 523976 - DNA, 20 bp, mouse
gcgagggtaaaaatgtctat

SEQ ID NO: 523977 - DNA, 20 bp, mouse
gggtaaagcccgctataccg

SEQ ID NO: 523978 - DNA, 20 bp, mouse
gcgcgaggtagtgacgtcac

SEQ ID NO: 523979 - DNA, 20 bp, mouse
ggtatagcgggctttaccga

SEQ ID NO: 523980 - DNA, 20 bp, mouse
gcgttggccccgcggtatag

SEQ ID NO: 523981 - DNA, 20 bp, mouse
gatgcccgacgtagtagcga

SEQ ID NO: 523982 - DNA, 20 bp, mouse
gcgtcactacctcgcgccgg

SEQ ID NO: 523983 - DNA, 20 bp, mouse
gcctcgcgccggcggcacgt

SEQ ID NO: 523984 - DNA, 20 bp, mouse
gaggatcgtgagttcgaggg

SEQ ID NO: 523985 - DNA, 20 bp, mouse
ggctactacgtcgggcataa

SEQ ID NO: 523986 - DNA, 20 bp, mouse
gtccagcacggtccgagggt

SEQ ID NO: 523987 - DNA, 20 bp, mouse
ggttcacgcttctctcttgg

SEQ ID NO: 523988 - DNA, 20 bp, mouse
ggaacatggcctcgccaagg

SEQ ID NO: 523989 - DNA, 20 bp, mouse
ggtgtgtgcgatcgcagcgg

SEQ ID NO: 523990 - DNA, 20 bp, mouse
gtccgcggttgggaggaagt

SEQ ID NO: 523991 - DNA, 20 bp, mouse
ggtccgctcgccccttccca

SEQ ID NO: 523992 - DNA, 20 bp, mouse
gagcacagatccctgggaag

SEQ ID NO: 523993 - DNA, 20 bp, mouse
gtctgtgtgtgcgatcgcag

SEQ ID NO: 523994 - DNA, 20 bp, mouse
ggaccagaaccaccttggcg

SEQ ID NO: 523995 - DNA, 20 bp, mouse
gacgcccagcacagatccct

SEQ ID NO: 523996 - DNA, 20 bp, mouse
gcggcgctggagcttcacaa

SEQ ID NO: 523997 - DNA, 20 bp, mouse
gccggcgggtaatcccgagt

SEQ ID NO: 523998 - DNA, 20 bp, mouse
gcttcacaagggagcgatcg

SEQ ID NO: 523999 - DNA, 20 bp, mouse
gcggcttcgaagctcaggtc

SEQ ID NO: 524000 - DNA, 20 bp, mouse
gtgggtcccgcagcctactc

SEQ ID NO: 524001 - DNA, 20 bp, mouse
gagcgatcgaggtaagctgc

SEQ ID NO: 524002 - DNA, 20 bp, mouse
gctaggatacgaaacacaca

SEQ ID NO: 524003 - DNA, 20 bp, mouse
gcgaggggatgagtggacgt

SEQ ID NO: 524004 - DNA, 20 bp, mouse
gggtaatcccgagtaggctg

SEQ ID NO: 524005 - DNA, 20 bp, mouse
gtggatgtgtaggggatccg

SEQ ID NO: 524006 - DNA, 20 bp, mouse
gtcgtccgactgcatggtgc

SEQ ID NO: 524007 - DNA, 20 bp, mouse
gccagtggtgccaaggcgag

SEQ ID NO: 524008 - DNA, 20 bp, mouse
gtccccggtccttcctaatg

SEQ ID NO: 524009 - DNA, 20 bp, mouse
gtcagctcgccgcattagga

SEQ ID NO: 524010 - DNA, 20 bp, mouse
ggccgcattaggaaggaccg

SEQ ID NO: 524011 - DNA, 20 bp, mouse
gactaaggaagcccacccgg

SEQ ID NO: 524012 - DNA, 20 bp, mouse
ggctgccggcaccatgcagt

SEQ ID NO: 524013 - DNA, 20 bp, mouse
ggcttcactgccaagcacta

SEQ ID NO: 524014 - DNA, 20 bp, mouse
gctctccggaagtggctccg

SEQ ID NO: 524015 - DNA, 20 bp, mouse
gttaggaaggaccggggaag

SEQ ID NO: 524016 - DNA, 20 bp, mouse
ggtggtcagtgcggagccgg

SEQ ID NO: 524017 - DNA, 20 bp, mouse
gcggccactgggctctccgg

SEQ ID NO: 524018 - DNA, 20 bp, mouse
ggactggacacgctcgcctc

SEQ ID NO: 524019 - DNA, 20 bp, mouse
gctggcgtcggccttgggac

SEQ ID NO: 524020 - DNA, 20 bp, mouse
gtctgggaaagggaccgggt

SEQ ID NO: 524021 - DNA, 20 bp, mouse
gactgaccactcgctccctc

SEQ ID NO: 524022 - DNA, 20 bp, mouse
gctccggcagcggcttcggg

SEQ ID NO: 524023 - DNA, 20 bp, mouse
gcgagtggtcagtgcggagc

SEQ ID NO: 524024 - DNA, 20 bp, mouse
gagcagaccacggagagatg

SEQ ID NO: 524025 - DNA, 20 bp, mouse
gctgctctgggaaagggacc

SEQ ID NO: 524026 - DNA, 20 bp, mouse
gaccccacggatcggatcgg

SEQ ID NO: 524027 - DNA, 20 bp, mouse
gtgaaccccacggatcggat

SEQ ID NO: 524028 - DNA, 20 bp, mouse
ggtgcgcggagacgtagcag

SEQ ID NO: 524029 - DNA, 20 bp, mouse
ggagtcccgggagcatggac

SEQ ID NO: 524030 - DNA, 20 bp, mouse
ggcagcacgcctgaacccca

SEQ ID NO: 524031 - DNA, 20 bp, mouse
gaggacacggcagggttcgg

SEQ ID NO: 524032 - DNA, 20 bp, mouse
gacgcctgaaccccacggat

SEQ ID NO: 524033 - DNA, 20 bp, mouse
gaagaggcccgggtcctaag

SEQ ID NO: 524034 - DNA, 20 bp, mouse
gcgtagcagcggcagcatgt

SEQ ID NO: 524035 - DNA, 20 bp, mouse
ggccgccgatccgatccgtg

SEQ ID NO: 524036 - DNA, 20 bp, mouse
gggagtaaagacgccagcag

SEQ ID NO: 524037 - DNA, 20 bp, mouse
gacaaggcggcgacccccga

SEQ ID NO: 524038 - DNA, 20 bp, mouse
gcgggcgcaggcgagtgcta

SEQ ID NO: 524039 - DNA, 20 bp, mouse
gggtgacagcatggcctccc

SEQ ID NO: 524040 - DNA, 20 bp, mouse
ggggatggtgaggaacaagg

SEQ ID NO: 524041 - DNA, 20 bp, mouse
gccgcctgacgtgccctcgg

SEQ ID NO: 524042 - DNA, 20 bp, mouse
gacccggcagggaacctcgc

SEQ ID NO: 524043 - DNA, 20 bp, mouse
gggaaacccacagggaaaga

SEQ ID NO: 524044 - DNA, 20 bp, mouse
ggtggccggcggtgtgtccc

SEQ ID NO: 524045 - DNA, 20 bp, mouse
ggcctcccgggacacaccgc

SEQ ID NO: 524046 - DNA, 20 bp, mouse
ggaagtcgcggcgagagcta

SEQ ID NO: 524047 - DNA, 20 bp, mouse
gcctccccccagagaagtcg

SEQ ID NO: 524048 - DNA, 20 bp, mouse
gcggcgagagctatgggtcc

SEQ ID NO: 524049 - DNA, 20 bp, mouse
ggagagctatgggtccgggc

SEQ ID NO: 524050 - DNA, 20 bp, mouse
ggagtcctagagggaggcta

SEQ ID NO: 524051 - DNA, 20 bp, mouse
gctcgccgcgacttctctgg

SEQ ID NO: 524052 - DNA, 20 bp, mouse
gtgggcctcagcccgaggag

SEQ ID NO: 524053 - DNA, 20 bp, mouse
gacccgagagtcctagaggg

SEQ ID NO: 524054 - DNA, 20 bp, mouse
gagcccgaggagcggaccgc

SEQ ID NO: 524055 - DNA, 20 bp, mouse
ggcctccctctaggactctc

SEQ ID NO: 524056 - DNA, 20 bp, mouse
gtgcacggcgaggccctcac

SEQ ID NO: 524057 - DNA, 20 bp, mouse
gcggctcccgggacggcgag

SEQ ID NO: 524058 - DNA, 20 bp, mouse
gacggcgagaggcaagcgga

SEQ ID NO: 524059 - DNA, 20 bp, mouse
gcgggacggcgagaggcaag

SEQ ID NO: 524060 - DNA, 20 bp, mouse
ggctgccgcacggccagggg

SEQ ID NO: 524061 - DNA, 20 bp, mouse
ggcagtgcttcttcctgtga

SEQ ID NO: 524062 - DNA, 20 bp, mouse
gagggttgcgccggctggag

SEQ ID NO: 524063 - DNA, 20 bp, mouse
gccccgcgcggcttcacagg

SEQ ID NO: 524064 - DNA, 20 bp, mouse
gagctcccgccggtcacctc

SEQ ID NO: 524065 - DNA, 20 bp, mouse
gttccgctcctgcggctccc

SEQ ID NO: 524066 - DNA, 20 bp, mouse
gtctcctctcccccaagtgg

SEQ ID NO: 524067 - DNA, 20 bp, mouse
gactgccggactggacaggg

SEQ ID NO: 524068 - DNA, 20 bp, mouse
ggcgactgccggactggaca

SEQ ID NO: 524069 - DNA, 20 bp, mouse
ggaagggccagccaccactt

SEQ ID NO: 524070 - DNA, 20 bp, mouse
ggagaggagaggtcagcaag

SEQ ID NO: 524071 - DNA, 20 bp, mouse
ggcccgctgctcctagggaa

SEQ ID NO: 524072 - DNA, 20 bp, mouse
gcaggcaggaggacccgcga

SEQ ID NO: 524073 - DNA, 20 bp, mouse
gacaactgcacacttgagaa

SEQ ID NO: 524074 - DNA, 20 bp, mouse
gagtcgcccggggcccaacc

SEQ ID NO: 524075 - DNA, 20 bp, mouse
gccccgggcgactgccggac

SEQ ID NO: 524076 - DNA, 20 bp, mouse
gggaggtcccagttcaagtg

SEQ ID NO: 524077 - DNA, 20 bp, mouse
ggtgaggctgtgcagtctag

SEQ ID NO: 524078 - DNA, 20 bp, mouse
gcagtccaccgtggcctcac

SEQ ID NO: 524079 - DNA, 20 bp, mouse
gaggcacatggccaggctag

SEQ ID NO: 524080 - DNA, 20 bp, mouse
gagagctaagtcagcctgtg

SEQ ID NO: 524081 - DNA, 20 bp, mouse
ggcacagcctcacttgaact

SEQ ID NO: 524082 - DNA, 20 bp, mouse
gatcctgtggcctctcctct

SEQ ID NO: 524083 - DNA, 20 bp, mouse
gggctgacttagctctcact

SEQ ID NO: 524084 - DNA, 20 bp, mouse
gctcagttatcagtccaccg

SEQ ID NO: 524085 - DNA, 20 bp, mouse
ggacccaggttgaaagaagg

SEQ ID NO: 524086 - DNA, 20 bp, mouse
gagcgcttcggggaacatgg

SEQ ID NO: 524087 - DNA, 20 bp, mouse
gtacatcaggaatctgaccg

SEQ ID NO: 524088 - DNA, 20 bp, mouse
gtcgagcgcttcggggaaca

SEQ ID NO: 524089 - DNA, 20 bp, mouse
ggaggcgggacgaaggttag

SEQ ID NO: 524090 - DNA, 20 bp, mouse
gggaacatggcggcggacct

SEQ ID NO: 524091 - DNA, 20 bp, mouse
gaccttcgtcccgcctccaa

SEQ ID NO: 524092 - DNA, 20 bp, mouse
gatgtagacattgattcgga

SEQ ID NO: 524093 - DNA, 20 bp, mouse
ggcccagagatcgagcgctt

SEQ ID NO: 524094 - DNA, 20 bp, mouse
gggccccacactgaactcta

SEQ ID NO: 524095 - DNA, 20 bp, mouse
ggggctgagtaccacggtga

SEQ ID NO: 524096 - DNA, 20 bp, mouse
gagcggcgcggaaaacaatg

SEQ ID NO: 524097 - DNA, 20 bp, mouse
gcaatggggcaggggtatag

SEQ ID NO: 524098 - DNA, 20 bp, mouse
ggaagcggaggaacccgaag

SEQ ID NO: 524099 - DNA, 20 bp, mouse
gggcaggtgggtagcaccat

SEQ ID NO: 524100 - DNA, 20 bp, mouse
ggacaggccgaagcctgagg

SEQ ID NO: 524101 - DNA, 20 bp, mouse
gtccgggccgtcagaagcgg

SEQ ID NO: 524102 - DNA, 20 bp, mouse
gggatccgggccgtcagaag

SEQ ID NO: 524103 - DNA, 20 bp, mouse
ggcggacaggccgaagcctg

SEQ ID NO: 524104 - DNA, 20 bp, mouse
gactccgccatggggcaggt

SEQ ID NO: 524105 - DNA, 20 bp, mouse
gtagcaccatgggccgcggg

SEQ ID NO: 524106 - DNA, 20 bp, mouse
gacaggccagctacacgaca

SEQ ID NO: 524107 - DNA, 20 bp, mouse
ggccagctacacgacaggga

SEQ ID NO: 524108 - DNA, 20 bp, mouse
gggaggagaggtgcagacag

SEQ ID NO: 524109 - DNA, 20 bp, mouse
gtcaaggagctggcagaaac

SEQ ID NO: 524110 - DNA, 20 bp, mouse
gacagggatggacgattgtt

SEQ ID NO: 524111 - DNA, 20 bp, mouse
gggattgctctagagctgtg

SEQ ID NO: 524112 - DNA, 20 bp, mouse
gagggcagggccccgtccac

SEQ ID NO: 524113 - DNA, 20 bp, mouse
gcagttctcagcgcagttgg

SEQ ID NO: 524114 - DNA, 20 bp, mouse
gagggccccgtccaccggag

SEQ ID NO: 524115 - DNA, 20 bp, mouse
gtgtttggtttttagaactc

SEQ ID NO: 524116 - DNA, 20 bp, mouse
gtatcactccgctggcatgg

SEQ ID NO: 524117 - DNA, 20 bp, mouse
gatgccagcggagtgatatc

SEQ ID NO: 524118 - DNA, 20 bp, mouse
gcagcctggccgagcattag

SEQ ID NO: 524119 - DNA, 20 bp, mouse
ggcctagacatcgagtcctc

SEQ ID NO: 524120 - DNA, 20 bp, mouse
gcgcgcgagctcagtaaaca

SEQ ID NO: 524121 - DNA, 20 bp, mouse
gtaaacacatggacagtccg

SEQ ID NO: 524122 - DNA, 20 bp, mouse
gagctcagtaaacacggcag

SEQ ID NO: 524123 - DNA, 20 bp, mouse
ggcccgaggactcgatgtct

SEQ ID NO: 524124 - DNA, 20 bp, mouse
ggtactttgagaacacgggg

SEQ ID NO: 524125 - DNA, 20 bp, mouse
gggctgggcaagtaaacaca

SEQ ID NO: 524126 - DNA, 20 bp, mouse
gcgcgagctgaagcgacggg

SEQ ID NO: 524127 - DNA, 20 bp, mouse
ggttaggccagtctgagagg

SEQ ID NO: 524128 - DNA, 20 bp, mouse
gctcgcggccaagttcatgc

SEQ ID NO: 524129 - DNA, 20 bp, mouse
gggccgcgagctgaagcgac

SEQ ID NO: 524130 - DNA, 20 bp, mouse
gagcgccgccagcatgaact

SEQ ID NO: 524131 - DNA, 20 bp, mouse
ggagctccgcaacacggtaa

SEQ ID NO: 524132 - DNA, 20 bp, mouse
gcatgctggcggcgctgcag

SEQ ID NO: 524133 - DNA, 20 bp, mouse
ggaatggagcgagcagattg

SEQ ID NO: 524134 - DNA, 20 bp, mouse
ggctggcggcgctgcagtgg

SEQ ID NO: 524135 - DNA, 20 bp, mouse
gctccagtggggggactcta

SEQ ID NO: 524136 - DNA, 20 bp, mouse
gagtaagtgtgggcccccaa

SEQ ID NO: 524137 - DNA, 20 bp, mouse
gatccgaagctgcaggacta

SEQ ID NO: 524138 - DNA, 20 bp, mouse
ggcagcttcggatccacaga

SEQ ID NO: 524139 - DNA, 20 bp, mouse
gtcaagactgcagtaagtgt

SEQ ID NO: 524140 - DNA, 20 bp, mouse
gtgtgggcccccaaggggag

SEQ ID NO: 524141 - DNA, 20 bp, mouse
ggcagtcttgattccgtctg

SEQ ID NO: 524142 - DNA, 20 bp, mouse
gggaaacgttagggtatctg

SEQ ID NO: 524143 - DNA, 20 bp, mouse
ggggacagggaaagcgggaa

SEQ ID NO: 524144 - DNA, 20 bp, mouse
gctccatccaggaaacgtta

SEQ ID NO: 524145 - DNA, 20 bp, mouse
gagtgggtgggggaaatgac

SEQ ID NO: 524146 - DNA, 20 bp, mouse
ggccgcgacggagggcagta

SEQ ID NO: 524147 - DNA, 20 bp, mouse
gcggcgtgagccagcgaacc

SEQ ID NO: 524148 - DNA, 20 bp, mouse
ggctctgaggccccgggaca

SEQ ID NO: 524149 - DNA, 20 bp, mouse
ggcaagggcggcgcacctct

SEQ ID NO: 524150 - DNA, 20 bp, mouse
ggcactgccggtctcccgag

SEQ ID NO: 524151 - DNA, 20 bp, mouse
gagcgagcgcaccgacctgc

SEQ ID NO: 524152 - DNA, 20 bp, mouse
gaggccccgggacacggctc

SEQ ID NO: 524153 - DNA, 20 bp, mouse
gggcacctcggtggcaaggg

SEQ ID NO: 524154 - DNA, 20 bp, mouse
gtagcacgcgtacagccggg

SEQ ID NO: 524155 - DNA, 20 bp, mouse
gaccgtactgccctccgtcg

SEQ ID NO: 524156 - DNA, 20 bp, mouse
gccctcagccgaggccgcga

SEQ ID NO: 524157 - DNA, 20 bp, mouse
ggccgaggccgcgagggcga

SEQ ID NO: 524158 - DNA, 20 bp, mouse
gccggcgcgatgctcagagg

SEQ ID NO: 524159 - DNA, 20 bp, mouse
gcagcgacgaccctcagccg

SEQ ID NO: 524160 - DNA, 20 bp, mouse
gctcctgacagagcgcgcgg

SEQ ID NO: 524161 - DNA, 20 bp, mouse
ggccccggcgcgatgctcag

SEQ ID NO: 524162 - DNA, 20 bp, mouse
gctccgcggcttccaagcag

SEQ ID NO: 524163 - DNA, 20 bp, mouse
gcgcgggcgctgtagtgttc

SEQ ID NO: 524164 - DNA, 20 bp, mouse
ggccctcgcggcctcggctg

SEQ ID NO: 524165 - DNA, 20 bp, mouse
gcgggacgccgtcgccctcg

SEQ ID NO: 524166 - DNA, 20 bp, mouse
gccgcgggctgccataacga

SEQ ID NO: 524167 - DNA, 20 bp, mouse
gcaagactgagaaagaccgc

SEQ ID NO: 524168 - DNA, 20 bp, mouse
gggtgtggatgccttcgtta

SEQ ID NO: 524169 - DNA, 20 bp, mouse
gcctcagctcaggatcccca

SEQ ID NO: 524170 - DNA, 20 bp, mouse
gaaaagacctcgcttgctgg

SEQ ID NO: 524171 - DNA, 20 bp, mouse
ggctggggaagccttaccga

SEQ ID NO: 524172 - DNA, 20 bp, mouse
gcgacaacagcaagagccgg

SEQ ID NO: 524173 - DNA, 20 bp, mouse
gccccagggcacctgacatt

SEQ ID NO: 524174 - DNA, 20 bp, mouse
gctcgcttgctggaggcgtc

SEQ ID NO: 524175 - DNA, 20 bp, mouse
gcaacagcaagagccggcgg

SEQ ID NO: 524176 - DNA, 20 bp, mouse
ggagtcctcagagtcctcaa

SEQ ID NO: 524177 - DNA, 20 bp, mouse
gcgcggggagagggataccc

SEQ ID NO: 524178 - DNA, 20 bp, mouse
gcacccgccgcagctccaga

SEQ ID NO: 524179 - DNA, 20 bp, mouse
gggagcagcggcggcccgtc

SEQ ID NO: 524180 - DNA, 20 bp, mouse
gccggcgccgcaactcggga

SEQ ID NO: 524181 - DNA, 20 bp, mouse
ggcgctgtcgcagtgagagc

SEQ ID NO: 524182 - DNA, 20 bp, mouse
gtcacctgttcccggccccg

SEQ ID NO: 524183 - DNA, 20 bp, mouse
gtgcggcgggtgagcctgcg

SEQ ID NO: 524184 - DNA, 20 bp, mouse
gggacggcatgtgaccactc

SEQ ID NO: 524185 - DNA, 20 bp, mouse
gggtgagcctgcgcggctag

SEQ ID NO: 524186 - DNA, 20 bp, mouse
gcgccacgagccggaggaga

SEQ ID NO: 524187 - DNA, 20 bp, mouse
gaccgcccgccacgagccgg

SEQ ID NO: 524188 - DNA, 20 bp, mouse
gccgggaggaggcaagccga

SEQ ID NO: 524189 - DNA, 20 bp, mouse
gcgggcgcctattgacccaa

SEQ ID NO: 524190 - DNA, 20 bp, mouse
gtgtaccgcccgccacgagc

SEQ ID NO: 524191 - DNA, 20 bp, mouse
gcccgcgagggggaaggtag

SEQ ID NO: 524192 - DNA, 20 bp, mouse
ggagaggaccgtccccggag

SEQ ID NO: 524193 - DNA, 20 bp, mouse
gctgcacgcggagggcgcag

SEQ ID NO: 524194 - DNA, 20 bp, mouse
gcagcggccgttgggtcaat

SEQ ID NO: 524195 - DNA, 20 bp, mouse
ggcggtacaggagcgccgag

SEQ ID NO: 524196 - DNA, 20 bp, mouse
gcggctgcggggccgagcag

SEQ ID NO: 524197 - DNA, 20 bp, mouse
ggtgcgcccggcaggaggag

SEQ ID NO: 524198 - DNA, 20 bp, mouse
gtcccccgggatgcgagcag

SEQ ID NO: 524199 - DNA, 20 bp, mouse
gcccgggatgcgagcagtgg

SEQ ID NO: 524200 - DNA, 20 bp, mouse
gcggccggccgggtcccgag

SEQ ID NO: 524201 - DNA, 20 bp, mouse
ggcagttgcgcaggctaaga

SEQ ID NO: 524202 - DNA, 20 bp, mouse
gggcccggacccaatctcca

SEQ ID NO: 524203 - DNA, 20 bp, mouse
gggcgggagcgcgggagcac

SEQ ID NO: 524204 - DNA, 20 bp, mouse
gcaggagctgggtcaccgtg

SEQ ID NO: 524205 - DNA, 20 bp, mouse
ggcaccgctcggccccgtgg

SEQ ID NO: 524206 - DNA, 20 bp, mouse
gccaccagcacggacaccag

SEQ ID NO: 524207 - DNA, 20 bp, mouse
ggctagggtagagaaagcca

SEQ ID NO: 524208 - DNA, 20 bp, mouse
ggcggcgtcgccggaaccat

SEQ ID NO: 524209 - DNA, 20 bp, mouse
gacaccagaggtgagcggtc

SEQ ID NO: 524210 - DNA, 20 bp, mouse
ggcaccggaccgctcacctc

SEQ ID NO: 524211 - DNA, 20 bp, mouse
ggtgctggtggcgggaacac

SEQ ID NO: 524212 - DNA, 20 bp, mouse
gtggtggcgggaacaccggg

SEQ ID NO: 524213 - DNA, 20 bp, mouse
gtcgccggaaccatgggcac

SEQ ID NO: 524214 - DNA, 20 bp, mouse
gattctcagggatttagcta

SEQ ID NO: 524215 - DNA, 20 bp, mouse
ggagctcatccagagccacc

SEQ ID NO: 524216 - DNA, 20 bp, mouse
ggcaacagctggccgagtag

SEQ ID NO: 524217 - DNA, 20 bp, mouse
ggcgcagcggccccattgct

SEQ ID NO: 524218 - DNA, 20 bp, mouse
ggtcccactgcccagcaatg

SEQ ID NO: 524219 - DNA, 20 bp, mouse
ggaagtggaccgctctaccc

SEQ ID NO: 524220 - DNA, 20 bp, mouse
gcagcgggtcctgggtagag

SEQ ID NO: 524221 - DNA, 20 bp, mouse
gccgggaagagaggcgacct

SEQ ID NO: 524222 - DNA, 20 bp, mouse
ggtagcggcagccagcgcag

SEQ ID NO: 524223 - DNA, 20 bp, mouse
gtgccagggcagcgggtcct

SEQ ID NO: 524224 - DNA, 20 bp, mouse
gtacccaggacccgctgccc

SEQ ID NO: 524225 - DNA, 20 bp, mouse
gccgacccagccgggaagag

SEQ ID NO: 524226 - DNA, 20 bp, mouse
gggaaggcgcatcgccatgg

SEQ ID NO: 524227 - DNA, 20 bp, mouse
ggagggaaggcgcatcgcca

SEQ ID NO: 524228 - DNA, 20 bp, mouse
gtgcgccagtgcttcaagaa

SEQ ID NO: 524229 - DNA, 20 bp, mouse
gcagcaccaaggatcttccg

SEQ ID NO: 524230 - DNA, 20 bp, mouse
gcagtcggtgaagtagatcg

SEQ ID NO: 524231 - DNA, 20 bp, mouse
gtccaagcggtgcaacgagc

SEQ ID NO: 524232 - DNA, 20 bp, mouse
gagcgccgttcttgaagcac

SEQ ID NO: 524233 - DNA, 20 bp, mouse
gaccaaggatcttccgggga

SEQ ID NO: 524234 - DNA, 20 bp, mouse
gctggcgcaccactttcgag

SEQ ID NO: 524235 - DNA, 20 bp, mouse
gttctccacccgctcgaaag

SEQ ID NO: 524236 - DNA, 20 bp, mouse
gccgctcgcaagcaggaacc

SEQ ID NO: 524237 - DNA, 20 bp, mouse
gaggcttgggcgacactgcc

SEQ ID NO: 524238 - DNA, 20 bp, mouse
gagcacgggctgatccaggt

SEQ ID NO: 524239 - DNA, 20 bp, mouse
gccaggccttggcaaggctt

SEQ ID NO: 524240 - DNA, 20 bp, mouse
gtagcgccaatatcaagagc

SEQ ID NO: 524241 - DNA, 20 bp, mouse
gggtcagtaggtgcagctgt

SEQ ID NO: 524242 - DNA, 20 bp, mouse
gtttcgggccggctgcgtgg

SEQ ID NO: 524243 - DNA, 20 bp, mouse
ggtcactgaagacccagcga

SEQ ID NO: 524244 - DNA, 20 bp, mouse
gcaccagcacgggctgatcc

SEQ ID NO: 524245 - DNA, 20 bp, mouse
gcttcacctgctcttgatat

SEQ ID NO: 524246 - DNA, 20 bp, mouse
gttccgggaggtaagtattg

SEQ ID NO: 524247 - DNA, 20 bp, mouse
gggcggcgcggcgttccggg

SEQ ID NO: 524248 - DNA, 20 bp, mouse
gtattgaggctcggataacc

SEQ ID NO: 524249 - DNA, 20 bp, mouse
gcccggccgaggcttcccgg

SEQ ID NO: 524250 - DNA, 20 bp, mouse
ggcggcgttgcgggttacag

SEQ ID NO: 524251 - DNA, 20 bp, mouse
gtaacccggccgaggcttcc

SEQ ID NO: 524252 - DNA, 20 bp, mouse
ggaacgccgcgccgccgcac

SEQ ID NO: 524253 - DNA, 20 bp, mouse
gggtcacgagggatcacttc

SEQ ID NO: 524254 - DNA, 20 bp, mouse
gcgagggatcacttccggtg

SEQ ID NO: 524255 - DNA, 20 bp, mouse
gcctgcgccgggaccagccg

SEQ ID NO: 524256 - DNA, 20 bp, mouse
gaagagctgtcagccctggt

SEQ ID NO: 524257 - DNA, 20 bp, mouse
gtcagccctggtaggattca

SEQ ID NO: 524258 - DNA, 20 bp, mouse
gagaaccgtgaatcctacca

SEQ ID NO: 524259 - DNA, 20 bp, mouse
gggtgcggacactaacctag

SEQ ID NO: 524260 - DNA, 20 bp, mouse
gctagcggcggggaccggcg

SEQ ID NO: 524261 - DNA, 20 bp, mouse
gcttatccggtgggtccacg

SEQ ID NO: 524262 - DNA, 20 bp, mouse
gtgtctgcggaggaacaagt

SEQ ID NO: 524263 - DNA, 20 bp, mouse
gcgtaagctgggctaggaga

SEQ ID NO: 524264 - DNA, 20 bp, mouse
gctagaggcccggggtcaaa

SEQ ID NO: 524265 - DNA, 20 bp, mouse
ggcctcacaattgctcaccg

SEQ ID NO: 524266 - DNA, 20 bp, mouse
ggccgccgcgctaacagctc

SEQ ID NO: 524267 - DNA, 20 bp, mouse
gtccggagctgttagcgcgg

SEQ ID NO: 524268 - DNA, 20 bp, mouse
gccgggccatggctttcccg

SEQ ID NO: 524269 - DNA, 20 bp, mouse
ggctgtggtctgggacgcgc

SEQ ID NO: 524270 - DNA, 20 bp, mouse
ggggcggaatggcgcgactc

SEQ ID NO: 524271 - DNA, 20 bp, mouse
gcctcgggacgcctctcgaa

SEQ ID NO: 524272 - DNA, 20 bp, mouse
ggactccggagctgttagcg

SEQ ID NO: 524273 - DNA, 20 bp, mouse
gcacgctcaaggccccggac

SEQ ID NO: 524274 - DNA, 20 bp, mouse
ggcgcggcggcgggcaccgc

SEQ ID NO: 524275 - DNA, 20 bp, mouse
gcgctcgccggctgtggtct

SEQ ID NO: 524276 - DNA, 20 bp, mouse
gagacggctgaggaggatgt

SEQ ID NO: 524277 - DNA, 20 bp, mouse
gctgtcaggcagcacgctca

SEQ ID NO: 524278 - DNA, 20 bp, mouse
ggcggtggtggagacggctg

SEQ ID NO: 524279 - DNA, 20 bp, mouse
ggaggatgtgggctacgcgc

SEQ ID NO: 524280 - DNA, 20 bp, mouse
ggtggtggagacggctgagg

SEQ ID NO: 524281 - DNA, 20 bp, mouse
ggccgcagcgcccggctgtc

SEQ ID NO: 524282 - DNA, 20 bp, mouse
gccaaggaaagcgaaagggt

SEQ ID NO: 524283 - DNA, 20 bp, mouse
gcggggctccgctggagaaa

SEQ ID NO: 524284 - DNA, 20 bp, mouse
gtaggcccgggaaataagtg

SEQ ID NO: 524285 - DNA, 20 bp, mouse
gtgcggccaggagactgtga

SEQ ID NO: 524286 - DNA, 20 bp, mouse
gtctacccgaggccagccag

SEQ ID NO: 524287 - DNA, 20 bp, mouse
gggctctggggaggatcgca

SEQ ID NO: 524288 - DNA, 20 bp, mouse
gaaaatctgcgggaccggtg

SEQ ID NO: 524289 - DNA, 20 bp, mouse
gacccgaggccagccagagg

SEQ ID NO: 524290 - DNA, 20 bp, mouse
gtgcgacggaagcaggaact

SEQ ID NO: 524291 - DNA, 20 bp, mouse
ggctgggccccggaaaggaa

SEQ ID NO: 524292 - DNA, 20 bp, mouse
gttggtcacgacaaaatctg

SEQ ID NO: 524293 - DNA, 20 bp, mouse
ggaccctagggaccagactt

SEQ ID NO: 524294 - DNA, 20 bp, mouse
gggtagacgcgaccccttgt

SEQ ID NO: 524295 - DNA, 20 bp, mouse
gcttgggcccaaggacagtt

SEQ ID NO: 524296 - DNA, 20 bp, mouse
gatctctccgtgctgaaggg

SEQ ID NO: 524297 - DNA, 20 bp, mouse
gggcagctggagctgatcat

SEQ ID NO: 524298 - DNA, 20 bp, mouse
gcttcagcacggagagatgc

SEQ ID NO: 524299 - DNA, 20 bp, mouse
ggctctcaccatccttccgg

SEQ ID NO: 524300 - DNA, 20 bp, mouse
gcacggagagatgcgggctg

SEQ ID NO: 524301 - DNA, 20 bp, mouse
gggacctggaggagtctcag

SEQ ID NO: 524302 - DNA, 20 bp, mouse
ggtactactcggagaacacc

SEQ ID NO: 524303 - DNA, 20 bp, mouse
gaatctctgtagaacacagt

SEQ ID NO: 524304 - DNA, 20 bp, mouse
gcaggtccaagagcatcccc

SEQ ID NO: 524305 - DNA, 20 bp, mouse
ggagcatccccgggaagcgg

SEQ ID NO: 524306 - DNA, 20 bp, mouse
gacatgtggcctgtgatact

SEQ ID NO: 524307 - DNA, 20 bp, mouse
gacgtagtcgtgattggagg

SEQ ID NO: 524308 - DNA, 20 bp, mouse
gaggggccctagatgaccag

SEQ ID NO: 524309 - DNA, 20 bp, mouse
gggcttctccagatccgtca

SEQ ID NO: 524310 - DNA, 20 bp, mouse
gtgttcgacgtagtcgtgat

SEQ ID NO: 524311 - DNA, 20 bp, mouse
gtcgacgtagtcgtgattgg

SEQ ID NO: 524312 - DNA, 20 bp, mouse
gacccaaaccatgacggatc

SEQ ID NO: 524313 - DNA, 20 bp, mouse
gtgattggaggcggcatctc

SEQ ID NO: 524314 - DNA, 20 bp, mouse
gccctacccctggtcatcta

SEQ ID NO: 524315 - DNA, 20 bp, mouse
gcacgactacgtcgaacatg

SEQ ID NO: 524316 - DNA, 20 bp, mouse
gggtccagacgcagtagcag

SEQ ID NO: 524317 - DNA, 20 bp, mouse
ggcagcgcggtcgcaggcag

SEQ ID NO: 524318 - DNA, 20 bp, mouse
ggcagcggacgcaagagacc

SEQ ID NO: 524319 - DNA, 20 bp, mouse
gacctacagtctagaatcta

SEQ ID NO: 524320 - DNA, 20 bp, mouse
ggagtccctgggccacaagt

SEQ ID NO: 524321 - DNA, 20 bp, mouse
gcagtaagcagcgcggtcgc

SEQ ID NO: 524322 - DNA, 20 bp, mouse
ggaggggacagtaagcagcg

SEQ ID NO: 524323 - DNA, 20 bp, mouse
gaaaggcctgcaaagcaaag

SEQ ID NO: 524324 - DNA, 20 bp, mouse
gtaaagccagctagtgtgag

SEQ ID NO: 524325 - DNA, 20 bp, mouse
gtagactgtaggtgtacctg

SEQ ID NO: 524326 - DNA, 20 bp, mouse
gtcgcccggggcaacagcaa

SEQ ID NO: 524327 - DNA, 20 bp, mouse
ggcaacagcaatggcgacca

SEQ ID NO: 524328 - DNA, 20 bp, mouse
gacagcaatggcgaccacgg

SEQ ID NO: 524329 - DNA, 20 bp, mouse
gggcagggtgcaggcgcagt

SEQ ID NO: 524330 - DNA, 20 bp, mouse
ggccgggcggctcttctcgc

SEQ ID NO: 524331 - DNA, 20 bp, mouse
gtccagcgagaagagccgcc

SEQ ID NO: 524332 - DNA, 20 bp, mouse
gttctcgctggagctgctcg

SEQ ID NO: 524333 - DNA, 20 bp, mouse
gctggagctgctcgtggact

SEQ ID NO: 524334 - DNA, 20 bp, mouse
gcctcgctcccgcttccggt

SEQ ID NO: 524335 - DNA, 20 bp, mouse
gccggcgggaagacgagcag

SEQ ID NO: 524336 - DNA, 20 bp, mouse
gcactccgcgggagtttcca

SEQ ID NO: 524337 - DNA, 20 bp, mouse
gccgccagctcagaacccgg

SEQ ID NO: 524338 - DNA, 20 bp, mouse
ggtcgccatggaaactcccg

SEQ ID NO: 524339 - DNA, 20 bp, mouse
gcagctagcctaacactccg

SEQ ID NO: 524340 - DNA, 20 bp, mouse
gggatgggcaagcaaggtgt

SEQ ID NO: 524341 - DNA, 20 bp, mouse
gagctccggagttgtctcca

SEQ ID NO: 524342 - DNA, 20 bp, mouse
ggaggccggtgccgcggtag

SEQ ID NO: 524343 - DNA, 20 bp, mouse
ggcaccgccagctcagaacc

SEQ ID NO: 524344 - DNA, 20 bp, mouse
ggaaactcccgcggagtgtt

SEQ ID NO: 524345 - DNA, 20 bp, mouse
gggccgcgcggtcccggctt

SEQ ID NO: 524346 - DNA, 20 bp, mouse
gccgcagagcagaggagcgg

SEQ ID NO: 524347 - DNA, 20 bp, mouse
gagcagaggagcggcgggag

SEQ ID NO: 524348 - DNA, 20 bp, mouse
gggcaggatggcgaccgtgg

SEQ ID NO: 524349 - DNA, 20 bp, mouse
gcggtcccgaggccccccag

SEQ ID NO: 524350 - DNA, 20 bp, mouse
gttctcctgccgcagagcag

SEQ ID NO: 524351 - DNA, 20 bp, mouse
gttgagcagagccggcagga

SEQ ID NO: 524352 - DNA, 20 bp, mouse
gctgcccgatggctccggtt

SEQ ID NO: 524353 - DNA, 20 bp, mouse
gaggatggcgaccgtggtgg

SEQ ID NO: 524354 - DNA, 20 bp, mouse
gcgtaaccgaagagcacctg

SEQ ID NO: 524355 - DNA, 20 bp, mouse
ggccagcacgaccccaccca

SEQ ID NO: 524356 - DNA, 20 bp, mouse
gctccggggctcgagctcaa

SEQ ID NO: 524357 - DNA, 20 bp, mouse
gctcgagctcaagggctgcg

SEQ ID NO: 524358 - DNA, 20 bp, mouse
gtgcgggaggtaactcgcct

SEQ ID NO: 524359 - DNA, 20 bp, mouse
gcggctcagagatgcgtctg

SEQ ID NO: 524360 - DNA, 20 bp, mouse
gaactcgcctgggtgacgtc

SEQ ID NO: 524361 - DNA, 20 bp, mouse
gcggccggccggaccccggg

SEQ ID NO: 524362 - DNA, 20 bp, mouse
gcccatccctcgatccccga

SEQ ID NO: 524363 - DNA, 20 bp, mouse
gcagcttcggtgaggccctg

SEQ ID NO: 524364 - DNA, 20 bp, mouse
gcagcggcgcagcttcggtg

SEQ ID NO: 524365 - DNA, 20 bp, mouse
gaactgccatcggggatcga

SEQ ID NO: 524366 - DNA, 20 bp, mouse
gcggccccgcaagacaccac

SEQ ID NO: 524367 - DNA, 20 bp, mouse
gcccggagcgacgcagccag

SEQ ID NO: 524368 - DNA, 20 bp, mouse
ggcccggggatgggagatcc

SEQ ID NO: 524369 - DNA, 20 bp, mouse
gcccgagaccaatatcccac

SEQ ID NO: 524370 - DNA, 20 bp, mouse
gctgtcatggccgctctcgg

SEQ ID NO: 524371 - DNA, 20 bp, mouse
gactggaggcccgaccccgg

SEQ ID NO: 524372 - DNA, 20 bp, mouse
gcaggggacgccgagcccat

SEQ ID NO: 524373 - DNA, 20 bp, mouse
ggtcttgcggggccgagacc

SEQ ID NO: 524374 - DNA, 20 bp, mouse
gcgagggcggcccccgagag

SEQ ID NO: 524375 - DNA, 20 bp, mouse
gaggcgtggcggaagctcgg

SEQ ID NO: 524376 - DNA, 20 bp, mouse
gtgggcgcctccacagcctc

SEQ ID NO: 524377 - DNA, 20 bp, mouse
gccagcaacagtagggagct

SEQ ID NO: 524378 - DNA, 20 bp, mouse
gatggcggcgccggaggctg

SEQ ID NO: 524379 - DNA, 20 bp, mouse
ggacgtaggccagcagcccg

SEQ ID NO: 524380 - DNA, 20 bp, mouse
gggcgctcagagcgtcgggg

SEQ ID NO: 524381 - DNA, 20 bp, mouse
ggcgaagatggcggcagtga

SEQ ID NO: 524382 - DNA, 20 bp, mouse
gcgtggcctacgatccagac

SEQ ID NO: 524383 - DNA, 20 bp, mouse
gcgtcggggcggtgcgaaga

SEQ ID NO: 524384 - DNA, 20 bp, mouse
gccagacccagtaacccgtg

SEQ ID NO: 524385 - DNA, 20 bp, mouse
gggcggggcgctcagagcgt

SEQ ID NO: 524386 - DNA, 20 bp, mouse
gagaggccgtagggaagcgg

SEQ ID NO: 524387 - DNA, 20 bp, mouse
gtagggaagcggaggtagag

SEQ ID NO: 524388 - DNA, 20 bp, mouse
ggaaagagaaagaggccgta

SEQ ID NO: 524389 - DNA, 20 bp, mouse
ggaaagaggccgtagggaag

SEQ ID NO: 524390 - DNA, 20 bp, mouse
ggggctgcgcgggctctcgg

SEQ ID NO: 524391 - DNA, 20 bp, mouse
gccggcgaccgaagaaacga

SEQ ID NO: 524392 - DNA, 20 bp, mouse
gcgaagaaacgagggaaaga

SEQ ID NO: 524393 - DNA, 20 bp, mouse
gctggctggcggctcctctc

SEQ ID NO: 524394 - DNA, 20 bp, mouse
gtctctggcagaggcacggg

SEQ ID NO: 524395 - DNA, 20 bp, mouse
ggggctctcggcggtggagg

SEQ ID NO: 524396 - DNA, 20 bp, mouse
gagctagcgacacagaacag

SEQ ID NO: 524397 - DNA, 20 bp, mouse
gctgaagcagggttctgcgg

SEQ ID NO: 524398 - DNA, 20 bp, mouse
gttccacggcacacacagac

SEQ ID NO: 524399 - DNA, 20 bp, mouse
gctttcagactgcgtctgtc

SEQ ID NO: 524400 - DNA, 20 bp, mouse
gctcctgtctgtgtgtgccg

SEQ ID NO: 524401 - DNA, 20 bp, mouse
gtgcagcaatacccctcgaa

SEQ ID NO: 524402 - DNA, 20 bp, mouse
gaacagaggaagcactgatt

SEQ ID NO: 524403 - DNA, 20 bp, mouse
gtcttacagactccattcga

SEQ ID NO: 524404 - DNA, 20 bp, mouse
gtcaaaggatcagctttatg

SEQ ID NO: 524405 - DNA, 20 bp, mouse
gggtattgctgcatatctac

SEQ ID NO: 524406 - DNA, 20 bp, mouse
gtcggctctgcccagagtcg

SEQ ID NO: 524407 - DNA, 20 bp, mouse
gctctgggcagagccgaggg

SEQ ID NO: 524408 - DNA, 20 bp, mouse
ggctctgcccagagtcgggg

SEQ ID NO: 524409 - DNA, 20 bp, mouse
gtcactgggacgtctgtgcg

SEQ ID NO: 524410 - DNA, 20 bp, mouse
gacgtctgtgcgcggcgtct

SEQ ID NO: 524411 - DNA, 20 bp, mouse
gagtgcggccaccgctgctc

SEQ ID NO: 524412 - DNA, 20 bp, mouse
ggcaggccccgcccccacgg

SEQ ID NO: 524413 - DNA, 20 bp, mouse
ggcgcggcgtctcggagcgc

SEQ ID NO: 524414 - DNA, 20 bp, mouse
gagctcggccgagtgagtac

SEQ ID NO: 524415 - DNA, 20 bp, mouse
ggccgagtgagtaccgggag

SEQ ID NO: 524416 - DNA, 20 bp, mouse
gggcgagcagaccgacgccg

SEQ ID NO: 524417 - DNA, 20 bp, mouse
gcagcgcagccgggaggtcg

SEQ ID NO: 524418 - DNA, 20 bp, mouse
gcgtcagcttcactcggcct

SEQ ID NO: 524419 - DNA, 20 bp, mouse
gcgggaggtcggggaacagg

SEQ ID NO: 524420 - DNA, 20 bp, mouse
gctgcagcgtcagcttcact

SEQ ID NO: 524421 - DNA, 20 bp, mouse
gagggcgcctctgagtgagt

SEQ ID NO: 524422 - DNA, 20 bp, mouse
ggccccgcctactcactcag

SEQ ID NO: 524423 - DNA, 20 bp, mouse
gaggccgggcagaaggtgga

SEQ ID NO: 524424 - DNA, 20 bp, mouse
gcttcactcggcctcggcgt

SEQ ID NO: 524425 - DNA, 20 bp, mouse
gtagtgagtgccggtaacac

SEQ ID NO: 524426 - DNA, 20 bp, mouse
gacaggcgacacagacgcga

SEQ ID NO: 524427 - DNA, 20 bp, mouse
gcacgggccgcgcaacaggg

SEQ ID NO: 524428 - DNA, 20 bp, mouse
gggcagcggcggcaggcgat

SEQ ID NO: 524429 - DNA, 20 bp, mouse
ggcggcaggcgatgggcgac

SEQ ID NO: 524430 - DNA, 20 bp, mouse
ggggagcccaggatcacggg

SEQ ID NO: 524431 - DNA, 20 bp, mouse
gcgtccggcgctgcccagtg

SEQ ID NO: 524432 - DNA, 20 bp, mouse
ggcggcgccaaagccacact

SEQ ID NO: 524433 - DNA, 20 bp, mouse
gtccaagcgtccgaggcggg

SEQ ID NO: 524434 - DNA, 20 bp, mouse
ggtctgtgcccagcccggaa

SEQ ID NO: 524435 - DNA, 20 bp, mouse
gtccatgctgcggaccgtcg

SEQ ID NO: 524436 - DNA, 20 bp, mouse
gggctcggagccgccattgt

SEQ ID NO: 524437 - DNA, 20 bp, mouse
ggaagagccgagcggcgccg

SEQ ID NO: 524438 - DNA, 20 bp, mouse
gtggcggctccgagcccgag

SEQ ID NO: 524439 - DNA, 20 bp, mouse
gttggaagtgaagagccgag

SEQ ID NO: 524440 - DNA, 20 bp, mouse
ggcgccctcagcggagcgag

SEQ ID NO: 524441 - DNA, 20 bp, mouse
gctccgagcccgagcggcgg

SEQ ID NO: 524442 - DNA, 20 bp, mouse
ggcccggggcggggatcccg

SEQ ID NO: 524443 - DNA, 20 bp, mouse
gcagaagctggaggtccgat

SEQ ID NO: 524444 - DNA, 20 bp, mouse
gcgaggccgggcccgagacg

SEQ ID NO: 524445 - DNA, 20 bp, mouse
gcatgcagggtaaggacggt

SEQ ID NO: 524446 - DNA, 20 bp, mouse
gcccaccgagacactcagga

SEQ ID NO: 524447 - DNA, 20 bp, mouse
gccgactgaggcccgcgtcc

SEQ ID NO: 524448 - DNA, 20 bp, mouse
ggaggcccgcgtcccggcag

SEQ ID NO: 524449 - DNA, 20 bp, mouse
ggcccgcgtcccggcagcgg

SEQ ID NO: 524450 - DNA, 20 bp, mouse
ggtctcggtgggcaagggga

SEQ ID NO: 524451 - DNA, 20 bp, mouse
gtgtgagtaagaggagacag

SEQ ID NO: 524452 - DNA, 20 bp, mouse
ggtgcaggatcgtccgactg

SEQ ID NO: 524453 - DNA, 20 bp, mouse
gcagccggaaccggagggcg

SEQ ID NO: 524454 - DNA, 20 bp, mouse
gtgtggagtgtccctaggag

SEQ ID NO: 524455 - DNA, 20 bp, mouse
gtggggctcctcctaagtag

SEQ ID NO: 524456 - DNA, 20 bp, mouse
gccagttgcaacgttaggga

SEQ ID NO: 524457 - DNA, 20 bp, mouse
gctacatgatgggccagggc

SEQ ID NO: 524458 - DNA, 20 bp, mouse
ggcagctacatgatgggcca

SEQ ID NO: 524459 - DNA, 20 bp, mouse
gctgtgctgcagctacatga

SEQ ID NO: 524460 - DNA, 20 bp, mouse
gtcccccagttgcaacgtta

SEQ ID NO: 524461 - DNA, 20 bp, mouse
gtgctcccctcccccatcaa

SEQ ID NO: 524462 - DNA, 20 bp, mouse
ggactttcagggagtcaagg

SEQ ID NO: 524463 - DNA, 20 bp, mouse
gatggactttcagggagtca

SEQ ID NO: 524464 - DNA, 20 bp, mouse
gtgcagcagatggactttca

SEQ ID NO: 524465 - DNA, 20 bp, mouse
gcagctaaaagctccaaact

SEQ ID NO: 524466 - DNA, 20 bp, mouse
gcaggccacccgtcagtccg

SEQ ID NO: 524467 - DNA, 20 bp, mouse
ggtggcctggcggtgagcgg

SEQ ID NO: 524468 - DNA, 20 bp, mouse
gtctaccccggactgacggg

SEQ ID NO: 524469 - DNA, 20 bp, mouse
ggacagcttctgctccaggg

SEQ ID NO: 524470 - DNA, 20 bp, mouse
gcgggacagcttctgctcca

SEQ ID NO: 524471 - DNA, 20 bp, mouse
gagtaagcacggcctcgtgg

SEQ ID NO: 524472 - DNA, 20 bp, mouse
gcgggtggcctggcggtgag

SEQ ID NO: 524473 - DNA, 20 bp, mouse
gttgtctaccccggactgac

SEQ ID NO: 524474 - DNA, 20 bp, mouse
ggtcgggtgggcagtctcca

SEQ ID NO: 524475 - DNA, 20 bp, mouse
ggctagcgccccggaagcgg

SEQ ID NO: 524476 - DNA, 20 bp, mouse
gaggcggcggcgaggaagag

SEQ ID NO: 524477 - DNA, 20 bp, mouse
gcctcgtcgtcgggattccc

SEQ ID NO: 524478 - DNA, 20 bp, mouse
gtgtagcccgcgagagaaaa

SEQ ID NO: 524479 - DNA, 20 bp, mouse
gggaccgccacccccgggag

SEQ ID NO: 524480 - DNA, 20 bp, mouse
ggccgcggcggcgagtcccg

SEQ ID NO: 524481 - DNA, 20 bp, mouse
gcgaggaagagcggctgctc

SEQ ID NO: 524482 - DNA, 20 bp, mouse
gggcgatcgcgcctcgtcgt

SEQ ID NO: 524483 - DNA, 20 bp, mouse
ggccgccagctcggcagagt

SEQ ID NO: 524484 - DNA, 20 bp, mouse
ggcggcagctgcgcaaagtg

SEQ ID NO: 524485 - DNA, 20 bp, mouse
gcggcgggaccgccaccccc

SEQ ID NO: 524486 - DNA, 20 bp, mouse
gcctcacgcgaggaacgcgt

SEQ ID NO: 524487 - DNA, 20 bp, mouse
gagccggctgaggaggatgg

SEQ ID NO: 524488 - DNA, 20 bp, mouse
ggcggggagagggacttagg

SEQ ID NO: 524489 - DNA, 20 bp, mouse
gtagggggccgaccaggagc

SEQ ID NO: 524490 - DNA, 20 bp, mouse
gccggcggggagagggactt

SEQ ID NO: 524491 - DNA, 20 bp, mouse
gctcgcgtgaggaggccgag

SEQ ID NO: 524492 - DNA, 20 bp, mouse
gaccgccaagagccccggcg

SEQ ID NO: 524493 - DNA, 20 bp, mouse
gcgaggccgagggcagcaag

SEQ ID NO: 524494 - DNA, 20 bp, mouse
gggcgcgccaccccatcccg

SEQ ID NO: 524495 - DNA, 20 bp, mouse
gctcccaggcggcatcgcgg

SEQ ID NO: 524496 - DNA, 20 bp, mouse
gaaggcactagcccaagaag

SEQ ID NO: 524497 - DNA, 20 bp, mouse
ggccgaagctacctcttctt

SEQ ID NO: 524498 - DNA, 20 bp, mouse
ggaggaggaagaagggaccg

SEQ ID NO: 524499 - DNA, 20 bp, mouse
gggtagcttcggctcaactg

SEQ ID NO: 524500 - DNA, 20 bp, mouse
ggcccaagaagaggtagctt

SEQ ID NO: 524501 - DNA, 20 bp, mouse
gaccggggtcggagctgtcg

SEQ ID NO: 524502 - DNA, 20 bp, mouse
gggcctccggcgcctcacca

SEQ ID NO: 524503 - DNA, 20 bp, mouse
gcccggggccaaagtacaaa

SEQ ID NO: 524504 - DNA, 20 bp, mouse
gttttggaggagggcaccaa

SEQ ID NO: 524505 - DNA, 20 bp, mouse
ggccccgacagctccgaccc

SEQ ID NO: 524506 - DNA, 20 bp, mouse
gacggtctcgcactaaggag

SEQ ID NO: 524507 - DNA, 20 bp, mouse
gggagaagtagcgaagtgac

SEQ ID NO: 524508 - DNA, 20 bp, mouse
ggagaggcggcccaagtcgg

SEQ ID NO: 524509 - DNA, 20 bp, mouse
gcggccgtcccatattttgg

SEQ ID NO: 524510 - DNA, 20 bp, mouse
gacccggccgtcccatattt

SEQ ID NO: 524511 - DNA, 20 bp, mouse
gagctctgacccggaagtag

SEQ ID NO: 524512 - DNA, 20 bp, mouse
gtctagagccaccaaaatat

SEQ ID NO: 524513 - DNA, 20 bp, mouse
gccggaaaaggaaaacctgg

SEQ ID NO: 524514 - DNA, 20 bp, mouse
gtggagaatgggactcctca

SEQ ID NO: 524515 - DNA, 20 bp, mouse
gtcatcaagtcgttacccaa

SEQ ID NO: 524516 - DNA, 20 bp, mouse
ggcccaggctctcacctcgg

SEQ ID NO: 524517 - DNA, 20 bp, mouse
ggagcctgggcgacttgtgg

SEQ ID NO: 524518 - DNA, 20 bp, mouse
ggcccccgaggtgagagcct

SEQ ID NO: 524519 - DNA, 20 bp, mouse
gtccgcggccgcagcacaaa

SEQ ID NO: 524520 - DNA, 20 bp, mouse
gtccggtggagggcaacggg

SEQ ID NO: 524521 - DNA, 20 bp, mouse
gtctcacctcgggggctccg

SEQ ID NO: 524522 - DNA, 20 bp, mouse
gccacccccacaagtcgccc

SEQ ID NO: 524523 - DNA, 20 bp, mouse
gggacccgacgcctggagat

SEQ ID NO: 524524 - DNA, 20 bp, mouse
gctaggtcctgaggttgagg

SEQ ID NO: 524525 - DNA, 20 bp, mouse
gccgacgcctggagatagga

SEQ ID NO: 524526 - DNA, 20 bp, mouse
gtctcagtcaagggcaagtg

SEQ ID NO: 524527 - DNA, 20 bp, mouse
ggcagctcaggtgctcctga

SEQ ID NO: 524528 - DNA, 20 bp, mouse
gtggcaaagaggagcagctc

SEQ ID NO: 524529 - DNA, 20 bp, mouse
gggcacaatggccaaccctc

SEQ ID NO: 524530 - DNA, 20 bp, mouse
gagttcagcaggtcaggcag

SEQ ID NO: 524531 - DNA, 20 bp, mouse
ggtgtaagcgaggattctag

SEQ ID NO: 524532 - DNA, 20 bp, mouse
gaagggcaagtgtggcaaag

SEQ ID NO: 524533 - DNA, 20 bp, mouse
gcctctcctgagggtcctca

SEQ ID NO: 524534 - DNA, 20 bp, mouse
gctcaggtgctcctgagggt

SEQ ID NO: 524535 - DNA, 20 bp, mouse
gctcagggagcttgggtgaa

SEQ ID NO: 524536 - DNA, 20 bp, mouse
ggctccgccggtaggtgact

SEQ ID NO: 524537 - DNA, 20 bp, mouse
ggttctgcccagtcacctac

SEQ ID NO: 524538 - DNA, 20 bp, mouse
gcgtcccgctttaggactcg

SEQ ID NO: 524539 - DNA, 20 bp, mouse
gacaacggcgctccgccggt

SEQ ID NO: 524540 - DNA, 20 bp, mouse
ggtagggcggctgaactcga

SEQ ID NO: 524541 - DNA, 20 bp, mouse
ggaggacaacggcgctccgc

SEQ ID NO: 524542 - DNA, 20 bp, mouse
ggtcctcaaacaagcgagtg

SEQ ID NO: 524543 - DNA, 20 bp, mouse
ggccaggtctgccagtaggg

SEQ ID NO: 524544 - DNA, 20 bp, mouse
gaagcgggacgccgagggag

SEQ ID NO: 524545 - DNA, 20 bp, mouse
gggagccaggtctgccagta

SEQ ID NO: 524546 - DNA, 20 bp, mouse
gccggccgccggagaacccg

SEQ ID NO: 524547 - DNA, 20 bp, mouse
gcaggtgaccacgggttctc

SEQ ID NO: 524548 - DNA, 20 bp, mouse
gcggggcgggcaggtgacca

SEQ ID NO: 524549 - DNA, 20 bp, mouse
ggtgaccacgggttctccgg

SEQ ID NO: 524550 - DNA, 20 bp, mouse
gaagccggcgagccgcccca

SEQ ID NO: 524551 - DNA, 20 bp, mouse
ggccggcggagcggagctca

SEQ ID NO: 524552 - DNA, 20 bp, mouse
ggccgcagggagccggagca

SEQ ID NO: 524553 - DNA, 20 bp, mouse
ggcggagcccgagagcacgg

SEQ ID NO: 524554 - DNA, 20 bp, mouse
gcccctgctccggctccctg

SEQ ID NO: 524555 - DNA, 20 bp, mouse
ggggcggaccggaggacgga

SEQ ID NO: 524556 - DNA, 20 bp, mouse
gtggattctatgcccagacc

SEQ ID NO: 524557 - DNA, 20 bp, mouse
gtagatgaagtggagtataa

SEQ ID NO: 524558 - DNA, 20 bp, mouse
gagaaatactgacctggtct

SEQ ID NO: 524559 - DNA, 20 bp, mouse
gccagagagaaatactgacc

SEQ ID NO: 524560 - DNA, 20 bp, mouse
gtcaaacagaactttcaaac

SEQ ID NO: 524561 - DNA, 20 bp, mouse
gatagcatcctcaaaaccac

SEQ ID NO: 524562 - DNA, 20 bp, mouse
gttcagtgcatagactcagc

SEQ ID NO: 524563 - DNA, 20 bp, mouse
gagtgactctttgaagcaca

SEQ ID NO: 524564 - DNA, 20 bp, mouse
gtcaatctccagtggttttg

SEQ ID NO: 524565 - DNA, 20 bp, mouse
gcagttactggacatcctga

SEQ ID NO: 524566 - DNA, 20 bp, mouse
ggtgctacgccagacatcac

SEQ ID NO: 524567 - DNA, 20 bp, mouse
gacgggtctgtgtacagtgg

SEQ ID NO: 524568 - DNA, 20 bp, mouse
gtcgccgggcgatgcagctg

SEQ ID NO: 524569 - DNA, 20 bp, mouse
gatcacgggtctgtgtacag

SEQ ID NO: 524570 - DNA, 20 bp, mouse
gctgcatcgcccggcgaggg

SEQ ID NO: 524571 - DNA, 20 bp, mouse
gagcacggcggcgcacgtca

SEQ ID NO: 524572 - DNA, 20 bp, mouse
gtctgtgtacagtggcggcc

SEQ ID NO: 524573 - DNA, 20 bp, mouse
ggaagcggcgaagaggccct

SEQ ID NO: 524574 - DNA, 20 bp, mouse
gccgctggatcgtccactgt

SEQ ID NO: 524575 - DNA, 20 bp, mouse
ggcgaggcgctgctcctggg

SEQ ID NO: 524576 - DNA, 20 bp, mouse
gtgaggtggagaacagtggc

SEQ ID NO: 524577 - DNA, 20 bp, mouse
ggtccagaagacgctccgac

SEQ ID NO: 524578 - DNA, 20 bp, mouse
gtcggcggcgccactcgacc

SEQ ID NO: 524579 - DNA, 20 bp, mouse
ggtggagaacagtggccggt

SEQ ID NO: 524580 - DNA, 20 bp, mouse
gcgcaggcggcccggtcgag

SEQ ID NO: 524581 - DNA, 20 bp, mouse
gaggcttgctgcgcgcccag

SEQ ID NO: 524582 - DNA, 20 bp, mouse
gggacttcaggactcgcagg

SEQ ID NO: 524583 - DNA, 20 bp, mouse
ggtttttcggagcgttcctg

SEQ ID NO: 524584 - DNA, 20 bp, mouse
gtttcggagcgttcctgagg

SEQ ID NO: 524585 - DNA, 20 bp, mouse
gcggcccaacccggcctcgg

SEQ ID NO: 524586 - DNA, 20 bp, mouse
gtcagatacaggaatagcaa

SEQ ID NO: 524587 - DNA, 20 bp, mouse
gttggtgctgttgatgtgta

SEQ ID NO: 524588 - DNA, 20 bp, mouse
gagaggtgaacagcacccta

SEQ ID NO: 524589 - DNA, 20 bp, mouse
gaagctttatagtcagatac

SEQ ID NO: 524590 - DNA, 20 bp, mouse
ggcccagaccatgcccggag

SEQ ID NO: 524591 - DNA, 20 bp, mouse
gtctgactataaagcttaca

SEQ ID NO: 524592 - DNA, 20 bp, mouse
gagagaaagaggccttcctc

SEQ ID NO: 524593 - DNA, 20 bp, mouse
gcgacttgagggacatttta

SEQ ID NO: 524594 - DNA, 20 bp, mouse
gacctgtcaactacttggtg

SEQ ID NO: 524595 - DNA, 20 bp, mouse
gtgggtgaaggacgttgctg

SEQ ID NO: 524596 - DNA, 20 bp, mouse
gtcgtccgcccgccaagagg

SEQ ID NO: 524597 - DNA, 20 bp, mouse
gcggccgcggcgagcgggaa

SEQ ID NO: 524598 - DNA, 20 bp, mouse
ggactcgtccgcccgccaag

SEQ ID NO: 524599 - DNA, 20 bp, mouse
ggcagggtggagagtccacg

SEQ ID NO: 524600 - DNA, 20 bp, mouse
gccacggaggcgccgaggag

SEQ ID NO: 524601 - DNA, 20 bp, mouse
ggcggcggcggcacaagcaa

SEQ ID NO: 524602 - DNA, 20 bp, mouse
gcctgcgcagcccggctcaa

SEQ ID NO: 524603 - DNA, 20 bp, mouse
gagcccacggacgcaaaggg

SEQ ID NO: 524604 - DNA, 20 bp, mouse
gggacagggcgcccgagcgg

SEQ ID NO: 524605 - DNA, 20 bp, mouse
ggggtggagagtccacgggg

SEQ ID NO: 524606 - DNA, 20 bp, mouse
gagagtcctgggaagtcaac

SEQ ID NO: 524607 - DNA, 20 bp, mouse
ggcgctcccttgagaagtct

SEQ ID NO: 524608 - DNA, 20 bp, mouse
gtggggtacccagtaatcct

SEQ ID NO: 524609 - DNA, 20 bp, mouse
gacaggtcacagaagagtcc

SEQ ID NO: 524610 - DNA, 20 bp, mouse
ggggcccagcctacatgtga

SEQ ID NO: 524611 - DNA, 20 bp, mouse
gctgtgagccgaggattact

SEQ ID NO: 524612 - DNA, 20 bp, mouse
gcgctgccggttgacttccc

SEQ ID NO: 524613 - DNA, 20 bp, mouse
gcctcgcgcaggcatcgcaa

SEQ ID NO: 524614 - DNA, 20 bp, mouse
ggctacacccagacttctca

SEQ ID NO: 524615 - DNA, 20 bp, mouse
gtctgggtgtagcacgctgc

SEQ ID NO: 524616 - DNA, 20 bp, mouse
gctgcggatgcgaacatcca

SEQ ID NO: 524617 - DNA, 20 bp, mouse
gtcgagagtcctaaaaagag

SEQ ID NO: 524618 - DNA, 20 bp, mouse
gcaacagagatgctcgccgg

SEQ ID NO: 524619 - DNA, 20 bp, mouse
gtaaaaagaggggacgtccg

SEQ ID NO: 524620 - DNA, 20 bp, mouse
gcgactcagcaagattcatg

SEQ ID NO: 524621 - DNA, 20 bp, mouse
gcgtctggaaaggcgaagag

SEQ ID NO: 524622 - DNA, 20 bp, mouse
ggactgcagccgactttcta

SEQ ID NO: 524623 - DNA, 20 bp, mouse
gcgagcatctctgttgactg

SEQ ID NO: 524624 - DNA, 20 bp, mouse
gggaagctatctcgaagtta

SEQ ID NO: 524625 - DNA, 20 bp, mouse
gcggacttggggtcaagggt

SEQ ID NO: 524626 - DNA, 20 bp, mouse
gagccgaagccgggactcgg

SEQ ID NO: 524627 - DNA, 20 bp, mouse
gccgtggcgcgggaccgacc

SEQ ID NO: 524628 - DNA, 20 bp, mouse
gaggagccgaagccgggact

SEQ ID NO: 524629 - DNA, 20 bp, mouse
ggcgctgaggagccgaagcc

SEQ ID NO: 524630 - DNA, 20 bp, mouse
gccgggccaccgccgagtcc

SEQ ID NO: 524631 - DNA, 20 bp, mouse
gtgacccggggagcgagtga

SEQ ID NO: 524632 - DNA, 20 bp, mouse
gccggcgacggaaagcgctg

SEQ ID NO: 524633 - DNA, 20 bp, mouse
gggcgcttcgatcatctcac

SEQ ID NO: 524634 - DNA, 20 bp, mouse
gatctcactggcagaagacg

SEQ ID NO: 524635 - DNA, 20 bp, mouse
gtgcggggctccgggctgaa

SEQ ID NO: 524636 - DNA, 20 bp, mouse
gctgctcctcagagtgtcgg

SEQ ID NO: 524637 - DNA, 20 bp, mouse
gagcacgggcaacttaactg

SEQ ID NO: 524638 - DNA, 20 bp, mouse
gcccgtgggatgggacagtg

SEQ ID NO: 524639 - DNA, 20 bp, mouse
gagctaaccgctctgagcac

SEQ ID NO: 524640 - DNA, 20 bp, mouse
gcggaacagggaggtcccgt

SEQ ID NO: 524641 - DNA, 20 bp, mouse
gcaacgactggccaaggcag

SEQ ID NO: 524642 - DNA, 20 bp, mouse
gccggggaggtgcgatggaa

SEQ ID NO: 524643 - DNA, 20 bp, mouse
gctctcaactaagtgaggta

SEQ ID NO: 524644 - DNA, 20 bp, mouse
gaagttgcccgtgctcagag

SEQ ID NO: 524645 - DNA, 20 bp, mouse
gaacatcctggctgtcggag

SEQ ID NO: 524646 - DNA, 20 bp, mouse
gaggcagtgtcccccgcagg

SEQ ID NO: 524647 - DNA, 20 bp, mouse
ggaccagtcagtgcaggcct

SEQ ID NO: 524648 - DNA, 20 bp, mouse
ggtgtcccccgcaggaggcg

SEQ ID NO: 524649 - DNA, 20 bp, mouse
gtccaggcagtgtcccccgc

SEQ ID NO: 524650 - DNA, 20 bp, mouse
gtcgggtgaccagtcagtgc

SEQ ID NO: 524651 - DNA, 20 bp, mouse
gtgggtcgagagggagttgt

SEQ ID NO: 524652 - DNA, 20 bp, mouse
gctccaagttgcactcaccc

SEQ ID NO: 524653 - DNA, 20 bp, mouse
gccgagatccgggaagaagg

SEQ ID NO: 524654 - DNA, 20 bp, mouse
ggctcaccgcgcctcctgcg

SEQ ID NO: 524655 - DNA, 20 bp, mouse
ggactggtcacccgagatcc

SEQ ID NO: 524656 - DNA, 20 bp, mouse
gacgggcggcacgagcaggt

SEQ ID NO: 524657 - DNA, 20 bp, mouse
gagcaggtgggagccgccga

SEQ ID NO: 524658 - DNA, 20 bp, mouse
gcctgctcgggccctacctg

SEQ ID NO: 524659 - DNA, 20 bp, mouse
ggggcacgggcggcacgagc

SEQ ID NO: 524660 - DNA, 20 bp, mouse
gggtagggcccgagcaggct

SEQ ID NO: 524661 - DNA, 20 bp, mouse
gaggcagccgagaagcgatc

SEQ ID NO: 524662 - DNA, 20 bp, mouse
gtacctgcggcggccgtcgg

SEQ ID NO: 524663 - DNA, 20 bp, mouse
ggggcggcctcgcccctcgg

SEQ ID NO: 524664 - DNA, 20 bp, mouse
gcagccgagaagcgatctgg

SEQ ID NO: 524665 - DNA, 20 bp, mouse
gagcgatctggaggactcca

SEQ ID NO: 524666 - DNA, 20 bp, mouse
gggcgggcccaggacttgtg

SEQ ID NO: 524667 - DNA, 20 bp, mouse
gagtgcccagggggccaaca

SEQ ID NO: 524668 - DNA, 20 bp, mouse
gggcctcagggttcaagctt

SEQ ID NO: 524669 - DNA, 20 bp, mouse
ggccacagcccacagagtca

SEQ ID NO: 524670 - DNA, 20 bp, mouse
gccacaagggccattcctgg

SEQ ID NO: 524671 - DNA, 20 bp, mouse
ggggctgggccagtgcccag

SEQ ID NO: 524672 - DNA, 20 bp, mouse
ggggcccgccttgactctgt

SEQ ID NO: 524673 - DNA, 20 bp, mouse
ggggggccaacagggcctca

SEQ ID NO: 524674 - DNA, 20 bp, mouse
gctgtctcaggcacccaagt

SEQ ID NO: 524675 - DNA, 20 bp, mouse
gcacaaccctgggatagttg

SEQ ID NO: 524676 - DNA, 20 bp, mouse
gcccacccgggcccacacct

SEQ ID NO: 524677 - DNA, 20 bp, mouse
gcgagactcggaggccgtag

SEQ ID NO: 524678 - DNA, 20 bp, mouse
ggacggtgtcacgggcctag

SEQ ID NO: 524679 - DNA, 20 bp, mouse
ggggcagcgccgagactcgg

SEQ ID NO: 524680 - DNA, 20 bp, mouse
gtcaagctagacccaggtgt

SEQ ID NO: 524681 - DNA, 20 bp, mouse
gacgctgtagcagctcgaag

SEQ ID NO: 524682 - DNA, 20 bp, mouse
ggagctgctacagcgtgtgg

SEQ ID NO: 524683 - DNA, 20 bp, mouse
gcccaggagaaactaaggtt

SEQ ID NO: 524684 - DNA, 20 bp, mouse
gcacaatgcaaggcacaaga

SEQ ID NO: 524685 - DNA, 20 bp, mouse
gggcctaggggcgagaagcg

SEQ ID NO: 524686 - DNA, 20 bp, mouse
ggagccgggtcacacccacc

SEQ ID NO: 524687 - DNA, 20 bp, mouse
ggaactgcaccccgagcgag

SEQ ID NO: 524688 - DNA, 20 bp, mouse
gcggcgggcggaagccatgt

SEQ ID NO: 524689 - DNA, 20 bp, mouse
gggcgacgtctacaaggtga

SEQ ID NO: 524690 - DNA, 20 bp, mouse
gtgcgggcgcgctcctctcc

SEQ ID NO: 524691 - DNA, 20 bp, mouse
ggccgggcgattgtgaccgg

SEQ ID NO: 524692 - DNA, 20 bp, mouse
gggtgtgacccggctcggcg

SEQ ID NO: 524693 - DNA, 20 bp, mouse
gtctcctggtgggtgtgacc

SEQ ID NO: 524694 - DNA, 20 bp, mouse
gcggggcccgccatgaaccc

SEQ ID NO: 524695 - DNA, 20 bp, mouse
gctgcgtgcagtcccgggaa

SEQ ID NO: 524696 - DNA, 20 bp, mouse
gcacgagcggcccggagctg

SEQ ID NO: 524697 - DNA, 20 bp, mouse
ggcgcgcgcgcctgcacgag

SEQ ID NO: 524698 - DNA, 20 bp, mouse
gcaggccgccgccgcccggg

SEQ ID NO: 524699 - DNA, 20 bp, mouse
gaccggacgacaagccgccc

SEQ ID NO: 524700 - DNA, 20 bp, mouse
gggccgcggagctcacacca

SEQ ID NO: 524701 - DNA, 20 bp, mouse
gcgctctccggccccagctc

SEQ ID NO: 524702 - DNA, 20 bp, mouse
gagggaggaccgccaagcca

SEQ ID NO: 524703 - DNA, 20 bp, mouse
gggacgacaagccgcccggg

SEQ ID NO: 524704 - DNA, 20 bp, mouse
ggcttgtcgtccggtcggag

SEQ ID NO: 524705 - DNA, 20 bp, mouse
ggctcgcccggcagacaaag

SEQ ID NO: 524706 - DNA, 20 bp, mouse
ggccgtctcggagaagacgc

SEQ ID NO: 524707 - DNA, 20 bp, mouse
ggccggcgctcggccaagaa

SEQ ID NO: 524708 - DNA, 20 bp, mouse
gactgtgcgcacggccgtct

SEQ ID NO: 524709 - DNA, 20 bp, mouse
gcactcggcgggcctcaggg

SEQ ID NO: 524710 - DNA, 20 bp, mouse
ggcgctcggccaagaacgga

SEQ ID NO: 524711 - DNA, 20 bp, mouse
gacccgcgtcttctccgaga

SEQ ID NO: 524712 - DNA, 20 bp, mouse
gcagccgcgggtggggaacg

SEQ ID NO: 524713 - DNA, 20 bp, mouse
ggcgggtggggaacgtggtg

SEQ ID NO: 524714 - DNA, 20 bp, mouse
gtggtgcagagggtcggcag

SEQ ID NO: 524715 - DNA, 20 bp, mouse
gcgttagcgggagacggctg

SEQ ID NO: 524716 - DNA, 20 bp, mouse
ggcggctgcggcatcaccgg

SEQ ID NO: 524717 - DNA, 20 bp, mouse
gcagaagacgacagcggcag

SEQ ID NO: 524718 - DNA, 20 bp, mouse
gtcaccgggggtatagatag

SEQ ID NO: 524719 - DNA, 20 bp, mouse
ggcagcggctgcggcatcac

SEQ ID NO: 524720 - DNA, 20 bp, mouse
gtgcggtgtctagcagaccc

SEQ ID NO: 524721 - DNA, 20 bp, mouse
gcggcctctatctatacccc

SEQ ID NO: 524722 - DNA, 20 bp, mouse
ggcctagcgaggcttggcag

SEQ ID NO: 524723 - DNA, 20 bp, mouse
ggtccaggcctagggcgtct

SEQ ID NO: 524724 - DNA, 20 bp, mouse
gccggccgcctagcgaggct

SEQ ID NO: 524725 - DNA, 20 bp, mouse
ggacaccgcagtcgcagaga

SEQ ID NO: 524726 - DNA, 20 bp, mouse
gagcacagccggctgatgca

SEQ ID NO: 524727 - DNA, 20 bp, mouse
ggtctcgcgcgggaacccgt

SEQ ID NO: 524728 - DNA, 20 bp, mouse
gctggaccgctcggacgtag

SEQ ID NO: 524729 - DNA, 20 bp, mouse
gcgagagcgaggtcggaagg

SEQ ID NO: 524730 - DNA, 20 bp, mouse
ggtgctgcctggcccggcga

SEQ ID NO: 524731 - DNA, 20 bp, mouse
gcggcaccgctacgtccgag

SEQ ID NO: 524732 - DNA, 20 bp, mouse
gcgcgctggtactgggtgag

SEQ ID NO: 524733 - DNA, 20 bp, mouse
ggcttcatcgagagcgaggt

SEQ ID NO: 524734 - DNA, 20 bp, mouse
gataggtgggtagctggctg

SEQ ID NO: 524735 - DNA, 20 bp, mouse
gctggttccatcgccgggcc

SEQ ID NO: 524736 - DNA, 20 bp, mouse
gctggcggcgacggccacag

SEQ ID NO: 524737 - DNA, 20 bp, mouse
gcgtcatcggagcaccatgg

SEQ ID NO: 524738 - DNA, 20 bp, mouse
ggcggcgacggccacagggg

SEQ ID NO: 524739 - DNA, 20 bp, mouse
ggcgcgtcatcggagcacca

SEQ ID NO: 524740 - DNA, 20 bp, mouse
gacggccacaggggcggcga

SEQ ID NO: 524741 - DNA, 20 bp, mouse
gcgcacagcgacccaggtga

SEQ ID NO: 524742 - DNA, 20 bp, mouse
gccatggcggagcagggagc

SEQ ID NO: 524743 - DNA, 20 bp, mouse
gggagcaccatggcggagca

SEQ ID NO: 524744 - DNA, 20 bp, mouse
ggcccgcgggccacaacagg

SEQ ID NO: 524745 - DNA, 20 bp, mouse
gccggatcgcgccgtcacct

SEQ ID NO: 524746 - DNA, 20 bp, mouse
gcagcccgggcggtacaata

SEQ ID NO: 524747 - DNA, 20 bp, mouse
gaggcggcggcgttccgagt

SEQ ID NO: 524748 - DNA, 20 bp, mouse
gacacgcgggccactctcca

SEQ ID NO: 524749 - DNA, 20 bp, mouse
gttccgagtgggagaggtag

SEQ ID NO: 524750 - DNA, 20 bp, mouse
ggggcaaaggagcagaatcg

SEQ ID NO: 524751 - DNA, 20 bp, mouse
gcgggcggtacaatagggtt

SEQ ID NO: 524752 - DNA, 20 bp, mouse
gcacaagagcgagcccggag

SEQ ID NO: 524753 - DNA, 20 bp, mouse
gccccgcgccggcccagtcc

SEQ ID NO: 524754 - DNA, 20 bp, mouse
gctgagtagccagctacccg

SEQ ID NO: 524755 - DNA, 20 bp, mouse
ggtcgcggaggaccgacctc

SEQ ID NO: 524756 - DNA, 20 bp, mouse
gtggagcgcagcggtgggaa

SEQ ID NO: 524757 - DNA, 20 bp, mouse
ggcatcccgatggagcgcag

SEQ ID NO: 524758 - DNA, 20 bp, mouse
gcccgatggagcgcagcggt

SEQ ID NO: 524759 - DNA, 20 bp, mouse
ggcggcggcggcgggtacgg

SEQ ID NO: 524760 - DNA, 20 bp, mouse
gtgcagcccgcgcatcccga

SEQ ID NO: 524761 - DNA, 20 bp, mouse
ggtaagggccggggagcact

SEQ ID NO: 524762 - DNA, 20 bp, mouse
gccccgcggtccgcaggtaa

SEQ ID NO: 524763 - DNA, 20 bp, mouse
gcggggccggtgcgacacag

SEQ ID NO: 524764 - DNA, 20 bp, mouse
ggccggtgcgacacagcggg

SEQ ID NO: 524765 - DNA, 20 bp, mouse
gagccggagtcccctcggaa

SEQ ID NO: 524766 - DNA, 20 bp, mouse
gcctcgcggtctgggaaacc

SEQ ID NO: 524767 - DNA, 20 bp, mouse
ggaggcggggcaaaagatgg

SEQ ID NO: 524768 - DNA, 20 bp, mouse
gaggtattggaataacctgg

SEQ ID NO: 524769 - DNA, 20 bp, mouse
gagcggctatgctctagcac

SEQ ID NO: 524770 - DNA, 20 bp, mouse
gctggaggcggggcaaaaga

SEQ ID NO: 524771 - DNA, 20 bp, mouse
gggtacgtggaggaacggag

SEQ ID NO: 524772 - DNA, 20 bp, mouse
gcagaccgcgaggcccgggc

SEQ ID NO: 524773 - DNA, 20 bp, mouse
ggccgcgcggagctgggatg

SEQ ID NO: 524774 - DNA, 20 bp, mouse
gctagcacaggtgtcgcccc

SEQ ID NO: 524775 - DNA, 20 bp, mouse
gttcccagaccgcgaggccc

SEQ ID NO: 524776 - DNA, 20 bp, mouse
gaggctggcagtggttctac

SEQ ID NO: 524777 - DNA, 20 bp, mouse
gtgacgggcgggctacgagt

SEQ ID NO: 524778 - DNA, 20 bp, mouse
gctggcagtggttctaccgg

SEQ ID NO: 524779 - DNA, 20 bp, mouse
gcggcgatcgggaacgagga

SEQ ID NO: 524780 - DNA, 20 bp, mouse
gagaggagagaattaaccgc

SEQ ID NO: 524781 - DNA, 20 bp, mouse
ggcccgcccgtcaggcagga

SEQ ID NO: 524782 - DNA, 20 bp, mouse
gcgatcgggaacgaggaagg

SEQ ID NO: 524783 - DNA, 20 bp, mouse
gcgggctacgagtgggagga

SEQ ID NO: 524784 - DNA, 20 bp, mouse
gggcggctgtgcagccaaca

SEQ ID NO: 524785 - DNA, 20 bp, mouse
ggtgcgtccagatcagccac

SEQ ID NO: 524786 - DNA, 20 bp, mouse
gtctgtccgtctcctctggt

SEQ ID NO: 524787 - DNA, 20 bp, mouse
gccattgtggaacctaccag

SEQ ID NO: 524788 - DNA, 20 bp, mouse
gtggtttccaggcagtgaga

SEQ ID NO: 524789 - DNA, 20 bp, mouse
ggcagcctcccgctgcacaa

SEQ ID NO: 524790 - DNA, 20 bp, mouse
ggtaggttccacaatggtac

SEQ ID NO: 524791 - DNA, 20 bp, mouse
ggaaaccattgtgcagcggg

SEQ ID NO: 524792 - DNA, 20 bp, mouse
ggaggctgcctgtaccattg

SEQ ID NO: 524793 - DNA, 20 bp, mouse
ggaatcaccctctcactgcc

SEQ ID NO: 524794 - DNA, 20 bp, mouse
gccagtagggaggatttctg

SEQ ID NO: 524795 - DNA, 20 bp, mouse
ggccctctgtccgtctcctc

SEQ ID NO: 524796 - DNA, 20 bp, mouse
gtgctgcgcgcggggatccg

SEQ ID NO: 524797 - DNA, 20 bp, mouse
ggggccggcaaggacctggt

SEQ ID NO: 524798 - DNA, 20 bp, mouse
gcccaccccgctttgctcag

SEQ ID NO: 524799 - DNA, 20 bp, mouse
gagtatgggaggtgccgcag

SEQ ID NO: 524800 - DNA, 20 bp, mouse
gccccagcctggagaccgga

SEQ ID NO: 524801 - DNA, 20 bp, mouse
gtccgcgcgcgggattctac

SEQ ID NO: 524802 - DNA, 20 bp, mouse
ggtaggggccggcaaggacc

SEQ ID NO: 524803 - DNA, 20 bp, mouse
gactcgctggcaggtagggg

SEQ ID NO: 524804 - DNA, 20 bp, mouse
gccagcgagtggaatctagt

SEQ ID NO: 524805 - DNA, 20 bp, mouse
ggcctacggctcagtctggt

SEQ ID NO: 524806 - DNA, 20 bp, mouse
gcgggccagagacaagggtc

SEQ ID NO: 524807 - DNA, 20 bp, mouse
gggttatagagagttcaggg

SEQ ID NO: 524808 - DNA, 20 bp, mouse
gacaagggtcgggtgggagt

SEQ ID NO: 524809 - DNA, 20 bp, mouse
gggcggttatagagagttca

SEQ ID NO: 524810 - DNA, 20 bp, mouse
gccgcaaaggaaaatctcag

SEQ ID NO: 524811 - DNA, 20 bp, mouse
gggaccggacccgggatcag

SEQ ID NO: 524812 - DNA, 20 bp, mouse
ggagcaccgcgccccaggac

SEQ ID NO: 524813 - DNA, 20 bp, mouse
gcctttgcgggctcttctct

SEQ ID NO: 524814 - DNA, 20 bp, mouse
gcccacccgacccttgtctc

SEQ ID NO: 524815 - DNA, 20 bp, mouse
gcgccaggaggtgaccaaaa

SEQ ID NO: 524816 - DNA, 20 bp, mouse
gctcatcccggaccccgtgg

SEQ ID NO: 524817 - DNA, 20 bp, mouse
gtcgcaggaccgccaccacg

SEQ ID NO: 524818 - DNA, 20 bp, mouse
gtcctgcgaggaggttgcgg

SEQ ID NO: 524819 - DNA, 20 bp, mouse
gcggtcctgcgaggaggttg

SEQ ID NO: 524820 - DNA, 20 bp, mouse
gtggtggcggtcctgcgagg

SEQ ID NO: 524821 - DNA, 20 bp, mouse
gttccgagtgaggctcatcc

SEQ ID NO: 524822 - DNA, 20 bp, mouse
gggcgacgccaaggaagggg

SEQ ID NO: 524823 - DNA, 20 bp, mouse
gaggctcatcccggaccccg

SEQ ID NO: 524824 - DNA, 20 bp, mouse
gtgagcctcactcggaaaag

SEQ ID NO: 524825 - DNA, 20 bp, mouse
ggccaccgcaacctcctcgc

SEQ ID NO: 524826 - DNA, 20 bp, mouse
gccagtggcggcgatcccac

SEQ ID NO: 524827 - DNA, 20 bp, mouse
gcgccactggagcccaagcg

SEQ ID NO: 524828 - DNA, 20 bp, mouse
gctgcagccgctccccgggg

SEQ ID NO: 524829 - DNA, 20 bp, mouse
gagcgcgagcgggtgtcttg

SEQ ID NO: 524830 - DNA, 20 bp, mouse
ggagccgccgcggctgacag

SEQ ID NO: 524831 - DNA, 20 bp, mouse
gccgccgcggctgacagggg

SEQ ID NO: 524832 - DNA, 20 bp, mouse
gagcggctgcaggaggaccg

SEQ ID NO: 524833 - DNA, 20 bp, mouse
gggctgcaggaggaccgcgg

SEQ ID NO: 524834 - DNA, 20 bp, mouse
gagcgggtgtcttgcggcgt

SEQ ID NO: 524835 - DNA, 20 bp, mouse
gcggggcgctgaagcgcgag

SEQ ID NO: 524836 - DNA, 20 bp, mouse
gccagctccagagaaagaat

SEQ ID NO: 524837 - DNA, 20 bp, mouse
ggctccagagaaagaatcgg

SEQ ID NO: 524838 - DNA, 20 bp, mouse
gcggcagcacacatggcgag

SEQ ID NO: 524839 - DNA, 20 bp, mouse
ggctacatgacggtccacct

SEQ ID NO: 524840 - DNA, 20 bp, mouse
ggcgcaagggaggagcatcg

SEQ ID NO: 524841 - DNA, 20 bp, mouse
ggtatctctgggctacatga

SEQ ID NO: 524842 - DNA, 20 bp, mouse
gcatggcgagaggcaggcgc

SEQ ID NO: 524843 - DNA, 20 bp, mouse
ggacgtcccgtcatatgagg

SEQ ID NO: 524844 - DNA, 20 bp, mouse
gcccaagccaacggatcaac

SEQ ID NO: 524845 - DNA, 20 bp, mouse
gagcacacatggcgagaggc

SEQ ID NO: 524846 - DNA, 20 bp, mouse
ggccatgcccctctccgtaa

SEQ ID NO: 524847 - DNA, 20 bp, mouse
ggagcatcccttacggagag

SEQ ID NO: 524848 - DNA, 20 bp, mouse
gcgcagtctgtggtctagaa

SEQ ID NO: 524849 - DNA, 20 bp, mouse
gcaagagagagacaccttca

SEQ ID NO: 524850 - DNA, 20 bp, mouse
gccaggtaaggcacaactat

SEQ ID NO: 524851 - DNA, 20 bp, mouse
gggccagcagaacaggtgtg

SEQ ID NO: 524852 - DNA, 20 bp, mouse
gtcccttacggagaggggca

SEQ ID NO: 524853 - DNA, 20 bp, mouse
gccaggtgagaggaacgctt

SEQ ID NO: 524854 - DNA, 20 bp, mouse
ggcagtcggccggcttttag

SEQ ID NO: 524855 - DNA, 20 bp, mouse
gaaaagccggccgactgccc

SEQ ID NO: 524856 - DNA, 20 bp, mouse
ggccgctgcggtccaaggag

SEQ ID NO: 524857 - DNA, 20 bp, mouse
gctagtccgctggcagatag

SEQ ID NO: 524858 - DNA, 20 bp, mouse
gtcctctccttggaccgcag

SEQ ID NO: 524859 - DNA, 20 bp, mouse
ggtccgctggcagatagagg

SEQ ID NO: 524860 - DNA, 20 bp, mouse
ggccttgacacgactcgaga

SEQ ID NO: 524861 - DNA, 20 bp, mouse
gtccaagacactcctctcct

SEQ ID NO: 524862 - DNA, 20 bp, mouse
gacgtagccgctgcggtcca

SEQ ID NO: 524863 - DNA, 20 bp, mouse
gggccgcctctatctgccag

SEQ ID NO: 524864 - DNA, 20 bp, mouse
gtctattggcagatccacgg

SEQ ID NO: 524865 - DNA, 20 bp, mouse
gcaggtgctccggggatcag

SEQ ID NO: 524866 - DNA, 20 bp, mouse
gcctaggcgcggcacagtgg

SEQ ID NO: 524867 - DNA, 20 bp, mouse
gagtcctaggcgcggcacag

SEQ ID NO: 524868 - DNA, 20 bp, mouse
ggaccgagacgacagcgaca

SEQ ID NO: 524869 - DNA, 20 bp, mouse
gagtccagagagacgggcaa

SEQ ID NO: 524870 - DNA, 20 bp, mouse
gaggcgcggcacagtggcgg

SEQ ID NO: 524871 - DNA, 20 bp, mouse
gaggatccgagtcctaggcg

SEQ ID NO: 524872 - DNA, 20 bp, mouse
gggcaatggagacccgctga

SEQ ID NO: 524873 - DNA, 20 bp, mouse
gccggcaggatccgagtcct

SEQ ID NO: 524874 - DNA, 20 bp, mouse
gggtccatcaggccttcagc

SEQ ID NO: 524875 - DNA, 20 bp, mouse
ggggcgccccggaacccgac

SEQ ID NO: 524876 - DNA, 20 bp, mouse
gacatcggcgagggcgcgta

SEQ ID NO: 524877 - DNA, 20 bp, mouse
gtgtgtgctcgggacatggg

SEQ ID NO: 524878 - DNA, 20 bp, mouse
gcgaccccagcagttcccct

SEQ ID NO: 524879 - DNA, 20 bp, mouse
gggctcagggagtgtcgcag

SEQ ID NO: 524880 - DNA, 20 bp, mouse
gagcgtgggcccacatcgaa

SEQ ID NO: 524881 - DNA, 20 bp, mouse
ggtcgtcccggtggtccccg

SEQ ID NO: 524882 - DNA, 20 bp, mouse
gacggcatggtcaggtgagg

SEQ ID NO: 524883 - DNA, 20 bp, mouse
gggaactgctggggtcgtcc

SEQ ID NO: 524884 - DNA, 20 bp, mouse
gaggctaggggcccaaagta

SEQ ID NO: 524885 - DNA, 20 bp, mouse
ggtcccggtggtccccgggg

SEQ ID NO: 524886 - DNA, 20 bp, mouse
gcagggctggtgcaaccggg

SEQ ID NO: 524887 - DNA, 20 bp, mouse
gcgccgcggccgcagacaaa

SEQ ID NO: 524888 - DNA, 20 bp, mouse
gcgaggcagacggagcgcgg

SEQ ID NO: 524889 - DNA, 20 bp, mouse
gcgggagctcggccgcgcca

SEQ ID NO: 524890 - DNA, 20 bp, mouse
gcgccagggctggtgcaacc

SEQ ID NO: 524891 - DNA, 20 bp, mouse
gtgggtcccaccagagacag

SEQ ID NO: 524892 - DNA, 20 bp, mouse
ggcaaccgggcggagagcgc

SEQ ID NO: 524893 - DNA, 20 bp, mouse
gagctcggccgcgccagggc

SEQ ID NO: 524894 - DNA, 20 bp, mouse
gcgcggcggccctttgtctg

SEQ ID NO: 524895 - DNA, 20 bp, mouse
gcaccgaggcagacggagcg

SEQ ID NO: 524896 - DNA, 20 bp, mouse
ggcgggtcggggttacatgg

SEQ ID NO: 524897 - DNA, 20 bp, mouse
gcccggagggtcacacacaa

SEQ ID NO: 524898 - DNA, 20 bp, mouse
gcgcggacagccctcaaggt

SEQ ID NO: 524899 - DNA, 20 bp, mouse
gctggcgggtcggggttaca

SEQ ID NO: 524900 - DNA, 20 bp, mouse
gaggtctccggctgtgctgg

SEQ ID NO: 524901 - DNA, 20 bp, mouse
gcggggaccggcctgagaca

SEQ ID NO: 524902 - DNA, 20 bp, mouse
gggttacatggcggcgactg

SEQ ID NO: 524903 - DNA, 20 bp, mouse
gggcggcagcggcgtttccg

SEQ ID NO: 524904 - DNA, 20 bp, mouse
gtgcggcaaagcgagagcct

SEQ ID NO: 524905 - DNA, 20 bp, mouse
gggcccgcggacagccctca

SEQ ID NO: 524906 - DNA, 20 bp, mouse
gaggttcttggccaccacag

SEQ ID NO: 524907 - DNA, 20 bp, mouse
gcacggcccaggatccaggg

SEQ ID NO: 524908 - DNA, 20 bp, mouse
ggttaagtgagcgagcccgg

SEQ ID NO: 524909 - DNA, 20 bp, mouse
gacctgtgcagcaggcgaga

SEQ ID NO: 524910 - DNA, 20 bp, mouse
gcagtgatgagtgttccccc

SEQ ID NO: 524911 - DNA, 20 bp, mouse
gccccacggcccaggatcca

SEQ ID NO: 524912 - DNA, 20 bp, mouse
ggctcacttaacaagaaccg

SEQ ID NO: 524913 - DNA, 20 bp, mouse
gggcgcggccccggaagaaa

SEQ ID NO: 524914 - DNA, 20 bp, mouse
ggccgaaccgctgaaggagg

SEQ ID NO: 524915 - DNA, 20 bp, mouse
gccgcgcccccctggatcct

SEQ ID NO: 524916 - DNA, 20 bp, mouse
gtctctgttagtcagcggag

SEQ ID NO: 524917 - DNA, 20 bp, mouse
gcgcgaacaggattgagtag

SEQ ID NO: 524918 - DNA, 20 bp, mouse
gggacgttgcggccgaaacg

SEQ ID NO: 524919 - DNA, 20 bp, mouse
gcggccgaggccggacgttg

SEQ ID NO: 524920 - DNA, 20 bp, mouse
ggcgacctggaagcccgtag

SEQ ID NO: 524921 - DNA, 20 bp, mouse
gccgcgtctctgttagtcag

SEQ ID NO: 524922 - DNA, 20 bp, mouse
ggaaacgcggagccgcgaac

SEQ ID NO: 524923 - DNA, 20 bp, mouse
gcacccggcagtgcagccaa

SEQ ID NO: 524924 - DNA, 20 bp, mouse
ggaacggcgccgtcctgcgg

SEQ ID NO: 524925 - DNA, 20 bp, mouse
gcgttcccgggagggggtca

SEQ ID NO: 524926 - DNA, 20 bp, mouse
gctcagtccgaaccccgcgg

SEQ ID NO: 524927 - DNA, 20 bp, mouse
gcggggttcggactgagctg

SEQ ID NO: 524928 - DNA, 20 bp, mouse
gcagcagcggaggcgcgtgg

SEQ ID NO: 524929 - DNA, 20 bp, mouse
gccagggctgcaccccggaa

SEQ ID NO: 524930 - DNA, 20 bp, mouse
gcggccgcttccccattcct

SEQ ID NO: 524931 - DNA, 20 bp, mouse
gggcgaagcggcgcgctgtc

SEQ ID NO: 524932 - DNA, 20 bp, mouse
gcctggactggaggttgtgg

SEQ ID NO: 524933 - DNA, 20 bp, mouse
gctctcgctccgccattccg

SEQ ID NO: 524934 - DNA, 20 bp, mouse
gcccaccccatgacacggaa

SEQ ID NO: 524935 - DNA, 20 bp, mouse
gtccttggagaccctgaggg

SEQ ID NO: 524936 - DNA, 20 bp, mouse
ggcgccctgccaggacaccg

SEQ ID NO: 524937 - DNA, 20 bp, mouse
gcacgccctgcgacacccgt

SEQ ID NO: 524938 - DNA, 20 bp, mouse
gggcgtgtcacgaggtgagt

SEQ ID NO: 524939 - DNA, 20 bp, mouse
gggcgacagcgagtgaaagg

SEQ ID NO: 524940 - DNA, 20 bp, mouse
gctgccgcggtgtcctggca

SEQ ID NO: 524941 - DNA, 20 bp, mouse
ggtgtcctggcagggcgctg

SEQ ID NO: 524942 - DNA, 20 bp, mouse
ggctgaggtgtgtcgccgac

SEQ ID NO: 524943 - DNA, 20 bp, mouse
gggaggcgacagcgagtgaa

SEQ ID NO: 524944 - DNA, 20 bp, mouse
ggccgcgccgcaggggtgag

SEQ ID NO: 524945 - DNA, 20 bp, mouse
gtgtcgcagggcgtgtcacg

SEQ ID NO: 524946 - DNA, 20 bp, mouse
ggcggcacgtcctaaggtag

SEQ ID NO: 524947 - DNA, 20 bp, mouse
gttccggggcccgaatccac

SEQ ID NO: 524948 - DNA, 20 bp, mouse
gtgggcggcggcacgtccta

SEQ ID NO: 524949 - DNA, 20 bp, mouse
gctcaggcagccgctacctt

SEQ ID NO: 524950 - DNA, 20 bp, mouse
gcttccggcaagggagtgac

SEQ ID NO: 524951 - DNA, 20 bp, mouse
ggccagcgcggctcgttccg

SEQ ID NO: 524952 - DNA, 20 bp, mouse
gctgaggtgacagcggcccg

SEQ ID NO: 524953 - DNA, 20 bp, mouse
gccagcacgttcaccaccag

SEQ ID NO: 524954 - DNA, 20 bp, mouse
gtgacagcggcccgtggatt

SEQ ID NO: 524955 - DNA, 20 bp, mouse
gcaggcgggacttccggcaa

SEQ ID NO: 524956 - DNA, 20 bp, mouse
ggaagggaaccggaccggaa

SEQ ID NO: 524957 - DNA, 20 bp, mouse
gtggcagcagcggagcagaa

SEQ ID NO: 524958 - DNA, 20 bp, mouse
gcagcggagcagaagggaac

SEQ ID NO: 524959 - DNA, 20 bp, mouse
gacccactgcgacggcgacg

SEQ ID NO: 524960 - DNA, 20 bp, mouse
gcgctgcgacccttccggtc

SEQ ID NO: 524961 - DNA, 20 bp, mouse
ggtcagactgagcgccgcgg

SEQ ID NO: 524962 - DNA, 20 bp, mouse
gcccctcacacccactgcga

SEQ ID NO: 524963 - DNA, 20 bp, mouse
ggccccgtcgccgtcgcagt

SEQ ID NO: 524964 - DNA, 20 bp, mouse
gccgcccgcccggctcacct

SEQ ID NO: 524965 - DNA, 20 bp, mouse
gtccgtcagactgagcgccg

SEQ ID NO: 524966 - DNA, 20 bp, mouse
gggcgcggctctgggtaaca

SEQ ID NO: 524967 - DNA, 20 bp, mouse
gggcggcggcggggtcatga

SEQ ID NO: 524968 - DNA, 20 bp, mouse
gggactgccgaggacttcgt

SEQ ID NO: 524969 - DNA, 20 bp, mouse
gcactcggccctggcgcccc

SEQ ID NO: 524970 - DNA, 20 bp, mouse
gtgctgttgccggccggcgg

SEQ ID NO: 524971 - DNA, 20 bp, mouse
ggcgaggcggcctgtagtgt

SEQ ID NO: 524972 - DNA, 20 bp, mouse
gtgggtgtgtgacttaggtg

SEQ ID NO: 524973 - DNA, 20 bp, mouse
gagaggtcggagggtcccgc

SEQ ID NO: 524974 - DNA, 20 bp, mouse
gccagcgcctacgaagtcct

SEQ ID NO: 524975 - DNA, 20 bp, mouse
gggctgctgttgccggccgg

SEQ ID NO: 524976 - DNA, 20 bp, mouse
gccgagaagtaccagcccgg

SEQ ID NO: 524977 - DNA, 20 bp, mouse
gcgctccggggaacgcggga

SEQ ID NO: 524978 - DNA, 20 bp, mouse
gagaagtaccagcccggggg

SEQ ID NO: 524979 - DNA, 20 bp, mouse
gctcggcgcggcgattcctc

SEQ ID NO: 524980 - DNA, 20 bp, mouse
gcggggaacgcgggacggca

SEQ ID NO: 524981 - DNA, 20 bp, mouse
gcgccgagcagcctgtgacg

SEQ ID NO: 524982 - DNA, 20 bp, mouse
ggactcgcgcgcagaggcag

SEQ ID NO: 524983 - DNA, 20 bp, mouse
ggcgccgagaagtaccagcc

SEQ ID NO: 524984 - DNA, 20 bp, mouse
gcagccctgctccctccccc

SEQ ID NO: 524985 - DNA, 20 bp, mouse
ggcgcacagcgggacccacg

SEQ ID NO: 524986 - DNA, 20 bp, mouse
gtcatggtgcaggcgagagt

SEQ ID NO: 524987 - DNA, 20 bp, mouse
gcggtcctcagcggactcca

SEQ ID NO: 524988 - DNA, 20 bp, mouse
gacgcgggcggcgagactct

SEQ ID NO: 524989 - DNA, 20 bp, mouse
gggcaagagatagtgatccc

SEQ ID NO: 524990 - DNA, 20 bp, mouse
gcccagcctggcgcgtccag

SEQ ID NO: 524991 - DNA, 20 bp, mouse
gcgcgtccagaggcacctga

SEQ ID NO: 524992 - DNA, 20 bp, mouse
gcggcgagactctgggtcca

SEQ ID NO: 524993 - DNA, 20 bp, mouse
gcaggcgaaggcgcacttgg

SEQ ID NO: 524994 - DNA, 20 bp, mouse
gcagaggcacctgaaggaaa

SEQ ID NO: 524995 - DNA, 20 bp, mouse
gaagcactacacgaaaatca

SEQ ID NO: 524996 - DNA, 20 bp, mouse
gcaggcgtcccggcgatgtg

SEQ ID NO: 524997 - DNA, 20 bp, mouse
gctgcccggcgcaggcgtcc

SEQ ID NO: 524998 - DNA, 20 bp, mouse
gtggcgaacccaggcctaag

SEQ ID NO: 524999 - DNA, 20 bp, mouse
ggtggcgctggagcggcagt

SEQ ID NO: 525000 - DNA, 20 bp, mouse
gagcgcccgcccctagggag

SEQ ID NO: 525001 - DNA, 20 bp, mouse
gccggggaggcaggctcccg

SEQ ID NO: 525002 - DNA, 20 bp, mouse
gcgaacccaggcctaagcgg

SEQ ID NO: 525003 - DNA, 20 bp, mouse
ggcatccgccggcctttctg

SEQ ID NO: 525004 - DNA, 20 bp, mouse
gtggcagccgaggaagcaaa

SEQ ID NO: 525005 - DNA, 20 bp, mouse
ggcgcgccccggggacgacc

SEQ ID NO: 525006 - DNA, 20 bp, mouse
gcccagctcacagcgccctc

SEQ ID NO: 525007 - DNA, 20 bp, mouse
gcctccggcatcgcgatcga

SEQ ID NO: 525008 - DNA, 20 bp, mouse
ggccaccatagctactgctg

SEQ ID NO: 525009 - DNA, 20 bp, mouse
ggctgggccccagcgaacgg

SEQ ID NO: 525010 - DNA, 20 bp, mouse
ggtagctatggtggcaccag

SEQ ID NO: 525011 - DNA, 20 bp, mouse
gatagctactgctgcggctg

SEQ ID NO: 525012 - DNA, 20 bp, mouse
gtgagctgggccccagcgaa

SEQ ID NO: 525013 - DNA, 20 bp, mouse
gggggcgctgacgagtagta

SEQ ID NO: 525014 - DNA, 20 bp, mouse
gctccgaagccactgggcaa

SEQ ID NO: 525015 - DNA, 20 bp, mouse
gaagccgtcgatcgcgatgc

SEQ ID NO: 525016 - DNA, 20 bp, mouse
gggcccgccagccgcctcac

SEQ ID NO: 525017 - DNA, 20 bp, mouse
gaacgagacgaagacggaac

SEQ ID NO: 525018 - DNA, 20 bp, mouse
gggtttgaacgagacgaaga

SEQ ID NO: 525019 - DNA, 20 bp, mouse
gccgcctcaccggctttctc

SEQ ID NO: 525020 - DNA, 20 bp, mouse
ggcagcagtcgggaattcac

SEQ ID NO: 525021 - DNA, 20 bp, mouse
gacgcgggtcctgagaaagc

SEQ ID NO: 525022 - DNA, 20 bp, mouse
gggcgcgcggacggcggacg

SEQ ID NO: 525023 - DNA, 20 bp, mouse
gcgaagacggaaccggagcc

SEQ ID NO: 525024 - DNA, 20 bp, mouse
ggcagtcgggaattcacggg

SEQ ID NO: 525025 - DNA, 20 bp, mouse
gcggtggggaccctgggtgt

SEQ ID NO: 525026 - DNA, 20 bp, mouse
gacagagggaacacacgcgg

SEQ ID NO: 525027 - DNA, 20 bp, mouse
gacgcggtggctgactgggg

SEQ ID NO: 525028 - DNA, 20 bp, mouse
gccgacagagggaacacacg

SEQ ID NO: 525029 - DNA, 20 bp, mouse
ggggtgagcagcaagcagcg

SEQ ID NO: 525030 - DNA, 20 bp, mouse
gacacacgcggtggctgact

SEQ ID NO: 525031 - DNA, 20 bp, mouse
gggagcggtcctacaggtac

SEQ ID NO: 525032 - DNA, 20 bp, mouse
gggagcagagcgcggctgca

SEQ ID NO: 525033 - DNA, 20 bp, mouse
ggtactggcacgggaggctg

SEQ ID NO: 525034 - DNA, 20 bp, mouse
ggcggggccgggcacagagc

SEQ ID NO: 525035 - DNA, 20 bp, mouse
gctacaggtactggcacggg

SEQ ID NO: 525036 - DNA, 20 bp, mouse
gagctgtcagcagaagaagg

SEQ ID NO: 525037 - DNA, 20 bp, mouse
gcccagtgcaaagggtgtcg

SEQ ID NO: 525038 - DNA, 20 bp, mouse
gagggtgtcggggcgcgcca

SEQ ID NO: 525039 - DNA, 20 bp, mouse
ggaggcgacaacgccggagc

SEQ ID NO: 525040 - DNA, 20 bp, mouse
gaaagagaggggccacccgt

SEQ ID NO: 525041 - DNA, 20 bp, mouse
ggtacttgactcacctgctc

SEQ ID NO: 525042 - DNA, 20 bp, mouse
gttcttctgctgacagctgg

SEQ ID NO: 525043 - DNA, 20 bp, mouse
gagggaccgacccagtgcaa

SEQ ID NO: 525044 - DNA, 20 bp, mouse
ggccccccacccaaagagag

SEQ ID NO: 525045 - DNA, 20 bp, mouse
ggaggtctggatcaccaccc

SEQ ID NO: 525046 - DNA, 20 bp, mouse
ggggcggagggtcctagcag

SEQ ID NO: 525047 - DNA, 20 bp, mouse
gtttaagccggagaccgcgg

SEQ ID NO: 525048 - DNA, 20 bp, mouse
gcagaggctgcggctccggc

SEQ ID NO: 525049 - DNA, 20 bp, mouse
ggacagcgccacatctagag

SEQ ID NO: 525050 - DNA, 20 bp, mouse
ggccccgaggccaccgagga

SEQ ID NO: 525051 - DNA, 20 bp, mouse
gtccctgtggacccacctag

SEQ ID NO: 525052 - DNA, 20 bp, mouse
gagacccgcagaacacgggt

SEQ ID NO: 525053 - DNA, 20 bp, mouse
ggacggagacccgcagaaca

SEQ ID NO: 525054 - DNA, 20 bp, mouse
gctctcgtcccccgcagtct

SEQ ID NO: 525055 - DNA, 20 bp, mouse
ggaggcggctccggctgaga

SEQ ID NO: 525056 - DNA, 20 bp, mouse
gggcggcggcggcagaaggt

SEQ ID NO: 525057 - DNA, 20 bp, mouse
gggacagaagaggacagcgg

SEQ ID NO: 525058 - DNA, 20 bp, mouse
gcagaaggcgaggacagaag

SEQ ID NO: 525059 - DNA, 20 bp, mouse
gaagaggacagcggaggaga

SEQ ID NO: 525060 - DNA, 20 bp, mouse
gacggcgcacagggccagag

SEQ ID NO: 525061 - DNA, 20 bp, mouse
gcccagctccccagcgccta

SEQ ID NO: 525062 - DNA, 20 bp, mouse
gagggagctgggcatcaatc

SEQ ID NO: 525063 - DNA, 20 bp, mouse
gggctccgcgcaaatgaggg

SEQ ID NO: 525064 - DNA, 20 bp, mouse
gcgcggatgacggtgaccta

SEQ ID NO: 525065 - DNA, 20 bp, mouse
gcgccccagagatggattta

SEQ ID NO: 525066 - DNA, 20 bp, mouse
gccgcacccatgactggaga

SEQ ID NO: 525067 - DNA, 20 bp, mouse
gtcccgccctctccagtcat

SEQ ID NO: 525068 - DNA, 20 bp, mouse
gaggaccccgcacccatgac

SEQ ID NO: 525069 - DNA, 20 bp, mouse
gctacagcaagtgggaacgg

SEQ ID NO: 525070 - DNA, 20 bp, mouse
gtgagcgcttgatacacctc

SEQ ID NO: 525071 - DNA, 20 bp, mouse
gtggcccgggacccgaaacg

SEQ ID NO: 525072 - DNA, 20 bp, mouse
gcctgggcgctgaccctctt

SEQ ID NO: 525073 - DNA, 20 bp, mouse
ggccggcggctacagcaagt

SEQ ID NO: 525074 - DNA, 20 bp, mouse
gaacgcggagaagccgaaga

SEQ ID NO: 525075 - DNA, 20 bp, mouse
gactggaccaagagctactg

SEQ ID NO: 525076 - DNA, 20 bp, mouse
ggccagagccgtagagctgg

SEQ ID NO: 525077 - DNA, 20 bp, mouse
ggcccgggatagtgtaacat

SEQ ID NO: 525078 - DNA, 20 bp, mouse
gacccatgttacactatccc

SEQ ID NO: 525079 - DNA, 20 bp, mouse
gcagtagcccaggcctgccc

SEQ ID NO: 525080 - DNA, 20 bp, mouse
gggctcgcctcggcctccct

SEQ ID NO: 525081 - DNA, 20 bp, mouse
gcgagccagagccgtagagc

SEQ ID NO: 525082 - DNA, 20 bp, mouse
gtcctccagctctacggctc

SEQ ID NO: 525083 - DNA, 20 bp, mouse
gcactatcccgggcaggcct

SEQ ID NO: 525084 - DNA, 20 bp, mouse
gggtggaccgcggctgccca

SEQ ID NO: 525085 - DNA, 20 bp, mouse
gccgatcaagtcctgcaagg

SEQ ID NO: 525086 - DNA, 20 bp, mouse
gcccgggagacagccagcaa

SEQ ID NO: 525087 - DNA, 20 bp, mouse
gatctggtggaggggcatac

SEQ ID NO: 525088 - DNA, 20 bp, mouse
gtgggattacagaaatctgg

SEQ ID NO: 525089 - DNA, 20 bp, mouse
gggctgggattacagaaatc

SEQ ID NO: 525090 - DNA, 20 bp, mouse
gttacagaaatctggtggag

SEQ ID NO: 525091 - DNA, 20 bp, mouse
gtctgtgtgcgctaggtgac

SEQ ID NO: 525092 - DNA, 20 bp, mouse
ggtggaggggcatactggct

SEQ ID NO: 525093 - DNA, 20 bp, mouse
gctagcgcacacagagagct

SEQ ID NO: 525094 - DNA, 20 bp, mouse
gtttgtgcggcacaactagg

SEQ ID NO: 525095 - DNA, 20 bp, mouse
gtcctgttgtacaggcagta

SEQ ID NO: 525096 - DNA, 20 bp, mouse
gcttggggtggagacggtgg

SEQ ID NO: 525097 - DNA, 20 bp, mouse
gccaccccaagaaaggccgg

SEQ ID NO: 525098 - DNA, 20 bp, mouse
gcggacagctgcctcccggg

SEQ ID NO: 525099 - DNA, 20 bp, mouse
gcggttgccaaggaaacggg

SEQ ID NO: 525100 - DNA, 20 bp, mouse
ggcggcctccggcctttctt

SEQ ID NO: 525101 - DNA, 20 bp, mouse
ggcctttcttggggtggaga

SEQ ID NO: 525102 - DNA, 20 bp, mouse
gtttcttggggtggagacgg

SEQ ID NO: 525103 - DNA, 20 bp, mouse
gccgcgcgaggagggaggca

SEQ ID NO: 525104 - DNA, 20 bp, mouse
ggttagcccgaagaagagag

SEQ ID NO: 525105 - DNA, 20 bp, mouse
gaaggaaacgggaggacgcc

SEQ ID NO: 525106 - DNA, 20 bp, mouse
ggaaagggccagggatgagg

SEQ ID NO: 525107 - DNA, 20 bp, mouse
ggcgatgccatgctaaggag

SEQ ID NO: 525108 - DNA, 20 bp, mouse
gccatgctaaggagagggaa

SEQ ID NO: 525109 - DNA, 20 bp, mouse
gtcacacacctcctcatccc

SEQ ID NO: 525110 - DNA, 20 bp, mouse
gagagtgcttgcgaaggggg

SEQ ID NO: 525111 - DNA, 20 bp, mouse
gtacataggaataaatccag

SEQ ID NO: 525112 - DNA, 20 bp, mouse
ggctagagtgcttgcgaagg

SEQ ID NO: 525113 - DNA, 20 bp, mouse
gctaggaaaatagtctccag

SEQ ID NO: 525114 - DNA, 20 bp, mouse
ggttgagaaggtccacaaaa

SEQ ID NO: 525115 - DNA, 20 bp, mouse
gggtgctagagtgcttgcga

SEQ ID NO: 525116 - DNA, 20 bp, mouse
gaggaaggcgggaccaggag

SEQ ID NO: 525117 - DNA, 20 bp, mouse
gggaccaggagaggacgcgg

SEQ ID NO: 525118 - DNA, 20 bp, mouse
ggcgggaccaggagaggacg

SEQ ID NO: 525119 - DNA, 20 bp, mouse
gcgcagaggcggctgttcag

SEQ ID NO: 525120 - DNA, 20 bp, mouse
gaggacgcggaggaccggcg

SEQ ID NO: 525121 - DNA, 20 bp, mouse
gtccatcagagccgagccgg

SEQ ID NO: 525122 - DNA, 20 bp, mouse
gacgcggaggaccggcgcgg

SEQ ID NO: 525123 - DNA, 20 bp, mouse
gagggtgggaaggggaaccg

SEQ ID NO: 525124 - DNA, 20 bp, mouse
gcggggcgaagggactagga

SEQ ID NO: 525125 - DNA, 20 bp, mouse
gcaccgggcgggcaggagga

SEQ ID NO: 525126 - DNA, 20 bp, mouse
gcggcccggcccgtcagcag

SEQ ID NO: 525127 - DNA, 20 bp, mouse
gtactcgagcgggacagata

SEQ ID NO: 525128 - DNA, 20 bp, mouse
gggagcaagccgctgctgac

SEQ ID NO: 525129 - DNA, 20 bp, mouse
gcgggccagggagaaccgag

SEQ ID NO: 525130 - DNA, 20 bp, mouse
ggcccgccgagcagacagca

SEQ ID NO: 525131 - DNA, 20 bp, mouse
gccggcgagcacctgcgtcc

SEQ ID NO: 525132 - DNA, 20 bp, mouse
gcagcggcttgctccggctc

SEQ ID NO: 525133 - DNA, 20 bp, mouse
gtcctgagcagggctaagta

SEQ ID NO: 525134 - DNA, 20 bp, mouse
gcagggctaagtaaggccaa

SEQ ID NO: 525135 - DNA, 20 bp, mouse
ggcccggccgcggaacaggt

SEQ ID NO: 525136 - DNA, 20 bp, mouse
gtgcagtctggcaagacttc

SEQ ID NO: 525137 - DNA, 20 bp, mouse
ggccgcgcctgtggtgaaga

SEQ ID NO: 525138 - DNA, 20 bp, mouse
ggtctggcaagacttcgggc

SEQ ID NO: 525139 - DNA, 20 bp, mouse
gggcaggtgactgcagcgac

SEQ ID NO: 525140 - DNA, 20 bp, mouse
gctgtggctgcccattcact

SEQ ID NO: 525141 - DNA, 20 bp, mouse
gaccgtcttcaccacaggcg

SEQ ID NO: 525142 - DNA, 20 bp, mouse
gccgtggcactacctctggg

SEQ ID NO: 525143 - DNA, 20 bp, mouse
gtaaccgtggcactacctct

SEQ ID NO: 525144 - DNA, 20 bp, mouse
ggcggactcttgccacccag

SEQ ID NO: 525145 - DNA, 20 bp, mouse
gttgtggcagcctagtgaat

SEQ ID NO: 525146 - DNA, 20 bp, mouse
gagggaaagagcgagagact

SEQ ID NO: 525147 - DNA, 20 bp, mouse
gcgcagacgccgctgaggga

SEQ ID NO: 525148 - DNA, 20 bp, mouse
ggagcgagagactaggagag

SEQ ID NO: 525149 - DNA, 20 bp, mouse
gaggctggcggtccgaggac

SEQ ID NO: 525150 - DNA, 20 bp, mouse
ggtctgcgtcaggcccccac

SEQ ID NO: 525151 - DNA, 20 bp, mouse
gccgcgcgtcatgccagtgg

SEQ ID NO: 525152 - DNA, 20 bp, mouse
gtgacgcgcggggtctgggt

SEQ ID NO: 525153 - DNA, 20 bp, mouse
gcaggtgctgaacgcagcag

SEQ ID NO: 525154 - DNA, 20 bp, mouse
gctgacgcagacgccgctga

SEQ ID NO: 525155 - DNA, 20 bp, mouse
gggaccgccagcctaccgcc

SEQ ID NO: 525156 - DNA, 20 bp, mouse
gaccggaaccctgggcggac

SEQ ID NO: 525157 - DNA, 20 bp, mouse
ggtccatggaccggaaccct

SEQ ID NO: 525158 - DNA, 20 bp, mouse
ggccccggcggtccatggac

SEQ ID NO: 525159 - DNA, 20 bp, mouse
gcatggaccggaaccctggg

SEQ ID NO: 525160 - DNA, 20 bp, mouse
gggcgactcttacctcacag

SEQ ID NO: 525161 - DNA, 20 bp, mouse
gtccggtccatggaccgccg

SEQ ID NO: 525162 - DNA, 20 bp, mouse
ggttcctgccggtccgccca

SEQ ID NO: 525163 - DNA, 20 bp, mouse
gacagaggtagctcctccgc

SEQ ID NO: 525164 - DNA, 20 bp, mouse
gaccccggcgcgcacggagg

SEQ ID NO: 525165 - DNA, 20 bp, mouse
gggagtaggcctcagtcccg

SEQ ID NO: 525166 - DNA, 20 bp, mouse
gtgcgagaggaagccggtcg

SEQ ID NO: 525167 - DNA, 20 bp, mouse
gaagccggtcgcgggcgagg

SEQ ID NO: 525168 - DNA, 20 bp, mouse
gctcgggtgcgagaggaagc

SEQ ID NO: 525169 - DNA, 20 bp, mouse
ggcgtgcgctcgggtgcgag

SEQ ID NO: 525170 - DNA, 20 bp, mouse
gaccgccgaggaaggtgagg

SEQ ID NO: 525171 - DNA, 20 bp, mouse
ggtcgcgggcgagggggaca

SEQ ID NO: 525172 - DNA, 20 bp, mouse
ggacaccgccgaggaaggtg

SEQ ID NO: 525173 - DNA, 20 bp, mouse
ggaaagcgagcgccggggag

SEQ ID NO: 525174 - DNA, 20 bp, mouse
gccgcgaggcgcccgcgacc

SEQ ID NO: 525175 - DNA, 20 bp, mouse
gcggcgcccgcgctccagtc

SEQ ID NO: 525176 - DNA, 20 bp, mouse
ggggctaccggcagagaagt

SEQ ID NO: 525177 - DNA, 20 bp, mouse
gagtcggcgacgaagcacaa

SEQ ID NO: 525178 - DNA, 20 bp, mouse
gttctgcggcgcatccggag

SEQ ID NO: 525179 - DNA, 20 bp, mouse
gcggcgacgaagcacaatgg

SEQ ID NO: 525180 - DNA, 20 bp, mouse
gacggcggcggccacttctg

SEQ ID NO: 525181 - DNA, 20 bp, mouse
gagcccagcgaggaaggcgg

SEQ ID NO: 525182 - DNA, 20 bp, mouse
gggctcggctctcgggctac

SEQ ID NO: 525183 - DNA, 20 bp, mouse
gggaagggcggggctgccaa

SEQ ID NO: 525184 - DNA, 20 bp, mouse
gagggcggggctgccaacgg

SEQ ID NO: 525185 - DNA, 20 bp, mouse
gtgggctcggctcggctctc

SEQ ID NO: 525186 - DNA, 20 bp, mouse
ggcccgggtcatgcaggaag

SEQ ID NO: 525187 - DNA, 20 bp, mouse
ggcctacaccacccagcgag

SEQ ID NO: 525188 - DNA, 20 bp, mouse
gcccgcttcctgcatgaccc

SEQ ID NO: 525189 - DNA, 20 bp, mouse
gcgtccggcccgggtcatgc

SEQ ID NO: 525190 - DNA, 20 bp, mouse
gggtccggtcaccctatcgg

SEQ ID NO: 525191 - DNA, 20 bp, mouse
gcgagcagctcaggtgggcg

SEQ ID NO: 525192 - DNA, 20 bp, mouse
gctgggaggccgcgacaggt

SEQ ID NO: 525193 - DNA, 20 bp, mouse
gccagcggccctgctgcgtc

SEQ ID NO: 525194 - DNA, 20 bp, mouse
ggcgggcggccgaaggtctc

SEQ ID NO: 525195 - DNA, 20 bp, mouse
gtgagagagcccgagacctt

SEQ ID NO: 525196 - DNA, 20 bp, mouse
gccgagaggacgacgatggg

SEQ ID NO: 525197 - DNA, 20 bp, mouse
gggcagtcggagcgggactg

SEQ ID NO: 525198 - DNA, 20 bp, mouse
ggttcggcggtagcaaatgg

SEQ ID NO: 525199 - DNA, 20 bp, mouse
gagcccgcggacggcagggt

SEQ ID NO: 525200 - DNA, 20 bp, mouse
gttgctaccgccgaacgcac

SEQ ID NO: 525201 - DNA, 20 bp, mouse
gccgctccgactgccggatc

SEQ ID NO: 525202 - DNA, 20 bp, mouse
ggttcggcccgtgcgttcgg

SEQ ID NO: 525203 - DNA, 20 bp, mouse
gaaatggcggctccttccgg

SEQ ID NO: 525204 - DNA, 20 bp, mouse
gcgcacgggccgaaccgagc

SEQ ID NO: 525205 - DNA, 20 bp, mouse
ggggccgagaggacgacgat

SEQ ID NO: 525206 - DNA, 20 bp, mouse
gacagtgcggctacaaatct

SEQ ID NO: 525207 - DNA, 20 bp, mouse
gtagccgcactgtagacaag

SEQ ID NO: 525208 - DNA, 20 bp, mouse
ggcggcggcggcacacacac

SEQ ID NO: 525209 - DNA, 20 bp, mouse
gactgtagacaagaggaaaa

SEQ ID NO: 525210 - DNA, 20 bp, mouse
gcgcatcttattagcaacca

SEQ ID NO: 525211 - DNA, 20 bp, mouse
gaccgccgagaggcccgggg

SEQ ID NO: 525212 - DNA, 20 bp, mouse
ggcacacacaccggagggag

SEQ ID NO: 525213 - DNA, 20 bp, mouse
gtctccaagaccgcagcgaa

SEQ ID NO: 525214 - DNA, 20 bp, mouse
gttcggttggtgtaacgacg

SEQ ID NO: 525215 - DNA, 20 bp, mouse
ggagaactgggcacccatgc

SEQ ID NO: 525216 - DNA, 20 bp, mouse
ggtgggcgcagctagcgggt

SEQ ID NO: 525217 - DNA, 20 bp, mouse
gcagcagtgggcgcagctag

SEQ ID NO: 525218 - DNA, 20 bp, mouse
gtagcgggtcggctgcggag

SEQ ID NO: 525219 - DNA, 20 bp, mouse
gagagctctaaggctccccg

SEQ ID NO: 525220 - DNA, 20 bp, mouse
ggcagctagcgggtcggctg

SEQ ID NO: 525221 - DNA, 20 bp, mouse
ggcctcgggcgcgtacatat

SEQ ID NO: 525222 - DNA, 20 bp, mouse
ggacggcccggcgggcagag

SEQ ID NO: 525223 - DNA, 20 bp, mouse
gtcgggcgcgtacatatagg

SEQ ID NO: 525224 - DNA, 20 bp, mouse
gcatcacttgggacgaccag

SEQ ID NO: 525225 - DNA, 20 bp, mouse
gcaggtgagtgcgctcggag

SEQ ID NO: 525226 - DNA, 20 bp, mouse
ggagccctgcttcctcctag

SEQ ID NO: 525227 - DNA, 20 bp, mouse
gagtaaagaactcctcaaag

SEQ ID NO: 525228 - DNA, 20 bp, mouse
gtctcccctaggaggaagca

SEQ ID NO: 525229 - DNA, 20 bp, mouse
gccagcagaaactctcccct

SEQ ID NO: 525230 - DNA, 20 bp, mouse
ggcagaaactctcccctagg

SEQ ID NO: 525231 - DNA, 20 bp, mouse
gagaaacttagtctgttggt

SEQ ID NO: 525232 - DNA, 20 bp, mouse
gaccaagggcacagcatctg

SEQ ID NO: 525233 - DNA, 20 bp, mouse
gctgggcaactgcattacaa

SEQ ID NO: 525234 - DNA, 20 bp, mouse
gcttaacaagcaccagacaa

SEQ ID NO: 525235 - DNA, 20 bp, mouse
gaacatagcttggtcaaaat

SEQ ID NO: 525236 - DNA, 20 bp, mouse
gcagtgccgggactccacta

SEQ ID NO: 525237 - DNA, 20 bp, mouse
gagtcgggaatcaaaataaa

SEQ ID NO: 525238 - DNA, 20 bp, mouse
gtgagccaagaaggagctag

SEQ ID NO: 525239 - DNA, 20 bp, mouse
gaagtggagggagcgcttgg

SEQ ID NO: 525240 - DNA, 20 bp, mouse
gcggcgggagctgcggagtc

SEQ ID NO: 525241 - DNA, 20 bp, mouse
gtggagggagcgcttggcgg

SEQ ID NO: 525242 - DNA, 20 bp, mouse
ggtacgccctagtggagtcc

SEQ ID NO: 525243 - DNA, 20 bp, mouse
gcggaagtggagggagcgct

SEQ ID NO: 525244 - DNA, 20 bp, mouse
gaacgcctcggaagagaccg

SEQ ID NO: 525245 - DNA, 20 bp, mouse
gagcatccggtacgccctag

SEQ ID NO: 525246 - DNA, 20 bp, mouse
ggatcagccggagccctcgg

SEQ ID NO: 525247 - DNA, 20 bp, mouse
ggcggccgccaagagcctcg

SEQ ID NO: 525248 - DNA, 20 bp, mouse
gctggcgcccgcccacccgg

SEQ ID NO: 525249 - DNA, 20 bp, mouse
gggagccggtgcgcgcggag

SEQ ID NO: 525250 - DNA, 20 bp, mouse
gccgcgctgaggcagctccg

SEQ ID NO: 525251 - DNA, 20 bp, mouse
gcgcgatcagccggagccct

SEQ ID NO: 525252 - DNA, 20 bp, mouse
gcacggcacgcagcgccccg

SEQ ID NO: 525253 - DNA, 20 bp, mouse
gctccggccgccgagggctc

SEQ ID NO: 525254 - DNA, 20 bp, mouse
gcccgccgctccgcgcgcac

SEQ ID NO: 525255 - DNA, 20 bp, mouse
gcccggcgcggatgcggcag

SEQ ID NO: 525256 - DNA, 20 bp, mouse
gttgggagcagcaggtccgg

SEQ ID NO: 525257 - DNA, 20 bp, mouse
gtgtcgggcgcggagcagtg

SEQ ID NO: 525258 - DNA, 20 bp, mouse
gtgctccgcgcccgacacac

SEQ ID NO: 525259 - DNA, 20 bp, mouse
gggagcagcaggtccggcgg

SEQ ID NO: 525260 - DNA, 20 bp, mouse
gatgttgggagcagcaggtc

SEQ ID NO: 525261 - DNA, 20 bp, mouse
ggcggcggctgcctgtgtgt

SEQ ID NO: 525262 - DNA, 20 bp, mouse
gcggtggtggcggccatgtt

SEQ ID NO: 525263 - DNA, 20 bp, mouse
gcgcggagcagtgcggctga

SEQ ID NO: 525264 - DNA, 20 bp, mouse
gggctgcggcggttgagagt

SEQ ID NO: 525265 - DNA, 20 bp, mouse
ggcccgagcggtgcatcacc

SEQ ID NO: 525266 - DNA, 20 bp, mouse
ggagcaggaagggagaccta

SEQ ID NO: 525267 - DNA, 20 bp, mouse
gacatcagaagttagttggg

SEQ ID NO: 525268 - DNA, 20 bp, mouse
ggcctgtgccggctgagtaa

SEQ ID NO: 525269 - DNA, 20 bp, mouse
gcaaagcctatggcttggta

SEQ ID NO: 525270 - DNA, 20 bp, mouse
gatggcttggtaaggctgag

SEQ ID NO: 525271 - DNA, 20 bp, mouse
gtgtgccggctgagtaaggg

SEQ ID NO: 525272 - DNA, 20 bp, mouse
gcaggaagggagacctaggg

SEQ ID NO: 525273 - DNA, 20 bp, mouse
gtggtacatcagaagttagt

SEQ ID NO: 525274 - DNA, 20 bp, mouse
gaagagatgggcgagcagga

SEQ ID NO: 525275 - DNA, 20 bp, mouse
gaacttctgatgtaccatcc

SEQ ID NO: 525276 - DNA, 20 bp, mouse
ggctcctgaggtgccgggag

SEQ ID NO: 525277 - DNA, 20 bp, mouse
gcctgaggtgccgggagcgg

SEQ ID NO: 525278 - DNA, 20 bp, mouse
gcggccggcagcccctgaag

SEQ ID NO: 525279 - DNA, 20 bp, mouse
ggcggcggtggcagccggca

SEQ ID NO: 525280 - DNA, 20 bp, mouse
ggcacgcgcgccgcaggaca

SEQ ID NO: 525281 - DNA, 20 bp, mouse
ggagccttacagactcaaga

SEQ ID NO: 525282 - DNA, 20 bp, mouse
gcggccatcttgagtctgta

SEQ ID NO: 525283 - DNA, 20 bp, mouse
gcagccccgggggctcgaca

SEQ ID NO: 525284 - DNA, 20 bp, mouse
gtctagactccggccaggga

SEQ ID NO: 525285 - DNA, 20 bp, mouse
gcggaaagcgagccggagaa

SEQ ID NO: 525286 - DNA, 20 bp, mouse
ggcggagggaggcgaccaag

SEQ ID NO: 525287 - DNA, 20 bp, mouse
gcccgtgcaaggggaacccg

SEQ ID NO: 525288 - DNA, 20 bp, mouse
gcggggaggaagggacgtca

SEQ ID NO: 525289 - DNA, 20 bp, mouse
gtgagctcgcgtccccaggt

SEQ ID NO: 525290 - DNA, 20 bp, mouse
gggaggcgaccaaggggccg

SEQ ID NO: 525291 - DNA, 20 bp, mouse
ggcaagagagggcaggacgg

SEQ ID NO: 525292 - DNA, 20 bp, mouse
gctcaggcagggctccccaa

SEQ ID NO: 525293 - DNA, 20 bp, mouse
gcggggtcagtggtccggga

SEQ ID NO: 525294 - DNA, 20 bp, mouse
gggggcgcggagccggcccg

SEQ ID NO: 525295 - DNA, 20 bp, mouse
gcccccccccagccgacctg

SEQ ID NO: 525296 - DNA, 20 bp, mouse
gtgcatcagcgtgggctccg

SEQ ID NO: 525297 - DNA, 20 bp, mouse
gagcttaacccaggagcggg

SEQ ID NO: 525298 - DNA, 20 bp, mouse
gttgcagcttaacccaggag

SEQ ID NO: 525299 - DNA, 20 bp, mouse
gcgtgagcgagggttccccg

SEQ ID NO: 525300 - DNA, 20 bp, mouse
ggagcccacgctgatgcaat

SEQ ID NO: 525301 - DNA, 20 bp, mouse
ggtacagtgagggtaactaa

SEQ ID NO: 525302 - DNA, 20 bp, mouse
gtactggagtggctgccggt

SEQ ID NO: 525303 - DNA, 20 bp, mouse
ggttccgattgcatcagcgt

SEQ ID NO: 525304 - DNA, 20 bp, mouse
gtaacccaggagcgggaggc

SEQ ID NO: 525305 - DNA, 20 bp, mouse
gtcagcaccgtaggccccga

SEQ ID NO: 525306 - DNA, 20 bp, mouse
gcggcgagcacgaaccgtag

SEQ ID NO: 525307 - DNA, 20 bp, mouse
gtgacagccggccccagcac

SEQ ID NO: 525308 - DNA, 20 bp, mouse
gcgacagccgcggccgaacc

SEQ ID NO: 525309 - DNA, 20 bp, mouse
gaactcggagacgacggtgg

SEQ ID NO: 525310 - DNA, 20 bp, mouse
gtgttgacgcgcacccggtt

SEQ ID NO: 525311 - DNA, 20 bp, mouse
gccggccccagcactggagg

SEQ ID NO: 525312 - DNA, 20 bp, mouse
gaccgtagcggcgacagccg

SEQ ID NO: 525313 - DNA, 20 bp, mouse
ggccgggaactcggagacga

SEQ ID NO: 525314 - DNA, 20 bp, mouse
ggaggctcggcaccgagtag

SEQ ID NO: 525315 - DNA, 20 bp, mouse
gggccagtagcgccgagtac

SEQ ID NO: 525316 - DNA, 20 bp, mouse
ggctgaggacttgaagtaga

SEQ ID NO: 525317 - DNA, 20 bp, mouse
ggccagcgcgagcccagcac

SEQ ID NO: 525318 - DNA, 20 bp, mouse
gcgctgctcccgctgctccg

SEQ ID NO: 525319 - DNA, 20 bp, mouse
gggcgccccgagcagcggaa

SEQ ID NO: 525320 - DNA, 20 bp, mouse
ggccccgagcagcggaatgg

SEQ ID NO: 525321 - DNA, 20 bp, mouse
ggcaatggtgatccagaagg

SEQ ID NO: 525322 - DNA, 20 bp, mouse
ggcggcggcgccccgagcag

SEQ ID NO: 525323 - DNA, 20 bp, mouse
ggtgatgaagtagagcccca

SEQ ID NO: 525324 - DNA, 20 bp, mouse
gggagcatggcccccggacg

SEQ ID NO: 525325 - DNA, 20 bp, mouse
gctgcaggcgcagggagccg

SEQ ID NO: 525326 - DNA, 20 bp, mouse
gggtgagtggggccgcgatg

SEQ ID NO: 525327 - DNA, 20 bp, mouse
ggcagagcgtgctgttccgg

SEQ ID NO: 525328 - DNA, 20 bp, mouse
gcaggcgcccggaaggacgg

SEQ ID NO: 525329 - DNA, 20 bp, mouse
ggcggccccactcacctgcg

SEQ ID NO: 525330 - DNA, 20 bp, mouse
gcaccaggcgcccggaagga

SEQ ID NO: 525331 - DNA, 20 bp, mouse
ggcgtcccgtcgccgcatcg

SEQ ID NO: 525332 - DNA, 20 bp, mouse
ggtgccgggaggctagatgg

SEQ ID NO: 525333 - DNA, 20 bp, mouse
gggaacagcacgctctgccg

SEQ ID NO: 525334 - DNA, 20 bp, mouse
ggtcccagtttcggtgcccg

SEQ ID NO: 525335 - DNA, 20 bp, mouse
gccagccgggaaagtggcga

SEQ ID NO: 525336 - DNA, 20 bp, mouse
gccgcccggaaacgatccga

SEQ ID NO: 525337 - DNA, 20 bp, mouse
gcacctgcctgggaaactta

SEQ ID NO: 525338 - DNA, 20 bp, mouse
gggccatgaaaaatacttcg

SEQ ID NO: 525339 - DNA, 20 bp, mouse
gagaggaacggtgacgtgag

SEQ ID NO: 525340 - DNA, 20 bp, mouse
gccgaggcggggacaggcac

SEQ ID NO: 525341 - DNA, 20 bp, mouse
gggtccgggtctctttctct

SEQ ID NO: 525342 - DNA, 20 bp, mouse
ggtggccaagctcaaggacg

SEQ ID NO: 525343 - DNA, 20 bp, mouse
gtcgccctcggatcgtttcc

SEQ ID NO: 525344 - DNA, 20 bp, mouse
gtgagcttggccacctgcct

SEQ ID NO: 525345 - DNA, 20 bp, mouse
ggtcccgcgaccgctcgacg

SEQ ID NO: 525346 - DNA, 20 bp, mouse
gcccggtcccagcatctccc

SEQ ID NO: 525347 - DNA, 20 bp, mouse
gactcgtctgcagcaatcct

SEQ ID NO: 525348 - DNA, 20 bp, mouse
ggatgctgggaccggggacc

SEQ ID NO: 525349 - DNA, 20 bp, mouse
gcggatgccacaggattcaa

SEQ ID NO: 525350 - DNA, 20 bp, mouse
gctggcaggctggccgggta

SEQ ID NO: 525351 - DNA, 20 bp, mouse
gatcctgtggcatccgtacc

SEQ ID NO: 525352 - DNA, 20 bp, mouse
gcagcaatcctgggagatgc

SEQ ID NO: 525353 - DNA, 20 bp, mouse
gtttgctcgagaagggtcag

SEQ ID NO: 525354 - DNA, 20 bp, mouse
gcaagacgacgacaaagcta

SEQ ID NO: 525355 - DNA, 20 bp, mouse
gggccgggtacggatgccac

SEQ ID NO: 525356 - DNA, 20 bp, mouse
gtagggagtttcatagaggg

SEQ ID NO: 525357 - DNA, 20 bp, mouse
gggagctgcattagaagata

SEQ ID NO: 525358 - DNA, 20 bp, mouse
gctggttacatccctggcaa

SEQ ID NO: 525359 - DNA, 20 bp, mouse
gaagatagggagtttcatag

SEQ ID NO: 525360 - DNA, 20 bp, mouse
ggagggaggctagttgccag

SEQ ID NO: 525361 - DNA, 20 bp, mouse
gagcttacctgcctttgcca

SEQ ID NO: 525362 - DNA, 20 bp, mouse
gtaacagccatcctgacggg

SEQ ID NO: 525363 - DNA, 20 bp, mouse
gttacatccctggcaaaggc

SEQ ID NO: 525364 - DNA, 20 bp, mouse
gtgtggaaagcccttaagga

SEQ ID NO: 525365 - DNA, 20 bp, mouse
gagtgtgtggaaagccctta

SEQ ID NO: 525366 - DNA, 20 bp, mouse
gacgagctcacagacaagtc

SEQ ID NO: 525367 - DNA, 20 bp, mouse
gggcatcgctgacaccacac

SEQ ID NO: 525368 - DNA, 20 bp, mouse
gggacctcagaacaaagata

SEQ ID NO: 525369 - DNA, 20 bp, mouse
gctcgtcccagtccccggtg

SEQ ID NO: 525370 - DNA, 20 bp, mouse
ggtgagctcgtcccagtccc

SEQ ID NO: 525371 - DNA, 20 bp, mouse
gggcagaaggaaccaaagcc

SEQ ID NO: 525372 - DNA, 20 bp, mouse
ggaggtgagtgcctggtcag

SEQ ID NO: 525373 - DNA, 20 bp, mouse
ggcctggtcaggggaccgag

SEQ ID NO: 525374 - DNA, 20 bp, mouse
gctctgtgagctcctggctt

SEQ ID NO: 525375 - DNA, 20 bp, mouse
gagtaggcagcaccctgtgc

SEQ ID NO: 525376 - DNA, 20 bp, mouse
gctggacctgcagagctagg

SEQ ID NO: 525377 - DNA, 20 bp, mouse
gggcacaccatgaggtgggt

SEQ ID NO: 525378 - DNA, 20 bp, mouse
gaggtggcacaccatgaggt

SEQ ID NO: 525379 - DNA, 20 bp, mouse
gagctaggtggcacaccatg

SEQ ID NO: 525380 - DNA, 20 bp, mouse
ggggtcgcccacccacctca

SEQ ID NO: 525381 - DNA, 20 bp, mouse
ggggcgacccatagcttctg

SEQ ID NO: 525382 - DNA, 20 bp, mouse
gcagcttccccagaagctat

SEQ ID NO: 525383 - DNA, 20 bp, mouse
ggcgctggacctgcagagct

SEQ ID NO: 525384 - DNA, 20 bp, mouse
gaggcgcaggcggtagccag

SEQ ID NO: 525385 - DNA, 20 bp, mouse
gctgtggagtcaggggtcaa

SEQ ID NO: 525386 - DNA, 20 bp, mouse
ggacatggtggcaggtgcgg

SEQ ID NO: 525387 - DNA, 20 bp, mouse
gagagtcagacatgacccgg

SEQ ID NO: 525388 - DNA, 20 bp, mouse
ggtcagacatgacccggcgg

SEQ ID NO: 525389 - DNA, 20 bp, mouse
gtgacccggcggcggcgaca

SEQ ID NO: 525390 - DNA, 20 bp, mouse
gcgcggggagcgagtgtgct

SEQ ID NO: 525391 - DNA, 20 bp, mouse
gggcacagcgcggacacctc

SEQ ID NO: 525392 - DNA, 20 bp, mouse
gcacccggaggtcccggaca

SEQ ID NO: 525393 - DNA, 20 bp, mouse
gggctcaggcggcctggtgg

SEQ ID NO: 525394 - DNA, 20 bp, mouse
ggcggcggcgacatggtggc

SEQ ID NO: 525395 - DNA, 20 bp, mouse
gcctgccgcagcagccggca

SEQ ID NO: 525396 - DNA, 20 bp, mouse
gttcccggcgcgcctcacgg

SEQ ID NO: 525397 - DNA, 20 bp, mouse
gaggcgcgccgggaaggtct

SEQ ID NO: 525398 - DNA, 20 bp, mouse
ggtttccccgcgcttcctgt

SEQ ID NO: 525399 - DNA, 20 bp, mouse
gcccagacgcggagatgaag

SEQ ID NO: 525400 - DNA, 20 bp, mouse
gaccttcccggcgcgcctca

SEQ ID NO: 525401 - DNA, 20 bp, mouse
gtgaggcgccgagaccttcc

SEQ ID NO: 525402 - DNA, 20 bp, mouse
gccgccgcccggcacacgct

SEQ ID NO: 525403 - DNA, 20 bp, mouse
ggaggcagctactggaggag

SEQ ID NO: 525404 - DNA, 20 bp, mouse
gcggctatgctgcctccgtg

SEQ ID NO: 525405 - DNA, 20 bp, mouse
gagccaggccggcgcagtcg

SEQ ID NO: 525406 - DNA, 20 bp, mouse
ggccactgggccgctctacg

SEQ ID NO: 525407 - DNA, 20 bp, mouse
gccagtggccgcgggcaaca

SEQ ID NO: 525408 - DNA, 20 bp, mouse
gcgaggcccgggcagacgga

SEQ ID NO: 525409 - DNA, 20 bp, mouse
gagcgcgcgcggtagcaagg

SEQ ID NO: 525410 - DNA, 20 bp, mouse
gacggggctcaggccgaatc

SEQ ID NO: 525411 - DNA, 20 bp, mouse
ggggcctcggccagatcggc

SEQ ID NO: 525412 - DNA, 20 bp, mouse
gtacagcgttccaaaaggta

SEQ ID NO: 525413 - DNA, 20 bp, mouse
ggcccagactgacgagtggg

SEQ ID NO: 525414 - DNA, 20 bp, mouse
gtagagcggcccagtggccg

SEQ ID NO: 525415 - DNA, 20 bp, mouse
gaggagcgcgcgcggtagca

SEQ ID NO: 525416 - DNA, 20 bp, mouse
gcgcgggaaccgacgcccgg

SEQ ID NO: 525417 - DNA, 20 bp, mouse
gttctccctgcgggacttca

SEQ ID NO: 525418 - DNA, 20 bp, mouse
ggcgacagactgcaagacag

SEQ ID NO: 525419 - DNA, 20 bp, mouse
gagcagacgcgctgggacta

SEQ ID NO: 525420 - DNA, 20 bp, mouse
gcgccgcgggaaccgacgcc

SEQ ID NO: 525421 - DNA, 20 bp, mouse
ggccggggctcaacaggcat

SEQ ID NO: 525422 - DNA, 20 bp, mouse
gaaccgacgcccggtggcac

SEQ ID NO: 525423 - DNA, 20 bp, mouse
gtgctcgcgcccggtgccac

SEQ ID NO: 525424 - DNA, 20 bp, mouse
ggccgccatgaagtcccgca

SEQ ID NO: 525425 - DNA, 20 bp, mouse
gcgctgggactatggacaga

SEQ ID NO: 525426 - DNA, 20 bp, mouse
gggagaagccgcagtcccgg

SEQ ID NO: 525427 - DNA, 20 bp, mouse
ggcggagcgccgatcgcggt

SEQ ID NO: 525428 - DNA, 20 bp, mouse
ggtcagcagccgagccacgg

SEQ ID NO: 525429 - DNA, 20 bp, mouse
gcagcgcggagcgccgatcg

SEQ ID NO: 525430 - DNA, 20 bp, mouse
ggcgggagaagccgcagtcc

SEQ ID NO: 525431 - DNA, 20 bp, mouse
ggggccatgcccaccgcgat

SEQ ID NO: 525432 - DNA, 20 bp, mouse
gcatgtcagcagccgagcca

SEQ ID NO: 525433 - DNA, 20 bp, mouse
ggctgccgccgaagagacta

SEQ ID NO: 525434 - DNA, 20 bp, mouse
gcaaagtgccgtccgagggg

SEQ ID NO: 525435 - DNA, 20 bp, mouse
ggtcccggaggcaggtttag

SEQ ID NO: 525436 - DNA, 20 bp, mouse
gcaagtgaggagaatgaagg

SEQ ID NO: 525437 - DNA, 20 bp, mouse
gagggcgagctgtgcagcaa

SEQ ID NO: 525438 - DNA, 20 bp, mouse
gagttgtacgcagtgaaggt

SEQ ID NO: 525439 - DNA, 20 bp, mouse
ggagtccgcctcggcaagtg

SEQ ID NO: 525440 - DNA, 20 bp, mouse
ggcagcaatggagtccgcct

SEQ ID NO: 525441 - DNA, 20 bp, mouse
gtcattctcctcacttgccg

SEQ ID NO: 525442 - DNA, 20 bp, mouse
gttctcctcacttgccgagg

SEQ ID NO: 525443 - DNA, 20 bp, mouse
gtcaaaagggaggtccgcga

SEQ ID NO: 525444 - DNA, 20 bp, mouse
gcacgggaggcgtccggcgt

SEQ ID NO: 525445 - DNA, 20 bp, mouse
ggaaggaggtgcggcgatag

SEQ ID NO: 525446 - DNA, 20 bp, mouse
gagcatatgaggacagggta

SEQ ID NO: 525447 - DNA, 20 bp, mouse
gcctatgagcatatgaggac

SEQ ID NO: 525448 - DNA, 20 bp, mouse
gcaaagagggagatagcgga

SEQ ID NO: 525449 - DNA, 20 bp, mouse
gcatatgctcataggcactt

SEQ ID NO: 525450 - DNA, 20 bp, mouse
ggggtaaggatgggcaaaga

SEQ ID NO: 525451 - DNA, 20 bp, mouse
ggagcaagctgcgaccagcc

SEQ ID NO: 525452 - DNA, 20 bp, mouse
gcccaggtgactcctatata

SEQ ID NO: 525453 - DNA, 20 bp, mouse
gggtcacacaagccatccac

SEQ ID NO: 525454 - DNA, 20 bp, mouse
gaacccaacaggcagatctt

SEQ ID NO: 525455 - DNA, 20 bp, mouse
ggaagtgaagtcgaaaagtg

SEQ ID NO: 525456 - DNA, 20 bp, mouse
gagactgagaggcggcgagg

SEQ ID NO: 525457 - DNA, 20 bp, mouse
gtgagccgacggggactcgg

SEQ ID NO: 525458 - DNA, 20 bp, mouse
gctgtaggggaaggtcaccc

SEQ ID NO: 525459 - DNA, 20 bp, mouse
gccctcctccgagtccccgt

SEQ ID NO: 525460 - DNA, 20 bp, mouse
gtggtcgaggccgtctccgg

SEQ ID NO: 525461 - DNA, 20 bp, mouse
gagtccccgtcggctcacct

SEQ ID NO: 525462 - DNA, 20 bp, mouse
gcgaggcgttcattgaggag

SEQ ID NO: 525463 - DNA, 20 bp, mouse
ggctggagactcggagcgaa

SEQ ID NO: 525464 - DNA, 20 bp, mouse
gaacggagcggcgggcgaag

SEQ ID NO: 525465 - DNA, 20 bp, mouse
gcgcgccgccggatgaggag

SEQ ID NO: 525466 - DNA, 20 bp, mouse
gactagcgcagcactgccag

SEQ ID NO: 525467 - DNA, 20 bp, mouse
ggtcggcctgggcctagggg

SEQ ID NO: 525468 - DNA, 20 bp, mouse
gcctaggggaggagggccaa

SEQ ID NO: 525469 - DNA, 20 bp, mouse
ggcgtgagcgcagccctaca

SEQ ID NO: 525470 - DNA, 20 bp, mouse
ggcctgggcctaggggagga

SEQ ID NO: 525471 - DNA, 20 bp, mouse
gcttgcggtcgcgactgaag

SEQ ID NO: 525472 - DNA, 20 bp, mouse
gcagccggggacgaagtgga

SEQ ID NO: 525473 - DNA, 20 bp, mouse
ggctgcgctagtggagcttg

SEQ ID NO: 525474 - DNA, 20 bp, mouse
gcaaagactgcgggcatggt

SEQ ID NO: 525475 - DNA, 20 bp, mouse
ggcagcagccggggacgaag

SEQ ID NO: 525476 - DNA, 20 bp, mouse
gaacgcagcgagagggatct

SEQ ID NO: 525477 - DNA, 20 bp, mouse
gggcggagcgaacaaagacc

SEQ ID NO: 525478 - DNA, 20 bp, mouse
gttggggaaacgcagcgaga

SEQ ID NO: 525479 - DNA, 20 bp, mouse
gcgaacaaagaccgggccag

SEQ ID NO: 525480 - DNA, 20 bp, mouse
gtctgggcgtctggctcctc

SEQ ID NO: 525481 - DNA, 20 bp, mouse
ggcgtccgtgtgctccgtgc

SEQ ID NO: 525482 - DNA, 20 bp, mouse
gcgagagggatctgggcgtc

SEQ ID NO: 525483 - DNA, 20 bp, mouse
gccgctgctacgagcagaaa

SEQ ID NO: 525484 - DNA, 20 bp, mouse
gatgccggaggccatggaac

SEQ ID NO: 525485 - DNA, 20 bp, mouse
ggacaaaagacaaaaaacct

SEQ ID NO: 525486 - DNA, 20 bp, mouse
gcagcgggtcgagcacccag

SEQ ID NO: 525487 - DNA, 20 bp, mouse
ggctggcagggaccctccga

SEQ ID NO: 525488 - DNA, 20 bp, mouse
gttagggcgcgaccctcgga

SEQ ID NO: 525489 - DNA, 20 bp, mouse
gctgcttagggcgcgaccct

SEQ ID NO: 525490 - DNA, 20 bp, mouse
gctgagtgcgcgagtcccgg

SEQ ID NO: 525491 - DNA, 20 bp, mouse
gtgctccgagttgagccact

SEQ ID NO: 525492 - DNA, 20 bp, mouse
gtgcgcctcccactccgtcc

SEQ ID NO: 525493 - DNA, 20 bp, mouse
gcggaggcgcacgtgcatct

SEQ ID NO: 525494 - DNA, 20 bp, mouse
gggtgctcgacccgctggca

SEQ ID NO: 525495 - DNA, 20 bp, mouse
gtcccagggtgggcgaagga

SEQ ID NO: 525496 - DNA, 20 bp, mouse
gagagcaaaggctggaccag

SEQ ID NO: 525497 - DNA, 20 bp, mouse
gggaccagaggtgaccttca

SEQ ID NO: 525498 - DNA, 20 bp, mouse
gctcagacagacagcggcag

SEQ ID NO: 525499 - DNA, 20 bp, mouse
ggagggtgtcggctcaggga

SEQ ID NO: 525500 - DNA, 20 bp, mouse
gagccagccggagtcaggag

SEQ ID NO: 525501 - DNA, 20 bp, mouse
gcggcagcggcacactggag

SEQ ID NO: 525502 - DNA, 20 bp, mouse
gtgagttgctgcaaccatga

SEQ ID NO: 525503 - DNA, 20 bp, mouse
ggacagcggcagcggcacac

SEQ ID NO: 525504 - DNA, 20 bp, mouse
ggagcgcagcgcaggagacc

SEQ ID NO: 525505 - DNA, 20 bp, mouse
gcccccaggccatttgtcaa

SEQ ID NO: 525506 - DNA, 20 bp, mouse
gaaggcggcttctcaggaca

SEQ ID NO: 525507 - DNA, 20 bp, mouse
ggcactgggatgggacttga

SEQ ID NO: 525508 - DNA, 20 bp, mouse
gctccttgggcaccgatccc

SEQ ID NO: 525509 - DNA, 20 bp, mouse
gcagcgggtcccccaggaga

SEQ ID NO: 525510 - DNA, 20 bp, mouse
ggcaagcgcggagagcgcac

SEQ ID NO: 525511 - DNA, 20 bp, mouse
gcccaggcagccagcaagcg

SEQ ID NO: 525512 - DNA, 20 bp, mouse
gcgcggagagcgcactggga

SEQ ID NO: 525513 - DNA, 20 bp, mouse
ggccaggcgcgggacacatg

SEQ ID NO: 525514 - DNA, 20 bp, mouse
ggacttgaaggcggcttctc

SEQ ID NO: 525515 - DNA, 20 bp, mouse
ggccaccgccgccgacaccc

SEQ ID NO: 525516 - DNA, 20 bp, mouse
ggggctgagagcaacatgat

SEQ ID NO: 525517 - DNA, 20 bp, mouse
ggtgagccgcgaggtaactg

SEQ ID NO: 525518 - DNA, 20 bp, mouse
gcccgggaggtggcgtaagg

SEQ ID NO: 525519 - DNA, 20 bp, mouse
gcagccatagggcctcacat

SEQ ID NO: 525520 - DNA, 20 bp, mouse
ggtgtaccccagttacctcg

SEQ ID NO: 525521 - DNA, 20 bp, mouse
gtgggcttgacgacctgccg

SEQ ID NO: 525522 - DNA, 20 bp, mouse
gctgcctgaggctgggataa

SEQ ID NO: 525523 - DNA, 20 bp, mouse
gccgcggcgcaggtacagtg

SEQ ID NO: 525524 - DNA, 20 bp, mouse
ggactcgtgtccccagccgg

SEQ ID NO: 525525 - DNA, 20 bp, mouse
ggcggctcacagaccccggc

SEQ ID NO: 525526 - DNA, 20 bp, mouse
gggggagttggaccaggtaa

SEQ ID NO: 525527 - DNA, 20 bp, mouse
ggagttggaccaggtaacgg

SEQ ID NO: 525528 - DNA, 20 bp, mouse
gcagccagggcgagcccaag

SEQ ID NO: 525529 - DNA, 20 bp, mouse
gcaggcgtggagggagatta

SEQ ID NO: 525530 - DNA, 20 bp, mouse
gagcctgccggacagctcag

SEQ ID NO: 525531 - DNA, 20 bp, mouse
gttggaccaggtaacggcgg

SEQ ID NO: 525532 - DNA, 20 bp, mouse
gaggttagacgtggacacgt

SEQ ID NO: 525533 - DNA, 20 bp, mouse
gggggaatgccagacagcca

SEQ ID NO: 525534 - DNA, 20 bp, mouse
gggtgcggctacagagcgac

SEQ ID NO: 525535 - DNA, 20 bp, mouse
gagtcgggcggcgacactcc

SEQ ID NO: 525536 - DNA, 20 bp, mouse
ggcgtcccgctcgctgagag

SEQ ID NO: 525537 - DNA, 20 bp, mouse
gcgcttcacgcctacctgag

SEQ ID NO: 525538 - DNA, 20 bp, mouse
gtcacgcctacctgagggga

SEQ ID NO: 525539 - DNA, 20 bp, mouse
gacatacgcagcgaccgagg

SEQ ID NO: 525540 - DNA, 20 bp, mouse
ggtgaagcgggtaagagtcc

SEQ ID NO: 525541 - DNA, 20 bp, mouse
gcgtatgtgaggcgcccgag

SEQ ID NO: 525542 - DNA, 20 bp, mouse
gcaacggcgctggcaggagg

SEQ ID NO: 525543 - DNA, 20 bp, mouse
gcgttgctgcgggggattgt

SEQ ID NO: 525544 - DNA, 20 bp, mouse
ggatacctctctcagcgagc

SEQ ID NO: 525545 - DNA, 20 bp, mouse
ggtgccgcgagagagttcgg

SEQ ID NO: 525546 - DNA, 20 bp, mouse
ggttgtgcgggccaagatgg

SEQ ID NO: 525547 - DNA, 20 bp, mouse
ggcctgtgcggcctgtgcgg

SEQ ID NO: 525548 - DNA, 20 bp, mouse
gaagatggcggcacaggcgg

SEQ ID NO: 525549 - DNA, 20 bp, mouse
ggccaagatggcggcacagg

SEQ ID NO: 525550 - DNA, 20 bp, mouse
gtccgggcctcgatccgctg

SEQ ID NO: 525551 - DNA, 20 bp, mouse
gcgcagccacctggagaagg

SEQ ID NO: 525552 - DNA, 20 bp, mouse
gcgtctgtcaccgcaggtga

SEQ ID NO: 525553 - DNA, 20 bp, mouse
gtgcttccgcctctctgtgg

SEQ ID NO: 525554 - DNA, 20 bp, mouse
gggaagtcccaagcccgacg

SEQ ID NO: 525555 - DNA, 20 bp, mouse
ggttgttgtgcgggccaaga

SEQ ID NO: 525556 - DNA, 20 bp, mouse
gtaccaagagaaaccagact

SEQ ID NO: 525557 - DNA, 20 bp, mouse
gcggagaggctcctgaacta

SEQ ID NO: 525558 - DNA, 20 bp, mouse
ggagccctcgcagatgaagg

SEQ ID NO: 525559 - DNA, 20 bp, mouse
gggctctgcacagtcgaacg

SEQ ID NO: 525560 - DNA, 20 bp, mouse
gtccagcctgggcaaactct

SEQ ID NO: 525561 - DNA, 20 bp, mouse
ggtcctgagcaccgacgccc

SEQ ID NO: 525562 - DNA, 20 bp, mouse
gcctgaactaggggagaatg

SEQ ID NO: 525563 - DNA, 20 bp, mouse
gtgggcgcgtggggtcggag

SEQ ID NO: 525564 - DNA, 20 bp, mouse
gatcaggccgtagcccggac

SEQ ID NO: 525565 - DNA, 20 bp, mouse
gtacgcctgggagtccgcat

SEQ ID NO: 525566 - DNA, 20 bp, mouse
gtgcagcaccggatcaacgg

SEQ ID NO: 525567 - DNA, 20 bp, mouse
gatccggtgctgcagtgagg

SEQ ID NO: 525568 - DNA, 20 bp, mouse
gcactgcagcaccggatcaa

SEQ ID NO: 525569 - DNA, 20 bp, mouse
ggagagcgacgtgagtcctg

SEQ ID NO: 525570 - DNA, 20 bp, mouse
ggcctcctgggactgaaggt

SEQ ID NO: 525571 - DNA, 20 bp, mouse
ggataacgatgacatcgagg

SEQ ID NO: 525572 - DNA, 20 bp, mouse
ggtgcgtgccgccgttgatc

SEQ ID NO: 525573 - DNA, 20 bp, mouse
gccccgcctgacaacccgaa

SEQ ID NO: 525574 - DNA, 20 bp, mouse
gcctgacaacccgaacggaa

SEQ ID NO: 525575 - DNA, 20 bp, mouse
gggttgtcaggcggggacag

SEQ ID NO: 525576 - DNA, 20 bp, mouse
gagccgaacgcatggcccga

SEQ ID NO: 525577 - DNA, 20 bp, mouse
gtctgggcgtgaccctgagg

SEQ ID NO: 525578 - DNA, 20 bp, mouse
gcggcggttggagcctggcg

SEQ ID NO: 525579 - DNA, 20 bp, mouse
gggcgacgccccctgggtgg

SEQ ID NO: 525580 - DNA, 20 bp, mouse
gggagcaagtccacttggag

SEQ ID NO: 525581 - DNA, 20 bp, mouse
gggttctgggcgtgaccctg

SEQ ID NO: 525582 - DNA, 20 bp, mouse
gggagtccaggcccagcacg

SEQ ID NO: 525583 - DNA, 20 bp, mouse
gcgttcggctcggcccaacc

SEQ ID NO: 525584 - DNA, 20 bp, mouse
gtggcgggaaggagttcatg

SEQ ID NO: 525585 - DNA, 20 bp, mouse
gggaaggagggcgtcttgtg

SEQ ID NO: 525586 - DNA, 20 bp, mouse
gccatcactgagccccatgg

SEQ ID NO: 525587 - DNA, 20 bp, mouse
gtccccatcactgagcccca

SEQ ID NO: 525588 - DNA, 20 bp, mouse
gcccatggtggcttctaaag

SEQ ID NO: 525589 - DNA, 20 bp, mouse
gggcttctaaagaggacaaa

SEQ ID NO: 525590 - DNA, 20 bp, mouse
ggctggcagggtagaccagt

SEQ ID NO: 525591 - DNA, 20 bp, mouse
ggaggccacctggtcctgaa

SEQ ID NO: 525592 - DNA, 20 bp, mouse
gtcctctttagaagccacca

SEQ ID NO: 525593 - DNA, 20 bp, mouse
gcagctggtgctgaatgtct

SEQ ID NO: 525594 - DNA, 20 bp, mouse
gtcaccatatggcgacaagg

SEQ ID NO: 525595 - DNA, 20 bp, mouse
gggttcaccatatggcgaca

SEQ ID NO: 525596 - DNA, 20 bp, mouse
gcgaaaaggggaactctcag

SEQ ID NO: 525597 - DNA, 20 bp, mouse
ggaagaaaggccgcgaaaag

SEQ ID NO: 525598 - DNA, 20 bp, mouse
ggagcgtgacggggacacca

SEQ ID NO: 525599 - DNA, 20 bp, mouse
ggctcgcggcggatactgac

SEQ ID NO: 525600 - DNA, 20 bp, mouse
ggaccgaagagcggcagata

SEQ ID NO: 525601 - DNA, 20 bp, mouse
gagctgcggcccgcaaaggg

SEQ ID NO: 525602 - DNA, 20 bp, mouse
gtgctgctggggcacccgga

SEQ ID NO: 525603 - DNA, 20 bp, mouse
gatttaagtttcatttccag

SEQ ID NO: 525604 - DNA, 20 bp, mouse
gggcggctggggctcccgta

SEQ ID NO: 525605 - DNA, 20 bp, mouse
gataaatcgacttcgaagaa

SEQ ID NO: 525606 - DNA, 20 bp, mouse
gtggactcgagcctccccgg

SEQ ID NO: 525607 - DNA, 20 bp, mouse
gcgcgggaggagcccgactg

SEQ ID NO: 525608 - DNA, 20 bp, mouse
gccagcaaggcagcctccct

SEQ ID NO: 525609 - DNA, 20 bp, mouse
gtcccggcaggactcgagga

SEQ ID NO: 525610 - DNA, 20 bp, mouse
gcgagtcctgccgggatcgg

SEQ ID NO: 525611 - DNA, 20 bp, mouse
gctgaaatccagctccggga

SEQ ID NO: 525612 - DNA, 20 bp, mouse
ggctgctggctccgtaacac

SEQ ID NO: 525613 - DNA, 20 bp, mouse
ggcagcaggcaggagcggag

SEQ ID NO: 525614 - DNA, 20 bp, mouse
gggctccgtaacaccggagc

SEQ ID NO: 525615 - DNA, 20 bp, mouse
ggtcctgccgggatcggtgg

SEQ ID NO: 525616 - DNA, 20 bp, mouse
ggagtaagcaaccgccgcag

SEQ ID NO: 525617 - DNA, 20 bp, mouse
gttggaagaggcactggtgg

SEQ ID NO: 525618 - DNA, 20 bp, mouse
ggtcctagtcggagccccaa

SEQ ID NO: 525619 - DNA, 20 bp, mouse
gggcccgtggacccatgaga

SEQ ID NO: 525620 - DNA, 20 bp, mouse
ggttttggaagaggcactgg

SEQ ID NO: 525621 - DNA, 20 bp, mouse
gggagtggcgacagctcggg

SEQ ID NO: 525622 - DNA, 20 bp, mouse
gtggctcagggcattgacag

SEQ ID NO: 525623 - DNA, 20 bp, mouse
ggcgcactgcggcttcacag

SEQ ID NO: 525624 - DNA, 20 bp, mouse
ggccgcagaggcgactgttt

SEQ ID NO: 525625 - DNA, 20 bp, mouse
gcgcggagcctccccaatga

SEQ ID NO: 525626 - DNA, 20 bp, mouse
gctgcccggagcaggaggag

SEQ ID NO: 525627 - DNA, 20 bp, mouse
gcgggtctccgggattccaa

SEQ ID NO: 525628 - DNA, 20 bp, mouse
gccctggcccccctgctcta

SEQ ID NO: 525629 - DNA, 20 bp, mouse
ggcggccgtccccagagtgg

SEQ ID NO: 525630 - DNA, 20 bp, mouse
gactccgccatagagcaggg

SEQ ID NO: 525631 - DNA, 20 bp, mouse
gtggcccccctgctctatgg

SEQ ID NO: 525632 - DNA, 20 bp, mouse
ggcagcagcggcctcccccc

SEQ ID NO: 525633 - DNA, 20 bp, mouse
gggccgctgccgccactctg

SEQ ID NO: 525634 - DNA, 20 bp, mouse
ggccgcggccgtccccagag

SEQ ID NO: 525635 - DNA, 20 bp, mouse
gagaagcgcagagccggctg

SEQ ID NO: 525636 - DNA, 20 bp, mouse
gggagcggcccccctagcgg

SEQ ID NO: 525637 - DNA, 20 bp, mouse
gggcggagcggcccccctag

SEQ ID NO: 525638 - DNA, 20 bp, mouse
ggcaatggagcggaagaggt

SEQ ID NO: 525639 - DNA, 20 bp, mouse
gaagccggggcgcaatggag

SEQ ID NO: 525640 - DNA, 20 bp, mouse
gtcgcaacttgcagaagcgg

SEQ ID NO: 525641 - DNA, 20 bp, mouse
ggaatcggcgacgagcccgg

SEQ ID NO: 525642 - DNA, 20 bp, mouse
ggcggcggcggcatcggcca

SEQ ID NO: 525643 - DNA, 20 bp, mouse
ggccgagcgggtggcgaagc

SEQ ID NO: 525644 - DNA, 20 bp, mouse
gagaagtgcccaggaggtcg

SEQ ID NO: 525645 - DNA, 20 bp, mouse
ggccccacgcgcgggcgggt

SEQ ID NO: 525646 - DNA, 20 bp, mouse
gagtccaggtagccggttag

SEQ ID NO: 525647 - DNA, 20 bp, mouse
gtgaaggttccaagtagtcc

SEQ ID NO: 525648 - DNA, 20 bp, mouse
gggacttcttggtatactgt

SEQ ID NO: 525649 - DNA, 20 bp, mouse
gggaagggacagtgaaggtt

SEQ ID NO: 525650 - DNA, 20 bp, mouse
gaccggctacctggactact

SEQ ID NO: 525651 - DNA, 20 bp, mouse
ggcaatacagaagtgatttg

SEQ ID NO: 525652 - DNA, 20 bp, mouse
ggaatgatgacagcatgtga

SEQ ID NO: 525653 - DNA, 20 bp, mouse
ggtaacatcttacctctaac

SEQ ID NO: 525654 - DNA, 20 bp, mouse
gtactaaacaggaagatgtg

SEQ ID NO: 525655 - DNA, 20 bp, mouse
ggacagtgaaggttaggcaa

SEQ ID NO: 525656 - DNA, 20 bp, mouse
gaagcagggctagaagctgg

SEQ ID NO: 525657 - DNA, 20 bp, mouse
gtccaacagtgaagcaaatt

SEQ ID NO: 525658 - DNA, 20 bp, mouse
gatagacagatggtaaagaa

SEQ ID NO: 525659 - DNA, 20 bp, mouse
gtctatggacagatagagcc

SEQ ID NO: 525660 - DNA, 20 bp, mouse
ggattctctcagtacttcta

SEQ ID NO: 525661 - DNA, 20 bp, mouse
gtctctcatagatagacaga

SEQ ID NO: 525662 - DNA, 20 bp, mouse
ggttggtccacaatcccctg

SEQ ID NO: 525663 - DNA, 20 bp, mouse
gaccctaagacaaagtcatt

SEQ ID NO: 525664 - DNA, 20 bp, mouse
gattgtggaccaaccctata

SEQ ID NO: 525665 - DNA, 20 bp, mouse
gctatgagagaataagttaa

SEQ ID NO: 525666 - DNA, 20 bp, mouse
gggcgggaaggctgctgtgt

SEQ ID NO: 525667 - DNA, 20 bp, mouse
ggcatctgtagctgaagcgg

SEQ ID NO: 525668 - DNA, 20 bp, mouse
ggtggcatctgtagctgaag

SEQ ID NO: 525669 - DNA, 20 bp, mouse
gccctgtgggaacaagacta

SEQ ID NO: 525670 - DNA, 20 bp, mouse
ggcagctccaggccgagagg

SEQ ID NO: 525671 - DNA, 20 bp, mouse
gctgtagctgaagcggtggc

SEQ ID NO: 525672 - DNA, 20 bp, mouse
gattggcgggaccctggctg

SEQ ID NO: 525673 - DNA, 20 bp, mouse
gtggaactaggctctctcca

SEQ ID NO: 525674 - DNA, 20 bp, mouse
gttggggacaacagagtccg

SEQ ID NO: 525675 - DNA, 20 bp, mouse
gaacctctctcgggcctcag

SEQ ID NO: 525676 - DNA, 20 bp, mouse
gttcagacaggtaccagcat

SEQ ID NO: 525677 - DNA, 20 bp, mouse
gaaaaaagtatttcattcct

SEQ ID NO: 525678 - DNA, 20 bp, mouse
gttccctggttgagagtgtt

SEQ ID NO: 525679 - DNA, 20 bp, mouse
gagcggcgtgtggaccataa

SEQ ID NO: 525680 - DNA, 20 bp, mouse
ggagtgtgacggaggagaca

SEQ ID NO: 525681 - DNA, 20 bp, mouse
ggaagtacacggggaaactt

SEQ ID NO: 525682 - DNA, 20 bp, mouse
gcgtctattacagagcatgg

SEQ ID NO: 525683 - DNA, 20 bp, mouse
gagtatttcattcctaggca

SEQ ID NO: 525684 - DNA, 20 bp, mouse
gtttaatgtagattataatg

SEQ ID NO: 525685 - DNA, 20 bp, mouse
gcacgccgctgccaacccac

SEQ ID NO: 525686 - DNA, 20 bp, mouse
ggccgccgcggatcaccgag

SEQ ID NO: 525687 - DNA, 20 bp, mouse
ggaggccgctcggtgatccg

SEQ ID NO: 525688 - DNA, 20 bp, mouse
ggccgctcggtgatccgcgg

SEQ ID NO: 525689 - DNA, 20 bp, mouse
gggagcccgagcctccggta

SEQ ID NO: 525690 - DNA, 20 bp, mouse
gcatgcgccataggggccag

SEQ ID NO: 525691 - DNA, 20 bp, mouse
gggccgaaaggacgcggagg

SEQ ID NO: 525692 - DNA, 20 bp, mouse
gcctatggcgcatgcgcggg

SEQ ID NO: 525693 - DNA, 20 bp, mouse
gtctgggaacggaatcccca

SEQ ID NO: 525694 - DNA, 20 bp, mouse
ggaagggagcgaggtcagga

SEQ ID NO: 525695 - DNA, 20 bp, mouse
ggggtgggcgaagcactgaa

SEQ ID NO: 525696 - DNA, 20 bp, mouse
gcggagcttagttcctcaag

SEQ ID NO: 525697 - DNA, 20 bp, mouse
gcccggccacggcacaccag

SEQ ID NO: 525698 - DNA, 20 bp, mouse
ggctgttcgcggtggttggg

SEQ ID NO: 525699 - DNA, 20 bp, mouse
gggctgctttgaaggtgtca

SEQ ID NO: 525700 - DNA, 20 bp, mouse
gggacctcgcgggtgaggag

SEQ ID NO: 525701 - DNA, 20 bp, mouse
gttcctcaagcggcagcgag

SEQ ID NO: 525702 - DNA, 20 bp, mouse
gcgcctccgagagaactaag

SEQ ID NO: 525703 - DNA, 20 bp, mouse
gtgggaccgggagatgccag

SEQ ID NO: 525704 - DNA, 20 bp, mouse
ggacgaagtccgcgagggag

SEQ ID NO: 525705 - DNA, 20 bp, mouse
ggacttcgcagaggacctcg

SEQ ID NO: 525706 - DNA, 20 bp, mouse
gctaaagtggagcccgggat

SEQ ID NO: 525707 - DNA, 20 bp, mouse
gaatggccctgtcattgggg

SEQ ID NO: 525708 - DNA, 20 bp, mouse
gaggctaatggccctgtcat

SEQ ID NO: 525709 - DNA, 20 bp, mouse
gggaggatactaccagaagc

SEQ ID NO: 525710 - DNA, 20 bp, mouse
gtgcataccacaacttacta

SEQ ID NO: 525711 - DNA, 20 bp, mouse
gagtatcctccccaatgaca

SEQ ID NO: 525712 - DNA, 20 bp, mouse
gggatgtacaccagtctggg

SEQ ID NO: 525713 - DNA, 20 bp, mouse
gtagggtttctttagagtaa

SEQ ID NO: 525714 - DNA, 20 bp, mouse
gtgcggatgtacaccagtct

SEQ ID NO: 525715 - DNA, 20 bp, mouse
gccagtctgggaggctaaag

SEQ ID NO: 525716 - DNA, 20 bp, mouse
gggcacagcaaagactcagg

SEQ ID NO: 525717 - DNA, 20 bp, mouse
gaacagatgcctcaaagtga

SEQ ID NO: 525718 - DNA, 20 bp, mouse
gcaccagatatgatatttca

SEQ ID NO: 525719 - DNA, 20 bp, mouse
gatatgatatttcagggctt

SEQ ID NO: 525720 - DNA, 20 bp, mouse
gctgggatctaagaccctta

SEQ ID NO: 525721 - DNA, 20 bp, mouse
gcaccaggcagaaatcgtgt

SEQ ID NO: 525722 - DNA, 20 bp, mouse
gtagctcctccctcactttg

SEQ ID NO: 525723 - DNA, 20 bp, mouse
gagatgcctcaaagtgaggg

SEQ ID NO: 525724 - DNA, 20 bp, mouse
ggaacagctggaagaaaact

SEQ ID NO: 525725 - DNA, 20 bp, mouse
gtaatcagatccccagactt

SEQ ID NO: 525726 - DNA, 20 bp, mouse
gagttgcaccttggaaagag

SEQ ID NO: 525727 - DNA, 20 bp, mouse
gcaccttggaaagagtggcg

SEQ ID NO: 525728 - DNA, 20 bp, mouse
gactgggcagacgtccgtgg

SEQ ID NO: 525729 - DNA, 20 bp, mouse
ggtaggattttggagggact

SEQ ID NO: 525730 - DNA, 20 bp, mouse
ggggactgggcagacgtccg

SEQ ID NO: 525731 - DNA, 20 bp, mouse
gagggagatttaccccgcca

SEQ ID NO: 525732 - DNA, 20 bp, mouse
ggagtggcggggcttgcggt

SEQ ID NO: 525733 - DNA, 20 bp, mouse
gcttgcggtaggattttgga

SEQ ID NO: 525734 - DNA, 20 bp, mouse
gtcgggaaggcagaagtcat

SEQ ID NO: 525735 - DNA, 20 bp, mouse
gtagcaaacgagttgcacct

SEQ ID NO: 525736 - DNA, 20 bp, mouse
gcagcagcagcagcgagtcc

SEQ ID NO: 525737 - DNA, 20 bp, mouse
gtgcctcccacaggcagtcc

SEQ ID NO: 525738 - DNA, 20 bp, mouse
gcaagaggccagaggagtag

SEQ ID NO: 525739 - DNA, 20 bp, mouse
ggggtgcggccgggctaggt

SEQ ID NO: 525740 - DNA, 20 bp, mouse
gatgctgctgcgcaggggtg

SEQ ID NO: 525741 - DNA, 20 bp, mouse
ggagctgagagtagctcctc

SEQ ID NO: 525742 - DNA, 20 bp, mouse
ggctgttgctgcagagccgg

SEQ ID NO: 525743 - DNA, 20 bp, mouse
gcaatcctgcaagaggccag

SEQ ID NO: 525744 - DNA, 20 bp, mouse
ggaggcacacccacctagcc

SEQ ID NO: 525745 - DNA, 20 bp, mouse
gggagtagaggtactccgga

SEQ ID NO: 525746 - DNA, 20 bp, mouse
ggggctgcggcgagagactg

SEQ ID NO: 525747 - DNA, 20 bp, mouse
ggcgagcgccccgactcgac

SEQ ID NO: 525748 - DNA, 20 bp, mouse
gccgccacgggaaagggaac

SEQ ID NO: 525749 - DNA, 20 bp, mouse
gactccgggatgcccgccac

SEQ ID NO: 525750 - DNA, 20 bp, mouse
gggatgcccgccacgggaaa

SEQ ID NO: 525751 - DNA, 20 bp, mouse
gtgctcccgtgacccggacc

SEQ ID NO: 525752 - DNA, 20 bp, mouse
gctggccgggtccgggtcac

SEQ ID NO: 525753 - DNA, 20 bp, mouse
gactagtggccggtgagccg

SEQ ID NO: 525754 - DNA, 20 bp, mouse
gcgccgcagcccgtcgagtc

SEQ ID NO: 525755 - DNA, 20 bp, mouse
ggacccccgagcgccacccg

SEQ ID NO: 525756 - DNA, 20 bp, mouse
gctctgcgagccgccggccg

SEQ ID NO: 525757 - DNA, 20 bp, mouse
gtctttgcttcatcatctga

SEQ ID NO: 525758 - DNA, 20 bp, mouse
gtccaccgcatcatgaggaa

SEQ ID NO: 525759 - DNA, 20 bp, mouse
ggcttctccaccgcatcatg

SEQ ID NO: 525760 - DNA, 20 bp, mouse
gatgcctcaccctaaacggg

SEQ ID NO: 525761 - DNA, 20 bp, mouse
ggcgagccgccggccgtggc

SEQ ID NO: 525762 - DNA, 20 bp, mouse
gattttccagccacggccgg

SEQ ID NO: 525763 - DNA, 20 bp, mouse
gggtcctgccagatgttctt

SEQ ID NO: 525764 - DNA, 20 bp, mouse
gacgccgcccgtttagggtg

SEQ ID NO: 525765 - DNA, 20 bp, mouse
gttagtggaatcggtctccc

SEQ ID NO: 525766 - DNA, 20 bp, mouse
gtcgctcactcggagaggtg

SEQ ID NO: 525767 - DNA, 20 bp, mouse
gtggagtcgctcactcggag

SEQ ID NO: 525768 - DNA, 20 bp, mouse
gcgagcgagccgcaaggagg

SEQ ID NO: 525769 - DNA, 20 bp, mouse
ggccgctggagtcgctcact

SEQ ID NO: 525770 - DNA, 20 bp, mouse
gtgaggctggacggtggcgg

SEQ ID NO: 525771 - DNA, 20 bp, mouse
ggggtgccggggagaactta

SEQ ID NO: 525772 - DNA, 20 bp, mouse
gcagcaaccacgagcctcgg

SEQ ID NO: 525773 - DNA, 20 bp, mouse
gggcagcgagcgccgcacgg

SEQ ID NO: 525774 - DNA, 20 bp, mouse
ggcgcaggaactcccccgtg

SEQ ID NO: 525775 - DNA, 20 bp, mouse
gccattcgggagagacaatt

SEQ ID NO: 525776 - DNA, 20 bp, mouse
gcaggtccgcgccctggagt

SEQ ID NO: 525777 - DNA, 20 bp, mouse
gtcctcaggagccctcaagg

SEQ ID NO: 525778 - DNA, 20 bp, mouse
ggaacctggcgccgactcca

SEQ ID NO: 525779 - DNA, 20 bp, mouse
gaggtcctcaggagccctca

SEQ ID NO: 525780 - DNA, 20 bp, mouse
ggggctcctgaggacctcgc

SEQ ID NO: 525781 - DNA, 20 bp, mouse
gtcgcccgggagctgcacac

SEQ ID NO: 525782 - DNA, 20 bp, mouse
gtgcacactggccaccttga

SEQ ID NO: 525783 - DNA, 20 bp, mouse
gaggttcccgcgaggtcctc

SEQ ID NO: 525784 - DNA, 20 bp, mouse
ggagggtctgggtagcgggt

SEQ ID NO: 525785 - DNA, 20 bp, mouse
gagcgggaagcagaacgtgg

SEQ ID NO: 525786 - DNA, 20 bp, mouse
ggccgagctacgccgaggat

SEQ ID NO: 525787 - DNA, 20 bp, mouse
ggcgtccgctcgctccggcc

SEQ ID NO: 525788 - DNA, 20 bp, mouse
gtctgtgccgagctacgccg

SEQ ID NO: 525789 - DNA, 20 bp, mouse
gccccatcctcggcgtagct

SEQ ID NO: 525790 - DNA, 20 bp, mouse
gtgcagcagggtggagcccg

SEQ ID NO: 525791 - DNA, 20 bp, mouse
gcagcgccgaggcccggcca

SEQ ID NO: 525792 - DNA, 20 bp, mouse
gacccgggcgggagcagggt

SEQ ID NO: 525793 - DNA, 20 bp, mouse
gacgccggtacctgatcgat

SEQ ID NO: 525794 - DNA, 20 bp, mouse
gagccggagcgacagccgag

SEQ ID NO: 525795 - DNA, 20 bp, mouse
gcggccggcagaggcggcca

SEQ ID NO: 525796 - DNA, 20 bp, mouse
gggcaccgcttagggactct

SEQ ID NO: 525797 - DNA, 20 bp, mouse
gccgcttagggactctagga

SEQ ID NO: 525798 - DNA, 20 bp, mouse
gactgtagccctagatggaa

SEQ ID NO: 525799 - DNA, 20 bp, mouse
gaagcggtgcccttgtaaaa

SEQ ID NO: 525800 - DNA, 20 bp, mouse
gcctcacattcaggatggat

SEQ ID NO: 525801 - DNA, 20 bp, mouse
gatctagggctacagtaata

SEQ ID NO: 525802 - DNA, 20 bp, mouse
gtgtgacttcccttttacaa

SEQ ID NO: 525803 - DNA, 20 bp, mouse
ggacagtgggcctcacattc

SEQ ID NO: 525804 - DNA, 20 bp, mouse
gcgcacgcatcacaaatgga

SEQ ID NO: 525805 - DNA, 20 bp, mouse
gtagggtggaacgcgcagag

SEQ ID NO: 525806 - DNA, 20 bp, mouse
ggagctgccagtacgtgaag

SEQ ID NO: 525807 - DNA, 20 bp, mouse
gcccaggttgggttgcatgg

SEQ ID NO: 525808 - DNA, 20 bp, mouse
ggatcgcgacaggcatcttg

SEQ ID NO: 525809 - DNA, 20 bp, mouse
ggcccacctgaaccgtccgt

SEQ ID NO: 525810 - DNA, 20 bp, mouse
gcggcgtcacgaagatcgta

SEQ ID NO: 525811 - DNA, 20 bp, mouse
gtccagaacgggcagtgcgg

SEQ ID NO: 525812 - DNA, 20 bp, mouse
ggtccaggccccgagagccg

SEQ ID NO: 525813 - DNA, 20 bp, mouse
gtgccggcgccctccagaac

SEQ ID NO: 525814 - DNA, 20 bp, mouse
gagccgaggcggcctcgaaa

SEQ ID NO: 525815 - DNA, 20 bp, mouse
gaccccgccccttcacgtac

SEQ ID NO: 525816 - DNA, 20 bp, mouse
gggcctccggaagctgctgt

SEQ ID NO: 525817 - DNA, 20 bp, mouse
gggtacttggatcgctgtga

SEQ ID NO: 525818 - DNA, 20 bp, mouse
gctgtgatgccatcacatcc

SEQ ID NO: 525819 - DNA, 20 bp, mouse
gtaaacccacagcttctcta

SEQ ID NO: 525820 - DNA, 20 bp, mouse
gtcccaaggcacagagacac

SEQ ID NO: 525821 - DNA, 20 bp, mouse
ggaagctcgtcggactctga

SEQ ID NO: 525822 - DNA, 20 bp, mouse
gacaggggtgcgcccaagcg

SEQ ID NO: 525823 - DNA, 20 bp, mouse
gtggatggtctgaagctcgt

SEQ ID NO: 525824 - DNA, 20 bp, mouse
gagctgctgtggggtcttct

SEQ ID NO: 525825 - DNA, 20 bp, mouse
gccttgccagagccccgctt

SEQ ID NO: 525826 - DNA, 20 bp, mouse
gcccatgtgggagttcctca

SEQ ID NO: 525827 - DNA, 20 bp, mouse
gggccacccgagttaaaagg

SEQ ID NO: 525828 - DNA, 20 bp, mouse
gtaaaaggggggaaatccgg

SEQ ID NO: 525829 - DNA, 20 bp, mouse
gcgacagcagtggcagcccc

SEQ ID NO: 525830 - DNA, 20 bp, mouse
gtaatgttgttgatatcctg

SEQ ID NO: 525831 - DNA, 20 bp, mouse
ggactgcggcgactacaggg

SEQ ID NO: 525832 - DNA, 20 bp, mouse
gtggggccacccgagttaaa

SEQ ID NO: 525833 - DNA, 20 bp, mouse
ggagagaggagggtacgtgg

SEQ ID NO: 525834 - DNA, 20 bp, mouse
gatcagggcctcatgggtag

SEQ ID NO: 525835 - DNA, 20 bp, mouse
gcggggccgccggacggagt

SEQ ID NO: 525836 - DNA, 20 bp, mouse
gacccgaggcgtgttcgcgg

SEQ ID NO: 525837 - DNA, 20 bp, mouse
gtccgcctcaggctcggggt

SEQ ID NO: 525838 - DNA, 20 bp, mouse
gtccgccgcgaacacgcctc

SEQ ID NO: 525839 - DNA, 20 bp, mouse
ggccgaccccgagcctgagg

SEQ ID NO: 525840 - DNA, 20 bp, mouse
ggagacccgaggcgtgttcg

SEQ ID NO: 525841 - DNA, 20 bp, mouse
gcacgcctcgggtctccatt

SEQ ID NO: 525842 - DNA, 20 bp, mouse
gcgagtaaacatcccccgaa

SEQ ID NO: 525843 - DNA, 20 bp, mouse
gcgctccgggccaatttctg

SEQ ID NO: 525844 - DNA, 20 bp, mouse
gtaacccccccacgccccag

SEQ ID NO: 525845 - DNA, 20 bp, mouse
ggcggagccgccgttctccc

SEQ ID NO: 525846 - DNA, 20 bp, mouse
ggcgggcgcacggctgactg

SEQ ID NO: 525847 - DNA, 20 bp, mouse
gcggcgcggagactccgaag

SEQ ID NO: 525848 - DNA, 20 bp, mouse
gcgcggatgctggagctgga

SEQ ID NO: 525849 - DNA, 20 bp, mouse
gtgctggagctggaaggctc

SEQ ID NO: 525850 - DNA, 20 bp, mouse
gccccagccggcggagtcca

SEQ ID NO: 525851 - DNA, 20 bp, mouse
ggagctggaaggctccgggc

SEQ ID NO: 525852 - DNA, 20 bp, mouse
ggatggacggcgggccccgg

SEQ ID NO: 525853 - DNA, 20 bp, mouse
ggccaccggagcaaagaacc

SEQ ID NO: 525854 - DNA, 20 bp, mouse
gcatcgtagcgacggatgga

SEQ ID NO: 525855 - DNA, 20 bp, mouse
gcgtagcgacggatggacgg

SEQ ID NO: 525856 - DNA, 20 bp, mouse
gggaaccagacatatatcag

SEQ ID NO: 525857 - DNA, 20 bp, mouse
gtcgccaagccagggtagac

SEQ ID NO: 525858 - DNA, 20 bp, mouse
gaagtaaccaagaagtctgg

SEQ ID NO: 525859 - DNA, 20 bp, mouse
gagtcccgtctaccctggct

SEQ ID NO: 525860 - DNA, 20 bp, mouse
gcctttccctcgccaagcca

SEQ ID NO: 525861 - DNA, 20 bp, mouse
gtccagagtcccgtctaccc

SEQ ID NO: 525862 - DNA, 20 bp, mouse
gggcaagtaaccaagaagtc

SEQ ID NO: 525863 - DNA, 20 bp, mouse
gggacaggccagcctcggca

SEQ ID NO: 525864 - DNA, 20 bp, mouse
ggacgggactctggagaaga

SEQ ID NO: 525865 - DNA, 20 bp, mouse
gagtaggaagcggtctgtgg

SEQ ID NO: 525866 - DNA, 20 bp, mouse
ggagtccagagcacttgaga

SEQ ID NO: 525867 - DNA, 20 bp, mouse
gtctgaagtaggatctttct

SEQ ID NO: 525868 - DNA, 20 bp, mouse
gttaccttcagctctgaagt

SEQ ID NO: 525869 - DNA, 20 bp, mouse
gagagcaagtaaatgatcct

SEQ ID NO: 525870 - DNA, 20 bp, mouse
gtccttggagcaggaaaggc

SEQ ID NO: 525871 - DNA, 20 bp, mouse
gtccggcctttcctgctcca

SEQ ID NO: 525872 - DNA, 20 bp, mouse
gtaagaaatagctacatctc

SEQ ID NO: 525873 - DNA, 20 bp, mouse
gtccctgggagctcggggca

SEQ ID NO: 525874 - DNA, 20 bp, mouse
gagtaaatgatccttggagc

SEQ ID NO: 525875 - DNA, 20 bp, mouse
gagtttgtggaggggagaca

SEQ ID NO: 525876 - DNA, 20 bp, mouse
gtagcaacgggtgtcgggtg

SEQ ID NO: 525877 - DNA, 20 bp, mouse
gcgtcaagtcccacaacccc

SEQ ID NO: 525878 - DNA, 20 bp, mouse
gctagcgagccaggggttgt

SEQ ID NO: 525879 - DNA, 20 bp, mouse
gagagctgtaactgtagcaa

SEQ ID NO: 525880 - DNA, 20 bp, mouse
gctcctgccagcaaccggag

SEQ ID NO: 525881 - DNA, 20 bp, mouse
gtaactgtagcaacgggtgt

SEQ ID NO: 525882 - DNA, 20 bp, mouse
gctctacttctagcgagcca

SEQ ID NO: 525883 - DNA, 20 bp, mouse
gtgattgctggagaccgcaa

SEQ ID NO: 525884 - DNA, 20 bp, mouse
gcagagaggttaggcagcat

SEQ ID NO: 525885 - DNA, 20 bp, mouse
ggagctagaggggatgaggc

SEQ ID NO: 525886 - DNA, 20 bp, mouse
gagccagagcagcctagtgc

SEQ ID NO: 525887 - DNA, 20 bp, mouse
ggggcgcgcagatgcagacg

SEQ ID NO: 525888 - DNA, 20 bp, mouse
gagaggctgcggtgtgagtg

SEQ ID NO: 525889 - DNA, 20 bp, mouse
ggaaatcagcagcccgcact

SEQ ID NO: 525890 - DNA, 20 bp, mouse
gagcccgcactaggctgctc

SEQ ID NO: 525891 - DNA, 20 bp, mouse
ggaagcagcggaactcgcaa

SEQ ID NO: 525892 - DNA, 20 bp, mouse
gagcagtacagcgagtctca

SEQ ID NO: 525893 - DNA, 20 bp, mouse
ggcagcctcccaacttctac

SEQ ID NO: 525894 - DNA, 20 bp, mouse
gagactgggagagaatcact

SEQ ID NO: 525895 - DNA, 20 bp, mouse
gaggttggatcagttcaagg

SEQ ID NO: 525896 - DNA, 20 bp, mouse
gctctcgccgaggtccgcct

SEQ ID NO: 525897 - DNA, 20 bp, mouse
gggacctcggcgagagagta

SEQ ID NO: 525898 - DNA, 20 bp, mouse
ggagagtagggccattgcca

SEQ ID NO: 525899 - DNA, 20 bp, mouse
gccgagccaggagccctcac

SEQ ID NO: 525900 - DNA, 20 bp, mouse
gtgtccacctaggcggacct

SEQ ID NO: 525901 - DNA, 20 bp, mouse
gggagactgcgccctggcaa

SEQ ID NO: 525902 - DNA, 20 bp, mouse
gaggtggacatcaggtgccc

SEQ ID NO: 525903 - DNA, 20 bp, mouse
gtgaggtgctagtttaggtc

SEQ ID NO: 525904 - DNA, 20 bp, mouse
gggtgctagtttaggtcggg

SEQ ID NO: 525905 - DNA, 20 bp, mouse
gtcgccgaggtccgcctagg

SEQ ID NO: 525906 - DNA, 20 bp, mouse
gcctccgtcggggaagcatg

SEQ ID NO: 525907 - DNA, 20 bp, mouse
gtggctcgcgccctccgtcg

SEQ ID NO: 525908 - DNA, 20 bp, mouse
gggagggcgcgagccaagtg

SEQ ID NO: 525909 - DNA, 20 bp, mouse
gagaagacgcacaccagttt

SEQ ID NO: 525910 - DNA, 20 bp, mouse
gcaagaaggagcgcccactg

SEQ ID NO: 525911 - DNA, 20 bp, mouse
gtgacgtcagcccccgacag

SEQ ID NO: 525912 - DNA, 20 bp, mouse
gagcatggggctgcccaaac

SEQ ID NO: 525913 - DNA, 20 bp, mouse
ggtgtaccggagatcagagc

SEQ ID NO: 525914 - DNA, 20 bp, mouse
gaggaactcgccgctgtcgg

SEQ ID NO: 525915 - DNA, 20 bp, mouse
gagagaggtatccctgatag

SEQ ID NO: 525916 - DNA, 20 bp, mouse
gcgggtagctcgggccgggt

SEQ ID NO: 525917 - DNA, 20 bp, mouse
gcaggagcgccaggcccacc

SEQ ID NO: 525918 - DNA, 20 bp, mouse
gccgcagcgataacgaccac

SEQ ID NO: 525919 - DNA, 20 bp, mouse
gcgcgtcgcaatgagcgctc

SEQ ID NO: 525920 - DNA, 20 bp, mouse
gatgagcgctcgggtagctc

SEQ ID NO: 525921 - DNA, 20 bp, mouse
gttgcgacgcgcagagccgg

SEQ ID NO: 525922 - DNA, 20 bp, mouse
ggctgccaggcggtcggcat

SEQ ID NO: 525923 - DNA, 20 bp, mouse
gctgcggctgagacgcactg

SEQ ID NO: 525924 - DNA, 20 bp, mouse
gcgctcgggtagctcgggcc

SEQ ID NO: 525925 - DNA, 20 bp, mouse
gtcattgcgacgcgcagagc

SEQ ID NO: 525926 - DNA, 20 bp, mouse
gccatcgcgctcccgcccgg

SEQ ID NO: 525927 - DNA, 20 bp, mouse
ggatggctacatcagcaggt

SEQ ID NO: 525928 - DNA, 20 bp, mouse
gctgctgttcctcctccggg

SEQ ID NO: 525929 - DNA, 20 bp, mouse
gcaagcgcctgcaacagcag

SEQ ID NO: 525930 - DNA, 20 bp, mouse
gggttctgggagctcttctc

SEQ ID NO: 525931 - DNA, 20 bp, mouse
gtgtgcggtcggggacaggt

SEQ ID NO: 525932 - DNA, 20 bp, mouse
gttcctggctgccagcaact

SEQ ID NO: 525933 - DNA, 20 bp, mouse
gggctgtcagcgtttgtgag

SEQ ID NO: 525934 - DNA, 20 bp, mouse
gaacttggctggagtttggg

SEQ ID NO: 525935 - DNA, 20 bp, mouse
gccgtcatcgggcaggttcg

SEQ ID NO: 525936 - DNA, 20 bp, mouse
gccaaggtggcagagtctgt

SEQ ID NO: 525937 - DNA, 20 bp, mouse
gcagcagaacagcgcggaga

SEQ ID NO: 525938 - DNA, 20 bp, mouse
ggatcagaaaccagccaagg

SEQ ID NO: 525939 - DNA, 20 bp, mouse
ggcctaccaaaactacacac

SEQ ID NO: 525940 - DNA, 20 bp, mouse
gggaatccagcagaacagcg

SEQ ID NO: 525941 - DNA, 20 bp, mouse
gcggctgcagcagcaggatc

SEQ ID NO: 525942 - DNA, 20 bp, mouse
gatggcggcggcggcgttgt

SEQ ID NO: 525943 - DNA, 20 bp, mouse
gaagagccaaagactgaagt

SEQ ID NO: 525944 - DNA, 20 bp, mouse
gctacacacaggcacttaaa

SEQ ID NO: 525945 - DNA, 20 bp, mouse
gcagtacccctgagtcacct

SEQ ID NO: 525946 - DNA, 20 bp, mouse
gctctggaggagcagccccc

SEQ ID NO: 525947 - DNA, 20 bp, mouse
gtcatcggaggccagagggt

SEQ ID NO: 525948 - DNA, 20 bp, mouse
ggctgcagaaccgagctgca

SEQ ID NO: 525949 - DNA, 20 bp, mouse
gagagagcggccctgcagct

SEQ ID NO: 525950 - DNA, 20 bp, mouse
gcctcctccacctaccaggt

SEQ ID NO: 525951 - DNA, 20 bp, mouse
gctcgctcaacctacctggt

SEQ ID NO: 525952 - DNA, 20 bp, mouse
gcaacctacctggtaggtgg

SEQ ID NO: 525953 - DNA, 20 bp, mouse
gctggcctccgatgactccg

SEQ ID NO: 525954 - DNA, 20 bp, mouse
gaggtggaggaggccgagtc

SEQ ID NO: 525955 - DNA, 20 bp, mouse
ggaggaggccgagtcaggct

SEQ ID NO: 525956 - DNA, 20 bp, mouse
ggcgcccgcagccaacgcgg

SEQ ID NO: 525957 - DNA, 20 bp, mouse
gacctagggcagagacaact

SEQ ID NO: 525958 - DNA, 20 bp, mouse
ggacatgaggcgtgtagtga

SEQ ID NO: 525959 - DNA, 20 bp, mouse
ggtagcgcccgcagccaacg

SEQ ID NO: 525960 - DNA, 20 bp, mouse
gcctgtagcttctggacatg

SEQ ID NO: 525961 - DNA, 20 bp, mouse
gctgtgcacagaggacaata

SEQ ID NO: 525962 - DNA, 20 bp, mouse
ggaatacggggcaccatcag

SEQ ID NO: 525963 - DNA, 20 bp, mouse
ggggcaacccctgtgcacag

SEQ ID NO: 525964 - DNA, 20 bp, mouse
gccgcacccggagcccctga

SEQ ID NO: 525965 - DNA, 20 bp, mouse
ggtagtgaaggccgccgcgt

SEQ ID NO: 525966 - DNA, 20 bp, mouse
gaggcacgtcctatgagtgg

SEQ ID NO: 525967 - DNA, 20 bp, mouse
gatcaggcacgtcctatgag

SEQ ID NO: 525968 - DNA, 20 bp, mouse
gtggactattcaagaagatc

SEQ ID NO: 525969 - DNA, 20 bp, mouse
gtaatccacaaggttcaatc

SEQ ID NO: 525970 - DNA, 20 bp, mouse
gaatcaggctaagtagttag

SEQ ID NO: 525971 - DNA, 20 bp, mouse
gcagcacaagctaatccaca

SEQ ID NO: 525972 - DNA, 20 bp, mouse
gctatcaaacaaagctacgg

SEQ ID NO: 525973 - DNA, 20 bp, mouse
gagctctgccgcggtggtaa

SEQ ID NO: 525974 - DNA, 20 bp, mouse
gatctagacagttcttaagg

SEQ ID NO: 525975 - DNA, 20 bp, mouse
ggctgcttccattaccaccg

SEQ ID NO: 525976 - DNA, 20 bp, mouse
gagcggaggacgatcttctg

SEQ ID NO: 525977 - DNA, 20 bp, mouse
gccccacccgacagcacctc

SEQ ID NO: 525978 - DNA, 20 bp, mouse
gagcacctctggtgcagcgg

SEQ ID NO: 525979 - DNA, 20 bp, mouse
ggacagcacctctggtgcag

SEQ ID NO: 525980 - DNA, 20 bp, mouse
gtcgtcctccgctgcaccag

SEQ ID NO: 525981 - DNA, 20 bp, mouse
ggaatcggaggatgaggttt

SEQ ID NO: 525982 - DNA, 20 bp, mouse
gcagcaaaggcaggcgtgat

SEQ ID NO: 525983 - DNA, 20 bp, mouse
gaccagaggtgctgtcgggt

SEQ ID NO: 525984 - DNA, 20 bp, mouse
ggctagggaatagtgaatga

SEQ ID NO: 525985 - DNA, 20 bp, mouse
gacttgcagactccccccac

SEQ ID NO: 525986 - DNA, 20 bp, mouse
gcagctggcaaggttcacgt

SEQ ID NO: 525987 - DNA, 20 bp, mouse
gactgcgtcggggattatcg

SEQ ID NO: 525988 - DNA, 20 bp, mouse
ggagaaaagcgtcccaggga

SEQ ID NO: 525989 - DNA, 20 bp, mouse
ggccggaggcctgaccctcg

SEQ ID NO: 525990 - DNA, 20 bp, mouse
gtcggggtgagcgaacccac

SEQ ID NO: 525991 - DNA, 20 bp, mouse
gtgcggagaaaagcgtccca

SEQ ID NO: 525992 - DNA, 20 bp, mouse
ggtgcttcgcgactgcgtcg

SEQ ID NO: 525993 - DNA, 20 bp, mouse
gcgggacctgtggcccacgg

SEQ ID NO: 525994 - DNA, 20 bp, mouse
gtcttccgagagggtttcgg

SEQ ID NO: 525995 - DNA, 20 bp, mouse
gtctgccccgaggaaggtgg

SEQ ID NO: 525996 - DNA, 20 bp, mouse
gagccccgcagtccagaaaa

SEQ ID NO: 525997 - DNA, 20 bp, mouse
ggctcaagctccggacaagg

SEQ ID NO: 525998 - DNA, 20 bp, mouse
gcaagctccggacaaggcgg

SEQ ID NO: 525999 - DNA, 20 bp, mouse
gcgtccacccacgcaggctg

SEQ ID NO: 526000 - DNA, 20 bp, mouse
gctccggacaaggcggtgga

SEQ ID NO: 526001 - DNA, 20 bp, mouse
gagggtcttcctctaccgcc

SEQ ID NO: 526002 - DNA, 20 bp, mouse
gggacgggcgctccactcca

SEQ ID NO: 526003 - DNA, 20 bp, mouse
gggggctcaagctccggaca

SEQ ID NO: 526004 - DNA, 20 bp, mouse
gggtcgcctgctccctggag

SEQ ID NO: 526005 - DNA, 20 bp, mouse
ggggagtggggcgagcagtt

SEQ ID NO: 526006 - DNA, 20 bp, mouse
gccaggatgcaagcgtgcga

SEQ ID NO: 526007 - DNA, 20 bp, mouse
gtggccaggcacagaaacgg

SEQ ID NO: 526008 - DNA, 20 bp, mouse
ggcagatgctgtcgaaggcc

SEQ ID NO: 526009 - DNA, 20 bp, mouse
gctgtcgaaggcccggcgtc

SEQ ID NO: 526010 - DNA, 20 bp, mouse
gccagtgccgcggcacctgt

SEQ ID NO: 526011 - DNA, 20 bp, mouse
ggacaggtccagcatcctgt

SEQ ID NO: 526012 - DNA, 20 bp, mouse
gggcagcgcagccggacgcc

SEQ ID NO: 526013 - DNA, 20 bp, mouse
gttggggcagatgctgtcga

SEQ ID NO: 526014 - DNA, 20 bp, mouse
gagacccacacccagtgccg

SEQ ID NO: 526015 - DNA, 20 bp, mouse
gggtgccgcggcactgggtg

SEQ ID NO: 526016 - DNA, 20 bp, mouse
ggaaggccgcgactccagac

SEQ ID NO: 526017 - DNA, 20 bp, mouse
gtcggacgccgcaggctgag

SEQ ID NO: 526018 - DNA, 20 bp, mouse
gacgccgcaggctgagggga

SEQ ID NO: 526019 - DNA, 20 bp, mouse
gcagcacggccctaaggcgg

SEQ ID NO: 526020 - DNA, 20 bp, mouse
gcaggcggaagtcaggagtg

SEQ ID NO: 526021 - DNA, 20 bp, mouse
gctccggaggaggaactgga

SEQ ID NO: 526022 - DNA, 20 bp, mouse
gcgtcagcacggccctaagg

SEQ ID NO: 526023 - DNA, 20 bp, mouse
gaggctgaggggaaggagcg

SEQ ID NO: 526024 - DNA, 20 bp, mouse
gtgcctccggtctggagtcg

SEQ ID NO: 526025 - DNA, 20 bp, mouse
gcttccgcctgcctccggtc

SEQ ID NO: 526026 - DNA, 20 bp, mouse
gtccgctgtggaccgggaag

SEQ ID NO: 526027 - DNA, 20 bp, mouse
ggcctcttcccggtccacag

SEQ ID NO: 526028 - DNA, 20 bp, mouse
gtgcgtgtgtccggaactct

SEQ ID NO: 526029 - DNA, 20 bp, mouse
gtaagacccgggcctcttcc

SEQ ID NO: 526030 - DNA, 20 bp, mouse
gggtcttaggtaagcgtcac

SEQ ID NO: 526031 - DNA, 20 bp, mouse
ggcgggatccgctgtggacc

SEQ ID NO: 526032 - DNA, 20 bp, mouse
ggagaggcgcgggctctgag

SEQ ID NO: 526033 - DNA, 20 bp, mouse
gacgcgtcgacgtcagagtt

SEQ ID NO: 526034 - DNA, 20 bp, mouse
gcgtcgacgtcagagttggg

SEQ ID NO: 526035 - DNA, 20 bp, mouse
gcgccgagatctggatccag

SEQ ID NO: 526036 - DNA, 20 bp, mouse
gtggatggccgagccatgct

SEQ ID NO: 526037 - DNA, 20 bp, mouse
gagatccaaacaatactgta

SEQ ID NO: 526038 - DNA, 20 bp, mouse
gcgctccttcactcccagca

SEQ ID NO: 526039 - DNA, 20 bp, mouse
ggcgacgccacaataccttc

SEQ ID NO: 526040 - DNA, 20 bp, mouse
ggagctggagcgaggcaacc

SEQ ID NO: 526041 - DNA, 20 bp, mouse
gaacccagtcctcaggactc

SEQ ID NO: 526042 - DNA, 20 bp, mouse
gggaagacagagctggagcg

SEQ ID NO: 526043 - DNA, 20 bp, mouse
gggcgtcgccgtcatggtgg

SEQ ID NO: 526044 - DNA, 20 bp, mouse
ggtgtgggtctcaatagtcc

SEQ ID NO: 526045 - DNA, 20 bp, mouse
gagcctgtttagagaagaca

SEQ ID NO: 526046 - DNA, 20 bp, mouse
gggagctagcgcagacatgg

SEQ ID NO: 526047 - DNA, 20 bp, mouse
gggtggagctagcgcagaca

SEQ ID NO: 526048 - DNA, 20 bp, mouse
gtagcgcagacatggcggtg

SEQ ID NO: 526049 - DNA, 20 bp, mouse
gagacatggcggtgaggaat

SEQ ID NO: 526050 - DNA, 20 bp, mouse
gccggtggcagctggtgcgg

SEQ ID NO: 526051 - DNA, 20 bp, mouse
gcggggcctagagacacatg

SEQ ID NO: 526052 - DNA, 20 bp, mouse
ggaatgggctgatcccgggc

SEQ ID NO: 526053 - DNA, 20 bp, mouse
ggttttcgcgcgaaaaccgg

SEQ ID NO: 526054 - DNA, 20 bp, mouse
gagggatgcacgcagctacg

SEQ ID NO: 526055 - DNA, 20 bp, mouse
gcgctgaataccgcccgccc

SEQ ID NO: 526056 - DNA, 20 bp, mouse
gcgatttcggagctgcgaca

SEQ ID NO: 526057 - DNA, 20 bp, mouse
ggcgtttccggactgtttgg

SEQ ID NO: 526058 - DNA, 20 bp, mouse
gacagtagtgctggatgatg

SEQ ID NO: 526059 - DNA, 20 bp, mouse
gtttcggagctgcgacatgg

SEQ ID NO: 526060 - DNA, 20 bp, mouse
gcacgcgtttccggactgtt

SEQ ID NO: 526061 - DNA, 20 bp, mouse
ggaagcgcagagagactact

SEQ ID NO: 526062 - DNA, 20 bp, mouse
ggtggtccccgcgggtgact

SEQ ID NO: 526063 - DNA, 20 bp, mouse
ggaaacgcgtgacaccgcct

SEQ ID NO: 526064 - DNA, 20 bp, mouse
gccgccacggaagtttatgg

SEQ ID NO: 526065 - DNA, 20 bp, mouse
gttccgtggcgggaaaactt

SEQ ID NO: 526066 - DNA, 20 bp, mouse
ggaggctgcacgcagactgt

SEQ ID NO: 526067 - DNA, 20 bp, mouse
gcaactcggcaaagacacaa

SEQ ID NO: 526068 - DNA, 20 bp, mouse
gcccagcagaagggagaccg

SEQ ID NO: 526069 - DNA, 20 bp, mouse
gggtgcggtgggcccggtag

SEQ ID NO: 526070 - DNA, 20 bp, mouse
gggagcaagtccgccagata

SEQ ID NO: 526071 - DNA, 20 bp, mouse
gaagacacaagggacagcgg

SEQ ID NO: 526072 - DNA, 20 bp, mouse
gcgacagtggccgtatctgg

SEQ ID NO: 526073 - DNA, 20 bp, mouse
gtctgcgtgcagcctctacc

SEQ ID NO: 526074 - DNA, 20 bp, mouse
ggcacaagcgctggcgacag

SEQ ID NO: 526075 - DNA, 20 bp, mouse
gtgtgggcgagcacaagcgc

SEQ ID NO: 526076 - DNA, 20 bp, mouse
gggcccaggaacgttctcct

SEQ ID NO: 526077 - DNA, 20 bp, mouse
ggagacacgaggcggaaagg

SEQ ID NO: 526078 - DNA, 20 bp, mouse
ggatgaaggagggaactcac

SEQ ID NO: 526079 - DNA, 20 bp, mouse
ggttgcaaacgcgcacaaaa

SEQ ID NO: 526080 - DNA, 20 bp, mouse
gggtcgctgtgacgacagag

SEQ ID NO: 526081 - DNA, 20 bp, mouse
gccaggaacgttctcctggg

SEQ ID NO: 526082 - DNA, 20 bp, mouse
gtccgaggtacgagaggtcc

SEQ ID NO: 526083 - DNA, 20 bp, mouse
gtgcaactaacccggatccg

SEQ ID NO: 526084 - DNA, 20 bp, mouse
gcccggatccgaggtacgag

SEQ ID NO: 526085 - DNA, 20 bp, mouse
ggaacgttcctgggcccgca

SEQ ID NO: 526086 - DNA, 20 bp, mouse
gaattgcgggaccccgtcta

SEQ ID NO: 526087 - DNA, 20 bp, mouse
ggcgggagcttccctagacg

SEQ ID NO: 526088 - DNA, 20 bp, mouse
gaagtcggcttcctctagga

SEQ ID NO: 526089 - DNA, 20 bp, mouse
gtctacagcgacagcttcgg

SEQ ID NO: 526090 - DNA, 20 bp, mouse
ggagtgggcaccgatcgcac

SEQ ID NO: 526091 - DNA, 20 bp, mouse
gctgtgaggtgagggaattg

SEQ ID NO: 526092 - DNA, 20 bp, mouse
ggcgaaagtcggcttcctct

SEQ ID NO: 526093 - DNA, 20 bp, mouse
gttcggtggcgaccccggtg

SEQ ID NO: 526094 - DNA, 20 bp, mouse
ggcccgacatgactgtacct

SEQ ID NO: 526095 - DNA, 20 bp, mouse
ggatagagtggtctacaatt

SEQ ID NO: 526096 - DNA, 20 bp, mouse
gtgctgagggaagaccaccg

SEQ ID NO: 526097 - DNA, 20 bp, mouse
ggccgctgcgaggtccatgg

SEQ ID NO: 526098 - DNA, 20 bp, mouse
ggagctacgcgtggaacctg

SEQ ID NO: 526099 - DNA, 20 bp, mouse
gagctgcggactctcctccg

SEQ ID NO: 526100 - DNA, 20 bp, mouse
gcgagagtacgcgctgctga

SEQ ID NO: 526101 - DNA, 20 bp, mouse
ggccggaagccagcacccgg

SEQ ID NO: 526102 - DNA, 20 bp, mouse
ggccgccatggacctcgcag

SEQ ID NO: 526103 - DNA, 20 bp, mouse
gtccgcagctgcagatagcc

SEQ ID NO: 526104 - DNA, 20 bp, mouse
gtgcggactctcctccgcgg

SEQ ID NO: 526105 - DNA, 20 bp, mouse
ggcggccgctgcgaggtcca

SEQ ID NO: 526106 - DNA, 20 bp, mouse
gtcagccgcacgggtcacat

SEQ ID NO: 526107 - DNA, 20 bp, mouse
gtgcagaggaggcctagtgg

SEQ ID NO: 526108 - DNA, 20 bp, mouse
gtgttatggagagaacccag

SEQ ID NO: 526109 - DNA, 20 bp, mouse
ggccctccaagcggaagtag

SEQ ID NO: 526110 - DNA, 20 bp, mouse
ggaagcagaaaacgaacgcg

SEQ ID NO: 526111 - DNA, 20 bp, mouse
ggtagccggccaaccgaaat

SEQ ID NO: 526112 - DNA, 20 bp, mouse
gtctcgggcggaggaatcct

SEQ ID NO: 526113 - DNA, 20 bp, mouse
gggcgcgctcggtagagacc

SEQ ID NO: 526114 - DNA, 20 bp, mouse
gagatagctgcagtaggtag

SEQ ID NO: 526115 - DNA, 20 bp, mouse
ggatctgtgactccgaggac

SEQ ID NO: 526116 - DNA, 20 bp, mouse
ggcaggacgcgaggaagacg

SEQ ID NO: 526117 - DNA, 20 bp, mouse
ggaacgccagacgcagggcg

SEQ ID NO: 526118 - DNA, 20 bp, mouse
gccctgcgtgagagtgtata

SEQ ID NO: 526119 - DNA, 20 bp, mouse
gcgccagaacgccagacgca

SEQ ID NO: 526120 - DNA, 20 bp, mouse
ggataacatactgagaacgg

SEQ ID NO: 526121 - DNA, 20 bp, mouse
gactctcacgcagggctccg

SEQ ID NO: 526122 - DNA, 20 bp, mouse
gtccggagacggagtgtccg

SEQ ID NO: 526123 - DNA, 20 bp, mouse
gcaggataacatactgagaa

SEQ ID NO: 526124 - DNA, 20 bp, mouse
gaggaagccacgcgactagg

SEQ ID NO: 526125 - DNA, 20 bp, mouse
gttctggcgcgcagtgacgc

SEQ ID NO: 526126 - DNA, 20 bp, mouse
gcacccggaagaagccccag

SEQ ID NO: 526127 - DNA, 20 bp, mouse
ggaaggacttgagcttcccg

SEQ ID NO: 526128 - DNA, 20 bp, mouse
gcggaagaagccccagcggc

SEQ ID NO: 526129 - DNA, 20 bp, mouse
gtgcgcggctcggggtccgc

SEQ ID NO: 526130 - DNA, 20 bp, mouse
gctcaactttccggccgctg

SEQ ID NO: 526131 - DNA, 20 bp, mouse
gcccccgggacctcacgctg

SEQ ID NO: 526132 - DNA, 20 bp, mouse
ggcgcactgcctcaactttc

SEQ ID NO: 526133 - DNA, 20 bp, mouse
gtgaggcagtgcgcggctcg

SEQ ID NO: 526134 - DNA, 20 bp, mouse
ggcgagcgagagcctagcgg

SEQ ID NO: 526135 - DNA, 20 bp, mouse
ggagacctgacgctaaccac

SEQ ID NO: 526136 - DNA, 20 bp, mouse
gccgccattgtgagaagtgg

SEQ ID NO: 526137 - DNA, 20 bp, mouse
gtcgctggcagcgcggtcgg

SEQ ID NO: 526138 - DNA, 20 bp, mouse
gaggtcgctggcagcgcggt

SEQ ID NO: 526139 - DNA, 20 bp, mouse
gtcacaatggcgggaaatcg

SEQ ID NO: 526140 - DNA, 20 bp, mouse
gtcggagcccggcttctcgg

SEQ ID NO: 526141 - DNA, 20 bp, mouse
ggcgacctgggtggagctcg

SEQ ID NO: 526142 - DNA, 20 bp, mouse
gttcccgccattgtgagaag

SEQ ID NO: 526143 - DNA, 20 bp, mouse
gattgtgagaagtggaggct

SEQ ID NO: 526144 - DNA, 20 bp, mouse
ggtgctgcgcactcccggag

SEQ ID NO: 526145 - DNA, 20 bp, mouse
gctccgcgcgtctcaaggag

SEQ ID NO: 526146 - DNA, 20 bp, mouse
gtgcactgcaggacccgcgt

SEQ ID NO: 526147 - DNA, 20 bp, mouse
ggacccgcgtgggctacaga

SEQ ID NO: 526148 - DNA, 20 bp, mouse
gcaggtgagtcttattccag

SEQ ID NO: 526149 - DNA, 20 bp, mouse
gaggccctctgtagcccacg

SEQ ID NO: 526150 - DNA, 20 bp, mouse
gccgcgcgcgcccgacagtt

SEQ ID NO: 526151 - DNA, 20 bp, mouse
gggcaacatagccaggtcga

SEQ ID NO: 526152 - DNA, 20 bp, mouse
ggagagtgcgcgtgcgcagg

SEQ ID NO: 526153 - DNA, 20 bp, mouse
ggcgcactctcccaactgtc

SEQ ID NO: 526154 - DNA, 20 bp, mouse
ggactccagtgccttcgacc

SEQ ID NO: 526155 - DNA, 20 bp, mouse
gccaagcgggttctctctag

SEQ ID NO: 526156 - DNA, 20 bp, mouse
gagcgaggctgcagtgaccg

SEQ ID NO: 526157 - DNA, 20 bp, mouse
ggatgcgggagggtttgaag

SEQ ID NO: 526158 - DNA, 20 bp, mouse
gcatgtcagctgatgcggga

SEQ ID NO: 526159 - DNA, 20 bp, mouse
ggtgagcgcgagacgcgggt

SEQ ID NO: 526160 - DNA, 20 bp, mouse
ggtttgaagcggcgccggga

SEQ ID NO: 526161 - DNA, 20 bp, mouse
ggcagggtgagcgcgagacg

SEQ ID NO: 526162 - DNA, 20 bp, mouse
gctgcagcggaagtcacccg

SEQ ID NO: 526163 - DNA, 20 bp, mouse
gcggcgcatgtcagctgatg

SEQ ID NO: 526164 - DNA, 20 bp, mouse
ggaagctctccgcctgaggt

SEQ ID NO: 526165 - DNA, 20 bp, mouse
gtagatggctcccagaacct

SEQ ID NO: 526166 - DNA, 20 bp, mouse
gatcagagcgctgactggaa

SEQ ID NO: 526167 - DNA, 20 bp, mouse
ggggccacgcgtagcgacca

SEQ ID NO: 526168 - DNA, 20 bp, mouse
gaagaggctttggtccccta

SEQ ID NO: 526169 - DNA, 20 bp, mouse
gtccccgcccagaggttcag

SEQ ID NO: 526170 - DNA, 20 bp, mouse
gccgggactttgcggaaaag

SEQ ID NO: 526171 - DNA, 20 bp, mouse
gcggggtagcaagaactcta

SEQ ID NO: 526172 - DNA, 20 bp, mouse
gagcgctctgatctcagccc

SEQ ID NO: 526173 - DNA, 20 bp, mouse
gtctcagccccgggactttg

SEQ ID NO: 526174 - DNA, 20 bp, mouse
gaaagcggctgtgtgcaccc

SEQ ID NO: 526175 - DNA, 20 bp, mouse
ggggccactgaacctctggg

SEQ ID NO: 526176 - DNA, 20 bp, mouse
gtaggacttggagcacaggg

SEQ ID NO: 526177 - DNA, 20 bp, mouse
ggaggatggccagagcctgt

SEQ ID NO: 526178 - DNA, 20 bp, mouse
ggacacgacacatcagcaca

SEQ ID NO: 526179 - DNA, 20 bp, mouse
ggatgtgtcgtgtccttcag

SEQ ID NO: 526180 - DNA, 20 bp, mouse
gggccagagcctgtaggact

SEQ ID NO: 526181 - DNA, 20 bp, mouse
gacagcggggacctgtgggg

SEQ ID NO: 526182 - DNA, 20 bp, mouse
gctgtaggacttggagcaca

SEQ ID NO: 526183 - DNA, 20 bp, mouse
gggcccaagtcactccgagg

SEQ ID NO: 526184 - DNA, 20 bp, mouse
gaggtcctgttagccgctga

SEQ ID NO: 526185 - DNA, 20 bp, mouse
gtggatggcacaaagaggga

SEQ ID NO: 526186 - DNA, 20 bp, mouse
gggctcagaagcctgaacaa

SEQ ID NO: 526187 - DNA, 20 bp, mouse
ggatttgccatctctaggga

SEQ ID NO: 526188 - DNA, 20 bp, mouse
gtagcaaacaccgcgggcct

SEQ ID NO: 526189 - DNA, 20 bp, mouse
ggcggtgtttgctactgcag

SEQ ID NO: 526190 - DNA, 20 bp, mouse
gcttagaagaccagatgagg

SEQ ID NO: 526191 - DNA, 20 bp, mouse
ggaagttctgggctcggggt

SEQ ID NO: 526192 - DNA, 20 bp, mouse
gtctcttagaagaccagatg

SEQ ID NO: 526193 - DNA, 20 bp, mouse
gctagagatggcaaatcccg

SEQ ID NO: 526194 - DNA, 20 bp, mouse
ggagcccagaacttctcaca

SEQ ID NO: 526195 - DNA, 20 bp, mouse
gcagctgctaaccagcacct

SEQ ID NO: 526196 - DNA, 20 bp, mouse
gcaagctggtcgggtcatgg

SEQ ID NO: 526197 - DNA, 20 bp, mouse
gcgccggcaggaaggcagag

SEQ ID NO: 526198 - DNA, 20 bp, mouse
gaggcctcgggaggcgttgg

SEQ ID NO: 526199 - DNA, 20 bp, mouse
gcggtcccgcagcttcaagc

SEQ ID NO: 526200 - DNA, 20 bp, mouse
gtaggatgtgagaggacctc

SEQ ID NO: 526201 - DNA, 20 bp, mouse
gcccgcagcttcaagctggt

SEQ ID NO: 526202 - DNA, 20 bp, mouse
gcgagcgtgcgccggcagga

SEQ ID NO: 526203 - DNA, 20 bp, mouse
ggcgcccccaacgcctcccg

SEQ ID NO: 526204 - DNA, 20 bp, mouse
gtggaggcctcgggaggcgt

SEQ ID NO: 526205 - DNA, 20 bp, mouse
ggcgtagggagccctgagat

SEQ ID NO: 526206 - DNA, 20 bp, mouse
gctcaccaaggctgcaccac

SEQ ID NO: 526207 - DNA, 20 bp, mouse
gtaaaagagaccctaagata

SEQ ID NO: 526208 - DNA, 20 bp, mouse
gtggtggacatggagacctg

SEQ ID NO: 526209 - DNA, 20 bp, mouse
gagggcctgcattttgccag

SEQ ID NO: 526210 - DNA, 20 bp, mouse
gtttgccagtggtgcagcct

SEQ ID NO: 526211 - DNA, 20 bp, mouse
gtaggaccctgccttatctt

SEQ ID NO: 526212 - DNA, 20 bp, mouse
gatggttcccggctgaaact

SEQ ID NO: 526213 - DNA, 20 bp, mouse
ggagaccctaagataaggca

SEQ ID NO: 526214 - DNA, 20 bp, mouse
gctccctcaacactaaagga

SEQ ID NO: 526215 - DNA, 20 bp, mouse
gcctaaattgaggtagtcca

SEQ ID NO: 526216 - DNA, 20 bp, mouse
gaagagctgcctatcagaac

SEQ ID NO: 526217 - DNA, 20 bp, mouse
gttgaggaaatgttctaaag

SEQ ID NO: 526218 - DNA, 20 bp, mouse
gactaaactaacatagtcaa

SEQ ID NO: 526219 - DNA, 20 bp, mouse
gagttgcttcctgttctgat

SEQ ID NO: 526220 - DNA, 20 bp, mouse
ggttgaggaagatcaaatga

SEQ ID NO: 526221 - DNA, 20 bp, mouse
gtgccaaagctaagagatga

SEQ ID NO: 526222 - DNA, 20 bp, mouse
gttaccatgagcggtggggt

SEQ ID NO: 526223 - DNA, 20 bp, mouse
gctgattaccatgagcggtg

SEQ ID NO: 526224 - DNA, 20 bp, mouse
gggggcctgattaccatgag

SEQ ID NO: 526225 - DNA, 20 bp, mouse
gatttagaccaaagggcatg

SEQ ID NO: 526226 - DNA, 20 bp, mouse
gtccaagctgtgaccgacac

SEQ ID NO: 526227 - DNA, 20 bp, mouse
ggccagtgtcggtcacagct

SEQ ID NO: 526228 - DNA, 20 bp, mouse
gttggtgaaacattctaaag

SEQ ID NO: 526229 - DNA, 20 bp, mouse
gatcagaacagagagtaatt

SEQ ID NO: 526230 - DNA, 20 bp, mouse
gcctaaactgacatagtcta

SEQ ID NO: 526231 - DNA, 20 bp, mouse
ggcccacccctccttgaatg

SEQ ID NO: 526232 - DNA, 20 bp, mouse
gaggatcctacctcatgtta

SEQ ID NO: 526233 - DNA, 20 bp, mouse
gtctgaatgaaggttgaggg

SEQ ID NO: 526234 - DNA, 20 bp, mouse
ggcctgagccccattcaagg

SEQ ID NO: 526235 - DNA, 20 bp, mouse
ggatcaaagggcatgtggat

SEQ ID NO: 526236 - DNA, 20 bp, mouse
gggcagccaccaggaggacc

SEQ ID NO: 526237 - DNA, 20 bp, mouse
gacctggtcagaccctgaag

SEQ ID NO: 526238 - DNA, 20 bp, mouse
ggccacatgccacacctcta

SEQ ID NO: 526239 - DNA, 20 bp, mouse
gaaagtggccaactgagacc

SEQ ID NO: 526240 - DNA, 20 bp, mouse
gccttcagcgttgactggca

SEQ ID NO: 526241 - DNA, 20 bp, mouse
gtcctcttcagggtctgacc

SEQ ID NO: 526242 - DNA, 20 bp, mouse
gggtctgaccaggtctcagt

SEQ ID NO: 526243 - DNA, 20 bp, mouse
gagcaagcggcttcctccag

SEQ ID NO: 526244 - DNA, 20 bp, mouse
gacacctctagggatgagga

SEQ ID NO: 526245 - DNA, 20 bp, mouse
gtacctccttcagcgttgac

SEQ ID NO: 526246 - DNA, 20 bp, mouse
gttacacagaaatgcaacat

SEQ ID NO: 526247 - DNA, 20 bp, mouse
gtcatcttttcatgtgccac

SEQ ID NO: 526248 - DNA, 20 bp, mouse
gagccatgcttaatttccag

SEQ ID NO: 526249 - DNA, 20 bp, mouse
gtcctctgtggaacacagag

SEQ ID NO: 526250 - DNA, 20 bp, mouse
gtgccactggaaattaagca

SEQ ID NO: 526251 - DNA, 20 bp, mouse
ggcaatcctgagatcctctg

SEQ ID NO: 526252 - DNA, 20 bp, mouse
gacattcagggagaactcaa

SEQ ID NO: 526253 - DNA, 20 bp, mouse
ggtgggtcatgacccctcta

SEQ ID NO: 526254 - DNA, 20 bp, mouse
gccccctctgtgttccacag

SEQ ID NO: 526255 - DNA, 20 bp, mouse
ggtgttccacagaggatctc

SEQ ID NO: 526256 - DNA, 20 bp, mouse
gcggaagtagatgtgtctca

SEQ ID NO: 526257 - DNA, 20 bp, mouse
ggcggggtctcaccattcct

SEQ ID NO: 526258 - DNA, 20 bp, mouse
ggtcgccgcggagaaattgt

SEQ ID NO: 526259 - DNA, 20 bp, mouse
gagctccaacaatttctccg

SEQ ID NO: 526260 - DNA, 20 bp, mouse
gggcgacggcaggagccgca

SEQ ID NO: 526261 - DNA, 20 bp, mouse
ggaagccggctttggccctg

SEQ ID NO: 526262 - DNA, 20 bp, mouse
gcgggttgcgaacgaagggt

SEQ ID NO: 526263 - DNA, 20 bp, mouse
ggtctcacggaagccggctt

SEQ ID NO: 526264 - DNA, 20 bp, mouse
gcttccgggttgcgaacgaa

SEQ ID NO: 526265 - DNA, 20 bp, mouse
ggtagacctggagggtgaag

SEQ ID NO: 526266 - DNA, 20 bp, mouse
ggcaggctctgacaacacca

SEQ ID NO: 526267 - DNA, 20 bp, mouse
gagctggtgtcagaagagct

SEQ ID NO: 526268 - DNA, 20 bp, mouse
gtggatacctgggtacagga

SEQ ID NO: 526269 - DNA, 20 bp, mouse
gctgggagccttggatacct

SEQ ID NO: 526270 - DNA, 20 bp, mouse
gcacatactgtgacagccgc

SEQ ID NO: 526271 - DNA, 20 bp, mouse
gtcacagtatgtgatgcagt

SEQ ID NO: 526272 - DNA, 20 bp, mouse
ggtgctgcaggtacccacca

SEQ ID NO: 526273 - DNA, 20 bp, mouse
ggctagagcaaaccgttctg

SEQ ID NO: 526274 - DNA, 20 bp, mouse
gggatggagccccaggccca

SEQ ID NO: 526275 - DNA, 20 bp, mouse
ggaaagctccgctctcagct

SEQ ID NO: 526276 - DNA, 20 bp, mouse
gcaagtgctcggtgctgaga

SEQ ID NO: 526277 - DNA, 20 bp, mouse
gagtgtctgttcacctccaa

SEQ ID NO: 526278 - DNA, 20 bp, mouse
gagagggcgctgctctccct

SEQ ID NO: 526279 - DNA, 20 bp, mouse
ggttcagagctgcaagtgct

SEQ ID NO: 526280 - DNA, 20 bp, mouse
gagagacttagagtgaaagt

SEQ ID NO: 526281 - DNA, 20 bp, mouse
gagagctgtgtctccagact

SEQ ID NO: 526282 - DNA, 20 bp, mouse
ggacttagagtgaaagtagg

SEQ ID NO: 526283 - DNA, 20 bp, mouse
gataaggtaagtgcaaggtt

SEQ ID NO: 526284 - DNA, 20 bp, mouse
gttgcgaagacagccaagtc

SEQ ID NO: 526285 - DNA, 20 bp, mouse
gcactatgctagatagctac

SEQ ID NO: 526286 - DNA, 20 bp, mouse
gggtggccgaggaagtcccg

SEQ ID NO: 526287 - DNA, 20 bp, mouse
gaggaagtcccgcggctctt

SEQ ID NO: 526288 - DNA, 20 bp, mouse
gccagcgttgctgtccctta

SEQ ID NO: 526289 - DNA, 20 bp, mouse
gagcagtgaccacagccata

SEQ ID NO: 526290 - DNA, 20 bp, mouse
gtaaggcggggctcacaagg

SEQ ID NO: 526291 - DNA, 20 bp, mouse
ggcgcgcccctcacttgcgt

SEQ ID NO: 526292 - DNA, 20 bp, mouse
gcagccggcaaccacgggtt

SEQ ID NO: 526293 - DNA, 20 bp, mouse
gacccccagccggcaaccac

SEQ ID NO: 526294 - DNA, 20 bp, mouse
gttgctgtcccttatggctg

SEQ ID NO: 526295 - DNA, 20 bp, mouse
gaggagcttcccaagagccg

SEQ ID NO: 526296 - DNA, 20 bp, mouse
gggaagggcccggaatggga

SEQ ID NO: 526297 - DNA, 20 bp, mouse
ggatagggaagggcccggaa

SEQ ID NO: 526298 - DNA, 20 bp, mouse
ggaagggtccagcacgagga

SEQ ID NO: 526299 - DNA, 20 bp, mouse
ggaaggcctgcactgacagt

SEQ ID NO: 526300 - DNA, 20 bp, mouse
gttaggaagggtccagcacg

SEQ ID NO: 526301 - DNA, 20 bp, mouse
gaaggggcgacgatagggaa

SEQ ID NO: 526302 - DNA, 20 bp, mouse
gggtgaaaggggcgacgata

SEQ ID NO: 526303 - DNA, 20 bp, mouse
gcagctccgactgtcagtgc

SEQ ID NO: 526304 - DNA, 20 bp, mouse
ggtgcaggccttcctcgtgc

SEQ ID NO: 526305 - DNA, 20 bp, mouse
ggcgacgatagggaagggcc

SEQ ID NO: 526306 - DNA, 20 bp, mouse
gcgagtcgcggtctacagga

SEQ ID NO: 526307 - DNA, 20 bp, mouse
gctgtagaccgcgactcgga

SEQ ID NO: 526308 - DNA, 20 bp, mouse
gagaccgcgactcggacggt

SEQ ID NO: 526309 - DNA, 20 bp, mouse
gtcgccgaccgtccgagtcg

SEQ ID NO: 526310 - DNA, 20 bp, mouse
gttggtgaaggggcaccgtc

SEQ ID NO: 526311 - DNA, 20 bp, mouse
gcaacggccggctcagatgc

SEQ ID NO: 526312 - DNA, 20 bp, mouse
ggtcttccggttagcgacaa

SEQ ID NO: 526313 - DNA, 20 bp, mouse
ggaacatgatcttggtgaag

SEQ ID NO: 526314 - DNA, 20 bp, mouse
gttttgacgggatctttctt

SEQ ID NO: 526315 - DNA, 20 bp, mouse
gcacaccagcaggtcgacaa

SEQ ID NO: 526316 - DNA, 20 bp, mouse
gagcaggagcgatctacctg

SEQ ID NO: 526317 - DNA, 20 bp, mouse
gaggagcgatctacctgcgg

SEQ ID NO: 526318 - DNA, 20 bp, mouse
gcaggcgctgaaggacacgg

SEQ ID NO: 526319 - DNA, 20 bp, mouse
gcccagcccgggaaagcagc

SEQ ID NO: 526320 - DNA, 20 bp, mouse
ggcccaggcagcgcagcgga

SEQ ID NO: 526321 - DNA, 20 bp, mouse
ggccgtttccagttgagaga

SEQ ID NO: 526322 - DNA, 20 bp, mouse
ggtggcccgccaccccgggg

SEQ ID NO: 526323 - DNA, 20 bp, mouse
ggcagcgcagcggacggcag

SEQ ID NO: 526324 - DNA, 20 bp, mouse
ggagggaccgagcccggagg

SEQ ID NO: 526325 - DNA, 20 bp, mouse
gccggccgcaccagcagcac

SEQ ID NO: 526326 - DNA, 20 bp, mouse
gatggacagcggctccgtgg

SEQ ID NO: 526327 - DNA, 20 bp, mouse
gcctgtgacccgctcgggga

SEQ ID NO: 526328 - DNA, 20 bp, mouse
ggcgcacaccgagtcgccag

SEQ ID NO: 526329 - DNA, 20 bp, mouse
ggccgctgtccatccccgag

SEQ ID NO: 526330 - DNA, 20 bp, mouse
gacgggagccgctggcgact

SEQ ID NO: 526331 - DNA, 20 bp, mouse
gcggctccgtggcggccgag

SEQ ID NO: 526332 - DNA, 20 bp, mouse
gtcgggcctgtgacccgctc

SEQ ID NO: 526333 - DNA, 20 bp, mouse
gcgcttgcgagcagccggag

SEQ ID NO: 526334 - DNA, 20 bp, mouse
gctcggccgctcggccgcca

SEQ ID NO: 526335 - DNA, 20 bp, mouse
ggcgcggggagggcacgagc

SEQ ID NO: 526336 - DNA, 20 bp, mouse
ggcgcgcgcgccaccagtaa

SEQ ID NO: 526337 - DNA, 20 bp, mouse
ggcgcgcgcgcggattcagt

SEQ ID NO: 526338 - DNA, 20 bp, mouse
gagtaacggccgctaccagg

SEQ ID NO: 526339 - DNA, 20 bp, mouse
gcactcccgccacctggtag

SEQ ID NO: 526340 - DNA, 20 bp, mouse
gtggtagcggccgttactgg

SEQ ID NO: 526341 - DNA, 20 bp, mouse
gaacggccgctaccaggtgg

SEQ ID NO: 526342 - DNA, 20 bp, mouse
gagggaacgaactccagcgt

SEQ ID NO: 526343 - DNA, 20 bp, mouse
gcggattcagtcggtgagtt

SEQ ID NO: 526344 - DNA, 20 bp, mouse
gagttcggcagcccgcgccc

SEQ ID NO: 526345 - DNA, 20 bp, mouse
gaagatggtaacccgggcgc

SEQ ID NO: 526346 - DNA, 20 bp, mouse
gtgcgagctggcgctggaat

SEQ ID NO: 526347 - DNA, 20 bp, mouse
gggagccaagagcgagtgag

SEQ ID NO: 526348 - DNA, 20 bp, mouse
ggaaggaaggggcgatcggt

SEQ ID NO: 526349 - DNA, 20 bp, mouse
gcaagagcgagtgagcgggg

SEQ ID NO: 526350 - DNA, 20 bp, mouse
gaccccgccatgcgacacct

SEQ ID NO: 526351 - DNA, 20 bp, mouse
ggcctaggcaggtcacctcg

SEQ ID NO: 526352 - DNA, 20 bp, mouse
ggcgatcggtgggtgcgagc

SEQ ID NO: 526353 - DNA, 20 bp, mouse
gaggcgcgtcgcagcgagaa

SEQ ID NO: 526354 - DNA, 20 bp, mouse
gcagcgctggggactccatg

SEQ ID NO: 526355 - DNA, 20 bp, mouse
gggaagaaggaaggggcgat

SEQ ID NO: 526356 - DNA, 20 bp, mouse
gtgtaggagtggcagcgcga

SEQ ID NO: 526357 - DNA, 20 bp, mouse
gtgtttgaagagtgtaggag

SEQ ID NO: 526358 - DNA, 20 bp, mouse
ggagcctcgctgactaccgg

SEQ ID NO: 526359 - DNA, 20 bp, mouse
gctcctccgggaaggacttt

SEQ ID NO: 526360 - DNA, 20 bp, mouse
gctaccggtggcgggaggaa

SEQ ID NO: 526361 - DNA, 20 bp, mouse
gaccttggcatcccccccgt

SEQ ID NO: 526362 - DNA, 20 bp, mouse
gcagcccctctcctccggga

SEQ ID NO: 526363 - DNA, 20 bp, mouse
gcggcggcagagcgacctaa

SEQ ID NO: 526364 - DNA, 20 bp, mouse
gatcctaaagtccttcccgg

SEQ ID NO: 526365 - DNA, 20 bp, mouse
gaggctgccagggcgtgatg

SEQ ID NO: 526366 - DNA, 20 bp, mouse
ggcacagcgaagcccaagtt

SEQ ID NO: 526367 - DNA, 20 bp, mouse
ggcccaagttagggagcgag

SEQ ID NO: 526368 - DNA, 20 bp, mouse
ggagcccgggaatgccacgg

SEQ ID NO: 526369 - DNA, 20 bp, mouse
ggcggagcccgggaatgcca

SEQ ID NO: 526370 - DNA, 20 bp, mouse
gtccgctcgctccctaactt

SEQ ID NO: 526371 - DNA, 20 bp, mouse
ggagggaccgcagccagcaa

SEQ ID NO: 526372 - DNA, 20 bp, mouse
gccgccgccgaggaatccgg

SEQ ID NO: 526373 - DNA, 20 bp, mouse
gccgccgccgtggcattccc

SEQ ID NO: 526374 - DNA, 20 bp, mouse
gggcggccagacggcgggag

SEQ ID NO: 526375 - DNA, 20 bp, mouse
gcggggcaccgcggccactc

SEQ ID NO: 526376 - DNA, 20 bp, mouse
gaacagggtacgtggagagc

SEQ ID NO: 526377 - DNA, 20 bp, mouse
ggtaacagccaaaggtaaaa

SEQ ID NO: 526378 - DNA, 20 bp, mouse
gtcactgtaaacagggtacg

SEQ ID NO: 526379 - DNA, 20 bp, mouse
gtatccaggatggtaaacct

SEQ ID NO: 526380 - DNA, 20 bp, mouse
gcgagtttggagtattttca

SEQ ID NO: 526381 - DNA, 20 bp, mouse
gcccaaacaacagtaaaagt

SEQ ID NO: 526382 - DNA, 20 bp, mouse
gttggagtattttcaaggaa

SEQ ID NO: 526383 - DNA, 20 bp, mouse
gcatgcactactatccagga

SEQ ID NO: 526384 - DNA, 20 bp, mouse
gagtggggtgggataaggcg

SEQ ID NO: 526385 - DNA, 20 bp, mouse
gctgggcttacatattacac

SEQ ID NO: 526386 - DNA, 20 bp, mouse
gagtcaggtcacctctacag

SEQ ID NO: 526387 - DNA, 20 bp, mouse
ggtagaggtgacctgactgc

SEQ ID NO: 526388 - DNA, 20 bp, mouse
gaaggcagtctccagcagtc

SEQ ID NO: 526389 - DNA, 20 bp, mouse
gcgatctctgcacctgcaaa

SEQ ID NO: 526390 - DNA, 20 bp, mouse
gtctacagcggaacagactc

SEQ ID NO: 526391 - DNA, 20 bp, mouse
gttgcaataatggtgagtgt

SEQ ID NO: 526392 - DNA, 20 bp, mouse
ggactctgggagagaacgcg

SEQ ID NO: 526393 - DNA, 20 bp, mouse
ggtcgcagtaacccagatac

SEQ ID NO: 526394 - DNA, 20 bp, mouse
gtaacccagatactggaaag

SEQ ID NO: 526395 - DNA, 20 bp, mouse
gccgcgcggaggacagctcc

SEQ ID NO: 526396 - DNA, 20 bp, mouse
gaacaaggctgaccacccat

SEQ ID NO: 526397 - DNA, 20 bp, mouse
gccaggaaaccgtgacgcca

SEQ ID NO: 526398 - DNA, 20 bp, mouse
gtaggtcttgctagaaatca

SEQ ID NO: 526399 - DNA, 20 bp, mouse
gcgccacggtcccagtttct

SEQ ID NO: 526400 - DNA, 20 bp, mouse
gaactgggaccgtggcgtca

SEQ ID NO: 526401 - DNA, 20 bp, mouse
gtcacccgcgatcacaaatt

SEQ ID NO: 526402 - DNA, 20 bp, mouse
gtctagcaagacctagaaac

SEQ ID NO: 526403 - DNA, 20 bp, mouse
gccgcggcgggtactaaaac

SEQ ID NO: 526404 - DNA, 20 bp, mouse
gtaaaactggccaagggcag

SEQ ID NO: 526405 - DNA, 20 bp, mouse
gtggccaaatttgtgatcgc

SEQ ID NO: 526406 - DNA, 20 bp, mouse
ggggcgggacacggagctac

SEQ ID NO: 526407 - DNA, 20 bp, mouse
gcggccactgcgcagagtgg

SEQ ID NO: 526408 - DNA, 20 bp, mouse
gagagcggcgccggcaggac

SEQ ID NO: 526409 - DNA, 20 bp, mouse
gtgcgcagagtggaggtcgt

SEQ ID NO: 526410 - DNA, 20 bp, mouse
ggggacacggagctactggc

SEQ ID NO: 526411 - DNA, 20 bp, mouse
gcggacagcatggctagggc

SEQ ID NO: 526412 - DNA, 20 bp, mouse
gagagcggacagcatggcta

SEQ ID NO: 526413 - DNA, 20 bp, mouse
gccggcaggacgggcgagag

SEQ ID NO: 526414 - DNA, 20 bp, mouse
ggcctaggaaggaactccgg

SEQ ID NO: 526415 - DNA, 20 bp, mouse
gctacgtggagcgcagacta

SEQ ID NO: 526416 - DNA, 20 bp, mouse
gtcctagcggagaagagact

SEQ ID NO: 526417 - DNA, 20 bp, mouse
gggcagagcagccgcctgaa

SEQ ID NO: 526418 - DNA, 20 bp, mouse
gttagcgggacaggccggag

SEQ ID NO: 526419 - DNA, 20 bp, mouse
gagtgggacaagtcagtcaa

SEQ ID NO: 526420 - DNA, 20 bp, mouse
gcccacctcagcccccttgg

SEQ ID NO: 526421 - DNA, 20 bp, mouse
gaccaccaagagggcaagaa

SEQ ID NO: 526422 - DNA, 20 bp, mouse
gggacaagtcagtcaagggt

SEQ ID NO: 526423 - DNA, 20 bp, mouse
gcggccttagcgggacaggc

SEQ ID NO: 526424 - DNA, 20 bp, mouse
ggcagccgcctgaagggact

SEQ ID NO: 526425 - DNA, 20 bp, mouse
gtccttcccgcggttcctag

SEQ ID NO: 526426 - DNA, 20 bp, mouse
gcgggacgacgcgacaacac

SEQ ID NO: 526427 - DNA, 20 bp, mouse
gcgggtccaggatcttgcta

SEQ ID NO: 526428 - DNA, 20 bp, mouse
gctgccccgccgacagttaa

SEQ ID NO: 526429 - DNA, 20 bp, mouse
gcgggagcaaaagccccgag

SEQ ID NO: 526430 - DNA, 20 bp, mouse
gccggtggcccagcgcggag

SEQ ID NO: 526431 - DNA, 20 bp, mouse
ggtgcgccggcgcgtcgtcg

SEQ ID NO: 526432 - DNA, 20 bp, mouse
gtggttccctagcaagatcc

SEQ ID NO: 526433 - DNA, 20 bp, mouse
gcccttgacagtgggacgaa

SEQ ID NO: 526434 - DNA, 20 bp, mouse
gagcaaaagccccgaggggg

SEQ ID NO: 526435 - DNA, 20 bp, mouse
gcgcgtcgtcccgccccctc

SEQ ID NO: 526436 - DNA, 20 bp, mouse
gggccagcgtagcctaggag

SEQ ID NO: 526437 - DNA, 20 bp, mouse
gagctcgagcgacgagaagg

SEQ ID NO: 526438 - DNA, 20 bp, mouse
gctcctcaccggccgctcct

SEQ ID NO: 526439 - DNA, 20 bp, mouse
gcagagctcgagcgacgaga

SEQ ID NO: 526440 - DNA, 20 bp, mouse
ggttacgagtaggccccgga

SEQ ID NO: 526441 - DNA, 20 bp, mouse
ggccggggcctgagcgacca

SEQ ID NO: 526442 - DNA, 20 bp, mouse
gtccggggccagcgtagcct

SEQ ID NO: 526443 - DNA, 20 bp, mouse
ggccggcccgggttacgagt

SEQ ID NO: 526444 - DNA, 20 bp, mouse
gagaagcgcggtgatccgag

SEQ ID NO: 526445 - DNA, 20 bp, mouse
gtagcaggtacccgctccgt

SEQ ID NO: 526446 - DNA, 20 bp, mouse
ggtgcaggccttagggtctc

SEQ ID NO: 526447 - DNA, 20 bp, mouse
gccctcccccagctaggagg

SEQ ID NO: 526448 - DNA, 20 bp, mouse
gggagtcgtagagagagacc

SEQ ID NO: 526449 - DNA, 20 bp, mouse
gattttgaaactgcgagcaa

SEQ ID NO: 526450 - DNA, 20 bp, mouse
gttcggagctaggaaccggg

SEQ ID NO: 526451 - DNA, 20 bp, mouse
gggcttcggagctaggaacc

SEQ ID NO: 526452 - DNA, 20 bp, mouse
ggagcggacagaaggtccgg

SEQ ID NO: 526453 - DNA, 20 bp, mouse
ggggggagcgactcatggag

SEQ ID NO: 526454 - DNA, 20 bp, mouse
ggagacctggagagtgtcat

SEQ ID NO: 526455 - DNA, 20 bp, mouse
ggtcgctccccctcctagct

SEQ ID NO: 526456 - DNA, 20 bp, mouse
ggacggccgaaaacccacga

SEQ ID NO: 526457 - DNA, 20 bp, mouse
gcggcaagcagacacacacg

SEQ ID NO: 526458 - DNA, 20 bp, mouse
gccaagaacgagaagagcag

SEQ ID NO: 526459 - DNA, 20 bp, mouse
gtctgcttgccggctttcgg

SEQ ID NO: 526460 - DNA, 20 bp, mouse
gtggccaagtcggtgagcgt

SEQ ID NO: 526461 - DNA, 20 bp, mouse
gcaagaagacccccgaaagc

SEQ ID NO: 526462 - DNA, 20 bp, mouse
gtggccgcggccggagacta

SEQ ID NO: 526463 - DNA, 20 bp, mouse
ggcagacacacacgtggtga

SEQ ID NO: 526464 - DNA, 20 bp, mouse
gccacggggccgcggggtga

SEQ ID NO: 526465 - DNA, 20 bp, mouse
gaaccgcgccgattcctgaa

SEQ ID NO: 526466 - DNA, 20 bp, mouse
gacttggccgccatagaatt

SEQ ID NO: 526467 - DNA, 20 bp, mouse
gttgcgggtggatcatgacg

SEQ ID NO: 526468 - DNA, 20 bp, mouse
gtctatggcggccaagtagg

SEQ ID NO: 526469 - DNA, 20 bp, mouse
gtgagtgtgtcccaattcta

SEQ ID NO: 526470 - DNA, 20 bp, mouse
gccacccgcaaatccaaact

SEQ ID NO: 526471 - DNA, 20 bp, mouse
ggatcaaaaaccgcaagctt

SEQ ID NO: 526472 - DNA, 20 bp, mouse
ggagcaggtgagactataag

SEQ ID NO: 526473 - DNA, 20 bp, mouse
gcgggcgagccacagagaac

SEQ ID NO: 526474 - DNA, 20 bp, mouse
gatggcggccaagtaggcgg

SEQ ID NO: 526475 - DNA, 20 bp, mouse
gacacactcagcgccaagtt

SEQ ID NO: 526476 - DNA, 20 bp, mouse
gcgggacccgcatctcaaca

SEQ ID NO: 526477 - DNA, 20 bp, mouse
gccgcagtggcctcccgggt

SEQ ID NO: 526478 - DNA, 20 bp, mouse
ggagaagcgctgagtcacgg

SEQ ID NO: 526479 - DNA, 20 bp, mouse
gcgaggggaccgtcccaccc

SEQ ID NO: 526480 - DNA, 20 bp, mouse
gggaccgggaaggcacgtcg

SEQ ID NO: 526481 - DNA, 20 bp, mouse
gggacctgcgtgccaccgag

SEQ ID NO: 526482 - DNA, 20 bp, mouse
gggctccgcagtggcctccc

SEQ ID NO: 526483 - DNA, 20 bp, mouse
ggagggcgccggctccgcag

SEQ ID NO: 526484 - DNA, 20 bp, mouse
gcgcgagaagcgctgagtca

SEQ ID NO: 526485 - DNA, 20 bp, mouse
gtgttcaaggcaggaccggt

SEQ ID NO: 526486 - DNA, 20 bp, mouse
ggctgccaggagctcgcggg

SEQ ID NO: 526487 - DNA, 20 bp, mouse
gccggctgccaggagctcgc

SEQ ID NO: 526488 - DNA, 20 bp, mouse
gcgccagggccgagcatctc

SEQ ID NO: 526489 - DNA, 20 bp, mouse
gggctggcagggtggcgcca

SEQ ID NO: 526490 - DNA, 20 bp, mouse
gcccacacgcgcagaggtag

SEQ ID NO: 526491 - DNA, 20 bp, mouse
gttcccaaccgagctcaggg

SEQ ID NO: 526492 - DNA, 20 bp, mouse
gacctggctggagccctagg

SEQ ID NO: 526493 - DNA, 20 bp, mouse
ggccaccctgcgctatccca

SEQ ID NO: 526494 - DNA, 20 bp, mouse
gagctcacgtgcgaccccga

SEQ ID NO: 526495 - DNA, 20 bp, mouse
gcgctacagccggagatgct

SEQ ID NO: 526496 - DNA, 20 bp, mouse
gtggcacagacctggaacca

SEQ ID NO: 526497 - DNA, 20 bp, mouse
gagcaggtggcctcggacaa

SEQ ID NO: 526498 - DNA, 20 bp, mouse
gggtggcctcggacaagggg

SEQ ID NO: 526499 - DNA, 20 bp, mouse
gggcctcggacaaggggagg

SEQ ID NO: 526500 - DNA, 20 bp, mouse
gaggcgggccagacttggag

SEQ ID NO: 526501 - DNA, 20 bp, mouse
gagcgcggcgcccatagccc

SEQ ID NO: 526502 - DNA, 20 bp, mouse
ggagctctcggagaggctgg

SEQ ID NO: 526503 - DNA, 20 bp, mouse
gctgcaggctatgcgaggca

SEQ ID NO: 526504 - DNA, 20 bp, mouse
gcatagccctggcacagacc

SEQ ID NO: 526505 - DNA, 20 bp, mouse
gctctccgagagctcaggtc

SEQ ID NO: 526506 - DNA, 20 bp, mouse
gccggctgtgggctctgaga

SEQ ID NO: 526507 - DNA, 20 bp, mouse
gggcggggcaggacatgctg

SEQ ID NO: 526508 - DNA, 20 bp, mouse
gcccagggtctccccttcaa

SEQ ID NO: 526509 - DNA, 20 bp, mouse
gccggaatagagggaatgag

SEQ ID NO: 526510 - DNA, 20 bp, mouse
gggaagtgaaggtgcgggtc

SEQ ID NO: 526511 - DNA, 20 bp, mouse
ggtcagtctcgggcacgggg

SEQ ID NO: 526512 - DNA, 20 bp, mouse
gcctgccccgccggaagtga

SEQ ID NO: 526513 - DNA, 20 bp, mouse
gagaatcagtggggcgggta

SEQ ID NO: 526514 - DNA, 20 bp, mouse
ggtagctggggccattgaag

SEQ ID NO: 526515 - DNA, 20 bp, mouse
gcctcgcttgcgtcagtctc

SEQ ID NO: 526516 - DNA, 20 bp, mouse
ggccgggtgtctgggatctg

SEQ ID NO: 526517 - DNA, 20 bp, mouse
gccgccgcttgagcccaaca

SEQ ID NO: 526518 - DNA, 20 bp, mouse
gatggcgatgcacaacaaga

SEQ ID NO: 526519 - DNA, 20 bp, mouse
gcagctcccgccgggtgtct

SEQ ID NO: 526520 - DNA, 20 bp, mouse
gagctcggccagctcccgcc

SEQ ID NO: 526521 - DNA, 20 bp, mouse
ggcccagagcgcccagaccc

SEQ ID NO: 526522 - DNA, 20 bp, mouse
gtgttgtgcatcgccatgtt

SEQ ID NO: 526523 - DNA, 20 bp, mouse
gtcgccatgttgggctcaag

SEQ ID NO: 526524 - DNA, 20 bp, mouse
ggcggcggcgcgcgaccagt

SEQ ID NO: 526525 - DNA, 20 bp, mouse
ggcggcgcgcgaccagtagg

SEQ ID NO: 526526 - DNA, 20 bp, mouse
gggcacagcatgagatccaa

SEQ ID NO: 526527 - DNA, 20 bp, mouse
gatgctagagatagcgagtg

SEQ ID NO: 526528 - DNA, 20 bp, mouse
ggcggcgctgagatgttgga

SEQ ID NO: 526529 - DNA, 20 bp, mouse
ggtctaacgcgcatgtgcga

SEQ ID NO: 526530 - DNA, 20 bp, mouse
gcagagcaggagccagggcg

SEQ ID NO: 526531 - DNA, 20 bp, mouse
ggcgcacggggagagagcgc

SEQ ID NO: 526532 - DNA, 20 bp, mouse
gccagcagcggctgcaggac

SEQ ID NO: 526533 - DNA, 20 bp, mouse
gaaggaaactggccacaagt

SEQ ID NO: 526534 - DNA, 20 bp, mouse
gcgcaagatggcagagaagg

SEQ ID NO: 526535 - DNA, 20 bp, mouse
ggagatccaaaggcagggca

SEQ ID NO: 526536 - DNA, 20 bp, mouse
gctccctcctctcggagaga

SEQ ID NO: 526537 - DNA, 20 bp, mouse
gtggagaaagccaccaccgg

SEQ ID NO: 526538 - DNA, 20 bp, mouse
gccaccggcggcagagggag

SEQ ID NO: 526539 - DNA, 20 bp, mouse
gcgcgcgcgctccctcctct

SEQ ID NO: 526540 - DNA, 20 bp, mouse
ggagtggagaaagccaccac

SEQ ID NO: 526541 - DNA, 20 bp, mouse
gggcgaagcccagacgacaa

SEQ ID NO: 526542 - DNA, 20 bp, mouse
gggctgtggtaaaacccgtc

SEQ ID NO: 526543 - DNA, 20 bp, mouse
gccacagccctctctccgag

SEQ ID NO: 526544 - DNA, 20 bp, mouse
gcctaggatgcgcacagatg

SEQ ID NO: 526545 - DNA, 20 bp, mouse
gcagccctctctccgagagg

SEQ ID NO: 526546 - DNA, 20 bp, mouse
ggtcagccagcgagtgacag

SEQ ID NO: 526547 - DNA, 20 bp, mouse
gcgaggagacccgcaagctg

SEQ ID NO: 526548 - DNA, 20 bp, mouse
gcccgcaagctgaggtgccc

SEQ ID NO: 526549 - DNA, 20 bp, mouse
gtcgcgcccctgtcactcgc

SEQ ID NO: 526550 - DNA, 20 bp, mouse
gaccccagctccctccccgg

SEQ ID NO: 526551 - DNA, 20 bp, mouse
gaacatgctgcttccagcac

SEQ ID NO: 526552 - DNA, 20 bp, mouse
gggctcagagagagcggagt

SEQ ID NO: 526553 - DNA, 20 bp, mouse
gaaggtcgtccagtaagagt

SEQ ID NO: 526554 - DNA, 20 bp, mouse
gttccagcactggcagaatc

SEQ ID NO: 526555 - DNA, 20 bp, mouse
gggatgtggtccggccgtgg

SEQ ID NO: 526556 - DNA, 20 bp, mouse
gctcagtctgaagtccccgg

SEQ ID NO: 526557 - DNA, 20 bp, mouse
gcccggcggcaagaagagaa

SEQ ID NO: 526558 - DNA, 20 bp, mouse
ggttccgttggggaagatgg

SEQ ID NO: 526559 - DNA, 20 bp, mouse
gagcggccccgactcttccg

SEQ ID NO: 526560 - DNA, 20 bp, mouse
gtcacgagtggaggagacgg

SEQ ID NO: 526561 - DNA, 20 bp, mouse
gaggctcagggggaaaccga

SEQ ID NO: 526562 - DNA, 20 bp, mouse
gaagaagagaagggtgctcg

SEQ ID NO: 526563 - DNA, 20 bp, mouse
gccgccgccatcttccccaa

SEQ ID NO: 526564 - DNA, 20 bp, mouse
ggcatctgtagggctcggtc

SEQ ID NO: 526565 - DNA, 20 bp, mouse
gtgctggagcgcctcctccg

SEQ ID NO: 526566 - DNA, 20 bp, mouse
gtcctgaccggacctcacag

SEQ ID NO: 526567 - DNA, 20 bp, mouse
gccggagtcgctcggagctg

SEQ ID NO: 526568 - DNA, 20 bp, mouse
gggatctgaccgcacaggag

SEQ ID NO: 526569 - DNA, 20 bp, mouse
gctgtggacccggagtcgct

SEQ ID NO: 526570 - DNA, 20 bp, mouse
gtgaccggacctcacagggg

SEQ ID NO: 526571 - DNA, 20 bp, mouse
ggaacgttagagccccagtg

SEQ ID NO: 526572 - DNA, 20 bp, mouse
gggcttccggaagccggaag

SEQ ID NO: 526573 - DNA, 20 bp, mouse
gtgtgagtgacggcccggca

SEQ ID NO: 526574 - DNA, 20 bp, mouse
gtagaaccggcctcccctcg

SEQ ID NO: 526575 - DNA, 20 bp, mouse
gtggggtccccaaggccggc

SEQ ID NO: 526576 - DNA, 20 bp, mouse
gtcgcaaaagacggcctgtg

SEQ ID NO: 526577 - DNA, 20 bp, mouse
gtaggtagccatcgttccag

SEQ ID NO: 526578 - DNA, 20 bp, mouse
gttccagtggaaagccccac

SEQ ID NO: 526579 - DNA, 20 bp, mouse
gctacagtctggcgaacgag

SEQ ID NO: 526580 - DNA, 20 bp, mouse
gtcacgctcgatatcctcca

SEQ ID NO: 526581 - DNA, 20 bp, mouse
gggcctgtggggctttccac

SEQ ID NO: 526582 - DNA, 20 bp, mouse
gacttctgtgcagcacgtgg

SEQ ID NO: 526583 - DNA, 20 bp, mouse
ggggctttccactggaacga

SEQ ID NO: 526584 - DNA, 20 bp, mouse
gagagggcgatgtcagaccc

SEQ ID NO: 526585 - DNA, 20 bp, mouse
gcgccacacctcgcaaaaga

SEQ ID NO: 526586 - DNA, 20 bp, mouse
gtacgggctgggcaagatgg

SEQ ID NO: 526587 - DNA, 20 bp, mouse
gcaggcgcctcaggcggtac

SEQ ID NO: 526588 - DNA, 20 bp, mouse
gtgcagggccaggcgaggtg

SEQ ID NO: 526589 - DNA, 20 bp, mouse
gtgacagttgagggcaaggg

SEQ ID NO: 526590 - DNA, 20 bp, mouse
gccgcagccgcttcaggggt

SEQ ID NO: 526591 - DNA, 20 bp, mouse
ggcccagcccgtaccgcctg

SEQ ID NO: 526592 - DNA, 20 bp, mouse
gtgaacaccgacccctgaag

SEQ ID NO: 526593 - DNA, 20 bp, mouse
ggcctcaggcggtacgggct

SEQ ID NO: 526594 - DNA, 20 bp, mouse
gccgggcaggtgtttcgtga

SEQ ID NO: 526595 - DNA, 20 bp, mouse
gaccgcctgaggcgcctgca

SEQ ID NO: 526596 - DNA, 20 bp, mouse
gtcgcgctcccgggccgtgg

SEQ ID NO: 526597 - DNA, 20 bp, mouse
ggccgtgggggcgagaacgc

SEQ ID NO: 526598 - DNA, 20 bp, mouse
ggcgcgagctcccgagttgg

SEQ ID NO: 526599 - DNA, 20 bp, mouse
gggagcgcgagctcccgagt

SEQ ID NO: 526600 - DNA, 20 bp, mouse
gcgccgccgtccgccaactc

SEQ ID NO: 526601 - DNA, 20 bp, mouse
ggacagcgagcgacgccccc

SEQ ID NO: 526602 - DNA, 20 bp, mouse
ggccagcgttctcgccccca

SEQ ID NO: 526603 - DNA, 20 bp, mouse
gctagctagcggctaggcag

SEQ ID NO: 526604 - DNA, 20 bp, mouse
ggagctcccgagttggcgga

SEQ ID NO: 526605 - DNA, 20 bp, mouse
ggttctcgcccccacggccc

SEQ ID NO: 526606 - DNA, 20 bp, mouse
gtcggaggcggcggtaatgg

SEQ ID NO: 526607 - DNA, 20 bp, mouse
gtggtcggaggcggcggtaa

SEQ ID NO: 526608 - DNA, 20 bp, mouse
gggcggtaatggcggatggt

SEQ ID NO: 526609 - DNA, 20 bp, mouse
gaggaggagaaagaccgagg

SEQ ID NO: 526610 - DNA, 20 bp, mouse
gtgtttctctctctggtcgg

SEQ ID NO: 526611 - DNA, 20 bp, mouse
ggggcctagccgggggacac

SEQ ID NO: 526612 - DNA, 20 bp, mouse
gttctctctctggtcggagg

SEQ ID NO: 526613 - DNA, 20 bp, mouse
gtggtgggttgtggcgccgg

SEQ ID NO: 526614 - DNA, 20 bp, mouse
ggccccgttcgacacgaagg

SEQ ID NO: 526615 - DNA, 20 bp, mouse
gaggcggcggtaatggcgga

SEQ ID NO: 526616 - DNA, 20 bp, mouse
gggagaagcgcggccgactg

SEQ ID NO: 526617 - DNA, 20 bp, mouse
gctcgctctgacagcaatgg

SEQ ID NO: 526618 - DNA, 20 bp, mouse
ggcggccgactggggaggag

SEQ ID NO: 526619 - DNA, 20 bp, mouse
gtcgctcgctctgacagcaa

SEQ ID NO: 526620 - DNA, 20 bp, mouse
gcgaagccagcgggcgaccc

SEQ ID NO: 526621 - DNA, 20 bp, mouse
gggcggctcccgggcaccag

SEQ ID NO: 526622 - DNA, 20 bp, mouse
ggccggcttggagataaaca

SEQ ID NO: 526623 - DNA, 20 bp, mouse
ggcccgcgcgggaggcccga

SEQ ID NO: 526624 - DNA, 20 bp, mouse
gaacaaggcggccgacgagg

SEQ ID NO: 526625 - DNA, 20 bp, mouse
gctgtcagagcgagcgagcc

SEQ ID NO: 526626 - DNA, 20 bp, mouse
gtgcggtcaccgagcccggg

SEQ ID NO: 526627 - DNA, 20 bp, mouse
ggcccgcgcccgcctcggtg

SEQ ID NO: 526628 - DNA, 20 bp, mouse
ggggctcggtgaccgcaccg

SEQ ID NO: 526629 - DNA, 20 bp, mouse
ggaggcggcctggcgctagg

SEQ ID NO: 526630 - DNA, 20 bp, mouse
gggctcggcttcctgttcag

SEQ ID NO: 526631 - DNA, 20 bp, mouse
gaagctccgagtaggcccgg

SEQ ID NO: 526632 - DNA, 20 bp, mouse
ggcggcctggcgctaggcgg

SEQ ID NO: 526633 - DNA, 20 bp, mouse
gctcggtgaccgcaccgagg

SEQ ID NO: 526634 - DNA, 20 bp, mouse
gtccagggccgcatctcagg

SEQ ID NO: 526635 - DNA, 20 bp, mouse
gggaagccgagcccaagctg

SEQ ID NO: 526636 - DNA, 20 bp, mouse
ggtcgctgtggtagaggcgg

SEQ ID NO: 526637 - DNA, 20 bp, mouse
gactcgggctacaagagtag

SEQ ID NO: 526638 - DNA, 20 bp, mouse
ggggtggccggtagggactc

SEQ ID NO: 526639 - DNA, 20 bp, mouse
gacagcgacaggcccgaacc

SEQ ID NO: 526640 - DNA, 20 bp, mouse
gttgtagcccgagtccctac

SEQ ID NO: 526641 - DNA, 20 bp, mouse
gttccggcgtggcccagtag

SEQ ID NO: 526642 - DNA, 20 bp, mouse
gctacaagagtaggggctcc

SEQ ID NO: 526643 - DNA, 20 bp, mouse
ggcgccgggggtggccggta

SEQ ID NO: 526644 - DNA, 20 bp, mouse
gtgggccacgccggaagtac

SEQ ID NO: 526645 - DNA, 20 bp, mouse
gttctgaccagggtcaagag

SEQ ID NO: 526646 - DNA, 20 bp, mouse
gggcgcgggcctagagatgg

SEQ ID NO: 526647 - DNA, 20 bp, mouse
ggccggcgcgggcctagaga

SEQ ID NO: 526648 - DNA, 20 bp, mouse
gagggagcggagtctaaggt

SEQ ID NO: 526649 - DNA, 20 bp, mouse
ggcctagggagcggagtcta

SEQ ID NO: 526650 - DNA, 20 bp, mouse
gatccgacgccgccatctct

SEQ ID NO: 526651 - DNA, 20 bp, mouse
gcacactcgccccaacgccc

SEQ ID NO: 526652 - DNA, 20 bp, mouse
gccgcgagcggaaggccgag

SEQ ID NO: 526653 - DNA, 20 bp, mouse
gggtagaggccgttgtggga

SEQ ID NO: 526654 - DNA, 20 bp, mouse
ggccgactgggcgcccgggg

SEQ ID NO: 526655 - DNA, 20 bp, mouse
gcgtcggatcccgggcgttg

SEQ ID NO: 526656 - DNA, 20 bp, mouse
gagtacagcaccgacacgga

SEQ ID NO: 526657 - DNA, 20 bp, mouse
gtcagagtacagcaccgaca

SEQ ID NO: 526658 - DNA, 20 bp, mouse
ggcttcccgcaagcccgacg

SEQ ID NO: 526659 - DNA, 20 bp, mouse
gcgctgcgcggaggattgtg

SEQ ID NO: 526660 - DNA, 20 bp, mouse
gggttctgcgacatggacag

SEQ ID NO: 526661 - DNA, 20 bp, mouse
gcagcaccgacacggaaggc

SEQ ID NO: 526662 - DNA, 20 bp, mouse
gttgttccagccttccgtgt

SEQ ID NO: 526663 - DNA, 20 bp, mouse
gcggcctgagggcgactcgc

SEQ ID NO: 526664 - DNA, 20 bp, mouse
ggtgctgtactctgagtctc

SEQ ID NO: 526665 - DNA, 20 bp, mouse
gcgcacgcccgacatgctgg

SEQ ID NO: 526666 - DNA, 20 bp, mouse
gtcctaccggaagtgctgaa

SEQ ID NO: 526667 - DNA, 20 bp, mouse
gcggaggccatgcagactca

SEQ ID NO: 526668 - DNA, 20 bp, mouse
gtgcagaggcgttctcataa

SEQ ID NO: 526669 - DNA, 20 bp, mouse
gggcctccgcatagagtgaa

SEQ ID NO: 526670 - DNA, 20 bp, mouse
ggagagtttggcggtttctc

SEQ ID NO: 526671 - DNA, 20 bp, mouse
gtcccttcagcacttccggt

SEQ ID NO: 526672 - DNA, 20 bp, mouse
gctgtccctcagcttcctac

SEQ ID NO: 526673 - DNA, 20 bp, mouse
gccgcctggctcatttgcag

SEQ ID NO: 526674 - DNA, 20 bp, mouse
gaagatccgagggagaccta

SEQ ID NO: 526675 - DNA, 20 bp, mouse
gttctctggctctgcgctgg

SEQ ID NO: 526676 - DNA, 20 bp, mouse
gccaggagcgcagagtgcta

SEQ ID NO: 526677 - DNA, 20 bp, mouse
gagaacttcacggcactgtt

SEQ ID NO: 526678 - DNA, 20 bp, mouse
gcaaagcctagggcgcttgg

SEQ ID NO: 526679 - DNA, 20 bp, mouse
gagggcgcttggtggcggtg

SEQ ID NO: 526680 - DNA, 20 bp, mouse
ggcaggagcggataagtcga

SEQ ID NO: 526681 - DNA, 20 bp, mouse
ggaattgccaggtgagtagt

SEQ ID NO: 526682 - DNA, 20 bp, mouse
gttcccgcatcaggtagaag

SEQ ID NO: 526683 - DNA, 20 bp, mouse
gtctgcgctcctggttaccc

SEQ ID NO: 526684 - DNA, 20 bp, mouse
gctttccaggcccaaagcct

SEQ ID NO: 526685 - DNA, 20 bp, mouse
ggtaattaacgcccgatccc

SEQ ID NO: 526686 - DNA, 20 bp, mouse
gacggcggccccctaaacac

SEQ ID NO: 526687 - DNA, 20 bp, mouse
gcccatagcgaaggatcaaa

SEQ ID NO: 526688 - DNA, 20 bp, mouse
gatagcgaaggatcaaaagg

SEQ ID NO: 526689 - DNA, 20 bp, mouse
gctggagtctctgagttcga

SEQ ID NO: 526690 - DNA, 20 bp, mouse
gcgccgttcgcgtgaaggtc

SEQ ID NO: 526691 - DNA, 20 bp, mouse
gtctgagttcgagggtttgg

SEQ ID NO: 526692 - DNA, 20 bp, mouse
gctccagaccttcacgcgaa

SEQ ID NO: 526693 - DNA, 20 bp, mouse
gaggttctcggttcctcggg

SEQ ID NO: 526694 - DNA, 20 bp, mouse
ggctatgggagtgacgtggt

SEQ ID NO: 526695 - DNA, 20 bp, mouse
ggtctctgagttcgagggtt

SEQ ID NO: 526696 - DNA, 20 bp, mouse
ggacgctgtgaactcggtga

SEQ ID NO: 526697 - DNA, 20 bp, mouse
gctgcaggacgctgtgaact

SEQ ID NO: 526698 - DNA, 20 bp, mouse
gcttgcgtgcgtggtgaaca

SEQ ID NO: 526699 - DNA, 20 bp, mouse
gaagcaaggctggcgagcag

SEQ ID NO: 526700 - DNA, 20 bp, mouse
gttcctgacgcggagagagg

SEQ ID NO: 526701 - DNA, 20 bp, mouse
ggatagactcactcagctgc

SEQ ID NO: 526702 - DNA, 20 bp, mouse
ggggtctcacgtagtccaca

SEQ ID NO: 526703 - DNA, 20 bp, mouse
gtaagggaggtgggacccgg

SEQ ID NO: 526704 - DNA, 20 bp, mouse
gcctgtcctgaggggagacc

SEQ ID NO: 526705 - DNA, 20 bp, mouse
gtctcacgtagtccacaggg

SEQ ID NO: 526706 - DNA, 20 bp, mouse
ggggaggcgccaggagtgaa

SEQ ID NO: 526707 - DNA, 20 bp, mouse
ggaccgcaggctccgagagg

SEQ ID NO: 526708 - DNA, 20 bp, mouse
ggcccggcagcaggccctta

SEQ ID NO: 526709 - DNA, 20 bp, mouse
gagccgcgggaaggagcgtg

SEQ ID NO: 526710 - DNA, 20 bp, mouse
gcgcaggctccgagaggcgg

SEQ ID NO: 526711 - DNA, 20 bp, mouse
gacccgcacgctccttcccg

SEQ ID NO: 526712 - DNA, 20 bp, mouse
ggtgaacggaagccgcggga

SEQ ID NO: 526713 - DNA, 20 bp, mouse
gcagcaggcccttacggcga

SEQ ID NO: 526714 - DNA, 20 bp, mouse
gggcccgaaccgagtactga

SEQ ID NO: 526715 - DNA, 20 bp, mouse
gaggagtgaacggaagccgc

SEQ ID NO: 526716 - DNA, 20 bp, mouse
ggacagacgggtgagagcca

SEQ ID NO: 526717 - DNA, 20 bp, mouse
ggacgggtgagagccagggt

SEQ ID NO: 526718 - DNA, 20 bp, mouse
gggggaacccggcgacagac

SEQ ID NO: 526719 - DNA, 20 bp, mouse
ggggaaagaatggagcggag

SEQ ID NO: 526720 - DNA, 20 bp, mouse
gatcgagccccgggctcccg

SEQ ID NO: 526721 - DNA, 20 bp, mouse
gtatagaagaggccttccca

SEQ ID NO: 526722 - DNA, 20 bp, mouse
gcggggctcgatggtaccga

SEQ ID NO: 526723 - DNA, 20 bp, mouse
ggacataggcgtctgaaccg

SEQ ID NO: 526724 - DNA, 20 bp, mouse
gtagatctggcagcagtccg

SEQ ID NO: 526725 - DNA, 20 bp, mouse
ggacgcctatgtcaacatag

SEQ ID NO: 526726 - DNA, 20 bp, mouse
gcaaaccggttgtacatcgt

SEQ ID NO: 526727 - DNA, 20 bp, mouse
gtccttagtaggtgtcaaga

SEQ ID NO: 526728 - DNA, 20 bp, mouse
ggatgtacaaccggtttgta

SEQ ID NO: 526729 - DNA, 20 bp, mouse
gttggggagatggtagatgt

SEQ ID NO: 526730 - DNA, 20 bp, mouse
gtacaaccggtttgtatggt

SEQ ID NO: 526731 - DNA, 20 bp, mouse
gtgtatggtaggcttaaatt

SEQ ID NO: 526732 - DNA, 20 bp, mouse
gtcagggccgaggaaggtag

SEQ ID NO: 526733 - DNA, 20 bp, mouse
gccctgaagcgagcaggaaa

SEQ ID NO: 526734 - DNA, 20 bp, mouse
ggccatcttgacacctacta

SEQ ID NO: 526735 - DNA, 20 bp, mouse
gttaagcctaccatacaaac

SEQ ID NO: 526736 - DNA, 20 bp, mouse
ggggacggcgacggcgtcag

SEQ ID NO: 526737 - DNA, 20 bp, mouse
gacttctgttcgtcccggga

SEQ ID NO: 526738 - DNA, 20 bp, mouse
gtcagcggcgctggcgtcgg

SEQ ID NO: 526739 - DNA, 20 bp, mouse
gcggcgcggggcatggtccc

SEQ ID NO: 526740 - DNA, 20 bp, mouse
ggcatggtccccggatccga

SEQ ID NO: 526741 - DNA, 20 bp, mouse
gcaaagacggaggaaaggcg

SEQ ID NO: 526742 - DNA, 20 bp, mouse
gcgccgggccttcggatccg

SEQ ID NO: 526743 - DNA, 20 bp, mouse
ggacggaggaaaggcggggt

SEQ ID NO: 526744 - DNA, 20 bp, mouse
ggttcgtcccgggacggcga

SEQ ID NO: 526745 - DNA, 20 bp, mouse
gacatcggcgaccaggcccc

SEQ ID NO: 526746 - DNA, 20 bp, mouse
ggaggaggaggagccgacgg

SEQ ID NO: 526747 - DNA, 20 bp, mouse
gccaccgccgagcgaggagg

SEQ ID NO: 526748 - DNA, 20 bp, mouse
gtggagtttggttctcgagg

SEQ ID NO: 526749 - DNA, 20 bp, mouse
gagtttggttctcgaggcgg

SEQ ID NO: 526750 - DNA, 20 bp, mouse
gttcgcccaggcaatgacag

SEQ ID NO: 526751 - DNA, 20 bp, mouse
ggtggcggaggctcctccgt

SEQ ID NO: 526752 - DNA, 20 bp, mouse
gttggttctcgaggcggcgg

SEQ ID NO: 526753 - DNA, 20 bp, mouse
gcactggagtttggttctcg

SEQ ID NO: 526754 - DNA, 20 bp, mouse
gttgcctgggcgaagcgggg

SEQ ID NO: 526755 - DNA, 20 bp, mouse
gggagccgctgtcattgcct

SEQ ID NO: 526756 - DNA, 20 bp, mouse
gggctgtgacagctgcaaca

SEQ ID NO: 526757 - DNA, 20 bp, mouse
gtgtgacagctgcaacatgg

SEQ ID NO: 526758 - DNA, 20 bp, mouse
ggtcaaccgggacctcaagt

SEQ ID NO: 526759 - DNA, 20 bp, mouse
gagcctgcgaaaaggcctcc

SEQ ID NO: 526760 - DNA, 20 bp, mouse
ggcgctaatagcctgcgaaa

SEQ ID NO: 526761 - DNA, 20 bp, mouse
gctagagcgtagcgcctgga

SEQ ID NO: 526762 - DNA, 20 bp, mouse
gcgggacctcaagtaggtac

SEQ ID NO: 526763 - DNA, 20 bp, mouse
gaggagagaggcccgtgact

SEQ ID NO: 526764 - DNA, 20 bp, mouse
gggcgggacaggtgccagaa

SEQ ID NO: 526765 - DNA, 20 bp, mouse
gccgctcaggctgtggactc

SEQ ID NO: 526766 - DNA, 20 bp, mouse
gcctgggagggatgttcact

SEQ ID NO: 526767 - DNA, 20 bp, mouse
gcccgccgttgcagacatgg

SEQ ID NO: 526768 - DNA, 20 bp, mouse
ggacgccgccatgtctgcaa

SEQ ID NO: 526769 - DNA, 20 bp, mouse
gacatggcggcgtccctggg

SEQ ID NO: 526770 - DNA, 20 bp, mouse
ggcggcggcgggggacctgg

SEQ ID NO: 526771 - DNA, 20 bp, mouse
gcagacatggcggcgtccct

SEQ ID NO: 526772 - DNA, 20 bp, mouse
gccgcccgccgttgcagaca

SEQ ID NO: 526773 - DNA, 20 bp, mouse
gacaggtagtacccaatcta

SEQ ID NO: 526774 - DNA, 20 bp, mouse
gcggcgggcggaaacgacac

SEQ ID NO: 526775 - DNA, 20 bp, mouse
gtgttcactgggcagcctcc

SEQ ID NO: 526776 - DNA, 20 bp, mouse
gcgcatttccggcgttctag

SEQ ID NO: 526777 - DNA, 20 bp, mouse
gcctgcgcggggagcaagag

SEQ ID NO: 526778 - DNA, 20 bp, mouse
gttgttgaaggagagatcgt

SEQ ID NO: 526779 - DNA, 20 bp, mouse
gtaaggcatggctaactagg

SEQ ID NO: 526780 - DNA, 20 bp, mouse
gtgctggggacccggacccc

SEQ ID NO: 526781 - DNA, 20 bp, mouse
gccgcgcagggcccatcacc

SEQ ID NO: 526782 - DNA, 20 bp, mouse
ggctgaccggagcttcactt

SEQ ID NO: 526783 - DNA, 20 bp, mouse
gcaactgaaggagagtctcc

SEQ ID NO: 526784 - DNA, 20 bp, mouse
gcggtaaggcatggctaact

SEQ ID NO: 526785 - DNA, 20 bp, mouse
ggtcataaatgcgtctgctc

SEQ ID NO: 526786 - DNA, 20 bp, mouse
ggtggacatggcacccccgg

SEQ ID NO: 526787 - DNA, 20 bp, mouse
gcccgtgggcgccagcggag

SEQ ID NO: 526788 - DNA, 20 bp, mouse
gggtccggcgcgagcccact

SEQ ID NO: 526789 - DNA, 20 bp, mouse
gcggtacagcgcttgcatcg

SEQ ID NO: 526790 - DNA, 20 bp, mouse
gtacagcgcttgcatcgcgg

SEQ ID NO: 526791 - DNA, 20 bp, mouse
gtcggccgatttcaaaaaag

SEQ ID NO: 526792 - DNA, 20 bp, mouse
ggccgcgcgcgaggtcaaca

SEQ ID NO: 526793 - DNA, 20 bp, mouse
ggccggacccgagccgccgg

SEQ ID NO: 526794 - DNA, 20 bp, mouse
gacccccggcggctcgggtc

SEQ ID NO: 526795 - DNA, 20 bp, mouse
gccacacctgcggcctctca

SEQ ID NO: 526796 - DNA, 20 bp, mouse
gcgaagtcgcggttcggtcg

SEQ ID NO: 526797 - DNA, 20 bp, mouse
gagagccagggttggagtag

SEQ ID NO: 526798 - DNA, 20 bp, mouse
gcccttggggtgaagactcg

SEQ ID NO: 526799 - DNA, 20 bp, mouse
gtccttagagttgggaccgg

SEQ ID NO: 526800 - DNA, 20 bp, mouse
gcggccccaagagccagggt

SEQ ID NO: 526801 - DNA, 20 bp, mouse
gtccgccggtcccaactcta

SEQ ID NO: 526802 - DNA, 20 bp, mouse
gcgaccggaagtaggagccg

SEQ ID NO: 526803 - DNA, 20 bp, mouse
gaccgaaccgcgacttcgat

SEQ ID NO: 526804 - DNA, 20 bp, mouse
ggcatccttagagttgggac

SEQ ID NO: 526805 - DNA, 20 bp, mouse
gaccaatcgaagtcgcggtt

SEQ ID NO: 526806 - DNA, 20 bp, mouse
ggtggtcagcggggcgatgg

SEQ ID NO: 526807 - DNA, 20 bp, mouse
gcgatggcggcttcttcaag

SEQ ID NO: 526808 - DNA, 20 bp, mouse
ggctcacactgcgcatgcga

SEQ ID NO: 526809 - DNA, 20 bp, mouse
gcggctgtgggcgctgactt

SEQ ID NO: 526810 - DNA, 20 bp, mouse
gcctccccttgactactggg

SEQ ID NO: 526811 - DNA, 20 bp, mouse
gtggggtctagggccttcgg

SEQ ID NO: 526812 - DNA, 20 bp, mouse
gccctagaccccacgtccaa

SEQ ID NO: 526813 - DNA, 20 bp, mouse
gggaggctccgttggacgtg

SEQ ID NO: 526814 - DNA, 20 bp, mouse
gtcacatgacctggaaacca

SEQ ID NO: 526815 - DNA, 20 bp, mouse
ggccaacacgaaggagccca

SEQ ID NO: 526816 - DNA, 20 bp, mouse
gtggcggcggtggatatccg

SEQ ID NO: 526817 - DNA, 20 bp, mouse
gtccttccggcgcacagtaa

SEQ ID NO: 526818 - DNA, 20 bp, mouse
gagcgcttttggaattatgg

SEQ ID NO: 526819 - DNA, 20 bp, mouse
gagtaaaccacaatctggta

SEQ ID NO: 526820 - DNA, 20 bp, mouse
ggtggctcctggatacccta

SEQ ID NO: 526821 - DNA, 20 bp, mouse
gaccccagtaaaccacaatc

SEQ ID NO: 526822 - DNA, 20 bp, mouse
gtatagcgcttttggaatta

SEQ ID NO: 526823 - DNA, 20 bp, mouse
gcgctataagagcctccttc

SEQ ID NO: 526824 - DNA, 20 bp, mouse
ggtccggggacccataaggt

SEQ ID NO: 526825 - DNA, 20 bp, mouse
gagcataaaattaattacct

SEQ ID NO: 526826 - DNA, 20 bp, mouse
gaagagctgaggtgagcggg

SEQ ID NO: 526827 - DNA, 20 bp, mouse
ggggagagacgcaaccgcgg

SEQ ID NO: 526828 - DNA, 20 bp, mouse
ggccgggagagacgcaaccg

SEQ ID NO: 526829 - DNA, 20 bp, mouse
gagagacgcaaccgcggggg

SEQ ID NO: 526830 - DNA, 20 bp, mouse
ggcttcgcggaggaaccggg

SEQ ID NO: 526831 - DNA, 20 bp, mouse
gtagccgcctgggagcgcgg

SEQ ID NO: 526832 - DNA, 20 bp, mouse
gaagaaagagctgaggtgag

SEQ ID NO: 526833 - DNA, 20 bp, mouse
ggcttgtcgtccggagagag

SEQ ID NO: 526834 - DNA, 20 bp, mouse
ggtccggagagagcggtact

SEQ ID NO: 526835 - DNA, 20 bp, mouse
gccccggggaggcttcgcgg

SEQ ID NO: 526836 - DNA, 20 bp, mouse
gcgctggcgggagggtgatt

SEQ ID NO: 526837 - DNA, 20 bp, mouse
gtgcaggtgagaagcgggtt

SEQ ID NO: 526838 - DNA, 20 bp, mouse
ggccgtgcgagaaaccggaa

SEQ ID NO: 526839 - DNA, 20 bp, mouse
ggagaaaccggaaagggaag

SEQ ID NO: 526840 - DNA, 20 bp, mouse
gcctcccgccagcggctata

SEQ ID NO: 526841 - DNA, 20 bp, mouse
ggctcacagccccaactccc

SEQ ID NO: 526842 - DNA, 20 bp, mouse
gcgccgggccgcggcaatgc

SEQ ID NO: 526843 - DNA, 20 bp, mouse
ggaaggctcgggaaagtagt

SEQ ID NO: 526844 - DNA, 20 bp, mouse
ggcgtggaaaaggatcgtgg

SEQ ID NO: 526845 - DNA, 20 bp, mouse
gtgaggacaccggggagttg

SEQ ID NO: 526846 - DNA, 20 bp, mouse
gactccggcagcagctcggg

SEQ ID NO: 526847 - DNA, 20 bp, mouse
gtggactccggcagcagctc

SEQ ID NO: 526848 - DNA, 20 bp, mouse
gggtggctgtagcgtatctt

SEQ ID NO: 526849 - DNA, 20 bp, mouse
gcagcgaccggcagaggctg

SEQ ID NO: 526850 - DNA, 20 bp, mouse
gcagtacgtgggcttcaccc

SEQ ID NO: 526851 - DNA, 20 bp, mouse
gtcccccgctggcgcgaagg

SEQ ID NO: 526852 - DNA, 20 bp, mouse
gatggcttcctctggggtgg

SEQ ID NO: 526853 - DNA, 20 bp, mouse
gtgatgacattgtgaaccaa

SEQ ID NO: 526854 - DNA, 20 bp, mouse
gcaatgtcatcaaatggtaa

SEQ ID NO: 526855 - DNA, 20 bp, mouse
gagcgcccctcggcagctgc

SEQ ID NO: 526856 - DNA, 20 bp, mouse
gtgcctgcagcgctccacaa

SEQ ID NO: 526857 - DNA, 20 bp, mouse
gcaagggtgggcaaccttca

SEQ ID NO: 526858 - DNA, 20 bp, mouse
gctgcagcgctccacaaggg

SEQ ID NO: 526859 - DNA, 20 bp, mouse
gaaccttcaaggtgacaaga

SEQ ID NO: 526860 - DNA, 20 bp, mouse
ggtctgtcccgagctacctt

SEQ ID NO: 526861 - DNA, 20 bp, mouse
gtgcaagtagtaagtagctc

SEQ ID NO: 526862 - DNA, 20 bp, mouse
gagctccccggatgaaatgg

SEQ ID NO: 526863 - DNA, 20 bp, mouse
gagccctcttgtcaccttga

SEQ ID NO: 526864 - DNA, 20 bp, mouse
gaccctgagggtcgctaagt

SEQ ID NO: 526865 - DNA, 20 bp, mouse
gcggggagctgcgcagtctg

SEQ ID NO: 526866 - DNA, 20 bp, mouse
gtgaaggaggcggctccggg

SEQ ID NO: 526867 - DNA, 20 bp, mouse
gggatgtcccggcgagtccc

SEQ ID NO: 526868 - DNA, 20 bp, mouse
ggagtctccgctactgccgg

SEQ ID NO: 526869 - DNA, 20 bp, mouse
ggcgcgcccgccggcagtag

SEQ ID NO: 526870 - DNA, 20 bp, mouse
ggagccgcctccttcagccc

SEQ ID NO: 526871 - DNA, 20 bp, mouse
ggatccgtgcgcggatgtcc

SEQ ID NO: 526872 - DNA, 20 bp, mouse
ggggctgcgaggccgaggag

SEQ ID NO: 526873 - DNA, 20 bp, mouse
gccggcgagtcccgggctga

SEQ ID NO: 526874 - DNA, 20 bp, mouse
gcggcctcgcagcccctccg

SEQ ID NO: 526875 - DNA, 20 bp, mouse
gcggcgcggagtgctgtggc

SEQ ID NO: 526876 - DNA, 20 bp, mouse
gctgctggctgccttcacta

SEQ ID NO: 526877 - DNA, 20 bp, mouse
gggcccctccaacccctcta

SEQ ID NO: 526878 - DNA, 20 bp, mouse
ggccagcagagcccagaaac

SEQ ID NO: 526879 - DNA, 20 bp, mouse
gtcaggttcttccatagtga

SEQ ID NO: 526880 - DNA, 20 bp, mouse
gtagcagggagtccttgacg

SEQ ID NO: 526881 - DNA, 20 bp, mouse
ggaccctagaggggttggag

SEQ ID NO: 526882 - DNA, 20 bp, mouse
gggttggaggggcctagaga

SEQ ID NO: 526883 - DNA, 20 bp, mouse
gtgcgggaccctagaggggt

SEQ ID NO: 526884 - DNA, 20 bp, mouse
gggtgttgcgggaccctaga

SEQ ID NO: 526885 - DNA, 20 bp, mouse
gacctcccggcgggagacac

SEQ ID NO: 526886 - DNA, 20 bp, mouse
gtagcagcccgaagatgtct

SEQ ID NO: 526887 - DNA, 20 bp, mouse
ggcgtacacccagacatctt

SEQ ID NO: 526888 - DNA, 20 bp, mouse
gaggcgagcgagcagagagc

SEQ ID NO: 526889 - DNA, 20 bp, mouse
gcccagtgcctggaagagat

SEQ ID NO: 526890 - DNA, 20 bp, mouse
ggactttgaaggttctgtgt

SEQ ID NO: 526891 - DNA, 20 bp, mouse
ggtcagaggtacttacatga

SEQ ID NO: 526892 - DNA, 20 bp, mouse
gcaagtggagaagcacttca

SEQ ID NO: 526893 - DNA, 20 bp, mouse
gaatattccaaggactaatt

SEQ ID NO: 526894 - DNA, 20 bp, mouse
ggctattggattgactttga

SEQ ID NO: 526895 - DNA, 20 bp, mouse
ggatagatagacccagtgcc

SEQ ID NO: 526896 - DNA, 20 bp, mouse
gccagactcgaggccgacgt

SEQ ID NO: 526897 - DNA, 20 bp, mouse
gtcctcctttcgggctccaa

SEQ ID NO: 526898 - DNA, 20 bp, mouse
gggctgcgcggtgcctacgt

SEQ ID NO: 526899 - DNA, 20 bp, mouse
gccacagggccgggaccccc

SEQ ID NO: 526900 - DNA, 20 bp, mouse
gctagcttgcgagatgggag

SEQ ID NO: 526901 - DNA, 20 bp, mouse
gccaaggcgcgaggcgacgg

SEQ ID NO: 526902 - DNA, 20 bp, mouse
gctccgacgggaaacagcga

SEQ ID NO: 526903 - DNA, 20 bp, mouse
gagcgcccaagccgcctcga

SEQ ID NO: 526904 - DNA, 20 bp, mouse
gcgcgtccacgcggcctggg

SEQ ID NO: 526905 - DNA, 20 bp, mouse
gcgcgcggccgggctcaggg

SEQ ID NO: 526906 - DNA, 20 bp, mouse
ggggactgcagccagctatg

SEQ ID NO: 526907 - DNA, 20 bp, mouse
ggccatggtgcgggccagga

SEQ ID NO: 526908 - DNA, 20 bp, mouse
gtagggcagcagctcctcca

SEQ ID NO: 526909 - DNA, 20 bp, mouse
gaagggtcttggccatggtg

SEQ ID NO: 526910 - DNA, 20 bp, mouse
gtccctcctggcccgcacca

SEQ ID NO: 526911 - DNA, 20 bp, mouse
gtttagcagatgatcaccaa

SEQ ID NO: 526912 - DNA, 20 bp, mouse
gctcggactgaagtggacag

SEQ ID NO: 526913 - DNA, 20 bp, mouse
gcggggaggagtatgctgta

SEQ ID NO: 526914 - DNA, 20 bp, mouse
gcccgtagtaggttatcaga

SEQ ID NO: 526915 - DNA, 20 bp, mouse
ggtggcccgcaggatctgca

SEQ ID NO: 526916 - DNA, 20 bp, mouse
gcaggcctccacgaaccgag

SEQ ID NO: 526917 - DNA, 20 bp, mouse
ggacgggacggagaaaggat

SEQ ID NO: 526918 - DNA, 20 bp, mouse
ggggagcgcaaaagtgggac

SEQ ID NO: 526919 - DNA, 20 bp, mouse
gagtgagggagcgcaaaagt

SEQ ID NO: 526920 - DNA, 20 bp, mouse
ggctgccgctcggttcgtgg

SEQ ID NO: 526921 - DNA, 20 bp, mouse
gagtgggacgggacggagaa

SEQ ID NO: 526922 - DNA, 20 bp, mouse
gacagcgcgtccctggagtg

SEQ ID NO: 526923 - DNA, 20 bp, mouse
gcggagaaaggatggggatc

SEQ ID NO: 526924 - DNA, 20 bp, mouse
gcagtcacttagctgccgct

SEQ ID NO: 526925 - DNA, 20 bp, mouse
gaaaggatggggatcaggcc

SEQ ID NO: 526926 - DNA, 20 bp, mouse
gctataccccggagccggag

SEQ ID NO: 526927 - DNA, 20 bp, mouse
gggagcggcttcaggtcccc

SEQ ID NO: 526928 - DNA, 20 bp, mouse
ggccgtggcagcagtcgcag

SEQ ID NO: 526929 - DNA, 20 bp, mouse
ggtcgcgcggtcctataccc

SEQ ID NO: 526930 - DNA, 20 bp, mouse
gctgcgaaccgccccgagcc

SEQ ID NO: 526931 - DNA, 20 bp, mouse
gcggcttcaggtccccaggc

SEQ ID NO: 526932 - DNA, 20 bp, mouse
gcgttctcagtgcccggagc

SEQ ID NO: 526933 - DNA, 20 bp, mouse
gtagagccgggacctggcca

SEQ ID NO: 526934 - DNA, 20 bp, mouse
ggccaggtcccggctctaga

SEQ ID NO: 526935 - DNA, 20 bp, mouse
gcctggccacggaggaccca

SEQ ID NO: 526936 - DNA, 20 bp, mouse
gccgagcgcgaaggtctcgg

SEQ ID NO: 526937 - DNA, 20 bp, mouse
ggtttgctctccatcactcc

SEQ ID NO: 526938 - DNA, 20 bp, mouse
ggcgggacgcagcagacgtc

SEQ ID NO: 526939 - DNA, 20 bp, mouse
ggaaccgagcgcgaaggtct

SEQ ID NO: 526940 - DNA, 20 bp, mouse
gcagcgtctactggccgtaa

SEQ ID NO: 526941 - DNA, 20 bp, mouse
gacgggcgccatacccccag

SEQ ID NO: 526942 - DNA, 20 bp, mouse
gggttcccgcaggtgcagat

SEQ ID NO: 526943 - DNA, 20 bp, mouse
ggcgaaggtctcggaggtcc

SEQ ID NO: 526944 - DNA, 20 bp, mouse
gcttcgcgctcggttcggcg

SEQ ID NO: 526945 - DNA, 20 bp, mouse
gtgggaggctgcaggcacgg

SEQ ID NO: 526946 - DNA, 20 bp, mouse
ggagccgcgcagcctctgag

SEQ ID NO: 526947 - DNA, 20 bp, mouse
ggctaggaggaggcgagaag

SEQ ID NO: 526948 - DNA, 20 bp, mouse
gcagcctctgaggggaggac

SEQ ID NO: 526949 - DNA, 20 bp, mouse
gacccgctgagagggcgagg

SEQ ID NO: 526950 - DNA, 20 bp, mouse
ggggagacccctccagacgg

SEQ ID NO: 526951 - DNA, 20 bp, mouse
ggcgagaagaggaagagcgg

SEQ ID NO: 526952 - DNA, 20 bp, mouse
gagcggccctgagaggacta

SEQ ID NO: 526953 - DNA, 20 bp, mouse
gggagactcccgggccagag

SEQ ID NO: 526954 - DNA, 20 bp, mouse
ggaagagcggcgggtcagag

SEQ ID NO: 526955 - DNA, 20 bp, mouse
gcctggcccggagactcctg

SEQ ID NO: 526956 - DNA, 20 bp, mouse
ggcgatggtgctcttggtgg

SEQ ID NO: 526957 - DNA, 20 bp, mouse
ggcggccgcgcagcacaaca

SEQ ID NO: 526958 - DNA, 20 bp, mouse
ggggccggccgcctgtcaga

SEQ ID NO: 526959 - DNA, 20 bp, mouse
ggaggtggcgatggtgctct

SEQ ID NO: 526960 - DNA, 20 bp, mouse
gcggcagggaatgtcaccgg

SEQ ID NO: 526961 - DNA, 20 bp, mouse
gatcgccacctccctctgac

SEQ ID NO: 526962 - DNA, 20 bp, mouse
gcctccctgccgtccgacca

SEQ ID NO: 526963 - DNA, 20 bp, mouse
gccgcgggcgggcctcaacg

SEQ ID NO: 526964 - DNA, 20 bp, mouse
gcctcggcagggaatgtcac

SEQ ID NO: 526965 - DNA, 20 bp, mouse
gcaacgcggagggagcgact

SEQ ID NO: 526966 - DNA, 20 bp, mouse
ggtggctgcggggcagatga

SEQ ID NO: 526967 - DNA, 20 bp, mouse
gctgcgctgcagagccgggg

SEQ ID NO: 526968 - DNA, 20 bp, mouse
gcagagccggggaggcgagg

SEQ ID NO: 526969 - DNA, 20 bp, mouse
gaggcgaggaggtggctgcg

SEQ ID NO: 526970 - DNA, 20 bp, mouse
gaacctgcgctgcagagccg

SEQ ID NO: 526971 - DNA, 20 bp, mouse
gctcaggcgagactgaaggt

SEQ ID NO: 526972 - DNA, 20 bp, mouse
gcagagccctcaggagggta

SEQ ID NO: 526973 - DNA, 20 bp, mouse
gatctctcccaaacgcggga

SEQ ID NO: 526974 - DNA, 20 bp, mouse
ggaagctggcttgctgagga

SEQ ID NO: 526975 - DNA, 20 bp, mouse
ggagcccctggatacctcca

SEQ ID NO: 526976 - DNA, 20 bp, mouse
ggcaagcgcagcccgcaggt

SEQ ID NO: 526977 - DNA, 20 bp, mouse
gggctctggcgcctacctgc

SEQ ID NO: 526978 - DNA, 20 bp, mouse
gaaggaaggacgccctcagg

SEQ ID NO: 526979 - DNA, 20 bp, mouse
gcgtgcatggccgggaatac

SEQ ID NO: 526980 - DNA, 20 bp, mouse
gccgggaggagtggcgctct

SEQ ID NO: 526981 - DNA, 20 bp, mouse
gggagtggcgctctgggctc

SEQ ID NO: 526982 - DNA, 20 bp, mouse
gaggcgacctacctccgcaa

SEQ ID NO: 526983 - DNA, 20 bp, mouse
ggcactggaagaaagccggg

SEQ ID NO: 526984 - DNA, 20 bp, mouse
ggaaggacgccctcaggcgg

SEQ ID NO: 526985 - DNA, 20 bp, mouse
gtgcatcagcgtgcatggcc

SEQ ID NO: 526986 - DNA, 20 bp, mouse
ggcctcgcaggagggcgcag

SEQ ID NO: 526987 - DNA, 20 bp, mouse
gtgcgaggccggctgaacga

SEQ ID NO: 526988 - DNA, 20 bp, mouse
gttcagccggcctcgcagga

SEQ ID NO: 526989 - DNA, 20 bp, mouse
gggctgaacgagggtaatcg

SEQ ID NO: 526990 - DNA, 20 bp, mouse
gggagacgcgccggttacac

SEQ ID NO: 526991 - DNA, 20 bp, mouse
gaccgctgcgccctcctgcg

SEQ ID NO: 526992 - DNA, 20 bp, mouse
gagccaggggccaactgtta

SEQ ID NO: 526993 - DNA, 20 bp, mouse
gggtgttcgtgttctctact

SEQ ID NO: 526994 - DNA, 20 bp, mouse
gaaacatcgtgatatatggg

SEQ ID NO: 526995 - DNA, 20 bp, mouse
gaccagaagggagtgcttga

SEQ ID NO: 526996 - DNA, 20 bp, mouse
gggaaggcctagagcgtgac

SEQ ID NO: 526997 - DNA, 20 bp, mouse
gaacggtcggggactccagg

SEQ ID NO: 526998 - DNA, 20 bp, mouse
gggccttcccacagcccggt

SEQ ID NO: 526999 - DNA, 20 bp, mouse
ggcccgctaggtgacccacg

SEQ ID NO: 527000 - DNA, 20 bp, mouse
ggcgtcaggtggaaccccgt

SEQ ID NO: 527001 - DNA, 20 bp, mouse
ggctaacggtcggggactcc

SEQ ID NO: 527002 - DNA, 20 bp, mouse
gcgcccaccgggctgtggga

SEQ ID NO: 527003 - DNA, 20 bp, mouse
gcggggctcgagctaacggt

SEQ ID NO: 527004 - DNA, 20 bp, mouse
gtccaggcggttcgcccacc

SEQ ID NO: 527005 - DNA, 20 bp, mouse
gtagcgggcccggaagtatc

SEQ ID NO: 527006 - DNA, 20 bp, mouse
gaagcgggcagcatcgatcg

SEQ ID NO: 527007 - DNA, 20 bp, mouse
gacgcacggcgactgcaagc

SEQ ID NO: 527008 - DNA, 20 bp, mouse
gcactgaagggagattagag

SEQ ID NO: 527009 - DNA, 20 bp, mouse
gtgaagggagattagagagg

SEQ ID NO: 527010 - DNA, 20 bp, mouse
ggtgtgttgcacaggcggag

SEQ ID NO: 527011 - DNA, 20 bp, mouse
gcacacactttacacacgca

SEQ ID NO: 527012 - DNA, 20 bp, mouse
gtgctagaacccggaagtag

SEQ ID NO: 527013 - DNA, 20 bp, mouse
gcgggttctagcattctggt

SEQ ID NO: 527014 - DNA, 20 bp, mouse
gctgtctgagtttgtcttaa

SEQ ID NO: 527015 - DNA, 20 bp, mouse
gtcaaggaaagcgggcgcta

SEQ ID NO: 527016 - DNA, 20 bp, mouse
ggctccagctccccactctc

SEQ ID NO: 527017 - DNA, 20 bp, mouse
gggagacacatcccgagagt

SEQ ID NO: 527018 - DNA, 20 bp, mouse
ggccatagcccgtcctacgg

SEQ ID NO: 527019 - DNA, 20 bp, mouse
ggtggccatagcccgtccta

SEQ ID NO: 527020 - DNA, 20 bp, mouse
gcgcactcgctgcatatcag

SEQ ID NO: 527021 - DNA, 20 bp, mouse
gtgacggaacccggaagtcg

SEQ ID NO: 527022 - DNA, 20 bp, mouse
gcggaacccggaagtcgtgg

SEQ ID NO: 527023 - DNA, 20 bp, mouse
gtgtgtctccgccgtaggac

SEQ ID NO: 527024 - DNA, 20 bp, mouse
gcgggatgtgtctccgccgt

SEQ ID NO: 527025 - DNA, 20 bp, mouse
gcggcgggagaacgaaatga

SEQ ID NO: 527026 - DNA, 20 bp, mouse
gtccgagtggccaagacccg

SEQ ID NO: 527027 - DNA, 20 bp, mouse
ggccgggcccgtgtgagcgg

SEQ ID NO: 527028 - DNA, 20 bp, mouse
ggggtgccagggtctccgag

SEQ ID NO: 527029 - DNA, 20 bp, mouse
gggatcgcggccgagggtgg

SEQ ID NO: 527030 - DNA, 20 bp, mouse
gcaggccgggcccgtgtgag

SEQ ID NO: 527031 - DNA, 20 bp, mouse
gcacggcctggagctcatcg

SEQ ID NO: 527032 - DNA, 20 bp, mouse
ggccagacaagggagagcag

SEQ ID NO: 527033 - DNA, 20 bp, mouse
ggcggctcctccgctcacac

SEQ ID NO: 527034 - DNA, 20 bp, mouse
gaggtccccgccgggtgcca

SEQ ID NO: 527035 - DNA, 20 bp, mouse
gggccaagacccgcggatcg

SEQ ID NO: 527036 - DNA, 20 bp, mouse
gtagcaaagccggaacaagt

SEQ ID NO: 527037 - DNA, 20 bp, mouse
gcaggaccgaacaggacaga

SEQ ID NO: 527038 - DNA, 20 bp, mouse
gggaccgaacaggaccgaac

SEQ ID NO: 527039 - DNA, 20 bp, mouse
gggcccagcaaggaccgaac

SEQ ID NO: 527040 - DNA, 20 bp, mouse
gtcctgcgctcaggaaggta

SEQ ID NO: 527041 - DNA, 20 bp, mouse
gcaaagccggaacaagtcgg

SEQ ID NO: 527042 - DNA, 20 bp, mouse
gccagagtgcggcccgagga

SEQ ID NO: 527043 - DNA, 20 bp, mouse
gtcctgagcgcaggagatac

SEQ ID NO: 527044 - DNA, 20 bp, mouse
gctgcagagtctagcaaagc

SEQ ID NO: 527045 - DNA, 20 bp, mouse
gaattcccaccgacttgttc

SEQ ID NO: 527046 - DNA, 20 bp, mouse
gcatcctcgtgcaccatagg

SEQ ID NO: 527047 - DNA, 20 bp, mouse
gcgtgcaccataggcggcac

SEQ ID NO: 527048 - DNA, 20 bp, mouse
gtgcacgaggatgaatgagg

SEQ ID NO: 527049 - DNA, 20 bp, mouse
gtggtgcacgaggatgaatg

SEQ ID NO: 527050 - DNA, 20 bp, mouse
gggcttcccggcagaccact

SEQ ID NO: 527051 - DNA, 20 bp, mouse
gtcccggcagaccactcggt

SEQ ID NO: 527052 - DNA, 20 bp, mouse
gaccagcccggcccaggagg

SEQ ID NO: 527053 - DNA, 20 bp, mouse
gaggatgaatgaggaggcgg

SEQ ID NO: 527054 - DNA, 20 bp, mouse
gcgctgggtgccccaagggt

SEQ ID NO: 527055 - DNA, 20 bp, mouse
gcgcccctggaaggagtgac

SEQ ID NO: 527056 - DNA, 20 bp, mouse
ggggatgtaagcgcggaggt

SEQ ID NO: 527057 - DNA, 20 bp, mouse
ggtgtgggatgtaagcgcgg

SEQ ID NO: 527058 - DNA, 20 bp, mouse
ggcgccgcggtgccttgtgt

SEQ ID NO: 527059 - DNA, 20 bp, mouse
gccgaagccgggactctcct

SEQ ID NO: 527060 - DNA, 20 bp, mouse
gcatcccacacaaggcaccg

SEQ ID NO: 527061 - DNA, 20 bp, mouse
gtctccttgggacttgtggg

SEQ ID NO: 527062 - DNA, 20 bp, mouse
gccgtgagcacaggacgaag

SEQ ID NO: 527063 - DNA, 20 bp, mouse
gagcgcggaggtgggcgcgg

SEQ ID NO: 527064 - DNA, 20 bp, mouse
ggggccgggtagagattgta

SEQ ID NO: 527065 - DNA, 20 bp, mouse
gcttgtgtgggatgtaagcg

SEQ ID NO: 527066 - DNA, 20 bp, mouse
gcactcagggtccccgggaa

SEQ ID NO: 527067 - DNA, 20 bp, mouse
ggtatgggtgggtccaaggt

SEQ ID NO: 527068 - DNA, 20 bp, mouse
gtactgacaagcccttcccg

SEQ ID NO: 527069 - DNA, 20 bp, mouse
gagggcttgtcagtatgggt

SEQ ID NO: 527070 - DNA, 20 bp, mouse
ggtgaatgagtgcctgcaga

SEQ ID NO: 527071 - DNA, 20 bp, mouse
ggcagacgtgaagcctagac

SEQ ID NO: 527072 - DNA, 20 bp, mouse
ggatagtcagcgtgtgtcgg

SEQ ID NO: 527073 - DNA, 20 bp, mouse
gacacgctgactatcgggca

SEQ ID NO: 527074 - DNA, 20 bp, mouse
gtgcgtgtccacacctgtct

SEQ ID NO: 527075 - DNA, 20 bp, mouse
gcctgccccagtcctttcaa

SEQ ID NO: 527076 - DNA, 20 bp, mouse
gctgcgaaggaagctcctcc

SEQ ID NO: 527077 - DNA, 20 bp, mouse
gctgctcagatgtcaagtgt

SEQ ID NO: 527078 - DNA, 20 bp, mouse
gtgcaggagactggccgcta

SEQ ID NO: 527079 - DNA, 20 bp, mouse
gagaggtggaagccaaaaga

SEQ ID NO: 527080 - DNA, 20 bp, mouse
gccaaagagggggtgttcca

SEQ ID NO: 527081 - DNA, 20 bp, mouse
gtggagggccagagaagact

SEQ ID NO: 527082 - DNA, 20 bp, mouse
gtcctgcacgtataaacact

SEQ ID NO: 527083 - DNA, 20 bp, mouse
gtcccagtcctgagccttag

SEQ ID NO: 527084 - DNA, 20 bp, mouse
gagactggccgctaaggctc

SEQ ID NO: 527085 - DNA, 20 bp, mouse
gtgccagccagcatcacagg

SEQ ID NO: 527086 - DNA, 20 bp, mouse
gtaccgatacagctgctatg

SEQ ID NO: 527087 - DNA, 20 bp, mouse
gtcagtgagagaagacacgc

SEQ ID NO: 527088 - DNA, 20 bp, mouse
ggcccacatagcagctgtat

SEQ ID NO: 527089 - DNA, 20 bp, mouse
gaatgggtaacaggctacaa

SEQ ID NO: 527090 - DNA, 20 bp, mouse
gggatgctcttaaatatcta

SEQ ID NO: 527091 - DNA, 20 bp, mouse
gcttaaatatctatggaagt

SEQ ID NO: 527092 - DNA, 20 bp, mouse
gttctgagttgtcttcaaca

SEQ ID NO: 527093 - DNA, 20 bp, mouse
gcagatcacgatacagatgt

SEQ ID NO: 527094 - DNA, 20 bp, mouse
gttcatttgcaataatgctt

SEQ ID NO: 527095 - DNA, 20 bp, mouse
gtttttatggcaaggaggct

SEQ ID NO: 527096 - DNA, 20 bp, mouse
gatgccgggcatccatactg

SEQ ID NO: 527097 - DNA, 20 bp, mouse
gctgcaagctatggcagtca

SEQ ID NO: 527098 - DNA, 20 bp, mouse
gggatgcccggcatcagcct

SEQ ID NO: 527099 - DNA, 20 bp, mouse
gagatgaaagctgcaagcta

SEQ ID NO: 527100 - DNA, 20 bp, mouse
ggtttttgccacatttctcc

SEQ ID NO: 527101 - DNA, 20 bp, mouse
gtttctcctggtttctggtt

SEQ ID NO: 527102 - DNA, 20 bp, mouse
gcggcatcagccttggtttc

SEQ ID NO: 527103 - DNA, 20 bp, mouse
gactgagaataacttgacac

SEQ ID NO: 527104 - DNA, 20 bp, mouse
gacaaacaattatcactcaa

SEQ ID NO: 527105 - DNA, 20 bp, mouse
ggaaaattgtcagaaaaact

SEQ ID NO: 527106 - DNA, 20 bp, mouse
ggtgcgatcccacccaccgt

SEQ ID NO: 527107 - DNA, 20 bp, mouse
gtagagccgggcggagacgg

SEQ ID NO: 527108 - DNA, 20 bp, mouse
ggaacaagggtcgggtgtca

SEQ ID NO: 527109 - DNA, 20 bp, mouse
gttcctcaggaacaagggtc

SEQ ID NO: 527110 - DNA, 20 bp, mouse
gacccaccgtaggcggggaa

SEQ ID NO: 527111 - DNA, 20 bp, mouse
ggtttagagccgggcggaga

SEQ ID NO: 527112 - DNA, 20 bp, mouse
gggagtgcgaaccaacttaa

SEQ ID NO: 527113 - DNA, 20 bp, mouse
gcccgttccccgcctacggt

SEQ ID NO: 527114 - DNA, 20 bp, mouse
gcggcggagcctcattcctc

SEQ ID NO: 527115 - DNA, 20 bp, mouse
gagctcccgttccccgccta

SEQ ID NO: 527116 - DNA, 20 bp, mouse
ggaaggcaattctccatgag

SEQ ID NO: 527117 - DNA, 20 bp, mouse
gtgtctctcgctgcccctca

SEQ ID NO: 527118 - DNA, 20 bp, mouse
gctgttctgtacagtaggtg

SEQ ID NO: 527119 - DNA, 20 bp, mouse
gcctgaaggtgaatgacgcc

SEQ ID NO: 527120 - DNA, 20 bp, mouse
gttcttcgggcttagtctct

SEQ ID NO: 527121 - DNA, 20 bp, mouse
gagcaagcacttctgacaga

SEQ ID NO: 527122 - DNA, 20 bp, mouse
gaatccttagcagtacggta

SEQ ID NO: 527123 - DNA, 20 bp, mouse
gcaggaaagcttggcttctt

SEQ ID NO: 527124 - DNA, 20 bp, mouse
ggatgcagtcccagttaatg

SEQ ID NO: 527125 - DNA, 20 bp, mouse
ggaactctatttaaacttca

SEQ ID NO: 527126 - DNA, 20 bp, mouse
ggtgcgaagcgcctcagtcc

SEQ ID NO: 527127 - DNA, 20 bp, mouse
gcaaactcgccagtcgccga

SEQ ID NO: 527128 - DNA, 20 bp, mouse
ggagccgtagagggttatgg

SEQ ID NO: 527129 - DNA, 20 bp, mouse
gactctggcgcctgctgccc

SEQ ID NO: 527130 - DNA, 20 bp, mouse
gcaactccgcactgccactc

SEQ ID NO: 527131 - DNA, 20 bp, mouse
gtacccgcgctctggagtgg

SEQ ID NO: 527132 - DNA, 20 bp, mouse
gctggcgcctgctgcccggg

SEQ ID NO: 527133 - DNA, 20 bp, mouse
ggcaccccaagacccggcta

SEQ ID NO: 527134 - DNA, 20 bp, mouse
gtgcaggttgcagggtctcc

SEQ ID NO: 527135 - DNA, 20 bp, mouse
gagacgtgcaccccaagacc

SEQ ID NO: 527136 - DNA, 20 bp, mouse
gacctcggccgtaacctccc

SEQ ID NO: 527137 - DNA, 20 bp, mouse
gataggctccggggaggtta

SEQ ID NO: 527138 - DNA, 20 bp, mouse
gcggcgagccgggggcgagg

SEQ ID NO: 527139 - DNA, 20 bp, mouse
gcgcatccgacgccccaggg

SEQ ID NO: 527140 - DNA, 20 bp, mouse
gattcctataggctccgggg

SEQ ID NO: 527141 - DNA, 20 bp, mouse
gaagattcctataggctccg

SEQ ID NO: 527142 - DNA, 20 bp, mouse
gttctgagccgaccaccctg

SEQ ID NO: 527143 - DNA, 20 bp, mouse
gctggcgtccgcctcgcccc

SEQ ID NO: 527144 - DNA, 20 bp, mouse
gtccggggaggttacggccg

SEQ ID NO: 527145 - DNA, 20 bp, mouse
gtccgacgccccagggtggt

SEQ ID NO: 527146 - DNA, 20 bp, mouse
ggggagcaacagaaggtccg

SEQ ID NO: 527147 - DNA, 20 bp, mouse
gccgccgcgtaggcattagg

SEQ ID NO: 527148 - DNA, 20 bp, mouse
gtaggctacggactcctcgg

SEQ ID NO: 527149 - DNA, 20 bp, mouse
gagaaccgcgcgcagccacc

SEQ ID NO: 527150 - DNA, 20 bp, mouse
gctgggcagtccgttacgct

SEQ ID NO: 527151 - DNA, 20 bp, mouse
ggacaggaggaaccagaacg

SEQ ID NO: 527152 - DNA, 20 bp, mouse
gttacgctaggctgctaaca

SEQ ID NO: 527153 - DNA, 20 bp, mouse
gccgcgtaggcattaggagg

SEQ ID NO: 527154 - DNA, 20 bp, mouse
gcgacttctggagcagtggg

SEQ ID NO: 527155 - DNA, 20 bp, mouse
gcaaatgtccgagagggtaa

SEQ ID NO: 527156 - DNA, 20 bp, mouse
gtcagtaagtcaggcaccta

SEQ ID NO: 527157 - DNA, 20 bp, mouse
gaactggcagtcctggccat

SEQ ID NO: 527158 - DNA, 20 bp, mouse
gaagtcaggcacctatggcc

SEQ ID NO: 527159 - DNA, 20 bp, mouse
gcttactgaggccccaaata

SEQ ID NO: 527160 - DNA, 20 bp, mouse
gtggagcagactggactaag

SEQ ID NO: 527161 - DNA, 20 bp, mouse
ggaggccccaaatatggtcc

SEQ ID NO: 527162 - DNA, 20 bp, mouse
gtcccatcggaaggcatcgg

SEQ ID NO: 527163 - DNA, 20 bp, mouse
ggccccaaatatggtccagg

SEQ ID NO: 527164 - DNA, 20 bp, mouse
gtttggggcctcagtaagtc

SEQ ID NO: 527165 - DNA, 20 bp, mouse
ggaactgaagtctagctcct

SEQ ID NO: 527166 - DNA, 20 bp, mouse
gcagagcccagggaaggtct

SEQ ID NO: 527167 - DNA, 20 bp, mouse
ggccctgggagaagacccag

SEQ ID NO: 527168 - DNA, 20 bp, mouse
gaaagcgggcccatttgcag

SEQ ID NO: 527169 - DNA, 20 bp, mouse
gctccattagagccttcgag

SEQ ID NO: 527170 - DNA, 20 bp, mouse
ggaccctggaggctctgagg

SEQ ID NO: 527171 - DNA, 20 bp, mouse
gcccctgccaggttgcagag

SEQ ID NO: 527172 - DNA, 20 bp, mouse
ggacccctcgaaggctctaa

SEQ ID NO: 527173 - DNA, 20 bp, mouse
gccagtggtcgagaccctgg

SEQ ID NO: 527174 - DNA, 20 bp, mouse
ggtggattctgacccctcga

SEQ ID NO: 527175 - DNA, 20 bp, mouse
ggggcccatttgcagaggtg

SEQ ID NO: 527176 - DNA, 20 bp, mouse
gttcggccaccagcacatcc

SEQ ID NO: 527177 - DNA, 20 bp, mouse
gcatcccggtgcttcttctc

SEQ ID NO: 527178 - DNA, 20 bp, mouse
gtacgccgtttggcgaggtg

SEQ ID NO: 527179 - DNA, 20 bp, mouse
gtgcgcctgagaagaagcac

SEQ ID NO: 527180 - DNA, 20 bp, mouse
ggctggtggccgaagcagag

SEQ ID NO: 527181 - DNA, 20 bp, mouse
gcgcagcgatacaggatcgg

SEQ ID NO: 527182 - DNA, 20 bp, mouse
ggaagcagagaggagcaagc

SEQ ID NO: 527183 - DNA, 20 bp, mouse
gaagcaccgggatgtgctgg

SEQ ID NO: 527184 - DNA, 20 bp, mouse
ggcagccgcacctcgccaaa

SEQ ID NO: 527185 - DNA, 20 bp, mouse
ggaggcagcaagcagcaact

SEQ ID NO: 527186 - DNA, 20 bp, mouse
gaccttggtagaagatgcgt

SEQ ID NO: 527187 - DNA, 20 bp, mouse
gaagatgcgtaggcctttgt

SEQ ID NO: 527188 - DNA, 20 bp, mouse
gtgcactcatggaagacttc

SEQ ID NO: 527189 - DNA, 20 bp, mouse
ggcaggtacgcagccagcaa

SEQ ID NO: 527190 - DNA, 20 bp, mouse
ggcctacgcatcttctacca

SEQ ID NO: 527191 - DNA, 20 bp, mouse
gctgtggagcaacagaccaa

SEQ ID NO: 527192 - DNA, 20 bp, mouse
gcttccatgagtgcagagca

SEQ ID NO: 527193 - DNA, 20 bp, mouse
gtggggctgcaattactacc

SEQ ID NO: 527194 - DNA, 20 bp, mouse
gttgctccacagtgaaggtg

SEQ ID NO: 527195 - DNA, 20 bp, mouse
gtggggcgtgggggaaacaa

SEQ ID NO: 527196 - DNA, 20 bp, mouse
ggctccgcacagggtcaccc

SEQ ID NO: 527197 - DNA, 20 bp, mouse
gccgctgactcgctggagaa

SEQ ID NO: 527198 - DNA, 20 bp, mouse
ggagcccgggtgaccctgtg

SEQ ID NO: 527199 - DNA, 20 bp, mouse
ggcccgggccgcaggtgacc

SEQ ID NO: 527200 - DNA, 20 bp, mouse
gctgactcgctggagaaggg

SEQ ID NO: 527201 - DNA, 20 bp, mouse
ggggccgcaggtgacccgga

SEQ ID NO: 527202 - DNA, 20 bp, mouse
gaggccgtccgggtcacctg

SEQ ID NO: 527203 - DNA, 20 bp, mouse
ggctgggtgcctgatcgacg

SEQ ID NO: 527204 - DNA, 20 bp, mouse
gaaggggcggagcagtccga

SEQ ID NO: 527205 - DNA, 20 bp, mouse
gctggaggacaagaccaccg

SEQ ID NO: 527206 - DNA, 20 bp, mouse
gcgcgggtgtgcgagacgga

SEQ ID NO: 527207 - DNA, 20 bp, mouse
ggagacgcgggtgtgcgaga

SEQ ID NO: 527208 - DNA, 20 bp, mouse
gcatggcggcggtggagacg

SEQ ID NO: 527209 - DNA, 20 bp, mouse
gaggcgacaaggcccagagg

SEQ ID NO: 527210 - DNA, 20 bp, mouse
gggagggaggaaccgccaca

SEQ ID NO: 527211 - DNA, 20 bp, mouse
gccctctccccgccctgtgg

SEQ ID NO: 527212 - DNA, 20 bp, mouse
gtggcggttcctccctcctc

SEQ ID NO: 527213 - DNA, 20 bp, mouse
gtgcccagcttgatgcaggt

SEQ ID NO: 527214 - DNA, 20 bp, mouse
ggcatcaagctgggcatcca

SEQ ID NO: 527215 - DNA, 20 bp, mouse
gccagaggcggaggaccgga

SEQ ID NO: 527216 - DNA, 20 bp, mouse
ggtgaccggagccaacatgg

SEQ ID NO: 527217 - DNA, 20 bp, mouse
gtacctccacggacgagcag

SEQ ID NO: 527218 - DNA, 20 bp, mouse
gcacgtgaccggagccaaca

SEQ ID NO: 527219 - DNA, 20 bp, mouse
ggtccgtggaggtaagcgat

SEQ ID NO: 527220 - DNA, 20 bp, mouse
gtgggcgcgtagccctggag

SEQ ID NO: 527221 - DNA, 20 bp, mouse
gtgccgatcgcttacctcca

SEQ ID NO: 527222 - DNA, 20 bp, mouse
gtccccctgctcgtccgtgg

SEQ ID NO: 527223 - DNA, 20 bp, mouse
gcgagcagggggacgccgat

SEQ ID NO: 527224 - DNA, 20 bp, mouse
ggcgtccccctgctcgtccg

SEQ ID NO: 527225 - DNA, 20 bp, mouse
gtcggcatacgaccgctcca

SEQ ID NO: 527226 - DNA, 20 bp, mouse
ggagagggagcgagaacgag

SEQ ID NO: 527227 - DNA, 20 bp, mouse
gccggcgtcgctggtggagg

SEQ ID NO: 527228 - DNA, 20 bp, mouse
ggttgcccgagaaagagaga

SEQ ID NO: 527229 - DNA, 20 bp, mouse
gcttccggcgtcgctggtgg

SEQ ID NO: 527230 - DNA, 20 bp, mouse
gcggccatgccgggcaggga

SEQ ID NO: 527231 - DNA, 20 bp, mouse
ggcgtccggaccatcgagcg

SEQ ID NO: 527232 - DNA, 20 bp, mouse
gtaatggtgggagggtgtag

SEQ ID NO: 527233 - DNA, 20 bp, mouse
ggcgctagcgagggtctccg

SEQ ID NO: 527234 - DNA, 20 bp, mouse
gacggctcctcggtaatggt

SEQ ID NO: 527235 - DNA, 20 bp, mouse
ggaagccgcgctcgatggtc

SEQ ID NO: 527236 - DNA, 20 bp, mouse
gtccgagtagccagcgtgag

SEQ ID NO: 527237 - DNA, 20 bp, mouse
gaagaccgctgcagctggag

SEQ ID NO: 527238 - DNA, 20 bp, mouse
gtagccagcgtgagcggacg

SEQ ID NO: 527239 - DNA, 20 bp, mouse
gcgtggctaccagcatggtt

SEQ ID NO: 527240 - DNA, 20 bp, mouse
gcagagcgcgcaaagaagcg

SEQ ID NO: 527241 - DNA, 20 bp, mouse
gtactgagggcgctatcgag

SEQ ID NO: 527242 - DNA, 20 bp, mouse
gagaagcgtggctaccagca

SEQ ID NO: 527243 - DNA, 20 bp, mouse
gctcccggggcagcagtccg

SEQ ID NO: 527244 - DNA, 20 bp, mouse
gccgcgggaaaagggatgag

SEQ ID NO: 527245 - DNA, 20 bp, mouse
ggcgccctcagtacagtcca

SEQ ID NO: 527246 - DNA, 20 bp, mouse
ggcccctagccgcccaccac

SEQ ID NO: 527247 - DNA, 20 bp, mouse
gtctctagttgcagcttggg

SEQ ID NO: 527248 - DNA, 20 bp, mouse
gtcctgtggtgggcggctag

SEQ ID NO: 527249 - DNA, 20 bp, mouse
ggcttgggcggctcctgtgg

SEQ ID NO: 527250 - DNA, 20 bp, mouse
ggcgcgtctatagcccatcc

SEQ ID NO: 527251 - DNA, 20 bp, mouse
ggcttctctagttgcagctt

SEQ ID NO: 527252 - DNA, 20 bp, mouse
ggctaggggcgagccgggat

SEQ ID NO: 527253 - DNA, 20 bp, mouse
gtgccagctcagaggttcta

SEQ ID NO: 527254 - DNA, 20 bp, mouse
gcgggaacttgccagctcag

SEQ ID NO: 527255 - DNA, 20 bp, mouse
ggggcggctcctgtggtggg

SEQ ID NO: 527256 - DNA, 20 bp, mouse
ggccgcagaagcgctactac

SEQ ID NO: 527257 - DNA, 20 bp, mouse
gggactgcgtggcatgatgg

SEQ ID NO: 527258 - DNA, 20 bp, mouse
gaggatggcttagggagatt

SEQ ID NO: 527259 - DNA, 20 bp, mouse
gtagcgcttctgcggctggg

SEQ ID NO: 527260 - DNA, 20 bp, mouse
ggccggtagtagcgcttctg

SEQ ID NO: 527261 - DNA, 20 bp, mouse
gcgtggactgcgtggcatga

SEQ ID NO: 527262 - DNA, 20 bp, mouse
gctctaggaagtccagctgg

SEQ ID NO: 527263 - DNA, 20 bp, mouse
ggctctccacgtggactgcg

SEQ ID NO: 527264 - DNA, 20 bp, mouse
gcgcgcccactccaacccca

SEQ ID NO: 527265 - DNA, 20 bp, mouse
gacgtggagagccgagctcg

SEQ ID NO: 527266 - DNA, 20 bp, mouse
ggcgcagagcgacatgaacg

SEQ ID NO: 527267 - DNA, 20 bp, mouse
gtctccagagggcagttccg

SEQ ID NO: 527268 - DNA, 20 bp, mouse
gccaaatcgcgtctctatgg

SEQ ID NO: 527269 - DNA, 20 bp, mouse
gtccccgcgcaatctccaga

SEQ ID NO: 527270 - DNA, 20 bp, mouse
gccgccgcggaactgccctc

SEQ ID NO: 527271 - DNA, 20 bp, mouse
gggggaccacagcaccgctg

SEQ ID NO: 527272 - DNA, 20 bp, mouse
gacatgaacgcggatgctga

SEQ ID NO: 527273 - DNA, 20 bp, mouse
gggagggcggaggcgacctg

SEQ ID NO: 527274 - DNA, 20 bp, mouse
gctccccaagggcctcgggt

SEQ ID NO: 527275 - DNA, 20 bp, mouse
ggagggccacagcggtgctg

SEQ ID NO: 527276 - DNA, 20 bp, mouse
gcaggtgggccatggtgaag

SEQ ID NO: 527277 - DNA, 20 bp, mouse
gcagagaaaggacgcttgtc

SEQ ID NO: 527278 - DNA, 20 bp, mouse
gagtgagtcagagctggtag

SEQ ID NO: 527279 - DNA, 20 bp, mouse
gtaattattcctgcagagaa

SEQ ID NO: 527280 - DNA, 20 bp, mouse
ggaagacttggagagacata

SEQ ID NO: 527281 - DNA, 20 bp, mouse
gctctgactcacttacccag

SEQ ID NO: 527282 - DNA, 20 bp, mouse
ggagtcagagctggtagagg

SEQ ID NO: 527283 - DNA, 20 bp, mouse
gggacccagaccagtgtcag

SEQ ID NO: 527284 - DNA, 20 bp, mouse
gtatagatgggacctgggac

SEQ ID NO: 527285 - DNA, 20 bp, mouse
gtgggctcccaggtgggcca

SEQ ID NO: 527286 - DNA, 20 bp, mouse
gcacgtggggcgcggaccga

SEQ ID NO: 527287 - DNA, 20 bp, mouse
ggtgtagctgcgggagtgtg

SEQ ID NO: 527288 - DNA, 20 bp, mouse
gaagcaccgggaggcagcag

SEQ ID NO: 527289 - DNA, 20 bp, mouse
ggtgtgtggctgctgcacgt

SEQ ID NO: 527290 - DNA, 20 bp, mouse
gcggcgcgtggccagctcag

SEQ ID NO: 527291 - DNA, 20 bp, mouse
gcgaagacgccgctcacggt

SEQ ID NO: 527292 - DNA, 20 bp, mouse
gtgctgcacagggcccggtt

SEQ ID NO: 527293 - DNA, 20 bp, mouse
gagatcaccccgggaagcac

SEQ ID NO: 527294 - DNA, 20 bp, mouse
ggccctgtgcagcagacgcg

SEQ ID NO: 527295 - DNA, 20 bp, mouse
gaaaacaaggggggcggcag

SEQ ID NO: 527296 - DNA, 20 bp, mouse
gggagcggcagaagttacgg

SEQ ID NO: 527297 - DNA, 20 bp, mouse
gccccgcagagattctgacc

SEQ ID NO: 527298 - DNA, 20 bp, mouse
ggagggacgtgaaagtctcc

SEQ ID NO: 527299 - DNA, 20 bp, mouse
gctccgggtcagaatctctg

SEQ ID NO: 527300 - DNA, 20 bp, mouse
gcaggcactcgagtagacta

SEQ ID NO: 527301 - DNA, 20 bp, mouse
gccgggagcggcagaagtta

SEQ ID NO: 527302 - DNA, 20 bp, mouse
gcagcaggtgtgcggcgggt

SEQ ID NO: 527303 - DNA, 20 bp, mouse
ggactttcacgtccctcagg

SEQ ID NO: 527304 - DNA, 20 bp, mouse
gcgccggaaacttcctcctg

SEQ ID NO: 527305 - DNA, 20 bp, mouse
gaggtgtgcggcgggtggga

SEQ ID NO: 527306 - DNA, 20 bp, mouse
gacacctaagtcccgagtgg

SEQ ID NO: 527307 - DNA, 20 bp, mouse
gagtacaccggaggggacgg

SEQ ID NO: 527308 - DNA, 20 bp, mouse
gggccggcagtacaccggag

SEQ ID NO: 527309 - DNA, 20 bp, mouse
gcgtacacctaagtcccgag

SEQ ID NO: 527310 - DNA, 20 bp, mouse
gagccaggccggcagtacac

SEQ ID NO: 527311 - DNA, 20 bp, mouse
gtttcccccactcgggactt

SEQ ID NO: 527312 - DNA, 20 bp, mouse
gtgtctccaaccctgaacta

SEQ ID NO: 527313 - DNA, 20 bp, mouse
ggacttaggtgtacgcaaac

SEQ ID NO: 527314 - DNA, 20 bp, mouse
gggcagtacaccggagggga

SEQ ID NO: 527315 - DNA, 20 bp, mouse
ggctagaaacgcgacctagg

SEQ ID NO: 527316 - DNA, 20 bp, mouse
ggctgggcctcagatgccgg

SEQ ID NO: 527317 - DNA, 20 bp, mouse
ggaggctgggcctcagatgc

SEQ ID NO: 527318 - DNA, 20 bp, mouse
ggctccgcccacctccgtca

SEQ ID NO: 527319 - DNA, 20 bp, mouse
gaggaaagtaacttctcctc

SEQ ID NO: 527320 - DNA, 20 bp, mouse
gactcgcagtttggcgccag

SEQ ID NO: 527321 - DNA, 20 bp, mouse
gacttctcctccggcatctg

SEQ ID NO: 527322 - DNA, 20 bp, mouse
gcagtttggcgccagaggct

SEQ ID NO: 527323 - DNA, 20 bp, mouse
gacgaccgcgcgcgttgcca

SEQ ID NO: 527324 - DNA, 20 bp, mouse
gagtctgcgggcctgtaaaa

SEQ ID NO: 527325 - DNA, 20 bp, mouse
gtcctgagcgactcgcagtt

SEQ ID NO: 527326 - DNA, 20 bp, mouse
ggattggctgcgcaagatgg

SEQ ID NO: 527327 - DNA, 20 bp, mouse
gcccccaaggatccgagaac

SEQ ID NO: 527328 - DNA, 20 bp, mouse
gagagtagtctgtccagtca

SEQ ID NO: 527329 - DNA, 20 bp, mouse
gacccagcggtaagccccca

SEQ ID NO: 527330 - DNA, 20 bp, mouse
gtccccggcttctgacccag

SEQ ID NO: 527331 - DNA, 20 bp, mouse
ggtccagtcacggcgcggat

SEQ ID NO: 527332 - DNA, 20 bp, mouse
gaggcggacggagtgcggac

SEQ ID NO: 527333 - DNA, 20 bp, mouse
gagagagcgctgaaacccag

SEQ ID NO: 527334 - DNA, 20 bp, mouse
gcagaagccggggacccggg

SEQ ID NO: 527335 - DNA, 20 bp, mouse
gccaaggatccgagaaccgg

SEQ ID NO: 527336 - DNA, 20 bp, mouse
ggacacaccgggcacaaggg

SEQ ID NO: 527337 - DNA, 20 bp, mouse
ggaggaagatgcacttactc

SEQ ID NO: 527338 - DNA, 20 bp, mouse
gagaacagcagcagaaatct

SEQ ID NO: 527339 - DNA, 20 bp, mouse
gccggtgtgtcctgaagcca

SEQ ID NO: 527340 - DNA, 20 bp, mouse
gggtgtcctggcggtggcca

SEQ ID NO: 527341 - DNA, 20 bp, mouse
gaatctcggtgtcctggcgg

SEQ ID NO: 527342 - DNA, 20 bp, mouse
gttccagagacatctctcgg

SEQ ID NO: 527343 - DNA, 20 bp, mouse
gtcccaggtagacaacgggt

SEQ ID NO: 527344 - DNA, 20 bp, mouse
gatgcacttactcgggactg

SEQ ID NO: 527345 - DNA, 20 bp, mouse
gtgaagccatggccaccgcc

SEQ ID NO: 527346 - DNA, 20 bp, mouse
ggccagggcgaacaaactac

SEQ ID NO: 527347 - DNA, 20 bp, mouse
gggctgaaggcgagtttctc

SEQ ID NO: 527348 - DNA, 20 bp, mouse
gattggaaagtcagacgcca

SEQ ID NO: 527349 - DNA, 20 bp, mouse
gggtgttcgccgtaggctga

SEQ ID NO: 527350 - DNA, 20 bp, mouse
gggacttctggtctcagcat

SEQ ID NO: 527351 - DNA, 20 bp, mouse
ggaaactcgccttcagccta

SEQ ID NO: 527352 - DNA, 20 bp, mouse
gttggcaggagccgtaggaa

SEQ ID NO: 527353 - DNA, 20 bp, mouse
gtctcgttggtgttcgccgt

SEQ ID NO: 527354 - DNA, 20 bp, mouse
gtctcgaacgcacctcacag

SEQ ID NO: 527355 - DNA, 20 bp, mouse
gtccggtagtttgttcgccc

SEQ ID NO: 527356 - DNA, 20 bp, mouse
gcgtgccggagaccgaggac

SEQ ID NO: 527357 - DNA, 20 bp, mouse
ggaaggcgtgccggagaccg

SEQ ID NO: 527358 - DNA, 20 bp, mouse
gaaggaggccgccatgacac

SEQ ID NO: 527359 - DNA, 20 bp, mouse
gggaaccggtgcccgaactg

SEQ ID NO: 527360 - DNA, 20 bp, mouse
gtccggcacgccttcaggga

SEQ ID NO: 527361 - DNA, 20 bp, mouse
gtcttcccgtcctcggtctc

SEQ ID NO: 527362 - DNA, 20 bp, mouse
gcgccgggtcgctcaggaac

SEQ ID NO: 527363 - DNA, 20 bp, mouse
gcccgctggccctcctcccg

SEQ ID NO: 527364 - DNA, 20 bp, mouse
ggggaacgtcggtcctcggg

SEQ ID NO: 527365 - DNA, 20 bp, mouse
ggagatgcagggcagttacc

SEQ ID NO: 527366 - DNA, 20 bp, mouse
gcagcgtagtgggtacgtga

SEQ ID NO: 527367 - DNA, 20 bp, mouse
ggagaggaagactgagcccg

SEQ ID NO: 527368 - DNA, 20 bp, mouse
gaaaaaaaaacaagtacggt

SEQ ID NO: 527369 - DNA, 20 bp, mouse
gcgctgtgtagttagagcca

SEQ ID NO: 527370 - DNA, 20 bp, mouse
gcgtagtgggtacgtgaagg

SEQ ID NO: 527371 - DNA, 20 bp, mouse
gctctaactacacagcgtag

SEQ ID NO: 527372 - DNA, 20 bp, mouse
gagtcttcctctcccgaaaa

SEQ ID NO: 527373 - DNA, 20 bp, mouse
gacggtaggtctcctttttc

SEQ ID NO: 527374 - DNA, 20 bp, mouse
ggaactcgcccttcacgtgc

SEQ ID NO: 527375 - DNA, 20 bp, mouse
ggtctcaggttgtagtctct

SEQ ID NO: 527376 - DNA, 20 bp, mouse
gaccgtgagtatctacgtgg

SEQ ID NO: 527377 - DNA, 20 bp, mouse
ggcctccacgtagatactca

SEQ ID NO: 527378 - DNA, 20 bp, mouse
ggatactcacggttccggga

SEQ ID NO: 527379 - DNA, 20 bp, mouse
gggagctccgcacagcgact

SEQ ID NO: 527380 - DNA, 20 bp, mouse
gtctacgtggaggcactgca

SEQ ID NO: 527381 - DNA, 20 bp, mouse
gcgcggctcgggtaccctcc

SEQ ID NO: 527382 - DNA, 20 bp, mouse
gggaaccgtgagtatctacg

SEQ ID NO: 527383 - DNA, 20 bp, mouse
ggggctggagcggacaatac

SEQ ID NO: 527384 - DNA, 20 bp, mouse
gggtggccagcgggctgtgt

SEQ ID NO: 527385 - DNA, 20 bp, mouse
ggtggatggagtcaccctgg

SEQ ID NO: 527386 - DNA, 20 bp, mouse
ggcgctcggatcccctctat

SEQ ID NO: 527387 - DNA, 20 bp, mouse
gtctcagggaccctcactta

SEQ ID NO: 527388 - DNA, 20 bp, mouse
gcaaccccgcaccgatagag

SEQ ID NO: 527389 - DNA, 20 bp, mouse
gtgggagcagcccatatggc

SEQ ID NO: 527390 - DNA, 20 bp, mouse
gatagagtccccgagcaccc

SEQ ID NO: 527391 - DNA, 20 bp, mouse
gtggggactgccagccatat

SEQ ID NO: 527392 - DNA, 20 bp, mouse
ggctcagagcctatgaggaa

SEQ ID NO: 527393 - DNA, 20 bp, mouse
gctaggccagaacgacccaa

SEQ ID NO: 527394 - DNA, 20 bp, mouse
gggccagaacgacccaaggg

SEQ ID NO: 527395 - DNA, 20 bp, mouse
ggtgcccacagaagcagaac

SEQ ID NO: 527396 - DNA, 20 bp, mouse
gtctctgcttcataaggtaa

SEQ ID NO: 527397 - DNA, 20 bp, mouse
gtgacaccaacaacagtggt

SEQ ID NO: 527398 - DNA, 20 bp, mouse
gctgcgatctctgcttcata

SEQ ID NO: 527399 - DNA, 20 bp, mouse
ggggtttgaaggcaataacc

SEQ ID NO: 527400 - DNA, 20 bp, mouse
gactgttgttggtgtcaaca

SEQ ID NO: 527401 - DNA, 20 bp, mouse
gacctatataaaaaacactg

SEQ ID NO: 527402 - DNA, 20 bp, mouse
gaaggttctgaggggtttga

SEQ ID NO: 527403 - DNA, 20 bp, mouse
gcatgtttcagataagggat

SEQ ID NO: 527404 - DNA, 20 bp, mouse
gctaatgtaagactctaaaa

SEQ ID NO: 527405 - DNA, 20 bp, mouse
gataatttgaaaaggttctg

SEQ ID NO: 527406 - DNA, 20 bp, mouse
gtccacctccggctccacgg

SEQ ID NO: 527407 - DNA, 20 bp, mouse
gcccgcacaaagctccacag

SEQ ID NO: 527408 - DNA, 20 bp, mouse
gggaggtacgggtgctgcgt

SEQ ID NO: 527409 - DNA, 20 bp, mouse
ggtcgcagccatgagcccca

SEQ ID NO: 527410 - DNA, 20 bp, mouse
gcagcacccgtacctcccag

SEQ ID NO: 527411 - DNA, 20 bp, mouse
gcgcgtgccgcagcctgcgg

SEQ ID NO: 527412 - DNA, 20 bp, mouse
gccctgccgctgggaggtac

SEQ ID NO: 527413 - DNA, 20 bp, mouse
gccccgtcgccagaaaaccc

SEQ ID NO: 527414 - DNA, 20 bp, mouse
gcccgccagctcttacccga

SEQ ID NO: 527415 - DNA, 20 bp, mouse
gtaccgcgtgccgcagcctg

SEQ ID NO: 527416 - DNA, 20 bp, mouse
gtagagaactacaagctcag

SEQ ID NO: 527417 - DNA, 20 bp, mouse
ggatctgctgctgtagtctc

SEQ ID NO: 527418 - DNA, 20 bp, mouse
gagcagcagatcacaagctg

SEQ ID NO: 527419 - DNA, 20 bp, mouse
gagttctctactgtataccc

SEQ ID NO: 527420 - DNA, 20 bp, mouse
gtactcatctctaggaagac

SEQ ID NO: 527421 - DNA, 20 bp, mouse
ggaaaggtacatgggatctt

SEQ ID NO: 527422 - DNA, 20 bp, mouse
gactgtacaccactcagagt

SEQ ID NO: 527423 - DNA, 20 bp, mouse
gatattattatggaagtagt

SEQ ID NO: 527424 - DNA, 20 bp, mouse
gttatagtgtataaactgta

SEQ ID NO: 527425 - DNA, 20 bp, mouse
gtttattgggaaaggtacat

SEQ ID NO: 527426 - DNA, 20 bp, mouse
gcatggctagggttccgcgt

SEQ ID NO: 527427 - DNA, 20 bp, mouse
gactggtctgaagtcccacg

SEQ ID NO: 527428 - DNA, 20 bp, mouse
gctgcgcaagctgtccgtca

SEQ ID NO: 527429 - DNA, 20 bp, mouse
gcgcaagctgtccgtcatgg

SEQ ID NO: 527430 - DNA, 20 bp, mouse
gttcctgagccccatggcta

SEQ ID NO: 527431 - DNA, 20 bp, mouse
gggtaagagcccgggagagg

SEQ ID NO: 527432 - DNA, 20 bp, mouse
ggctcaggaagccgccatga

SEQ ID NO: 527433 - DNA, 20 bp, mouse
gggacttcagaccagtgtca

SEQ ID NO: 527434 - DNA, 20 bp, mouse
gctcttacccgccatgacac

SEQ ID NO: 527435 - DNA, 20 bp, mouse
gtggagggcgcagggctcag

SEQ ID NO: 527436 - DNA, 20 bp, mouse
gcactgtccatggcaaacac

SEQ ID NO: 527437 - DNA, 20 bp, mouse
gcggccggaaggagaccgca

SEQ ID NO: 527438 - DNA, 20 bp, mouse
gcgtaggccaaagcagggag

SEQ ID NO: 527439 - DNA, 20 bp, mouse
gcttccggccgggcccgctg

SEQ ID NO: 527440 - DNA, 20 bp, mouse
gtctgcgcgtcgcttccctg

SEQ ID NO: 527441 - DNA, 20 bp, mouse
gcgtgcggcggcacccacgt

SEQ ID NO: 527442 - DNA, 20 bp, mouse
ggttcccggaggcaatcggg

SEQ ID NO: 527443 - DNA, 20 bp, mouse
gccagttcccggaggcaatc

SEQ ID NO: 527444 - DNA, 20 bp, mouse
gaggccgggctcgcacgtag

SEQ ID NO: 527445 - DNA, 20 bp, mouse
gcactcccgctccaaacagg

SEQ ID NO: 527446 - DNA, 20 bp, mouse
gcccacgcggagccagaagg

SEQ ID NO: 527447 - DNA, 20 bp, mouse
gtgcagagaagcgttcccaa

SEQ ID NO: 527448 - DNA, 20 bp, mouse
ggaagcgttcccaacggacc

SEQ ID NO: 527449 - DNA, 20 bp, mouse
gcggaccgggctgacaactg

SEQ ID NO: 527450 - DNA, 20 bp, mouse
ggttgtcagcccggtccgtt

SEQ ID NO: 527451 - DNA, 20 bp, mouse
gcgcccgggaggcttgacag

SEQ ID NO: 527452 - DNA, 20 bp, mouse
gggcttgacagtggccatgg

SEQ ID NO: 527453 - DNA, 20 bp, mouse
gccccggacacacctactgt

SEQ ID NO: 527454 - DNA, 20 bp, mouse
gcggcaccgagcagccaccg

SEQ ID NO: 527455 - DNA, 20 bp, mouse
gggaggcttgacagtggcca

SEQ ID NO: 527456 - DNA, 20 bp, mouse
gccccggaggatgagcgtca

SEQ ID NO: 527457 - DNA, 20 bp, mouse
gcggaggatgagcgtcatgg

SEQ ID NO: 527458 - DNA, 20 bp, mouse
gtgggcaggtccggggtcct

SEQ ID NO: 527459 - DNA, 20 bp, mouse
gtgcagcgtgggcaggtccg

SEQ ID NO: 527460 - DNA, 20 bp, mouse
gaggatgagcgtcatggcgg

SEQ ID NO: 527461 - DNA, 20 bp, mouse
gccgccagcacgctctcagg

SEQ ID NO: 527462 - DNA, 20 bp, mouse
gcttccggcggggaagagag

SEQ ID NO: 527463 - DNA, 20 bp, mouse
ggagccgcgcgaggcagaga

SEQ ID NO: 527464 - DNA, 20 bp, mouse
ggtccggggtcctgggcaga

SEQ ID NO: 527465 - DNA, 20 bp, mouse
gctggcggcgctgagggagt

SEQ ID NO: 527466 - DNA, 20 bp, mouse
ggcttcgcgagagattgcag

SEQ ID NO: 527467 - DNA, 20 bp, mouse
gactcggctcgaatcaggcg

SEQ ID NO: 527468 - DNA, 20 bp, mouse
gcggctcgaatcaggcgcgg

SEQ ID NO: 527469 - DNA, 20 bp, mouse
ggcgacggaagcaggactct

SEQ ID NO: 527470 - DNA, 20 bp, mouse
gttctcacgaggacgcccga

SEQ ID NO: 527471 - DNA, 20 bp, mouse
gcgcggactcggctcgaatc

SEQ ID NO: 527472 - DNA, 20 bp, mouse
ggggcggggcgagagactcc

SEQ ID NO: 527473 - DNA, 20 bp, mouse
ggaaacatctaattctcacg

SEQ ID NO: 527474 - DNA, 20 bp, mouse
ggagaggagtggacccatgt

SEQ ID NO: 527475 - DNA, 20 bp, mouse
ggactctgggcacttgggtg

SEQ ID NO: 527476 - DNA, 20 bp, mouse
gacaccgacgatgacctggg

SEQ ID NO: 527477 - DNA, 20 bp, mouse
ggctcctcccaggtcatcgt

SEQ ID NO: 527478 - DNA, 20 bp, mouse
gtcggtgtcggcgacctgaa

SEQ ID NO: 527479 - DNA, 20 bp, mouse
gccgacaccgacgatgacct

SEQ ID NO: 527480 - DNA, 20 bp, mouse
ggccagcttcccggatagga

SEQ ID NO: 527481 - DNA, 20 bp, mouse
gagacgccagcttcccggat

SEQ ID NO: 527482 - DNA, 20 bp, mouse
gataggatggaactcccttc

SEQ ID NO: 527483 - DNA, 20 bp, mouse
gtccacgtggcgagcctggg

SEQ ID NO: 527484 - DNA, 20 bp, mouse
gcgtttcctgacggtaggag

SEQ ID NO: 527485 - DNA, 20 bp, mouse
gccagtcgagacgtgatgtg

SEQ ID NO: 527486 - DNA, 20 bp, mouse
ggaccgcgaggaccagctag

SEQ ID NO: 527487 - DNA, 20 bp, mouse
gcgtggaacccagacgctcc

SEQ ID NO: 527488 - DNA, 20 bp, mouse
gagcgtctgggttccacggg

SEQ ID NO: 527489 - DNA, 20 bp, mouse
gtgcctctagctggtcctcg

SEQ ID NO: 527490 - DNA, 20 bp, mouse
gtacttccggcactgcgggg

SEQ ID NO: 527491 - DNA, 20 bp, mouse
gacaggatcaagccccaaga

SEQ ID NO: 527492 - DNA, 20 bp, mouse
ggtgctttcctggagcgtct

SEQ ID NO: 527493 - DNA, 20 bp, mouse
gcgatccccgcgaggctcgt

SEQ ID NO: 527494 - DNA, 20 bp, mouse
gggatcccacgagcctcgcg

SEQ ID NO: 527495 - DNA, 20 bp, mouse
gtcgcggggatcgccgcccg

SEQ ID NO: 527496 - DNA, 20 bp, mouse
gtccccaacggaaatagcgg

SEQ ID NO: 527497 - DNA, 20 bp, mouse
ggtcagtcaagcccaggcgt

SEQ ID NO: 527498 - DNA, 20 bp, mouse
gcatggagagagagttctcc

SEQ ID NO: 527499 - DNA, 20 bp, mouse
gctgtgggctgcagcagtcc

SEQ ID NO: 527500 - DNA, 20 bp, mouse
gccttagaccagaaaactgt

SEQ ID NO: 527501 - DNA, 20 bp, mouse
ggacatgcccgagaccctag

SEQ ID NO: 527502 - DNA, 20 bp, mouse
gctggtctaaggaggagccc

SEQ ID NO: 527503 - DNA, 20 bp, mouse
gaatagcgggggcagtgcca

SEQ ID NO: 527504 - DNA, 20 bp, mouse
gagcaggccgctagggtctc

SEQ ID NO: 527505 - DNA, 20 bp, mouse
gagggtctcgggcatgtcca

SEQ ID NO: 527506 - DNA, 20 bp, mouse
gagaaacatgggaagcgcca

SEQ ID NO: 527507 - DNA, 20 bp, mouse
gcggctggtggtctgtaccc

SEQ ID NO: 527508 - DNA, 20 bp, mouse
gttccccaggagacacttct

SEQ ID NO: 527509 - DNA, 20 bp, mouse
gtccccagaagtgtctcctg

SEQ ID NO: 527510 - DNA, 20 bp, mouse
gcagatggcgagccaaaagc

SEQ ID NO: 527511 - DNA, 20 bp, mouse
gtcctggggaaggagagcgc

SEQ ID NO: 527512 - DNA, 20 bp, mouse
gatctgctcattgtacatca

SEQ ID NO: 527513 - DNA, 20 bp, mouse
gcatcacggagaatcgcttc

SEQ ID NO: 527514 - DNA, 20 bp, mouse
gaccagccgcagggccagga

SEQ ID NO: 527515 - DNA, 20 bp, mouse
ggccgtcctggccctgcggc

SEQ ID NO: 527516 - DNA, 20 bp, mouse
gcccgtgcagatcaaagacc

SEQ ID NO: 527517 - DNA, 20 bp, mouse
gaattagctggaaatcgcag

SEQ ID NO: 527518 - DNA, 20 bp, mouse
ggtgcagatcaaagaccagg

SEQ ID NO: 527519 - DNA, 20 bp, mouse
ggaagagcggttgtcagcat

SEQ ID NO: 527520 - DNA, 20 bp, mouse
gttccagcacgtacaaggta

SEQ ID NO: 527521 - DNA, 20 bp, mouse
gtgagttgcgacagccttgg

SEQ ID NO: 527522 - DNA, 20 bp, mouse
gcagaccagacaatgaagag

SEQ ID NO: 527523 - DNA, 20 bp, mouse
gtagggctgcatgggcaaac

SEQ ID NO: 527524 - DNA, 20 bp, mouse
gtactgttccagcacgtaca

SEQ ID NO: 527525 - DNA, 20 bp, mouse
gggtctggcccgacgcacag

SEQ ID NO: 527526 - DNA, 20 bp, mouse
ggagtgagggcaggaccctg

SEQ ID NO: 527527 - DNA, 20 bp, mouse
gagggcatggctgtgtctct

SEQ ID NO: 527528 - DNA, 20 bp, mouse
gctgattggtgctggagtga

SEQ ID NO: 527529 - DNA, 20 bp, mouse
gcttggggaagctgacctca

SEQ ID NO: 527530 - DNA, 20 bp, mouse
gttggtgctggagtgagggc

SEQ ID NO: 527531 - DNA, 20 bp, mouse
gcggctggtggtctgcatcg

SEQ ID NO: 527532 - DNA, 20 bp, mouse
ggaaggttcagcagaaacat

SEQ ID NO: 527533 - DNA, 20 bp, mouse
ggcttgccgtccaggccatg

SEQ ID NO: 527534 - DNA, 20 bp, mouse
gaagatggcgagcctaaagc

SEQ ID NO: 527535 - DNA, 20 bp, mouse
gacctggtgcatgtcctccc

SEQ ID NO: 527536 - DNA, 20 bp, mouse
gatggctgcgagtgtctctt

SEQ ID NO: 527537 - DNA, 20 bp, mouse
gagaatgttcagcagaaata

SEQ ID NO: 527538 - DNA, 20 bp, mouse
gcgcttcgtggtggcagtcg

SEQ ID NO: 527539 - DNA, 20 bp, mouse
gttcgtggtggcagtcgggg

SEQ ID NO: 527540 - DNA, 20 bp, mouse
ggctgaagagctcctgcttt

SEQ ID NO: 527541 - DNA, 20 bp, mouse
gagtagaggagaaagggcta

SEQ ID NO: 527542 - DNA, 20 bp, mouse
gcggctggtggtctgcatcg

SEQ ID NO: 527543 - DNA, 20 bp, mouse
ggcttgccgtccaggccatg

SEQ ID NO: 527544 - DNA, 20 bp, mouse
gtcttggggaagcagacctc

SEQ ID NO: 527545 - DNA, 20 bp, mouse
gaagatggcgagcctaaagc

SEQ ID NO: 527546 - DNA, 20 bp, mouse
ggcagagccagtaggtgtag

SEQ ID NO: 527547 - DNA, 20 bp, mouse
gtaggtgtagaggtagagtc

SEQ ID NO: 527548 - DNA, 20 bp, mouse
gccatgataccagctcctgg

SEQ ID NO: 527549 - DNA, 20 bp, mouse
gttccacgagacgctccacc

SEQ ID NO: 527550 - DNA, 20 bp, mouse
gcagctgcagaaatagaacc

SEQ ID NO: 527551 - DNA, 20 bp, mouse
gcatccatgataccagctcc

SEQ ID NO: 527552 - DNA, 20 bp, mouse
gcatctgccagcctgggcag

SEQ ID NO: 527553 - DNA, 20 bp, mouse
gctcctggtggagcgtctcg

SEQ ID NO: 527554 - DNA, 20 bp, mouse
gaagatggaaagcaagaaac

SEQ ID NO: 527555 - DNA, 20 bp, mouse
gggtgaccttgcagccctgt

SEQ ID NO: 527556 - DNA, 20 bp, mouse
ggtgaagcgacaccaccagg

SEQ ID NO: 527557 - DNA, 20 bp, mouse
gcaggtgaagcgacaccacc

SEQ ID NO: 527558 - DNA, 20 bp, mouse
gcggtaaacctggatagctt

SEQ ID NO: 527559 - DNA, 20 bp, mouse
gtagggctgcgcagtgggtc

SEQ ID NO: 527560 - DNA, 20 bp, mouse
ggggctgcacgcggtaaacc

SEQ ID NO: 527561 - DNA, 20 bp, mouse
gccttgcagggccaaaggag

SEQ ID NO: 527562 - DNA, 20 bp, mouse
gcccacgaccagggcagaaa

SEQ ID NO: 527563 - DNA, 20 bp, mouse
ggtgggtcgggtagccttcc

SEQ ID NO: 527564 - DNA, 20 bp, mouse
ggcacccaccaaagctatcc

SEQ ID NO: 527565 - DNA, 20 bp, mouse
gggccagtgggaccctccaa

SEQ ID NO: 527566 - DNA, 20 bp, mouse
gtcggggccgaggcagaggg

SEQ ID NO: 527567 - DNA, 20 bp, mouse
gtctgcctcggccccgaagg

SEQ ID NO: 527568 - DNA, 20 bp, mouse
ggcgatggctcgagctccgg

SEQ ID NO: 527569 - DNA, 20 bp, mouse
ggcccgtgcagcccccttcg

SEQ ID NO: 527570 - DNA, 20 bp, mouse
gggctgcacgggcgacttgg

SEQ ID NO: 527571 - DNA, 20 bp, mouse
gccacacggacgccaggctc

SEQ ID NO: 527572 - DNA, 20 bp, mouse
gcgacgacggtggccggagg

SEQ ID NO: 527573 - DNA, 20 bp, mouse
gggccccccgatgagactgt

SEQ ID NO: 527574 - DNA, 20 bp, mouse
gccgccaacagtctcatcgg

SEQ ID NO: 527575 - DNA, 20 bp, mouse
gcaccgccgggcccaagccc

SEQ ID NO: 527576 - DNA, 20 bp, mouse
gtcggtgcgggaacctaagg

SEQ ID NO: 527577 - DNA, 20 bp, mouse
gccgcaccgagccccagtcc

SEQ ID NO: 527578 - DNA, 20 bp, mouse
ggtcccggagcgtcgctcag

SEQ ID NO: 527579 - DNA, 20 bp, mouse
gaggccgagctgcgactgaa

SEQ ID NO: 527580 - DNA, 20 bp, mouse
gagcacgtggccgagatcgt

SEQ ID NO: 527581 - DNA, 20 bp, mouse
ggaaggggctgggctctatt

SEQ ID NO: 527582 - DNA, 20 bp, mouse
gggccactgagcgacgctcc

SEQ ID NO: 527583 - DNA, 20 bp, mouse
ggccgagcagacgccccctt

SEQ ID NO: 527584 - DNA, 20 bp, mouse
gggctcggtgcgggaaccta

SEQ ID NO: 527585 - DNA, 20 bp, mouse
gagagactctgggtccgagg

SEQ ID NO: 527586 - DNA, 20 bp, mouse
gccagccagccgggcactcg

SEQ ID NO: 527587 - DNA, 20 bp, mouse
ggtcaagaggcgggtaggag

SEQ ID NO: 527588 - DNA, 20 bp, mouse
gggtgggggcagagctcgag

SEQ ID NO: 527589 - DNA, 20 bp, mouse
gccaaccgccagcagatctg

SEQ ID NO: 527590 - DNA, 20 bp, mouse
gccgggaagccggcagtcag

SEQ ID NO: 527591 - DNA, 20 bp, mouse
gcccaccccagatctgctgg

SEQ ID NO: 527592 - DNA, 20 bp, mouse
gatctgctggcggttggggt

SEQ ID NO: 527593 - DNA, 20 bp, mouse
gtgccgagcgcaaagcgaac

SEQ ID NO: 527594 - DNA, 20 bp, mouse
gccccagccggctctctgct

SEQ ID NO: 527595 - DNA, 20 bp, mouse
gttgcagacctggagcgcaa

SEQ ID NO: 527596 - DNA, 20 bp, mouse
gcgggaacggagccgaggta

SEQ ID NO: 527597 - DNA, 20 bp, mouse
ggccgaggtagggaactagg

SEQ ID NO: 527598 - DNA, 20 bp, mouse
gggagccgaggtagggaact

SEQ ID NO: 527599 - DNA, 20 bp, mouse
gcccgggctgaggagcgcca

SEQ ID NO: 527600 - DNA, 20 bp, mouse
ggggccgccggagcgcgcga

SEQ ID NO: 527601 - DNA, 20 bp, mouse
gggaggcccagagctcgaag

SEQ ID NO: 527602 - DNA, 20 bp, mouse
gggcggcgcgctgtcaatgg

SEQ ID NO: 527603 - DNA, 20 bp, mouse
gccgccggagcgcgcgaggg

SEQ ID NO: 527604 - DNA, 20 bp, mouse
gcccacctagttccctacct

SEQ ID NO: 527605 - DNA, 20 bp, mouse
gggcagcggctcccctctca

SEQ ID NO: 527606 - DNA, 20 bp, mouse
ggggcggtggcgctgtggca

SEQ ID NO: 527607 - DNA, 20 bp, mouse
gcgcgcgccccggagatgaa

SEQ ID NO: 527608 - DNA, 20 bp, mouse
gagccatgccgggctccacc

SEQ ID NO: 527609 - DNA, 20 bp, mouse
ggccggccgccggcatccag

SEQ ID NO: 527610 - DNA, 20 bp, mouse
gccgggcagcccgacgcggg

SEQ ID NO: 527611 - DNA, 20 bp, mouse
ggaccaccgccggcgacccc

SEQ ID NO: 527612 - DNA, 20 bp, mouse
gccaccgggcagcccgacgc

SEQ ID NO: 527613 - DNA, 20 bp, mouse
gctcccgcgagtgcagggtg

SEQ ID NO: 527614 - DNA, 20 bp, mouse
gcgggaaccgggaccaccgc

SEQ ID NO: 527615 - DNA, 20 bp, mouse
gggatgcccggggtcgccgg

SEQ ID NO: 527616 - DNA, 20 bp, mouse
ggggcacagcctgtgggaca

SEQ ID NO: 527617 - DNA, 20 bp, mouse
ggccgaaagccctgtcccac

SEQ ID NO: 527618 - DNA, 20 bp, mouse
gtggttcctctaccccctac

SEQ ID NO: 527619 - DNA, 20 bp, mouse
ggagatactcaggatgaaag

SEQ ID NO: 527620 - DNA, 20 bp, mouse
gtgtcagttgcgcagctgtg

SEQ ID NO: 527621 - DNA, 20 bp, mouse
gacagaaacaacttccggta

SEQ ID NO: 527622 - DNA, 20 bp, mouse
gaacttccggtagggggtag

SEQ ID NO: 527623 - DNA, 20 bp, mouse
ggcctgtgggacagggcttt

SEQ ID NO: 527624 - DNA, 20 bp, mouse
gatcccaacaacgaaaagca

SEQ ID NO: 527625 - DNA, 20 bp, mouse
gacatggtgacggctgccgc

SEQ ID NO: 527626 - DNA, 20 bp, mouse
gcagcacagcctgtgggacg

SEQ ID NO: 527627 - DNA, 20 bp, mouse
gtgtgtccagcacagcctgt

SEQ ID NO: 527628 - DNA, 20 bp, mouse
gccggcagaggtagaggaac

SEQ ID NO: 527629 - DNA, 20 bp, mouse
gggtgactcaacaacaacct

SEQ ID NO: 527630 - DNA, 20 bp, mouse
gcaacttccggcagaggtag

SEQ ID NO: 527631 - DNA, 20 bp, mouse
gccgttttggagagtctccg

SEQ ID NO: 527632 - DNA, 20 bp, mouse
gcagaaacaacttccggcag

SEQ ID NO: 527633 - DNA, 20 bp, mouse
gctctcgaaatatgaagtaa

SEQ ID NO: 527634 - DNA, 20 bp, mouse
ggcagaacgccgcgtcccac

SEQ ID NO: 527635 - DNA, 20 bp, mouse
gggctggagaggcagatcag

SEQ ID NO: 527636 - DNA, 20 bp, mouse
gcgcagaggccccaacaggt

SEQ ID NO: 527637 - DNA, 20 bp, mouse
ggcgggtcgggcacgtccag

SEQ ID NO: 527638 - DNA, 20 bp, mouse
gacagcgcagaggccccaac

SEQ ID NO: 527639 - DNA, 20 bp, mouse
ggcagggagctggaacttag

SEQ ID NO: 527640 - DNA, 20 bp, mouse
gcaacaggtaggcgcgggtc

SEQ ID NO: 527641 - DNA, 20 bp, mouse
ggcactagagcacagcgcag

SEQ ID NO: 527642 - DNA, 20 bp, mouse
gaggccccaacaggtaggcg

SEQ ID NO: 527643 - DNA, 20 bp, mouse
gcattgtgcttagacacccc

SEQ ID NO: 527644 - DNA, 20 bp, mouse
gtaggggtcagtagaaatgg

SEQ ID NO: 527645 - DNA, 20 bp, mouse
gctagttccaggatatggag

SEQ ID NO: 527646 - DNA, 20 bp, mouse
gccgggtcaagcatcctcta

SEQ ID NO: 527647 - DNA, 20 bp, mouse
gcaggaagccaccggagcag

SEQ ID NO: 527648 - DNA, 20 bp, mouse
gggtcaagcatcctctaggg

SEQ ID NO: 527649 - DNA, 20 bp, mouse
gagtgaatccgctgctccgg

SEQ ID NO: 527650 - DNA, 20 bp, mouse
ggtgagtgaatccgctgctc

SEQ ID NO: 527651 - DNA, 20 bp, mouse
gtcacggagggcggacatcc

SEQ ID NO: 527652 - DNA, 20 bp, mouse
gaagcatcctctagggcgga

SEQ ID NO: 527653 - DNA, 20 bp, mouse
gacccggaagtactcctcga

SEQ ID NO: 527654 - DNA, 20 bp, mouse
gcgagggccagcgacgatcc

SEQ ID NO: 527655 - DNA, 20 bp, mouse
ggctcactgcaaaggtggtg

SEQ ID NO: 527656 - DNA, 20 bp, mouse
ggcccgtaggtgggaagctc

SEQ ID NO: 527657 - DNA, 20 bp, mouse
gggctctggagcccgtaggt

SEQ ID NO: 527658 - DNA, 20 bp, mouse
ggccggagcttcccacctac

SEQ ID NO: 527659 - DNA, 20 bp, mouse
gcgccggctctggagcccgt

SEQ ID NO: 527660 - DNA, 20 bp, mouse
gcgtaacccgcatcgagaag

SEQ ID NO: 527661 - DNA, 20 bp, mouse
gaagctccggctcccggcgg

SEQ ID NO: 527662 - DNA, 20 bp, mouse
ggggaagctccggctcccgg

SEQ ID NO: 527663 - DNA, 20 bp, mouse
ggcggcgggctacagtagga

SEQ ID NO: 527664 - DNA, 20 bp, mouse
gcatcgagaagaggcgcggg

SEQ ID NO: 527665 - DNA, 20 bp, mouse
ggtaggagggagcctcgcac

SEQ ID NO: 527666 - DNA, 20 bp, mouse
gctccaggccagtaccttca

SEQ ID NO: 527667 - DNA, 20 bp, mouse
gcaccatgaaggtactggcc

SEQ ID NO: 527668 - DNA, 20 bp, mouse
gagggaacagcgaagctcag

SEQ ID NO: 527669 - DNA, 20 bp, mouse
gcagctcagttgagagaggc

SEQ ID NO: 527670 - DNA, 20 bp, mouse
gacaagccacttgccagata

SEQ ID NO: 527671 - DNA, 20 bp, mouse
gtgagtgtagcccccaacat

SEQ ID NO: 527672 - DNA, 20 bp, mouse
gtgagagaggctggctgtct

SEQ ID NO: 527673 - DNA, 20 bp, mouse
gcaaatggtcttgatcctcc

SEQ ID NO: 527674 - DNA, 20 bp, mouse
gatcagtggcagggctggga

SEQ ID NO: 527675 - DNA, 20 bp, mouse
gcagagggcagagttcaggc

SEQ ID NO: 527676 - DNA, 20 bp, mouse
gggacacactcagcagccag

SEQ ID NO: 527677 - DNA, 20 bp, mouse
gacagcagagaagcgtgaga

SEQ ID NO: 527678 - DNA, 20 bp, mouse
gagagctgcgatctgtctgc

SEQ ID NO: 527679 - DNA, 20 bp, mouse
ggctgcgatctgtctgccgg

SEQ ID NO: 527680 - DNA, 20 bp, mouse
gcattatgtggggaactcaa

SEQ ID NO: 527681 - DNA, 20 bp, mouse
gcaaaggtagcttagatatt

SEQ ID NO: 527682 - DNA, 20 bp, mouse
ggcttctctgctgttctact

SEQ ID NO: 527683 - DNA, 20 bp, mouse
gtggtggattgagaagagtg

SEQ ID NO: 527684 - DNA, 20 bp, mouse
ggagccctctccattatgtg

SEQ ID NO: 527685 - DNA, 20 bp, mouse
gtgcattccaagctaaaagg

SEQ ID NO: 527686 - DNA, 20 bp, mouse
gaggcgcccgggcaaagaag

SEQ ID NO: 527687 - DNA, 20 bp, mouse
gcgcccgggcaaagaagcgg

SEQ ID NO: 527688 - DNA, 20 bp, mouse
gcgtctgtcccggcccgtcg

SEQ ID NO: 527689 - DNA, 20 bp, mouse
ggggcaaagaagcggcggag

SEQ ID NO: 527690 - DNA, 20 bp, mouse
ggccgggacagacgcgagaa

SEQ ID NO: 527691 - DNA, 20 bp, mouse
gctcgggtgagcgctcgcag

SEQ ID NO: 527692 - DNA, 20 bp, mouse
gtcctggaaggggtcagtcc

SEQ ID NO: 527693 - DNA, 20 bp, mouse
ggacagacgcgagaacggcc

SEQ ID NO: 527694 - DNA, 20 bp, mouse
gtccgctacggctcctggaa

SEQ ID NO: 527695 - DNA, 20 bp, mouse
gccccttccaggagccgtag

SEQ ID NO: 527696 - DNA, 20 bp, mouse
gtattccggagtgagaggag

SEQ ID NO: 527697 - DNA, 20 bp, mouse
gcgagcggcgggcagaacag

SEQ ID NO: 527698 - DNA, 20 bp, mouse
ggcacagcgcggccagcaca

SEQ ID NO: 527699 - DNA, 20 bp, mouse
gacgggagacctgcatgctg

SEQ ID NO: 527700 - DNA, 20 bp, mouse
ggacgcggcgaagaggccag

SEQ ID NO: 527701 - DNA, 20 bp, mouse
gtcacagccccaaggcccca

SEQ ID NO: 527702 - DNA, 20 bp, mouse
ggtccacgcgctctgatgct

SEQ ID NO: 527703 - DNA, 20 bp, mouse
gtgctgcgggacgcgggaaa

SEQ ID NO: 527704 - DNA, 20 bp, mouse
gttgtcaacagtaggagtag

SEQ ID NO: 527705 - DNA, 20 bp, mouse
gcctggagggggacgctcag

SEQ ID NO: 527706 - DNA, 20 bp, mouse
gccgcggggaaacggagaca

SEQ ID NO: 527707 - DNA, 20 bp, mouse
gcgacgcaggcaggtttgag

SEQ ID NO: 527708 - DNA, 20 bp, mouse
gcgtttccccgcggctcggg

SEQ ID NO: 527709 - DNA, 20 bp, mouse
gaaggagacgccttcacctc

SEQ ID NO: 527710 - DNA, 20 bp, mouse
gtcgcgctctccaagcgccg

SEQ ID NO: 527711 - DNA, 20 bp, mouse
gagccccgctaccctcgcag

SEQ ID NO: 527712 - DNA, 20 bp, mouse
ggcgcttggagagcgcgatc

SEQ ID NO: 527713 - DNA, 20 bp, mouse
gtgggtcctagcgcagccgg

SEQ ID NO: 527714 - DNA, 20 bp, mouse
gaccgccgctgcgagggtag

SEQ ID NO: 527715 - DNA, 20 bp, mouse
gtctccaagcgccggggacg

SEQ ID NO: 527716 - DNA, 20 bp, mouse
ggtgaaggccagagagacca

SEQ ID NO: 527717 - DNA, 20 bp, mouse
ggccagagagaccagggaag

SEQ ID NO: 527718 - DNA, 20 bp, mouse
gggagcctcatggcaacgtt

SEQ ID NO: 527719 - DNA, 20 bp, mouse
gctcaccagtgcgcagggac

SEQ ID NO: 527720 - DNA, 20 bp, mouse
ggtccctgagggaggataca

SEQ ID NO: 527721 - DNA, 20 bp, mouse
gcctcatggcaacgttgggt

SEQ ID NO: 527722 - DNA, 20 bp, mouse
gtagccaaaaagtcacgctc

SEQ ID NO: 527723 - DNA, 20 bp, mouse
gtaagccccatagcagagta

SEQ ID NO: 527724 - DNA, 20 bp, mouse
gtgccctgtatcctccctca

SEQ ID NO: 527725 - DNA, 20 bp, mouse
gtactcctgtccctgcgcac

SEQ ID NO: 527726 - DNA, 20 bp, mouse
gtggttgctgggtgacagtg

SEQ ID NO: 527727 - DNA, 20 bp, mouse
gcggagctcgaaggtcaccc

SEQ ID NO: 527728 - DNA, 20 bp, mouse
gggacgtcgccacccgccag

SEQ ID NO: 527729 - DNA, 20 bp, mouse
gccgccgccccggcccgtca

SEQ ID NO: 527730 - DNA, 20 bp, mouse
gtggggagaggaagccgcgt

SEQ ID NO: 527731 - DNA, 20 bp, mouse
gcagctccgccacagccccc

SEQ ID NO: 527732 - DNA, 20 bp, mouse
gagccgggtggattcctacc

SEQ ID NO: 527733 - DNA, 20 bp, mouse
gcgggaggatgagacagcca

SEQ ID NO: 527734 - DNA, 20 bp, mouse
gaaagaggggaggtgcccag

SEQ ID NO: 527735 - DNA, 20 bp, mouse
ggcacctcccctctttcggg

SEQ ID NO: 527736 - DNA, 20 bp, mouse
gcgcgaggccgggaaggtga

SEQ ID NO: 527737 - DNA, 20 bp, mouse
gcgggaaggtgaaggtgaga

SEQ ID NO: 527738 - DNA, 20 bp, mouse
gcctgccggttccaccaccc

SEQ ID NO: 527739 - DNA, 20 bp, mouse
gcgcgccggggtggtggaac

SEQ ID NO: 527740 - DNA, 20 bp, mouse
ggcgccggctagtgacgtgt

SEQ ID NO: 527741 - DNA, 20 bp, mouse
gcctgctcggctctgaggag

SEQ ID NO: 527742 - DNA, 20 bp, mouse
gacaccgagagaagcgggag

SEQ ID NO: 527743 - DNA, 20 bp, mouse
gacggttaccaggcacgcgg

SEQ ID NO: 527744 - DNA, 20 bp, mouse
gggactgaaggctgggaggt

SEQ ID NO: 527745 - DNA, 20 bp, mouse
gcccagcgtcctaagccggg

SEQ ID NO: 527746 - DNA, 20 bp, mouse
gccggctggcaggacggtgg

SEQ ID NO: 527747 - DNA, 20 bp, mouse
gaaagtctggcaggcatcgg

SEQ ID NO: 527748 - DNA, 20 bp, mouse
ggggcacacaccaacgggaa

SEQ ID NO: 527749 - DNA, 20 bp, mouse
gcacacaccaacgggaaagg

SEQ ID NO: 527750 - DNA, 20 bp, mouse
gaacgggaaaggaggaagct

SEQ ID NO: 527751 - DNA, 20 bp, mouse
gagacaggagccccacgcac

SEQ ID NO: 527752 - DNA, 20 bp, mouse
gacgcacaggagggtaaaga

SEQ ID NO: 527753 - DNA, 20 bp, mouse
gcatcgggggcacacaccaa

SEQ ID NO: 527754 - DNA, 20 bp, mouse
gaggagccccacgcacagga

SEQ ID NO: 527755 - DNA, 20 bp, mouse
gagactgattggggagtcgg

SEQ ID NO: 527756 - DNA, 20 bp, mouse
gaggcagccggagagagaac

SEQ ID NO: 527757 - DNA, 20 bp, mouse
gcacaagccaccaatcaaag

SEQ ID NO: 527758 - DNA, 20 bp, mouse
ggagtgagttgagcaaggta

SEQ ID NO: 527759 - DNA, 20 bp, mouse
gccttgtccctcaagagcaa

SEQ ID NO: 527760 - DNA, 20 bp, mouse
ggcaaggtaaggcggcaagg

SEQ ID NO: 527761 - DNA, 20 bp, mouse
gaggcggcctttgctcttga

SEQ ID NO: 527762 - DNA, 20 bp, mouse
gcaactcactcgcctctgga

SEQ ID NO: 527763 - DNA, 20 bp, mouse
gctcaagcaacccctgacgg

SEQ ID NO: 527764 - DNA, 20 bp, mouse
gaggccgcctctttgattgg

SEQ ID NO: 527765 - DNA, 20 bp, mouse
gggaggtcttgagctatcag

SEQ ID NO: 527766 - DNA, 20 bp, mouse
ggacgaggatggggaagatc

SEQ ID NO: 527767 - DNA, 20 bp, mouse
gctgatggaggacgaggatg

SEQ ID NO: 527768 - DNA, 20 bp, mouse
gtgcaagctgatggaggacg

SEQ ID NO: 527769 - DNA, 20 bp, mouse
ggttccaggctgcaagctga

SEQ ID NO: 527770 - DNA, 20 bp, mouse
gaagatcgggcgctgcttgg

SEQ ID NO: 527771 - DNA, 20 bp, mouse
gcggctggggcagatgatag

SEQ ID NO: 527772 - DNA, 20 bp, mouse
ggaggagctgctgaacaccg

SEQ ID NO: 527773 - DNA, 20 bp, mouse
gaggcggacagcgcagtcca

SEQ ID NO: 527774 - DNA, 20 bp, mouse
gttgcttcctgctccgttcc

SEQ ID NO: 527775 - DNA, 20 bp, mouse
ggactgcgctgtccgcctcg

SEQ ID NO: 527776 - DNA, 20 bp, mouse
ggctccaggcggggacaaac

SEQ ID NO: 527777 - DNA, 20 bp, mouse
gccaggcggggacaaacggg

SEQ ID NO: 527778 - DNA, 20 bp, mouse
ggtgtggctgctatccaggg

SEQ ID NO: 527779 - DNA, 20 bp, mouse
gcgactcccttaccaaccta

SEQ ID NO: 527780 - DNA, 20 bp, mouse
gttgtccccgcctggagctg

SEQ ID NO: 527781 - DNA, 20 bp, mouse
gctcagggccgcagtggtca

SEQ ID NO: 527782 - DNA, 20 bp, mouse
ggtgtgcacaggtcccagct

SEQ ID NO: 527783 - DNA, 20 bp, mouse
gagtaagctcagggccgcag

SEQ ID NO: 527784 - DNA, 20 bp, mouse
ggctgccaggagccatagag

SEQ ID NO: 527785 - DNA, 20 bp, mouse
gacaaacgggtggatgaaca

SEQ ID NO: 527786 - DNA, 20 bp, mouse
gttgcagggaacgggatccg

SEQ ID NO: 527787 - DNA, 20 bp, mouse
ggggacgcgaccgagtgcag

SEQ ID NO: 527788 - DNA, 20 bp, mouse
gggttcgactggaggagaag

SEQ ID NO: 527789 - DNA, 20 bp, mouse
ggttgcggcgggtagacccc

SEQ ID NO: 527790 - DNA, 20 bp, mouse
ggctgtgagtcaggccggga

SEQ ID NO: 527791 - DNA, 20 bp, mouse
gcaactccagttgcagggaa

SEQ ID NO: 527792 - DNA, 20 bp, mouse
ggggtcccgactgtaccggt

SEQ ID NO: 527793 - DNA, 20 bp, mouse
ggggaacgggatccggggca

SEQ ID NO: 527794 - DNA, 20 bp, mouse
gcctgcaactggagttgcgg

SEQ ID NO: 527795 - DNA, 20 bp, mouse
gcggtacagtcgggaccctc

SEQ ID NO: 527796 - DNA, 20 bp, mouse
ggcccgccaccccgtcggta

SEQ ID NO: 527797 - DNA, 20 bp, mouse
gcgccaccccgtcggtacgg

SEQ ID NO: 527798 - DNA, 20 bp, mouse
ggctacaccaaggagtcccg

SEQ ID NO: 527799 - DNA, 20 bp, mouse
ggtacggcggcggcggctac

SEQ ID NO: 527800 - DNA, 20 bp, mouse
gccgcgggaccgctacacca

SEQ ID NO: 527801 - DNA, 20 bp, mouse
ggggaggcggacgggcacaa

SEQ ID NO: 527802 - DNA, 20 bp, mouse
gcgccgccgccgtaccgacg

SEQ ID NO: 527803 - DNA, 20 bp, mouse
gcaccccgtcggtacggcgg

SEQ ID NO: 527804 - DNA, 20 bp, mouse
ggcggagccgcaggtgagcg

SEQ ID NO: 527805 - DNA, 20 bp, mouse
ggcttcgcagccatgagcta

SEQ ID NO: 527806 - DNA, 20 bp, mouse
gtagcgcggggcggcagtgt

SEQ ID NO: 527807 - DNA, 20 bp, mouse
gtccgacggaggcgacatcg

SEQ ID NO: 527808 - DNA, 20 bp, mouse
gggcctgcgtcgtccgacgg

SEQ ID NO: 527809 - DNA, 20 bp, mouse
gcccgggagccgcctcaaca

SEQ ID NO: 527810 - DNA, 20 bp, mouse
gttgaggcggctcccgggag

SEQ ID NO: 527811 - DNA, 20 bp, mouse
gggacacaggacgacagtca

SEQ ID NO: 527812 - DNA, 20 bp, mouse
ggcggcagtgtggggcggtg

SEQ ID NO: 527813 - DNA, 20 bp, mouse
gccgggcctgcgtcgtccga

SEQ ID NO: 527814 - DNA, 20 bp, mouse
gtagccgcgcgggtagcgcg

SEQ ID NO: 527815 - DNA, 20 bp, mouse
gggagaggacggacacaggg

SEQ ID NO: 527816 - DNA, 20 bp, mouse
ggtgctagcgaacgtagtag

SEQ ID NO: 527817 - DNA, 20 bp, mouse
gcgcctgtggctccgatcct

SEQ ID NO: 527818 - DNA, 20 bp, mouse
ggcgaacgtagtagtggctg

SEQ ID NO: 527819 - DNA, 20 bp, mouse
ggtgaaggtgaggtcccgag

SEQ ID NO: 527820 - DNA, 20 bp, mouse
gcgcctaggatcggagccac

SEQ ID NO: 527821 - DNA, 20 bp, mouse
ggaacggccggtccaggtga

SEQ ID NO: 527822 - DNA, 20 bp, mouse
gctggggctgcgcctaggat

SEQ ID NO: 527823 - DNA, 20 bp, mouse
gaggctccgccagccgagat

SEQ ID NO: 527824 - DNA, 20 bp, mouse
ggcaggcccgaacctttaag

SEQ ID NO: 527825 - DNA, 20 bp, mouse
gaggtgaggtcccgagagga

SEQ ID NO: 527826 - DNA, 20 bp, mouse
gggctctgcgacaggagcgg

SEQ ID NO: 527827 - DNA, 20 bp, mouse
ggctcggtgagcgtcagggt

SEQ ID NO: 527828 - DNA, 20 bp, mouse
ggagcgggggtgggtccatg

SEQ ID NO: 527829 - DNA, 20 bp, mouse
ggtcggagcttaacagccac

SEQ ID NO: 527830 - DNA, 20 bp, mouse
ggtcgcagagcctcacaccc

SEQ ID NO: 527831 - DNA, 20 bp, mouse
gatggggcaccgacatcccg

SEQ ID NO: 527832 - DNA, 20 bp, mouse
gcttaacagccacgggatgt

SEQ ID NO: 527833 - DNA, 20 bp, mouse
gccaggctcggtgagcgtca

SEQ ID NO: 527834 - DNA, 20 bp, mouse
gcaccccagagaaaatagga

SEQ ID NO: 527835 - DNA, 20 bp, mouse
gcccgatagtgactgcgctg

SEQ ID NO: 527836 - DNA, 20 bp, mouse
gtatgggctgtgcaagactg

SEQ ID NO: 527837 - DNA, 20 bp, mouse
gtcccaccatgcgataggac

SEQ ID NO: 527838 - DNA, 20 bp, mouse
gacactgggaccagaaatcc

SEQ ID NO: 527839 - DNA, 20 bp, mouse
gccacgaacgggccatgcat

SEQ ID NO: 527840 - DNA, 20 bp, mouse
gaactggactgcagtccata

SEQ ID NO: 527841 - DNA, 20 bp, mouse
gcgttcgtggtgggatcgga

SEQ ID NO: 527842 - DNA, 20 bp, mouse
gtcccggaagtaccgaagct

SEQ ID NO: 527843 - DNA, 20 bp, mouse
gcatagggccggggacagtc

SEQ ID NO: 527844 - DNA, 20 bp, mouse
gcaagatagaggccggccag

SEQ ID NO: 527845 - DNA, 20 bp, mouse
gtgcggtcccaccatgcgat

SEQ ID NO: 527846 - DNA, 20 bp, mouse
ggagctgccggccgagccat

SEQ ID NO: 527847 - DNA, 20 bp, mouse
ggcagctcgcagcgagccca

SEQ ID NO: 527848 - DNA, 20 bp, mouse
ggagcgtgggctgtaggttg

SEQ ID NO: 527849 - DNA, 20 bp, mouse
gacccggccgtcgcagccca

SEQ ID NO: 527850 - DNA, 20 bp, mouse
ggcggagcagctcagacacc

SEQ ID NO: 527851 - DNA, 20 bp, mouse
ggccgagccatgggctgcga

SEQ ID NO: 527852 - DNA, 20 bp, mouse
gcgctccagtaggtgagcgt

SEQ ID NO: 527853 - DNA, 20 bp, mouse
gtccccgcccggcctccggt

SEQ ID NO: 527854 - DNA, 20 bp, mouse
ggagtgccgcggccaaccgg

SEQ ID NO: 527855 - DNA, 20 bp, mouse
gcgtgggctgtaggttgcgg

SEQ ID NO: 527856 - DNA, 20 bp, mouse
gcgcgctgctggaacccgag

SEQ ID NO: 527857 - DNA, 20 bp, mouse
ggccggagccagtgcgggga

SEQ ID NO: 527858 - DNA, 20 bp, mouse
gcgggccgccctccccgcac

SEQ ID NO: 527859 - DNA, 20 bp, mouse
gtcccggaagcaggctgtga

SEQ ID NO: 527860 - DNA, 20 bp, mouse
gggagcgtcccggcagaccg

SEQ ID NO: 527861 - DNA, 20 bp, mouse
ggcggagccggagccagtgc

SEQ ID NO: 527862 - DNA, 20 bp, mouse
ggccctccccgcactggctc

SEQ ID NO: 527863 - DNA, 20 bp, mouse
gcccatagccggggaacctg

SEQ ID NO: 527864 - DNA, 20 bp, mouse
ggggacgctccggacacgtc

SEQ ID NO: 527865 - DNA, 20 bp, mouse
gtgaccgcgaagcattggag

SEQ ID NO: 527866 - DNA, 20 bp, mouse
gtccagccggtcgggagcga

SEQ ID NO: 527867 - DNA, 20 bp, mouse
gcggtcgggagcgaaggcgg

SEQ ID NO: 527868 - DNA, 20 bp, mouse
gaccggctggacccgtttca

SEQ ID NO: 527869 - DNA, 20 bp, mouse
gccaaagcggcgaggaggag

SEQ ID NO: 527870 - DNA, 20 bp, mouse
gcatccgccgccgcaggagg

SEQ ID NO: 527871 - DNA, 20 bp, mouse
gtgacaggcggcacccggga

SEQ ID NO: 527872 - DNA, 20 bp, mouse
gggaggcggagcgctgcacc

SEQ ID NO: 527873 - DNA, 20 bp, mouse
gagagcgccgcatgtcggtt

SEQ ID NO: 527874 - DNA, 20 bp, mouse
ggccctgaaacgggtccagc

SEQ ID NO: 527875 - DNA, 20 bp, mouse
gtgcaccccgagatgacagg

SEQ ID NO: 527876 - DNA, 20 bp, mouse
ggcgcggcgctccatatcct

SEQ ID NO: 527877 - DNA, 20 bp, mouse
gcctgggaagggagaatcgc

SEQ ID NO: 527878 - DNA, 20 bp, mouse
ggcgctccatatcctgggaa

SEQ ID NO: 527879 - DNA, 20 bp, mouse
gagggagaatcgctggctca

SEQ ID NO: 527880 - DNA, 20 bp, mouse
ggtcaggaacggagtcacac

SEQ ID NO: 527881 - DNA, 20 bp, mouse
gccatgaggatgcccaccaa

SEQ ID NO: 527882 - DNA, 20 bp, mouse
gccggactccgcacaccaag

SEQ ID NO: 527883 - DNA, 20 bp, mouse
ggtgtggccgcgcccttggt

SEQ ID NO: 527884 - DNA, 20 bp, mouse
gtagccgttggctaggtgac

SEQ ID NO: 527885 - DNA, 20 bp, mouse
gccgcaatgggacgtcccca

SEQ ID NO: 527886 - DNA, 20 bp, mouse
gcatggccgggactatggat

SEQ ID NO: 527887 - DNA, 20 bp, mouse
ggtgggcggcctgcggacac

SEQ ID NO: 527888 - DNA, 20 bp, mouse
gcggcctgcggacactggca

SEQ ID NO: 527889 - DNA, 20 bp, mouse
gtgcagtgtatgaaagtggg

SEQ ID NO: 527890 - DNA, 20 bp, mouse
ggccgggactatggataggc

SEQ ID NO: 527891 - DNA, 20 bp, mouse
gcgttgcagtgtatgaaagt

SEQ ID NO: 527892 - DNA, 20 bp, mouse
gtgcggacactggcatggcc

SEQ ID NO: 527893 - DNA, 20 bp, mouse
gggcggtcccagatgtttcc

SEQ ID NO: 527894 - DNA, 20 bp, mouse
gactggcatggccgggacta

SEQ ID NO: 527895 - DNA, 20 bp, mouse
gtccagcctatccatagtcc

SEQ ID NO: 527896 - DNA, 20 bp, mouse
gcgagcgcgctgaaccgggt

SEQ ID NO: 527897 - DNA, 20 bp, mouse
ggccggcgaggagcactaag

SEQ ID NO: 527898 - DNA, 20 bp, mouse
gggcctgaggcgctgaacgg

SEQ ID NO: 527899 - DNA, 20 bp, mouse
gcaggcgagcgcgctgaacc

SEQ ID NO: 527900 - DNA, 20 bp, mouse
gccgggtgggacctaggagc

SEQ ID NO: 527901 - DNA, 20 bp, mouse
ggctgaaccgggtgggacct

SEQ ID NO: 527902 - DNA, 20 bp, mouse
gaggtggccgggaagatgag

SEQ ID NO: 527903 - DNA, 20 bp, mouse
gcccaagggcgccccggacg

SEQ ID NO: 527904 - DNA, 20 bp, mouse
gtgggacctaggagccggcg

SEQ ID NO: 527905 - DNA, 20 bp, mouse
gaagggcgccccggacgggg

SEQ ID NO: 527906 - DNA, 20 bp, mouse
gctggacagcctggaacgcg

SEQ ID NO: 527907 - DNA, 20 bp, mouse
ggatgaagcgttgaccgtcc

SEQ ID NO: 527908 - DNA, 20 bp, mouse
gactcctgaacagcgaactg

SEQ ID NO: 527909 - DNA, 20 bp, mouse
ggcgtctgcggccaacttgg

SEQ ID NO: 527910 - DNA, 20 bp, mouse
ggtgttgcctcagctctagg

SEQ ID NO: 527911 - DNA, 20 bp, mouse
gtgctgacccataagactgt

SEQ ID NO: 527912 - DNA, 20 bp, mouse
gtgaacagcgaactgtggca

SEQ ID NO: 527913 - DNA, 20 bp, mouse
gcagcctggaacgcgtggca

SEQ ID NO: 527914 - DNA, 20 bp, mouse
gcaacgagctcctgaatccc

SEQ ID NO: 527915 - DNA, 20 bp, mouse
gtttgctagggagtgatcgt

SEQ ID NO: 527916 - DNA, 20 bp, mouse
gggcgcgcaagcgcactcgt

SEQ ID NO: 527917 - DNA, 20 bp, mouse
gtcttgggcccgggatcacc

SEQ ID NO: 527918 - DNA, 20 bp, mouse
gagtgcgcttgcgcgccgtg

SEQ ID NO: 527919 - DNA, 20 bp, mouse
gcgcttgcgcgccgtgaggc

SEQ ID NO: 527920 - DNA, 20 bp, mouse
gcctgcttccgggtgatccc

SEQ ID NO: 527921 - DNA, 20 bp, mouse
gagggaaatgtgaagtgtgt

SEQ ID NO: 527922 - DNA, 20 bp, mouse
gcttgtgtacctagaaagct

SEQ ID NO: 527923 - DNA, 20 bp, mouse
gccgcctgctcacctgcttc

SEQ ID NO: 527924 - DNA, 20 bp, mouse
ggtttcttcatacaaaacaa

SEQ ID NO: 527925 - DNA, 20 bp, mouse
gtgtacctagaaagctgggc

SEQ ID NO: 527926 - DNA, 20 bp, mouse
gcccagcgccattcccagga

SEQ ID NO: 527927 - DNA, 20 bp, mouse
gaatggcgctgggggtcccg

SEQ ID NO: 527928 - DNA, 20 bp, mouse
ggacccccagcgccattccc

SEQ ID NO: 527929 - DNA, 20 bp, mouse
ggccattcccaggagggctg

SEQ ID NO: 527930 - DNA, 20 bp, mouse
gtccagtgtagacccctcca

SEQ ID NO: 527931 - DNA, 20 bp, mouse
gcatgggcgtggtcaatcct

SEQ ID NO: 527932 - DNA, 20 bp, mouse
gcgggggcgtggtctgcagt

SEQ ID NO: 527933 - DNA, 20 bp, mouse
gggtcaaggagtcacacctg

SEQ ID NO: 527934 - DNA, 20 bp, mouse
gctgggcgtggccacggcgg

SEQ ID NO: 527935 - DNA, 20 bp, mouse
ggccctcctgggaatggcgc

SEQ ID NO: 527936 - DNA, 20 bp, mouse
ggtccttcacatccctctag

SEQ ID NO: 527937 - DNA, 20 bp, mouse
gctcccctagagggatgtga

SEQ ID NO: 527938 - DNA, 20 bp, mouse
gaggggagggttattctgaa

SEQ ID NO: 527939 - DNA, 20 bp, mouse
gagaataaccctcccctaga

SEQ ID NO: 527940 - DNA, 20 bp, mouse
gaactcgctcaagggaccaa

SEQ ID NO: 527941 - DNA, 20 bp, mouse
gcacggaagtgaggtcgggg

SEQ ID NO: 527942 - DNA, 20 bp, mouse
gaggcccgagagttaccgtg

SEQ ID NO: 527943 - DNA, 20 bp, mouse
ggcgtgcgaagctctctctg

SEQ ID NO: 527944 - DNA, 20 bp, mouse
gggagaccgagaccacgagg

SEQ ID NO: 527945 - DNA, 20 bp, mouse
ggcggggtgagaagtgccta

SEQ ID NO: 527946 - DNA, 20 bp, mouse
gtgcaacggggagcgcccaa

SEQ ID NO: 527947 - DNA, 20 bp, mouse
ggcccaagggcgatggttca

SEQ ID NO: 527948 - DNA, 20 bp, mouse
gtaaggacgctcacacctac

SEQ ID NO: 527949 - DNA, 20 bp, mouse
gatggttcacggctcctgga

SEQ ID NO: 527950 - DNA, 20 bp, mouse
gttacttcgcctgcccctcc

SEQ ID NO: 527951 - DNA, 20 bp, mouse
gcgcatcccggcgtgcaacg

SEQ ID NO: 527952 - DNA, 20 bp, mouse
gtgctctgcagcacactgag

SEQ ID NO: 527953 - DNA, 20 bp, mouse
gcctggcacggtgctcgaag

SEQ ID NO: 527954 - DNA, 20 bp, mouse
ggccgtgaaccatcgccctt

SEQ ID NO: 527955 - DNA, 20 bp, mouse
gggggagcgcccaagggcga

SEQ ID NO: 527956 - DNA, 20 bp, mouse
ggaaatggtagaggaaggtg

SEQ ID NO: 527957 - DNA, 20 bp, mouse
gctctgcccagaaatggtag

SEQ ID NO: 527958 - DNA, 20 bp, mouse
gagtcttctctgcccagaaa

SEQ ID NO: 527959 - DNA, 20 bp, mouse
gaattctgcaaccctctctg

SEQ ID NO: 527960 - DNA, 20 bp, mouse
gtccatgaggaacaaaggta

SEQ ID NO: 527961 - DNA, 20 bp, mouse
gaacagtggacagtgcgtgg

SEQ ID NO: 527962 - DNA, 20 bp, mouse
gccacctggacaaggagaaa

SEQ ID NO: 527963 - DNA, 20 bp, mouse
ggaagactggaatagataca

SEQ ID NO: 527964 - DNA, 20 bp, mouse
gatcacaggccacctggaca

SEQ ID NO: 527965 - DNA, 20 bp, mouse
ggccgagacagtcacatcac

SEQ ID NO: 527966 - DNA, 20 bp, mouse
gactctggcgctgccccgga

SEQ ID NO: 527967 - DNA, 20 bp, mouse
ggacccgggggcgccctccg

SEQ ID NO: 527968 - DNA, 20 bp, mouse
gctggcgatgtatctccgca

SEQ ID NO: 527969 - DNA, 20 bp, mouse
gcccgggtcccgcgccgctg

SEQ ID NO: 527970 - DNA, 20 bp, mouse
gatgcgctcagattcagcag

SEQ ID NO: 527971 - DNA, 20 bp, mouse
gaagaggtgaaggaacggat

SEQ ID NO: 527972 - DNA, 20 bp, mouse
gggtcccgcgccgctgggga

SEQ ID NO: 527973 - DNA, 20 bp, mouse
gccgaaccctgggccagtga

SEQ ID NO: 527974 - DNA, 20 bp, mouse
gggccagtgaaggaacagtg

SEQ ID NO: 527975 - DNA, 20 bp, mouse
gtgggccctagaagaagtgt

SEQ ID NO: 527976 - DNA, 20 bp, mouse
gaaccaggctcgccccggac

SEQ ID NO: 527977 - DNA, 20 bp, mouse
gaggccaaccagaccggacg

SEQ ID NO: 527978 - DNA, 20 bp, mouse
ggaccggcaacacccagcgc

SEQ ID NO: 527979 - DNA, 20 bp, mouse
gactcaccccgcctggaacc

SEQ ID NO: 527980 - DNA, 20 bp, mouse
gcctggaaccaggctcgccc

SEQ ID NO: 527981 - DNA, 20 bp, mouse
ggtcccccggcccagctcac

SEQ ID NO: 527982 - DNA, 20 bp, mouse
ggcaacacccagcgctggag

SEQ ID NO: 527983 - DNA, 20 bp, mouse
ggcgctggagcggcctcgtc

SEQ ID NO: 527984 - DNA, 20 bp, mouse
gagagaggccgcgcagccag

SEQ ID NO: 527985 - DNA, 20 bp, mouse
ggccagggcggtgagagtgg

SEQ ID NO: 527986 - DNA, 20 bp, mouse
gcagtcgcggcttgtcagag

SEQ ID NO: 527987 - DNA, 20 bp, mouse
gggcgctcgcaggccagtcg

SEQ ID NO: 527988 - DNA, 20 bp, mouse
gccttgctcgcacggcggaa

SEQ ID NO: 527989 - DNA, 20 bp, mouse
gccgcagcctcgccccgctc

SEQ ID NO: 527990 - DNA, 20 bp, mouse
gagagcggtcgctgccggag

SEQ ID NO: 527991 - DNA, 20 bp, mouse
gctcatccttgctcgcacgg

SEQ ID NO: 527992 - DNA, 20 bp, mouse
gccccgggtgctgaatggag

SEQ ID NO: 527993 - DNA, 20 bp, mouse
gtgctgaatggagaggaccg

SEQ ID NO: 527994 - DNA, 20 bp, mouse
ggttgagccgcggctcgtag

SEQ ID NO: 527995 - DNA, 20 bp, mouse
ggccctcgctaactcatccc

SEQ ID NO: 527996 - DNA, 20 bp, mouse
ggcacgcacggtcacaggca

SEQ ID NO: 527997 - DNA, 20 bp, mouse
ggcttgactgcaccccgggg

SEQ ID NO: 527998 - DNA, 20 bp, mouse
ggcagcggcggtagaagcag

SEQ ID NO: 527999 - DNA, 20 bp, mouse
ggtccgctgggtctcagcag

SEQ ID NO: 528000 - DNA, 20 bp, mouse
gacacgaaagaggcgcgggg

SEQ ID NO: 528001 - DNA, 20 bp, mouse
gacacccgcacaggacgccc

SEQ ID NO: 528002 - DNA, 20 bp, mouse
gccgggcccgcgggacgggg

SEQ ID NO: 528003 - DNA, 20 bp, mouse
ggccgccggagcccgggatg

SEQ ID NO: 528004 - DNA, 20 bp, mouse
ggcgccgggcccgcgggacg

SEQ ID NO: 528005 - DNA, 20 bp, mouse
gctgagacccagcggacgat

SEQ ID NO: 528006 - DNA, 20 bp, mouse
gtccactcggctcacctctg

SEQ ID NO: 528007 - DNA, 20 bp, mouse
gtggcgatgacaagcaagac

SEQ ID NO: 528008 - DNA, 20 bp, mouse
gcacgtggtataccaggata

SEQ ID NO: 528009 - DNA, 20 bp, mouse
ggcccgggaccaaggcgttc

SEQ ID NO: 528010 - DNA, 20 bp, mouse
gaggtgagccgagtggaaat

SEQ ID NO: 528011 - DNA, 20 bp, mouse
gggtataccaggatagggta

SEQ ID NO: 528012 - DNA, 20 bp, mouse
gtccagaacgccttggtccc

SEQ ID NO: 528013 - DNA, 20 bp, mouse
gaacttgctaaccagtgtga

SEQ ID NO: 528014 - DNA, 20 bp, mouse
gaacagaatccagaacgcct

SEQ ID NO: 528015 - DNA, 20 bp, mouse
gtaccaggatagggtaagga

SEQ ID NO: 528016 - DNA, 20 bp, mouse
ggctccagcagcgacgccgg

SEQ ID NO: 528017 - DNA, 20 bp, mouse
ggaaggagcgcagcaccgag

SEQ ID NO: 528018 - DNA, 20 bp, mouse
ggcagaagcgccctggcccg

SEQ ID NO: 528019 - DNA, 20 bp, mouse
ggcggctccagcagcgacgc

SEQ ID NO: 528020 - DNA, 20 bp, mouse
gcctcacctgccgcgggcca

SEQ ID NO: 528021 - DNA, 20 bp, mouse
ggaccccgccgtactcctcc

SEQ ID NO: 528022 - DNA, 20 bp, mouse
gaagcgccctggcccgcggc

SEQ ID NO: 528023 - DNA, 20 bp, mouse
gtccaggccaaccaccggga

SEQ ID NO: 528024 - DNA, 20 bp, mouse
ggaggctccaggccaaccac

SEQ ID NO: 528025 - DNA, 20 bp, mouse
ggcgcagcaccgaggggctg

SEQ ID NO: 528026 - DNA, 20 bp, mouse
ggcccgggagaggaggctac

SEQ ID NO: 528027 - DNA, 20 bp, mouse
gtgctggcggcctcgatctg

SEQ ID NO: 528028 - DNA, 20 bp, mouse
ggccggggccgagcagggtt

SEQ ID NO: 528029 - DNA, 20 bp, mouse
ggctgcgggcccgggagagg

SEQ ID NO: 528030 - DNA, 20 bp, mouse
gggcaaggcggcaagagccg

SEQ ID NO: 528031 - DNA, 20 bp, mouse
gccggcccagcctcagatcg

SEQ ID NO: 528032 - DNA, 20 bp, mouse
gtacaggcagggcgggaatg

SEQ ID NO: 528033 - DNA, 20 bp, mouse
ggggagatgaggctccgcaa

SEQ ID NO: 528034 - DNA, 20 bp, mouse
gagtcccgagcgccacacgg

SEQ ID NO: 528035 - DNA, 20 bp, mouse
gtgcgggcctgagcaggcgg

SEQ ID NO: 528036 - DNA, 20 bp, mouse
gctggcttgttgcaaacacg

SEQ ID NO: 528037 - DNA, 20 bp, mouse
gccaaggaatcacgggagac

SEQ ID NO: 528038 - DNA, 20 bp, mouse
ggacagaggagtcgagctcg

SEQ ID NO: 528039 - DNA, 20 bp, mouse
ggagatggtgtgtgcaccca

SEQ ID NO: 528040 - DNA, 20 bp, mouse
gtgtctgagtgcacgagtca

SEQ ID NO: 528041 - DNA, 20 bp, mouse
gggtgtcacacaaatctcgt

SEQ ID NO: 528042 - DNA, 20 bp, mouse
gccaaatgaaagaccatagt

SEQ ID NO: 528043 - DNA, 20 bp, mouse
ggcttgatagactgttctgg

SEQ ID NO: 528044 - DNA, 20 bp, mouse
ggagttaatactggatcatg

SEQ ID NO: 528045 - DNA, 20 bp, mouse
gccataatcagagctcagtc

SEQ ID NO: 528046 - DNA, 20 bp, mouse
ggaggtggagatgtctaacg

SEQ ID NO: 528047 - DNA, 20 bp, mouse
gggcagcatgagtgatcctt

SEQ ID NO: 528048 - DNA, 20 bp, mouse
gcacacaaaagcaagataat

SEQ ID NO: 528049 - DNA, 20 bp, mouse
gagcccgagtgccgttatga

SEQ ID NO: 528050 - DNA, 20 bp, mouse
gatccatcataacggcactc

SEQ ID NO: 528051 - DNA, 20 bp, mouse
gactgagcacggttactatc

SEQ ID NO: 528052 - DNA, 20 bp, mouse
gggcacagatgtaacaggag

SEQ ID NO: 528053 - DNA, 20 bp, mouse
gggagtgcaaacactgagca

SEQ ID NO: 528054 - DNA, 20 bp, mouse
gggagatgtctaacggggag

SEQ ID NO: 528055 - DNA, 20 bp, mouse
gttctcattcgaaagagagg

SEQ ID NO: 528056 - DNA, 20 bp, mouse
ggggtaggtcgatccgggaa

SEQ ID NO: 528057 - DNA, 20 bp, mouse
gcgatcaggacagaatggtt

SEQ ID NO: 528058 - DNA, 20 bp, mouse
ggccccctgagactgagatg

SEQ ID NO: 528059 - DNA, 20 bp, mouse
ggaagttgggtaggtcgatc

SEQ ID NO: 528060 - DNA, 20 bp, mouse
gctccaggaacagaggtccc

SEQ ID NO: 528061 - DNA, 20 bp, mouse
gagccttgctccaggaacag

SEQ ID NO: 528062 - DNA, 20 bp, mouse
ggctgcgcacggccccgaca

SEQ ID NO: 528063 - DNA, 20 bp, mouse
gccaaacgatcaggacagaa

SEQ ID NO: 528064 - DNA, 20 bp, mouse
gaggtttctgctacccttcc

SEQ ID NO: 528065 - DNA, 20 bp, mouse
ggactgagatgcggctacct

SEQ ID NO: 528066 - DNA, 20 bp, mouse
gcgcgcggcgctacaacccg

SEQ ID NO: 528067 - DNA, 20 bp, mouse
gctcctcagagggaacaatg

SEQ ID NO: 528068 - DNA, 20 bp, mouse
ggcgcgggccccgggaatga

SEQ ID NO: 528069 - DNA, 20 bp, mouse
gtcccgggccgcctcctcag

SEQ ID NO: 528070 - DNA, 20 bp, mouse
gagcgggcgggcgaggacga

SEQ ID NO: 528071 - DNA, 20 bp, mouse
gcctcagagccggctagagg

SEQ ID NO: 528072 - DNA, 20 bp, mouse
gcgccctcagagccggctag

SEQ ID NO: 528073 - DNA, 20 bp, mouse
gcgctcggccacccgcgctc

SEQ ID NO: 528074 - DNA, 20 bp, mouse
gagggaacaatgcggcgcct

SEQ ID NO: 528075 - DNA, 20 bp, mouse
ggaaacgcgaggccgctccc

SEQ ID NO: 528076 - DNA, 20 bp, mouse
gtgcttagggactccggtgg

SEQ ID NO: 528077 - DNA, 20 bp, mouse
gcggataaacaggaagcggg

SEQ ID NO: 528078 - DNA, 20 bp, mouse
gaacaggaagcgggcggcag

SEQ ID NO: 528079 - DNA, 20 bp, mouse
gagctgcttagggactccgg

SEQ ID NO: 528080 - DNA, 20 bp, mouse
gtccggctctcttcccccac

SEQ ID NO: 528081 - DNA, 20 bp, mouse
gcggagtgcccggatgagaa

SEQ ID NO: 528082 - DNA, 20 bp, mouse
gcacggaaggaggaccgagg

SEQ ID NO: 528083 - DNA, 20 bp, mouse
ggaagagagccggagacgcc

SEQ ID NO: 528084 - DNA, 20 bp, mouse
gcgaggcagcggctgacaaa

SEQ ID NO: 528085 - DNA, 20 bp, mouse
gaggcgcagtgcggataaac

SEQ ID NO: 528086 - DNA, 20 bp, mouse
gagaggcgagaactcagtcg

SEQ ID NO: 528087 - DNA, 20 bp, mouse
gcacacaggtaactgggtcg

SEQ ID NO: 528088 - DNA, 20 bp, mouse
gaactgggtcggggttgcca

SEQ ID NO: 528089 - DNA, 20 bp, mouse
gggcgagaactcagtcgggg

SEQ ID NO: 528090 - DNA, 20 bp, mouse
gtacacatctcttgccccac

SEQ ID NO: 528091 - DNA, 20 bp, mouse
gcagcactgcactctagctt

SEQ ID NO: 528092 - DNA, 20 bp, mouse
gtagggataagactagagtt

SEQ ID NO: 528093 - DNA, 20 bp, mouse
gtatagaaggggttcgtgta

SEQ ID NO: 528094 - DNA, 20 bp, mouse
gatttgcctagggattgtgg

SEQ ID NO: 528095 - DNA, 20 bp, mouse
gtaagcaaagaactaaggtt

SEQ ID NO: 528096 - DNA, 20 bp, mouse
gccggccgcgcgcagtagtc

SEQ ID NO: 528097 - DNA, 20 bp, mouse
gctgggaagatgcagttgac

SEQ ID NO: 528098 - DNA, 20 bp, mouse
gggccggctgcgcagcgata

SEQ ID NO: 528099 - DNA, 20 bp, mouse
gtgctcggggaacgtgacag

SEQ ID NO: 528100 - DNA, 20 bp, mouse
gccacgcgggtccgggtctg

SEQ ID NO: 528101 - DNA, 20 bp, mouse
gcggcacgccacacaggacg

SEQ ID NO: 528102 - DNA, 20 bp, mouse
gcgttccccgagcaccacgc

SEQ ID NO: 528103 - DNA, 20 bp, mouse
gcgcgggtccgggtctgcgg

SEQ ID NO: 528104 - DNA, 20 bp, mouse
ggcgcgcaggggacccctgg

SEQ ID NO: 528105 - DNA, 20 bp, mouse
gatcagcgccaggcaaacga

SEQ ID NO: 528106 - DNA, 20 bp, mouse
gtaaatagaaggtcggtcag

SEQ ID NO: 528107 - DNA, 20 bp, mouse
gagaaggtcggtcagcggca

SEQ ID NO: 528108 - DNA, 20 bp, mouse
gtcgtgcccgagtttggata

SEQ ID NO: 528109 - DNA, 20 bp, mouse
ggcgggaccgatgaaagtac

SEQ ID NO: 528110 - DNA, 20 bp, mouse
ggaaagtacgggtcccgaga

SEQ ID NO: 528111 - DNA, 20 bp, mouse
ggcccgcaaacaaccctctc

SEQ ID NO: 528112 - DNA, 20 bp, mouse
gcgggctgggtgttacagcg

SEQ ID NO: 528113 - DNA, 20 bp, mouse
gtcccgagagggttgtttgc

SEQ ID NO: 528114 - DNA, 20 bp, mouse
gctcgggacatgtcgcaagt

SEQ ID NO: 528115 - DNA, 20 bp, mouse
ggagtatttaaatagaaggt

SEQ ID NO: 528116 - DNA, 20 bp, mouse
gcccggggccaagggaagta

SEQ ID NO: 528117 - DNA, 20 bp, mouse
ggtgcctgagcaccaagatc

SEQ ID NO: 528118 - DNA, 20 bp, mouse
gtgcagacagcaacggggaa

SEQ ID NO: 528119 - DNA, 20 bp, mouse
gcaaactgcagacagcaacg

SEQ ID NO: 528120 - DNA, 20 bp, mouse
gagggcagcctgtacagaag

SEQ ID NO: 528121 - DNA, 20 bp, mouse
gccttggccccggggttcgt

SEQ ID NO: 528122 - DNA, 20 bp, mouse
gaagtccagggagacagtcg

SEQ ID NO: 528123 - DNA, 20 bp, mouse
gtgttgggcatctggaggtg

SEQ ID NO: 528124 - DNA, 20 bp, mouse
ggggctgaggtcctagagaa

SEQ ID NO: 528125 - DNA, 20 bp, mouse
ggacttgcccacgaaccccg

SEQ ID NO: 528126 - DNA, 20 bp, mouse
ggctgctgcgccagacacag

SEQ ID NO: 528127 - DNA, 20 bp, mouse
ggccttccccagcagcatgt

SEQ ID NO: 528128 - DNA, 20 bp, mouse
gcgcagccaggatggccaga

SEQ ID NO: 528129 - DNA, 20 bp, mouse
gagacagtgaggagcgtgaa

SEQ ID NO: 528130 - DNA, 20 bp, mouse
gatagagaacgggaaagatg

SEQ ID NO: 528131 - DNA, 20 bp, mouse
gcttaaaggtaaggttatag

SEQ ID NO: 528132 - DNA, 20 bp, mouse
gacggccagcgcagccagga

SEQ ID NO: 528133 - DNA, 20 bp, mouse
gcaggctcttcatggtgtct

SEQ ID NO: 528134 - DNA, 20 bp, mouse
gctgctccctctggccatcc

SEQ ID NO: 528135 - DNA, 20 bp, mouse
gccgtggcaaccctgtgcta

SEQ ID NO: 528136 - DNA, 20 bp, mouse
gccggccagccggagaggag

SEQ ID NO: 528137 - DNA, 20 bp, mouse
gcggtgggtacgcgttggtg

SEQ ID NO: 528138 - DNA, 20 bp, mouse
gctgtggagaggtgccgcgg

SEQ ID NO: 528139 - DNA, 20 bp, mouse
gggcggcggtgggtacgcgt

SEQ ID NO: 528140 - DNA, 20 bp, mouse
gcggctgcggcgtcctcaca

SEQ ID NO: 528141 - DNA, 20 bp, mouse
gaggaggagggtccgcgaca

SEQ ID NO: 528142 - DNA, 20 bp, mouse
gcggcgtcctcacacggaca

SEQ ID NO: 528143 - DNA, 20 bp, mouse
gcacggacatggcccaaaac

SEQ ID NO: 528144 - DNA, 20 bp, mouse
ggaggagaggttgtcggctg

SEQ ID NO: 528145 - DNA, 20 bp, mouse
gttctaccggccagccggag

SEQ ID NO: 528146 - DNA, 20 bp, mouse
gcagcacccacctgaatcca

SEQ ID NO: 528147 - DNA, 20 bp, mouse
gtagcctgggagcagcaccg

SEQ ID NO: 528148 - DNA, 20 bp, mouse
gcttctccctggattcaggt

SEQ ID NO: 528149 - DNA, 20 bp, mouse
ggtgccagcgcgggtcctgt

SEQ ID NO: 528150 - DNA, 20 bp, mouse
gtgggtgctgcgcacggcca

SEQ ID NO: 528151 - DNA, 20 bp, mouse
ggccgagcctgtgcacttct

SEQ ID NO: 528152 - DNA, 20 bp, mouse
gcaggtgtaaggctagagag

SEQ ID NO: 528153 - DNA, 20 bp, mouse
gacccacccactcctagcct

SEQ ID NO: 528154 - DNA, 20 bp, mouse
gagtcacccgggacactgta

SEQ ID NO: 528155 - DNA, 20 bp, mouse
gcggccacggtgctgctccc

SEQ ID NO: 528156 - DNA, 20 bp, mouse
ggaagtcagatgaagagcat

SEQ ID NO: 528157 - DNA, 20 bp, mouse
gcccatctcggggaaggagt

SEQ ID NO: 528158 - DNA, 20 bp, mouse
gggagaagaccagcccctca

SEQ ID NO: 528159 - DNA, 20 bp, mouse
gctttcacagaactgtttgt

SEQ ID NO: 528160 - DNA, 20 bp, mouse
gtcagagagtgaaagaaaga

SEQ ID NO: 528161 - DNA, 20 bp, mouse
gggtgctttaggaccctgag

SEQ ID NO: 528162 - DNA, 20 bp, mouse
gagtgaaagaaagatggccg

SEQ ID NO: 528163 - DNA, 20 bp, mouse
ggtgttcttactttgctgac

SEQ ID NO: 528164 - DNA, 20 bp, mouse
ggccccaggagtctcaggca

SEQ ID NO: 528165 - DNA, 20 bp, mouse
ggagagcacagacagccgtt

SEQ ID NO: 528166 - DNA, 20 bp, mouse
gaggtgagccaggtaagtgc

SEQ ID NO: 528167 - DNA, 20 bp, mouse
ggcagctgccagcacttacc

SEQ ID NO: 528168 - DNA, 20 bp, mouse
ggtctgtaccaggcgcacga

SEQ ID NO: 528169 - DNA, 20 bp, mouse
gagcatgcagggagggcgga

SEQ ID NO: 528170 - DNA, 20 bp, mouse
ggagaagcacagcagtgcct

SEQ ID NO: 528171 - DNA, 20 bp, mouse
gcctaagctacaccatcggg

SEQ ID NO: 528172 - DNA, 20 bp, mouse
gaggcgcacgaaggtgagcc

SEQ ID NO: 528173 - DNA, 20 bp, mouse
gcggggggagcatgcaggga

SEQ ID NO: 528174 - DNA, 20 bp, mouse
gagctgcagtgagtaaggtc

SEQ ID NO: 528175 - DNA, 20 bp, mouse
gtaactcagggaggttctca

SEQ ID NO: 528176 - DNA, 20 bp, mouse
gactggggaccacaccatca

SEQ ID NO: 528177 - DNA, 20 bp, mouse
gagtgaagaacgaggtctct

SEQ ID NO: 528178 - DNA, 20 bp, mouse
gcgtaagagtcagggaacaa

SEQ ID NO: 528179 - DNA, 20 bp, mouse
ggatattcagcctggaagga

SEQ ID NO: 528180 - DNA, 20 bp, mouse
gtgtggtccccagtgctcct

SEQ ID NO: 528181 - DNA, 20 bp, mouse
gaatgaccaagtgaagaacg

SEQ ID NO: 528182 - DNA, 20 bp, mouse
gtcctggagggccacagcca

SEQ ID NO: 528183 - DNA, 20 bp, mouse
ggctgactggaagctgtgtg

SEQ ID NO: 528184 - DNA, 20 bp, mouse
ggtcaagaagcggcaatcag

SEQ ID NO: 528185 - DNA, 20 bp, mouse
gaatgcagccgtaagagtca

SEQ ID NO: 528186 - DNA, 20 bp, mouse
gggtctcagtctgcagagtc

SEQ ID NO: 528187 - DNA, 20 bp, mouse
ggctgggccagcgccccatc

SEQ ID NO: 528188 - DNA, 20 bp, mouse
ggggaaaatgtagctacgaa

SEQ ID NO: 528189 - DNA, 20 bp, mouse
ggtagccggatgataccgaa

SEQ ID NO: 528190 - DNA, 20 bp, mouse
gttcagaaattaacactctc

SEQ ID NO: 528191 - DNA, 20 bp, mouse
gtaagcccttcggtatcatc

SEQ ID NO: 528192 - DNA, 20 bp, mouse
gtagctacattttcccgatg

SEQ ID NO: 528193 - DNA, 20 bp, mouse
gacggaagggagcgtcgcat

SEQ ID NO: 528194 - DNA, 20 bp, mouse
ggcttgtccaggatccttgg

SEQ ID NO: 528195 - DNA, 20 bp, mouse
gttcctcttgcgctacggaa

SEQ ID NO: 528196 - DNA, 20 bp, mouse
gagcagctcggggtcccccg

SEQ ID NO: 528197 - DNA, 20 bp, mouse
gctgcgtagagcaccgagag

SEQ ID NO: 528198 - DNA, 20 bp, mouse
ggctgtcaccgcctccccgg

SEQ ID NO: 528199 - DNA, 20 bp, mouse
gtctaggagcttggctatga

SEQ ID NO: 528200 - DNA, 20 bp, mouse
ggcagctgccccccatacga

SEQ ID NO: 528201 - DNA, 20 bp, mouse
gcagagcgagtgtctcggag

SEQ ID NO: 528202 - DNA, 20 bp, mouse
gagtgagtccatcgtatggg

SEQ ID NO: 528203 - DNA, 20 bp, mouse
gaggcagtgagtccatcgta

SEQ ID NO: 528204 - DNA, 20 bp, mouse
gggcagtgaaagtgtggagt

SEQ ID NO: 528205 - DNA, 20 bp, mouse
gcccacaccgcagcgcccgg

SEQ ID NO: 528206 - DNA, 20 bp, mouse
gagccgcgtccaggcccgag

SEQ ID NO: 528207 - DNA, 20 bp, mouse
gtcctcagcgacaacgggat

SEQ ID NO: 528208 - DNA, 20 bp, mouse
gcgagagcggctccacatcc

SEQ ID NO: 528209 - DNA, 20 bp, mouse
gaggtgctcctcagcgacaa

SEQ ID NO: 528210 - DNA, 20 bp, mouse
gcgcctcgtgaggaactgcg

SEQ ID NO: 528211 - DNA, 20 bp, mouse
gagtccccgccgggcgagag

SEQ ID NO: 528212 - DNA, 20 bp, mouse
gtcctcacgaggcgccgctc

SEQ ID NO: 528213 - DNA, 20 bp, mouse
ggcgagccgccggccctcag

SEQ ID NO: 528214 - DNA, 20 bp, mouse
gtccgggtacagccgcgtcc

SEQ ID NO: 528215 - DNA, 20 bp, mouse
gcacctcgcagttcctcacg

SEQ ID NO: 528216 - DNA, 20 bp, mouse
gcgtggtggggctccctggt

SEQ ID NO: 528217 - DNA, 20 bp, mouse
gtagtcggggagccgtggtg

SEQ ID NO: 528218 - DNA, 20 bp, mouse
gctcttgcgctagcccacca

SEQ ID NO: 528219 - DNA, 20 bp, mouse
gtgggctagcgcaagagagg

SEQ ID NO: 528220 - DNA, 20 bp, mouse
ggactgtagtcggggagccg

SEQ ID NO: 528221 - DNA, 20 bp, mouse
ggcgccccgcgactgtagtc

SEQ ID NO: 528222 - DNA, 20 bp, mouse
ggcagcgcagaggctgacag

SEQ ID NO: 528223 - DNA, 20 bp, mouse
gctcaggggcgggtattcct

SEQ ID NO: 528224 - DNA, 20 bp, mouse
gggcgtcctcccagcgacgg

SEQ ID NO: 528225 - DNA, 20 bp, mouse
ggctccccgactacagtcgc

SEQ ID NO: 528226 - DNA, 20 bp, mouse
ggcgccagcgcagagcacag

SEQ ID NO: 528227 - DNA, 20 bp, mouse
gtgcctggtggcagaaaccg

SEQ ID NO: 528228 - DNA, 20 bp, mouse
gggaggactgcggagtacgg

SEQ ID NO: 528229 - DNA, 20 bp, mouse
ggaaagcaagagatgcctgg

SEQ ID NO: 528230 - DNA, 20 bp, mouse
gcccaggctgtccccagagg

SEQ ID NO: 528231 - DNA, 20 bp, mouse
gactgcggagtacggaggtt

SEQ ID NO: 528232 - DNA, 20 bp, mouse
gcgctgcggtccaaactctt

SEQ ID NO: 528233 - DNA, 20 bp, mouse
gcggggagttccaaagagtt

SEQ ID NO: 528234 - DNA, 20 bp, mouse
gagaggaggactgcggagta

SEQ ID NO: 528235 - DNA, 20 bp, mouse
ggctggaccttgagcagcgg

SEQ ID NO: 528236 - DNA, 20 bp, mouse
gctcagacagaggacaagaa

SEQ ID NO: 528237 - DNA, 20 bp, mouse
gagaaccgcaggcacccggc

SEQ ID NO: 528238 - DNA, 20 bp, mouse
ggggccgcctcgctagctcc

SEQ ID NO: 528239 - DNA, 20 bp, mouse
ggcctcgctagctccgggct

SEQ ID NO: 528240 - DNA, 20 bp, mouse
ggcagaaatccgggacccag

SEQ ID NO: 528241 - DNA, 20 bp, mouse
gtctgagggcgcagaaatcc

SEQ ID NO: 528242 - DNA, 20 bp, mouse
ggtgggtctgagatcccgga

SEQ ID NO: 528243 - DNA, 20 bp, mouse
gccctccggggcgtccagta

SEQ ID NO: 528244 - DNA, 20 bp, mouse
ggccgagcccggagctagcg

SEQ ID NO: 528245 - DNA, 20 bp, mouse
gccgcggctcacagaaccgc

SEQ ID NO: 528246 - DNA, 20 bp, mouse
gtagcccgcagcgtccggcg

SEQ ID NO: 528247 - DNA, 20 bp, mouse
gctgccgcgccggacgctgc

SEQ ID NO: 528248 - DNA, 20 bp, mouse
ggctgcgggctagcgcgcgg

SEQ ID NO: 528249 - DNA, 20 bp, mouse
ggcacgcgtccgccagaggg

SEQ ID NO: 528250 - DNA, 20 bp, mouse
gcgcgctagcccgcagcgtc

SEQ ID NO: 528251 - DNA, 20 bp, mouse
ggcggggccagcacatggga

SEQ ID NO: 528252 - DNA, 20 bp, mouse
ggggctgcggctgcgtgtcc

SEQ ID NO: 528253 - DNA, 20 bp, mouse
ggccgccgaccggcacaccg

SEQ ID NO: 528254 - DNA, 20 bp, mouse
gggaggcacaaggcaccggg

SEQ ID NO: 528255 - DNA, 20 bp, mouse
gcagagcgggaagcgcagag

SEQ ID NO: 528256 - DNA, 20 bp, mouse
gggttaaagcagagacccta

SEQ ID NO: 528257 - DNA, 20 bp, mouse
ggccatgccagccactacct

SEQ ID NO: 528258 - DNA, 20 bp, mouse
gcagaaccttcagctcctta

SEQ ID NO: 528259 - DNA, 20 bp, mouse
gaggaagagacccccaggag

SEQ ID NO: 528260 - DNA, 20 bp, mouse
gcagttccactatcccactg

SEQ ID NO: 528261 - DNA, 20 bp, mouse
ggcgtgagcgcacatgtgag

SEQ ID NO: 528262 - DNA, 20 bp, mouse
ggaggtgagagaacattcac

SEQ ID NO: 528263 - DNA, 20 bp, mouse
gtggtggtaataggccacgt

SEQ ID NO: 528264 - DNA, 20 bp, mouse
gtggcctattaccaccagtg

SEQ ID NO: 528265 - DNA, 20 bp, mouse
gtctctgctttaacctcagt

SEQ ID NO: 528266 - DNA, 20 bp, mouse
ggcgggccgcggtgagtaag

SEQ ID NO: 528267 - DNA, 20 bp, mouse
gggccgcggtgagtaagcgg

SEQ ID NO: 528268 - DNA, 20 bp, mouse
gccgcggccggcccacaatg

SEQ ID NO: 528269 - DNA, 20 bp, mouse
gcggcccacaatgaggacag

SEQ ID NO: 528270 - DNA, 20 bp, mouse
gggccgccgcttactcaccg

SEQ ID NO: 528271 - DNA, 20 bp, mouse
gaggcttcgcgggcaggtcg

SEQ ID NO: 528272 - DNA, 20 bp, mouse
ggtgccacctgaccccgagt

SEQ ID NO: 528273 - DNA, 20 bp, mouse
gggccctgccggagcgcaag

SEQ ID NO: 528274 - DNA, 20 bp, mouse
ggccagtgcgagggctaccg

SEQ ID NO: 528275 - DNA, 20 bp, mouse
gcaatgaggacagcgggccg

SEQ ID NO: 528276 - DNA, 20 bp, mouse
gcaggcgtcaagagtgtgtg

SEQ ID NO: 528277 - DNA, 20 bp, mouse
ggctggaagaagagaacacc

SEQ ID NO: 528278 - DNA, 20 bp, mouse
gcgccgaccaccagccgggc

SEQ ID NO: 528279 - DNA, 20 bp, mouse
gggacccgccgaccaccagc

SEQ ID NO: 528280 - DNA, 20 bp, mouse
gcgcgtctcgggcccaagag

SEQ ID NO: 528281 - DNA, 20 bp, mouse
gccgagacgcgcaggaggcc

SEQ ID NO: 528282 - DNA, 20 bp, mouse
ggtgtggggcgccggtctcc

SEQ ID NO: 528283 - DNA, 20 bp, mouse
gaagaggcggggcctctagg

SEQ ID NO: 528284 - DNA, 20 bp, mouse
gctggctacaggcccctctt

SEQ ID NO: 528285 - DNA, 20 bp, mouse
gttccagcccggctggtggt

SEQ ID NO: 528286 - DNA, 20 bp, mouse
gggagtcacgtgagagtggg

SEQ ID NO: 528287 - DNA, 20 bp, mouse
ggcgtctctatggttgtcag

SEQ ID NO: 528288 - DNA, 20 bp, mouse
ggtggagaggatgcactctg

SEQ ID NO: 528289 - DNA, 20 bp, mouse
gctaaagctggagcgcggac

SEQ ID NO: 528290 - DNA, 20 bp, mouse
gcccggcatttgcgtctcta

SEQ ID NO: 528291 - DNA, 20 bp, mouse
ggtcacgtgagagtgggcgg

SEQ ID NO: 528292 - DNA, 20 bp, mouse
gaagatcccggcaggcccag

SEQ ID NO: 528293 - DNA, 20 bp, mouse
ggatagggtgaagggagcgg

SEQ ID NO: 528294 - DNA, 20 bp, mouse
gtctccctgacagggataag

SEQ ID NO: 528295 - DNA, 20 bp, mouse
ggggcggaggacgcagagcg

SEQ ID NO: 528296 - DNA, 20 bp, mouse
ggcttccgcaaagatggcgg

SEQ ID NO: 528297 - DNA, 20 bp, mouse
ggcgcgcgagggctcccgaa

SEQ ID NO: 528298 - DNA, 20 bp, mouse
gctgcgagagggccgcgagt

SEQ ID NO: 528299 - DNA, 20 bp, mouse
gggctgcgggaagaagcgct

SEQ ID NO: 528300 - DNA, 20 bp, mouse
gctcgggcaacagacggtga

SEQ ID NO: 528301 - DNA, 20 bp, mouse
gggaagaagcgcttggctgg

SEQ ID NO: 528302 - DNA, 20 bp, mouse
ggagggctcccgaacggtgt

SEQ ID NO: 528303 - DNA, 20 bp, mouse
gcggaggcacaggagaccct

SEQ ID NO: 528304 - DNA, 20 bp, mouse
gtcgggcgcttccgcaaaga

SEQ ID NO: 528305 - DNA, 20 bp, mouse
gaacggtgtcggcgcaggta

SEQ ID NO: 528306 - DNA, 20 bp, mouse
gctcggagcatcagagaatt

SEQ ID NO: 528307 - DNA, 20 bp, mouse
ggccacgccgtggtagagga

SEQ ID NO: 528308 - DNA, 20 bp, mouse
gctgctctgggtgccctgct

SEQ ID NO: 528309 - DNA, 20 bp, mouse
gcgggcgccgtcctctacca

SEQ ID NO: 528310 - DNA, 20 bp, mouse
gaggacggcgcccgtaacca

SEQ ID NO: 528311 - DNA, 20 bp, mouse
ggactttatgattgaagcaa

SEQ ID NO: 528312 - DNA, 20 bp, mouse
ggccgtgggatgcagcgcac

SEQ ID NO: 528313 - DNA, 20 bp, mouse
ggagaattcggcaccgagca

SEQ ID NO: 528314 - DNA, 20 bp, mouse
gcctcagcccagccacgccg

SEQ ID NO: 528315 - DNA, 20 bp, mouse
ggcccgtgcgctgcatccca

SEQ ID NO: 528316 - DNA, 20 bp, mouse
gcaggctagcgaggaccgcc

SEQ ID NO: 528317 - DNA, 20 bp, mouse
gcagttcacagggacgtcgt

SEQ ID NO: 528318 - DNA, 20 bp, mouse
gagtcgggcgcaggctagcg

SEQ ID NO: 528319 - DNA, 20 bp, mouse
gctggcgcgggtaggtagta

SEQ ID NO: 528320 - DNA, 20 bp, mouse
ggcaactcggtcgaatccac

SEQ ID NO: 528321 - DNA, 20 bp, mouse
gtgggagtaacaggtcgcag

SEQ ID NO: 528322 - DNA, 20 bp, mouse
gcgggtaggtagtaaggacg

SEQ ID NO: 528323 - DNA, 20 bp, mouse
ggcgttccagcagatccatt

SEQ ID NO: 528324 - DNA, 20 bp, mouse
gacttttcataggctggaaa

SEQ ID NO: 528325 - DNA, 20 bp, mouse
gctccctgccggatgggtca

SEQ ID NO: 528326 - DNA, 20 bp, mouse
gacctgtgggtcctccaagg

SEQ ID NO: 528327 - DNA, 20 bp, mouse
gtcgcctcggatcagctgaa

SEQ ID NO: 528328 - DNA, 20 bp, mouse
gcagccattcagctgatccg

SEQ ID NO: 528329 - DNA, 20 bp, mouse
gacccaggaagcatagggag

SEQ ID NO: 528330 - DNA, 20 bp, mouse
ggagcagtctgtacttgccc

SEQ ID NO: 528331 - DNA, 20 bp, mouse
gtacagactgctcttcgcct

SEQ ID NO: 528332 - DNA, 20 bp, mouse
ggcctccttggaggacccac

SEQ ID NO: 528333 - DNA, 20 bp, mouse
gtcctccaaggaggctgctc

SEQ ID NO: 528334 - DNA, 20 bp, mouse
gtgccccggagcagcctcct

SEQ ID NO: 528335 - DNA, 20 bp, mouse
ggaatcgctccccctctcca

SEQ ID NO: 528336 - DNA, 20 bp, mouse
gctgatcggactgtgagtaa

SEQ ID NO: 528337 - DNA, 20 bp, mouse
gcgctgctgcggtcactgat

SEQ ID NO: 528338 - DNA, 20 bp, mouse
gctgtgagtaagggcgactg

SEQ ID NO: 528339 - DNA, 20 bp, mouse
gctggccagagaaggcacaa

SEQ ID NO: 528340 - DNA, 20 bp, mouse
gagcagccgggcctcacgaa

SEQ ID NO: 528341 - DNA, 20 bp, mouse
gctgcccaagggcgctgctg

SEQ ID NO: 528342 - DNA, 20 bp, mouse
gacgcaagcactgagaacca

SEQ ID NO: 528343 - DNA, 20 bp, mouse
gtcagtgcttgcgttgcgga

SEQ ID NO: 528344 - DNA, 20 bp, mouse
ggagcacctggaatgggcag

SEQ ID NO: 528345 - DNA, 20 bp, mouse
ggaggaggagacatcagggg

SEQ ID NO: 528346 - DNA, 20 bp, mouse
ggtgctgcctctggaccgag

SEQ ID NO: 528347 - DNA, 20 bp, mouse
gtcccgcgtctaggtctccc

SEQ ID NO: 528348 - DNA, 20 bp, mouse
gttttcgcctctcggtccag

SEQ ID NO: 528349 - DNA, 20 bp, mouse
gtgcggcggaaatgacagtg

SEQ ID NO: 528350 - DNA, 20 bp, mouse
gtggtgctgcggtggtgtca

SEQ ID NO: 528351 - DNA, 20 bp, mouse
ggcccgggagacctagacgc

SEQ ID NO: 528352 - DNA, 20 bp, mouse
gcggcggcctagagtggtgg

SEQ ID NO: 528353 - DNA, 20 bp, mouse
gaagcgcgcctccagaggag

SEQ ID NO: 528354 - DNA, 20 bp, mouse
gtgacagtgtggtgctgcgg

SEQ ID NO: 528355 - DNA, 20 bp, mouse
gcagcccgcgcgccccacgg

SEQ ID NO: 528356 - DNA, 20 bp, mouse
gcgccgctcgcaagatctgg

SEQ ID NO: 528357 - DNA, 20 bp, mouse
gcggctgcggctgttgctaa

SEQ ID NO: 528358 - DNA, 20 bp, mouse
gcacgacccgagagggatcc

SEQ ID NO: 528359 - DNA, 20 bp, mouse
gatcttgcgagcggcggctg

SEQ ID NO: 528360 - DNA, 20 bp, mouse
gctaagggaagggacgcgcg

SEQ ID NO: 528361 - DNA, 20 bp, mouse
gacggtgcctggatccctct

SEQ ID NO: 528362 - DNA, 20 bp, mouse
gggggtagcacgacccgaga

SEQ ID NO: 528363 - DNA, 20 bp, mouse
ggatgacagcgacctgggta

SEQ ID NO: 528364 - DNA, 20 bp, mouse
gcacccccagatcttgcgag

SEQ ID NO: 528365 - DNA, 20 bp, mouse
ggcgcgcgctggagaactgg

SEQ ID NO: 528366 - DNA, 20 bp, mouse
gcggtcccgcccctactcac

SEQ ID NO: 528367 - DNA, 20 bp, mouse
gcgcaggtcatctggagcag

SEQ ID NO: 528368 - DNA, 20 bp, mouse
gctacggagccggtgagtag

SEQ ID NO: 528369 - DNA, 20 bp, mouse
gcgcccgcccggccccagac

SEQ ID NO: 528370 - DNA, 20 bp, mouse
gtatgggtcctggcaagagg

SEQ ID NO: 528371 - DNA, 20 bp, mouse
ggcccggccccagaccggca

SEQ ID NO: 528372 - DNA, 20 bp, mouse
gatgacctgcgtatgggtcc

SEQ ID NO: 528373 - DNA, 20 bp, mouse
gtcaccggctccgtaggtcc

SEQ ID NO: 528374 - DNA, 20 bp, mouse
gctccagatgacctgcgtat

SEQ ID NO: 528375 - DNA, 20 bp, mouse
gtctggagcagtggtgaccc

SEQ ID NO: 528376 - DNA, 20 bp, mouse
gtgacccggagagaggtact

SEQ ID NO: 528377 - DNA, 20 bp, mouse
gtgatgggtgacccggagag

SEQ ID NO: 528378 - DNA, 20 bp, mouse
ggtcgtgccccggaagtaga

SEQ ID NO: 528379 - DNA, 20 bp, mouse
ggagagaggtactgggcgag

SEQ ID NO: 528380 - DNA, 20 bp, mouse
ggggcgagtggcgagtcctg

SEQ ID NO: 528381 - DNA, 20 bp, mouse
gtccgggtcacccatcaaca

SEQ ID NO: 528382 - DNA, 20 bp, mouse
gggtacaacgcccagaggac

SEQ ID NO: 528383 - DNA, 20 bp, mouse
gccacgcgctacctttcctc

SEQ ID NO: 528384 - DNA, 20 bp, mouse
gtgagtgagggagcgaatga

SEQ ID NO: 528385 - DNA, 20 bp, mouse
gtcgctccctcactcacccg

SEQ ID NO: 528386 - DNA, 20 bp, mouse
gcgaacgccgaggcccgagg

SEQ ID NO: 528387 - DNA, 20 bp, mouse
gcccaggactcgcctaggaa

SEQ ID NO: 528388 - DNA, 20 bp, mouse
gagggcgagtaggaccctgg

SEQ ID NO: 528389 - DNA, 20 bp, mouse
gacccaaggacagggcgagt

SEQ ID NO: 528390 - DNA, 20 bp, mouse
gaggcggcaagtgacccgaa

SEQ ID NO: 528391 - DNA, 20 bp, mouse
ggacagggcgagtaggaccc

SEQ ID NO: 528392 - DNA, 20 bp, mouse
gcctcggcgttcggttcccg

SEQ ID NO: 528393 - DNA, 20 bp, mouse
gcgcatcccggggcaggtgg

SEQ ID NO: 528394 - DNA, 20 bp, mouse
gagcgcatggacccaaggac

SEQ ID NO: 528395 - DNA, 20 bp, mouse
gggaggcccaggactcgcct

SEQ ID NO: 528396 - DNA, 20 bp, mouse
gggagcgggcagcaatgagt

SEQ ID NO: 528397 - DNA, 20 bp, mouse
gagcagccctgcagcggagc

SEQ ID NO: 528398 - DNA, 20 bp, mouse
ggagggggcactacggacac

SEQ ID NO: 528399 - DNA, 20 bp, mouse
ggcgctcgccagctccaggt

SEQ ID NO: 528400 - DNA, 20 bp, mouse
gatgagtggggagccagcgc

SEQ ID NO: 528401 - DNA, 20 bp, mouse
gggcagtggagtccacatcg

SEQ ID NO: 528402 - DNA, 20 bp, mouse
ggcactacggacaccggcgc

SEQ ID NO: 528403 - DNA, 20 bp, mouse
gcttccacctccccgggagg

SEQ ID NO: 528404 - DNA, 20 bp, mouse
gctgtgaaggaggagtatcc

SEQ ID NO: 528405 - DNA, 20 bp, mouse
ggtagtgccccctcccgggg

SEQ ID NO: 528406 - DNA, 20 bp, mouse
gggctgcaggcggatggatg

SEQ ID NO: 528407 - DNA, 20 bp, mouse
gtggatggggcgtctccagg

SEQ ID NO: 528408 - DNA, 20 bp, mouse
gatggggcgtctccaggcgg

SEQ ID NO: 528409 - DNA, 20 bp, mouse
gtcccaggctgcgagtctcc

SEQ ID NO: 528410 - DNA, 20 bp, mouse
gcagccctcccggtacactc

SEQ ID NO: 528411 - DNA, 20 bp, mouse
gggatggatggggcgtctcc

SEQ ID NO: 528412 - DNA, 20 bp, mouse
gctgcccgagtgtaccggga

SEQ ID NO: 528413 - DNA, 20 bp, mouse
gaagttaggagtcttccggg

SEQ ID NO: 528414 - DNA, 20 bp, mouse
gggcggcgctctcccgtggg

SEQ ID NO: 528415 - DNA, 20 bp, mouse
gtcgggcgacgattcggagg

SEQ ID NO: 528416 - DNA, 20 bp, mouse
ggccgggccggacaacaggt

SEQ ID NO: 528417 - DNA, 20 bp, mouse
ggccgaagcggcggcggaga

SEQ ID NO: 528418 - DNA, 20 bp, mouse
ggcgggtcgcggccagaacc

SEQ ID NO: 528419 - DNA, 20 bp, mouse
gcgcgttcccgccgaagcgg

SEQ ID NO: 528420 - DNA, 20 bp, mouse
ggcggcccaggcgcacatcc

SEQ ID NO: 528421 - DNA, 20 bp, mouse
gagaacccggatgtgcgcct

SEQ ID NO: 528422 - DNA, 20 bp, mouse
gctgcgcgttcccgccgaag

SEQ ID NO: 528423 - DNA, 20 bp, mouse
gccaccgggtcacatcgccg

SEQ ID NO: 528424 - DNA, 20 bp, mouse
ggttcccgccgaagcggcgg

SEQ ID NO: 528425 - DNA, 20 bp, mouse
gccggacaacaggtgggcag

SEQ ID NO: 528426 - DNA, 20 bp, mouse
ggccggaccaggtcgaccca

SEQ ID NO: 528427 - DNA, 20 bp, mouse
gcatggcggaggtgagtgag

SEQ ID NO: 528428 - DNA, 20 bp, mouse
gtcgacccagggcagtgtgt

SEQ ID NO: 528429 - DNA, 20 bp, mouse
gcgcgcacgctcggccatgg

SEQ ID NO: 528430 - DNA, 20 bp, mouse
gtgagtgagcggctgggtag

SEQ ID NO: 528431 - DNA, 20 bp, mouse
gcggaggtgagtgagcggct

SEQ ID NO: 528432 - DNA, 20 bp, mouse
gagggcgccgcggaccgggt

SEQ ID NO: 528433 - DNA, 20 bp, mouse
gccgcgcgcacgctcggcca

SEQ ID NO: 528434 - DNA, 20 bp, mouse
ggctcggactgggagagcac

SEQ ID NO: 528435 - DNA, 20 bp, mouse
gggagagcacgggccggacc

SEQ ID NO: 528436 - DNA, 20 bp, mouse
gcgccctaaaggtaccaata

SEQ ID NO: 528437 - DNA, 20 bp, mouse
gccaatatggcggaggtgag

SEQ ID NO: 528438 - DNA, 20 bp, mouse
ggagcggagaaaccgggcag

SEQ ID NO: 528439 - DNA, 20 bp, mouse
gcctaaaggtaccaatatgg

SEQ ID NO: 528440 - DNA, 20 bp, mouse
ggccgcggcctagtcccgaa

SEQ ID NO: 528441 - DNA, 20 bp, mouse
gcggaggtgagcggagaaac

SEQ ID NO: 528442 - DNA, 20 bp, mouse
gaaaggtaccaatatggcgg

SEQ ID NO: 528443 - DNA, 20 bp, mouse
ggcagccggcccgagagcca

SEQ ID NO: 528444 - DNA, 20 bp, mouse
gtggctcaggcgccccatcc

SEQ ID NO: 528445 - DNA, 20 bp, mouse
gccgccaggcacccgcccgg

SEQ ID NO: 528446 - DNA, 20 bp, mouse
gagcggcagccggcttgggg

SEQ ID NO: 528447 - DNA, 20 bp, mouse
ggacgtcagcggaggcggag

SEQ ID NO: 528448 - DNA, 20 bp, mouse
gcgtagtctgacgtcagcgg

SEQ ID NO: 528449 - DNA, 20 bp, mouse
gggacgtagtctgacgtcag

SEQ ID NO: 528450 - DNA, 20 bp, mouse
ggctcagtaccgccccaagc

SEQ ID NO: 528451 - DNA, 20 bp, mouse
ggccaccggcaagcccgcac

SEQ ID NO: 528452 - DNA, 20 bp, mouse
gaagcccgcacaggtttgca

SEQ ID NO: 528453 - DNA, 20 bp, mouse
gccgacgtgtgaggagggat

SEQ ID NO: 528454 - DNA, 20 bp, mouse
gagtctgacgtcagcggagg

SEQ ID NO: 528455 - DNA, 20 bp, mouse
ggccggcccgacgtgtgagg

SEQ ID NO: 528456 - DNA, 20 bp, mouse
ggcaagggatatggtgaccc

SEQ ID NO: 528457 - DNA, 20 bp, mouse
gtgccccgctcaggtgaact

SEQ ID NO: 528458 - DNA, 20 bp, mouse
ggcttggcgcggagacggat

SEQ ID NO: 528459 - DNA, 20 bp, mouse
ggacctagttcacctgagcg

SEQ ID NO: 528460 - DNA, 20 bp, mouse
gcaggtcgcaccccgcgccg

SEQ ID NO: 528461 - DNA, 20 bp, mouse
gcgtgggaggagcttcggga

SEQ ID NO: 528462 - DNA, 20 bp, mouse
gcatatcccttgccccgctc

SEQ ID NO: 528463 - DNA, 20 bp, mouse
ggatatggtgaccccggcgc

SEQ ID NO: 528464 - DNA, 20 bp, mouse
gaactaggtcagactctccc

SEQ ID NO: 528465 - DNA, 20 bp, mouse
gtccgcgccaagcgagggag

SEQ ID NO: 528466 - DNA, 20 bp, mouse
ggctgatctcgggaccacag

SEQ ID NO: 528467 - DNA, 20 bp, mouse
gcatggcagccgctgatctc

SEQ ID NO: 528468 - DNA, 20 bp, mouse
gggacgaaggcacgcctctg

SEQ ID NO: 528469 - DNA, 20 bp, mouse
gtaccggtctagcgggacga

SEQ ID NO: 528470 - DNA, 20 bp, mouse
ggggaatctgggctttcggg

SEQ ID NO: 528471 - DNA, 20 bp, mouse
gaagtctccaggggcctgta

SEQ ID NO: 528472 - DNA, 20 bp, mouse
gcgctagaccggtagagaag

SEQ ID NO: 528473 - DNA, 20 bp, mouse
ggctttcgggcggagagcgt

SEQ ID NO: 528474 - DNA, 20 bp, mouse
gccccggctgctgggaatct

SEQ ID NO: 528475 - DNA, 20 bp, mouse
gtctccaggggcctgtaggg

SEQ ID NO: 528476 - DNA, 20 bp, mouse
gacctctcatcaacaaggac

SEQ ID NO: 528477 - DNA, 20 bp, mouse
gggtggagggggatcctaag

SEQ ID NO: 528478 - DNA, 20 bp, mouse
ggagcaggtacactatccac

SEQ ID NO: 528479 - DNA, 20 bp, mouse
ggcctgtccttgttgatgag

SEQ ID NO: 528480 - DNA, 20 bp, mouse
gcacaggtggatcgcagcta

SEQ ID NO: 528481 - DNA, 20 bp, mouse
ggatcgcagctagggctctg

SEQ ID NO: 528482 - DNA, 20 bp, mouse
gtaccaacctcaggaatcca

SEQ ID NO: 528483 - DNA, 20 bp, mouse
gactgggacttcaggtggag

SEQ ID NO: 528484 - DNA, 20 bp, mouse
gttctctacaataagcagga

SEQ ID NO: 528485 - DNA, 20 bp, mouse
gttgtcttaatgttttggat

SEQ ID NO: 528486 - DNA, 20 bp, mouse
gctgctggtctgaattctct

SEQ ID NO: 528487 - DNA, 20 bp, mouse
gtgatgggtggagctctgaa

SEQ ID NO: 528488 - DNA, 20 bp, mouse
gcagtcctactgttgatctt

SEQ ID NO: 528489 - DNA, 20 bp, mouse
gcgggtgtgctaggtaggta

SEQ ID NO: 528490 - DNA, 20 bp, mouse
gtagggaagtcacaacggag

SEQ ID NO: 528491 - DNA, 20 bp, mouse
gtcctgcccagagctcacct

SEQ ID NO: 528492 - DNA, 20 bp, mouse
gctgctccttagagactcac

SEQ ID NO: 528493 - DNA, 20 bp, mouse
gaggtccgggtgtgctaggt

SEQ ID NO: 528494 - DNA, 20 bp, mouse
gggaataggtcagagcgcat

SEQ ID NO: 528495 - DNA, 20 bp, mouse
ggggataccgggagaaccta

SEQ ID NO: 528496 - DNA, 20 bp, mouse
gtagtaactcaattaaccat

SEQ ID NO: 528497 - DNA, 20 bp, mouse
gccagcacttggtggagcaa

SEQ ID NO: 528498 - DNA, 20 bp, mouse
gcttgaatgaaacggcagag

SEQ ID NO: 528499 - DNA, 20 bp, mouse
gattcaagggaataagatgc

SEQ ID NO: 528500 - DNA, 20 bp, mouse
gattgagttactacagaatg

SEQ ID NO: 528501 - DNA, 20 bp, mouse
gctcaattaaccatgggcga

SEQ ID NO: 528502 - DNA, 20 bp, mouse
ggctgcagtggattgtacga

SEQ ID NO: 528503 - DNA, 20 bp, mouse
ggtacgagggtggaaaataa

SEQ ID NO: 528504 - DNA, 20 bp, mouse
ggaattgactctgggacggg

SEQ ID NO: 528505 - DNA, 20 bp, mouse
gggacgggggggccagcact

SEQ ID NO: 528506 - DNA, 20 bp, mouse
gacccagctaaggcatggaa

SEQ ID NO: 528507 - DNA, 20 bp, mouse
gccgcaagttgacccagcta

SEQ ID NO: 528508 - DNA, 20 bp, mouse
gacggtcgcggactgaggag

SEQ ID NO: 528509 - DNA, 20 bp, mouse
gagttgacccagctaaggca

SEQ ID NO: 528510 - DNA, 20 bp, mouse
gtgcgcgcgcagacggggag

SEQ ID NO: 528511 - DNA, 20 bp, mouse
gacgccggcgagctagagcc

SEQ ID NO: 528512 - DNA, 20 bp, mouse
gccgtgccggtgcagcgcgt

SEQ ID NO: 528513 - DNA, 20 bp, mouse
gcacttgttggacatcctgg

SEQ ID NO: 528514 - DNA, 20 bp, mouse
ggacacgcaacaggccgtgc

SEQ ID NO: 528515 - DNA, 20 bp, mouse
ggcctaactggtgagccggg

SEQ ID NO: 528516 - DNA, 20 bp, mouse
ggaccgacccagcggctgac

SEQ ID NO: 528517 - DNA, 20 bp, mouse
ggcagggcagccggcgactc

SEQ ID NO: 528518 - DNA, 20 bp, mouse
gcagagggcgaacccccggg

SEQ ID NO: 528519 - DNA, 20 bp, mouse
ggatcccagcagcaaggtag

SEQ ID NO: 528520 - DNA, 20 bp, mouse
gcccagcagcaaggtagggg

SEQ ID NO: 528521 - DNA, 20 bp, mouse
gctccagagggcgaaccccc

SEQ ID NO: 528522 - DNA, 20 bp, mouse
gcgcctgtcagccgctgggt

SEQ ID NO: 528523 - DNA, 20 bp, mouse
gactcgggttgcaggcgcgc

SEQ ID NO: 528524 - DNA, 20 bp, mouse
gtggctcccagaatctccag

SEQ ID NO: 528525 - DNA, 20 bp, mouse
gagacaggtcgatgtcgtcc

SEQ ID NO: 528526 - DNA, 20 bp, mouse
gtccgagctgggcagaaagt

SEQ ID NO: 528527 - DNA, 20 bp, mouse
gttgccagtgaggaacatgt

SEQ ID NO: 528528 - DNA, 20 bp, mouse
gccagcccagggcctaccag

SEQ ID NO: 528529 - DNA, 20 bp, mouse
gacatgtcggagtccgagct

SEQ ID NO: 528530 - DNA, 20 bp, mouse
ggaccgtgtcggccatgcac

SEQ ID NO: 528531 - DNA, 20 bp, mouse
gactccgacatgttcctcac

SEQ ID NO: 528532 - DNA, 20 bp, mouse
ggaccggtgcatggccgaca

SEQ ID NO: 528533 - DNA, 20 bp, mouse
gtgacgactgtcaagcgggg

SEQ ID NO: 528534 - DNA, 20 bp, mouse
gagtgctggagttgccagtg

SEQ ID NO: 528535 - DNA, 20 bp, mouse
ggccatcagtaggagcgcgg

SEQ ID NO: 528536 - DNA, 20 bp, mouse
gaccgcggcgggcgctaccg

SEQ ID NO: 528537 - DNA, 20 bp, mouse
gcggatcgaccagcagccag

SEQ ID NO: 528538 - DNA, 20 bp, mouse
gggcgggcgctaccgaggcc

SEQ ID NO: 528539 - DNA, 20 bp, mouse
gccccgggcacgatgcttcg

SEQ ID NO: 528540 - DNA, 20 bp, mouse
gccggcggatccggaagtgg

SEQ ID NO: 528541 - DNA, 20 bp, mouse
gccgagtggccgctgtggta

SEQ ID NO: 528542 - DNA, 20 bp, mouse
gccggcccgggaacctcaga

SEQ ID NO: 528543 - DNA, 20 bp, mouse
gactcgctcggtgacagcac

SEQ ID NO: 528544 - DNA, 20 bp, mouse
gccgcagccaggaccgcggc

SEQ ID NO: 528545 - DNA, 20 bp, mouse
gcgcgcgctgctctctcccg

SEQ ID NO: 528546 - DNA, 20 bp, mouse
gatggccgccgaagcacggg

SEQ ID NO: 528547 - DNA, 20 bp, mouse
ggcgaggaggtctgcttcgg

SEQ ID NO: 528548 - DNA, 20 bp, mouse
ggcggcgaggaggtctgctt

SEQ ID NO: 528549 - DNA, 20 bp, mouse
gaagatggccgccgaagcac

SEQ ID NO: 528550 - DNA, 20 bp, mouse
ggaagcacgggcggtgaccc

SEQ ID NO: 528551 - DNA, 20 bp, mouse
ggtctgcgtgaggcccgggg

SEQ ID NO: 528552 - DNA, 20 bp, mouse
gcggaggcggcagggtggtt

SEQ ID NO: 528553 - DNA, 20 bp, mouse
gacccgccggcgaggctctg

SEQ ID NO: 528554 - DNA, 20 bp, mouse
gggccgcactcactgacctg

SEQ ID NO: 528555 - DNA, 20 bp, mouse
gcagtgagtgcggcccggag

SEQ ID NO: 528556 - DNA, 20 bp, mouse
gtgagggagcagtcacccga

SEQ ID NO: 528557 - DNA, 20 bp, mouse
gcggggactggaccacaaca

SEQ ID NO: 528558 - DNA, 20 bp, mouse
ggactgctccctcaggatga

SEQ ID NO: 528559 - DNA, 20 bp, mouse
ggccatgggctcaacagaag

SEQ ID NO: 528560 - DNA, 20 bp, mouse
gacatcgaccttcatcctga

SEQ ID NO: 528561 - DNA, 20 bp, mouse
gcgtgaggagactaattaag

SEQ ID NO: 528562 - DNA, 20 bp, mouse
gtgcaggaaagcgaaatcgt

SEQ ID NO: 528563 - DNA, 20 bp, mouse
gggactggaccacaacaggg

SEQ ID NO: 528564 - DNA, 20 bp, mouse
gttgtggtccagtccccgta

SEQ ID NO: 528565 - DNA, 20 bp, mouse
gtcctgcaagctctgccgtc

SEQ ID NO: 528566 - DNA, 20 bp, mouse
gaatatggccctccaaaagg

SEQ ID NO: 528567 - DNA, 20 bp, mouse
ggcagaccgaagttcccaca

SEQ ID NO: 528568 - DNA, 20 bp, mouse
ggtgaccgcagggttgacat

SEQ ID NO: 528569 - DNA, 20 bp, mouse
gtcaacccaggcaggtccag

SEQ ID NO: 528570 - DNA, 20 bp, mouse
gcaggtccagggggttatta

SEQ ID NO: 528571 - DNA, 20 bp, mouse
gagggggttattagggaccc

SEQ ID NO: 528572 - DNA, 20 bp, mouse
gtaaaggggactgtcaaccc

SEQ ID NO: 528573 - DNA, 20 bp, mouse
ggaagttcccacatggcagt

SEQ ID NO: 528574 - DNA, 20 bp, mouse
ggcaaatatggccctccaaa

SEQ ID NO: 528575 - DNA, 20 bp, mouse
gtgggggtgaacacagtgcc

SEQ ID NO: 528576 - DNA, 20 bp, mouse
gtggcagagccggggtccgg

SEQ ID NO: 528577 - DNA, 20 bp, mouse
gggccgccagcagcatcctc

SEQ ID NO: 528578 - DNA, 20 bp, mouse
gggataagcgcaccccggag

SEQ ID NO: 528579 - DNA, 20 bp, mouse
gccacgccgcggaactcgca

SEQ ID NO: 528580 - DNA, 20 bp, mouse
gctgctgccttggaaacgcg

SEQ ID NO: 528581 - DNA, 20 bp, mouse
gcccggagcggctgacccag

SEQ ID NO: 528582 - DNA, 20 bp, mouse
gctcccccaacaggttccat

SEQ ID NO: 528583 - DNA, 20 bp, mouse
gagcagcatcctccggaccc

SEQ ID NO: 528584 - DNA, 20 bp, mouse
ggtactagctggtccccggt

SEQ ID NO: 528585 - DNA, 20 bp, mouse
ggtctgccctgcgagttccg

SEQ ID NO: 528586 - DNA, 20 bp, mouse
gtaacggcgtggaccgggag

SEQ ID NO: 528587 - DNA, 20 bp, mouse
gcccgcggctcctcaggtaa

SEQ ID NO: 528588 - DNA, 20 bp, mouse
gggccgcggccggaagtccc

SEQ ID NO: 528589 - DNA, 20 bp, mouse
ggggaggggggagaacctca

SEQ ID NO: 528590 - DNA, 20 bp, mouse
gaagcgcgcgagagcacgcg

SEQ ID NO: 528591 - DNA, 20 bp, mouse
ggctctttttggttactcag

SEQ ID NO: 528592 - DNA, 20 bp, mouse
gaggggggagaacctcaggg

SEQ ID NO: 528593 - DNA, 20 bp, mouse
gcgcggccggaagtcccggg

SEQ ID NO: 528594 - DNA, 20 bp, mouse
ggtggcggcgccacaggacc

SEQ ID NO: 528595 - DNA, 20 bp, mouse
gcgacgattggctgcctcgg

SEQ ID NO: 528596 - DNA, 20 bp, mouse
gtccttcaagctacactcag

SEQ ID NO: 528597 - DNA, 20 bp, mouse
gtggaagaaggcggtaacac

SEQ ID NO: 528598 - DNA, 20 bp, mouse
ggagtgtagcttgaaggaag

SEQ ID NO: 528599 - DNA, 20 bp, mouse
gcaggtctcagtcgattcgg

SEQ ID NO: 528600 - DNA, 20 bp, mouse
gtgtagcttgaaggaagtgg

SEQ ID NO: 528601 - DNA, 20 bp, mouse
gaggcaggtctcagtcgatt

SEQ ID NO: 528602 - DNA, 20 bp, mouse
gcccaggccggccagaccgg

SEQ ID NO: 528603 - DNA, 20 bp, mouse
gggtctggccggcctgggta

SEQ ID NO: 528604 - DNA, 20 bp, mouse
gccttggcgttcgttcgcag

SEQ ID NO: 528605 - DNA, 20 bp, mouse
ggatggattccgccccacac

SEQ ID NO: 528606 - DNA, 20 bp, mouse
gttattcccgtgaggttccg

SEQ ID NO: 528607 - DNA, 20 bp, mouse
gtacctgcggctgcagaagt

SEQ ID NO: 528608 - DNA, 20 bp, mouse
gggagaggcgtccctgtggg

SEQ ID NO: 528609 - DNA, 20 bp, mouse
gggtcttccatgccccccaa

SEQ ID NO: 528610 - DNA, 20 bp, mouse
gctcaaccgctgcccttggg

SEQ ID NO: 528611 - DNA, 20 bp, mouse
ggcggcaaattcgtatgtca

SEQ ID NO: 528612 - DNA, 20 bp, mouse
ggcaggagaggcgtccctgt

SEQ ID NO: 528613 - DNA, 20 bp, mouse
gctcgctcgacatagccagg

SEQ ID NO: 528614 - DNA, 20 bp, mouse
ggtcgagcgcagacgcgtta

SEQ ID NO: 528615 - DNA, 20 bp, mouse
ggccgcggcggagaacccgc

SEQ ID NO: 528616 - DNA, 20 bp, mouse
gctggggaagtggacgagga

SEQ ID NO: 528617 - DNA, 20 bp, mouse
gcccacggaggcccgggcaa

SEQ ID NO: 528618 - DNA, 20 bp, mouse
gcgtgctggggaagtggacg

SEQ ID NO: 528619 - DNA, 20 bp, mouse
gtcgaggccgtggttaccca

SEQ ID NO: 528620 - DNA, 20 bp, mouse
gcgagcggagtttcagtctg

SEQ ID NO: 528621 - DNA, 20 bp, mouse
gtccccgcctgactcttctc

SEQ ID NO: 528622 - DNA, 20 bp, mouse
gccggacccagcattcctag

SEQ ID NO: 528623 - DNA, 20 bp, mouse
gacgcgtggagcccttgccc

SEQ ID NO: 528624 - DNA, 20 bp, mouse
gggtccggagacaaagagtt

SEQ ID NO: 528625 - DNA, 20 bp, mouse
gtttgtccgtgctggggaag

SEQ ID NO: 528626 - DNA, 20 bp, mouse
gtggcgaaaatgcccagtga

SEQ ID NO: 528627 - DNA, 20 bp, mouse
gtggagaccgaggcccgtgg

SEQ ID NO: 528628 - DNA, 20 bp, mouse
gggctgctgcagccctcact

SEQ ID NO: 528629 - DNA, 20 bp, mouse
ggctgggtcctgtagagcac

SEQ ID NO: 528630 - DNA, 20 bp, mouse
ggactctgcggcacctggtc

SEQ ID NO: 528631 - DNA, 20 bp, mouse
gagctgtcgcttacctgacc

SEQ ID NO: 528632 - DNA, 20 bp, mouse
ggccaggttctgcatagtag

SEQ ID NO: 528633 - DNA, 20 bp, mouse
gtgagggctgcagcagccgc

SEQ ID NO: 528634 - DNA, 20 bp, mouse
gtcctctactatgcagaacc

SEQ ID NO: 528635 - DNA, 20 bp, mouse
gtgtggccagccacccccac

SEQ ID NO: 528636 - DNA, 20 bp, mouse
gtctggagccgggtaaggtg

SEQ ID NO: 528637 - DNA, 20 bp, mouse
gcgggggacgctgggagtcc

SEQ ID NO: 528638 - DNA, 20 bp, mouse
gagcaggctctgatatccag

SEQ ID NO: 528639 - DNA, 20 bp, mouse
ggctgggagtcccggaagct

SEQ ID NO: 528640 - DNA, 20 bp, mouse
ggcacgtgcctcaccttacc

SEQ ID NO: 528641 - DNA, 20 bp, mouse
ggcctaccaaccctgccagt

SEQ ID NO: 528642 - DNA, 20 bp, mouse
gggagctggcaggtgaggcg

SEQ ID NO: 528643 - DNA, 20 bp, mouse
ggtcccggaagctgggagtc

SEQ ID NO: 528644 - DNA, 20 bp, mouse
ggagtggcgaaatacagacg

SEQ ID NO: 528645 - DNA, 20 bp, mouse
ggggttggtaggcctccagg

SEQ ID NO: 528646 - DNA, 20 bp, mouse
ggctatcggaatcctgtccc

SEQ ID NO: 528647 - DNA, 20 bp, mouse
gagcgcagtgggtcagctct

SEQ ID NO: 528648 - DNA, 20 bp, mouse
gtgatggctaagtccagcct

SEQ ID NO: 528649 - DNA, 20 bp, mouse
gagagctggatgcagagtcc

SEQ ID NO: 528650 - DNA, 20 bp, mouse
gcgctcagtcccagacagag

SEQ ID NO: 528651 - DNA, 20 bp, mouse
gtatcgctaaggaccataag

SEQ ID NO: 528652 - DNA, 20 bp, mouse
gtgctcttgcaggttctgaa

SEQ ID NO: 528653 - DNA, 20 bp, mouse
ggcggtggcggtactaaagc

SEQ ID NO: 528654 - DNA, 20 bp, mouse
ggattccgatagcactgcgg

SEQ ID NO: 528655 - DNA, 20 bp, mouse
gccatcactgtgacaactcc

SEQ ID NO: 528656 - DNA, 20 bp, mouse
gccggctagcgggctgagtg

SEQ ID NO: 528657 - DNA, 20 bp, mouse
gcgggcacctgagaaagatg

SEQ ID NO: 528658 - DNA, 20 bp, mouse
gctgagtggggcactgcgcg

SEQ ID NO: 528659 - DNA, 20 bp, mouse
ggccctgtaccccaaggcaa

SEQ ID NO: 528660 - DNA, 20 bp, mouse
ggagtaaactcaccgcgccg

SEQ ID NO: 528661 - DNA, 20 bp, mouse
ggcgcggcttggggtacccg

SEQ ID NO: 528662 - DNA, 20 bp, mouse
gtctcacaccagagcgggag

SEQ ID NO: 528663 - DNA, 20 bp, mouse
gtagcaggcgcggggcccat

SEQ ID NO: 528664 - DNA, 20 bp, mouse
gtccgaatcgggaatcgtgg

SEQ ID NO: 528665 - DNA, 20 bp, mouse
gtgggacttggaccagaacc

SEQ ID NO: 528666 - DNA, 20 bp, mouse
gaccccgaggagacgagacg

SEQ ID NO: 528667 - DNA, 20 bp, mouse
ggccgcgtctcgtctcctcg

SEQ ID NO: 528668 - DNA, 20 bp, mouse
ggcggaagcgattattcccg

SEQ ID NO: 528669 - DNA, 20 bp, mouse
gtgacccggggacggaatga

SEQ ID NO: 528670 - DNA, 20 bp, mouse
gcccggggacggaatgaggg

SEQ ID NO: 528671 - DNA, 20 bp, mouse
gatgcgcggcggggaagatg

SEQ ID NO: 528672 - DNA, 20 bp, mouse
ggcggcgccatcaaaggcgt

SEQ ID NO: 528673 - DNA, 20 bp, mouse
ggcttccgctgacccgggga

SEQ ID NO: 528674 - DNA, 20 bp, mouse
gccccgccgcgcatcccgga

SEQ ID NO: 528675 - DNA, 20 bp, mouse
gattcccgcggcgtctggcg

SEQ ID NO: 528676 - DNA, 20 bp, mouse
gccgcctaggcggacagtcg

SEQ ID NO: 528677 - DNA, 20 bp, mouse
gcagccccgactgtccgcct

SEQ ID NO: 528678 - DNA, 20 bp, mouse
gccttggcgcggaaccgcct

SEQ ID NO: 528679 - DNA, 20 bp, mouse
gcgggcacttgggacgcggg

SEQ ID NO: 528680 - DNA, 20 bp, mouse
gtggcgcggaaccgcctagg

SEQ ID NO: 528681 - DNA, 20 bp, mouse
gcggacagtcggggctggac

SEQ ID NO: 528682 - DNA, 20 bp, mouse
gagccgcggaggaccgacca

SEQ ID NO: 528683 - DNA, 20 bp, mouse
gtggcgggtggcgggcactt

SEQ ID NO: 528684 - DNA, 20 bp, mouse
gccgtcgggactgcggacca

SEQ ID NO: 528685 - DNA, 20 bp, mouse
gacgcgggcggcgggagtgc

SEQ ID NO: 528686 - DNA, 20 bp, mouse
gtcgggagccaacctctcac

SEQ ID NO: 528687 - DNA, 20 bp, mouse
gccgcgtggattgacttgtt

SEQ ID NO: 528688 - DNA, 20 bp, mouse
ggtctcggaagcggaagtag

SEQ ID NO: 528689 - DNA, 20 bp, mouse
gagacgatggttccaatcag

SEQ ID NO: 528690 - DNA, 20 bp, mouse
ggaggaggggtaccacgtgt

SEQ ID NO: 528691 - DNA, 20 bp, mouse
gggctctgacgcagatccaa

SEQ ID NO: 528692 - DNA, 20 bp, mouse
gtgccagactcggcttcgcg

SEQ ID NO: 528693 - DNA, 20 bp, mouse
gttgttcgggttctccagca

SEQ ID NO: 528694 - DNA, 20 bp, mouse
gcaggggaccgaggcaggtc

SEQ ID NO: 528695 - DNA, 20 bp, mouse
gaaggaaacgtcacttccga

SEQ ID NO: 528696 - DNA, 20 bp, mouse
gttgccgcgcagggcaaagg

SEQ ID NO: 528697 - DNA, 20 bp, mouse
gtagaggtgcagctgctggt

SEQ ID NO: 528698 - DNA, 20 bp, mouse
gttcttgccgcgcagggcaa

SEQ ID NO: 528699 - DNA, 20 bp, mouse
gtttgggggcggggatacag

SEQ ID NO: 528700 - DNA, 20 bp, mouse
gtggcgctccgctgcgtggt

SEQ ID NO: 528701 - DNA, 20 bp, mouse
gtgaaggtggcctgacctag

SEQ ID NO: 528702 - DNA, 20 bp, mouse
gttgggacaagggtatttgg

SEQ ID NO: 528703 - DNA, 20 bp, mouse
gccgtcaccggaaatcttac

SEQ ID NO: 528704 - DNA, 20 bp, mouse
ggcagctgcacctctaggtc

SEQ ID NO: 528705 - DNA, 20 bp, mouse
gaccgcgtccccgcacggaa

SEQ ID NO: 528706 - DNA, 20 bp, mouse
ggcccctagagaggacagga

SEQ ID NO: 528707 - DNA, 20 bp, mouse
gaagttcgtggttagagcag

SEQ ID NO: 528708 - DNA, 20 bp, mouse
ggagttgagtgagtgcagac

SEQ ID NO: 528709 - DNA, 20 bp, mouse
gcccctcctgtcctctctag

SEQ ID NO: 528710 - DNA, 20 bp, mouse
gtccagcagagtcatgacgg

SEQ ID NO: 528711 - DNA, 20 bp, mouse
gtcccggagaagagcagtga

SEQ ID NO: 528712 - DNA, 20 bp, mouse
gcccttcaggcaagtcaaga

SEQ ID NO: 528713 - DNA, 20 bp, mouse
gagagaagacctgaagttcg

SEQ ID NO: 528714 - DNA, 20 bp, mouse
ggagcctgagatgctaatga

SEQ ID NO: 528715 - DNA, 20 bp, mouse
ggtctcatgcctgtgcgcag

SEQ ID NO: 528716 - DNA, 20 bp, mouse
ggaagtctcgcgagatccgg

SEQ ID NO: 528717 - DNA, 20 bp, mouse
gcgctcgccgctcacctccc

SEQ ID NO: 528718 - DNA, 20 bp, mouse
gccggtggtagctgcggcag

SEQ ID NO: 528719 - DNA, 20 bp, mouse
ggccgttgggactgaggcag

SEQ ID NO: 528720 - DNA, 20 bp, mouse
gcacaggggacccccgacga

SEQ ID NO: 528721 - DNA, 20 bp, mouse
ggaggcggccgttgggactg

SEQ ID NO: 528722 - DNA, 20 bp, mouse
ggggccgcggccgcacacag

SEQ ID NO: 528723 - DNA, 20 bp, mouse
ggccccgggagagggacgga

SEQ ID NO: 528724 - DNA, 20 bp, mouse
gccgggccccgggagaggga

SEQ ID NO: 528725 - DNA, 20 bp, mouse
gcaggctgcccgggaagatc

SEQ ID NO: 528726 - DNA, 20 bp, mouse
gcagacacactccttcgggt

SEQ ID NO: 528727 - DNA, 20 bp, mouse
gcctctgccttcctctagtg

SEQ ID NO: 528728 - DNA, 20 bp, mouse
ggttaaaggctcccacccga

SEQ ID NO: 528729 - DNA, 20 bp, mouse
gcctgcagacacactccttc

SEQ ID NO: 528730 - DNA, 20 bp, mouse
ggctgggaactccaagcgaa

SEQ ID NO: 528731 - DNA, 20 bp, mouse
gtaagtctctaagtgacata

SEQ ID NO: 528732 - DNA, 20 bp, mouse
ggaggaaggcagaggctgcg

SEQ ID NO: 528733 - DNA, 20 bp, mouse
gtttaactcttccacactag

SEQ ID NO: 528734 - DNA, 20 bp, mouse
gttcttggagctatcgatca

SEQ ID NO: 528735 - DNA, 20 bp, mouse
gggtgaagacttctggagac

SEQ ID NO: 528736 - DNA, 20 bp, mouse
gtacggtgctgacaagatgg

SEQ ID NO: 528737 - DNA, 20 bp, mouse
gcgctcggtggtggccgcta

SEQ ID NO: 528738 - DNA, 20 bp, mouse
gcgctacggtgctgacaaga

SEQ ID NO: 528739 - DNA, 20 bp, mouse
gtccacttatgcagcgcgta

SEQ ID NO: 528740 - DNA, 20 bp, mouse
gtgctgtggcgccggagtgc

SEQ ID NO: 528741 - DNA, 20 bp, mouse
ggccgagagaggcccaggcg

SEQ ID NO: 528742 - DNA, 20 bp, mouse
ggccctacgcgctgcataag

SEQ ID NO: 528743 - DNA, 20 bp, mouse
gcgcacttactcgggaaggt

SEQ ID NO: 528744 - DNA, 20 bp, mouse
ggcttgcgcagcgggaggtg

SEQ ID NO: 528745 - DNA, 20 bp, mouse
gcccgtcacaggccccgcct

SEQ ID NO: 528746 - DNA, 20 bp, mouse
gtagttgaccaccgcgggaa

SEQ ID NO: 528747 - DNA, 20 bp, mouse
ggtgctcgcggccgttcccg

SEQ ID NO: 528748 - DNA, 20 bp, mouse
ggcctcttccgcgttctcga

SEQ ID NO: 528749 - DNA, 20 bp, mouse
ggagccagcgaggagtccct

SEQ ID NO: 528750 - DNA, 20 bp, mouse
gtccgtcgagaacgcggaag

SEQ ID NO: 528751 - DNA, 20 bp, mouse
gcaggtctccgtcgagaacg

SEQ ID NO: 528752 - DNA, 20 bp, mouse
gccgccgagggactcctcgc

SEQ ID NO: 528753 - DNA, 20 bp, mouse
gggagggcccgagcagaagg

SEQ ID NO: 528754 - DNA, 20 bp, mouse
gctgcaggtgggggtgctcg

SEQ ID NO: 528755 - DNA, 20 bp, mouse
gtgcggaggagcagccgaag

SEQ ID NO: 528756 - DNA, 20 bp, mouse
gccagtggaggggtccgtgg

SEQ ID NO: 528757 - DNA, 20 bp, mouse
gcggcagcggcccagtggag

SEQ ID NO: 528758 - DNA, 20 bp, mouse
gctgcgggcggaggagacaa

SEQ ID NO: 528759 - DNA, 20 bp, mouse
gctcggcggcagcggcccag

SEQ ID NO: 528760 - DNA, 20 bp, mouse
gtcagtccgggccccaccag

SEQ ID NO: 528761 - DNA, 20 bp, mouse
gcaagggcgacattctccga

SEQ ID NO: 528762 - DNA, 20 bp, mouse
ggtccgggccccaccagcgg

SEQ ID NO: 528763 - DNA, 20 bp, mouse
ggagctcccgcgcctgactc

SEQ ID NO: 528764 - DNA, 20 bp, mouse
gcggaggagacaaaggaccg

SEQ ID NO: 528765 - DNA, 20 bp, mouse
ggctgtgctaggtgaggtga

SEQ ID NO: 528766 - DNA, 20 bp, mouse
ggctcggagacgcggtgaca

SEQ ID NO: 528767 - DNA, 20 bp, mouse
gggactggcgcagagctctc

SEQ ID NO: 528768 - DNA, 20 bp, mouse
gacctgagcgctcggagacg

SEQ ID NO: 528769 - DNA, 20 bp, mouse
gaggagaagacagcgaaggg

SEQ ID NO: 528770 - DNA, 20 bp, mouse
gagaaggagaagacagcgaa

SEQ ID NO: 528771 - DNA, 20 bp, mouse
ggcagcgactgtggggatag

SEQ ID NO: 528772 - DNA, 20 bp, mouse
gcggtgacacggcgcgggac

SEQ ID NO: 528773 - DNA, 20 bp, mouse
gtgtgtgggataaacagtaa

SEQ ID NO: 528774 - DNA, 20 bp, mouse
gggataaacagtaatggcgg

SEQ ID NO: 528775 - DNA, 20 bp, mouse
ggagacgcggtgacacggcg

SEQ ID NO: 528776 - DNA, 20 bp, mouse
gcagcgcccaaggcccagag

SEQ ID NO: 528777 - DNA, 20 bp, mouse
ggtgagtgcgcggcccctct

SEQ ID NO: 528778 - DNA, 20 bp, mouse
gggccgcatagaggctagag

SEQ ID NO: 528779 - DNA, 20 bp, mouse
gctcatggcggcggggccac

SEQ ID NO: 528780 - DNA, 20 bp, mouse
gggcgattgcggggaaacac

SEQ ID NO: 528781 - DNA, 20 bp, mouse
gacttgcagagagtgagcga

SEQ ID NO: 528782 - DNA, 20 bp, mouse
gaggaaaccgaggccaccag

SEQ ID NO: 528783 - DNA, 20 bp, mouse
gtcgaaatgggactcttcgg

SEQ ID NO: 528784 - DNA, 20 bp, mouse
ggctcactctctgcaagtcg

SEQ ID NO: 528785 - DNA, 20 bp, mouse
ggagtgagcgagggcgattg

SEQ ID NO: 528786 - DNA, 20 bp, mouse
gtgaattgcggagctggaga

SEQ ID NO: 528787 - DNA, 20 bp, mouse
gctggtccggagcgcaacag

SEQ ID NO: 528788 - DNA, 20 bp, mouse
gcttcgctccgagaagaagc

SEQ ID NO: 528789 - DNA, 20 bp, mouse
gggctcgaccagcttcttct

SEQ ID NO: 528790 - DNA, 20 bp, mouse
gcccgatgcctgctgcagag

SEQ ID NO: 528791 - DNA, 20 bp, mouse
gggccagcgccagccgaagg

SEQ ID NO: 528792 - DNA, 20 bp, mouse
gcgaggcaggtgctgaaggg

SEQ ID NO: 528793 - DNA, 20 bp, mouse
ggcctcaaactgaggagggg

SEQ ID NO: 528794 - DNA, 20 bp, mouse
gtctgggcggcggagatcta

SEQ ID NO: 528795 - DNA, 20 bp, mouse
gctgcagcaggcatcgggtc

SEQ ID NO: 528796 - DNA, 20 bp, mouse
gcggtctggagcactgacac

SEQ ID NO: 528797 - DNA, 20 bp, mouse
gcgcgaagcagctgtcatgg

SEQ ID NO: 528798 - DNA, 20 bp, mouse
ggggtcccgggagcgataca

SEQ ID NO: 528799 - DNA, 20 bp, mouse
ggcagctgtcatggcggaag

SEQ ID NO: 528800 - DNA, 20 bp, mouse
gtgtcatggcggaagcggtc

SEQ ID NO: 528801 - DNA, 20 bp, mouse
gacgcgcgcagagatggcag

SEQ ID NO: 528802 - DNA, 20 bp, mouse
gtggagcactgacaccggcg

SEQ ID NO: 528803 - DNA, 20 bp, mouse
gtcggggaaagaaatcacag

SEQ ID NO: 528804 - DNA, 20 bp, mouse
ggagcgatacacggcctcgc

SEQ ID NO: 528805 - DNA, 20 bp, mouse
ggctgctgcaaagaagaggt

SEQ ID NO: 528806 - DNA, 20 bp, mouse
gccgcggaatcggcagccag

SEQ ID NO: 528807 - DNA, 20 bp, mouse
gagcctgagccgagaacatg

SEQ ID NO: 528808 - DNA, 20 bp, mouse
ggagccgagaacatgcggtg

SEQ ID NO: 528809 - DNA, 20 bp, mouse
ggtggccccggtgaacgcgt

SEQ ID NO: 528810 - DNA, 20 bp, mouse
ggtgtgcctagtccagagac

SEQ ID NO: 528811 - DNA, 20 bp, mouse
ggagaacatgcggtggggat

SEQ ID NO: 528812 - DNA, 20 bp, mouse
gcccacaagatctcagacgg

SEQ ID NO: 528813 - DNA, 20 bp, mouse
gaaagcagagacgactccgg

SEQ ID NO: 528814 - DNA, 20 bp, mouse
gggctccgacgcgttcaccg

SEQ ID NO: 528815 - DNA, 20 bp, mouse
gagatctcagacggaggtgg

SEQ ID NO: 528816 - DNA, 20 bp, mouse
gcagggagaagtgttcctcg

SEQ ID NO: 528817 - DNA, 20 bp, mouse
gggtgttcttaccttccccg

SEQ ID NO: 528818 - DNA, 20 bp, mouse
gtgtacagttaacaagaagt

SEQ ID NO: 528819 - DNA, 20 bp, mouse
gacttccgttggcttcactg

SEQ ID NO: 528820 - DNA, 20 bp, mouse
gtgtaaggtgagccctacgt

SEQ ID NO: 528821 - DNA, 20 bp, mouse
gtcaacgtgtggggtgatgg

SEQ ID NO: 528822 - DNA, 20 bp, mouse
gctggctctgtatgtgaaga

SEQ ID NO: 528823 - DNA, 20 bp, mouse
gagccaacggaagtcccttt

SEQ ID NO: 528824 - DNA, 20 bp, mouse
gacctccgatggggagtgta

SEQ ID NO: 528825 - DNA, 20 bp, mouse
gcacccaaagggacttccgt

SEQ ID NO: 528826 - DNA, 20 bp, mouse
gaaccgccggacgacagcag

SEQ ID NO: 528827 - DNA, 20 bp, mouse
gctggaagtccatcacccag

SEQ ID NO: 528828 - DNA, 20 bp, mouse
gtacctctgctgtcgtccgg

SEQ ID NO: 528829 - DNA, 20 bp, mouse
gggccagctttcccaaccgc

SEQ ID NO: 528830 - DNA, 20 bp, mouse
ggacattaaactgcaaagta

SEQ ID NO: 528831 - DNA, 20 bp, mouse
gggaatatactcatactcta

SEQ ID NO: 528832 - DNA, 20 bp, mouse
gctctatgagtcccaaacag

SEQ ID NO: 528833 - DNA, 20 bp, mouse
gaaagctggcctctgggtga

SEQ ID NO: 528834 - DNA, 20 bp, mouse
gtagggctgtgaacttaaag

SEQ ID NO: 528835 - DNA, 20 bp, mouse
ggtccggcggttgggaaagc

SEQ ID NO: 528836 - DNA, 20 bp, mouse
ggacatgtcccgggttgccg

SEQ ID NO: 528837 - DNA, 20 bp, mouse
gccgggttgccgaggcagaa

SEQ ID NO: 528838 - DNA, 20 bp, mouse
gcgaggacgagggtcggcag

SEQ ID NO: 528839 - DNA, 20 bp, mouse
gcctgagagcgacatgtccc

SEQ ID NO: 528840 - DNA, 20 bp, mouse
gctgccggagagcgtcatct

SEQ ID NO: 528841 - DNA, 20 bp, mouse
gagcatggcggccaccacgg

SEQ ID NO: 528842 - DNA, 20 bp, mouse
gatggcggccaccacggcgg

SEQ ID NO: 528843 - DNA, 20 bp, mouse
gcggcgccccaaggccgagg

SEQ ID NO: 528844 - DNA, 20 bp, mouse
gaccctctggaaggccgggt

SEQ ID NO: 528845 - DNA, 20 bp, mouse
gtctcccggctggagaggaa

SEQ ID NO: 528846 - DNA, 20 bp, mouse
gggcgggcgcggatggaaat

SEQ ID NO: 528847 - DNA, 20 bp, mouse
ggcagacgcgcgaagcaagc

SEQ ID NO: 528848 - DNA, 20 bp, mouse
gatgcgggtgaggagaatgg

SEQ ID NO: 528849 - DNA, 20 bp, mouse
gccggaacatcgtgatcctg

SEQ ID NO: 528850 - DNA, 20 bp, mouse
gagaagtgtgtgagaagtgg

SEQ ID NO: 528851 - DNA, 20 bp, mouse
gaacatcgtgatcctgcggc

SEQ ID NO: 528852 - DNA, 20 bp, mouse
gtgcttcgcgcgtctgccgg

SEQ ID NO: 528853 - DNA, 20 bp, mouse
gggcgggaggcgcgaagaaa

SEQ ID NO: 528854 - DNA, 20 bp, mouse
gatcgccgcgcccgcgacta

SEQ ID NO: 528855 - DNA, 20 bp, mouse
gcagccgcgctcgccggaaa

SEQ ID NO: 528856 - DNA, 20 bp, mouse
ggccatcctaccgttcccaa

SEQ ID NO: 528857 - DNA, 20 bp, mouse
gccctgcctttgggaacggt

SEQ ID NO: 528858 - DNA, 20 bp, mouse
gtcctgggcggatttcgggg

SEQ ID NO: 528859 - DNA, 20 bp, mouse
ggaacggtaggatggctgca

SEQ ID NO: 528860 - DNA, 20 bp, mouse
ggcctttgggaacggtagga

SEQ ID NO: 528861 - DNA, 20 bp, mouse
ggagatactcggggaacccg

SEQ ID NO: 528862 - DNA, 20 bp, mouse
gtggctgttcagagcaagac

SEQ ID NO: 528863 - DNA, 20 bp, mouse
ggagaagtttgagatactcg

SEQ ID NO: 528864 - DNA, 20 bp, mouse
ggagtcaagctgtgtggtag

SEQ ID NO: 528865 - DNA, 20 bp, mouse
ggaccggctaggcgcgagtt

SEQ ID NO: 528866 - DNA, 20 bp, mouse
ggtacggaggtggcaggcga

SEQ ID NO: 528867 - DNA, 20 bp, mouse
gggcccgagaagccgatctt

SEQ ID NO: 528868 - DNA, 20 bp, mouse
ggaccgaagatcggcttctc

SEQ ID NO: 528869 - DNA, 20 bp, mouse
gttcgggcctgaccgaagat

SEQ ID NO: 528870 - DNA, 20 bp, mouse
gaggcaggaggcggtgcggg

SEQ ID NO: 528871 - DNA, 20 bp, mouse
gcggcccgggacgcaaggat

SEQ ID NO: 528872 - DNA, 20 bp, mouse
gacctccgtacccccgccct

SEQ ID NO: 528873 - DNA, 20 bp, mouse
gcccgccgggcgagccggag

SEQ ID NO: 528874 - DNA, 20 bp, mouse
gacgcaaggattggtccgcg

SEQ ID NO: 528875 - DNA, 20 bp, mouse
ggatcggcttctcgggccga

SEQ ID NO: 528876 - DNA, 20 bp, mouse
gattcggcgtctggacgaga

SEQ ID NO: 528877 - DNA, 20 bp, mouse
gccgagcacggggaccgtgg

SEQ ID NO: 528878 - DNA, 20 bp, mouse
ggggaactcgggcgccaata

SEQ ID NO: 528879 - DNA, 20 bp, mouse
gacggtagtgaaccgcatag

SEQ ID NO: 528880 - DNA, 20 bp, mouse
gggcgggggaagtcattcag

SEQ ID NO: 528881 - DNA, 20 bp, mouse
gcgtgaggagctcgagtgat

SEQ ID NO: 528882 - DNA, 20 bp, mouse
ggtagtgaaccgcatagcgg

SEQ ID NO: 528883 - DNA, 20 bp, mouse
ggacttcccccgccgctatg

SEQ ID NO: 528884 - DNA, 20 bp, mouse
ggtggccgactgcagcaggt

SEQ ID NO: 528885 - DNA, 20 bp, mouse
gcctgctacaaacgccatat

SEQ ID NO: 528886 - DNA, 20 bp, mouse
gggtcggtgagagttgatgg

SEQ ID NO: 528887 - DNA, 20 bp, mouse
gggcgttggaggtggttggt

SEQ ID NO: 528888 - DNA, 20 bp, mouse
ggctcggcgttggaggtggt

SEQ ID NO: 528889 - DNA, 20 bp, mouse
gaggagattcgaggtgaagg

SEQ ID NO: 528890 - DNA, 20 bp, mouse
ggttggtcggtgagagttga

SEQ ID NO: 528891 - DNA, 20 bp, mouse
gagttgatggaggagattcg

SEQ ID NO: 528892 - DNA, 20 bp, mouse
gagcgcgcgctcggcgttgg

SEQ ID NO: 528893 - DNA, 20 bp, mouse
ggtctcggaagcgcatgctc

SEQ ID NO: 528894 - DNA, 20 bp, mouse
gtgtgtaatgagcagttcta

SEQ ID NO: 528895 - DNA, 20 bp, mouse
gtcgtgcagacgccgtctgg

SEQ ID NO: 528896 - DNA, 20 bp, mouse
gaacttagaggagggagtga

SEQ ID NO: 528897 - DNA, 20 bp, mouse
gaagaggaacaagaacttag

SEQ ID NO: 528898 - DNA, 20 bp, mouse
gtacttactgatactaggaa

SEQ ID NO: 528899 - DNA, 20 bp, mouse
gggaacaagaacttagagga

SEQ ID NO: 528900 - DNA, 20 bp, mouse
gtcttacaacgtggaatgcc

SEQ ID NO: 528901 - DNA, 20 bp, mouse
ggtcctaggctcttacaacg

SEQ ID NO: 528902 - DNA, 20 bp, mouse
gtcaggctggtcaataatct

SEQ ID NO: 528903 - DNA, 20 bp, mouse
ggggcttctgatatcgtcct

SEQ ID NO: 528904 - DNA, 20 bp, mouse
ggagtgacggtaagatgcct

SEQ ID NO: 528905 - DNA, 20 bp, mouse
gtgccagctttgaacatgga

SEQ ID NO: 528906 - DNA, 20 bp, mouse
gggcttccggagcagaactc

SEQ ID NO: 528907 - DNA, 20 bp, mouse
ggaagaccgcggtccgggag

SEQ ID NO: 528908 - DNA, 20 bp, mouse
gaactgagcgcaggatagac

SEQ ID NO: 528909 - DNA, 20 bp, mouse
gtaaagctctcgcctctcgg

SEQ ID NO: 528910 - DNA, 20 bp, mouse
gaggaactccgcaccagccg

SEQ ID NO: 528911 - DNA, 20 bp, mouse
gaaatagctgtcggacaggt

SEQ ID NO: 528912 - DNA, 20 bp, mouse
ggaccgcggtccgggagcgg

SEQ ID NO: 528913 - DNA, 20 bp, mouse
ggggagactgatgatcctac

SEQ ID NO: 528914 - DNA, 20 bp, mouse
gtcaacgaggcagaagaccg

SEQ ID NO: 528915 - DNA, 20 bp, mouse
gaatccagtgagctgtagcg

SEQ ID NO: 528916 - DNA, 20 bp, mouse
ggcagcgggaggccagtccc

SEQ ID NO: 528917 - DNA, 20 bp, mouse
gggcgaggccgggcccgagt

SEQ ID NO: 528918 - DNA, 20 bp, mouse
gggctcggaggcttgtccat

SEQ ID NO: 528919 - DNA, 20 bp, mouse
ggagaagggcccatccgggt

SEQ ID NO: 528920 - DNA, 20 bp, mouse
ggcgggaggccagtcccggg

SEQ ID NO: 528921 - DNA, 20 bp, mouse
gaggggtacgtgggtcacag

SEQ ID NO: 528922 - DNA, 20 bp, mouse
ggctggagaagggcccatcc

SEQ ID NO: 528923 - DNA, 20 bp, mouse
gaggtaagaagcctccgccc

SEQ ID NO: 528924 - DNA, 20 bp, mouse
ggcgccagtcatggacaatc

SEQ ID NO: 528925 - DNA, 20 bp, mouse
gcgccgcgcagggcagcggg

SEQ ID NO: 528926 - DNA, 20 bp, mouse
gtccgcacaggcgcactggg

SEQ ID NO: 528927 - DNA, 20 bp, mouse
ggccgggtgacgctcggagg

SEQ ID NO: 528928 - DNA, 20 bp, mouse
gatcaagcaggcctccgcac

SEQ ID NO: 528929 - DNA, 20 bp, mouse
gtacgccgggtgacgctcgg

SEQ ID NO: 528930 - DNA, 20 bp, mouse
gtgagggaggcggcccagag

SEQ ID NO: 528931 - DNA, 20 bp, mouse
gtagcggccgggtggaggtg

SEQ ID NO: 528932 - DNA, 20 bp, mouse
gtcgccgccccgggcccagc

SEQ ID NO: 528933 - DNA, 20 bp, mouse
gtatgtgtgccctcctcggg

SEQ ID NO: 528934 - DNA, 20 bp, mouse
gctaacgccgccgcccgagg

SEQ ID NO: 528935 - DNA, 20 bp, mouse
ggcactggggggctcccgct

SEQ ID NO: 528936 - DNA, 20 bp, mouse
gggtcggctctggactggag

SEQ ID NO: 528937 - DNA, 20 bp, mouse
ggaagctgtcgcggatgtga

SEQ ID NO: 528938 - DNA, 20 bp, mouse
gctgctgaaggaagctgtcg

SEQ ID NO: 528939 - DNA, 20 bp, mouse
gggatgcctcaggggctcgg

SEQ ID NO: 528940 - DNA, 20 bp, mouse
gagacgagggagaaggcgtg

SEQ ID NO: 528941 - DNA, 20 bp, mouse
gctgtcacagacgagggaga

SEQ ID NO: 528942 - DNA, 20 bp, mouse
ggcgtggcccgcggggacag

SEQ ID NO: 528943 - DNA, 20 bp, mouse
gccgcgctcggggacaaccg

SEQ ID NO: 528944 - DNA, 20 bp, mouse
gaccccgtgtgagaccgagg

SEQ ID NO: 528945 - DNA, 20 bp, mouse
gcagattctgtcacagacga

SEQ ID NO: 528946 - DNA, 20 bp, mouse
ggcccgggtgtcaggcgcca

SEQ ID NO: 528947 - DNA, 20 bp, mouse
gatgctccggactcatcctc

SEQ ID NO: 528948 - DNA, 20 bp, mouse
ggagtccggagcatgcgccg

SEQ ID NO: 528949 - DNA, 20 bp, mouse
ggagagagcgagcacggggt

SEQ ID NO: 528950 - DNA, 20 bp, mouse
gggcgccacggcgcatgctc

SEQ ID NO: 528951 - DNA, 20 bp, mouse
ggccgtggcgcctgacaccc

SEQ ID NO: 528952 - DNA, 20 bp, mouse
gggtttgccggggtgttgtg

SEQ ID NO: 528953 - DNA, 20 bp, mouse
gcggactcatcctctggccc

SEQ ID NO: 528954 - DNA, 20 bp, mouse
gccgggcttcgagcctctag

SEQ ID NO: 528955 - DNA, 20 bp, mouse
ggagcgcgcccgggagctga

SEQ ID NO: 528956 - DNA, 20 bp, mouse
gcggctgaggcgggctgaag

SEQ ID NO: 528957 - DNA, 20 bp, mouse
ggagcccggcggaggacgcg

SEQ ID NO: 528958 - DNA, 20 bp, mouse
gggacgcgggccgagcccgg

SEQ ID NO: 528959 - DNA, 20 bp, mouse
ggagatcagccagccgaccg

SEQ ID NO: 528960 - DNA, 20 bp, mouse
gtggccagcggggtccctag

SEQ ID NO: 528961 - DNA, 20 bp, mouse
gcggccgcgacgaagagcgg

SEQ ID NO: 528962 - DNA, 20 bp, mouse
gcggcggcgctcacctcggt

SEQ ID NO: 528963 - DNA, 20 bp, mouse
gagccgggccggaacaccgc

SEQ ID NO: 528964 - DNA, 20 bp, mouse
ggggcggccgcgacgaagag

SEQ ID NO: 528965 - DNA, 20 bp, mouse
gcaccggccgcggctgaggc

SEQ ID NO: 528966 - DNA, 20 bp, mouse
gtaccagagccgcccggccg

SEQ ID NO: 528967 - DNA, 20 bp, mouse
gggctctggtagccggcgag

SEQ ID NO: 528968 - DNA, 20 bp, mouse
gtgcttgcaccgcggccggg

SEQ ID NO: 528969 - DNA, 20 bp, mouse
ggccgggcggctctggtagc

SEQ ID NO: 528970 - DNA, 20 bp, mouse
gccggcgagcggcgcggaag

SEQ ID NO: 528971 - DNA, 20 bp, mouse
gaggcaaagaaaagaagcgg

SEQ ID NO: 528972 - DNA, 20 bp, mouse
ggtgcaagcagggcccggcg

SEQ ID NO: 528973 - DNA, 20 bp, mouse
ggagctgcgggaccccgggg

SEQ ID NO: 528974 - DNA, 20 bp, mouse
gccgcggtgcaagcagggcc

SEQ ID NO: 528975 - DNA, 20 bp, mouse
ggcgccgagtggcacatcgc

SEQ ID NO: 528976 - DNA, 20 bp, mouse
gccgagcgaggccagtgtca

SEQ ID NO: 528977 - DNA, 20 bp, mouse
gctcctgagagagaaacccc

SEQ ID NO: 528978 - DNA, 20 bp, mouse
ggctcagtgcaccctgacac

SEQ ID NO: 528979 - DNA, 20 bp, mouse
ggagctgtgtgcggggatcc

SEQ ID NO: 528980 - DNA, 20 bp, mouse
ggccgcaagttgggcaggac

SEQ ID NO: 528981 - DNA, 20 bp, mouse
gaaaccccaggcaccgagcg

SEQ ID NO: 528982 - DNA, 20 bp, mouse
gcttgcggctcagatcacgt

SEQ ID NO: 528983 - DNA, 20 bp, mouse
gagacttggaccggagccca

SEQ ID NO: 528984 - DNA, 20 bp, mouse
gtccggtccaagtctcccga

SEQ ID NO: 528985 - DNA, 20 bp, mouse
ggtgatctgagccgcaagtt

SEQ ID NO: 528986 - DNA, 20 bp, mouse
ggcctcgccgtcctggacta

SEQ ID NO: 528987 - DNA, 20 bp, mouse
gcactctcctagccacccag

SEQ ID NO: 528988 - DNA, 20 bp, mouse
gagcgtgtgttaaggtacgg

SEQ ID NO: 528989 - DNA, 20 bp, mouse
gactctgccttagtccagga

SEQ ID NO: 528990 - DNA, 20 bp, mouse
gcagagcgtgtgttaaggta

SEQ ID NO: 528991 - DNA, 20 bp, mouse
ggctgctaccgaccactggg

SEQ ID NO: 528992 - DNA, 20 bp, mouse
gctcctagccacccagtggt

SEQ ID NO: 528993 - DNA, 20 bp, mouse
ggagtgcagagcgtgtgtta

SEQ ID NO: 528994 - DNA, 20 bp, mouse
gcgccgtctctcgcaagggt

SEQ ID NO: 528995 - DNA, 20 bp, mouse
ggttaaggtacgggggacac

SEQ ID NO: 528996 - DNA, 20 bp, mouse
gacggagccgggcgcctctc

SEQ ID NO: 528997 - DNA, 20 bp, mouse
ggcctctccggaggaccctt

SEQ ID NO: 528998 - DNA, 20 bp, mouse
gccggaggacccttgggtca

SEQ ID NO: 528999 - DNA, 20 bp, mouse
gcgaagcttgccttgaccca

SEQ ID NO: 529000 - DNA, 20 bp, mouse
gcccgggccccggacagcag

SEQ ID NO: 529001 - DNA, 20 bp, mouse
gcgtgtgtgcgggaacgagg

SEQ ID NO: 529002 - DNA, 20 bp, mouse
gttcggtaggttcacgatga

SEQ ID NO: 529003 - DNA, 20 bp, mouse
gggtcctccggagaggcgcc

SEQ ID NO: 529004 - DNA, 20 bp, mouse
gacccggcctgtgccaaggt

SEQ ID NO: 529005 - DNA, 20 bp, mouse
ggacctgcagcaccaagcaa

SEQ ID NO: 529006 - DNA, 20 bp, mouse
ggaagcacggggaacggagg

SEQ ID NO: 529007 - DNA, 20 bp, mouse
gtcccgggcagtctgcgcga

SEQ ID NO: 529008 - DNA, 20 bp, mouse
gcctcaggccgcgcgttccc

SEQ ID NO: 529009 - DNA, 20 bp, mouse
ggagccggggcgacgtaaag

SEQ ID NO: 529010 - DNA, 20 bp, mouse
gcgtaaagcggagaagcacg

SEQ ID NO: 529011 - DNA, 20 bp, mouse
ggccctcgcgcagactgccc

SEQ ID NO: 529012 - DNA, 20 bp, mouse
gaagtggccacgccggaggg

SEQ ID NO: 529013 - DNA, 20 bp, mouse
ggcgagcacccgcccaagaa

SEQ ID NO: 529014 - DNA, 20 bp, mouse
gcagactgcccgggaacgcg

SEQ ID NO: 529015 - DNA, 20 bp, mouse
ggacagcagatcatccacag

SEQ ID NO: 529016 - DNA, 20 bp, mouse
gcgggctagggacgacccgg

SEQ ID NO: 529017 - DNA, 20 bp, mouse
gatgctgcgcggcccgaagt

SEQ ID NO: 529018 - DNA, 20 bp, mouse
gctccagagcgcccgagagt

SEQ ID NO: 529019 - DNA, 20 bp, mouse
gcgaccaggaggggcccgtg

SEQ ID NO: 529020 - DNA, 20 bp, mouse
gcgaagtcggcgagccccac

SEQ ID NO: 529021 - DNA, 20 bp, mouse
gcaggctcaagcactcgaag

SEQ ID NO: 529022 - DNA, 20 bp, mouse
gctcaagcactcgaagaggt

SEQ ID NO: 529023 - DNA, 20 bp, mouse
ggtccgggctagggacgacc

SEQ ID NO: 529024 - DNA, 20 bp, mouse
gcgagagttggcgacaatag

SEQ ID NO: 529025 - DNA, 20 bp, mouse
gcgtatccgagtccgagtcc

SEQ ID NO: 529026 - DNA, 20 bp, mouse
ggcagaggcccgctctccag

SEQ ID NO: 529027 - DNA, 20 bp, mouse
ggctccgcgacagctgctag

SEQ ID NO: 529028 - DNA, 20 bp, mouse
ggagctgcgcgagaagacgc

SEQ ID NO: 529029 - DNA, 20 bp, mouse
gtgctagcgggagacgccac

SEQ ID NO: 529030 - DNA, 20 bp, mouse
ggccgcggcggggaccgcag

SEQ ID NO: 529031 - DNA, 20 bp, mouse
gagccctcaagcctggcccg

SEQ ID NO: 529032 - DNA, 20 bp, mouse
gggcctcgggccaggcttga

SEQ ID NO: 529033 - DNA, 20 bp, mouse
ggggagacgccactggagag

SEQ ID NO: 529034 - DNA, 20 bp, mouse
ggagctgtcatgcgaggcct

SEQ ID NO: 529035 - DNA, 20 bp, mouse
gacatcagcaagctggacgg

SEQ ID NO: 529036 - DNA, 20 bp, mouse
gctgctgcgcggcctcgcga

SEQ ID NO: 529037 - DNA, 20 bp, mouse
ggcgcggaggccaggagtcg

SEQ ID NO: 529038 - DNA, 20 bp, mouse
ggagcagtgggcggaagggg

SEQ ID NO: 529039 - DNA, 20 bp, mouse
gcctcgcgagggtgagtgtg

SEQ ID NO: 529040 - DNA, 20 bp, mouse
ggcgggagcagtgggcggaa

SEQ ID NO: 529041 - DNA, 20 bp, mouse
gcgacagcggggctgacccc

SEQ ID NO: 529042 - DNA, 20 bp, mouse
gagcagcagacccctcagag

SEQ ID NO: 529043 - DNA, 20 bp, mouse
gccccccgcgagcctccagg

SEQ ID NO: 529044 - DNA, 20 bp, mouse
gtggggcccggtgcgcgcgg

SEQ ID NO: 529045 - DNA, 20 bp, mouse
ggctgctgtcaggttctcgt

SEQ ID NO: 529046 - DNA, 20 bp, mouse
ggagacgcccgcgcaggccg

SEQ ID NO: 529047 - DNA, 20 bp, mouse
gtgcctagccgggtcagtct

SEQ ID NO: 529048 - DNA, 20 bp, mouse
gtaccgtgcgcatggctgtg

SEQ ID NO: 529049 - DNA, 20 bp, mouse
gatccaagactgacccggct

SEQ ID NO: 529050 - DNA, 20 bp, mouse
ggccacatagagcacgtcat

SEQ ID NO: 529051 - DNA, 20 bp, mouse
gggagagtaactcaacacgg

SEQ ID NO: 529052 - DNA, 20 bp, mouse
gaacgcatccaagactgacc

SEQ ID NO: 529053 - DNA, 20 bp, mouse
gctgtggtcagtcagggcag

SEQ ID NO: 529054 - DNA, 20 bp, mouse
gggcgctgagacgcccgcgc

SEQ ID NO: 529055 - DNA, 20 bp, mouse
gcctggacgggtgcctagcc

SEQ ID NO: 529056 - DNA, 20 bp, mouse
gagctcaccctaggaccaca

SEQ ID NO: 529057 - DNA, 20 bp, mouse
ggcttcagctctgcgactcg

SEQ ID NO: 529058 - DNA, 20 bp, mouse
gtcgaagccaaaaggacaca

SEQ ID NO: 529059 - DNA, 20 bp, mouse
gtaggttgagaggatcagaa

SEQ ID NO: 529060 - DNA, 20 bp, mouse
gcagcgttcagcgtgcgtta

SEQ ID NO: 529061 - DNA, 20 bp, mouse
gatggctgcagtaggttgag

SEQ ID NO: 529062 - DNA, 20 bp, mouse
ggataaacttcgaagccaaa

SEQ ID NO: 529063 - DNA, 20 bp, mouse
gtgtcttccctgtggtccta

SEQ ID NO: 529064 - DNA, 20 bp, mouse
ggtcatcagatggctgcagt

SEQ ID NO: 529065 - DNA, 20 bp, mouse
gtgacaggttaggggatctt

SEQ ID NO: 529066 - DNA, 20 bp, mouse
ggccatcttgccagtggacg

SEQ ID NO: 529067 - DNA, 20 bp, mouse
ggtagccgccatcttgccag

SEQ ID NO: 529068 - DNA, 20 bp, mouse
gaccccgtccactggcaaga

SEQ ID NO: 529069 - DNA, 20 bp, mouse
ggctactgcggtccaggcag

SEQ ID NO: 529070 - DNA, 20 bp, mouse
ggggaagccgggggacacta

SEQ ID NO: 529071 - DNA, 20 bp, mouse
gagtgtgcagaagagaccgc

SEQ ID NO: 529072 - DNA, 20 bp, mouse
ggcgcggtgactggtacgga

SEQ ID NO: 529073 - DNA, 20 bp, mouse
gggcaagatggcggctactg

SEQ ID NO: 529074 - DNA, 20 bp, mouse
gggggcaagaccgccagcag

SEQ ID NO: 529075 - DNA, 20 bp, mouse
gggctcggaggcaactactc

SEQ ID NO: 529076 - DNA, 20 bp, mouse
gaggcgggagccacgcaact

SEQ ID NO: 529077 - DNA, 20 bp, mouse
gccggagtgggccacaccgg

SEQ ID NO: 529078 - DNA, 20 bp, mouse
gaactgggcagggccggagt

SEQ ID NO: 529079 - DNA, 20 bp, mouse
gccctgtgctgaccgacccc

SEQ ID NO: 529080 - DNA, 20 bp, mouse
gtgctgaccgacccccggtg

SEQ ID NO: 529081 - DNA, 20 bp, mouse
gagtgggccacaccgggggt

SEQ ID NO: 529082 - DNA, 20 bp, mouse
gcgggagccggtcctcgtca

SEQ ID NO: 529083 - DNA, 20 bp, mouse
ggtggagcggtggatcaatg

SEQ ID NO: 529084 - DNA, 20 bp, mouse
gggccagagcaggcgcctgg

SEQ ID NO: 529085 - DNA, 20 bp, mouse
ggttcaggaatcgattccag

SEQ ID NO: 529086 - DNA, 20 bp, mouse
gggctccggaggcaactgat

SEQ ID NO: 529087 - DNA, 20 bp, mouse
gagatcctcgggctgctcca

SEQ ID NO: 529088 - DNA, 20 bp, mouse
ggaggcgcagcaggttggaa

SEQ ID NO: 529089 - DNA, 20 bp, mouse
gaaggccctggagcagcccg

SEQ ID NO: 529090 - DNA, 20 bp, mouse
gttgcgatccgggagactcc

SEQ ID NO: 529091 - DNA, 20 bp, mouse
gttcgggaggcgcagcaggt

SEQ ID NO: 529092 - DNA, 20 bp, mouse
ggtcagggggtgatagacag

SEQ ID NO: 529093 - DNA, 20 bp, mouse
gaaggtgagtagcgggtcag

SEQ ID NO: 529094 - DNA, 20 bp, mouse
gtccatcagcgcccagacca

SEQ ID NO: 529095 - DNA, 20 bp, mouse
gcaccaggagccgcttcggg

SEQ ID NO: 529096 - DNA, 20 bp, mouse
gacaagtgcatgagatttga

SEQ ID NO: 529097 - DNA, 20 bp, mouse
gacagagaggctgatctcca

SEQ ID NO: 529098 - DNA, 20 bp, mouse
ggccaaagaagaaacagcga

SEQ ID NO: 529099 - DNA, 20 bp, mouse
gttgctcctgactatcatag

SEQ ID NO: 529100 - DNA, 20 bp, mouse
gaaacagcgatggactcccc

SEQ ID NO: 529101 - DNA, 20 bp, mouse
gacacacatctgaatctgat

SEQ ID NO: 529102 - DNA, 20 bp, mouse
gtctgaatctgattggtccc

SEQ ID NO: 529103 - DNA, 20 bp, mouse
gtccatcgctgtttcttctt

SEQ ID NO: 529104 - DNA, 20 bp, mouse
gggaagatcagaaagtcaga

SEQ ID NO: 529105 - DNA, 20 bp, mouse
gtaaaaaagttgattgggcc

SEQ ID NO: 529106 - DNA, 20 bp, mouse
gtccgcccaggagttctgtt

SEQ ID NO: 529107 - DNA, 20 bp, mouse
gtgcaccggggttcatttgg

SEQ ID NO: 529108 - DNA, 20 bp, mouse
ggcgctgccaaattgcaccg

SEQ ID NO: 529109 - DNA, 20 bp, mouse
gaccaaacagaactcctggg

SEQ ID NO: 529110 - DNA, 20 bp, mouse
gaatgaaccccggtgcaatt

SEQ ID NO: 529111 - DNA, 20 bp, mouse
gcgaagcacgatgaagaggt

SEQ ID NO: 529112 - DNA, 20 bp, mouse
gccagcccccaaatgaaccc

SEQ ID NO: 529113 - DNA, 20 bp, mouse
gaaaaacagtgtctgtacag

SEQ ID NO: 529114 - DNA, 20 bp, mouse
gcccgcgccagccaaccctt

SEQ ID NO: 529115 - DNA, 20 bp, mouse
gacttgaccgagaggctcag

SEQ ID NO: 529116 - DNA, 20 bp, mouse
gttgggatgtctcagagctg

SEQ ID NO: 529117 - DNA, 20 bp, mouse
gctccacccggagcccacct

SEQ ID NO: 529118 - DNA, 20 bp, mouse
gaggcagggacaccccaggt

SEQ ID NO: 529119 - DNA, 20 bp, mouse
gctgctaggcaagtccttaa

SEQ ID NO: 529120 - DNA, 20 bp, mouse
gagtccttaaaggctaggtt

SEQ ID NO: 529121 - DNA, 20 bp, mouse
gtggggtgagctggccaagg

SEQ ID NO: 529122 - DNA, 20 bp, mouse
ggctggccaaggtgggctcc

SEQ ID NO: 529123 - DNA, 20 bp, mouse
gagctgggtgtgaggtcaca

SEQ ID NO: 529124 - DNA, 20 bp, mouse
gaggcaagtccttaaaggct

SEQ ID NO: 529125 - DNA, 20 bp, mouse
ggtgactgagagcaccaggt

SEQ ID NO: 529126 - DNA, 20 bp, mouse
ggctatcacacagcttgggg

SEQ ID NO: 529127 - DNA, 20 bp, mouse
gaccctgaatggccaccccg

SEQ ID NO: 529128 - DNA, 20 bp, mouse
gttcagtgatgaatccctga

SEQ ID NO: 529129 - DNA, 20 bp, mouse
ggggctggaggaacagaacg

SEQ ID NO: 529130 - DNA, 20 bp, mouse
gtagcaggtgagcttctccc

SEQ ID NO: 529131 - DNA, 20 bp, mouse
ggtgatgaatccctgagggc

SEQ ID NO: 529132 - DNA, 20 bp, mouse
gtctgttcctccagccctca

SEQ ID NO: 529133 - DNA, 20 bp, mouse
gatgggcagccctctgcagg

SEQ ID NO: 529134 - DNA, 20 bp, mouse
gtcttgtggggaagcgaaag

SEQ ID NO: 529135 - DNA, 20 bp, mouse
gcagctgggcaagattctag

SEQ ID NO: 529136 - DNA, 20 bp, mouse
gaacaaaaggagacgaaggg

SEQ ID NO: 529137 - DNA, 20 bp, mouse
gaggagacgaagggcggcag

SEQ ID NO: 529138 - DNA, 20 bp, mouse
gggagcggcagcccaacaaa

SEQ ID NO: 529139 - DNA, 20 bp, mouse
ggacgcccgccggtgaaagg

SEQ ID NO: 529140 - DNA, 20 bp, mouse
gagccgtgcagggtcctcag

SEQ ID NO: 529141 - DNA, 20 bp, mouse
ggcccaacaaaaggagacga

SEQ ID NO: 529142 - DNA, 20 bp, mouse
ggacggcgccatgattcaga

SEQ ID NO: 529143 - DNA, 20 bp, mouse
gctcgcgtgggggacaccag

SEQ ID NO: 529144 - DNA, 20 bp, mouse
ggtggacgcccgccggtgaa

SEQ ID NO: 529145 - DNA, 20 bp, mouse
ggcagctgaaaaggcagcgt

SEQ ID NO: 529146 - DNA, 20 bp, mouse
gtgaggcccagggattacgg

SEQ ID NO: 529147 - DNA, 20 bp, mouse
gctgactgcgcgcctaggtg

SEQ ID NO: 529148 - DNA, 20 bp, mouse
gtcccaccaccgtaatccct

SEQ ID NO: 529149 - DNA, 20 bp, mouse
gcgcgcctaggtgaggccca

SEQ ID NO: 529150 - DNA, 20 bp, mouse
gaggtcggggcgccgagcga

SEQ ID NO: 529151 - DNA, 20 bp, mouse
ggcccagggattacggtggt

SEQ ID NO: 529152 - DNA, 20 bp, mouse
gacggtggtgggaggaggtc

SEQ ID NO: 529153 - DNA, 20 bp, mouse
gcgcgcagtcaggaaagcat

SEQ ID NO: 529154 - DNA, 20 bp, mouse
ggagggagggagacacgcgg

SEQ ID NO: 529155 - DNA, 20 bp, mouse
gaaggagcgggcgccggaga

SEQ ID NO: 529156 - DNA, 20 bp, mouse
gccaggtgctagagaaggat

SEQ ID NO: 529157 - DNA, 20 bp, mouse
gatggagccactagccatcc

SEQ ID NO: 529158 - DNA, 20 bp, mouse
gtccgcttcaaccaaagtgg

SEQ ID NO: 529159 - DNA, 20 bp, mouse
gggccactaaagggaagata

SEQ ID NO: 529160 - DNA, 20 bp, mouse
gaaagtaaagactgtctgta

SEQ ID NO: 529161 - DNA, 20 bp, mouse
gcagccgaagtggggagact

SEQ ID NO: 529162 - DNA, 20 bp, mouse
ggtgtcactgccccatgcag

SEQ ID NO: 529163 - DNA, 20 bp, mouse
gtgctcaggtaatcagtcag

SEQ ID NO: 529164 - DNA, 20 bp, mouse
ggctggaagaccaaagggca

SEQ ID NO: 529165 - DNA, 20 bp, mouse
gggatccgcttcaaccaaag

SEQ ID NO: 529166 - DNA, 20 bp, mouse
ggaaatcgcgcggaggagac

SEQ ID NO: 529167 - DNA, 20 bp, mouse
gtcggggacagactgcacta

SEQ ID NO: 529168 - DNA, 20 bp, mouse
ggccccggggcggatggcac

SEQ ID NO: 529169 - DNA, 20 bp, mouse
ggaggacgcgcgaaatcgcg

SEQ ID NO: 529170 - DNA, 20 bp, mouse
ggactgcactagggtagcca

SEQ ID NO: 529171 - DNA, 20 bp, mouse
gacgctcagagagacccaga

SEQ ID NO: 529172 - DNA, 20 bp, mouse
gcccgggccatcagcggcga

SEQ ID NO: 529173 - DNA, 20 bp, mouse
gcggcccgtgccatccgccc

SEQ ID NO: 529174 - DNA, 20 bp, mouse
gaggagtggcgggcactcac

SEQ ID NO: 529175 - DNA, 20 bp, mouse
ggacgcgcgaaatcgcgcgg

SEQ ID NO: 529176 - DNA, 20 bp, mouse
gaagggaacttgcagtcgga

SEQ ID NO: 529177 - DNA, 20 bp, mouse
gacttgcagtcggagggaac

SEQ ID NO: 529178 - DNA, 20 bp, mouse
gctttaagggaacttgcagt

SEQ ID NO: 529179 - DNA, 20 bp, mouse
gtcttacaggtatctgcctg

SEQ ID NO: 529180 - DNA, 20 bp, mouse
gtcatctttataatcctctc

SEQ ID NO: 529181 - DNA, 20 bp, mouse
gaactattaaagatacagtc

SEQ ID NO: 529182 - DNA, 20 bp, mouse
gctaatagagtgttgtgtat

SEQ ID NO: 529183 - DNA, 20 bp, mouse
gccagtaataatgcaagatt

SEQ ID NO: 529184 - DNA, 20 bp, mouse
gtaccatctacaaaaagctt

SEQ ID NO: 529185 - DNA, 20 bp, mouse
gtgaaagaatgtcattaaac

SEQ ID NO: 529186 - DNA, 20 bp, mouse
ggtccagctcaacaagaaga

SEQ ID NO: 529187 - DNA, 20 bp, mouse
gggaaggggcagggaccaac

SEQ ID NO: 529188 - DNA, 20 bp, mouse
ggccaggatagctgaatgca

SEQ ID NO: 529189 - DNA, 20 bp, mouse
gtcatcatcaccatagggaa

SEQ ID NO: 529190 - DNA, 20 bp, mouse
ggagagactccaggcactgc

SEQ ID NO: 529191 - DNA, 20 bp, mouse
gcatcatcatcatcaccata

SEQ ID NO: 529192 - DNA, 20 bp, mouse
gtctcggagcctgtcaactg

SEQ ID NO: 529193 - DNA, 20 bp, mouse
gtcccgcaagagtcgcagga

SEQ ID NO: 529194 - DNA, 20 bp, mouse
gtgcactacagtgccatcct

SEQ ID NO: 529195 - DNA, 20 bp, mouse
gcggagcctgtcaactgtgg

SEQ ID NO: 529196 - DNA, 20 bp, mouse
ggagaggcggcgcgacccca

SEQ ID NO: 529197 - DNA, 20 bp, mouse
gcagaagaaagatcaaaaaa

SEQ ID NO: 529198 - DNA, 20 bp, mouse
gcttagtcggcgaactgagt

SEQ ID NO: 529199 - DNA, 20 bp, mouse
ggcggtcggcttggaggtga

SEQ ID NO: 529200 - DNA, 20 bp, mouse
gtagagcgcggtcggcttgg

SEQ ID NO: 529201 - DNA, 20 bp, mouse
ggacaaaggcgccccaagag

SEQ ID NO: 529202 - DNA, 20 bp, mouse
gaaaggcgccccaagagagg

SEQ ID NO: 529203 - DNA, 20 bp, mouse
gagagcccatctctcagcgg

SEQ ID NO: 529204 - DNA, 20 bp, mouse
ggggtcgcgccgcctctctt

SEQ ID NO: 529205 - DNA, 20 bp, mouse
gcccagagcccatctctcag

SEQ ID NO: 529206 - DNA, 20 bp, mouse
gccccaggcagtcccgggag

SEQ ID NO: 529207 - DNA, 20 bp, mouse
gccgccgcgcactgggagta

SEQ ID NO: 529208 - DNA, 20 bp, mouse
ggcgctggctagctggctgg

SEQ ID NO: 529209 - DNA, 20 bp, mouse
gcaatcgggcctggatcccc

SEQ ID NO: 529210 - DNA, 20 bp, mouse
gtgcggagccaaactcgccg

SEQ ID NO: 529211 - DNA, 20 bp, mouse
gcaaactcgccggggacgcc

SEQ ID NO: 529212 - DNA, 20 bp, mouse
gaagcgggcagggcaggtcg

SEQ ID NO: 529213 - DNA, 20 bp, mouse
ggagagtgcagggcgcgcag

SEQ ID NO: 529214 - DNA, 20 bp, mouse
ggggcagcgcggaggacctt

SEQ ID NO: 529215 - DNA, 20 bp, mouse
ggcgggctcgtcgctctgtc

SEQ ID NO: 529216 - DNA, 20 bp, mouse
gcccttcccgcagaaactgg

SEQ ID NO: 529217 - DNA, 20 bp, mouse
ggcaccggcggcgtaggagg

SEQ ID NO: 529218 - DNA, 20 bp, mouse
gggaaaggcagggtcagcgg

SEQ ID NO: 529219 - DNA, 20 bp, mouse
gccggtgcccccagtttctg

SEQ ID NO: 529220 - DNA, 20 bp, mouse
ggagaaggcggaggacgcac

SEQ ID NO: 529221 - DNA, 20 bp, mouse
gaccgatgaacattctggag

SEQ ID NO: 529222 - DNA, 20 bp, mouse
gagtgagctgggagcggctg

SEQ ID NO: 529223 - DNA, 20 bp, mouse
gcggaaccgcgggtgaactt

SEQ ID NO: 529224 - DNA, 20 bp, mouse
gatccccgcagaccccggga

SEQ ID NO: 529225 - DNA, 20 bp, mouse
gtccccatccctggacgggt

SEQ ID NO: 529226 - DNA, 20 bp, mouse
ggaccctcgccacccgacct

SEQ ID NO: 529227 - DNA, 20 bp, mouse
gcccgcggagcggagcggtg

SEQ ID NO: 529228 - DNA, 20 bp, mouse
gggtggtgagtgaacgacag

SEQ ID NO: 529229 - DNA, 20 bp, mouse
gggcgcgcggctcagtcccg

SEQ ID NO: 529230 - DNA, 20 bp, mouse
gcgacctgggagagcgggat

SEQ ID NO: 529231 - DNA, 20 bp, mouse
ggcggctcagtcccgcggag

SEQ ID NO: 529232 - DNA, 20 bp, mouse
gtggcgctggcggcccatgg

SEQ ID NO: 529233 - DNA, 20 bp, mouse
gccagtacaagcagcagtgg

SEQ ID NO: 529234 - DNA, 20 bp, mouse
gacctctccgaaaggagcaa

SEQ ID NO: 529235 - DNA, 20 bp, mouse
gctcccaggtcgggtggcga

SEQ ID NO: 529236 - DNA, 20 bp, mouse
gggcttataaagaggaccag

SEQ ID NO: 529237 - DNA, 20 bp, mouse
ggaggctgacagcaaagacc

SEQ ID NO: 529238 - DNA, 20 bp, mouse
gttcagaagtctcaggccag

SEQ ID NO: 529239 - DNA, 20 bp, mouse
gaaaggagggctcagagtgt

SEQ ID NO: 529240 - DNA, 20 bp, mouse
gcagttgaaggcttataaag

SEQ ID NO: 529241 - DNA, 20 bp, mouse
ggagacttctgaaagtttgg

SEQ ID NO: 529242 - DNA, 20 bp, mouse
gcagtcttggtgagtcctct

SEQ ID NO: 529243 - DNA, 20 bp, mouse
gtcagagtgtgggaatgaca

SEQ ID NO: 529244 - DNA, 20 bp, mouse
gctaacaggccagatatgag

SEQ ID NO: 529245 - DNA, 20 bp, mouse
gcctgagacttctgaaagtt

SEQ ID NO: 529246 - DNA, 20 bp, mouse
gctctgggcaaaatcaccag

SEQ ID NO: 529247 - DNA, 20 bp, mouse
gaagttcctgactaggatgt

SEQ ID NO: 529248 - DNA, 20 bp, mouse
ggtctccgttgtgaaacaca

SEQ ID NO: 529249 - DNA, 20 bp, mouse
ggagttgcccctccttgctt

SEQ ID NO: 529250 - DNA, 20 bp, mouse
gggtaggggggacccaagca

SEQ ID NO: 529251 - DNA, 20 bp, mouse
gaacggagaccggcaaaatg

SEQ ID NO: 529252 - DNA, 20 bp, mouse
gaaaataattaggataatga

SEQ ID NO: 529253 - DNA, 20 bp, mouse
ggcaactccctctataaatg

SEQ ID NO: 529254 - DNA, 20 bp, mouse
gtgaaaagtaattctctatt

SEQ ID NO: 529255 - DNA, 20 bp, mouse
gacctctttctggttggggt

SEQ ID NO: 529256 - DNA, 20 bp, mouse
ggagtccatcctgaatcaca

SEQ ID NO: 529257 - DNA, 20 bp, mouse
ggggtagaggggacctgtga

SEQ ID NO: 529258 - DNA, 20 bp, mouse
ggtgtgatttcatgaatgga

SEQ ID NO: 529259 - DNA, 20 bp, mouse
gttctaagagaaatggtatt

SEQ ID NO: 529260 - DNA, 20 bp, mouse
gtgaaatcacactataatat

SEQ ID NO: 529261 - DNA, 20 bp, mouse
gtatagtgtgatttcatgaa

SEQ ID NO: 529262 - DNA, 20 bp, mouse
ggatggatttctaagagaaa

SEQ ID NO: 529263 - DNA, 20 bp, mouse
ggtttccctgtgattcagga

SEQ ID NO: 529264 - DNA, 20 bp, mouse
ggactgtcttcacatttttc

SEQ ID NO: 529265 - DNA, 20 bp, mouse
gttttgagaatgttacattt

SEQ ID NO: 529266 - DNA, 20 bp, mouse
gctggatgcagcggaaacaa

SEQ ID NO: 529267 - DNA, 20 bp, mouse
ggccagccgggcggacccca

SEQ ID NO: 529268 - DNA, 20 bp, mouse
gcctgagccccgagaagcag

SEQ ID NO: 529269 - DNA, 20 bp, mouse
ggatgcagcggaaacaaggg

SEQ ID NO: 529270 - DNA, 20 bp, mouse
gcaggacctgcaagcacccg

SEQ ID NO: 529271 - DNA, 20 bp, mouse
gggcgggcagacgccagatg

SEQ ID NO: 529272 - DNA, 20 bp, mouse
gcccgggagcgcaacgatgg

SEQ ID NO: 529273 - DNA, 20 bp, mouse
gggacgcagagaacccgcag

SEQ ID NO: 529274 - DNA, 20 bp, mouse
gggctccgcgtgtcaccctg

SEQ ID NO: 529275 - DNA, 20 bp, mouse
gacgccagatgtggccggct

SEQ ID NO: 529276 - DNA, 20 bp, mouse
gagtaggttggggtctgcag

SEQ ID NO: 529277 - DNA, 20 bp, mouse
gtaacccagtacacccaaca

SEQ ID NO: 529278 - DNA, 20 bp, mouse
ggatgattgtatcagcccag

SEQ ID NO: 529279 - DNA, 20 bp, mouse
gtacaatcatcaagcaagag

SEQ ID NO: 529280 - DNA, 20 bp, mouse
gttgctcctgaaggtcctag

SEQ ID NO: 529281 - DNA, 20 bp, mouse
gcctaggggtggctgccagt

SEQ ID NO: 529282 - DNA, 20 bp, mouse
gtgaaggtgctacctgcctc

SEQ ID NO: 529283 - DNA, 20 bp, mouse
ggtgcactgtctgccacccc

SEQ ID NO: 529284 - DNA, 20 bp, mouse
gaaactttaaagctgtgaca

SEQ ID NO: 529285 - DNA, 20 bp, mouse
gcagctgaacaaaatatctg

SEQ ID NO: 529286 - DNA, 20 bp, mouse
ggtgcaactagccagcagag

SEQ ID NO: 529287 - DNA, 20 bp, mouse
gagtgtcagacgcaagacag

SEQ ID NO: 529288 - DNA, 20 bp, mouse
ggtccgaacggtcccggctg

SEQ ID NO: 529289 - DNA, 20 bp, mouse
gagatggctccaggtccgaa

SEQ ID NO: 529290 - DNA, 20 bp, mouse
gctggcaggaggccaacaga

SEQ ID NO: 529291 - DNA, 20 bp, mouse
ggcagcaagcatggcttcac

SEQ ID NO: 529292 - DNA, 20 bp, mouse
ggagagcagcagcatttgtg

SEQ ID NO: 529293 - DNA, 20 bp, mouse
gtacagagaaaggacagtac

SEQ ID NO: 529294 - DNA, 20 bp, mouse
gctccaggtccgaacggtcc

SEQ ID NO: 529295 - DNA, 20 bp, mouse
ggaactatgtgtaactccgt

SEQ ID NO: 529296 - DNA, 20 bp, mouse
gagacaggcccggcagccca

SEQ ID NO: 529297 - DNA, 20 bp, mouse
gcccatggcagactccagtc

SEQ ID NO: 529298 - DNA, 20 bp, mouse
gctccggacggagacaggcc

SEQ ID NO: 529299 - DNA, 20 bp, mouse
gcgcgccggacgcctccgga

SEQ ID NO: 529300 - DNA, 20 bp, mouse
gagtcgggttagggccacaa

SEQ ID NO: 529301 - DNA, 20 bp, mouse
ggctcaggtgagaggacgaa

SEQ ID NO: 529302 - DNA, 20 bp, mouse
gacccgactggagtctgcca

SEQ ID NO: 529303 - DNA, 20 bp, mouse
gggagcgggtcagcatctga

SEQ ID NO: 529304 - DNA, 20 bp, mouse
gtgccgggcctgtctccgtc

SEQ ID NO: 529305 - DNA, 20 bp, mouse
gagaaggcacaacccgctca

SEQ ID NO: 529306 - DNA, 20 bp, mouse
gtgactcggcggctccgcag

SEQ ID NO: 529307 - DNA, 20 bp, mouse
gccgcggcgccgtgactcgg

SEQ ID NO: 529308 - DNA, 20 bp, mouse
gcgtccgcggcgccgtgact

SEQ ID NO: 529309 - DNA, 20 bp, mouse
gtgcagcgggaggacccggc

SEQ ID NO: 529310 - DNA, 20 bp, mouse
gagcagagcgcgggcagcag

SEQ ID NO: 529311 - DNA, 20 bp, mouse
gccgcgaggcagcagagcgc

SEQ ID NO: 529312 - DNA, 20 bp, mouse
gcctcccgctgcagccgctg

SEQ ID NO: 529313 - DNA, 20 bp, mouse
gggccgcccggctgcgatgg

SEQ ID NO: 529314 - DNA, 20 bp, mouse
gcgcccggctgcgatggcgg

SEQ ID NO: 529315 - DNA, 20 bp, mouse
ggctccgcagcggctgcagc

SEQ ID NO: 529316 - DNA, 20 bp, mouse
gtcgcccaggctggacctgg

SEQ ID NO: 529317 - DNA, 20 bp, mouse
gtcaggaggggacagaggtc

SEQ ID NO: 529318 - DNA, 20 bp, mouse
gaggctcccactagcatatt

SEQ ID NO: 529319 - DNA, 20 bp, mouse
ggcctcgcccaggctggacc

SEQ ID NO: 529320 - DNA, 20 bp, mouse
ggggacccggtgcagatcca

SEQ ID NO: 529321 - DNA, 20 bp, mouse
gggcagttggcgcctcgccc

SEQ ID NO: 529322 - DNA, 20 bp, mouse
gggaagtctggaggaggtca

SEQ ID NO: 529323 - DNA, 20 bp, mouse
ggatccagggagccgacaca

SEQ ID NO: 529324 - DNA, 20 bp, mouse
gggacagaggtccggcaaag

SEQ ID NO: 529325 - DNA, 20 bp, mouse
gcagcttggacggaccgcgg

SEQ ID NO: 529326 - DNA, 20 bp, mouse
gctgtctggaggaaatgcag

SEQ ID NO: 529327 - DNA, 20 bp, mouse
gaagctttaactgaagagac

SEQ ID NO: 529328 - DNA, 20 bp, mouse
gtcccgagagaagctataaa

SEQ ID NO: 529329 - DNA, 20 bp, mouse
gtagagttagacacatggaa

SEQ ID NO: 529330 - DNA, 20 bp, mouse
gtgtaaaggacacagactac

SEQ ID NO: 529331 - DNA, 20 bp, mouse
gtggctgcccttagttgtat

SEQ ID NO: 529332 - DNA, 20 bp, mouse
gcctgtcaggaaagatgtaa

SEQ ID NO: 529333 - DNA, 20 bp, mouse
gttcaagagcataagatgaa

SEQ ID NO: 529334 - DNA, 20 bp, mouse
ggccttttatagcttctctc

SEQ ID NO: 529335 - DNA, 20 bp, mouse
gagtaagaatataagccaag

SEQ ID NO: 529336 - DNA, 20 bp, mouse
ggcgggtgccggacaacctc

SEQ ID NO: 529337 - DNA, 20 bp, mouse
gggtgccggacaacctcggg

SEQ ID NO: 529338 - DNA, 20 bp, mouse
gctcgggcggcggtggaacc

SEQ ID NO: 529339 - DNA, 20 bp, mouse
gccaggcgctagggaccctg

SEQ ID NO: 529340 - DNA, 20 bp, mouse
ggcggtggaaccaggcgcta

SEQ ID NO: 529341 - DNA, 20 bp, mouse
gctccggttgactgacccac

SEQ ID NO: 529342 - DNA, 20 bp, mouse
gaccgccgcccgaggttgtc

SEQ ID NO: 529343 - DNA, 20 bp, mouse
ggtcaaccggaggaccgagg

SEQ ID NO: 529344 - DNA, 20 bp, mouse
gcggacccaccaggtcccca

SEQ ID NO: 529345 - DNA, 20 bp, mouse
ggacccacaggcaggcatcg

SEQ ID NO: 529346 - DNA, 20 bp, mouse
ggcagagaacctactgaagg

SEQ ID NO: 529347 - DNA, 20 bp, mouse
ggcagcagagaacctactga

SEQ ID NO: 529348 - DNA, 20 bp, mouse
ggctctgtaccaccttcagt

SEQ ID NO: 529349 - DNA, 20 bp, mouse
gtacacaggcagtcagaacc

SEQ ID NO: 529350 - DNA, 20 bp, mouse
gggtgcaggaggcacatgaa

SEQ ID NO: 529351 - DNA, 20 bp, mouse
ggcactgtcatgcaatgggt

SEQ ID NO: 529352 - DNA, 20 bp, mouse
gggcagtcagaacccggctg

SEQ ID NO: 529353 - DNA, 20 bp, mouse
gtgccaagccacatttacac

SEQ ID NO: 529354 - DNA, 20 bp, mouse
gatggtggcagaggcaacac

SEQ ID NO: 529355 - DNA, 20 bp, mouse
gaaagttgggcttaagaagg

SEQ ID NO: 529356 - DNA, 20 bp, mouse
ggagaacaatcgcctgttga

SEQ ID NO: 529357 - DNA, 20 bp, mouse
gcgtggcagtaaatattctt

SEQ ID NO: 529358 - DNA, 20 bp, mouse
gctgcatagctgccatcaac

SEQ ID NO: 529359 - DNA, 20 bp, mouse
gaccacacgtggaatattgg

SEQ ID NO: 529360 - DNA, 20 bp, mouse
ggatgtgagcgcacatcagt

SEQ ID NO: 529361 - DNA, 20 bp, mouse
gcatcagtgggaacaggctc

SEQ ID NO: 529362 - DNA, 20 bp, mouse
gctttgatgtttcctgacag

SEQ ID NO: 529363 - DNA, 20 bp, mouse
gactgccacgcaagcaccga

SEQ ID NO: 529364 - DNA, 20 bp, mouse
ggagaaccccgagtgagaga

SEQ ID NO: 529365 - DNA, 20 bp, mouse
gagcgcacatcagtgggaac

SEQ ID NO: 529366 - DNA, 20 bp, mouse
gaccagacaagagcagtgat

SEQ ID NO: 529367 - DNA, 20 bp, mouse
gggggatgctgtgagcttga

SEQ ID NO: 529368 - DNA, 20 bp, mouse
gaaggcaggagaggttgtct

SEQ ID NO: 529369 - DNA, 20 bp, mouse
ggcttgagggcacttgccag

SEQ ID NO: 529370 - DNA, 20 bp, mouse
gtgtggaggaagatcagtaa

SEQ ID NO: 529371 - DNA, 20 bp, mouse
gcaagagcagtgattggcag

SEQ ID NO: 529372 - DNA, 20 bp, mouse
gcggtggttacagaattctg

SEQ ID NO: 529373 - DNA, 20 bp, mouse
gggcattggcaagctgtgtg

SEQ ID NO: 529374 - DNA, 20 bp, mouse
gtgtccttctagactaagaa

SEQ ID NO: 529375 - DNA, 20 bp, mouse
gcccaaggaacactactgtc

SEQ ID NO: 529376 - DNA, 20 bp, mouse
gggtcctcaccatgagtccc

SEQ ID NO: 529377 - DNA, 20 bp, mouse
ggtcggctggcgctggtaag

SEQ ID NO: 529378 - DNA, 20 bp, mouse
gctgccagggactcatggtg

SEQ ID NO: 529379 - DNA, 20 bp, mouse
ggccagggttaggcagtagg

SEQ ID NO: 529380 - DNA, 20 bp, mouse
gagagctgcagccgaaagcc

SEQ ID NO: 529381 - DNA, 20 bp, mouse
gctcggtggatagctgagaa

SEQ ID NO: 529382 - DNA, 20 bp, mouse
gtagctgagaagggctggtc

SEQ ID NO: 529383 - DNA, 20 bp, mouse
gatctgaggccccattcctt

SEQ ID NO: 529384 - DNA, 20 bp, mouse
gaccccctactgcctaaccc

SEQ ID NO: 529385 - DNA, 20 bp, mouse
gaggccccattccttgggag

SEQ ID NO: 529386 - DNA, 20 bp, mouse
gccagcatggcagtaaattt

SEQ ID NO: 529387 - DNA, 20 bp, mouse
gagtggccgagagcacttgg

SEQ ID NO: 529388 - DNA, 20 bp, mouse
gtgagtggaggggttctgag

SEQ ID NO: 529389 - DNA, 20 bp, mouse
ggcagctgcaggaccctgag

SEQ ID NO: 529390 - DNA, 20 bp, mouse
gtgcaggaccctgagtggag

SEQ ID NO: 529391 - DNA, 20 bp, mouse
gttaggcacaaaaattcatg

SEQ ID NO: 529392 - DNA, 20 bp, mouse
gaattggctatcagaaaggc

SEQ ID NO: 529393 - DNA, 20 bp, mouse
gctgagtggccgagagcact

SEQ ID NO: 529394 - DNA, 20 bp, mouse
gtggcttctcccgtcaggag

SEQ ID NO: 529395 - DNA, 20 bp, mouse
ggggctgtgatgttgactgt

SEQ ID NO: 529396 - DNA, 20 bp, mouse
gcagtgtcgggatcatggtg

SEQ ID NO: 529397 - DNA, 20 bp, mouse
ggcctgaaggctggagacta

SEQ ID NO: 529398 - DNA, 20 bp, mouse
gaatttgagagtcacttgta

SEQ ID NO: 529399 - DNA, 20 bp, mouse
gcagcagagaccccatcaga

SEQ ID NO: 529400 - DNA, 20 bp, mouse
gatctcccgatctccgacaa

SEQ ID NO: 529401 - DNA, 20 bp, mouse
ggtaacacagctcccactag

SEQ ID NO: 529402 - DNA, 20 bp, mouse
ggagaccccatcagacggta

SEQ ID NO: 529403 - DNA, 20 bp, mouse
gtgagtcccatgccactagt

SEQ ID NO: 529404 - DNA, 20 bp, mouse
gtgatcccgacactgctgct

SEQ ID NO: 529405 - DNA, 20 bp, mouse
gataggcccggcatgcctga

SEQ ID NO: 529406 - DNA, 20 bp, mouse
gactgcctcctccagaccgg

SEQ ID NO: 529407 - DNA, 20 bp, mouse
gtcttgcacgaggccacaca

SEQ ID NO: 529408 - DNA, 20 bp, mouse
ggacgctagccagagattgt

SEQ ID NO: 529409 - DNA, 20 bp, mouse
gggccacacagggcgcccat

SEQ ID NO: 529410 - DNA, 20 bp, mouse
gatggctgccgccaccggtc

SEQ ID NO: 529411 - DNA, 20 bp, mouse
ggcggcgggaagggagtgaa

SEQ ID NO: 529412 - DNA, 20 bp, mouse
gaggaggcagtggcgcctat

SEQ ID NO: 529413 - DNA, 20 bp, mouse
ggcagtagcgctcccagcgg

SEQ ID NO: 529414 - DNA, 20 bp, mouse
gttccccctcccacaatctc

SEQ ID NO: 529415 - DNA, 20 bp, mouse
ggcgtcatggctgccgccac

SEQ ID NO: 529416 - DNA, 20 bp, mouse
gggcagcccggagggagcga

SEQ ID NO: 529417 - DNA, 20 bp, mouse
gcccccgcaaacctagaacg

SEQ ID NO: 529418 - DNA, 20 bp, mouse
ggcgagggcctcaaaaccca

SEQ ID NO: 529419 - DNA, 20 bp, mouse
gaacgccgcgctgggactga

SEQ ID NO: 529420 - DNA, 20 bp, mouse
gcccagcgcggcgttcgggg

SEQ ID NO: 529421 - DNA, 20 bp, mouse
ggagcgcgcgggaaaaccgc

SEQ ID NO: 529422 - DNA, 20 bp, mouse
gagcctgaggaggtgcgcga

SEQ ID NO: 529423 - DNA, 20 bp, mouse
gagtcccagcgcggcgttcg

SEQ ID NO: 529424 - DNA, 20 bp, mouse
ggcggcgttggaaggcttgg

SEQ ID NO: 529425 - DNA, 20 bp, mouse
ggcgctgcgttccgcgttct

SEQ ID NO: 529426 - DNA, 20 bp, mouse
gcgccggcgagaggcagacg

SEQ ID NO: 529427 - DNA, 20 bp, mouse
ggcgagaggcagacgcggag

SEQ ID NO: 529428 - DNA, 20 bp, mouse
gggcgaggcgctgcgaggtc

SEQ ID NO: 529429 - DNA, 20 bp, mouse
gcagacgcggagcggaatcc

SEQ ID NO: 529430 - DNA, 20 bp, mouse
gttctcccggcgccggcgag

SEQ ID NO: 529431 - DNA, 20 bp, mouse
gtcggcggcgaaagcctcag

SEQ ID NO: 529432 - DNA, 20 bp, mouse
gacccgggaatgggccgcgc

SEQ ID NO: 529433 - DNA, 20 bp, mouse
ggcccgggagcggggactcg

SEQ ID NO: 529434 - DNA, 20 bp, mouse
gtgggccgcgcgggcgagca

SEQ ID NO: 529435 - DNA, 20 bp, mouse
ggggcaggggaaggaccaag

SEQ ID NO: 529436 - DNA, 20 bp, mouse
ggcagtggctgaaatccgtg

SEQ ID NO: 529437 - DNA, 20 bp, mouse
gtagttgacatctggtctgg

SEQ ID NO: 529438 - DNA, 20 bp, mouse
gtggcgaccgtggattcctg

SEQ ID NO: 529439 - DNA, 20 bp, mouse
ggtctgggggttcttgtagg

SEQ ID NO: 529440 - DNA, 20 bp, mouse
gtagcagcttagttgacatc

SEQ ID NO: 529441 - DNA, 20 bp, mouse
ggtggctgaaatccgtgtgg

SEQ ID NO: 529442 - DNA, 20 bp, mouse
gcaactaagctgctaccaac

SEQ ID NO: 529443 - DNA, 20 bp, mouse
ggagacgccatggacgacca

SEQ ID NO: 529444 - DNA, 20 bp, mouse
ggaccgtggattcctggggt

SEQ ID NO: 529445 - DNA, 20 bp, mouse
ggcttagttgacatctggtc

SEQ ID NO: 529446 - DNA, 20 bp, mouse
gaaggaccggaggaagtgca

SEQ ID NO: 529447 - DNA, 20 bp, mouse
ggtcctaccagggccgccag

SEQ ID NO: 529448 - DNA, 20 bp, mouse
ggtaggactgcgggacccga

SEQ ID NO: 529449 - DNA, 20 bp, mouse
ggggtcccgcagtcctacca

SEQ ID NO: 529450 - DNA, 20 bp, mouse
ggacccctggcggccctggt

SEQ ID NO: 529451 - DNA, 20 bp, mouse
gatctcccctgcacttcctc

SEQ ID NO: 529452 - DNA, 20 bp, mouse
gtaattccaggagaaccgaa

SEQ ID NO: 529453 - DNA, 20 bp, mouse
gacgctccggttcggaacca

SEQ ID NO: 529454 - DNA, 20 bp, mouse
gctccggttcggaaccaggg

SEQ ID NO: 529455 - DNA, 20 bp, mouse
gagggctcgggcgcagcagt

SEQ ID NO: 529456 - DNA, 20 bp, mouse
gttaatgctgtgagtgaagc

SEQ ID NO: 529457 - DNA, 20 bp, mouse
gctaactcatgaaaactcat

SEQ ID NO: 529458 - DNA, 20 bp, mouse
gacgaaactgggagtaggcc

SEQ ID NO: 529459 - DNA, 20 bp, mouse
gccttcaccgggtcaagaag

SEQ ID NO: 529460 - DNA, 20 bp, mouse
gcagatcctgagaccttcac

SEQ ID NO: 529461 - DNA, 20 bp, mouse
gagcaggccacttcttgacc

SEQ ID NO: 529462 - DNA, 20 bp, mouse
gagttgggtgtaaaggaaga

SEQ ID NO: 529463 - DNA, 20 bp, mouse
gaaactcataggaatagagg

SEQ ID NO: 529464 - DNA, 20 bp, mouse
gactgcagaaatatccagga

SEQ ID NO: 529465 - DNA, 20 bp, mouse
gactgaacagttgggtgtaa

SEQ ID NO: 529466 - DNA, 20 bp, mouse
gttaccacaagctcgaggga

SEQ ID NO: 529467 - DNA, 20 bp, mouse
gatttattgactttatactt

SEQ ID NO: 529468 - DNA, 20 bp, mouse
gtttcttaccacaagctcga

SEQ ID NO: 529469 - DNA, 20 bp, mouse
gtacaaaataacagggaggg

SEQ ID NO: 529470 - DNA, 20 bp, mouse
gacagtgtgctgtcttcctg

SEQ ID NO: 529471 - DNA, 20 bp, mouse
gttgctgagaaatttcactg

SEQ ID NO: 529472 - DNA, 20 bp, mouse
gggagacttaagatgaaatt

SEQ ID NO: 529473 - DNA, 20 bp, mouse
gttcagcaagtcaggaaatg

SEQ ID NO: 529474 - DNA, 20 bp, mouse
gtctccatccctcgagcttg

SEQ ID NO: 529475 - DNA, 20 bp, mouse
ggataaatcttcagcaagtc

SEQ ID NO: 529476 - DNA, 20 bp, mouse
gggagcagcagccacggcag

SEQ ID NO: 529477 - DNA, 20 bp, mouse
gcagagacccatcctgccgg

SEQ ID NO: 529478 - DNA, 20 bp, mouse
ggaagacgcgtttgcaactg

SEQ ID NO: 529479 - DNA, 20 bp, mouse
gcctcctcctccggcaggat

SEQ ID NO: 529480 - DNA, 20 bp, mouse
gaggcagagacccatcctgc

SEQ ID NO: 529481 - DNA, 20 bp, mouse
ggcacaggtatccgctgccg

SEQ ID NO: 529482 - DNA, 20 bp, mouse
gaacttaacccagcgtgcac

SEQ ID NO: 529483 - DNA, 20 bp, mouse
ggagatggtaagcagctcgg

SEQ ID NO: 529484 - DNA, 20 bp, mouse
gagcggatacctgtgcacgc

SEQ ID NO: 529485 - DNA, 20 bp, mouse
gttgaagtgcgtaatccgag

SEQ ID NO: 529486 - DNA, 20 bp, mouse
ggagtcccgccgacaagaaa

SEQ ID NO: 529487 - DNA, 20 bp, mouse
gcttgtcggcgggactccgg

SEQ ID NO: 529488 - DNA, 20 bp, mouse
gttgcaacaagatggcgagg

SEQ ID NO: 529489 - DNA, 20 bp, mouse
ggcgggaggcatcggaaggg

SEQ ID NO: 529490 - DNA, 20 bp, mouse
gggggcgggaggcatcggaa

SEQ ID NO: 529491 - DNA, 20 bp, mouse
gtcgcagggaggcccctcta

SEQ ID NO: 529492 - DNA, 20 bp, mouse
gcggcccgcgagccaagcac

SEQ ID NO: 529493 - DNA, 20 bp, mouse
ggctttgcaacaagatggcg

SEQ ID NO: 529494 - DNA, 20 bp, mouse
gcgacacacacaacaaggga

SEQ ID NO: 529495 - DNA, 20 bp, mouse
ggccgcggggcgggaggcat

SEQ ID NO: 529496 - DNA, 20 bp, mouse
gggcaccagtggcctcgatg

SEQ ID NO: 529497 - DNA, 20 bp, mouse
ggtccccaccaaggcaccag

SEQ ID NO: 529498 - DNA, 20 bp, mouse
gagctcaagcgaccgcatcg

SEQ ID NO: 529499 - DNA, 20 bp, mouse
ggggaccgcgctccactcac

SEQ ID NO: 529500 - DNA, 20 bp, mouse
gcactggtatgaacttccac

SEQ ID NO: 529501 - DNA, 20 bp, mouse
gacaatcagggtccaagggt

SEQ ID NO: 529502 - DNA, 20 bp, mouse
gttacggagactgagcgtgg

SEQ ID NO: 529503 - DNA, 20 bp, mouse
ggagcttcaagtgtgcggag

SEQ ID NO: 529504 - DNA, 20 bp, mouse
ggctcctgcgagtttgtgtt

SEQ ID NO: 529505 - DNA, 20 bp, mouse
ggcgaccgcatcgaggccac

SEQ ID NO: 529506 - DNA, 20 bp, mouse
gtactcgcccgaaagctcca

SEQ ID NO: 529507 - DNA, 20 bp, mouse
ggcgcgctgttgaagctgag

SEQ ID NO: 529508 - DNA, 20 bp, mouse
gtgaagctgagtggtcgcca

SEQ ID NO: 529509 - DNA, 20 bp, mouse
gtccgggtggcgtttctccg

SEQ ID NO: 529510 - DNA, 20 bp, mouse
gagctttcgggcgagtacgt

SEQ ID NO: 529511 - DNA, 20 bp, mouse
gaggacactcgtagccgctg

SEQ ID NO: 529512 - DNA, 20 bp, mouse
ggagaaacgccacccggaag

SEQ ID NO: 529513 - DNA, 20 bp, mouse
ggctggcttccgcttccggg

SEQ ID NO: 529514 - DNA, 20 bp, mouse
gcgggaccgggcagtgtgaa

SEQ ID NO: 529515 - DNA, 20 bp, mouse
gcaaggcttggcggaagatc

SEQ ID NO: 529516 - DNA, 20 bp, mouse
gagcttcgcgccgcctccag

SEQ ID NO: 529517 - DNA, 20 bp, mouse
gaacagacaaccgcctctgg

SEQ ID NO: 529518 - DNA, 20 bp, mouse
ggaccgcagcaaacgcctca

SEQ ID NO: 529519 - DNA, 20 bp, mouse
ggcgcccgcctcccggccga

SEQ ID NO: 529520 - DNA, 20 bp, mouse
gagacaaccgcctctggagg

SEQ ID NO: 529521 - DNA, 20 bp, mouse
gttcgcgccgcctccagagg

SEQ ID NO: 529522 - DNA, 20 bp, mouse
gactgctcgggagtcagaca

SEQ ID NO: 529523 - DNA, 20 bp, mouse
ggggaacagacaaccgcctc

SEQ ID NO: 529524 - DNA, 20 bp, mouse
gcggggtttaggagagaccc

SEQ ID NO: 529525 - DNA, 20 bp, mouse
gtacgggcaggtgatcctga

SEQ ID NO: 529526 - DNA, 20 bp, mouse
gagctccgcgagccaaaatg

SEQ ID NO: 529527 - DNA, 20 bp, mouse
gcgcggtcggtgcttggtcg

SEQ ID NO: 529528 - DNA, 20 bp, mouse
ggacggtccgcggctctaca

SEQ ID NO: 529529 - DNA, 20 bp, mouse
gaagcttcacggcccgggtt

SEQ ID NO: 529530 - DNA, 20 bp, mouse
gggtcggtgcttggtcgcgg

SEQ ID NO: 529531 - DNA, 20 bp, mouse
gcggtctcgcgagatcctct

SEQ ID NO: 529532 - DNA, 20 bp, mouse
gcccggagcagccctaggtc

SEQ ID NO: 529533 - DNA, 20 bp, mouse
ggagggcggagcccgaccta

SEQ ID NO: 529534 - DNA, 20 bp, mouse
ggaaaggcgcaggttctcag

SEQ ID NO: 529535 - DNA, 20 bp, mouse
ggtgcctcggtgaccagacc

SEQ ID NO: 529536 - DNA, 20 bp, mouse
gggagcggccgcgacttctc

SEQ ID NO: 529537 - DNA, 20 bp, mouse
gagcgaagccggagaagtcg

SEQ ID NO: 529538 - DNA, 20 bp, mouse
gccgcggcaagtagcgaagc

SEQ ID NO: 529539 - DNA, 20 bp, mouse
gtccgcccctcagccggccg

SEQ ID NO: 529540 - DNA, 20 bp, mouse
ggggccccgagagcacccgg

SEQ ID NO: 529541 - DNA, 20 bp, mouse
gagggccggccagcaccccg

SEQ ID NO: 529542 - DNA, 20 bp, mouse
gggcagtacggaagactaga

SEQ ID NO: 529543 - DNA, 20 bp, mouse
gagagaaaaggtggcggagg

SEQ ID NO: 529544 - DNA, 20 bp, mouse
ggctgaggggcggaagtgga

SEQ ID NO: 529545 - DNA, 20 bp, mouse
gcaggactcggcaggctcac

SEQ ID NO: 529546 - DNA, 20 bp, mouse
gcaccccatgagccagtcca

SEQ ID NO: 529547 - DNA, 20 bp, mouse
ggctccgcgcagccatggac

SEQ ID NO: 529548 - DNA, 20 bp, mouse
ggactggctcatggggtgag

SEQ ID NO: 529549 - DNA, 20 bp, mouse
ggctgaggccgagcgaggcg

SEQ ID NO: 529550 - DNA, 20 bp, mouse
gcagccatggactggctcat

SEQ ID NO: 529551 - DNA, 20 bp, mouse
ggcggggctgaggccgagcg

SEQ ID NO: 529552 - DNA, 20 bp, mouse
ggcctcccagcaccccgcag

SEQ ID NO: 529553 - DNA, 20 bp, mouse
gggcgaacgtagggagcgta

SEQ ID NO: 529554 - DNA, 20 bp, mouse
gttacttccggccgccggcg

SEQ ID NO: 529555 - DNA, 20 bp, mouse
ggaacgtagggagcgtaggg

SEQ ID NO: 529556 - DNA, 20 bp, mouse
ggactgggcgaagcgagaga

SEQ ID NO: 529557 - DNA, 20 bp, mouse
gcgcccgccttggccctcgg

SEQ ID NO: 529558 - DNA, 20 bp, mouse
gagccaggtgggtcctccga

SEQ ID NO: 529559 - DNA, 20 bp, mouse
gaggccgaggagtgctgaag

SEQ ID NO: 529560 - DNA, 20 bp, mouse
ggaggacccacctggctgtc

SEQ ID NO: 529561 - DNA, 20 bp, mouse
ggcgaagcgagagacggttc

SEQ ID NO: 529562 - DNA, 20 bp, mouse
gtgagtcagcggagatggga

SEQ ID NO: 529563 - DNA, 20 bp, mouse
gccgcgggcgtgtccctctg

SEQ ID NO: 529564 - DNA, 20 bp, mouse
gcggttccggacagccaggt

SEQ ID NO: 529565 - DNA, 20 bp, mouse
gagcacaggctagcctccag

SEQ ID NO: 529566 - DNA, 20 bp, mouse
gactccagatgcagcgacca

SEQ ID NO: 529567 - DNA, 20 bp, mouse
ggaggtgcggggcacaccta

SEQ ID NO: 529568 - DNA, 20 bp, mouse
gcggcgcgctgggtgcatgt

SEQ ID NO: 529569 - DNA, 20 bp, mouse
ggatgcagcgaccacggctc

SEQ ID NO: 529570 - DNA, 20 bp, mouse
ggggggccgcaccagagccg

SEQ ID NO: 529571 - DNA, 20 bp, mouse
gccgggaagtgcgtacccgg

SEQ ID NO: 529572 - DNA, 20 bp, mouse
gccggaagctcgcggaggag

SEQ ID NO: 529573 - DNA, 20 bp, mouse
gagccacagaccccctgggt

SEQ ID NO: 529574 - DNA, 20 bp, mouse
gcaaccccggaagctcgcgg

SEQ ID NO: 529575 - DNA, 20 bp, mouse
ggggcgccactgcaactcac

SEQ ID NO: 529576 - DNA, 20 bp, mouse
gcggcccagatcagactggt

SEQ ID NO: 529577 - DNA, 20 bp, mouse
ggccgcggcccagatcagac

SEQ ID NO: 529578 - DNA, 20 bp, mouse
ggtagacgctgagacccgca

SEQ ID NO: 529579 - DNA, 20 bp, mouse
gtcgagcactggcggcggga

SEQ ID NO: 529580 - DNA, 20 bp, mouse
ggcgtctcctcgagcactgg

SEQ ID NO: 529581 - DNA, 20 bp, mouse
gagcactggcggcgggacgg

SEQ ID NO: 529582 - DNA, 20 bp, mouse
ggacgctgagacccgcacgg

SEQ ID NO: 529583 - DNA, 20 bp, mouse
gctggcgtctcctcgagcac

SEQ ID NO: 529584 - DNA, 20 bp, mouse
gctacccaccagtctgatct

SEQ ID NO: 529585 - DNA, 20 bp, mouse
gtctcctcgagcactggcgg

SEQ ID NO: 529586 - DNA, 20 bp, mouse
ggaccatagtgccagagtct

SEQ ID NO: 529587 - DNA, 20 bp, mouse
gatggtcatggcggagggga

SEQ ID NO: 529588 - DNA, 20 bp, mouse
gcggaacaggccaggcacca

SEQ ID NO: 529589 - DNA, 20 bp, mouse
gcactatggtcatggcggag

SEQ ID NO: 529590 - DNA, 20 bp, mouse
gtctggcactatggtcatgg

SEQ ID NO: 529591 - DNA, 20 bp, mouse
gggcagtgctgaggcggaac

SEQ ID NO: 529592 - DNA, 20 bp, mouse
gtgcgtctagcaggcctcca

SEQ ID NO: 529593 - DNA, 20 bp, mouse
gctgtgacaggaaagccgta

SEQ ID NO: 529594 - DNA, 20 bp, mouse
gctccgtctaggagaggcca

SEQ ID NO: 529595 - DNA, 20 bp, mouse
gcgcccagactctggcacta

SEQ ID NO: 529596 - DNA, 20 bp, mouse
gaccagggcccgctatccac

SEQ ID NO: 529597 - DNA, 20 bp, mouse
gaggtcgcccagctccacca

SEQ ID NO: 529598 - DNA, 20 bp, mouse
gtcctcttacctgcgagtaa

SEQ ID NO: 529599 - DNA, 20 bp, mouse
gcctggagcagacaaacctg

SEQ ID NO: 529600 - DNA, 20 bp, mouse
gctgttgtgaaaggttcctg

SEQ ID NO: 529601 - DNA, 20 bp, mouse
gccttcccacgtgaggtaca

SEQ ID NO: 529602 - DNA, 20 bp, mouse
gagtacacgaggaatatata

SEQ ID NO: 529603 - DNA, 20 bp, mouse
gcacaacagccattactcgc

SEQ ID NO: 529604 - DNA, 20 bp, mouse
gagcgggccctggtggagct

SEQ ID NO: 529605 - DNA, 20 bp, mouse
ggaaaggttcctgtggatag

SEQ ID NO: 529606 - DNA, 20 bp, mouse
gggatcgcgcctgaagtctg

SEQ ID NO: 529607 - DNA, 20 bp, mouse
gcgatccatggcctgcgggg

SEQ ID NO: 529608 - DNA, 20 bp, mouse
ggatccagaccgtccagccc

SEQ ID NO: 529609 - DNA, 20 bp, mouse
ggacagcgcgccccacacct

SEQ ID NO: 529610 - DNA, 20 bp, mouse
gcctgccttgctcacttccc

SEQ ID NO: 529611 - DNA, 20 bp, mouse
ggactcgggtccccacccag

SEQ ID NO: 529612 - DNA, 20 bp, mouse
gttggccgcctagcaggtga

SEQ ID NO: 529613 - DNA, 20 bp, mouse
ggcgcgatccatggcctgcg

SEQ ID NO: 529614 - DNA, 20 bp, mouse
gcagggctggaacctaggtg

SEQ ID NO: 529615 - DNA, 20 bp, mouse
gcttcccgggctggacggtc

SEQ ID NO: 529616 - DNA, 20 bp, mouse
ggaagtacccggcctgaagt

SEQ ID NO: 529617 - DNA, 20 bp, mouse
ggcctgcgttcggaatagtg

SEQ ID NO: 529618 - DNA, 20 bp, mouse
gagtcagcaaaggaagtacc

SEQ ID NO: 529619 - DNA, 20 bp, mouse
ggtcccgggctagagtgctc

SEQ ID NO: 529620 - DNA, 20 bp, mouse
gaggtctcgagggctccccg

SEQ ID NO: 529621 - DNA, 20 bp, mouse
gtggaggcccacttcaggcc

SEQ ID NO: 529622 - DNA, 20 bp, mouse
ggagccctcgagacctacca

SEQ ID NO: 529623 - DNA, 20 bp, mouse
gccctcgagacctaccaggg

SEQ ID NO: 529624 - DNA, 20 bp, mouse
gaatagtgcggcagctcctg

SEQ ID NO: 529625 - DNA, 20 bp, mouse
ggagctgcaaccccgagcat

SEQ ID NO: 529626 - DNA, 20 bp, mouse
ggagtcaccggcgcctctag

SEQ ID NO: 529627 - DNA, 20 bp, mouse
ggcgcgaaccaactcttacc

SEQ ID NO: 529628 - DNA, 20 bp, mouse
gctaggtgccaggtaagagt

SEQ ID NO: 529629 - DNA, 20 bp, mouse
ggtgtagcgggatggttcct

SEQ ID NO: 529630 - DNA, 20 bp, mouse
gcaccggcgcctctaggggt

SEQ ID NO: 529631 - DNA, 20 bp, mouse
gcctctaggggttggagaac

SEQ ID NO: 529632 - DNA, 20 bp, mouse
gttcgcggtgtgtagcggga

SEQ ID NO: 529633 - DNA, 20 bp, mouse
gctggcttcgcggtgtgtag

SEQ ID NO: 529634 - DNA, 20 bp, mouse
gcgcatgcgctctgagtcac

SEQ ID NO: 529635 - DNA, 20 bp, mouse
ggcaagacccggaacccggg

SEQ ID NO: 529636 - DNA, 20 bp, mouse
gaaggcagctacgtcctccg

SEQ ID NO: 529637 - DNA, 20 bp, mouse
gacaggctgaaatcacccgg

SEQ ID NO: 529638 - DNA, 20 bp, mouse
ggaggacgtagctgccttac

SEQ ID NO: 529639 - DNA, 20 bp, mouse
gtttccggaagaggctgtca

SEQ ID NO: 529640 - DNA, 20 bp, mouse
gcttacaggctgaaatcacc

SEQ ID NO: 529641 - DNA, 20 bp, mouse
gctccggcagcagtagctgg

SEQ ID NO: 529642 - DNA, 20 bp, mouse
ggggctggtggaccacgacg

SEQ ID NO: 529643 - DNA, 20 bp, mouse
gccgctggcgcagtacctgg

SEQ ID NO: 529644 - DNA, 20 bp, mouse
gcagtagctggcggctgtag

SEQ ID NO: 529645 - DNA, 20 bp, mouse
ggctagctcttcctcccgcc

SEQ ID NO: 529646 - DNA, 20 bp, mouse
ggacagagtccctaacagca

SEQ ID NO: 529647 - DNA, 20 bp, mouse
gaggccaagctgaggtcctc

SEQ ID NO: 529648 - DNA, 20 bp, mouse
gggaagggacatgcagccgg

SEQ ID NO: 529649 - DNA, 20 bp, mouse
gccgaagggagaatctggga

SEQ ID NO: 529650 - DNA, 20 bp, mouse
gctcccttcgggcttcttgg

SEQ ID NO: 529651 - DNA, 20 bp, mouse
ggaagcccgaagggagaatc

SEQ ID NO: 529652 - DNA, 20 bp, mouse
gtgctcctaggtctctgcag

SEQ ID NO: 529653 - DNA, 20 bp, mouse
gttcctccaagaagcccgaa

SEQ ID NO: 529654 - DNA, 20 bp, mouse
gtccacccctgcagagacct

SEQ ID NO: 529655 - DNA, 20 bp, mouse
gtggcctgaccctgctgtta

SEQ ID NO: 529656 - DNA, 20 bp, mouse
gcctgcgaaaggagtcctcc

SEQ ID NO: 529657 - DNA, 20 bp, mouse
gcctccgggtagaaccatga

SEQ ID NO: 529658 - DNA, 20 bp, mouse
ggtgccagcggggtgttgag

SEQ ID NO: 529659 - DNA, 20 bp, mouse
gggctgtgcgcagtagggta

SEQ ID NO: 529660 - DNA, 20 bp, mouse
gcgaccatcatggttctacc

SEQ ID NO: 529661 - DNA, 20 bp, mouse
gggcgcgaactcgaccatca

SEQ ID NO: 529662 - DNA, 20 bp, mouse
gggtactgctaccgactggg

SEQ ID NO: 529663 - DNA, 20 bp, mouse
gggagcctcggcctcccagt

SEQ ID NO: 529664 - DNA, 20 bp, mouse
gaggtgaacactgtctgacc

SEQ ID NO: 529665 - DNA, 20 bp, mouse
gcagcaccgcagcggtctgt

SEQ ID NO: 529666 - DNA, 20 bp, mouse
gctcaggaggctctacacac

SEQ ID NO: 529667 - DNA, 20 bp, mouse
gtcccatggtaccaacaggg

SEQ ID NO: 529668 - DNA, 20 bp, mouse
gcgctcccatggtaccaaca

SEQ ID NO: 529669 - DNA, 20 bp, mouse
gacccactgaaggaccgcga

SEQ ID NO: 529670 - DNA, 20 bp, mouse
ggtggagttcgcccccctgt

SEQ ID NO: 529671 - DNA, 20 bp, mouse
ggcccccctgttggtaccat

SEQ ID NO: 529672 - DNA, 20 bp, mouse
ggtcttccagagcctcgtgt

SEQ ID NO: 529673 - DNA, 20 bp, mouse
gtctgtaacctgcgctccca

SEQ ID NO: 529674 - DNA, 20 bp, mouse
gcgggcacacgggaagggca

SEQ ID NO: 529675 - DNA, 20 bp, mouse
gaccttcgcggtccttcagt

SEQ ID NO: 529676 - DNA, 20 bp, mouse
gctccccggctgccaccgtg

SEQ ID NO: 529677 - DNA, 20 bp, mouse
ggaccgcacggtggcagccg

SEQ ID NO: 529678 - DNA, 20 bp, mouse
gaggctgcccgcatggcccg

SEQ ID NO: 529679 - DNA, 20 bp, mouse
gcaggactggaggagtccgg

SEQ ID NO: 529680 - DNA, 20 bp, mouse
gcggtccgctgaccgcacgg

SEQ ID NO: 529681 - DNA, 20 bp, mouse
ggctgccaccgtgcggtcag

SEQ ID NO: 529682 - DNA, 20 bp, mouse
ggggcagcctgcacgctccc

SEQ ID NO: 529683 - DNA, 20 bp, mouse
ggctcggtccgctgaccgca

SEQ ID NO: 529684 - DNA, 20 bp, mouse
ggccctggccgtggtggtgt

SEQ ID NO: 529685 - DNA, 20 bp, mouse
gagcggccgcgccccctctg

SEQ ID NO: 529686 - DNA, 20 bp, mouse
gccggtggccggttaagggt

SEQ ID NO: 529687 - DNA, 20 bp, mouse
gaccgggcctccgccaccag

SEQ ID NO: 529688 - DNA, 20 bp, mouse
gagctttcaccggcctctgg

SEQ ID NO: 529689 - DNA, 20 bp, mouse
gaagggtcggcaggagagat

SEQ ID NO: 529690 - DNA, 20 bp, mouse
gacagacatggccacagcgg

SEQ ID NO: 529691 - DNA, 20 bp, mouse
gcccctggaggatacagaca

SEQ ID NO: 529692 - DNA, 20 bp, mouse
gtctcctgccgacccttaac

SEQ ID NO: 529693 - DNA, 20 bp, mouse
gagtgactggtaccctcggt

SEQ ID NO: 529694 - DNA, 20 bp, mouse
gtgcgccggtggccggttaa

SEQ ID NO: 529695 - DNA, 20 bp, mouse
ggaaacacaggacctaccga

SEQ ID NO: 529696 - DNA, 20 bp, mouse
gcacaccaggaagtgtggtg

SEQ ID NO: 529697 - DNA, 20 bp, mouse
gaggaagtgtggtgcggcag

SEQ ID NO: 529698 - DNA, 20 bp, mouse
gcccaccacaccaggaagtg

SEQ ID NO: 529699 - DNA, 20 bp, mouse
gacctcttatctcaactggg

SEQ ID NO: 529700 - DNA, 20 bp, mouse
ggtctccagcctcctctctg

SEQ ID NO: 529701 - DNA, 20 bp, mouse
gggcgtcgcttccggaagtg

SEQ ID NO: 529702 - DNA, 20 bp, mouse
gggtggacagcaacactttg

SEQ ID NO: 529703 - DNA, 20 bp, mouse
ggcactaggaatgtatccgg

SEQ ID NO: 529704 - DNA, 20 bp, mouse
ggtcctgtcgaaaaccgtag

SEQ ID NO: 529705 - DNA, 20 bp, mouse
gacgcagttccccagagagg

SEQ ID NO: 529706 - DNA, 20 bp, mouse
ggcttcagcgatgcccgccc

SEQ ID NO: 529707 - DNA, 20 bp, mouse
gtaatggcgtcggcgggtct

SEQ ID NO: 529708 - DNA, 20 bp, mouse
gcggcgggtctgggcacccg

SEQ ID NO: 529709 - DNA, 20 bp, mouse
gtggccacggcgggcgtcac

SEQ ID NO: 529710 - DNA, 20 bp, mouse
ggcgactgggctaatggcgt

SEQ ID NO: 529711 - DNA, 20 bp, mouse
gctcggaattgtgggcgact

SEQ ID NO: 529712 - DNA, 20 bp, mouse
ggggccgcgctcggaattgt

SEQ ID NO: 529713 - DNA, 20 bp, mouse
gcggaggcgagtctctggag

SEQ ID NO: 529714 - DNA, 20 bp, mouse
gtaggttccccaggccgggg

SEQ ID NO: 529715 - DNA, 20 bp, mouse
gggcggcccggggggaactc

SEQ ID NO: 529716 - DNA, 20 bp, mouse
gcaggtggtgcctgaagaca

SEQ ID NO: 529717 - DNA, 20 bp, mouse
gctgcggacaacagaagacg

SEQ ID NO: 529718 - DNA, 20 bp, mouse
gtgtgtgtgaggacttagca

SEQ ID NO: 529719 - DNA, 20 bp, mouse
gacagtgtcttccagagtgt

SEQ ID NO: 529720 - DNA, 20 bp, mouse
gcagagggctaaactgcatc

SEQ ID NO: 529721 - DNA, 20 bp, mouse
gtgtcggagtaaggatagaa

SEQ ID NO: 529722 - DNA, 20 bp, mouse
gatgtctgaccggaaactgt

SEQ ID NO: 529723 - DNA, 20 bp, mouse
gggcgtgggccaacagtttc

SEQ ID NO: 529724 - DNA, 20 bp, mouse
gcgaattcgtgagtttccag

SEQ ID NO: 529725 - DNA, 20 bp, mouse
gttccaattgagtatggtgg

SEQ ID NO: 529726 - DNA, 20 bp, mouse
gtgcgcttacggagacaaag

SEQ ID NO: 529727 - DNA, 20 bp, mouse
gattccacggggagggacaa

SEQ ID NO: 529728 - DNA, 20 bp, mouse
gggagacaaagcggtggctg

SEQ ID NO: 529729 - DNA, 20 bp, mouse
gggagttagtcccagagcct

SEQ ID NO: 529730 - DNA, 20 bp, mouse
ggtgcaccaccagatccgat

SEQ ID NO: 529731 - DNA, 20 bp, mouse
gggcaacgcccgatcggatc

SEQ ID NO: 529732 - DNA, 20 bp, mouse
gcccgaggccatcttctgaa

SEQ ID NO: 529733 - DNA, 20 bp, mouse
gctgtctgtcggtagcgagg

SEQ ID NO: 529734 - DNA, 20 bp, mouse
gaacgcccgatcggatctgg

SEQ ID NO: 529735 - DNA, 20 bp, mouse
gcacctgaggtgattcggga

SEQ ID NO: 529736 - DNA, 20 bp, mouse
ggtgcgcacaagctggttag

SEQ ID NO: 529737 - DNA, 20 bp, mouse
gcacaagctggttagtggtg

SEQ ID NO: 529738 - DNA, 20 bp, mouse
gtgcaactgtcctacacctt

SEQ ID NO: 529739 - DNA, 20 bp, mouse
gtagctgcaggatcccaagt

SEQ ID NO: 529740 - DNA, 20 bp, mouse
ggagtgagtctcagcttgca

SEQ ID NO: 529741 - DNA, 20 bp, mouse
gattctaaacagagggacaa

SEQ ID NO: 529742 - DNA, 20 bp, mouse
gctcactcctcccggagagg

SEQ ID NO: 529743 - DNA, 20 bp, mouse
gcagagggacaagggcttct

SEQ ID NO: 529744 - DNA, 20 bp, mouse
ggtcggacagggaatggtgt

SEQ ID NO: 529745 - DNA, 20 bp, mouse
gagctgagactcactcctcc

SEQ ID NO: 529746 - DNA, 20 bp, mouse
gtgtagctcactcaagatgg

SEQ ID NO: 529747 - DNA, 20 bp, mouse
gtccgagcgaggagacatgg

SEQ ID NO: 529748 - DNA, 20 bp, mouse
gtgaggcggatcccggtggg

SEQ ID NO: 529749 - DNA, 20 bp, mouse
gcctcggccgcagcccgact

SEQ ID NO: 529750 - DNA, 20 bp, mouse
ggactcgtagcctcccagtc

SEQ ID NO: 529751 - DNA, 20 bp, mouse
gaggcgggccagccaggagg

SEQ ID NO: 529752 - DNA, 20 bp, mouse
gtcctccgagcgaggagaca

SEQ ID NO: 529753 - DNA, 20 bp, mouse
gaccgcgctgaggcggatcc

SEQ ID NO: 529754 - DNA, 20 bp, mouse
ggtgggcggcggcgactcaa

SEQ ID NO: 529755 - DNA, 20 bp, mouse
gtggcggcgcagccacccac

SEQ ID NO: 529756 - DNA, 20 bp, mouse
ggcagtcggtgggtcaggag

SEQ ID NO: 529757 - DNA, 20 bp, mouse
ggagaggtgctgacaaggcg

SEQ ID NO: 529758 - DNA, 20 bp, mouse
gggcagccctggcagtcggt

SEQ ID NO: 529759 - DNA, 20 bp, mouse
gcacctgtccccagcgggag

SEQ ID NO: 529760 - DNA, 20 bp, mouse
ggtcaggagaggtgctgaca

SEQ ID NO: 529761 - DNA, 20 bp, mouse
gccagcgggaggggtgaagc

SEQ ID NO: 529762 - DNA, 20 bp, mouse
ggcgggaggggtgaagccgg

SEQ ID NO: 529763 - DNA, 20 bp, mouse
gccctggcagtcggtgggtc

SEQ ID NO: 529764 - DNA, 20 bp, mouse
gggcggggcgggcagacgct

SEQ ID NO: 529765 - DNA, 20 bp, mouse
gcgagcgcgcccgggtccca

SEQ ID NO: 529766 - DNA, 20 bp, mouse
ggtcgcggtgctgtgaggtc

SEQ ID NO: 529767 - DNA, 20 bp, mouse
gcagccgccgcctcagccaa

SEQ ID NO: 529768 - DNA, 20 bp, mouse
gacagccagctctacatcct

SEQ ID NO: 529769 - DNA, 20 bp, mouse
gggttagccgttggctgagg

SEQ ID NO: 529770 - DNA, 20 bp, mouse
gcgcgggtcgcggtgctgtg

SEQ ID NO: 529771 - DNA, 20 bp, mouse
gcgcaggcttgtgtgcgtag

SEQ ID NO: 529772 - DNA, 20 bp, mouse
gtagagctggctgtggccga

SEQ ID NO: 529773 - DNA, 20 bp, mouse
gcgcgcccaggatgtagagc

SEQ ID NO: 529774 - DNA, 20 bp, mouse
gtttggggagaggcatctaa

SEQ ID NO: 529775 - DNA, 20 bp, mouse
gatcccggcatgcctctggg

SEQ ID NO: 529776 - DNA, 20 bp, mouse
ggagaaacctggctttacta

SEQ ID NO: 529777 - DNA, 20 bp, mouse
gtctggcaactgatatccat

SEQ ID NO: 529778 - DNA, 20 bp, mouse
ggctcgccaacgcccagctt

SEQ ID NO: 529779 - DNA, 20 bp, mouse
gggcagacacgtcaccctgg

SEQ ID NO: 529780 - DNA, 20 bp, mouse
gaaacctggctttactatgg

SEQ ID NO: 529781 - DNA, 20 bp, mouse
gctggctttactatggcggt

SEQ ID NO: 529782 - DNA, 20 bp, mouse
gataggcagacacgtcaccc

SEQ ID NO: 529783 - DNA, 20 bp, mouse
gccaacgcccagcttgggca

SEQ ID NO: 529784 - DNA, 20 bp, mouse
gtgtgaagcctgtccccgaa

SEQ ID NO: 529785 - DNA, 20 bp, mouse
gatagtagctatctcagacg

SEQ ID NO: 529786 - DNA, 20 bp, mouse
gtctccgatgcaggcgccta

SEQ ID NO: 529787 - DNA, 20 bp, mouse
gcggctcaaggtgtctctcc

SEQ ID NO: 529788 - DNA, 20 bp, mouse
gggcgcctgcatcggagact

SEQ ID NO: 529789 - DNA, 20 bp, mouse
gtctccctaggcgcctgcat

SEQ ID NO: 529790 - DNA, 20 bp, mouse
gcagccacaagggcggctca

SEQ ID NO: 529791 - DNA, 20 bp, mouse
gtgtgctgtccggagtgaga

SEQ ID NO: 529792 - DNA, 20 bp, mouse
gacaccttgagccgcccttg

SEQ ID NO: 529793 - DNA, 20 bp, mouse
gacacaggtgagctccctca

SEQ ID NO: 529794 - DNA, 20 bp, mouse
gcaggcctagtctccgatgc

SEQ ID NO: 529795 - DNA, 20 bp, mouse
gcaggtaaggtccgtcacac

SEQ ID NO: 529796 - DNA, 20 bp, mouse
ggctggagcgaagcctggta

SEQ ID NO: 529797 - DNA, 20 bp, mouse
ggtctcggcgagtgccgacg

SEQ ID NO: 529798 - DNA, 20 bp, mouse
gaactttggcggcaagatgg

SEQ ID NO: 529799 - DNA, 20 bp, mouse
ggcagctggcgatccctacc

SEQ ID NO: 529800 - DNA, 20 bp, mouse
gggcttcgctccagccgcgt

SEQ ID NO: 529801 - DNA, 20 bp, mouse
gcgtttcgcggcggcagtct

SEQ ID NO: 529802 - DNA, 20 bp, mouse
gagcccgtaccgtttcgcgg

SEQ ID NO: 529803 - DNA, 20 bp, mouse
gatggttgctagggaaactt

SEQ ID NO: 529804 - DNA, 20 bp, mouse
gctgccgccgcgaaacggta

SEQ ID NO: 529805 - DNA, 20 bp, mouse
gacgcgacggagctccagcg

SEQ ID NO: 529806 - DNA, 20 bp, mouse
ggccgagctggcgagcctag

SEQ ID NO: 529807 - DNA, 20 bp, mouse
ggcgactctgcgattcccct

SEQ ID NO: 529808 - DNA, 20 bp, mouse
ggccagctcggcaggctgga

SEQ ID NO: 529809 - DNA, 20 bp, mouse
gctgcgggtgaggtccaaga

SEQ ID NO: 529810 - DNA, 20 bp, mouse
gtgatggagacgtgaaggac

SEQ ID NO: 529811 - DNA, 20 bp, mouse
ggctgggctctaggacagag

SEQ ID NO: 529812 - DNA, 20 bp, mouse
gtcacttgatggagacgtga

SEQ ID NO: 529813 - DNA, 20 bp, mouse
gcaacgctacgagccaggta

SEQ ID NO: 529814 - DNA, 20 bp, mouse
gctttacggtgccagatcaa

SEQ ID NO: 529815 - DNA, 20 bp, mouse
gggatccggagatacagcgt

SEQ ID NO: 529816 - DNA, 20 bp, mouse
ggcaggtgaagagccctcag

SEQ ID NO: 529817 - DNA, 20 bp, mouse
gcacagagggatccccactg

SEQ ID NO: 529818 - DNA, 20 bp, mouse
ggcctgcctgagttccaata

SEQ ID NO: 529819 - DNA, 20 bp, mouse
gggaccctaggagaatgcaa

SEQ ID NO: 529820 - DNA, 20 bp, mouse
gtgggtcagtccagcacaga

SEQ ID NO: 529821 - DNA, 20 bp, mouse
ggagccgccgtggaaagggt

SEQ ID NO: 529822 - DNA, 20 bp, mouse
gtccctgacagatggaccct

SEQ ID NO: 529823 - DNA, 20 bp, mouse
ggccagcgtggggtcagagt

SEQ ID NO: 529824 - DNA, 20 bp, mouse
ggggctcttcacctgccctg

SEQ ID NO: 529825 - DNA, 20 bp, mouse
gggtcccaccctttccacgg

SEQ ID NO: 529826 - DNA, 20 bp, mouse
ggggatggcggcgtccagtg

SEQ ID NO: 529827 - DNA, 20 bp, mouse
gtgcggcccgtcagggatgg

SEQ ID NO: 529828 - DNA, 20 bp, mouse
gtgcccagtgcggcccgtca

SEQ ID NO: 529829 - DNA, 20 bp, mouse
gccacccgcctcagccacac

SEQ ID NO: 529830 - DNA, 20 bp, mouse
gcagtgcggcccgtcaggga

SEQ ID NO: 529831 - DNA, 20 bp, mouse
ggagtgcggtccaccaggta

SEQ ID NO: 529832 - DNA, 20 bp, mouse
gcaccaggtagggactaagg

SEQ ID NO: 529833 - DNA, 20 bp, mouse
gcgtccagtgtggctgaggc

SEQ ID NO: 529834 - DNA, 20 bp, mouse
gtggacgccgccatccctga

SEQ ID NO: 529835 - DNA, 20 bp, mouse
ggtccaccaggtagggacta

SEQ ID NO: 529836 - DNA, 20 bp, mouse
gacgccaagacagctgaagt

SEQ ID NO: 529837 - DNA, 20 bp, mouse
gaccgggagccagtatttcg

SEQ ID NO: 529838 - DNA, 20 bp, mouse
gtatgacaaccaggagatgt

SEQ ID NO: 529839 - DNA, 20 bp, mouse
gtccccgaaatactggctcc

SEQ ID NO: 529840 - DNA, 20 bp, mouse
gctgttaacatgcagtacac

SEQ ID NO: 529841 - DNA, 20 bp, mouse
ggatacctaataagtcgcat

SEQ ID NO: 529842 - DNA, 20 bp, mouse
gtggagacatggacgaatgg

SEQ ID NO: 529843 - DNA, 20 bp, mouse
gggtctccgcccacatctcc

SEQ ID NO: 529844 - DNA, 20 bp, mouse
gtttggctgagggtccttgg

SEQ ID NO: 529845 - DNA, 20 bp, mouse
gcggggaatacataaacggg

SEQ ID NO: 529846 - DNA, 20 bp, mouse
gacactagggagaaatgagt

SEQ ID NO: 529847 - DNA, 20 bp, mouse
gggaacagccagggaagttt

SEQ ID NO: 529848 - DNA, 20 bp, mouse
gccatgctcccaaacttccc

SEQ ID NO: 529849 - DNA, 20 bp, mouse
gcgatggcgacagctcacga

SEQ ID NO: 529850 - DNA, 20 bp, mouse
gacgagggaggtagcgacac

SEQ ID NO: 529851 - DNA, 20 bp, mouse
ggacacaggcttagaggcga

SEQ ID NO: 529852 - DNA, 20 bp, mouse
gatgtgactgtcccatctga

SEQ ID NO: 529853 - DNA, 20 bp, mouse
gaggaccgcgagtccaccga

SEQ ID NO: 529854 - DNA, 20 bp, mouse
gccagccggcgtggcagtcc

SEQ ID NO: 529855 - DNA, 20 bp, mouse
ggcataggctgggctctgga

SEQ ID NO: 529856 - DNA, 20 bp, mouse
gcccagcaggcagtgcagtc

SEQ ID NO: 529857 - DNA, 20 bp, mouse
gcagtcgcagctgctttccg

SEQ ID NO: 529858 - DNA, 20 bp, mouse
ggtgggtgacgggacattga

SEQ ID NO: 529859 - DNA, 20 bp, mouse
gcccgcaagtcagagaaagt

SEQ ID NO: 529860 - DNA, 20 bp, mouse
gactctcacctcagcaacac

SEQ ID NO: 529861 - DNA, 20 bp, mouse
gttcagtgccgggctaaggt

SEQ ID NO: 529862 - DNA, 20 bp, mouse
gccctggagaccctgcagaa

SEQ ID NO: 529863 - DNA, 20 bp, mouse
gctgcctgctgggatatggg

SEQ ID NO: 529864 - DNA, 20 bp, mouse
ggccaccaacagtccaagaa

SEQ ID NO: 529865 - DNA, 20 bp, mouse
gaccaacagtccaagaacgg

SEQ ID NO: 529866 - DNA, 20 bp, mouse
gtggctggtgatgagacact

SEQ ID NO: 529867 - DNA, 20 bp, mouse
gaggctgtggaaggagcgac

SEQ ID NO: 529868 - DNA, 20 bp, mouse
gcccaaaggtagatcaagaa

SEQ ID NO: 529869 - DNA, 20 bp, mouse
gacagtcgcggaacctattg

SEQ ID NO: 529870 - DNA, 20 bp, mouse
gtcccttcttgatctacctt

SEQ ID NO: 529871 - DNA, 20 bp, mouse
gcgacgggtacaaccacaat

SEQ ID NO: 529872 - DNA, 20 bp, mouse
ggctgtgttgggagtgatct

SEQ ID NO: 529873 - DNA, 20 bp, mouse
gcacggcccaggcagcgatg

SEQ ID NO: 529874 - DNA, 20 bp, mouse
ggctaatctcagagacccgg

SEQ ID NO: 529875 - DNA, 20 bp, mouse
gaaggaccgagagcatctta

SEQ ID NO: 529876 - DNA, 20 bp, mouse
gtgggcggtcggacatccga

SEQ ID NO: 529877 - DNA, 20 bp, mouse
gctgggccccaggttcctat

SEQ ID NO: 529878 - DNA, 20 bp, mouse
gcacatctagcggggttcca

SEQ ID NO: 529879 - DNA, 20 bp, mouse
ggcggggcctataggaacct

SEQ ID NO: 529880 - DNA, 20 bp, mouse
gctgcaggatccacatctag

SEQ ID NO: 529881 - DNA, 20 bp, mouse
gtagcggggttccaaggcag

SEQ ID NO: 529882 - DNA, 20 bp, mouse
ggtttgggaaccggggcccg

SEQ ID NO: 529883 - DNA, 20 bp, mouse
ggcttccgaggtgaagagac

SEQ ID NO: 529884 - DNA, 20 bp, mouse
gaataagagaggccgtacgg

SEQ ID NO: 529885 - DNA, 20 bp, mouse
gtcagggcggaccagagaag

SEQ ID NO: 529886 - DNA, 20 bp, mouse
gtaggagaaggacggaggag

SEQ ID NO: 529887 - DNA, 20 bp, mouse
gccgaaaggaaggctcaggt

SEQ ID NO: 529888 - DNA, 20 bp, mouse
gtggccggagcagacgtcag

SEQ ID NO: 529889 - DNA, 20 bp, mouse
gcggagcagacgtcagaggt

SEQ ID NO: 529890 - DNA, 20 bp, mouse
gcagagccccggacatgggt

SEQ ID NO: 529891 - DNA, 20 bp, mouse
ggaccttggagcctcagcta

SEQ ID NO: 529892 - DNA, 20 bp, mouse
gaacttgctaggcatcgcgg

SEQ ID NO: 529893 - DNA, 20 bp, mouse
gagcagacgtcagaggtagg

SEQ ID NO: 529894 - DNA, 20 bp, mouse
gagggcagagccccggacat

SEQ ID NO: 529895 - DNA, 20 bp, mouse
gctggggtgagggtgcaaag

SEQ ID NO: 529896 - DNA, 20 bp, mouse
gcagcatggcatccacgcgg

SEQ ID NO: 529897 - DNA, 20 bp, mouse
ggcgcagcatggcatccacg

SEQ ID NO: 529898 - DNA, 20 bp, mouse
ggggcaagaagctgggacgg

SEQ ID NO: 529899 - DNA, 20 bp, mouse
gggcgtgcgggcaagaagct

SEQ ID NO: 529900 - DNA, 20 bp, mouse
gcagaagaaggacaccagct

SEQ ID NO: 529901 - DNA, 20 bp, mouse
gttggcagcaaggcgcagca

SEQ ID NO: 529902 - DNA, 20 bp, mouse
gcgggagagcccgaccggag

SEQ ID NO: 529903 - DNA, 20 bp, mouse
gaggaaggaggacatccctg

SEQ ID NO: 529904 - DNA, 20 bp, mouse
ggaaggcgggagagcccgac

SEQ ID NO: 529905 - DNA, 20 bp, mouse
ggcctgctgagggcttccag

SEQ ID NO: 529906 - DNA, 20 bp, mouse
gctgggctgcagccactggg

SEQ ID NO: 529907 - DNA, 20 bp, mouse
gcctggtcttcgccccccag

SEQ ID NO: 529908 - DNA, 20 bp, mouse
gggcagcgcagtccacccaa

SEQ ID NO: 529909 - DNA, 20 bp, mouse
gccgcggccatgctcccggt

SEQ ID NO: 529910 - DNA, 20 bp, mouse
gcctgtcccgcgccgcacct

SEQ ID NO: 529911 - DNA, 20 bp, mouse
gtacgcacgaacggctacgt

SEQ ID NO: 529912 - DNA, 20 bp, mouse
gtgggcgctgctccccgcga

SEQ ID NO: 529913 - DNA, 20 bp, mouse
gcacgcggtgcgggtacgag

SEQ ID NO: 529914 - DNA, 20 bp, mouse
gcccggggcggtcccaagtt

SEQ ID NO: 529915 - DNA, 20 bp, mouse
gagaccagggagcccaactt

SEQ ID NO: 529916 - DNA, 20 bp, mouse
gagtctgaagagtagaacac

SEQ ID NO: 529917 - DNA, 20 bp, mouse
gtggcctgggcatcacagac

SEQ ID NO: 529918 - DNA, 20 bp, mouse
gaaggggagatgtaggaccc

SEQ ID NO: 529919 - DNA, 20 bp, mouse
gaacagcacgggaaggatct

SEQ ID NO: 529920 - DNA, 20 bp, mouse
gaggaacctggaataacgaa

SEQ ID NO: 529921 - DNA, 20 bp, mouse
gcaactggctgggttggcct

SEQ ID NO: 529922 - DNA, 20 bp, mouse
gttggaggagtcctacccaa

SEQ ID NO: 529923 - DNA, 20 bp, mouse
ggaacacaggccatggttcc

SEQ ID NO: 529924 - DNA, 20 bp, mouse
gtgggaagtgatctggtagt

SEQ ID NO: 529925 - DNA, 20 bp, mouse
gtcctggcagccttttctca

SEQ ID NO: 529926 - DNA, 20 bp, mouse
ggcctcagccgagtccacag

SEQ ID NO: 529927 - DNA, 20 bp, mouse
ggctggggtgagagcgccga

SEQ ID NO: 529928 - DNA, 20 bp, mouse
gtgtcgtgaggcgggcgctg

SEQ ID NO: 529929 - DNA, 20 bp, mouse
gaccgctgtggactcggctg

SEQ ID NO: 529930 - DNA, 20 bp, mouse
gccgctgcgggaaaaccctg

SEQ ID NO: 529931 - DNA, 20 bp, mouse
gtggactcggctgaggccct

SEQ ID NO: 529932 - DNA, 20 bp, mouse
gtgcggcgccgtgccaaggt

SEQ ID NO: 529933 - DNA, 20 bp, mouse
gggcttctccgagtgtcgtg

SEQ ID NO: 529934 - DNA, 20 bp, mouse
ggtagcggcttcaccgccaa

SEQ ID NO: 529935 - DNA, 20 bp, mouse
gccgtgccaaggtaggagag

SEQ ID NO: 529936 - DNA, 20 bp, mouse
gggcgtccgcctctgcccta

SEQ ID NO: 529937 - DNA, 20 bp, mouse
gccagaggtgaagcacctag

SEQ ID NO: 529938 - DNA, 20 bp, mouse
gcctggctgacaacgaaggg

SEQ ID NO: 529939 - DNA, 20 bp, mouse
ggttcctggctgacaacgaa

SEQ ID NO: 529940 - DNA, 20 bp, mouse
gagccggggaagggcgccct

SEQ ID NO: 529941 - DNA, 20 bp, mouse
gggatcgacagcagcagggt

SEQ ID NO: 529942 - DNA, 20 bp, mouse
ggccaggaacgcggacacag

SEQ ID NO: 529943 - DNA, 20 bp, mouse
ggtcccgcaaaggctcaggg

SEQ ID NO: 529944 - DNA, 20 bp, mouse
gtagaggccgagtcccgcaa

SEQ ID NO: 529945 - DNA, 20 bp, mouse
gctgccgggtggttgtaaag

SEQ ID NO: 529946 - DNA, 20 bp, mouse
ggcaccagcagccctttgaa

SEQ ID NO: 529947 - DNA, 20 bp, mouse
gggccgacgggccgttcaaa

SEQ ID NO: 529948 - DNA, 20 bp, mouse
gcagaaggcggttctgacga

SEQ ID NO: 529949 - DNA, 20 bp, mouse
gctgggagtcgaactcaggg

SEQ ID NO: 529950 - DNA, 20 bp, mouse
gaaggcggttctgacgaggg

SEQ ID NO: 529951 - DNA, 20 bp, mouse
ggctggtcgtaacatttctc

SEQ ID NO: 529952 - DNA, 20 bp, mouse
gcatggcgggggaggccgac

SEQ ID NO: 529953 - DNA, 20 bp, mouse
ggcgcggcgcggataaatgg

SEQ ID NO: 529954 - DNA, 20 bp, mouse
gagccctttgaacggcccgt

SEQ ID NO: 529955 - DNA, 20 bp, mouse
gcatgcgcggcgcggataaa

SEQ ID NO: 529956 - DNA, 20 bp, mouse
gcagccccgcggcctccggg

SEQ ID NO: 529957 - DNA, 20 bp, mouse
gtcacgcgtggccggagaac

SEQ ID NO: 529958 - DNA, 20 bp, mouse
gccgagggccgcgactacag

SEQ ID NO: 529959 - DNA, 20 bp, mouse
ggccggagaaccggagcccg

SEQ ID NO: 529960 - DNA, 20 bp, mouse
ggaaacttccagagtcccgg

SEQ ID NO: 529961 - DNA, 20 bp, mouse
gcgcgcgcagcaaggctggc

SEQ ID NO: 529962 - DNA, 20 bp, mouse
gggccgcgcggagagcacgg

SEQ ID NO: 529963 - DNA, 20 bp, mouse
gtggcgcgaacgctcacgcg

SEQ ID NO: 529964 - DNA, 20 bp, mouse
gcagcaaggctggccggccg

SEQ ID NO: 529965 - DNA, 20 bp, mouse
gggtccgcgcgcagcaaggc

SEQ ID NO: 529966 - DNA, 20 bp, mouse
gtctgtcagaaggctctgtc

SEQ ID NO: 529967 - DNA, 20 bp, mouse
gcagagaagtgaaagctggt

SEQ ID NO: 529968 - DNA, 20 bp, mouse
gcctgtgtagaagaaaggca

SEQ ID NO: 529969 - DNA, 20 bp, mouse
gttggcacccagtaaaagtg

SEQ ID NO: 529970 - DNA, 20 bp, mouse
gcaattggagcagcataaag

SEQ ID NO: 529971 - DNA, 20 bp, mouse
gcaagactggggcaaacaga

SEQ ID NO: 529972 - DNA, 20 bp, mouse
gatcatccagatgaggacca

SEQ ID NO: 529973 - DNA, 20 bp, mouse
ggttggtgaatgcttagggc

SEQ ID NO: 529974 - DNA, 20 bp, mouse
gaatgcttagggctggtata

SEQ ID NO: 529975 - DNA, 20 bp, mouse
gcatggccttggtcctcatc

SEQ ID NO: 529976 - DNA, 20 bp, mouse
gtgccagcgccggtgagagg

SEQ ID NO: 529977 - DNA, 20 bp, mouse
gacgcggcgccccctctcac

SEQ ID NO: 529978 - DNA, 20 bp, mouse
ggggctcgtccaagaaatgg

SEQ ID NO: 529979 - DNA, 20 bp, mouse
ggcggtggtagtgcgcgccc

SEQ ID NO: 529980 - DNA, 20 bp, mouse
gctagtgaccggatatcatg

SEQ ID NO: 529981 - DNA, 20 bp, mouse
gggcagaggagccctaaaac

SEQ ID NO: 529982 - DNA, 20 bp, mouse
gaccggaagcgcggagaggg

SEQ ID NO: 529983 - DNA, 20 bp, mouse
gactagatgcccgcgcgcgg

SEQ ID NO: 529984 - DNA, 20 bp, mouse
ggccaccggaagcgcggaga

SEQ ID NO: 529985 - DNA, 20 bp, mouse
ggagcaggatccctagtgac

SEQ ID NO: 529986 - DNA, 20 bp, mouse
ggcgccatagctacacacta

SEQ ID NO: 529987 - DNA, 20 bp, mouse
ggtgccgtagtgtgtagcta

SEQ ID NO: 529988 - DNA, 20 bp, mouse
gccggctcgcagcactcgcg

SEQ ID NO: 529989 - DNA, 20 bp, mouse
gaacttctgaaagccaggaa

SEQ ID NO: 529990 - DNA, 20 bp, mouse
gtctgtcgacgaaacacgcg

SEQ ID NO: 529991 - DNA, 20 bp, mouse
ggtgtttcgtcgacagactc

SEQ ID NO: 529992 - DNA, 20 bp, mouse
gtctctggacgcgaataact

SEQ ID NO: 529993 - DNA, 20 bp, mouse
gtaagtacagatccaggtct

SEQ ID NO: 529994 - DNA, 20 bp, mouse
gagaagcccgcagaagaggg

SEQ ID NO: 529995 - DNA, 20 bp, mouse
gactctggaacggtgtctga

SEQ ID NO: 529996 - DNA, 20 bp, mouse
gtcgcgagaagtggtcccta

SEQ ID NO: 529997 - DNA, 20 bp, mouse
ggcttgcgcacggtcaagag

SEQ ID NO: 529998 - DNA, 20 bp, mouse
ggcgggcctttgggcaccag

SEQ ID NO: 529999 - DNA, 20 bp, mouse
ggctgcgcatgaaggtgctg

SEQ ID NO: 530000 - DNA, 20 bp, mouse
gggaggaacaacgtgaggga

SEQ ID NO: 530001 - DNA, 20 bp, mouse
gcgagaagtggtccctaagg

SEQ ID NO: 530002 - DNA, 20 bp, mouse
ggccgaagcgatgggcagac

SEQ ID NO: 530003 - DNA, 20 bp, mouse
gcaggctccctccccacatc

SEQ ID NO: 530004 - DNA, 20 bp, mouse
gtgggcagactggctcggga

SEQ ID NO: 530005 - DNA, 20 bp, mouse
gctaaggaggaacaacgtga

SEQ ID NO: 530006 - DNA, 20 bp, mouse
gaaccgccggcgacccacag

SEQ ID NO: 530007 - DNA, 20 bp, mouse
gagtgcgagggagtatgtgg

SEQ ID NO: 530008 - DNA, 20 bp, mouse
gtcccgctgtgggtcgccgg

SEQ ID NO: 530009 - DNA, 20 bp, mouse
gactgcgtctgtgatggcgg

SEQ ID NO: 530010 - DNA, 20 bp, mouse
gtgcactgcgtctgtgatgg

SEQ ID NO: 530011 - DNA, 20 bp, mouse
ggggttgggagaatccgagt

SEQ ID NO: 530012 - DNA, 20 bp, mouse
gggagcggattagggcggag

SEQ ID NO: 530013 - DNA, 20 bp, mouse
gaaccaacgcgaaaaaccgc

SEQ ID NO: 530014 - DNA, 20 bp, mouse
gtggggacagcgaggaggat

SEQ ID NO: 530015 - DNA, 20 bp, mouse
ggccggacagggagtctccg

SEQ ID NO: 530016 - DNA, 20 bp, mouse
ggttcatctggaggactgta

SEQ ID NO: 530017 - DNA, 20 bp, mouse
ggagcctgaggttcatctgg

SEQ ID NO: 530018 - DNA, 20 bp, mouse
gtcccgtcagaggcatccag

SEQ ID NO: 530019 - DNA, 20 bp, mouse
gtgggagcctgaggttcatc

SEQ ID NO: 530020 - DNA, 20 bp, mouse
ggcagtcaggaaagatattc

SEQ ID NO: 530021 - DNA, 20 bp, mouse
gccctggtgcttcccgtcag

SEQ ID NO: 530022 - DNA, 20 bp, mouse
ggtctctcaaataggaccat

SEQ ID NO: 530023 - DNA, 20 bp, mouse
ggcctctgacgggaagcacc

SEQ ID NO: 530024 - DNA, 20 bp, mouse
gtacctctggatgcctctga

SEQ ID NO: 530025 - DNA, 20 bp, mouse
gtaaggtgtcagtctacctc

SEQ ID NO: 530026 - DNA, 20 bp, mouse
gtctccgggtacccgatcta

SEQ ID NO: 530027 - DNA, 20 bp, mouse
gccgggtacccgatctaagg

SEQ ID NO: 530028 - DNA, 20 bp, mouse
gcgcgtgaggccaaatctcc

SEQ ID NO: 530029 - DNA, 20 bp, mouse
gatctaaggcggaggcgagg

SEQ ID NO: 530030 - DNA, 20 bp, mouse
gggcgaggaggtcaggtaag

SEQ ID NO: 530031 - DNA, 20 bp, mouse
gaggcggaggcgaggaggtc

SEQ ID NO: 530032 - DNA, 20 bp, mouse
ggatcgggtacccggagatt

SEQ ID NO: 530033 - DNA, 20 bp, mouse
gcctcactgatgtcactcaa

SEQ ID NO: 530034 - DNA, 20 bp, mouse
gccgatctaaggcggaggcg

SEQ ID NO: 530035 - DNA, 20 bp, mouse
ggggagctgcgtggccgcaa

SEQ ID NO: 530036 - DNA, 20 bp, mouse
gccaccaagatagctaacat

SEQ ID NO: 530037 - DNA, 20 bp, mouse
gctgggatggcgagtccgcg

SEQ ID NO: 530038 - DNA, 20 bp, mouse
ggatagctaacatgggtaaa

SEQ ID NO: 530039 - DNA, 20 bp, mouse
ggggtttcaggcaactggga

SEQ ID NO: 530040 - DNA, 20 bp, mouse
gagccgggtttcaggcaact

SEQ ID NO: 530041 - DNA, 20 bp, mouse
gccgcgcgcagaaaaagcgg

SEQ ID NO: 530042 - DNA, 20 bp, mouse
ggcgtcctggggacctatac

SEQ ID NO: 530043 - DNA, 20 bp, mouse
gccaggtctgaagagtggaa

SEQ ID NO: 530044 - DNA, 20 bp, mouse
gagcacaaggataggatctg

SEQ ID NO: 530045 - DNA, 20 bp, mouse
ggctccgcgcgcagaaaaag

SEQ ID NO: 530046 - DNA, 20 bp, mouse
ggtttggaagggccaagagg

SEQ ID NO: 530047 - DNA, 20 bp, mouse
gaccatgaagagggcccaag

SEQ ID NO: 530048 - DNA, 20 bp, mouse
gcaggaggtgaccatgaaga

SEQ ID NO: 530049 - DNA, 20 bp, mouse
gctggtttggaagggccaag

SEQ ID NO: 530050 - DNA, 20 bp, mouse
gacttgtgcctggtttggaa

SEQ ID NO: 530051 - DNA, 20 bp, mouse
gctgaagggaggatgggcta

SEQ ID NO: 530052 - DNA, 20 bp, mouse
ggccggagaagatgccctct

SEQ ID NO: 530053 - DNA, 20 bp, mouse
gtggtgacttgtgcctggtt

SEQ ID NO: 530054 - DNA, 20 bp, mouse
gtggggcccagcttcctgaa

SEQ ID NO: 530055 - DNA, 20 bp, mouse
gcccagaacctaccctcggt

SEQ ID NO: 530056 - DNA, 20 bp, mouse
ggatcgcagaggttccggtg

SEQ ID NO: 530057 - DNA, 20 bp, mouse
gttctggcggttgatcgcag

SEQ ID NO: 530058 - DNA, 20 bp, mouse
gcacacgccgaacgcctcac

SEQ ID NO: 530059 - DNA, 20 bp, mouse
ggaggttccggtgaggcgtt

SEQ ID NO: 530060 - DNA, 20 bp, mouse
gcgggagcagccagtctccg

SEQ ID NO: 530061 - DNA, 20 bp, mouse
ggccagtctccgcggcacgg

SEQ ID NO: 530062 - DNA, 20 bp, mouse
ggccccgggctaggccgtac

SEQ ID NO: 530063 - DNA, 20 bp, mouse
gcctccccgcgggacgggta

SEQ ID NO: 530064 - DNA, 20 bp, mouse
ggtatcacgtctgccatcac

SEQ ID NO: 530065 - DNA, 20 bp, mouse
gcacggcggcaacttctcgg

SEQ ID NO: 530066 - DNA, 20 bp, mouse
gtgccgggacacagcgtcca

SEQ ID NO: 530067 - DNA, 20 bp, mouse
gccccgggagacagagactc

SEQ ID NO: 530068 - DNA, 20 bp, mouse
gcacagcgtccatggcaggt

SEQ ID NO: 530069 - DNA, 20 bp, mouse
ggcgtccatggcaggtagga

SEQ ID NO: 530070 - DNA, 20 bp, mouse
ggaggagcccgttcactcgg

SEQ ID NO: 530071 - DNA, 20 bp, mouse
ggtccgcgcaggcggggacg

SEQ ID NO: 530072 - DNA, 20 bp, mouse
gtgccatggacgctgtgtcc

SEQ ID NO: 530073 - DNA, 20 bp, mouse
ggaggcgccggaggaggatg

SEQ ID NO: 530074 - DNA, 20 bp, mouse
gactcggaggaggctgtgcc

SEQ ID NO: 530075 - DNA, 20 bp, mouse
gaggatggtccgcgcaggcg

SEQ ID NO: 530076 - DNA, 20 bp, mouse
gctaaagctgagaagttatg

SEQ ID NO: 530077 - DNA, 20 bp, mouse
ggaccaggcccactagggta

SEQ ID NO: 530078 - DNA, 20 bp, mouse
gagcgtagccccatggagag

SEQ ID NO: 530079 - DNA, 20 bp, mouse
gtcatagaccaggcccacta

SEQ ID NO: 530080 - DNA, 20 bp, mouse
ggctttagctccctgaattt

SEQ ID NO: 530081 - DNA, 20 bp, mouse
ggagagtctagtcttgggat

SEQ ID NO: 530082 - DNA, 20 bp, mouse
gggggagtagcgtagcccca

SEQ ID NO: 530083 - DNA, 20 bp, mouse
ggcctggggtgtaaaagctg

SEQ ID NO: 530084 - DNA, 20 bp, mouse
gggtagggctgtgtataaag

SEQ ID NO: 530085 - DNA, 20 bp, mouse
ggtgggcctggtctatgaag

SEQ ID NO: 530086 - DNA, 20 bp, mouse
gtcagagacgagctagacta

SEQ ID NO: 530087 - DNA, 20 bp, mouse
ggagacgagctagactaagg

SEQ ID NO: 530088 - DNA, 20 bp, mouse
gacgagctagactaaggcgg

SEQ ID NO: 530089 - DNA, 20 bp, mouse
gtagactaaggcggcggagg

SEQ ID NO: 530090 - DNA, 20 bp, mouse
ggcccaggaatcgcaaatcg

SEQ ID NO: 530091 - DNA, 20 bp, mouse
gtaaggcggcggaggaggca

SEQ ID NO: 530092 - DNA, 20 bp, mouse
gccgaacccagaggacccca

SEQ ID NO: 530093 - DNA, 20 bp, mouse
gatcgcaaatcggggaactg

SEQ ID NO: 530094 - DNA, 20 bp, mouse
gtcctgggctcaaagctctg

SEQ ID NO: 530095 - DNA, 20 bp, mouse
gggtcccgctaacctcaggt

SEQ ID NO: 530096 - DNA, 20 bp, mouse
gcggaatcgccccaagctag

SEQ ID NO: 530097 - DNA, 20 bp, mouse
gggctccccaaaacgcaggt

SEQ ID NO: 530098 - DNA, 20 bp, mouse
ggattgacaagcaataaccg

SEQ ID NO: 530099 - DNA, 20 bp, mouse
ggctagccgcgctcttaaag

SEQ ID NO: 530100 - DNA, 20 bp, mouse
gaggtctcctaggagcgaag

SEQ ID NO: 530101 - DNA, 20 bp, mouse
gtttggggagcccctagctt

SEQ ID NO: 530102 - DNA, 20 bp, mouse
ggaggcaagggttctgaggt

SEQ ID NO: 530103 - DNA, 20 bp, mouse
gtaggggctccccaaaacgc

SEQ ID NO: 530104 - DNA, 20 bp, mouse
gtatttgcgcggcctctcca

SEQ ID NO: 530105 - DNA, 20 bp, mouse
ggcaataaccgcggagcgcc

SEQ ID NO: 530106 - DNA, 20 bp, mouse
gggatctgggatcggtgacc

SEQ ID NO: 530107 - DNA, 20 bp, mouse
gagcagcgcgtggcacacaa

SEQ ID NO: 530108 - DNA, 20 bp, mouse
ggaggctggtggctcccgcg

SEQ ID NO: 530109 - DNA, 20 bp, mouse
gggagcaccagtcacatcga

SEQ ID NO: 530110 - DNA, 20 bp, mouse
gagggtgggccgcaaggcag

SEQ ID NO: 530111 - DNA, 20 bp, mouse
ggagccccgccggggagggt

SEQ ID NO: 530112 - DNA, 20 bp, mouse
ggcggacgccgagcagtgaa

SEQ ID NO: 530113 - DNA, 20 bp, mouse
gcccagatcctggcgcgacg

SEQ ID NO: 530114 - DNA, 20 bp, mouse
gaggcagtggtgcacccgag

SEQ ID NO: 530115 - DNA, 20 bp, mouse
ggaccccgcgcgccgcgaca

SEQ ID NO: 530116 - DNA, 20 bp, mouse
ggcaagcaggaagcaccagg

SEQ ID NO: 530117 - DNA, 20 bp, mouse
ggaagcaagcaggaagcacc

SEQ ID NO: 530118 - DNA, 20 bp, mouse
gctctagagcatcaggtgac

SEQ ID NO: 530119 - DNA, 20 bp, mouse
gcaaggccctcacagaagat

SEQ ID NO: 530120 - DNA, 20 bp, mouse
gctcagggagggttgcatat

SEQ ID NO: 530121 - DNA, 20 bp, mouse
ggcttaagagatggtactgt

SEQ ID NO: 530122 - DNA, 20 bp, mouse
ggccagcaggccatttctca

SEQ ID NO: 530123 - DNA, 20 bp, mouse
gagcagctacagataatcgt

SEQ ID NO: 530124 - DNA, 20 bp, mouse
ggcaatgccgcatttccaga

SEQ ID NO: 530125 - DNA, 20 bp, mouse
gctgtgccacgcttaagaga

SEQ ID NO: 530126 - DNA, 20 bp, mouse
ggtctcgcgcggcctcgagg

SEQ ID NO: 530127 - DNA, 20 bp, mouse
ggaggagttgctggcgacgg

SEQ ID NO: 530128 - DNA, 20 bp, mouse
gggactggagactccgaggt

SEQ ID NO: 530129 - DNA, 20 bp, mouse
ggcggggactggagactccg

SEQ ID NO: 530130 - DNA, 20 bp, mouse
gggcctcgaggaggagttgc

SEQ ID NO: 530131 - DNA, 20 bp, mouse
ggccggggcttggaggtaag

SEQ ID NO: 530132 - DNA, 20 bp, mouse
gttgagggccgccagacgga

SEQ ID NO: 530133 - DNA, 20 bp, mouse
gcgccagcaactcctcctcg

SEQ ID NO: 530134 - DNA, 20 bp, mouse
gctggagactccgaggtggg

SEQ ID NO: 530135 - DNA, 20 bp, mouse
gttgctggcgacggcggcga

SEQ ID NO: 530136 - DNA, 20 bp, mouse
gcgggaggagcgcgccccgg

SEQ ID NO: 530137 - DNA, 20 bp, mouse
ggggctcagagatcccgggg

SEQ ID NO: 530138 - DNA, 20 bp, mouse
gggagcggagcggctgagag

SEQ ID NO: 530139 - DNA, 20 bp, mouse
ggagcgcgccccggcggcga

SEQ ID NO: 530140 - DNA, 20 bp, mouse
gccgcgactgatgagtggag

SEQ ID NO: 530141 - DNA, 20 bp, mouse
ggcgcccgcgccgcagaggg

SEQ ID NO: 530142 - DNA, 20 bp, mouse
gggcgcccgcgactgatgag

SEQ ID NO: 530143 - DNA, 20 bp, mouse
ggcgtggggccgccactcac

SEQ ID NO: 530144 - DNA, 20 bp, mouse
gcgaggtgcgagccggtgag

SEQ ID NO: 530145 - DNA, 20 bp, mouse
ggccccatctaccgactcag

SEQ ID NO: 530146 - DNA, 20 bp, mouse
gacaactgaggacaatccgg

SEQ ID NO: 530147 - DNA, 20 bp, mouse
gatcacaactgaggacaatc

SEQ ID NO: 530148 - DNA, 20 bp, mouse
gcagctcaggatcacaactg

SEQ ID NO: 530149 - DNA, 20 bp, mouse
gggacaatccggaggcagat

SEQ ID NO: 530150 - DNA, 20 bp, mouse
gtagcaccttgcttagagga

SEQ ID NO: 530151 - DNA, 20 bp, mouse
ggccaaggcaggagttgtgg

SEQ ID NO: 530152 - DNA, 20 bp, mouse
gcccgggcctcgtacctact

SEQ ID NO: 530153 - DNA, 20 bp, mouse
gcaggagccgagaccgcgag

SEQ ID NO: 530154 - DNA, 20 bp, mouse
gtaagcaaggtgctacggcg

SEQ ID NO: 530155 - DNA, 20 bp, mouse
ggagttgtggcgggtgcaac

SEQ ID NO: 530156 - DNA, 20 bp, mouse
gtcccgagaagctgccacgg

SEQ ID NO: 530157 - DNA, 20 bp, mouse
gtgtagctgcgacttcctgg

SEQ ID NO: 530158 - DNA, 20 bp, mouse
gcgctgcacagccgccactg

SEQ ID NO: 530159 - DNA, 20 bp, mouse
gaagtcgcagctacaccgag

SEQ ID NO: 530160 - DNA, 20 bp, mouse
ggccaaagtctcagccgccg

SEQ ID NO: 530161 - DNA, 20 bp, mouse
gggaaggagccgccaggagt

SEQ ID NO: 530162 - DNA, 20 bp, mouse
gcccttccccgggcctggga

SEQ ID NO: 530163 - DNA, 20 bp, mouse
gtcgcagctacaccgagcgg

SEQ ID NO: 530164 - DNA, 20 bp, mouse
gtcgccggggccatcctccg

SEQ ID NO: 530165 - DNA, 20 bp, mouse
ggaagggcgcaggcggtccc

SEQ ID NO: 530166 - DNA, 20 bp, mouse
ggaggagcccggggccaggt

SEQ ID NO: 530167 - DNA, 20 bp, mouse
gctggccccgggctcctctt

SEQ ID NO: 530168 - DNA, 20 bp, mouse
gcccggggccaggtaggacc

SEQ ID NO: 530169 - DNA, 20 bp, mouse
gggccgccgaagaggagccc

SEQ ID NO: 530170 - DNA, 20 bp, mouse
gggccccgctggctgcgcag

SEQ ID NO: 530171 - DNA, 20 bp, mouse
ggagcagcagcgcgcgcgga

SEQ ID NO: 530172 - DNA, 20 bp, mouse
gcgggcgcgcggccccgggt

SEQ ID NO: 530173 - DNA, 20 bp, mouse
gcccgctcgcactcccggcc

SEQ ID NO: 530174 - DNA, 20 bp, mouse
gggcccggccgggtcctacc

SEQ ID NO: 530175 - DNA, 20 bp, mouse
ggaggctggcagcacacagt

SEQ ID NO: 530176 - DNA, 20 bp, mouse
ggggcgaggagaggcagcga

SEQ ID NO: 530177 - DNA, 20 bp, mouse
gcgcgagcggtgcagtgaca

SEQ ID NO: 530178 - DNA, 20 bp, mouse
gcgagcgaagggagcgcgag

SEQ ID NO: 530179 - DNA, 20 bp, mouse
gcgagggcgcggcgagcgaa

SEQ ID NO: 530180 - DNA, 20 bp, mouse
ggggaagagaaggagcgagg

SEQ ID NO: 530181 - DNA, 20 bp, mouse
gaccggagcagcctcgatct

SEQ ID NO: 530182 - DNA, 20 bp, mouse
gtcggcggcggggacctccg

SEQ ID NO: 530183 - DNA, 20 bp, mouse
gggactgccactggggtcaa

SEQ ID NO: 530184 - DNA, 20 bp, mouse
gtgccgggcgcgagaggaag

SEQ ID NO: 530185 - DNA, 20 bp, mouse
gctcccaggccctggatcgg

SEQ ID NO: 530186 - DNA, 20 bp, mouse
gcggccagcgcaaaatgcgg

SEQ ID NO: 530187 - DNA, 20 bp, mouse
gcggcggccagcgcaaaatg

SEQ ID NO: 530188 - DNA, 20 bp, mouse
gcggcccagcgctctcccgg

SEQ ID NO: 530189 - DNA, 20 bp, mouse
gccggccgctggctccaccg

SEQ ID NO: 530190 - DNA, 20 bp, mouse
gtccaccgcggccgccccca

SEQ ID NO: 530191 - DNA, 20 bp, mouse
gcagctcggttcgttcgcgg

SEQ ID NO: 530192 - DNA, 20 bp, mouse
ggcgctgagtccccgacccc

SEQ ID NO: 530193 - DNA, 20 bp, mouse
ggcccagctcggttcgttcg

SEQ ID NO: 530194 - DNA, 20 bp, mouse
ggcggccgcggtggagccag

SEQ ID NO: 530195 - DNA, 20 bp, mouse
gttgccggccggcgccttgg

SEQ ID NO: 530196 - DNA, 20 bp, mouse
gaggagatgctcagattgcg

SEQ ID NO: 530197 - DNA, 20 bp, mouse
gattgcggggctgcaaaaca

SEQ ID NO: 530198 - DNA, 20 bp, mouse
gatcgcggcccagcttgggt

SEQ ID NO: 530199 - DNA, 20 bp, mouse
gttgaggagcgccacatccc

SEQ ID NO: 530200 - DNA, 20 bp, mouse
gcaggcttgtctctccattc

SEQ ID NO: 530201 - DNA, 20 bp, mouse
gctggtgtctgcgcagtggg

SEQ ID NO: 530202 - DNA, 20 bp, mouse
gtgcggggcggccatggcct

SEQ ID NO: 530203 - DNA, 20 bp, mouse
ggatatgtgctaatcggtgt

SEQ ID NO: 530204 - DNA, 20 bp, mouse
gcgatcgatgtcgaagaagg

SEQ ID NO: 530205 - DNA, 20 bp, mouse
gacgcgtccagtaacttcag

SEQ ID NO: 530206 - DNA, 20 bp, mouse
gggaaggagggaacctctga

SEQ ID NO: 530207 - DNA, 20 bp, mouse
gagccaaagggaggagactt

SEQ ID NO: 530208 - DNA, 20 bp, mouse
gcccctccccacgccctcag

SEQ ID NO: 530209 - DNA, 20 bp, mouse
ggctggccgcaggttggtgg

SEQ ID NO: 530210 - DNA, 20 bp, mouse
gttggctggccgcaggttgg

SEQ ID NO: 530211 - DNA, 20 bp, mouse
gagggaacctctgagggcgt

SEQ ID NO: 530212 - DNA, 20 bp, mouse
gtgcccaagtctcctccctt

SEQ ID NO: 530213 - DNA, 20 bp, mouse
gtcggagtggcccaaacagt

SEQ ID NO: 530214 - DNA, 20 bp, mouse
gcctttggctggccgcaggt

SEQ ID NO: 530215 - DNA, 20 bp, mouse
gcaggttggtggcggaagga

SEQ ID NO: 530216 - DNA, 20 bp, mouse
gtcccaagcacggatctcta

SEQ ID NO: 530217 - DNA, 20 bp, mouse
gccacatccagaacataggg

SEQ ID NO: 530218 - DNA, 20 bp, mouse
gccacagcagcaaaaggtgt

SEQ ID NO: 530219 - DNA, 20 bp, mouse
gcccatagagatccgtgctt

SEQ ID NO: 530220 - DNA, 20 bp, mouse
ggttggacctccctatgttc

SEQ ID NO: 530221 - DNA, 20 bp, mouse
gctctttcaagctgctaatt

SEQ ID NO: 530222 - DNA, 20 bp, mouse
gtcagtttatttcaagatgc

SEQ ID NO: 530223 - DNA, 20 bp, mouse
gtcaagaaactgtgagtgaa

SEQ ID NO: 530224 - DNA, 20 bp, mouse
gcaggaagtgtagcagaaac

SEQ ID NO: 530225 - DNA, 20 bp, mouse
gtgagaaccacagcagcaaa

SEQ ID NO: 530226 - DNA, 20 bp, mouse
gtcccaagcacaggtctcta

SEQ ID NO: 530227 - DNA, 20 bp, mouse
gcccatagagacctgtgctt

SEQ ID NO: 530228 - DNA, 20 bp, mouse
gagctcctgttcccaagcac

SEQ ID NO: 530229 - DNA, 20 bp, mouse
gccacagcagcaaaaagtac

SEQ ID NO: 530230 - DNA, 20 bp, mouse
gtctttcaagctgttaagtt

SEQ ID NO: 530231 - DNA, 20 bp, mouse
gggaaattaagagtggtctg

SEQ ID NO: 530232 - DNA, 20 bp, mouse
gttttgctgctgtggttccc

SEQ ID NO: 530233 - DNA, 20 bp, mouse
gtcagttcatttcaggatgc

SEQ ID NO: 530234 - DNA, 20 bp, mouse
gatcaatttcagttcatttc

SEQ ID NO: 530235 - DNA, 20 bp, mouse
gaccattcactcagtttcct

SEQ ID NO: 530236 - DNA, 20 bp, mouse
ggagctggcactcaggtgag

SEQ ID NO: 530237 - DNA, 20 bp, mouse
gctggcactcaggtgagcgg

SEQ ID NO: 530238 - DNA, 20 bp, mouse
ggcttcggtcacgtgagaga

SEQ ID NO: 530239 - DNA, 20 bp, mouse
ggaagaggcggtgctcgata

SEQ ID NO: 530240 - DNA, 20 bp, mouse
gcagagacttgaagcactgt

SEQ ID NO: 530241 - DNA, 20 bp, mouse
ggaagtccctggaccagctt

SEQ ID NO: 530242 - DNA, 20 bp, mouse
gcgtgaccgaagctggtcca

SEQ ID NO: 530243 - DNA, 20 bp, mouse
gtcaggtgagcggaggttct

SEQ ID NO: 530244 - DNA, 20 bp, mouse
gatggaacccagactctgga

SEQ ID NO: 530245 - DNA, 20 bp, mouse
gtgctcgatacggaagtccc

SEQ ID NO: 530246 - DNA, 20 bp, mouse
gtcacccgccgagaagagcc

SEQ ID NO: 530247 - DNA, 20 bp, mouse
gtacgccgggctcttctcgg

SEQ ID NO: 530248 - DNA, 20 bp, mouse
gcgtagagcagcacgttagt

SEQ ID NO: 530249 - DNA, 20 bp, mouse
gggcagcacggcgctatccg

SEQ ID NO: 530250 - DNA, 20 bp, mouse
gccccgcagtcgctgctgca

SEQ ID NO: 530251 - DNA, 20 bp, mouse
gtgccctgcagcagcgactg

SEQ ID NO: 530252 - DNA, 20 bp, mouse
gtggtggcgcgcgtttccac

SEQ ID NO: 530253 - DNA, 20 bp, mouse
ggcagcacgttagtgggcca

SEQ ID NO: 530254 - DNA, 20 bp, mouse
gtggcagggcgcgctccagt

SEQ ID NO: 530255 - DNA, 20 bp, mouse
gtaacgtgctgctctacgcc

SEQ ID NO: 530256 - DNA, 20 bp, mouse
gtagcggcgatggctctggg

SEQ ID NO: 530257 - DNA, 20 bp, mouse
ggcgcgcggccctggaacag

SEQ ID NO: 530258 - DNA, 20 bp, mouse
gtacagacaccagggagccg

SEQ ID NO: 530259 - DNA, 20 bp, mouse
gcgctgggctcgcaaggcgt

SEQ ID NO: 530260 - DNA, 20 bp, mouse
gctggtgtctgtagcggcga

SEQ ID NO: 530261 - DNA, 20 bp, mouse
ggcgggacagggagagtcaa

SEQ ID NO: 530262 - DNA, 20 bp, mouse
gtgacaggccccaggaaggt

SEQ ID NO: 530263 - DNA, 20 bp, mouse
ggcgcggcgctcaggtgaga

SEQ ID NO: 530264 - DNA, 20 bp, mouse
gggctggcgctgggctcgca

SEQ ID NO: 530265 - DNA, 20 bp, mouse
ggacctgtgcgcgaacgaga

SEQ ID NO: 530266 - DNA, 20 bp, mouse
gaaggcccagagtgtctgtg

SEQ ID NO: 530267 - DNA, 20 bp, mouse
ggcccagagtgtctgtgggg

SEQ ID NO: 530268 - DNA, 20 bp, mouse
gcgggagccatagctggggt

SEQ ID NO: 530269 - DNA, 20 bp, mouse
ggagccccgggagccatagc

SEQ ID NO: 530270 - DNA, 20 bp, mouse
gcatagctggggtagggcaa

SEQ ID NO: 530271 - DNA, 20 bp, mouse
gggcagccaggatagggctg

SEQ ID NO: 530272 - DNA, 20 bp, mouse
gagagcagggcagccaggat

SEQ ID NO: 530273 - DNA, 20 bp, mouse
gcactgctaagagccagcaa

SEQ ID NO: 530274 - DNA, 20 bp, mouse
ggctggctcttagcagtgaa

SEQ ID NO: 530275 - DNA, 20 bp, mouse
gcagtgaagggtgagaggat

SEQ ID NO: 530276 - DNA, 20 bp, mouse
ggaagccgggcggaacggag

SEQ ID NO: 530277 - DNA, 20 bp, mouse
ggacagagctgtgtggtcta

SEQ ID NO: 530278 - DNA, 20 bp, mouse
gagcagtggggcgggcacag

SEQ ID NO: 530279 - DNA, 20 bp, mouse
gtggccactggggccgggag

SEQ ID NO: 530280 - DNA, 20 bp, mouse
gcacagctctgtccggatcg

SEQ ID NO: 530281 - DNA, 20 bp, mouse
gcccagggagctgcaaggta

SEQ ID NO: 530282 - DNA, 20 bp, mouse
gaccgcagcgggaagccggg

SEQ ID NO: 530283 - DNA, 20 bp, mouse
ggcggggagcggtggcgtgg

SEQ ID NO: 530284 - DNA, 20 bp, mouse
gctggagctgggcagaaggc

SEQ ID NO: 530285 - DNA, 20 bp, mouse
ggcaagccagccgaccgcag

SEQ ID NO: 530286 - DNA, 20 bp, mouse
gccgctgtgcgccttcccat

SEQ ID NO: 530287 - DNA, 20 bp, mouse
gaggcggcacagtttaccca

SEQ ID NO: 530288 - DNA, 20 bp, mouse
gagggactcggacctctccg

SEQ ID NO: 530289 - DNA, 20 bp, mouse
gcaaggctaggacgagcagg

SEQ ID NO: 530290 - DNA, 20 bp, mouse
gcccaaccaaggccaaggct

SEQ ID NO: 530291 - DNA, 20 bp, mouse
ggcacagtttacccacggag

SEQ ID NO: 530292 - DNA, 20 bp, mouse
gggccaaggctaggacgagc

SEQ ID NO: 530293 - DNA, 20 bp, mouse
gggactccagcacccaacca

SEQ ID NO: 530294 - DNA, 20 bp, mouse
ggtccgagtccctcacctat

SEQ ID NO: 530295 - DNA, 20 bp, mouse
ggagtccctcacctatggga

SEQ ID NO: 530296 - DNA, 20 bp, mouse
ggaggaacagtaggaggccg

SEQ ID NO: 530297 - DNA, 20 bp, mouse
ggcactcaccctggacgact

SEQ ID NO: 530298 - DNA, 20 bp, mouse
gtggaaagagagcgcagcca

SEQ ID NO: 530299 - DNA, 20 bp, mouse
gccagctggcgcactcaccc

SEQ ID NO: 530300 - DNA, 20 bp, mouse
gtccccgggaggcgtaaaga

SEQ ID NO: 530301 - DNA, 20 bp, mouse
gaagtatcggaagagctgtc

SEQ ID NO: 530302 - DNA, 20 bp, mouse
gaaagagggtgtgtaagtat

SEQ ID NO: 530303 - DNA, 20 bp, mouse
gtcgggctctgagagctgag

SEQ ID NO: 530304 - DNA, 20 bp, mouse
gagagctgtcgggatgcagc

SEQ ID NO: 530305 - DNA, 20 bp, mouse
gtgagcatcctagtcgtcca

SEQ ID NO: 530306 - DNA, 20 bp, mouse
gttctcaaaagattcatcag

SEQ ID NO: 530307 - DNA, 20 bp, mouse
gttaccaagtgtaagtaagt

SEQ ID NO: 530308 - DNA, 20 bp, mouse
gaggggtctgtcactgtctg

SEQ ID NO: 530309 - DNA, 20 bp, mouse
gcaatgctgaagcataacga

SEQ ID NO: 530310 - DNA, 20 bp, mouse
ggtggggacatagctctcag

SEQ ID NO: 530311 - DNA, 20 bp, mouse
ggcactgtggggtgggacag

SEQ ID NO: 530312 - DNA, 20 bp, mouse
gttgggtacaaaggacctgt

SEQ ID NO: 530313 - DNA, 20 bp, mouse
gcgtgtagggagagtttcag

SEQ ID NO: 530314 - DNA, 20 bp, mouse
gaagcaaaggacttcagcac

SEQ ID NO: 530315 - DNA, 20 bp, mouse
gctaccgacttacttacact

SEQ ID NO: 530316 - DNA, 20 bp, mouse
gggaaccagaagccctacag

SEQ ID NO: 530317 - DNA, 20 bp, mouse
gagtaggcaggccccatgcc

SEQ ID NO: 530318 - DNA, 20 bp, mouse
ggaatcacccggcttgtctg

SEQ ID NO: 530319 - DNA, 20 bp, mouse
gtagctggtgagcgggacag

SEQ ID NO: 530320 - DNA, 20 bp, mouse
gggagagccacagacaagcc

SEQ ID NO: 530321 - DNA, 20 bp, mouse
gctgcatggctggaaggtca

SEQ ID NO: 530322 - DNA, 20 bp, mouse
gtctgtggctctcccggcat

SEQ ID NO: 530323 - DNA, 20 bp, mouse
gtgtctgccagagttagtaa

SEQ ID NO: 530324 - DNA, 20 bp, mouse
ggccaagagggcctcacccc

SEQ ID NO: 530325 - DNA, 20 bp, mouse
ggggctcacggcccagctgt

SEQ ID NO: 530326 - DNA, 20 bp, mouse
gggcggtgaggctcgagcac

SEQ ID NO: 530327 - DNA, 20 bp, mouse
gggtgaggctcgagcaccgg

SEQ ID NO: 530328 - DNA, 20 bp, mouse
gggttaccgcaggctttaca

SEQ ID NO: 530329 - DNA, 20 bp, mouse
gggtaacccaggacaggacg

SEQ ID NO: 530330 - DNA, 20 bp, mouse
ggcctgcggtaacccaggac

SEQ ID NO: 530331 - DNA, 20 bp, mouse
gcggcggcacggcggcggtg

SEQ ID NO: 530332 - DNA, 20 bp, mouse
gctctgttcactggcggcgg

SEQ ID NO: 530333 - DNA, 20 bp, mouse
gcagctctgttcactggcgg

SEQ ID NO: 530334 - DNA, 20 bp, mouse
ggcacagctctgttcactgg

SEQ ID NO: 530335 - DNA, 20 bp, mouse
gttacacggttcagctcctc

SEQ ID NO: 530336 - DNA, 20 bp, mouse
ggcgcggagccgtcagtcgg

SEQ ID NO: 530337 - DNA, 20 bp, mouse
gagccagagccggtggtagg

SEQ ID NO: 530338 - DNA, 20 bp, mouse
gcccggtgcgagcgaggagg

SEQ ID NO: 530339 - DNA, 20 bp, mouse
ggccccgcgccgccgactga

SEQ ID NO: 530340 - DNA, 20 bp, mouse
gctcgctcgcaccgggagga

SEQ ID NO: 530341 - DNA, 20 bp, mouse
gctggcgcggagccgtcagt

SEQ ID NO: 530342 - DNA, 20 bp, mouse
gtaacgagcgcaggccccag

SEQ ID NO: 530343 - DNA, 20 bp, mouse
gggcctctgccccctaccac

SEQ ID NO: 530344 - DNA, 20 bp, mouse
gggctgcccgggtaaggact

SEQ ID NO: 530345 - DNA, 20 bp, mouse
gcgggcagccgaggaacccc

SEQ ID NO: 530346 - DNA, 20 bp, mouse
gtcaggcagctcccagacct

SEQ ID NO: 530347 - DNA, 20 bp, mouse
gtgagcaaaggggcaacctg

SEQ ID NO: 530348 - DNA, 20 bp, mouse
gcttccaatgagggagaaga

SEQ ID NO: 530349 - DNA, 20 bp, mouse
gaaaggcaaagaatacaacc

SEQ ID NO: 530350 - DNA, 20 bp, mouse
ggaagcctcatggcccagag

SEQ ID NO: 530351 - DNA, 20 bp, mouse
gcagagtggatcttccaatg

SEQ ID NO: 530352 - DNA, 20 bp, mouse
gaaactggaaactagaacta

SEQ ID NO: 530353 - DNA, 20 bp, mouse
gctttgctcagtccaaggtc

SEQ ID NO: 530354 - DNA, 20 bp, mouse
ggacctgaacacaccagggt

SEQ ID NO: 530355 - DNA, 20 bp, mouse
gtcctgtgtacatctggaag

SEQ ID NO: 530356 - DNA, 20 bp, mouse
ggctgtgctcagatgaccgc

SEQ ID NO: 530357 - DNA, 20 bp, mouse
gcggaggacgagagtacgga

SEQ ID NO: 530358 - DNA, 20 bp, mouse
gtcatctgagcacagcgcta

SEQ ID NO: 530359 - DNA, 20 bp, mouse
ggaggatgcgatcccctcgc

SEQ ID NO: 530360 - DNA, 20 bp, mouse
ggtacggagggcgcacggca

SEQ ID NO: 530361 - DNA, 20 bp, mouse
gtcacttcgtccggacccgg

SEQ ID NO: 530362 - DNA, 20 bp, mouse
gcttcgtccggacccggagg

SEQ ID NO: 530363 - DNA, 20 bp, mouse
gctccctcctcctctccggg

SEQ ID NO: 530364 - DNA, 20 bp, mouse
gtcagatgaccgccggcgag

SEQ ID NO: 530365 - DNA, 20 bp, mouse
ggaagtgatgcctcccggag

SEQ ID NO: 530366 - DNA, 20 bp, mouse
ggacttgtcagagtcgacca

SEQ ID NO: 530367 - DNA, 20 bp, mouse
gtccgaggcggactccgagg

SEQ ID NO: 530368 - DNA, 20 bp, mouse
gtgaattaggcgcgggagag

SEQ ID NO: 530369 - DNA, 20 bp, mouse
gggtgggaggtctcctgtag

SEQ ID NO: 530370 - DNA, 20 bp, mouse
gccatctctacctcaggaaa

SEQ ID NO: 530371 - DNA, 20 bp, mouse
gcacccgcgggactccgagg

SEQ ID NO: 530372 - DNA, 20 bp, mouse
gttgtcagagtcgaccaggg

SEQ ID NO: 530373 - DNA, 20 bp, mouse
gtaattcaggtttctgggag

SEQ ID NO: 530374 - DNA, 20 bp, mouse
ggcgcctaattcaggtttct

SEQ ID NO: 530375 - DNA, 20 bp, mouse
gcgagtgcgtggggccgtta

SEQ ID NO: 530376 - DNA, 20 bp, mouse
gggccgtgcgcatcacgccg

SEQ ID NO: 530377 - DNA, 20 bp, mouse
gcgcgcagctcgcgtcccca

SEQ ID NO: 530378 - DNA, 20 bp, mouse
gctcctccaggcaccggcac

SEQ ID NO: 530379 - DNA, 20 bp, mouse
gcagctcgcgtccccacggc

SEQ ID NO: 530380 - DNA, 20 bp, mouse
ggagcccgcgcggcccgaga

SEQ ID NO: 530381 - DNA, 20 bp, mouse
gagagagggaaaagctcccg

SEQ ID NO: 530382 - DNA, 20 bp, mouse
gagtcagtggcgtttcccag

SEQ ID NO: 530383 - DNA, 20 bp, mouse
ggcgtccccacggccggccg

SEQ ID NO: 530384 - DNA, 20 bp, mouse
gcgcgggctcctccaggcac

SEQ ID NO: 530385 - DNA, 20 bp, mouse
ggcaggcgctccgtagccag

SEQ ID NO: 530386 - DNA, 20 bp, mouse
gcggcagtcactcgtctccg

SEQ ID NO: 530387 - DNA, 20 bp, mouse
ggagacgagtgactgccgag

SEQ ID NO: 530388 - DNA, 20 bp, mouse
ggggcgagcgacgaacaaaa

SEQ ID NO: 530389 - DNA, 20 bp, mouse
gactgctcgaagtcctcctc

SEQ ID NO: 530390 - DNA, 20 bp, mouse
gtgttcgtcgctcgcccgct

SEQ ID NO: 530391 - DNA, 20 bp, mouse
gagcgccgagcgctggttga

SEQ ID NO: 530392 - DNA, 20 bp, mouse
gggcgccgccggcaccctgc

SEQ ID NO: 530393 - DNA, 20 bp, mouse
gtcaaccgtcaaccagcgct

SEQ ID NO: 530394 - DNA, 20 bp, mouse
ggaggtgctggagcccgagg

SEQ ID NO: 530395 - DNA, 20 bp, mouse
gaccctcacggacggagctc

SEQ ID NO: 530396 - DNA, 20 bp, mouse
gtcgccggcggccatggggg

SEQ ID NO: 530397 - DNA, 20 bp, mouse
gccgggcgctcgtcaatcgc

SEQ ID NO: 530398 - DNA, 20 bp, mouse
gcgggcgccccaggcgacaa

SEQ ID NO: 530399 - DNA, 20 bp, mouse
gtagtagggcaccccagagt

SEQ ID NO: 530400 - DNA, 20 bp, mouse
gaggccgaggtgggcggcac

SEQ ID NO: 530401 - DNA, 20 bp, mouse
gcgagcgcccggcgcgagaa

SEQ ID NO: 530402 - DNA, 20 bp, mouse
gagccctgctgaggagacgg

SEQ ID NO: 530403 - DNA, 20 bp, mouse
gtcaatcgccggcggccatg

SEQ ID NO: 530404 - DNA, 20 bp, mouse
gtctcgggcaggaaagtcat

SEQ ID NO: 530405 - DNA, 20 bp, mouse
gggagcctgcgacctcccac

SEQ ID NO: 530406 - DNA, 20 bp, mouse
gcttgctggatgtagctctc

SEQ ID NO: 530407 - DNA, 20 bp, mouse
ggctctctggcttctgtgca

SEQ ID NO: 530408 - DNA, 20 bp, mouse
gctctagaggtaaggatatc

SEQ ID NO: 530409 - DNA, 20 bp, mouse
gggttgcagatgtcttccag

SEQ ID NO: 530410 - DNA, 20 bp, mouse
gttgccatgaggaccaggag

SEQ ID NO: 530411 - DNA, 20 bp, mouse
gtccacataacaccatactg

SEQ ID NO: 530412 - DNA, 20 bp, mouse
gtcaagttgccatgaggacc

SEQ ID NO: 530413 - DNA, 20 bp, mouse
gacagtgtgcaactcccttt

SEQ ID NO: 530414 - DNA, 20 bp, mouse
ggccccagtatggtgttatg

SEQ ID NO: 530415 - DNA, 20 bp, mouse
gacatattcaagttgccatg

SEQ ID NO: 530416 - DNA, 20 bp, mouse
gagctaccccacccaaattc

SEQ ID NO: 530417 - DNA, 20 bp, mouse
gatagcttgctggcttgtgt

SEQ ID NO: 530418 - DNA, 20 bp, mouse
gaaacaggctggacagggaa

SEQ ID NO: 530419 - DNA, 20 bp, mouse
gttgccatgaggaccaatag

SEQ ID NO: 530420 - DNA, 20 bp, mouse
gatatactgcctgagtatgg

SEQ ID NO: 530421 - DNA, 20 bp, mouse
gtccacataccaccatactc

SEQ ID NO: 530422 - DNA, 20 bp, mouse
gggaaaactacagttactac

SEQ ID NO: 530423 - DNA, 20 bp, mouse
ggggagcagatgtcagccaa

SEQ ID NO: 530424 - DNA, 20 bp, mouse
ggcagtgtgcaactccgttt

SEQ ID NO: 530425 - DNA, 20 bp, mouse
gtggtgagtttggtgcaaac

SEQ ID NO: 530426 - DNA, 20 bp, mouse
gctcaaatcacagaccctta

SEQ ID NO: 530427 - DNA, 20 bp, mouse
gatagcttgctggcttgtgt

SEQ ID NO: 530428 - DNA, 20 bp, mouse
gttgccatgaggaccaatag

SEQ ID NO: 530429 - DNA, 20 bp, mouse
gggaaaactacagttactac

SEQ ID NO: 530430 - DNA, 20 bp, mouse
gaaacaggctggacagggaa

SEQ ID NO: 530431 - DNA, 20 bp, mouse
gtccacataccaccatactc

SEQ ID NO: 530432 - DNA, 20 bp, mouse
gatatactgcctgagtatgg

SEQ ID NO: 530433 - DNA, 20 bp, mouse
gggagaagtgcatttaaagt

SEQ ID NO: 530434 - DNA, 20 bp, mouse
gacaggatattcgtttgctc

SEQ ID NO: 530435 - DNA, 20 bp, mouse
ggcagtgtgcaactccgttt

SEQ ID NO: 530436 - DNA, 20 bp, mouse
ggaggattggggaaaggtaa

SEQ ID NO: 530437 - DNA, 20 bp, mouse
gtacatccaacaagaggatt

SEQ ID NO: 530438 - DNA, 20 bp, mouse
gctttccccaatcctcttgt

SEQ ID NO: 530439 - DNA, 20 bp, mouse
gttgtcattggggccatgag

SEQ ID NO: 530440 - DNA, 20 bp, mouse
gagctggctgggctgttgtt

SEQ ID NO: 530441 - DNA, 20 bp, mouse
ggcagtgcacagctccattt

SEQ ID NO: 530442 - DNA, 20 bp, mouse
gtggtgaatttgatgcagac

SEQ ID NO: 530443 - DNA, 20 bp, mouse
gcacccaaattgagagctaa

SEQ ID NO: 530444 - DNA, 20 bp, mouse
gagcatattaaagttgtcat

SEQ ID NO: 530445 - DNA, 20 bp, mouse
ggtgagctacatccaacaag

SEQ ID NO: 530446 - DNA, 20 bp, mouse
gtaatctcaccaaaagggat

SEQ ID NO: 530447 - DNA, 20 bp, mouse
gtgaagttgtaattaggacc

SEQ ID NO: 530448 - DNA, 20 bp, mouse
ggcatattgaagttgtaatt

SEQ ID NO: 530449 - DNA, 20 bp, mouse
gccacataactcgatatttg

SEQ ID NO: 530450 - DNA, 20 bp, mouse
gatgctcatttttcatctcc

SEQ ID NO: 530451 - DNA, 20 bp, mouse
gagacatcaaccattgttct

SEQ ID NO: 530452 - DNA, 20 bp, mouse
gagacagactgaacagtgaa

SEQ ID NO: 530453 - DNA, 20 bp, mouse
gctttagtggtaaggagatc

SEQ ID NO: 530454 - DNA, 20 bp, mouse
gtcagtagtaaaagctttag

SEQ ID NO: 530455 - DNA, 20 bp, mouse
gagcatagtccaatcccttt

SEQ ID NO: 530456 - DNA, 20 bp, mouse
gccaaccccctgaactccta

SEQ ID NO: 530457 - DNA, 20 bp, mouse
gggagttcagggggttggtg

SEQ ID NO: 530458 - DNA, 20 bp, mouse
gtggccatatcatgcattga

SEQ ID NO: 530459 - DNA, 20 bp, mouse
ggcatcaatagaaccttcat

SEQ ID NO: 530460 - DNA, 20 bp, mouse
ggaaggggggaagcaggaaa

SEQ ID NO: 530461 - DNA, 20 bp, mouse
gcttagtccctaggagttca

SEQ ID NO: 530462 - DNA, 20 bp, mouse
gcttccatcaatgcatgata

SEQ ID NO: 530463 - DNA, 20 bp, mouse
ggccctaaacacctcagcct

SEQ ID NO: 530464 - DNA, 20 bp, mouse
gagatgggggtttccaggaa

SEQ ID NO: 530465 - DNA, 20 bp, mouse
ggccgaggctgaggtgttta

SEQ ID NO: 530466 - DNA, 20 bp, mouse
ggccctgaacacctcaacct

SEQ ID NO: 530467 - DNA, 20 bp, mouse
gctctgtggaagctatgatg

SEQ ID NO: 530468 - DNA, 20 bp, mouse
ggccgaggttgaggtgttca

SEQ ID NO: 530469 - DNA, 20 bp, mouse
ggttgtgagtgccgttgccg

SEQ ID NO: 530470 - DNA, 20 bp, mouse
gtgtcagcccgactagtccg

SEQ ID NO: 530471 - DNA, 20 bp, mouse
gagtgccgttgccgaggttg

SEQ ID NO: 530472 - DNA, 20 bp, mouse
ggcatagaagtatcagcatc

SEQ ID NO: 530473 - DNA, 20 bp, mouse
gcctgcgcaagcggaagagc

SEQ ID NO: 530474 - DNA, 20 bp, mouse
gagttgataaagatactgtt

SEQ ID NO: 530475 - DNA, 20 bp, mouse
gcgtcatcctcggactagtc

SEQ ID NO: 530476 - DNA, 20 bp, mouse
gtttgctggatgtagatcac

SEQ ID NO: 530477 - DNA, 20 bp, mouse
gagattgagaagtaagttgt

SEQ ID NO: 530478 - DNA, 20 bp, mouse
gctctagaggtaaggaggtc

SEQ ID NO: 530479 - DNA, 20 bp, mouse
gtgcaaccccacagaacgag

SEQ ID NO: 530480 - DNA, 20 bp, mouse
gggtcataagggtctgtgag

SEQ ID NO: 530481 - DNA, 20 bp, mouse
ggcacatcctctcgttctgt

SEQ ID NO: 530482 - DNA, 20 bp, mouse
gaaggaatgggggaaaggta

SEQ ID NO: 530483 - DNA, 20 bp, mouse
ggatcactggcttctgtaca

SEQ ID NO: 530484 - DNA, 20 bp, mouse
ggaggtaaggaggtcaggat

SEQ ID NO: 530485 - DNA, 20 bp, mouse
gttaccatgaggaccatgag

SEQ ID NO: 530486 - DNA, 20 bp, mouse
gctaagtacaggaaactaca

SEQ ID NO: 530487 - DNA, 20 bp, mouse
gtgtgactggtgcctgatga

SEQ ID NO: 530488 - DNA, 20 bp, mouse
ggcatggataacaatgtgac

SEQ ID NO: 530489 - DNA, 20 bp, mouse
gccttgagatggagaatcca

SEQ ID NO: 530490 - DNA, 20 bp, mouse
gatactgtaagtcaagacac

SEQ ID NO: 530491 - DNA, 20 bp, mouse
gattctgattagccttcatc

SEQ ID NO: 530492 - DNA, 20 bp, mouse
ggaaacacgtctgcagcgca

SEQ ID NO: 530493 - DNA, 20 bp, mouse
gtaattgagatgagagagaa

SEQ ID NO: 530494 - DNA, 20 bp, mouse
gttgagttactgacataaca

SEQ ID NO: 530495 - DNA, 20 bp, mouse
gatctcaaggtgtagatata

SEQ ID NO: 530496 - DNA, 20 bp, mouse
gcataagaagaatagagcaa

SEQ ID NO: 530497 - DNA, 20 bp, mouse
gttggaaagaaggtctcaaa

SEQ ID NO: 530498 - DNA, 20 bp, mouse
gttcctcacgacagcattgt

SEQ ID NO: 530499 - DNA, 20 bp, mouse
gacttgctaagtcaaggaaa

SEQ ID NO: 530500 - DNA, 20 bp, mouse
gcattgtaggtttgtagact

SEQ ID NO: 530501 - DNA, 20 bp, mouse
gcacgaagaagacattgcct

SEQ ID NO: 530502 - DNA, 20 bp, mouse
gctgagactgaaatgcacaa

SEQ ID NO: 530503 - DNA, 20 bp, mouse
gtgggatgacagcagaattt

SEQ ID NO: 530504 - DNA, 20 bp, mouse
gagatacacttgctaagtca

SEQ ID NO: 530505 - DNA, 20 bp, mouse
gactgagggactgacataac

SEQ ID NO: 530506 - DNA, 20 bp, mouse
gacagccaggttgaggatgt

SEQ ID NO: 530507 - DNA, 20 bp, mouse
ggatacaaattgaaattgga

SEQ ID NO: 530508 - DNA, 20 bp, mouse
gctaataaccaccacagcac

SEQ ID NO: 530509 - DNA, 20 bp, mouse
ggatgggccacatgatagac

SEQ ID NO: 530510 - DNA, 20 bp, mouse
gtgatgatacaaattgaaat

SEQ ID NO: 530511 - DNA, 20 bp, mouse
gccaacaggggaaatggtga

SEQ ID NO: 530512 - DNA, 20 bp, mouse
gaccatcccaacaggggaaa

SEQ ID NO: 530513 - DNA, 20 bp, mouse
gttggaaggctggttttatc

SEQ ID NO: 530514 - DNA, 20 bp, mouse
ggttttatccggtgctgtgg

SEQ ID NO: 530515 - DNA, 20 bp, mouse
gtgatgtgtgtcttggacgt

SEQ ID NO: 530516 - DNA, 20 bp, mouse
gttgttaatgttccaggcca

SEQ ID NO: 530517 - DNA, 20 bp, mouse
ggggtacaaccaccctggcc

SEQ ID NO: 530518 - DNA, 20 bp, mouse
gaggcagcgttcagcactga

SEQ ID NO: 530519 - DNA, 20 bp, mouse
gacgaggctcaacaatagag

SEQ ID NO: 530520 - DNA, 20 bp, mouse
gtgagcctcgtggtagggct

SEQ ID NO: 530521 - DNA, 20 bp, mouse
gacagcctagccctaccacg

SEQ ID NO: 530522 - DNA, 20 bp, mouse
gactcaagttgtgcattccc

SEQ ID NO: 530523 - DNA, 20 bp, mouse
gaggaaacggcatagtgcta

SEQ ID NO: 530524 - DNA, 20 bp, mouse
gctgtcatcatagctgtggt

SEQ ID NO: 530525 - DNA, 20 bp, mouse
gattgttgagcctcgtggta

SEQ ID NO: 530526 - DNA, 20 bp, mouse
gctggaaacttcctaaacat

SEQ ID NO: 530527 - DNA, 20 bp, mouse
gtaagcaaacataaatacaa

SEQ ID NO: 530528 - DNA, 20 bp, mouse
ggggtctaaccactccagcc

SEQ ID NO: 530529 - DNA, 20 bp, mouse
gttttttgcgggaacaccac

SEQ ID NO: 530530 - DNA, 20 bp, mouse
ggtattgaacttgctgacac

SEQ ID NO: 530531 - DNA, 20 bp, mouse
gagagagcgctcaacactga

SEQ ID NO: 530532 - DNA, 20 bp, mouse
gaggaaatgccatagtccta

SEQ ID NO: 530533 - DNA, 20 bp, mouse
gtgatggatgatgtatgtct

SEQ ID NO: 530534 - DNA, 20 bp, mouse
gatgtttccttcagttaaat

SEQ ID NO: 530535 - DNA, 20 bp, mouse
gcatatctctatttttttgc

SEQ ID NO: 530536 - DNA, 20 bp, mouse
gccatgtttgggaacactcc

SEQ ID NO: 530537 - DNA, 20 bp, mouse
ggaagcttgaatccatgttt

SEQ ID NO: 530538 - DNA, 20 bp, mouse
gggattcaagcttcccagac

SEQ ID NO: 530539 - DNA, 20 bp, mouse
ggaggaagtttgccccagac

SEQ ID NO: 530540 - DNA, 20 bp, mouse
gatactggcataccttgcag

SEQ ID NO: 530541 - DNA, 20 bp, mouse
gtacatcttcaacctgtctg

SEQ ID NO: 530542 - DNA, 20 bp, mouse
gccaatgatggcaatgataa

SEQ ID NO: 530543 - DNA, 20 bp, mouse
ggttgggcatgataccaagt

SEQ ID NO: 530544 - DNA, 20 bp, mouse
gatgataccaagtgggccaa

SEQ ID NO: 530545 - DNA, 20 bp, mouse
gtgaattcaatattccagtc

SEQ ID NO: 530546 - DNA, 20 bp, mouse
gtagcaaggaccactccttc

SEQ ID NO: 530547 - DNA, 20 bp, mouse
gatgctctgaggcattgaga

SEQ ID NO: 530548 - DNA, 20 bp, mouse
gctaccaggatgatgccaga

SEQ ID NO: 530549 - DNA, 20 bp, mouse
gggcaggagagggccatact

SEQ ID NO: 530550 - DNA, 20 bp, mouse
gactccttctggcatcatcc

SEQ ID NO: 530551 - DNA, 20 bp, mouse
gaggtctccacagggtggac

SEQ ID NO: 530552 - DNA, 20 bp, mouse
gcagattcctttgatactgg

SEQ ID NO: 530553 - DNA, 20 bp, mouse
gtcttcagctaggctcctgt

SEQ ID NO: 530554 - DNA, 20 bp, mouse
gcaaaagcccccagtatcaa

SEQ ID NO: 530555 - DNA, 20 bp, mouse
gctaatgggcctccccagta

SEQ ID NO: 530556 - DNA, 20 bp, mouse
ggcccaagacagaggacgga

SEQ ID NO: 530557 - DNA, 20 bp, mouse
gatggcacagcccaagacag

SEQ ID NO: 530558 - DNA, 20 bp, mouse
gcgcctggccaggaatttcc

SEQ ID NO: 530559 - DNA, 20 bp, mouse
gtagcggcggctgggtgagt

SEQ ID NO: 530560 - DNA, 20 bp, mouse
ggagctgcctgcaagccaga

SEQ ID NO: 530561 - DNA, 20 bp, mouse
ggccctccgtcctctgtctt

SEQ ID NO: 530562 - DNA, 20 bp, mouse
gacgtcccctgagggagaga

SEQ ID NO: 530563 - DNA, 20 bp, mouse
gcaggagcctcaccacaggt

SEQ ID NO: 530564 - DNA, 20 bp, mouse
gcctgctccaccccgggtct

SEQ ID NO: 530565 - DNA, 20 bp, mouse
gtgtcttctgggagatgcgg

SEQ ID NO: 530566 - DNA, 20 bp, mouse
gctctacgaagggaactcgg

SEQ ID NO: 530567 - DNA, 20 bp, mouse
gtggctagcctgctgcccgt

SEQ ID NO: 530568 - DNA, 20 bp, mouse
gtccgagtttgctgacccac

SEQ ID NO: 530569 - DNA, 20 bp, mouse
gaggagaagatctctacgaa

SEQ ID NO: 530570 - DNA, 20 bp, mouse
gtcagcaaactcggagtccc

SEQ ID NO: 530571 - DNA, 20 bp, mouse
ggcccgtgggtcagcaaact

SEQ ID NO: 530572 - DNA, 20 bp, mouse
ggcttcaggatcaggatcag

SEQ ID NO: 530573 - DNA, 20 bp, mouse
ggactaggggagggagacca

SEQ ID NO: 530574 - DNA, 20 bp, mouse
gggtagcactctgggaccca

SEQ ID NO: 530575 - DNA, 20 bp, mouse
gagtatcccagggatatagg

SEQ ID NO: 530576 - DNA, 20 bp, mouse
gagatcaagacaacaagtgt

SEQ ID NO: 530577 - DNA, 20 bp, mouse
ggatgaccgcctgctgacag

SEQ ID NO: 530578 - DNA, 20 bp, mouse
gggagacagccactgtcagc

SEQ ID NO: 530579 - DNA, 20 bp, mouse
gaggcggtcatcaggtgaga

SEQ ID NO: 530580 - DNA, 20 bp, mouse
gggcaggcaagtgatgtaga

SEQ ID NO: 530581 - DNA, 20 bp, mouse
gtgatgtagagggtaagaga

SEQ ID NO: 530582 - DNA, 20 bp, mouse
gctctaaaagggaccttatg

SEQ ID NO: 530583 - DNA, 20 bp, mouse
gttatggggaaggcagttaa

SEQ ID NO: 530584 - DNA, 20 bp, mouse
gaaggcagttaagggagcct

SEQ ID NO: 530585 - DNA, 20 bp, mouse
gccaggtccattggagaaca

SEQ ID NO: 530586 - DNA, 20 bp, mouse
ggtggagccaggccaacatg

SEQ ID NO: 530587 - DNA, 20 bp, mouse
ggtactgacaggaccacaag

SEQ ID NO: 530588 - DNA, 20 bp, mouse
gatgagaaaaactctcagtg

SEQ ID NO: 530589 - DNA, 20 bp, mouse
ggatctgtgcggtggttctt

SEQ ID NO: 530590 - DNA, 20 bp, mouse
ggttggcctggctccacttg

SEQ ID NO: 530591 - DNA, 20 bp, mouse
gcaggaccacaagtggagcc

SEQ ID NO: 530592 - DNA, 20 bp, mouse
gagtacttggatctgtgcgg

SEQ ID NO: 530593 - DNA, 20 bp, mouse
gaaccacaaccagcagcagg

SEQ ID NO: 530594 - DNA, 20 bp, mouse
gacttgcctgtaggaactcg

SEQ ID NO: 530595 - DNA, 20 bp, mouse
gaggaggtgttggcctcatt

SEQ ID NO: 530596 - DNA, 20 bp, mouse
gactttgactggcatttatt

SEQ ID NO: 530597 - DNA, 20 bp, mouse
gctcttaataacactttgac

SEQ ID NO: 530598 - DNA, 20 bp, mouse
gtatgggaggaatgtctgta

SEQ ID NO: 530599 - DNA, 20 bp, mouse
gtctcccctaagcaacacaa

SEQ ID NO: 530600 - DNA, 20 bp, mouse
ggcaacacaatggataaact

SEQ ID NO: 530601 - DNA, 20 bp, mouse
ggtatggttacttagatgat

SEQ ID NO: 530602 - DNA, 20 bp, mouse
gcgtttggggactgctacat

SEQ ID NO: 530603 - DNA, 20 bp, mouse
gatactgagaagctgcgttt

SEQ ID NO: 530604 - DNA, 20 bp, mouse
gtgacagagcattggaaaaa

SEQ ID NO: 530605 - DNA, 20 bp, mouse
gagtatttagagaatgtgga

SEQ ID NO: 530606 - DNA, 20 bp, mouse
gcttatgggagatgttaaat

SEQ ID NO: 530607 - DNA, 20 bp, mouse
gccttgaagtggagattcca

SEQ ID NO: 530608 - DNA, 20 bp, mouse
gcatgtctgtagtgcatggt

SEQ ID NO: 530609 - DNA, 20 bp, mouse
gacatctcccataagaaaaa

SEQ ID NO: 530610 - DNA, 20 bp, mouse
gcttgctaagtcaaggagag

SEQ ID NO: 530611 - DNA, 20 bp, mouse
gataagaatactgtgagtca

SEQ ID NO: 530612 - DNA, 20 bp, mouse
gccatatgcttgctaagtca

SEQ ID NO: 530613 - DNA, 20 bp, mouse
ggaaacatgtctgtagtgca

SEQ ID NO: 530614 - DNA, 20 bp, mouse
gatactgtgagtcaaggtgc

SEQ ID NO: 530615 - DNA, 20 bp, mouse
ggttgagatgagagcagaat

SEQ ID NO: 530616 - DNA, 20 bp, mouse
gcttgcgcaagcggaagccc

SEQ ID NO: 530617 - DNA, 20 bp, mouse
gcagcgccatcggcactgaa

SEQ ID NO: 530618 - DNA, 20 bp, mouse
gtgagcatactcagcgccat

SEQ ID NO: 530619 - DNA, 20 bp, mouse
gacttgcgaaagataatgtt

SEQ ID NO: 530620 - DNA, 20 bp, mouse
ggtaaatgactatggatgta

SEQ ID NO: 530621 - DNA, 20 bp, mouse
gagacaccgttcagtgccga

SEQ ID NO: 530622 - DNA, 20 bp, mouse
gtgctggttctctacattgc

SEQ ID NO: 530623 - DNA, 20 bp, mouse
gtccactctgtttcttctca

SEQ ID NO: 530624 - DNA, 20 bp, mouse
gtgcttcttcagcgtcatgc

SEQ ID NO: 530625 - DNA, 20 bp, mouse
gccattgtgttctggctcct

SEQ ID NO: 530626 - DNA, 20 bp, mouse
gcagcgagccgggcgagtag

SEQ ID NO: 530627 - DNA, 20 bp, mouse
gggagctcagtgcctcatag

SEQ ID NO: 530628 - DNA, 20 bp, mouse
ggattcctcgtggccctgca

SEQ ID NO: 530629 - DNA, 20 bp, mouse
gcgaggatctgcagcgagcc

SEQ ID NO: 530630 - DNA, 20 bp, mouse
ggcctgtgcaggattcctcg

SEQ ID NO: 530631 - DNA, 20 bp, mouse
gcccaggaggcggaacgaga

SEQ ID NO: 530632 - DNA, 20 bp, mouse
ggccacgaggaatcctgcac

SEQ ID NO: 530633 - DNA, 20 bp, mouse
gcagctccacggccaggctg

SEQ ID NO: 530634 - DNA, 20 bp, mouse
gtcccgcacggtctcttcag

SEQ ID NO: 530635 - DNA, 20 bp, mouse
gtggcagctgcagctggtcg

SEQ ID NO: 530636 - DNA, 20 bp, mouse
ggcaatgcggcgactctgga

SEQ ID NO: 530637 - DNA, 20 bp, mouse
gccgagccaccgaggagaaa

SEQ ID NO: 530638 - DNA, 20 bp, mouse
gagccaccgaggagaaatgg

SEQ ID NO: 530639 - DNA, 20 bp, mouse
gctgtctgtcagtggagtct

SEQ ID NO: 530640 - DNA, 20 bp, mouse
gtgcggcgactctggacggt

SEQ ID NO: 530641 - DNA, 20 bp, mouse
gacgcctgggcctcaagaca

SEQ ID NO: 530642 - DNA, 20 bp, mouse
gggagaaatggcgggcaatc

SEQ ID NO: 530643 - DNA, 20 bp, mouse
gagccgggccacgcgccgac

SEQ ID NO: 530644 - DNA, 20 bp, mouse
gtggagcaatgcggcgactc

SEQ ID NO: 530645 - DNA, 20 bp, mouse
gacgaagtgtgggaggtcaa

SEQ ID NO: 530646 - DNA, 20 bp, mouse
gctatgcaatgaggagcctg

SEQ ID NO: 530647 - DNA, 20 bp, mouse
gggtccgagccgccttacct

SEQ ID NO: 530648 - DNA, 20 bp, mouse
gcatcaggatgagtgcagag

SEQ ID NO: 530649 - DNA, 20 bp, mouse
gttacctgggctatgcaatg

SEQ ID NO: 530650 - DNA, 20 bp, mouse
gggggaaagccagacgcccc

SEQ ID NO: 530651 - DNA, 20 bp, mouse
gctgcactcatcctgatgaa

SEQ ID NO: 530652 - DNA, 20 bp, mouse
gatgaggagcctggggcgtc

SEQ ID NO: 530653 - DNA, 20 bp, mouse
gcaggttgaacagaacaggt

SEQ ID NO: 530654 - DNA, 20 bp, mouse
ggctcctcattgcatagccc

SEQ ID NO: 530655 - DNA, 20 bp, mouse
gtagcccaggtaaggcggct

SEQ ID NO: 530656 - DNA, 20 bp, mouse
ggtgcatgagaccggacagg

SEQ ID NO: 530657 - DNA, 20 bp, mouse
gggacaggaggaataagtta

SEQ ID NO: 530658 - DNA, 20 bp, mouse
gaggatccgcgagtacgagg

SEQ ID NO: 530659 - DNA, 20 bp, mouse
gtcggcagtgtggtgcacaa

SEQ ID NO: 530660 - DNA, 20 bp, mouse
ggaggaataagttaaggggc

SEQ ID NO: 530661 - DNA, 20 bp, mouse
gtggtcctgggtccctcggg

SEQ ID NO: 530662 - DNA, 20 bp, mouse
gaagaaagtgtgcatgagac

SEQ ID NO: 530663 - DNA, 20 bp, mouse
gcagcagagaacagaaaagt

SEQ ID NO: 530664 - DNA, 20 bp, mouse
gagccaggtaaggtgacccg

SEQ ID NO: 530665 - DNA, 20 bp, mouse
gaggcggcacctcggcagtg

SEQ ID NO: 530666 - DNA, 20 bp, mouse
ggccccaagcgtctcagagt

SEQ ID NO: 530667 - DNA, 20 bp, mouse
gacgcttggggcatagaggg

SEQ ID NO: 530668 - DNA, 20 bp, mouse
gtgagacgcttggggcatag

SEQ ID NO: 530669 - DNA, 20 bp, mouse
gcggcggctcctcaggtaaa

SEQ ID NO: 530670 - DNA, 20 bp, mouse
ggcctactctgagacgcttg

SEQ ID NO: 530671 - DNA, 20 bp, mouse
gggcggcgcccgggccgtgg

SEQ ID NO: 530672 - DNA, 20 bp, mouse
gtcaggtaaacggcttgtta

SEQ ID NO: 530673 - DNA, 20 bp, mouse
gcggcccgctgaccttgggg

SEQ ID NO: 530674 - DNA, 20 bp, mouse
gtcagcgggccggtgccagg

SEQ ID NO: 530675 - DNA, 20 bp, mouse
gatgcgaagccgggcccgct

SEQ ID NO: 530676 - DNA, 20 bp, mouse
gagacactcggcctcctcca

SEQ ID NO: 530677 - DNA, 20 bp, mouse
gctcatgaggattaccatgg

SEQ ID NO: 530678 - DNA, 20 bp, mouse
gttcctcatgaggattacca

SEQ ID NO: 530679 - DNA, 20 bp, mouse
gaggaacaggactccttgca

SEQ ID NO: 530680 - DNA, 20 bp, mouse
gctggaggaggaagtatctg

SEQ ID NO: 530681 - DNA, 20 bp, mouse
gatgaggattaccatggagg

SEQ ID NO: 530682 - DNA, 20 bp, mouse
ggtctgggagataactgtga

SEQ ID NO: 530683 - DNA, 20 bp, mouse
ggaacagaagtccctctcag

SEQ ID NO: 530684 - DNA, 20 bp, mouse
gggactccttgcatggctgg

SEQ ID NO: 530685 - DNA, 20 bp, mouse
gtgaaacctccagccatgca

SEQ ID NO: 530686 - DNA, 20 bp, mouse
gttaagaatggtgtatgtat

SEQ ID NO: 530687 - DNA, 20 bp, mouse
gcaacatcaggccaggaaag

SEQ ID NO: 530688 - DNA, 20 bp, mouse
gtgaggtcagtcacacaaca

SEQ ID NO: 530689 - DNA, 20 bp, mouse
gtggtcttgatagttctatt

SEQ ID NO: 530690 - DNA, 20 bp, mouse
ggagaccagtatgtctgagg

SEQ ID NO: 530691 - DNA, 20 bp, mouse
ggtattggtggccactttcc

SEQ ID NO: 530692 - DNA, 20 bp, mouse
gtgacccatgagtttaagaa

SEQ ID NO: 530693 - DNA, 20 bp, mouse
ggctttaccaacatcaggcc

SEQ ID NO: 530694 - DNA, 20 bp, mouse
gtaaaagctttaccaacatc

SEQ ID NO: 530695 - DNA, 20 bp, mouse
gccagaatggaagaatacgg

SEQ ID NO: 530696 - DNA, 20 bp, mouse
ggaggtgactggtgaagggt

SEQ ID NO: 530697 - DNA, 20 bp, mouse
ggcagtggggacatcttcca

SEQ ID NO: 530698 - DNA, 20 bp, mouse
gacctctgtcaggaacacca

SEQ ID NO: 530699 - DNA, 20 bp, mouse
gcagatgccagcctgtccat

SEQ ID NO: 530700 - DNA, 20 bp, mouse
gcagggaagcaactgtgacc

SEQ ID NO: 530701 - DNA, 20 bp, mouse
gtgacagaggtgactggtga

SEQ ID NO: 530702 - DNA, 20 bp, mouse
gtgtgaccagggagctgctc

SEQ ID NO: 530703 - DNA, 20 bp, mouse
gcctggtctatctctgccca

SEQ ID NO: 530704 - DNA, 20 bp, mouse
ggccctggtgttcctgacag

SEQ ID NO: 530705 - DNA, 20 bp, mouse
gctgctctggaaggctccca

SEQ ID NO: 530706 - DNA, 20 bp, mouse
gagtgtgagactctgcatgt

SEQ ID NO: 530707 - DNA, 20 bp, mouse
gctggacatcccatgcacgt

SEQ ID NO: 530708 - DNA, 20 bp, mouse
gacttgcagaagcaattccg

SEQ ID NO: 530709 - DNA, 20 bp, mouse
ggttggccgtcaagtttcca

SEQ ID NO: 530710 - DNA, 20 bp, mouse
gggatgtccagaggtagcgg

SEQ ID NO: 530711 - DNA, 20 bp, mouse
gaggaagaggcagacgggtg

SEQ ID NO: 530712 - DNA, 20 bp, mouse
gacaggcggctaaaagtgtg

SEQ ID NO: 530713 - DNA, 20 bp, mouse
gcaattccgtggaaacttga

SEQ ID NO: 530714 - DNA, 20 bp, mouse
gatgggatgtccagaggtag

SEQ ID NO: 530715 - DNA, 20 bp, mouse
gaaccaggcaagaggtgatg

SEQ ID NO: 530716 - DNA, 20 bp, mouse
ggagacatggagggtacacg

SEQ ID NO: 530717 - DNA, 20 bp, mouse
ggggcctgaatcgtctggaa

SEQ ID NO: 530718 - DNA, 20 bp, mouse
ggggtgaagagagtgttgtc

SEQ ID NO: 530719 - DNA, 20 bp, mouse
gtgctgagaatcctgtggag

SEQ ID NO: 530720 - DNA, 20 bp, mouse
gtctaatgctgagaatcctg

SEQ ID NO: 530721 - DNA, 20 bp, mouse
gcctgaatcgtctggaaggg

SEQ ID NO: 530722 - DNA, 20 bp, mouse
ggcttggagcatatcatcca

SEQ ID NO: 530723 - DNA, 20 bp, mouse
gtctatgacaagagttggtg

SEQ ID NO: 530724 - DNA, 20 bp, mouse
gtctcccccaaggtgttctt

SEQ ID NO: 530725 - DNA, 20 bp, mouse
gaacaccttgggggagacac

SEQ ID NO: 530726 - DNA, 20 bp, mouse
gtccaaccagaagcccccaa

SEQ ID NO: 530727 - DNA, 20 bp, mouse
gctatccccaaggctcagtg

SEQ ID NO: 530728 - DNA, 20 bp, mouse
ggcttctggttggatttctt

SEQ ID NO: 530729 - DNA, 20 bp, mouse
ggacaggtctgtctttgagg

SEQ ID NO: 530730 - DNA, 20 bp, mouse
gcagagagtgccctcgactg

SEQ ID NO: 530731 - DNA, 20 bp, mouse
gcaatccccactgagccttg

SEQ ID NO: 530732 - DNA, 20 bp, mouse
gggcaggggacagactcgaa

SEQ ID NO: 530733 - DNA, 20 bp, mouse
gctttgagttactatcccca

SEQ ID NO: 530734 - DNA, 20 bp, mouse
gggaggggagacacacctag

SEQ ID NO: 530735 - DNA, 20 bp, mouse
gtagatggcaggatcctgag

SEQ ID NO: 530736 - DNA, 20 bp, mouse
ggcggccaggcgaacgggaa

SEQ ID NO: 530737 - DNA, 20 bp, mouse
gcccgcgggtcgtagaagag

SEQ ID NO: 530738 - DNA, 20 bp, mouse
gtcgtagaagagcggcccgg

SEQ ID NO: 530739 - DNA, 20 bp, mouse
gacgacccgcgggaccgcgc

SEQ ID NO: 530740 - DNA, 20 bp, mouse
ggtcgccgccgtagatgtcg

SEQ ID NO: 530741 - DNA, 20 bp, mouse
gtggccgccaggcccggacc

SEQ ID NO: 530742 - DNA, 20 bp, mouse
ggcttccccgacatctacgg

SEQ ID NO: 530743 - DNA, 20 bp, mouse
ggggtcgtagaagagcggcc

SEQ ID NO: 530744 - DNA, 20 bp, mouse
gcgggcgcgacagtcagcgg

SEQ ID NO: 530745 - DNA, 20 bp, mouse
ggaagcccgcgcggtcccgc

SEQ ID NO: 530746 - DNA, 20 bp, mouse
gcagctgttccaggtcttgg

SEQ ID NO: 530747 - DNA, 20 bp, mouse
gtgtgtcggcaggagatctg

SEQ ID NO: 530748 - DNA, 20 bp, mouse
gggtctcctccaagacatca

SEQ ID NO: 530749 - DNA, 20 bp, mouse
gaggtcttggtggcagtcat

SEQ ID NO: 530750 - DNA, 20 bp, mouse
gcatcggggaagggataggt

SEQ ID NO: 530751 - DNA, 20 bp, mouse
gtcggcatcggggaagggat

SEQ ID NO: 530752 - DNA, 20 bp, mouse
gggagtccttgatgtcttgg

SEQ ID NO: 530753 - DNA, 20 bp, mouse
ggagcacatgaccaagtcca

SEQ ID NO: 530754 - DNA, 20 bp, mouse
gccccaggcaactgactaaa

SEQ ID NO: 530755 - DNA, 20 bp, mouse
gcatcaagcaggtacccaag

SEQ ID NO: 530756 - DNA, 20 bp, mouse
ggccgctggtaggaacacta

SEQ ID NO: 530757 - DNA, 20 bp, mouse
ggccatagtgttcctaccag

SEQ ID NO: 530758 - DNA, 20 bp, mouse
gggtctggacacaacttcac

SEQ ID NO: 530759 - DNA, 20 bp, mouse
ggtaggaacactatggctgg

SEQ ID NO: 530760 - DNA, 20 bp, mouse
ggctagagctgtcagagtta

SEQ ID NO: 530761 - DNA, 20 bp, mouse
gggtggcaggtgccgctggt

SEQ ID NO: 530762 - DNA, 20 bp, mouse
gctgtagaagagggtcccac

SEQ ID NO: 530763 - DNA, 20 bp, mouse
gcacaacttcactggaagag

SEQ ID NO: 530764 - DNA, 20 bp, mouse
gaggctgggcctcaaaggca

SEQ ID NO: 530765 - DNA, 20 bp, mouse
gacctggtacggtctctcgg

SEQ ID NO: 530766 - DNA, 20 bp, mouse
gtgccttgtggaggccgtaa

SEQ ID NO: 530767 - DNA, 20 bp, mouse
gtgggacagtatcaagggta

SEQ ID NO: 530768 - DNA, 20 bp, mouse
gagcctttacggcctccaca

SEQ ID NO: 530769 - DNA, 20 bp, mouse
gggtagtaactgccttgtgg

SEQ ID NO: 530770 - DNA, 20 bp, mouse
gggttttgggacagtatcaa

SEQ ID NO: 530771 - DNA, 20 bp, mouse
gggagcccaggtaagcggaa

SEQ ID NO: 530772 - DNA, 20 bp, mouse
gctaggtagtaactgccttg

SEQ ID NO: 530773 - DNA, 20 bp, mouse
ggcccaggtaagcggaaggg

SEQ ID NO: 530774 - DNA, 20 bp, mouse
gagggtagggtcagccttta

SEQ ID NO: 530775 - DNA, 20 bp, mouse
gtccttccctgggtgagcag

SEQ ID NO: 530776 - DNA, 20 bp, mouse
gttcggggtcgagcgtgtgg

SEQ ID NO: 530777 - DNA, 20 bp, mouse
ggcggttcccctcccctacg

SEQ ID NO: 530778 - DNA, 20 bp, mouse
ggaagtgctggggacccgaa

SEQ ID NO: 530779 - DNA, 20 bp, mouse
gaggctagtgcggaccacac

SEQ ID NO: 530780 - DNA, 20 bp, mouse
gccctacggggcaggggcat

SEQ ID NO: 530781 - DNA, 20 bp, mouse
gtccggtgggacctgctcgg

SEQ ID NO: 530782 - DNA, 20 bp, mouse
ggctttcggggtcgagcgtg

SEQ ID NO: 530783 - DNA, 20 bp, mouse
gtgggacctgctcggaggaa

SEQ ID NO: 530784 - DNA, 20 bp, mouse
gctgcgagctggtgaagtgc

SEQ ID NO: 530785 - DNA, 20 bp, mouse
gatgggcacgggcgctttcg

SEQ ID NO: 530786 - DNA, 20 bp, mouse
ggcatttccaaggaattcca

SEQ ID NO: 530787 - DNA, 20 bp, mouse
gacaggtagcagcatttcca

SEQ ID NO: 530788 - DNA, 20 bp, mouse
gtggctgaaaactatccaaa

SEQ ID NO: 530789 - DNA, 20 bp, mouse
ggaaatgctgctacctgtca

SEQ ID NO: 530790 - DNA, 20 bp, mouse
gtctggatgctaggaatata

SEQ ID NO: 530791 - DNA, 20 bp, mouse
ggatctcaaataccagtcat

SEQ ID NO: 530792 - DNA, 20 bp, mouse
gaaaaaagcaggccatgagt

SEQ ID NO: 530793 - DNA, 20 bp, mouse
gcaatggcccagccaatgac

SEQ ID NO: 530794 - DNA, 20 bp, mouse
gctacagagaaattatagac

SEQ ID NO: 530795 - DNA, 20 bp, mouse
gtttcagccatggaattcct

SEQ ID NO: 530796 - DNA, 20 bp, mouse
gccgcgtcccccgaccgatg

SEQ ID NO: 530797 - DNA, 20 bp, mouse
ggcccgggacacgctcccct

SEQ ID NO: 530798 - DNA, 20 bp, mouse
ggcgccgccgcatcggtcgg

SEQ ID NO: 530799 - DNA, 20 bp, mouse
gcgtcccccgaccgatgcgg

SEQ ID NO: 530800 - DNA, 20 bp, mouse
gagcgcgccgccgcatcggt

SEQ ID NO: 530801 - DNA, 20 bp, mouse
gaagcagcgcgccgccgcat

SEQ ID NO: 530802 - DNA, 20 bp, mouse
ggccgaggggagcgtgtccc

SEQ ID NO: 530803 - DNA, 20 bp, mouse
gactacactgcaggatatgg

SEQ ID NO: 530804 - DNA, 20 bp, mouse
gcgctggacggcgaggacag

SEQ ID NO: 530805 - DNA, 20 bp, mouse
gggctgctgagagcgctgga

SEQ ID NO: 530806 - DNA, 20 bp, mouse
gccgtaaggtgcctccgtag

SEQ ID NO: 530807 - DNA, 20 bp, mouse
gtccggaacagtcaacatgg

SEQ ID NO: 530808 - DNA, 20 bp, mouse
ggctcctcttacctctacgg

SEQ ID NO: 530809 - DNA, 20 bp, mouse
ggtgcctccgtagaggtaag

SEQ ID NO: 530810 - DNA, 20 bp, mouse
gactgctcctcttacctcta

SEQ ID NO: 530811 - DNA, 20 bp, mouse
gcaatccggaacagtcaaca

SEQ ID NO: 530812 - DNA, 20 bp, mouse
gcaacatggcggcggccgta

SEQ ID NO: 530813 - DNA, 20 bp, mouse
gtccgctgcaacaggaaact

SEQ ID NO: 530814 - DNA, 20 bp, mouse
gggaacagtcaacatggcgg

SEQ ID NO: 530815 - DNA, 20 bp, mouse
gcggattgtgctgacgaagt

SEQ ID NO: 530816 - DNA, 20 bp, mouse
gccggggcgggagacctcca

SEQ ID NO: 530817 - DNA, 20 bp, mouse
ggggcgggagacctccacgg

SEQ ID NO: 530818 - DNA, 20 bp, mouse
gtggccgggatcctccgtgg

SEQ ID NO: 530819 - DNA, 20 bp, mouse
gcggtggccgggatcctccg

SEQ ID NO: 530820 - DNA, 20 bp, mouse
ggctgtggaagggatgtcac

SEQ ID NO: 530821 - DNA, 20 bp, mouse
gagacctccacggaggatcc

SEQ ID NO: 530822 - DNA, 20 bp, mouse
ggccccgggcgggtaaggag

SEQ ID NO: 530823 - DNA, 20 bp, mouse
gtgggaacttcctgtagcga

SEQ ID NO: 530824 - DNA, 20 bp, mouse
ggccactccttacccgcccg

SEQ ID NO: 530825 - DNA, 20 bp, mouse
ggtctccgcgcagcgcgcat

SEQ ID NO: 530826 - DNA, 20 bp, mouse
ggtagttctttgcttctccg

SEQ ID NO: 530827 - DNA, 20 bp, mouse
gaacccggcctgggagacgt

SEQ ID NO: 530828 - DNA, 20 bp, mouse
ggaagcaaagaactacgctc

SEQ ID NO: 530829 - DNA, 20 bp, mouse
gccaagatgggacctagtgg

SEQ ID NO: 530830 - DNA, 20 bp, mouse
gggcttcttgagggtccgag

SEQ ID NO: 530831 - DNA, 20 bp, mouse
gtcccatcttgggtcaggtg

SEQ ID NO: 530832 - DNA, 20 bp, mouse
gagcaggccaagctattcct

SEQ ID NO: 530833 - DNA, 20 bp, mouse
gggagagtgcgctggagccg

SEQ ID NO: 530834 - DNA, 20 bp, mouse
ggcacctctgacccccaagt

SEQ ID NO: 530835 - DNA, 20 bp, mouse
ggacccaagatgggacctag

SEQ ID NO: 530836 - DNA, 20 bp, mouse
gtccaagccgtggcccccac

SEQ ID NO: 530837 - DNA, 20 bp, mouse
gggagctatgctgccggtgg

SEQ ID NO: 530838 - DNA, 20 bp, mouse
gccacggcttggactccggg

SEQ ID NO: 530839 - DNA, 20 bp, mouse
gccgtggcccccacaggcag

SEQ ID NO: 530840 - DNA, 20 bp, mouse
gtgcggagctatgctgccgg

SEQ ID NO: 530841 - DNA, 20 bp, mouse
gcatagctccgcaagcggga

SEQ ID NO: 530842 - DNA, 20 bp, mouse
gggcagcggctagccgccac

SEQ ID NO: 530843 - DNA, 20 bp, mouse
gggtcacacgcggctctaag

SEQ ID NO: 530844 - DNA, 20 bp, mouse
gtctcagcggcgggaagctg

SEQ ID NO: 530845 - DNA, 20 bp, mouse
ggccttgccaggtaaagcgg

SEQ ID NO: 530846 - DNA, 20 bp, mouse
gagtaaaggacgccgcgggt

SEQ ID NO: 530847 - DNA, 20 bp, mouse
gaaacgcgcaaactcacctg

SEQ ID NO: 530848 - DNA, 20 bp, mouse
gcggggcgggtgcaaagtaa

SEQ ID NO: 530849 - DNA, 20 bp, mouse
gtggggcgccctagagaagc

SEQ ID NO: 530850 - DNA, 20 bp, mouse
gggacatgctctccgacccg

SEQ ID NO: 530851 - DNA, 20 bp, mouse
gaggcagactcacaaccctc

SEQ ID NO: 530852 - DNA, 20 bp, mouse
gtgcaaagtaaaggacgccg

SEQ ID NO: 530853 - DNA, 20 bp, mouse
gaacaaagatatcaagtggt

SEQ ID NO: 530854 - DNA, 20 bp, mouse
gggaacaaaagacacgaaag

SEQ ID NO: 530855 - DNA, 20 bp, mouse
gcgccggggaaccagcacca

SEQ ID NO: 530856 - DNA, 20 bp, mouse
gtccgtggcgggagattccc

SEQ ID NO: 530857 - DNA, 20 bp, mouse
ggccaagcgggggtccgtgg

SEQ ID NO: 530858 - DNA, 20 bp, mouse
ggcggggccttgccaagcgg

SEQ ID NO: 530859 - DNA, 20 bp, mouse
gcgtaccgcgttaacagcct

SEQ ID NO: 530860 - DNA, 20 bp, mouse
gtgttaacgcggtacggtgg

SEQ ID NO: 530861 - DNA, 20 bp, mouse
ggcctgggaatctcccgcca

SEQ ID NO: 530862 - DNA, 20 bp, mouse
ggattcccaggctgttaacg

SEQ ID NO: 530863 - DNA, 20 bp, mouse
gcttgccaagcgggggtccg

SEQ ID NO: 530864 - DNA, 20 bp, mouse
gcccgccacggacccccgct

SEQ ID NO: 530865 - DNA, 20 bp, mouse
ggtagagcctcggggaatgg

SEQ ID NO: 530866 - DNA, 20 bp, mouse
gcggccatgggatcccaaga

SEQ ID NO: 530867 - DNA, 20 bp, mouse
ggagccccaaagcccagtaa

SEQ ID NO: 530868 - DNA, 20 bp, mouse
gggagaagacactgtagcac

SEQ ID NO: 530869 - DNA, 20 bp, mouse
gtttctctgggggcctgtgt

SEQ ID NO: 530870 - DNA, 20 bp, mouse
gacagtgtcttctcccacac

SEQ ID NO: 530871 - DNA, 20 bp, mouse
ggatcctgtggtgactagga

SEQ ID NO: 530872 - DNA, 20 bp, mouse
gcagagaggcaggcttaccg

SEQ ID NO: 530873 - DNA, 20 bp, mouse
gcccaagacggcaaacctgc

SEQ ID NO: 530874 - DNA, 20 bp, mouse
gggctccgagcagctctcta

SEQ ID NO: 530875 - DNA, 20 bp, mouse
gcctctctggccggatcctg

SEQ ID NO: 530876 - DNA, 20 bp, mouse
gaagcaccgcgggtcatggc

SEQ ID NO: 530877 - DNA, 20 bp, mouse
gttcaagggcgcccaggaag

SEQ ID NO: 530878 - DNA, 20 bp, mouse
gccgtgccagccatgacccg

SEQ ID NO: 530879 - DNA, 20 bp, mouse
gatgacccgcggtgcttcaa

SEQ ID NO: 530880 - DNA, 20 bp, mouse
gaggcggagggtacacactc

SEQ ID NO: 530881 - DNA, 20 bp, mouse
ggggcgcccttgaagcaccg

SEQ ID NO: 530882 - DNA, 20 bp, mouse
gacactgggcgcacgcggaa

SEQ ID NO: 530883 - DNA, 20 bp, mouse
gtcatggctggcacggcgcg

SEQ ID NO: 530884 - DNA, 20 bp, mouse
ggaccgcagcaggtccaggc

SEQ ID NO: 530885 - DNA, 20 bp, mouse
ggcggagccgtaaagcaacg

SEQ ID NO: 530886 - DNA, 20 bp, mouse
gcggcccgcggacacaagac

SEQ ID NO: 530887 - DNA, 20 bp, mouse
ggccggcaaagctctgaact

SEQ ID NO: 530888 - DNA, 20 bp, mouse
gcacacgcgtggccatgtgg

SEQ ID NO: 530889 - DNA, 20 bp, mouse
gacgcgtgtgctgccgggtc

SEQ ID NO: 530890 - DNA, 20 bp, mouse
gtttctctcaactacaacag

SEQ ID NO: 530891 - DNA, 20 bp, mouse
gccaggcctccgcatagtgg

SEQ ID NO: 530892 - DNA, 20 bp, mouse
ggaggtgtctagaagcacgg

SEQ ID NO: 530893 - DNA, 20 bp, mouse
gagtggaggtggaagaagta

SEQ ID NO: 530894 - DNA, 20 bp, mouse
gtggccacgcgtgtgctgcc

SEQ ID NO: 530895 - DNA, 20 bp, mouse
gcagcacacgcgtggccatg

SEQ ID NO: 530896 - DNA, 20 bp, mouse
gacgcggccgtgggagatag

SEQ ID NO: 530897 - DNA, 20 bp, mouse
gtggctgccgctatctccca

SEQ ID NO: 530898 - DNA, 20 bp, mouse
gacgctgggagaactttcca

SEQ ID NO: 530899 - DNA, 20 bp, mouse
ggcccaggcggcggtagacg

SEQ ID NO: 530900 - DNA, 20 bp, mouse
gccacacacggccagagcgg

SEQ ID NO: 530901 - DNA, 20 bp, mouse
gcacgcgcggacgagatgag

SEQ ID NO: 530902 - DNA, 20 bp, mouse
gtccccacacacggccagag

SEQ ID NO: 530903 - DNA, 20 bp, mouse
gggtctgaggctggacccgg

SEQ ID NO: 530904 - DNA, 20 bp, mouse
ggaacgcatcgaggcgacat

SEQ ID NO: 530905 - DNA, 20 bp, mouse
gacggtagcgaattcccgtg

SEQ ID NO: 530906 - DNA, 20 bp, mouse
ggctttacccacagttaaca

SEQ ID NO: 530907 - DNA, 20 bp, mouse
ggccatggctgacgggacct

SEQ ID NO: 530908 - DNA, 20 bp, mouse
gactgtgggtaaagctacaa

SEQ ID NO: 530909 - DNA, 20 bp, mouse
ggtcgcagccatgttaactg

SEQ ID NO: 530910 - DNA, 20 bp, mouse
gcagcccgacgtggagagta

SEQ ID NO: 530911 - DNA, 20 bp, mouse
gacaagggccggcagtacct

SEQ ID NO: 530912 - DNA, 20 bp, mouse
gccggccgtgcagcccgacg

SEQ ID NO: 530913 - DNA, 20 bp, mouse
gccgggtccttgagacaccg

SEQ ID NO: 530914 - DNA, 20 bp, mouse
gtacctggcaggatcagtca

SEQ ID NO: 530915 - DNA, 20 bp, mouse
ggagagtaaggaaaacgaag

SEQ ID NO: 530916 - DNA, 20 bp, mouse
gacgctccgggccaggtaca

SEQ ID NO: 530917 - DNA, 20 bp, mouse
gcggaagacgagagaaggtg

SEQ ID NO: 530918 - DNA, 20 bp, mouse
gttcattgagggtgtagaca

SEQ ID NO: 530919 - DNA, 20 bp, mouse
gctccatggcagaaagttgt

SEQ ID NO: 530920 - DNA, 20 bp, mouse
gattgagggtgtagacatgg

SEQ ID NO: 530921 - DNA, 20 bp, mouse
gatgcgaaggcagcaagccg

SEQ ID NO: 530922 - DNA, 20 bp, mouse
gagtcccggaagacgagaga

SEQ ID NO: 530923 - DNA, 20 bp, mouse
gtctttcgtgatctagagag

SEQ ID NO: 530924 - DNA, 20 bp, mouse
gaagacgagagaaggtgagg

SEQ ID NO: 530925 - DNA, 20 bp, mouse
gctggcccggagcgtccgaa

SEQ ID NO: 530926 - DNA, 20 bp, mouse
gggtaaaagcgagcacggcg

SEQ ID NO: 530927 - DNA, 20 bp, mouse
gagcgccaggctctggatga

SEQ ID NO: 530928 - DNA, 20 bp, mouse
gagcacggcgcggaggagcc

SEQ ID NO: 530929 - DNA, 20 bp, mouse
gatcccagagcgccaggctc

SEQ ID NO: 530930 - DNA, 20 bp, mouse
ggtcagcgcacacagcgcca

SEQ ID NO: 530931 - DNA, 20 bp, mouse
gatgaaggtaaaagcgagca

SEQ ID NO: 530932 - DNA, 20 bp, mouse
gaaaagcgagcacggcgcgg

SEQ ID NO: 530933 - DNA, 20 bp, mouse
gcggcgcggaggagcccggc

SEQ ID NO: 530934 - DNA, 20 bp, mouse
ggtcggaacccgggcggtaa

SEQ ID NO: 530935 - DNA, 20 bp, mouse
gcgggattgacggagaacga

SEQ ID NO: 530936 - DNA, 20 bp, mouse
gccgccaatagcgatcggtg

SEQ ID NO: 530937 - DNA, 20 bp, mouse
gcagccagagccgcgtcgtg

SEQ ID NO: 530938 - DNA, 20 bp, mouse
ggcgcttctggcagccggtc

SEQ ID NO: 530939 - DNA, 20 bp, mouse
gcatggtcttcctcacgacg

SEQ ID NO: 530940 - DNA, 20 bp, mouse
gtgggctcccgaagcccgac

SEQ ID NO: 530941 - DNA, 20 bp, mouse
gccaatagcgatcggtgagg

SEQ ID NO: 530942 - DNA, 20 bp, mouse
ggcctgtctgaccgttgacc

SEQ ID NO: 530943 - DNA, 20 bp, mouse
gagaagcgcttccgggtcaa

SEQ ID NO: 530944 - DNA, 20 bp, mouse
gtgctaccgcctggccgtca

SEQ ID NO: 530945 - DNA, 20 bp, mouse
gcttcctcacgacgcggctc

SEQ ID NO: 530946 - DNA, 20 bp, mouse
gggcaatgccgaggccgcta

SEQ ID NO: 530947 - DNA, 20 bp, mouse
gacagacaccagccgcccga

SEQ ID NO: 530948 - DNA, 20 bp, mouse
gggttgggactgtggaaaca

SEQ ID NO: 530949 - DNA, 20 bp, mouse
gaacatggctgctgccatag

SEQ ID NO: 530950 - DNA, 20 bp, mouse
gacacacgggcggcagacgg

SEQ ID NO: 530951 - DNA, 20 bp, mouse
gccacagtcccaaccggaag

SEQ ID NO: 530952 - DNA, 20 bp, mouse
gggatcaggtgagaccaggg

SEQ ID NO: 530953 - DNA, 20 bp, mouse
ggctgcttccgcttccggtt

SEQ ID NO: 530954 - DNA, 20 bp, mouse
gtccggatcaggtgagacca

SEQ ID NO: 530955 - DNA, 20 bp, mouse
gcatcccagggatccggatc

SEQ ID NO: 530956 - DNA, 20 bp, mouse
gctactgcgagagttgggta

SEQ ID NO: 530957 - DNA, 20 bp, mouse
ggatcccggaggcttccgta

SEQ ID NO: 530958 - DNA, 20 bp, mouse
ggccgcactactgcgagagt

SEQ ID NO: 530959 - DNA, 20 bp, mouse
gcccaactctcgcagtagtg

SEQ ID NO: 530960 - DNA, 20 bp, mouse
gcaccgagaggagcccccgg

SEQ ID NO: 530961 - DNA, 20 bp, mouse
gagccggcgtttgatcccgg

SEQ ID NO: 530962 - DNA, 20 bp, mouse
ggcagcctgcaagatcttcg

SEQ ID NO: 530963 - DNA, 20 bp, mouse
gtctttcttagaatttggga

SEQ ID NO: 530964 - DNA, 20 bp, mouse
ggtgcctacggaatagggag

SEQ ID NO: 530965 - DNA, 20 bp, mouse
gagcctccgggatcaaacgc

SEQ ID NO: 530966 - DNA, 20 bp, mouse
gtaagcagcccaggtcgggt

SEQ ID NO: 530967 - DNA, 20 bp, mouse
gccttcctgaccaggaggtg

SEQ ID NO: 530968 - DNA, 20 bp, mouse
gccccgcacccacccgacct

SEQ ID NO: 530969 - DNA, 20 bp, mouse
gctgctttggcagacagcca

SEQ ID NO: 530970 - DNA, 20 bp, mouse
gaagtcgtgacccgcggaac

SEQ ID NO: 530971 - DNA, 20 bp, mouse
gtgcaggcaacggccaatcc

SEQ ID NO: 530972 - DNA, 20 bp, mouse
gctagggccacccaaccagt

SEQ ID NO: 530973 - DNA, 20 bp, mouse
gtcgctccttcctgaccagg

SEQ ID NO: 530974 - DNA, 20 bp, mouse
gtgagtaaagtcgtgacccg

SEQ ID NO: 530975 - DNA, 20 bp, mouse
gggcccgggccggaagccgg

SEQ ID NO: 530976 - DNA, 20 bp, mouse
ggacgctgggaggctcgctt

SEQ ID NO: 530977 - DNA, 20 bp, mouse
gactcagcgacggggaaggt

SEQ ID NO: 530978 - DNA, 20 bp, mouse
gctagcaaaagaggagccca

SEQ ID NO: 530979 - DNA, 20 bp, mouse
gcggaaggtggataagcgaa

SEQ ID NO: 530980 - DNA, 20 bp, mouse
gactagagttcccagacgct

SEQ ID NO: 530981 - DNA, 20 bp, mouse
ggtgaggctactcagcgacg

SEQ ID NO: 530982 - DNA, 20 bp, mouse
gggctactcagcgacgggga

SEQ ID NO: 530983 - DNA, 20 bp, mouse
ggatgctgcatgctaagaga

SEQ ID NO: 530984 - DNA, 20 bp, mouse
ggacggggaaggtcggaagg

SEQ ID NO: 530985 - DNA, 20 bp, mouse
gatgtagtcaaattgcggaa

SEQ ID NO: 530986 - DNA, 20 bp, mouse
ggatccacataaacccagag

SEQ ID NO: 530987 - DNA, 20 bp, mouse
gtagtcttcttcaaatccgg

SEQ ID NO: 530988 - DNA, 20 bp, mouse
gacttagtcttcttcaaatc

SEQ ID NO: 530989 - DNA, 20 bp, mouse
gttctggagtaactatccaa

SEQ ID NO: 530990 - DNA, 20 bp, mouse
ggtgcagaatgaaagcccgt

SEQ ID NO: 530991 - DNA, 20 bp, mouse
gcatgaccaacgcttaggtc

SEQ ID NO: 530992 - DNA, 20 bp, mouse
gggcggtgcttgcggagggt

SEQ ID NO: 530993 - DNA, 20 bp, mouse
gtgaggagccaattaagagg

SEQ ID NO: 530994 - DNA, 20 bp, mouse
gcagagtaccagcataaaca

SEQ ID NO: 530995 - DNA, 20 bp, mouse
gagacggcaaactacacagt

SEQ ID NO: 530996 - DNA, 20 bp, mouse
ggcgctctcctagaagtaga

SEQ ID NO: 530997 - DNA, 20 bp, mouse
gcgcgcgaccctctacttct

SEQ ID NO: 530998 - DNA, 20 bp, mouse
ggcacaggatacctgtgcag

SEQ ID NO: 530999 - DNA, 20 bp, mouse
gcccagcagggactgtgggg

SEQ ID NO: 531000 - DNA, 20 bp, mouse
gcaagatcaaccccaagaat

SEQ ID NO: 531001 - DNA, 20 bp, mouse
gactctggagggtagtgaac

SEQ ID NO: 531002 - DNA, 20 bp, mouse
gtccagtgagcgcaagaagt

SEQ ID NO: 531003 - DNA, 20 bp, mouse
gtcgcgcgatgccgctgcac

SEQ ID NO: 531004 - DNA, 20 bp, mouse
ggagggtagtgaactggaat

SEQ ID NO: 531005 - DNA, 20 bp, mouse
ggtgagcgcaagaagtgggc

SEQ ID NO: 531006 - DNA, 20 bp, mouse
gggcctactacgaactcctg

SEQ ID NO: 531007 - DNA, 20 bp, mouse
gaaccccaggagttcgtagt

SEQ ID NO: 531008 - DNA, 20 bp, mouse
gcctccgcggagggcattgg

SEQ ID NO: 531009 - DNA, 20 bp, mouse
ggagggcattggcggacaaa

SEQ ID NO: 531010 - DNA, 20 bp, mouse
gtgtccgccaatgccctccg

SEQ ID NO: 531011 - DNA, 20 bp, mouse
gtttcctccgcggagggcat

SEQ ID NO: 531012 - DNA, 20 bp, mouse
gttagagagaaggtgggtat

SEQ ID NO: 531013 - DNA, 20 bp, mouse
ggctgtggcgccagaggcct

SEQ ID NO: 531014 - DNA, 20 bp, mouse
ggaactcctggggtttgggt

SEQ ID NO: 531015 - DNA, 20 bp, mouse
gacggcgtgactgctgtccc

SEQ ID NO: 531016 - DNA, 20 bp, mouse
gctcccacgaccgcactcac

SEQ ID NO: 531017 - DNA, 20 bp, mouse
ggtgcggtcgtgggagctag

SEQ ID NO: 531018 - DNA, 20 bp, mouse
gcgccggtgagtgcggtcgt

SEQ ID NO: 531019 - DNA, 20 bp, mouse
gtcctctccttccggctgcg

SEQ ID NO: 531020 - DNA, 20 bp, mouse
gtagtaggcagccgtcataa

SEQ ID NO: 531021 - DNA, 20 bp, mouse
ggtctcactcgtgtagatct

SEQ ID NO: 531022 - DNA, 20 bp, mouse
gggctgagaggccgttatga

SEQ ID NO: 531023 - DNA, 20 bp, mouse
gtcgaattcccaggacgtaa

SEQ ID NO: 531024 - DNA, 20 bp, mouse
gagatcaagaaataggtctg

SEQ ID NO: 531025 - DNA, 20 bp, mouse
gctcgaataaagtgacaacc

SEQ ID NO: 531026 - DNA, 20 bp, mouse
gctctgtcttgagaagatca

SEQ ID NO: 531027 - DNA, 20 bp, mouse
gagcacctctggagcggtcc

SEQ ID NO: 531028 - DNA, 20 bp, mouse
gggagcggtccgggacgcac

SEQ ID NO: 531029 - DNA, 20 bp, mouse
ggagttcgtggaaagagggt

SEQ ID NO: 531030 - DNA, 20 bp, mouse
gctccttacggaccccacgg

SEQ ID NO: 531031 - DNA, 20 bp, mouse
gtccgtaaggagagagttcg

SEQ ID NO: 531032 - DNA, 20 bp, mouse
ggtggaaagagggttggtga

SEQ ID NO: 531033 - DNA, 20 bp, mouse
gctcaagacagagcgggacg

SEQ ID NO: 531034 - DNA, 20 bp, mouse
gtctctccttacggacccca

SEQ ID NO: 531035 - DNA, 20 bp, mouse
gcaaaaaccacgctacaacc

SEQ ID NO: 531036 - DNA, 20 bp, mouse
gggcgggtctcggtgagaat

SEQ ID NO: 531037 - DNA, 20 bp, mouse
ggtaagtcggtctgaggcgg

SEQ ID NO: 531038 - DNA, 20 bp, mouse
gcttgtaagtcggtctgagg

SEQ ID NO: 531039 - DNA, 20 bp, mouse
gacccctgcagagggcgacg

SEQ ID NO: 531040 - DNA, 20 bp, mouse
gtccgggtctggtgagaagg

SEQ ID NO: 531041 - DNA, 20 bp, mouse
gcagcggggtaataccacag

SEQ ID NO: 531042 - DNA, 20 bp, mouse
gcccgaggtggagcccggag

SEQ ID NO: 531043 - DNA, 20 bp, mouse
gtctcttgtaagtcggtctg

SEQ ID NO: 531044 - DNA, 20 bp, mouse
gctgcggcgtggagccgagg

SEQ ID NO: 531045 - DNA, 20 bp, mouse
gagctcaacgactacttccg

SEQ ID NO: 531046 - DNA, 20 bp, mouse
gctaggaaagccatatccag

SEQ ID NO: 531047 - DNA, 20 bp, mouse
gggcctggcacccaaagcac

SEQ ID NO: 531048 - DNA, 20 bp, mouse
ggagcccagagtgtaggaac

SEQ ID NO: 531049 - DNA, 20 bp, mouse
gcagcggcgggtcaatggtc

SEQ ID NO: 531050 - DNA, 20 bp, mouse
ggatcggtggccctattgag

SEQ ID NO: 531051 - DNA, 20 bp, mouse
gatatccagcggcgggtcaa

SEQ ID NO: 531052 - DNA, 20 bp, mouse
gggaaagccatatccagcgg

SEQ ID NO: 531053 - DNA, 20 bp, mouse
ggagatacctgtgggaccag

SEQ ID NO: 531054 - DNA, 20 bp, mouse
ggcacccaaagcaccgggct

SEQ ID NO: 531055 - DNA, 20 bp, mouse
gtggcattgacccggacgac

SEQ ID NO: 531056 - DNA, 20 bp, mouse
gtaggcaggctgcaagatgg

SEQ ID NO: 531057 - DNA, 20 bp, mouse
gtgacctgaggcagctctca

SEQ ID NO: 531058 - DNA, 20 bp, mouse
gagtccactgcggccaccgt

SEQ ID NO: 531059 - DNA, 20 bp, mouse
gtggcggcttccatcttcac

SEQ ID NO: 531060 - DNA, 20 bp, mouse
gccgtaggcaggctgcaaga

SEQ ID NO: 531061 - DNA, 20 bp, mouse
gcccgagactgaggtagagg

SEQ ID NO: 531062 - DNA, 20 bp, mouse
gctcacggcgcccgtgaaga

SEQ ID NO: 531063 - DNA, 20 bp, mouse
ggtctcgggtgtgcttccta

SEQ ID NO: 531064 - DNA, 20 bp, mouse
ggcgccgtgagagctgcctc

SEQ ID NO: 531065 - DNA, 20 bp, mouse
ggcttcactgagaagagggt

SEQ ID NO: 531066 - DNA, 20 bp, mouse
gcggcgcccgaagttgatta

SEQ ID NO: 531067 - DNA, 20 bp, mouse
gtaggggagggcctagggac

SEQ ID NO: 531068 - DNA, 20 bp, mouse
gttaaggacttctccgccgg

SEQ ID NO: 531069 - DNA, 20 bp, mouse
ggaagtccttaatcaacttc

SEQ ID NO: 531070 - DNA, 20 bp, mouse
ggcctgggcacatggagacg

SEQ ID NO: 531071 - DNA, 20 bp, mouse
ggccggtggcaccccttccc

SEQ ID NO: 531072 - DNA, 20 bp, mouse
gacgcggaagcttcgctaac

SEQ ID NO: 531073 - DNA, 20 bp, mouse
gggcaccccttcccaggtgt

SEQ ID NO: 531074 - DNA, 20 bp, mouse
ggagaagccgcagattccgg

SEQ ID NO: 531075 - DNA, 20 bp, mouse
gcgcgtctgcgcagtggagt

SEQ ID NO: 531076 - DNA, 20 bp, mouse
gcctgcacgggcaaagatgg

SEQ ID NO: 531077 - DNA, 20 bp, mouse
ggatggcggcgtccaggtag

SEQ ID NO: 531078 - DNA, 20 bp, mouse
ggtccctgcacgggcaaaga

SEQ ID NO: 531079 - DNA, 20 bp, mouse
gacagggtgtacgagatccc

SEQ ID NO: 531080 - DNA, 20 bp, mouse
ggagcctcgccccctggaca

SEQ ID NO: 531081 - DNA, 20 bp, mouse
gtggagcccattacctacga

SEQ ID NO: 531082 - DNA, 20 bp, mouse
ggtgtacgagatccccggtc

SEQ ID NO: 531083 - DNA, 20 bp, mouse
gtgtagaaacggagtcggta

SEQ ID NO: 531084 - DNA, 20 bp, mouse
gagcgttgccgactcctgga

SEQ ID NO: 531085 - DNA, 20 bp, mouse
ggatcggcctcgccagccac

SEQ ID NO: 531086 - DNA, 20 bp, mouse
gaaaacgccgcacgccacca

SEQ ID NO: 531087 - DNA, 20 bp, mouse
gaaggctgcgggcacagaca

SEQ ID NO: 531088 - DNA, 20 bp, mouse
gcgacgtgagcaacctggag

SEQ ID NO: 531089 - DNA, 20 bp, mouse
gggtcgccaaagacgcccgt

SEQ ID NO: 531090 - DNA, 20 bp, mouse
gacccgaggtgctgaagccc

SEQ ID NO: 531091 - DNA, 20 bp, mouse
gaaagatggcggcgccctgg

SEQ ID NO: 531092 - DNA, 20 bp, mouse
gggtgtccggcggctgagga

SEQ ID NO: 531093 - DNA, 20 bp, mouse
gcccgagcgggggtgtccgg

SEQ ID NO: 531094 - DNA, 20 bp, mouse
ggaagtaccggagcttcgag

SEQ ID NO: 531095 - DNA, 20 bp, mouse
gggcgtctttggcgacctgg

SEQ ID NO: 531096 - DNA, 20 bp, mouse
gcgggaagccatggctaccg

SEQ ID NO: 531097 - DNA, 20 bp, mouse
gcatggctaccgcggtggga

SEQ ID NO: 531098 - DNA, 20 bp, mouse
gtggcttcccgaagtagcca

SEQ ID NO: 531099 - DNA, 20 bp, mouse
ggaagccatggctaccgcgg

SEQ ID NO: 531100 - DNA, 20 bp, mouse
gagaaccagccttcccaccg

SEQ ID NO: 531101 - DNA, 20 bp, mouse
gccgggacgccgagctacct

SEQ ID NO: 531102 - DNA, 20 bp, mouse
ggccaagggtgagccatcca

SEQ ID NO: 531103 - DNA, 20 bp, mouse
ggagctaccttggctacttc

SEQ ID NO: 531104 - DNA, 20 bp, mouse
ggggaaggctggttcttcgg

SEQ ID NO: 531105 - DNA, 20 bp, mouse
gcgccgggtacaactctaga

SEQ ID NO: 531106 - DNA, 20 bp, mouse
ggaggtcctccgagatgctg

SEQ ID NO: 531107 - DNA, 20 bp, mouse
gcgaagcgaggcccgggaag

SEQ ID NO: 531108 - DNA, 20 bp, mouse
ggagagtcgaagcgaggccc

SEQ ID NO: 531109 - DNA, 20 bp, mouse
gaacaaccgcagcatctcgg

SEQ ID NO: 531110 - DNA, 20 bp, mouse
gtggaacaaccgcagcatct

SEQ ID NO: 531111 - DNA, 20 bp, mouse
gcgccgaggtcgctgcggta

SEQ ID NO: 531112 - DNA, 20 bp, mouse
gactctctggctcccgggta

SEQ ID NO: 531113 - DNA, 20 bp, mouse
gaggacctctcgcagcgccg

SEQ ID NO: 531114 - DNA, 20 bp, mouse
ggtccgtaccgcagcgacct

SEQ ID NO: 531115 - DNA, 20 bp, mouse
gcgcagcgccgaggtcgctg

SEQ ID NO: 531116 - DNA, 20 bp, mouse
ggaagctgcccgccagcggg

SEQ ID NO: 531117 - DNA, 20 bp, mouse
gcgggtggcgtgaaaaacta

SEQ ID NO: 531118 - DNA, 20 bp, mouse
ggcagcacacagcatcaccc

SEQ ID NO: 531119 - DNA, 20 bp, mouse
gctcaggtcggaccgcccag

SEQ ID NO: 531120 - DNA, 20 bp, mouse
gaggcctgccagacccgacc

SEQ ID NO: 531121 - DNA, 20 bp, mouse
gtgaaaaactatggctaccg

SEQ ID NO: 531122 - DNA, 20 bp, mouse
ggtgtgctgcgcgggctctg

SEQ ID NO: 531123 - DNA, 20 bp, mouse
gccgggagcacgcccctggg

SEQ ID NO: 531124 - DNA, 20 bp, mouse
gccgaccgggtacctcaggt

SEQ ID NO: 531125 - DNA, 20 bp, mouse
gctgggtattctgccacccg

SEQ ID NO: 531126 - DNA, 20 bp, mouse
gtgaccggtcactccttcca

SEQ ID NO: 531127 - DNA, 20 bp, mouse
ggtgccttggaaggagtgac

SEQ ID NO: 531128 - DNA, 20 bp, mouse
ggaaggagtgaccggtcagg

SEQ ID NO: 531129 - DNA, 20 bp, mouse
gtctagagctcggcccgcaa

SEQ ID NO: 531130 - DNA, 20 bp, mouse
gtcggcccgcaagggagaaa

SEQ ID NO: 531131 - DNA, 20 bp, mouse
gagccacgggcgcagaggac

SEQ ID NO: 531132 - DNA, 20 bp, mouse
gcgcaccaggccttgagtca

SEQ ID NO: 531133 - DNA, 20 bp, mouse
gcgaagatacgagaagccac

SEQ ID NO: 531134 - DNA, 20 bp, mouse
ggtttaaaacaccgcctgac

SEQ ID NO: 531135 - DNA, 20 bp, mouse
gcgagaagccacgggcgcag

SEQ ID NO: 531136 - DNA, 20 bp, mouse
gttccgggcctgtaaggaga

SEQ ID NO: 531137 - DNA, 20 bp, mouse
ggagggcagcggtacctcca

SEQ ID NO: 531138 - DNA, 20 bp, mouse
ggcgcggtgagtagccgtgg

SEQ ID NO: 531139 - DNA, 20 bp, mouse
gagcgcgcggtgagtagccg

SEQ ID NO: 531140 - DNA, 20 bp, mouse
gccgaggtgtgctacaggaa

SEQ ID NO: 531141 - DNA, 20 bp, mouse
gcaagccttccgggcctgta

SEQ ID NO: 531142 - DNA, 20 bp, mouse
ggcccggaaggcttgtccgt

SEQ ID NO: 531143 - DNA, 20 bp, mouse
ggcgtatagcgcgcgctgga

SEQ ID NO: 531144 - DNA, 20 bp, mouse
gaggagtcgcaaggtcaact

SEQ ID NO: 531145 - DNA, 20 bp, mouse
ggcttcaatctgggtcctaa

SEQ ID NO: 531146 - DNA, 20 bp, mouse
ggaagtcccgcgaccggtca

SEQ ID NO: 531147 - DNA, 20 bp, mouse
gctctaaccgtagccatgac

SEQ ID NO: 531148 - DNA, 20 bp, mouse
gccgcgaccggtcatggcta

SEQ ID NO: 531149 - DNA, 20 bp, mouse
ggacccggcgaaggtgagta

SEQ ID NO: 531150 - DNA, 20 bp, mouse
gcggttagagagccaggacg

SEQ ID NO: 531151 - DNA, 20 bp, mouse
ggaccagcgtcctccataat

SEQ ID NO: 531152 - DNA, 20 bp, mouse
gcggctcgaagtcccgcgac

SEQ ID NO: 531153 - DNA, 20 bp, mouse
gccccggaaccggaagtcac

SEQ ID NO: 531154 - DNA, 20 bp, mouse
gagcccattatggaggacgc

SEQ ID NO: 531155 - DNA, 20 bp, mouse
gccggcgaaggtgagtacgg

SEQ ID NO: 531156 - DNA, 20 bp, mouse
ggacggccggagccaatagg

SEQ ID NO: 531157 - DNA, 20 bp, mouse
ggcaagaacaaggcaatagg

SEQ ID NO: 531158 - DNA, 20 bp, mouse
gagggccctgctgcagcaac

SEQ ID NO: 531159 - DNA, 20 bp, mouse
gaaccggaggagccagcgtg

SEQ ID NO: 531160 - DNA, 20 bp, mouse
gagaagccatggcaagaaca

SEQ ID NO: 531161 - DNA, 20 bp, mouse
ggacggtaggcgtctcggga

SEQ ID NO: 531162 - DNA, 20 bp, mouse
gagaacaaggcaataggagg

SEQ ID NO: 531163 - DNA, 20 bp, mouse
gcagggccctcgccgcctat

SEQ ID NO: 531164 - DNA, 20 bp, mouse
gaccaggctgcaggcaactg

SEQ ID NO: 531165 - DNA, 20 bp, mouse
gggggacggccggagccaat

SEQ ID NO: 531166 - DNA, 20 bp, mouse
ggatggtggtctcggcaggt

SEQ ID NO: 531167 - DNA, 20 bp, mouse
gtagagagacttgtctagag

SEQ ID NO: 531168 - DNA, 20 bp, mouse
ggatcaccgagccggagaaa

SEQ ID NO: 531169 - DNA, 20 bp, mouse
ggccctctgcgccttttctc

SEQ ID NO: 531170 - DNA, 20 bp, mouse
ggccggagaaaaggcgcaga

SEQ ID NO: 531171 - DNA, 20 bp, mouse
gatacgagtcagacttcatc

SEQ ID NO: 531172 - DNA, 20 bp, mouse
gaagaggaggatagagtaga

SEQ ID NO: 531173 - DNA, 20 bp, mouse
gctgtgggcgttgctgagtt

SEQ ID NO: 531174 - DNA, 20 bp, mouse
gttacgttaattctagtctt

SEQ ID NO: 531175 - DNA, 20 bp, mouse
ggaggggaataatcatgctg

SEQ ID NO: 531176 - DNA, 20 bp, mouse
gaaagatggcggcgcccgta

SEQ ID NO: 531177 - DNA, 20 bp, mouse
ggggcgccgcggtaccttgt

SEQ ID NO: 531178 - DNA, 20 bp, mouse
gcgtagggcgtactctttta

SEQ ID NO: 531179 - DNA, 20 bp, mouse
gtttagggctggctagaggc

SEQ ID NO: 531180 - DNA, 20 bp, mouse
gcggccaccgctgatcacca

SEQ ID NO: 531181 - DNA, 20 bp, mouse
gaggctggcggcagcttgac

SEQ ID NO: 531182 - DNA, 20 bp, mouse
gtgagcgccttggtgatcag

SEQ ID NO: 531183 - DNA, 20 bp, mouse
ggggtctattacagcaggta

SEQ ID NO: 531184 - DNA, 20 bp, mouse
gtctgggcaggtagttctcg

SEQ ID NO: 531185 - DNA, 20 bp, mouse
ggggcgtactcttttagggc

SEQ ID NO: 531186 - DNA, 20 bp, mouse
gtcgtggacaccgacactgt

SEQ ID NO: 531187 - DNA, 20 bp, mouse
gtctagacaggccaccgcgg

SEQ ID NO: 531188 - DNA, 20 bp, mouse
gaggactagtgcgccaggat

SEQ ID NO: 531189 - DNA, 20 bp, mouse
ggtcgcagccatgtttctaa

SEQ ID NO: 531190 - DNA, 20 bp, mouse
gtagggaacaagctgccttc

SEQ ID NO: 531191 - DNA, 20 bp, mouse
ggccagcggaagtgacctcg

SEQ ID NO: 531192 - DNA, 20 bp, mouse
gaagaagcgcccaaaggcgg

SEQ ID NO: 531193 - DNA, 20 bp, mouse
gcgcggcgacagaacgcagg

SEQ ID NO: 531194 - DNA, 20 bp, mouse
gacgctctctgcctccgcgg

SEQ ID NO: 531195 - DNA, 20 bp, mouse
gcaaggacgctgctcactcg

SEQ ID NO: 531196 - DNA, 20 bp, mouse
gaggcgtctggaaacagggc

SEQ ID NO: 531197 - DNA, 20 bp, mouse
gtctggaaacagggccggaa

SEQ ID NO: 531198 - DNA, 20 bp, mouse
gagactggcaagctcgccct

SEQ ID NO: 531199 - DNA, 20 bp, mouse
gaggcagcgagggtgacaag

SEQ ID NO: 531200 - DNA, 20 bp, mouse
gggagctgaggaaagcggaa

SEQ ID NO: 531201 - DNA, 20 bp, mouse
gcctaggcacgaggcagcga

SEQ ID NO: 531202 - DNA, 20 bp, mouse
gaaagcgtctcggtaggatt

SEQ ID NO: 531203 - DNA, 20 bp, mouse
ggcgagggtgacaagtggag

SEQ ID NO: 531204 - DNA, 20 bp, mouse
ggcgtctcggtaggatttgg

SEQ ID NO: 531205 - DNA, 20 bp, mouse
ggcgtgagcagaaagcgtct

SEQ ID NO: 531206 - DNA, 20 bp, mouse
gtctccgcccgcggacatga

SEQ ID NO: 531207 - DNA, 20 bp, mouse
gagctgcagcggtctggaag

SEQ ID NO: 531208 - DNA, 20 bp, mouse
gggttggagctgcagcggtc

SEQ ID NO: 531209 - DNA, 20 bp, mouse
ggcggacatgatggagccgg

SEQ ID NO: 531210 - DNA, 20 bp, mouse
ggcggtctggaagaggtctc

SEQ ID NO: 531211 - DNA, 20 bp, mouse
gggagagtgcctccaccgac

SEQ ID NO: 531212 - DNA, 20 bp, mouse
ggctaggcgactctgcgggg

SEQ ID NO: 531213 - DNA, 20 bp, mouse
gcccgcggacatgatggagc

SEQ ID NO: 531214 - DNA, 20 bp, mouse
gagacttcgggaatccgctg

SEQ ID NO: 531215 - DNA, 20 bp, mouse
ggaagagggccgagctgaag

SEQ ID NO: 531216 - DNA, 20 bp, mouse
gtcgcccgtagctccgaccg

SEQ ID NO: 531217 - DNA, 20 bp, mouse
gctcagttgaggcgccaaga

SEQ ID NO: 531218 - DNA, 20 bp, mouse
gctcctccagtcctgcaaag

SEQ ID NO: 531219 - DNA, 20 bp, mouse
gagccgctttgcaggactgg

SEQ ID NO: 531220 - DNA, 20 bp, mouse
gctgcctcggtcggagctac

SEQ ID NO: 531221 - DNA, 20 bp, mouse
gctggaggagctgcctcggt

SEQ ID NO: 531222 - DNA, 20 bp, mouse
ggcgagccgctttgcaggac

SEQ ID NO: 531223 - DNA, 20 bp, mouse
gtttatggagggtagattga

SEQ ID NO: 531224 - DNA, 20 bp, mouse
ggactgcgcttggagagtct

SEQ ID NO: 531225 - DNA, 20 bp, mouse
gcaaatctaaggcctcgtga

SEQ ID NO: 531226 - DNA, 20 bp, mouse
gtgtctcggttagcaagaag

SEQ ID NO: 531227 - DNA, 20 bp, mouse
gtggctgtggaagcttccct

SEQ ID NO: 531228 - DNA, 20 bp, mouse
gggttgcttgtcgagaatgg

SEQ ID NO: 531229 - DNA, 20 bp, mouse
gtcggttagcaagaagaggc

SEQ ID NO: 531230 - DNA, 20 bp, mouse
gggcggcgctgatcgtgtct

SEQ ID NO: 531231 - DNA, 20 bp, mouse
gattctctacgtgttgccaa

SEQ ID NO: 531232 - DNA, 20 bp, mouse
gttgggttgcttgtcgagaa

SEQ ID NO: 531233 - DNA, 20 bp, mouse
ggcggaggggacgagttcag

SEQ ID NO: 531234 - DNA, 20 bp, mouse
ggggcacgtctggcgctctt

SEQ ID NO: 531235 - DNA, 20 bp, mouse
gttggcaggaccgcttctaa

SEQ ID NO: 531236 - DNA, 20 bp, mouse
gacctgggtaaggcccaaaa

SEQ ID NO: 531237 - DNA, 20 bp, mouse
gagcttagggagtcatccca

SEQ ID NO: 531238 - DNA, 20 bp, mouse
gtccctaagctacctgggta

SEQ ID NO: 531239 - DNA, 20 bp, mouse
gggccttacccaggtagctt

SEQ ID NO: 531240 - DNA, 20 bp, mouse
gatgactccctaagctacct

SEQ ID NO: 531241 - DNA, 20 bp, mouse
ggccattttgggccttaccc

SEQ ID NO: 531242 - DNA, 20 bp, mouse
gcttacccagagagaagctt

SEQ ID NO: 531243 - DNA, 20 bp, mouse
gtggctgtgcgagccacctt

SEQ ID NO: 531244 - DNA, 20 bp, mouse
gtcacaggccggaacttgga

SEQ ID NO: 531245 - DNA, 20 bp, mouse
gaccgtgggacgcctaggga

SEQ ID NO: 531246 - DNA, 20 bp, mouse
gctggacagccaggtcccta

SEQ ID NO: 531247 - DNA, 20 bp, mouse
gacccgcgaaggaccagtca

SEQ ID NO: 531248 - DNA, 20 bp, mouse
gtgggtgggggagacagtgt

SEQ ID NO: 531249 - DNA, 20 bp, mouse
gggcccatagccggaagggt

SEQ ID NO: 531250 - DNA, 20 bp, mouse
gctgtccagtgagtgattgt

SEQ ID NO: 531251 - DNA, 20 bp, mouse
ggacagtgtgggtgaggacg

SEQ ID NO: 531252 - DNA, 20 bp, mouse
gtccggctatgggcccctca

SEQ ID NO: 531253 - DNA, 20 bp, mouse
gacttccggttcccttgctc

SEQ ID NO: 531254 - DNA, 20 bp, mouse
gcagtcagggagctccgtga

SEQ ID NO: 531255 - DNA, 20 bp, mouse
ggtctcccccacccaggcaa

SEQ ID NO: 531256 - DNA, 20 bp, mouse
ggtggaggtaaccatggcgg

SEQ ID NO: 531257 - DNA, 20 bp, mouse
gcccggaaggagtagcactg

SEQ ID NO: 531258 - DNA, 20 bp, mouse
ggccatggttacctccaccc

SEQ ID NO: 531259 - DNA, 20 bp, mouse
ggaactcgaaccagcttgac

SEQ ID NO: 531260 - DNA, 20 bp, mouse
gggaaggtcctgcggccgga

SEQ ID NO: 531261 - DNA, 20 bp, mouse
gggcaggaccccgagggaga

SEQ ID NO: 531262 - DNA, 20 bp, mouse
gcgtctggaggaaggtcctg

SEQ ID NO: 531263 - DNA, 20 bp, mouse
gtggttacctccaccccgga

SEQ ID NO: 531264 - DNA, 20 bp, mouse
gctcgctgctcaccgtctgg

SEQ ID NO: 531265 - DNA, 20 bp, mouse
gtttggctcggctcggacta

SEQ ID NO: 531266 - DNA, 20 bp, mouse
gcgggaagcccggaggagat

SEQ ID NO: 531267 - DNA, 20 bp, mouse
gtgccagcgggcccacaccc

SEQ ID NO: 531268 - DNA, 20 bp, mouse
ggagcggccggccagcgtca

SEQ ID NO: 531269 - DNA, 20 bp, mouse
gccacacccgggaagcccgg

SEQ ID NO: 531270 - DNA, 20 bp, mouse
gctggagggctgacgtaaca

SEQ ID NO: 531271 - DNA, 20 bp, mouse
ggagcgcccggggatgccag

SEQ ID NO: 531272 - DNA, 20 bp, mouse
gtgggcggccgccatgacgc

SEQ ID NO: 531273 - DNA, 20 bp, mouse
gggaagtctgcacgtgcgag

SEQ ID NO: 531274 - DNA, 20 bp, mouse
gggcggccgcccatctcctc

SEQ ID NO: 531275 - DNA, 20 bp, mouse
gtgggcccgctggcatcccc

SEQ ID NO: 531276 - DNA, 20 bp, mouse
ggggcgccttcaggacatct

SEQ ID NO: 531277 - DNA, 20 bp, mouse
gtcatctacagtgacgggac

SEQ ID NO: 531278 - DNA, 20 bp, mouse
gcttcaggacatctgggtta

SEQ ID NO: 531279 - DNA, 20 bp, mouse
gactgaggccgagccacgca

SEQ ID NO: 531280 - DNA, 20 bp, mouse
ggacatctgggttatggtga

SEQ ID NO: 531281 - DNA, 20 bp, mouse
ggattatcatctacagtgac

SEQ ID NO: 531282 - DNA, 20 bp, mouse
gacgggacgggttccctgtg

SEQ ID NO: 531283 - DNA, 20 bp, mouse
gctctcccacgctaaggtag

SEQ ID NO: 531284 - DNA, 20 bp, mouse
gcgcgtcgggtggataaaat

SEQ ID NO: 531285 - DNA, 20 bp, mouse
gccaacactgaggggtaaat

SEQ ID NO: 531286 - DNA, 20 bp, mouse
gctaaccccgggagccacag

SEQ ID NO: 531287 - DNA, 20 bp, mouse
gtcccggggttaggactctg

SEQ ID NO: 531288 - DNA, 20 bp, mouse
gtgacagcggagcggacagg

SEQ ID NO: 531289 - DNA, 20 bp, mouse
gccatgacagcggagcggac

SEQ ID NO: 531290 - DNA, 20 bp, mouse
gcaccacagagtcctaaccc

SEQ ID NO: 531291 - DNA, 20 bp, mouse
ggctgtcatggcggcctctg

SEQ ID NO: 531292 - DNA, 20 bp, mouse
gctggggcttgggtcctaca

SEQ ID NO: 531293 - DNA, 20 bp, mouse
gcagccccgcagtctgagtc

SEQ ID NO: 531294 - DNA, 20 bp, mouse
gctgcttggctgcgtcaagg

SEQ ID NO: 531295 - DNA, 20 bp, mouse
ggtgctgcttggctgcgtca

SEQ ID NO: 531296 - DNA, 20 bp, mouse
gaagcggtcctgggcgatca

SEQ ID NO: 531297 - DNA, 20 bp, mouse
ggcgcctgcagcaggtaaag

SEQ ID NO: 531298 - DNA, 20 bp, mouse
gagcgtgtgtggctctgtgc

SEQ ID NO: 531299 - DNA, 20 bp, mouse
gcgagcagggcgtcccagtg

SEQ ID NO: 531300 - DNA, 20 bp, mouse
ggcggcgcgcgcagcgtgtg

SEQ ID NO: 531301 - DNA, 20 bp, mouse
gcctctctaccgtggaggga

SEQ ID NO: 531302 - DNA, 20 bp, mouse
gtcccagtggggctgcaccg

SEQ ID NO: 531303 - DNA, 20 bp, mouse
gtccatggccctctctaccg

SEQ ID NO: 531304 - DNA, 20 bp, mouse
ggtacgggtcgggcagaggg

SEQ ID NO: 531305 - DNA, 20 bp, mouse
gcgagggaccctacataaat

SEQ ID NO: 531306 - DNA, 20 bp, mouse
ggaccgcaggagccacgacc

SEQ ID NO: 531307 - DNA, 20 bp, mouse
gcaggctcgagagtgacagt

SEQ ID NO: 531308 - DNA, 20 bp, mouse
gggctggacatggaatgacc

SEQ ID NO: 531309 - DNA, 20 bp, mouse
ggacatggaatgaccaggta

SEQ ID NO: 531310 - DNA, 20 bp, mouse
gatgtccagcccaggaccgc

SEQ ID NO: 531311 - DNA, 20 bp, mouse
gtcgtggctcctgcggtcct

SEQ ID NO: 531312 - DNA, 20 bp, mouse
gataggtctggaaggaaggt

SEQ ID NO: 531313 - DNA, 20 bp, mouse
ggagagagagagtacgatga

SEQ ID NO: 531314 - DNA, 20 bp, mouse
gtaatctcggggctccggtg

SEQ ID NO: 531315 - DNA, 20 bp, mouse
ggactgaaattgaccctccg

SEQ ID NO: 531316 - DNA, 20 bp, mouse
gtaaggaggaaccccggaag

SEQ ID NO: 531317 - DNA, 20 bp, mouse
gcccgctaggttggtgaggt

SEQ ID NO: 531318 - DNA, 20 bp, mouse
gcgaccccgctaggttggtg

SEQ ID NO: 531319 - DNA, 20 bp, mouse
gccggaaggggctggaggta

SEQ ID NO: 531320 - DNA, 20 bp, mouse
gtctagaaggctctgagagt

SEQ ID NO: 531321 - DNA, 20 bp, mouse
ggtgtgcgaccccgctaggt

SEQ ID NO: 531322 - DNA, 20 bp, mouse
ggaaccccggaaggggctgg

SEQ ID NO: 531323 - DNA, 20 bp, mouse
ggcgtgtgtgcgaccccgct

SEQ ID NO: 531324 - DNA, 20 bp, mouse
gacccacctcaccaacctag

SEQ ID NO: 531325 - DNA, 20 bp, mouse
gcttgcccggatactggaag

SEQ ID NO: 531326 - DNA, 20 bp, mouse
gaggctggcgagaaaggcag

SEQ ID NO: 531327 - DNA, 20 bp, mouse
ggctggctgggcagacaaca

SEQ ID NO: 531328 - DNA, 20 bp, mouse
gaggggtaggctggcgagaa

SEQ ID NO: 531329 - DNA, 20 bp, mouse
gagcccagagcagcagtcga

SEQ ID NO: 531330 - DNA, 20 bp, mouse
gctcgctgctgcggaccttc

SEQ ID NO: 531331 - DNA, 20 bp, mouse
gaggggcctgacctgccgga

SEQ ID NO: 531332 - DNA, 20 bp, mouse
gacatggcggcgtccgtgct

SEQ ID NO: 531333 - DNA, 20 bp, mouse
gttcccgtcctggctaggtt

SEQ ID NO: 531334 - DNA, 20 bp, mouse
gctcctaacctagccaggac

SEQ ID NO: 531335 - DNA, 20 bp, mouse
gagggttacgagggacccac

SEQ ID NO: 531336 - DNA, 20 bp, mouse
gggtcgagcccgaaccgtca

SEQ ID NO: 531337 - DNA, 20 bp, mouse
ggcacccggagacccgagaa

SEQ ID NO: 531338 - DNA, 20 bp, mouse
gccgccgagctgggtcccaa

SEQ ID NO: 531339 - DNA, 20 bp, mouse
gagctcggcggctcactcgg

SEQ ID NO: 531340 - DNA, 20 bp, mouse
gaccgcggagcgggcagtgg

SEQ ID NO: 531341 - DNA, 20 bp, mouse
ggcgcgacaagagctgccga

SEQ ID NO: 531342 - DNA, 20 bp, mouse
gtccaccgcggagcgggcag

SEQ ID NO: 531343 - DNA, 20 bp, mouse
ggcggtggatccaggttaca

SEQ ID NO: 531344 - DNA, 20 bp, mouse
gggcgcagccatgacggttc

SEQ ID NO: 531345 - DNA, 20 bp, mouse
gtacatgggcgcagccatga

SEQ ID NO: 531346 - DNA, 20 bp, mouse
gtaatcacagggcctttggg

SEQ ID NO: 531347 - DNA, 20 bp, mouse
gaccatggtgcctgggcgag

SEQ ID NO: 531348 - DNA, 20 bp, mouse
ggtgccgcggggctgtgcag

SEQ ID NO: 531349 - DNA, 20 bp, mouse
ggtcccgctgcacagccccg

SEQ ID NO: 531350 - DNA, 20 bp, mouse
ggctccgctggaaggcgatg

SEQ ID NO: 531351 - DNA, 20 bp, mouse
gcagaggcaaaggtctgtct

SEQ ID NO: 531352 - DNA, 20 bp, mouse
ggctggagagccgctcgccc

SEQ ID NO: 531353 - DNA, 20 bp, mouse
gtaagggtaagacaaggtca

SEQ ID NO: 531354 - DNA, 20 bp, mouse
gcggccacatcgccttccag

SEQ ID NO: 531355 - DNA, 20 bp, mouse
gatgtggccgcgcctagccc

SEQ ID NO: 531356 - DNA, 20 bp, mouse
ggccttgtggtggactccgg

SEQ ID NO: 531357 - DNA, 20 bp, mouse
gtgctccgccggccttgtgg

SEQ ID NO: 531358 - DNA, 20 bp, mouse
gacctccggagtccaccaca

SEQ ID NO: 531359 - DNA, 20 bp, mouse
ggagggtgtcaaccaggtct

SEQ ID NO: 531360 - DNA, 20 bp, mouse
ggtgagcgagggtgtcaacc

SEQ ID NO: 531361 - DNA, 20 bp, mouse
gcaaccaggtctgggttctg

SEQ ID NO: 531362 - DNA, 20 bp, mouse
ggagtccaccacaaggccgg

SEQ ID NO: 531363 - DNA, 20 bp, mouse
ggtcgctaccgaaaccacca

SEQ ID NO: 531364 - DNA, 20 bp, mouse
gaccaccagggaaactgaca

SEQ ID NO: 531365 - DNA, 20 bp, mouse
gccatgctccgccggccttg

SEQ ID NO: 531366 - DNA, 20 bp, mouse
gtccaagatggcggccctca

SEQ ID NO: 531367 - DNA, 20 bp, mouse
gtctggtgtcaggctgcggg

SEQ ID NO: 531368 - DNA, 20 bp, mouse
gggtcaggtgcgttccaaga

SEQ ID NO: 531369 - DNA, 20 bp, mouse
gcaggtgcgttccaagatgg

SEQ ID NO: 531370 - DNA, 20 bp, mouse
gagcgactctgagacccggg

SEQ ID NO: 531371 - DNA, 20 bp, mouse
ggagagggaggggcacatcg

SEQ ID NO: 531372 - DNA, 20 bp, mouse
gggctctggtgtcaggctgc

SEQ ID NO: 531373 - DNA, 20 bp, mouse
gcggcagctccaagcgttcc

SEQ ID NO: 531374 - DNA, 20 bp, mouse
gatggcggccctcagggctc

SEQ ID NO: 531375 - DNA, 20 bp, mouse
ggaagacactgagaaccggg

SEQ ID NO: 531376 - DNA, 20 bp, mouse
gcaggttccagcggcagatg

SEQ ID NO: 531377 - DNA, 20 bp, mouse
gcattctacaaggctatcag

SEQ ID NO: 531378 - DNA, 20 bp, mouse
gactggcctgaggggttagg

SEQ ID NO: 531379 - DNA, 20 bp, mouse
gggtagcttgaagaaatact

SEQ ID NO: 531380 - DNA, 20 bp, mouse
gccagcggcagatggggcac

SEQ ID NO: 531381 - DNA, 20 bp, mouse
gcagatccccctaacccctc

SEQ ID NO: 531382 - DNA, 20 bp, mouse
gaagcacaaatatacctatg

SEQ ID NO: 531383 - DNA, 20 bp, mouse
gtagaccccaaagcatgcag

SEQ ID NO: 531384 - DNA, 20 bp, mouse
gggacagtgctcaaggtaag

SEQ ID NO: 531385 - DNA, 20 bp, mouse
gcacaggtgtcgcatgtaca

SEQ ID NO: 531386 - DNA, 20 bp, mouse
gagaagcgtgtgccgcaagg

SEQ ID NO: 531387 - DNA, 20 bp, mouse
gaggaacttcgtaagagtgt

SEQ ID NO: 531388 - DNA, 20 bp, mouse
gcgtccggtgtgcgtcaaga

SEQ ID NO: 531389 - DNA, 20 bp, mouse
gtccattaggaggagtcaag

SEQ ID NO: 531390 - DNA, 20 bp, mouse
gcgcgcgccgtaggggacgg

SEQ ID NO: 531391 - DNA, 20 bp, mouse
gcaccagcctccgtccccta

SEQ ID NO: 531392 - DNA, 20 bp, mouse
gaagtatagacaccacgggg

SEQ ID NO: 531393 - DNA, 20 bp, mouse
gggctgacacgtagacatgt

SEQ ID NO: 531394 - DNA, 20 bp, mouse
gcggcacacgcttctaaagc

SEQ ID NO: 531395 - DNA, 20 bp, mouse
gtgtagctcaggtaaaacgt

SEQ ID NO: 531396 - DNA, 20 bp, mouse
gggcgcttagggaaatagaa

SEQ ID NO: 531397 - DNA, 20 bp, mouse
gtcgaatcccgggcagacag

SEQ ID NO: 531398 - DNA, 20 bp, mouse
gcggagaaccatggccgctc

SEQ ID NO: 531399 - DNA, 20 bp, mouse
gaactaggtttgagataagt

SEQ ID NO: 531400 - DNA, 20 bp, mouse
gcaccagaaaggacctgtcg

SEQ ID NO: 531401 - DNA, 20 bp, mouse
gggaccccaccgacaatcag

SEQ ID NO: 531402 - DNA, 20 bp, mouse
gctcaagcaggtaaaacgtc

SEQ ID NO: 531403 - DNA, 20 bp, mouse
gagaggcttcgtccaagcag

SEQ ID NO: 531404 - DNA, 20 bp, mouse
gaataagtaacggggtaaag

SEQ ID NO: 531405 - DNA, 20 bp, mouse
gggacctgtcggggcgctta

SEQ ID NO: 531406 - DNA, 20 bp, mouse
gcgggtcagcacggccggag

SEQ ID NO: 531407 - DNA, 20 bp, mouse
gcagtcagcgagccccagga

SEQ ID NO: 531408 - DNA, 20 bp, mouse
gacggccggagcgggcgcca

SEQ ID NO: 531409 - DNA, 20 bp, mouse
gccctgcggagcagaatggt

SEQ ID NO: 531410 - DNA, 20 bp, mouse
gcccgccatggcgcccgctc

SEQ ID NO: 531411 - DNA, 20 bp, mouse
gtctgtccacgcgcccgcca

SEQ ID NO: 531412 - DNA, 20 bp, mouse
ggagagctaccaggccacag

SEQ ID NO: 531413 - DNA, 20 bp, mouse
gcgggccctgcggagcagaa

SEQ ID NO: 531414 - DNA, 20 bp, mouse
gggtgaatctcggagatggg

SEQ ID NO: 531415 - DNA, 20 bp, mouse
gtgacccggctgctgtgtgc

SEQ ID NO: 531416 - DNA, 20 bp, mouse
gcccaggtagggagctcgag

SEQ ID NO: 531417 - DNA, 20 bp, mouse
ggaattcagaggccccaggt

SEQ ID NO: 531418 - DNA, 20 bp, mouse
gacccggagtccgaattcag

SEQ ID NO: 531419 - DNA, 20 bp, mouse
gcttccggtccgcagagacc

SEQ ID NO: 531420 - DNA, 20 bp, mouse
gtagggagctcgaggggtgt

SEQ ID NO: 531421 - DNA, 20 bp, mouse
gacccctcgagctccctacc

SEQ ID NO: 531422 - DNA, 20 bp, mouse
ggagccctggatccttacgg

SEQ ID NO: 531423 - DNA, 20 bp, mouse
gaagctacggagtcccgcga

SEQ ID NO: 531424 - DNA, 20 bp, mouse
gttcggactccgggtctctg

SEQ ID NO: 531425 - DNA, 20 bp, mouse
ggcctctgaattcggactcc

SEQ ID NO: 531426 - DNA, 20 bp, mouse
gggaacctccacagcgacaa

SEQ ID NO: 531427 - DNA, 20 bp, mouse
gcgctgtggaggttccaatt

SEQ ID NO: 531428 - DNA, 20 bp, mouse
gtgctcgccgagagcccaat

SEQ ID NO: 531429 - DNA, 20 bp, mouse
gaaagagcgtctggtaatca

SEQ ID NO: 531430 - DNA, 20 bp, mouse
gaacaccgttgtcgctgtgg

SEQ ID NO: 531431 - DNA, 20 bp, mouse
gcagaacaccgttgtcgctg

SEQ ID NO: 531432 - DNA, 20 bp, mouse
gttgctctaacgagtgaagg

SEQ ID NO: 531433 - DNA, 20 bp, mouse
gggctctcggcgagcacggc

SEQ ID NO: 531434 - DNA, 20 bp, mouse
gtaagttctgcaaggacgga

SEQ ID NO: 531435 - DNA, 20 bp, mouse
gcgtcgcgagcagagcatcg

SEQ ID NO: 531436 - DNA, 20 bp, mouse
ggagccggctggagacggtg

SEQ ID NO: 531437 - DNA, 20 bp, mouse
gctccccgccatggccactt

SEQ ID NO: 531438 - DNA, 20 bp, mouse
gcccaactcggagcacgcac

SEQ ID NO: 531439 - DNA, 20 bp, mouse
gtccagccggctccccgcca

SEQ ID NO: 531440 - DNA, 20 bp, mouse
gtagcccaagtggccatggc

SEQ ID NO: 531441 - DNA, 20 bp, mouse
ggtggcgagcacaatctgac

SEQ ID NO: 531442 - DNA, 20 bp, mouse
gcgcttccggtaacagcccg

SEQ ID NO: 531443 - DNA, 20 bp, mouse
gcccggtgcgtgctccgagt

SEQ ID NO: 531444 - DNA, 20 bp, mouse
gacttgggctagaaagcctc

SEQ ID NO: 531445 - DNA, 20 bp, mouse
ggccatggcggggagccggc

SEQ ID NO: 531446 - DNA, 20 bp, mouse
ggctagggcagcgggtgagt

SEQ ID NO: 531447 - DNA, 20 bp, mouse
gcctagcccgcgcaccgacg

SEQ ID NO: 531448 - DNA, 20 bp, mouse
gaagccggtgagctacgagg

SEQ ID NO: 531449 - DNA, 20 bp, mouse
gaagatggcgtggtccgcgt

SEQ ID NO: 531450 - DNA, 20 bp, mouse
ggggtcgcgccggcccaaga

SEQ ID NO: 531451 - DNA, 20 bp, mouse
ggtgacccgtgccaccaggg

SEQ ID NO: 531452 - DNA, 20 bp, mouse
gggaaggactgccaccctgg

SEQ ID NO: 531453 - DNA, 20 bp, mouse
gggagtgagcggacaccgga

SEQ ID NO: 531454 - DNA, 20 bp, mouse
gagagtgacccgtgccacca

SEQ ID NO: 531455 - DNA, 20 bp, mouse
gacctccgcggtctgcgcca

SEQ ID NO: 531456 - DNA, 20 bp, mouse
gtcgggaagcgacccttcat

SEQ ID NO: 531457 - DNA, 20 bp, mouse
gacccaggtactgcagcgta

SEQ ID NO: 531458 - DNA, 20 bp, mouse
gcaggtactgcagcgtacgg

SEQ ID NO: 531459 - DNA, 20 bp, mouse
gccggagccgcgctggtccg

SEQ ID NO: 531460 - DNA, 20 bp, mouse
gaagcgacccttcatcggca

SEQ ID NO: 531461 - DNA, 20 bp, mouse
gcttccaccatgccgatgaa

SEQ ID NO: 531462 - DNA, 20 bp, mouse
gctgcagcgtacggcggatc

SEQ ID NO: 531463 - DNA, 20 bp, mouse
ggcgcggctccgggaatctt

SEQ ID NO: 531464 - DNA, 20 bp, mouse
gcggctccgggaatcttggg

SEQ ID NO: 531465 - DNA, 20 bp, mouse
gtcaggaactcctcaagccg

SEQ ID NO: 531466 - DNA, 20 bp, mouse
ggggtcttgcggccgcgcac

SEQ ID NO: 531467 - DNA, 20 bp, mouse
ggagaggcccgggactgggt

SEQ ID NO: 531468 - DNA, 20 bp, mouse
gggccccggcccttcccgaa

SEQ ID NO: 531469 - DNA, 20 bp, mouse
gagtggccgcggagcaccac

SEQ ID NO: 531470 - DNA, 20 bp, mouse
gcgggcaggagcagcggggt

SEQ ID NO: 531471 - DNA, 20 bp, mouse
gacccgtccgaccttggatt

SEQ ID NO: 531472 - DNA, 20 bp, mouse
gggcagacgcccttcgggaa

SEQ ID NO: 531473 - DNA, 20 bp, mouse
gctggaaccgggacgagaac

SEQ ID NO: 531474 - DNA, 20 bp, mouse
ggagctgatggcctggaacc

SEQ ID NO: 531475 - DNA, 20 bp, mouse
ggacccgcctgccaaatcca

SEQ ID NO: 531476 - DNA, 20 bp, mouse
gcacttggtgcgctccaaga

SEQ ID NO: 531477 - DNA, 20 bp, mouse
ggcatcccacaccgcaccat

SEQ ID NO: 531478 - DNA, 20 bp, mouse
gggctcccatggtgcggtgt

SEQ ID NO: 531479 - DNA, 20 bp, mouse
gccaccaacctgcgaggcaa

SEQ ID NO: 531480 - DNA, 20 bp, mouse
gaccatgggagccgccatct

SEQ ID NO: 531481 - DNA, 20 bp, mouse
ggtgtgggatgctcctggct

SEQ ID NO: 531482 - DNA, 20 bp, mouse
gcagcagccaccaacctgcg

SEQ ID NO: 531483 - DNA, 20 bp, mouse
gttggagcgcaccaagtgga

SEQ ID NO: 531484 - DNA, 20 bp, mouse
gcccacgcccgccttccact

SEQ ID NO: 531485 - DNA, 20 bp, mouse
gagcgcaccaagtggaaggc

SEQ ID NO: 531486 - DNA, 20 bp, mouse
gggtcgcgcaggcgtcatgg

SEQ ID NO: 531487 - DNA, 20 bp, mouse
gagaggtcgcgcaggcgtca

SEQ ID NO: 531488 - DNA, 20 bp, mouse
ggacaagcgctctcaagaaa

SEQ ID NO: 531489 - DNA, 20 bp, mouse
gctcccagcagtcccggcgt

SEQ ID NO: 531490 - DNA, 20 bp, mouse
gcgtcatggcggcgctgtgt

SEQ ID NO: 531491 - DNA, 20 bp, mouse
gcgaggagcggaggagtcgt

SEQ ID NO: 531492 - DNA, 20 bp, mouse
ggtcccacgccgggactgct

SEQ ID NO: 531493 - DNA, 20 bp, mouse
gcgctgtgtaggtcccacgc

SEQ ID NO: 531494 - DNA, 20 bp, mouse
gaagaggtcagaggtcgcgc

SEQ ID NO: 531495 - DNA, 20 bp, mouse
gaggcggcgactccagggag

SEQ ID NO: 531496 - DNA, 20 bp, mouse
gtcgcggcgggcgaaaatgg

SEQ ID NO: 531497 - DNA, 20 bp, mouse
gaatggcggcggccaggtat

SEQ ID NO: 531498 - DNA, 20 bp, mouse
gggcattctgggacaatccc

SEQ ID NO: 531499 - DNA, 20 bp, mouse
ggggtcgcggcgggcgaaaa

SEQ ID NO: 531500 - DNA, 20 bp, mouse
gcggcgggcgaaaatggcgg

SEQ ID NO: 531501 - DNA, 20 bp, mouse
gggcaccagcttccaatacc

SEQ ID NO: 531502 - DNA, 20 bp, mouse
ggtgcacgcggccccctcgg

SEQ ID NO: 531503 - DNA, 20 bp, mouse
gattggaagctggtgccccg

SEQ ID NO: 531504 - DNA, 20 bp, mouse
ggtagcggacgccttagcag

SEQ ID NO: 531505 - DNA, 20 bp, mouse
ggccttagcagcggcattct

SEQ ID NO: 531506 - DNA, 20 bp, mouse
gcaaagggaggcccgagaaa

SEQ ID NO: 531507 - DNA, 20 bp, mouse
gtagaaatgccgggattctg

SEQ ID NO: 531508 - DNA, 20 bp, mouse
ggaggcccgagaaagggcga

SEQ ID NO: 531509 - DNA, 20 bp, mouse
gacgatgctccacagaatcc

SEQ ID NO: 531510 - DNA, 20 bp, mouse
ggcgagggcgtagaaatgcc

SEQ ID NO: 531511 - DNA, 20 bp, mouse
ggtcgctgcaaggcaagtag

SEQ ID NO: 531512 - DNA, 20 bp, mouse
gttacagtatccaaccccgg

SEQ ID NO: 531513 - DNA, 20 bp, mouse
gtggccgcgccgggcttcca

SEQ ID NO: 531514 - DNA, 20 bp, mouse
gggttggatactgtaagcgt

SEQ ID NO: 531515 - DNA, 20 bp, mouse
gccggagctgtgaggtaagg

SEQ ID NO: 531516 - DNA, 20 bp, mouse
ggcgaggtcaggagcaggta

SEQ ID NO: 531517 - DNA, 20 bp, mouse
gtaaggcaagcggagcgctg

SEQ ID NO: 531518 - DNA, 20 bp, mouse
gtcacagcagagggcggcgg

SEQ ID NO: 531519 - DNA, 20 bp, mouse
ggacgcgcgtgcgcgaggtc

SEQ ID NO: 531520 - DNA, 20 bp, mouse
gctgggaagcaagtaaaggg

SEQ ID NO: 531521 - DNA, 20 bp, mouse
ggggtcacagcagagggcgg

SEQ ID NO: 531522 - DNA, 20 bp, mouse
ggtgcgagggcgggctcact

SEQ ID NO: 531523 - DNA, 20 bp, mouse
ggagctgggaagcaagtaaa

SEQ ID NO: 531524 - DNA, 20 bp, mouse
gtccaccaggttagggaccc

SEQ ID NO: 531525 - DNA, 20 bp, mouse
gcggacccgggtccctaacc

SEQ ID NO: 531526 - DNA, 20 bp, mouse
ggcggaagaaagtaagaccc

SEQ ID NO: 531527 - DNA, 20 bp, mouse
gtggagtaaggacactgaca

SEQ ID NO: 531528 - DNA, 20 bp, mouse
ggcccaggccgaacaagggg

SEQ ID NO: 531529 - DNA, 20 bp, mouse
gtaaggacactgacatggcg

SEQ ID NO: 531530 - DNA, 20 bp, mouse
ggaggcgggcgagcagctgt

SEQ ID NO: 531531 - DNA, 20 bp, mouse
ggcgggcgagcagctgtagg

SEQ ID NO: 531532 - DNA, 20 bp, mouse
ggacggcccaggccgaacaa

SEQ ID NO: 531533 - DNA, 20 bp, mouse
gcccaccctggactatacat

SEQ ID NO: 531534 - DNA, 20 bp, mouse
gcaggccgaacaaggggagg

SEQ ID NO: 531535 - DNA, 20 bp, mouse
gtacccgcaagtcctggctg

SEQ ID NO: 531536 - DNA, 20 bp, mouse
gcggccgccatgataaagga

SEQ ID NO: 531537 - DNA, 20 bp, mouse
gtgcctcagctgcagcgcgg

SEQ ID NO: 531538 - DNA, 20 bp, mouse
gtgaggcagaccctgtgccc

SEQ ID NO: 531539 - DNA, 20 bp, mouse
gacgcgcgctcccgggcaca

SEQ ID NO: 531540 - DNA, 20 bp, mouse
gggctcgccgtcctttatca

SEQ ID NO: 531541 - DNA, 20 bp, mouse
ggcggcggccgccatgataa

SEQ ID NO: 531542 - DNA, 20 bp, mouse
ggggagccgcgtgcaagagt

SEQ ID NO: 531543 - DNA, 20 bp, mouse
ggggctggcgaccgaggaga

SEQ ID NO: 531544 - DNA, 20 bp, mouse
ggtctgcctcagctgcagcg

SEQ ID NO: 531545 - DNA, 20 bp, mouse
gtgagcccggcacaccgcag

SEQ ID NO: 531546 - DNA, 20 bp, mouse
gcgagcaggggcagcttccg

SEQ ID NO: 531547 - DNA, 20 bp, mouse
ggcagcgccgggaggaaagg

SEQ ID NO: 531548 - DNA, 20 bp, mouse
gctgcagaagtatctggagt

SEQ ID NO: 531549 - DNA, 20 bp, mouse
ggacgagctgcagaagtatc

SEQ ID NO: 531550 - DNA, 20 bp, mouse
gatctggagtgggcagcgtg

SEQ ID NO: 531551 - DNA, 20 bp, mouse
ggcggcagcgccgggaggaa

SEQ ID NO: 531552 - DNA, 20 bp, mouse
gctctaaccagctccaaggg

SEQ ID NO: 531553 - DNA, 20 bp, mouse
gagggatggtgcagacgcag

SEQ ID NO: 531554 - DNA, 20 bp, mouse
ggattggccggactgctgga

SEQ ID NO: 531555 - DNA, 20 bp, mouse
ggcggtcacgatgcattctc

SEQ ID NO: 531556 - DNA, 20 bp, mouse
gaggagaggcccctgctcgg

SEQ ID NO: 531557 - DNA, 20 bp, mouse
ggtaaggagaggcccctgct

SEQ ID NO: 531558 - DNA, 20 bp, mouse
ggtgaagtaagagtaaggag

SEQ ID NO: 531559 - DNA, 20 bp, mouse
gtggtgcatcagtaaatcgg

SEQ ID NO: 531560 - DNA, 20 bp, mouse
gtgcttgtcaccagacagaa

SEQ ID NO: 531561 - DNA, 20 bp, mouse
gtgacaagcagcagccacga

SEQ ID NO: 531562 - DNA, 20 bp, mouse
gtaaagctaacccttctgtc

SEQ ID NO: 531563 - DNA, 20 bp, mouse
gcctgctcgggggtcacgat

SEQ ID NO: 531564 - DNA, 20 bp, mouse
ggggtccagagtgaccgtcg

SEQ ID NO: 531565 - DNA, 20 bp, mouse
gaggtttgtctcttctgtga

SEQ ID NO: 531566 - DNA, 20 bp, mouse
gtgctccggctccagcatgg

SEQ ID NO: 531567 - DNA, 20 bp, mouse
gctgcaggcggtgaggaagg

SEQ ID NO: 531568 - DNA, 20 bp, mouse
gagacagcctgcagcgcgta

SEQ ID NO: 531569 - DNA, 20 bp, mouse
gggaaggcggttccagagac

SEQ ID NO: 531570 - DNA, 20 bp, mouse
gctgccctcgtggaccacag

SEQ ID NO: 531571 - DNA, 20 bp, mouse
gcgctgctccggctccagca

SEQ ID NO: 531572 - DNA, 20 bp, mouse
gcagccggccggacccgaat

SEQ ID NO: 531573 - DNA, 20 bp, mouse
gcaaacggcgcgaccagaga

SEQ ID NO: 531574 - DNA, 20 bp, mouse
ggcaggtgagccctgggacc

SEQ ID NO: 531575 - DNA, 20 bp, mouse
ggcctcggacagctgctcag

SEQ ID NO: 531576 - DNA, 20 bp, mouse
ggcgcagaggaagacgagag

SEQ ID NO: 531577 - DNA, 20 bp, mouse
gaggagagccggggtcgcga

SEQ ID NO: 531578 - DNA, 20 bp, mouse
ggccgagtccaggagagccg

SEQ ID NO: 531579 - DNA, 20 bp, mouse
gcggccggtcagctcccgga

SEQ ID NO: 531580 - DNA, 20 bp, mouse
gtcgccgtccgggagctgac

SEQ ID NO: 531581 - DNA, 20 bp, mouse
ggcgggactgggaggcctag

SEQ ID NO: 531582 - DNA, 20 bp, mouse
gaacacggccggtcagctcc

SEQ ID NO: 531583 - DNA, 20 bp, mouse
ggacgagagaggaacacggc

SEQ ID NO: 531584 - DNA, 20 bp, mouse
gacacagacacggcccggga

SEQ ID NO: 531585 - DNA, 20 bp, mouse
gagcggggcatcgcccaggt

SEQ ID NO: 531586 - DNA, 20 bp, mouse
gccagcccggaccagcgaag

SEQ ID NO: 531587 - DNA, 20 bp, mouse
gagcggagcgcgcagcgcgg

SEQ ID NO: 531588 - DNA, 20 bp, mouse
gacggcgcacctcactccca

SEQ ID NO: 531589 - DNA, 20 bp, mouse
ggtcctgacagcggccaaga

SEQ ID NO: 531590 - DNA, 20 bp, mouse
gccctccgaggtcctgacag

SEQ ID NO: 531591 - DNA, 20 bp, mouse
gcaccctggaaggttccaga

SEQ ID NO: 531592 - DNA, 20 bp, mouse
ggcgggagggcactaactcg

SEQ ID NO: 531593 - DNA, 20 bp, mouse
ggcctgtcaggcataggaca

SEQ ID NO: 531594 - DNA, 20 bp, mouse
ggccgctgtcaggacctcgg

SEQ ID NO: 531595 - DNA, 20 bp, mouse
gcgctgtgggcagccctccg

SEQ ID NO: 531596 - DNA, 20 bp, mouse
gtcggccgcaggacacacag

SEQ ID NO: 531597 - DNA, 20 bp, mouse
gacagcgggagtgaaccaaa

SEQ ID NO: 531598 - DNA, 20 bp, mouse
ggtacccgggcctctggcag

SEQ ID NO: 531599 - DNA, 20 bp, mouse
ggccagagccctcaaggtag

SEQ ID NO: 531600 - DNA, 20 bp, mouse
ggagccctcaaggtagaggt

SEQ ID NO: 531601 - DNA, 20 bp, mouse
gccctcaaggtagaggtcgg

SEQ ID NO: 531602 - DNA, 20 bp, mouse
ggccgtaagaaacatcctgg

SEQ ID NO: 531603 - DNA, 20 bp, mouse
ggcgacccggaagatgtcct

SEQ ID NO: 531604 - DNA, 20 bp, mouse
gacacagggggcggccatgt

SEQ ID NO: 531605 - DNA, 20 bp, mouse
gtctggcagccctggaaggt

SEQ ID NO: 531606 - DNA, 20 bp, mouse
gaacacacgcgggacagcgg

SEQ ID NO: 531607 - DNA, 20 bp, mouse
gagaaacacacgcgggacag

SEQ ID NO: 531608 - DNA, 20 bp, mouse
gcccggccgtagctggtgag

SEQ ID NO: 531609 - DNA, 20 bp, mouse
gctctcggagggacctcgta

SEQ ID NO: 531610 - DNA, 20 bp, mouse
gactatagagaaacacacgc

SEQ ID NO: 531611 - DNA, 20 bp, mouse
gtgactggttcagcagagtt

SEQ ID NO: 531612 - DNA, 20 bp, mouse
ggggtcggctctcaaggagt

SEQ ID NO: 531613 - DNA, 20 bp, mouse
gcgcgggacagcggaggtgc

SEQ ID NO: 531614 - DNA, 20 bp, mouse
gagtggccttgagtgtgtgt

SEQ ID NO: 531615 - DNA, 20 bp, mouse
gacgtcacgggccagcgcgg

SEQ ID NO: 531616 - DNA, 20 bp, mouse
gaggcagcgcaggcattcca

SEQ ID NO: 531617 - DNA, 20 bp, mouse
gtcggaccggcgtcctgggg

SEQ ID NO: 531618 - DNA, 20 bp, mouse
ggagttccggcatgtcggac

SEQ ID NO: 531619 - DNA, 20 bp, mouse
ggcaaccgggaagccgcccc

SEQ ID NO: 531620 - DNA, 20 bp, mouse
gccatggcgcgcgggcaacc

SEQ ID NO: 531621 - DNA, 20 bp, mouse
gatgtcggaccggcgtcctg

SEQ ID NO: 531622 - DNA, 20 bp, mouse
gggaagccgccccaggacgc

SEQ ID NO: 531623 - DNA, 20 bp, mouse
ggcgcggtgcgcggttgtcg

SEQ ID NO: 531624 - DNA, 20 bp, mouse
ggacccgagttccggcatgt

SEQ ID NO: 531625 - DNA, 20 bp, mouse
gcggcgcggggcagcagccc

SEQ ID NO: 531626 - DNA, 20 bp, mouse
gcctccgcagagccatagag

SEQ ID NO: 531627 - DNA, 20 bp, mouse
gcggttcgcgagggacttgg

SEQ ID NO: 531628 - DNA, 20 bp, mouse
gtatggctctgcggagggag

SEQ ID NO: 531629 - DNA, 20 bp, mouse
ggagaggaaccggttcgcga

SEQ ID NO: 531630 - DNA, 20 bp, mouse
ggcgaaccggttcctctcta

SEQ ID NO: 531631 - DNA, 20 bp, mouse
gcgggtccctccagtcccgg

SEQ ID NO: 531632 - DNA, 20 bp, mouse
ggcggcagccgggtcctaac

SEQ ID NO: 531633 - DNA, 20 bp, mouse
gaaccggttcgcgagggact

SEQ ID NO: 531634 - DNA, 20 bp, mouse
gctggagggacccgggacct

SEQ ID NO: 531635 - DNA, 20 bp, mouse
gtgggcggccggttaggacc

SEQ ID NO: 531636 - DNA, 20 bp, mouse
gcaggagagccaggagtaag

SEQ ID NO: 531637 - DNA, 20 bp, mouse
gtgaagaggcaggttattct

SEQ ID NO: 531638 - DNA, 20 bp, mouse
ggtacagggcgctgggatgg

SEQ ID NO: 531639 - DNA, 20 bp, mouse
gaggctggccgggaggaaag

SEQ ID NO: 531640 - DNA, 20 bp, mouse
gccagcgccctgtaccttta

SEQ ID NO: 531641 - DNA, 20 bp, mouse
gcagagaggggctggatgag

SEQ ID NO: 531642 - DNA, 20 bp, mouse
gtctcctccttaaaggtaca

SEQ ID NO: 531643 - DNA, 20 bp, mouse
ggtgccagaggggtatgaag

SEQ ID NO: 531644 - DNA, 20 bp, mouse
ggcactgccatcggctatgg

SEQ ID NO: 531645 - DNA, 20 bp, mouse
gctagggttcaaggaaggtt

SEQ ID NO: 531646 - DNA, 20 bp, mouse
gactcacagctgagatcagt

SEQ ID NO: 531647 - DNA, 20 bp, mouse
gagccttggagacccaggta

SEQ ID NO: 531648 - DNA, 20 bp, mouse
gagaggtaccactccaggtc

SEQ ID NO: 531649 - DNA, 20 bp, mouse
ggcagacctaacccttacct

SEQ ID NO: 531650 - DNA, 20 bp, mouse
gcagctgtgagtggctaatt

SEQ ID NO: 531651 - DNA, 20 bp, mouse
gccaaggctccaaggcttaa

SEQ ID NO: 531652 - DNA, 20 bp, mouse
ggagagtcagctctcagtct

SEQ ID NO: 531653 - DNA, 20 bp, mouse
gggcagcatgatctgaagtg

SEQ ID NO: 531654 - DNA, 20 bp, mouse
gaatgactctgggcaatggg

SEQ ID NO: 531655 - DNA, 20 bp, mouse
ggagtgcgatagaccagacc

SEQ ID NO: 531656 - DNA, 20 bp, mouse
ggcctacaacagagttcccg

SEQ ID NO: 531657 - DNA, 20 bp, mouse
ggtcatcagggcctcaagtg

SEQ ID NO: 531658 - DNA, 20 bp, mouse
gtggagagggggtactcacc

SEQ ID NO: 531659 - DNA, 20 bp, mouse
ggtcagtagctgcaagctgg

SEQ ID NO: 531660 - DNA, 20 bp, mouse
gcaaggttccagggttagaa

SEQ ID NO: 531661 - DNA, 20 bp, mouse
gaaacaagggagggtcatca

SEQ ID NO: 531662 - DNA, 20 bp, mouse
ggacccccccagaagtgaac

SEQ ID NO: 531663 - DNA, 20 bp, mouse
gcagcagaaacaaacaaggg

SEQ ID NO: 531664 - DNA, 20 bp, mouse
gagttcctgttcacttctgg

SEQ ID NO: 531665 - DNA, 20 bp, mouse
gggggtactcacctggcccc

SEQ ID NO: 531666 - DNA, 20 bp, mouse
gctggctgcatagccatcag

SEQ ID NO: 531667 - DNA, 20 bp, mouse
ggcgcagtctagctcccagg

SEQ ID NO: 531668 - DNA, 20 bp, mouse
ggcgctgagagcaccatcca

SEQ ID NO: 531669 - DNA, 20 bp, mouse
ggtgctctcagcgctagatc

SEQ ID NO: 531670 - DNA, 20 bp, mouse
gcaagccgccgggttgtcaa

SEQ ID NO: 531671 - DNA, 20 bp, mouse
ggaggagcttgacaaccacc

SEQ ID NO: 531672 - DNA, 20 bp, mouse
ggttgcccttgacaacccgg

SEQ ID NO: 531673 - DNA, 20 bp, mouse
gctgaagagaaggatcaccg

SEQ ID NO: 531674 - DNA, 20 bp, mouse
gagcgcgcagtctagctccc

SEQ ID NO: 531675 - DNA, 20 bp, mouse
gccctatcaggcctaggcac

SEQ ID NO: 531676 - DNA, 20 bp, mouse
gtgtgaatgtgggagcgcag

SEQ ID NO: 531677 - DNA, 20 bp, mouse
gctttctggaaggacaatgg

SEQ ID NO: 531678 - DNA, 20 bp, mouse
gggtactcaccggcttgcca

SEQ ID NO: 531679 - DNA, 20 bp, mouse
ggcagccggtacagcagccg

SEQ ID NO: 531680 - DNA, 20 bp, mouse
gcaggatgatgtgtgaatgt

SEQ ID NO: 531681 - DNA, 20 bp, mouse
gcttgccacggctgctgtac

SEQ ID NO: 531682 - DNA, 20 bp, mouse
gattgggaagtgggatccta

SEQ ID NO: 531683 - DNA, 20 bp, mouse
gacccacctggtataagatt

SEQ ID NO: 531684 - DNA, 20 bp, mouse
gtgttgccctgagcgggagt

SEQ ID NO: 531685 - DNA, 20 bp, mouse
gtaggagctgcgcctctggt

SEQ ID NO: 531686 - DNA, 20 bp, mouse
gaactgccagggcctaaaga

SEQ ID NO: 531687 - DNA, 20 bp, mouse
gacagacttgccaggactca

SEQ ID NO: 531688 - DNA, 20 bp, mouse
ggaaatcttaccttgagtcc

SEQ ID NO: 531689 - DNA, 20 bp, mouse
gatcagtgtacagtctatag

SEQ ID NO: 531690 - DNA, 20 bp, mouse
gtagactgtacactgatgta

SEQ ID NO: 531691 - DNA, 20 bp, mouse
gctgtacactgatgtatggt

SEQ ID NO: 531692 - DNA, 20 bp, mouse
ggaggacctgataggaacaa

SEQ ID NO: 531693 - DNA, 20 bp, mouse
gtctcggtgaaacttcaagg

SEQ ID NO: 531694 - DNA, 20 bp, mouse
gctttagaaatttctcacaa

SEQ ID NO: 531695 - DNA, 20 bp, mouse
gtcaagagggctccaagacc

SEQ ID NO: 531696 - DNA, 20 bp, mouse
gaatgcggtgtgctctggat

SEQ ID NO: 531697 - DNA, 20 bp, mouse
gttcattaattgggctatcc

SEQ ID NO: 531698 - DNA, 20 bp, mouse
gatgggcagttaagatgggt

SEQ ID NO: 531699 - DNA, 20 bp, mouse
gctgtgagctctatatacag

SEQ ID NO: 531700 - DNA, 20 bp, mouse
gacagaaatgcggtgtgctc

SEQ ID NO: 531701 - DNA, 20 bp, mouse
ggacagaaattcacagtgct

SEQ ID NO: 531702 - DNA, 20 bp, mouse
gcttacctggaggattcttg

SEQ ID NO: 531703 - DNA, 20 bp, mouse
gtcccatgccctaagcacaa

SEQ ID NO: 531704 - DNA, 20 bp, mouse
gtgcttttgggtatgagaca

SEQ ID NO: 531705 - DNA, 20 bp, mouse
gagaaacttaagtaacttac

SEQ ID NO: 531706 - DNA, 20 bp, mouse
gtaatgagttggacttgcag

SEQ ID NO: 531707 - DNA, 20 bp, mouse
gcaatggagaaaggtctggt

SEQ ID NO: 531708 - DNA, 20 bp, mouse
ggtccaactcattacagaag

SEQ ID NO: 531709 - DNA, 20 bp, mouse
gagattcgttaagcctgagg

SEQ ID NO: 531710 - DNA, 20 bp, mouse
gggccaggtctagctatgag

SEQ ID NO: 531711 - DNA, 20 bp, mouse
gggtttaccttgaagaattc

SEQ ID NO: 531712 - DNA, 20 bp, mouse
gcaggtctagctatgagagg

SEQ ID NO: 531713 - DNA, 20 bp, mouse
gtacctggcgcctggtaacc

SEQ ID NO: 531714 - DNA, 20 bp, mouse
gacatggatagaccaatgtt

SEQ ID NO: 531715 - DNA, 20 bp, mouse
gaatgaagagatgattccaa

SEQ ID NO: 531716 - DNA, 20 bp, mouse
gcctgtccttagtgattgta

SEQ ID NO: 531717 - DNA, 20 bp, mouse
gtgattgtagggaatgacaa

SEQ ID NO: 531718 - DNA, 20 bp, mouse
gtcattccctacaatcacta

SEQ ID NO: 531719 - DNA, 20 bp, mouse
gggagaagctttcaacgatc

SEQ ID NO: 531720 - DNA, 20 bp, mouse
gtaaaataatatataaagca

SEQ ID NO: 531721 - DNA, 20 bp, mouse
gtcttatgtttctacgtaca

SEQ ID NO: 531722 - DNA, 20 bp, mouse
gtctattttttctaaactat

SEQ ID NO: 531723 - DNA, 20 bp, mouse
ggtaaattttacttaaaaca

SEQ ID NO: 531724 - DNA, 20 bp, mouse
ggaataattataaatcacag

SEQ ID NO: 531725 - DNA, 20 bp, mouse
gtttgtgcttctgttagatc

SEQ ID NO: 531726 - DNA, 20 bp, mouse
gagtctgctatctacaaagg

SEQ ID NO: 531727 - DNA, 20 bp, mouse
ggatgtactaaccagacaat

SEQ ID NO: 531728 - DNA, 20 bp, mouse
gggtttaaaatatgataagg

SEQ ID NO: 531729 - DNA, 20 bp, mouse
gggagaagctttcaaagatg

SEQ ID NO: 531730 - DNA, 20 bp, mouse
gcattttttaaaagcatagt

SEQ ID NO: 531731 - DNA, 20 bp, mouse
gacctgtcattgctgattat

SEQ ID NO: 531732 - DNA, 20 bp, mouse
gctggatcttcagctgctct

SEQ ID NO: 531733 - DNA, 20 bp, mouse
gtaaaataatctgttatgca

SEQ ID NO: 531734 - DNA, 20 bp, mouse
ggaagcagctttggagaagc

SEQ ID NO: 531735 - DNA, 20 bp, mouse
gccctataatcagcaatgac

SEQ ID NO: 531736 - DNA, 20 bp, mouse
gcaggcctgagatgaagccc

SEQ ID NO: 531737 - DNA, 20 bp, mouse
ggctgcgcctggacttccaa

SEQ ID NO: 531738 - DNA, 20 bp, mouse
gacagccagaacaggctcgg

SEQ ID NO: 531739 - DNA, 20 bp, mouse
gacagcccgggcttcatctc

SEQ ID NO: 531740 - DNA, 20 bp, mouse
gagcacagtcagaggtgcgg

SEQ ID NO: 531741 - DNA, 20 bp, mouse
ggggacagccagaacaggct

SEQ ID NO: 531742 - DNA, 20 bp, mouse
gcttgggtcccgctgtcaca

SEQ ID NO: 531743 - DNA, 20 bp, mouse
ggggacctccgagcctgttc

SEQ ID NO: 531744 - DNA, 20 bp, mouse
gccgggctgtggggttccct

SEQ ID NO: 531745 - DNA, 20 bp, mouse
ggacccaaggactctacaac

SEQ ID NO: 531746 - DNA, 20 bp, mouse
gaaacgaacatggtctaaat

SEQ ID NO: 531747 - DNA, 20 bp, mouse
gtcagtacaggaaacgaaca

SEQ ID NO: 531748 - DNA, 20 bp, mouse
ggaatccatgatggtatagt

SEQ ID NO: 531749 - DNA, 20 bp, mouse
gttggttttttcaagtggaa

SEQ ID NO: 531750 - DNA, 20 bp, mouse
gagaaaattggagatcttag

SEQ ID NO: 531751 - DNA, 20 bp, mouse
ggctaccagatcttatacat

SEQ ID NO: 531752 - DNA, 20 bp, mouse
ggacctctggagggaacacc

SEQ ID NO: 531753 - DNA, 20 bp, mouse
gttgagtggtgacctctgga

SEQ ID NO: 531754 - DNA, 20 bp, mouse
gaaaaccaactataccatca

SEQ ID NO: 531755 - DNA, 20 bp, mouse
gtgtccctatgtataagatc

SEQ ID NO: 531756 - DNA, 20 bp, mouse
gagtggtgcttaacaggttg

SEQ ID NO: 531757 - DNA, 20 bp, mouse
gtggtccttccacctaacaa

SEQ ID NO: 531758 - DNA, 20 bp, mouse
gacaggaagtggtgcttaac

SEQ ID NO: 531759 - DNA, 20 bp, mouse
gcacttccagccgagctctc

SEQ ID NO: 531760 - DNA, 20 bp, mouse
ggggctctttagaattaaat

SEQ ID NO: 531761 - DNA, 20 bp, mouse
gcaatcatgcccttgttagg

SEQ ID NO: 531762 - DNA, 20 bp, mouse
gtgacaatcatgcccttgtt

SEQ ID NO: 531763 - DNA, 20 bp, mouse
gctcagaaaccgattcccca

SEQ ID NO: 531764 - DNA, 20 bp, mouse
ggtggaaggaccatgttccc

SEQ ID NO: 531765 - DNA, 20 bp, mouse
gaccgattccccagggaaca

SEQ ID NO: 531766 - DNA, 20 bp, mouse
gtgtgctcgctgcacgggaa

SEQ ID NO: 531767 - DNA, 20 bp, mouse
gcgctgcacgggaagggaag

SEQ ID NO: 531768 - DNA, 20 bp, mouse
ggaagggaagtggtgcttac

SEQ ID NO: 531769 - DNA, 20 bp, mouse
gatcctggagtcctaagctg

SEQ ID NO: 531770 - DNA, 20 bp, mouse
gcataaggagcagagctccc

SEQ ID NO: 531771 - DNA, 20 bp, mouse
gggcctctttagaactaaat

SEQ ID NO: 531772 - DNA, 20 bp, mouse
gcctaatcagtaaatgacct

SEQ ID NO: 531773 - DNA, 20 bp, mouse
ggcaatagcatgagaaatcc

SEQ ID NO: 531774 - DNA, 20 bp, mouse
gtaacagggatataattgtc

SEQ ID NO: 531775 - DNA, 20 bp, mouse
ggacacagactgccattggc

SEQ ID NO: 531776 - DNA, 20 bp, mouse
gaccccaagagctttaacta

SEQ ID NO: 531777 - DNA, 20 bp, mouse
ggcagtctaaggtctgagag

SEQ ID NO: 531778 - DNA, 20 bp, mouse
gacctcaggttacaactcca

SEQ ID NO: 531779 - DNA, 20 bp, mouse
gtggaagcaatagagacact

SEQ ID NO: 531780 - DNA, 20 bp, mouse
gctaaatgggcaaacggaat

SEQ ID NO: 531781 - DNA, 20 bp, mouse
ggctcagaaaccaattccac

SEQ ID NO: 531782 - DNA, 20 bp, mouse
gagactgcctaattagtgaa

SEQ ID NO: 531783 - DNA, 20 bp, mouse
gatgggtattgggtttatat

SEQ ID NO: 531784 - DNA, 20 bp, mouse
ggccctggagttgtaacctg

SEQ ID NO: 531785 - DNA, 20 bp, mouse
gtttaagccattcactaatt

SEQ ID NO: 531786 - DNA, 20 bp, mouse
gagctgcagcacacaggaca

SEQ ID NO: 531787 - DNA, 20 bp, mouse
gggaggaaacagctggtaag

SEQ ID NO: 531788 - DNA, 20 bp, mouse
ggttgagtctgagttctccc

SEQ ID NO: 531789 - DNA, 20 bp, mouse
gcagacagtgcaacttctgg

SEQ ID NO: 531790 - DNA, 20 bp, mouse
gaggcagacagtgcaacttc

SEQ ID NO: 531791 - DNA, 20 bp, mouse
gagagcacaacatctcccag

SEQ ID NO: 531792 - DNA, 20 bp, mouse
gcaaaatgactgagtgtcaa

SEQ ID NO: 531793 - DNA, 20 bp, mouse
gtaagggaactaactatata

SEQ ID NO: 531794 - DNA, 20 bp, mouse
gtgaggacaggtaggaactt

SEQ ID NO: 531795 - DNA, 20 bp, mouse
gagactaagtggcaagagta

SEQ ID NO: 531796 - DNA, 20 bp, mouse
gcagggtgcagtcaatctct

SEQ ID NO: 531797 - DNA, 20 bp, mouse
gaggccagaagataactggt

SEQ ID NO: 531798 - DNA, 20 bp, mouse
gttggcaaccgggcacagta

SEQ ID NO: 531799 - DNA, 20 bp, mouse
gagacgctggagaggtatat

SEQ ID NO: 531800 - DNA, 20 bp, mouse
gatgaatcgcccaactgcac

SEQ ID NO: 531801 - DNA, 20 bp, mouse
ggttaatgctgagacccaca

SEQ ID NO: 531802 - DNA, 20 bp, mouse
gaaagaagtagagaggactt

SEQ ID NO: 531803 - DNA, 20 bp, mouse
gttgggtgaaaaacatagaa

SEQ ID NO: 531804 - DNA, 20 bp, mouse
gacagcaaagagttgggaac

SEQ ID NO: 531805 - DNA, 20 bp, mouse
gagagacttacttggcaacc

SEQ ID NO: 531806 - DNA, 20 bp, mouse
ggaggaaggaggtaatttct

SEQ ID NO: 531807 - DNA, 20 bp, mouse
gaacagggggtccttcctgg

SEQ ID NO: 531808 - DNA, 20 bp, mouse
gggagaaatggaacaatcgt

SEQ ID NO: 531809 - DNA, 20 bp, mouse
gttctgagcctaaagaacag

SEQ ID NO: 531810 - DNA, 20 bp, mouse
gagcatgccaggcatactac

SEQ ID NO: 531811 - DNA, 20 bp, mouse
gagcaggccagtagtatgcc

SEQ ID NO: 531812 - DNA, 20 bp, mouse
gcccctgcctgatcaaagat

SEQ ID NO: 531813 - DNA, 20 bp, mouse
gggtcttgctgtcatttcat

SEQ ID NO: 531814 - DNA, 20 bp, mouse
ggcatagtcagtaacttact

SEQ ID NO: 531815 - DNA, 20 bp, mouse
ggaaggaccccctgttcttt

SEQ ID NO: 531816 - DNA, 20 bp, mouse
gcgggcagctccgagccaca

SEQ ID NO: 531817 - DNA, 20 bp, mouse
gccgggcgagaaggagaccg

SEQ ID NO: 531818 - DNA, 20 bp, mouse
gtcacttccgggcggtgcag

SEQ ID NO: 531819 - DNA, 20 bp, mouse
gggaagatggctgcgccctg

SEQ ID NO: 531820 - DNA, 20 bp, mouse
ggcgctgccgggcccgagag

SEQ ID NO: 531821 - DNA, 20 bp, mouse
gccatcttcggaattttgag

SEQ ID NO: 531822 - DNA, 20 bp, mouse
gttttgagcggcgagttggc

SEQ ID NO: 531823 - DNA, 20 bp, mouse
gcttccgggcggtgcagcgg

SEQ ID NO: 531824 - DNA, 20 bp, mouse
gctgccgggcccgagagggg

SEQ ID NO: 531825 - DNA, 20 bp, mouse
gggaattttgagcggcgagt

SEQ ID NO: 531826 - DNA, 20 bp, mouse
ggcggccgcaagtcccgggg

SEQ ID NO: 531827 - DNA, 20 bp, mouse
gttggcgctgaactcagagt

SEQ ID NO: 531828 - DNA, 20 bp, mouse
ggcagctcccgggccaaggt

SEQ ID NO: 531829 - DNA, 20 bp, mouse
ggcggcggccgcaagtcccg

SEQ ID NO: 531830 - DNA, 20 bp, mouse
gaggaggcagggggtctcaa

SEQ ID NO: 531831 - DNA, 20 bp, mouse
gtaggaggttgaggcccgga

SEQ ID NO: 531832 - DNA, 20 bp, mouse
gcgtcggcctgcggggagga

SEQ ID NO: 531833 - DNA, 20 bp, mouse
gtccggtccagaggtataaa

SEQ ID NO: 531834 - DNA, 20 bp, mouse
gccgcgccgccgctgcaggt

SEQ ID NO: 531835 - DNA, 20 bp, mouse
gtggcccgggagctgcggaa

SEQ ID NO: 531836 - DNA, 20 bp, mouse
gaagctggctagatacctaa

SEQ ID NO: 531837 - DNA, 20 bp, mouse
gagtcatctagatcagacgt

SEQ ID NO: 531838 - DNA, 20 bp, mouse
gcacaaacccaaggctttgt

SEQ ID NO: 531839 - DNA, 20 bp, mouse
gctggcgcgcactcatgaaa

SEQ ID NO: 531840 - DNA, 20 bp, mouse
gactgaggtttccaatcacc

SEQ ID NO: 531841 - DNA, 20 bp, mouse
gctaagagccaacaaagcct

SEQ ID NO: 531842 - DNA, 20 bp, mouse
gatgaagcgaatggcctggg

SEQ ID NO: 531843 - DNA, 20 bp, mouse
ggaaccaacgagcttcatgt

SEQ ID NO: 531844 - DNA, 20 bp, mouse
gaggccaacatgaagctcgt

SEQ ID NO: 531845 - DNA, 20 bp, mouse
gaaagaaattaccaagagga

SEQ ID NO: 531846 - DNA, 20 bp, mouse
gagcagagccctgggctaca

SEQ ID NO: 531847 - DNA, 20 bp, mouse
gtgagctgggcgcctggagt

SEQ ID NO: 531848 - DNA, 20 bp, mouse
gctgctgaccctgtagccca

SEQ ID NO: 531849 - DNA, 20 bp, mouse
gaggggaggaccagagacca

SEQ ID NO: 531850 - DNA, 20 bp, mouse
gagcagatcgcgcccactcc

SEQ ID NO: 531851 - DNA, 20 bp, mouse
gtcaagttcagcagagccct

SEQ ID NO: 531852 - DNA, 20 bp, mouse
gcaggggagcctcagtgcgg

SEQ ID NO: 531853 - DNA, 20 bp, mouse
gtcagtgcggaggcaagccc

SEQ ID NO: 531854 - DNA, 20 bp, mouse
gcgaagactcggagatgagg

SEQ ID NO: 531855 - DNA, 20 bp, mouse
gtgaggctcccctgtgagct

SEQ ID NO: 531856 - DNA, 20 bp, mouse
gtcccgggtatggacaacct

SEQ ID NO: 531857 - DNA, 20 bp, mouse
gggcagtgcgacctcagagt

SEQ ID NO: 531858 - DNA, 20 bp, mouse
gcccgggaggcagcagtaca

SEQ ID NO: 531859 - DNA, 20 bp, mouse
ggctgaggaaggtctcaccc

SEQ ID NO: 531860 - DNA, 20 bp, mouse
gcagcagtacaagggctcct

SEQ ID NO: 531861 - DNA, 20 bp, mouse
gacccaggttgtccataccc

SEQ ID NO: 531862 - DNA, 20 bp, mouse
gagagtccaggccatcctcc

SEQ ID NO: 531863 - DNA, 20 bp, mouse
gtctctggagtcctactctg

SEQ ID NO: 531864 - DNA, 20 bp, mouse
gcagcagtgtgtagataggg

SEQ ID NO: 531865 - DNA, 20 bp, mouse
gccagcacaggaggcagcga

SEQ ID NO: 531866 - DNA, 20 bp, mouse
gtggagcggctcggaaatgg

SEQ ID NO: 531867 - DNA, 20 bp, mouse
ggtgtggagcggctcggaaa

SEQ ID NO: 531868 - DNA, 20 bp, mouse
ggcgaggtgttcaagaccca

SEQ ID NO: 531869 - DNA, 20 bp, mouse
gctctgtgctctagtggtgt

SEQ ID NO: 531870 - DNA, 20 bp, mouse
gccaactgcagcgtctcctt

SEQ ID NO: 531871 - DNA, 20 bp, mouse
ggggtcgctctgtgctctag

SEQ ID NO: 531872 - DNA, 20 bp, mouse
gcctaggagcgaggagtgga

SEQ ID NO: 531873 - DNA, 20 bp, mouse
ggaaatggcggtgcagccta

SEQ ID NO: 531874 - DNA, 20 bp, mouse
gaaacgacgcggccagcgca

SEQ ID NO: 531875 - DNA, 20 bp, mouse
gctgggcgcatgcagcggtg

SEQ ID NO: 531876 - DNA, 20 bp, mouse
ggcgcaggcgcgagaaagtg

SEQ ID NO: 531877 - DNA, 20 bp, mouse
gcccaaggccggtcccgcac

SEQ ID NO: 531878 - DNA, 20 bp, mouse
gcagcagagaaggtaaagta

SEQ ID NO: 531879 - DNA, 20 bp, mouse
ggccggtcccgcacaggttg

SEQ ID NO: 531880 - DNA, 20 bp, mouse
gtagccgtcgtggccggaag

SEQ ID NO: 531881 - DNA, 20 bp, mouse
gttctctgctggctccgtgg

SEQ ID NO: 531882 - DNA, 20 bp, mouse
gtcgcctaggtggacgctag

SEQ ID NO: 531883 - DNA, 20 bp, mouse
gtggagagcttattaatggt

SEQ ID NO: 531884 - DNA, 20 bp, mouse
ggcgcccctagcgtccacct

SEQ ID NO: 531885 - DNA, 20 bp, mouse
gcctaggcgaaggccgtccc

SEQ ID NO: 531886 - DNA, 20 bp, mouse
gtggtacctaaggagtgaag

SEQ ID NO: 531887 - DNA, 20 bp, mouse
gttgttgagcctggtaccta

SEQ ID NO: 531888 - DNA, 20 bp, mouse
gcagcgcaggcgcagttcag

SEQ ID NO: 531889 - DNA, 20 bp, mouse
gggcacaaccctggacgcaa

SEQ ID NO: 531890 - DNA, 20 bp, mouse
ggacaacctaggtggttagt

SEQ ID NO: 531891 - DNA, 20 bp, mouse
gtatagcccactaaccacct

SEQ ID NO: 531892 - DNA, 20 bp, mouse
ggccacgcgcgcagaacctt

SEQ ID NO: 531893 - DNA, 20 bp, mouse
gaaaggccggagagatgctg

SEQ ID NO: 531894 - DNA, 20 bp, mouse
gtagcctcccgccttgtcag

SEQ ID NO: 531895 - DNA, 20 bp, mouse
gcgtggcttcgagcactcca

SEQ ID NO: 531896 - DNA, 20 bp, mouse
gtcagggaggtggatcgtcg

SEQ ID NO: 531897 - DNA, 20 bp, mouse
gggcttgcggcggttggtca

SEQ ID NO: 531898 - DNA, 20 bp, mouse
gcttcgagtgacaggaatga

SEQ ID NO: 531899 - DNA, 20 bp, mouse
ggcggctgaggtgacggaaa

SEQ ID NO: 531900 - DNA, 20 bp, mouse
gacaggctgcaggcttgcgg

SEQ ID NO: 531901 - DNA, 20 bp, mouse
gttgcggcggttggtcaggg

SEQ ID NO: 531902 - DNA, 20 bp, mouse
gatcgtcgcggctgaggtga

SEQ ID NO: 531903 - DNA, 20 bp, mouse
gctggtgcgcgggctttcag

SEQ ID NO: 531904 - DNA, 20 bp, mouse
ggctgaggtgacggaaaagg

SEQ ID NO: 531905 - DNA, 20 bp, mouse
ggcgcgcggcccacgcctac

SEQ ID NO: 531906 - DNA, 20 bp, mouse
gcggtggatgcgatccttgt

SEQ ID NO: 531907 - DNA, 20 bp, mouse
gcgggaagcggaggctccag

SEQ ID NO: 531908 - DNA, 20 bp, mouse
gtgacgggcagaccgggcca

SEQ ID NO: 531909 - DNA, 20 bp, mouse
gacggctccgagcgcctaca

SEQ ID NO: 531910 - DNA, 20 bp, mouse
ggaaggctgacgggcagacc

SEQ ID NO: 531911 - DNA, 20 bp, mouse
ggcggaggctccagaggcag

SEQ ID NO: 531912 - DNA, 20 bp, mouse
ggggctacggatgctcgggt

SEQ ID NO: 531913 - DNA, 20 bp, mouse
gcgccgctggcgggaaagtc

SEQ ID NO: 531914 - DNA, 20 bp, mouse
gctggagcgaggctgaaccc

SEQ ID NO: 531915 - DNA, 20 bp, mouse
gctttgtcgggacatgatga

SEQ ID NO: 531916 - DNA, 20 bp, mouse
ggctcggcgcggggcagatg

SEQ ID NO: 531917 - DNA, 20 bp, mouse
gatgaggagcgcggcgaagg

SEQ ID NO: 531918 - DNA, 20 bp, mouse
ggcggggcagatgaggagcg

SEQ ID NO: 531919 - DNA, 20 bp, mouse
gcagatgaggagcgcggcga

SEQ ID NO: 531920 - DNA, 20 bp, mouse
gtcgtgcggcgagtccgggg

SEQ ID NO: 531921 - DNA, 20 bp, mouse
ggggaggccccggcccgacc

SEQ ID NO: 531922 - DNA, 20 bp, mouse
gcgcagggtgagccagccca

SEQ ID NO: 531923 - DNA, 20 bp, mouse
gaacatggccgatccgggtc

SEQ ID NO: 531924 - DNA, 20 bp, mouse
gccgggccggaccgtaccag

SEQ ID NO: 531925 - DNA, 20 bp, mouse
gggcgcggaagagggcacga

SEQ ID NO: 531926 - DNA, 20 bp, mouse
ggaggagggacggagatctg

SEQ ID NO: 531927 - DNA, 20 bp, mouse
ggcgagagcccgtcacacgt

SEQ ID NO: 531928 - DNA, 20 bp, mouse
ggagcttcgcagccgccggg

SEQ ID NO: 531929 - DNA, 20 bp, mouse
gacagcgaagcggagcgcag

SEQ ID NO: 531930 - DNA, 20 bp, mouse
gttcgcagccgccgggcggg

SEQ ID NO: 531931 - DNA, 20 bp, mouse
ggccccgaacgagcccgcgg

SEQ ID NO: 531932 - DNA, 20 bp, mouse
ggcgaagcggagcgcagcgg

SEQ ID NO: 531933 - DNA, 20 bp, mouse
ggggtcgtgctgggagtcgt

SEQ ID NO: 531934 - DNA, 20 bp, mouse
ggagccgagcccacgtgtga

SEQ ID NO: 531935 - DNA, 20 bp, mouse
gaggtgcgcgagtgccccaa

SEQ ID NO: 531936 - DNA, 20 bp, mouse
gtctgcggcgaaggcgacgg

SEQ ID NO: 531937 - DNA, 20 bp, mouse
ggcctctgcggcgaaggcga

SEQ ID NO: 531938 - DNA, 20 bp, mouse
ggctccggggatgagctcgg

SEQ ID NO: 531939 - DNA, 20 bp, mouse
gcggcgaggccaccatgggt

SEQ ID NO: 531940 - DNA, 20 bp, mouse
ggaggcccgccgccgaccca

SEQ ID NO: 531941 - DNA, 20 bp, mouse
ggcggcggcgaggccaccat

SEQ ID NO: 531942 - DNA, 20 bp, mouse
gccggcgagcggagaagtgg

SEQ ID NO: 531943 - DNA, 20 bp, mouse
gccgcccccgagctcatccc

SEQ ID NO: 531944 - DNA, 20 bp, mouse
gccgccggcgagcggagaag

SEQ ID NO: 531945 - DNA, 20 bp, mouse
ggcagcgcgggggaccgaga

SEQ ID NO: 531946 - DNA, 20 bp, mouse
gcgtcgctgcgatggagtaa

SEQ ID NO: 531947 - DNA, 20 bp, mouse
gcatcgcagcgacgtcgcgg

SEQ ID NO: 531948 - DNA, 20 bp, mouse
gccgtcggaagagaaacgtg

SEQ ID NO: 531949 - DNA, 20 bp, mouse
gagcgggacggtggggacta

SEQ ID NO: 531950 - DNA, 20 bp, mouse
gcacgggagcgggcccggtg

SEQ ID NO: 531951 - DNA, 20 bp, mouse
gctccatcgcagcgacgtcg

SEQ ID NO: 531952 - DNA, 20 bp, mouse
gcggccgcggaggcacctcc

SEQ ID NO: 531953 - DNA, 20 bp, mouse
gagcgacgtcgcggaggcag

SEQ ID NO: 531954 - DNA, 20 bp, mouse
ggcggctgggtgctccggac

SEQ ID NO: 531955 - DNA, 20 bp, mouse
ggcggaggcagcgggacggt

SEQ ID NO: 531956 - DNA, 20 bp, mouse
ggagcggcccgggactacag

SEQ ID NO: 531957 - DNA, 20 bp, mouse
gagcaaatgagcgcgagcga

SEQ ID NO: 531958 - DNA, 20 bp, mouse
ggagtcctggacagccacca

SEQ ID NO: 531959 - DNA, 20 bp, mouse
gcgcgctcatttgctcatcg

SEQ ID NO: 531960 - DNA, 20 bp, mouse
gcagcactcgcgccttggta

SEQ ID NO: 531961 - DNA, 20 bp, mouse
gtgggaggcaaaggggccag

SEQ ID NO: 531962 - DNA, 20 bp, mouse
gactgggttcgagggatggg

SEQ ID NO: 531963 - DNA, 20 bp, mouse
ggctcatttgctcatcgtgg

SEQ ID NO: 531964 - DNA, 20 bp, mouse
gggcggagggcgaggctccg

SEQ ID NO: 531965 - DNA, 20 bp, mouse
gaggccaaggcgcgccctgg

SEQ ID NO: 531966 - DNA, 20 bp, mouse
gcagctctcgatctaaaggg

SEQ ID NO: 531967 - DNA, 20 bp, mouse
gacccagctctcgatctaaa

SEQ ID NO: 531968 - DNA, 20 bp, mouse
gtctcgatctaaagggggga

SEQ ID NO: 531969 - DNA, 20 bp, mouse
gttatcgggaaagacgaaaa

SEQ ID NO: 531970 - DNA, 20 bp, mouse
gagtaatcatgcctcagacc

SEQ ID NO: 531971 - DNA, 20 bp, mouse
gggaaagcttgcctggtctg

SEQ ID NO: 531972 - DNA, 20 bp, mouse
gaggaaatactactcacgcg

SEQ ID NO: 531973 - DNA, 20 bp, mouse
ggagtaatctctagaaatct

SEQ ID NO: 531974 - DNA, 20 bp, mouse
gccgaaaattactataagtt

SEQ ID NO: 531975 - DNA, 20 bp, mouse
gggttaccaataaagcacaa

SEQ ID NO: 531976 - DNA, 20 bp, mouse
gcaaccgaactgctcgctgt

SEQ ID NO: 531977 - DNA, 20 bp, mouse
ggtctggagaggtattctag

SEQ ID NO: 531978 - DNA, 20 bp, mouse
gaaagcagtcgaaaactgcg

SEQ ID NO: 531979 - DNA, 20 bp, mouse
gtgccaccaagagtaagcta

SEQ ID NO: 531980 - DNA, 20 bp, mouse
gattcccacagcgagcagtt

SEQ ID NO: 531981 - DNA, 20 bp, mouse
ggtgctggtcagtggggtca

SEQ ID NO: 531982 - DNA, 20 bp, mouse
gagcttacctcatcaaggtg

SEQ ID NO: 531983 - DNA, 20 bp, mouse
gactgcttttgaagcccagg

SEQ ID NO: 531984 - DNA, 20 bp, mouse
gagttgtcaatgccctctct

SEQ ID NO: 531985 - DNA, 20 bp, mouse
ggaccctagcttactcttgg

SEQ ID NO: 531986 - DNA, 20 bp, mouse
gctgtttggagacaacgaag

SEQ ID NO: 531987 - DNA, 20 bp, mouse
gacctgcagtagtgtctact

SEQ ID NO: 531988 - DNA, 20 bp, mouse
gttccacaggaccccagcag

SEQ ID NO: 531989 - DNA, 20 bp, mouse
ggcctggcaagcggtcagtg

SEQ ID NO: 531990 - DNA, 20 bp, mouse
ggcctagtagacactactgc

SEQ ID NO: 531991 - DNA, 20 bp, mouse
gaacagtggtgtgggttgag

SEQ ID NO: 531992 - DNA, 20 bp, mouse
gcccatactcaccaagacta

SEQ ID NO: 531993 - DNA, 20 bp, mouse
ggtcttggtgagtatgggtt

SEQ ID NO: 531994 - DNA, 20 bp, mouse
gccctaggcctacagagcat

SEQ ID NO: 531995 - DNA, 20 bp, mouse
gtgggctgatccccaggaag

SEQ ID NO: 531996 - DNA, 20 bp, mouse
gtgctatgcctgggcccaag

SEQ ID NO: 531997 - DNA, 20 bp, mouse
gggttgatacaagcattacc

SEQ ID NO: 531998 - DNA, 20 bp, mouse
gtcagccccaggagaaactc

SEQ ID NO: 531999 - DNA, 20 bp, mouse
gtgtggctgtgacacctgcc

SEQ ID NO: 532000 - DNA, 20 bp, mouse
gcagccacagtagattgact

SEQ ID NO: 532001 - DNA, 20 bp, mouse
ggcaggtgcgtgctatgcct

SEQ ID NO: 532002 - DNA, 20 bp, mouse
gctgcctagtcaatctactg

SEQ ID NO: 532003 - DNA, 20 bp, mouse
ggtatcaaccccttgggccc

SEQ ID NO: 532004 - DNA, 20 bp, mouse
ggaaggctactaccctgcgt

SEQ ID NO: 532005 - DNA, 20 bp, mouse
gaaggagactagactgtgcc

SEQ ID NO: 532006 - DNA, 20 bp, mouse
gagcaggactccttacaggt

SEQ ID NO: 532007 - DNA, 20 bp, mouse
gctggaggtacccacctgta

SEQ ID NO: 532008 - DNA, 20 bp, mouse
gacaaagcaggactccttac

SEQ ID NO: 532009 - DNA, 20 bp, mouse
gacagagctaggggtcgagg

SEQ ID NO: 532010 - DNA, 20 bp, mouse
gggtgactgattcatacata

SEQ ID NO: 532011 - DNA, 20 bp, mouse
gcctccttggacagagctag

SEQ ID NO: 532012 - DNA, 20 bp, mouse
gatgaatcagtcacctacca

SEQ ID NO: 532013 - DNA, 20 bp, mouse
gagctaggggtcgaggaggt

SEQ ID NO: 532014 - DNA, 20 bp, mouse
ggagtcctgctttgtcacca

SEQ ID NO: 532015 - DNA, 20 bp, mouse
ggaggcctcagagtgaactc

SEQ ID NO: 532016 - DNA, 20 bp, mouse
gaagccaaggggatcctcgg

SEQ ID NO: 532017 - DNA, 20 bp, mouse
ggagagaaactcaggagtca

SEQ ID NO: 532018 - DNA, 20 bp, mouse
gtctgagccgaagccaggaa

SEQ ID NO: 532019 - DNA, 20 bp, mouse
gggtatgagacgggagccca

SEQ ID NO: 532020 - DNA, 20 bp, mouse
gcccaaggagagagaaactc

SEQ ID NO: 532021 - DNA, 20 bp, mouse
gaagggggtaagaagaccag

SEQ ID NO: 532022 - DNA, 20 bp, mouse
gctgctgaggagagctggac

SEQ ID NO: 532023 - DNA, 20 bp, mouse
gcccagccatggtatgagac

SEQ ID NO: 532024 - DNA, 20 bp, mouse
gactcaggagtcaaggagca

SEQ ID NO: 532025 - DNA, 20 bp, mouse
gcgtagtggcagggagctag

SEQ ID NO: 532026 - DNA, 20 bp, mouse
ggcaaggactccggagaacc

SEQ ID NO: 532027 - DNA, 20 bp, mouse
gagaaccgggtgctcagatt

SEQ ID NO: 532028 - DNA, 20 bp, mouse
gagtcgcccaacgctagagt

SEQ ID NO: 532029 - DNA, 20 bp, mouse
gtgggtcccactctagcgtt

SEQ ID NO: 532030 - DNA, 20 bp, mouse
gcgcgcagtacacttcggca

SEQ ID NO: 532031 - DNA, 20 bp, mouse
ggcggcaagggcagaggagt

SEQ ID NO: 532032 - DNA, 20 bp, mouse
gtacacttcggcaaggactc

SEQ ID NO: 532033 - DNA, 20 bp, mouse
gggagcgagcagcgcaacgg

SEQ ID NO: 532034 - DNA, 20 bp, mouse
gcaagcccgaagccataaag

SEQ ID NO: 532035 - DNA, 20 bp, mouse
gagcgctctagagggtgaca

SEQ ID NO: 532036 - DNA, 20 bp, mouse
gttaccagcaatgacaaaag

SEQ ID NO: 532037 - DNA, 20 bp, mouse
gggtttcaattgtaaagaga

SEQ ID NO: 532038 - DNA, 20 bp, mouse
ggcatctagcccacaaggaa

SEQ ID NO: 532039 - DNA, 20 bp, mouse
gtttcagcatctagcccaca

SEQ ID NO: 532040 - DNA, 20 bp, mouse
gactgtgagataaagatttt

SEQ ID NO: 532041 - DNA, 20 bp, mouse
gtgttgcttaacaggtaaac

SEQ ID NO: 532042 - DNA, 20 bp, mouse
gtgaagtacaattcagagaa

SEQ ID NO: 532043 - DNA, 20 bp, mouse
gatacctcttttgtcattgc

SEQ ID NO: 532044 - DNA, 20 bp, mouse
gtttcttcttgtgaaatttc

SEQ ID NO: 532045 - DNA, 20 bp, mouse
gaattgtaaagagagggaag

SEQ ID NO: 532046 - DNA, 20 bp, mouse
gttctagaggcggagagcat

SEQ ID NO: 532047 - DNA, 20 bp, mouse
gtggagagcccttctagagg

SEQ ID NO: 532048 - DNA, 20 bp, mouse
gggaggtctgccccgcgaga

SEQ ID NO: 532049 - DNA, 20 bp, mouse
ggcggcgtgtccgtctcgcg

SEQ ID NO: 532050 - DNA, 20 bp, mouse
gctctagcgccaacccggta

SEQ ID NO: 532051 - DNA, 20 bp, mouse
gccaggcctggctgtctctg

SEQ ID NO: 532052 - DNA, 20 bp, mouse
gatccctgtaacaggtaagg

SEQ ID NO: 532053 - DNA, 20 bp, mouse
gcggggcagacctccaggcc

SEQ ID NO: 532054 - DNA, 20 bp, mouse
gcccatcctccgtaccgggt

SEQ ID NO: 532055 - DNA, 20 bp, mouse
ggacgtgcgggaccgcgggt

SEQ ID NO: 532056 - DNA, 20 bp, mouse
gcgttctgcagcttcttcgg

SEQ ID NO: 532057 - DNA, 20 bp, mouse
gtggagcaggaggacttgag

SEQ ID NO: 532058 - DNA, 20 bp, mouse
gaagaagctgcagaacgaca

SEQ ID NO: 532059 - DNA, 20 bp, mouse
gtcgagccaggtacaccccg

SEQ ID NO: 532060 - DNA, 20 bp, mouse
ggacatggtcgcgacgggac

SEQ ID NO: 532061 - DNA, 20 bp, mouse
gagaacgacatggtcgcgac

SEQ ID NO: 532062 - DNA, 20 bp, mouse
gccactctgacaccatccgg

SEQ ID NO: 532063 - DNA, 20 bp, mouse
gtaatgccacggggtgtacc

SEQ ID NO: 532064 - DNA, 20 bp, mouse
gaaagctcccagccaggtcc

SEQ ID NO: 532065 - DNA, 20 bp, mouse
gtaagggtgatgccaccgga

SEQ ID NO: 532066 - DNA, 20 bp, mouse
gggcttgggaggaaacccgt

SEQ ID NO: 532067 - DNA, 20 bp, mouse
gttgggaggaaacccgttgg

SEQ ID NO: 532068 - DNA, 20 bp, mouse
gcccgttggtggcagcgtca

SEQ ID NO: 532069 - DNA, 20 bp, mouse
gggagagggcgcacaaggta

SEQ ID NO: 532070 - DNA, 20 bp, mouse
ggactgctgcgagcgctgcg

SEQ ID NO: 532071 - DNA, 20 bp, mouse
gggaggaggggaagagacct

SEQ ID NO: 532072 - DNA, 20 bp, mouse
gtttgctgcaggcgcctgga

SEQ ID NO: 532073 - DNA, 20 bp, mouse
gcctgagagactggtcccag

SEQ ID NO: 532074 - DNA, 20 bp, mouse
gcggcccgctgcctgagttg

SEQ ID NO: 532075 - DNA, 20 bp, mouse
gccctgggcggcctcctgtg

SEQ ID NO: 532076 - DNA, 20 bp, mouse
gcgcggctaggcagagaccc

SEQ ID NO: 532077 - DNA, 20 bp, mouse
gacccaggcagagcgcgatt

SEQ ID NO: 532078 - DNA, 20 bp, mouse
gggtccacgccgagactcta

SEQ ID NO: 532079 - DNA, 20 bp, mouse
gagcgcgattgggcacggga

SEQ ID NO: 532080 - DNA, 20 bp, mouse
gaggagggatcggacagcgg

SEQ ID NO: 532081 - DNA, 20 bp, mouse
gctgtcgcccggagccggga

SEQ ID NO: 532082 - DNA, 20 bp, mouse
ggggaggagggatcggacag

SEQ ID NO: 532083 - DNA, 20 bp, mouse
ggcagagcgcgattgggcac

SEQ ID NO: 532084 - DNA, 20 bp, mouse
ggggtccgccgcgcactctt

SEQ ID NO: 532085 - DNA, 20 bp, mouse
gcttccccaagagtgcgcgg

SEQ ID NO: 532086 - DNA, 20 bp, mouse
gagagaaggaaggaagccta

SEQ ID NO: 532087 - DNA, 20 bp, mouse
gggaagcctagggcttaaca

SEQ ID NO: 532088 - DNA, 20 bp, mouse
gacttaccctgttaagccct

SEQ ID NO: 532089 - DNA, 20 bp, mouse
ggatcatagggagcccagtc

SEQ ID NO: 532090 - DNA, 20 bp, mouse
gtgggctccttgaacaggat

SEQ ID NO: 532091 - DNA, 20 bp, mouse
gaagcatttacttcacttgg

SEQ ID NO: 532092 - DNA, 20 bp, mouse
gcttctgagatatccagact

SEQ ID NO: 532093 - DNA, 20 bp, mouse
ggcttcatctcttcagacct

SEQ ID NO: 532094 - DNA, 20 bp, mouse
gcaaatgtggggagaaggta

SEQ ID NO: 532095 - DNA, 20 bp, mouse
gggaagcagaaatggttact

SEQ ID NO: 532096 - DNA, 20 bp, mouse
gggcagactgggatcagggt

SEQ ID NO: 532097 - DNA, 20 bp, mouse
gccagcttaggagaatgggg

SEQ ID NO: 532098 - DNA, 20 bp, mouse
gcttctggtacagtgttcaa

SEQ ID NO: 532099 - DNA, 20 bp, mouse
ggcctccagcttaggagaat

SEQ ID NO: 532100 - DNA, 20 bp, mouse
gtcatctgaggggtgagaag

SEQ ID NO: 532101 - DNA, 20 bp, mouse
gtccgggatggggctgtggt

SEQ ID NO: 532102 - DNA, 20 bp, mouse
gagagcatactgtagcccag

SEQ ID NO: 532103 - DNA, 20 bp, mouse
gtggcctctcaccagaataa

SEQ ID NO: 532104 - DNA, 20 bp, mouse
gagctctgctcaacaggcca

SEQ ID NO: 532105 - DNA, 20 bp, mouse
gtcccagtctgccttcacga

SEQ ID NO: 532106 - DNA, 20 bp, mouse
gggacccacggacacggcaa

SEQ ID NO: 532107 - DNA, 20 bp, mouse
gtggcacgatcacctcacca

SEQ ID NO: 532108 - DNA, 20 bp, mouse
gggctgtggacccacggaca

SEQ ID NO: 532109 - DNA, 20 bp, mouse
ggcagctggggcccctggtg

SEQ ID NO: 532110 - DNA, 20 bp, mouse
gatccaagtagctgtagcag

SEQ ID NO: 532111 - DNA, 20 bp, mouse
ggcacctggctgtggaccca

SEQ ID NO: 532112 - DNA, 20 bp, mouse
gggctgcgtagggtattcgt

SEQ ID NO: 532113 - DNA, 20 bp, mouse
gagcggtactgaaagctcct

SEQ ID NO: 532114 - DNA, 20 bp, mouse
ggtgccattgccgtgtccgt

SEQ ID NO: 532115 - DNA, 20 bp, mouse
gtcagctcggaccctgagtc

SEQ ID NO: 532116 - DNA, 20 bp, mouse
gtggcaggttgtctctcgga

SEQ ID NO: 532117 - DNA, 20 bp, mouse
ggcccagtggatctaaatga

SEQ ID NO: 532118 - DNA, 20 bp, mouse
gggcgtggcaggttgtctct

SEQ ID NO: 532119 - DNA, 20 bp, mouse
gtatacaggactccctggcg

SEQ ID NO: 532120 - DNA, 20 bp, mouse
gagaaaatgtggaaaaagag

SEQ ID NO: 532121 - DNA, 20 bp, mouse
gcaggactccctggcgtggc

SEQ ID NO: 532122 - DNA, 20 bp, mouse
gcatgcactaatatttcact

SEQ ID NO: 532123 - DNA, 20 bp, mouse
gttccaggcgcagcttactg

SEQ ID NO: 532124 - DNA, 20 bp, mouse
gcgatcagttcccggagtgg

SEQ ID NO: 532125 - DNA, 20 bp, mouse
ggatcgatcagttcccggag

SEQ ID NO: 532126 - DNA, 20 bp, mouse
ggtggagtgcccaagagcag

SEQ ID NO: 532127 - DNA, 20 bp, mouse
ggagtgcccaagagcagcgg

SEQ ID NO: 532128 - DNA, 20 bp, mouse
gccataccgccgctgctctt

SEQ ID NO: 532129 - DNA, 20 bp, mouse
gccggctgatgggcccgcgg

SEQ ID NO: 532130 - DNA, 20 bp, mouse
gcgggcccatcagccggagg

SEQ ID NO: 532131 - DNA, 20 bp, mouse
ggcatcctgtaggggtcaca

SEQ ID NO: 532132 - DNA, 20 bp, mouse
gctgcagcgtgagcacctcg

SEQ ID NO: 532133 - DNA, 20 bp, mouse
gccagcgcagcatcctgtag

SEQ ID NO: 532134 - DNA, 20 bp, mouse
gtgaaaggtgaggcgatggt

SEQ ID NO: 532135 - DNA, 20 bp, mouse
ggcccatcagccggaggggg

SEQ ID NO: 532136 - DNA, 20 bp, mouse
gcgctcgagttggccttctg

SEQ ID NO: 532137 - DNA, 20 bp, mouse
ggcgagtgcgcctgggaact

SEQ ID NO: 532138 - DNA, 20 bp, mouse
gggagccggcgagtgcgcct

SEQ ID NO: 532139 - DNA, 20 bp, mouse
gcaagttctcaggggagcgg

SEQ ID NO: 532140 - DNA, 20 bp, mouse
gcgagacagccctggatcat

SEQ ID NO: 532141 - DNA, 20 bp, mouse
gaggccaactcgagcgagcg

SEQ ID NO: 532142 - DNA, 20 bp, mouse
gctcgcgcgcgagcctcctg

SEQ ID NO: 532143 - DNA, 20 bp, mouse
ggcccgaaacccatgatcca

SEQ ID NO: 532144 - DNA, 20 bp, mouse
ggcttctgcgagctcctgac

SEQ ID NO: 532145 - DNA, 20 bp, mouse
gaggccccgctcgctcgagt

SEQ ID NO: 532146 - DNA, 20 bp, mouse
gtacgcggcgcagaaagtca

SEQ ID NO: 532147 - DNA, 20 bp, mouse
gtcgcgcgccgacagctacg

SEQ ID NO: 532148 - DNA, 20 bp, mouse
gtggcttctccgactaaagg

SEQ ID NO: 532149 - DNA, 20 bp, mouse
gttctgcgccgcgtagctgt

SEQ ID NO: 532150 - DNA, 20 bp, mouse
gtgtcggcgcgcgactccgc

SEQ ID NO: 532151 - DNA, 20 bp, mouse
ggcccagcctgtcctccgag

SEQ ID NO: 532152 - DNA, 20 bp, mouse
gcagccgaggcgcagtcggg

SEQ ID NO: 532153 - DNA, 20 bp, mouse
gacaagtcaccgcctttagt

SEQ ID NO: 532154 - DNA, 20 bp, mouse
gtcatggcttctccgactaa

SEQ ID NO: 532155 - DNA, 20 bp, mouse
gagcgcgaggggtcccagag

SEQ ID NO: 532156 - DNA, 20 bp, mouse
gtgggacgcgtgggacccag

SEQ ID NO: 532157 - DNA, 20 bp, mouse
gcccacgcgtcccagccggg

SEQ ID NO: 532158 - DNA, 20 bp, mouse
ggcccgggccatgcatggga

SEQ ID NO: 532159 - DNA, 20 bp, mouse
gtgtcgcccgggccatgcat

SEQ ID NO: 532160 - DNA, 20 bp, mouse
gggtcccacgcgtcccagcc

SEQ ID NO: 532161 - DNA, 20 bp, mouse
gagcgtcgagtctctgctgg

SEQ ID NO: 532162 - DNA, 20 bp, mouse
ggctaggaccttgggctctg

SEQ ID NO: 532163 - DNA, 20 bp, mouse
ggggccatgcatgggatggc

SEQ ID NO: 532164 - DNA, 20 bp, mouse
gggagactgagcacttacgt

SEQ ID NO: 532165 - DNA, 20 bp, mouse
ggggtagcggcgcatgaaag

SEQ ID NO: 532166 - DNA, 20 bp, mouse
gtggagctacggagtaagtg

SEQ ID NO: 532167 - DNA, 20 bp, mouse
ggcttcaccagatctcggaa

SEQ ID NO: 532168 - DNA, 20 bp, mouse
gtacggagtaagtgaggaga

SEQ ID NO: 532169 - DNA, 20 bp, mouse
gggatcgggagtcttaccgg

SEQ ID NO: 532170 - DNA, 20 bp, mouse
gctccagcttcaccagatct

SEQ ID NO: 532171 - DNA, 20 bp, mouse
gtggggtccattccgagatc

SEQ ID NO: 532172 - DNA, 20 bp, mouse
gactcaggacgttgaagtcg

SEQ ID NO: 532173 - DNA, 20 bp, mouse
gtggcacgactggctcggat

SEQ ID NO: 532174 - DNA, 20 bp, mouse
gctccgcccaggtctctctc

SEQ ID NO: 532175 - DNA, 20 bp, mouse
gggaatgaatcgccaactaa

SEQ ID NO: 532176 - DNA, 20 bp, mouse
gcagcagtcccccttaccgg

SEQ ID NO: 532177 - DNA, 20 bp, mouse
gtaggcgagccactatctca

SEQ ID NO: 532178 - DNA, 20 bp, mouse
gtgaggcaaatcacccgggt

SEQ ID NO: 532179 - DNA, 20 bp, mouse
gaagagttctaggagcgtga

SEQ ID NO: 532180 - DNA, 20 bp, mouse
gtcccccttaccggaggcac

SEQ ID NO: 532181 - DNA, 20 bp, mouse
gtgctcctgtgcctccggta

SEQ ID NO: 532182 - DNA, 20 bp, mouse
gtcctgtgcctccggtaagg

SEQ ID NO: 532183 - DNA, 20 bp, mouse
gctgttctcctaggaaggtg

SEQ ID NO: 532184 - DNA, 20 bp, mouse
gttgaagatcgacgagagat

SEQ ID NO: 532185 - DNA, 20 bp, mouse
gtcagtgagcgcggttgagt

SEQ ID NO: 532186 - DNA, 20 bp, mouse
ggggctcaccagtaggacag

SEQ ID NO: 532187 - DNA, 20 bp, mouse
ggggaggaaccaagctacgg

SEQ ID NO: 532188 - DNA, 20 bp, mouse
ggcggctgctggactggata

SEQ ID NO: 532189 - DNA, 20 bp, mouse
gcggatgcgctacgtagcca

SEQ ID NO: 532190 - DNA, 20 bp, mouse
gggcaaagtgctgcaggagg

SEQ ID NO: 532191 - DNA, 20 bp, mouse
gagcgcatccgcttgccggg

SEQ ID NO: 532192 - DNA, 20 bp, mouse
gtaggacaggggcaggtctc

SEQ ID NO: 532193 - DNA, 20 bp, mouse
gtcaccagtaggacaggggc

SEQ ID NO: 532194 - DNA, 20 bp, mouse
gaccaagctacggcggctgc

SEQ ID NO: 532195 - DNA, 20 bp, mouse
gtccagcagccgccgtagct

SEQ ID NO: 532196 - DNA, 20 bp, mouse
gacctggaccatggaccctg

SEQ ID NO: 532197 - DNA, 20 bp, mouse
gtgtgtgagcagctaagaaa

SEQ ID NO: 532198 - DNA, 20 bp, mouse
gtgctcacacacctggacca

SEQ ID NO: 532199 - DNA, 20 bp, mouse
gcatacacgtgcattcccca

SEQ ID NO: 532200 - DNA, 20 bp, mouse
ggttataagattccctaaca

SEQ ID NO: 532201 - DNA, 20 bp, mouse
gaagtaaggaagccctgtta

SEQ ID NO: 532202 - DNA, 20 bp, mouse
gtccccagggtccatggtcc

SEQ ID NO: 532203 - DNA, 20 bp, mouse
ggtgcattccccagggtcca

SEQ ID NO: 532204 - DNA, 20 bp, mouse
gcgtgtatgtctggtaagta

SEQ ID NO: 532205 - DNA, 20 bp, mouse
ggggaatgcacgtgtatgtc

SEQ ID NO: 532206 - DNA, 20 bp, mouse
gaggccgcgcagggacggga

SEQ ID NO: 532207 - DNA, 20 bp, mouse
ggccgaggccgcgcagggac

SEQ ID NO: 532208 - DNA, 20 bp, mouse
gcggccctcccgtccctgcg

SEQ ID NO: 532209 - DNA, 20 bp, mouse
gccgccaacatgtacagggt

SEQ ID NO: 532210 - DNA, 20 bp, mouse
gcgggacgcaggcggagtag

SEQ ID NO: 532211 - DNA, 20 bp, mouse
ggcgccggcgggcggtttaa

SEQ ID NO: 532212 - DNA, 20 bp, mouse
gccgcggcgcataaaggccg

SEQ ID NO: 532213 - DNA, 20 bp, mouse
gcgcgcgcgcgccccggcac

SEQ ID NO: 532214 - DNA, 20 bp, mouse
gatgtacagggtcggaggta

SEQ ID NO: 532215 - DNA, 20 bp, mouse
gcccgccgccggcccggaca

SEQ ID NO: 532216 - DNA, 20 bp, mouse
gcccagcgctcggctcaggt

SEQ ID NO: 532217 - DNA, 20 bp, mouse
gcgtctgctgggactcggtg

SEQ ID NO: 532218 - DNA, 20 bp, mouse
gagcccggcgatccagtcac

SEQ ID NO: 532219 - DNA, 20 bp, mouse
gctggaacctcactccggtc

SEQ ID NO: 532220 - DNA, 20 bp, mouse
gggtctcaagagcaccgtta

SEQ ID NO: 532221 - DNA, 20 bp, mouse
gggcgcagagtctaccgcag

SEQ ID NO: 532222 - DNA, 20 bp, mouse
gcggtgaggacgctaggagc

SEQ ID NO: 532223 - DNA, 20 bp, mouse
gtcggccgatccggagaaca

SEQ ID NO: 532224 - DNA, 20 bp, mouse
gtccggaagtggccgatctg

SEQ ID NO: 532225 - DNA, 20 bp, mouse
ggcccacacgaccccagatg

SEQ ID NO: 532226 - DNA, 20 bp, mouse
gtaccgggtcggaggtagga

SEQ ID NO: 532227 - DNA, 20 bp, mouse
gcatgtaccgggtcggaggt

SEQ ID NO: 532228 - DNA, 20 bp, mouse
gctccccgacgggccgggaa

SEQ ID NO: 532229 - DNA, 20 bp, mouse
gagccttcctacctccgacc

SEQ ID NO: 532230 - DNA, 20 bp, mouse
gcccaccgcccgctccccga

SEQ ID NO: 532231 - DNA, 20 bp, mouse
gtcggctcgggctccgcggg

SEQ ID NO: 532232 - DNA, 20 bp, mouse
gacgccgggcaggagcggtg

SEQ ID NO: 532233 - DNA, 20 bp, mouse
gacgatggtggcccaggtgg

SEQ ID NO: 532234 - DNA, 20 bp, mouse
ggcggcggtcgaggctgagg

SEQ ID NO: 532235 - DNA, 20 bp, mouse
gcgatgcgtgtccccagaag

SEQ ID NO: 532236 - DNA, 20 bp, mouse
ggccgcagcgtgggaccggg

SEQ ID NO: 532237 - DNA, 20 bp, mouse
gccacagcgggccgcagcgt

SEQ ID NO: 532238 - DNA, 20 bp, mouse
ggagcagtgcggggacccac

SEQ ID NO: 532239 - DNA, 20 bp, mouse
gaaggctggggacatcgggg

SEQ ID NO: 532240 - DNA, 20 bp, mouse
ggacttccctggtgcagaca

SEQ ID NO: 532241 - DNA, 20 bp, mouse
ggtgggcctagtcaaagtag

SEQ ID NO: 532242 - DNA, 20 bp, mouse
gcgcgggagtgagcagtgcg

SEQ ID NO: 532243 - DNA, 20 bp, mouse
ggcccgagcggtggtaaccg

SEQ ID NO: 532244 - DNA, 20 bp, mouse
ggagtggtactaaaagaggg

SEQ ID NO: 532245 - DNA, 20 bp, mouse
gggtaaccggggctctgatg

SEQ ID NO: 532246 - DNA, 20 bp, mouse
ggagagtagttgagaaccac

SEQ ID NO: 532247 - DNA, 20 bp, mouse
gctactggtagcagcaaaag

SEQ ID NO: 532248 - DNA, 20 bp, mouse
gtagaccatgagggaccgag

SEQ ID NO: 532249 - DNA, 20 bp, mouse
gactggaggtggttcttggg

SEQ ID NO: 532250 - DNA, 20 bp, mouse
ggtagcagcacatctttccg

SEQ ID NO: 532251 - DNA, 20 bp, mouse
gctggtccccgacgcagaca

SEQ ID NO: 532252 - DNA, 20 bp, mouse
ggagtcccctcggtccctca

SEQ ID NO: 532253 - DNA, 20 bp, mouse
gcaagcgttcgtgtagcccc

SEQ ID NO: 532254 - DNA, 20 bp, mouse
ggggggacagggacactcat

SEQ ID NO: 532255 - DNA, 20 bp, mouse
gagttgagaaccactggagg

SEQ ID NO: 532256 - DNA, 20 bp, mouse
gagtccgggcgcgaagagga

SEQ ID NO: 532257 - DNA, 20 bp, mouse
ggagacctaacactgagtcc

SEQ ID NO: 532258 - DNA, 20 bp, mouse
gactgagtccgggcgcgaag

SEQ ID NO: 532259 - DNA, 20 bp, mouse
gcttgctgctggtcacctgg

SEQ ID NO: 532260 - DNA, 20 bp, mouse
gtgctggtcacctggaggga

SEQ ID NO: 532261 - DNA, 20 bp, mouse
gaagaggcgggaacgaccgg

SEQ ID NO: 532262 - DNA, 20 bp, mouse
gatcccggagggaggcgcat

SEQ ID NO: 532263 - DNA, 20 bp, mouse
ggagaagaggcgggaacgac

SEQ ID NO: 532264 - DNA, 20 bp, mouse
gcgaaacttcccttccctcc

SEQ ID NO: 532265 - DNA, 20 bp, mouse
gaccggcggcggggaagcga

SEQ ID NO: 532266 - DNA, 20 bp, mouse
ggagctggtgcaggagctcg

SEQ ID NO: 532267 - DNA, 20 bp, mouse
gcggcgccgccgggagccca

SEQ ID NO: 532268 - DNA, 20 bp, mouse
gagcccaaggcgccacttcc

SEQ ID NO: 532269 - DNA, 20 bp, mouse
gcgtcggcgcgcaggatgga

SEQ ID NO: 532270 - DNA, 20 bp, mouse
ggacaacgccccgaccaccg

SEQ ID NO: 532271 - DNA, 20 bp, mouse
gcgagcgcgggcctcgactc

SEQ ID NO: 532272 - DNA, 20 bp, mouse
ggcggcgccgcggggatggc

SEQ ID NO: 532273 - DNA, 20 bp, mouse
gggcgggcccgggagcacca

SEQ ID NO: 532274 - DNA, 20 bp, mouse
gtccgggtccgaagccccca

SEQ ID NO: 532275 - DNA, 20 bp, mouse
ggccacgaacagcgcctcgg

SEQ ID NO: 532276 - DNA, 20 bp, mouse
ggagcccaggagcacctgac

SEQ ID NO: 532277 - DNA, 20 bp, mouse
gtccgcgggtgccatcatgg

SEQ ID NO: 532278 - DNA, 20 bp, mouse
gccgtccgcgggtgccatca

SEQ ID NO: 532279 - DNA, 20 bp, mouse
gggacgcagagccaacccaa

SEQ ID NO: 532280 - DNA, 20 bp, mouse
gtccgccatgatggcacccg

SEQ ID NO: 532281 - DNA, 20 bp, mouse
gcggccagtcaggtgctcct

SEQ ID NO: 532282 - DNA, 20 bp, mouse
ggaagggcagcatctcgaga

SEQ ID NO: 532283 - DNA, 20 bp, mouse
gctggccgcgtccgccatga

SEQ ID NO: 532284 - DNA, 20 bp, mouse
gctcgagagggtgaaggcct

SEQ ID NO: 532285 - DNA, 20 bp, mouse
gtgggacaggatggtgagac

SEQ ID NO: 532286 - DNA, 20 bp, mouse
gacctgggagaagagcgggt

SEQ ID NO: 532287 - DNA, 20 bp, mouse
gaacagcgcgggttccacag

SEQ ID NO: 532288 - DNA, 20 bp, mouse
ggagtagctccaggccgcca

SEQ ID NO: 532289 - DNA, 20 bp, mouse
gtgcccgcctagcagcacct

SEQ ID NO: 532290 - DNA, 20 bp, mouse
gaccaacccgctcttctccc

SEQ ID NO: 532291 - DNA, 20 bp, mouse
ggcattgggacgttgggtgg

SEQ ID NO: 532292 - DNA, 20 bp, mouse
ggcagccggaagtggtccaa

SEQ ID NO: 532293 - DNA, 20 bp, mouse
gatgggcgccagcactatga

SEQ ID NO: 532294 - DNA, 20 bp, mouse
gggtcactagaactgaaggt

SEQ ID NO: 532295 - DNA, 20 bp, mouse
ggcagacgccttcatagtgc

SEQ ID NO: 532296 - DNA, 20 bp, mouse
gtcccccggcggaacaatgg

SEQ ID NO: 532297 - DNA, 20 bp, mouse
gtcctcccccggcggaacaa

SEQ ID NO: 532298 - DNA, 20 bp, mouse
gccgccgctggaacagtcgt

SEQ ID NO: 532299 - DNA, 20 bp, mouse
gcgccggagtaggggataga

SEQ ID NO: 532300 - DNA, 20 bp, mouse
gccgccacggggagagccaa

SEQ ID NO: 532301 - DNA, 20 bp, mouse
gggggacagagtgtctccag

SEQ ID NO: 532302 - DNA, 20 bp, mouse
gggccctctatcccctactc

SEQ ID NO: 532303 - DNA, 20 bp, mouse
gggccggtcgggtcacgtgg

SEQ ID NO: 532304 - DNA, 20 bp, mouse
gccgctggaacagtcgtggg

SEQ ID NO: 532305 - DNA, 20 bp, mouse
gacagtcgtgggaggcgaca

SEQ ID NO: 532306 - DNA, 20 bp, mouse
ggatttgaaggtgtctagcc

SEQ ID NO: 532307 - DNA, 20 bp, mouse
gtctcacaaaaatgatttga

SEQ ID NO: 532308 - DNA, 20 bp, mouse
ggtctaccgggagcgttggt

SEQ ID NO: 532309 - DNA, 20 bp, mouse
ggtccagaggcggaagtgaa

SEQ ID NO: 532310 - DNA, 20 bp, mouse
gaggtgtctaccgggagcgt

SEQ ID NO: 532311 - DNA, 20 bp, mouse
gctccctcccgggcgtccag

SEQ ID NO: 532312 - DNA, 20 bp, mouse
gcctcccgggcgtccagagg

SEQ ID NO: 532313 - DNA, 20 bp, mouse
gggagcgcggatgcagtgtg

SEQ ID NO: 532314 - DNA, 20 bp, mouse
ggaagtgaaaggtgtctacc

SEQ ID NO: 532315 - DNA, 20 bp, mouse
ggcgctcctaccaacgctcc

SEQ ID NO: 532316 - DNA, 20 bp, mouse
gggtaggccggacagtaatc

SEQ ID NO: 532317 - DNA, 20 bp, mouse
gggacagtaatccggccggg

SEQ ID NO: 532318 - DNA, 20 bp, mouse
gcagtaatccggccgggcgg

SEQ ID NO: 532319 - DNA, 20 bp, mouse
gtcgccggcttgcgaagcta

SEQ ID NO: 532320 - DNA, 20 bp, mouse
ggaccgtgcaacctacgccg

SEQ ID NO: 532321 - DNA, 20 bp, mouse
gtgcaccgtatccccggcgt

SEQ ID NO: 532322 - DNA, 20 bp, mouse
gctacggtgcaccgtatccc

SEQ ID NO: 532323 - DNA, 20 bp, mouse
gtaaggccccgaggatgtcc

SEQ ID NO: 532324 - DNA, 20 bp, mouse
gctgctgggtacaggtaggc

SEQ ID NO: 532325 - DNA, 20 bp, mouse
gggagcgcgagaccgccgcc

SEQ ID NO: 532326 - DNA, 20 bp, mouse
ggctgtgagcccgggaccta

SEQ ID NO: 532327 - DNA, 20 bp, mouse
gttcgctgggaaggcaggtg

SEQ ID NO: 532328 - DNA, 20 bp, mouse
ggtgaggttgccctaggtcc

SEQ ID NO: 532329 - DNA, 20 bp, mouse
ggttcttcgcttggtctcca

SEQ ID NO: 532330 - DNA, 20 bp, mouse
gctccatggcttcgctggga

SEQ ID NO: 532331 - DNA, 20 bp, mouse
gactgtgagaccggaagagg

SEQ ID NO: 532332 - DNA, 20 bp, mouse
gcaacagccgctgtgagccc

SEQ ID NO: 532333 - DNA, 20 bp, mouse
gatggcttcgctgggaaggc

SEQ ID NO: 532334 - DNA, 20 bp, mouse
gtgttggcgggacgttcagg

SEQ ID NO: 532335 - DNA, 20 bp, mouse
gacaactgtgagaccggaag

SEQ ID NO: 532336 - DNA, 20 bp, mouse
gaatagggtggcttacctgt

SEQ ID NO: 532337 - DNA, 20 bp, mouse
gagcacagcggagagacctt

SEQ ID NO: 532338 - DNA, 20 bp, mouse
gtgcttggactgctgcccac

SEQ ID NO: 532339 - DNA, 20 bp, mouse
gtgctaaccctgaccccggt

SEQ ID NO: 532340 - DNA, 20 bp, mouse
gagaggcctgcggaacaggg

SEQ ID NO: 532341 - DNA, 20 bp, mouse
gtggagaggcctgcggaaca

SEQ ID NO: 532342 - DNA, 20 bp, mouse
ggaacttagctcaacgccca

SEQ ID NO: 532343 - DNA, 20 bp, mouse
ggcctcaagcctgcctaccg

SEQ ID NO: 532344 - DNA, 20 bp, mouse
ggaggccacggtagcggtcc

SEQ ID NO: 532345 - DNA, 20 bp, mouse
gaggcaaagaaccacaaagt

SEQ ID NO: 532346 - DNA, 20 bp, mouse
gcctccgcggctcccggcaa

SEQ ID NO: 532347 - DNA, 20 bp, mouse
gccgcggctcccggcaacgg

SEQ ID NO: 532348 - DNA, 20 bp, mouse
gtgacgctagggacaggtgg

SEQ ID NO: 532349 - DNA, 20 bp, mouse
gcagcttctcccctcccaag

SEQ ID NO: 532350 - DNA, 20 bp, mouse
gcggaagtgacgctagggac

SEQ ID NO: 532351 - DNA, 20 bp, mouse
ggccgcggaggtaaaagcag

SEQ ID NO: 532352 - DNA, 20 bp, mouse
gggaagcggaagtgacgcta

SEQ ID NO: 532353 - DNA, 20 bp, mouse
gaagtgacgctagggacagg

SEQ ID NO: 532354 - DNA, 20 bp, mouse
gatgctgcgtgggtacagtg

SEQ ID NO: 532355 - DNA, 20 bp, mouse
gggcaatcatggtgccgctt

SEQ ID NO: 532356 - DNA, 20 bp, mouse
gagtccgcgggaaaccaaaa

SEQ ID NO: 532357 - DNA, 20 bp, mouse
gagaatgtgcgtgctcacac

SEQ ID NO: 532358 - DNA, 20 bp, mouse
ggcgaagggctgttgcgaag

SEQ ID NO: 532359 - DNA, 20 bp, mouse
gttggggacgagggttagga

SEQ ID NO: 532360 - DNA, 20 bp, mouse
ggggaaaccaaaatggcgaa

SEQ ID NO: 532361 - DNA, 20 bp, mouse
gagaatgcaccgctagtccg

SEQ ID NO: 532362 - DNA, 20 bp, mouse
gggagcgcggagctactccg

SEQ ID NO: 532363 - DNA, 20 bp, mouse
ggcgagtccgggcactccct

SEQ ID NO: 532364 - DNA, 20 bp, mouse
gccctcgtccccaaggaact

SEQ ID NO: 532365 - DNA, 20 bp, mouse
gcgaatgaggtgagagacct

SEQ ID NO: 532366 - DNA, 20 bp, mouse
gtcggtggctgatgggaagg

SEQ ID NO: 532367 - DNA, 20 bp, mouse
gaccgaccccagcagcaccg

SEQ ID NO: 532368 - DNA, 20 bp, mouse
gaacccggcaggtgcttgac

SEQ ID NO: 532369 - DNA, 20 bp, mouse
gtgccggccgggacccaaca

SEQ ID NO: 532370 - DNA, 20 bp, mouse
ggctggggtcggtggctgat

SEQ ID NO: 532371 - DNA, 20 bp, mouse
gagccgcggtggcgacccca

SEQ ID NO: 532372 - DNA, 20 bp, mouse
gcgcggaaggagcatcacct

SEQ ID NO: 532373 - DNA, 20 bp, mouse
gtccttccgcggtgctgctg

SEQ ID NO: 532374 - DNA, 20 bp, mouse
gaccctgccccggtacctgg

SEQ ID NO: 532375 - DNA, 20 bp, mouse
gtgcacgccgccaggtaccg

SEQ ID NO: 532376 - DNA, 20 bp, mouse
gagaacccgccagtagtccg

SEQ ID NO: 532377 - DNA, 20 bp, mouse
ggtagtccgaggctgaagga

SEQ ID NO: 532378 - DNA, 20 bp, mouse
gggtgttagccaagtgctag

SEQ ID NO: 532379 - DNA, 20 bp, mouse
gtcagcctcggactactggc

SEQ ID NO: 532380 - DNA, 20 bp, mouse
gcgaccccaccactccggag

SEQ ID NO: 532381 - DNA, 20 bp, mouse
ggacctctaccgggacacgt

SEQ ID NO: 532382 - DNA, 20 bp, mouse
gcagcccctccggagtggtg

SEQ ID NO: 532383 - DNA, 20 bp, mouse
gagtcatgtcggagcagcag

SEQ ID NO: 532384 - DNA, 20 bp, mouse
ggcgctacctgggtgagcgt

SEQ ID NO: 532385 - DNA, 20 bp, mouse
gctactggcgggttcttgcc

SEQ ID NO: 532386 - DNA, 20 bp, mouse
gtgagcagctgcgaaggtga

SEQ ID NO: 532387 - DNA, 20 bp, mouse
gctgcgcagccgaggtgagt

SEQ ID NO: 532388 - DNA, 20 bp, mouse
ggccgaggtgagtggggccc

SEQ ID NO: 532389 - DNA, 20 bp, mouse
gaccacccggagctgaacgg

SEQ ID NO: 532390 - DNA, 20 bp, mouse
ggccaccgttcagctccggg

SEQ ID NO: 532391 - DNA, 20 bp, mouse
gcccgggacagaaaagcggt

SEQ ID NO: 532392 - DNA, 20 bp, mouse
ggctaccacccggagctgaa

SEQ ID NO: 532393 - DNA, 20 bp, mouse
gttcagcccggatccagcga

SEQ ID NO: 532394 - DNA, 20 bp, mouse
gctgattggcataaggtcct

SEQ ID NO: 532395 - DNA, 20 bp, mouse
ggctgccagccgacaatgac

SEQ ID NO: 532396 - DNA, 20 bp, mouse
gccgcccgctggggtaggag

SEQ ID NO: 532397 - DNA, 20 bp, mouse
ggaggccgggccgcccgctg

SEQ ID NO: 532398 - DNA, 20 bp, mouse
ggagtgtggcgctggagtcc

SEQ ID NO: 532399 - DNA, 20 bp, mouse
ggctggggtaggaggggctg

SEQ ID NO: 532400 - DNA, 20 bp, mouse
gcaccgagcccgtctcctgt

SEQ ID NO: 532401 - DNA, 20 bp, mouse
gtcctgtgggaccccgcatc

SEQ ID NO: 532402 - DNA, 20 bp, mouse
gccgggccgcccgctggggt

SEQ ID NO: 532403 - DNA, 20 bp, mouse
ggcggaagtgagggacttcg

SEQ ID NO: 532404 - DNA, 20 bp, mouse
gggaccagtgccctcaccga

SEQ ID NO: 532405 - DNA, 20 bp, mouse
ggcccgatgcggggtcccac

SEQ ID NO: 532406 - DNA, 20 bp, mouse
gccgggaagaagctactctg

SEQ ID NO: 532407 - DNA, 20 bp, mouse
gggcggccggggaaactctc

SEQ ID NO: 532408 - DNA, 20 bp, mouse
ggctggggtcgagtcggaag

SEQ ID NO: 532409 - DNA, 20 bp, mouse
ggctgggcggttctctccag

SEQ ID NO: 532410 - DNA, 20 bp, mouse
gttccaggctggggtcgagt

SEQ ID NO: 532411 - DNA, 20 bp, mouse
gggaagcggcgagcgattcc

SEQ ID NO: 532412 - DNA, 20 bp, mouse
gcggggtgaagagagcggct

SEQ ID NO: 532413 - DNA, 20 bp, mouse
ggaagctactctgcggctgt

SEQ ID NO: 532414 - DNA, 20 bp, mouse
ggctccagggatggtgatct

SEQ ID NO: 532415 - DNA, 20 bp, mouse
gcgcgtccggagagtttccc

SEQ ID NO: 532416 - DNA, 20 bp, mouse
gtcgcgccaagcgccccgga

SEQ ID NO: 532417 - DNA, 20 bp, mouse
gcagatccaggccctggcgg

SEQ ID NO: 532418 - DNA, 20 bp, mouse
gcaccagtgacatgaggctg

SEQ ID NO: 532419 - DNA, 20 bp, mouse
gagtcggaccgcctccgcca

SEQ ID NO: 532420 - DNA, 20 bp, mouse
gaggcatggggtgccgtccg

SEQ ID NO: 532421 - DNA, 20 bp, mouse
gggctgtggccgcaggcatg

SEQ ID NO: 532422 - DNA, 20 bp, mouse
gcgccttcctggcatcgggt

SEQ ID NO: 532423 - DNA, 20 bp, mouse
gatgccaggaaggcgaacca

SEQ ID NO: 532424 - DNA, 20 bp, mouse
ggaaccctgtgagcagatcc

SEQ ID NO: 532425 - DNA, 20 bp, mouse
ggacatgaggctgtggccgc

SEQ ID NO: 532426 - DNA, 20 bp, mouse
ggtccttgccaagacaagtc

SEQ ID NO: 532427 - DNA, 20 bp, mouse
gggcctgaggacagcacgtg

SEQ ID NO: 532428 - DNA, 20 bp, mouse
gaggcatcctccctaagcag

SEQ ID NO: 532429 - DNA, 20 bp, mouse
ggtatctaccagacttgtct

SEQ ID NO: 532430 - DNA, 20 bp, mouse
gtgaggacagcacgtgtgga

SEQ ID NO: 532431 - DNA, 20 bp, mouse
gtgatgcttgtagaagaagg

SEQ ID NO: 532432 - DNA, 20 bp, mouse
ggctgctgctagagacaacg

SEQ ID NO: 532433 - DNA, 20 bp, mouse
gggtaagccactgcttaggg

SEQ ID NO: 532434 - DNA, 20 bp, mouse
gcttgtagaagaaggtggct

SEQ ID NO: 532435 - DNA, 20 bp, mouse
gtaagcaccgggagccttct

SEQ ID NO: 532436 - DNA, 20 bp, mouse
gccacctcctgagtaagtgg

SEQ ID NO: 532437 - DNA, 20 bp, mouse
gggcatgccaccacttactc

SEQ ID NO: 532438 - DNA, 20 bp, mouse
gttgcatgtgtctggctccc

SEQ ID NO: 532439 - DNA, 20 bp, mouse
gcccggctactgtccacaag

SEQ ID NO: 532440 - DNA, 20 bp, mouse
gttgtgcatgctaggtcggt

SEQ ID NO: 532441 - DNA, 20 bp, mouse
gattccaggggtcaacccca

SEQ ID NO: 532442 - DNA, 20 bp, mouse
gacggtgctaccgtgtgaga

SEQ ID NO: 532443 - DNA, 20 bp, mouse
ggtccacaagaggtgtgtcc

SEQ ID NO: 532444 - DNA, 20 bp, mouse
gctggattatgtgattccag

SEQ ID NO: 532445 - DNA, 20 bp, mouse
ggcatcctgtatagcagcag

SEQ ID NO: 532446 - DNA, 20 bp, mouse
ggggaggtccctgagcacgt

SEQ ID NO: 532447 - DNA, 20 bp, mouse
ggaagagaggacatcgacac

SEQ ID NO: 532448 - DNA, 20 bp, mouse
ggtgaacaccagcaaaaatc

SEQ ID NO: 532449 - DNA, 20 bp, mouse
gtgctggtgttcaccgtggg

SEQ ID NO: 532450 - DNA, 20 bp, mouse
gcctcaggtagcccgtgtct

SEQ ID NO: 532451 - DNA, 20 bp, mouse
gcaggagaggtgcttagatg

SEQ ID NO: 532452 - DNA, 20 bp, mouse
ggcactagctgatttctccc

SEQ ID NO: 532453 - DNA, 20 bp, mouse
gtggtggtgggctcagagca

SEQ ID NO: 532454 - DNA, 20 bp, mouse
gagcccaccaccactatcac

SEQ ID NO: 532455 - DNA, 20 bp, mouse
gtacttgccagtgatagtgg

SEQ ID NO: 532456 - DNA, 20 bp, mouse
gatccccaggcgccgagatg

SEQ ID NO: 532457 - DNA, 20 bp, mouse
gtgcctcccacgccagcccg

SEQ ID NO: 532458 - DNA, 20 bp, mouse
gcggctgcaagttcttcccc

SEQ ID NO: 532459 - DNA, 20 bp, mouse
gaggaactgaggcccctagg

SEQ ID NO: 532460 - DNA, 20 bp, mouse
ggcctgagcgacacagctca

SEQ ID NO: 532461 - DNA, 20 bp, mouse
gggcgacacgccgggcccga

SEQ ID NO: 532462 - DNA, 20 bp, mouse
gggcctcagttcctcccacg

SEQ ID NO: 532463 - DNA, 20 bp, mouse
gtgagcgacacagctcacgg

SEQ ID NO: 532464 - DNA, 20 bp, mouse
gacgatggagtccatcccgg

SEQ ID NO: 532465 - DNA, 20 bp, mouse
ggacccgagggaccgttcgt

SEQ ID NO: 532466 - DNA, 20 bp, mouse
gcgggcaccggcgcgagcca

SEQ ID NO: 532467 - DNA, 20 bp, mouse
gccgcgcgcgcgcttctctc

SEQ ID NO: 532468 - DNA, 20 bp, mouse
gacagccaacgcagacaaca

SEQ ID NO: 532469 - DNA, 20 bp, mouse
ggcactgccgccaggtggaa

SEQ ID NO: 532470 - DNA, 20 bp, mouse
gtgccgctagggtccgggaa

SEQ ID NO: 532471 - DNA, 20 bp, mouse
gttctctccggcgcgggcac

SEQ ID NO: 532472 - DNA, 20 bp, mouse
ggggccagcccccaacggag

SEQ ID NO: 532473 - DNA, 20 bp, mouse
gctgaagccatggctcgcgc

SEQ ID NO: 532474 - DNA, 20 bp, mouse
gccgaggccgggtgatgctt

SEQ ID NO: 532475 - DNA, 20 bp, mouse
gtgcagagatgggtgcggag

SEQ ID NO: 532476 - DNA, 20 bp, mouse
gctgaccgcgggacccccgg

SEQ ID NO: 532477 - DNA, 20 bp, mouse
gcgggacccccggaggcgga

SEQ ID NO: 532478 - DNA, 20 bp, mouse
gaccgcgggacccccggagg

SEQ ID NO: 532479 - DNA, 20 bp, mouse
gccgagccccgagaaggcag

SEQ ID NO: 532480 - DNA, 20 bp, mouse
ggagctgaccgcgggacccc

SEQ ID NO: 532481 - DNA, 20 bp, mouse
gacgcccggggccctcagca

SEQ ID NO: 532482 - DNA, 20 bp, mouse
gttcttgtgcgaggaggagt

SEQ ID NO: 532483 - DNA, 20 bp, mouse
gggaggcggacggcgaggca

SEQ ID NO: 532484 - DNA, 20 bp, mouse
ggcggggccgagccccgaga

SEQ ID NO: 532485 - DNA, 20 bp, mouse
gccggagcagcgagaagccg

SEQ ID NO: 532486 - DNA, 20 bp, mouse
gcacctaaccgcctgcccac

SEQ ID NO: 532487 - DNA, 20 bp, mouse
ggacctgtgggcaggcggtt

SEQ ID NO: 532488 - DNA, 20 bp, mouse
gccacaggtctagcttgcgg

SEQ ID NO: 532489 - DNA, 20 bp, mouse
gcggatagattcgcagagtc

SEQ ID NO: 532490 - DNA, 20 bp, mouse
gtgcccacaggtctagcttg

SEQ ID NO: 532491 - DNA, 20 bp, mouse
gcaaaaggcttgggacgctg

SEQ ID NO: 532492 - DNA, 20 bp, mouse
ggaggtaacgcaaaaggctt

SEQ ID NO: 532493 - DNA, 20 bp, mouse
gcgggtcccagaaggctgca

SEQ ID NO: 532494 - DNA, 20 bp, mouse
ggccaccgatctgacgcaag

SEQ ID NO: 532495 - DNA, 20 bp, mouse
gacctcttgcgtcagatcgg

SEQ ID NO: 532496 - DNA, 20 bp, mouse
gctctgggtctgagcagatc

SEQ ID NO: 532497 - DNA, 20 bp, mouse
gctcagacccagagtgagtg

SEQ ID NO: 532498 - DNA, 20 bp, mouse
gtgggcacaccctccaggaa

SEQ ID NO: 532499 - DNA, 20 bp, mouse
gtcttgcagctcctacccag

SEQ ID NO: 532500 - DNA, 20 bp, mouse
ggacgacagcaggggcgtgg

SEQ ID NO: 532501 - DNA, 20 bp, mouse
gagctcacagatcggatcgt

SEQ ID NO: 532502 - DNA, 20 bp, mouse
ggacccagagtgagtgggga

SEQ ID NO: 532503 - DNA, 20 bp, mouse
gctgcttcatcagtcagcac

SEQ ID NO: 532504 - DNA, 20 bp, mouse
ggcagacgacagcaggggcg

SEQ ID NO: 532505 - DNA, 20 bp, mouse
gcctggagggtgtgcccaac

SEQ ID NO: 532506 - DNA, 20 bp, mouse
gtgtagcccctaagggatca

SEQ ID NO: 532507 - DNA, 20 bp, mouse
gacatgattgtagcccctaa

SEQ ID NO: 532508 - DNA, 20 bp, mouse
gcggtgcttgccaggaatgg

SEQ ID NO: 532509 - DNA, 20 bp, mouse
ggggcggtgcttgccaggaa

SEQ ID NO: 532510 - DNA, 20 bp, mouse
ggagcgcgctccgcaggcaa

SEQ ID NO: 532511 - DNA, 20 bp, mouse
gtgcttgccaggaatggcgg

SEQ ID NO: 532512 - DNA, 20 bp, mouse
gtcggcccgcaggccccgct

SEQ ID NO: 532513 - DNA, 20 bp, mouse
gctgcgtgaggaggagagac

SEQ ID NO: 532514 - DNA, 20 bp, mouse
gcgcaggcgcacctccccgg

SEQ ID NO: 532515 - DNA, 20 bp, mouse
gccaggaatggcggcggtca

SEQ ID NO: 532516 - DNA, 20 bp, mouse
ggcctccttggcctctaggt

SEQ ID NO: 532517 - DNA, 20 bp, mouse
ggcccacctagaggccaagg

SEQ ID NO: 532518 - DNA, 20 bp, mouse
gaagatggcatcattaactg

SEQ ID NO: 532519 - DNA, 20 bp, mouse
gcacaggagaatggatacgg

SEQ ID NO: 532520 - DNA, 20 bp, mouse
gatacggcggaatggaggtt

SEQ ID NO: 532521 - DNA, 20 bp, mouse
gaatggatacggcggaatgg

SEQ ID NO: 532522 - DNA, 20 bp, mouse
ggagaatggatacggcggaa

SEQ ID NO: 532523 - DNA, 20 bp, mouse
gctcttgcggaagttttttg

SEQ ID NO: 532524 - DNA, 20 bp, mouse
ggcactctgcatgctttgct

SEQ ID NO: 532525 - DNA, 20 bp, mouse
gtttttttctagtgaagaat

SEQ ID NO: 532526 - DNA, 20 bp, mouse
gggagggtgaggaagaccga

SEQ ID NO: 532527 - DNA, 20 bp, mouse
gagcgcgcggggacatgcta

SEQ ID NO: 532528 - DNA, 20 bp, mouse
ggtgttagccatggagaccc

SEQ ID NO: 532529 - DNA, 20 bp, mouse
gaggaagaccgagggtgatg

SEQ ID NO: 532530 - DNA, 20 bp, mouse
gagccaagcaaggcgaggat

SEQ ID NO: 532531 - DNA, 20 bp, mouse
gtcggtttccccatcaccct

SEQ ID NO: 532532 - DNA, 20 bp, mouse
gctcggtgacgtgttagcca

SEQ ID NO: 532533 - DNA, 20 bp, mouse
gccccacgcatgcggaccac

SEQ ID NO: 532534 - DNA, 20 bp, mouse
gccggccgcgaaagtaggga

SEQ ID NO: 532535 - DNA, 20 bp, mouse
gaaccgcgccgtcccagcct

SEQ ID NO: 532536 - DNA, 20 bp, mouse
gccccactcactcaactccc

SEQ ID NO: 532537 - DNA, 20 bp, mouse
gaagccgcggcaagtgacac

SEQ ID NO: 532538 - DNA, 20 bp, mouse
gccggagggcgacctcgcct

SEQ ID NO: 532539 - DNA, 20 bp, mouse
ggcctgggagttgagtgagt

SEQ ID NO: 532540 - DNA, 20 bp, mouse
ggagtggggtctctgcgcta

SEQ ID NO: 532541 - DNA, 20 bp, mouse
gcgacggggacctcacggaa

SEQ ID NO: 532542 - DNA, 20 bp, mouse
gccggacccaggagaattgt

SEQ ID NO: 532543 - DNA, 20 bp, mouse
gtagcggcaaccgagaactc

SEQ ID NO: 532544 - DNA, 20 bp, mouse
gaagcacgacggggacctca

SEQ ID NO: 532545 - DNA, 20 bp, mouse
gtggggtctctgcgctaggg

SEQ ID NO: 532546 - DNA, 20 bp, mouse
gctccggcggagtccaggta

SEQ ID NO: 532547 - DNA, 20 bp, mouse
gcccggcccaggtaacgctg

SEQ ID NO: 532548 - DNA, 20 bp, mouse
gggaagccgacgcggtgctc

SEQ ID NO: 532549 - DNA, 20 bp, mouse
gcggtgctccggcggagtcc

SEQ ID NO: 532550 - DNA, 20 bp, mouse
ggaactagcaggtccgtacc

SEQ ID NO: 532551 - DNA, 20 bp, mouse
gtgctcgcctaccccggccc

SEQ ID NO: 532552 - DNA, 20 bp, mouse
gagccgacgcggtgctccgg

SEQ ID NO: 532553 - DNA, 20 bp, mouse
gtcttcctgctcgcctaccc

SEQ ID NO: 532554 - DNA, 20 bp, mouse
gctggcgagcaagtgattat

SEQ ID NO: 532555 - DNA, 20 bp, mouse
gctccgccggagcaccgcgt

SEQ ID NO: 532556 - DNA, 20 bp, mouse
gagctcgccttgcttctgag

SEQ ID NO: 532557 - DNA, 20 bp, mouse
gtcgtcttcggggccagtca

SEQ ID NO: 532558 - DNA, 20 bp, mouse
gcgagaacagcgacacgacg

SEQ ID NO: 532559 - DNA, 20 bp, mouse
gggtaggcgtcggccagaac

SEQ ID NO: 532560 - DNA, 20 bp, mouse
gccgagcagcgcgtcctcca

SEQ ID NO: 532561 - DNA, 20 bp, mouse
gcgctgttctcgggtcccag

SEQ ID NO: 532562 - DNA, 20 bp, mouse
gggctcggtggcgcccaggt

SEQ ID NO: 532563 - DNA, 20 bp, mouse
gcggggccagcccacaggat

SEQ ID NO: 532564 - DNA, 20 bp, mouse
gctgtaggcgggaggcggag

SEQ ID NO: 532565 - DNA, 20 bp, mouse
gtacctcagcgcccggcggg

SEQ ID NO: 532566 - DNA, 20 bp, mouse
gagcagcctggcaacagcgg

SEQ ID NO: 532567 - DNA, 20 bp, mouse
gaagaaagcgaactcacctc

SEQ ID NO: 532568 - DNA, 20 bp, mouse
gcctaggacaagtagaacag

SEQ ID NO: 532569 - DNA, 20 bp, mouse
gcggtggctccctgagccgg

SEQ ID NO: 532570 - DNA, 20 bp, mouse
gcgaactcacctccggctca

SEQ ID NO: 532571 - DNA, 20 bp, mouse
gcagctgtctctgcaaggca

SEQ ID NO: 532572 - DNA, 20 bp, mouse
gtgggactggaatatagggt

SEQ ID NO: 532573 - DNA, 20 bp, mouse
gcattgcggggatccaggat

SEQ ID NO: 532574 - DNA, 20 bp, mouse
ggcacctgcctgccactccc

SEQ ID NO: 532575 - DNA, 20 bp, mouse
gccgtggcctcgccaagtgg

SEQ ID NO: 532576 - DNA, 20 bp, mouse
ggccaggtgacagctaatgg

SEQ ID NO: 532577 - DNA, 20 bp, mouse
ggtcaagcagcgaagcaggg

SEQ ID NO: 532578 - DNA, 20 bp, mouse
ggccgccaggtgacagctaa

SEQ ID NO: 532579 - DNA, 20 bp, mouse
ggccacagtccggagtgcag

SEQ ID NO: 532580 - DNA, 20 bp, mouse
gaggtgacagctaatggcgg

SEQ ID NO: 532581 - DNA, 20 bp, mouse
gccggactgtggctcaccgg

SEQ ID NO: 532582 - DNA, 20 bp, mouse
ggctagctggagaccctctc

SEQ ID NO: 532583 - DNA, 20 bp, mouse
ggcggtcaagcagcgaagca

SEQ ID NO: 532584 - DNA, 20 bp, mouse
ggctgggcaccgagagtctg

SEQ ID NO: 532585 - DNA, 20 bp, mouse
gtaagcaggtggccaacccc

SEQ ID NO: 532586 - DNA, 20 bp, mouse
gtggccggtcagaagtctcc

SEQ ID NO: 532587 - DNA, 20 bp, mouse
gcctgtgcgccccggcccta

SEQ ID NO: 532588 - DNA, 20 bp, mouse
gtgcaccgggaacgctgaac

SEQ ID NO: 532589 - DNA, 20 bp, mouse
ggaaccgggagacttctgac

SEQ ID NO: 532590 - DNA, 20 bp, mouse
gagacttctgaccggccata

SEQ ID NO: 532591 - DNA, 20 bp, mouse
gtgcgccccggccctatggc

SEQ ID NO: 532592 - DNA, 20 bp, mouse
gcggcctgggcagctgcacc

SEQ ID NO: 532593 - DNA, 20 bp, mouse
gcgcgcctcccgggagccac

SEQ ID NO: 532594 - DNA, 20 bp, mouse
gtgcgcccgtggctcccggg

SEQ ID NO: 532595 - DNA, 20 bp, mouse
gaacttgtagcgctccgcgg

SEQ ID NO: 532596 - DNA, 20 bp, mouse
gaccaggagcacagttccag

SEQ ID NO: 532597 - DNA, 20 bp, mouse
ggtgtgtcctgcccagacag

SEQ ID NO: 532598 - DNA, 20 bp, mouse
gcaaagagcctcccctgtct

SEQ ID NO: 532599 - DNA, 20 bp, mouse
ggaggctaaatcctagaggt

SEQ ID NO: 532600 - DNA, 20 bp, mouse
gaacattgccccccagaagg

SEQ ID NO: 532601 - DNA, 20 bp, mouse
gggggaggacgcagcggtag

SEQ ID NO: 532602 - DNA, 20 bp, mouse
gccacaagctctgaggaagg

SEQ ID NO: 532603 - DNA, 20 bp, mouse
gactcaatgcgggtctccaa

SEQ ID NO: 532604 - DNA, 20 bp, mouse
gtagcggcatttcggatacc

SEQ ID NO: 532605 - DNA, 20 bp, mouse
gtccaggggtcttatttgaa

SEQ ID NO: 532606 - DNA, 20 bp, mouse
gagcgcggcgacagcagagg

SEQ ID NO: 532607 - DNA, 20 bp, mouse
gccgccgcggccctagggat

SEQ ID NO: 532608 - DNA, 20 bp, mouse
gcggcggccaccagcaccag

SEQ ID NO: 532609 - DNA, 20 bp, mouse
ggcggctccggctcaggttc

SEQ ID NO: 532610 - DNA, 20 bp, mouse
ggctcaggttccggcagcgg

SEQ ID NO: 532611 - DNA, 20 bp, mouse
gccggctcaggttccggcag

SEQ ID NO: 532612 - DNA, 20 bp, mouse
gggggctccgcccatcccta

SEQ ID NO: 532613 - DNA, 20 bp, mouse
gaagcaacgaagccgaagcg

SEQ ID NO: 532614 - DNA, 20 bp, mouse
gccggcgcactctcacctca

SEQ ID NO: 532615 - DNA, 20 bp, mouse
gactcgcggagaaaagtccc

SEQ ID NO: 532616 - DNA, 20 bp, mouse
ggcacctgaagctcggactc

SEQ ID NO: 532617 - DNA, 20 bp, mouse
gacagcctcgagtcccctca

SEQ ID NO: 532618 - DNA, 20 bp, mouse
gtccgagcttcaggtgccat

SEQ ID NO: 532619 - DNA, 20 bp, mouse
gggcgccttcccccagccca

SEQ ID NO: 532620 - DNA, 20 bp, mouse
gagtaccgtgccaaggacag

SEQ ID NO: 532621 - DNA, 20 bp, mouse
ggcggctgagtcggttcagg

SEQ ID NO: 532622 - DNA, 20 bp, mouse
gggcgccctgaggggactcg

SEQ ID NO: 532623 - DNA, 20 bp, mouse
ggcggcggctgagtcggttc

SEQ ID NO: 532624 - DNA, 20 bp, mouse
gggcgggaagagcggctcta

SEQ ID NO: 532625 - DNA, 20 bp, mouse
gtgggggaaggcgccctgag

SEQ ID NO: 532626 - DNA, 20 bp, mouse
ggccaggcaggctccgagac

SEQ ID NO: 532627 - DNA, 20 bp, mouse
gcgccggcgcgagatgcaga

SEQ ID NO: 532628 - DNA, 20 bp, mouse
gcctggcgcggggctgaccg

SEQ ID NO: 532629 - DNA, 20 bp, mouse
gcgtgcgggaagagagactg

SEQ ID NO: 532630 - DNA, 20 bp, mouse
gccatggcgcgagaaactgg

SEQ ID NO: 532631 - DNA, 20 bp, mouse
ggcgcacggggccgcagccg

SEQ ID NO: 532632 - DNA, 20 bp, mouse
gtccggtctcggagcctgcc

SEQ ID NO: 532633 - DNA, 20 bp, mouse
gcgcgcgcagtgcaggctgg

SEQ ID NO: 532634 - DNA, 20 bp, mouse
gaggtgaggccgggcgtatg

SEQ ID NO: 532635 - DNA, 20 bp, mouse
gaggactcactgtccaggtg

SEQ ID NO: 532636 - DNA, 20 bp, mouse
gctcgggagcgcgctctgtg

SEQ ID NO: 532637 - DNA, 20 bp, mouse
ggccaccagagccggagggt

SEQ ID NO: 532638 - DNA, 20 bp, mouse
gcctcgccaccagagccgga

SEQ ID NO: 532639 - DNA, 20 bp, mouse
ggcgcgctcccgagaccgat

SEQ ID NO: 532640 - DNA, 20 bp, mouse
gagaccgtgggagtccttag

SEQ ID NO: 532641 - DNA, 20 bp, mouse
gcttaccaggcggcaggaca

SEQ ID NO: 532642 - DNA, 20 bp, mouse
gtgccagccagggtcggcgg

SEQ ID NO: 532643 - DNA, 20 bp, mouse
gggagggtgggcttcttacc

SEQ ID NO: 532644 - DNA, 20 bp, mouse
ggggtgggcttcttaccagg

SEQ ID NO: 532645 - DNA, 20 bp, mouse
ggccgctggagcgtctccgc

SEQ ID NO: 532646 - DNA, 20 bp, mouse
gcagctgcgggagacggaag

SEQ ID NO: 532647 - DNA, 20 bp, mouse
ggtgagagcgcggctttgga

SEQ ID NO: 532648 - DNA, 20 bp, mouse
gagcgcggctttggagggtc

SEQ ID NO: 532649 - DNA, 20 bp, mouse
ggacggaagtggtgagagcg

SEQ ID NO: 532650 - DNA, 20 bp, mouse
gcccaggctggcagtgcacg

SEQ ID NO: 532651 - DNA, 20 bp, mouse
gggccccgcccctaaaacct

SEQ ID NO: 532652 - DNA, 20 bp, mouse
ggcggctttggagggtcggg

SEQ ID NO: 532653 - DNA, 20 bp, mouse
gtgcagcagagccccatagg

SEQ ID NO: 532654 - DNA, 20 bp, mouse
gagagaggaagggagcgaca

SEQ ID NO: 532655 - DNA, 20 bp, mouse
gcgcgagccagggagccgtg

SEQ ID NO: 532656 - DNA, 20 bp, mouse
gggcccgcctgatgcagcca

SEQ ID NO: 532657 - DNA, 20 bp, mouse
ggagaggcgcgcgggagcag

SEQ ID NO: 532658 - DNA, 20 bp, mouse
gccgggcacccgctgcatcc

SEQ ID NO: 532659 - DNA, 20 bp, mouse
gcggccagaagcaagcgccc

SEQ ID NO: 532660 - DNA, 20 bp, mouse
gtggccgtggctgcatcagg

SEQ ID NO: 532661 - DNA, 20 bp, mouse
gccccgcagccgggatgcag

SEQ ID NO: 532662 - DNA, 20 bp, mouse
ggcgcgcgggagcagaggct

SEQ ID NO: 532663 - DNA, 20 bp, mouse
gacccgctgcatcccggctg

SEQ ID NO: 532664 - DNA, 20 bp, mouse
gttctggccgtggctgcatc

SEQ ID NO: 532665 - DNA, 20 bp, mouse
gcctggaaatctgcagtcaa

SEQ ID NO: 532666 - DNA, 20 bp, mouse
ggcctcaggagagcaccatc

SEQ ID NO: 532667 - DNA, 20 bp, mouse
gcaccatcgggagagaaacg

SEQ ID NO: 532668 - DNA, 20 bp, mouse
gcgcaggaactccctcaacc

SEQ ID NO: 532669 - DNA, 20 bp, mouse
gccggatgtgctccatcccg

SEQ ID NO: 532670 - DNA, 20 bp, mouse
ggcctgcgcagtgccaccgg

SEQ ID NO: 532671 - DNA, 20 bp, mouse
gtcccgatggtgctctcctg

SEQ ID NO: 532672 - DNA, 20 bp, mouse
ggcctctgcccaatggaccc

SEQ ID NO: 532673 - DNA, 20 bp, mouse
ggcagctgccggggtccatt

SEQ ID NO: 532674 - DNA, 20 bp, mouse
gccaaactgccggccctcaa

SEQ ID NO: 532675 - DNA, 20 bp, mouse
gtgcgggcgtcgccccggga

SEQ ID NO: 532676 - DNA, 20 bp, mouse
gggcgtgcggatgtgctcca

SEQ ID NO: 532677 - DNA, 20 bp, mouse
gcgcccgggccaccaacctt

SEQ ID NO: 532678 - DNA, 20 bp, mouse
gcgtctgcagggtccccggc

SEQ ID NO: 532679 - DNA, 20 bp, mouse
gtgcagacgcgggcccgcca

SEQ ID NO: 532680 - DNA, 20 bp, mouse
gcccgcgtctgcagggtccc

SEQ ID NO: 532681 - DNA, 20 bp, mouse
ggtgcggatgtgctccatgg

SEQ ID NO: 532682 - DNA, 20 bp, mouse
ggcgtgcggcgcaatgggaa

SEQ ID NO: 532683 - DNA, 20 bp, mouse
ggcgcagtggacgcaggggt

SEQ ID NO: 532684 - DNA, 20 bp, mouse
gacatccgcacgcccaaggt

SEQ ID NO: 532685 - DNA, 20 bp, mouse
gggagctggaccgcgaacga

SEQ ID NO: 532686 - DNA, 20 bp, mouse
gggagacggacccggcgtcg

SEQ ID NO: 532687 - DNA, 20 bp, mouse
gtacttccgccagaagtccc

SEQ ID NO: 532688 - DNA, 20 bp, mouse
gatccgagcccgagcagcca

SEQ ID NO: 532689 - DNA, 20 bp, mouse
gcccagccggggctccgtcc

SEQ ID NO: 532690 - DNA, 20 bp, mouse
ggctgccaccggcgtctgac

SEQ ID NO: 532691 - DNA, 20 bp, mouse
gtcccgggcccgcccagccg

SEQ ID NO: 532692 - DNA, 20 bp, mouse
gcccgcccgtcagacgccgg

SEQ ID NO: 532693 - DNA, 20 bp, mouse
gtcccggcaggacaacacgg

SEQ ID NO: 532694 - DNA, 20 bp, mouse
gcagtcccgcaggtgcccgg

SEQ ID NO: 532695 - DNA, 20 bp, mouse
gtcttcccggcaggacaaca

SEQ ID NO: 532696 - DNA, 20 bp, mouse
ggctgcggtgaggcacccag

SEQ ID NO: 532697 - DNA, 20 bp, mouse
gtgagcagttgagggctccg

SEQ ID NO: 532698 - DNA, 20 bp, mouse
ggcacccaggggaccatgaa

SEQ ID NO: 532699 - DNA, 20 bp, mouse
gctccggggcgacaggacaa

SEQ ID NO: 532700 - DNA, 20 bp, mouse
gccgcctggagcctgctgag

SEQ ID NO: 532701 - DNA, 20 bp, mouse
gcctcaccgcagcacagcca

SEQ ID NO: 532702 - DNA, 20 bp, mouse
gaatggccctggctgtgctg

SEQ ID NO: 532703 - DNA, 20 bp, mouse
gggagggccataaaaagtgg

SEQ ID NO: 532704 - DNA, 20 bp, mouse
gggcgacaggacaatggccc

SEQ ID NO: 532705 - DNA, 20 bp, mouse
gaagctcaggaactcaggta

SEQ ID NO: 532706 - DNA, 20 bp, mouse
gcggctgacccagaccaact

SEQ ID NO: 532707 - DNA, 20 bp, mouse
gtagggattgagctgttctc

SEQ ID NO: 532708 - DNA, 20 bp, mouse
ggctggcagcgcgccctagt

SEQ ID NO: 532709 - DNA, 20 bp, mouse
ggggcccgggcagtcacagg

SEQ ID NO: 532710 - DNA, 20 bp, mouse
gtgctgtgaggccagcgggc

SEQ ID NO: 532711 - DNA, 20 bp, mouse
gctaactgctgtgaggccag

SEQ ID NO: 532712 - DNA, 20 bp, mouse
gcagcgcgccctagttggtc

SEQ ID NO: 532713 - DNA, 20 bp, mouse
gaccagtggcaaggtatggt

SEQ ID NO: 532714 - DNA, 20 bp, mouse
gaggttccccacgaagtcca

SEQ ID NO: 532715 - DNA, 20 bp, mouse
gggacagaacagggacatgt

SEQ ID NO: 532716 - DNA, 20 bp, mouse
gagacgcccggaactgtcac

SEQ ID NO: 532717 - DNA, 20 bp, mouse
ggcccagctggcttctactc

SEQ ID NO: 532718 - DNA, 20 bp, mouse
gcgcgagccacagcgagcgg

SEQ ID NO: 532719 - DNA, 20 bp, mouse
ggtccgcgagccacagcgag

SEQ ID NO: 532720 - DNA, 20 bp, mouse
ggaagctagctagagacgcc

SEQ ID NO: 532721 - DNA, 20 bp, mouse
ggagccacagcgagcggcgg

SEQ ID NO: 532722 - DNA, 20 bp, mouse
gcggagaaggaacatgttga

SEQ ID NO: 532723 - DNA, 20 bp, mouse
gctactccggtgacagttcc

SEQ ID NO: 532724 - DNA, 20 bp, mouse
gtcgacgtggtagttatcgg

SEQ ID NO: 532725 - DNA, 20 bp, mouse
gcagctgggcgtcgccatct

SEQ ID NO: 532726 - DNA, 20 bp, mouse
gtgaggctgggggcctgaag

SEQ ID NO: 532727 - DNA, 20 bp, mouse
ggggcctgaagcggcggtac

SEQ ID NO: 532728 - DNA, 20 bp, mouse
gcctggcctagaagacagcg

SEQ ID NO: 532729 - DNA, 20 bp, mouse
ggaagcggcggtaccggctc

SEQ ID NO: 532730 - DNA, 20 bp, mouse
gagaagacagcggggaaggc

SEQ ID NO: 532731 - DNA, 20 bp, mouse
gggctgggggcctgaagcgg

SEQ ID NO: 532732 - DNA, 20 bp, mouse
gaggcgggtgttgaggctgg

SEQ ID NO: 532733 - DNA, 20 bp, mouse
gcccccagcacggcccacac

SEQ ID NO: 532734 - DNA, 20 bp, mouse
gccaggtcctgagcccgaga

SEQ ID NO: 532735 - DNA, 20 bp, mouse
gctggtgctggggcgctgta

SEQ ID NO: 532736 - DNA, 20 bp, mouse
gtccgtctctgggaacacac

SEQ ID NO: 532737 - DNA, 20 bp, mouse
gccgcgagcagccattatca

SEQ ID NO: 532738 - DNA, 20 bp, mouse
gcttcctgctgccctgataa

SEQ ID NO: 532739 - DNA, 20 bp, mouse
ggctccagtgacaggcggga

SEQ ID NO: 532740 - DNA, 20 bp, mouse
ggcagtcgtgctccagtgac

SEQ ID NO: 532741 - DNA, 20 bp, mouse
gaatagtccctggacaactg

SEQ ID NO: 532742 - DNA, 20 bp, mouse
gtaatggctgctcgcggcgt

SEQ ID NO: 532743 - DNA, 20 bp, mouse
gggcagatgcgctaaggtca

SEQ ID NO: 532744 - DNA, 20 bp, mouse
ggtcgtgctccagtgacagg

SEQ ID NO: 532745 - DNA, 20 bp, mouse
gtctccctcccgcctgtcac

SEQ ID NO: 532746 - DNA, 20 bp, mouse
ggtcgcggctacggttcggg

SEQ ID NO: 532747 - DNA, 20 bp, mouse
ggcgggtcgcggctacggtt

SEQ ID NO: 532748 - DNA, 20 bp, mouse
gccgttgggcccagcagagc

SEQ ID NO: 532749 - DNA, 20 bp, mouse
gcgggcgagactgcgggtcg

SEQ ID NO: 532750 - DNA, 20 bp, mouse
gctgcttctcctcagctagg

SEQ ID NO: 532751 - DNA, 20 bp, mouse
gagactgcgggtcgcggcta

SEQ ID NO: 532752 - DNA, 20 bp, mouse
gtgcgacaaggagttcatgt

SEQ ID NO: 532753 - DNA, 20 bp, mouse
gcgcgcctcaggccgctgag

SEQ ID NO: 532754 - DNA, 20 bp, mouse
gaggcggaacctgctctgct

SEQ ID NO: 532755 - DNA, 20 bp, mouse
gcgcagtctcgcccgctcag

SEQ ID NO: 532756 - DNA, 20 bp, mouse
gggccgcagcgacagactaa

SEQ ID NO: 532757 - DNA, 20 bp, mouse
gtgccggaggctagattgag

SEQ ID NO: 532758 - DNA, 20 bp, mouse
gagagctaacggcgcagtgg

SEQ ID NO: 532759 - DNA, 20 bp, mouse
ggctaacggcgcagtggcgg

SEQ ID NO: 532760 - DNA, 20 bp, mouse
gcggagagctaacggcgcag

SEQ ID NO: 532761 - DNA, 20 bp, mouse
gggaattgacgacgtagaga

SEQ ID NO: 532762 - DNA, 20 bp, mouse
gagattgagcggagagctaa

SEQ ID NO: 532763 - DNA, 20 bp, mouse
gagctccccgctacagagca

SEQ ID NO: 532764 - DNA, 20 bp, mouse
gagtcctcctcaagcaggga

SEQ ID NO: 532765 - DNA, 20 bp, mouse
gcgcccgcggtggaattctt

SEQ ID NO: 532766 - DNA, 20 bp, mouse
gaacccggaagcagtagcct

SEQ ID NO: 532767 - DNA, 20 bp, mouse
gtgcaagcatgatcagtccc

SEQ ID NO: 532768 - DNA, 20 bp, mouse
gaccttgagctgaaatgttg

SEQ ID NO: 532769 - DNA, 20 bp, mouse
gaaatgttgcggtgcacagg

SEQ ID NO: 532770 - DNA, 20 bp, mouse
gatacggaagtaacaccagt

SEQ ID NO: 532771 - DNA, 20 bp, mouse
gctgaaatgttgcggtgcac

SEQ ID NO: 532772 - DNA, 20 bp, mouse
gaccgcaacatttcagctca

SEQ ID NO: 532773 - DNA, 20 bp, mouse
gaggagagggcgatccactt

SEQ ID NO: 532774 - DNA, 20 bp, mouse
gtggttagggcactaggaga

SEQ ID NO: 532775 - DNA, 20 bp, mouse
ggaagctgcgacgtccaaag

SEQ ID NO: 532776 - DNA, 20 bp, mouse
ggaaaatatacaaacactct

SEQ ID NO: 532777 - DNA, 20 bp, mouse
ggggcggcccagccaggatg

SEQ ID NO: 532778 - DNA, 20 bp, mouse
ggctccaggaaggcccgcag

SEQ ID NO: 532779 - DNA, 20 bp, mouse
gatatacaaacactctagga

SEQ ID NO: 532780 - DNA, 20 bp, mouse
ggaagttctcgtaacatttc

SEQ ID NO: 532781 - DNA, 20 bp, mouse
gccttcctggagcgccgcgt

SEQ ID NO: 532782 - DNA, 20 bp, mouse
gccgcgggcgaggagctcct

SEQ ID NO: 532783 - DNA, 20 bp, mouse
gggagctcctcggaaggcgg

SEQ ID NO: 532784 - DNA, 20 bp, mouse
gtggcagagcaccttgtcca

SEQ ID NO: 532785 - DNA, 20 bp, mouse
gtacccagcgtccagaccac

SEQ ID NO: 532786 - DNA, 20 bp, mouse
gtgcctgtcggaggagaacg

SEQ ID NO: 532787 - DNA, 20 bp, mouse
gcgcgcctggaggtattcgg

SEQ ID NO: 532788 - DNA, 20 bp, mouse
gtcccccgccgaatacctcc

SEQ ID NO: 532789 - DNA, 20 bp, mouse
gcgcggtccggaaaactcag

SEQ ID NO: 532790 - DNA, 20 bp, mouse
gcctccgacaggcacagtcc

SEQ ID NO: 532791 - DNA, 20 bp, mouse
gacggcgggagcgacggaag

SEQ ID NO: 532792 - DNA, 20 bp, mouse
gaaccccgttctcctccgac

SEQ ID NO: 532793 - DNA, 20 bp, mouse
ggcctggaggtattcggcgg

SEQ ID NO: 532794 - DNA, 20 bp, mouse
gggagcgacggaagcggtgg

SEQ ID NO: 532795 - DNA, 20 bp, mouse
gattcgcgcctggaggtatt

SEQ ID NO: 532796 - DNA, 20 bp, mouse
ggcgcacaggagtaaaaagg

SEQ ID NO: 532797 - DNA, 20 bp, mouse
gcgggcgcacaggagtaaaa

SEQ ID NO: 532798 - DNA, 20 bp, mouse
ggtctgcgagcaacagatcc

SEQ ID NO: 532799 - DNA, 20 bp, mouse
gaggagtaaaaaggaggcgg

SEQ ID NO: 532800 - DNA, 20 bp, mouse
gagcgcggggccgggcgcac

SEQ ID NO: 532801 - DNA, 20 bp, mouse
gagaaagagagaacgaaaaa

SEQ ID NO: 532802 - DNA, 20 bp, mouse
gggagccgagcactgcacat

SEQ ID NO: 532803 - DNA, 20 bp, mouse
gggtgactcgccctccggag

SEQ ID NO: 532804 - DNA, 20 bp, mouse
gccgtcgtgggcactcttgg

SEQ ID NO: 532805 - DNA, 20 bp, mouse
gcttggattgggacttgggg

SEQ ID NO: 532806 - DNA, 20 bp, mouse
gcgcgggccatggctcggtg

SEQ ID NO: 532807 - DNA, 20 bp, mouse
gggccccagcatggagacgg

SEQ ID NO: 532808 - DNA, 20 bp, mouse
gcgtgacgcccgagcttcgg

SEQ ID NO: 532809 - DNA, 20 bp, mouse
ggcagttcgcggcgcagcct

SEQ ID NO: 532810 - DNA, 20 bp, mouse
gccccagccccaccgagcca

SEQ ID NO: 532811 - DNA, 20 bp, mouse
gcgctccagtgcccgcgccg

SEQ ID NO: 532812 - DNA, 20 bp, mouse
ggtccggcccctcccctgca

SEQ ID NO: 532813 - DNA, 20 bp, mouse
ggcggcggcagggcgcgcaa

SEQ ID NO: 532814 - DNA, 20 bp, mouse
ggccatggctcggtggggct

SEQ ID NO: 532815 - DNA, 20 bp, mouse
gcccgccacgcgtccctcag

SEQ ID NO: 532816 - DNA, 20 bp, mouse
ggagtcccggggactggatg

SEQ ID NO: 532817 - DNA, 20 bp, mouse
gcactgctcagtgagtcccg

SEQ ID NO: 532818 - DNA, 20 bp, mouse
gggagccagcatgatcctct

SEQ ID NO: 532819 - DNA, 20 bp, mouse
gactgccaagaggatcatgc

SEQ ID NO: 532820 - DNA, 20 bp, mouse
gctcagtgagtcccggggac

SEQ ID NO: 532821 - DNA, 20 bp, mouse
gcctttaacggaagcagagt

SEQ ID NO: 532822 - DNA, 20 bp, mouse
gggggactggatgtggcaga

SEQ ID NO: 532823 - DNA, 20 bp, mouse
gttgtcgccggttctgaaga

SEQ ID NO: 532824 - DNA, 20 bp, mouse
gataagattggaatatctgg

SEQ ID NO: 532825 - DNA, 20 bp, mouse
gctagagacacactgctctg

SEQ ID NO: 532826 - DNA, 20 bp, mouse
ggatctgtgaggagcagctc

SEQ ID NO: 532827 - DNA, 20 bp, mouse
gcgtctgagcaagatctgtg

SEQ ID NO: 532828 - DNA, 20 bp, mouse
gcagatcttgctcagacgaa

SEQ ID NO: 532829 - DNA, 20 bp, mouse
gcagtgggagaacttcgcag

SEQ ID NO: 532830 - DNA, 20 bp, mouse
gcgggaaccacaacaacccg

SEQ ID NO: 532831 - DNA, 20 bp, mouse
ggcacagtgtgatgtaattc

SEQ ID NO: 532832 - DNA, 20 bp, mouse
gcaacatctggaagagcaaa

SEQ ID NO: 532833 - DNA, 20 bp, mouse
gccaggccacccagattggg

SEQ ID NO: 532834 - DNA, 20 bp, mouse
gcaagagacacagtatgtga

SEQ ID NO: 532835 - DNA, 20 bp, mouse
gtgtgtctcttggcaactcg

SEQ ID NO: 532836 - DNA, 20 bp, mouse
gccaggtacagacgtctcca

SEQ ID NO: 532837 - DNA, 20 bp, mouse
gggttcccgcctggccgcca

SEQ ID NO: 532838 - DNA, 20 bp, mouse
gcagggtgctggtgcgggtt

SEQ ID NO: 532839 - DNA, 20 bp, mouse
gtccggagaacgaggagctg

SEQ ID NO: 532840 - DNA, 20 bp, mouse
gcaggcgggaaccgggaacc

SEQ ID NO: 532841 - DNA, 20 bp, mouse
gtccccaccgcggccgggat

SEQ ID NO: 532842 - DNA, 20 bp, mouse
ggggtcgatctgcaagcccc

SEQ ID NO: 532843 - DNA, 20 bp, mouse
gccctcggcgggtcctgcct

SEQ ID NO: 532844 - DNA, 20 bp, mouse
gtggggacctccggagaacg

SEQ ID NO: 532845 - DNA, 20 bp, mouse
gtccaaggcaggacccgccg

SEQ ID NO: 532846 - DNA, 20 bp, mouse
ggcagagaggaggactcggg

SEQ ID NO: 532847 - DNA, 20 bp, mouse
gcgaggtgctggctcccaaa

SEQ ID NO: 532848 - DNA, 20 bp, mouse
gaggtagtcgggagaccaca

SEQ ID NO: 532849 - DNA, 20 bp, mouse
gttcagcgattgcagagagg

SEQ ID NO: 532850 - DNA, 20 bp, mouse
ggaagttatcaggagaaata

SEQ ID NO: 532851 - DNA, 20 bp, mouse
gaacttcagcgattgcagag

SEQ ID NO: 532852 - DNA, 20 bp, mouse
ggaccaaggagggggaggtg

SEQ ID NO: 532853 - DNA, 20 bp, mouse
gaggcatgcgagagaggcgg

SEQ ID NO: 532854 - DNA, 20 bp, mouse
gtgcaatcgctgaagttatc

SEQ ID NO: 532855 - DNA, 20 bp, mouse
gttctctgcccagaccaagg

SEQ ID NO: 532856 - DNA, 20 bp, mouse
ggagctgttctgctggtcag

SEQ ID NO: 532857 - DNA, 20 bp, mouse
gggtcagagagcgtacaaga

SEQ ID NO: 532858 - DNA, 20 bp, mouse
gggcagtcgaaggccgatgt

SEQ ID NO: 532859 - DNA, 20 bp, mouse
gcagcacggccagactatcc

SEQ ID NO: 532860 - DNA, 20 bp, mouse
ggactatccaggtccaccga

SEQ ID NO: 532861 - DNA, 20 bp, mouse
gtaaggcgcggagcccacat

SEQ ID NO: 532862 - DNA, 20 bp, mouse
gtgcgtcttgagagaaactg

SEQ ID NO: 532863 - DNA, 20 bp, mouse
gccccacagccagactgtgt

SEQ ID NO: 532864 - DNA, 20 bp, mouse
gcctgaggcggcccccgtaa

SEQ ID NO: 532865 - DNA, 20 bp, mouse
gcccccgcggcgtccgctca

SEQ ID NO: 532866 - DNA, 20 bp, mouse
gagacgagcagagctcacct

SEQ ID NO: 532867 - DNA, 20 bp, mouse
ggagctcacctcggcagcgg

SEQ ID NO: 532868 - DNA, 20 bp, mouse
gggcctggcggtaaccttgc

SEQ ID NO: 532869 - DNA, 20 bp, mouse
ggatcgcaggtagcccgtgt

SEQ ID NO: 532870 - DNA, 20 bp, mouse
ggacctcggcggccttcccc

SEQ ID NO: 532871 - DNA, 20 bp, mouse
ggctctgctcgtcttagcgt

SEQ ID NO: 532872 - DNA, 20 bp, mouse
ggccgctgccgcctccaccc

SEQ ID NO: 532873 - DNA, 20 bp, mouse
gccctcccgcgcgacctcgg

SEQ ID NO: 532874 - DNA, 20 bp, mouse
ggcagccgacatgtctctgg

SEQ ID NO: 532875 - DNA, 20 bp, mouse
ggaagctcgtcagctgccgg

SEQ ID NO: 532876 - DNA, 20 bp, mouse
gggactcgctgtggaccgaa

SEQ ID NO: 532877 - DNA, 20 bp, mouse
ggagtacttccgggtgacag

SEQ ID NO: 532878 - DNA, 20 bp, mouse
ggaggtcagccccggcaaga

SEQ ID NO: 532879 - DNA, 20 bp, mouse
gggcaagatggcggccccca

SEQ ID NO: 532880 - DNA, 20 bp, mouse
gcaccaccaaggactcgctg

SEQ ID NO: 532881 - DNA, 20 bp, mouse
ggtccacagcgagtccttgg

SEQ ID NO: 532882 - DNA, 20 bp, mouse
ggggcggtacgagtacttcc

SEQ ID NO: 532883 - DNA, 20 bp, mouse
ggccagggcgcgggaggact

SEQ ID NO: 532884 - DNA, 20 bp, mouse
gctgactgatgcaccctcaa

SEQ ID NO: 532885 - DNA, 20 bp, mouse
gtggggacctcggatgcagg

SEQ ID NO: 532886 - DNA, 20 bp, mouse
ggtggtgaacaggcgggaag

SEQ ID NO: 532887 - DNA, 20 bp, mouse
gcgaatgcccggggtcatgg

SEQ ID NO: 532888 - DNA, 20 bp, mouse
gccgtgtgtgaggtggaaca

SEQ ID NO: 532889 - DNA, 20 bp, mouse
gcatggtggtggtgaacagg

SEQ ID NO: 532890 - DNA, 20 bp, mouse
gaagttgagaggacataagg

SEQ ID NO: 532891 - DNA, 20 bp, mouse
gggagagtgggcactatagt

SEQ ID NO: 532892 - DNA, 20 bp, mouse
gtggcgctccgtgtgtgagg

SEQ ID NO: 532893 - DNA, 20 bp, mouse
gacctggggtagtcaaggag

SEQ ID NO: 532894 - DNA, 20 bp, mouse
ggaaaggagcccgaatgccc

SEQ ID NO: 532895 - DNA, 20 bp, mouse
gaggagaagtagctccggag

SEQ ID NO: 532896 - DNA, 20 bp, mouse
ggctcttgcttgataatcca

SEQ ID NO: 532897 - DNA, 20 bp, mouse
gcagaggcaaaagaagtcta

SEQ ID NO: 532898 - DNA, 20 bp, mouse
gactccaggcagcgaaggag

SEQ ID NO: 532899 - DNA, 20 bp, mouse
gcttacccacggtcaccaaa

SEQ ID NO: 532900 - DNA, 20 bp, mouse
ggtgacccccaagacagcag

SEQ ID NO: 532901 - DNA, 20 bp, mouse
gaaaaggagtttcttaccca

SEQ ID NO: 532902 - DNA, 20 bp, mouse
gcttgcttgataatccaagg

SEQ ID NO: 532903 - DNA, 20 bp, mouse
gctgacattgggacacagca

SEQ ID NO: 532904 - DNA, 20 bp, mouse
gtcagagagtcagacctgga

SEQ ID NO: 532905 - DNA, 20 bp, mouse
gtggctgctagtcttgactt

SEQ ID NO: 532906 - DNA, 20 bp, mouse
gacagtaagacctcagcaca

SEQ ID NO: 532907 - DNA, 20 bp, mouse
gttatcaaagagaatcacag

SEQ ID NO: 532908 - DNA, 20 bp, mouse
gtggcttaagtctgacagtg

SEQ ID NO: 532909 - DNA, 20 bp, mouse
gactaacaggtatttacaga

SEQ ID NO: 532910 - DNA, 20 bp, mouse
gtatagaaggtaattaacta

SEQ ID NO: 532911 - DNA, 20 bp, mouse
gagttgctaactgaataaag

SEQ ID NO: 532912 - DNA, 20 bp, mouse
gtaattaactaaggaaacaa

SEQ ID NO: 532913 - DNA, 20 bp, mouse
ggaaaatagcgctgttgacc

SEQ ID NO: 532914 - DNA, 20 bp, mouse
gacttaccttcagaactaac

SEQ ID NO: 532915 - DNA, 20 bp, mouse
gggcaggtcagtcaggttct

SEQ ID NO: 532916 - DNA, 20 bp, mouse
gtcttcgatgtccctctcta

SEQ ID NO: 532917 - DNA, 20 bp, mouse
gcactgaatataaccataca

SEQ ID NO: 532918 - DNA, 20 bp, mouse
ggaatatattaccctagaga

SEQ ID NO: 532919 - DNA, 20 bp, mouse
ggtaatgataggggtactca

SEQ ID NO: 532920 - DNA, 20 bp, mouse
gttgaaaacactggagaagt

SEQ ID NO: 532921 - DNA, 20 bp, mouse
gaggtgtgtggtctatttcc

SEQ ID NO: 532922 - DNA, 20 bp, mouse
ggtcagatggagtaatgata

SEQ ID NO: 532923 - DNA, 20 bp, mouse
ggataggggtactcagggaa

SEQ ID NO: 532924 - DNA, 20 bp, mouse
gagctggtacttgccctgta

SEQ ID NO: 532925 - DNA, 20 bp, mouse
gaggctcatggagaagcacc

SEQ ID NO: 532926 - DNA, 20 bp, mouse
ggtaaattacctgaagtact

SEQ ID NO: 532927 - DNA, 20 bp, mouse
gtgggtgttctagtcgtagt

SEQ ID NO: 532928 - DNA, 20 bp, mouse
gcacccacacccagtacttc

SEQ ID NO: 532929 - DNA, 20 bp, mouse
ggactttaatcagattgtaa

SEQ ID NO: 532930 - DNA, 20 bp, mouse
gtcaatccccggtaaagaga

SEQ ID NO: 532931 - DNA, 20 bp, mouse
gcttcaggtaatttactttc

SEQ ID NO: 532932 - DNA, 20 bp, mouse
gtgttggttactaacttact

SEQ ID NO: 532933 - DNA, 20 bp, mouse
gccgattctgtgttaaaaac

SEQ ID NO: 532934 - DNA, 20 bp, mouse
gtcctgagtaaaagatttag

SEQ ID NO: 532935 - DNA, 20 bp, mouse
ggttgtgccttaaacgataa

SEQ ID NO: 532936 - DNA, 20 bp, mouse
gaggatgatgcccattgagg

SEQ ID NO: 532937 - DNA, 20 bp, mouse
gtgtgggccaccggcaacag

SEQ ID NO: 532938 - DNA, 20 bp, mouse
gtcaatgggcatcatcctca

SEQ ID NO: 532939 - DNA, 20 bp, mouse
ggccggtggcccacagtcta

SEQ ID NO: 532940 - DNA, 20 bp, mouse
gggaggtatgtggctgggac

SEQ ID NO: 532941 - DNA, 20 bp, mouse
gccaccggcaacagaggact

SEQ ID NO: 532942 - DNA, 20 bp, mouse
ggaggtggaggtatgtggct

SEQ ID NO: 532943 - DNA, 20 bp, mouse
gtatgtggctgggactggct

SEQ ID NO: 532944 - DNA, 20 bp, mouse
gcacatacctccacctcaat

SEQ ID NO: 532945 - DNA, 20 bp, mouse
gctgaggatgggtgaatagg

SEQ ID NO: 532946 - DNA, 20 bp, mouse
gcaggtccggcagacagcgg

SEQ ID NO: 532947 - DNA, 20 bp, mouse
gggtcagggccaggcacgat

SEQ ID NO: 532948 - DNA, 20 bp, mouse
gcggcagacagcggtggtca

SEQ ID NO: 532949 - DNA, 20 bp, mouse
gaggcacgatgggctctgtc

SEQ ID NO: 532950 - DNA, 20 bp, mouse
gcttccagcagaagacaagg

SEQ ID NO: 532951 - DNA, 20 bp, mouse
gcaccagggaggatccccgg

SEQ ID NO: 532952 - DNA, 20 bp, mouse
ggctaggtaacgatgttgga

SEQ ID NO: 532953 - DNA, 20 bp, mouse
gagtgtgagctctccaggta

SEQ ID NO: 532954 - DNA, 20 bp, mouse
gcatcactgtaagggagtct

SEQ ID NO: 532955 - DNA, 20 bp, mouse
gctgggctaggtaacgatgt

SEQ ID NO: 532956 - DNA, 20 bp, mouse
ggtggtggaaacatcactag

SEQ ID NO: 532957 - DNA, 20 bp, mouse
ggttgtggtgacttcacctg

SEQ ID NO: 532958 - DNA, 20 bp, mouse
ggtggtgacttcacctgtgg

SEQ ID NO: 532959 - DNA, 20 bp, mouse
ggtggaggtggtatcagcag

SEQ ID NO: 532960 - DNA, 20 bp, mouse
ggaggtggtatcagcagtgg

SEQ ID NO: 532961 - DNA, 20 bp, mouse
gctgatgatgtcaccaccac

SEQ ID NO: 532962 - DNA, 20 bp, mouse
ggttgtgatttctacagtgg

SEQ ID NO: 532963 - DNA, 20 bp, mouse
ggtggttgtgatttctacag

SEQ ID NO: 532964 - DNA, 20 bp, mouse
gcagcagtggtggtgacatc

SEQ ID NO: 532965 - DNA, 20 bp, mouse
ggtgacttcagcagtggagg

SEQ ID NO: 532966 - DNA, 20 bp, mouse
gatcggctataagctctgaa

SEQ ID NO: 532967 - DNA, 20 bp, mouse
gtgagggagcataccggaaa

SEQ ID NO: 532968 - DNA, 20 bp, mouse
ggagatgcatgtcttctaga

SEQ ID NO: 532969 - DNA, 20 bp, mouse
gcttgggcaagaagacctta

SEQ ID NO: 532970 - DNA, 20 bp, mouse
gggatagacaagaacaactt

SEQ ID NO: 532971 - DNA, 20 bp, mouse
ggcacacacgcgtatcctag

SEQ ID NO: 532972 - DNA, 20 bp, mouse
gggatagcttcttggaacag

SEQ ID NO: 532973 - DNA, 20 bp, mouse
gaggctcccaagctgattca

SEQ ID NO: 532974 - DNA, 20 bp, mouse
ggctgattcaaggtgaatca

SEQ ID NO: 532975 - DNA, 20 bp, mouse
gtgtgtgcgtaagtgttcac

SEQ ID NO: 532976 - DNA, 20 bp, mouse
ggtgctgtggggattcctga

SEQ ID NO: 532977 - DNA, 20 bp, mouse
gggaatccccacagcacttg

SEQ ID NO: 532978 - DNA, 20 bp, mouse
ggattcctgagggagcctga

SEQ ID NO: 532979 - DNA, 20 bp, mouse
gctccagtgaggccctctca

SEQ ID NO: 532980 - DNA, 20 bp, mouse
gagccatgagagggcctcac

SEQ ID NO: 532981 - DNA, 20 bp, mouse
gtttggggccagcagccagt

SEQ ID NO: 532982 - DNA, 20 bp, mouse
gactctctggagccatgaga

SEQ ID NO: 532983 - DNA, 20 bp, mouse
ggggagcctgagggactctc

SEQ ID NO: 532984 - DNA, 20 bp, mouse
gaggtgggtatgggacaagg

SEQ ID NO: 532985 - DNA, 20 bp, mouse
ggcctggcttggggaaccta

SEQ ID NO: 532986 - DNA, 20 bp, mouse
gcagggctaggacccagaat

SEQ ID NO: 532987 - DNA, 20 bp, mouse
gtgctccacagcatgggtgt

SEQ ID NO: 532988 - DNA, 20 bp, mouse
gggtgtcggccggagaaagt

SEQ ID NO: 532989 - DNA, 20 bp, mouse
gccggccgacacccatgctg

SEQ ID NO: 532990 - DNA, 20 bp, mouse
ggactagagtctttcctcag

SEQ ID NO: 532991 - DNA, 20 bp, mouse
gcatggggaaatgtccccac

SEQ ID NO: 532992 - DNA, 20 bp, mouse
gttcctcagaggctgccagt

SEQ ID NO: 532993 - DNA, 20 bp, mouse
gtggcctgcagccaatgcac

SEQ ID NO: 532994 - DNA, 20 bp, mouse
gctcaagccctggactcagg

SEQ ID NO: 532995 - DNA, 20 bp, mouse
gacccatgctgtggagcatg

SEQ ID NO: 532996 - DNA, 20 bp, mouse
gatcctgggggcagtacaga

SEQ ID NO: 532997 - DNA, 20 bp, mouse
gaccatgagcaaggccacgg

SEQ ID NO: 532998 - DNA, 20 bp, mouse
gcacaccatgagcaaggcca

SEQ ID NO: 532999 - DNA, 20 bp, mouse
ggctggcatagctagagtgt

SEQ ID NO: 533000 - DNA, 20 bp, mouse
gtgggggcagtacagagggc

SEQ ID NO: 533001 - DNA, 20 bp, mouse
gcaaggcacttgctccctgg

SEQ ID NO: 533002 - DNA, 20 bp, mouse
gacataagtccaggccccca

SEQ ID NO: 533003 - DNA, 20 bp, mouse
ggacctgggaccacgatgtt

SEQ ID NO: 533004 - DNA, 20 bp, mouse
gatggtgtggccagcaggta

SEQ ID NO: 533005 - DNA, 20 bp, mouse
gccaggtcttgaagttctct

SEQ ID NO: 533006 - DNA, 20 bp, mouse
ggcccagcagtagaagccca

SEQ ID NO: 533007 - DNA, 20 bp, mouse
gtggcacgcctggatcagag

SEQ ID NO: 533008 - DNA, 20 bp, mouse
gcacgcctggatcagagagg

SEQ ID NO: 533009 - DNA, 20 bp, mouse
gtgtcggaccctgagcatgg

SEQ ID NO: 533010 - DNA, 20 bp, mouse
ggcctcaggcagagtcaaca

SEQ ID NO: 533011 - DNA, 20 bp, mouse
gagttagacagtcgcagcag

SEQ ID NO: 533012 - DNA, 20 bp, mouse
ggccctgggcttctactgct

SEQ ID NO: 533013 - DNA, 20 bp, mouse
gagctgtcggaccctgagca

SEQ ID NO: 533014 - DNA, 20 bp, mouse
ggtcaacaaggcaagaccag

SEQ ID NO: 533015 - DNA, 20 bp, mouse
gcatatggctaacctgcctc

SEQ ID NO: 533016 - DNA, 20 bp, mouse
gacaggaaataacagcatgt

SEQ ID NO: 533017 - DNA, 20 bp, mouse
ggaaccaggtactaggtaag

SEQ ID NO: 533018 - DNA, 20 bp, mouse
gcactaagtatcatgtatta

SEQ ID NO: 533019 - DNA, 20 bp, mouse
gacatattgtcattcatgtg

SEQ ID NO: 533020 - DNA, 20 bp, mouse
gcacatcattataagtagct

SEQ ID NO: 533021 - DNA, 20 bp, mouse
gagctcttctcttataagct

SEQ ID NO: 533022 - DNA, 20 bp, mouse
ggaggtgagtaccagcaaga

SEQ ID NO: 533023 - DNA, 20 bp, mouse
gtgagatagaaccaggtact

SEQ ID NO: 533024 - DNA, 20 bp, mouse
gtaatgatgtgtcaaaatgg

SEQ ID NO: 533025 - DNA, 20 bp, mouse
gtaaaaattgagatagaacc

SEQ ID NO: 533026 - DNA, 20 bp, mouse
gggcaaggagaaccgaaaaa

SEQ ID NO: 533027 - DNA, 20 bp, mouse
ggctcagttgtgcctttttt

SEQ ID NO: 533028 - DNA, 20 bp, mouse
ggaatttaaggaggttttag

SEQ ID NO: 533029 - DNA, 20 bp, mouse
gaaagaagcagaatgcagga

SEQ ID NO: 533030 - DNA, 20 bp, mouse
gagcagaatgcaggaaggca

SEQ ID NO: 533031 - DNA, 20 bp, mouse
ggagtaaagaagcagaatgc

SEQ ID NO: 533032 - DNA, 20 bp, mouse
gattctgcttctttactcaa

SEQ ID NO: 533033 - DNA, 20 bp, mouse
gaaggaggttttaggggaag

SEQ ID NO: 533034 - DNA, 20 bp, mouse
gttgagacagataagacttc

SEQ ID NO: 533035 - DNA, 20 bp, mouse
gaggagagaatatacgaaaa

SEQ ID NO: 533036 - DNA, 20 bp, mouse
gaatttaaggaggtttttag

SEQ ID NO: 533037 - DNA, 20 bp, mouse
gaagggactgtaaagggaaa

SEQ ID NO: 533038 - DNA, 20 bp, mouse
gaaggaggtttttaggggaa

SEQ ID NO: 533039 - DNA, 20 bp, mouse
gaccatgtggaagagcagac

SEQ ID NO: 533040 - DNA, 20 bp, mouse
gtaagaaaggacaggaggac

SEQ ID NO: 533041 - DNA, 20 bp, mouse
gtaggggaagggactgtaaa

SEQ ID NO: 533042 - DNA, 20 bp, mouse
gcttctgcttcttcactcaa

SEQ ID NO: 533043 - DNA, 20 bp, mouse
gctacttgttcagtaataag

SEQ ID NO: 533044 - DNA, 20 bp, mouse
gtatacgaagatggctttgg

SEQ ID NO: 533045 - DNA, 20 bp, mouse
ggaatatacgaagatggctt

SEQ ID NO: 533046 - DNA, 20 bp, mouse
ggggctgcgcggctgcgtag

SEQ ID NO: 533047 - DNA, 20 bp, mouse
gggtcgcgaaccgctctcca

SEQ ID NO: 533048 - DNA, 20 bp, mouse
ggtcgcaggtgatttcgagg

SEQ ID NO: 533049 - DNA, 20 bp, mouse
ggcgagctgccagtgagacc

SEQ ID NO: 533050 - DNA, 20 bp, mouse
ggtgggcagcccggtctcac

SEQ ID NO: 533051 - DNA, 20 bp, mouse
gggttccgggaagggctgcg

SEQ ID NO: 533052 - DNA, 20 bp, mouse
ggggcgacgggttccgggaa

SEQ ID NO: 533053 - DNA, 20 bp, mouse
gggatgacctggccgagcga

SEQ ID NO: 533054 - DNA, 20 bp, mouse
ggtgcggcttggggtcgcca

SEQ ID NO: 533055 - DNA, 20 bp, mouse
gggggtcgcaggtgatttcg

SEQ ID NO: 533056 - DNA, 20 bp, mouse
ggccgcggcggtcccaacgg

SEQ ID NO: 533057 - DNA, 20 bp, mouse
gcaggccgcggcggtcccaa

SEQ ID NO: 533058 - DNA, 20 bp, mouse
gagcctgagcgaccaggccg

SEQ ID NO: 533059 - DNA, 20 bp, mouse
gaggcggagagcctggggaa

SEQ ID NO: 533060 - DNA, 20 bp, mouse
gcgcgtcaggcgggctgggt

SEQ ID NO: 533061 - DNA, 20 bp, mouse
gtctgcgcagggcccacgtg

SEQ ID NO: 533062 - DNA, 20 bp, mouse
gtagcccgcggggatctgcg

SEQ ID NO: 533063 - DNA, 20 bp, mouse
gggcggggcctgcctcacag

SEQ ID NO: 533064 - DNA, 20 bp, mouse
gtccgccgttgggaccgccg

SEQ ID NO: 533065 - DNA, 20 bp, mouse
gcgtccgagcctgagcgacc

SEQ ID NO: 533066 - DNA, 20 bp, mouse
gtgagggagagactgcctaa

SEQ ID NO: 533067 - DNA, 20 bp, mouse
gcgcccctcggccaccagag

SEQ ID NO: 533068 - DNA, 20 bp, mouse
gactgactgttgcttcgtga

SEQ ID NO: 533069 - DNA, 20 bp, mouse
gagcctctctggtggccgag

SEQ ID NO: 533070 - DNA, 20 bp, mouse
gtccgcgggccactcgctcg

SEQ ID NO: 533071 - DNA, 20 bp, mouse
gcggccgcgacaggcgccag

SEQ ID NO: 533072 - DNA, 20 bp, mouse
ggggctgcggggtgaaagta

SEQ ID NO: 533073 - DNA, 20 bp, mouse
gggtgcgagccgcgagcgag

SEQ ID NO: 533074 - DNA, 20 bp, mouse
gtgaaaggtgagaaaagtcg

SEQ ID NO: 533075 - DNA, 20 bp, mouse
gcgaaacagcacagccacta

SEQ ID NO: 533076 - DNA, 20 bp, mouse
ggccaagtaggccctttgaa

SEQ ID NO: 533077 - DNA, 20 bp, mouse
gactatactcatccattcaa

SEQ ID NO: 533078 - DNA, 20 bp, mouse
gctgagaggcagggagagta

SEQ ID NO: 533079 - DNA, 20 bp, mouse
gtccattcaaagggcctact

SEQ ID NO: 533080 - DNA, 20 bp, mouse
gtcattcatctaataaattg

SEQ ID NO: 533081 - DNA, 20 bp, mouse
gtctaccaaaatgaagctgc

SEQ ID NO: 533082 - DNA, 20 bp, mouse
ggttatatctgaatatcttc

SEQ ID NO: 533083 - DNA, 20 bp, mouse
gttcagatataacaacattt

SEQ ID NO: 533084 - DNA, 20 bp, mouse
gagaaagacgtggttctgac

SEQ ID NO: 533085 - DNA, 20 bp, mouse
gatcttctggtcttacttca

SEQ ID NO: 533086 - DNA, 20 bp, mouse
ggctaaaggagacccatatg

SEQ ID NO: 533087 - DNA, 20 bp, mouse
gattagccttgaagccaagt

SEQ ID NO: 533088 - DNA, 20 bp, mouse
gtgcctctcagtgaaaccag

SEQ ID NO: 533089 - DNA, 20 bp, mouse
gcagaccttgaagtaagact

SEQ ID NO: 533090 - DNA, 20 bp, mouse
gctacttgaactcctcacta

SEQ ID NO: 533091 - DNA, 20 bp, mouse
gaaggacccacttggcttca

SEQ ID NO: 533092 - DNA, 20 bp, mouse
gcaaagcctgactgagctaa

SEQ ID NO: 533093 - DNA, 20 bp, mouse
gtgagatctacacttgtgta

SEQ ID NO: 533094 - DNA, 20 bp, mouse
gaacaaagtttggggacctc

SEQ ID NO: 533095 - DNA, 20 bp, mouse
gtctacacttgtgtatggtc

SEQ ID NO: 533096 - DNA, 20 bp, mouse
gatagaattgtcctcctgtc

SEQ ID NO: 533097 - DNA, 20 bp, mouse
gtaaagtcagttccaaacac

SEQ ID NO: 533098 - DNA, 20 bp, mouse
gtatttgaactccgcactat

SEQ ID NO: 533099 - DNA, 20 bp, mouse
gagaaaaggtttaggggaga

SEQ ID NO: 533100 - DNA, 20 bp, mouse
gaagacgtggtcctgacagg

SEQ ID NO: 533101 - DNA, 20 bp, mouse
gtaattcagaatgggctttg

SEQ ID NO: 533102 - DNA, 20 bp, mouse
gatcttttctctttcatcag

SEQ ID NO: 533103 - DNA, 20 bp, mouse
gaaatggaatttaaagacta

SEQ ID NO: 533104 - DNA, 20 bp, mouse
gaagagataagaaaaggttt

SEQ ID NO: 533105 - DNA, 20 bp, mouse
gggtttaggggagaaggggc

SEQ ID NO: 533106 - DNA, 20 bp, mouse
gtctgcatgaatacagacta

SEQ ID NO: 533107 - DNA, 20 bp, mouse
gagataaagcaaatggttaa

SEQ ID NO: 533108 - DNA, 20 bp, mouse
gctgtaatagataaagcaaa

SEQ ID NO: 533109 - DNA, 20 bp, mouse
gcagaagaagctacttccaa

SEQ ID NO: 533110 - DNA, 20 bp, mouse
gcagatctaacaatgtttgg

SEQ ID NO: 533111 - DNA, 20 bp, mouse
gcaccatcaccagaaggacg

SEQ ID NO: 533112 - DNA, 20 bp, mouse
gggcctcttttctcactgag

SEQ ID NO: 533113 - DNA, 20 bp, mouse
gacatttaagttctgtccct

SEQ ID NO: 533114 - DNA, 20 bp, mouse
gtgcctctcagtgagaaaag

SEQ ID NO: 533115 - DNA, 20 bp, mouse
gcagaacttaaatgtagaaa

SEQ ID NO: 533116 - DNA, 20 bp, mouse
ggagctagggaatatagtgt

SEQ ID NO: 533117 - DNA, 20 bp, mouse
gggaactcttgagtccaagt

SEQ ID NO: 533118 - DNA, 20 bp, mouse
gtaccaggtctttcagatga

SEQ ID NO: 533119 - DNA, 20 bp, mouse
ggacccctgttctcacttag

SEQ ID NO: 533120 - DNA, 20 bp, mouse
gcagaagaagctagttctga

SEQ ID NO: 533121 - DNA, 20 bp, mouse
gctgttctcacttagaggaa

SEQ ID NO: 533122 - DNA, 20 bp, mouse
gcaccgtcatctgaaagacc

SEQ ID NO: 533123 - DNA, 20 bp, mouse
gctgtctgtctctcagtacc

SEQ ID NO: 533124 - DNA, 20 bp, mouse
gaggacaagctaaggagcta

SEQ ID NO: 533125 - DNA, 20 bp, mouse
gcagaacttaaatgtagaaa

SEQ ID NO: 533126 - DNA, 20 bp, mouse
gtacgcctggagccaaaagt

SEQ ID NO: 533127 - DNA, 20 bp, mouse
gtggctccaggcgtaggaac

SEQ ID NO: 533128 - DNA, 20 bp, mouse
gctggagccaaaagtcggct

SEQ ID NO: 533129 - DNA, 20 bp, mouse
gctgtccagcacggtcacaa

SEQ ID NO: 533130 - DNA, 20 bp, mouse
gaaggtgtcctatggcaatc

SEQ ID NO: 533131 - DNA, 20 bp, mouse
ggcaagccagaagagaattg

SEQ ID NO: 533132 - DNA, 20 bp, mouse
ggtaggaaccggattgccat

SEQ ID NO: 533133 - DNA, 20 bp, mouse
ggacagagtggccagtgtcg

SEQ ID NO: 533134 - DNA, 20 bp, mouse
gagtgtcgtggacagtgtgc

SEQ ID NO: 533135 - DNA, 20 bp, mouse
ggtgaccgtgctggacagag

SEQ ID NO: 533136 - DNA, 20 bp, mouse
gcaatgcctggcgaacacaa

SEQ ID NO: 533137 - DNA, 20 bp, mouse
gtgggggcggttctaaggaa

SEQ ID NO: 533138 - DNA, 20 bp, mouse
gtggtgccggcgggcgaatg

SEQ ID NO: 533139 - DNA, 20 bp, mouse
gggcattgcgctccctccaa

SEQ ID NO: 533140 - DNA, 20 bp, mouse
ggggtctctccaacctagca

SEQ ID NO: 533141 - DNA, 20 bp, mouse
ggctagccgcctgagattgg

SEQ ID NO: 533142 - DNA, 20 bp, mouse
gctgttcgttgagaaccagg

SEQ ID NO: 533143 - DNA, 20 bp, mouse
gccatgtactatgcagtaag

SEQ ID NO: 533144 - DNA, 20 bp, mouse
ggcttccggcccaggcggac

SEQ ID NO: 533145 - DNA, 20 bp, mouse
gcgttcgttggctgaccgag

SEQ ID NO: 533146 - DNA, 20 bp, mouse
ggtcccgctgaaggcaacca

SEQ ID NO: 533147 - DNA, 20 bp, mouse
gacaatagagttgtccgcta

SEQ ID NO: 533148 - DNA, 20 bp, mouse
ggaagctcacacgcactgta

SEQ ID NO: 533149 - DNA, 20 bp, mouse
gtgattctacttagagccgg

SEQ ID NO: 533150 - DNA, 20 bp, mouse
gtcaccctggttgccttcag

SEQ ID NO: 533151 - DNA, 20 bp, mouse
ggggtgagcatctgtaacag

SEQ ID NO: 533152 - DNA, 20 bp, mouse
gggactgagaaacttccaaa

SEQ ID NO: 533153 - DNA, 20 bp, mouse
ggatgtagggatagaatgta

SEQ ID NO: 533154 - DNA, 20 bp, mouse
gaaacaaaaaacacgctccc

SEQ ID NO: 533155 - DNA, 20 bp, mouse
gtttgtgtctgcagcgccac

SEQ ID NO: 533156 - DNA, 20 bp, mouse
gctcgctgttggtagctctc

SEQ ID NO: 533157 - DNA, 20 bp, mouse
ggaggtaaggaggcccagaa

SEQ ID NO: 533158 - DNA, 20 bp, mouse
gcagagcctggtgagaccca

SEQ ID NO: 533159 - DNA, 20 bp, mouse
gtgccaagcaagctcgctgt

SEQ ID NO: 533160 - DNA, 20 bp, mouse
gtctggcaggcagtagccac

SEQ ID NO: 533161 - DNA, 20 bp, mouse
gctgttggtagctctctggc

SEQ ID NO: 533162 - DNA, 20 bp, mouse
gtgagacccagggtgtccag

SEQ ID NO: 533163 - DNA, 20 bp, mouse
gctccttacctcggacatgt

SEQ ID NO: 533164 - DNA, 20 bp, mouse
gatccaacatgtccgaggta

SEQ ID NO: 533165 - DNA, 20 bp, mouse
ggcaccaactagtcccttct

SEQ ID NO: 533166 - DNA, 20 bp, mouse
ggaaccgaacccagacgccg

SEQ ID NO: 533167 - DNA, 20 bp, mouse
gcggcgagcgggtgtgaccc

SEQ ID NO: 533168 - DNA, 20 bp, mouse
ggacgtgctccacagcgcac

SEQ ID NO: 533169 - DNA, 20 bp, mouse
gtgaagtccgggcttggtcc

SEQ ID NO: 533170 - DNA, 20 bp, mouse
gggatcacccggaccaagcc

SEQ ID NO: 533171 - DNA, 20 bp, mouse
gtgaccccggcgtctgggtt

SEQ ID NO: 533172 - DNA, 20 bp, mouse
gatatttcaggagcaagcag

SEQ ID NO: 533173 - DNA, 20 bp, mouse
gattggctgccgagctcctg

SEQ ID NO: 533174 - DNA, 20 bp, mouse
ggggtgtgaccccggcgtct

SEQ ID NO: 533175 - DNA, 20 bp, mouse
gtgggttcggttctgaagtc

SEQ ID NO: 533176 - DNA, 20 bp, mouse
gctcctgcgcagtctccgac

SEQ ID NO: 533177 - DNA, 20 bp, mouse
gctaggagttcgggagagag

SEQ ID NO: 533178 - DNA, 20 bp, mouse
gggccggtcggagactgcgc

SEQ ID NO: 533179 - DNA, 20 bp, mouse
gtctgtgctttcatttgtgg

SEQ ID NO: 533180 - DNA, 20 bp, mouse
gtcccaagaaaccccgaagg

SEQ ID NO: 533181 - DNA, 20 bp, mouse
gttcgggagagaggggtgca

SEQ ID NO: 533182 - DNA, 20 bp, mouse
gggtgcacggccgagtaaag

SEQ ID NO: 533183 - DNA, 20 bp, mouse
gtttcttgggagcggccggt

SEQ ID NO: 533184 - DNA, 20 bp, mouse
gatttgtggtggcgggaacg

SEQ ID NO: 533185 - DNA, 20 bp, mouse
gaaagcaagcctaggagttc

SEQ ID NO: 533186 - DNA, 20 bp, mouse
gcccaggaaggatggatccc

SEQ ID NO: 533187 - DNA, 20 bp, mouse
gggaaggatggatcccggga

SEQ ID NO: 533188 - DNA, 20 bp, mouse
gatggatcccgggacggact

SEQ ID NO: 533189 - DNA, 20 bp, mouse
gaggcagctacagccctcgg

SEQ ID NO: 533190 - DNA, 20 bp, mouse
gagcggcgccgagtccgtcc

SEQ ID NO: 533191 - DNA, 20 bp, mouse
ggccttctgagctcccagga

SEQ ID NO: 533192 - DNA, 20 bp, mouse
ggttctgggagcacgagagg

SEQ ID NO: 533193 - DNA, 20 bp, mouse
gcggtatgagcagtaagggt

SEQ ID NO: 533194 - DNA, 20 bp, mouse
ggcatcccggaggtgagcac

SEQ ID NO: 533195 - DNA, 20 bp, mouse
gttaccgcgctgaaacccgg

SEQ ID NO: 533196 - DNA, 20 bp, mouse
gggaggctgcgctcgagctg

SEQ ID NO: 533197 - DNA, 20 bp, mouse
ggctcgagcgcagcctcccc

SEQ ID NO: 533198 - DNA, 20 bp, mouse
gggagccccccgagagcctg

SEQ ID NO: 533199 - DNA, 20 bp, mouse
ggtggggacaggccccgtga

SEQ ID NO: 533200 - DNA, 20 bp, mouse
gaagcagcttctcatcgccc

SEQ ID NO: 533201 - DNA, 20 bp, mouse
ggcccgcgcgggaagacggg

SEQ ID NO: 533202 - DNA, 20 bp, mouse
gtgggggcacccgaactgta

SEQ ID NO: 533203 - DNA, 20 bp, mouse
gggggcgacgatctccaccg

SEQ ID NO: 533204 - DNA, 20 bp, mouse
gcagcttctcatcgcccggg

SEQ ID NO: 533205 - DNA, 20 bp, mouse
gcggctctcagctgtcacgt

SEQ ID NO: 533206 - DNA, 20 bp, mouse
gaggtgaccattaggtcctg

SEQ ID NO: 533207 - DNA, 20 bp, mouse
ggactccagcatctcagtta

SEQ ID NO: 533208 - DNA, 20 bp, mouse
ggacctaatggtcacctgca

SEQ ID NO: 533209 - DNA, 20 bp, mouse
gcgccgtgcaggtgaccatt

SEQ ID NO: 533210 - DNA, 20 bp, mouse
gcctccaggctggaatgagg

SEQ ID NO: 533211 - DNA, 20 bp, mouse
gactgtgcccatggatctga

SEQ ID NO: 533212 - DNA, 20 bp, mouse
ggccctaggaccctgaatcc

SEQ ID NO: 533213 - DNA, 20 bp, mouse
gtcgccaccgtcagatccat

SEQ ID NO: 533214 - DNA, 20 bp, mouse
gatgttgaccggcgccgtgc

SEQ ID NO: 533215 - DNA, 20 bp, mouse
ggtgcccatggatctgacgg

SEQ ID NO: 533216 - DNA, 20 bp, mouse
gtggagaagaccgggagctg

SEQ ID NO: 533217 - DNA, 20 bp, mouse
gcccgggtttcagctcactt

SEQ ID NO: 533218 - DNA, 20 bp, mouse
gcggggcaggtgagaagcct

SEQ ID NO: 533219 - DNA, 20 bp, mouse
gatcagatgggagagttcca

SEQ ID NO: 533220 - DNA, 20 bp, mouse
gggtcttctccatatcagat

SEQ ID NO: 533221 - DNA, 20 bp, mouse
gagatgggagagttccaagg

SEQ ID NO: 533222 - DNA, 20 bp, mouse
ggcctgggctgcgggatggg

SEQ ID NO: 533223 - DNA, 20 bp, mouse
ggactagggtcccgtagact

SEQ ID NO: 533224 - DNA, 20 bp, mouse
ggaagcctgggctgcgggat

SEQ ID NO: 533225 - DNA, 20 bp, mouse
gcactaagtagcccagtcta

SEQ ID NO: 533226 - DNA, 20 bp, mouse
ggggaagtcatcccaagtgt

SEQ ID NO: 533227 - DNA, 20 bp, mouse
gctgctgcaggccacaggtc

SEQ ID NO: 533228 - DNA, 20 bp, mouse
gagtcttgggggtcccgcca

SEQ ID NO: 533229 - DNA, 20 bp, mouse
gaccctgctaaatgtgagta

SEQ ID NO: 533230 - DNA, 20 bp, mouse
gtccgtactcacatttagca

SEQ ID NO: 533231 - DNA, 20 bp, mouse
gtcccgggttggagtcttgg

SEQ ID NO: 533232 - DNA, 20 bp, mouse
ggagggaaattcctgacctg

SEQ ID NO: 533233 - DNA, 20 bp, mouse
gtaatgggctgggcaggcag

SEQ ID NO: 533234 - DNA, 20 bp, mouse
gcaggtttctgagtagggag

SEQ ID NO: 533235 - DNA, 20 bp, mouse
ggctggctgctgcaggccac

SEQ ID NO: 533236 - DNA, 20 bp, mouse
ggatagaggataccttctaa

SEQ ID NO: 533237 - DNA, 20 bp, mouse
gtctctcttcaagcctggag

SEQ ID NO: 533238 - DNA, 20 bp, mouse
gaagggttctttgtagacat

SEQ ID NO: 533239 - DNA, 20 bp, mouse
gaggagaggatggggttcca

SEQ ID NO: 533240 - DNA, 20 bp, mouse
gcctggggggagggcactgt

SEQ ID NO: 533241 - DNA, 20 bp, mouse
gttaagctttgattctccct

SEQ ID NO: 533242 - DNA, 20 bp, mouse
gtgggtgctattaaaataaa

SEQ ID NO: 533243 - DNA, 20 bp, mouse
ggctggcttcactccttccc

SEQ ID NO: 533244 - DNA, 20 bp, mouse
gcacccagctgctgattgtg

SEQ ID NO: 533245 - DNA, 20 bp, mouse
gtgtagacatgggtgaactc

SEQ ID NO: 533246 - DNA, 20 bp, mouse
gtctgtctccaagccgggag

SEQ ID NO: 533247 - DNA, 20 bp, mouse
gagtattgcacaggattctg

SEQ ID NO: 533248 - DNA, 20 bp, mouse
gagtacagcagggcatttgt

SEQ ID NO: 533249 - DNA, 20 bp, mouse
gatactcacccctcccggct

SEQ ID NO: 533250 - DNA, 20 bp, mouse
ggcacactctgtctccaagc

SEQ ID NO: 533251 - DNA, 20 bp, mouse
ggagggtgtgatgagatgtg

SEQ ID NO: 533252 - DNA, 20 bp, mouse
gaaggcttctttgtagacac

SEQ ID NO: 533253 - DNA, 20 bp, mouse
gtggtgctgtaacaataatg

SEQ ID NO: 533254 - DNA, 20 bp, mouse
gttccattctccctgggaag

SEQ ID NO: 533255 - DNA, 20 bp, mouse
gcagttctattaaaataagg

SEQ ID NO: 533256 - DNA, 20 bp, mouse
gccaccggccgggaacaccg

SEQ ID NO: 533257 - DNA, 20 bp, mouse
gagccaggaggggcagcgat

SEQ ID NO: 533258 - DNA, 20 bp, mouse
gtcctggctggccagcgcgg

SEQ ID NO: 533259 - DNA, 20 bp, mouse
ggtggcccgcgggcacggag

SEQ ID NO: 533260 - DNA, 20 bp, mouse
ggtcccatcgctgcccctcc

SEQ ID NO: 533261 - DNA, 20 bp, mouse
gagtcgggataaacactcgg

SEQ ID NO: 533262 - DNA, 20 bp, mouse
gggcggccgactacctggag

SEQ ID NO: 533263 - DNA, 20 bp, mouse
gtgcccgcgggccaccggcc

SEQ ID NO: 533264 - DNA, 20 bp, mouse
gcgcgccccaaccaccccag

SEQ ID NO: 533265 - DNA, 20 bp, mouse
ggcgagtcgggataaacact

SEQ ID NO: 533266 - DNA, 20 bp, mouse
gggcgacagccgacgaccag

SEQ ID NO: 533267 - DNA, 20 bp, mouse
gagtggtaaggcggctgaca

SEQ ID NO: 533268 - DNA, 20 bp, mouse
ggccgacgaccagcgggcta

SEQ ID NO: 533269 - DNA, 20 bp, mouse
gctagccacgggttccatgt

SEQ ID NO: 533270 - DNA, 20 bp, mouse
gtgaaacaaaagtggtaagg

SEQ ID NO: 533271 - DNA, 20 bp, mouse
gtccctagcccgctggtcgt

SEQ ID NO: 533272 - DNA, 20 bp, mouse
gcattgaaacaaaagtggta

SEQ ID NO: 533273 - DNA, 20 bp, mouse
gagttacattgaaacaaaag

SEQ ID NO: 533274 - DNA, 20 bp, mouse
ggtcgccgacatggaacccg

SEQ ID NO: 533275 - DNA, 20 bp, mouse
ggagaggcgcgagagaggtg

SEQ ID NO: 533276 - DNA, 20 bp, mouse
gccgcacgccccgcgcctgg

SEQ ID NO: 533277 - DNA, 20 bp, mouse
gggcacaccagcccgactcg

SEQ ID NO: 533278 - DNA, 20 bp, mouse
gagcgctggagtccgcgagt

SEQ ID NO: 533279 - DNA, 20 bp, mouse
gctctgcgggacagacggtg

SEQ ID NO: 533280 - DNA, 20 bp, mouse
gtggagtccgcgagtcgggc

SEQ ID NO: 533281 - DNA, 20 bp, mouse
gcgcccaccctggcacaaag

SEQ ID NO: 533282 - DNA, 20 bp, mouse
gccgtcgaagggcagcacgg

SEQ ID NO: 533283 - DNA, 20 bp, mouse
gctgccgcccgcgcacggga

SEQ ID NO: 533284 - DNA, 20 bp, mouse
ggccgagtacctggagcgta

SEQ ID NO: 533285 - DNA, 20 bp, mouse
ggagggtggcggcccagcgc

SEQ ID NO: 533286 - DNA, 20 bp, mouse
ggaggctcgggaagtcagtc

SEQ ID NO: 533287 - DNA, 20 bp, mouse
gtggagtcaccgaggcaccg

SEQ ID NO: 533288 - DNA, 20 bp, mouse
gcggcctgctggagtcaccg

SEQ ID NO: 533289 - DNA, 20 bp, mouse
gaggcaccggggcaaggagc

SEQ ID NO: 533290 - DNA, 20 bp, mouse
gctcgggaagtcagtcaggc

SEQ ID NO: 533291 - DNA, 20 bp, mouse
gaaccgcacgcagcgaggct

SEQ ID NO: 533292 - DNA, 20 bp, mouse
gtcccgagcctcgctgcgtg

SEQ ID NO: 533293 - DNA, 20 bp, mouse
gctcacaaccgcacgcagcg

SEQ ID NO: 533294 - DNA, 20 bp, mouse
ggcagggcctctgggagacc

SEQ ID NO: 533295 - DNA, 20 bp, mouse
ggcaaggaggcgcgctgcga

SEQ ID NO: 533296 - DNA, 20 bp, mouse
gggcgcggcgggcacggcta

SEQ ID NO: 533297 - DNA, 20 bp, mouse
gaccgcgcgcgggctgcagg

SEQ ID NO: 533298 - DNA, 20 bp, mouse
ggagcgcggagcccatggag

SEQ ID NO: 533299 - DNA, 20 bp, mouse
gccacgcgcggagcccgagg

SEQ ID NO: 533300 - DNA, 20 bp, mouse
ggcggcgggcacggctaggg

SEQ ID NO: 533301 - DNA, 20 bp, mouse
gagcgcagggagcgaggtaa

SEQ ID NO: 533302 - DNA, 20 bp, mouse
gcttctccgcgcgagcacgg

SEQ ID NO: 533303 - DNA, 20 bp, mouse
ggcgggcacggctagggcgg

SEQ ID NO: 533304 - DNA, 20 bp, mouse
gcggagagcgcgccgagccg

SEQ ID NO: 533305 - DNA, 20 bp, mouse
gaacgtgcagcgcctgctgg

SEQ ID NO: 533306 - DNA, 20 bp, mouse
gcgggctggcggccactcgg

SEQ ID NO: 533307 - DNA, 20 bp, mouse
gtcgcgccgtggccgccgag

SEQ ID NO: 533308 - DNA, 20 bp, mouse
gcacggcgcgatggagtcgc

SEQ ID NO: 533309 - DNA, 20 bp, mouse
gggcgcggcgggttccctcg

SEQ ID NO: 533310 - DNA, 20 bp, mouse
ggagccggaggagtccgagg

SEQ ID NO: 533311 - DNA, 20 bp, mouse
gccctccggtgcaggctccg

SEQ ID NO: 533312 - DNA, 20 bp, mouse
gcggccaggacggggaggaa

SEQ ID NO: 533313 - DNA, 20 bp, mouse
ggctccggggcgcaagactc

SEQ ID NO: 533314 - DNA, 20 bp, mouse
ggcggagccggaggagtccg

SEQ ID NO: 533315 - DNA, 20 bp, mouse
ggtccagccagcaggctcgt

SEQ ID NO: 533316 - DNA, 20 bp, mouse
gcagtttccacagcaggacg

SEQ ID NO: 533317 - DNA, 20 bp, mouse
gctggagccacacagaatgt

SEQ ID NO: 533318 - DNA, 20 bp, mouse
gagcagctccatggcgcctg

SEQ ID NO: 533319 - DNA, 20 bp, mouse
ggacaaagcacgtcccccgc

SEQ ID NO: 533320 - DNA, 20 bp, mouse
gactggggctgacaactaag

SEQ ID NO: 533321 - DNA, 20 bp, mouse
gcagggctccgtgatgtcag

SEQ ID NO: 533322 - DNA, 20 bp, mouse
gatcccagaggtcttaagtg

SEQ ID NO: 533323 - DNA, 20 bp, mouse
ggctgtcccgcgtcctgctg

SEQ ID NO: 533324 - DNA, 20 bp, mouse
ggaggggtggagaaaaggac

SEQ ID NO: 533325 - DNA, 20 bp, mouse
gactccaaaagaaatcccag

SEQ ID NO: 533326 - DNA, 20 bp, mouse
gcagtcgccactgcctggag

SEQ ID NO: 533327 - DNA, 20 bp, mouse
gggcgactgtagcacaaaca

SEQ ID NO: 533328 - DNA, 20 bp, mouse
gaagctgcagggacccccaa

SEQ ID NO: 533329 - DNA, 20 bp, mouse
gtgctacagtcgccactgcc

SEQ ID NO: 533330 - DNA, 20 bp, mouse
gcctgcagctttacctctcc

SEQ ID NO: 533331 - DNA, 20 bp, mouse
ggactggggagtgggcacgt

SEQ ID NO: 533332 - DNA, 20 bp, mouse
gcgacagctgcagaccaaaa

SEQ ID NO: 533333 - DNA, 20 bp, mouse
ggctcatacaggtcatacat

SEQ ID NO: 533334 - DNA, 20 bp, mouse
gaccaaaagggtcttaggac

SEQ ID NO: 533335 - DNA, 20 bp, mouse
gcccagtcctaagacccttt

SEQ ID NO: 533336 - DNA, 20 bp, mouse
gctgttgccgcggaagacag

SEQ ID NO: 533337 - DNA, 20 bp, mouse
gtcagctgggcagaccccca

SEQ ID NO: 533338 - DNA, 20 bp, mouse
gccgcggcaacagcaggtgc

SEQ ID NO: 533339 - DNA, 20 bp, mouse
ggcatccggcaggctcaggt

SEQ ID NO: 533340 - DNA, 20 bp, mouse
gacagatgcaggtgcgtcag

SEQ ID NO: 533341 - DNA, 20 bp, mouse
ggtgggcgtctagcatccag

SEQ ID NO: 533342 - DNA, 20 bp, mouse
ggcattcgggctgtacccac

SEQ ID NO: 533343 - DNA, 20 bp, mouse
gccagtcgggtgaagtacag

SEQ ID NO: 533344 - DNA, 20 bp, mouse
ggggaggtagcgagccagat

SEQ ID NO: 533345 - DNA, 20 bp, mouse
gcacagcagggtcgccaaca

SEQ ID NO: 533346 - DNA, 20 bp, mouse
gtcctcccccggctgcgcag

SEQ ID NO: 533347 - DNA, 20 bp, mouse
gagcgccgctgcgcagccgg

SEQ ID NO: 533348 - DNA, 20 bp, mouse
gaggacgcaggcaaggcgga

SEQ ID NO: 533349 - DNA, 20 bp, mouse
gagagccccggggaccgcac

SEQ ID NO: 533350 - DNA, 20 bp, mouse
gctccggagaaacttcgccc

SEQ ID NO: 533351 - DNA, 20 bp, mouse
ggaggagaaggaggtcaccg

SEQ ID NO: 533352 - DNA, 20 bp, mouse
gcaggcatcccggagcaggt

SEQ ID NO: 533353 - DNA, 20 bp, mouse
gccttgcctgcgtcctcccc

SEQ ID NO: 533354 - DNA, 20 bp, mouse
gcgcagccgggggaggacgc

SEQ ID NO: 533355 - DNA, 20 bp, mouse
gccccgcaaaccaacaggga

SEQ ID NO: 533356 - DNA, 20 bp, mouse
gccgcttctgcgggagtcgc

SEQ ID NO: 533357 - DNA, 20 bp, mouse
gtcttctgagcccacgtgtt

SEQ ID NO: 533358 - DNA, 20 bp, mouse
gcacaaggcccaatgtatga

SEQ ID NO: 533359 - DNA, 20 bp, mouse
ggaggggcccaggcccatcg

SEQ ID NO: 533360 - DNA, 20 bp, mouse
gccagagccacgatgggcct

SEQ ID NO: 533361 - DNA, 20 bp, mouse
gcgctttgcgccgcttctgc

SEQ ID NO: 533362 - DNA, 20 bp, mouse
gcgatctcgctgggcaaagg

SEQ ID NO: 533363 - DNA, 20 bp, mouse
gggcccaatgtatgatggag

SEQ ID NO: 533364 - DNA, 20 bp, mouse
gttgcatccagagccacgat

SEQ ID NO: 533365 - DNA, 20 bp, mouse
ggaagaagtccaagaactcg

SEQ ID NO: 533366 - DNA, 20 bp, mouse
gggctgggcgcgagattcgg

SEQ ID NO: 533367 - DNA, 20 bp, mouse
ggccctgcgccgctccgtca

SEQ ID NO: 533368 - DNA, 20 bp, mouse
ggtcggcgcccgtgacggag

SEQ ID NO: 533369 - DNA, 20 bp, mouse
ggctgctcgctgcggggaga

SEQ ID NO: 533370 - DNA, 20 bp, mouse
gggaggctgggcgcgagatt

SEQ ID NO: 533371 - DNA, 20 bp, mouse
gcggccgcggctaggagcag

SEQ ID NO: 533372 - DNA, 20 bp, mouse
gggtgcggacaaaaccctgc

SEQ ID NO: 533373 - DNA, 20 bp, mouse
gagcaggcccggtcaggtca

SEQ ID NO: 533374 - DNA, 20 bp, mouse
ggctgcagtgctgctcgctg

SEQ ID NO: 533375 - DNA, 20 bp, mouse
gcagggccaggcgggactga

SEQ ID NO: 533376 - DNA, 20 bp, mouse
gagccgctccgggccccagg

SEQ ID NO: 533377 - DNA, 20 bp, mouse
gcaccgcctggggcccggag

SEQ ID NO: 533378 - DNA, 20 bp, mouse
ggtcagcgtgtctgcaggtc

SEQ ID NO: 533379 - DNA, 20 bp, mouse
gcgggccggggtcaggactc

SEQ ID NO: 533380 - DNA, 20 bp, mouse
ggtggttctgtgcgctccct

SEQ ID NO: 533381 - DNA, 20 bp, mouse
gcttgccgacccaaggagaa

SEQ ID NO: 533382 - DNA, 20 bp, mouse
gcgcctgagagcaccgcctg

SEQ ID NO: 533383 - DNA, 20 bp, mouse
gcagctggaggcccattact

SEQ ID NO: 533384 - DNA, 20 bp, mouse
gctgggacccggtctagagg

SEQ ID NO: 533385 - DNA, 20 bp, mouse
gggtctggtcgcacgttccc

SEQ ID NO: 533386 - DNA, 20 bp, mouse
gcggttgacagaaaccccaa

SEQ ID NO: 533387 - DNA, 20 bp, mouse
gggcagcagagagatggtgt

SEQ ID NO: 533388 - DNA, 20 bp, mouse
gctgtcaaccgctgctagaa

SEQ ID NO: 533389 - DNA, 20 bp, mouse
gacaagcagctgcttagagg

SEQ ID NO: 533390 - DNA, 20 bp, mouse
gcatctctctgctgcccttg

SEQ ID NO: 533391 - DNA, 20 bp, mouse
gcagctgcttagaggtggac

SEQ ID NO: 533392 - DNA, 20 bp, mouse
ggtgacaagcagctgcttag

SEQ ID NO: 533393 - DNA, 20 bp, mouse
gtaaaacagtagaattactg

SEQ ID NO: 533394 - DNA, 20 bp, mouse
gcaaaagattactctccaaa

SEQ ID NO: 533395 - DNA, 20 bp, mouse
gtcttaccctctttcttagt

SEQ ID NO: 533396 - DNA, 20 bp, mouse
gccaggacttgggaccgcag

SEQ ID NO: 533397 - DNA, 20 bp, mouse
gggcctggttagagccactg

SEQ ID NO: 533398 - DNA, 20 bp, mouse
gaccaggccctagcagggac

SEQ ID NO: 533399 - DNA, 20 bp, mouse
gggtttagcctcaggcatgt

SEQ ID NO: 533400 - DNA, 20 bp, mouse
ggaccgcagtggctctaacc

SEQ ID NO: 533401 - DNA, 20 bp, mouse
gctacatctaggtagagtgt

SEQ ID NO: 533402 - DNA, 20 bp, mouse
gaaggtcgccgacatgcctg

SEQ ID NO: 533403 - DNA, 20 bp, mouse
gacctgtccctgctagggcc

SEQ ID NO: 533404 - DNA, 20 bp, mouse
gagccacctggtttagcctc

SEQ ID NO: 533405 - DNA, 20 bp, mouse
ggacagcctggagggcttgg

SEQ ID NO: 533406 - DNA, 20 bp, mouse
gcggagccagggaagaaacc

SEQ ID NO: 533407 - DNA, 20 bp, mouse
ggcatcaagcaggccaccca

SEQ ID NO: 533408 - DNA, 20 bp, mouse
gtcaagcaggccacccaagg

SEQ ID NO: 533409 - DNA, 20 bp, mouse
gaccaggtagctccacgtaa

SEQ ID NO: 533410 - DNA, 20 bp, mouse
gagctacctggtttcttccc

SEQ ID NO: 533411 - DNA, 20 bp, mouse
gacccttacgtggagctacc

SEQ ID NO: 533412 - DNA, 20 bp, mouse
gtagtgaagtcatctctcag

SEQ ID NO: 533413 - DNA, 20 bp, mouse
gtgtgggcagggttaggtac

SEQ ID NO: 533414 - DNA, 20 bp, mouse
gactgacccaaacccttacg

SEQ ID NO: 533415 - DNA, 20 bp, mouse
gcagggttaggtaccggtgt

SEQ ID NO: 533416 - DNA, 20 bp, mouse
ggtcaagctggagtgtttaa

SEQ ID NO: 533417 - DNA, 20 bp, mouse
gcctgtgcctgaggcttctg

SEQ ID NO: 533418 - DNA, 20 bp, mouse
gaagcatgaacctagcctgg

SEQ ID NO: 533419 - DNA, 20 bp, mouse
gcaccagctaaaaaaatgac

SEQ ID NO: 533420 - DNA, 20 bp, mouse
ggctcaggtgctgtctcctc

SEQ ID NO: 533421 - DNA, 20 bp, mouse
ggagtccaccgggcaagagc

SEQ ID NO: 533422 - DNA, 20 bp, mouse
ggcttctgtctctactccag

SEQ ID NO: 533423 - DNA, 20 bp, mouse
gctcggaggttcaggcttag

SEQ ID NO: 533424 - DNA, 20 bp, mouse
ggctcacagtcaaggagctg

SEQ ID NO: 533425 - DNA, 20 bp, mouse
gtccaaggtcagccgcagtg

SEQ ID NO: 533426 - DNA, 20 bp, mouse
ggcctgtggctgtgacccca

SEQ ID NO: 533427 - DNA, 20 bp, mouse
gctctattgaaggtgatctg

SEQ ID NO: 533428 - DNA, 20 bp, mouse
ggatctgtggcagtctgtaa

SEQ ID NO: 533429 - DNA, 20 bp, mouse
gtctttgttgctggtgaggg

SEQ ID NO: 533430 - DNA, 20 bp, mouse
gtgtggcagtctgtaagggt

SEQ ID NO: 533431 - DNA, 20 bp, mouse
ggccacaggcttatgtaagt

SEQ ID NO: 533432 - DNA, 20 bp, mouse
gacctgccgctgggagcatg

SEQ ID NO: 533433 - DNA, 20 bp, mouse
ggcccacttacataagcctg

SEQ ID NO: 533434 - DNA, 20 bp, mouse
gcggacttcacatcaacagg

SEQ ID NO: 533435 - DNA, 20 bp, mouse
gagctcctgccctctattga

SEQ ID NO: 533436 - DNA, 20 bp, mouse
ggacagagggagtgagcgga

SEQ ID NO: 533437 - DNA, 20 bp, mouse
ggagggagtgagcggacggt

SEQ ID NO: 533438 - DNA, 20 bp, mouse
ggagcgcggctctgcacaca

SEQ ID NO: 533439 - DNA, 20 bp, mouse
ggctccggggcgacctaaga

SEQ ID NO: 533440 - DNA, 20 bp, mouse
ggcgggcagacacttctcac

SEQ ID NO: 533441 - DNA, 20 bp, mouse
gtcccctcctgcctcctgaa

SEQ ID NO: 533442 - DNA, 20 bp, mouse
gtcgcagggttggggagagt

SEQ ID NO: 533443 - DNA, 20 bp, mouse
gggcagctctggagtgagag

SEQ ID NO: 533444 - DNA, 20 bp, mouse
gtgcgcggccgaggacccct

SEQ ID NO: 533445 - DNA, 20 bp, mouse
gagcctggggagtcctgtcc

SEQ ID NO: 533446 - DNA, 20 bp, mouse
gtagctggcgccggagacac

SEQ ID NO: 533447 - DNA, 20 bp, mouse
ggcggcctgaggagacacgg

SEQ ID NO: 533448 - DNA, 20 bp, mouse
ggggcagagagcgaccaccg

SEQ ID NO: 533449 - DNA, 20 bp, mouse
ggaagcgcgagcagttccgg

SEQ ID NO: 533450 - DNA, 20 bp, mouse
gtggcgccggagacacgggc

SEQ ID NO: 533451 - DNA, 20 bp, mouse
ggcccgcctgcccgtgtctc

SEQ ID NO: 533452 - DNA, 20 bp, mouse
ggacacggcgggtcagggac

SEQ ID NO: 533453 - DNA, 20 bp, mouse
gggcgccagctacgccgctg

SEQ ID NO: 533454 - DNA, 20 bp, mouse
gtgctggacacgctgacgaa

SEQ ID NO: 533455 - DNA, 20 bp, mouse
gaggtacttggagaagtcgg

SEQ ID NO: 533456 - DNA, 20 bp, mouse
gccacccgcggagtgtgagg

SEQ ID NO: 533457 - DNA, 20 bp, mouse
gttgcgggcaactccggtgg

SEQ ID NO: 533458 - DNA, 20 bp, mouse
gagatgagcggccccaacag

SEQ ID NO: 533459 - DNA, 20 bp, mouse
gtcgttggcggagcctgtga

SEQ ID NO: 533460 - DNA, 20 bp, mouse
gcaggctccgccaacgacga

SEQ ID NO: 533461 - DNA, 20 bp, mouse
gagcacgcgcgcgccctcac

SEQ ID NO: 533462 - DNA, 20 bp, mouse
gccaacgacgacggctggag

SEQ ID NO: 533463 - DNA, 20 bp, mouse
ggccccaacagcggcgaggg

SEQ ID NO: 533464 - DNA, 20 bp, mouse
gctcccattgcgggcaactc

SEQ ID NO: 533465 - DNA, 20 bp, mouse
ggccggccgcctcccattgc

SEQ ID NO: 533466 - DNA, 20 bp, mouse
ggggtctgcgaacaagccta

SEQ ID NO: 533467 - DNA, 20 bp, mouse
ggatgaagaagattactgaa

SEQ ID NO: 533468 - DNA, 20 bp, mouse
ggacgtcaagagtctgaccg

SEQ ID NO: 533469 - DNA, 20 bp, mouse
ggtctgaccggggcattctc

SEQ ID NO: 533470 - DNA, 20 bp, mouse
gcaaggcaggtaaccccgga

SEQ ID NO: 533471 - DNA, 20 bp, mouse
ggcaccgcaagcggctcctt

SEQ ID NO: 533472 - DNA, 20 bp, mouse
ggcagaccccgagaatgccc

SEQ ID NO: 533473 - DNA, 20 bp, mouse
gccggtggaggcggagtctg

SEQ ID NO: 533474 - DNA, 20 bp, mouse
ggggccaaggcaggtaaccc

SEQ ID NO: 533475 - DNA, 20 bp, mouse
gcgctgcgcagtcatcttag

SEQ ID NO: 533476 - DNA, 20 bp, mouse
gcgccgcccgccacctggag

SEQ ID NO: 533477 - DNA, 20 bp, mouse
gcccgccacctggagcggag

SEQ ID NO: 533478 - DNA, 20 bp, mouse
gtgcccgccgagggaagagg

SEQ ID NO: 533479 - DNA, 20 bp, mouse
gacgggccgaccaggctgag

SEQ ID NO: 533480 - DNA, 20 bp, mouse
ggagcggagcggctccccgc

SEQ ID NO: 533481 - DNA, 20 bp, mouse
gcctggggtcagctcgctca

SEQ ID NO: 533482 - DNA, 20 bp, mouse
gagctcgcaacgggccgacc

SEQ ID NO: 533483 - DNA, 20 bp, mouse
gcgctcagggcagctcgcaa

SEQ ID NO: 533484 - DNA, 20 bp, mouse
ggacgctcccgggatcgacg

SEQ ID NO: 533485 - DNA, 20 bp, mouse
gcggtgcccgccgagggaag

SEQ ID NO: 533486 - DNA, 20 bp, mouse
gcggctccaacccagttccc

SEQ ID NO: 533487 - DNA, 20 bp, mouse
ggtggatgcggggggctcct

SEQ ID NO: 533488 - DNA, 20 bp, mouse
gcgcgctgggtggatgcggg

SEQ ID NO: 533489 - DNA, 20 bp, mouse
gtctgtctggacgcgctggg

SEQ ID NO: 533490 - DNA, 20 bp, mouse
gtcgagcgcccggggaacgg

SEQ ID NO: 533491 - DNA, 20 bp, mouse
gcgcctggctagcgctcgtt

SEQ ID NO: 533492 - DNA, 20 bp, mouse
ggcttcgagcgcccggggaa

SEQ ID NO: 533493 - DNA, 20 bp, mouse
gtcatctgtctggacgcgct

SEQ ID NO: 533494 - DNA, 20 bp, mouse
ggggatccggaggcgactcg

SEQ ID NO: 533495 - DNA, 20 bp, mouse
gtccgggtgggctgagggag

SEQ ID NO: 533496 - DNA, 20 bp, mouse
gagccaggagagccctagtt

SEQ ID NO: 533497 - DNA, 20 bp, mouse
ggagctgcaaagttctccag

SEQ ID NO: 533498 - DNA, 20 bp, mouse
ggttaggcacaagggcaatc

SEQ ID NO: 533499 - DNA, 20 bp, mouse
ggagccctagttaggcacaa

SEQ ID NO: 533500 - DNA, 20 bp, mouse
gtcccgtgggaggtcacata

SEQ ID NO: 533501 - DNA, 20 bp, mouse
gttgcccttgtgcctaacta

SEQ ID NO: 533502 - DNA, 20 bp, mouse
ggtctgtctctaaagcccac

SEQ ID NO: 533503 - DNA, 20 bp, mouse
gcaacctccaacactctctg

SEQ ID NO: 533504 - DNA, 20 bp, mouse
ggttgtcaggtggagacgaa

SEQ ID NO: 533505 - DNA, 20 bp, mouse
gaccctatgtgacctcccac

SEQ ID NO: 533506 - DNA, 20 bp, mouse
gctgctggttgtggacacac

SEQ ID NO: 533507 - DNA, 20 bp, mouse
gttctcttgctcaaccacaa

SEQ ID NO: 533508 - DNA, 20 bp, mouse
gcaaggactccctaagctcg

SEQ ID NO: 533509 - DNA, 20 bp, mouse
gagaatcaaactgctggttg

SEQ ID NO: 533510 - DNA, 20 bp, mouse
gctttttcttgtggacatta

SEQ ID NO: 533511 - DNA, 20 bp, mouse
gctaataacaccacgagctt

SEQ ID NO: 533512 - DNA, 20 bp, mouse
gaaccatcaccagatagtta

SEQ ID NO: 533513 - DNA, 20 bp, mouse
gagttcggtgaaaaccaaga

SEQ ID NO: 533514 - DNA, 20 bp, mouse
gcttaagttaaaagcagtga

SEQ ID NO: 533515 - DNA, 20 bp, mouse
ggaaacattaaagactaatc

SEQ ID NO: 533516 - DNA, 20 bp, mouse
gcacaggcgagcgtactgga

SEQ ID NO: 533517 - DNA, 20 bp, mouse
ggcgtactggacggcaccgg

SEQ ID NO: 533518 - DNA, 20 bp, mouse
gggtctcccgcagacatggc

SEQ ID NO: 533519 - DNA, 20 bp, mouse
gggacccggatcccacgcgg

SEQ ID NO: 533520 - DNA, 20 bp, mouse
gagacatggcaggcaaccct

SEQ ID NO: 533521 - DNA, 20 bp, mouse
ggggaagtaggaaactccac

SEQ ID NO: 533522 - DNA, 20 bp, mouse
gactccacaggcgagcgtac

SEQ ID NO: 533523 - DNA, 20 bp, mouse
gcgagcgtactggacggcac

SEQ ID NO: 533524 - DNA, 20 bp, mouse
gggacggcaccgggggccca

SEQ ID NO: 533525 - DNA, 20 bp, mouse
gccttgctggcggaggagat

SEQ ID NO: 533526 - DNA, 20 bp, mouse
ggcggccggagaagcggtaa

SEQ ID NO: 533527 - DNA, 20 bp, mouse
gatggcggcggccggagaag

SEQ ID NO: 533528 - DNA, 20 bp, mouse
gcatcctcggggaggaccca

SEQ ID NO: 533529 - DNA, 20 bp, mouse
ggcacacgcggccctcaccg

SEQ ID NO: 533530 - DNA, 20 bp, mouse
gcgatccgttaccgcttctc

SEQ ID NO: 533531 - DNA, 20 bp, mouse
gaaaggccccgagcgctcgg

SEQ ID NO: 533532 - DNA, 20 bp, mouse
gcatccctgggtcctccccg

SEQ ID NO: 533533 - DNA, 20 bp, mouse
ggaggctagcctcatcctcg

SEQ ID NO: 533534 - DNA, 20 bp, mouse
gctcggaaccgggccgggag

SEQ ID NO: 533535 - DNA, 20 bp, mouse
gcggttccgagccccggtga

SEQ ID NO: 533536 - DNA, 20 bp, mouse
ggtcgagatgaaacccgcag

SEQ ID NO: 533537 - DNA, 20 bp, mouse
gacctcatccaggtccacat

SEQ ID NO: 533538 - DNA, 20 bp, mouse
ggaactgcagcgaggaagta

SEQ ID NO: 533539 - DNA, 20 bp, mouse
gcaggcctttggggattcag

SEQ ID NO: 533540 - DNA, 20 bp, mouse
ggagggcgcggggccctatg

SEQ ID NO: 533541 - DNA, 20 bp, mouse
gcctaagcaagggtagggtg

SEQ ID NO: 533542 - DNA, 20 bp, mouse
gcgctcgggccttccctctc

SEQ ID NO: 533543 - DNA, 20 bp, mouse
ggggaacatctcatccactg

SEQ ID NO: 533544 - DNA, 20 bp, mouse
gcctctctggaagatttatc

SEQ ID NO: 533545 - DNA, 20 bp, mouse
ggggtttcatctcgacaagg

SEQ ID NO: 533546 - DNA, 20 bp, mouse
gagggagacacgccagtccc

SEQ ID NO: 533547 - DNA, 20 bp, mouse
ggcaggccagcaaatccagg

SEQ ID NO: 533548 - DNA, 20 bp, mouse
ggagagacagtcccaaactc

SEQ ID NO: 533549 - DNA, 20 bp, mouse
ggttggccagggtcggtcag

SEQ ID NO: 533550 - DNA, 20 bp, mouse
gctccgaaggctgctactct

SEQ ID NO: 533551 - DNA, 20 bp, mouse
gtgtctctctgtaattaaca

SEQ ID NO: 533552 - DNA, 20 bp, mouse
gaggcggagctcccggagtt

SEQ ID NO: 533553 - DNA, 20 bp, mouse
gcggtcagtggctgaggttg

SEQ ID NO: 533554 - DNA, 20 bp, mouse
gtcctgtatcccctcaccag

SEQ ID NO: 533555 - DNA, 20 bp, mouse
gagctttgcaggcccacatg

SEQ ID NO: 533556 - DNA, 20 bp, mouse
gtcagatcagtcagaggcca

SEQ ID NO: 533557 - DNA, 20 bp, mouse
gcccagatcagatcagtcag

SEQ ID NO: 533558 - DNA, 20 bp, mouse
ggggagcgacagcagtggag

SEQ ID NO: 533559 - DNA, 20 bp, mouse
gagccctctgccacttctaa

SEQ ID NO: 533560 - DNA, 20 bp, mouse
gcccagaggagccacccaga

SEQ ID NO: 533561 - DNA, 20 bp, mouse
gataggagccagtttcaaaa

SEQ ID NO: 533562 - DNA, 20 bp, mouse
gtgtcgctcccggcttcctg

SEQ ID NO: 533563 - DNA, 20 bp, mouse
gactgatctgatctgggtga

SEQ ID NO: 533564 - DNA, 20 bp, mouse
gagtggagaggaacacgttc

SEQ ID NO: 533565 - DNA, 20 bp, mouse
gcgacgcttcagggcctcaa

SEQ ID NO: 533566 - DNA, 20 bp, mouse
gcccttggagggaactatat

SEQ ID NO: 533567 - DNA, 20 bp, mouse
gctgggcttggagaactgac

SEQ ID NO: 533568 - DNA, 20 bp, mouse
gcttggagaactgaccggag

SEQ ID NO: 533569 - DNA, 20 bp, mouse
gctccaagggaaggtcgacc

SEQ ID NO: 533570 - DNA, 20 bp, mouse
gcctgcccgagtacgcggta

SEQ ID NO: 533571 - DNA, 20 bp, mouse
gaggtccgtaccgcgtactc

SEQ ID NO: 533572 - DNA, 20 bp, mouse
gctgctctgagccaagcatg

SEQ ID NO: 533573 - DNA, 20 bp, mouse
gacatcgtggtggatgtggg

SEQ ID NO: 533574 - DNA, 20 bp, mouse
gttccgggtcgaccttccct

SEQ ID NO: 533575 - DNA, 20 bp, mouse
gcctctggtgatgatcataa

SEQ ID NO: 533576 - DNA, 20 bp, mouse
ggtaagagtgtgtgaggaca

SEQ ID NO: 533577 - DNA, 20 bp, mouse
gggctctgtgtggacgggaa

SEQ ID NO: 533578 - DNA, 20 bp, mouse
ggacagggctctgtgtggac

SEQ ID NO: 533579 - DNA, 20 bp, mouse
ggtggacgggaagggatgcc

SEQ ID NO: 533580 - DNA, 20 bp, mouse
ggtgtgcatgccacacatcc

SEQ ID NO: 533581 - DNA, 20 bp, mouse
gcttaccttgaagctttatg

SEQ ID NO: 533582 - DNA, 20 bp, mouse
gatctgaaggaaccaggaaa

SEQ ID NO: 533583 - DNA, 20 bp, mouse
ggagcacagttcttatctga

SEQ ID NO: 533584 - DNA, 20 bp, mouse
gtaagaactgtgctcttatt

SEQ ID NO: 533585 - DNA, 20 bp, mouse
ggtcgaagttgcatccctaa

SEQ ID NO: 533586 - DNA, 20 bp, mouse
gcaccttcagccgaagatgg

SEQ ID NO: 533587 - DNA, 20 bp, mouse
ggtgccggcgccaccatctt

SEQ ID NO: 533588 - DNA, 20 bp, mouse
ggcccggcggaggcagcggt

SEQ ID NO: 533589 - DNA, 20 bp, mouse
gcagtgctaaaggagcccgg

SEQ ID NO: 533590 - DNA, 20 bp, mouse
gaattgagacgctggatctg

SEQ ID NO: 533591 - DNA, 20 bp, mouse
gaacaggaggggaggaaccg

SEQ ID NO: 533592 - DNA, 20 bp, mouse
ggagatggcccaatgagggt

SEQ ID NO: 533593 - DNA, 20 bp, mouse
gcgctgctggggacgtgtgc

SEQ ID NO: 533594 - DNA, 20 bp, mouse
ggagcacagagacggagccc

SEQ ID NO: 533595 - DNA, 20 bp, mouse
gtctcaccttcagccgaaga

SEQ ID NO: 533596 - DNA, 20 bp, mouse
gcggatggagagctcggatc

SEQ ID NO: 533597 - DNA, 20 bp, mouse
gttagcaggaggacaccgga

SEQ ID NO: 533598 - DNA, 20 bp, mouse
gcggatctggcactgatccc

SEQ ID NO: 533599 - DNA, 20 bp, mouse
gacttacagatctactccgg

SEQ ID NO: 533600 - DNA, 20 bp, mouse
gctggcactgatcccaggct

SEQ ID NO: 533601 - DNA, 20 bp, mouse
gccgggggtggattagcagg

SEQ ID NO: 533602 - DNA, 20 bp, mouse
gagtagagttggtcccttag

SEQ ID NO: 533603 - DNA, 20 bp, mouse
ggggggaggggagtaatcac

SEQ ID NO: 533604 - DNA, 20 bp, mouse
gcgaagcttacagagagatt

SEQ ID NO: 533605 - DNA, 20 bp, mouse
gtacagatctactccggggg

SEQ ID NO: 533606 - DNA, 20 bp, mouse
ggctccgaccgcagcatcta

SEQ ID NO: 533607 - DNA, 20 bp, mouse
gggttaattctcactctctg

SEQ ID NO: 533608 - DNA, 20 bp, mouse
ggtgcttaccttagatgctg

SEQ ID NO: 533609 - DNA, 20 bp, mouse
gctctctgggggagagaaag

SEQ ID NO: 533610 - DNA, 20 bp, mouse
gagtgagaattaacctggtt

SEQ ID NO: 533611 - DNA, 20 bp, mouse
gcttggctggtcacccaacc

SEQ ID NO: 533612 - DNA, 20 bp, mouse
gctgcggtcggagcaatttc

SEQ ID NO: 533613 - DNA, 20 bp, mouse
gcgcctgatctcatcagaaa

SEQ ID NO: 533614 - DNA, 20 bp, mouse
gtagcatctacctagaaaat

SEQ ID NO: 533615 - DNA, 20 bp, mouse
gtcttgcgtggagaaccgtg

SEQ ID NO: 533616 - DNA, 20 bp, mouse
ggcgcctggcggtagagatg

SEQ ID NO: 533617 - DNA, 20 bp, mouse
gcgcagagccggcctcacct

SEQ ID NO: 533618 - DNA, 20 bp, mouse
gcctggcggtagagatgggg

SEQ ID NO: 533619 - DNA, 20 bp, mouse
gaggctacctgggcgcctgg

SEQ ID NO: 533620 - DNA, 20 bp, mouse
ggcggatcccgaggctacct

SEQ ID NO: 533621 - DNA, 20 bp, mouse
ggtctgagcgaggagagcag

SEQ ID NO: 533622 - DNA, 20 bp, mouse
ggccaggtaccccaagtcag

SEQ ID NO: 533623 - DNA, 20 bp, mouse
gcagatcctctccagcaccc

SEQ ID NO: 533624 - DNA, 20 bp, mouse
gggctctgcggtccagcaag

SEQ ID NO: 533625 - DNA, 20 bp, mouse
gtctctaccgccaggcgccc

SEQ ID NO: 533626 - DNA, 20 bp, mouse
ggaggtccccggacactcac

SEQ ID NO: 533627 - DNA, 20 bp, mouse
gcactcaccggcgcccaggg

SEQ ID NO: 533628 - DNA, 20 bp, mouse
gcttggggcgcaccacgggg

SEQ ID NO: 533629 - DNA, 20 bp, mouse
gggacactcaccggcgccca

SEQ ID NO: 533630 - DNA, 20 bp, mouse
gggcgcccagggcggtccag

SEQ ID NO: 533631 - DNA, 20 bp, mouse
ggaggcctctggaccgccct

SEQ ID NO: 533632 - DNA, 20 bp, mouse
gcggtccagaggcctcggcc

SEQ ID NO: 533633 - DNA, 20 bp, mouse
ggcctcggcctggacagaaa

SEQ ID NO: 533634 - DNA, 20 bp, mouse
gcgtggtgcgccccaagggt

SEQ ID NO: 533635 - DNA, 20 bp, mouse
gaggctctggccaacccttg

SEQ ID NO: 533636 - DNA, 20 bp, mouse
gtggagggcaggggaatgta

SEQ ID NO: 533637 - DNA, 20 bp, mouse
gttcactgggggatgatgga

SEQ ID NO: 533638 - DNA, 20 bp, mouse
gggctgcaggtaatgtgaaa

SEQ ID NO: 533639 - DNA, 20 bp, mouse
gtttcttctgaggaaggctg

SEQ ID NO: 533640 - DNA, 20 bp, mouse
gggttagtctccagaactga

SEQ ID NO: 533641 - DNA, 20 bp, mouse
gtgttctgcaaaaagatatg

SEQ ID NO: 533642 - DNA, 20 bp, mouse
gaagtaataatatgaactca

SEQ ID NO: 533643 - DNA, 20 bp, mouse
gtcatattattacttcaaga

SEQ ID NO: 533644 - DNA, 20 bp, mouse
gaatattcactgggggatga

SEQ ID NO: 533645 - DNA, 20 bp, mouse
gagtagctgggagtcctccc

SEQ ID NO: 533646 - DNA, 20 bp, mouse
gaccaggggagctgcagctc

SEQ ID NO: 533647 - DNA, 20 bp, mouse
gcaccaggattcacagacca

SEQ ID NO: 533648 - DNA, 20 bp, mouse
ggagacaggcactttctcag

SEQ ID NO: 533649 - DNA, 20 bp, mouse
ggtcctgctcccacctacct

SEQ ID NO: 533650 - DNA, 20 bp, mouse
gccagtccctggaggcgtga

SEQ ID NO: 533651 - DNA, 20 bp, mouse
gctttaaaaagctccaaggt

SEQ ID NO: 533652 - DNA, 20 bp, mouse
gggttggactaaccagtccc

SEQ ID NO: 533653 - DNA, 20 bp, mouse
gaggcgtgatggagaatctc

SEQ ID NO: 533654 - DNA, 20 bp, mouse
gcagaggatgcgaaatgaca

SEQ ID NO: 533655 - DNA, 20 bp, mouse
gtcgtttgccagtaaggtaa

SEQ ID NO: 533656 - DNA, 20 bp, mouse
gcagggagggccacagtcca

SEQ ID NO: 533657 - DNA, 20 bp, mouse
gcactttcctagtatctctg

SEQ ID NO: 533658 - DNA, 20 bp, mouse
gtagaggagagctgccccct

SEQ ID NO: 533659 - DNA, 20 bp, mouse
gtgatccacagaatgaacag

SEQ ID NO: 533660 - DNA, 20 bp, mouse
gagcttcgatgatctgctag

SEQ ID NO: 533661 - DNA, 20 bp, mouse
gcccagcaggtatagcgtcc

SEQ ID NO: 533662 - DNA, 20 bp, mouse
gggcatgggcctgtccacca

SEQ ID NO: 533663 - DNA, 20 bp, mouse
ggcaggtatagcgtccaggt

SEQ ID NO: 533664 - DNA, 20 bp, mouse
ggcctgctataacaaagcca

SEQ ID NO: 533665 - DNA, 20 bp, mouse
gtgcttgggaaggatcctgt

SEQ ID NO: 533666 - DNA, 20 bp, mouse
gggagcgggtgctcatgtga

SEQ ID NO: 533667 - DNA, 20 bp, mouse
ggtatgtgtagcagagcact

SEQ ID NO: 533668 - DNA, 20 bp, mouse
gctagctgtgcactcctgat

SEQ ID NO: 533669 - DNA, 20 bp, mouse
gtcctcaaacccttaaaggt

SEQ ID NO: 533670 - DNA, 20 bp, mouse
gatgagcacccgctcccatc

SEQ ID NO: 533671 - DNA, 20 bp, mouse
gatgtcggcatccctgagag

SEQ ID NO: 533672 - DNA, 20 bp, mouse
ggtgcactcctgatgggagc

SEQ ID NO: 533673 - DNA, 20 bp, mouse
gtacacatacctacctttaa

SEQ ID NO: 533674 - DNA, 20 bp, mouse
gtccttcctcaaacccttaa

SEQ ID NO: 533675 - DNA, 20 bp, mouse
gcttcatctggtaacacaag

SEQ ID NO: 533676 - DNA, 20 bp, mouse
gttctaggtggggagaggtc

SEQ ID NO: 533677 - DNA, 20 bp, mouse
ggtaagagggagtttcgggt

SEQ ID NO: 533678 - DNA, 20 bp, mouse
gccaggtaagagggagtttc

SEQ ID NO: 533679 - DNA, 20 bp, mouse
ggatggaggagacagcgtaa

SEQ ID NO: 533680 - DNA, 20 bp, mouse
gggcagtttccttctaggtg

SEQ ID NO: 533681 - DNA, 20 bp, mouse
gtgaaccccacttccaggaa

SEQ ID NO: 533682 - DNA, 20 bp, mouse
gggagacagcgtaagggaag

SEQ ID NO: 533683 - DNA, 20 bp, mouse
gttctccaacccaggtaaga

SEQ ID NO: 533684 - DNA, 20 bp, mouse
ggccaagataaaccaagacg

SEQ ID NO: 533685 - DNA, 20 bp, mouse
gtttccttctaggtggggag

SEQ ID NO: 533686 - DNA, 20 bp, mouse
gagctcccactcctacctga

SEQ ID NO: 533687 - DNA, 20 bp, mouse
gtgctaccctcaggtaggag

SEQ ID NO: 533688 - DNA, 20 bp, mouse
gtacctgagggtagcaagta

SEQ ID NO: 533689 - DNA, 20 bp, mouse
gggcttccctctgggataag

SEQ ID NO: 533690 - DNA, 20 bp, mouse
ggagccagacctggtctcag

SEQ ID NO: 533691 - DNA, 20 bp, mouse
gtggagccccttatcccaga

SEQ ID NO: 533692 - DNA, 20 bp, mouse
gttccttacttgctaccctc

SEQ ID NO: 533693 - DNA, 20 bp, mouse
gttgggctcccacattccta

SEQ ID NO: 533694 - DNA, 20 bp, mouse
gcccccaccttggaacactt

SEQ ID NO: 533695 - DNA, 20 bp, mouse
ggaatgctcagagccagacc

SEQ ID NO: 533696 - DNA, 20 bp, mouse
ggcatcagctccagcatagt

SEQ ID NO: 533697 - DNA, 20 bp, mouse
gtagagctcgaatgccccgg

SEQ ID NO: 533698 - DNA, 20 bp, mouse
ggactcagtgagatagacct

SEQ ID NO: 533699 - DNA, 20 bp, mouse
gatgccccgggggtacttac

SEQ ID NO: 533700 - DNA, 20 bp, mouse
gtcagtgagatagacctggg

SEQ ID NO: 533701 - DNA, 20 bp, mouse
gatgcccgtaagtacccccg

SEQ ID NO: 533702 - DNA, 20 bp, mouse
gcagcggcggacaaaggcaa

SEQ ID NO: 533703 - DNA, 20 bp, mouse
gtttcctggccaccagacga

SEQ ID NO: 533704 - DNA, 20 bp, mouse
gataaagaggcaaggagtag

SEQ ID NO: 533705 - DNA, 20 bp, mouse
gagagcagacacggtctgaa

SEQ ID NO: 533706 - DNA, 20 bp, mouse
gccacggtgaggacagggag

SEQ ID NO: 533707 - DNA, 20 bp, mouse
gctggcaccacggtgaggac

SEQ ID NO: 533708 - DNA, 20 bp, mouse
gcccacctggcaccacggtg

SEQ ID NO: 533709 - DNA, 20 bp, mouse
gatgtcctgggcccacccat

SEQ ID NO: 533710 - DNA, 20 bp, mouse
gggtgccaggtgggtgatca

SEQ ID NO: 533711 - DNA, 20 bp, mouse
gcaggagagtgcccatgggt

SEQ ID NO: 533712 - DNA, 20 bp, mouse
gaggctgagggtgtgtgatc

SEQ ID NO: 533713 - DNA, 20 bp, mouse
gaggtgggtgatcaaggctg

SEQ ID NO: 533714 - DNA, 20 bp, mouse
gaaggcaggagagtgcccat

SEQ ID NO: 533715 - DNA, 20 bp, mouse
gagggtgtgtgatcaggtgg

SEQ ID NO: 533716 - DNA, 20 bp, mouse
gccagaggtaagtgatggat

SEQ ID NO: 533717 - DNA, 20 bp, mouse
gtgggctcttggcggagata

SEQ ID NO: 533718 - DNA, 20 bp, mouse
gcatgctcggagacagccac

SEQ ID NO: 533719 - DNA, 20 bp, mouse
gttgggagcctgaggaccct

SEQ ID NO: 533720 - DNA, 20 bp, mouse
gggcggagatagggtgtgag

SEQ ID NO: 533721 - DNA, 20 bp, mouse
ggaaatccaagtcttaccta

SEQ ID NO: 533722 - DNA, 20 bp, mouse
ggagctccataggtaagact

SEQ ID NO: 533723 - DNA, 20 bp, mouse
gagtgatggatgggagcctt

SEQ ID NO: 533724 - DNA, 20 bp, mouse
gtaatcccaggcttcagtga

SEQ ID NO: 533725 - DNA, 20 bp, mouse
gttgtttcacagtgaaggac

SEQ ID NO: 533726 - DNA, 20 bp, mouse
gttcctgggcagggcacgga

SEQ ID NO: 533727 - DNA, 20 bp, mouse
gctggaagctgcagcaggtc

SEQ ID NO: 533728 - DNA, 20 bp, mouse
gggtggggcgaacgcgagac

SEQ ID NO: 533729 - DNA, 20 bp, mouse
gtgaggcgcgcagatcaccg

SEQ ID NO: 533730 - DNA, 20 bp, mouse
ggcggaggccgagaaccaca

SEQ ID NO: 533731 - DNA, 20 bp, mouse
gtcaccgcggttcctgggca

SEQ ID NO: 533732 - DNA, 20 bp, mouse
ggcagatcaccgcggttcct

SEQ ID NO: 533733 - DNA, 20 bp, mouse
gcgcgcaccagagctgggtg

SEQ ID NO: 533734 - DNA, 20 bp, mouse
gccagtgccccgaccgggaa

SEQ ID NO: 533735 - DNA, 20 bp, mouse
gcgagactggaagctgcagc

SEQ ID NO: 533736 - DNA, 20 bp, mouse
gccgcagcccagcgtctgga

SEQ ID NO: 533737 - DNA, 20 bp, mouse
gcagcccagcgtctggaggg

SEQ ID NO: 533738 - DNA, 20 bp, mouse
gggtccaccctccagacgct

SEQ ID NO: 533739 - DNA, 20 bp, mouse
gaacctgtcagagtgacact

SEQ ID NO: 533740 - DNA, 20 bp, mouse
gtgacccgcagcccagcgtc

SEQ ID NO: 533741 - DNA, 20 bp, mouse
gcctgccccagccaaaccta

SEQ ID NO: 533742 - DNA, 20 bp, mouse
gagagtgttaaatggtataa

SEQ ID NO: 533743 - DNA, 20 bp, mouse
ggtggacccagagtgttaaa

SEQ ID NO: 533744 - DNA, 20 bp, mouse
gctctgacaggttcttctgg

SEQ ID NO: 533745 - DNA, 20 bp, mouse
gttccaagtgtcactctgac

SEQ ID NO: 533746 - DNA, 20 bp, mouse
gtgagggcggcactatccca

SEQ ID NO: 533747 - DNA, 20 bp, mouse
ggaaaacctaccttaagtga

SEQ ID NO: 533748 - DNA, 20 bp, mouse
gctagagaatagagccacaa

SEQ ID NO: 533749 - DNA, 20 bp, mouse
gaacctaccttaagtgaggg

SEQ ID NO: 533750 - DNA, 20 bp, mouse
gacacacacaccggcagcca

SEQ ID NO: 533751 - DNA, 20 bp, mouse
gagtcaaaaacccagcccgt

SEQ ID NO: 533752 - DNA, 20 bp, mouse
gtgccgccctcacttaaggt

SEQ ID NO: 533753 - DNA, 20 bp, mouse
gatgacagtgtgagcagtca

SEQ ID NO: 533754 - DNA, 20 bp, mouse
gatagtgccgccctcactta

SEQ ID NO: 533755 - DNA, 20 bp, mouse
gaggttcagagagggttccc

SEQ ID NO: 533756 - DNA, 20 bp, mouse
ggcctataggtagcacacat

SEQ ID NO: 533757 - DNA, 20 bp, mouse
gtagtaagggcctcttaaag

SEQ ID NO: 533758 - DNA, 20 bp, mouse
gagcacacataggacaagaa

SEQ ID NO: 533759 - DNA, 20 bp, mouse
gagttcagcaccactttaag

SEQ ID NO: 533760 - DNA, 20 bp, mouse
gagggtgaacatacatccag

SEQ ID NO: 533761 - DNA, 20 bp, mouse
gcttctgggtccgtgcctat

SEQ ID NO: 533762 - DNA, 20 bp, mouse
gaagtggtgctgaactgggc

SEQ ID NO: 533763 - DNA, 20 bp, mouse
gaggagttaagagactagga

SEQ ID NO: 533764 - DNA, 20 bp, mouse
gctcagaactcagctgagta

SEQ ID NO: 533765 - DNA, 20 bp, mouse
ggtgcagtatagtctcttct

SEQ ID NO: 533766 - DNA, 20 bp, mouse
ggccggaagtggccgtactg

SEQ ID NO: 533767 - DNA, 20 bp, mouse
gcggctcggggagcgtacct

SEQ ID NO: 533768 - DNA, 20 bp, mouse
gcggcagcggcggagcttcg

SEQ ID NO: 533769 - DNA, 20 bp, mouse
gtagtgtgggaagcagagcg

SEQ ID NO: 533770 - DNA, 20 bp, mouse
gtcggtgcgccagcccggac

SEQ ID NO: 533771 - DNA, 20 bp, mouse
gcctccgctcgcgaaccgga

SEQ ID NO: 533772 - DNA, 20 bp, mouse
ggaaccggaaggaagcctag

SEQ ID NO: 533773 - DNA, 20 bp, mouse
gcttccttccggttcgcgag

SEQ ID NO: 533774 - DNA, 20 bp, mouse
gggagagctggagcgagctg

SEQ ID NO: 533775 - DNA, 20 bp, mouse
gtggccgctaggcttccttc

SEQ ID NO: 533776 - DNA, 20 bp, mouse
gctggcataccattcttcag

SEQ ID NO: 533777 - DNA, 20 bp, mouse
gttatcagataataaaatcc

SEQ ID NO: 533778 - DNA, 20 bp, mouse
gtgcctggagaatataactg

SEQ ID NO: 533779 - DNA, 20 bp, mouse
gagctacagttcataggaca

SEQ ID NO: 533780 - DNA, 20 bp, mouse
ggtgaacagccctgatcagc

SEQ ID NO: 533781 - DNA, 20 bp, mouse
ggagtgcagctacagttcat

SEQ ID NO: 533782 - DNA, 20 bp, mouse
gctagtacttagagacttaa

SEQ ID NO: 533783 - DNA, 20 bp, mouse
gtttattatctgataactat

SEQ ID NO: 533784 - DNA, 20 bp, mouse
gtgtcttagtcctgctgatc

SEQ ID NO: 533785 - DNA, 20 bp, mouse
gctccgcagttatattctcc

SEQ ID NO: 533786 - DNA, 20 bp, mouse
gctgatgctgcacacccgag

SEQ ID NO: 533787 - DNA, 20 bp, mouse
ggggtgtgcagcatcaggtc

SEQ ID NO: 533788 - DNA, 20 bp, mouse
ggaccggcgactgcgaccag

SEQ ID NO: 533789 - DNA, 20 bp, mouse
gctgcgaccagcggaggttg

SEQ ID NO: 533790 - DNA, 20 bp, mouse
gctccgctggtcgcagtcgc

SEQ ID NO: 533791 - DNA, 20 bp, mouse
gaccccgcggggcatctccc

SEQ ID NO: 533792 - DNA, 20 bp, mouse
ggccagcacaggaaccgcgt

SEQ ID NO: 533793 - DNA, 20 bp, mouse
gcggcccgggagatgccccg

SEQ ID NO: 533794 - DNA, 20 bp, mouse
ggtcccgccccaacctccgc

SEQ ID NO: 533795 - DNA, 20 bp, mouse
gcgaccagcggaggttgggg

SEQ ID NO: 533796 - DNA, 20 bp, mouse
gggctcctcgaactctccag

SEQ ID NO: 533797 - DNA, 20 bp, mouse
gaccctgcgtctcttctcaa

SEQ ID NO: 533798 - DNA, 20 bp, mouse
gcctcagacaccatggtgag

SEQ ID NO: 533799 - DNA, 20 bp, mouse
ggtttactgaccactcacca

SEQ ID NO: 533800 - DNA, 20 bp, mouse
gtgaggccagttgccacctc

SEQ ID NO: 533801 - DNA, 20 bp, mouse
gcaaggtgctggtccatcta

SEQ ID NO: 533802 - DNA, 20 bp, mouse
ggccacctctggagagttcg

SEQ ID NO: 533803 - DNA, 20 bp, mouse
gaccccaatcagctccccta

SEQ ID NO: 533804 - DNA, 20 bp, mouse
gacccttgagaagagacgca

SEQ ID NO: 533805 - DNA, 20 bp, mouse
gactctccagaggtggcaac

SEQ ID NO: 533806 - DNA, 20 bp, mouse
gtggagctgtaatcacaaag

SEQ ID NO: 533807 - DNA, 20 bp, mouse
gaaggagaagagagtaagat

SEQ ID NO: 533808 - DNA, 20 bp, mouse
gagctgtaatcacaaagagg

SEQ ID NO: 533809 - DNA, 20 bp, mouse
gagcaggataaagcccaggg

SEQ ID NO: 533810 - DNA, 20 bp, mouse
gctttggcatcatccttctt

SEQ ID NO: 533811 - DNA, 20 bp, mouse
gagctggtgagactcccctg

SEQ ID NO: 533812 - DNA, 20 bp, mouse
gctcagagtggaacctacca

SEQ ID NO: 533813 - DNA, 20 bp, mouse
gatgagcaggataaagccca

SEQ ID NO: 533814 - DNA, 20 bp, mouse
gcgggtagctggggtgtaga

SEQ ID NO: 533815 - DNA, 20 bp, mouse
gtgagtcctactaccaccct

SEQ ID NO: 533816 - DNA, 20 bp, mouse
ggtggaggtgggacctagaa

SEQ ID NO: 533817 - DNA, 20 bp, mouse
gggacctagaaaggaaccaa

SEQ ID NO: 533818 - DNA, 20 bp, mouse
gggctcgtgagagagaagat

SEQ ID NO: 533819 - DNA, 20 bp, mouse
gcctagaaaggaaccaaagg

SEQ ID NO: 533820 - DNA, 20 bp, mouse
ggctttaggctctccagtgg

SEQ ID NO: 533821 - DNA, 20 bp, mouse
gtcttaggctcgggtttctt

SEQ ID NO: 533822 - DNA, 20 bp, mouse
gtaggctcgggtttcttggg

SEQ ID NO: 533823 - DNA, 20 bp, mouse
gctcacacaaagcccagggg

SEQ ID NO: 533824 - DNA, 20 bp, mouse
gcacaccgacaaggaccatc

SEQ ID NO: 533825 - DNA, 20 bp, mouse
gtttgtgtgagggttatcaa

SEQ ID NO: 533826 - DNA, 20 bp, mouse
gttcccagggcccaccatct

SEQ ID NO: 533827 - DNA, 20 bp, mouse
gacgtactaaggctggggtt

SEQ ID NO: 533828 - DNA, 20 bp, mouse
gcgaggaccagaccgcaggt

SEQ ID NO: 533829 - DNA, 20 bp, mouse
gatgggacgtactaaggctg

SEQ ID NO: 533830 - DNA, 20 bp, mouse
gtgcgccatgggacgtacta

SEQ ID NO: 533831 - DNA, 20 bp, mouse
ggccctgggaagcgaatcct

SEQ ID NO: 533832 - DNA, 20 bp, mouse
gctgggaatcgggagatcag

SEQ ID NO: 533833 - DNA, 20 bp, mouse
ggccgaggattcgcttccca

SEQ ID NO: 533834 - DNA, 20 bp, mouse
gcaaggagaggaccgcgggt

SEQ ID NO: 533835 - DNA, 20 bp, mouse
gatggtgggccctgggaatc

SEQ ID NO: 533836 - DNA, 20 bp, mouse
gcggcaaggtgagttttgag

SEQ ID NO: 533837 - DNA, 20 bp, mouse
gcccttcctcggacccggca

SEQ ID NO: 533838 - DNA, 20 bp, mouse
gaccttgccgggtccgagga

SEQ ID NO: 533839 - DNA, 20 bp, mouse
ggagttcgcagagtagcagt

SEQ ID NO: 533840 - DNA, 20 bp, mouse
gactcaccttgccgggtccg

SEQ ID NO: 533841 - DNA, 20 bp, mouse
ggcgaactccagggcctaag

SEQ ID NO: 533842 - DNA, 20 bp, mouse
gggcagctcctgtccctgaa

SEQ ID NO: 533843 - DNA, 20 bp, mouse
gtaggagtgagtgaaagtga

SEQ ID NO: 533844 - DNA, 20 bp, mouse
gtgctactctgcgaactcca

SEQ ID NO: 533845 - DNA, 20 bp, mouse
gtggataaagaagaattaca

SEQ ID NO: 533846 - DNA, 20 bp, mouse
gagtccctggctctgtccca

SEQ ID NO: 533847 - DNA, 20 bp, mouse
gtcatggtgagtgctgggtg

SEQ ID NO: 533848 - DNA, 20 bp, mouse
ggtcagaccgccacagatca

SEQ ID NO: 533849 - DNA, 20 bp, mouse
gcagcactcaccatgatctg

SEQ ID NO: 533850 - DNA, 20 bp, mouse
gagctcagagactagcacct

SEQ ID NO: 533851 - DNA, 20 bp, mouse
gcactcaccatgatctgtgg

SEQ ID NO: 533852 - DNA, 20 bp, mouse
gcacgagactacatgaggta

SEQ ID NO: 533853 - DNA, 20 bp, mouse
gacttccctgagcccagcac

SEQ ID NO: 533854 - DNA, 20 bp, mouse
gactagcacctgggtgtggc

SEQ ID NO: 533855 - DNA, 20 bp, mouse
ggcacaggcacacaagtccc

SEQ ID NO: 533856 - DNA, 20 bp, mouse
gagctgcccgggtgctgagt

SEQ ID NO: 533857 - DNA, 20 bp, mouse
ggggagcccactcagcaccc

SEQ ID NO: 533858 - DNA, 20 bp, mouse
gtgcagagaagaaaagtcct

SEQ ID NO: 533859 - DNA, 20 bp, mouse
gaagcaccgcaacagcgccg

SEQ ID NO: 533860 - DNA, 20 bp, mouse
gcccgggcagctacagtagg

SEQ ID NO: 533861 - DNA, 20 bp, mouse
ggcacccgggcagctacagt

SEQ ID NO: 533862 - DNA, 20 bp, mouse
gcggtgcttcgagagttggc

SEQ ID NO: 533863 - DNA, 20 bp, mouse
ggcagctacagtaggtggtc

SEQ ID NO: 533864 - DNA, 20 bp, mouse
gacctcacccggccttctga

SEQ ID NO: 533865 - DNA, 20 bp, mouse
ggttgcggtgcttcgagagt

SEQ ID NO: 533866 - DNA, 20 bp, mouse
gtgtagcggcgcaggcagta

SEQ ID NO: 533867 - DNA, 20 bp, mouse
gggcagtagggctgtcggag

SEQ ID NO: 533868 - DNA, 20 bp, mouse
gcgggaactggctgtcgtgg

SEQ ID NO: 533869 - DNA, 20 bp, mouse
ggcgcggccgtgtagctccc

SEQ ID NO: 533870 - DNA, 20 bp, mouse
ggcgcaggcagtagggctgt

SEQ ID NO: 533871 - DNA, 20 bp, mouse
ggcgcacacccgagaagaag

SEQ ID NO: 533872 - DNA, 20 bp, mouse
gtagggctgtcggagcggcg

SEQ ID NO: 533873 - DNA, 20 bp, mouse
gtcccgggaactggctgtcg

SEQ ID NO: 533874 - DNA, 20 bp, mouse
ggtggcggggacgcgagtgg

SEQ ID NO: 533875 - DNA, 20 bp, mouse
gacccgagaagaagcggcgg

SEQ ID NO: 533876 - DNA, 20 bp, mouse
gatcctggagagctgtagag

SEQ ID NO: 533877 - DNA, 20 bp, mouse
gaggcactggtgagtcagca

SEQ ID NO: 533878 - DNA, 20 bp, mouse
gccacagccgaccacagaga

SEQ ID NO: 533879 - DNA, 20 bp, mouse
gaaggctctcttggaaaccc

SEQ ID NO: 533880 - DNA, 20 bp, mouse
ggccaggacaaaatctgaaa

SEQ ID NO: 533881 - DNA, 20 bp, mouse
gtgccctggaaagtcgggag

SEQ ID NO: 533882 - DNA, 20 bp, mouse
gttcccctctacagctctcc

SEQ ID NO: 533883 - DNA, 20 bp, mouse
gggaactcgtgtctctgcct

SEQ ID NO: 533884 - DNA, 20 bp, mouse
gaggggtgccctggaaagtc

SEQ ID NO: 533885 - DNA, 20 bp, mouse
gttcccctcccgactttcca

SEQ ID NO: 533886 - DNA, 20 bp, mouse
ggatgtccctggatagagag

SEQ ID NO: 533887 - DNA, 20 bp, mouse
gccaaggccagtcaactgag

SEQ ID NO: 533888 - DNA, 20 bp, mouse
gatagagaggggcaacctgg

SEQ ID NO: 533889 - DNA, 20 bp, mouse
gagaggggcaacctggtggc

SEQ ID NO: 533890 - DNA, 20 bp, mouse
gctactcaggcgcaatcctg

SEQ ID NO: 533891 - DNA, 20 bp, mouse
gaggttgcccctctctatcc

SEQ ID NO: 533892 - DNA, 20 bp, mouse
ggtcaacaggtgccaagccg

SEQ ID NO: 533893 - DNA, 20 bp, mouse
gcagtctgctgcagctactc

SEQ ID NO: 533894 - DNA, 20 bp, mouse
gcagcagactgccggccacc

SEQ ID NO: 533895 - DNA, 20 bp, mouse
ggcaccaaacagagaacctt

SEQ ID NO: 533896 - DNA, 20 bp, mouse
ggcagcaaggctcttaccag

SEQ ID NO: 533897 - DNA, 20 bp, mouse
ggctgagtgcgagatagaca

SEQ ID NO: 533898 - DNA, 20 bp, mouse
gagggtctgccagcattggg

SEQ ID NO: 533899 - DNA, 20 bp, mouse
gtcttaccagcggaggacaa

SEQ ID NO: 533900 - DNA, 20 bp, mouse
ggcaaggctcttaccagcgg

SEQ ID NO: 533901 - DNA, 20 bp, mouse
gaatgctggcagaccctggg

SEQ ID NO: 533902 - DNA, 20 bp, mouse
gcagagggtctggcccccca

SEQ ID NO: 533903 - DNA, 20 bp, mouse
gatgttagcaccaaagtgaa

SEQ ID NO: 533904 - DNA, 20 bp, mouse
gagcaggctccgcccaatgc

SEQ ID NO: 533905 - DNA, 20 bp, mouse
gcagcctgtcactctctcag

SEQ ID NO: 533906 - DNA, 20 bp, mouse
gaagagacttcactctcagt

SEQ ID NO: 533907 - DNA, 20 bp, mouse
gagagggaagacacttcctc

SEQ ID NO: 533908 - DNA, 20 bp, mouse
gctcggcgtggcatttgaga

SEQ ID NO: 533909 - DNA, 20 bp, mouse
ggggcagaagtcatctagca

SEQ ID NO: 533910 - DNA, 20 bp, mouse
ggggatctgcagaattcaga

SEQ ID NO: 533911 - DNA, 20 bp, mouse
ggtaataccaaaaatagact

SEQ ID NO: 533912 - DNA, 20 bp, mouse
gagtgagtgggtcagactcc

SEQ ID NO: 533913 - DNA, 20 bp, mouse
gtttaaacaggggctcggcg

SEQ ID NO: 533914 - DNA, 20 bp, mouse
gccactcactccgcaagtag

SEQ ID NO: 533915 - DNA, 20 bp, mouse
ggcaggcagagctcagtgct

SEQ ID NO: 533916 - DNA, 20 bp, mouse
gccccaggagatctaagaca

SEQ ID NO: 533917 - DNA, 20 bp, mouse
ggcaaggcagtagctccaga

SEQ ID NO: 533918 - DNA, 20 bp, mouse
gcctgagctaatgctaggtt

SEQ ID NO: 533919 - DNA, 20 bp, mouse
gagtagctccagatggaaaa

SEQ ID NO: 533920 - DNA, 20 bp, mouse
gaccatgtcttagatctcct

SEQ ID NO: 533921 - DNA, 20 bp, mouse
ggctatcctgagctaatgct

SEQ ID NO: 533922 - DNA, 20 bp, mouse
gggggccagaggagagtgat

SEQ ID NO: 533923 - DNA, 20 bp, mouse
ggagctactgccttgccccc

SEQ ID NO: 533924 - DNA, 20 bp, mouse
gaggagagtgatgggctgaa

SEQ ID NO: 533925 - DNA, 20 bp, mouse
gcccctacccctagacatca

SEQ ID NO: 533926 - DNA, 20 bp, mouse
gggagtaggggcctcaccca

SEQ ID NO: 533927 - DNA, 20 bp, mouse
ggcctcacccatggctgcaa

SEQ ID NO: 533928 - DNA, 20 bp, mouse
gtatcgacaaagaggatctt

SEQ ID NO: 533929 - DNA, 20 bp, mouse
gcatttatagataggagtag

SEQ ID NO: 533930 - DNA, 20 bp, mouse
gtaattgatcagaacaggga

SEQ ID NO: 533931 - DNA, 20 bp, mouse
gacagtgaacgcctgtggag

SEQ ID NO: 533932 - DNA, 20 bp, mouse
ggggacacctttgcagccat

SEQ ID NO: 533933 - DNA, 20 bp, mouse
ggagtctagcgcgtccccaa

SEQ ID NO: 533934 - DNA, 20 bp, mouse
gcattgagacggcctgaatg

SEQ ID NO: 533935 - DNA, 20 bp, mouse
gacccggaggatgtgatcac

SEQ ID NO: 533936 - DNA, 20 bp, mouse
gctaccagaatgcccttacc

SEQ ID NO: 533937 - DNA, 20 bp, mouse
gcattctggtagatgagctt

SEQ ID NO: 533938 - DNA, 20 bp, mouse
gttgccaggtaagggcattc

SEQ ID NO: 533939 - DNA, 20 bp, mouse
gtcgccccggtcaagaacca

SEQ ID NO: 533940 - DNA, 20 bp, mouse
gctaatgaagacaggatgac

SEQ ID NO: 533941 - DNA, 20 bp, mouse
gtgggcatgccgggaagtca

SEQ ID NO: 533942 - DNA, 20 bp, mouse
gcgcaacgtgggaggaaggt

SEQ ID NO: 533943 - DNA, 20 bp, mouse
gcggatgcgagtgagcaagg

SEQ ID NO: 533944 - DNA, 20 bp, mouse
gcactgggcatgcgcaacgt

SEQ ID NO: 533945 - DNA, 20 bp, mouse
ggtgcagagccggcctctcc

SEQ ID NO: 533946 - DNA, 20 bp, mouse
ggagccggccgcgcctgggg

SEQ ID NO: 533947 - DNA, 20 bp, mouse
gcggggcggaccgagcacaa

SEQ ID NO: 533948 - DNA, 20 bp, mouse
ggcacaagggtaagcgagac

SEQ ID NO: 533949 - DNA, 20 bp, mouse
ggtaagcgagaccggagagc

SEQ ID NO: 533950 - DNA, 20 bp, mouse
gccggctctcaccagctctc

SEQ ID NO: 533951 - DNA, 20 bp, mouse
gtgagagccggccgcgcctg

SEQ ID NO: 533952 - DNA, 20 bp, mouse
gagctctcccgccccaggcg

SEQ ID NO: 533953 - DNA, 20 bp, mouse
gcccggcggagctccaaggg

SEQ ID NO: 533954 - DNA, 20 bp, mouse
gttctgggcgaagtgctccc

SEQ ID NO: 533955 - DNA, 20 bp, mouse
gttggaggaaggagagacaa

SEQ ID NO: 533956 - DNA, 20 bp, mouse
gtctgcaatgccggagccag

SEQ ID NO: 533957 - DNA, 20 bp, mouse
ggcagaagcttaaggaccca

SEQ ID NO: 533958 - DNA, 20 bp, mouse
gtggcaacggtgttacacca

SEQ ID NO: 533959 - DNA, 20 bp, mouse
gacccaggaaggcaaggcta

SEQ ID NO: 533960 - DNA, 20 bp, mouse
gagccagtggcagaagctta

SEQ ID NO: 533961 - DNA, 20 bp, mouse
gaagggtacccaggaaggca

SEQ ID NO: 533962 - DNA, 20 bp, mouse
ggacccaggtaaggggccct

SEQ ID NO: 533963 - DNA, 20 bp, mouse
gcaacaaacagcatgcaggt

SEQ ID NO: 533964 - DNA, 20 bp, mouse
gcttacctgggtcctgtggc

SEQ ID NO: 533965 - DNA, 20 bp, mouse
ggtccttaagcttctgccac

SEQ ID NO: 533966 - DNA, 20 bp, mouse
gtcctggtgccctagcagac

SEQ ID NO: 533967 - DNA, 20 bp, mouse
gctgctagggcaccaggaag

SEQ ID NO: 533968 - DNA, 20 bp, mouse
gcgggccaggggcacactgt

SEQ ID NO: 533969 - DNA, 20 bp, mouse
ggtgacggtgagattggaga

SEQ ID NO: 533970 - DNA, 20 bp, mouse
ggcacagcggggagccctgg

SEQ ID NO: 533971 - DNA, 20 bp, mouse
gggtaggtgaggtcgggtgg

SEQ ID NO: 533972 - DNA, 20 bp, mouse
gagaatgtcatagacccaga

SEQ ID NO: 533973 - DNA, 20 bp, mouse
ggtcagcctggcatagtatg

SEQ ID NO: 533974 - DNA, 20 bp, mouse
gtggcacacaagggacagtt

SEQ ID NO: 533975 - DNA, 20 bp, mouse
ggtgcccctggcccgcacag

SEQ ID NO: 533976 - DNA, 20 bp, mouse
gacgctgccgctggcccagg

SEQ ID NO: 533977 - DNA, 20 bp, mouse
gtgctggagtccctccccct

SEQ ID NO: 533978 - DNA, 20 bp, mouse
ggtccctccccctgggccag

SEQ ID NO: 533979 - DNA, 20 bp, mouse
gctgccgctggcccaggggg

SEQ ID NO: 533980 - DNA, 20 bp, mouse
gacagatcgcgagatctctt

SEQ ID NO: 533981 - DNA, 20 bp, mouse
gagaggcagaaggttcgctt

SEQ ID NO: 533982 - DNA, 20 bp, mouse
gggcctggctgacatgattc

SEQ ID NO: 533983 - DNA, 20 bp, mouse
ggacgttccataccatactt

SEQ ID NO: 533984 - DNA, 20 bp, mouse
gaccctctttgtcatgatgg

SEQ ID NO: 533985 - DNA, 20 bp, mouse
gtccaccatcatgacaaaga

SEQ ID NO: 533986 - DNA, 20 bp, mouse
gggcagcaggagcggagacg

SEQ ID NO: 533987 - DNA, 20 bp, mouse
ggcggagacgcggcatccag

SEQ ID NO: 533988 - DNA, 20 bp, mouse
ggcgcccagactgccagcaa

SEQ ID NO: 533989 - DNA, 20 bp, mouse
gctgcgctccagccgggacc

SEQ ID NO: 533990 - DNA, 20 bp, mouse
gctcctgctgcctgccgggc

SEQ ID NO: 533991 - DNA, 20 bp, mouse
gggtggccttcggcttggga

SEQ ID NO: 533992 - DNA, 20 bp, mouse
gcgcctgcggcgggataggg

SEQ ID NO: 533993 - DNA, 20 bp, mouse
gtccgggccgccgtttccag

SEQ ID NO: 533994 - DNA, 20 bp, mouse
ggcccagagctgcgggatgg

SEQ ID NO: 533995 - DNA, 20 bp, mouse
gtggtgaaccgggcccggga

SEQ ID NO: 533996 - DNA, 20 bp, mouse
gggaggccgggacatttccg

SEQ ID NO: 533997 - DNA, 20 bp, mouse
gagaggagactccttgttct

SEQ ID NO: 533998 - DNA, 20 bp, mouse
gttccggggttggggtcaga

SEQ ID NO: 533999 - DNA, 20 bp, mouse
gctgagagagaggagcccca

SEQ ID NO: 534000 - DNA, 20 bp, mouse
gctgcctcagagcccctacg

SEQ ID NO: 534001 - DNA, 20 bp, mouse
gtaaatgaggaaacatcgtg

SEQ ID NO: 534002 - DNA, 20 bp, mouse
gcccaaccccggaaatgtcc

SEQ ID NO: 534003 - DNA, 20 bp, mouse
gtcaccagcatggcttggcc

SEQ ID NO: 534004 - DNA, 20 bp, mouse
gttgcctcgtaggggctctg

SEQ ID NO: 534005 - DNA, 20 bp, mouse
gtatgtgccttgcctcgtag

SEQ ID NO: 534006 - DNA, 20 bp, mouse
gggagagccaggcagggcga

SEQ ID NO: 534007 - DNA, 20 bp, mouse
gcaagtgtggagagccaggc

SEQ ID NO: 534008 - DNA, 20 bp, mouse
gaaagggaccccagcaagtg

SEQ ID NO: 534009 - DNA, 20 bp, mouse
gtctccccgagtggttacaa

SEQ ID NO: 534010 - DNA, 20 bp, mouse
gggtgtgttcggtattggga

SEQ ID NO: 534011 - DNA, 20 bp, mouse
ggtccctttgtaaccactcg

SEQ ID NO: 534012 - DNA, 20 bp, mouse
gtgtgaggccgggggacatg

SEQ ID NO: 534013 - DNA, 20 bp, mouse
gttcctggtggtgagtgctt

SEQ ID NO: 534014 - DNA, 20 bp, mouse
gccaaaagagtctccccgag

SEQ ID NO: 534015 - DNA, 20 bp, mouse
gagggtctctggaactactc

SEQ ID NO: 534016 - DNA, 20 bp, mouse
gcagcgggaagagcccgtgg

SEQ ID NO: 534017 - DNA, 20 bp, mouse
gagcggccgggagagaaagc

SEQ ID NO: 534018 - DNA, 20 bp, mouse
gggagctccaggccgcctgg

SEQ ID NO: 534019 - DNA, 20 bp, mouse
gcacaccgcctgaggaggta

SEQ ID NO: 534020 - DNA, 20 bp, mouse
gagagaaagccgggagctcc

SEQ ID NO: 534021 - DNA, 20 bp, mouse
ggccgattggaagggcgggt

SEQ ID NO: 534022 - DNA, 20 bp, mouse
gcccgccggctcctccccag

SEQ ID NO: 534023 - DNA, 20 bp, mouse
ggttgcagtgctccgccagg

SEQ ID NO: 534024 - DNA, 20 bp, mouse
gagctcccggctttctctcc

SEQ ID NO: 534025 - DNA, 20 bp, mouse
gtggcggagcactgcaaccg

SEQ ID NO: 534026 - DNA, 20 bp, mouse
gaatgaagtcactgtggtaa

SEQ ID NO: 534027 - DNA, 20 bp, mouse
gccggggtagagggtgagat

SEQ ID NO: 534028 - DNA, 20 bp, mouse
gagggaggtggaggaacccg

SEQ ID NO: 534029 - DNA, 20 bp, mouse
gagagagacctcttggagat

SEQ ID NO: 534030 - DNA, 20 bp, mouse
gtctgcccacctgaggggaa

SEQ ID NO: 534031 - DNA, 20 bp, mouse
gggagggcaaggaggcataa

SEQ ID NO: 534032 - DNA, 20 bp, mouse
gggtgagatgggcatcagat

SEQ ID NO: 534033 - DNA, 20 bp, mouse
gtgggaattgtagagggatt

SEQ ID NO: 534034 - DNA, 20 bp, mouse
gccaacctggccatccaggg

SEQ ID NO: 534035 - DNA, 20 bp, mouse
gcaagaggctagagggtcct

SEQ ID NO: 534036 - DNA, 20 bp, mouse
gcagccggcggacgcggtgt

SEQ ID NO: 534037 - DNA, 20 bp, mouse
gggtgcactgaacgcacggt

SEQ ID NO: 534038 - DNA, 20 bp, mouse
gggatccccggcagcaactg

SEQ ID NO: 534039 - DNA, 20 bp, mouse
ggaacgcacggtcggctgag

SEQ ID NO: 534040 - DNA, 20 bp, mouse
gggagcccagccggcggacg

SEQ ID NO: 534041 - DNA, 20 bp, mouse
gtgtgggtgcactgaacgca

SEQ ID NO: 534042 - DNA, 20 bp, mouse
ggcagcacgcggagacggag

SEQ ID NO: 534043 - DNA, 20 bp, mouse
gagcgcactcggagcccagc

SEQ ID NO: 534044 - DNA, 20 bp, mouse
ggccgcgcgcacaaaggcac

SEQ ID NO: 534045 - DNA, 20 bp, mouse
gacaaaggcacgggcgggaa

SEQ ID NO: 534046 - DNA, 20 bp, mouse
gtccggcaggatgcgctacc

SEQ ID NO: 534047 - DNA, 20 bp, mouse
gaccgggcatcggtgagcat

SEQ ID NO: 534048 - DNA, 20 bp, mouse
gagtacagaccaagaggcgc

SEQ ID NO: 534049 - DNA, 20 bp, mouse
ggggtcttagccatcaccag

SEQ ID NO: 534050 - DNA, 20 bp, mouse
gtagcgcatcctgccggacc

SEQ ID NO: 534051 - DNA, 20 bp, mouse
gaggatgcgctaccgggcat

SEQ ID NO: 534052 - DNA, 20 bp, mouse
gcgccccctggtcctcaagt

SEQ ID NO: 534053 - DNA, 20 bp, mouse
ggcccggtagcgcatcctgc

SEQ ID NO: 534054 - DNA, 20 bp, mouse
ggcccatgctcaccgatgcc

SEQ ID NO: 534055 - DNA, 20 bp, mouse
gacaggaggccgaggcggag

SEQ ID NO: 534056 - DNA, 20 bp, mouse
ggggcggagagatcgtaccg

SEQ ID NO: 534057 - DNA, 20 bp, mouse
gtggacggcgtggccacctc

SEQ ID NO: 534058 - DNA, 20 bp, mouse
ggcccctagcgggccctggg

SEQ ID NO: 534059 - DNA, 20 bp, mouse
ggggttgcggactccggagg

SEQ ID NO: 534060 - DNA, 20 bp, mouse
gcaagccggtgggtacacga

SEQ ID NO: 534061 - DNA, 20 bp, mouse
gccctccctcgtgtacccac

SEQ ID NO: 534062 - DNA, 20 bp, mouse
gtcttcgggtgatcgggcgg

SEQ ID NO: 534063 - DNA, 20 bp, mouse
gctggaaccctgcactagtc

SEQ ID NO: 534064 - DNA, 20 bp, mouse
gggttcttcgggtgatcggg

SEQ ID NO: 534065 - DNA, 20 bp, mouse
gcccgaagaaccaagccggt

SEQ ID NO: 534066 - DNA, 20 bp, mouse
gcagccggcgcggctctgaa

SEQ ID NO: 534067 - DNA, 20 bp, mouse
gctcagagctccagccggcg

SEQ ID NO: 534068 - DNA, 20 bp, mouse
gggctctgaacgggcgaggc

SEQ ID NO: 534069 - DNA, 20 bp, mouse
gtctgaacgggcgaggccgg

SEQ ID NO: 534070 - DNA, 20 bp, mouse
gcacaacccgcagccaccgc

SEQ ID NO: 534071 - DNA, 20 bp, mouse
gagcaggagagccttgagtt

SEQ ID NO: 534072 - DNA, 20 bp, mouse
gtaaggttggccatgaactc

SEQ ID NO: 534073 - DNA, 20 bp, mouse
gcactcctcagagctccagc

SEQ ID NO: 534074 - DNA, 20 bp, mouse
ggagagccttgagttcggca

SEQ ID NO: 534075 - DNA, 20 bp, mouse
gaacccgcagccaccgcggg

SEQ ID NO: 534076 - DNA, 20 bp, mouse
gaccgcggcgggagtcacca

SEQ ID NO: 534077 - DNA, 20 bp, mouse
gcggcgcagccaactcacca

SEQ ID NO: 534078 - DNA, 20 bp, mouse
gcgggtccaggcaaagcagt

SEQ ID NO: 534079 - DNA, 20 bp, mouse
gtcccgctgcctaggcactg

SEQ ID NO: 534080 - DNA, 20 bp, mouse
ggacgcctgaccctgggatg

SEQ ID NO: 534081 - DNA, 20 bp, mouse
gcccggcggaggcgcgaccg

SEQ ID NO: 534082 - DNA, 20 bp, mouse
gctggcagccacaacaacat

SEQ ID NO: 534083 - DNA, 20 bp, mouse
gggctggaacgcggtctcct

SEQ ID NO: 534084 - DNA, 20 bp, mouse
gtccaagagggactccatcc

SEQ ID NO: 534085 - DNA, 20 bp, mouse
gccctcgggtcctctcccct

SEQ ID NO: 534086 - DNA, 20 bp, mouse
gaggctcagagggttctagg

SEQ ID NO: 534087 - DNA, 20 bp, mouse
ggctcctgtgggtaatgaca

SEQ ID NO: 534088 - DNA, 20 bp, mouse
gctcagagggttctaggggg

SEQ ID NO: 534089 - DNA, 20 bp, mouse
ggacaggggtgcaggctcag

SEQ ID NO: 534090 - DNA, 20 bp, mouse
gatggtgagggatggtatgt

SEQ ID NO: 534091 - DNA, 20 bp, mouse
gatggtatgtaggctcctgt

SEQ ID NO: 534092 - DNA, 20 bp, mouse
gcacccctgtcattacccac

SEQ ID NO: 534093 - DNA, 20 bp, mouse
gcatggctctcctccttcac

SEQ ID NO: 534094 - DNA, 20 bp, mouse
gaacttaccatggtgaggga

SEQ ID NO: 534095 - DNA, 20 bp, mouse
gttcagagacagagttccat

SEQ ID NO: 534096 - DNA, 20 bp, mouse
gtttctgtacagaggtgaag

SEQ ID NO: 534097 - DNA, 20 bp, mouse
ggcagtagtcaggcagggct

SEQ ID NO: 534098 - DNA, 20 bp, mouse
gtagagctcaggtagatgtg

SEQ ID NO: 534099 - DNA, 20 bp, mouse
gaggtctgtgtggatgataa

SEQ ID NO: 534100 - DNA, 20 bp, mouse
gctgaagtactgcagtagtc

SEQ ID NO: 534101 - DNA, 20 bp, mouse
gagtactgcagtagtcaggc

SEQ ID NO: 534102 - DNA, 20 bp, mouse
gtgggaccagggtaccttca

SEQ ID NO: 534103 - DNA, 20 bp, mouse
gaagctctggcgacctgcct

SEQ ID NO: 534104 - DNA, 20 bp, mouse
gcgaagaaggccctgagtat

SEQ ID NO: 534105 - DNA, 20 bp, mouse
gtgccttggatgcttgcagt

SEQ ID NO: 534106 - DNA, 20 bp, mouse
gaaggcagactcgctggtgt

SEQ ID NO: 534107 - DNA, 20 bp, mouse
gtccaggaaggcagactcgc

SEQ ID NO: 534108 - DNA, 20 bp, mouse
ggcgctcaccgccagggaca

SEQ ID NO: 534109 - DNA, 20 bp, mouse
gttgcgaagattctccagga

SEQ ID NO: 534110 - DNA, 20 bp, mouse
gagtcacaaagggcctgtag

SEQ ID NO: 534111 - DNA, 20 bp, mouse
gacgcttgcgaagattctcc

SEQ ID NO: 534112 - DNA, 20 bp, mouse
gtgcactccaaccttgtccc

SEQ ID NO: 534113 - DNA, 20 bp, mouse
ggtgcacagcctggaccacc

SEQ ID NO: 534114 - DNA, 20 bp, mouse
ggtccaggctgtgcacggag

SEQ ID NO: 534115 - DNA, 20 bp, mouse
gtaacgacgacgctaaacgg

SEQ ID NO: 534116 - DNA, 20 bp, mouse
gcacactgtgcacccacctg

SEQ ID NO: 534117 - DNA, 20 bp, mouse
ggccagcagaggaattggag

SEQ ID NO: 534118 - DNA, 20 bp, mouse
ggtctgcaggctccttcccc

SEQ ID NO: 534119 - DNA, 20 bp, mouse
gatatgagccaggcgttcta

SEQ ID NO: 534120 - DNA, 20 bp, mouse
gcctctgctggcccaatact

SEQ ID NO: 534121 - DNA, 20 bp, mouse
gccctctgtaggggacccgg

SEQ ID NO: 534122 - DNA, 20 bp, mouse
ggggacccggcggcgcgcta

SEQ ID NO: 534123 - DNA, 20 bp, mouse
gggtgcaaaatcccagtatt

SEQ ID NO: 534124 - DNA, 20 bp, mouse
gaatagggtttgtagagaag

SEQ ID NO: 534125 - DNA, 20 bp, mouse
gacccggcggcgcgctaggg

SEQ ID NO: 534126 - DNA, 20 bp, mouse
gaggtgagcggtgagcacac

SEQ ID NO: 534127 - DNA, 20 bp, mouse
gcagcagcctcggaggtgag

SEQ ID NO: 534128 - DNA, 20 bp, mouse
gggttctcccgagtgcagga

SEQ ID NO: 534129 - DNA, 20 bp, mouse
gctctgggccgcttgaacaa

SEQ ID NO: 534130 - DNA, 20 bp, mouse
ggtgtcccgggagaccccag

SEQ ID NO: 534131 - DNA, 20 bp, mouse
ggtgggttgacaccagtcaa

SEQ ID NO: 534132 - DNA, 20 bp, mouse
ggttcaagcggcccagagat

SEQ ID NO: 534133 - DNA, 20 bp, mouse
gctcccgggacaccagggtc

SEQ ID NO: 534134 - DNA, 20 bp, mouse
gtgacaccggagcccttgac

SEQ ID NO: 534135 - DNA, 20 bp, mouse
gctgtgccctgcacatctga

SEQ ID NO: 534136 - DNA, 20 bp, mouse
ggaggccgcagctcgcgtgg

SEQ ID NO: 534137 - DNA, 20 bp, mouse
ggcccgcgcgggtgaaacgg

SEQ ID NO: 534138 - DNA, 20 bp, mouse
gccgacgccccccgcctagg

SEQ ID NO: 534139 - DNA, 20 bp, mouse
ggccgcccgcgcgggtgaaa

SEQ ID NO: 534140 - DNA, 20 bp, mouse
gagagaccaggcctctaagg

SEQ ID NO: 534141 - DNA, 20 bp, mouse
ggaggtacagccgggcagtg

SEQ ID NO: 534142 - DNA, 20 bp, mouse
ggcggccgccacgcgagctg

SEQ ID NO: 534143 - DNA, 20 bp, mouse
gcatccgaaatgggctcggg

SEQ ID NO: 534144 - DNA, 20 bp, mouse
gggcctctaaggaggcgaag

SEQ ID NO: 534145 - DNA, 20 bp, mouse
ggcgactgaagagaccgcaa

SEQ ID NO: 534146 - DNA, 20 bp, mouse
ggggtcggtccacccgagaa

SEQ ID NO: 534147 - DNA, 20 bp, mouse
gacccgagaaaggagcgcgg

SEQ ID NO: 534148 - DNA, 20 bp, mouse
gggcactagcgccagcgggt

SEQ ID NO: 534149 - DNA, 20 bp, mouse
ggaggaactgggaccggtct

SEQ ID NO: 534150 - DNA, 20 bp, mouse
gtggcaggggcgtccagtag

SEQ ID NO: 534151 - DNA, 20 bp, mouse
gaaaggagcgcggaggaact

SEQ ID NO: 534152 - DNA, 20 bp, mouse
ggcgtcggcactagcgccag

SEQ ID NO: 534153 - DNA, 20 bp, mouse
ggccgggcccgcactcaccc

SEQ ID NO: 534154 - DNA, 20 bp, mouse
gtccacccgagaaaggagcg

SEQ ID NO: 534155 - DNA, 20 bp, mouse
gccgtgcactgagatcgcgg

SEQ ID NO: 534156 - DNA, 20 bp, mouse
gtgcgggtgggcaaacccaa

SEQ ID NO: 534157 - DNA, 20 bp, mouse
gggccaggcgctgagtgcct

SEQ ID NO: 534158 - DNA, 20 bp, mouse
gtagagctcggccaccgcca

SEQ ID NO: 534159 - DNA, 20 bp, mouse
ggagctctacgcgcaggtag

SEQ ID NO: 534160 - DNA, 20 bp, mouse
ggtgggcaggagcttcgatc

SEQ ID NO: 534161 - DNA, 20 bp, mouse
gggtgggcaaacccaacgga

SEQ ID NO: 534162 - DNA, 20 bp, mouse
ggggacagcagccctccgtt

SEQ ID NO: 534163 - DNA, 20 bp, mouse
gggaaaacttctgcacaaga

SEQ ID NO: 534164 - DNA, 20 bp, mouse
ggcccagacgggtagatgag

SEQ ID NO: 534165 - DNA, 20 bp, mouse
ggggactcagattccatcag

SEQ ID NO: 534166 - DNA, 20 bp, mouse
gccacagatggatttcagat

SEQ ID NO: 534167 - DNA, 20 bp, mouse
gacatctgcctcctccacta

SEQ ID NO: 534168 - DNA, 20 bp, mouse
gtggggtggggtgcccaaac

SEQ ID NO: 534169 - DNA, 20 bp, mouse
gattcctgccatagtggagg

SEQ ID NO: 534170 - DNA, 20 bp, mouse
ggaagatggaaagcccgttt

SEQ ID NO: 534171 - DNA, 20 bp, mouse
gaatattcctgccatagtgg

SEQ ID NO: 534172 - DNA, 20 bp, mouse
gtgaaatccatctgtggggt

SEQ ID NO: 534173 - DNA, 20 bp, mouse
gttcaattgttaagctgtca

SEQ ID NO: 534174 - DNA, 20 bp, mouse
gtttcagatgggcaatattg

SEQ ID NO: 534175 - DNA, 20 bp, mouse
gcacaggtcccatttaatca

SEQ ID NO: 534176 - DNA, 20 bp, mouse
gagaaagaaagagtgaccca

SEQ ID NO: 534177 - DNA, 20 bp, mouse
gtccagtcccaggaacctaa

SEQ ID NO: 534178 - DNA, 20 bp, mouse
gctaagggcagaggctccag

SEQ ID NO: 534179 - DNA, 20 bp, mouse
gaagaaacagagtagcccaa

SEQ ID NO: 534180 - DNA, 20 bp, mouse
gtgggaggtggtgactcgga

SEQ ID NO: 534181 - DNA, 20 bp, mouse
gccacagcagcagcagatca

SEQ ID NO: 534182 - DNA, 20 bp, mouse
gacaggggccttgccaccat

SEQ ID NO: 534183 - DNA, 20 bp, mouse
gaggcttatgccctagatga

SEQ ID NO: 534184 - DNA, 20 bp, mouse
ggggcagcccatccttacct

SEQ ID NO: 534185 - DNA, 20 bp, mouse
gtcagctattccctcatcta

SEQ ID NO: 534186 - DNA, 20 bp, mouse
gcaccctgaaagatccaggt

SEQ ID NO: 534187 - DNA, 20 bp, mouse
gtgggcaccctgaaagatcc

SEQ ID NO: 534188 - DNA, 20 bp, mouse
gtcaaaactcctggcagtgt

SEQ ID NO: 534189 - DNA, 20 bp, mouse
ggcccagggtgtagtcaaaa

SEQ ID NO: 534190 - DNA, 20 bp, mouse
gggcaggcctgtggagtaaa

SEQ ID NO: 534191 - DNA, 20 bp, mouse
gggacaggaagggctccaag

SEQ ID NO: 534192 - DNA, 20 bp, mouse
ggcccttttgactacaccct

SEQ ID NO: 534193 - DNA, 20 bp, mouse
gttcaacagggttagaggag

SEQ ID NO: 534194 - DNA, 20 bp, mouse
gaggtttcctaggtctggag

SEQ ID NO: 534195 - DNA, 20 bp, mouse
ggaagggctccaagcggaac

SEQ ID NO: 534196 - DNA, 20 bp, mouse
gtcagggtccgagagagcgg

SEQ ID NO: 534197 - DNA, 20 bp, mouse
ggggtaggagggttccgcga

SEQ ID NO: 534198 - DNA, 20 bp, mouse
ggcctcagggtccgagagag

SEQ ID NO: 534199 - DNA, 20 bp, mouse
gcagaggccgaggccgccgg

SEQ ID NO: 534200 - DNA, 20 bp, mouse
gaggagggttccgcgagggt

SEQ ID NO: 534201 - DNA, 20 bp, mouse
ggcgactgggcccaccctcg

SEQ ID NO: 534202 - DNA, 20 bp, mouse
gctcggaccctgaggcgact

SEQ ID NO: 534203 - DNA, 20 bp, mouse
gaggccgccggggggtagga

SEQ ID NO: 534204 - DNA, 20 bp, mouse
gagagccgagcgggagacgt

SEQ ID NO: 534205 - DNA, 20 bp, mouse
ggcggaaccctcctaccccc

SEQ ID NO: 534206 - DNA, 20 bp, mouse
ggaggctggtcgcttcgggg

SEQ ID NO: 534207 - DNA, 20 bp, mouse
gcaggctggccggggaccgg

SEQ ID NO: 534208 - DNA, 20 bp, mouse
gctgaagtcgtgggacgtga

SEQ ID NO: 534209 - DNA, 20 bp, mouse
gggacgcgtggacgctgagg

SEQ ID NO: 534210 - DNA, 20 bp, mouse
gggcttaccgcgtctttcag

SEQ ID NO: 534211 - DNA, 20 bp, mouse
ggtgaaatcgcacggtgcag

SEQ ID NO: 534212 - DNA, 20 bp, mouse
gcagccgccgctgaaagacg

SEQ ID NO: 534213 - DNA, 20 bp, mouse
gttcagcggcggctgaggag

SEQ ID NO: 534214 - DNA, 20 bp, mouse
gaatcgcacggtgcagcggc

SEQ ID NO: 534215 - DNA, 20 bp, mouse
gggcgaggctggtcgcttcg

SEQ ID NO: 534216 - DNA, 20 bp, mouse
gggacagcagtgtggaggct

SEQ ID NO: 534217 - DNA, 20 bp, mouse
gtcctgcaaggtgtctggat

SEQ ID NO: 534218 - DNA, 20 bp, mouse
gcatggcctggtcctccctt

SEQ ID NO: 534219 - DNA, 20 bp, mouse
ggacccaggaggcccaagag

SEQ ID NO: 534220 - DNA, 20 bp, mouse
gctgcagcagcgtgcagaga

SEQ ID NO: 534221 - DNA, 20 bp, mouse
gtgcaaggtgtctggatggg

SEQ ID NO: 534222 - DNA, 20 bp, mouse
gggccacagtgaaggtgtat

SEQ ID NO: 534223 - DNA, 20 bp, mouse
ggaaaggccaatgatcggag

SEQ ID NO: 534224 - DNA, 20 bp, mouse
ggaatctagctgcccaaggg

SEQ ID NO: 534225 - DNA, 20 bp, mouse
gtcggcccaaggtcatctgg

SEQ ID NO: 534226 - DNA, 20 bp, mouse
gtgttcccggccaccctcag

SEQ ID NO: 534227 - DNA, 20 bp, mouse
gtcccggccaccctcagagg

SEQ ID NO: 534228 - DNA, 20 bp, mouse
ggccaggaacgcctaggatg

SEQ ID NO: 534229 - DNA, 20 bp, mouse
gacatcagccaggaacgcct

SEQ ID NO: 534230 - DNA, 20 bp, mouse
gccgggaacagccgcatcct

SEQ ID NO: 534231 - DNA, 20 bp, mouse
gcgttcctggctgatgtcat

SEQ ID NO: 534232 - DNA, 20 bp, mouse
ggcgcctggccaacgaccag

SEQ ID NO: 534233 - DNA, 20 bp, mouse
gtgtgcgtcctcctacccaa

SEQ ID NO: 534234 - DNA, 20 bp, mouse
gactcttggggagctccctt

SEQ ID NO: 534235 - DNA, 20 bp, mouse
gtcctcctctgagggtggcc

SEQ ID NO: 534236 - DNA, 20 bp, mouse
gaccactcctctgacaggac

SEQ ID NO: 534237 - DNA, 20 bp, mouse
gtgtgggttggaatgcacac

SEQ ID NO: 534238 - DNA, 20 bp, mouse
gtcttcaccactcctctgac

SEQ ID NO: 534239 - DNA, 20 bp, mouse
ggcgcctggcgcgaagctag

SEQ ID NO: 534240 - DNA, 20 bp, mouse
gggagcagagagagccgtcg

SEQ ID NO: 534241 - DNA, 20 bp, mouse
gtcaagtctatgtcccggag

SEQ ID NO: 534242 - DNA, 20 bp, mouse
ggccctgggctatttatcca

SEQ ID NO: 534243 - DNA, 20 bp, mouse
gtagacttgacaggccccga

SEQ ID NO: 534244 - DNA, 20 bp, mouse
gagtctatgtcccggagtgg

SEQ ID NO: 534245 - DNA, 20 bp, mouse
gtactgttggggttccggag

SEQ ID NO: 534246 - DNA, 20 bp, mouse
gaccgccagaggaacagagt

SEQ ID NO: 534247 - DNA, 20 bp, mouse
gtcactcgaagcatggctcg

SEQ ID NO: 534248 - DNA, 20 bp, mouse
ggcaccgcgtcttctctgct

SEQ ID NO: 534249 - DNA, 20 bp, mouse
ggccatgcttcgagtgattg

SEQ ID NO: 534250 - DNA, 20 bp, mouse
ggtaaacctgggaccgccag

SEQ ID NO: 534251 - DNA, 20 bp, mouse
gagacatcctcctcccaggg

SEQ ID NO: 534252 - DNA, 20 bp, mouse
gggcggtcccaggtttacct

SEQ ID NO: 534253 - DNA, 20 bp, mouse
ggacctgcccaggtaaacct

SEQ ID NO: 534254 - DNA, 20 bp, mouse
gtttgttttagggatgttag

SEQ ID NO: 534255 - DNA, 20 bp, mouse
gtccacaatcactcgaagca

SEQ ID NO: 534256 - DNA, 20 bp, mouse
gggctcctggtagaaatagg

SEQ ID NO: 534257 - DNA, 20 bp, mouse
gtcatacagctccatcaggt

SEQ ID NO: 534258 - DNA, 20 bp, mouse
gtggggctcctggtagaaat

SEQ ID NO: 534259 - DNA, 20 bp, mouse
gagctccatcaggtcggaaa

SEQ ID NO: 534260 - DNA, 20 bp, mouse
gtgtctcatacagctccatc

SEQ ID NO: 534261 - DNA, 20 bp, mouse
ggcgggagcttgggggccag

SEQ ID NO: 534262 - DNA, 20 bp, mouse
gaggggctgcgggagcttgg

SEQ ID NO: 534263 - DNA, 20 bp, mouse
gcctgctcaaccccaaccag

SEQ ID NO: 534264 - DNA, 20 bp, mouse
gtgcctgccgtgggcatgta

SEQ ID NO: 534265 - DNA, 20 bp, mouse
gaggagggcagccacactga

SEQ ID NO: 534266 - DNA, 20 bp, mouse
gctctcctgctcctcgactg

SEQ ID NO: 534267 - DNA, 20 bp, mouse
gagagaatgagggcccacct

SEQ ID NO: 534268 - DNA, 20 bp, mouse
gtgtcacttaccggtttctg

SEQ ID NO: 534269 - DNA, 20 bp, mouse
gaaaccggtaagtgacatgg

SEQ ID NO: 534270 - DNA, 20 bp, mouse
gctgctcctcgactgcggca

SEQ ID NO: 534271 - DNA, 20 bp, mouse
gccggtaagtgacatggagg

SEQ ID NO: 534272 - DNA, 20 bp, mouse
gcttgcagttccagaaacag

SEQ ID NO: 534273 - DNA, 20 bp, mouse
gctcgactgcggcagggcag

SEQ ID NO: 534274 - DNA, 20 bp, mouse
gggctagaggctggattctg

SEQ ID NO: 534275 - DNA, 20 bp, mouse
gaggggagacgggagcagta

SEQ ID NO: 534276 - DNA, 20 bp, mouse
gggaagcacagagctctgca

SEQ ID NO: 534277 - DNA, 20 bp, mouse
gtctgctggctcttctcctt

SEQ ID NO: 534278 - DNA, 20 bp, mouse
ggctgtcttgggccagtgtc

SEQ ID NO: 534279 - DNA, 20 bp, mouse
gcaaagataggcacaaagat

SEQ ID NO: 534280 - DNA, 20 bp, mouse
gagttacctgcatatactgt

SEQ ID NO: 534281 - DNA, 20 bp, mouse
ggtctgtgctcatctgagtt

SEQ ID NO: 534282 - DNA, 20 bp, mouse
gactctgaacttggccccca

SEQ ID NO: 534283 - DNA, 20 bp, mouse
gcagctgtgatattttttgg

SEQ ID NO: 534284 - DNA, 20 bp, mouse
gtgctgcacttgcttttcca

SEQ ID NO: 534285 - DNA, 20 bp, mouse
gctgtgcttccccccattta

SEQ ID NO: 534286 - DNA, 20 bp, mouse
gcagtctctaggacagtaag

SEQ ID NO: 534287 - DNA, 20 bp, mouse
gctcggctcagtgaggacgg

SEQ ID NO: 534288 - DNA, 20 bp, mouse
gtcttgtcctcggctcagtg

SEQ ID NO: 534289 - DNA, 20 bp, mouse
gagaaacagcagtgtccact

SEQ ID NO: 534290 - DNA, 20 bp, mouse
gagtcacatgtagggtgcag

SEQ ID NO: 534291 - DNA, 20 bp, mouse
ggtttctgtgagtcacatgt

SEQ ID NO: 534292 - DNA, 20 bp, mouse
gcctatgggggtggtatata

SEQ ID NO: 534293 - DNA, 20 bp, mouse
gatgtgtgtctgtgatgtac

SEQ ID NO: 534294 - DNA, 20 bp, mouse
gccccataggtcattcactg

SEQ ID NO: 534295 - DNA, 20 bp, mouse
gaacatcattgactttacat

SEQ ID NO: 534296 - DNA, 20 bp, mouse
gaacccactactgaagagaa

SEQ ID NO: 534297 - DNA, 20 bp, mouse
gctcacccttagctcagagg

SEQ ID NO: 534298 - DNA, 20 bp, mouse
gagccacgggagcctgagca

SEQ ID NO: 534299 - DNA, 20 bp, mouse
gctcccttctcttcagtagt

SEQ ID NO: 534300 - DNA, 20 bp, mouse
gggactcacccttagctcag

SEQ ID NO: 534301 - DNA, 20 bp, mouse
gctggccccctctgagctaa

SEQ ID NO: 534302 - DNA, 20 bp, mouse
gccatagcataaataaagaa

SEQ ID NO: 534303 - DNA, 20 bp, mouse
gcagtagtgggttgagacgc

SEQ ID NO: 534304 - DNA, 20 bp, mouse
ggagaagcatttccttgctc

SEQ ID NO: 534305 - DNA, 20 bp, mouse
gaggatcaaggccactgcac

SEQ ID NO: 534306 - DNA, 20 bp, mouse
gccgaagctgctggaccccg

SEQ ID NO: 534307 - DNA, 20 bp, mouse
gtgagcagctggtaagtcta

SEQ ID NO: 534308 - DNA, 20 bp, mouse
gcagctgctcagttggtggt

SEQ ID NO: 534309 - DNA, 20 bp, mouse
gtggtggtcggctctccccg

SEQ ID NO: 534310 - DNA, 20 bp, mouse
gccggggcgagcgagcgtag

SEQ ID NO: 534311 - DNA, 20 bp, mouse
gagggacctaaggagttggg

SEQ ID NO: 534312 - DNA, 20 bp, mouse
ggacttaccagctgctcagt

SEQ ID NO: 534313 - DNA, 20 bp, mouse
gacaaggagctcagaagagt

SEQ ID NO: 534314 - DNA, 20 bp, mouse
ggactagagaacctgagccg

SEQ ID NO: 534315 - DNA, 20 bp, mouse
ggcgagcgtaggggcagcac

SEQ ID NO: 534316 - DNA, 20 bp, mouse
gtttatccttgaacctggaa

SEQ ID NO: 534317 - DNA, 20 bp, mouse
gcactgaaggtggaatatga

SEQ ID NO: 534318 - DNA, 20 bp, mouse
gccttgaacctggaacggca

SEQ ID NO: 534319 - DNA, 20 bp, mouse
ggatgccagtcttctcagaa

SEQ ID NO: 534320 - DNA, 20 bp, mouse
gcctcgatctgactcaaaca

SEQ ID NO: 534321 - DNA, 20 bp, mouse
gcgagggaccatgccgttcc

SEQ ID NO: 534322 - DNA, 20 bp, mouse
gattagtcagttggccccag

SEQ ID NO: 534323 - DNA, 20 bp, mouse
ggacggcacttgggcccaat

SEQ ID NO: 534324 - DNA, 20 bp, mouse
ggttcaaggataaaacccat

SEQ ID NO: 534325 - DNA, 20 bp, mouse
ggtggaatatgacggcactt

SEQ ID NO: 534326 - DNA, 20 bp, mouse
ggctcgctgaccgctgacct

SEQ ID NO: 534327 - DNA, 20 bp, mouse
gttgcagtctcccaggtcag

SEQ ID NO: 534328 - DNA, 20 bp, mouse
gtcggccttacagagatcta

SEQ ID NO: 534329 - DNA, 20 bp, mouse
gtggtggggccacagtagat

SEQ ID NO: 534330 - DNA, 20 bp, mouse
ggggagactgcaatagacac

SEQ ID NO: 534331 - DNA, 20 bp, mouse
gaagccaggcactggctgta

SEQ ID NO: 534332 - DNA, 20 bp, mouse
gcaagattaacacttcagtc

SEQ ID NO: 534333 - DNA, 20 bp, mouse
gcagtccctagatctctgta

SEQ ID NO: 534334 - DNA, 20 bp, mouse
gctgtaaggccgagactccc

SEQ ID NO: 534335 - DNA, 20 bp, mouse
gctgtggccccaccaggtac

SEQ ID NO: 534336 - DNA, 20 bp, mouse
ggttaactcctcgctctcta

SEQ ID NO: 534337 - DNA, 20 bp, mouse
gtggctgtccatagagagcg

SEQ ID NO: 534338 - DNA, 20 bp, mouse
gaggatggctgttagaagct

SEQ ID NO: 534339 - DNA, 20 bp, mouse
ggctctggccgcggcggtga

SEQ ID NO: 534340 - DNA, 20 bp, mouse
ggaggagttaaccgtagttt

SEQ ID NO: 534341 - DNA, 20 bp, mouse
gacaaatgctctggccgcgg

SEQ ID NO: 534342 - DNA, 20 bp, mouse
gtgggcaaccgtcaccgccg

SEQ ID NO: 534343 - DNA, 20 bp, mouse
ggttaaccgtagttttggtg

SEQ ID NO: 534344 - DNA, 20 bp, mouse
ggatgaaaacgctggagaaa

SEQ ID NO: 534345 - DNA, 20 bp, mouse
gaccgtagttttggtgagga

SEQ ID NO: 534346 - DNA, 20 bp, mouse
gctgacccaccggcaggcag

SEQ ID NO: 534347 - DNA, 20 bp, mouse
ggaagccctgacccaccggc

SEQ ID NO: 534348 - DNA, 20 bp, mouse
gagccgaagccctgacccac

SEQ ID NO: 534349 - DNA, 20 bp, mouse
gtgcgcagtgctgggagaca

SEQ ID NO: 534350 - DNA, 20 bp, mouse
gcggcacggtgagtgacccg

SEQ ID NO: 534351 - DNA, 20 bp, mouse
ggtgacccgcggcccaactg

SEQ ID NO: 534352 - DNA, 20 bp, mouse
gggcgcagtagaacaggaca

SEQ ID NO: 534353 - DNA, 20 bp, mouse
ggcagcccctgcctgccggt

SEQ ID NO: 534354 - DNA, 20 bp, mouse
gaggagttagaggagaacgg

SEQ ID NO: 534355 - DNA, 20 bp, mouse
gctgggcaatgcagcagacg

SEQ ID NO: 534356 - DNA, 20 bp, mouse
ggcggcccgcgcgacagtcc

SEQ ID NO: 534357 - DNA, 20 bp, mouse
ggagcctggccggactgtac

SEQ ID NO: 534358 - DNA, 20 bp, mouse
gctgggctcccggtacagtc

SEQ ID NO: 534359 - DNA, 20 bp, mouse
gccgcgcgacagtcccggct

SEQ ID NO: 534360 - DNA, 20 bp, mouse
gaggccaaccagtctccctg

SEQ ID NO: 534361 - DNA, 20 bp, mouse
gcccgctacagcctggcccg

SEQ ID NO: 534362 - DNA, 20 bp, mouse
gagcgagcgtgaggagagcc

SEQ ID NO: 534363 - DNA, 20 bp, mouse
gctcccggtacagtccggcc

SEQ ID NO: 534364 - DNA, 20 bp, mouse
gacagtcccggctgggctcc

SEQ ID NO: 534365 - DNA, 20 bp, mouse
gcccgggggcgcggcatcgc

SEQ ID NO: 534366 - DNA, 20 bp, mouse
gatcacgaagagggaagtaa

SEQ ID NO: 534367 - DNA, 20 bp, mouse
gaaaggcgtgcagccacaca

SEQ ID NO: 534368 - DNA, 20 bp, mouse
ggaaaaaaaaatcacgaaga

SEQ ID NO: 534369 - DNA, 20 bp, mouse
gcatggtgctggggttctaa

SEQ ID NO: 534370 - DNA, 20 bp, mouse
ggaggtctcatagctcctgt

SEQ ID NO: 534371 - DNA, 20 bp, mouse
ggaagcgtaagtggactccg

SEQ ID NO: 534372 - DNA, 20 bp, mouse
gaggctcagagaagaaaccg

SEQ ID NO: 534373 - DNA, 20 bp, mouse
gaagagcccactgggcacca

SEQ ID NO: 534374 - DNA, 20 bp, mouse
gaatggcaaatctatctctc

SEQ ID NO: 534375 - DNA, 20 bp, mouse
ggatgtgctgggtgaaaacg

SEQ ID NO: 534376 - DNA, 20 bp, mouse
gggcagcgcgggcaggacga

SEQ ID NO: 534377 - DNA, 20 bp, mouse
gcgcagtcacagcgggagcc

SEQ ID NO: 534378 - DNA, 20 bp, mouse
gacgagggcgcgcggcgcga

SEQ ID NO: 534379 - DNA, 20 bp, mouse
gtcccgaggctgcagatcgc

SEQ ID NO: 534380 - DNA, 20 bp, mouse
gactccaggccggccacccc

SEQ ID NO: 534381 - DNA, 20 bp, mouse
gtcgagctgcgggcgcggag

SEQ ID NO: 534382 - DNA, 20 bp, mouse
gcgtccagcgcgcgatcccg

SEQ ID NO: 534383 - DNA, 20 bp, mouse
gccgcggcggagctcatgga

SEQ ID NO: 534384 - DNA, 20 bp, mouse
ggcctggagtgggtccgcgg

SEQ ID NO: 534385 - DNA, 20 bp, mouse
ggcgcggaggggagagctgg

SEQ ID NO: 534386 - DNA, 20 bp, mouse
ggcgtcaggtgcagtcatgg

SEQ ID NO: 534387 - DNA, 20 bp, mouse
gtcaggtgcagtcatggagg

SEQ ID NO: 534388 - DNA, 20 bp, mouse
ggcagtcatggaggcggagg

SEQ ID NO: 534389 - DNA, 20 bp, mouse
gcctgcgtcaggtgcagtca

SEQ ID NO: 534390 - DNA, 20 bp, mouse
gggtgcagtcatggaggcgg

SEQ ID NO: 534391 - DNA, 20 bp, mouse
ggtggaaggagatgttgcgg

SEQ ID NO: 534392 - DNA, 20 bp, mouse
gtcgcgagtacgcctgcgtc

SEQ ID NO: 534393 - DNA, 20 bp, mouse
gagacagcgcgaatgcaggt

SEQ ID NO: 534394 - DNA, 20 bp, mouse
gagataaacagtgcaacctg

SEQ ID NO: 534395 - DNA, 20 bp, mouse
gtgcggcggctgcacagccg

SEQ ID NO: 534396 - DNA, 20 bp, mouse
gtagcagcggtggcacgggc

SEQ ID NO: 534397 - DNA, 20 bp, mouse
gtggagccccaagggttcat

SEQ ID NO: 534398 - DNA, 20 bp, mouse
gccgctctcattagcagcgg

SEQ ID NO: 534399 - DNA, 20 bp, mouse
gtgaccgctctcattagcag

SEQ ID NO: 534400 - DNA, 20 bp, mouse
gtcattagcagcggtggcac

SEQ ID NO: 534401 - DNA, 20 bp, mouse
gatgggtagcgtatttacaa

SEQ ID NO: 534402 - DNA, 20 bp, mouse
ggaactcctaagccagctaa

SEQ ID NO: 534403 - DNA, 20 bp, mouse
gcacgtgactgcggtgaggg

SEQ ID NO: 534404 - DNA, 20 bp, mouse
gtgacaaaggcagataccca

SEQ ID NO: 534405 - DNA, 20 bp, mouse
gtaggagttcgcacactgag

SEQ ID NO: 534406 - DNA, 20 bp, mouse
ggaccacgcatagcaccgag

SEQ ID NO: 534407 - DNA, 20 bp, mouse
gttgtgtgcagtagcttagg

SEQ ID NO: 534408 - DNA, 20 bp, mouse
ggaggtaaagcagatctctt

SEQ ID NO: 534409 - DNA, 20 bp, mouse
gatgcagcaggagaggctag

SEQ ID NO: 534410 - DNA, 20 bp, mouse
gggcctccaagaagactgca

SEQ ID NO: 534411 - DNA, 20 bp, mouse
gtagggggaaaatgtcgcgc

SEQ ID NO: 534412 - DNA, 20 bp, mouse
gcattaggggctggctgtgg

SEQ ID NO: 534413 - DNA, 20 bp, mouse
ggtggagctgcgtgcattag

SEQ ID NO: 534414 - DNA, 20 bp, mouse
gccacaccgctcacaagtga

SEQ ID NO: 534415 - DNA, 20 bp, mouse
gctcggcctcccacttgtgg

SEQ ID NO: 534416 - DNA, 20 bp, mouse
gcgcagcggctgtggagcaa

SEQ ID NO: 534417 - DNA, 20 bp, mouse
ggggtgcccgcgctgctccg

SEQ ID NO: 534418 - DNA, 20 bp, mouse
ggtctgagcctcccccgcgt

SEQ ID NO: 534419 - DNA, 20 bp, mouse
ggcggctgtggagcaagggc

SEQ ID NO: 534420 - DNA, 20 bp, mouse
ggctcagacactagaagcta

SEQ ID NO: 534421 - DNA, 20 bp, mouse
gccggggcaggataagcgtg

SEQ ID NO: 534422 - DNA, 20 bp, mouse
gtccagagggagggtcactg

SEQ ID NO: 534423 - DNA, 20 bp, mouse
gccgcctcgggagcatccag

SEQ ID NO: 534424 - DNA, 20 bp, mouse
gctcccgaggcgggaagaga

SEQ ID NO: 534425 - DNA, 20 bp, mouse
ggccccatctgtagggatgt

SEQ ID NO: 534426 - DNA, 20 bp, mouse
gacagtagcaacagtggcag

SEQ ID NO: 534427 - DNA, 20 bp, mouse
gctccaagaagtaagttcag

SEQ ID NO: 534428 - DNA, 20 bp, mouse
gcgggtgcagggctatcctg

SEQ ID NO: 534429 - DNA, 20 bp, mouse
ggagagggaaaccctatccc

SEQ ID NO: 534430 - DNA, 20 bp, mouse
ggtgggagccgaagccgaga

SEQ ID NO: 534431 - DNA, 20 bp, mouse
gctggggattgaaggctcaa

SEQ ID NO: 534432 - DNA, 20 bp, mouse
ggctatcctggggagcgccg

SEQ ID NO: 534433 - DNA, 20 bp, mouse
gtacctggaaggccacagcc

SEQ ID NO: 534434 - DNA, 20 bp, mouse
gggagcacaggctgtggtcg

SEQ ID NO: 534435 - DNA, 20 bp, mouse
ggccaggcctgctgggggac

SEQ ID NO: 534436 - DNA, 20 bp, mouse
gcgtgcacaatcctctcggg

SEQ ID NO: 534437 - DNA, 20 bp, mouse
ggcatgcgcagtctggaagg

SEQ ID NO: 534438 - DNA, 20 bp, mouse
gaattcgtggccgggagtgt

SEQ ID NO: 534439 - DNA, 20 bp, mouse
ggaatccgttgccccccgag

SEQ ID NO: 534440 - DNA, 20 bp, mouse
gcgacgtgcacaatcctctc

SEQ ID NO: 534441 - DNA, 20 bp, mouse
ggccacgaattcaggcgtca

SEQ ID NO: 534442 - DNA, 20 bp, mouse
gcccctagggacgggaagaa

SEQ ID NO: 534443 - DNA, 20 bp, mouse
gagtgtgggaagagacgtcc

SEQ ID NO: 534444 - DNA, 20 bp, mouse
gggggcatgcgcagtctgga

SEQ ID NO: 534445 - DNA, 20 bp, mouse
gaggattgtgcacgtcgtcg

SEQ ID NO: 534446 - DNA, 20 bp, mouse
ggcctcggccaacctgaacg

SEQ ID NO: 534447 - DNA, 20 bp, mouse
gcggtgagggagaccatgga

SEQ ID NO: 534448 - DNA, 20 bp, mouse
ggggccgctaccgctcgcca

SEQ ID NO: 534449 - DNA, 20 bp, mouse
gtctccatggcgagcggtag

SEQ ID NO: 534450 - DNA, 20 bp, mouse
gagaggagaggcccccgccc

SEQ ID NO: 534451 - DNA, 20 bp, mouse
gaacgcggtgagggagacca

SEQ ID NO: 534452 - DNA, 20 bp, mouse
gtccctcaccgcgttcaggt

SEQ ID NO: 534453 - DNA, 20 bp, mouse
ggcggaagaccggagctctg

SEQ ID NO: 534454 - DNA, 20 bp, mouse
ggagaggcccccgccccggt

SEQ ID NO: 534455 - DNA, 20 bp, mouse
ggccaacctgaacgcggtga

SEQ ID NO: 534456 - DNA, 20 bp, mouse
gagtgtgctaggcatggggt

SEQ ID NO: 534457 - DNA, 20 bp, mouse
gtatttcggggtcgggggac

SEQ ID NO: 534458 - DNA, 20 bp, mouse
gcccaagtttatgtatttcg

SEQ ID NO: 534459 - DNA, 20 bp, mouse
gttatgtatttcggggtcgg

SEQ ID NO: 534460 - DNA, 20 bp, mouse
ggtcaacagctccagcaccg

SEQ ID NO: 534461 - DNA, 20 bp, mouse
gtatgccaggtactattctg

SEQ ID NO: 534462 - DNA, 20 bp, mouse
gggggagtaaagagcaactg

SEQ ID NO: 534463 - DNA, 20 bp, mouse
ggctatacgaatggcggcgg

SEQ ID NO: 534464 - DNA, 20 bp, mouse
gtagggaccgtcaacagaac

SEQ ID NO: 534465 - DNA, 20 bp, mouse
gccgaggcgagagttccaag

SEQ ID NO: 534466 - DNA, 20 bp, mouse
gcagcacgtcggctctggag

SEQ ID NO: 534467 - DNA, 20 bp, mouse
ggccgagcaccgggagcggg

SEQ ID NO: 534468 - DNA, 20 bp, mouse
gctgggccgagcaccgggag

SEQ ID NO: 534469 - DNA, 20 bp, mouse
ggcggcacgacaggctgagg

SEQ ID NO: 534470 - DNA, 20 bp, mouse
gcgggcggcacgacaggctg

SEQ ID NO: 534471 - DNA, 20 bp, mouse
ggcacgacaggctgaggcgg

SEQ ID NO: 534472 - DNA, 20 bp, mouse
gttgcacaggggccccgtgg

SEQ ID NO: 534473 - DNA, 20 bp, mouse
ggacgtgctgggccgagcac

SEQ ID NO: 534474 - DNA, 20 bp, mouse
gtcggctctggagcggccgt

SEQ ID NO: 534475 - DNA, 20 bp, mouse
gggactgtcccggtaagcga

SEQ ID NO: 534476 - DNA, 20 bp, mouse
ggcatgcgtggcggctgtgg

SEQ ID NO: 534477 - DNA, 20 bp, mouse
gctgccccgctgccccgcca

SEQ ID NO: 534478 - DNA, 20 bp, mouse
ggggcggcgagtttccacaa

SEQ ID NO: 534479 - DNA, 20 bp, mouse
gagcgcatgcgtggcggctg

SEQ ID NO: 534480 - DNA, 20 bp, mouse
gcggcgagtttccacaacgg

SEQ ID NO: 534481 - DNA, 20 bp, mouse
ggtgctcggcgccctcgggg

SEQ ID NO: 534482 - DNA, 20 bp, mouse
ggggcgccgggggccagcgg

SEQ ID NO: 534483 - DNA, 20 bp, mouse
gacggcccacgcctcctgag

SEQ ID NO: 534484 - DNA, 20 bp, mouse
gccgctacaccatcacgaca

SEQ ID NO: 534485 - DNA, 20 bp, mouse
gtcgcgaagggtgcgttggt

SEQ ID NO: 534486 - DNA, 20 bp, mouse
ggccgcgccggagagcgtag

SEQ ID NO: 534487 - DNA, 20 bp, mouse
gcggagagcgtagtggctgg

SEQ ID NO: 534488 - DNA, 20 bp, mouse
ggagcgcggagtcccagagg

SEQ ID NO: 534489 - DNA, 20 bp, mouse
gcgagagacgcggcaacccc

SEQ ID NO: 534490 - DNA, 20 bp, mouse
gagagcgtagtggctggcgg

SEQ ID NO: 534491 - DNA, 20 bp, mouse
gcgccggagagcgtagtggc

SEQ ID NO: 534492 - DNA, 20 bp, mouse
gcgggagcgcggagtcccag

SEQ ID NO: 534493 - DNA, 20 bp, mouse
gccgctcccgcagcaggtaa

SEQ ID NO: 534494 - DNA, 20 bp, mouse
gaagagcgggaggggatccc

SEQ ID NO: 534495 - DNA, 20 bp, mouse
ggggcggcgagcgagagacg

SEQ ID NO: 534496 - DNA, 20 bp, mouse
gaagaccgtgacttcaggaa

SEQ ID NO: 534497 - DNA, 20 bp, mouse
ggaggccgcgcaggaggtag

SEQ ID NO: 534498 - DNA, 20 bp, mouse
gtggccaagaccgtgacttc

SEQ ID NO: 534499 - DNA, 20 bp, mouse
gagctcccttcctgaagtca

SEQ ID NO: 534500 - DNA, 20 bp, mouse
gacctcctgcgcggcctccc

SEQ ID NO: 534501 - DNA, 20 bp, mouse
gggccatgtgatagatggag

SEQ ID NO: 534502 - DNA, 20 bp, mouse
gaactgtcctccatggggag

SEQ ID NO: 534503 - DNA, 20 bp, mouse
gccagaaaactgtcctccat

SEQ ID NO: 534504 - DNA, 20 bp, mouse
gtcggggcaggagcgcgagt

SEQ ID NO: 534505 - DNA, 20 bp, mouse
ggctggccaggtaatgagag

SEQ ID NO: 534506 - DNA, 20 bp, mouse
ggagcgatgggtcccggtgg

SEQ ID NO: 534507 - DNA, 20 bp, mouse
gccaaaacgtagctattaaa

SEQ ID NO: 534508 - DNA, 20 bp, mouse
gggagctggaaagagacgcg

SEQ ID NO: 534509 - DNA, 20 bp, mouse
ggcatgggtaatcctagagg

SEQ ID NO: 534510 - DNA, 20 bp, mouse
gtgggtcccggtggaggtga

SEQ ID NO: 534511 - DNA, 20 bp, mouse
gagagctgtgtcaaagccgg

SEQ ID NO: 534512 - DNA, 20 bp, mouse
ggctgcatgggtaatcctag

SEQ ID NO: 534513 - DNA, 20 bp, mouse
gacagagcgatgggtcccgg

SEQ ID NO: 534514 - DNA, 20 bp, mouse
ggaatccggggaggtcccga

SEQ ID NO: 534515 - DNA, 20 bp, mouse
gcccaaggcctcctgaccgg

SEQ ID NO: 534516 - DNA, 20 bp, mouse
gcgtccgctggccccagaga

SEQ ID NO: 534517 - DNA, 20 bp, mouse
ggaacgcgcgggagccggat

SEQ ID NO: 534518 - DNA, 20 bp, mouse
gcgctggccccagagacgga

SEQ ID NO: 534519 - DNA, 20 bp, mouse
gggcgggcaaaggacgcact

SEQ ID NO: 534520 - DNA, 20 bp, mouse
gcgcgcgggagccggatcgg

SEQ ID NO: 534521 - DNA, 20 bp, mouse
ggagccggatcggcgggcaa

SEQ ID NO: 534522 - DNA, 20 bp, mouse
gcgcgggagcagaggacacc

SEQ ID NO: 534523 - DNA, 20 bp, mouse
gcccacgccgcagctaggag

SEQ ID NO: 534524 - DNA, 20 bp, mouse
gcgcgcgggtgagtcaggcc

SEQ ID NO: 534525 - DNA, 20 bp, mouse
ggcgcgttcccgaagagcct

SEQ ID NO: 534526 - DNA, 20 bp, mouse
ggacccacgtgcccgtacaa

SEQ ID NO: 534527 - DNA, 20 bp, mouse
gacaacggcgtggggacact

SEQ ID NO: 534528 - DNA, 20 bp, mouse
ggtactcaacgcccgcccat

SEQ ID NO: 534529 - DNA, 20 bp, mouse
gccgcccataggaagcggaa

SEQ ID NO: 534530 - DNA, 20 bp, mouse
gtgtccccacgccgttgtac

SEQ ID NO: 534531 - DNA, 20 bp, mouse
gcgtgcccgtacaacggcgt

SEQ ID NO: 534532 - DNA, 20 bp, mouse
gcaccacttccggaggaggg

SEQ ID NO: 534533 - DNA, 20 bp, mouse
ggccggcccaccacttccgg

SEQ ID NO: 534534 - DNA, 20 bp, mouse
gaactccggctgctcctcag

SEQ ID NO: 534535 - DNA, 20 bp, mouse
gcgctggctcgtacacgtcg

SEQ ID NO: 534536 - DNA, 20 bp, mouse
gtggcggccacggagtgtgg

SEQ ID NO: 534537 - DNA, 20 bp, mouse
gcgcatgcgtcagtggtgag

SEQ ID NO: 534538 - DNA, 20 bp, mouse
gacgactgcgcatgcgtcag

SEQ ID NO: 534539 - DNA, 20 bp, mouse
gcagtggtgagtggcggcca

SEQ ID NO: 534540 - DNA, 20 bp, mouse
gcctccgccgccacactccg

SEQ ID NO: 534541 - DNA, 20 bp, mouse
gtgtggcggcggagggtcaa

SEQ ID NO: 534542 - DNA, 20 bp, mouse
ggagtggcggccacggagtg

SEQ ID NO: 534543 - DNA, 20 bp, mouse
gcggccacggagtgtggcgg

SEQ ID NO: 534544 - DNA, 20 bp, mouse
gaagtctccaagggtcagta

SEQ ID NO: 534545 - DNA, 20 bp, mouse
gcgcagtcgtcacagtgcgg

SEQ ID NO: 534546 - DNA, 20 bp, mouse
gcgtgaacgcgtgcactcgg

SEQ ID NO: 534547 - DNA, 20 bp, mouse
gggactggggccaggatcct

SEQ ID NO: 534548 - DNA, 20 bp, mouse
gcgctgcaggcaggtcggag

SEQ ID NO: 534549 - DNA, 20 bp, mouse
ggacgataggagcttggact

SEQ ID NO: 534550 - DNA, 20 bp, mouse
gctgcagcagccttaaggtc

SEQ ID NO: 534551 - DNA, 20 bp, mouse
gcagccttaaggtccggcgt

SEQ ID NO: 534552 - DNA, 20 bp, mouse
gggtcgtgaacgcgtgcact

SEQ ID NO: 534553 - DNA, 20 bp, mouse
gcaggatcctgggacggcgg

SEQ ID NO: 534554 - DNA, 20 bp, mouse
gcctgggacggcggcggaaa

SEQ ID NO: 534555 - DNA, 20 bp, mouse
gccggcgtcggcagacctac

SEQ ID NO: 534556 - DNA, 20 bp, mouse
gggccaggccgagcagagac

SEQ ID NO: 534557 - DNA, 20 bp, mouse
gccgctgaggtccattgcca

SEQ ID NO: 534558 - DNA, 20 bp, mouse
gcaggccgagcagagaccgg

SEQ ID NO: 534559 - DNA, 20 bp, mouse
ggccgagcagagaccggtgg

SEQ ID NO: 534560 - DNA, 20 bp, mouse
gggcgtcgttgccttggcaa

SEQ ID NO: 534561 - DNA, 20 bp, mouse
gcccgtggggaacatcatcg

SEQ ID NO: 534562 - DNA, 20 bp, mouse
ggtcgtcgggccgggcattg

SEQ ID NO: 534563 - DNA, 20 bp, mouse
gatgaggacggcaagatcgt

SEQ ID NO: 534564 - DNA, 20 bp, mouse
gtggcgggaaggcctacggg

SEQ ID NO: 534565 - DNA, 20 bp, mouse
ggaaggcctacgggcggaag

SEQ ID NO: 534566 - DNA, 20 bp, mouse
gcgccgacggagacccggga

SEQ ID NO: 534567 - DNA, 20 bp, mouse
ggaaccgccgacggagaccc

SEQ ID NO: 534568 - DNA, 20 bp, mouse
gccccctcccgggtctccgt

SEQ ID NO: 534569 - DNA, 20 bp, mouse
gtaactgaaaagaccgacag

SEQ ID NO: 534570 - DNA, 20 bp, mouse
ggaccccggaggcctagtgg

SEQ ID NO: 534571 - DNA, 20 bp, mouse
ggctgaagtgagctcgggaa

SEQ ID NO: 534572 - DNA, 20 bp, mouse
gagctcgggaacggcagtgg

SEQ ID NO: 534573 - DNA, 20 bp, mouse
gtctccgtcggcggttcacg

SEQ ID NO: 534574 - DNA, 20 bp, mouse
gacagaggcagccaaaatgg

SEQ ID NO: 534575 - DNA, 20 bp, mouse
gttaccacgtgaaccgccga

SEQ ID NO: 534576 - DNA, 20 bp, mouse
gtacctcggcgggatgccac

SEQ ID NO: 534577 - DNA, 20 bp, mouse
gatcccgccgaggtaacccg

SEQ ID NO: 534578 - DNA, 20 bp, mouse
gtccagtgggcggcccggga

SEQ ID NO: 534579 - DNA, 20 bp, mouse
gcccgggccgcgggttacct

SEQ ID NO: 534580 - DNA, 20 bp, mouse
ggtggggagctccagagtca

SEQ ID NO: 534581 - DNA, 20 bp, mouse
ggggccgcgggttacctcgg

SEQ ID NO: 534582 - DNA, 20 bp, mouse
ggaacacagcgcactccagt

SEQ ID NO: 534583 - DNA, 20 bp, mouse
gtccctcccgggccgcccac

SEQ ID NO: 534584 - DNA, 20 bp, mouse
gcacagcgcactccagtggg

SEQ ID NO: 534585 - DNA, 20 bp, mouse
gttcccgtggcatcccgccg

SEQ ID NO: 534586 - DNA, 20 bp, mouse
ggtcgcgccgagcgggttgg

SEQ ID NO: 534587 - DNA, 20 bp, mouse
gcggtgcgcccgggatgatg

SEQ ID NO: 534588 - DNA, 20 bp, mouse
gggggtcgcgccgagcgggt

SEQ ID NO: 534589 - DNA, 20 bp, mouse
ggtgaggccgcctcagggag

SEQ ID NO: 534590 - DNA, 20 bp, mouse
gccgcgggcgcgagtacttc

SEQ ID NO: 534591 - DNA, 20 bp, mouse
gcgagtacttccggtagtgc

SEQ ID NO: 534592 - DNA, 20 bp, mouse
gcgccagcctccaacccgct

SEQ ID NO: 534593 - DNA, 20 bp, mouse
gcccggctccgcatcatccc

SEQ ID NO: 534594 - DNA, 20 bp, mouse
ggcgcctcggccaaggtcac

SEQ ID NO: 534595 - DNA, 20 bp, mouse
gccgcagtgaggccgcctca

SEQ ID NO: 534596 - DNA, 20 bp, mouse
gtgtgcaggaccctaacgac

SEQ ID NO: 534597 - DNA, 20 bp, mouse
gccggaggcgccggtcgtta

SEQ ID NO: 534598 - DNA, 20 bp, mouse
gcccggaggcgacaagacaa

SEQ ID NO: 534599 - DNA, 20 bp, mouse
ggcgacgcggggccatgtgc

SEQ ID NO: 534600 - DNA, 20 bp, mouse
gggttctgcgcttgtcatca

SEQ ID NO: 534601 - DNA, 20 bp, mouse
ggtactcaccgtaaatgggc

SEQ ID NO: 534602 - DNA, 20 bp, mouse
gggctaacagaccgactccg

SEQ ID NO: 534603 - DNA, 20 bp, mouse
gggggtccgcgcctaagcga

SEQ ID NO: 534604 - DNA, 20 bp, mouse
gctcaccgtaaatgggccgg

SEQ ID NO: 534605 - DNA, 20 bp, mouse
gacggtgagtaccccggagt

SEQ ID NO: 534606 - DNA, 20 bp, mouse
gcgggtgagaggctcggcag

SEQ ID NO: 534607 - DNA, 20 bp, mouse
ggccgaggcggggggaacaa

SEQ ID NO: 534608 - DNA, 20 bp, mouse
gcaggcgaggcgctttacgg

SEQ ID NO: 534609 - DNA, 20 bp, mouse
gctcgggcggccagggacgg

SEQ ID NO: 534610 - DNA, 20 bp, mouse
ggagaggaggccatgagagg

SEQ ID NO: 534611 - DNA, 20 bp, mouse
ggcgcggcgttggggacact

SEQ ID NO: 534612 - DNA, 20 bp, mouse
ggaagcgacacagccgagag

SEQ ID NO: 534613 - DNA, 20 bp, mouse
ggcgcctgcggccccagcgg

SEQ ID NO: 534614 - DNA, 20 bp, mouse
ggcgttggggacactcggtg

SEQ ID NO: 534615 - DNA, 20 bp, mouse
ggcggcggtgaaggcgactg

SEQ ID NO: 534616 - DNA, 20 bp, mouse
ggcggcggcgacggtattgt

SEQ ID NO: 534617 - DNA, 20 bp, mouse
gctcgtcgcccgggcgacac

SEQ ID NO: 534618 - DNA, 20 bp, mouse
gactgagaccgagatcgagg

SEQ ID NO: 534619 - DNA, 20 bp, mouse
gtcctcgccgcgcctcgggt

SEQ ID NO: 534620 - DNA, 20 bp, mouse
gcactccctgagatccgcca

SEQ ID NO: 534621 - DNA, 20 bp, mouse
gcggtgggccagggtctctg

SEQ ID NO: 534622 - DNA, 20 bp, mouse
gggtcgtgggaaagtatccg

SEQ ID NO: 534623 - DNA, 20 bp, mouse
ggatctcagggagtgggcac

SEQ ID NO: 534624 - DNA, 20 bp, mouse
ggccactgagaccgagatcg

SEQ ID NO: 534625 - DNA, 20 bp, mouse
gctcagggagtgggcaccgg

SEQ ID NO: 534626 - DNA, 20 bp, mouse
gaggtcccgggaatctgcga

SEQ ID NO: 534627 - DNA, 20 bp, mouse
ggagcacgggaggcccggag

SEQ ID NO: 534628 - DNA, 20 bp, mouse
gagcgggcgcgaagctgtcc

SEQ ID NO: 534629 - DNA, 20 bp, mouse
gagctgtccgggtttctgtc

SEQ ID NO: 534630 - DNA, 20 bp, mouse
gcgagactctgaggcctcag

SEQ ID NO: 534631 - DNA, 20 bp, mouse
ggtcatgctgctgggcccgg

SEQ ID NO: 534632 - DNA, 20 bp, mouse
gacaccgcccgacagaaacc

SEQ ID NO: 534633 - DNA, 20 bp, mouse
gagcagcccgccggaggata

SEQ ID NO: 534634 - DNA, 20 bp, mouse
gacgggaggcccggagtggt

SEQ ID NO: 534635 - DNA, 20 bp, mouse
gtgtccgggtttctgtcggg

SEQ ID NO: 534636 - DNA, 20 bp, mouse
ggcccgtagggaggtggcaa

SEQ ID NO: 534637 - DNA, 20 bp, mouse
gcgtagggaggtggcaacgg

SEQ ID NO: 534638 - DNA, 20 bp, mouse
ggcacttgcccgtagggagg

SEQ ID NO: 534639 - DNA, 20 bp, mouse
gctacgggcaagtgcgagag

SEQ ID NO: 534640 - DNA, 20 bp, mouse
gctcgcacttgcccgtaggg

SEQ ID NO: 534641 - DNA, 20 bp, mouse
gtgaggacgcagagggtgaa

SEQ ID NO: 534642 - DNA, 20 bp, mouse
ggcctcacttacccccatgg

SEQ ID NO: 534643 - DNA, 20 bp, mouse
gaacccgagcgacagcgaag

SEQ ID NO: 534644 - DNA, 20 bp, mouse
gcgcagaaccggaccagagt

SEQ ID NO: 534645 - DNA, 20 bp, mouse
gggtcacgtgagactgtaag

SEQ ID NO: 534646 - DNA, 20 bp, mouse
gtgcacgtgtggaggagcgg

SEQ ID NO: 534647 - DNA, 20 bp, mouse
gctccgggcgacgaggacga

SEQ ID NO: 534648 - DNA, 20 bp, mouse
gacgacggcctcagcagacg

SEQ ID NO: 534649 - DNA, 20 bp, mouse
gagcagacggggaagatgaa

SEQ ID NO: 534650 - DNA, 20 bp, mouse
gcacgtgcactcgggacact

SEQ ID NO: 534651 - DNA, 20 bp, mouse
gcggagagctccgggcgacg

SEQ ID NO: 534652 - DNA, 20 bp, mouse
gacgaggacgacggcgttgg

SEQ ID NO: 534653 - DNA, 20 bp, mouse
gggcgcgggcggagagctcc

SEQ ID NO: 534654 - DNA, 20 bp, mouse
ggtcccgagtgcacgtgtgg

SEQ ID NO: 534655 - DNA, 20 bp, mouse
gcacagcgcggcggcgggtc

SEQ ID NO: 534656 - DNA, 20 bp, mouse
ggcgcaggctgacctcgctg

SEQ ID NO: 534657 - DNA, 20 bp, mouse
gcaggtgtgaatgacagagg

SEQ ID NO: 534658 - DNA, 20 bp, mouse
gccacaggtgtgaatgacag

SEQ ID NO: 534659 - DNA, 20 bp, mouse
gtatgtcatcgtggcagagg

SEQ ID NO: 534660 - DNA, 20 bp, mouse
gcctcgctgagggcgctgga

SEQ ID NO: 534661 - DNA, 20 bp, mouse
ggggtctggcaggaccataa

SEQ ID NO: 534662 - DNA, 20 bp, mouse
gagcagacacagagacctga

SEQ ID NO: 534663 - DNA, 20 bp, mouse
ggggaaaccagtcgccacac

SEQ ID NO: 534664 - DNA, 20 bp, mouse
ggagcccaacactcactcaa

SEQ ID NO: 534665 - DNA, 20 bp, mouse
gtgcagtgctgctactaagg

SEQ ID NO: 534666 - DNA, 20 bp, mouse
gctcagaagccggagctatg

SEQ ID NO: 534667 - DNA, 20 bp, mouse
gcggcttctgaggccaccac

SEQ ID NO: 534668 - DNA, 20 bp, mouse
gcacgcggccctggtggcta

SEQ ID NO: 534669 - DNA, 20 bp, mouse
gatggggaccctagccacca

SEQ ID NO: 534670 - DNA, 20 bp, mouse
gcagggccaggtgtgcccca

SEQ ID NO: 534671 - DNA, 20 bp, mouse
gaccagggccgcgtgccatg

SEQ ID NO: 534672 - DNA, 20 bp, mouse
gcgcggtgcgcaagaagtct

SEQ ID NO: 534673 - DNA, 20 bp, mouse
gcaggacagcaaagattcat

SEQ ID NO: 534674 - DNA, 20 bp, mouse
gtgcagcggtgagagggtag

SEQ ID NO: 534675 - DNA, 20 bp, mouse
gacagccgacagccagggac

SEQ ID NO: 534676 - DNA, 20 bp, mouse
ggacaagggaaactctagag

SEQ ID NO: 534677 - DNA, 20 bp, mouse
ggaagcagcctgctcccccg

SEQ ID NO: 534678 - DNA, 20 bp, mouse
gagaggagttggaagccccg

SEQ ID NO: 534679 - DNA, 20 bp, mouse
gggatagctaagatgagaag

SEQ ID NO: 534680 - DNA, 20 bp, mouse
gcaaggcctaggcatctccg

SEQ ID NO: 534681 - DNA, 20 bp, mouse
gactgcaactgcaggcctgg

SEQ ID NO: 534682 - DNA, 20 bp, mouse
gggcctgcagttgcagtcag

SEQ ID NO: 534683 - DNA, 20 bp, mouse
gaggagacctcatcgcaggg

SEQ ID NO: 534684 - DNA, 20 bp, mouse
gagggctgggatgtgttcgg

SEQ ID NO: 534685 - DNA, 20 bp, mouse
gtgagtctgcctgcagtgga

SEQ ID NO: 534686 - DNA, 20 bp, mouse
ggcactgggtgaaaatacta

SEQ ID NO: 534687 - DNA, 20 bp, mouse
gaagagcgcagcagccccta

SEQ ID NO: 534688 - DNA, 20 bp, mouse
gcaggatccgagagaacctt

SEQ ID NO: 534689 - DNA, 20 bp, mouse
gtgggtgaaaatactagggg

SEQ ID NO: 534690 - DNA, 20 bp, mouse
gaatctcagccaggactgca

SEQ ID NO: 534691 - DNA, 20 bp, mouse
gggagagtggaatgtatcag

SEQ ID NO: 534692 - DNA, 20 bp, mouse
gctgtttccacaggatgcac

SEQ ID NO: 534693 - DNA, 20 bp, mouse
gctgaagtgctggaggtcag

SEQ ID NO: 534694 - DNA, 20 bp, mouse
gttctctgcagggtgcgcag

SEQ ID NO: 534695 - DNA, 20 bp, mouse
gggaaacagccctgcagtcc

SEQ ID NO: 534696 - DNA, 20 bp, mouse
gggccgcgtaggtaccggga

SEQ ID NO: 534697 - DNA, 20 bp, mouse
ggaagaaagcggagactcag

SEQ ID NO: 534698 - DNA, 20 bp, mouse
gtaccgggagggcctcgaga

SEQ ID NO: 534699 - DNA, 20 bp, mouse
gccgcagctgcgggccgcgt

SEQ ID NO: 534700 - DNA, 20 bp, mouse
gcccccgcgcccatcgaggg

SEQ ID NO: 534701 - DNA, 20 bp, mouse
gctgcgggccgcgtaggtac

SEQ ID NO: 534702 - DNA, 20 bp, mouse
gctccatctcgaggccctcc

SEQ ID NO: 534703 - DNA, 20 bp, mouse
gcgtcccccgcccgccccga

SEQ ID NO: 534704 - DNA, 20 bp, mouse
gcccgcccggcaggacgcga

SEQ ID NO: 534705 - DNA, 20 bp, mouse
gggccctcccggtacctacg

SEQ ID NO: 534706 - DNA, 20 bp, mouse
gcgccgggcaccgagagggg

SEQ ID NO: 534707 - DNA, 20 bp, mouse
gagcgcagccggggaggtgg

SEQ ID NO: 534708 - DNA, 20 bp, mouse
gacgcacagggagcgaggcc

SEQ ID NO: 534709 - DNA, 20 bp, mouse
gctccctgtgcgtcctgcgg

SEQ ID NO: 534710 - DNA, 20 bp, mouse
ggcaggcgccgggcaccgag

SEQ ID NO: 534711 - DNA, 20 bp, mouse
gctcccccgcaggacgcaca

SEQ ID NO: 534712 - DNA, 20 bp, mouse
gagggacggagcctggacag

SEQ ID NO: 534713 - DNA, 20 bp, mouse
gggctccgagagagaagacg

SEQ ID NO: 534714 - DNA, 20 bp, mouse
gagggcgtgggcagaaccgg

SEQ ID NO: 534715 - DNA, 20 bp, mouse
gggcacagacagaggcgcgg

SEQ ID NO: 534716 - DNA, 20 bp, mouse
gtcaggaagcggtaattcag

SEQ ID NO: 534717 - DNA, 20 bp, mouse
gagagccggggagcaacctg

SEQ ID NO: 534718 - DNA, 20 bp, mouse
ggagcccgctcccaagtggg

SEQ ID NO: 534719 - DNA, 20 bp, mouse
gccgggtaaaccagccctag

SEQ ID NO: 534720 - DNA, 20 bp, mouse
gacgtgacagcaaaacggca

SEQ ID NO: 534721 - DNA, 20 bp, mouse
gcgcgcgccccctccgtccc

SEQ ID NO: 534722 - DNA, 20 bp, mouse
gcacgtagcgagccagagga

SEQ ID NO: 534723 - DNA, 20 bp, mouse
gaagaggtccgagctctcga

SEQ ID NO: 534724 - DNA, 20 bp, mouse
gcctgagcccgctcccaagt

SEQ ID NO: 534725 - DNA, 20 bp, mouse
gcagttgctgcttgggacgc

SEQ ID NO: 534726 - DNA, 20 bp, mouse
gacccgcagggggagccagg

SEQ ID NO: 534727 - DNA, 20 bp, mouse
gccggcggcagccagccccc

SEQ ID NO: 534728 - DNA, 20 bp, mouse
gccccctgcgggtggctcgg

SEQ ID NO: 534729 - DNA, 20 bp, mouse
gacaccgccgagccacccgc

SEQ ID NO: 534730 - DNA, 20 bp, mouse
ggccgccggatgctgcggag

SEQ ID NO: 534731 - DNA, 20 bp, mouse
gagccccctggctccccctg

SEQ ID NO: 534732 - DNA, 20 bp, mouse
gctcggcggtgtgcacagtc

SEQ ID NO: 534733 - DNA, 20 bp, mouse
gaggccgagcgggagcatgg

SEQ ID NO: 534734 - DNA, 20 bp, mouse
gtccgggaatgtaagcgctc

SEQ ID NO: 534735 - DNA, 20 bp, mouse
gctcacgctccgaagccggg

SEQ ID NO: 534736 - DNA, 20 bp, mouse
gtggaaagcagagacgccag

SEQ ID NO: 534737 - DNA, 20 bp, mouse
gcagcaggcgaggatggcta

SEQ ID NO: 534738 - DNA, 20 bp, mouse
gacttactgtgcggagatca

SEQ ID NO: 534739 - DNA, 20 bp, mouse
gaggcgaggatggctacgga

SEQ ID NO: 534740 - DNA, 20 bp, mouse
gagctggcagcaggcgagga

SEQ ID NO: 534741 - DNA, 20 bp, mouse
gcgcgcctgcgggcaaaatg

SEQ ID NO: 534742 - DNA, 20 bp, mouse
gaaaccgggagccggacccg

SEQ ID NO: 534743 - DNA, 20 bp, mouse
gcgcagagcaagaagaacac

SEQ ID NO: 534744 - DNA, 20 bp, mouse
gcattgcggtggagccggag

SEQ ID NO: 534745 - DNA, 20 bp, mouse
gctggacgaggaggttaagg

SEQ ID NO: 534746 - DNA, 20 bp, mouse
gtaagaggcgatgtcacctt

SEQ ID NO: 534747 - DNA, 20 bp, mouse
gctgcggagcgccagaggga

SEQ ID NO: 534748 - DNA, 20 bp, mouse
gtcttggggcttaggagctt

SEQ ID NO: 534749 - DNA, 20 bp, mouse
gttcccgcagcatccaaggg

SEQ ID NO: 534750 - DNA, 20 bp, mouse
gcctttcccgcagcatccaa

SEQ ID NO: 534751 - DNA, 20 bp, mouse
ggaggcgatgtcaccttggg

SEQ ID NO: 534752 - DNA, 20 bp, mouse
ggcagtgggagagaggcgat

SEQ ID NO: 534753 - DNA, 20 bp, mouse
gagtcattgagcgataggtt

SEQ ID NO: 534754 - DNA, 20 bp, mouse
gtgtcaccttgggaggagtc

SEQ ID NO: 534755 - DNA, 20 bp, mouse
ggtccaggccatgccagggg

SEQ ID NO: 534756 - DNA, 20 bp, mouse
gcggcctggcccacaatgaa

SEQ ID NO: 534757 - DNA, 20 bp, mouse
gcgcggcggccattcattgt

SEQ ID NO: 534758 - DNA, 20 bp, mouse
gcttcctcggcgctcggctg

SEQ ID NO: 534759 - DNA, 20 bp, mouse
gcgagcgccgaggaagcgca

SEQ ID NO: 534760 - DNA, 20 bp, mouse
ggagcccgcggcgctgacag

SEQ ID NO: 534761 - DNA, 20 bp, mouse
gaggacatcagaggttccgg

SEQ ID NO: 534762 - DNA, 20 bp, mouse
gccgaggccgaggcgcaggg

SEQ ID NO: 534763 - DNA, 20 bp, mouse
gccgccccagccgagcgccg

SEQ ID NO: 534764 - DNA, 20 bp, mouse
ggcgggaggaggccggaatt

SEQ ID NO: 534765 - DNA, 20 bp, mouse
ggttccggcggagggccgag

SEQ ID NO: 534766 - DNA, 20 bp, mouse
gcgaggtcggagaaagtccg

SEQ ID NO: 534767 - DNA, 20 bp, mouse
gccgcgggcgccggagctcg

SEQ ID NO: 534768 - DNA, 20 bp, mouse
gctccggcgtccccgagctc

SEQ ID NO: 534769 - DNA, 20 bp, mouse
gcgacctcgcccagcaccgg

SEQ ID NO: 534770 - DNA, 20 bp, mouse
gacccggcccagtccggcct

SEQ ID NO: 534771 - DNA, 20 bp, mouse
gcccggggcgcggccgagtg

SEQ ID NO: 534772 - DNA, 20 bp, mouse
ggggcgcgcggcgggcactg

SEQ ID NO: 534773 - DNA, 20 bp, mouse
ggagcacttcctgccgcggg

SEQ ID NO: 534774 - DNA, 20 bp, mouse
gcggtgcggccgccggtgct

SEQ ID NO: 534775 - DNA, 20 bp, mouse
gggaccccaacgggaaagga

SEQ ID NO: 534776 - DNA, 20 bp, mouse
gtgcccgggagagccggcct

SEQ ID NO: 534777 - DNA, 20 bp, mouse
gcggcagacaggaaccggag

SEQ ID NO: 534778 - DNA, 20 bp, mouse
gggccacagccgctgaaggt

SEQ ID NO: 534779 - DNA, 20 bp, mouse
gctggccggcagacaggaac

SEQ ID NO: 534780 - DNA, 20 bp, mouse
ggagatgctgcgcgctgccc

SEQ ID NO: 534781 - DNA, 20 bp, mouse
gaggcgccgggtggctgtag

SEQ ID NO: 534782 - DNA, 20 bp, mouse
ggcctgctgccaggctgagt

SEQ ID NO: 534783 - DNA, 20 bp, mouse
gaggaaagacctaccttcag

SEQ ID NO: 534784 - DNA, 20 bp, mouse
gagcaaggaaccctgaggtg

SEQ ID NO: 534785 - DNA, 20 bp, mouse
gcggatgcagacgaacatcc

SEQ ID NO: 534786 - DNA, 20 bp, mouse
gggaccgagcggccatgggg

SEQ ID NO: 534787 - DNA, 20 bp, mouse
gggccgctcggtccagagac

SEQ ID NO: 534788 - DNA, 20 bp, mouse
gccagccgcccgccacccca

SEQ ID NO: 534789 - DNA, 20 bp, mouse
gtgagagccaggtagcagta

SEQ ID NO: 534790 - DNA, 20 bp, mouse
gtctggaccgagcggccatg

SEQ ID NO: 534791 - DNA, 20 bp, mouse
gtgccggtctctggaccgag

SEQ ID NO: 534792 - DNA, 20 bp, mouse
ggccgggacccgtgaagaca

SEQ ID NO: 534793 - DNA, 20 bp, mouse
gctgctgccctactgctacc

SEQ ID NO: 534794 - DNA, 20 bp, mouse
ggcttgcgcactgacagccg

SEQ ID NO: 534795 - DNA, 20 bp, mouse
ggcttggtggtgccggtctc

SEQ ID NO: 534796 - DNA, 20 bp, mouse
gcgctacgcggagctctcgg

SEQ ID NO: 534797 - DNA, 20 bp, mouse
ggtcccaggagccccctcta

SEQ ID NO: 534798 - DNA, 20 bp, mouse
gggtagcaagtcatgatccg

SEQ ID NO: 534799 - DNA, 20 bp, mouse
ggccgcgcacaggttaagtg

SEQ ID NO: 534800 - DNA, 20 bp, mouse
ggggccccacaggcaatcgg

SEQ ID NO: 534801 - DNA, 20 bp, mouse
ggcgcaggcgcccaagaaaa

SEQ ID NO: 534802 - DNA, 20 bp, mouse
gcaccgcgccggccgcgcac

SEQ ID NO: 534803 - DNA, 20 bp, mouse
gcaccaccaccacccgcgag

SEQ ID NO: 534804 - DNA, 20 bp, mouse
ggacgcacgcgagggcggag

SEQ ID NO: 534805 - DNA, 20 bp, mouse
ggtggtagccccgccgacgg

SEQ ID NO: 534806 - DNA, 20 bp, mouse
gggctgggacggtgtaataa

SEQ ID NO: 534807 - DNA, 20 bp, mouse
gccggctagtatcttccctg

SEQ ID NO: 534808 - DNA, 20 bp, mouse
ggtgtaataacggagaccac

SEQ ID NO: 534809 - DNA, 20 bp, mouse
gagatactagccggactgtc

SEQ ID NO: 534810 - DNA, 20 bp, mouse
gaagctacgcaggcgtagac

SEQ ID NO: 534811 - DNA, 20 bp, mouse
ggtccacaatgggtaggaca

SEQ ID NO: 534812 - DNA, 20 bp, mouse
gtggaacctgtaaccagcat

SEQ ID NO: 534813 - DNA, 20 bp, mouse
ggatcctagaggatggatga

SEQ ID NO: 534814 - DNA, 20 bp, mouse
gctggttacaggttccaggc

SEQ ID NO: 534815 - DNA, 20 bp, mouse
gggcgtgggaacagatagaa

SEQ ID NO: 534816 - DNA, 20 bp, mouse
gcgcctgcgtgaggccgagt

SEQ ID NO: 534817 - DNA, 20 bp, mouse
gctgcgtgaggccgagtggg

SEQ ID NO: 534818 - DNA, 20 bp, mouse
gcgcggccatggcgcagcca

SEQ ID NO: 534819 - DNA, 20 bp, mouse
gcgcgggccaggcgcggcca

SEQ ID NO: 534820 - DNA, 20 bp, mouse
gcaaggagcaaaagtacgac

SEQ ID NO: 534821 - DNA, 20 bp, mouse
gatcttccctggctgcgcca

SEQ ID NO: 534822 - DNA, 20 bp, mouse
gcggcagctgaggtgagccg

SEQ ID NO: 534823 - DNA, 20 bp, mouse
gcgaacagcaaagccgccta

SEQ ID NO: 534824 - DNA, 20 bp, mouse
gagtgggtggcggcctcctt

SEQ ID NO: 534825 - DNA, 20 bp, mouse
gacagcaaagccgcctaagg

SEQ ID NO: 534826 - DNA, 20 bp, mouse
gggcttcagcgtggccgagt

SEQ ID NO: 534827 - DNA, 20 bp, mouse
gggttacctgagaaacgcgc

SEQ ID NO: 534828 - DNA, 20 bp, mouse
gccgcacgcggaccgacctg

SEQ ID NO: 534829 - DNA, 20 bp, mouse
ggaagccaagctagccaact

SEQ ID NO: 534830 - DNA, 20 bp, mouse
ggtcccgtgaatgatgccgg

SEQ ID NO: 534831 - DNA, 20 bp, mouse
gcctcccggcgatcctcagg

SEQ ID NO: 534832 - DNA, 20 bp, mouse
gcgggggcgtgtcctcaggt

SEQ ID NO: 534833 - DNA, 20 bp, mouse
gagaccctcgcgctgctctg

SEQ ID NO: 534834 - DNA, 20 bp, mouse
gtgaagcccgcgcgtttctc

SEQ ID NO: 534835 - DNA, 20 bp, mouse
gcagccacctgaggatcgcc

SEQ ID NO: 534836 - DNA, 20 bp, mouse
ggcgcgagggtaagaatcaa

SEQ ID NO: 534837 - DNA, 20 bp, mouse
ggccgtgaaagcccccgtgg

SEQ ID NO: 534838 - DNA, 20 bp, mouse
gctcgcgctcgctcagtccg

SEQ ID NO: 534839 - DNA, 20 bp, mouse
gttccgggaagtaaagggta

SEQ ID NO: 534840 - DNA, 20 bp, mouse
gtaagccgtgaaagcccccg

SEQ ID NO: 534841 - DNA, 20 bp, mouse
gcggttccaggtccccgtgt

SEQ ID NO: 534842 - DNA, 20 bp, mouse
ggggctttcacggcttaccg

SEQ ID NO: 534843 - DNA, 20 bp, mouse
gcttaaacatcgcaggccca

SEQ ID NO: 534844 - DNA, 20 bp, mouse
gtaggtacaagcggccgcca

SEQ ID NO: 534845 - DNA, 20 bp, mouse
gcccgggaggcggaatgtca

SEQ ID NO: 534846 - DNA, 20 bp, mouse
ggctagggtcgaggttgcta

SEQ ID NO: 534847 - DNA, 20 bp, mouse
ggtatggccgcgctttatgg

SEQ ID NO: 534848 - DNA, 20 bp, mouse
gagcggtggcaacggtagta

SEQ ID NO: 534849 - DNA, 20 bp, mouse
gtgctacggcggaccagcgg

SEQ ID NO: 534850 - DNA, 20 bp, mouse
gggcggaccagcggtggcaa

SEQ ID NO: 534851 - DNA, 20 bp, mouse
gggttgctacggcggaccag

SEQ ID NO: 534852 - DNA, 20 bp, mouse
ggtgggcgggagcgaagtca

SEQ ID NO: 534853 - DNA, 20 bp, mouse
ggggagcgaagtcacggcta

SEQ ID NO: 534854 - DNA, 20 bp, mouse
gagggtcgaggttgctacgg

SEQ ID NO: 534855 - DNA, 20 bp, mouse
gggaagggtgagcgctggat

SEQ ID NO: 534856 - DNA, 20 bp, mouse
gagaatcacggccagccccg

SEQ ID NO: 534857 - DNA, 20 bp, mouse
gtggagccgcgcacaagcac

SEQ ID NO: 534858 - DNA, 20 bp, mouse
gacccacagagcccccagcc

SEQ ID NO: 534859 - DNA, 20 bp, mouse
gggccgcgcggttggcatca

SEQ ID NO: 534860 - DNA, 20 bp, mouse
gacacctacagcctgagcgg

SEQ ID NO: 534861 - DNA, 20 bp, mouse
gcttggtattggttgtgagg

SEQ ID NO: 534862 - DNA, 20 bp, mouse
gtggacacctacagcctgag

SEQ ID NO: 534863 - DNA, 20 bp, mouse
gattctggggttcctactcc

SEQ ID NO: 534864 - DNA, 20 bp, mouse
gtggcatcatggaagccgcg

SEQ ID NO: 534865 - DNA, 20 bp, mouse
gcgggcccggagcttggtat

SEQ ID NO: 534866 - DNA, 20 bp, mouse
ggccgagcagcgcgggtatg

SEQ ID NO: 534867 - DNA, 20 bp, mouse
ggagcaccaatccaatatgg

SEQ ID NO: 534868 - DNA, 20 bp, mouse
gccggagcaccaatccaata

SEQ ID NO: 534869 - DNA, 20 bp, mouse
ggcgctgctcggcttactcg

SEQ ID NO: 534870 - DNA, 20 bp, mouse
gcgggtatgaggaacagccc

SEQ ID NO: 534871 - DNA, 20 bp, mouse
gcctggcctggaatcacgtg

SEQ ID NO: 534872 - DNA, 20 bp, mouse
gctgctcggcttactcgggg

SEQ ID NO: 534873 - DNA, 20 bp, mouse
ggtctgcgcgctagtgggta

SEQ ID NO: 534874 - DNA, 20 bp, mouse
ggggcgccgccatattggat

SEQ ID NO: 534875 - DNA, 20 bp, mouse
gcccgggcgcagtctcgcga

SEQ ID NO: 534876 - DNA, 20 bp, mouse
gtctggagcgcacagcacta

SEQ ID NO: 534877 - DNA, 20 bp, mouse
gactcgtcccccccacccac

SEQ ID NO: 534878 - DNA, 20 bp, mouse
gcagagcgaccgtcacctgt

SEQ ID NO: 534879 - DNA, 20 bp, mouse
gagcgaccgtcacctgtggg

SEQ ID NO: 534880 - DNA, 20 bp, mouse
gaccgccagggctcacgcag

SEQ ID NO: 534881 - DNA, 20 bp, mouse
gtcctctgcgtgagccctgg

SEQ ID NO: 534882 - DNA, 20 bp, mouse
ggaccgtcacctgtgggtgg

SEQ ID NO: 534883 - DNA, 20 bp, mouse
ggccgctgcagcagaccgca

SEQ ID NO: 534884 - DNA, 20 bp, mouse
ggaggcgcaggggattcgag

SEQ ID NO: 534885 - DNA, 20 bp, mouse
gctgggctggatcagactcg

SEQ ID NO: 534886 - DNA, 20 bp, mouse
gggttctaggcagatcagtg

SEQ ID NO: 534887 - DNA, 20 bp, mouse
gctaggtgttgagggaggat

SEQ ID NO: 534888 - DNA, 20 bp, mouse
gcagagacatgtgggtgttg

SEQ ID NO: 534889 - DNA, 20 bp, mouse
ggttgctcacagagacatgt

SEQ ID NO: 534890 - DNA, 20 bp, mouse
gaccagattagaggcaccgg

SEQ ID NO: 534891 - DNA, 20 bp, mouse
gctgtgagcaaccagattag

SEQ ID NO: 534892 - DNA, 20 bp, mouse
ggctcgtcgtggctacagat

SEQ ID NO: 534893 - DNA, 20 bp, mouse
gtctatctagagggaagtag

SEQ ID NO: 534894 - DNA, 20 bp, mouse
ggccaccggtgcctctaatc

SEQ ID NO: 534895 - DNA, 20 bp, mouse
gcttggccttgaggtccgta

SEQ ID NO: 534896 - DNA, 20 bp, mouse
gcaccatggcacggaaggtt

SEQ ID NO: 534897 - DNA, 20 bp, mouse
ggaagggataaattccacca

SEQ ID NO: 534898 - DNA, 20 bp, mouse
ggagaagggaagtgcaggat

SEQ ID NO: 534899 - DNA, 20 bp, mouse
gaattccaccatggcacgga

SEQ ID NO: 534900 - DNA, 20 bp, mouse
gcaaggaactggccatggct

SEQ ID NO: 534901 - DNA, 20 bp, mouse
gtaccaaaccttccgtgcca

SEQ ID NO: 534902 - DNA, 20 bp, mouse
gttcagaggcctgatttctg

SEQ ID NO: 534903 - DNA, 20 bp, mouse
gcaggcctctgaagcccaac

SEQ ID NO: 534904 - DNA, 20 bp, mouse
gaatcaaagctgccaagcca

SEQ ID NO: 534905 - DNA, 20 bp, mouse
gttacacaaggaactggcca

SEQ ID NO: 534906 - DNA, 20 bp, mouse
gcaaggtggcacagaaggct

SEQ ID NO: 534907 - DNA, 20 bp, mouse
ggggccagctcctctctaca

SEQ ID NO: 534908 - DNA, 20 bp, mouse
gtatctcaaggtggcacaga

SEQ ID NO: 534909 - DNA, 20 bp, mouse
ggtattaaaatgaccagcat

SEQ ID NO: 534910 - DNA, 20 bp, mouse
gaactccaggcgaccaatgc

SEQ ID NO: 534911 - DNA, 20 bp, mouse
gctttgtctcttaattgcta

SEQ ID NO: 534912 - DNA, 20 bp, mouse
gatgaccagcattggtcgcc

SEQ ID NO: 534913 - DNA, 20 bp, mouse
gcagctcctctctacaggga

SEQ ID NO: 534914 - DNA, 20 bp, mouse
ggggggcagagaaaatgaac

SEQ ID NO: 534915 - DNA, 20 bp, mouse
gtgaggattgatagaactcc

SEQ ID NO: 534916 - DNA, 20 bp, mouse
ggctccttccctgtagagaa

SEQ ID NO: 534917 - DNA, 20 bp, mouse
gttccctgtagagaaggggc

SEQ ID NO: 534918 - DNA, 20 bp, mouse
ggtgtatgtcagggacggca

SEQ ID NO: 534919 - DNA, 20 bp, mouse
gtggaaggcttggcaggatc

SEQ ID NO: 534920 - DNA, 20 bp, mouse
gtatctcaaggtggcatgga

SEQ ID NO: 534921 - DNA, 20 bp, mouse
gcaaggtggcatggaaggct

SEQ ID NO: 534922 - DNA, 20 bp, mouse
gggccagccccttctctaca

SEQ ID NO: 534923 - DNA, 20 bp, mouse
ggggatgcatcaggacacaa

SEQ ID NO: 534924 - DNA, 20 bp, mouse
gagtgaaagcaaataggaag

SEQ ID NO: 534925 - DNA, 20 bp, mouse
gtaagtgtgtatgtcaggga

SEQ ID NO: 534926 - DNA, 20 bp, mouse
ggggatgaatctagttcagc

SEQ ID NO: 534927 - DNA, 20 bp, mouse
gtgagctctctgctcgtttc

SEQ ID NO: 534928 - DNA, 20 bp, mouse
gcattttcatccgttcttta

SEQ ID NO: 534929 - DNA, 20 bp, mouse
gcacacaggggtgaaacttg

SEQ ID NO: 534930 - DNA, 20 bp, mouse
gcagaatgtgagttccttca

SEQ ID NO: 534931 - DNA, 20 bp, mouse
gaccaacatcttttccctga

SEQ ID NO: 534932 - DNA, 20 bp, mouse
gaacgtgtcataggactcaa

SEQ ID NO: 534933 - DNA, 20 bp, mouse
ggagcatggggagtcctccg

SEQ ID NO: 534934 - DNA, 20 bp, mouse
gagcagttcttgggtgttcg

SEQ ID NO: 534935 - DNA, 20 bp, mouse
gtggggagtcctccgaggat

SEQ ID NO: 534936 - DNA, 20 bp, mouse
ggagctacggaggatgctca

SEQ ID NO: 534937 - DNA, 20 bp, mouse
gtttgctgcgcgagctacgg

SEQ ID NO: 534938 - DNA, 20 bp, mouse
gcagcaaagccaacagcaaa

SEQ ID NO: 534939 - DNA, 20 bp, mouse
ggagagagctgcaggagtcc

SEQ ID NO: 534940 - DNA, 20 bp, mouse
gcacctgcaagtacggaccc

SEQ ID NO: 534941 - DNA, 20 bp, mouse
gggacgcggcccctcaccta

SEQ ID NO: 534942 - DNA, 20 bp, mouse
ggcagcgccgccgcagctgg

SEQ ID NO: 534943 - DNA, 20 bp, mouse
ggagctgactgagccgccat

SEQ ID NO: 534944 - DNA, 20 bp, mouse
gcaagtacggaccctggcac

SEQ ID NO: 534945 - DNA, 20 bp, mouse
ggggaagccacctgcaagta

SEQ ID NO: 534946 - DNA, 20 bp, mouse
gcattcatctcgggccggag

SEQ ID NO: 534947 - DNA, 20 bp, mouse
gtggaggagccgcaacgcgg

SEQ ID NO: 534948 - DNA, 20 bp, mouse
gctgccgcagcattcatctc

SEQ ID NO: 534949 - DNA, 20 bp, mouse
gcgagcggtgacttaagcaa

SEQ ID NO: 534950 - DNA, 20 bp, mouse
gaggtggaggagccgcaacg

SEQ ID NO: 534951 - DNA, 20 bp, mouse
gctgcgagcaaggagaaaaa

SEQ ID NO: 534952 - DNA, 20 bp, mouse
gcgcggtggctgaaggatgg

SEQ ID NO: 534953 - DNA, 20 bp, mouse
gtggcgcggcgtctccgctc

SEQ ID NO: 534954 - DNA, 20 bp, mouse
ggaggactggatgagaccgt

SEQ ID NO: 534955 - DNA, 20 bp, mouse
gcaacgcggtggctgaagga

SEQ ID NO: 534956 - DNA, 20 bp, mouse
gtctttctgtgggaaggctg

SEQ ID NO: 534957 - DNA, 20 bp, mouse
ggagccgttggccttcagat

SEQ ID NO: 534958 - DNA, 20 bp, mouse
gggtgtcttgctctttctgt

SEQ ID NO: 534959 - DNA, 20 bp, mouse
gtcagataggctgatttggt

SEQ ID NO: 534960 - DNA, 20 bp, mouse
gcagtgtgatggcgagggaa

SEQ ID NO: 534961 - DNA, 20 bp, mouse
gctcagaactaggcaaactg

SEQ ID NO: 534962 - DNA, 20 bp, mouse
gaaattatcaagaagtcaga

SEQ ID NO: 534963 - DNA, 20 bp, mouse
gcacaggacggagcaatata

SEQ ID NO: 534964 - DNA, 20 bp, mouse
ggtaagcaagaatagttctc

SEQ ID NO: 534965 - DNA, 20 bp, mouse
gcatgtcagtgtgatggcga

SEQ ID NO: 534966 - DNA, 20 bp, mouse
ggccccgcagctggtgaggt

SEQ ID NO: 534967 - DNA, 20 bp, mouse
gcggcaagggccagacggaa

SEQ ID NO: 534968 - DNA, 20 bp, mouse
gcccccggacggaggcggag

SEQ ID NO: 534969 - DNA, 20 bp, mouse
gaggcgccccgcagctggtg

SEQ ID NO: 534970 - DNA, 20 bp, mouse
ggaggtgggcgcagcgcacg

SEQ ID NO: 534971 - DNA, 20 bp, mouse
gcggggcgcaggaaacgcgc

SEQ ID NO: 534972 - DNA, 20 bp, mouse
gccgcgcccccggacggagg

SEQ ID NO: 534973 - DNA, 20 bp, mouse
gcgcccgcgcccccggacgg

SEQ ID NO: 534974 - DNA, 20 bp, mouse
gcgcctggcatcctgcgagg

SEQ ID NO: 534975 - DNA, 20 bp, mouse
ggccggcctgccgtggggta

SEQ ID NO: 534976 - DNA, 20 bp, mouse
ggtggctgtgggcactggag

SEQ ID NO: 534977 - DNA, 20 bp, mouse
gtcaaagggcggtaggtcca

SEQ ID NO: 534978 - DNA, 20 bp, mouse
gtatggtaggcagacatcca

SEQ ID NO: 534979 - DNA, 20 bp, mouse
gggtccatggcacttaaatg

SEQ ID NO: 534980 - DNA, 20 bp, mouse
gtaaatgtggctgtgggcac

SEQ ID NO: 534981 - DNA, 20 bp, mouse
gctctccacatgtcaaaggg

SEQ ID NO: 534982 - DNA, 20 bp, mouse
gcgccggtggctccacatag

SEQ ID NO: 534983 - DNA, 20 bp, mouse
gggcacttaaatgtggctgt

SEQ ID NO: 534984 - DNA, 20 bp, mouse
gaagagtgagcaggacctgg

SEQ ID NO: 534985 - DNA, 20 bp, mouse
gacatccagggtagccctcc

SEQ ID NO: 534986 - DNA, 20 bp, mouse
ggcagagaagaaacccaacc

SEQ ID NO: 534987 - DNA, 20 bp, mouse
gcctgagcttcagggtagta

SEQ ID NO: 534988 - DNA, 20 bp, mouse
gttcagggtagtaaggaagt

SEQ ID NO: 534989 - DNA, 20 bp, mouse
gattgaaagtccccatggct

SEQ ID NO: 534990 - DNA, 20 bp, mouse
gaaggaagttggagccaggt

SEQ ID NO: 534991 - DNA, 20 bp, mouse
gaggacatgggactgataga

SEQ ID NO: 534992 - DNA, 20 bp, mouse
gtggacagattacctaggtc

SEQ ID NO: 534993 - DNA, 20 bp, mouse
gatctttggacagattacct

SEQ ID NO: 534994 - DNA, 20 bp, mouse
gtgtcctgaaggatgaggca

SEQ ID NO: 534995 - DNA, 20 bp, mouse
gtcccatgtcctgaaggatg

SEQ ID NO: 534996 - DNA, 20 bp, mouse
gatgcgcggcgcggcagaag

SEQ ID NO: 534997 - DNA, 20 bp, mouse
gcgcgggaaagaagctccac

SEQ ID NO: 534998 - DNA, 20 bp, mouse
gcggggctgcagcaagagga

SEQ ID NO: 534999 - DNA, 20 bp, mouse
ggcgccgcgcatgcgcaagg

SEQ ID NO: 535000 - DNA, 20 bp, mouse
ggcgcatgcgcaaggcggtc

SEQ ID NO: 535001 - DNA, 20 bp, mouse
gcccgggtgaccgcaggtgg

SEQ ID NO: 535002 - DNA, 20 bp, mouse
gcacgcagcggggggactga

SEQ ID NO: 535003 - DNA, 20 bp, mouse
ggaacacctgggcggagtct

SEQ ID NO: 535004 - DNA, 20 bp, mouse
gagcccggaaggccacaggg

SEQ ID NO: 535005 - DNA, 20 bp, mouse
gagcacccggccccacgcgc

SEQ ID NO: 535006 - DNA, 20 bp, mouse
gcccgtggaggagtaagtag

SEQ ID NO: 535007 - DNA, 20 bp, mouse
ggagcaggccaggcaagggt

SEQ ID NO: 535008 - DNA, 20 bp, mouse
gtgtgtcccgggcgctgggt

SEQ ID NO: 535009 - DNA, 20 bp, mouse
gaacgcccggggcagcaagc

SEQ ID NO: 535010 - DNA, 20 bp, mouse
ggcgggtgcggaaacgcccg

SEQ ID NO: 535011 - DNA, 20 bp, mouse
gagctccagttccagcggca

SEQ ID NO: 535012 - DNA, 20 bp, mouse
gtggaactggagctgtgtcc

SEQ ID NO: 535013 - DNA, 20 bp, mouse
gagcccaggaaggttgacgg

SEQ ID NO: 535014 - DNA, 20 bp, mouse
gcccgggagaattcacggag

SEQ ID NO: 535015 - DNA, 20 bp, mouse
gagatcggccagaaccacca

SEQ ID NO: 535016 - DNA, 20 bp, mouse
gtgcggcctgagggaccccg

SEQ ID NO: 535017 - DNA, 20 bp, mouse
gcagccgccggcgctccccg

SEQ ID NO: 535018 - DNA, 20 bp, mouse
ggaggcggccgggcgaccca

SEQ ID NO: 535019 - DNA, 20 bp, mouse
gggctccaccgaggcagagg

SEQ ID NO: 535020 - DNA, 20 bp, mouse
ggagcctcctggaacggtaa

SEQ ID NO: 535021 - DNA, 20 bp, mouse
ggagttccgcccgcagggag

SEQ ID NO: 535022 - DNA, 20 bp, mouse
gcgaggccgcgggagagcgg

SEQ ID NO: 535023 - DNA, 20 bp, mouse
gctcgcggtgggctccaccg

SEQ ID NO: 535024 - DNA, 20 bp, mouse
gcccaccgcgagggcaaccc

SEQ ID NO: 535025 - DNA, 20 bp, mouse
gctccggagcgctcaccccg

SEQ ID NO: 535026 - DNA, 20 bp, mouse
gagctgctccagccactcgg

SEQ ID NO: 535027 - DNA, 20 bp, mouse
ggactgcagagagccgcagt

SEQ ID NO: 535028 - DNA, 20 bp, mouse
gccatccctccgcccccgag

SEQ ID NO: 535029 - DNA, 20 bp, mouse
gcaactgcgtaatcatactg

SEQ ID NO: 535030 - DNA, 20 bp, mouse
ggcagagatgaaccaagagg

SEQ ID NO: 535031 - DNA, 20 bp, mouse
ggagatgaaccaagaggcgg

SEQ ID NO: 535032 - DNA, 20 bp, mouse
gctgtctgggcggagactct

SEQ ID NO: 535033 - DNA, 20 bp, mouse
gcggagactctaggccctga

SEQ ID NO: 535034 - DNA, 20 bp, mouse
gccctccgcccccgagtggc

SEQ ID NO: 535035 - DNA, 20 bp, mouse
gaccgtggctgctggagtag

SEQ ID NO: 535036 - DNA, 20 bp, mouse
gactggactgcagcaggtct

SEQ ID NO: 535037 - DNA, 20 bp, mouse
gggcggcggccgggatccag

SEQ ID NO: 535038 - DNA, 20 bp, mouse
gtctcggcgcaggtccattg

SEQ ID NO: 535039 - DNA, 20 bp, mouse
gcagtccagtgacgcagtac

SEQ ID NO: 535040 - DNA, 20 bp, mouse
ggcgaaggccggagaaggtc

SEQ ID NO: 535041 - DNA, 20 bp, mouse
ggaggcttgtcaggccgcaa

SEQ ID NO: 535042 - DNA, 20 bp, mouse
gagggctgtcaacaagggag

SEQ ID NO: 535043 - DNA, 20 bp, mouse
ggggctgcccatcctaaccc

SEQ ID NO: 535044 - DNA, 20 bp, mouse
gcccatcctaacccaggaga

SEQ ID NO: 535045 - DNA, 20 bp, mouse
gaccagagggctgtcaacaa

SEQ ID NO: 535046 - DNA, 20 bp, mouse
gcccggagcgagcttaggac

SEQ ID NO: 535047 - DNA, 20 bp, mouse
gccgcaggaggcgcgaggtg

SEQ ID NO: 535048 - DNA, 20 bp, mouse
ggcagccccggagcgagctt

SEQ ID NO: 535049 - DNA, 20 bp, mouse
ggtgctggcgggtaacggcg

SEQ ID NO: 535050 - DNA, 20 bp, mouse
gccaggcgcggtctgagacg

SEQ ID NO: 535051 - DNA, 20 bp, mouse
gaccgggtcagaggtccggg

SEQ ID NO: 535052 - DNA, 20 bp, mouse
gcaggcgccactgccgcagg

SEQ ID NO: 535053 - DNA, 20 bp, mouse
gccgcttcgcgtgggttctc

SEQ ID NO: 535054 - DNA, 20 bp, mouse
ggtgcggtgctggcgggtaa

SEQ ID NO: 535055 - DNA, 20 bp, mouse
ggcgcaggcggttccttgag

SEQ ID NO: 535056 - DNA, 20 bp, mouse
gcacagctgcaggacctctc

SEQ ID NO: 535057 - DNA, 20 bp, mouse
gcaatagagctggtccagag

SEQ ID NO: 535058 - DNA, 20 bp, mouse
ggcgcagtctgcaatagagc

SEQ ID NO: 535059 - DNA, 20 bp, mouse
gggagcagcggcactgtcac

SEQ ID NO: 535060 - DNA, 20 bp, mouse
ggtttgccgcagtggtctgg

SEQ ID NO: 535061 - DNA, 20 bp, mouse
gtcctcggcgcggctctcag

SEQ ID NO: 535062 - DNA, 20 bp, mouse
ggtcggccatggctactgct

SEQ ID NO: 535063 - DNA, 20 bp, mouse
gggtcctgcagctgtgattg

SEQ ID NO: 535064 - DNA, 20 bp, mouse
gcttgtttgccgcagtggtc

SEQ ID NO: 535065 - DNA, 20 bp, mouse
gccgaggacgaggtaatgga

SEQ ID NO: 535066 - DNA, 20 bp, mouse
gcgacgtcatggacaactcc

SEQ ID NO: 535067 - DNA, 20 bp, mouse
ggagcagctgcgcgacgtca

SEQ ID NO: 535068 - DNA, 20 bp, mouse
ggtcgtcgccaggctgtgtc

SEQ ID NO: 535069 - DNA, 20 bp, mouse
gaggcgcggccaccagtcag

SEQ ID NO: 535070 - DNA, 20 bp, mouse
gcagcctggcgacgactcac

SEQ ID NO: 535071 - DNA, 20 bp, mouse
gccggacaccgcgcactcag

SEQ ID NO: 535072 - DNA, 20 bp, mouse
gctgggccgcacagatccac

SEQ ID NO: 535073 - DNA, 20 bp, mouse
ggctcaggcccgacacagcc

SEQ ID NO: 535074 - DNA, 20 bp, mouse
ggccggagtacgaggtgtga

SEQ ID NO: 535075 - DNA, 20 bp, mouse
ggacgacacccgctgactgg

SEQ ID NO: 535076 - DNA, 20 bp, mouse
ggagcctagctagtcagcag

SEQ ID NO: 535077 - DNA, 20 bp, mouse
gtagtcagcagaggaggctt

SEQ ID NO: 535078 - DNA, 20 bp, mouse
gcgggcaccaagacccctaa

SEQ ID NO: 535079 - DNA, 20 bp, mouse
ggctgactagctaggctccc

SEQ ID NO: 535080 - DNA, 20 bp, mouse
ggggagggctaagtcgtccc

SEQ ID NO: 535081 - DNA, 20 bp, mouse
ggccggctgggcaggggatc

SEQ ID NO: 535082 - DNA, 20 bp, mouse
gtgcgcggggtactctgcgg

SEQ ID NO: 535083 - DNA, 20 bp, mouse
gttggctgcagcgggtgaca

SEQ ID NO: 535084 - DNA, 20 bp, mouse
ggacatggacaacgcaggga

SEQ ID NO: 535085 - DNA, 20 bp, mouse
gagttgcgcggggtactctg

SEQ ID NO: 535086 - DNA, 20 bp, mouse
gagcagggaggctcacccgc

SEQ ID NO: 535087 - DNA, 20 bp, mouse
gccgcctcccgcgaagatcc

SEQ ID NO: 535088 - DNA, 20 bp, mouse
gtggctgccccggaggacag

SEQ ID NO: 535089 - DNA, 20 bp, mouse
gatcttcgcgggaggcggtt

SEQ ID NO: 535090 - DNA, 20 bp, mouse
gctgttagcctggatcttcg

SEQ ID NO: 535091 - DNA, 20 bp, mouse
ggcaagctccgcaactccag

SEQ ID NO: 535092 - DNA, 20 bp, mouse
gctggagatgcacttgtgag

SEQ ID NO: 535093 - DNA, 20 bp, mouse
gaaggcggcgcgctgtatgt

SEQ ID NO: 535094 - DNA, 20 bp, mouse
gtagcctggatcttcgcggg

SEQ ID NO: 535095 - DNA, 20 bp, mouse
gccgggaacctgagcgcctg

SEQ ID NO: 535096 - DNA, 20 bp, mouse
gcagcaagcgaccgaggcga

SEQ ID NO: 535097 - DNA, 20 bp, mouse
ggtttttgctgagatctagg

SEQ ID NO: 535098 - DNA, 20 bp, mouse
gagcccagaagatcaacgag

SEQ ID NO: 535099 - DNA, 20 bp, mouse
ggggattgacccacaaggga

SEQ ID NO: 535100 - DNA, 20 bp, mouse
ggcaaaaacacccggagcgt

SEQ ID NO: 535101 - DNA, 20 bp, mouse
gctgtcacggccgactgcag

SEQ ID NO: 535102 - DNA, 20 bp, mouse
gttctgggctgccatcgcct

SEQ ID NO: 535103 - DNA, 20 bp, mouse
gacacccggagcgtcggcgt

SEQ ID NO: 535104 - DNA, 20 bp, mouse
gtcgcgtcagcaagcgaccg

SEQ ID NO: 535105 - DNA, 20 bp, mouse
ggcgcgccggctgattggga

SEQ ID NO: 535106 - DNA, 20 bp, mouse
gcgggagcctgtgtaccccg

SEQ ID NO: 535107 - DNA, 20 bp, mouse
gtccattccgcggggtacac

SEQ ID NO: 535108 - DNA, 20 bp, mouse
ggagtagggcgccattagtc

SEQ ID NO: 535109 - DNA, 20 bp, mouse
ggatagaggtcggtgagcag

SEQ ID NO: 535110 - DNA, 20 bp, mouse
ggatggagctggacagcgag

SEQ ID NO: 535111 - DNA, 20 bp, mouse
gggcgaaggagcctccgaaa

SEQ ID NO: 535112 - DNA, 20 bp, mouse
gtctggaccagtgccgtagg

SEQ ID NO: 535113 - DNA, 20 bp, mouse
ggcctccgaaagggcagtgg

SEQ ID NO: 535114 - DNA, 20 bp, mouse
gtacacaggctcccgactaa

SEQ ID NO: 535115 - DNA, 20 bp, mouse
gatggtagcctgatagaggt

SEQ ID NO: 535116 - DNA, 20 bp, mouse
gagtagtggcgacatctctg

SEQ ID NO: 535117 - DNA, 20 bp, mouse
gggatcagtttggcctcctc

SEQ ID NO: 535118 - DNA, 20 bp, mouse
gtgcctgctgctggggaatt

SEQ ID NO: 535119 - DNA, 20 bp, mouse
gagagtgggggtccccatac

SEQ ID NO: 535120 - DNA, 20 bp, mouse
gatctgtcaggagtgagagt

SEQ ID NO: 535121 - DNA, 20 bp, mouse
gctggggaatttggagcctg

SEQ ID NO: 535122 - DNA, 20 bp, mouse
gaaagggccacaggacatct

SEQ ID NO: 535123 - DNA, 20 bp, mouse
gtccccataccggatcagtt

SEQ ID NO: 535124 - DNA, 20 bp, mouse
ggctgggccaagatgtcctg

SEQ ID NO: 535125 - DNA, 20 bp, mouse
gaggccaaactgatccggta

SEQ ID NO: 535126 - DNA, 20 bp, mouse
gacttcatctggagtgggac

SEQ ID NO: 535127 - DNA, 20 bp, mouse
ggcctaagctgtgaggagta

SEQ ID NO: 535128 - DNA, 20 bp, mouse
gccgacgcgcctaagctgtg

SEQ ID NO: 535129 - DNA, 20 bp, mouse
gcacctgtctgcagaggact

SEQ ID NO: 535130 - DNA, 20 bp, mouse
ggtcgcaggtcgctagcggg

SEQ ID NO: 535131 - DNA, 20 bp, mouse
gtgtgaggagtaaggaagac

SEQ ID NO: 535132 - DNA, 20 bp, mouse
ggctagcgggcggcaggcgg

SEQ ID NO: 535133 - DNA, 20 bp, mouse
gctcacacttcatctggagt

SEQ ID NO: 535134 - DNA, 20 bp, mouse
gtagcttccacggacagtcc

SEQ ID NO: 535135 - DNA, 20 bp, mouse
gcatctggagtgggactggc

SEQ ID NO: 535136 - DNA, 20 bp, mouse
gatggcgtcgcccttcagtg

SEQ ID NO: 535137 - DNA, 20 bp, mouse
ggcactacagctgaccgact

SEQ ID NO: 535138 - DNA, 20 bp, mouse
gacccccgtgtgacactcgg

SEQ ID NO: 535139 - DNA, 20 bp, mouse
ggccgccgagtgtcacacgg

SEQ ID NO: 535140 - DNA, 20 bp, mouse
gccgatgaagtcgtccaagt

SEQ ID NO: 535141 - DNA, 20 bp, mouse
gtcatcgggccatctcaggt

SEQ ID NO: 535142 - DNA, 20 bp, mouse
ggagcgatccctgggaccat

SEQ ID NO: 535143 - DNA, 20 bp, mouse
ggtgacactcggcggcagtg

SEQ ID NO: 535144 - DNA, 20 bp, mouse
gcagggagggccagacaacg

SEQ ID NO: 535145 - DNA, 20 bp, mouse
gttggccggcccacctgaga

SEQ ID NO: 535146 - DNA, 20 bp, mouse
gggccgtgcgggcgccctcg

SEQ ID NO: 535147 - DNA, 20 bp, mouse
gcactgctgcccgcctacga

SEQ ID NO: 535148 - DNA, 20 bp, mouse
gttttaaatgaggccttcgt

SEQ ID NO: 535149 - DNA, 20 bp, mouse
gagccccgagggcgcccgca

SEQ ID NO: 535150 - DNA, 20 bp, mouse
gctgtgagcaaagtccggtg

SEQ ID NO: 535151 - DNA, 20 bp, mouse
gcgccgaggaagacacgtga

SEQ ID NO: 535152 - DNA, 20 bp, mouse
gtaaatgaggccttcgtagg

SEQ ID NO: 535153 - DNA, 20 bp, mouse
gaaggcctgtgagcaaagtc

SEQ ID NO: 535154 - DNA, 20 bp, mouse
gacatggcgacgcgggtctg

SEQ ID NO: 535155 - DNA, 20 bp, mouse
ggctcacaggccttcctcgg

SEQ ID NO: 535156 - DNA, 20 bp, mouse
gggaagccttcagtgcacgt

SEQ ID NO: 535157 - DNA, 20 bp, mouse
gcgttggggtgagcaggcgg

SEQ ID NO: 535158 - DNA, 20 bp, mouse
gctgaaggcttccttgactg

SEQ ID NO: 535159 - DNA, 20 bp, mouse
gtcaccccaacgtgcactga

SEQ ID NO: 535160 - DNA, 20 bp, mouse
ggtccccctaatcacctccg

SEQ ID NO: 535161 - DNA, 20 bp, mouse
ggcagtgtctatgtcctcgg

SEQ ID NO: 535162 - DNA, 20 bp, mouse
ggtcctcggaggtgattagg

SEQ ID NO: 535163 - DNA, 20 bp, mouse
gcagacccggaccaccgagt

SEQ ID NO: 535164 - DNA, 20 bp, mouse
gagtgcacgttggggtgagc

SEQ ID NO: 535165 - DNA, 20 bp, mouse
gggtctggggcgagcgacca

SEQ ID NO: 535166 - DNA, 20 bp, mouse
gtcgactacacggaacacag

SEQ ID NO: 535167 - DNA, 20 bp, mouse
gtgcactccggtcccatgta

SEQ ID NO: 535168 - DNA, 20 bp, mouse
gcacagaaggttcgactaca

SEQ ID NO: 535169 - DNA, 20 bp, mouse
ggcaggaaacggaggaacag

SEQ ID NO: 535170 - DNA, 20 bp, mouse
gagcatggcgagaccggaca

SEQ ID NO: 535171 - DNA, 20 bp, mouse
gtcagtgtcacaccgtacat

SEQ ID NO: 535172 - DNA, 20 bp, mouse
ggtcacaccgtacatgggac

SEQ ID NO: 535173 - DNA, 20 bp, mouse
gaggcgccgggccccgagca

SEQ ID NO: 535174 - DNA, 20 bp, mouse
gtaagtctgggtctgcactc

SEQ ID NO: 535175 - DNA, 20 bp, mouse
gagaccggacagggttccac

SEQ ID NO: 535176 - DNA, 20 bp, mouse
gcctgaggtggtgggccagt

SEQ ID NO: 535177 - DNA, 20 bp, mouse
gagcttgaggccagtcctca

SEQ ID NO: 535178 - DNA, 20 bp, mouse
gtccgcggcgatggcagcag

SEQ ID NO: 535179 - DNA, 20 bp, mouse
gtgagtgagtctctgctgtc

SEQ ID NO: 535180 - DNA, 20 bp, mouse
gccaaacgggaagggataca

SEQ ID NO: 535181 - DNA, 20 bp, mouse
gctgacggggatacccgaga

SEQ ID NO: 535182 - DNA, 20 bp, mouse
gcctacctaccggcaacctc

SEQ ID NO: 535183 - DNA, 20 bp, mouse
gggaggatccggaagtggat

SEQ ID NO: 535184 - DNA, 20 bp, mouse
gggccatcgttcccctgagg

SEQ ID NO: 535185 - DNA, 20 bp, mouse
gcacggccgccgttgttccg

SEQ ID NO: 535186 - DNA, 20 bp, mouse
gatgcctctaactatctcat

SEQ ID NO: 535187 - DNA, 20 bp, mouse
gtaatctctgtgccccttaa

SEQ ID NO: 535188 - DNA, 20 bp, mouse
gtgaagaacttcagttaatg

SEQ ID NO: 535189 - DNA, 20 bp, mouse
gtgtttgccttaggggacca

SEQ ID NO: 535190 - DNA, 20 bp, mouse
gtcatatcactttgactgca

SEQ ID NO: 535191 - DNA, 20 bp, mouse
gacattacaacaattcttgt

SEQ ID NO: 535192 - DNA, 20 bp, mouse
gactgggctctgaccaaaat

SEQ ID NO: 535193 - DNA, 20 bp, mouse
ggctttgaaaccacaatgtt

SEQ ID NO: 535194 - DNA, 20 bp, mouse
gcatcgaagcatactttgaa

SEQ ID NO: 535195 - DNA, 20 bp, mouse
gagctacagatagctgactc

SEQ ID NO: 535196 - DNA, 20 bp, mouse
gtaagtggcagacagcacgt

SEQ ID NO: 535197 - DNA, 20 bp, mouse
gcgtgggcaagtgctcagaa

SEQ ID NO: 535198 - DNA, 20 bp, mouse
gggtagggctggctcgagta

SEQ ID NO: 535199 - DNA, 20 bp, mouse
ggcacgtgaatccgcttaag

SEQ ID NO: 535200 - DNA, 20 bp, mouse
gacaccaggcagctgcacaa

SEQ ID NO: 535201 - DNA, 20 bp, mouse
ggtgctgtctgccacttaag

SEQ ID NO: 535202 - DNA, 20 bp, mouse
ggggcaagtgctcagaaggg

SEQ ID NO: 535203 - DNA, 20 bp, mouse
ggaaggtcccatagctgtag

SEQ ID NO: 535204 - DNA, 20 bp, mouse
ggcgaagagtccgaagatac

SEQ ID NO: 535205 - DNA, 20 bp, mouse
gtaagcggattcacgtgcag

SEQ ID NO: 535206 - DNA, 20 bp, mouse
ggcagaaacagggccctgaa

SEQ ID NO: 535207 - DNA, 20 bp, mouse
gcctgaaaggcacctccacg

SEQ ID NO: 535208 - DNA, 20 bp, mouse
gagggattcgagcaaccccg

SEQ ID NO: 535209 - DNA, 20 bp, mouse
gaccccacatagcagaaaca

SEQ ID NO: 535210 - DNA, 20 bp, mouse
gagagccccactgggtatgg

SEQ ID NO: 535211 - DNA, 20 bp, mouse
gccttctcccttactgtcaa

SEQ ID NO: 535212 - DNA, 20 bp, mouse
ggccctgtttctgctatgtg

SEQ ID NO: 535213 - DNA, 20 bp, mouse
gagcagccggtctcctgaag

SEQ ID NO: 535214 - DNA, 20 bp, mouse
gggcaggagagggtcaccac

SEQ ID NO: 535215 - DNA, 20 bp, mouse
gcaggcaggcccctccccaa

SEQ ID NO: 535216 - DNA, 20 bp, mouse
gcctggtagcgggtaagtgg

SEQ ID NO: 535217 - DNA, 20 bp, mouse
gcgctaccaggactgcaacc

SEQ ID NO: 535218 - DNA, 20 bp, mouse
gtaccaggactgcaaccggg

SEQ ID NO: 535219 - DNA, 20 bp, mouse
ggtccgcccggttgcagtcc

SEQ ID NO: 535220 - DNA, 20 bp, mouse
gagtcctggtagcgggtaag

SEQ ID NO: 535221 - DNA, 20 bp, mouse
gtctctcccggtcttccttc

SEQ ID NO: 535222 - DNA, 20 bp, mouse
gctgatttccaaatctatta

SEQ ID NO: 535223 - DNA, 20 bp, mouse
gactcactcagcttacttcc

SEQ ID NO: 535224 - DNA, 20 bp, mouse
ggggggctccctaatagatt

SEQ ID NO: 535225 - DNA, 20 bp, mouse
gagtcccagagggaacaaat

SEQ ID NO: 535226 - DNA, 20 bp, mouse
gaggcacctcggagtctcag

SEQ ID NO: 535227 - DNA, 20 bp, mouse
gaaggggagacctaagatgg

SEQ ID NO: 535228 - DNA, 20 bp, mouse
ggactgacctggccacctcc

SEQ ID NO: 535229 - DNA, 20 bp, mouse
ggtctcaggggagactgacc

SEQ ID NO: 535230 - DNA, 20 bp, mouse
gctctcaggggacccaacac

SEQ ID NO: 535231 - DNA, 20 bp, mouse
gtggagcacagcaaccctgg

SEQ ID NO: 535232 - DNA, 20 bp, mouse
gcgctgtagaagagccacca

SEQ ID NO: 535233 - DNA, 20 bp, mouse
gggctggtacttcctggagg

SEQ ID NO: 535234 - DNA, 20 bp, mouse
ggaagccggctggtacttcc

SEQ ID NO: 535235 - DNA, 20 bp, mouse
gggctggagcacagcaaccc

SEQ ID NO: 535236 - DNA, 20 bp, mouse
gatgctgatggtaccctcag

SEQ ID NO: 535237 - DNA, 20 bp, mouse
ggtactagcatcactcaacc

SEQ ID NO: 535238 - DNA, 20 bp, mouse
gtgcatctctcctggttggt

SEQ ID NO: 535239 - DNA, 20 bp, mouse
gagtactctgagcagattca

SEQ ID NO: 535240 - DNA, 20 bp, mouse
ggtgtgcaaggttctatctt

SEQ ID NO: 535241 - DNA, 20 bp, mouse
gggtaccatcagcatgcagt

SEQ ID NO: 535242 - DNA, 20 bp, mouse
gaacacaagcatcactctat

SEQ ID NO: 535243 - DNA, 20 bp, mouse
gatggtaccctcagagggct

SEQ ID NO: 535244 - DNA, 20 bp, mouse
gtttaattagctcctaaaat

SEQ ID NO: 535245 - DNA, 20 bp, mouse
gggtgtgcatcatccatgcc

SEQ ID NO: 535246 - DNA, 20 bp, mouse
gggctgtagtagcagctaag

SEQ ID NO: 535247 - DNA, 20 bp, mouse
gacaaggttggtgttcctga

SEQ ID NO: 535248 - DNA, 20 bp, mouse
gttggtgttcctgagggtgg

SEQ ID NO: 535249 - DNA, 20 bp, mouse
gaaacacccaggaaggctgt

SEQ ID NO: 535250 - DNA, 20 bp, mouse
gtacagccgagtgtccaaaa

SEQ ID NO: 535251 - DNA, 20 bp, mouse
gtaccttcaaacacccagga

SEQ ID NO: 535252 - DNA, 20 bp, mouse
gacatggacatggtagcccg

SEQ ID NO: 535253 - DNA, 20 bp, mouse
gagtagatgagcacacacac

SEQ ID NO: 535254 - DNA, 20 bp, mouse
gttacaggctacctgatctg

SEQ ID NO: 535255 - DNA, 20 bp, mouse
gggacatggtagcccgtgga

SEQ ID NO: 535256 - DNA, 20 bp, mouse
gatggtcgctgtcctggtac

SEQ ID NO: 535257 - DNA, 20 bp, mouse
gctgggtggctgaatctggg

SEQ ID NO: 535258 - DNA, 20 bp, mouse
ggggcaccccaagtaagagt

SEQ ID NO: 535259 - DNA, 20 bp, mouse
gtggtactggcggatgtgat

SEQ ID NO: 535260 - DNA, 20 bp, mouse
ggcacatggcgaaaggtgga

SEQ ID NO: 535261 - DNA, 20 bp, mouse
gtcgtggatgtgttcaccac

SEQ ID NO: 535262 - DNA, 20 bp, mouse
ggtaagagtaggaaggttcg

SEQ ID NO: 535263 - DNA, 20 bp, mouse
gagccgcagcacatggcgaa

SEQ ID NO: 535264 - DNA, 20 bp, mouse
ggggaaccatggaagacttc

SEQ ID NO: 535265 - DNA, 20 bp, mouse
gtcggggcagccgcagcaca

SEQ ID NO: 535266 - DNA, 20 bp, mouse
gtccgctgccgggaacggtc

SEQ ID NO: 535267 - DNA, 20 bp, mouse
gcgggtgtcagattggagtg

SEQ ID NO: 535268 - DNA, 20 bp, mouse
ggaacggtcgggtgtcagat

SEQ ID NO: 535269 - DNA, 20 bp, mouse
gtgaggacgcggctgaaatg

SEQ ID NO: 535270 - DNA, 20 bp, mouse
gcggccgctggcagtaatca

SEQ ID NO: 535271 - DNA, 20 bp, mouse
ggcaggtccgctgccgggaa

SEQ ID NO: 535272 - DNA, 20 bp, mouse
ggcgccgcgtacagacaaag

SEQ ID NO: 535273 - DNA, 20 bp, mouse
ggtgtcagattggagtgggg

SEQ ID NO: 535274 - DNA, 20 bp, mouse
gggaccgcgggagcacggag

SEQ ID NO: 535275 - DNA, 20 bp, mouse
gccagcggccgcggaagaag

SEQ ID NO: 535276 - DNA, 20 bp, mouse
gggaaggcgtccccaacgac

SEQ ID NO: 535277 - DNA, 20 bp, mouse
gaaccaccccctgccgagga

SEQ ID NO: 535278 - DNA, 20 bp, mouse
gacgctgacgcctgtcgttg

SEQ ID NO: 535279 - DNA, 20 bp, mouse
gtcacaaccaccccctgccg

SEQ ID NO: 535280 - DNA, 20 bp, mouse
ggggacgccttcctcggcag

SEQ ID NO: 535281 - DNA, 20 bp, mouse
gcgccttcctcggcaggggg

SEQ ID NO: 535282 - DNA, 20 bp, mouse
ggcgtctgtcccggagaaac

SEQ ID NO: 535283 - DNA, 20 bp, mouse
ggcggaaagcctgtttctcc

SEQ ID NO: 535284 - DNA, 20 bp, mouse
ggcgtgggaagacactatgg

SEQ ID NO: 535285 - DNA, 20 bp, mouse
gcctgcgtgggaagacacta

SEQ ID NO: 535286 - DNA, 20 bp, mouse
gccgcggccgccctagtgag

SEQ ID NO: 535287 - DNA, 20 bp, mouse
gggccttcagcctctcacta

SEQ ID NO: 535288 - DNA, 20 bp, mouse
gcgccctagtgagaggctga

SEQ ID NO: 535289 - DNA, 20 bp, mouse
gccccgtgcgggtcactcac

SEQ ID NO: 535290 - DNA, 20 bp, mouse
ggtagtggagcgggagcccg

SEQ ID NO: 535291 - DNA, 20 bp, mouse
gtccccgcgcgagtctcagc

SEQ ID NO: 535292 - DNA, 20 bp, mouse
gagagtctgatgccagaggg

SEQ ID NO: 535293 - DNA, 20 bp, mouse
gctcccgctccactacgaga

SEQ ID NO: 535294 - DNA, 20 bp, mouse
gccgcacggggcgggcacgg

SEQ ID NO: 535295 - DNA, 20 bp, mouse
gcgccggctgagactcgcgc

SEQ ID NO: 535296 - DNA, 20 bp, mouse
gggcggtggtgacagagcgc

SEQ ID NO: 535297 - DNA, 20 bp, mouse
ggcgctccagcgcagcacgg

SEQ ID NO: 535298 - DNA, 20 bp, mouse
gctccagcgcagcacggcgg

SEQ ID NO: 535299 - DNA, 20 bp, mouse
gccgcgcctaggcagactct

SEQ ID NO: 535300 - DNA, 20 bp, mouse
gctaggcgcgggtgaccctg

SEQ ID NO: 535301 - DNA, 20 bp, mouse
ggctggacgcaggggaggac

SEQ ID NO: 535302 - DNA, 20 bp, mouse
gcctggccagctgcgcgtcc

SEQ ID NO: 535303 - DNA, 20 bp, mouse
ggcccagacagacctgtctg

SEQ ID NO: 535304 - DNA, 20 bp, mouse
gtccgcagacaggtctgtct

SEQ ID NO: 535305 - DNA, 20 bp, mouse
ggtgacagagcgcgggcacc

SEQ ID NO: 535306 - DNA, 20 bp, mouse
gttgaggcaaccccaaggac

SEQ ID NO: 535307 - DNA, 20 bp, mouse
gacacactgatgccaagatt

SEQ ID NO: 535308 - DNA, 20 bp, mouse
gtgatgccaagattcggtat

SEQ ID NO: 535309 - DNA, 20 bp, mouse
ggaactctgctataaggagg

SEQ ID NO: 535310 - DNA, 20 bp, mouse
gcagttttgaggcaacccca

SEQ ID NO: 535311 - DNA, 20 bp, mouse
gcaggctttggcccaacagc

SEQ ID NO: 535312 - DNA, 20 bp, mouse
gccggtgtagcaaattccag

SEQ ID NO: 535313 - DNA, 20 bp, mouse
gctcttccgataccgaatct

SEQ ID NO: 535314 - DNA, 20 bp, mouse
ggaagccatgcctgtccttg

SEQ ID NO: 535315 - DNA, 20 bp, mouse
gtaaagtctacagtaacctt

SEQ ID NO: 535316 - DNA, 20 bp, mouse
gatgttggccgggaacagag

SEQ ID NO: 535317 - DNA, 20 bp, mouse
gctgttcccggccaacatgg

SEQ ID NO: 535318 - DNA, 20 bp, mouse
gcccggctctgcggacgagg

SEQ ID NO: 535319 - DNA, 20 bp, mouse
gttggccgggaacagagtgg

SEQ ID NO: 535320 - DNA, 20 bp, mouse
gaaagccggcgctgactcgg

SEQ ID NO: 535321 - DNA, 20 bp, mouse
gcagcgccggctttgagtcc

SEQ ID NO: 535322 - DNA, 20 bp, mouse
ggctttgagtcccggctctg

SEQ ID NO: 535323 - DNA, 20 bp, mouse
ggcggcccccgagtcagcgc

SEQ ID NO: 535324 - DNA, 20 bp, mouse
gagtcccggctctgcggacg

SEQ ID NO: 535325 - DNA, 20 bp, mouse
gggcgtgtaaagccacgtcg

SEQ ID NO: 535326 - DNA, 20 bp, mouse
gaacatggcggagtgagcgg

SEQ ID NO: 535327 - DNA, 20 bp, mouse
gggcaacatggcggagtgag

SEQ ID NO: 535328 - DNA, 20 bp, mouse
gcggggcttcacaacaacag

SEQ ID NO: 535329 - DNA, 20 bp, mouse
gcaggcagggggcggcaaca

SEQ ID NO: 535330 - DNA, 20 bp, mouse
gggagtgagcggcggcgtcg

SEQ ID NO: 535331 - DNA, 20 bp, mouse
gtggccgctaccgcaggcag

SEQ ID NO: 535332 - DNA, 20 bp, mouse
gacaacaacagcggcgccgg

SEQ ID NO: 535333 - DNA, 20 bp, mouse
gatctgcgaggagctccgtg

SEQ ID NO: 535334 - DNA, 20 bp, mouse
gcgctaccgcaggcaggggg

SEQ ID NO: 535335 - DNA, 20 bp, mouse
gagggccgtgcgagacgagg

SEQ ID NO: 535336 - DNA, 20 bp, mouse
ggctttgagctttactgtaa

SEQ ID NO: 535337 - DNA, 20 bp, mouse
gctgtaacggctgataaact

SEQ ID NO: 535338 - DNA, 20 bp, mouse
gcagaatggcagccagagag

SEQ ID NO: 535339 - DNA, 20 bp, mouse
gaaaataaagtaatatgata

SEQ ID NO: 535340 - DNA, 20 bp, mouse
gagttcaaagagcctctctc

SEQ ID NO: 535341 - DNA, 20 bp, mouse
gaatcctgaactggcaggtg

SEQ ID NO: 535342 - DNA, 20 bp, mouse
gtaatatttcctcaaaaaga

SEQ ID NO: 535343 - DNA, 20 bp, mouse
ggagtttgagtctatcctag

SEQ ID NO: 535344 - DNA, 20 bp, mouse
gcctggcccggcattgttct

SEQ ID NO: 535345 - DNA, 20 bp, mouse
gaaatattaaagtaccagag

SEQ ID NO: 535346 - DNA, 20 bp, mouse
gtcgccgcgggcagggcgga

SEQ ID NO: 535347 - DNA, 20 bp, mouse
gccggcttcggggtgacacg

SEQ ID NO: 535348 - DNA, 20 bp, mouse
gggcttcgccgcgggcaggg

SEQ ID NO: 535349 - DNA, 20 bp, mouse
gagggcagcaagttagcccg

SEQ ID NO: 535350 - DNA, 20 bp, mouse
ggcagcaagttagcccgcgg

SEQ ID NO: 535351 - DNA, 20 bp, mouse
gaagttagcccgcggcgggg

SEQ ID NO: 535352 - DNA, 20 bp, mouse
gcgctctgggacccagaccc

SEQ ID NO: 535353 - DNA, 20 bp, mouse
gagggctgcagcctgagggg

SEQ ID NO: 535354 - DNA, 20 bp, mouse
gggcctgtgagcgtggtgag

SEQ ID NO: 535355 - DNA, 20 bp, mouse
gcgcagggctgcagcctgag

SEQ ID NO: 535356 - DNA, 20 bp, mouse
gggccatggccgcctcggag

SEQ ID NO: 535357 - DNA, 20 bp, mouse
gaactcgtagagccgctccg

SEQ ID NO: 535358 - DNA, 20 bp, mouse
gtcgtagagccgctccgagg

SEQ ID NO: 535359 - DNA, 20 bp, mouse
gccagagcccggtcaggcca

SEQ ID NO: 535360 - DNA, 20 bp, mouse
gggtcaggccatggccgcct

SEQ ID NO: 535361 - DNA, 20 bp, mouse
ggcagggccagagcccggtc

SEQ ID NO: 535362 - DNA, 20 bp, mouse
gcgcggaccaggggcgagac

SEQ ID NO: 535363 - DNA, 20 bp, mouse
gtgactggccagggcaactg

SEQ ID NO: 535364 - DNA, 20 bp, mouse
gcgacaggtggcgcgcagca

SEQ ID NO: 535365 - DNA, 20 bp, mouse
gctggctgccgggctacctc

SEQ ID NO: 535366 - DNA, 20 bp, mouse
ggccgggctgcgtaacacga

SEQ ID NO: 535367 - DNA, 20 bp, mouse
ggcgggtcgccggagcaaag

SEQ ID NO: 535368 - DNA, 20 bp, mouse
ggagggactgccggactcgg

SEQ ID NO: 535369 - DNA, 20 bp, mouse
gcgagggtcgcgagctggag

SEQ ID NO: 535370 - DNA, 20 bp, mouse
gcaccgccaggactgagagt

SEQ ID NO: 535371 - DNA, 20 bp, mouse
gcagcccagccgagcctcgc

SEQ ID NO: 535372 - DNA, 20 bp, mouse
gcgccccagcccgaggaccc

SEQ ID NO: 535373 - DNA, 20 bp, mouse
gctgggggtcctagaaagtg

SEQ ID NO: 535374 - DNA, 20 bp, mouse
ggccaggactgagagtagga

SEQ ID NO: 535375 - DNA, 20 bp, mouse
gctgcgctgctggccgtctg

SEQ ID NO: 535376 - DNA, 20 bp, mouse
gggtaggcgcgttaaggagg

SEQ ID NO: 535377 - DNA, 20 bp, mouse
gcccggtgaccgcgcaggct

SEQ ID NO: 535378 - DNA, 20 bp, mouse
gcaggctgggcagctgcggt

SEQ ID NO: 535379 - DNA, 20 bp, mouse
gctgagacgccggccccatg

SEQ ID NO: 535380 - DNA, 20 bp, mouse
gtgcagcccggtgaccgcgc

SEQ ID NO: 535381 - DNA, 20 bp, mouse
ggctggagccggtctaacct

SEQ ID NO: 535382 - DNA, 20 bp, mouse
gcgtccgccggaaggcgaga

SEQ ID NO: 535383 - DNA, 20 bp, mouse
gcctgggaacgcgcacgtcc

SEQ ID NO: 535384 - DNA, 20 bp, mouse
gccaacgcccgaagtacggt

SEQ ID NO: 535385 - DNA, 20 bp, mouse
gcgccggaaggcgagaagga

SEQ ID NO: 535386 - DNA, 20 bp, mouse
gactggcaagcgccccccgt

SEQ ID NO: 535387 - DNA, 20 bp, mouse
gctgcggggtgaatctaaca

SEQ ID NO: 535388 - DNA, 20 bp, mouse
gccgcgaacggtccttgcac

SEQ ID NO: 535389 - DNA, 20 bp, mouse
gcgtgggcggaaagctggta

SEQ ID NO: 535390 - DNA, 20 bp, mouse
gcaggcgagctggccgcgaa

SEQ ID NO: 535391 - DNA, 20 bp, mouse
gccctacttctaggtaacag

SEQ ID NO: 535392 - DNA, 20 bp, mouse
gcggggtgaatctaacatgg

SEQ ID NO: 535393 - DNA, 20 bp, mouse
ggactggctgcccctgaaca

SEQ ID NO: 535394 - DNA, 20 bp, mouse
gccagctttccgcccacggg

SEQ ID NO: 535395 - DNA, 20 bp, mouse
gcttgccagtggccagtgca

SEQ ID NO: 535396 - DNA, 20 bp, mouse
gaaggcttgtgagaatctgg

SEQ ID NO: 535397 - DNA, 20 bp, mouse
ggctgagtccgcacagtcaa

SEQ ID NO: 535398 - DNA, 20 bp, mouse
gagttgtaggaggttaagag

SEQ ID NO: 535399 - DNA, 20 bp, mouse
gtgtggttgttgcttcccag

SEQ ID NO: 535400 - DNA, 20 bp, mouse
gtcaaaggcttgtgagaatc

SEQ ID NO: 535401 - DNA, 20 bp, mouse
ggttgctgtccctacagctg

SEQ ID NO: 535402 - DNA, 20 bp, mouse
gctcttgaaggcaaagttgt

SEQ ID NO: 535403 - DNA, 20 bp, mouse
gtgtaggaggttaagagggg

SEQ ID NO: 535404 - DNA, 20 bp, mouse
ggaagctgcttcacattctt

SEQ ID NO: 535405 - DNA, 20 bp, mouse
gaggggagggaaaaccatca

SEQ ID NO: 535406 - DNA, 20 bp, mouse
gacgctgggagcggccctgg

SEQ ID NO: 535407 - DNA, 20 bp, mouse
gcccgctccctgctagagga

SEQ ID NO: 535408 - DNA, 20 bp, mouse
gggctcccgctccctgctag

SEQ ID NO: 535409 - DNA, 20 bp, mouse
ggcgctgcgactcaccgcca

SEQ ID NO: 535410 - DNA, 20 bp, mouse
gctgctaacccgcccagctg

SEQ ID NO: 535411 - DNA, 20 bp, mouse
gccgcggcgacacagacgct

SEQ ID NO: 535412 - DNA, 20 bp, mouse
ggcgacacagacgctgggag

SEQ ID NO: 535413 - DNA, 20 bp, mouse
gagcgggagccgcagctggg

SEQ ID NO: 535414 - DNA, 20 bp, mouse
gcgccttccctcctctagca

SEQ ID NO: 535415 - DNA, 20 bp, mouse
ggacaaggtgggtggcactg

SEQ ID NO: 535416 - DNA, 20 bp, mouse
gcgtgaacgcagctcggcag

SEQ ID NO: 535417 - DNA, 20 bp, mouse
gaacgcagctcggcagtggc

SEQ ID NO: 535418 - DNA, 20 bp, mouse
ggcggcggagcaatggaccg

SEQ ID NO: 535419 - DNA, 20 bp, mouse
gcggccgccactgagcgggg

SEQ ID NO: 535420 - DNA, 20 bp, mouse
gcctccgcgggcacacaagt

SEQ ID NO: 535421 - DNA, 20 bp, mouse
gaccgggcttctcggggata

SEQ ID NO: 535422 - DNA, 20 bp, mouse
gttgcgagtgtgctgaggct

SEQ ID NO: 535423 - DNA, 20 bp, mouse
gaaagcagcgctgcccatca

SEQ ID NO: 535424 - DNA, 20 bp, mouse
gcggctgcctccccgctcag

SEQ ID NO: 535425 - DNA, 20 bp, mouse
gaaacccgtgccctccggga

SEQ ID NO: 535426 - DNA, 20 bp, mouse
gcggctggggcacccgggag

SEQ ID NO: 535427 - DNA, 20 bp, mouse
gccgccgcctggatatagtg

SEQ ID NO: 535428 - DNA, 20 bp, mouse
gcccgagcaggtagaaggag

SEQ ID NO: 535429 - DNA, 20 bp, mouse
gctggggcacccgggagcgg

SEQ ID NO: 535430 - DNA, 20 bp, mouse
gagcggcggcgggctagcag

SEQ ID NO: 535431 - DNA, 20 bp, mouse
gcgggcaaggtaggagtgtg

SEQ ID NO: 535432 - DNA, 20 bp, mouse
ggccttgccgcactatatcc

SEQ ID NO: 535433 - DNA, 20 bp, mouse
ggcgggcggctggggcaccc

SEQ ID NO: 535434 - DNA, 20 bp, mouse
gctctccacccaacccggag

SEQ ID NO: 535435 - DNA, 20 bp, mouse
gtcggtgtgaaagagatcat

SEQ ID NO: 535436 - DNA, 20 bp, mouse
gctagggctgaagaaacacc

SEQ ID NO: 535437 - DNA, 20 bp, mouse
gtagcgcgaacacatcccca

SEQ ID NO: 535438 - DNA, 20 bp, mouse
gcccacggttccgggcacaa

SEQ ID NO: 535439 - DNA, 20 bp, mouse
ggctgaagaaacaccgggag

SEQ ID NO: 535440 - DNA, 20 bp, mouse
gcaggaggtgctgaaagcta

SEQ ID NO: 535441 - DNA, 20 bp, mouse
gaggactgaccagaatgaag

SEQ ID NO: 535442 - DNA, 20 bp, mouse
gaatgggcagggaacgatgg

SEQ ID NO: 535443 - DNA, 20 bp, mouse
ggatcctccctaccagagat

SEQ ID NO: 535444 - DNA, 20 bp, mouse
gcttccggcccccccacacc

SEQ ID NO: 535445 - DNA, 20 bp, mouse
gcgcgctaaggagccaggtg

SEQ ID NO: 535446 - DNA, 20 bp, mouse
gggctctccggttgaagaag

SEQ ID NO: 535447 - DNA, 20 bp, mouse
gcagccatactggatctcaa

SEQ ID NO: 535448 - DNA, 20 bp, mouse
gtctccggttgaagaagcgg

SEQ ID NO: 535449 - DNA, 20 bp, mouse
gggagagccccctgctgaaa

SEQ ID NO: 535450 - DNA, 20 bp, mouse
gggaggaaccggccaatccg

SEQ ID NO: 535451 - DNA, 20 bp, mouse
gtgaagaagcggcgggtgag

SEQ ID NO: 535452 - DNA, 20 bp, mouse
gcgggagcgacggtctggta

SEQ ID NO: 535453 - DNA, 20 bp, mouse
gtgtggcagtgcgaaaggtt

SEQ ID NO: 535454 - DNA, 20 bp, mouse
gggagtgcggtcgggagcga

SEQ ID NO: 535455 - DNA, 20 bp, mouse
gcaaaggctgcgtcacgtcc

SEQ ID NO: 535456 - DNA, 20 bp, mouse
gcccgagttctactggagag

SEQ ID NO: 535457 - DNA, 20 bp, mouse
gaggacttgacggaacatct

SEQ ID NO: 535458 - DNA, 20 bp, mouse
gttgcagtgctaggacttga

SEQ ID NO: 535459 - DNA, 20 bp, mouse
ggcgcatgtgcagtgccaaa

SEQ ID NO: 535460 - DNA, 20 bp, mouse
gcactgagcgtgcatgggaa

SEQ ID NO: 535461 - DNA, 20 bp, mouse
gcaaccggaatattacaagg

SEQ ID NO: 535462 - DNA, 20 bp, mouse
gcgctcagtgtcaccggaag

SEQ ID NO: 535463 - DNA, 20 bp, mouse
gatgcaaccggaatattaca

SEQ ID NO: 535464 - DNA, 20 bp, mouse
gccactgcgtgcgcataagt

SEQ ID NO: 535465 - DNA, 20 bp, mouse
gaagtgggcggggcaaagac

SEQ ID NO: 535466 - DNA, 20 bp, mouse
gaggaggactcagtttcccg

SEQ ID NO: 535467 - DNA, 20 bp, mouse
gtgtggttcgcgatccgagg

SEQ ID NO: 535468 - DNA, 20 bp, mouse
gcgtcactcggagccttgca

SEQ ID NO: 535469 - DNA, 20 bp, mouse
gtcggagccttgcagggcta

SEQ ID NO: 535470 - DNA, 20 bp, mouse
ggcgaaccacagtctctctc

SEQ ID NO: 535471 - DNA, 20 bp, mouse
ggactgtggttcgcgatccg

SEQ ID NO: 535472 - DNA, 20 bp, mouse
ggctagggtgtcggaagccg

SEQ ID NO: 535473 - DNA, 20 bp, mouse
ggctgtggccgggagacctc

SEQ ID NO: 535474 - DNA, 20 bp, mouse
gtccgtcgcggggcgcgcaa

SEQ ID NO: 535475 - DNA, 20 bp, mouse
ggacggagggatgggatccg

SEQ ID NO: 535476 - DNA, 20 bp, mouse
gtccgagcgcgggaaactat

SEQ ID NO: 535477 - DNA, 20 bp, mouse
ggccgcgcggtgagttgggt

SEQ ID NO: 535478 - DNA, 20 bp, mouse
ggagcgccgcgcggtgagtt

SEQ ID NO: 535479 - DNA, 20 bp, mouse
ggcgggaaactatgggtctg

SEQ ID NO: 535480 - DNA, 20 bp, mouse
gctaggtaggacctcagact

SEQ ID NO: 535481 - DNA, 20 bp, mouse
gtcccacccaactcaccgcg

SEQ ID NO: 535482 - DNA, 20 bp, mouse
gggagcgtccggggtatacg

SEQ ID NO: 535483 - DNA, 20 bp, mouse
gagggcagagcgggatcccc

SEQ ID NO: 535484 - DNA, 20 bp, mouse
gaaggacctgatgcagacta

SEQ ID NO: 535485 - DNA, 20 bp, mouse
ggcacagtagggaggctctc

SEQ ID NO: 535486 - DNA, 20 bp, mouse
gccccagtgacgtcacgcgg

SEQ ID NO: 535487 - DNA, 20 bp, mouse
gggaggggaagagagtgcaa

SEQ ID NO: 535488 - DNA, 20 bp, mouse
gcgcgtgggcaggtccagaa

SEQ ID NO: 535489 - DNA, 20 bp, mouse
ggaccgaagggtgctcgcgt

SEQ ID NO: 535490 - DNA, 20 bp, mouse
gatcttgctctccacgtctc

SEQ ID NO: 535491 - DNA, 20 bp, mouse
gattagagcccagccgccac

SEQ ID NO: 535492 - DNA, 20 bp, mouse
gatcaggacgcagctgccag

SEQ ID NO: 535493 - DNA, 20 bp, mouse
gactcgagctcacctgagcg

SEQ ID NO: 535494 - DNA, 20 bp, mouse
gtggcaggatcaggaccgaa

SEQ ID NO: 535495 - DNA, 20 bp, mouse
gccccgcgccctggttctaa

SEQ ID NO: 535496 - DNA, 20 bp, mouse
gatggcgccagaaccagtag

SEQ ID NO: 535497 - DNA, 20 bp, mouse
gccctggctacgtacttccg

SEQ ID NO: 535498 - DNA, 20 bp, mouse
gcagacggctacagacccgg

SEQ ID NO: 535499 - DNA, 20 bp, mouse
gtggctacgtacttccgggg

SEQ ID NO: 535500 - DNA, 20 bp, mouse
gtcttagtgagatcccggat

SEQ ID NO: 535501 - DNA, 20 bp, mouse
gacggctacagacccggagg

SEQ ID NO: 535502 - DNA, 20 bp, mouse
gctgcggatgacacaccaga

SEQ ID NO: 535503 - DNA, 20 bp, mouse
gctacagacccggaggcggg

SEQ ID NO: 535504 - DNA, 20 bp, mouse
gccatggctcaacccgctac

SEQ ID NO: 535505 - DNA, 20 bp, mouse
gcaccagacggctacagacc

SEQ ID NO: 535506 - DNA, 20 bp, mouse
gctgcaaccccagaaccgtc

SEQ ID NO: 535507 - DNA, 20 bp, mouse
gcggcagcccgacggttctg

SEQ ID NO: 535508 - DNA, 20 bp, mouse
gcagtctcccgggaacggat

SEQ ID NO: 535509 - DNA, 20 bp, mouse
gggcggctagcaactcagat

SEQ ID NO: 535510 - DNA, 20 bp, mouse
gctcggggagccccaaaggg

SEQ ID NO: 535511 - DNA, 20 bp, mouse
gccggccggtgcgcggtcag

SEQ ID NO: 535512 - DNA, 20 bp, mouse
gtgcgtccgggtgagaaccg

SEQ ID NO: 535513 - DNA, 20 bp, mouse
ggacttccggagaaaggtga

SEQ ID NO: 535514 - DNA, 20 bp, mouse
ggtgtcgcgggaccccaggt

SEQ ID NO: 535515 - DNA, 20 bp, mouse
ggccttcagtctcccgggaa

SEQ ID NO: 535516 - DNA, 20 bp, mouse
gcacggccgggagaaccaag

SEQ ID NO: 535517 - DNA, 20 bp, mouse
gggccgggagaaccaagcgg

SEQ ID NO: 535518 - DNA, 20 bp, mouse
gaccaaacccgacacggcca

SEQ ID NO: 535519 - DNA, 20 bp, mouse
gctcccggccgtggccgtgt

SEQ ID NO: 535520 - DNA, 20 bp, mouse
gacccgacacggccacggcc

SEQ ID NO: 535521 - DNA, 20 bp, mouse
gagaaacaccaaacccgaca

SEQ ID NO: 535522 - DNA, 20 bp, mouse
gtgggccccaggagatcagg

SEQ ID NO: 535523 - DNA, 20 bp, mouse
ggtttctgcatcatgtcggg

SEQ ID NO: 535524 - DNA, 20 bp, mouse
gggtgtttctgcatcatgtc

SEQ ID NO: 535525 - DNA, 20 bp, mouse
ggggagaaccaagcggcggg

SEQ ID NO: 535526 - DNA, 20 bp, mouse
gtgggctgctggtctgagag

SEQ ID NO: 535527 - DNA, 20 bp, mouse
gaccagcagcccagttctca

SEQ ID NO: 535528 - DNA, 20 bp, mouse
gaggacagagacacgctcag

SEQ ID NO: 535529 - DNA, 20 bp, mouse
gggaggaggaccttgagaac

SEQ ID NO: 535530 - DNA, 20 bp, mouse
ggaggggtccctgaactcgg

SEQ ID NO: 535531 - DNA, 20 bp, mouse
ggctgccagctgattctcgg

SEQ ID NO: 535532 - DNA, 20 bp, mouse
ggagagggcgtgttagggga

SEQ ID NO: 535533 - DNA, 20 bp, mouse
gtggcaggatggaagccgag

SEQ ID NO: 535534 - DNA, 20 bp, mouse
ggaggggcggggcaagtcat

SEQ ID NO: 535535 - DNA, 20 bp, mouse
gttaagagagggcgtgttag

SEQ ID NO: 535536 - DNA, 20 bp, mouse
gaccaggctgcggccccgag

SEQ ID NO: 535537 - DNA, 20 bp, mouse
ggagccaagagtgggcaacg

SEQ ID NO: 535538 - DNA, 20 bp, mouse
ggcgatgctccgggagcctg

SEQ ID NO: 535539 - DNA, 20 bp, mouse
ggagcggcgaagtctttctc

SEQ ID NO: 535540 - DNA, 20 bp, mouse
gtctccgggcgcgatgctcc

SEQ ID NO: 535541 - DNA, 20 bp, mouse
gacgccgcgttgcccactct

SEQ ID NO: 535542 - DNA, 20 bp, mouse
ggctcccggagcatcgcgcc

SEQ ID NO: 535543 - DNA, 20 bp, mouse
ggtacggtgatgtcgagata

SEQ ID NO: 535544 - DNA, 20 bp, mouse
gatggagtctcgacagggta

SEQ ID NO: 535545 - DNA, 20 bp, mouse
gacaaaatggagtctcgaca

SEQ ID NO: 535546 - DNA, 20 bp, mouse
gtccggagctgaccgcggta

SEQ ID NO: 535547 - DNA, 20 bp, mouse
gggctgtccggagctgaccg

SEQ ID NO: 535548 - DNA, 20 bp, mouse
ggaggagcaaggacgagacg

SEQ ID NO: 535549 - DNA, 20 bp, mouse
ggtagcatcgcaccgtaccg

SEQ ID NO: 535550 - DNA, 20 bp, mouse
gagccagcagagcggccagt

SEQ ID NO: 535551 - DNA, 20 bp, mouse
ggtggtgagcagagcgaaag

SEQ ID NO: 535552 - DNA, 20 bp, mouse
gacctcattgtccccaggcc

SEQ ID NO: 535553 - DNA, 20 bp, mouse
gagtgggatgtacacgtagt

SEQ ID NO: 535554 - DNA, 20 bp, mouse
ggtccccaggccgggctgtc

SEQ ID NO: 535555 - DNA, 20 bp, mouse
gacacgtgaaacagcagctg

SEQ ID NO: 535556 - DNA, 20 bp, mouse
ggaagcccagcagggcaata

SEQ ID NO: 535557 - DNA, 20 bp, mouse
gcgaatgaaggtgtccccca

SEQ ID NO: 535558 - DNA, 20 bp, mouse
gtgtcacggcccagccatgg

SEQ ID NO: 535559 - DNA, 20 bp, mouse
gagggcaatatggcgaatga

SEQ ID NO: 535560 - DNA, 20 bp, mouse
ggaaggtgtcccccatggct

SEQ ID NO: 535561 - DNA, 20 bp, mouse
gactcacatagtgctggctg

SEQ ID NO: 535562 - DNA, 20 bp, mouse
gtgagagggagggggatcag

SEQ ID NO: 535563 - DNA, 20 bp, mouse
gtaggctactcacatagtgc

SEQ ID NO: 535564 - DNA, 20 bp, mouse
gttcgccatattgccctgct

SEQ ID NO: 535565 - DNA, 20 bp, mouse
gaaaccacctggaccaggga

SEQ ID NO: 535566 - DNA, 20 bp, mouse
ggccgagcaggtgagttgag

SEQ ID NO: 535567 - DNA, 20 bp, mouse
ggcagagccccacccatggg

SEQ ID NO: 535568 - DNA, 20 bp, mouse
gagagcagagccccacccat

SEQ ID NO: 535569 - DNA, 20 bp, mouse
ggggatgaggtttccagagg

SEQ ID NO: 535570 - DNA, 20 bp, mouse
gtcatcccccagagccggaa

SEQ ID NO: 535571 - DNA, 20 bp, mouse
gggaaaggctataattacag

SEQ ID NO: 535572 - DNA, 20 bp, mouse
gggccaggggcaattagttg

SEQ ID NO: 535573 - DNA, 20 bp, mouse
gtcagagccacccatgggtg

SEQ ID NO: 535574 - DNA, 20 bp, mouse
gggctgcgtgaacactatcc

SEQ ID NO: 535575 - DNA, 20 bp, mouse
gcctctgaggttgttctgga

SEQ ID NO: 535576 - DNA, 20 bp, mouse
gtggctgagaagacgtgtga

SEQ ID NO: 535577 - DNA, 20 bp, mouse
ggcctgaaggaggtacttca

SEQ ID NO: 535578 - DNA, 20 bp, mouse
gcagggcgggacctcctcaa

SEQ ID NO: 535579 - DNA, 20 bp, mouse
ggccttgcccaaccagatcc

SEQ ID NO: 535580 - DNA, 20 bp, mouse
ggctctcagatgcacatagg

SEQ ID NO: 535581 - DNA, 20 bp, mouse
gtgcacagcagttgaggaag

SEQ ID NO: 535582 - DNA, 20 bp, mouse
gtgaaggaggtacttcaagg

SEQ ID NO: 535583 - DNA, 20 bp, mouse
gaggccagtttcagtctgaa

SEQ ID NO: 535584 - DNA, 20 bp, mouse
gtgatcccaataggcctggg

SEQ ID NO: 535585 - DNA, 20 bp, mouse
ggtgggtatggggaagtaag

SEQ ID NO: 535586 - DNA, 20 bp, mouse
gctctccgagagctacgcgg

SEQ ID NO: 535587 - DNA, 20 bp, mouse
gccgcaccgggacgccaccg

SEQ ID NO: 535588 - DNA, 20 bp, mouse
gcacaggcctcgtgcggtaa

SEQ ID NO: 535589 - DNA, 20 bp, mouse
gcccctctccgagagctacg

SEQ ID NO: 535590 - DNA, 20 bp, mouse
gagtcacctgaggaccgcac

SEQ ID NO: 535591 - DNA, 20 bp, mouse
gggcatccgggcagccgcgg

SEQ ID NO: 535592 - DNA, 20 bp, mouse
gtcgtgcggtaacggcatcc

SEQ ID NO: 535593 - DNA, 20 bp, mouse
gcaggcagagcggaccgacc

SEQ ID NO: 535594 - DNA, 20 bp, mouse
gcggggcgcgcgcaaccggt

SEQ ID NO: 535595 - DNA, 20 bp, mouse
ggcgtcccggtgcggtcctc

SEQ ID NO: 535596 - DNA, 20 bp, mouse
gagcagcgcgagtcccgggg

SEQ ID NO: 535597 - DNA, 20 bp, mouse
gggcctcggcgtgcactgtg

SEQ ID NO: 535598 - DNA, 20 bp, mouse
gagtgcacgccgaggccgga

SEQ ID NO: 535599 - DNA, 20 bp, mouse
gaccggcctgcgatccgcgg

SEQ ID NO: 535600 - DNA, 20 bp, mouse
gcgcaccggcctgcgatccg

SEQ ID NO: 535601 - DNA, 20 bp, mouse
ggcaccggccgggtacgcag

SEQ ID NO: 535602 - DNA, 20 bp, mouse
gggcagcagcgcgagtcccg

SEQ ID NO: 535603 - DNA, 20 bp, mouse
ggtgcggcgaggtaaggcga

SEQ ID NO: 535604 - DNA, 20 bp, mouse
gtgcactgtgcggcgaggta

SEQ ID NO: 535605 - DNA, 20 bp, mouse
gtcggcggcaggcaggctcg

SEQ ID NO: 535606 - DNA, 20 bp, mouse
ggaactgctgaagttaggtg

SEQ ID NO: 535607 - DNA, 20 bp, mouse
gagtaacagaaccggaagaa

SEQ ID NO: 535608 - DNA, 20 bp, mouse
gctttctggagagagatctg

SEQ ID NO: 535609 - DNA, 20 bp, mouse
gaaggcactgaatagcctat

SEQ ID NO: 535610 - DNA, 20 bp, mouse
gggcaggagacaaaccgcag

SEQ ID NO: 535611 - DNA, 20 bp, mouse
gccgatggctgaggatcctc

SEQ ID NO: 535612 - DNA, 20 bp, mouse
gtctctagccctatctccga

SEQ ID NO: 535613 - DNA, 20 bp, mouse
gatcctcagccatcggagat

SEQ ID NO: 535614 - DNA, 20 bp, mouse
gagaatggtgataagaaatt

SEQ ID NO: 535615 - DNA, 20 bp, mouse
gccttttcttcttggagggt

SEQ ID NO: 535616 - DNA, 20 bp, mouse
ggcggcggctgagaacgagt

SEQ ID NO: 535617 - DNA, 20 bp, mouse
ggctgtgtcacggcgcgggt

SEQ ID NO: 535618 - DNA, 20 bp, mouse
gcgccgcggctgctgtgtca

SEQ ID NO: 535619 - DNA, 20 bp, mouse
ggcgggtggaggcggaaggg

SEQ ID NO: 535620 - DNA, 20 bp, mouse
ggcgggtgggcgcacggcat

SEQ ID NO: 535621 - DNA, 20 bp, mouse
gcgccgtgacacagcagccg

SEQ ID NO: 535622 - DNA, 20 bp, mouse
ggccgcgggtggaggcggaa

SEQ ID NO: 535623 - DNA, 20 bp, mouse
gcgggcggaagcgagcgccg

SEQ ID NO: 535624 - DNA, 20 bp, mouse
gcgccgggcgcgctactccc

SEQ ID NO: 535625 - DNA, 20 bp, mouse
gcacggagcgcgacatggtg

SEQ ID NO: 535626 - DNA, 20 bp, mouse
ggccaggctgagaatatttg

SEQ ID NO: 535627 - DNA, 20 bp, mouse
gatgatggccaccgagagag

SEQ ID NO: 535628 - DNA, 20 bp, mouse
gtccggatggtcctctctct

SEQ ID NO: 535629 - DNA, 20 bp, mouse
gaatttaagctgataggcag

SEQ ID NO: 535630 - DNA, 20 bp, mouse
gggatggtcctctctctcgg

SEQ ID NO: 535631 - DNA, 20 bp, mouse
gttgggtcttgttatccgga

SEQ ID NO: 535632 - DNA, 20 bp, mouse
gtctgctaatttaagctgat

SEQ ID NO: 535633 - DNA, 20 bp, mouse
gagacccgtctagcaaatca

SEQ ID NO: 535634 - DNA, 20 bp, mouse
ggcatttgggtcttgttatc

SEQ ID NO: 535635 - DNA, 20 bp, mouse
gctatgacttagggttgggt

SEQ ID NO: 535636 - DNA, 20 bp, mouse
gtagctaatggctaggatgt

SEQ ID NO: 535637 - DNA, 20 bp, mouse
gttaactaaggcttattata

SEQ ID NO: 535638 - DNA, 20 bp, mouse
ggaggggcaaagtacaggaa

SEQ ID NO: 535639 - DNA, 20 bp, mouse
gctacacaagaccttaaaaa

SEQ ID NO: 535640 - DNA, 20 bp, mouse
gtggttacctagagaattct

SEQ ID NO: 535641 - DNA, 20 bp, mouse
ggatgtgggcacagtgctgc

SEQ ID NO: 535642 - DNA, 20 bp, mouse
gggaatgaggggcaaagtac

SEQ ID NO: 535643 - DNA, 20 bp, mouse
ggaccttaaaaaagggagca

SEQ ID NO: 535644 - DNA, 20 bp, mouse
gctgtagttaggggatcgag

SEQ ID NO: 535645 - DNA, 20 bp, mouse
ggctccattgttatagctaa

SEQ ID NO: 535646 - DNA, 20 bp, mouse
ggatcacgaggagaacttcg

SEQ ID NO: 535647 - DNA, 20 bp, mouse
gccccggagcaggctaacgg

SEQ ID NO: 535648 - DNA, 20 bp, mouse
ggtcctagtgctacccagga

SEQ ID NO: 535649 - DNA, 20 bp, mouse
gccgggcgatcccgatcacg

SEQ ID NO: 535650 - DNA, 20 bp, mouse
gggttctcggatcttcctgt

SEQ ID NO: 535651 - DNA, 20 bp, mouse
ggaagatccgagaacccccc

SEQ ID NO: 535652 - DNA, 20 bp, mouse
gcggagcaggctaacggtgg

SEQ ID NO: 535653 - DNA, 20 bp, mouse
gcaaggagggaagcctgctt

SEQ ID NO: 535654 - DNA, 20 bp, mouse
ggacttctccgctgcctcgt

SEQ ID NO: 535655 - DNA, 20 bp, mouse
ggaaccccggagcaggctaa

SEQ ID NO: 535656 - DNA, 20 bp, mouse
gcagcaggcgcgcactccta

SEQ ID NO: 535657 - DNA, 20 bp, mouse
gagggccagagcggacccat

SEQ ID NO: 535658 - DNA, 20 bp, mouse
ggccggtggtaaggcaggcg

SEQ ID NO: 535659 - DNA, 20 bp, mouse
gcgcgccgacaggcttgaca

SEQ ID NO: 535660 - DNA, 20 bp, mouse
ggccgcgcctgccttaccac

SEQ ID NO: 535661 - DNA, 20 bp, mouse
gctccgcagcccgggcacct

SEQ ID NO: 535662 - DNA, 20 bp, mouse
gattgcactgggacaccggg

SEQ ID NO: 535663 - DNA, 20 bp, mouse
gaaagatgcccccaagccgg

SEQ ID NO: 535664 - DNA, 20 bp, mouse
ggcacaagagggttacccag

SEQ ID NO: 535665 - DNA, 20 bp, mouse
gagggcccaggtcgtagtgg

SEQ ID NO: 535666 - DNA, 20 bp, mouse
ggtccatggccgcatctcgg

SEQ ID NO: 535667 - DNA, 20 bp, mouse
gccgcatctcgggggcggga

SEQ ID NO: 535668 - DNA, 20 bp, mouse
gagagtgcagcgcgagggac

SEQ ID NO: 535669 - DNA, 20 bp, mouse
gtggcagctttggctggaag

SEQ ID NO: 535670 - DNA, 20 bp, mouse
gccgcggagtgtggagtgaa

SEQ ID NO: 535671 - DNA, 20 bp, mouse
gccggcaggcgtcgaggtgt

SEQ ID NO: 535672 - DNA, 20 bp, mouse
gagggtccatggccgcatct

SEQ ID NO: 535673 - DNA, 20 bp, mouse
gtcacaacaggacccctcct

SEQ ID NO: 535674 - DNA, 20 bp, mouse
gcatggccgcatctcggggg

SEQ ID NO: 535675 - DNA, 20 bp, mouse
ggtggagtgaaaggctctcg

SEQ ID NO: 535676 - DNA, 20 bp, mouse
ggggtacgcgacgaaggttg

SEQ ID NO: 535677 - DNA, 20 bp, mouse
gccgggcggcgcggcactca

SEQ ID NO: 535678 - DNA, 20 bp, mouse
gtcggtcgagaggcctggga

SEQ ID NO: 535679 - DNA, 20 bp, mouse
gggagcgcagcagcacgcac

SEQ ID NO: 535680 - DNA, 20 bp, mouse
gggggctgggtacgcgacga

SEQ ID NO: 535681 - DNA, 20 bp, mouse
gggcgcgcagtggcgagacc

SEQ ID NO: 535682 - DNA, 20 bp, mouse
gcgcgcggcgtgtcacgggg

SEQ ID NO: 535683 - DNA, 20 bp, mouse
ggggcggggcaagcgccggg

SEQ ID NO: 535684 - DNA, 20 bp, mouse
gcactggtggttagcagcac

SEQ ID NO: 535685 - DNA, 20 bp, mouse
gtaggcaggcggcacgtacc

SEQ ID NO: 535686 - DNA, 20 bp, mouse
gtagcgggtaccgacgactc

SEQ ID NO: 535687 - DNA, 20 bp, mouse
ggcagctcggaagagctcag

SEQ ID NO: 535688 - DNA, 20 bp, mouse
ggtacgtgctccagagtcgt

SEQ ID NO: 535689 - DNA, 20 bp, mouse
gcagctacagctagcgtctg

SEQ ID NO: 535690 - DNA, 20 bp, mouse
gtccgggagggcgatatcga

SEQ ID NO: 535691 - DNA, 20 bp, mouse
gcggtgtgaggagagatcgg

SEQ ID NO: 535692 - DNA, 20 bp, mouse
gtccgtcgcggaggggagga

SEQ ID NO: 535693 - DNA, 20 bp, mouse
gaccatggtgaagctcgcaa

SEQ ID NO: 535694 - DNA, 20 bp, mouse
gacgaaagcgactgcagtag

SEQ ID NO: 535695 - DNA, 20 bp, mouse
gctttccagaggcgattact

SEQ ID NO: 535696 - DNA, 20 bp, mouse
gggcagcgacggagggcgac

SEQ ID NO: 535697 - DNA, 20 bp, mouse
gacgggaagcggccgaggct

SEQ ID NO: 535698 - DNA, 20 bp, mouse
ggacggagggcgacgggaag

SEQ ID NO: 535699 - DNA, 20 bp, mouse
gggactcagctcggcatggg

SEQ ID NO: 535700 - DNA, 20 bp, mouse
ggggcggcaggccgcaaagg

SEQ ID NO: 535701 - DNA, 20 bp, mouse
gggcgggcggcaggccgcaa

SEQ ID NO: 535702 - DNA, 20 bp, mouse
gggcggactcagctcggcat

SEQ ID NO: 535703 - DNA, 20 bp, mouse
gggcgccacgagcagcaaca

SEQ ID NO: 535704 - DNA, 20 bp, mouse
ggccgcaaaggcggcagcga

SEQ ID NO: 535705 - DNA, 20 bp, mouse
gcggctgctgaggtccttcg

SEQ ID NO: 535706 - DNA, 20 bp, mouse
gcgcagggcacggaacgcgg

SEQ ID NO: 535707 - DNA, 20 bp, mouse
gctggggtgtggagcaggta

SEQ ID NO: 535708 - DNA, 20 bp, mouse
gttggaaggacagcgcacag

SEQ ID NO: 535709 - DNA, 20 bp, mouse
ggcaggtagggcgcagggca

SEQ ID NO: 535710 - DNA, 20 bp, mouse
gcggaacgcgggggcttgga

SEQ ID NO: 535711 - DNA, 20 bp, mouse
ggagagctcaggacccgagg

SEQ ID NO: 535712 - DNA, 20 bp, mouse
gccaggctggggacccctgg

SEQ ID NO: 535713 - DNA, 20 bp, mouse
gcccgcggaagatagctctc

SEQ ID NO: 535714 - DNA, 20 bp, mouse
gtagctctccggacccccag

SEQ ID NO: 535715 - DNA, 20 bp, mouse
gtccggagagctatcttccg

SEQ ID NO: 535716 - DNA, 20 bp, mouse
gtcccgactgtcccattcca

SEQ ID NO: 535717 - DNA, 20 bp, mouse
gagctgagaggaaggtcact

SEQ ID NO: 535718 - DNA, 20 bp, mouse
gctgatctgtagcctcacac

SEQ ID NO: 535719 - DNA, 20 bp, mouse
gcagaaagctgtacactaga

SEQ ID NO: 535720 - DNA, 20 bp, mouse
gcaggaagcccaacgtctta

SEQ ID NO: 535721 - DNA, 20 bp, mouse
gtaggcaggccaccctttca

SEQ ID NO: 535722 - DNA, 20 bp, mouse
ggggtggcctgcctagacac

SEQ ID NO: 535723 - DNA, 20 bp, mouse
gtatcaaagggtcgcatcgt

SEQ ID NO: 535724 - DNA, 20 bp, mouse
gagatatgggctccctgaaa

SEQ ID NO: 535725 - DNA, 20 bp, mouse
ggactcactgctctgctcaa

SEQ ID NO: 535726 - DNA, 20 bp, mouse
gctcgcccggcctgaagaac

SEQ ID NO: 535727 - DNA, 20 bp, mouse
ggcatttcagccgctctccg

SEQ ID NO: 535728 - DNA, 20 bp, mouse
gtgcatccccctgaagtggg

SEQ ID NO: 535729 - DNA, 20 bp, mouse
ggcggcggcagccgtggagg

SEQ ID NO: 535730 - DNA, 20 bp, mouse
gaccgacggacgacaggacg

SEQ ID NO: 535731 - DNA, 20 bp, mouse
gaggagtccccccacttcag

SEQ ID NO: 535732 - DNA, 20 bp, mouse
ggctccgaccgacggacgac

SEQ ID NO: 535733 - DNA, 20 bp, mouse
gcggccgcggcggccctagg

SEQ ID NO: 535734 - DNA, 20 bp, mouse
ggactcctgctccggaggag

SEQ ID NO: 535735 - DNA, 20 bp, mouse
ggccggggagcgcggcccag

SEQ ID NO: 535736 - DNA, 20 bp, mouse
gtattaacacgggaacatgg

SEQ ID NO: 535737 - DNA, 20 bp, mouse
gaggcagcagttattaacac

SEQ ID NO: 535738 - DNA, 20 bp, mouse
gagttattaacacgggaaca

SEQ ID NO: 535739 - DNA, 20 bp, mouse
gccgtcacgccgtcaggtgc

SEQ ID NO: 535740 - DNA, 20 bp, mouse
ggccgcccgtgagcccccag

SEQ ID NO: 535741 - DNA, 20 bp, mouse
ggacggcagcccgcacctga

SEQ ID NO: 535742 - DNA, 20 bp, mouse
ggcgccgggcgagagagctc

SEQ ID NO: 535743 - DNA, 20 bp, mouse
gtcgcgggctccgcacgcct

SEQ ID NO: 535744 - DNA, 20 bp, mouse
gccgagtccccgggagagaa

SEQ ID NO: 535745 - DNA, 20 bp, mouse
ggctccgcacgcctgggcag

SEQ ID NO: 535746 - DNA, 20 bp, mouse
gcccaggtgcgggtgaccaa

SEQ ID NO: 535747 - DNA, 20 bp, mouse
gagggacgcgccagagtgga

SEQ ID NO: 535748 - DNA, 20 bp, mouse
gtattccacaaacccaggtg

SEQ ID NO: 535749 - DNA, 20 bp, mouse
gcgccgcgagccctccactc

SEQ ID NO: 535750 - DNA, 20 bp, mouse
gaccaagggacgcgccagag

SEQ ID NO: 535751 - DNA, 20 bp, mouse
gcgccagagtggagggctcg

SEQ ID NO: 535752 - DNA, 20 bp, mouse
gagggctcgcggcgtctcca

SEQ ID NO: 535753 - DNA, 20 bp, mouse
gggtgctgagatccagaacg

SEQ ID NO: 535754 - DNA, 20 bp, mouse
ggacccggggagacctgcat

SEQ ID NO: 535755 - DNA, 20 bp, mouse
ggacactattccacaaaccc

SEQ ID NO: 535756 - DNA, 20 bp, mouse
ggcctcggcggagtcggtgt

SEQ ID NO: 535757 - DNA, 20 bp, mouse
gctcctcagagcgccggcgg

SEQ ID NO: 535758 - DNA, 20 bp, mouse
gcagctcctcagagcgccgg

SEQ ID NO: 535759 - DNA, 20 bp, mouse
ggccgacaccgactccgccg

SEQ ID NO: 535760 - DNA, 20 bp, mouse
ggcggcggcctcggcggagt

SEQ ID NO: 535761 - DNA, 20 bp, mouse
gccggcgggaagaggagact

SEQ ID NO: 535762 - DNA, 20 bp, mouse
ggagccccagcggcaagcag

SEQ ID NO: 535763 - DNA, 20 bp, mouse
gcctcagctcctcagagcgc

SEQ ID NO: 535764 - DNA, 20 bp, mouse
ggccgcgggactacaaatcc

SEQ ID NO: 535765 - DNA, 20 bp, mouse
gcaggcgacagggatcgcgc

SEQ ID NO: 535766 - DNA, 20 bp, mouse
gtaaggtccgctcggatcac

SEQ ID NO: 535767 - DNA, 20 bp, mouse
gcagggtccggatccttcca

SEQ ID NO: 535768 - DNA, 20 bp, mouse
gctccttccggtgatccgag

SEQ ID NO: 535769 - DNA, 20 bp, mouse
gcacggctaagtgtctgggt

SEQ ID NO: 535770 - DNA, 20 bp, mouse
gggagcgctgccagccggta

SEQ ID NO: 535771 - DNA, 20 bp, mouse
gcacaggccggagcgaagaa

SEQ ID NO: 535772 - DNA, 20 bp, mouse
ggtccgctcggatcaccgga

SEQ ID NO: 535773 - DNA, 20 bp, mouse
gtagcgtcgggacgagggga

SEQ ID NO: 535774 - DNA, 20 bp, mouse
gaagtgtctgggtcggtcta

SEQ ID NO: 535775 - DNA, 20 bp, mouse
gcagccggtaaggacgagag

SEQ ID NO: 535776 - DNA, 20 bp, mouse
gcgcagtctcctggcccagg

SEQ ID NO: 535777 - DNA, 20 bp, mouse
gcctggtaagtgtgccacct

SEQ ID NO: 535778 - DNA, 20 bp, mouse
gatgcgcagtctcctggccc

SEQ ID NO: 535779 - DNA, 20 bp, mouse
gtaatgaaattggtccccca

SEQ ID NO: 535780 - DNA, 20 bp, mouse
ggcacgcatgcgcagtctcc

SEQ ID NO: 535781 - DNA, 20 bp, mouse
ggcacacttaccaggtagtc

SEQ ID NO: 535782 - DNA, 20 bp, mouse
ggcaagctagagggctgtgg

SEQ ID NO: 535783 - DNA, 20 bp, mouse
ggctgcgagaacacgctcga

SEQ ID NO: 535784 - DNA, 20 bp, mouse
gcattagccgctcctagaaa

SEQ ID NO: 535785 - DNA, 20 bp, mouse
gtaatggcaaaactaaagta

SEQ ID NO: 535786 - DNA, 20 bp, mouse
gtgtcctacggcgggcaggt

SEQ ID NO: 535787 - DNA, 20 bp, mouse
ggccgaggcgtagtactgat

SEQ ID NO: 535788 - DNA, 20 bp, mouse
gcgtgcccgcgctagtcggt

SEQ ID NO: 535789 - DNA, 20 bp, mouse
gacggcgggcaggtgggcag

SEQ ID NO: 535790 - DNA, 20 bp, mouse
gtggtggcgcctttgtccta

SEQ ID NO: 535791 - DNA, 20 bp, mouse
gcgcgggcacgaggcaatgg

SEQ ID NO: 535792 - DNA, 20 bp, mouse
ggcctcgtgcccgcgctagt

SEQ ID NO: 535793 - DNA, 20 bp, mouse
gtagcgcgggcacgaggcaa

SEQ ID NO: 535794 - DNA, 20 bp, mouse
ggagtctggcggacccaagt

SEQ ID NO: 535795 - DNA, 20 bp, mouse
ggccaccaaccgactagcgc

SEQ ID NO: 535796 - DNA, 20 bp, mouse
gcgccgacggccggacagac

SEQ ID NO: 535797 - DNA, 20 bp, mouse
gggccgcccgcagcccgacc

SEQ ID NO: 535798 - DNA, 20 bp, mouse
gccgacccggcagggcctca

SEQ ID NO: 535799 - DNA, 20 bp, mouse
gcccgcagcccgacccggca

SEQ ID NO: 535800 - DNA, 20 bp, mouse
ggacgggcacacgcgaggac

SEQ ID NO: 535801 - DNA, 20 bp, mouse
ggggcacacgcgaggacggg

SEQ ID NO: 535802 - DNA, 20 bp, mouse
gagggcctcagggagccggt

SEQ ID NO: 535803 - DNA, 20 bp, mouse
gtgcccgtctgtccggccgt

SEQ ID NO: 535804 - DNA, 20 bp, mouse
gcggctccctgaggccctgc

SEQ ID NO: 535805 - DNA, 20 bp, mouse
gacgctggcccgtaaggggt

SEQ ID NO: 535806 - DNA, 20 bp, mouse
ggaggcctcgagcaccccgg

SEQ ID NO: 535807 - DNA, 20 bp, mouse
gcgcccggcgccctgaccgt

SEQ ID NO: 535808 - DNA, 20 bp, mouse
gcgcccagcggcagaggcca

SEQ ID NO: 535809 - DNA, 20 bp, mouse
ggtacctgcagcagcaccca

SEQ ID NO: 535810 - DNA, 20 bp, mouse
gggtgctgctgcaggtacct

SEQ ID NO: 535811 - DNA, 20 bp, mouse
ggcagcagcacccacggtca

SEQ ID NO: 535812 - DNA, 20 bp, mouse
gtgcggggtgcgctcctgaa

SEQ ID NO: 535813 - DNA, 20 bp, mouse
gctgggaagcgcatcctccg

SEQ ID NO: 535814 - DNA, 20 bp, mouse
ggcctcgagcaccccggcgg

SEQ ID NO: 535815 - DNA, 20 bp, mouse
gggcgaggcctcgagcaccc

SEQ ID NO: 535816 - DNA, 20 bp, mouse
gtaaggtggcgaagctgcgg

SEQ ID NO: 535817 - DNA, 20 bp, mouse
gggtggcgaagctgcggcgg

SEQ ID NO: 535818 - DNA, 20 bp, mouse
ggcggccgcccggcctgagg

SEQ ID NO: 535819 - DNA, 20 bp, mouse
gaggcgccgagcctactcac

SEQ ID NO: 535820 - DNA, 20 bp, mouse
gtcgccgcgctgccgagcga

SEQ ID NO: 535821 - DNA, 20 bp, mouse
ggcgctgccgagcgagggcc

SEQ ID NO: 535822 - DNA, 20 bp, mouse
gctcgcccgggagcttcctc

SEQ ID NO: 535823 - DNA, 20 bp, mouse
ggttcaggctagacgagtgg

SEQ ID NO: 535824 - DNA, 20 bp, mouse
gctcggcagcgcggcgagct

SEQ ID NO: 535825 - DNA, 20 bp, mouse
gctggcgccctgggagcccg

SEQ ID NO: 535826 - DNA, 20 bp, mouse
gtacccggcatggaattggt

SEQ ID NO: 535827 - DNA, 20 bp, mouse
gaggcgcagtgccacttacc

SEQ ID NO: 535828 - DNA, 20 bp, mouse
gccggaggaagccccaagtc

SEQ ID NO: 535829 - DNA, 20 bp, mouse
gcgctgagttccaaacccgg

SEQ ID NO: 535830 - DNA, 20 bp, mouse
gcgaggagacggggcagtat

SEQ ID NO: 535831 - DNA, 20 bp, mouse
ggccgtggctgtcctgactt

SEQ ID NO: 535832 - DNA, 20 bp, mouse
gcacttacccggcatggaat

SEQ ID NO: 535833 - DNA, 20 bp, mouse
gtccgtgggtcagagtgcgg

SEQ ID NO: 535834 - DNA, 20 bp, mouse
gggctggagaccaagattcg

SEQ ID NO: 535835 - DNA, 20 bp, mouse
gctgaaactggagcagatag

SEQ ID NO: 535836 - DNA, 20 bp, mouse
gcgccatgcgcgccccgcag

SEQ ID NO: 535837 - DNA, 20 bp, mouse
gccggacgcgcgggccgctg

SEQ ID NO: 535838 - DNA, 20 bp, mouse
gccgccaggagcggagccgc

SEQ ID NO: 535839 - DNA, 20 bp, mouse
gcgcccctcgccgccaggag

SEQ ID NO: 535840 - DNA, 20 bp, mouse
gacgcggggcccggacgcgc

SEQ ID NO: 535841 - DNA, 20 bp, mouse
gcgcccgccgcgctacgacg

SEQ ID NO: 535842 - DNA, 20 bp, mouse
gcccgcaggtccctaagtct

SEQ ID NO: 535843 - DNA, 20 bp, mouse
gtcggcccgactcacctcgc

SEQ ID NO: 535844 - DNA, 20 bp, mouse
ggccgccggcgaggtgagtc

SEQ ID NO: 535845 - DNA, 20 bp, mouse
gagtcgggccgagtgcgcgg

SEQ ID NO: 535846 - DNA, 20 bp, mouse
ggactcaccaaggcacagta

SEQ ID NO: 535847 - DNA, 20 bp, mouse
gagtgttggcagcataccag

SEQ ID NO: 535848 - DNA, 20 bp, mouse
ggaatcaagagcagattggg

SEQ ID NO: 535849 - DNA, 20 bp, mouse
gtgagaacatccagagacgg

SEQ ID NO: 535850 - DNA, 20 bp, mouse
gtcagcactggtctggccac

SEQ ID NO: 535851 - DNA, 20 bp, mouse
gttggtgagtccttcattaa

SEQ ID NO: 535852 - DNA, 20 bp, mouse
gtagggagaccttaagctgg

SEQ ID NO: 535853 - DNA, 20 bp, mouse
gttcaactcccctttaatga

SEQ ID NO: 535854 - DNA, 20 bp, mouse
gctggcggttgagataaagt

SEQ ID NO: 535855 - DNA, 20 bp, mouse
gtgggcattatgcctcacta

SEQ ID NO: 535856 - DNA, 20 bp, mouse
gctacgcagcccagtaacca

SEQ ID NO: 535857 - DNA, 20 bp, mouse
gcagtaaccagggacgaccg

SEQ ID NO: 535858 - DNA, 20 bp, mouse
gcgcgggcacggccagacaa

SEQ ID NO: 535859 - DNA, 20 bp, mouse
gcgcggcaaccgagccccgg

SEQ ID NO: 535860 - DNA, 20 bp, mouse
ggaccgcggcaaccgagccc

SEQ ID NO: 535861 - DNA, 20 bp, mouse
gctgagagccgcagccgccg

SEQ ID NO: 535862 - DNA, 20 bp, mouse
ggcgcccagcgggagcggtt

SEQ ID NO: 535863 - DNA, 20 bp, mouse
gcgggaggcggggagcgtag

SEQ ID NO: 535864 - DNA, 20 bp, mouse
gcacggcgaggagttgcgcg

SEQ ID NO: 535865 - DNA, 20 bp, mouse
gcccgggccggacccgctcg

SEQ ID NO: 535866 - DNA, 20 bp, mouse
gggcctgacccaggaagtcg

SEQ ID NO: 535867 - DNA, 20 bp, mouse
gaggcaagatggctacgact

SEQ ID NO: 535868 - DNA, 20 bp, mouse
gagatggctacgactagggg

SEQ ID NO: 535869 - DNA, 20 bp, mouse
gcgagtctggaagggacctg

SEQ ID NO: 535870 - DNA, 20 bp, mouse
gaggcttccgcccagcggag

SEQ ID NO: 535871 - DNA, 20 bp, mouse
gggccgctacgagtctggaa

SEQ ID NO: 535872 - DNA, 20 bp, mouse
gacctgaggcttccgcccag

SEQ ID NO: 535873 - DNA, 20 bp, mouse
gaagaagaccccgacttcct

SEQ ID NO: 535874 - DNA, 20 bp, mouse
ggccatcttgcctctccgct

SEQ ID NO: 535875 - DNA, 20 bp, mouse
gatcttgcctctccgctggg

SEQ ID NO: 535876 - DNA, 20 bp, mouse
gccggcacgcttgagagcgg

SEQ ID NO: 535877 - DNA, 20 bp, mouse
gtccccggcacgcttgagag

SEQ ID NO: 535878 - DNA, 20 bp, mouse
gagagaggcagggagcgcca

SEQ ID NO: 535879 - DNA, 20 bp, mouse
ggcccgccaccactgttcaa

SEQ ID NO: 535880 - DNA, 20 bp, mouse
gcgcgccaaaggatgtcccg

SEQ ID NO: 535881 - DNA, 20 bp, mouse
gcgggcggacactctgtccc

SEQ ID NO: 535882 - DNA, 20 bp, mouse
ggcgggggccgccatctcca

SEQ ID NO: 535883 - DNA, 20 bp, mouse
gcgcgcaggcaccgccagag

SEQ ID NO: 535884 - DNA, 20 bp, mouse
ggtcgccgcgggacatcctt

SEQ ID NO: 535885 - DNA, 20 bp, mouse
gattgggtgcaagggtgtgt

SEQ ID NO: 535886 - DNA, 20 bp, mouse
gcgccttgggttgacggaag

SEQ ID NO: 535887 - DNA, 20 bp, mouse
gggaagcggacgctctggtt

SEQ ID NO: 535888 - DNA, 20 bp, mouse
ggtgcggtttacggaaagct

SEQ ID NO: 535889 - DNA, 20 bp, mouse
gtaaccctctgtggaagcta

SEQ ID NO: 535890 - DNA, 20 bp, mouse
gttgacggaagcggacgctc

SEQ ID NO: 535891 - DNA, 20 bp, mouse
ggttttcgtgtgcagtcgtg

SEQ ID NO: 535892 - DNA, 20 bp, mouse
ggactgttgcgagggagctg

SEQ ID NO: 535893 - DNA, 20 bp, mouse
ggtccgcttccgtcaaccca

SEQ ID NO: 535894 - DNA, 20 bp, mouse
gagcctggtatggacatgac

SEQ ID NO: 535895 - DNA, 20 bp, mouse
gtgtgcagtcgtgcggttta

SEQ ID NO: 535896 - DNA, 20 bp, mouse
gtccacttacccagcccggg

SEQ ID NO: 535897 - DNA, 20 bp, mouse
ggccgcccgggctgggtaag

SEQ ID NO: 535898 - DNA, 20 bp, mouse
gcagtaccggcgaggctgga

SEQ ID NO: 535899 - DNA, 20 bp, mouse
gatggatgctgcgggcgtgg

SEQ ID NO: 535900 - DNA, 20 bp, mouse
gaatcgtcgccgcccgggct

SEQ ID NO: 535901 - DNA, 20 bp, mouse
gggcggcgacgattccagcg

SEQ ID NO: 535902 - DNA, 20 bp, mouse
ggaactcgggggccttgggg

SEQ ID NO: 535903 - DNA, 20 bp, mouse
ggcagccagcagaagaggaa

SEQ ID NO: 535904 - DNA, 20 bp, mouse
gagtggagccaggctgcggg

SEQ ID NO: 535905 - DNA, 20 bp, mouse
gacacgtcggatggatgctg

SEQ ID NO: 535906 - DNA, 20 bp, mouse
gatacgcggagtggagctca

SEQ ID NO: 535907 - DNA, 20 bp, mouse
gagcccggtgcggggatacg

SEQ ID NO: 535908 - DNA, 20 bp, mouse
gggtcaggcaggctcccccg

SEQ ID NO: 535909 - DNA, 20 bp, mouse
gtggagctcagggctgcgga

SEQ ID NO: 535910 - DNA, 20 bp, mouse
gcgcctggctcgaaccccag

SEQ ID NO: 535911 - DNA, 20 bp, mouse
gcggaggtgtggcccaccgg

SEQ ID NO: 535912 - DNA, 20 bp, mouse
gcacctccgccagtaaggag

SEQ ID NO: 535913 - DNA, 20 bp, mouse
ggcgccgaggcctgccccgg

SEQ ID NO: 535914 - DNA, 20 bp, mouse
gagagacgtcggccgagcgg

SEQ ID NO: 535915 - DNA, 20 bp, mouse
gggtgcggggatacgcggag

SEQ ID NO: 535916 - DNA, 20 bp, mouse
ggaggagaacgtctcagcgt

SEQ ID NO: 535917 - DNA, 20 bp, mouse
ggggtcgccgggaggccgaa

SEQ ID NO: 535918 - DNA, 20 bp, mouse
ggcgccggggcgtgtgtgga

SEQ ID NO: 535919 - DNA, 20 bp, mouse
gggccgaaaggtacgcgccg

SEQ ID NO: 535920 - DNA, 20 bp, mouse
gcgtccgtccacacacgccc

SEQ ID NO: 535921 - DNA, 20 bp, mouse
gggccgcggcggagccttgg

SEQ ID NO: 535922 - DNA, 20 bp, mouse
ggcgagcgagagagctgatc

SEQ ID NO: 535923 - DNA, 20 bp, mouse
gcggacgcgctcagtgccgg

SEQ ID NO: 535924 - DNA, 20 bp, mouse
gtcctccccaggggccgcgg

SEQ ID NO: 535925 - DNA, 20 bp, mouse
ggcgcagcgggcctcaggga

SEQ ID NO: 535926 - DNA, 20 bp, mouse
ggtcgctccctcggctccag

SEQ ID NO: 535927 - DNA, 20 bp, mouse
gccccgccaggcgacctcgg

SEQ ID NO: 535928 - DNA, 20 bp, mouse
gagctctccgctggagccga

SEQ ID NO: 535929 - DNA, 20 bp, mouse
gtcggcggcagaacccgagg

SEQ ID NO: 535930 - DNA, 20 bp, mouse
gcgccgatcggcgagcgacg

SEQ ID NO: 535931 - DNA, 20 bp, mouse
gtcggggtccggcttccgag

SEQ ID NO: 535932 - DNA, 20 bp, mouse
ggcgacgacgtcgacccggg

SEQ ID NO: 535933 - DNA, 20 bp, mouse
ggcgaccagtccccagctgg

SEQ ID NO: 535934 - DNA, 20 bp, mouse
ggatggatcaccaccagctg

SEQ ID NO: 535935 - DNA, 20 bp, mouse
ggacgctccccgactcaccc

SEQ ID NO: 535936 - DNA, 20 bp, mouse
gggagcgggcactccctcgg

SEQ ID NO: 535937 - DNA, 20 bp, mouse
gctctgctggtctccaccga

SEQ ID NO: 535938 - DNA, 20 bp, mouse
gcttggagcgggcactccct

SEQ ID NO: 535939 - DNA, 20 bp, mouse
gtagcggccagagaagcggg

SEQ ID NO: 535940 - DNA, 20 bp, mouse
gggagggatccccaccggaa

SEQ ID NO: 535941 - DNA, 20 bp, mouse
gtgcgctcccgaaggcccta

SEQ ID NO: 535942 - DNA, 20 bp, mouse
gaggttagcggccagagaag

SEQ ID NO: 535943 - DNA, 20 bp, mouse
ggagcaggaccgatgcggct

SEQ ID NO: 535944 - DNA, 20 bp, mouse
gtccgaaggcgcagacatgt

SEQ ID NO: 535945 - DNA, 20 bp, mouse
gggcggtggcgaggcctgtt

SEQ ID NO: 535946 - DNA, 20 bp, mouse
gcgtgcaccagccacagagg

SEQ ID NO: 535947 - DNA, 20 bp, mouse
gagaggcggcggctcatacg

SEQ ID NO: 535948 - DNA, 20 bp, mouse
gtgcgaagtggcgcagacgg

SEQ ID NO: 535949 - DNA, 20 bp, mouse
ggcacactccttgcccggag

SEQ ID NO: 535950 - DNA, 20 bp, mouse
gcgcagaagttgctgcgaag

SEQ ID NO: 535951 - DNA, 20 bp, mouse
gcgaggggacgtgcacgcta

SEQ ID NO: 535952 - DNA, 20 bp, mouse
ggcgctgtcctgagaccccc

SEQ ID NO: 535953 - DNA, 20 bp, mouse
gtgctgcgaagtggcgcaga

SEQ ID NO: 535954 - DNA, 20 bp, mouse
gtccgcaccacacacccccc

SEQ ID NO: 535955 - DNA, 20 bp, mouse
gaggacagcgctggtcagtg

SEQ ID NO: 535956 - DNA, 20 bp, mouse
ggctcggcggagtcttctgg

SEQ ID NO: 535957 - DNA, 20 bp, mouse
gcgagcgcgccccagaggct

SEQ ID NO: 535958 - DNA, 20 bp, mouse
gcggagagcaggccgcgatc

SEQ ID NO: 535959 - DNA, 20 bp, mouse
ggaagcgcgggagccctggg

SEQ ID NO: 535960 - DNA, 20 bp, mouse
gctcgctcggcggagtcttc

SEQ ID NO: 535961 - DNA, 20 bp, mouse
gcggttgctgctcccgatcg

SEQ ID NO: 535962 - DNA, 20 bp, mouse
gagggaagcgcgggagccct

SEQ ID NO: 535963 - DNA, 20 bp, mouse
gcccacggtcggggccgaca

SEQ ID NO: 535964 - DNA, 20 bp, mouse
ggcaacatgtccccggtcgg

SEQ ID NO: 535965 - DNA, 20 bp, mouse
gtccccggtcggcggagagc

SEQ ID NO: 535966 - DNA, 20 bp, mouse
gactggtacagcccaggacg

SEQ ID NO: 535967 - DNA, 20 bp, mouse
gggtacagcccaggacgagg

SEQ ID NO: 535968 - DNA, 20 bp, mouse
gagcctctccgcctcgtcct

SEQ ID NO: 535969 - DNA, 20 bp, mouse
gctggctgccgaaaagcacc

SEQ ID NO: 535970 - DNA, 20 bp, mouse
gtacggcggagaccctccac

SEQ ID NO: 535971 - DNA, 20 bp, mouse
gatgcaggttccacagctcc

SEQ ID NO: 535972 - DNA, 20 bp, mouse
gccgagggcgcgaagtccgg

SEQ ID NO: 535973 - DNA, 20 bp, mouse
gtagcgcccgagcctcacca

SEQ ID NO: 535974 - DNA, 20 bp, mouse
gtgggcccaagcggattcag

SEQ ID NO: 535975 - DNA, 20 bp, mouse
gtgaggtgtgcggttctggc

SEQ ID NO: 535976 - DNA, 20 bp, mouse
gaggcaagccatgtgacaga

SEQ ID NO: 535977 - DNA, 20 bp, mouse
gagcatgctagccttgtgga

SEQ ID NO: 535978 - DNA, 20 bp, mouse
gaagtgggatgaaggcggta

SEQ ID NO: 535979 - DNA, 20 bp, mouse
gggaataccacggaaatgtt

SEQ ID NO: 535980 - DNA, 20 bp, mouse
ggagccctgcgtttccccca

SEQ ID NO: 535981 - DNA, 20 bp, mouse
ggtttgcctgcttaccttgg

SEQ ID NO: 535982 - DNA, 20 bp, mouse
ggcaggcaaacaagcgctga

SEQ ID NO: 535983 - DNA, 20 bp, mouse
gctatgtgacaccataaagg

SEQ ID NO: 535984 - DNA, 20 bp, mouse
gaaaagcatttggaagtaac

SEQ ID NO: 535985 - DNA, 20 bp, mouse
gggactccacaaacgcaagt

SEQ ID NO: 535986 - DNA, 20 bp, mouse
gtgaagagggagacgaagat

SEQ ID NO: 535987 - DNA, 20 bp, mouse
gcgccccgcgggaggtgaag

SEQ ID NO: 535988 - DNA, 20 bp, mouse
gggagagcctgggaatacct

SEQ ID NO: 535989 - DNA, 20 bp, mouse
gtgagcaagcaagcacggaa

SEQ ID NO: 535990 - DNA, 20 bp, mouse
gcgcaagggccacaaaagac

SEQ ID NO: 535991 - DNA, 20 bp, mouse
gccagttgtggtcttcgcaa

SEQ ID NO: 535992 - DNA, 20 bp, mouse
gaaggagccaaccacaaggt

SEQ ID NO: 535993 - DNA, 20 bp, mouse
ggagggatagctggcatcac

SEQ ID NO: 535994 - DNA, 20 bp, mouse
gcgctgggagcagagggtct

SEQ ID NO: 535995 - DNA, 20 bp, mouse
gatctgcctgcaacgcgaga

SEQ ID NO: 535996 - DNA, 20 bp, mouse
gcggcggctgcagcaggtag

SEQ ID NO: 535997 - DNA, 20 bp, mouse
gaaggtggcagcgaccgcgg

SEQ ID NO: 535998 - DNA, 20 bp, mouse
gtagggcggacctaagtcaa

SEQ ID NO: 535999 - DNA, 20 bp, mouse
ggtgaaggtggcagcgaccg

SEQ ID NO: 536000 - DNA, 20 bp, mouse
gagtcaaaggcaagtgaagg

SEQ ID NO: 536001 - DNA, 20 bp, mouse
gccgcgccttgccagcccag

SEQ ID NO: 536002 - DNA, 20 bp, mouse
gcgggcggagctgaaatcgt

SEQ ID NO: 536003 - DNA, 20 bp, mouse
gggcagcgagaagctcatag

SEQ ID NO: 536004 - DNA, 20 bp, mouse
gaggcgcgggcccggagggt

SEQ ID NO: 536005 - DNA, 20 bp, mouse
gcctagccccccagattgag

SEQ ID NO: 536006 - DNA, 20 bp, mouse
gcgtcaatctacagcagcag

SEQ ID NO: 536007 - DNA, 20 bp, mouse
gccctccgccgactaggtac

SEQ ID NO: 536008 - DNA, 20 bp, mouse
ggcccctgccggtacctagt

SEQ ID NO: 536009 - DNA, 20 bp, mouse
ggccgactaggtaccggcag

SEQ ID NO: 536010 - DNA, 20 bp, mouse
ggccgtgagaggcggagaac

SEQ ID NO: 536011 - DNA, 20 bp, mouse
gtgaacgcgataggctcggg

SEQ ID NO: 536012 - DNA, 20 bp, mouse
gccgtcgctggaaccccctg

SEQ ID NO: 536013 - DNA, 20 bp, mouse
ggcacagaggagcgacaccc

SEQ ID NO: 536014 - DNA, 20 bp, mouse
gagcgacgccggaccccaac

SEQ ID NO: 536015 - DNA, 20 bp, mouse
gctgtgaggggcaacggggt

SEQ ID NO: 536016 - DNA, 20 bp, mouse
gcagcctgggtgggagactt

SEQ ID NO: 536017 - DNA, 20 bp, mouse
ggagccgaagtctcccaccc

SEQ ID NO: 536018 - DNA, 20 bp, mouse
gggatttgccgaaccagagc

SEQ ID NO: 536019 - DNA, 20 bp, mouse
gcctgagtcactcggtctgg

SEQ ID NO: 536020 - DNA, 20 bp, mouse
ggtcactcggtctggaggta

SEQ ID NO: 536021 - DNA, 20 bp, mouse
gaagcctgagtcactcggtc

SEQ ID NO: 536022 - DNA, 20 bp, mouse
gagacttcggctctgtggtg

SEQ ID NO: 536023 - DNA, 20 bp, mouse
gaccaggaaaggtagcatcc

SEQ ID NO: 536024 - DNA, 20 bp, mouse
gggtctgaatagaccaggaa

SEQ ID NO: 536025 - DNA, 20 bp, mouse
gcggcatcttgccgaggaag

SEQ ID NO: 536026 - DNA, 20 bp, mouse
gcgccgccgccacccacgag

SEQ ID NO: 536027 - DNA, 20 bp, mouse
gaacctgcaccgctcgtggg

SEQ ID NO: 536028 - DNA, 20 bp, mouse
ggggaacctgcaccgctcgt

SEQ ID NO: 536029 - DNA, 20 bp, mouse
gctgccgagcgacacggtcg

SEQ ID NO: 536030 - DNA, 20 bp, mouse
gcccaggctgccgagcgaca

SEQ ID NO: 536031 - DNA, 20 bp, mouse
gcgccgagaggggatcccag

SEQ ID NO: 536032 - DNA, 20 bp, mouse
gcggcggaggcgtccaggcc

SEQ ID NO: 536033 - DNA, 20 bp, mouse
gccgagcgacacggtcgcgg

SEQ ID NO: 536034 - DNA, 20 bp, mouse
gagggcgcggcgactcaccc

SEQ ID NO: 536035 - DNA, 20 bp, mouse
gagcgagccccgggagctgg

SEQ ID NO: 536036 - DNA, 20 bp, mouse
gtaggaagtgaggcgttcga

SEQ ID NO: 536037 - DNA, 20 bp, mouse
gagcctccggaggcacgcca

SEQ ID NO: 536038 - DNA, 20 bp, mouse
gaggcgttcgagggcagtgg

SEQ ID NO: 536039 - DNA, 20 bp, mouse
ggccccggttccaaccatat

SEQ ID NO: 536040 - DNA, 20 bp, mouse
ggtgaggcgttcgagggcag

SEQ ID NO: 536041 - DNA, 20 bp, mouse
ggtgcctccggaggctgtgt

SEQ ID NO: 536042 - DNA, 20 bp, mouse
ggtgccgacacagcctccgg

SEQ ID NO: 536043 - DNA, 20 bp, mouse
gtgtcggcacctgtccccac

SEQ ID NO: 536044 - DNA, 20 bp, mouse
ggggtccccacagtcagact

SEQ ID NO: 536045 - DNA, 20 bp, mouse
ggggcttgattggcaggagg

SEQ ID NO: 536046 - DNA, 20 bp, mouse
gcggtacttgagcccgactg

SEQ ID NO: 536047 - DNA, 20 bp, mouse
gagcgttcgctcggagatgg

SEQ ID NO: 536048 - DNA, 20 bp, mouse
gccccgcgagcagggaagcc

SEQ ID NO: 536049 - DNA, 20 bp, mouse
gcggagcgttcgctcggaga

SEQ ID NO: 536050 - DNA, 20 bp, mouse
gaccctgcgggtggtttcgg

SEQ ID NO: 536051 - DNA, 20 bp, mouse
gggccagcggctgggactcg

SEQ ID NO: 536052 - DNA, 20 bp, mouse
ggcccgaggccccgcgagca

SEQ ID NO: 536053 - DNA, 20 bp, mouse
gccacccgcagggtcgtcct

SEQ ID NO: 536054 - DNA, 20 bp, mouse
gcaggggtgcggccgagagt

SEQ ID NO: 536055 - DNA, 20 bp, mouse
gggacggggtccaccctggt

SEQ ID NO: 536056 - DNA, 20 bp, mouse
gggaccaagaggcagaatgc

SEQ ID NO: 536057 - DNA, 20 bp, mouse
gacctcgggcggtggagcgc

SEQ ID NO: 536058 - DNA, 20 bp, mouse
gtcctagtgattacctcggg

SEQ ID NO: 536059 - DNA, 20 bp, mouse
gaccgcccgaggtaatcact

SEQ ID NO: 536060 - DNA, 20 bp, mouse
ggctcaggagccgatgctgg

SEQ ID NO: 536061 - DNA, 20 bp, mouse
gcaggagccgatgctggggg

SEQ ID NO: 536062 - DNA, 20 bp, mouse
ggcgccggcattctgcctct

SEQ ID NO: 536063 - DNA, 20 bp, mouse
gaagtggccagggttggatc

SEQ ID NO: 536064 - DNA, 20 bp, mouse
gtccatcctagtgattacct

SEQ ID NO: 536065 - DNA, 20 bp, mouse
ggagccgatgctgggggagg

SEQ ID NO: 536066 - DNA, 20 bp, mouse
ggctggaagggtccagacac

SEQ ID NO: 536067 - DNA, 20 bp, mouse
gacaggagcagctggtattc

SEQ ID NO: 536068 - DNA, 20 bp, mouse
gggacacgagccttacccca

SEQ ID NO: 536069 - DNA, 20 bp, mouse
gcagaccgggtacagcaaaa

SEQ ID NO: 536070 - DNA, 20 bp, mouse
gcttaccccagggagcagac

SEQ ID NO: 536071 - DNA, 20 bp, mouse
gatgagaactatttaatcac

SEQ ID NO: 536072 - DNA, 20 bp, mouse
ggtacccggtctgctccctg

SEQ ID NO: 536073 - DNA, 20 bp, mouse
ggtaaggctcgtgtccgaga

SEQ ID NO: 536074 - DNA, 20 bp, mouse
gagggtccagacaccggcac

SEQ ID NO: 536075 - DNA, 20 bp, mouse
gttaacggtgtgctgaacag

SEQ ID NO: 536076 - DNA, 20 bp, mouse
gtggcgtgcgagtaacggtg

SEQ ID NO: 536077 - DNA, 20 bp, mouse
gcgggttggcgtgcgagtaa

SEQ ID NO: 536078 - DNA, 20 bp, mouse
ggagtaacggtgcggagatg

SEQ ID NO: 536079 - DNA, 20 bp, mouse
gccgcgtgctgccggaagag

SEQ ID NO: 536080 - DNA, 20 bp, mouse
ggaggaggatcccccttaga

SEQ ID NO: 536081 - DNA, 20 bp, mouse
ggagttgggccctggttcct

SEQ ID NO: 536082 - DNA, 20 bp, mouse
gtccctctgcctaggaacca

SEQ ID NO: 536083 - DNA, 20 bp, mouse
ggctccggaggaggaagcga

SEQ ID NO: 536084 - DNA, 20 bp, mouse
ggcgttcaggcaacattaag

SEQ ID NO: 536085 - DNA, 20 bp, mouse
gcaccaacgggggcaaggta

SEQ ID NO: 536086 - DNA, 20 bp, mouse
gaggttgctgagactcgtcc

SEQ ID NO: 536087 - DNA, 20 bp, mouse
gggcgcagacggcgaagtca

SEQ ID NO: 536088 - DNA, 20 bp, mouse
ggcgccggctcaaggaccag

SEQ ID NO: 536089 - DNA, 20 bp, mouse
ggtccttgagccggcgcaga

SEQ ID NO: 536090 - DNA, 20 bp, mouse
gcggcgaagtcatggccttg

SEQ ID NO: 536091 - DNA, 20 bp, mouse
gcgcgcgcgggagccgacgc

SEQ ID NO: 536092 - DNA, 20 bp, mouse
ggctgcaccggtgctgtgag

SEQ ID NO: 536093 - DNA, 20 bp, mouse
ggaacgccttgtagactctg

SEQ ID NO: 536094 - DNA, 20 bp, mouse
gctgagactcgtcccggcgt

SEQ ID NO: 536095 - DNA, 20 bp, mouse
gaggcctccgctcacagcac

SEQ ID NO: 536096 - DNA, 20 bp, mouse
gagcgtctgggcgaactcaa

SEQ ID NO: 536097 - DNA, 20 bp, mouse
ggagcaagcccagctaggta

SEQ ID NO: 536098 - DNA, 20 bp, mouse
gggccgaccctaaagcgtct

SEQ ID NO: 536099 - DNA, 20 bp, mouse
gcgcccagacgctttagggt

SEQ ID NO: 536100 - DNA, 20 bp, mouse
gaggtatggcgatggtgaag

SEQ ID NO: 536101 - DNA, 20 bp, mouse
gagttcgcccagacgcttta

SEQ ID NO: 536102 - DNA, 20 bp, mouse
gaactcaagggtagccggct

SEQ ID NO: 536103 - DNA, 20 bp, mouse
ggggcgcgcggaggtccctg

SEQ ID NO: 536104 - DNA, 20 bp, mouse
gctggggcgccggggcgcaa

SEQ ID NO: 536105 - DNA, 20 bp, mouse
gcggggcgcaatggctgtaa

SEQ ID NO: 536106 - DNA, 20 bp, mouse
gtggtggaggtcctgaagcg

SEQ ID NO: 536107 - DNA, 20 bp, mouse
ggtgcgtccccagagaccca

SEQ ID NO: 536108 - DNA, 20 bp, mouse
gaggtccagggatccggtca

SEQ ID NO: 536109 - DNA, 20 bp, mouse
ggtcacagctccgccactag

SEQ ID NO: 536110 - DNA, 20 bp, mouse
gcgccactaggggctgagta

SEQ ID NO: 536111 - DNA, 20 bp, mouse
gggccctactcagcccctag

SEQ ID NO: 536112 - DNA, 20 bp, mouse
gtacccgaacacggaagggg

SEQ ID NO: 536113 - DNA, 20 bp, mouse
gtgcccaaggtcaccgtgag

SEQ ID NO: 536114 - DNA, 20 bp, mouse
gactcgagcccggagcatcc

SEQ ID NO: 536115 - DNA, 20 bp, mouse
gcgagtcctggggtgtaatg

SEQ ID NO: 536116 - DNA, 20 bp, mouse
ggagcgccgcgtcaagatca

SEQ ID NO: 536117 - DNA, 20 bp, mouse
gacctgagcaccacctactg

SEQ ID NO: 536118 - DNA, 20 bp, mouse
gcgtcacctgaggtgctcct

SEQ ID NO: 536119 - DNA, 20 bp, mouse
gacctcaggtgacgcatacg

SEQ ID NO: 536120 - DNA, 20 bp, mouse
gtgggccgcacgataggtga

SEQ ID NO: 536121 - DNA, 20 bp, mouse
gtacgcggccgagccgcagt

SEQ ID NO: 536122 - DNA, 20 bp, mouse
ggcggccgagccgcagtagg

SEQ ID NO: 536123 - DNA, 20 bp, mouse
gactgcctgcagcaggtcgg

SEQ ID NO: 536124 - DNA, 20 bp, mouse
ggcaggatggacagctctcg

SEQ ID NO: 536125 - DNA, 20 bp, mouse
gaagctgtacatcgtgatgg

SEQ ID NO: 536126 - DNA, 20 bp, mouse
gccgaccgctcggctagcag

SEQ ID NO: 536127 - DNA, 20 bp, mouse
gagcggtcggcgcaaagctg

SEQ ID NO: 536128 - DNA, 20 bp, mouse
gcctttgctaacaaagatgg

SEQ ID NO: 536129 - DNA, 20 bp, mouse
ggcagccagggtgtgaggtg

SEQ ID NO: 536130 - DNA, 20 bp, mouse
gctggctgcctggggaacgc

SEQ ID NO: 536131 - DNA, 20 bp, mouse
gagggtgaaaggtcgtgatt

SEQ ID NO: 536132 - DNA, 20 bp, mouse
gcgggttgcagaatacggga

SEQ ID NO: 536133 - DNA, 20 bp, mouse
ggctcctttgctaacaaaga

SEQ ID NO: 536134 - DNA, 20 bp, mouse
gtggtccgattgagggtgaa

SEQ ID NO: 536135 - DNA, 20 bp, mouse
gagcattcgcggatcagaat

SEQ ID NO: 536136 - DNA, 20 bp, mouse
ggatggccgggagtaagtac

SEQ ID NO: 536137 - DNA, 20 bp, mouse
gtcttggcggcgacaaggag

SEQ ID NO: 536138 - DNA, 20 bp, mouse
gccgggagtaagtacaggtt

SEQ ID NO: 536139 - DNA, 20 bp, mouse
gtcacccttggggactactg

SEQ ID NO: 536140 - DNA, 20 bp, mouse
ggaaactgtgggctgatccg

SEQ ID NO: 536141 - DNA, 20 bp, mouse
gccgccaagaacaagatggc

SEQ ID NO: 536142 - DNA, 20 bp, mouse
gaggggcgcggcagtcacga

SEQ ID NO: 536143 - DNA, 20 bp, mouse
gacaaggagcggagctctct

SEQ ID NO: 536144 - DNA, 20 bp, mouse
gggaagtcatcagcattcca

SEQ ID NO: 536145 - DNA, 20 bp, mouse
gcttgttcttggcggcgaca

SEQ ID NO: 536146 - DNA, 20 bp, mouse
gccttcaggtaggaggtcct

SEQ ID NO: 536147 - DNA, 20 bp, mouse
gcgccaggggtccttcaggt

SEQ ID NO: 536148 - DNA, 20 bp, mouse
ggaacgtccccaggggacac

SEQ ID NO: 536149 - DNA, 20 bp, mouse
gtaatcttctctctgcgtgt

SEQ ID NO: 536150 - DNA, 20 bp, mouse
gctcctgcccgtgtcccctg

SEQ ID NO: 536151 - DNA, 20 bp, mouse
ggaaaagagaacgtccccag

SEQ ID NO: 536152 - DNA, 20 bp, mouse
gcacagctaagaggccaccc

SEQ ID NO: 536153 - DNA, 20 bp, mouse
gtctgagtgttggaacactg

SEQ ID NO: 536154 - DNA, 20 bp, mouse
ggaaggacccctggcgctga

SEQ ID NO: 536155 - DNA, 20 bp, mouse
gcgtaccactcacccctctt

SEQ ID NO: 536156 - DNA, 20 bp, mouse
gtctagggacccgcttctac

SEQ ID NO: 536157 - DNA, 20 bp, mouse
ggaggactgaactcacccca

SEQ ID NO: 536158 - DNA, 20 bp, mouse
ggatggcaggaactagtcta

SEQ ID NO: 536159 - DNA, 20 bp, mouse
gagaggcagggtgacaagag

SEQ ID NO: 536160 - DNA, 20 bp, mouse
ggcagataaaaagacaccct

SEQ ID NO: 536161 - DNA, 20 bp, mouse
gtttatctgccggtagaagc

SEQ ID NO: 536162 - DNA, 20 bp, mouse
gcagtgtctggtcttctagg

SEQ ID NO: 536163 - DNA, 20 bp, mouse
gttggacaggatcactgtaa

SEQ ID NO: 536164 - DNA, 20 bp, mouse
gaatgtccctgggaaaactt

SEQ ID NO: 536165 - DNA, 20 bp, mouse
gttgagtacattgcagagag

SEQ ID NO: 536166 - DNA, 20 bp, mouse
gcccaccgatgagggagacg

SEQ ID NO: 536167 - DNA, 20 bp, mouse
gcgctggacgctgtcatggc

SEQ ID NO: 536168 - DNA, 20 bp, mouse
ggtccccattcgcagcatca

SEQ ID NO: 536169 - DNA, 20 bp, mouse
ggaggcgctggacgctgtca

SEQ ID NO: 536170 - DNA, 20 bp, mouse
ggggagggtcggctaaccag

SEQ ID NO: 536171 - DNA, 20 bp, mouse
ggctcccgcccacctaggag

SEQ ID NO: 536172 - DNA, 20 bp, mouse
gccagagggctgtgcgctgg

SEQ ID NO: 536173 - DNA, 20 bp, mouse
ggcagagacgctaagaggag

SEQ ID NO: 536174 - DNA, 20 bp, mouse
ggaaaaaggtgagcgtgtgg

SEQ ID NO: 536175 - DNA, 20 bp, mouse
ggtgcgtagttgtgtcggga

SEQ ID NO: 536176 - DNA, 20 bp, mouse
gggcttcctcggcaagatgg

SEQ ID NO: 536177 - DNA, 20 bp, mouse
gagctcggccgagagacctt

SEQ ID NO: 536178 - DNA, 20 bp, mouse
gccgagctgaggtcacgtag

SEQ ID NO: 536179 - DNA, 20 bp, mouse
gtcaggtcgcgactgaaaat

SEQ ID NO: 536180 - DNA, 20 bp, mouse
gatgggcttcaccgaggtac

SEQ ID NO: 536181 - DNA, 20 bp, mouse
gatcgggaggtgccgaacac

SEQ ID NO: 536182 - DNA, 20 bp, mouse
gccgcggacgcccctcccag

SEQ ID NO: 536183 - DNA, 20 bp, mouse
ggcagcagcttggcgcaggc

SEQ ID NO: 536184 - DNA, 20 bp, mouse
gcggggcttcctcggcaaga

SEQ ID NO: 536185 - DNA, 20 bp, mouse
gggtgccgaacaccggtgag

SEQ ID NO: 536186 - DNA, 20 bp, mouse
ggctaaagccaggcaatcta

SEQ ID NO: 536187 - DNA, 20 bp, mouse
ggctgcggaactgggcgtct

SEQ ID NO: 536188 - DNA, 20 bp, mouse
ggcggtacccaggaatcctc

SEQ ID NO: 536189 - DNA, 20 bp, mouse
gtaagggggataggattcaa

SEQ ID NO: 536190 - DNA, 20 bp, mouse
gctcacgtgggagacaaatg

SEQ ID NO: 536191 - DNA, 20 bp, mouse
gaatccttcccggcccggat

SEQ ID NO: 536192 - DNA, 20 bp, mouse
gctctgtcccgaggattcct

SEQ ID NO: 536193 - DNA, 20 bp, mouse
gaatgaggcgaagagagaaa

SEQ ID NO: 536194 - DNA, 20 bp, mouse
gggaccttgagtctgactac

SEQ ID NO: 536195 - DNA, 20 bp, mouse
gagattccaagctgatacgg

SEQ ID NO: 536196 - DNA, 20 bp, mouse
gggccgagggcacctggtca

SEQ ID NO: 536197 - DNA, 20 bp, mouse
gggtagccgcgaccctgacc

SEQ ID NO: 536198 - DNA, 20 bp, mouse
gggcagtcttggccagccaa

SEQ ID NO: 536199 - DNA, 20 bp, mouse
gactatccccggcatgacgg

SEQ ID NO: 536200 - DNA, 20 bp, mouse
gccagccaaaggggacttga

SEQ ID NO: 536201 - DNA, 20 bp, mouse
gagacgggcgacacggccga

SEQ ID NO: 536202 - DNA, 20 bp, mouse
gttgaaggagacgggcgaca

SEQ ID NO: 536203 - DNA, 20 bp, mouse
ggtcgcagtgcgcacaggaa

SEQ ID NO: 536204 - DNA, 20 bp, mouse
gtcaccgggagggagagcaa

SEQ ID NO: 536205 - DNA, 20 bp, mouse
ggggcacctggtcagggtcg

SEQ ID NO: 536206 - DNA, 20 bp, mouse
gctaacaacccgaaagcgga

SEQ ID NO: 536207 - DNA, 20 bp, mouse
gacaacccgaaagcggacgg

SEQ ID NO: 536208 - DNA, 20 bp, mouse
gcgctctaacaacccgaaag

SEQ ID NO: 536209 - DNA, 20 bp, mouse
gggtgacacttacgtgacat

SEQ ID NO: 536210 - DNA, 20 bp, mouse
gggagaacccggacactgac

SEQ ID NO: 536211 - DNA, 20 bp, mouse
gccggtgcttccgccaacta

SEQ ID NO: 536212 - DNA, 20 bp, mouse
ggggagggacgaggagaacc

SEQ ID NO: 536213 - DNA, 20 bp, mouse
gcgaatgcaaccccaagacc

SEQ ID NO: 536214 - DNA, 20 bp, mouse
gcaccggccgtgaggcattg

SEQ ID NO: 536215 - DNA, 20 bp, mouse
ggcgttgttgccgtagttgg

SEQ ID NO: 536216 - DNA, 20 bp, mouse
gggcgcagtgcatcctgggt

SEQ ID NO: 536217 - DNA, 20 bp, mouse
gctttgccggggctagtcag

SEQ ID NO: 536218 - DNA, 20 bp, mouse
gcgctcgcgcaggtgacttg

SEQ ID NO: 536219 - DNA, 20 bp, mouse
ggcaggggtgatggggtaca

SEQ ID NO: 536220 - DNA, 20 bp, mouse
gacttgcggtgactttgccg

SEQ ID NO: 536221 - DNA, 20 bp, mouse
ggcccctcccccaacccgga

SEQ ID NO: 536222 - DNA, 20 bp, mouse
gcaaaacccgtcaggcagtg

SEQ ID NO: 536223 - DNA, 20 bp, mouse
gcctgacccctgactagccc

SEQ ID NO: 536224 - DNA, 20 bp, mouse
ggggtcaaccaaaacccgtc

SEQ ID NO: 536225 - DNA, 20 bp, mouse
gagtcaggggtcagggcccc

SEQ ID NO: 536226 - DNA, 20 bp, mouse
ggtgagcggaaccttctcat

SEQ ID NO: 536227 - DNA, 20 bp, mouse
gctgcagggacgaggaggtc

SEQ ID NO: 536228 - DNA, 20 bp, mouse
gccgaatgtggggtctgaga

SEQ ID NO: 536229 - DNA, 20 bp, mouse
gaagtagaaggactattcgg

SEQ ID NO: 536230 - DNA, 20 bp, mouse
gtcgggggaagccgaatgtg

SEQ ID NO: 536231 - DNA, 20 bp, mouse
ggcagttcccacctatgaga

SEQ ID NO: 536232 - DNA, 20 bp, mouse
ggcggaaccttctcataggt

SEQ ID NO: 536233 - DNA, 20 bp, mouse
ggctaggcgctcccgaggag

SEQ ID NO: 536234 - DNA, 20 bp, mouse
ggtcctggcgggtgaggtga

SEQ ID NO: 536235 - DNA, 20 bp, mouse
gaccggaagcgtggcgaacc

SEQ ID NO: 536236 - DNA, 20 bp, mouse
ggagctggtggtccggtgtg

SEQ ID NO: 536237 - DNA, 20 bp, mouse
ggcgtgggcgtgtcctccgg

SEQ ID NO: 536238 - DNA, 20 bp, mouse
gaagcctcagaccttgagtt

SEQ ID NO: 536239 - DNA, 20 bp, mouse
ggaggcccggcccccaagta

SEQ ID NO: 536240 - DNA, 20 bp, mouse
gcaaacagagcgccacacac

SEQ ID NO: 536241 - DNA, 20 bp, mouse
gcatgcctgcgccgaactca

SEQ ID NO: 536242 - DNA, 20 bp, mouse
ggcgccgaactcaaggtctg

SEQ ID NO: 536243 - DNA, 20 bp, mouse
gcggcgcaggcatgagctgg

SEQ ID NO: 536244 - DNA, 20 bp, mouse
ggttcggcgcaggcatgagc

SEQ ID NO: 536245 - DNA, 20 bp, mouse
gcaggcatgagctggtggtc

SEQ ID NO: 536246 - DNA, 20 bp, mouse
gcgcaggtcgcgttcggaaa

SEQ ID NO: 536247 - DNA, 20 bp, mouse
gggtcgacgtgccgacagag

SEQ ID NO: 536248 - DNA, 20 bp, mouse
ggcagtagccatggctgcaa

SEQ ID NO: 536249 - DNA, 20 bp, mouse
ggcttaacgacccggtcgta

SEQ ID NO: 536250 - DNA, 20 bp, mouse
gtccctgggagcccgaataa

SEQ ID NO: 536251 - DNA, 20 bp, mouse
gcaactctgtccctacgacc

SEQ ID NO: 536252 - DNA, 20 bp, mouse
gcacccgcatggggagacag

SEQ ID NO: 536253 - DNA, 20 bp, mouse
gccagcgacagtccctaagg

SEQ ID NO: 536254 - DNA, 20 bp, mouse
gttaagcgccgttgcagcca

SEQ ID NO: 536255 - DNA, 20 bp, mouse
ggagcggcgcaggtcgcgtt

SEQ ID NO: 536256 - DNA, 20 bp, mouse
gccgtgcgtacagaggtcac

SEQ ID NO: 536257 - DNA, 20 bp, mouse
gcagaggtcaccggtgccgg

SEQ ID NO: 536258 - DNA, 20 bp, mouse
ggtgtagaagccaccggcac

SEQ ID NO: 536259 - DNA, 20 bp, mouse
gagacgccgggagagagcgc

SEQ ID NO: 536260 - DNA, 20 bp, mouse
gtggcggctggaaggaatcc

SEQ ID NO: 536261 - DNA, 20 bp, mouse
ggcatgctccgtgcgtacag

SEQ ID NO: 536262 - DNA, 20 bp, mouse
gatgtcaccggaggcctggg

SEQ ID NO: 536263 - DNA, 20 bp, mouse
ggggcatcatgatttagaga

SEQ ID NO: 536264 - DNA, 20 bp, mouse
gacgacctcaatgtcaccgg

SEQ ID NO: 536265 - DNA, 20 bp, mouse
gcggagcatgcgcacaccag

SEQ ID NO: 536266 - DNA, 20 bp, mouse
gcagcccgggcgccacagca

SEQ ID NO: 536267 - DNA, 20 bp, mouse
gcgctggccggccaagcagt

SEQ ID NO: 536268 - DNA, 20 bp, mouse
ggggctgaagatgctgcgaa

SEQ ID NO: 536269 - DNA, 20 bp, mouse
gcagcggtctctgcatcgag

SEQ ID NO: 536270 - DNA, 20 bp, mouse
gggaggcgtggagccgggta

SEQ ID NO: 536271 - DNA, 20 bp, mouse
gatgccctgctgtggcgccc

SEQ ID NO: 536272 - DNA, 20 bp, mouse
gagtaggagacacatagaca

SEQ ID NO: 536273 - DNA, 20 bp, mouse
ggcagggcatggtttctatt

SEQ ID NO: 536274 - DNA, 20 bp, mouse
gcaaggtcacacagtcgggt

SEQ ID NO: 536275 - DNA, 20 bp, mouse
gcttcgacagggaattgaag

SEQ ID NO: 536276 - DNA, 20 bp, mouse
gaggcggctggcgatggaac

SEQ ID NO: 536277 - DNA, 20 bp, mouse
gagctccaggcagtagaggt

SEQ ID NO: 536278 - DNA, 20 bp, mouse
gggcccaaggccattcggtt

SEQ ID NO: 536279 - DNA, 20 bp, mouse
ggcgtggcctcagggtcgga

SEQ ID NO: 536280 - DNA, 20 bp, mouse
ggttcccacgcatcccgagg

SEQ ID NO: 536281 - DNA, 20 bp, mouse
gcagcagctccaggcagtag

SEQ ID NO: 536282 - DNA, 20 bp, mouse
gatcccgaggcggctggcga

SEQ ID NO: 536283 - DNA, 20 bp, mouse
gacaggttagccaaaccgaa

SEQ ID NO: 536284 - DNA, 20 bp, mouse
ggtcatggcgacctccatgc

SEQ ID NO: 536285 - DNA, 20 bp, mouse
gtccgcggcccaaggccatt

SEQ ID NO: 536286 - DNA, 20 bp, mouse
ggacgctgcgtggcccgcgc

SEQ ID NO: 536287 - DNA, 20 bp, mouse
gcaacgtcaggacccgatgg

SEQ ID NO: 536288 - DNA, 20 bp, mouse
ggagcctggcctcggggtgt

SEQ ID NO: 536289 - DNA, 20 bp, mouse
gcgggtgagagtccccttgc

SEQ ID NO: 536290 - DNA, 20 bp, mouse
gccccaacgtcaggacccga

SEQ ID NO: 536291 - DNA, 20 bp, mouse
gccgcgccatacggtttcca

SEQ ID NO: 536292 - DNA, 20 bp, mouse
gtcaggacccgatggaggca

SEQ ID NO: 536293 - DNA, 20 bp, mouse
gaccaaggagccgcgccata

SEQ ID NO: 536294 - DNA, 20 bp, mouse
gtacagctccgggaatgagc

SEQ ID NO: 536295 - DNA, 20 bp, mouse
ggtgagcaacggagggacca

SEQ ID NO: 536296 - DNA, 20 bp, mouse
gcgtggagcgagtagaaggt

SEQ ID NO: 536297 - DNA, 20 bp, mouse
gagcgagtagaaggtcggtg

SEQ ID NO: 536298 - DNA, 20 bp, mouse
gggcccagcggatccggacg

SEQ ID NO: 536299 - DNA, 20 bp, mouse
gggatccgctgggcccgcta

SEQ ID NO: 536300 - DNA, 20 bp, mouse
gcggacgtggagcgagtaga

SEQ ID NO: 536301 - DNA, 20 bp, mouse
ggcgtccttagcgggcccag

SEQ ID NO: 536302 - DNA, 20 bp, mouse
ggaccctcgtgagaggtaca

SEQ ID NO: 536303 - DNA, 20 bp, mouse
ggagcaggcgtgcggctcgg

SEQ ID NO: 536304 - DNA, 20 bp, mouse
gcagcgggtggtggtttcag

SEQ ID NO: 536305 - DNA, 20 bp, mouse
gggcccgtgaccctcgtgag

SEQ ID NO: 536306 - DNA, 20 bp, mouse
gtaaagagcgggcctcttag

SEQ ID NO: 536307 - DNA, 20 bp, mouse
gcgtctacgcgaaggtgaga

SEQ ID NO: 536308 - DNA, 20 bp, mouse
gtaggggccaatctggacca

SEQ ID NO: 536309 - DNA, 20 bp, mouse
ggacgctgtaggggccaatc

SEQ ID NO: 536310 - DNA, 20 bp, mouse
gaccatacaagcttaacagt

SEQ ID NO: 536311 - DNA, 20 bp, mouse
ggacgaaaacgtctacgcga

SEQ ID NO: 536312 - DNA, 20 bp, mouse
gcagaaatcacactgaaaga

SEQ ID NO: 536313 - DNA, 20 bp, mouse
gctatttagcaaggtaaggg

SEQ ID NO: 536314 - DNA, 20 bp, mouse
gttcggtagcgacacggcgt

SEQ ID NO: 536315 - DNA, 20 bp, mouse
gccagcgaacgcgagcagcc

SEQ ID NO: 536316 - DNA, 20 bp, mouse
ggagcaggcggcctccgacg

SEQ ID NO: 536317 - DNA, 20 bp, mouse
gcggccgaaaggtaccagac

SEQ ID NO: 536318 - DNA, 20 bp, mouse
gtcggaggccgcctgctccg

SEQ ID NO: 536319 - DNA, 20 bp, mouse
gatgtctgcgctcacccgtc

SEQ ID NO: 536320 - DNA, 20 bp, mouse
gcgcgcggcagccccggagc

SEQ ID NO: 536321 - DNA, 20 bp, mouse
gggcctccgacgcggccgaa

SEQ ID NO: 536322 - DNA, 20 bp, mouse
gttgaagcagtcgcccggga

SEQ ID NO: 536323 - DNA, 20 bp, mouse
gtgggctagaggtgaaggga

SEQ ID NO: 536324 - DNA, 20 bp, mouse
gagcatgcctcgggcggcag

SEQ ID NO: 536325 - DNA, 20 bp, mouse
ggagtttcacgcaccctccc

SEQ ID NO: 536326 - DNA, 20 bp, mouse
gcccagcaagaaccttgcag

SEQ ID NO: 536327 - DNA, 20 bp, mouse
gaagatccgggatctagcta

SEQ ID NO: 536328 - DNA, 20 bp, mouse
gttgctgggctgtgttgagg

SEQ ID NO: 536329 - DNA, 20 bp, mouse
gtaagaccgggagaagatcc

SEQ ID NO: 536330 - DNA, 20 bp, mouse
gccttacagccggagacaac

SEQ ID NO: 536331 - DNA, 20 bp, mouse
gtcctggagcaagacaaaca

SEQ ID NO: 536332 - DNA, 20 bp, mouse
gtcctgtcgtaagaaactag

SEQ ID NO: 536333 - DNA, 20 bp, mouse
gttcttgctgggctgtgttg

SEQ ID NO: 536334 - DNA, 20 bp, mouse
ggtccgtttccggttgtctc

SEQ ID NO: 536335 - DNA, 20 bp, mouse
ggcgctccctagctagatcc

SEQ ID NO: 536336 - DNA, 20 bp, mouse
gctgaaggtcagactcgaga

SEQ ID NO: 536337 - DNA, 20 bp, mouse
gtgcgcctgcgcggatatga

SEQ ID NO: 536338 - DNA, 20 bp, mouse
ggcagccctcatatccgcgc

SEQ ID NO: 536339 - DNA, 20 bp, mouse
ggggcagccgcatctcgcgt

SEQ ID NO: 536340 - DNA, 20 bp, mouse
gccggtgtccagcacacgga

SEQ ID NO: 536341 - DNA, 20 bp, mouse
gcgtgtgcccacgcgagatg

SEQ ID NO: 536342 - DNA, 20 bp, mouse
ggccgaaggccgaagttgaa

SEQ ID NO: 536343 - DNA, 20 bp, mouse
gagtggtcaaagggatcgga

SEQ ID NO: 536344 - DNA, 20 bp, mouse
gaagccgagactatgcagag

SEQ ID NO: 536345 - DNA, 20 bp, mouse
ggctcagtggtcaaagggat

SEQ ID NO: 536346 - DNA, 20 bp, mouse
ggagtctaggaccagcgcgg

SEQ ID NO: 536347 - DNA, 20 bp, mouse
gtccgtggccggtgtagcca

SEQ ID NO: 536348 - DNA, 20 bp, mouse
gccggccacggaaggaagtg

SEQ ID NO: 536349 - DNA, 20 bp, mouse
gggacctccgagggagagag

SEQ ID NO: 536350 - DNA, 20 bp, mouse
gagcaggctcatggccgcca

SEQ ID NO: 536351 - DNA, 20 bp, mouse
ggccatggctacaccggcca

SEQ ID NO: 536352 - DNA, 20 bp, mouse
gtccgagtctaggaccagcg

SEQ ID NO: 536353 - DNA, 20 bp, mouse
gatggccgccatggctacac

SEQ ID NO: 536354 - DNA, 20 bp, mouse
gcaagacagcgctgtcagcg

SEQ ID NO: 536355 - DNA, 20 bp, mouse
gacgcgggtgagaggtggga

SEQ ID NO: 536356 - DNA, 20 bp, mouse
ggctcgtcggcaacatgtca

SEQ ID NO: 536357 - DNA, 20 bp, mouse
gcacgccggatgagaagctg

SEQ ID NO: 536358 - DNA, 20 bp, mouse
gtcagtgaccggtcctgtgt

SEQ ID NO: 536359 - DNA, 20 bp, mouse
gcggtcctgtgtaggctcgt

SEQ ID NO: 536360 - DNA, 20 bp, mouse
ggcgggagctaaggagacga

SEQ ID NO: 536361 - DNA, 20 bp, mouse
gaacatgtcagggtacacgc

SEQ ID NO: 536362 - DNA, 20 bp, mouse
gtcgctttgcggagcgggag

SEQ ID NO: 536363 - DNA, 20 bp, mouse
ggcagcagctgcgggagcta

SEQ ID NO: 536364 - DNA, 20 bp, mouse
ggttgccgacgagcctacac

SEQ ID NO: 536365 - DNA, 20 bp, mouse
gccaggctgcgacccggggt

SEQ ID NO: 536366 - DNA, 20 bp, mouse
gcggctactaaagaagggta

SEQ ID NO: 536367 - DNA, 20 bp, mouse
gtaaggcagagtagccatgg

SEQ ID NO: 536368 - DNA, 20 bp, mouse
gggtgggagcgaggtgaccc

SEQ ID NO: 536369 - DNA, 20 bp, mouse
gcccaggacgaagtgcaccg

SEQ ID NO: 536370 - DNA, 20 bp, mouse
gctgacccggcgctatctgt

SEQ ID NO: 536371 - DNA, 20 bp, mouse
gctgagttccgcgggatctg

SEQ ID NO: 536372 - DNA, 20 bp, mouse
gcgggtcaggtgcgccccca

SEQ ID NO: 536373 - DNA, 20 bp, mouse
gggcgcgaccgcagatcccg

SEQ ID NO: 536374 - DNA, 20 bp, mouse
gagcaggcagctgagttccg

SEQ ID NO: 536375 - DNA, 20 bp, mouse
gtgaccccggctactaaaga

SEQ ID NO: 536376 - DNA, 20 bp, mouse
ggcatgtgcagagtgaaccg

SEQ ID NO: 536377 - DNA, 20 bp, mouse
gtgcggccctgggagtccga

SEQ ID NO: 536378 - DNA, 20 bp, mouse
gtccagtggcaccacgcccc

SEQ ID NO: 536379 - DNA, 20 bp, mouse
ggccatcttcaccttctccg

SEQ ID NO: 536380 - DNA, 20 bp, mouse
ggtgaagatggctgccgccc

SEQ ID NO: 536381 - DNA, 20 bp, mouse
gtgccactggaggcacggag

SEQ ID NO: 536382 - DNA, 20 bp, mouse
gtgcccaaagaagggataca

SEQ ID NO: 536383 - DNA, 20 bp, mouse
ggcagagtgaaccgcggaga

SEQ ID NO: 536384 - DNA, 20 bp, mouse
ggattcgtgtgcccaaagaa

SEQ ID NO: 536385 - DNA, 20 bp, mouse
gtcatatcctaggaccccag

SEQ ID NO: 536386 - DNA, 20 bp, mouse
gtggtgggtcaggtaggccg

SEQ ID NO: 536387 - DNA, 20 bp, mouse
ggaaggtgagccggacgcta

SEQ ID NO: 536388 - DNA, 20 bp, mouse
gcgcagaacgccatagcgtc

SEQ ID NO: 536389 - DNA, 20 bp, mouse
gcatcgggacccgggttcaa

SEQ ID NO: 536390 - DNA, 20 bp, mouse
gcaccttctgctggtgggtc

SEQ ID NO: 536391 - DNA, 20 bp, mouse
ggatacaccatgactcgagg

SEQ ID NO: 536392 - DNA, 20 bp, mouse
gccgcagcaccttctgctgg

SEQ ID NO: 536393 - DNA, 20 bp, mouse
gccgtgggccaggctgatca

SEQ ID NO: 536394 - DNA, 20 bp, mouse
gtacctgacccaccagcaga

SEQ ID NO: 536395 - DNA, 20 bp, mouse
ggccaggctgatcaaggact

SEQ ID NO: 536396 - DNA, 20 bp, mouse
ggctaggctgagggccgaat

SEQ ID NO: 536397 - DNA, 20 bp, mouse
gaaacgagcaacccgagaag

SEQ ID NO: 536398 - DNA, 20 bp, mouse
gtcctcctccggagattcca

SEQ ID NO: 536399 - DNA, 20 bp, mouse
ggctgacggctaatgatgag

SEQ ID NO: 536400 - DNA, 20 bp, mouse
gtgcgcgcgcagggagaagg

SEQ ID NO: 536401 - DNA, 20 bp, mouse
gggctctggagtgggaggtt

SEQ ID NO: 536402 - DNA, 20 bp, mouse
ggccaccctggaatctccgg

SEQ ID NO: 536403 - DNA, 20 bp, mouse
gtgtctgggagacccttccg

SEQ ID NO: 536404 - DNA, 20 bp, mouse
ggcaggctccgcctcttctc

SEQ ID NO: 536405 - DNA, 20 bp, mouse
ggaaggcgccctgagtacca

SEQ ID NO: 536406 - DNA, 20 bp, mouse
gcctagagcgcggaggagga

SEQ ID NO: 536407 - DNA, 20 bp, mouse
gtgacctcgactccaactat

SEQ ID NO: 536408 - DNA, 20 bp, mouse
gtcagcctagagcgcggagg

SEQ ID NO: 536409 - DNA, 20 bp, mouse
gccttcagcctagagcgcgg

SEQ ID NO: 536410 - DNA, 20 bp, mouse
gcggtgatgagagcaggtga

SEQ ID NO: 536411 - DNA, 20 bp, mouse
ggcggaggaggacggtagct

SEQ ID NO: 536412 - DNA, 20 bp, mouse
ggcccaagctgaacgacccg

SEQ ID NO: 536413 - DNA, 20 bp, mouse
gtgcccttcagcctagagcg

SEQ ID NO: 536414 - DNA, 20 bp, mouse
gggctgaagggcattgcgta

SEQ ID NO: 536415 - DNA, 20 bp, mouse
gggcgctgagaacccgagag

SEQ ID NO: 536416 - DNA, 20 bp, mouse
gggagctggtacccagtcaa

SEQ ID NO: 536417 - DNA, 20 bp, mouse
gctccaggtcgggctgacag

SEQ ID NO: 536418 - DNA, 20 bp, mouse
gggagacccggacaggtccg

SEQ ID NO: 536419 - DNA, 20 bp, mouse
gggccgctaagtcaatatgg

SEQ ID NO: 536420 - DNA, 20 bp, mouse
gcctggccgctaagtcaata

SEQ ID NO: 536421 - DNA, 20 bp, mouse
gtagttccgcggacctgtcc

SEQ ID NO: 536422 - DNA, 20 bp, mouse
ggggtcagggagacccggac

SEQ ID NO: 536423 - DNA, 20 bp, mouse
gggtccgcggaactactcgg

SEQ ID NO: 536424 - DNA, 20 bp, mouse
gagcccaccgagtagttccg

SEQ ID NO: 536425 - DNA, 20 bp, mouse
ggggctgacagaggttgccg

SEQ ID NO: 536426 - DNA, 20 bp, mouse
gcggggctccgaccccacgg

SEQ ID NO: 536427 - DNA, 20 bp, mouse
ggcgctgcgctgcctccgtg

SEQ ID NO: 536428 - DNA, 20 bp, mouse
gaggcagcgcagcgccctca

SEQ ID NO: 536429 - DNA, 20 bp, mouse
gtgcagcccggtaaagatgg

SEQ ID NO: 536430 - DNA, 20 bp, mouse
gtggctgcacctaggaacct

SEQ ID NO: 536431 - DNA, 20 bp, mouse
ggtctgcagcccggtaaaga

SEQ ID NO: 536432 - DNA, 20 bp, mouse
ggtaaagatggcggccctga

SEQ ID NO: 536433 - DNA, 20 bp, mouse
ggcaagcggatcccagaccc

SEQ ID NO: 536434 - DNA, 20 bp, mouse
gcaccggggctccgacccca

SEQ ID NO: 536435 - DNA, 20 bp, mouse
gcgggctgcagactgtagga

SEQ ID NO: 536436 - DNA, 20 bp, mouse
gagtttggactgcagagtaa

SEQ ID NO: 536437 - DNA, 20 bp, mouse
gcagcagcaaatcttactca

SEQ ID NO: 536438 - DNA, 20 bp, mouse
gcctcgggagacctgaaaca

SEQ ID NO: 536439 - DNA, 20 bp, mouse
ggggtgagcaggagtctgga

SEQ ID NO: 536440 - DNA, 20 bp, mouse
ggcgctgggtcagaaggctt

SEQ ID NO: 536441 - DNA, 20 bp, mouse
gcagtccaaactctgagtga

SEQ ID NO: 536442 - DNA, 20 bp, mouse
gttactcagggtcagtaaac

SEQ ID NO: 536443 - DNA, 20 bp, mouse
gcaagagaaagcagaccgag

SEQ ID NO: 536444 - DNA, 20 bp, mouse
ggagtctggatggaagcctc

SEQ ID NO: 536445 - DNA, 20 bp, mouse
gcgaagtgcctggattctac

SEQ ID NO: 536446 - DNA, 20 bp, mouse
gtgttctccggctacttagt

SEQ ID NO: 536447 - DNA, 20 bp, mouse
ggcaggccacggagccccaa

SEQ ID NO: 536448 - DNA, 20 bp, mouse
ggagccccaagggcacggac

SEQ ID NO: 536449 - DNA, 20 bp, mouse
ggtggcctgcgtgtgttctc

SEQ ID NO: 536450 - DNA, 20 bp, mouse
gagaagggaacaaatatcta

SEQ ID NO: 536451 - DNA, 20 bp, mouse
gagcagcaggttgagaccac

SEQ ID NO: 536452 - DNA, 20 bp, mouse
gagtgtgccgactaagtagc

SEQ ID NO: 536453 - DNA, 20 bp, mouse
ggtagccggagaacacacgc

SEQ ID NO: 536454 - DNA, 20 bp, mouse
ggtcgcccagcccctgcaca

SEQ ID NO: 536455 - DNA, 20 bp, mouse
gaaggcgcgggtgagactcg

SEQ ID NO: 536456 - DNA, 20 bp, mouse
gtttgcctacaggaagatgg

SEQ ID NO: 536457 - DNA, 20 bp, mouse
ggcctacaggaagatggcgg

SEQ ID NO: 536458 - DNA, 20 bp, mouse
ggctgagacaggcgatgttg

SEQ ID NO: 536459 - DNA, 20 bp, mouse
gcatcccgaggaagggtcaa

SEQ ID NO: 536460 - DNA, 20 bp, mouse
gcccgaggaagggtcaaggg

SEQ ID NO: 536461 - DNA, 20 bp, mouse
gaccgccgccatcttcctgt

SEQ ID NO: 536462 - DNA, 20 bp, mouse
gggaactctacagacggaaa

SEQ ID NO: 536463 - DNA, 20 bp, mouse
gcgagtacggatccccgcta

SEQ ID NO: 536464 - DNA, 20 bp, mouse
ggtccccgcatcccgaggaa

SEQ ID NO: 536465 - DNA, 20 bp, mouse
gatgttggggcgaagggcaa

SEQ ID NO: 536466 - DNA, 20 bp, mouse
gcctgacaagggcactgcag

SEQ ID NO: 536467 - DNA, 20 bp, mouse
gaggagcgggatgtcagggt

SEQ ID NO: 536468 - DNA, 20 bp, mouse
ggtgctgcgggcgtccttta

SEQ ID NO: 536469 - DNA, 20 bp, mouse
gggcactgcagaggtgcggt

SEQ ID NO: 536470 - DNA, 20 bp, mouse
gctgtgggtggcccaggtct

SEQ ID NO: 536471 - DNA, 20 bp, mouse
gacgcagacgcctgccgtaa

SEQ ID NO: 536472 - DNA, 20 bp, mouse
ggcaggagtccggcagacgg

SEQ ID NO: 536473 - DNA, 20 bp, mouse
gggaggacacgcccagacct

SEQ ID NO: 536474 - DNA, 20 bp, mouse
ggggtgacgacctagttacg

SEQ ID NO: 536475 - DNA, 20 bp, mouse
gaaaaaggagcgggatgtca

SEQ ID NO: 536476 - DNA, 20 bp, mouse
ggctagcgcgcggcactact

SEQ ID NO: 536477 - DNA, 20 bp, mouse
ggtacgacgcgtggggtcaa

SEQ ID NO: 536478 - DNA, 20 bp, mouse
gtcaagggtcaccggcaaga

SEQ ID NO: 536479 - DNA, 20 bp, mouse
gagggctgcacggggtttcg

SEQ ID NO: 536480 - DNA, 20 bp, mouse
gtgggctgcaacgccaggta

SEQ ID NO: 536481 - DNA, 20 bp, mouse
gcagctagaaaccggagcag

SEQ ID NO: 536482 - DNA, 20 bp, mouse
ggacccgggacagaggactg

SEQ ID NO: 536483 - DNA, 20 bp, mouse
gacgcataccggccaggtaa

SEQ ID NO: 536484 - DNA, 20 bp, mouse
gggcacttggtacgacgcgt

SEQ ID NO: 536485 - DNA, 20 bp, mouse
gcttctgccaggctagcgcg

SEQ ID NO: 536486 - DNA, 20 bp, mouse
ggccactctcccgaccgcaa

SEQ ID NO: 536487 - DNA, 20 bp, mouse
gctgaaggccgaggccaaga

SEQ ID NO: 536488 - DNA, 20 bp, mouse
ggcccttgcggtcgggagag

SEQ ID NO: 536489 - DNA, 20 bp, mouse
gcgggtgagtgaagcccttg

SEQ ID NO: 536490 - DNA, 20 bp, mouse
ggggagagtggcgtagtcct

SEQ ID NO: 536491 - DNA, 20 bp, mouse
ggagtgaagcccttgcggtc

SEQ ID NO: 536492 - DNA, 20 bp, mouse
ggaccgcagaggttgtctga

SEQ ID NO: 536493 - DNA, 20 bp, mouse
gtttggaggacggaccgcag

SEQ ID NO: 536494 - DNA, 20 bp, mouse
gggccttcagacaacctctg

SEQ ID NO: 536495 - DNA, 20 bp, mouse
gggagaggcccaggacactt

SEQ ID NO: 536496 - DNA, 20 bp, mouse
gagccgcagcacttcaaggt

SEQ ID NO: 536497 - DNA, 20 bp, mouse
gaaggagccgcagcacttca

SEQ ID NO: 536498 - DNA, 20 bp, mouse
gggcggcgaagacagggtct

SEQ ID NO: 536499 - DNA, 20 bp, mouse
ggggcaaggcggcgaagaca

SEQ ID NO: 536500 - DNA, 20 bp, mouse
gtccttccctggcccagatg

SEQ ID NO: 536501 - DNA, 20 bp, mouse
gtctgggtgacgcaacgaca

SEQ ID NO: 536502 - DNA, 20 bp, mouse
gcagatgcggttcaaccgga

SEQ ID NO: 536503 - DNA, 20 bp, mouse
gttgaaccgcatctgggcca

SEQ ID NO: 536504 - DNA, 20 bp, mouse
gcacccaccttgaagtgctg

SEQ ID NO: 536505 - DNA, 20 bp, mouse
gatggcagcatcctgagctt

SEQ ID NO: 536506 - DNA, 20 bp, mouse
gagcatcgcgggagccagac

SEQ ID NO: 536507 - DNA, 20 bp, mouse
gccgcggttcggagttgtga

SEQ ID NO: 536508 - DNA, 20 bp, mouse
ggtggtagctcggagaggag

SEQ ID NO: 536509 - DNA, 20 bp, mouse
gcagccggaggtgacccgtc

SEQ ID NO: 536510 - DNA, 20 bp, mouse
gccggcgcgacagaaacaca

SEQ ID NO: 536511 - DNA, 20 bp, mouse
gaccgggtggtagctcggag

SEQ ID NO: 536512 - DNA, 20 bp, mouse
gcaactccgaaccgcgggac

SEQ ID NO: 536513 - DNA, 20 bp, mouse
gttgtgaaggtgacagccgg

SEQ ID NO: 536514 - DNA, 20 bp, mouse
gagaggagaggactctgcag

SEQ ID NO: 536515 - DNA, 20 bp, mouse
gtcgcgccggtcccgcggtt

SEQ ID NO: 536516 - DNA, 20 bp, mouse
ggcgccaaggagaacatggc

SEQ ID NO: 536517 - DNA, 20 bp, mouse
gagcctagagcggccggggt

SEQ ID NO: 536518 - DNA, 20 bp, mouse
gagtcagcctagagcggccg

SEQ ID NO: 536519 - DNA, 20 bp, mouse
ggttcccagtcagcctagag

SEQ ID NO: 536520 - DNA, 20 bp, mouse
ggagcatcccggaggcactg

SEQ ID NO: 536521 - DNA, 20 bp, mouse
gtaccccgccatgttctcct

SEQ ID NO: 536522 - DNA, 20 bp, mouse
gtccttggcgctgcgggcca

SEQ ID NO: 536523 - DNA, 20 bp, mouse
gccggaggcactgaggacga

SEQ ID NO: 536524 - DNA, 20 bp, mouse
ggtacgcgatgctccgaccc

SEQ ID NO: 536525 - DNA, 20 bp, mouse
gacccactgagcagcgaggc

SEQ ID NO: 536526 - DNA, 20 bp, mouse
gaggaggagagagaccgcca

SEQ ID NO: 536527 - DNA, 20 bp, mouse
ggatccgtcctccccgcagg

SEQ ID NO: 536528 - DNA, 20 bp, mouse
ggcacaaatgccaagagcgg

SEQ ID NO: 536529 - DNA, 20 bp, mouse
gcggtctctctcctcctgcg

SEQ ID NO: 536530 - DNA, 20 bp, mouse
ggtggtgcgtgtgcacaagt

SEQ ID NO: 536531 - DNA, 20 bp, mouse
ggagtgaaaccgagtcactg

SEQ ID NO: 536532 - DNA, 20 bp, mouse
gatccgggcgctgaaggtaa

SEQ ID NO: 536533 - DNA, 20 bp, mouse
gatggcacaaatgccaagag

SEQ ID NO: 536534 - DNA, 20 bp, mouse
gtaagtgcgacctccgctct

SEQ ID NO: 536535 - DNA, 20 bp, mouse
gtcacctgacccggacagaa

SEQ ID NO: 536536 - DNA, 20 bp, mouse
ggtctcaggaggggagagcg

SEQ ID NO: 536537 - DNA, 20 bp, mouse
ggtcaagcaataccgagaga

SEQ ID NO: 536538 - DNA, 20 bp, mouse
ggcccaggcaaaagccaccg

SEQ ID NO: 536539 - DNA, 20 bp, mouse
gtgtctgacacagagcgtgg

SEQ ID NO: 536540 - DNA, 20 bp, mouse
ggttgggagcgcctgcaccc

SEQ ID NO: 536541 - DNA, 20 bp, mouse
gctcccctcctgagacgccc

SEQ ID NO: 536542 - DNA, 20 bp, mouse
gtcctacgatgaaggctcca

SEQ ID NO: 536543 - DNA, 20 bp, mouse
gctccggaagaagtcacgaa

SEQ ID NO: 536544 - DNA, 20 bp, mouse
gtcggcctgacgccagagaa

SEQ ID NO: 536545 - DNA, 20 bp, mouse
gcgagctatgcgaataaccc

SEQ ID NO: 536546 - DNA, 20 bp, mouse
gcagcgcgcgcctacccaaa

SEQ ID NO: 536547 - DNA, 20 bp, mouse
gttgctgcagcgggaactag

SEQ ID NO: 536548 - DNA, 20 bp, mouse
gtcgctagcgctccaggtac

SEQ ID NO: 536549 - DNA, 20 bp, mouse
gtgggtaggcgcgcgctggt

SEQ ID NO: 536550 - DNA, 20 bp, mouse
gagagccccgcgccacctcg

SEQ ID NO: 536551 - DNA, 20 bp, mouse
gttggcctgcgcggcgacgg

SEQ ID NO: 536552 - DNA, 20 bp, mouse
gtcttcgggggatgtcacag

SEQ ID NO: 536553 - DNA, 20 bp, mouse
gccttctccctgccccgagg

SEQ ID NO: 536554 - DNA, 20 bp, mouse
gagtgagcgagcgcaagggg

SEQ ID NO: 536555 - DNA, 20 bp, mouse
gggtttggcctgcgcggcga

SEQ ID NO: 536556 - DNA, 20 bp, mouse
gcgcgccgcgccaccagggt

SEQ ID NO: 536557 - DNA, 20 bp, mouse
gtggcgctggcgggcagact

SEQ ID NO: 536558 - DNA, 20 bp, mouse
gggatgcaaaggctctgacc

SEQ ID NO: 536559 - DNA, 20 bp, mouse
gaccagggtcggatgcaagt

SEQ ID NO: 536560 - DNA, 20 bp, mouse
gtccccgcgccgcgccacca

SEQ ID NO: 536561 - DNA, 20 bp, mouse
gctaccctgcaactgtccaa

SEQ ID NO: 536562 - DNA, 20 bp, mouse
ggccagcgccaggaccgctg

SEQ ID NO: 536563 - DNA, 20 bp, mouse
gaggggtcaggagcagcggt

SEQ ID NO: 536564 - DNA, 20 bp, mouse
gctgaggatggaggattccc

SEQ ID NO: 536565 - DNA, 20 bp, mouse
ggcatccgaccctggtggcg

SEQ ID NO: 536566 - DNA, 20 bp, mouse
gcgcccagcgcgcggccctg

SEQ ID NO: 536567 - DNA, 20 bp, mouse
ggtgcagggccggcgcgcac

SEQ ID NO: 536568 - DNA, 20 bp, mouse
ggcgggctgctgcgctgggt

SEQ ID NO: 536569 - DNA, 20 bp, mouse
gctgggtgggcgccaggatg

SEQ ID NO: 536570 - DNA, 20 bp, mouse
ggtccgcggaggggatgtcg

SEQ ID NO: 536571 - DNA, 20 bp, mouse
gacaggcagggagcgaatgg

SEQ ID NO: 536572 - DNA, 20 bp, mouse
gtcagcggcagtgagagttg

SEQ ID NO: 536573 - DNA, 20 bp, mouse
gggaacaggcagggagcgaa

SEQ ID NO: 536574 - DNA, 20 bp, mouse
gagtccacacccgggaccta

SEQ ID NO: 536575 - DNA, 20 bp, mouse
gcggcgcgcctgtgcagggc

SEQ ID NO: 536576 - DNA, 20 bp, mouse
gcggcaggcgcagagtgtcg

SEQ ID NO: 536577 - DNA, 20 bp, mouse
gagcagcccggcgcacgcca

SEQ ID NO: 536578 - DNA, 20 bp, mouse
ggcagggtcacagatagtct

SEQ ID NO: 536579 - DNA, 20 bp, mouse
gcatggaagactgagaccta

SEQ ID NO: 536580 - DNA, 20 bp, mouse
gcttgcaagcctccgagcca

SEQ ID NO: 536581 - DNA, 20 bp, mouse
gcagagtgtcgcggctgctg

SEQ ID NO: 536582 - DNA, 20 bp, mouse
gtcggaggcttgcaaggctg

SEQ ID NO: 536583 - DNA, 20 bp, mouse
ggcaggaccaacagatgtgg

SEQ ID NO: 536584 - DNA, 20 bp, mouse
gcctcaggcctgatcaaggg

SEQ ID NO: 536585 - DNA, 20 bp, mouse
gaagcctcaggcctgatcaa

SEQ ID NO: 536586 - DNA, 20 bp, mouse
ggctagcggagccaagatgg

SEQ ID NO: 536587 - DNA, 20 bp, mouse
gtccggtagacgctgacgtc

SEQ ID NO: 536588 - DNA, 20 bp, mouse
gggcgctagcggagccaaga

SEQ ID NO: 536589 - DNA, 20 bp, mouse
ggagccgccggcagcccggg

SEQ ID NO: 536590 - DNA, 20 bp, mouse
gccgggtggcaggctaacta

SEQ ID NO: 536591 - DNA, 20 bp, mouse
gggtggcaggctaactacgg

SEQ ID NO: 536592 - DNA, 20 bp, mouse
gggaggcccgcggcggaatc

SEQ ID NO: 536593 - DNA, 20 bp, mouse
gggctccgctagcgccgcgg

SEQ ID NO: 536594 - DNA, 20 bp, mouse
ggaggtggaaagacgcatga

SEQ ID NO: 536595 - DNA, 20 bp, mouse
ggcccgacgtcagcgtctac

SEQ ID NO: 536596 - DNA, 20 bp, mouse
ggctcgggcgatagagatgg

SEQ ID NO: 536597 - DNA, 20 bp, mouse
gagggctcgggcgatagaga

SEQ ID NO: 536598 - DNA, 20 bp, mouse
gtgcggtagacgtggacctc

SEQ ID NO: 536599 - DNA, 20 bp, mouse
ggagaagccggaagtcccga

SEQ ID NO: 536600 - DNA, 20 bp, mouse
gtcggggccagacttaggag

SEQ ID NO: 536601 - DNA, 20 bp, mouse
gcggcgggatgcggtagacg

SEQ ID NO: 536602 - DNA, 20 bp, mouse
ggttctgtgtgtcaagccgg

SEQ ID NO: 536603 - DNA, 20 bp, mouse
gccgccgggagggcacggga

SEQ ID NO: 536604 - DNA, 20 bp, mouse
gggtcacctgtaaccacggt

SEQ ID NO: 536605 - DNA, 20 bp, mouse
gggtggcccgcggcgggatg

SEQ ID NO: 536606 - DNA, 20 bp, mouse
gctcaagcgtggggccacag

SEQ ID NO: 536607 - DNA, 20 bp, mouse
gaagcgcagcgaggaacggg

SEQ ID NO: 536608 - DNA, 20 bp, mouse
gaagcgtggggccacagggg

SEQ ID NO: 536609 - DNA, 20 bp, mouse
gccggaagcgcagcgaggaa

SEQ ID NO: 536610 - DNA, 20 bp, mouse
ggccccacgcttgagaggtg

SEQ ID NO: 536611 - DNA, 20 bp, mouse
gacagagcctccctgtcagg

SEQ ID NO: 536612 - DNA, 20 bp, mouse
ggagccagacccgggagtcg

SEQ ID NO: 536613 - DNA, 20 bp, mouse
ggcgaggaacgggtggagct

SEQ ID NO: 536614 - DNA, 20 bp, mouse
gctacgggcgagccagaccc

SEQ ID NO: 536615 - DNA, 20 bp, mouse
ggggagccggaagcgcagcg

SEQ ID NO: 536616 - DNA, 20 bp, mouse
gtggacgaagcgcccctact

SEQ ID NO: 536617 - DNA, 20 bp, mouse
gcgccgctgcagcctagtag

SEQ ID NO: 536618 - DNA, 20 bp, mouse
gcggcggaggaggcccactc

SEQ ID NO: 536619 - DNA, 20 bp, mouse
gggaggaggaggcgtcgctg

SEQ ID NO: 536620 - DNA, 20 bp, mouse
ggaggccccagtactctcgg

SEQ ID NO: 536621 - DNA, 20 bp, mouse
ggcccccggaggccccccgg

SEQ ID NO: 536622 - DNA, 20 bp, mouse
ggccatggccctcccggaga

SEQ ID NO: 536623 - DNA, 20 bp, mouse
gggaggaggcgtcgctgcgg

SEQ ID NO: 536624 - DNA, 20 bp, mouse
ggacatggcagccgacgagt

SEQ ID NO: 536625 - DNA, 20 bp, mouse
gggttcatcgtggcgagggg

SEQ ID NO: 536626 - DNA, 20 bp, mouse
gcgagcgggagggtccccgt

SEQ ID NO: 536627 - DNA, 20 bp, mouse
gcgtagtgcaggggatctgg

SEQ ID NO: 536628 - DNA, 20 bp, mouse
gccgggcggcgcaggcgggg

SEQ ID NO: 536629 - DNA, 20 bp, mouse
gtggcaggggacgctcacag

SEQ ID NO: 536630 - DNA, 20 bp, mouse
gggtccccgtgggcgccggg

SEQ ID NO: 536631 - DNA, 20 bp, mouse
gaggccgggagagccatcgg

SEQ ID NO: 536632 - DNA, 20 bp, mouse
gccgcggcgccgcttcctcc

SEQ ID NO: 536633 - DNA, 20 bp, mouse
ggtccccgcagccttccggg

SEQ ID NO: 536634 - DNA, 20 bp, mouse
gagcccgctcggcgatcccc

SEQ ID NO: 536635 - DNA, 20 bp, mouse
gggcttggggagcctgtcta

SEQ ID NO: 536636 - DNA, 20 bp, mouse
ggcggcagcagcgaccacag

SEQ ID NO: 536637 - DNA, 20 bp, mouse
ggagtgctgggaagcggcag

SEQ ID NO: 536638 - DNA, 20 bp, mouse
gccgcctgcaaccccaacct

SEQ ID NO: 536639 - DNA, 20 bp, mouse
ggccgcttcccagcactcca

SEQ ID NO: 536640 - DNA, 20 bp, mouse
gtgtattcagacccagaagg

SEQ ID NO: 536641 - DNA, 20 bp, mouse
ggccctgcgcgaggcttgat

SEQ ID NO: 536642 - DNA, 20 bp, mouse
ggcctcgcgcagggccccga

SEQ ID NO: 536643 - DNA, 20 bp, mouse
ggcatcttcttcccaggttg

SEQ ID NO: 536644 - DNA, 20 bp, mouse
gcgaggcttgatgggaacta

SEQ ID NO: 536645 - DNA, 20 bp, mouse
ggaactagggggaccccggg

SEQ ID NO: 536646 - DNA, 20 bp, mouse
gagcccagcgctcaatggag

SEQ ID NO: 536647 - DNA, 20 bp, mouse
gcgcagtgcgcgggaggcga

SEQ ID NO: 536648 - DNA, 20 bp, mouse
gagactccgcagtgcgcggg

SEQ ID NO: 536649 - DNA, 20 bp, mouse
gccgtctcctgagaagctag

SEQ ID NO: 536650 - DNA, 20 bp, mouse
gcattgagcgctgggctgga

SEQ ID NO: 536651 - DNA, 20 bp, mouse
gctgctggcggtacacccgg

SEQ ID NO: 536652 - DNA, 20 bp, mouse
gagccgccgccagagatcag

SEQ ID NO: 536653 - DNA, 20 bp, mouse
ggatccctgcccagttgtca

SEQ ID NO: 536654 - DNA, 20 bp, mouse
gggtggagtagagttagcat

SEQ ID NO: 536655 - DNA, 20 bp, mouse
gcagagactccgcagtgcgc

SEQ ID NO: 536656 - DNA, 20 bp, mouse
gatcccctccttgcatctaa

SEQ ID NO: 536657 - DNA, 20 bp, mouse
gtgcccttagatgcaaggag

SEQ ID NO: 536658 - DNA, 20 bp, mouse
ggagaagcataaggacacag

SEQ ID NO: 536659 - DNA, 20 bp, mouse
gcaggccacgaacatccgac

SEQ ID NO: 536660 - DNA, 20 bp, mouse
gggatgtctgacaccaacac

SEQ ID NO: 536661 - DNA, 20 bp, mouse
gtcagctgcccttagatgca

SEQ ID NO: 536662 - DNA, 20 bp, mouse
gcacgaacatccgacgggtg

SEQ ID NO: 536663 - DNA, 20 bp, mouse
gactgagcaaccacacccgt

SEQ ID NO: 536664 - DNA, 20 bp, mouse
gtcttctaggtaggcaggca

SEQ ID NO: 536665 - DNA, 20 bp, mouse
ggcctacctagaagagatca

SEQ ID NO: 536666 - DNA, 20 bp, mouse
ggcgctgccgaagctcatca

SEQ ID NO: 536667 - DNA, 20 bp, mouse
gatcatggccggagcaggtg

SEQ ID NO: 536668 - DNA, 20 bp, mouse
gccgcggccggctcctccag

SEQ ID NO: 536669 - DNA, 20 bp, mouse
gctccggccatgatgagctt

SEQ ID NO: 536670 - DNA, 20 bp, mouse
gccagcggagcgggagtgcg

SEQ ID NO: 536671 - DNA, 20 bp, mouse
gtccagcggcttccactcgt

SEQ ID NO: 536672 - DNA, 20 bp, mouse
gggacgtccgcgcccacgag

SEQ ID NO: 536673 - DNA, 20 bp, mouse
ggggctacatcgacaaggtg

SEQ ID NO: 536674 - DNA, 20 bp, mouse
ggtgcggccgccagcggagc

SEQ ID NO: 536675 - DNA, 20 bp, mouse
gcggctgggtgaggcggaca

SEQ ID NO: 536676 - DNA, 20 bp, mouse
gggacctagagagaagaacg

SEQ ID NO: 536677 - DNA, 20 bp, mouse
gagaagaacgggggagaaga

SEQ ID NO: 536678 - DNA, 20 bp, mouse
gcaggcccggggcggagatg

SEQ ID NO: 536679 - DNA, 20 bp, mouse
gcggacagcgaggaggagac

SEQ ID NO: 536680 - DNA, 20 bp, mouse
gtagccgaacgaactcatgg

SEQ ID NO: 536681 - DNA, 20 bp, mouse
gtctccgccccgggcctgag

SEQ ID NO: 536682 - DNA, 20 bp, mouse
gggtgcgcccctcaggcccg

SEQ ID NO: 536683 - DNA, 20 bp, mouse
ggtgcgcagcggctacagca

SEQ ID NO: 536684 - DNA, 20 bp, mouse
gcggcgcacggacagcgagg

SEQ ID NO: 536685 - DNA, 20 bp, mouse
gagcgaggaggagaccggcg

SEQ ID NO: 536686 - DNA, 20 bp, mouse
gctgctcagagggccgagag

SEQ ID NO: 536687 - DNA, 20 bp, mouse
ggtctcggtgacccgccggt

SEQ ID NO: 536688 - DNA, 20 bp, mouse
ggagtggcgagacaaagaaa

SEQ ID NO: 536689 - DNA, 20 bp, mouse
gtccagcgtgtagctcatct

SEQ ID NO: 536690 - DNA, 20 bp, mouse
gcaacccgtccgcctaccgg

SEQ ID NO: 536691 - DNA, 20 bp, mouse
gtcggtgacccgccggtagg

SEQ ID NO: 536692 - DNA, 20 bp, mouse
gcagctgctccgctataaag

SEQ ID NO: 536693 - DNA, 20 bp, mouse
gagcgtgtagctcatcttgg

SEQ ID NO: 536694 - DNA, 20 bp, mouse
ggagctgtaggcgagacgcg

SEQ ID NO: 536695 - DNA, 20 bp, mouse
gcctcgtcgctgctcaacgg

SEQ ID NO: 536696 - DNA, 20 bp, mouse
gccggagcgtggctaatccc

SEQ ID NO: 536697 - DNA, 20 bp, mouse
ggagcgtggctaatccctgg

SEQ ID NO: 536698 - DNA, 20 bp, mouse
ggaggctgcgagcagagcgc

SEQ ID NO: 536699 - DNA, 20 bp, mouse
gggccgcacaccgtcctgcg

SEQ ID NO: 536700 - DNA, 20 bp, mouse
gacgcccgacaactagggag

SEQ ID NO: 536701 - DNA, 20 bp, mouse
gcggccgggcgccccgaagg

SEQ ID NO: 536702 - DNA, 20 bp, mouse
gaggctgcccgataaccagg

SEQ ID NO: 536703 - DNA, 20 bp, mouse
gagcctcgcaggacggtgtg

SEQ ID NO: 536704 - DNA, 20 bp, mouse
ggctctgctcgcagcctcgc

SEQ ID NO: 536705 - DNA, 20 bp, mouse
gggccgggaggcaagagcac

SEQ ID NO: 536706 - DNA, 20 bp, mouse
gctggttactgctcaacctg

SEQ ID NO: 536707 - DNA, 20 bp, mouse
gtgaggcagcagccagtaag

SEQ ID NO: 536708 - DNA, 20 bp, mouse
gcaagatctgaggagaaggt

SEQ ID NO: 536709 - DNA, 20 bp, mouse
ggagcagtcgcgtaacccgg

SEQ ID NO: 536710 - DNA, 20 bp, mouse
gcgattcggggtctcagtaa

SEQ ID NO: 536711 - DNA, 20 bp, mouse
ggttgagcagtaaccagagc

SEQ ID NO: 536712 - DNA, 20 bp, mouse
gcaggcggcgcagtatggaa

SEQ ID NO: 536713 - DNA, 20 bp, mouse
ggctgggattaaccccttac

SEQ ID NO: 536714 - DNA, 20 bp, mouse
ggttgaatgaatacctgctc

SEQ ID NO: 536715 - DNA, 20 bp, mouse
gttgctactagcaagatctg

SEQ ID NO: 536716 - DNA, 20 bp, mouse
gacctgcgccttccagacca

SEQ ID NO: 536717 - DNA, 20 bp, mouse
gcgccttccagaccagggcg

SEQ ID NO: 536718 - DNA, 20 bp, mouse
gctccccgccctggtctgga

SEQ ID NO: 536719 - DNA, 20 bp, mouse
gcggaccccgtgcgctccaa

SEQ ID NO: 536720 - DNA, 20 bp, mouse
gggaggacgagttcagccat

SEQ ID NO: 536721 - DNA, 20 bp, mouse
gcgtcctccccgccctggtc

SEQ ID NO: 536722 - DNA, 20 bp, mouse
ggagggctcagggagtcgga

SEQ ID NO: 536723 - DNA, 20 bp, mouse
gtctggaaggcgcaggtgga

SEQ ID NO: 536724 - DNA, 20 bp, mouse
gcagcggaaccccagctacc

SEQ ID NO: 536725 - DNA, 20 bp, mouse
ggaactcgtcctccccgccc

SEQ ID NO: 536726 - DNA, 20 bp, mouse
gcaggccttgcaactagcag

SEQ ID NO: 536727 - DNA, 20 bp, mouse
gtccgggcgggctacagaga

SEQ ID NO: 536728 - DNA, 20 bp, mouse
gaactagcaggggttccggg

SEQ ID NO: 536729 - DNA, 20 bp, mouse
ggaggtagcgacatcagcca

SEQ ID NO: 536730 - DNA, 20 bp, mouse
gacacaggactgacttaccg

SEQ ID NO: 536731 - DNA, 20 bp, mouse
gtgcaactagcaggggttcc

SEQ ID NO: 536732 - DNA, 20 bp, mouse
gggctacagagatggtggaa

SEQ ID NO: 536733 - DNA, 20 bp, mouse
ggcgacatcagccagggagg

SEQ ID NO: 536734 - DNA, 20 bp, mouse
ggtagcgacatcagccaggg

SEQ ID NO: 536735 - DNA, 20 bp, mouse
gtgaacttcccgcccagtgt

SEQ ID NO: 536736 - DNA, 20 bp, mouse
gactgcacaggctcaaggta

SEQ ID NO: 536737 - DNA, 20 bp, mouse
gctcctcagcagtagctcta

SEQ ID NO: 536738 - DNA, 20 bp, mouse
gacagtgactatggattccg

SEQ ID NO: 536739 - DNA, 20 bp, mouse
gcagtagctctatggtttca

SEQ ID NO: 536740 - DNA, 20 bp, mouse
ggccagcgacagtgacgcga

SEQ ID NO: 536741 - DNA, 20 bp, mouse
ggggcaactgcacaggctca

SEQ ID NO: 536742 - DNA, 20 bp, mouse
gcctgaccccttggaaacgg

SEQ ID NO: 536743 - DNA, 20 bp, mouse
ggtaccgcccccaacttcac

SEQ ID NO: 536744 - DNA, 20 bp, mouse
gtgacgaggcgggaggactt

SEQ ID NO: 536745 - DNA, 20 bp, mouse
gactgtgcctgacccgacgg

SEQ ID NO: 536746 - DNA, 20 bp, mouse
gatgcccgatcaagatacaa

SEQ ID NO: 536747 - DNA, 20 bp, mouse
ggtcccttgttgcttatcag

SEQ ID NO: 536748 - DNA, 20 bp, mouse
gaaccgctgataagcaacaa

SEQ ID NO: 536749 - DNA, 20 bp, mouse
ggggagcagtggcattaggt

SEQ ID NO: 536750 - DNA, 20 bp, mouse
gacatttctttacctggtgg

SEQ ID NO: 536751 - DNA, 20 bp, mouse
gtcgcctttgtatcttgatc

SEQ ID NO: 536752 - DNA, 20 bp, mouse
gccaggtaaagaaatgtctg

SEQ ID NO: 536753 - DNA, 20 bp, mouse
gaatgtctgtggtcatccat

SEQ ID NO: 536754 - DNA, 20 bp, mouse
gcagcaggtagtgttttcaa

SEQ ID NO: 536755 - DNA, 20 bp, mouse
ggcttgactgaacgttcaac

SEQ ID NO: 536756 - DNA, 20 bp, mouse
ggcgagctctaggctgacgg

SEQ ID NO: 536757 - DNA, 20 bp, mouse
gctccgaggcagcgagctct

SEQ ID NO: 536758 - DNA, 20 bp, mouse
ggcaggctggggacctgtaa

SEQ ID NO: 536759 - DNA, 20 bp, mouse
gtaaacaaccacgccctccg

SEQ ID NO: 536760 - DNA, 20 bp, mouse
gagaagctgagggctctccc

SEQ ID NO: 536761 - DNA, 20 bp, mouse
gggctgacggaggcttggcc

SEQ ID NO: 536762 - DNA, 20 bp, mouse
ggccgcaagtgtgagaggaa

SEQ ID NO: 536763 - DNA, 20 bp, mouse
gcagcgggatgggtacccca

SEQ ID NO: 536764 - DNA, 20 bp, mouse
gctctaggctgacggaggct

SEQ ID NO: 536765 - DNA, 20 bp, mouse
gagctgagggctctccctgg

SEQ ID NO: 536766 - DNA, 20 bp, mouse
gactcaggcaggcagacgag

SEQ ID NO: 536767 - DNA, 20 bp, mouse
gccgctgtcagaagattcgg

SEQ ID NO: 536768 - DNA, 20 bp, mouse
ggcaggcagacgaggggctc

SEQ ID NO: 536769 - DNA, 20 bp, mouse
gaagcccgcgacggttgacc

SEQ ID NO: 536770 - DNA, 20 bp, mouse
ggccggttgctcgccgactc

SEQ ID NO: 536771 - DNA, 20 bp, mouse
ggaagagcgacggcaaggtg

SEQ ID NO: 536772 - DNA, 20 bp, mouse
ggttgctcgccgactcaggc

SEQ ID NO: 536773 - DNA, 20 bp, mouse
ggcgccgggcagcccttcca

SEQ ID NO: 536774 - DNA, 20 bp, mouse
gccctaagcccgccgtggaa

SEQ ID NO: 536775 - DNA, 20 bp, mouse
gcccgcgacggttgacccgg

SEQ ID NO: 536776 - DNA, 20 bp, mouse
gacgcacgccgctgggaggt

SEQ ID NO: 536777 - DNA, 20 bp, mouse
gccgctgggaggtgggtgaa

SEQ ID NO: 536778 - DNA, 20 bp, mouse
gagcgacgcacgccgctggg

SEQ ID NO: 536779 - DNA, 20 bp, mouse
gtgaagggagctgtacgggt

SEQ ID NO: 536780 - DNA, 20 bp, mouse
gtgggtgaagggagctgtac

SEQ ID NO: 536781 - DNA, 20 bp, mouse
ggagctgtacgggtcggccg

SEQ ID NO: 536782 - DNA, 20 bp, mouse
gcccgctcctctctccaccg

SEQ ID NO: 536783 - DNA, 20 bp, mouse
gctgtacgggtcggccgcgg

SEQ ID NO: 536784 - DNA, 20 bp, mouse
gactggggcgcacagcctac

SEQ ID NO: 536785 - DNA, 20 bp, mouse
gcggggcgacggccaaatgt

SEQ ID NO: 536786 - DNA, 20 bp, mouse
gatggtagcggcgtccgggt

SEQ ID NO: 536787 - DNA, 20 bp, mouse
gcataaacgcggcccaccgc

SEQ ID NO: 536788 - DNA, 20 bp, mouse
gcccgctcatgccagacggg

SEQ ID NO: 536789 - DNA, 20 bp, mouse
gtaccccgccagtatcgcta

SEQ ID NO: 536790 - DNA, 20 bp, mouse
gggccccgctcatgccagac

SEQ ID NO: 536791 - DNA, 20 bp, mouse
ggcctcgaagctcctgcccg

SEQ ID NO: 536792 - DNA, 20 bp, mouse
gtcgaagctcctgcccgcgg

SEQ ID NO: 536793 - DNA, 20 bp, mouse
ggcctacagtcgggaagctg

SEQ ID NO: 536794 - DNA, 20 bp, mouse
gtcgtgggcaggggtagtta

SEQ ID NO: 536795 - DNA, 20 bp, mouse
gtgtacaggcccggagtgat

SEQ ID NO: 536796 - DNA, 20 bp, mouse
gctgcgtctgggaggcttag

SEQ ID NO: 536797 - DNA, 20 bp, mouse
gtggccctgcccctgcgtct

SEQ ID NO: 536798 - DNA, 20 bp, mouse
ggggcgttaagcagtgagca

SEQ ID NO: 536799 - DNA, 20 bp, mouse
gtccggaaaaatgaacacat

SEQ ID NO: 536800 - DNA, 20 bp, mouse
gagggcaacagccagcatgt

SEQ ID NO: 536801 - DNA, 20 bp, mouse
gtaggcaggagtaaacaggg

SEQ ID NO: 536802 - DNA, 20 bp, mouse
ggaggggcccgcgacagctc

SEQ ID NO: 536803 - DNA, 20 bp, mouse
gctaggaagccccgctcact

SEQ ID NO: 536804 - DNA, 20 bp, mouse
ggccttgggtggtcaactat

SEQ ID NO: 536805 - DNA, 20 bp, mouse
ggcgggcccctcgaagctga

SEQ ID NO: 536806 - DNA, 20 bp, mouse
ggcgctggcggctctctcgg

SEQ ID NO: 536807 - DNA, 20 bp, mouse
gcgggcgcgcgcagaagcgg

SEQ ID NO: 536808 - DNA, 20 bp, mouse
gaagcggcggctgaaccaag

SEQ ID NO: 536809 - DNA, 20 bp, mouse
ggcgcgggtcacacgcgagt

SEQ ID NO: 536810 - DNA, 20 bp, mouse
gctggtcccaggccactcac

SEQ ID NO: 536811 - DNA, 20 bp, mouse
gcgggaacgttcagacacgt

SEQ ID NO: 536812 - DNA, 20 bp, mouse
gcaggaggccgaggtgtccg

SEQ ID NO: 536813 - DNA, 20 bp, mouse
gcgggtcacacgcgagttgg

SEQ ID NO: 536814 - DNA, 20 bp, mouse
ggcactcccgcgcagctggg

SEQ ID NO: 536815 - DNA, 20 bp, mouse
ggcgcgggcgcgcgcagaag

SEQ ID NO: 536816 - DNA, 20 bp, mouse
gggagcggagccgggaggat

SEQ ID NO: 536817 - DNA, 20 bp, mouse
gtagcggcggcccatcctcc

SEQ ID NO: 536818 - DNA, 20 bp, mouse
ggccgccgctaacctcgcag

SEQ ID NO: 536819 - DNA, 20 bp, mouse
gcccactgcgaggttagcgg

SEQ ID NO: 536820 - DNA, 20 bp, mouse
gcttcccactgcgaggttag

SEQ ID NO: 536821 - DNA, 20 bp, mouse
gaagcgcgggccgagcaggg

SEQ ID NO: 536822 - DNA, 20 bp, mouse
gacctcgcagtgggaagcgc

SEQ ID NO: 536823 - DNA, 20 bp, mouse
gcgtcccgggcggtcctcgg

SEQ ID NO: 536824 - DNA, 20 bp, mouse
ggcccgcgcttcccactgcg

SEQ ID NO: 536825 - DNA, 20 bp, mouse
ggtcaggagggtaaacatcc

SEQ ID NO: 536826 - DNA, 20 bp, mouse
gagcgccctggctcacccga

SEQ ID NO: 536827 - DNA, 20 bp, mouse
gacgagcggatccgagtggt

SEQ ID NO: 536828 - DNA, 20 bp, mouse
gtgagatggagaagtacgag

SEQ ID NO: 536829 - DNA, 20 bp, mouse
ggaagccagagcaccactat

SEQ ID NO: 536830 - DNA, 20 bp, mouse
ggaggagctcccagatggga

SEQ ID NO: 536831 - DNA, 20 bp, mouse
gggcctcccgcctaaaccta

SEQ ID NO: 536832 - DNA, 20 bp, mouse
gtggtgggaagaggtgcctt

SEQ ID NO: 536833 - DNA, 20 bp, mouse
gcccgcctaaacctaaggac

SEQ ID NO: 536834 - DNA, 20 bp, mouse
gggtgccttcgggtgagcca

SEQ ID NO: 536835 - DNA, 20 bp, mouse
gtgggcggggcatcccatag

SEQ ID NO: 536836 - DNA, 20 bp, mouse
gggcctcagacgccaggcag

SEQ ID NO: 536837 - DNA, 20 bp, mouse
ggcccagggagcttccatgg

SEQ ID NO: 536838 - DNA, 20 bp, mouse
gcagggggcaggagccacca

SEQ ID NO: 536839 - DNA, 20 bp, mouse
ggcggcccagggagcttcca

SEQ ID NO: 536840 - DNA, 20 bp, mouse
ggccaccatggaagctccct

SEQ ID NO: 536841 - DNA, 20 bp, mouse
gtaggtggccccgcggccca

SEQ ID NO: 536842 - DNA, 20 bp, mouse
gcgccaggcagcggcttagg

SEQ ID NO: 536843 - DNA, 20 bp, mouse
gacttcggaagcgagtccgg

SEQ ID NO: 536844 - DNA, 20 bp, mouse
gggagccgcccgcgtatcca

SEQ ID NO: 536845 - DNA, 20 bp, mouse
gagcggcttaggtggccccg

SEQ ID NO: 536846 - DNA, 20 bp, mouse
gccggtgtcactctccctca

SEQ ID NO: 536847 - DNA, 20 bp, mouse
ggccaagatggcttccatga

SEQ ID NO: 536848 - DNA, 20 bp, mouse
gatggaagccatcttggcgg

SEQ ID NO: 536849 - DNA, 20 bp, mouse
ggtcctcgccggggacacgt

SEQ ID NO: 536850 - DNA, 20 bp, mouse
gggagagtgacaccggcctg

SEQ ID NO: 536851 - DNA, 20 bp, mouse
ggcgaggacccccaacatgg

SEQ ID NO: 536852 - DNA, 20 bp, mouse
gcgtcggccggcatcttacg

SEQ ID NO: 536853 - DNA, 20 bp, mouse
gggagaggcggtggaagcag

SEQ ID NO: 536854 - DNA, 20 bp, mouse
gccggcgaggacccccaaca

SEQ ID NO: 536855 - DNA, 20 bp, mouse
gcttcacggccgaggagagg

SEQ ID NO: 536856 - DNA, 20 bp, mouse
ggctggacctaggcagtcaa

SEQ ID NO: 536857 - DNA, 20 bp, mouse
gcgcgatctggccacactgg

SEQ ID NO: 536858 - DNA, 20 bp, mouse
ggccccagaagccctctcca

SEQ ID NO: 536859 - DNA, 20 bp, mouse
gggacctaggcagtcaaggg

SEQ ID NO: 536860 - DNA, 20 bp, mouse
gggcagtcaagggcggaagt

SEQ ID NO: 536861 - DNA, 20 bp, mouse
gtgacgcgatctggccacac

SEQ ID NO: 536862 - DNA, 20 bp, mouse
ggtcagcagagcagctcgca

SEQ ID NO: 536863 - DNA, 20 bp, mouse
gctggccacactggaggcgg

SEQ ID NO: 536864 - DNA, 20 bp, mouse
gtggagccccgcgaacatgg

SEQ ID NO: 536865 - DNA, 20 bp, mouse
gggctcggtgcagttggtca

SEQ ID NO: 536866 - DNA, 20 bp, mouse
gcacgcgcagtgaggagacg

SEQ ID NO: 536867 - DNA, 20 bp, mouse
gggagacgcggcagatatgg

SEQ ID NO: 536868 - DNA, 20 bp, mouse
gtgaggagacgcggcagata

SEQ ID NO: 536869 - DNA, 20 bp, mouse
gcggcgccgggtacaattat

SEQ ID NO: 536870 - DNA, 20 bp, mouse
ggcctcttcgccccactctg

SEQ ID NO: 536871 - DNA, 20 bp, mouse
ggcggcagatatggcgggtc

SEQ ID NO: 536872 - DNA, 20 bp, mouse
gtcggaggtcagggagtcaa

SEQ ID NO: 536873 - DNA, 20 bp, mouse
ggatatggcgggtccggcgc

SEQ ID NO: 536874 - DNA, 20 bp, mouse
gtcgggaatgcctcagagtg

SEQ ID NO: 536875 - DNA, 20 bp, mouse
gtatgggagaagactacttc

SEQ ID NO: 536876 - DNA, 20 bp, mouse
gacgaagccctcacctgagg

SEQ ID NO: 536877 - DNA, 20 bp, mouse
ggcgccgccccctcaggtga

SEQ ID NO: 536878 - DNA, 20 bp, mouse
gcggcggcgccggagaccgc

SEQ ID NO: 536879 - DNA, 20 bp, mouse
ggcgctatctgggcaaccag

SEQ ID NO: 536880 - DNA, 20 bp, mouse
gcgcgcagtagcccgcgcgg

SEQ ID NO: 536881 - DNA, 20 bp, mouse
gcagcgcgcagtagcccgcg

SEQ ID NO: 536882 - DNA, 20 bp, mouse
gtccgggctgaggtacccca

SEQ ID NO: 536883 - DNA, 20 bp, mouse
ggcagcctcggaggaacgag

SEQ ID NO: 536884 - DNA, 20 bp, mouse
gtctgggcaaccagaggagg

SEQ ID NO: 536885 - DNA, 20 bp, mouse
gcgcccgggcccgcggtctc

SEQ ID NO: 536886 - DNA, 20 bp, mouse
gcggctctgtgggctcgaag

SEQ ID NO: 536887 - DNA, 20 bp, mouse
gcagaaagccgcggctctgt

SEQ ID NO: 536888 - DNA, 20 bp, mouse
gggccaaacttactagcggg

SEQ ID NO: 536889 - DNA, 20 bp, mouse
gtactagcgggcggcagggg

SEQ ID NO: 536890 - DNA, 20 bp, mouse
gtgccgcccgctagtaagtt

SEQ ID NO: 536891 - DNA, 20 bp, mouse
gtctctgacgggctagagaa

SEQ ID NO: 536892 - DNA, 20 bp, mouse
gggaggccccccgccaagca

SEQ ID NO: 536893 - DNA, 20 bp, mouse
gaagcggccaaacttactag

SEQ ID NO: 536894 - DNA, 20 bp, mouse
gctgcgctccccctgagcta

SEQ ID NO: 536895 - DNA, 20 bp, mouse
gtgcatctccggagtccagg

SEQ ID NO: 536896 - DNA, 20 bp, mouse
ggacaggcgcgggagaccga

SEQ ID NO: 536897 - DNA, 20 bp, mouse
ggcgggagaccgaaggagat

SEQ ID NO: 536898 - DNA, 20 bp, mouse
gggagatgggtagtgagcag

SEQ ID NO: 536899 - DNA, 20 bp, mouse
gctcctaggtgaagctggac

SEQ ID NO: 536900 - DNA, 20 bp, mouse
ggggcgcgcacgcagaggaa

SEQ ID NO: 536901 - DNA, 20 bp, mouse
gcaaagcacgcaagactcct

SEQ ID NO: 536902 - DNA, 20 bp, mouse
gaggtgaagctggacaggcg

SEQ ID NO: 536903 - DNA, 20 bp, mouse
gctggccagcccagactgag

SEQ ID NO: 536904 - DNA, 20 bp, mouse
gcacgcgcccgatttcgagg

SEQ ID NO: 536905 - DNA, 20 bp, mouse
gagcgtgagtgtctaagtga

SEQ ID NO: 536906 - DNA, 20 bp, mouse
ggtgctgaaccggctcttca

SEQ ID NO: 536907 - DNA, 20 bp, mouse
gcgtcggctcagtccctgaa

SEQ ID NO: 536908 - DNA, 20 bp, mouse
ggaggtcaaccgtgctgaac

SEQ ID NO: 536909 - DNA, 20 bp, mouse
gtcagtccctgaaaggactg

SEQ ID NO: 536910 - DNA, 20 bp, mouse
gcaggcctagagaatccccg

SEQ ID NO: 536911 - DNA, 20 bp, mouse
ggaaccggctcttcatggct

SEQ ID NO: 536912 - DNA, 20 bp, mouse
gcgctaccgcagtcctttca

SEQ ID NO: 536913 - DNA, 20 bp, mouse
gaagcatagtggtcctgcgt

SEQ ID NO: 536914 - DNA, 20 bp, mouse
gttccgcgagcactgcgcgg

SEQ ID NO: 536915 - DNA, 20 bp, mouse
gaggcaccgggacgaccgtg

SEQ ID NO: 536916 - DNA, 20 bp, mouse
ggcgccccgcgccctggtgg

SEQ ID NO: 536917 - DNA, 20 bp, mouse
gctgctggcggcgctcgtcc

SEQ ID NO: 536918 - DNA, 20 bp, mouse
ggctgtcccgagctgactgg

SEQ ID NO: 536919 - DNA, 20 bp, mouse
ggctacggcggcgaggaggt

SEQ ID NO: 536920 - DNA, 20 bp, mouse
ggggcgcgccatagacagcg

SEQ ID NO: 536921 - DNA, 20 bp, mouse
ggcctgctcctcgctgtcta

SEQ ID NO: 536922 - DNA, 20 bp, mouse
gcgcagccgccaccagggcg

SEQ ID NO: 536923 - DNA, 20 bp, mouse
gaggaggagctggcccgcta

SEQ ID NO: 536924 - DNA, 20 bp, mouse
gcagtaggcccgggacaccg

SEQ ID NO: 536925 - DNA, 20 bp, mouse
gaggagctggcccgctacgg

SEQ ID NO: 536926 - DNA, 20 bp, mouse
gtaccgtgaggagcccgagt

SEQ ID NO: 536927 - DNA, 20 bp, mouse
gagccctgcggcgcagagac

SEQ ID NO: 536928 - DNA, 20 bp, mouse
gcgtgaggagcccgagtcgg

SEQ ID NO: 536929 - DNA, 20 bp, mouse
gctgaggcgcgctgagggaa

SEQ ID NO: 536930 - DNA, 20 bp, mouse
gactcgtggggtagagatgg

SEQ ID NO: 536931 - DNA, 20 bp, mouse
gcccccctcgctctaccgtg

SEQ ID NO: 536932 - DNA, 20 bp, mouse
gtcctcacggtagagcgagg

SEQ ID NO: 536933 - DNA, 20 bp, mouse
gatctctaccccacgagtgg

SEQ ID NO: 536934 - DNA, 20 bp, mouse
ggcggcgcagagaccggctg

SEQ ID NO: 536935 - DNA, 20 bp, mouse
gattccggccgagagccggg

SEQ ID NO: 536936 - DNA, 20 bp, mouse
gggtgcattgtccaacacag

SEQ ID NO: 536937 - DNA, 20 bp, mouse
gcagtttgcactgaggccat

SEQ ID NO: 536938 - DNA, 20 bp, mouse
gtacttgcaaacctctgtgt

SEQ ID NO: 536939 - DNA, 20 bp, mouse
ggcctcagtgcaaactgtcc

SEQ ID NO: 536940 - DNA, 20 bp, mouse
ggagggtgtgggataagtat

SEQ ID NO: 536941 - DNA, 20 bp, mouse
gctgcttgctgggcatcagt

SEQ ID NO: 536942 - DNA, 20 bp, mouse
gttggacaatgcacccgctt

SEQ ID NO: 536943 - DNA, 20 bp, mouse
gggctcatggaactcccatc

SEQ ID NO: 536944 - DNA, 20 bp, mouse
gtcaaaaaatacatattcag

SEQ ID NO: 536945 - DNA, 20 bp, mouse
gtcctggacagtttgcactg

SEQ ID NO: 536946 - DNA, 20 bp, mouse
gtgcagctgagggagctctt

SEQ ID NO: 536947 - DNA, 20 bp, mouse
ggcagtgttgcagtgagtga

SEQ ID NO: 536948 - DNA, 20 bp, mouse
gtctgtgactactcccgagg

SEQ ID NO: 536949 - DNA, 20 bp, mouse
gcactgcaacactgcagctg

SEQ ID NO: 536950 - DNA, 20 bp, mouse
gctcaggccactaggtgact

SEQ ID NO: 536951 - DNA, 20 bp, mouse
ggtcaaggagaaaggccagg

SEQ ID NO: 536952 - DNA, 20 bp, mouse
ggagggctaaggcactgact

SEQ ID NO: 536953 - DNA, 20 bp, mouse
gcctgcccaggaaaactgga

SEQ ID NO: 536954 - DNA, 20 bp, mouse
ggctctttggctacatgaaa

SEQ ID NO: 536955 - DNA, 20 bp, mouse
gtgccacagaccctaccccc

SEQ ID NO: 536956 - DNA, 20 bp, mouse
gagcggcgacagtgacccag

SEQ ID NO: 536957 - DNA, 20 bp, mouse
gcgctggtctggccccccga

SEQ ID NO: 536958 - DNA, 20 bp, mouse
gggacgtggagcactagaga

SEQ ID NO: 536959 - DNA, 20 bp, mouse
ggacagtgacccagcggaag

SEQ ID NO: 536960 - DNA, 20 bp, mouse
gccccgagggcaagcggacg

SEQ ID NO: 536961 - DNA, 20 bp, mouse
gcgggagcggaccatcgagg

SEQ ID NO: 536962 - DNA, 20 bp, mouse
gtcccccttaaaagctccaa

SEQ ID NO: 536963 - DNA, 20 bp, mouse
gtgatcgacgaggacccgca

SEQ ID NO: 536964 - DNA, 20 bp, mouse
ggacatggagggttgcgtcg

SEQ ID NO: 536965 - DNA, 20 bp, mouse
gtggcccttggagcttttaa

SEQ ID NO: 536966 - DNA, 20 bp, mouse
ggtgcccaggagaccgatcg

SEQ ID NO: 536967 - DNA, 20 bp, mouse
ggtagccgctctctgctaga

SEQ ID NO: 536968 - DNA, 20 bp, mouse
ggtcgccttctagcagagag

SEQ ID NO: 536969 - DNA, 20 bp, mouse
gatgcccgccagcttctgcg

SEQ ID NO: 536970 - DNA, 20 bp, mouse
gcccaggagaccgatcgtgg

SEQ ID NO: 536971 - DNA, 20 bp, mouse
gctgcctcgcagaagctggc

SEQ ID NO: 536972 - DNA, 20 bp, mouse
gtcaaatccccggatgacgg

SEQ ID NO: 536973 - DNA, 20 bp, mouse
gggcggcgaacgagaggtga

SEQ ID NO: 536974 - DNA, 20 bp, mouse
gacggtgggtgaccaaggac

SEQ ID NO: 536975 - DNA, 20 bp, mouse
ggtgtcggccggaagccccg

SEQ ID NO: 536976 - DNA, 20 bp, mouse
gccaccgcgagcggaggcat

SEQ ID NO: 536977 - DNA, 20 bp, mouse
gttacctcctgctcccggaa

SEQ ID NO: 536978 - DNA, 20 bp, mouse
gggaggtaagagcagaccga

SEQ ID NO: 536979 - DNA, 20 bp, mouse
gggcaacgccgccaaggcgc

SEQ ID NO: 536980 - DNA, 20 bp, mouse
ggcatgggcgcatggctgcc

SEQ ID NO: 536981 - DNA, 20 bp, mouse
ggaaaagcccggcgccttgg

SEQ ID NO: 536982 - DNA, 20 bp, mouse
ggaagaaaagcccggcgcct

SEQ ID NO: 536983 - DNA, 20 bp, mouse
gtggtggcgcatgatgagat

SEQ ID NO: 536984 - DNA, 20 bp, mouse
ggttaataaccagcccttcc

SEQ ID NO: 536985 - DNA, 20 bp, mouse
ggttattaacatctaagact

SEQ ID NO: 536986 - DNA, 20 bp, mouse
gtagccccttctgctggagc

SEQ ID NO: 536987 - DNA, 20 bp, mouse
gcagctgcccagtctcaccc

SEQ ID NO: 536988 - DNA, 20 bp, mouse
gacagcggcttggttcgtgg

SEQ ID NO: 536989 - DNA, 20 bp, mouse
ggtggtggaggggaacacgg

SEQ ID NO: 536990 - DNA, 20 bp, mouse
gtcagccagctccagcagaa

SEQ ID NO: 536991 - DNA, 20 bp, mouse
gcagacgacagcgaagtcag

SEQ ID NO: 536992 - DNA, 20 bp, mouse
gcctccactgagatgcagtg

SEQ ID NO: 536993 - DNA, 20 bp, mouse
gcggatcgacggcaacgact

SEQ ID NO: 536994 - DNA, 20 bp, mouse
gggaggcaggggtccgtcat

SEQ ID NO: 536995 - DNA, 20 bp, mouse
ggagtcttaatcatagctat

SEQ ID NO: 536996 - DNA, 20 bp, mouse
gtcctcagcccgccgagagg

SEQ ID NO: 536997 - DNA, 20 bp, mouse
ggacggccgccgcctctcgg

SEQ ID NO: 536998 - DNA, 20 bp, mouse
gacttcaagggagcccgccg

SEQ ID NO: 536999 - DNA, 20 bp, mouse
ggctccgagagcgcccgagg

SEQ ID NO: 537000 - DNA, 20 bp, mouse
gccggcgcgcgccacttcaa

SEQ ID NO: 537001 - DNA, 20 bp, mouse
gccccggagcgagctcgcag

SEQ ID NO: 537002 - DNA, 20 bp, mouse
gctttcctcagcccgccgag

SEQ ID NO: 537003 - DNA, 20 bp, mouse
gagctctgcgcggtcctcaa

SEQ ID NO: 537004 - DNA, 20 bp, mouse
ggcggcggccgtcggggacc

SEQ ID NO: 537005 - DNA, 20 bp, mouse
gccgagagcgcccgaggcgg

SEQ ID NO: 537006 - DNA, 20 bp, mouse
gtcgccgggagctatggtgg

SEQ ID NO: 537007 - DNA, 20 bp, mouse
gggatcgccgggagctatgg

SEQ ID NO: 537008 - DNA, 20 bp, mouse
gtccaggaactggtcaccgg

SEQ ID NO: 537009 - DNA, 20 bp, mouse
gcagggatcgccgggagcta

SEQ ID NO: 537010 - DNA, 20 bp, mouse
gctcccggcgatccctgtcc

SEQ ID NO: 537011 - DNA, 20 bp, mouse
gctgtccaggaactggtcac

SEQ ID NO: 537012 - DNA, 20 bp, mouse
gggcagacccgaccagaccc

SEQ ID NO: 537013 - DNA, 20 bp, mouse
gggcccgcccaatagctcag

SEQ ID NO: 537014 - DNA, 20 bp, mouse
gctgcccccaccatagctcc

SEQ ID NO: 537015 - DNA, 20 bp, mouse
ggcgatccctgtccaggaac

SEQ ID NO: 537016 - DNA, 20 bp, mouse
gcagggggcgggtcagtcag

SEQ ID NO: 537017 - DNA, 20 bp, mouse
gcctggctgcaaggtaatat

SEQ ID NO: 537018 - DNA, 20 bp, mouse
gatcggaagttgactaagaa

SEQ ID NO: 537019 - DNA, 20 bp, mouse
gacccaatctcagactcagg

SEQ ID NO: 537020 - DNA, 20 bp, mouse
ggccccctgagtctgagatt

SEQ ID NO: 537021 - DNA, 20 bp, mouse
gatgtcaacctgcacctcag

SEQ ID NO: 537022 - DNA, 20 bp, mouse
gcaggttgacatgacccaaa

SEQ ID NO: 537023 - DNA, 20 bp, mouse
ggggtgcaggtaagattcgg

SEQ ID NO: 537024 - DNA, 20 bp, mouse
gaaaaggggaggtgccactg

SEQ ID NO: 537025 - DNA, 20 bp, mouse
gggagggtgcaggtaagatt

SEQ ID NO: 537026 - DNA, 20 bp, mouse
gagctcttctactctaccca

SEQ ID NO: 537027 - DNA, 20 bp, mouse
gacccagggctagcagatga

SEQ ID NO: 537028 - DNA, 20 bp, mouse
gctgccaggggatgactcat

SEQ ID NO: 537029 - DNA, 20 bp, mouse
gtctcccatgagtcatcccc

SEQ ID NO: 537030 - DNA, 20 bp, mouse
gcgccatgggcctgagatct

SEQ ID NO: 537031 - DNA, 20 bp, mouse
gcaggtggcactcatctgac

SEQ ID NO: 537032 - DNA, 20 bp, mouse
ggcagctatccgactgccag

SEQ ID NO: 537033 - DNA, 20 bp, mouse
gaaccttcatctgctagccc

SEQ ID NO: 537034 - DNA, 20 bp, mouse
gtggcaaatggagtcctgtc

SEQ ID NO: 537035 - DNA, 20 bp, mouse
gcagaatcatccaattcagg

SEQ ID NO: 537036 - DNA, 20 bp, mouse
ggtgaccgctgcgcaagaac

SEQ ID NO: 537037 - DNA, 20 bp, mouse
ggagcagaaggaatgcgctg

SEQ ID NO: 537038 - DNA, 20 bp, mouse
ggtaatgagacaaatatccc

SEQ ID NO: 537039 - DNA, 20 bp, mouse
gctccggagccggtgagctg

SEQ ID NO: 537040 - DNA, 20 bp, mouse
gaggactgagagcagcgtct

SEQ ID NO: 537041 - DNA, 20 bp, mouse
gccttcttccgagactccac

SEQ ID NO: 537042 - DNA, 20 bp, mouse
gccggctccggaggctctct

SEQ ID NO: 537043 - DNA, 20 bp, mouse
ggactctcaccccagctcac

SEQ ID NO: 537044 - DNA, 20 bp, mouse
gtgcaggtccccacagtccc

SEQ ID NO: 537045 - DNA, 20 bp, mouse
ggaattcggccggggactgt

SEQ ID NO: 537046 - DNA, 20 bp, mouse
gaacaggacagtgtgcatca

SEQ ID NO: 537047 - DNA, 20 bp, mouse
ggaagccccagagctattag

SEQ ID NO: 537048 - DNA, 20 bp, mouse
gacccagaggacctaaggct

SEQ ID NO: 537049 - DNA, 20 bp, mouse
gagctcagaacaccaagagg

SEQ ID NO: 537050 - DNA, 20 bp, mouse
gtggtcagcacagccctcgg

SEQ ID NO: 537051 - DNA, 20 bp, mouse
gaggctccgcagaccaccga

SEQ ID NO: 537052 - DNA, 20 bp, mouse
ggggtctgccaggcacagtc

SEQ ID NO: 537053 - DNA, 20 bp, mouse
gtaaggcttggctctagtgg

SEQ ID NO: 537054 - DNA, 20 bp, mouse
gacctaaggcttggctctag

SEQ ID NO: 537055 - DNA, 20 bp, mouse
ggagctattagtggttgaac

SEQ ID NO: 537056 - DNA, 20 bp, mouse
gctgggcaggagcggaggaa

SEQ ID NO: 537057 - DNA, 20 bp, mouse
ggcccctgggccccggcccg

SEQ ID NO: 537058 - DNA, 20 bp, mouse
gcccggtcgcagccccgcca

SEQ ID NO: 537059 - DNA, 20 bp, mouse
gcgccaagcccagggagagc

SEQ ID NO: 537060 - DNA, 20 bp, mouse
gtcggattccggctgcgggt

SEQ ID NO: 537061 - DNA, 20 bp, mouse
ggctgcgctctgcctggtgc

SEQ ID NO: 537062 - DNA, 20 bp, mouse
gagctcacccgcgggcggga

SEQ ID NO: 537063 - DNA, 20 bp, mouse
gcccgcgggccatagagtcg

SEQ ID NO: 537064 - DNA, 20 bp, mouse
gctcgcgccacccggctacc

SEQ ID NO: 537065 - DNA, 20 bp, mouse
gccgccggagcacccccggg

SEQ ID NO: 537066 - DNA, 20 bp, mouse
gccgctgcaccggcgaccgg

SEQ ID NO: 537067 - DNA, 20 bp, mouse
gcgaccggcgggcggcagat

SEQ ID NO: 537068 - DNA, 20 bp, mouse
gccggcgggcggcagatggg

SEQ ID NO: 537069 - DNA, 20 bp, mouse
gcggctgcgacgacccgggg

SEQ ID NO: 537070 - DNA, 20 bp, mouse
ggagccggagggaggtatcg

SEQ ID NO: 537071 - DNA, 20 bp, mouse
gccggagccgcgccccgaag

SEQ ID NO: 537072 - DNA, 20 bp, mouse
gcgacctccggctggaacaa

SEQ ID NO: 537073 - DNA, 20 bp, mouse
ggccctgcaacccccctgaa

SEQ ID NO: 537074 - DNA, 20 bp, mouse
gggctccggcaaccaggctc

SEQ ID NO: 537075 - DNA, 20 bp, mouse
gatcgctactccgagactcg

SEQ ID NO: 537076 - DNA, 20 bp, mouse
gctgctccctccgaacacgt

SEQ ID NO: 537077 - DNA, 20 bp, mouse
gccgaacacgtaggactggg

SEQ ID NO: 537078 - DNA, 20 bp, mouse
gcctccgaacacgtaggact

SEQ ID NO: 537079 - DNA, 20 bp, mouse
gagactggcgggatccagag

SEQ ID NO: 537080 - DNA, 20 bp, mouse
gcgtaggactgggtggccca

SEQ ID NO: 537081 - DNA, 20 bp, mouse
gatctccaagccgtgcaaca

SEQ ID NO: 537082 - DNA, 20 bp, mouse
ggcacttggtggaagcgggt

SEQ ID NO: 537083 - DNA, 20 bp, mouse
gcatgagctgccctgttgca

SEQ ID NO: 537084 - DNA, 20 bp, mouse
ggaaggtcaaccagaagcgg

SEQ ID NO: 537085 - DNA, 20 bp, mouse
gcttctggttgaccttcccg

SEQ ID NO: 537086 - DNA, 20 bp, mouse
gtcagcctgagctcctcctg

SEQ ID NO: 537087 - DNA, 20 bp, mouse
ggtcttgtaaccctgaccac

SEQ ID NO: 537088 - DNA, 20 bp, mouse
gcagggacttgtgccccagg

SEQ ID NO: 537089 - DNA, 20 bp, mouse
gcatggtctgggctgcgcga

SEQ ID NO: 537090 - DNA, 20 bp, mouse
gacccagggacttgtgcccc

SEQ ID NO: 537091 - DNA, 20 bp, mouse
gcttactggcctcagggctg

SEQ ID NO: 537092 - DNA, 20 bp, mouse
gagggttacaagactccgga

SEQ ID NO: 537093 - DNA, 20 bp, mouse
gtaagggagaatcaaggctg

SEQ ID NO: 537094 - DNA, 20 bp, mouse
gacaggtgggaggtctggaa

SEQ ID NO: 537095 - DNA, 20 bp, mouse
ggactgcatggagtacaggt

SEQ ID NO: 537096 - DNA, 20 bp, mouse
gcgcgcggccgcggtatcag

SEQ ID NO: 537097 - DNA, 20 bp, mouse
ggccatcgccgctgataccg

SEQ ID NO: 537098 - DNA, 20 bp, mouse
gcggcccagcgggacgacag

SEQ ID NO: 537099 - DNA, 20 bp, mouse
gaccgcaaggtgcaaagccg

SEQ ID NO: 537100 - DNA, 20 bp, mouse
ggggccaagagtttaaccac

SEQ ID NO: 537101 - DNA, 20 bp, mouse
ggccaagcgcggctgtcgcg

SEQ ID NO: 537102 - DNA, 20 bp, mouse
ggacgggagggagaagcggt

SEQ ID NO: 537103 - DNA, 20 bp, mouse
gaaccgaggtctctcacgag

SEQ ID NO: 537104 - DNA, 20 bp, mouse
ggtccgcagctaaggaaccg

SEQ ID NO: 537105 - DNA, 20 bp, mouse
gatcagcggcgatggcggcg

SEQ ID NO: 537106 - DNA, 20 bp, mouse
gcagaaggcaaggtgtcccg

SEQ ID NO: 537107 - DNA, 20 bp, mouse
gcccgcgccaccgggacacg

SEQ ID NO: 537108 - DNA, 20 bp, mouse
gtctcgggagagtaaaaaat

SEQ ID NO: 537109 - DNA, 20 bp, mouse
gttcgcccacgcagaaggca

SEQ ID NO: 537110 - DNA, 20 bp, mouse
ggacaccttgccttctgcgt

SEQ ID NO: 537111 - DNA, 20 bp, mouse
ggtacttgtgggcaattacg

SEQ ID NO: 537112 - DNA, 20 bp, mouse
gaggaattcgcccacgcaga

SEQ ID NO: 537113 - DNA, 20 bp, mouse
gcaaggtgtcccgaggctcc

SEQ ID NO: 537114 - DNA, 20 bp, mouse
gcgaattcctcgtgtcccgg

SEQ ID NO: 537115 - DNA, 20 bp, mouse
gcttgtgggcaattacgagg

SEQ ID NO: 537116 - DNA, 20 bp, mouse
ggggcagcggttcctcaagg

SEQ ID NO: 537117 - DNA, 20 bp, mouse
gccccatcttcagggagcgg

SEQ ID NO: 537118 - DNA, 20 bp, mouse
gcatggcgctctgaagacgc

SEQ ID NO: 537119 - DNA, 20 bp, mouse
gcagagcgccatgcgagccg

SEQ ID NO: 537120 - DNA, 20 bp, mouse
gtacctcagagaggagtcaa

SEQ ID NO: 537121 - DNA, 20 bp, mouse
gcgggggcagcggttcctca

SEQ ID NO: 537122 - DNA, 20 bp, mouse
gcagcggttcctcaaggcgg

SEQ ID NO: 537123 - DNA, 20 bp, mouse
gagatgccacactcgctccg

SEQ ID NO: 537124 - DNA, 20 bp, mouse
gtagaggctggtaccccgcc

SEQ ID NO: 537125 - DNA, 20 bp, mouse
gcgagtgtggcatctctacc

SEQ ID NO: 537126 - DNA, 20 bp, mouse
gaggagctgcccagagactg

SEQ ID NO: 537127 - DNA, 20 bp, mouse
ggaagctccagtcagatcac

SEQ ID NO: 537128 - DNA, 20 bp, mouse
gactcgcgggagctgacccc

SEQ ID NO: 537129 - DNA, 20 bp, mouse
ggccaaaaccagcaaaacgg

SEQ ID NO: 537130 - DNA, 20 bp, mouse
gggagctgaccccgggaaag

SEQ ID NO: 537131 - DNA, 20 bp, mouse
gtttcagtaccacagtctct

SEQ ID NO: 537132 - DNA, 20 bp, mouse
gacctgaccaggcagatcgt

SEQ ID NO: 537133 - DNA, 20 bp, mouse
ggcagctcctgtgatctgac

SEQ ID NO: 537134 - DNA, 20 bp, mouse
gaccaggaacagtcactaga

SEQ ID NO: 537135 - DNA, 20 bp, mouse
gtactgaaagaactactcgc

SEQ ID NO: 537136 - DNA, 20 bp, mouse
gtgagtgtcgcatcgtctcc

SEQ ID NO: 537137 - DNA, 20 bp, mouse
gcactcagcctgaaaagatt

SEQ ID NO: 537138 - DNA, 20 bp, mouse
gatctggcatccctgtaagt

SEQ ID NO: 537139 - DNA, 20 bp, mouse
gatggcatgggtaccagctc

SEQ ID NO: 537140 - DNA, 20 bp, mouse
gatgctggtacccacttaca

SEQ ID NO: 537141 - DNA, 20 bp, mouse
gacaggaggttagactgata

SEQ ID NO: 537142 - DNA, 20 bp, mouse
gcgtcactagcagatggcat

SEQ ID NO: 537143 - DNA, 20 bp, mouse
gagccatgtgatcctctctt

SEQ ID NO: 537144 - DNA, 20 bp, mouse
gggatcttccaaatcttttc

SEQ ID NO: 537145 - DNA, 20 bp, mouse
ggggtaccagctctggcagt

SEQ ID NO: 537146 - DNA, 20 bp, mouse
gagggccgggaagatcgcag

SEQ ID NO: 537147 - DNA, 20 bp, mouse
gctcctgtgagcaccaagtg

SEQ ID NO: 537148 - DNA, 20 bp, mouse
gatcgccggcgacatcactc

SEQ ID NO: 537149 - DNA, 20 bp, mouse
gaggggctcagggagtgaat

SEQ ID NO: 537150 - DNA, 20 bp, mouse
ggtctcctgagtgatgtcgc

SEQ ID NO: 537151 - DNA, 20 bp, mouse
gagtgtgcaggaccgacaga

SEQ ID NO: 537152 - DNA, 20 bp, mouse
gggacgaagagcaggaacgg

SEQ ID NO: 537153 - DNA, 20 bp, mouse
gcccggcgcgtggcccctgc

SEQ ID NO: 537154 - DNA, 20 bp, mouse
gtgccacacttggtgctcac

SEQ ID NO: 537155 - DNA, 20 bp, mouse
gaggctagccccgggtcgta

SEQ ID NO: 537156 - DNA, 20 bp, mouse
gctgctggcacgcgactcca

SEQ ID NO: 537157 - DNA, 20 bp, mouse
gcgagctgcttgtggttcag

SEQ ID NO: 537158 - DNA, 20 bp, mouse
gcaagcagctcggctttaac

SEQ ID NO: 537159 - DNA, 20 bp, mouse
gccgagaggcccccccgcgg

SEQ ID NO: 537160 - DNA, 20 bp, mouse
ggccagcagccacacggcca

SEQ ID NO: 537161 - DNA, 20 bp, mouse
gcagtcagtccctggccgtg

SEQ ID NO: 537162 - DNA, 20 bp, mouse
gccaagagcccggacgaccg

SEQ ID NO: 537163 - DNA, 20 bp, mouse
gtccctggccgtgtggctgc

SEQ ID NO: 537164 - DNA, 20 bp, mouse
ggacattcccggacacacac

SEQ ID NO: 537165 - DNA, 20 bp, mouse
gcgcagcccggaaccgagca

SEQ ID NO: 537166 - DNA, 20 bp, mouse
gcagtggtcgagtacctcct

SEQ ID NO: 537167 - DNA, 20 bp, mouse
gtcgtagaaaagctccgagg

SEQ ID NO: 537168 - DNA, 20 bp, mouse
gctgcagtgatgagacccag

SEQ ID NO: 537169 - DNA, 20 bp, mouse
ggcagctcagaaatccctct

SEQ ID NO: 537170 - DNA, 20 bp, mouse
gaagtcgtagaaaagctccg

SEQ ID NO: 537171 - DNA, 20 bp, mouse
ggggatgaggcgccatcctg

SEQ ID NO: 537172 - DNA, 20 bp, mouse
gggatggtgagcgcatccaa

SEQ ID NO: 537173 - DNA, 20 bp, mouse
ggcagtgacctctaagtcag

SEQ ID NO: 537174 - DNA, 20 bp, mouse
gcttagaggtcactgcacgg

SEQ ID NO: 537175 - DNA, 20 bp, mouse
gggagaactaggtaacaatt

SEQ ID NO: 537176 - DNA, 20 bp, mouse
ggactcactacttataacag

SEQ ID NO: 537177 - DNA, 20 bp, mouse
gaattatgtatcttacacat

SEQ ID NO: 537178 - DNA, 20 bp, mouse
gcgcaagaagcaagcggaag

SEQ ID NO: 537179 - DNA, 20 bp, mouse
gacaaaggatcctgaggacc

SEQ ID NO: 537180 - DNA, 20 bp, mouse
gtgccttctcgcctcctcaa

SEQ ID NO: 537181 - DNA, 20 bp, mouse
gccaaatcatacaaaacacc

SEQ ID NO: 537182 - DNA, 20 bp, mouse
ggcacgttgcctctcgtgaa

SEQ ID NO: 537183 - DNA, 20 bp, mouse
ggtaacaagtttgtttgcat

SEQ ID NO: 537184 - DNA, 20 bp, mouse
ggaaaatcgcaagaagcaag

SEQ ID NO: 537185 - DNA, 20 bp, mouse
ggaagagagacgttcctttg

SEQ ID NO: 537186 - DNA, 20 bp, mouse
gtcttccctggccctctgca

SEQ ID NO: 537187 - DNA, 20 bp, mouse
gcagcgagggaccgcagaca

SEQ ID NO: 537188 - DNA, 20 bp, mouse
gcaagtttgaagccatgcag

SEQ ID NO: 537189 - DNA, 20 bp, mouse
gcaggcagcgtaggcagcga

SEQ ID NO: 537190 - DNA, 20 bp, mouse
ggctttggcacataggactt

SEQ ID NO: 537191 - DNA, 20 bp, mouse
gtatgtgccaaagcttggca

SEQ ID NO: 537192 - DNA, 20 bp, mouse
gcatctcccttgccaagctt

SEQ ID NO: 537193 - DNA, 20 bp, mouse
gtgaaaagcagtgttaaccg

SEQ ID NO: 537194 - DNA, 20 bp, mouse
gggaacccacgggaccctag

SEQ ID NO: 537195 - DNA, 20 bp, mouse
ggtctatatgaaatgttagt

SEQ ID NO: 537196 - DNA, 20 bp, mouse
ggcggcgtctcggactgtga

SEQ ID NO: 537197 - DNA, 20 bp, mouse
gcacttccggtggggtgtca

SEQ ID NO: 537198 - DNA, 20 bp, mouse
gtcggactgtgatggctgag

SEQ ID NO: 537199 - DNA, 20 bp, mouse
gggaagtgggatcctttcca

SEQ ID NO: 537200 - DNA, 20 bp, mouse
gctctccccgagccgtggaa

SEQ ID NO: 537201 - DNA, 20 bp, mouse
gccgagcggctgaggagtgc

SEQ ID NO: 537202 - DNA, 20 bp, mouse
gaaggatcccacttccggtg

SEQ ID NO: 537203 - DNA, 20 bp, mouse
gggctccgcagaccgaggaa

SEQ ID NO: 537204 - DNA, 20 bp, mouse
ggggtgtcatggcggcgtct

SEQ ID NO: 537205 - DNA, 20 bp, mouse
ggcagctagcgttcccacgg

SEQ ID NO: 537206 - DNA, 20 bp, mouse
gggtagaggacgcttcccga

SEQ ID NO: 537207 - DNA, 20 bp, mouse
ggcctctcagcgacccccga

SEQ ID NO: 537208 - DNA, 20 bp, mouse
ggcggggccgcgcagtagtt

SEQ ID NO: 537209 - DNA, 20 bp, mouse
gctgtgcagctactccaggg

SEQ ID NO: 537210 - DNA, 20 bp, mouse
gcttcgggctggggacgcca

SEQ ID NO: 537211 - DNA, 20 bp, mouse
ggcccgaagctccaagctcg

SEQ ID NO: 537212 - DNA, 20 bp, mouse
gacccagaacgcgggcctag

SEQ ID NO: 537213 - DNA, 20 bp, mouse
gctaggggtgaggggatcca

SEQ ID NO: 537214 - DNA, 20 bp, mouse
gttcccgagggcgcgcggag

SEQ ID NO: 537215 - DNA, 20 bp, mouse
gcggcaggtcgctgaggtgg

SEQ ID NO: 537216 - DNA, 20 bp, mouse
gctgaagcggaaggaggaac

SEQ ID NO: 537217 - DNA, 20 bp, mouse
gtgcagtgacctgaagcgga

SEQ ID NO: 537218 - DNA, 20 bp, mouse
gagtgacctgaagcggaagg

SEQ ID NO: 537219 - DNA, 20 bp, mouse
gagtctgcagtgacctgaag

SEQ ID NO: 537220 - DNA, 20 bp, mouse
gcttggcgcacggtattcca

SEQ ID NO: 537221 - DNA, 20 bp, mouse
ggaactctagctgccagcag

SEQ ID NO: 537222 - DNA, 20 bp, mouse
ggggcaccggcagcaaacag

SEQ ID NO: 537223 - DNA, 20 bp, mouse
gtgcagactaaggcccctgc

SEQ ID NO: 537224 - DNA, 20 bp, mouse
gatccccagagacaggtccc

SEQ ID NO: 537225 - DNA, 20 bp, mouse
gcgaacaagaggacgtgaga

SEQ ID NO: 537226 - DNA, 20 bp, mouse
gggtgctgcaggggacgcga

SEQ ID NO: 537227 - DNA, 20 bp, mouse
ggctgccagccgccgcatta

SEQ ID NO: 537228 - DNA, 20 bp, mouse
gtgcggcggctggcagcgag

SEQ ID NO: 537229 - DNA, 20 bp, mouse
gagtctctgccctaatgcgg

SEQ ID NO: 537230 - DNA, 20 bp, mouse
ggctagtctctgccctaatg

SEQ ID NO: 537231 - DNA, 20 bp, mouse
ggtctcggaagcccaaccag

SEQ ID NO: 537232 - DNA, 20 bp, mouse
ggcgccgggagcggacatct

SEQ ID NO: 537233 - DNA, 20 bp, mouse
gtgagcgcgggtacccggta

SEQ ID NO: 537234 - DNA, 20 bp, mouse
gaccttacctcgaggagctc

SEQ ID NO: 537235 - DNA, 20 bp, mouse
gagtcccagatgtccgctcc

SEQ ID NO: 537236 - DNA, 20 bp, mouse
gctgcaagcaccgcccatgg

SEQ ID NO: 537237 - DNA, 20 bp, mouse
ggcaccgcccatggaggaag

SEQ ID NO: 537238 - DNA, 20 bp, mouse
ggtgactgaggtagaataaa

SEQ ID NO: 537239 - DNA, 20 bp, mouse
gctgaggtagaataaatggt

SEQ ID NO: 537240 - DNA, 20 bp, mouse
gtaaatggtagggctggaag

SEQ ID NO: 537241 - DNA, 20 bp, mouse
ggagctgcaagcaccgccca

SEQ ID NO: 537242 - DNA, 20 bp, mouse
gccagcaagtcctcaggtgg

SEQ ID NO: 537243 - DNA, 20 bp, mouse
ggatgtcctgccaggatgag

SEQ ID NO: 537244 - DNA, 20 bp, mouse
gtatccagcaagtcctcagg

SEQ ID NO: 537245 - DNA, 20 bp, mouse
ggcatccatcaaccccgaag

SEQ ID NO: 537246 - DNA, 20 bp, mouse
gcgagaggctccgaactggg

SEQ ID NO: 537247 - DNA, 20 bp, mouse
ggtcgccgcgcggatcggag

SEQ ID NO: 537248 - DNA, 20 bp, mouse
ggaccgagaggctccgaact

SEQ ID NO: 537249 - DNA, 20 bp, mouse
ggcgtcagagtgagaccgag

SEQ ID NO: 537250 - DNA, 20 bp, mouse
ggcgcgtgtcggcaaaggag

SEQ ID NO: 537251 - DNA, 20 bp, mouse
ggcagagtcgccgcgcggat

SEQ ID NO: 537252 - DNA, 20 bp, mouse
gcgcgcggatcggagcggcg

SEQ ID NO: 537253 - DNA, 20 bp, mouse
gggcagcggcgagcagcagg

SEQ ID NO: 537254 - DNA, 20 bp, mouse
gcggcggggcacgagctccc

SEQ ID NO: 537255 - DNA, 20 bp, mouse
gctcgcgggggcgaagggaa

SEQ ID NO: 537256 - DNA, 20 bp, mouse
ggcgcgaccccgacatgacg

SEQ ID NO: 537257 - DNA, 20 bp, mouse
gctccagccccgtcatgtcg

SEQ ID NO: 537258 - DNA, 20 bp, mouse
ggctctgatcgaactcgaag

SEQ ID NO: 537259 - DNA, 20 bp, mouse
gtgcgcggccaggagcgacg

SEQ ID NO: 537260 - DNA, 20 bp, mouse
gggaaatcgaagtcgaactc

SEQ ID NO: 537261 - DNA, 20 bp, mouse
ggcagccgggctctcagaaa

SEQ ID NO: 537262 - DNA, 20 bp, mouse
gccaggaggcccttacccaa

SEQ ID NO: 537263 - DNA, 20 bp, mouse
gcccccgccggacccacctg

SEQ ID NO: 537264 - DNA, 20 bp, mouse
gcagcggtgctgccagaggg

SEQ ID NO: 537265 - DNA, 20 bp, mouse
gtggcaccagccgggacccc

SEQ ID NO: 537266 - DNA, 20 bp, mouse
gcgcacggtgaggccgagga

SEQ ID NO: 537267 - DNA, 20 bp, mouse
gaggatggctcacggcgcag

SEQ ID NO: 537268 - DNA, 20 bp, mouse
ggcgtccggggagcgggtgg

SEQ ID NO: 537269 - DNA, 20 bp, mouse
ggtatctgtggcgcacggtg

SEQ ID NO: 537270 - DNA, 20 bp, mouse
gtgggtcctggacgcgtccg

SEQ ID NO: 537271 - DNA, 20 bp, mouse
ggccccggccacgagcccgg

SEQ ID NO: 537272 - DNA, 20 bp, mouse
gctcacggcgcagtgggtcc

SEQ ID NO: 537273 - DNA, 20 bp, mouse
gggcgcgagcttcctgctca

SEQ ID NO: 537274 - DNA, 20 bp, mouse
gtgcaacaggtgccttgagc

SEQ ID NO: 537275 - DNA, 20 bp, mouse
gccgctccccggacgcgtcc

SEQ ID NO: 537276 - DNA, 20 bp, mouse
gccgcggtcgcttactccag

SEQ ID NO: 537277 - DNA, 20 bp, mouse
gtgcggggcgctgcatctgt

SEQ ID NO: 537278 - DNA, 20 bp, mouse
ggggagcctgagcaggagcc

SEQ ID NO: 537279 - DNA, 20 bp, mouse
gatgcaggcagggaagccaa

SEQ ID NO: 537280 - DNA, 20 bp, mouse
gggagcaggagcacaggagt

SEQ ID NO: 537281 - DNA, 20 bp, mouse
gagagccggagcaggagcac

SEQ ID NO: 537282 - DNA, 20 bp, mouse
ggctcccgctgccgtgctcc

SEQ ID NO: 537283 - DNA, 20 bp, mouse
ggtccgcagaccccatggtg

SEQ ID NO: 537284 - DNA, 20 bp, mouse
ggtaagcgaccgcggagcgc

SEQ ID NO: 537285 - DNA, 20 bp, mouse
ggtgcctcccggaggggtag

SEQ ID NO: 537286 - DNA, 20 bp, mouse
gagatggcggaaccactgag

SEQ ID NO: 537287 - DNA, 20 bp, mouse
gtcggaccacgtcccctcag

SEQ ID NO: 537288 - DNA, 20 bp, mouse
gtgggccggtgactgtgtag

SEQ ID NO: 537289 - DNA, 20 bp, mouse
ggaagtcgcagacccagtag

SEQ ID NO: 537290 - DNA, 20 bp, mouse
ggtgtttgtggaagcagtgt

SEQ ID NO: 537291 - DNA, 20 bp, mouse
gggcgaccggcacctctact

SEQ ID NO: 537292 - DNA, 20 bp, mouse
ggtggtccgaggtcccgcgg

SEQ ID NO: 537293 - DNA, 20 bp, mouse
ggacgtggtccgaggtcccg

SEQ ID NO: 537294 - DNA, 20 bp, mouse
gcggaaccactgaggggacg

SEQ ID NO: 537295 - DNA, 20 bp, mouse
gggacagacgctaatacggt

SEQ ID NO: 537296 - DNA, 20 bp, mouse
ggccacggtcgcctcaacca

SEQ ID NO: 537297 - DNA, 20 bp, mouse
gcgagggtgcagaaaagcca

SEQ ID NO: 537298 - DNA, 20 bp, mouse
gcggcagtggcggcgactgt

SEQ ID NO: 537299 - DNA, 20 bp, mouse
gggcgcggcccagcatgaag

SEQ ID NO: 537300 - DNA, 20 bp, mouse
gcgtcaccgccgccggtcga

SEQ ID NO: 537301 - DNA, 20 bp, mouse
ggccttggttgaggcgaccg

SEQ ID NO: 537302 - DNA, 20 bp, mouse
gtggcggcgactgtgggggt

SEQ ID NO: 537303 - DNA, 20 bp, mouse
gccgcccggaaagtttgcag

SEQ ID NO: 537304 - DNA, 20 bp, mouse
ggcggtgacggctcccggtg

SEQ ID NO: 537305 - DNA, 20 bp, mouse
gccgccgcggccgcctgagg

SEQ ID NO: 537306 - DNA, 20 bp, mouse
ggctccggccggatccatgg

SEQ ID NO: 537307 - DNA, 20 bp, mouse
ggccgcaagctgcgaggatg

SEQ ID NO: 537308 - DNA, 20 bp, mouse
ggcggcagcgacagaagagg

SEQ ID NO: 537309 - DNA, 20 bp, mouse
gcccacccaggcgggacctg

SEQ ID NO: 537310 - DNA, 20 bp, mouse
gaggtgggtcagaggatgaa

SEQ ID NO: 537311 - DNA, 20 bp, mouse
gcggcccccatggatccggc

SEQ ID NO: 537312 - DNA, 20 bp, mouse
gtcgcagcttgcggccccca

SEQ ID NO: 537313 - DNA, 20 bp, mouse
ggacccccagggcccagcgg

SEQ ID NO: 537314 - DNA, 20 bp, mouse
gggtcccgcctgggtgggag

SEQ ID NO: 537315 - DNA, 20 bp, mouse
ggaggcggcagcgacagaag

SEQ ID NO: 537316 - DNA, 20 bp, mouse
gtgcgggtagtgtccctgag

SEQ ID NO: 537317 - DNA, 20 bp, mouse
ggtagtgtccctgagaggct

SEQ ID NO: 537318 - DNA, 20 bp, mouse
ggtcagagctgacacctcct

SEQ ID NO: 537319 - DNA, 20 bp, mouse
gctcgcctttcaggcacctg

SEQ ID NO: 537320 - DNA, 20 bp, mouse
gacctccccagagcccactg

SEQ ID NO: 537321 - DNA, 20 bp, mouse
ggcctcatctctctcctcgc

SEQ ID NO: 537322 - DNA, 20 bp, mouse
gcctgaaaggcgagtctgaa

SEQ ID NO: 537323 - DNA, 20 bp, mouse
ggcctttcaggcacctgtgg

SEQ ID NO: 537324 - DNA, 20 bp, mouse
gctgtggcggattccaagcc

SEQ ID NO: 537325 - DNA, 20 bp, mouse
gcctacaccaggtatagtct

SEQ ID NO: 537326 - DNA, 20 bp, mouse
ggaggcgcgtcggcgagagt

SEQ ID NO: 537327 - DNA, 20 bp, mouse
gagaaagcttggaggcgcgt

SEQ ID NO: 537328 - DNA, 20 bp, mouse
gtctcatccagactcgggta

SEQ ID NO: 537329 - DNA, 20 bp, mouse
gtgaagtgggagcgacacgt

SEQ ID NO: 537330 - DNA, 20 bp, mouse
gcgtgtcccagaaagcttgg

SEQ ID NO: 537331 - DNA, 20 bp, mouse
gcgagtgcagtggaaggagg

SEQ ID NO: 537332 - DNA, 20 bp, mouse
gaccgaatgagggtattcgt

SEQ ID NO: 537333 - DNA, 20 bp, mouse
gtccagactcgggtacggca

SEQ ID NO: 537334 - DNA, 20 bp, mouse
gaccctgccgtacccgagtc

SEQ ID NO: 537335 - DNA, 20 bp, mouse
gaggccctcagcccaagtcc

SEQ ID NO: 537336 - DNA, 20 bp, mouse
ggtccgagcagcggagaact

SEQ ID NO: 537337 - DNA, 20 bp, mouse
gagaggtgaggcggcggcaa

SEQ ID NO: 537338 - DNA, 20 bp, mouse
ggcgaggctacttgcagcag

SEQ ID NO: 537339 - DNA, 20 bp, mouse
ggagggcggacgctgtggta

SEQ ID NO: 537340 - DNA, 20 bp, mouse
gcaatggctagtccgagcag

SEQ ID NO: 537341 - DNA, 20 bp, mouse
gcaggagctcgaggggatag

SEQ ID NO: 537342 - DNA, 20 bp, mouse
gatagtggctccgggaggga

SEQ ID NO: 537343 - DNA, 20 bp, mouse
gaagccggcaggagctcgag

SEQ ID NO: 537344 - DNA, 20 bp, mouse
ggtagggctccccgacggcg

SEQ ID NO: 537345 - DNA, 20 bp, mouse
gctgcaagtagcctcgccgt

SEQ ID NO: 537346 - DNA, 20 bp, mouse
ggccgcgccaggcactgtgt

SEQ ID NO: 537347 - DNA, 20 bp, mouse
ggcactgtgtgggcagccga

SEQ ID NO: 537348 - DNA, 20 bp, mouse
gcggggacccagagaggcgg

SEQ ID NO: 537349 - DNA, 20 bp, mouse
ggcaccagccgaaaagacaa

SEQ ID NO: 537350 - DNA, 20 bp, mouse
ggattctgttgagcttggta

SEQ ID NO: 537351 - DNA, 20 bp, mouse
gaagctcccgaagccttggt

SEQ ID NO: 537352 - DNA, 20 bp, mouse
gtgccaagccgggtggacac

SEQ ID NO: 537353 - DNA, 20 bp, mouse
ggccttccgaagccgagaag

SEQ ID NO: 537354 - DNA, 20 bp, mouse
gtcggctggtgccacagggg

SEQ ID NO: 537355 - DNA, 20 bp, mouse
ggaagaggtccaggtccaca

SEQ ID NO: 537356 - DNA, 20 bp, mouse
gaggaggagagagctaggag

SEQ ID NO: 537357 - DNA, 20 bp, mouse
gcgtgagtgtgggtgcgaga

SEQ ID NO: 537358 - DNA, 20 bp, mouse
gtggaggtgtgcgtgagtgt

SEQ ID NO: 537359 - DNA, 20 bp, mouse
gtgcggtgcggtgcagaacg

SEQ ID NO: 537360 - DNA, 20 bp, mouse
gaaatgtgaacgcaagaagc

SEQ ID NO: 537361 - DNA, 20 bp, mouse
gcccaggtaagcagctgcgg

SEQ ID NO: 537362 - DNA, 20 bp, mouse
gcgtggagcggcaagagcgc

SEQ ID NO: 537363 - DNA, 20 bp, mouse
gcctgctcggccatttgtgt

SEQ ID NO: 537364 - DNA, 20 bp, mouse
gtaaagttcagcgcgtggag

SEQ ID NO: 537365 - DNA, 20 bp, mouse
gacagaaacacgcgcagaca

SEQ ID NO: 537366 - DNA, 20 bp, mouse
gctgcagcaggatccgggag

SEQ ID NO: 537367 - DNA, 20 bp, mouse
gcaacactgcagcaggatcc

SEQ ID NO: 537368 - DNA, 20 bp, mouse
gcagcagcctgcaccagcgg

SEQ ID NO: 537369 - DNA, 20 bp, mouse
gtcgagcggggtccagaggg

SEQ ID NO: 537370 - DNA, 20 bp, mouse
gagctcgagcggggtccaga

SEQ ID NO: 537371 - DNA, 20 bp, mouse
ggcgccggccgagctctccg

SEQ ID NO: 537372 - DNA, 20 bp, mouse
gcgcctgcgatcgccactcc

SEQ ID NO: 537373 - DNA, 20 bp, mouse
gatccgggagtggcgatcgc

SEQ ID NO: 537374 - DNA, 20 bp, mouse
ggcgcaggcgcggagctccc

SEQ ID NO: 537375 - DNA, 20 bp, mouse
gcacagcccacggaaaggat

SEQ ID NO: 537376 - DNA, 20 bp, mouse
ggcggggaggaatacatccc

SEQ ID NO: 537377 - DNA, 20 bp, mouse
gacctgggtcaggcagagcg

SEQ ID NO: 537378 - DNA, 20 bp, mouse
ggctggcaccggaggcgcag

SEQ ID NO: 537379 - DNA, 20 bp, mouse
gcggggtgcgtacctgggtc

SEQ ID NO: 537380 - DNA, 20 bp, mouse
gcccggggcgctggcaccgg

SEQ ID NO: 537381 - DNA, 20 bp, mouse
ggggagcggggtgcgtacct

SEQ ID NO: 537382 - DNA, 20 bp, mouse
gaatgactcagtaagttcgg

SEQ ID NO: 537383 - DNA, 20 bp, mouse
ggtccatgccaggaacaccc

SEQ ID NO: 537384 - DNA, 20 bp, mouse
gaacaccctggcctggaaga

SEQ ID NO: 537385 - DNA, 20 bp, mouse
gtgttcctggcatggacctg

SEQ ID NO: 537386 - DNA, 20 bp, mouse
ggacgtaccatggcgctgtg

SEQ ID NO: 537387 - DNA, 20 bp, mouse
ggcctcgccgcacagcgcca

SEQ ID NO: 537388 - DNA, 20 bp, mouse
gcgggggcggagacgtacca

SEQ ID NO: 537389 - DNA, 20 bp, mouse
ggcgctgtgcggcgaggcga

SEQ ID NO: 537390 - DNA, 20 bp, mouse
gaccatggcgctgtgcggcg

SEQ ID NO: 537391 - DNA, 20 bp, mouse
gtccgcccccgagggagaga

SEQ ID NO: 537392 - DNA, 20 bp, mouse
gtgtgcggcgaggcgacggc

SEQ ID NO: 537393 - DNA, 20 bp, mouse
ggaaagtcccccgcgcggag

SEQ ID NO: 537394 - DNA, 20 bp, mouse
gggcgaggcgacggccggcg

SEQ ID NO: 537395 - DNA, 20 bp, mouse
gcgggaccccgagtgcgcaa

SEQ ID NO: 537396 - DNA, 20 bp, mouse
ggcgcggcgcgggagacgag

SEQ ID NO: 537397 - DNA, 20 bp, mouse
gagctccgccgggccctcag

SEQ ID NO: 537398 - DNA, 20 bp, mouse
gccgagagatgtgtgttagt

SEQ ID NO: 537399 - DNA, 20 bp, mouse
gggccgcgcgctccaagagc

SEQ ID NO: 537400 - DNA, 20 bp, mouse
gacatctctcggcgcggcca

SEQ ID NO: 537401 - DNA, 20 bp, mouse
gagcgggcgcgccgggtccg

SEQ ID NO: 537402 - DNA, 20 bp, mouse
gtaacacacatctctcggcg

SEQ ID NO: 537403 - DNA, 20 bp, mouse
gcggtaagcgctccgcccac

SEQ ID NO: 537404 - DNA, 20 bp, mouse
gccgccgggccctcagcggg

SEQ ID NO: 537405 - DNA, 20 bp, mouse
gccgggccctcagcgggcgg

SEQ ID NO: 537406 - DNA, 20 bp, mouse
gcactttcacagcgcggcgg

SEQ ID NO: 537407 - DNA, 20 bp, mouse
gacctgggtgaggcagtacg

SEQ ID NO: 537408 - DNA, 20 bp, mouse
gcgagcctgtgagcgcggag

SEQ ID NO: 537409 - DNA, 20 bp, mouse
gtttcactttcacagcgcgg

SEQ ID NO: 537410 - DNA, 20 bp, mouse
ggcatggagtagacgcgcgg

SEQ ID NO: 537411 - DNA, 20 bp, mouse
ggcggcatggagtagacgcg

SEQ ID NO: 537412 - DNA, 20 bp, mouse
gggcggccggtacctgggtg

SEQ ID NO: 537413 - DNA, 20 bp, mouse
gttggaagcggcgcactccg

SEQ ID NO: 537414 - DNA, 20 bp, mouse
gggcgggcgccgcgcggcag

SEQ ID NO: 537415 - DNA, 20 bp, mouse
gggggcggcggccggtacct

SEQ ID NO: 537416 - DNA, 20 bp, mouse
ggccgggtgcttcagatcaa

SEQ ID NO: 537417 - DNA, 20 bp, mouse
ggaatctcagaatcaggcgt

SEQ ID NO: 537418 - DNA, 20 bp, mouse
gatcaggcgttggctttgcc

SEQ ID NO: 537419 - DNA, 20 bp, mouse
ggttagggcggtgggacttg

SEQ ID NO: 537420 - DNA, 20 bp, mouse
gccctctgtcacctgattga

SEQ ID NO: 537421 - DNA, 20 bp, mouse
gttagggttaaaagctacat

SEQ ID NO: 537422 - DNA, 20 bp, mouse
gaccctcaatcaggtgacag

SEQ ID NO: 537423 - DNA, 20 bp, mouse
gacagagttatgagttaggg

SEQ ID NO: 537424 - DNA, 20 bp, mouse
gaaggggttgtgggagattg

SEQ ID NO: 537425 - DNA, 20 bp, mouse
gtggatgttccaacaggatc

SEQ ID NO: 537426 - DNA, 20 bp, mouse
gggacgagagagaagtaccg

SEQ ID NO: 537427 - DNA, 20 bp, mouse
ggcgcgcagccgggctgctc

SEQ ID NO: 537428 - DNA, 20 bp, mouse
gagaagtaccgaggcgagcc

SEQ ID NO: 537429 - DNA, 20 bp, mouse
gcccgcgagcaggccgaggg

SEQ ID NO: 537430 - DNA, 20 bp, mouse
ggtgagagagtgagcgagag

SEQ ID NO: 537431 - DNA, 20 bp, mouse
gatctccagggtaagccccg

SEQ ID NO: 537432 - DNA, 20 bp, mouse
gaggccgcgccgcatctcca

SEQ ID NO: 537433 - DNA, 20 bp, mouse
gcttcctgcccggctcgcct

SEQ ID NO: 537434 - DNA, 20 bp, mouse
gtaagccccggggcaggtag

SEQ ID NO: 537435 - DNA, 20 bp, mouse
gggagcccgcaggcgaggag

SEQ ID NO: 537436 - DNA, 20 bp, mouse
gcaacgaccggtccggggaa

SEQ ID NO: 537437 - DNA, 20 bp, mouse
ggaagggctcggaaagaagt

SEQ ID NO: 537438 - DNA, 20 bp, mouse
ggctggagaggagcaacgac

SEQ ID NO: 537439 - DNA, 20 bp, mouse
gtctagggaatggagaggga

SEQ ID NO: 537440 - DNA, 20 bp, mouse
gtgaacccggccactcaccg

SEQ ID NO: 537441 - DNA, 20 bp, mouse
ggcacaggcaagctaagggc

SEQ ID NO: 537442 - DNA, 20 bp, mouse
gagaggagcaacgaccggtc

SEQ ID NO: 537443 - DNA, 20 bp, mouse
gacaccggccggctgtgcac

SEQ ID NO: 537444 - DNA, 20 bp, mouse
gtccgagcccttccccggac

SEQ ID NO: 537445 - DNA, 20 bp, mouse
gaccggtccggggaagggct

SEQ ID NO: 537446 - DNA, 20 bp, mouse
gagcggcctggactccatga

SEQ ID NO: 537447 - DNA, 20 bp, mouse
gcggccagcggcgcctcctg

SEQ ID NO: 537448 - DNA, 20 bp, mouse
ggctgaaacatggctgtgcg

SEQ ID NO: 537449 - DNA, 20 bp, mouse
gtggaagcagcagctcacgg

SEQ ID NO: 537450 - DNA, 20 bp, mouse
gggcgaggtctgactgttgt

SEQ ID NO: 537451 - DNA, 20 bp, mouse
gccatcccgcgggccctcca

SEQ ID NO: 537452 - DNA, 20 bp, mouse
gtccagggctcggcggccag

SEQ ID NO: 537453 - DNA, 20 bp, mouse
ggaggacggagactcgtaag

SEQ ID NO: 537454 - DNA, 20 bp, mouse
ggccctccatggcccagtcc

SEQ ID NO: 537455 - DNA, 20 bp, mouse
gccttcttgaggccatcccg

SEQ ID NO: 537456 - DNA, 20 bp, mouse
ggacaggcaggcgaccacag

SEQ ID NO: 537457 - DNA, 20 bp, mouse
gcacagggggccacccgagg

SEQ ID NO: 537458 - DNA, 20 bp, mouse
ggaccacagggggccacccg

SEQ ID NO: 537459 - DNA, 20 bp, mouse
gcatcgcagagcccagcgac

SEQ ID NO: 537460 - DNA, 20 bp, mouse
gaagcacgcgaccccggcca

SEQ ID NO: 537461 - DNA, 20 bp, mouse
gtggtcgcctgcctgtcgct

SEQ ID NO: 537462 - DNA, 20 bp, mouse
gtggccccagccacctcggg

SEQ ID NO: 537463 - DNA, 20 bp, mouse
gggactcaggtaagatccca

SEQ ID NO: 537464 - DNA, 20 bp, mouse
gccgctgtcgcaccattcat

SEQ ID NO: 537465 - DNA, 20 bp, mouse
gtgacgtagccaaagactaa

SEQ ID NO: 537466 - DNA, 20 bp, mouse
gtgcagactgtgggccccca

SEQ ID NO: 537467 - DNA, 20 bp, mouse
gtagatcggggacccggcgg

SEQ ID NO: 537468 - DNA, 20 bp, mouse
gctccgcggggcaggtagcg

SEQ ID NO: 537469 - DNA, 20 bp, mouse
gctttagatcggggacccgg

SEQ ID NO: 537470 - DNA, 20 bp, mouse
gtctggacgttgaagaggag

SEQ ID NO: 537471 - DNA, 20 bp, mouse
gctgagaggcctgataccgg

SEQ ID NO: 537472 - DNA, 20 bp, mouse
gtcctcgaggtaagagctgg

SEQ ID NO: 537473 - DNA, 20 bp, mouse
ggccgaggccgcggccctgg

SEQ ID NO: 537474 - DNA, 20 bp, mouse
gctgtgggcccccagggccg

SEQ ID NO: 537475 - DNA, 20 bp, mouse
gaggatgtccaacactccca

SEQ ID NO: 537476 - DNA, 20 bp, mouse
ggcgacttccagagactcac

SEQ ID NO: 537477 - DNA, 20 bp, mouse
gcgccgacagcagcagccag

SEQ ID NO: 537478 - DNA, 20 bp, mouse
gccggcaccccagcagcctc

SEQ ID NO: 537479 - DNA, 20 bp, mouse
gtggggtgccggtgagtctc

SEQ ID NO: 537480 - DNA, 20 bp, mouse
gagtggctggaccagaggag

SEQ ID NO: 537481 - DNA, 20 bp, mouse
gccatctcccccagcgcaca

SEQ ID NO: 537482 - DNA, 20 bp, mouse
gcagacggtaaagaagcttc

SEQ ID NO: 537483 - DNA, 20 bp, mouse
ggaagtcgccatgtgcgctg

SEQ ID NO: 537484 - DNA, 20 bp, mouse
gtctgaggctctgcaggtgg

SEQ ID NO: 537485 - DNA, 20 bp, mouse
gccctcaactccggagtact

SEQ ID NO: 537486 - DNA, 20 bp, mouse
ggagaaaagcgagaggtcca

SEQ ID NO: 537487 - DNA, 20 bp, mouse
gccggccaggtccaccgcag

SEQ ID NO: 537488 - DNA, 20 bp, mouse
gctgcccaaagcacccgctg

SEQ ID NO: 537489 - DNA, 20 bp, mouse
gagcggatgagaaaagcgag

SEQ ID NO: 537490 - DNA, 20 bp, mouse
gcgacagagaagacctaact

SEQ ID NO: 537491 - DNA, 20 bp, mouse
gagctgaacggtccctagtt

SEQ ID NO: 537492 - DNA, 20 bp, mouse
gggtgctttgggcagctgaa

SEQ ID NO: 537493 - DNA, 20 bp, mouse
gcccaaagcacccgctgcgg

SEQ ID NO: 537494 - DNA, 20 bp, mouse
gccagcgggatctaactctg

SEQ ID NO: 537495 - DNA, 20 bp, mouse
ggcacccgctgcggtggacc

SEQ ID NO: 537496 - DNA, 20 bp, mouse
gcaaggaccctcagagacgg

SEQ ID NO: 537497 - DNA, 20 bp, mouse
gccccaaggaccctcagaga

SEQ ID NO: 537498 - DNA, 20 bp, mouse
gtaagacgctcggagaaggg

SEQ ID NO: 537499 - DNA, 20 bp, mouse
gagacggaggccggaggcct

SEQ ID NO: 537500 - DNA, 20 bp, mouse
gcctcagagacggaggccgg

SEQ ID NO: 537501 - DNA, 20 bp, mouse
gacccgacagacagacgtag

SEQ ID NO: 537502 - DNA, 20 bp, mouse
gacgctcggagaagggaggt

SEQ ID NO: 537503 - DNA, 20 bp, mouse
gggcctgggcttaagacgct

SEQ ID NO: 537504 - DNA, 20 bp, mouse
ggaccctcagagacggaggc

SEQ ID NO: 537505 - DNA, 20 bp, mouse
gctccgagcgtcttaagccc

SEQ ID NO: 537506 - DNA, 20 bp, mouse
gcaaccgcgtagccatccgg

SEQ ID NO: 537507 - DNA, 20 bp, mouse
gagacacctgcgccaccgga

SEQ ID NO: 537508 - DNA, 20 bp, mouse
gatggctacgcggttggctg

SEQ ID NO: 537509 - DNA, 20 bp, mouse
gtagcctgggagcatgatcg

SEQ ID NO: 537510 - DNA, 20 bp, mouse
ggcgccaccggatggctacg

SEQ ID NO: 537511 - DNA, 20 bp, mouse
gtgtccacgatcatgctccc

SEQ ID NO: 537512 - DNA, 20 bp, mouse
gctcccaggctaggcgctcg

SEQ ID NO: 537513 - DNA, 20 bp, mouse
gagtacgtgcgcgcccggag

SEQ ID NO: 537514 - DNA, 20 bp, mouse
gacggccccgcaggaggaca

SEQ ID NO: 537515 - DNA, 20 bp, mouse
gccgggcgcggagggcacgg

SEQ ID NO: 537516 - DNA, 20 bp, mouse
gcggcgagctctagagaaag

SEQ ID NO: 537517 - DNA, 20 bp, mouse
gctcccgccacgaggtcaga

SEQ ID NO: 537518 - DNA, 20 bp, mouse
gtcgccgtctgacctcgtgg

SEQ ID NO: 537519 - DNA, 20 bp, mouse
gagagcatcagaagacggct

SEQ ID NO: 537520 - DNA, 20 bp, mouse
gacgtgagagcatcagaaga

SEQ ID NO: 537521 - DNA, 20 bp, mouse
gagctcgccgtctgacctcg

SEQ ID NO: 537522 - DNA, 20 bp, mouse
gcagtggagggtacatgtgg

SEQ ID NO: 537523 - DNA, 20 bp, mouse
ggctcccaaggaaagagcat

SEQ ID NO: 537524 - DNA, 20 bp, mouse
gggccctggcctcctttata

SEQ ID NO: 537525 - DNA, 20 bp, mouse
gtgggaaaggaacgggttga

SEQ ID NO: 537526 - DNA, 20 bp, mouse
ggaaccccgggtgagacccg

SEQ ID NO: 537527 - DNA, 20 bp, mouse
gagtccgcgggtctcacccg

SEQ ID NO: 537528 - DNA, 20 bp, mouse
gccacggcccgacgaacccc

SEQ ID NO: 537529 - DNA, 20 bp, mouse
gagacccgcggactctgctg

SEQ ID NO: 537530 - DNA, 20 bp, mouse
ggtctcacccggggttcgtc

SEQ ID NO: 537531 - DNA, 20 bp, mouse
gtcacctcagcagagtccgc

SEQ ID NO: 537532 - DNA, 20 bp, mouse
gcgggtgggcgagggttagg

SEQ ID NO: 537533 - DNA, 20 bp, mouse
ggagcgcgtttcggagccca

SEQ ID NO: 537534 - DNA, 20 bp, mouse
gtcgcgagggtctagagggt

SEQ ID NO: 537535 - DNA, 20 bp, mouse
gtgcgggagcgagcgcgttt

SEQ ID NO: 537536 - DNA, 20 bp, mouse
gccgcggatggtgggctctg

SEQ ID NO: 537537 - DNA, 20 bp, mouse
gtgcaagcgccgcggatggt

SEQ ID NO: 537538 - DNA, 20 bp, mouse
gcagttacttccgggagcat

SEQ ID NO: 537539 - DNA, 20 bp, mouse
gaacgacgcccgcctccaag

SEQ ID NO: 537540 - DNA, 20 bp, mouse
gtagcagcaccgacccaagg

SEQ ID NO: 537541 - DNA, 20 bp, mouse
ggacttgcaagcgccgcgga

SEQ ID NO: 537542 - DNA, 20 bp, mouse
gtgaggacttgcaagcgccg

SEQ ID NO: 537543 - DNA, 20 bp, mouse
ggaccttcccagggccaagg

SEQ ID NO: 537544 - DNA, 20 bp, mouse
ggctgcgagccgcttggagg

SEQ ID NO: 537545 - DNA, 20 bp, mouse
gcttccgggagcatgggctg

SEQ ID NO: 537546 - DNA, 20 bp, mouse
gactggcactgaagtgatgg

SEQ ID NO: 537547 - DNA, 20 bp, mouse
gagcagcggtcggtgtagtc

SEQ ID NO: 537548 - DNA, 20 bp, mouse
ggacagggatctgctagcca

SEQ ID NO: 537549 - DNA, 20 bp, mouse
gctgtgcaggcggtaggtgt

SEQ ID NO: 537550 - DNA, 20 bp, mouse
ggtggctccgaagggaagag

SEQ ID NO: 537551 - DNA, 20 bp, mouse
gacgggaatgtggctccgaa

SEQ ID NO: 537552 - DNA, 20 bp, mouse
ggtccggctgtgcaggcggt

SEQ ID NO: 537553 - DNA, 20 bp, mouse
gggctctggagccaggacaa

SEQ ID NO: 537554 - DNA, 20 bp, mouse
gcaggacacgacacaacccc

SEQ ID NO: 537555 - DNA, 20 bp, mouse
gctgtgagaaggcagcgaca

SEQ ID NO: 537556 - DNA, 20 bp, mouse
gggacagtacctgagaccgg

SEQ ID NO: 537557 - DNA, 20 bp, mouse
ggaggtgctgcggcacggga

SEQ ID NO: 537558 - DNA, 20 bp, mouse
ggagccccgccaccgagcga

SEQ ID NO: 537559 - DNA, 20 bp, mouse
gctgcggcacgggatggcgg

SEQ ID NO: 537560 - DNA, 20 bp, mouse
gttcccgcgcgggaccccta

SEQ ID NO: 537561 - DNA, 20 bp, mouse
ggccgagcctccccatcccg

SEQ ID NO: 537562 - DNA, 20 bp, mouse
gcccatcccgtggaagatgg

SEQ ID NO: 537563 - DNA, 20 bp, mouse
gctagactgctagaccctag

SEQ ID NO: 537564 - DNA, 20 bp, mouse
ggctctcctcggaaacccag

SEQ ID NO: 537565 - DNA, 20 bp, mouse
ggctaagaggcggcctggag

SEQ ID NO: 537566 - DNA, 20 bp, mouse
ggcctcaggagaagtgcggt

SEQ ID NO: 537567 - DNA, 20 bp, mouse
gcgaggagggaaaagacgga

SEQ ID NO: 537568 - DNA, 20 bp, mouse
gagccacgaggagcccaccc

SEQ ID NO: 537569 - DNA, 20 bp, mouse
gcgggaaccaactgctgaag

SEQ ID NO: 537570 - DNA, 20 bp, mouse
ggaaacgcgaactgaccgtg

SEQ ID NO: 537571 - DNA, 20 bp, mouse
gccctgcagcggagagataa

SEQ ID NO: 537572 - DNA, 20 bp, mouse
gccccgcgacacggagaccc

SEQ ID NO: 537573 - DNA, 20 bp, mouse
ggcggccctgtgtctcccga

SEQ ID NO: 537574 - DNA, 20 bp, mouse
ggcggtgggcgccgtcggta

SEQ ID NO: 537575 - DNA, 20 bp, mouse
gcgaactgaccgtgcggccg

SEQ ID NO: 537576 - DNA, 20 bp, mouse
ggaccccgaaacccaatcag

SEQ ID NO: 537577 - DNA, 20 bp, mouse
ggcggctggagcctctgatt

SEQ ID NO: 537578 - DNA, 20 bp, mouse
ggctactggctacccagctc

SEQ ID NO: 537579 - DNA, 20 bp, mouse
ggagcccgggagtcgagccg

SEQ ID NO: 537580 - DNA, 20 bp, mouse
gctcgctgaccactcaggag

SEQ ID NO: 537581 - DNA, 20 bp, mouse
gcagcctcggctcgactccc

SEQ ID NO: 537582 - DNA, 20 bp, mouse
gcgggtctcgctgaccactc

SEQ ID NO: 537583 - DNA, 20 bp, mouse
gagcgcgggcagcgaaccgg

SEQ ID NO: 537584 - DNA, 20 bp, mouse
gtcggtcccgagaggtcagg

SEQ ID NO: 537585 - DNA, 20 bp, mouse
ggaaccgggggagcgaggca

SEQ ID NO: 537586 - DNA, 20 bp, mouse
gtggagacgggagccaacca

SEQ ID NO: 537587 - DNA, 20 bp, mouse
gggcccggcccgaagcacag

SEQ ID NO: 537588 - DNA, 20 bp, mouse
gccggcccgcccgaagactg

SEQ ID NO: 537589 - DNA, 20 bp, mouse
gcaaacagccgattggagac

SEQ ID NO: 537590 - DNA, 20 bp, mouse
gccaaccagggctgcattgg

SEQ ID NO: 537591 - DNA, 20 bp, mouse
ggtccaaccaaacagccgat

SEQ ID NO: 537592 - DNA, 20 bp, mouse
gggaacgctgcgccccggag

SEQ ID NO: 537593 - DNA, 20 bp, mouse
gagacaaagcggccgctccg

SEQ ID NO: 537594 - DNA, 20 bp, mouse
gcgggatgcgggagacaaag

SEQ ID NO: 537595 - DNA, 20 bp, mouse
gtcggtttaggagcgatcat

SEQ ID NO: 537596 - DNA, 20 bp, mouse
gggaggctgcagggcttcat

SEQ ID NO: 537597 - DNA, 20 bp, mouse
gtgactgttaaagtggaagg

SEQ ID NO: 537598 - DNA, 20 bp, mouse
gctttgactgttaaagtgga

SEQ ID NO: 537599 - DNA, 20 bp, mouse
gcccccccaaaaaagaacgg

SEQ ID NO: 537600 - DNA, 20 bp, mouse
gaaacagagcaaggtaatct

SEQ ID NO: 537601 - DNA, 20 bp, mouse
gtaaagtggaaggaggctgc

SEQ ID NO: 537602 - DNA, 20 bp, mouse
gtaggaaaatcttagttgaa

SEQ ID NO: 537603 - DNA, 20 bp, mouse
gtaatctaggtgcaccaaga

SEQ ID NO: 537604 - DNA, 20 bp, mouse
gtggcgaatagtttgctggg

SEQ ID NO: 537605 - DNA, 20 bp, mouse
gatgcctttgactgttaaag

SEQ ID NO: 537606 - DNA, 20 bp, mouse
gtacgcgttgctgggagtcg

SEQ ID NO: 537607 - DNA, 20 bp, mouse
gagcaacgcgtagtgcgcag

SEQ ID NO: 537608 - DNA, 20 bp, mouse
ggagtcgaggcgcggagtgg

SEQ ID NO: 537609 - DNA, 20 bp, mouse
ggcgtagtgcgcagcggctg

SEQ ID NO: 537610 - DNA, 20 bp, mouse
ggcggcggccgcagagggaa

SEQ ID NO: 537611 - DNA, 20 bp, mouse
gcactcacaggcctctactc

SEQ ID NO: 537612 - DNA, 20 bp, mouse
gagcgcagccgcgacgacag

SEQ ID NO: 537613 - DNA, 20 bp, mouse
ggcccggcgaacacataaca

SEQ ID NO: 537614 - DNA, 20 bp, mouse
gcggcgaacacataacatgg

SEQ ID NO: 537615 - DNA, 20 bp, mouse
gacaattctcgcgagacttc

SEQ ID NO: 537616 - DNA, 20 bp, mouse
gcgcagtgatgggaccctcg

SEQ ID NO: 537617 - DNA, 20 bp, mouse
gactcgcgggacgcagtgat

SEQ ID NO: 537618 - DNA, 20 bp, mouse
ggatgggaccctcgaggcgt

SEQ ID NO: 537619 - DNA, 20 bp, mouse
gtctcgagcccactacggtt

SEQ ID NO: 537620 - DNA, 20 bp, mouse
gctctctcccaggagactcg

SEQ ID NO: 537621 - DNA, 20 bp, mouse
gtgcgtcccgcgagtctcct

SEQ ID NO: 537622 - DNA, 20 bp, mouse
gtgagagctgcggggcactg

SEQ ID NO: 537623 - DNA, 20 bp, mouse
gaggggtgcctaaccgtagt

SEQ ID NO: 537624 - DNA, 20 bp, mouse
ggactgcacccacgcctcga

SEQ ID NO: 537625 - DNA, 20 bp, mouse
ggctccatgctctctctccc

SEQ ID NO: 537626 - DNA, 20 bp, mouse
ggcaaggagacagaactcac

SEQ ID NO: 537627 - DNA, 20 bp, mouse
ggttcgggcccggaaagggt

SEQ ID NO: 537628 - DNA, 20 bp, mouse
ggtgggctttgcgaagatgg

SEQ ID NO: 537629 - DNA, 20 bp, mouse
gggaagttcgggcccggaaa

SEQ ID NO: 537630 - DNA, 20 bp, mouse
gtcctttccgggaagaagca

SEQ ID NO: 537631 - DNA, 20 bp, mouse
gcgtatgtcagatgagaggg

SEQ ID NO: 537632 - DNA, 20 bp, mouse
gtccttgcttcttcccggaa

SEQ ID NO: 537633 - DNA, 20 bp, mouse
gagggtgggctttgcgaaga

SEQ ID NO: 537634 - DNA, 20 bp, mouse
gtttgcgaagatggcggctc

SEQ ID NO: 537635 - DNA, 20 bp, mouse
gggtttgcctcgatccgtgg

SEQ ID NO: 537636 - DNA, 20 bp, mouse
gcgggagcgctctacagcag

SEQ ID NO: 537637 - DNA, 20 bp, mouse
ggagcgctctacagcagcgg

SEQ ID NO: 537638 - DNA, 20 bp, mouse
gaatgcgcgggctctgagtg

SEQ ID NO: 537639 - DNA, 20 bp, mouse
gcagcgcgcgcggctcaagc

SEQ ID NO: 537640 - DNA, 20 bp, mouse
ggaccacgacagctccacct

SEQ ID NO: 537641 - DNA, 20 bp, mouse
gagcgaccgggtaggctcag

SEQ ID NO: 537642 - DNA, 20 bp, mouse
gcgcgtgtcgctctccgagg

SEQ ID NO: 537643 - DNA, 20 bp, mouse
gtggggaccagcgaccgggt

SEQ ID NO: 537644 - DNA, 20 bp, mouse
gagtgaggtcgcagcgcgcg

SEQ ID NO: 537645 - DNA, 20 bp, mouse
ggacgcacggctctcccagg

SEQ ID NO: 537646 - DNA, 20 bp, mouse
ggagccggaggggagcgcat

SEQ ID NO: 537647 - DNA, 20 bp, mouse
gtgtaggaacacgagatcgt

SEQ ID NO: 537648 - DNA, 20 bp, mouse
gtctgagccgagccccgata

SEQ ID NO: 537649 - DNA, 20 bp, mouse
gggcagagagcgcctggagc

SEQ ID NO: 537650 - DNA, 20 bp, mouse
gcgagatcgtgggcacgcaa

SEQ ID NO: 537651 - DNA, 20 bp, mouse
gtcaccgatgcgctcccctc

SEQ ID NO: 537652 - DNA, 20 bp, mouse
gaactgtcccgagtagatgt

SEQ ID NO: 537653 - DNA, 20 bp, mouse
gcagcacggcagagagcgcc

SEQ ID NO: 537654 - DNA, 20 bp, mouse
gatacgggtgcaacgcggtg

SEQ ID NO: 537655 - DNA, 20 bp, mouse
gccgcgttgcacccgtatcg

SEQ ID NO: 537656 - DNA, 20 bp, mouse
gagcctccgccagctccggc

SEQ ID NO: 537657 - DNA, 20 bp, mouse
gcgctgcccgccggagctgg

SEQ ID NO: 537658 - DNA, 20 bp, mouse
gtgcctgcagcgccatggac

SEQ ID NO: 537659 - DNA, 20 bp, mouse
gtgcccgccggagctggcgg

SEQ ID NO: 537660 - DNA, 20 bp, mouse
gcggaggcgagcaatgagga

SEQ ID NO: 537661 - DNA, 20 bp, mouse
gtccagcgcccgctgcccgc

SEQ ID NO: 537662 - DNA, 20 bp, mouse
gctaggggtaagtgattagt

SEQ ID NO: 537663 - DNA, 20 bp, mouse
ggcaccatcggtccgcagag

SEQ ID NO: 537664 - DNA, 20 bp, mouse
ggcgggatcatgacccacag

SEQ ID NO: 537665 - DNA, 20 bp, mouse
gcccagatgctggcaacggg

SEQ ID NO: 537666 - DNA, 20 bp, mouse
gtggaagccgagagtccagg

SEQ ID NO: 537667 - DNA, 20 bp, mouse
gtctgcagacagggtgggat

SEQ ID NO: 537668 - DNA, 20 bp, mouse
ggtcaatctgcagacagggt

SEQ ID NO: 537669 - DNA, 20 bp, mouse
gcggtgggtccgaggaaggc

SEQ ID NO: 537670 - DNA, 20 bp, mouse
gccgctgccgcctggactct

SEQ ID NO: 537671 - DNA, 20 bp, mouse
ggactggaagccgagagtcc

SEQ ID NO: 537672 - DNA, 20 bp, mouse
ggcaccgcacccgccttcct

SEQ ID NO: 537673 - DNA, 20 bp, mouse
gtccagtcaatctgcagaca

SEQ ID NO: 537674 - DNA, 20 bp, mouse
ggtcaattcccgctgccgcc

SEQ ID NO: 537675 - DNA, 20 bp, mouse
gatcgtgggcggccgtgtag

SEQ ID NO: 537676 - DNA, 20 bp, mouse
gctctggccgcaggcctctg

SEQ ID NO: 537677 - DNA, 20 bp, mouse
gcgggccgcggtgcgcgagg

SEQ ID NO: 537678 - DNA, 20 bp, mouse
gctacgccgacaacatcctg

SEQ ID NO: 537679 - DNA, 20 bp, mouse
ggaggcctgcggccagaggg

SEQ ID NO: 537680 - DNA, 20 bp, mouse
gctgcggccctcaggctcga

SEQ ID NO: 537681 - DNA, 20 bp, mouse
gtggccgcaggcctctgcgg

SEQ ID NO: 537682 - DNA, 20 bp, mouse
gcgcggcgcagccatggcgt

SEQ ID NO: 537683 - DNA, 20 bp, mouse
gaactcagtgacagcctcgg

SEQ ID NO: 537684 - DNA, 20 bp, mouse
gcgggatcctgcagcgagat

SEQ ID NO: 537685 - DNA, 20 bp, mouse
ggacactcgggcctgaggcg

SEQ ID NO: 537686 - DNA, 20 bp, mouse
gagttgtcgaagggcctcac

SEQ ID NO: 537687 - DNA, 20 bp, mouse
gtcacaggagaccacagcca

SEQ ID NO: 537688 - DNA, 20 bp, mouse
gaaggccaccaccaatacaa

SEQ ID NO: 537689 - DNA, 20 bp, mouse
gagagacaatggcagggctg

SEQ ID NO: 537690 - DNA, 20 bp, mouse
gacctgactagaaggcggag

SEQ ID NO: 537691 - DNA, 20 bp, mouse
gcatagaggcatacaaccaa

SEQ ID NO: 537692 - DNA, 20 bp, mouse
gtactcacctgactagaagg

SEQ ID NO: 537693 - DNA, 20 bp, mouse
gtggaagacctttgtattgg

SEQ ID NO: 537694 - DNA, 20 bp, mouse
gagaggcatacaaccaaggg

SEQ ID NO: 537695 - DNA, 20 bp, mouse
gtcatatcttagttgtcgaa

SEQ ID NO: 537696 - DNA, 20 bp, mouse
ggacacgaccgcccaaaaag

SEQ ID NO: 537697 - DNA, 20 bp, mouse
ggggcgcgaagcctaactcc

SEQ ID NO: 537698 - DNA, 20 bp, mouse
ggcccctgtgccctagacaa

SEQ ID NO: 537699 - DNA, 20 bp, mouse
gataccacctcgcgtcgcaa

SEQ ID NO: 537700 - DNA, 20 bp, mouse
ggctcgcgaccggaaagcac

SEQ ID NO: 537701 - DNA, 20 bp, mouse
gaacccacagcgagcgagag

SEQ ID NO: 537702 - DNA, 20 bp, mouse
ggcgccattgcgacgcgagg

SEQ ID NO: 537703 - DNA, 20 bp, mouse
gacgggacctagggtgtcaa

SEQ ID NO: 537704 - DNA, 20 bp, mouse
ggacatgcggtcagacgaga

SEQ ID NO: 537705 - DNA, 20 bp, mouse
gactagagcctgtgcagacg

SEQ ID NO: 537706 - DNA, 20 bp, mouse
ggcactgcagagtcatgtga

SEQ ID NO: 537707 - DNA, 20 bp, mouse
gggtagaggcactcaagtag

SEQ ID NO: 537708 - DNA, 20 bp, mouse
gcctctgatgggtgtgagcc

SEQ ID NO: 537709 - DNA, 20 bp, mouse
gggagctagcagcattgctt

SEQ ID NO: 537710 - DNA, 20 bp, mouse
gccaggcctaccaggagagt

SEQ ID NO: 537711 - DNA, 20 bp, mouse
gatcacagctcaagaggtag

SEQ ID NO: 537712 - DNA, 20 bp, mouse
gagtaagagggcattctcag

SEQ ID NO: 537713 - DNA, 20 bp, mouse
gatttgattcatcctctgat

SEQ ID NO: 537714 - DNA, 20 bp, mouse
gagaggcaggacattatcct

SEQ ID NO: 537715 - DNA, 20 bp, mouse
gaacttagaactccataagt

SEQ ID NO: 537716 - DNA, 20 bp, mouse
gtccagtcagagattaggag

SEQ ID NO: 537717 - DNA, 20 bp, mouse
gctcttacttagtccagaac

SEQ ID NO: 537718 - DNA, 20 bp, mouse
gtgagcagcgagaagagact

SEQ ID NO: 537719 - DNA, 20 bp, mouse
gcctagaaggactctgccaa

SEQ ID NO: 537720 - DNA, 20 bp, mouse
gcagtttctagagctcttag

SEQ ID NO: 537721 - DNA, 20 bp, mouse
ggggactccagtcagagatt

SEQ ID NO: 537722 - DNA, 20 bp, mouse
gttgtaaggcctaggcaaaa

SEQ ID NO: 537723 - DNA, 20 bp, mouse
gtctgccaagggatccaagc

SEQ ID NO: 537724 - DNA, 20 bp, mouse
gcacatgatgaggatttgta

SEQ ID NO: 537725 - DNA, 20 bp, mouse
gctaggtaagggggaaccat

SEQ ID NO: 537726 - DNA, 20 bp, mouse
gagcagagaaaggggagctt

SEQ ID NO: 537727 - DNA, 20 bp, mouse
ggagatggtggaagagataa

SEQ ID NO: 537728 - DNA, 20 bp, mouse
gatctccaggctaaatcaat

SEQ ID NO: 537729 - DNA, 20 bp, mouse
gtgggaagtgcggtcaggga

SEQ ID NO: 537730 - DNA, 20 bp, mouse
gcccagcccgattaagggaa

SEQ ID NO: 537731 - DNA, 20 bp, mouse
gccacaaggtaaagagggga

SEQ ID NO: 537732 - DNA, 20 bp, mouse
gttcaccacaaggtaaagag

SEQ ID NO: 537733 - DNA, 20 bp, mouse
gcttctggagtaacagtgac

SEQ ID NO: 537734 - DNA, 20 bp, mouse
gatcgggctggggcgaaact

SEQ ID NO: 537735 - DNA, 20 bp, mouse
gggaaggagtcctcaaggaa

SEQ ID NO: 537736 - DNA, 20 bp, mouse
gggagcagcgggagcaatgg

SEQ ID NO: 537737 - DNA, 20 bp, mouse
gtgaccgtggccgtgactga

SEQ ID NO: 537738 - DNA, 20 bp, mouse
gtccgcgcagccctcagtca

SEQ ID NO: 537739 - DNA, 20 bp, mouse
gcagccctcagtcacggcca

SEQ ID NO: 537740 - DNA, 20 bp, mouse
ggccgtgactgagggctgcg

SEQ ID NO: 537741 - DNA, 20 bp, mouse
ggagggctgcgcggaggcag

SEQ ID NO: 537742 - DNA, 20 bp, mouse
gcgctccgtgaccgtgaccg

SEQ ID NO: 537743 - DNA, 20 bp, mouse
gccggcagaagggacactcg

SEQ ID NO: 537744 - DNA, 20 bp, mouse
gggcaggcccgccggcagaa

SEQ ID NO: 537745 - DNA, 20 bp, mouse
ggcccgcgcaacctgccctg

SEQ ID NO: 537746 - DNA, 20 bp, mouse
ggcggcccggaacctggaag

SEQ ID NO: 537747 - DNA, 20 bp, mouse
ggggagctcgcgcaacatgg

SEQ ID NO: 537748 - DNA, 20 bp, mouse
ggcccggaacctggaagggg

SEQ ID NO: 537749 - DNA, 20 bp, mouse
gccggaggaaggcttattgg

SEQ ID NO: 537750 - DNA, 20 bp, mouse
gactcgagcgaggtctgcgc

SEQ ID NO: 537751 - DNA, 20 bp, mouse
gatgttgcgcgagctcccga

SEQ ID NO: 537752 - DNA, 20 bp, mouse
gccaaagggccgtgcttccc

SEQ ID NO: 537753 - DNA, 20 bp, mouse
gggagggagccaccgaggaa

SEQ ID NO: 537754 - DNA, 20 bp, mouse
gggagccaccgaggaagggg

SEQ ID NO: 537755 - DNA, 20 bp, mouse
gtccggacgccaaagtccaa

SEQ ID NO: 537756 - DNA, 20 bp, mouse
gaggcctgaagccggctcta

SEQ ID NO: 537757 - DNA, 20 bp, mouse
gtcgctgggcgcctgactcg

SEQ ID NO: 537758 - DNA, 20 bp, mouse
ggccatcgcgagggtctggg

SEQ ID NO: 537759 - DNA, 20 bp, mouse
gaagcaccgggaaactcgac

SEQ ID NO: 537760 - DNA, 20 bp, mouse
gcagaggcagactaaagcac

SEQ ID NO: 537761 - DNA, 20 bp, mouse
gacccggaattagtcttcgg

SEQ ID NO: 537762 - DNA, 20 bp, mouse
gcaggggctgtacccctcgg

SEQ ID NO: 537763 - DNA, 20 bp, mouse
gaccgccgaagactaattcc

SEQ ID NO: 537764 - DNA, 20 bp, mouse
gttagtcttcggcggttctc

SEQ ID NO: 537765 - DNA, 20 bp, mouse
ggacacccggaattagtctt

SEQ ID NO: 537766 - DNA, 20 bp, mouse
gaggctgtctccaacaacag

SEQ ID NO: 537767 - DNA, 20 bp, mouse
gggcctgacctaaagccctg

SEQ ID NO: 537768 - DNA, 20 bp, mouse
gcagtgaaggagtcatccca

SEQ ID NO: 537769 - DNA, 20 bp, mouse
ggatatgatacttcttacct

SEQ ID NO: 537770 - DNA, 20 bp, mouse
gggcctcagggctttaggtc

SEQ ID NO: 537771 - DNA, 20 bp, mouse
ggacaccacacactcaagag

SEQ ID NO: 537772 - DNA, 20 bp, mouse
gtatcctgatctctgtggaa

SEQ ID NO: 537773 - DNA, 20 bp, mouse
gcgcccctccccaaacaccc

SEQ ID NO: 537774 - DNA, 20 bp, mouse
gtatcatatcctgatctctg

SEQ ID NO: 537775 - DNA, 20 bp, mouse
gcatcccttccacagagatc

SEQ ID NO: 537776 - DNA, 20 bp, mouse
gccggcatagaggaaccacg

SEQ ID NO: 537777 - DNA, 20 bp, mouse
gaacccggaagtgatgtcgg

SEQ ID NO: 537778 - DNA, 20 bp, mouse
gccggaagtgatgtcggagg

SEQ ID NO: 537779 - DNA, 20 bp, mouse
gagcaactacaactccgtcc

SEQ ID NO: 537780 - DNA, 20 bp, mouse
gcaactccgtcccggcatag

SEQ ID NO: 537781 - DNA, 20 bp, mouse
gtggttcctctatgccggga

SEQ ID NO: 537782 - DNA, 20 bp, mouse
ggcctcggactcttcgggag

SEQ ID NO: 537783 - DNA, 20 bp, mouse
ggccgctcccgaagagtccg

SEQ ID NO: 537784 - DNA, 20 bp, mouse
ggctaagatgaccaaagtaa

SEQ ID NO: 537785 - DNA, 20 bp, mouse
gcccgggccgcccaagtcac

SEQ ID NO: 537786 - DNA, 20 bp, mouse
gccgggagtggagaagacgt

SEQ ID NO: 537787 - DNA, 20 bp, mouse
ggcggcggagtggagatccc

SEQ ID NO: 537788 - DNA, 20 bp, mouse
gctggaggtcggccatctcg

SEQ ID NO: 537789 - DNA, 20 bp, mouse
ggaggtcggccatctcgggg

SEQ ID NO: 537790 - DNA, 20 bp, mouse
ggcccgcgaggtcgttcctg

SEQ ID NO: 537791 - DNA, 20 bp, mouse
gcagccgtgggcgtgcccag

SEQ ID NO: 537792 - DNA, 20 bp, mouse
ggccccaggaacgacctcgc

SEQ ID NO: 537793 - DNA, 20 bp, mouse
gaacgagaaggagaacagac

SEQ ID NO: 537794 - DNA, 20 bp, mouse
ggaaaatgagcgccccacgt

SEQ ID NO: 537795 - DNA, 20 bp, mouse
ggaccggcgcaccgcagcca

SEQ ID NO: 537796 - DNA, 20 bp, mouse
ggcgcaatcgctccccggag

SEQ ID NO: 537797 - DNA, 20 bp, mouse
ggctccccggagcggccgag

SEQ ID NO: 537798 - DNA, 20 bp, mouse
gcagatgaggacacgagtgg

SEQ ID NO: 537799 - DNA, 20 bp, mouse
gcccaggcgcaatcgctccc

SEQ ID NO: 537800 - DNA, 20 bp, mouse
ggcccacctgagcgaggaga

SEQ ID NO: 537801 - DNA, 20 bp, mouse
gtaggcggcggcagtggcca

SEQ ID NO: 537802 - DNA, 20 bp, mouse
ggtccggcaaggagcgatcc

SEQ ID NO: 537803 - DNA, 20 bp, mouse
gccccggttgaaagcaagtg

SEQ ID NO: 537804 - DNA, 20 bp, mouse
gcggggaggagatttcggaa

SEQ ID NO: 537805 - DNA, 20 bp, mouse
gtgccgccgcctatataaat

SEQ ID NO: 537806 - DNA, 20 bp, mouse
ggtcgaagaactgccacctg

SEQ ID NO: 537807 - DNA, 20 bp, mouse
gaggtgcactctggagcagt

SEQ ID NO: 537808 - DNA, 20 bp, mouse
gaaagctgggtcccctaggt

SEQ ID NO: 537809 - DNA, 20 bp, mouse
ggctgggtcccctaggtcgg

SEQ ID NO: 537810 - DNA, 20 bp, mouse
gaacaaaagctgggtcccct

SEQ ID NO: 537811 - DNA, 20 bp, mouse
gctctctgcagcacctacat

SEQ ID NO: 537812 - DNA, 20 bp, mouse
gctcagagttacagcagctt

SEQ ID NO: 537813 - DNA, 20 bp, mouse
gcagtttgccaccgacctag

SEQ ID NO: 537814 - DNA, 20 bp, mouse
ggagtgcacctttcttcctc

SEQ ID NO: 537815 - DNA, 20 bp, mouse
gtctaattctgagcctatgt

SEQ ID NO: 537816 - DNA, 20 bp, mouse
ggacgggaaggagggcaagt

SEQ ID NO: 537817 - DNA, 20 bp, mouse
ggcttcccagacgggaagga

SEQ ID NO: 537818 - DNA, 20 bp, mouse
gctaggagcgcttcccagac

SEQ ID NO: 537819 - DNA, 20 bp, mouse
ggtaatcctacgcctctcca

SEQ ID NO: 537820 - DNA, 20 bp, mouse
ggccatgcagccaagagtcg

SEQ ID NO: 537821 - DNA, 20 bp, mouse
ggttactcaggagaaatcaa

SEQ ID NO: 537822 - DNA, 20 bp, mouse
gttaagagggaaagatgccc

SEQ ID NO: 537823 - DNA, 20 bp, mouse
ggcatggctagcatccctaa

SEQ ID NO: 537824 - DNA, 20 bp, mouse
gggctctgttgtcccggccc

SEQ ID NO: 537825 - DNA, 20 bp, mouse
ggccaaggtaccccgactct

SEQ ID NO: 537826 - DNA, 20 bp, mouse
ggcgggcgagcgagaggcac

SEQ ID NO: 537827 - DNA, 20 bp, mouse
gtgcagcgccggctccccgc

SEQ ID NO: 537828 - DNA, 20 bp, mouse
gtctgctggaggacctcgag

SEQ ID NO: 537829 - DNA, 20 bp, mouse
gccgcgggctgcacactcgc

SEQ ID NO: 537830 - DNA, 20 bp, mouse
gggcactcgggaatcctgag

SEQ ID NO: 537831 - DNA, 20 bp, mouse
gccacagtgcgccggtagaa

SEQ ID NO: 537832 - DNA, 20 bp, mouse
ggccggtagaacggcatccc

SEQ ID NO: 537833 - DNA, 20 bp, mouse
ggccagctcgcagacctctg

SEQ ID NO: 537834 - DNA, 20 bp, mouse
gcacgggcggctgtgcgggc

SEQ ID NO: 537835 - DNA, 20 bp, mouse
gccgggccaagcaggcgaca

SEQ ID NO: 537836 - DNA, 20 bp, mouse
gagagtgcctcacctagcga

SEQ ID NO: 537837 - DNA, 20 bp, mouse
gaggcactctgaagctggac

SEQ ID NO: 537838 - DNA, 20 bp, mouse
gcttgagccttcgctaggtg

SEQ ID NO: 537839 - DNA, 20 bp, mouse
gggtctgacttgctcatgag

SEQ ID NO: 537840 - DNA, 20 bp, mouse
gctcgccttgagccttcgct

SEQ ID NO: 537841 - DNA, 20 bp, mouse
gtgttggctatgaaccgaca

SEQ ID NO: 537842 - DNA, 20 bp, mouse
gactgggactggaggttcgg

SEQ ID NO: 537843 - DNA, 20 bp, mouse
gcatagttgtccgtcaggaa

SEQ ID NO: 537844 - DNA, 20 bp, mouse
gattccagccccaacaccgg

SEQ ID NO: 537845 - DNA, 20 bp, mouse
gatcaggagaaagtcagcca

SEQ ID NO: 537846 - DNA, 20 bp, mouse
ggttggatggagactgtgag

SEQ ID NO: 537847 - DNA, 20 bp, mouse
gggacgccaataagagctag

SEQ ID NO: 537848 - DNA, 20 bp, mouse
gtgacagggcaccaacacac

SEQ ID NO: 537849 - DNA, 20 bp, mouse
gcaacacacgggacatgatt

SEQ ID NO: 537850 - DNA, 20 bp, mouse
gccagtgcccaggatatcac

SEQ ID NO: 537851 - DNA, 20 bp, mouse
ggcactgtagccctgcaagt

SEQ ID NO: 537852 - DNA, 20 bp, mouse
gtccaaccactagctcttat

SEQ ID NO: 537853 - DNA, 20 bp, mouse
gatgctgaagaggataggac

SEQ ID NO: 537854 - DNA, 20 bp, mouse
ggtagttccagtgatatcct

SEQ ID NO: 537855 - DNA, 20 bp, mouse
gtagttcttttggttgataa

SEQ ID NO: 537856 - DNA, 20 bp, mouse
gtagcactcgaagtttaggg

SEQ ID NO: 537857 - DNA, 20 bp, mouse
gagggactgcggaggggcgt

SEQ ID NO: 537858 - DNA, 20 bp, mouse
gttagcagctcaggcggagg

SEQ ID NO: 537859 - DNA, 20 bp, mouse
ggtgaggagggactgcggag

SEQ ID NO: 537860 - DNA, 20 bp, mouse
gggtttagcagctcaggcgg

SEQ ID NO: 537861 - DNA, 20 bp, mouse
gtgtggtcccacaatcccgg

SEQ ID NO: 537862 - DNA, 20 bp, mouse
gggcggtttagcagctcagg

SEQ ID NO: 537863 - DNA, 20 bp, mouse
gcccctgcccagggccgaag

SEQ ID NO: 537864 - DNA, 20 bp, mouse
gggattgtgggaccacagtt

SEQ ID NO: 537865 - DNA, 20 bp, mouse
ggctaaaccgccgggattgt

SEQ ID NO: 537866 - DNA, 20 bp, mouse
gcagagacttgcggagtgga

SEQ ID NO: 537867 - DNA, 20 bp, mouse
gtgtggcccgcagagacttg

SEQ ID NO: 537868 - DNA, 20 bp, mouse
ggcatcaccagcagcgatag

SEQ ID NO: 537869 - DNA, 20 bp, mouse
gacgtagaggctgctgaact

SEQ ID NO: 537870 - DNA, 20 bp, mouse
gccagcagcgatagcggtga

SEQ ID NO: 537871 - DNA, 20 bp, mouse
gtcgggacccgacagccggg

SEQ ID NO: 537872 - DNA, 20 bp, mouse
ggggagctgaacttacgtag

SEQ ID NO: 537873 - DNA, 20 bp, mouse
ggcagcgatagcggtgatgg

SEQ ID NO: 537874 - DNA, 20 bp, mouse
ggagaccagctgctgccgga

SEQ ID NO: 537875 - DNA, 20 bp, mouse
ggggaggagtgagcatgttt

SEQ ID NO: 537876 - DNA, 20 bp, mouse
gaccactgaagggctcgcgg

SEQ ID NO: 537877 - DNA, 20 bp, mouse
gagagactgacgggagagta

SEQ ID NO: 537878 - DNA, 20 bp, mouse
gagcccggagccctccgcag

SEQ ID NO: 537879 - DNA, 20 bp, mouse
ggtgctgactccaggaataa

SEQ ID NO: 537880 - DNA, 20 bp, mouse
gtggtcctccgagtcctagt

SEQ ID NO: 537881 - DNA, 20 bp, mouse
gagagctctcaggggccgag

SEQ ID NO: 537882 - DNA, 20 bp, mouse
gcgctctgctctgaagctcc

SEQ ID NO: 537883 - DNA, 20 bp, mouse
gtgccgtacaatggagagat

SEQ ID NO: 537884 - DNA, 20 bp, mouse
gagtcctagtcggtgtgatg

SEQ ID NO: 537885 - DNA, 20 bp, mouse
gcacaccgactaggactcgg

SEQ ID NO: 537886 - DNA, 20 bp, mouse
ggacgtctgggtcgctccta

SEQ ID NO: 537887 - DNA, 20 bp, mouse
ggccaggcgcagacaggcaa

SEQ ID NO: 537888 - DNA, 20 bp, mouse
gtcccggggcgcagacgtct

SEQ ID NO: 537889 - DNA, 20 bp, mouse
gggcggagccaggcgcagac

SEQ ID NO: 537890 - DNA, 20 bp, mouse
gaagccctcggctctggtgg

SEQ ID NO: 537891 - DNA, 20 bp, mouse
ggcgaagccctcggctctgg

SEQ ID NO: 537892 - DNA, 20 bp, mouse
ggatctgacccacagggccg

SEQ ID NO: 537893 - DNA, 20 bp, mouse
gagcagatccgggatctcaa

SEQ ID NO: 537894 - DNA, 20 bp, mouse
gaccagggcatctcatacag

SEQ ID NO: 537895 - DNA, 20 bp, mouse
gcacacacgcgcccagacca

SEQ ID NO: 537896 - DNA, 20 bp, mouse
gccgcggcccgatctccggg

SEQ ID NO: 537897 - DNA, 20 bp, mouse
gcccccgcggcccgatctcc

SEQ ID NO: 537898 - DNA, 20 bp, mouse
gccgccgccacccggagatc

SEQ ID NO: 537899 - DNA, 20 bp, mouse
gccatgaccgcgggactctc

SEQ ID NO: 537900 - DNA, 20 bp, mouse
ggcggcctgggagatcgagg

SEQ ID NO: 537901 - DNA, 20 bp, mouse
gcccccgagccgccacccgg

SEQ ID NO: 537902 - DNA, 20 bp, mouse
gggaccccgagcgccctgag

SEQ ID NO: 537903 - DNA, 20 bp, mouse
gcgcccagcgcgcttgctcc

SEQ ID NO: 537904 - DNA, 20 bp, mouse
gcgcgcggcctgggagatcg

SEQ ID NO: 537905 - DNA, 20 bp, mouse
gagccgggagcaagcgcgct

SEQ ID NO: 537906 - DNA, 20 bp, mouse
ggcccgggccgcccagcaca

SEQ ID NO: 537907 - DNA, 20 bp, mouse
ggcggccgcaccatggagtc

SEQ ID NO: 537908 - DNA, 20 bp, mouse
ggctcaggccgtgtgctggg

SEQ ID NO: 537909 - DNA, 20 bp, mouse
gtcctcagtgcccgactcca

SEQ ID NO: 537910 - DNA, 20 bp, mouse
gggcccgggcggccgcacca

SEQ ID NO: 537911 - DNA, 20 bp, mouse
gctgaggagtatgagctcaa

SEQ ID NO: 537912 - DNA, 20 bp, mouse
ggcacagccgtagcccgtgg

SEQ ID NO: 537913 - DNA, 20 bp, mouse
ggacgtgccgggcccagaga

SEQ ID NO: 537914 - DNA, 20 bp, mouse
gcacgtcagcgggcacctgt

SEQ ID NO: 537915 - DNA, 20 bp, mouse
gcggaggcgcgggtgcgctc

SEQ ID NO: 537916 - DNA, 20 bp, mouse
gagggtggcgagtggcccca

SEQ ID NO: 537917 - DNA, 20 bp, mouse
ggcaaactgcagacactcgg

SEQ ID NO: 537918 - DNA, 20 bp, mouse
gccagtgtgttcagagaagg

SEQ ID NO: 537919 - DNA, 20 bp, mouse
gtgggcttatggctcttctg

SEQ ID NO: 537920 - DNA, 20 bp, mouse
gacactcggagggtggcgag

SEQ ID NO: 537921 - DNA, 20 bp, mouse
gtttttcagctgggcagtct

SEQ ID NO: 537922 - DNA, 20 bp, mouse
gcttatggctcttctgaggt

SEQ ID NO: 537923 - DNA, 20 bp, mouse
gctttgactagaggaagcag

SEQ ID NO: 537924 - DNA, 20 bp, mouse
gcagccaggggtatcaaaat

SEQ ID NO: 537925 - DNA, 20 bp, mouse
gctgggagcggttgtgaagg

SEQ ID NO: 537926 - DNA, 20 bp, mouse
gatgcgcggcgcggcagaag

SEQ ID NO: 537927 - DNA, 20 bp, mouse
gcgcgggaaagaagctccac

SEQ ID NO: 537928 - DNA, 20 bp, mouse
gcggggctgcagcaagagga

SEQ ID NO: 537929 - DNA, 20 bp, mouse
ggcgccgcgcatgcgcaagg

SEQ ID NO: 537930 - DNA, 20 bp, mouse
ggcgcatgcgcaaggcggtc

SEQ ID NO: 537931 - DNA, 20 bp, mouse
gcccgggtgaccgcaggtgg

SEQ ID NO: 537932 - DNA, 20 bp, mouse
gcacgcagcggggggactga

SEQ ID NO: 537933 - DNA, 20 bp, mouse
ggaacacctgggcggagtct

SEQ ID NO: 537934 - DNA, 20 bp, mouse
gagcccggaaggccacaggg

SEQ ID NO: 537935 - DNA, 20 bp, mouse
gagcacccggccccacgcgc

SEQ ID NO: 537936 - DNA, 20 bp, mouse
gggtgcaaagcgagccgggt

SEQ ID NO: 537937 - DNA, 20 bp, mouse
gcgcgctggggtgtcctacc

SEQ ID NO: 537938 - DNA, 20 bp, mouse
gtgcagcggccggtacacag

SEQ ID NO: 537939 - DNA, 20 bp, mouse
gagacacaaagagcggccga

SEQ ID NO: 537940 - DNA, 20 bp, mouse
gagccgagcggagccgaggg

SEQ ID NO: 537941 - DNA, 20 bp, mouse
ggagttcaggatgcgggctc

SEQ ID NO: 537942 - DNA, 20 bp, mouse
ggcccggtgcaaagcgagcc

SEQ ID NO: 537943 - DNA, 20 bp, mouse
gcaccccagcgcgcgtccct

SEQ ID NO: 537944 - DNA, 20 bp, mouse
gctgccggccgcgctcccct

SEQ ID NO: 537945 - DNA, 20 bp, mouse
ggcgcctgcatcgcaagcat

SEQ ID NO: 537946 - DNA, 20 bp, mouse
gtccaggcacgaggattccc

SEQ ID NO: 537947 - DNA, 20 bp, mouse
gccaagcaagcggcaagatg

SEQ ID NO: 537948 - DNA, 20 bp, mouse
ggtgcctggagagccggaag

SEQ ID NO: 537949 - DNA, 20 bp, mouse
ggaagtagtaagaactggag

SEQ ID NO: 537950 - DNA, 20 bp, mouse
gtgccgcttgcttggctccc

SEQ ID NO: 537951 - DNA, 20 bp, mouse
ggagaaccttcaactcctag

SEQ ID NO: 537952 - DNA, 20 bp, mouse
gccccaggaagtgggcgggt

SEQ ID NO: 537953 - DNA, 20 bp, mouse
ggtcttgttgccctcagcat

SEQ ID NO: 537954 - DNA, 20 bp, mouse
gaggtacccggtgacgacca

SEQ ID NO: 537955 - DNA, 20 bp, mouse
ggaactggagaggcggatga

SEQ ID NO: 537956 - DNA, 20 bp, mouse
gcccaggccgagcgacacgg

SEQ ID NO: 537957 - DNA, 20 bp, mouse
gacgcccaggccgagcgaca

SEQ ID NO: 537958 - DNA, 20 bp, mouse
gggacaccacagccacgccc

SEQ ID NO: 537959 - DNA, 20 bp, mouse
ggtgtctgtgcacagagcac

SEQ ID NO: 537960 - DNA, 20 bp, mouse
ggccgagcgacacggcggcg

SEQ ID NO: 537961 - DNA, 20 bp, mouse
gcgcgctaaaaggcgaggta

SEQ ID NO: 537962 - DNA, 20 bp, mouse
gggaagctctgcctgacagt

SEQ ID NO: 537963 - DNA, 20 bp, mouse
gcgttcgtgctgcagaagaa

SEQ ID NO: 537964 - DNA, 20 bp, mouse
gggtagggcgggccgaggtc

SEQ ID NO: 537965 - DNA, 20 bp, mouse
gcgacacggcggcggggctc

SEQ ID NO: 537966 - DNA, 20 bp, mouse
gagccgagaggagcctacct

SEQ ID NO: 537967 - DNA, 20 bp, mouse
gcctccatgggagagccgag

SEQ ID NO: 537968 - DNA, 20 bp, mouse
ggccgaaggctgtccgaggt

SEQ ID NO: 537969 - DNA, 20 bp, mouse
ggtgagcgccgcctcctcca

SEQ ID NO: 537970 - DNA, 20 bp, mouse
gtttcccggcaggttctcgg

SEQ ID NO: 537971 - DNA, 20 bp, mouse
gagaacctgccgggaaacct

SEQ ID NO: 537972 - DNA, 20 bp, mouse
gctgtaagcgagctccaggg

SEQ ID NO: 537973 - DNA, 20 bp, mouse
gacagccttcggccgcaccg

SEQ ID NO: 537974 - DNA, 20 bp, mouse
ggactcactgcggatcacca

SEQ ID NO: 537975 - DNA, 20 bp, mouse
gagtctgcgcccaggtttcc

SEQ ID NO: 537976 - DNA, 20 bp, mouse
gagcctcagctgtaccccca

SEQ ID NO: 537977 - DNA, 20 bp, mouse
gcatggcagggctctccggg

SEQ ID NO: 537978 - DNA, 20 bp, mouse
gaaagcgggtcccgggacac

SEQ ID NO: 537979 - DNA, 20 bp, mouse
gcagtcggctgtcccaccaa

SEQ ID NO: 537980 - DNA, 20 bp, mouse
gtacagctgaggctgccacc

SEQ ID NO: 537981 - DNA, 20 bp, mouse
ggaaactattgctagcacag

SEQ ID NO: 537982 - DNA, 20 bp, mouse
ggctgtacccccatggcctg

SEQ ID NO: 537983 - DNA, 20 bp, mouse
gaagcccggtccccaggcca

SEQ ID NO: 537984 - DNA, 20 bp, mouse
gggccatgggggtacagctg

SEQ ID NO: 537985 - DNA, 20 bp, mouse
gggacagccgactggacgac

SEQ ID NO: 537986 - DNA, 20 bp, mouse
gcgcgtggattcagtcctca

SEQ ID NO: 537987 - DNA, 20 bp, mouse
ggtggattcagtcctcatgg

SEQ ID NO: 537988 - DNA, 20 bp, mouse
gcgagacagctcgtctagga

SEQ ID NO: 537989 - DNA, 20 bp, mouse
ggccgaggcgtcgtcctcgg

SEQ ID NO: 537990 - DNA, 20 bp, mouse
ggttccgagacagctcgtct

SEQ ID NO: 537991 - DNA, 20 bp, mouse
gtgcgggaggacggacggga

SEQ ID NO: 537992 - DNA, 20 bp, mouse
gagctcgtctaggacggccg

SEQ ID NO: 537993 - DNA, 20 bp, mouse
gcgggtcgccgggcaggaag

SEQ ID NO: 537994 - DNA, 20 bp, mouse
gaatccacgcgctgggactc

SEQ ID NO: 537995 - DNA, 20 bp, mouse
ggcgcgccggagccgccatg

SEQ ID NO: 537996 - DNA, 20 bp, mouse
gaagaggctgtacctagggg

SEQ ID NO: 537997 - DNA, 20 bp, mouse
gagctgggaagggatccaag

SEQ ID NO: 537998 - DNA, 20 bp, mouse
ggacactccgtgccacccct

SEQ ID NO: 537999 - DNA, 20 bp, mouse
gaggttccggagaagcgact

SEQ ID NO: 538000 - DNA, 20 bp, mouse
ggatccaagaggctgtacct

SEQ ID NO: 538001 - DNA, 20 bp, mouse
gacaaggctggcaacaacaa

SEQ ID NO: 538002 - DNA, 20 bp, mouse
gcttctccggaacctgggat

SEQ ID NO: 538003 - DNA, 20 bp, mouse
ggaacgtcccgggtgagtca

SEQ ID NO: 538004 - DNA, 20 bp, mouse
gcccagctccgagtttccaa

SEQ ID NO: 538005 - DNA, 20 bp, mouse
gctgcagccccttggaaact

SEQ ID NO: 538006 - DNA, 20 bp, mouse
ggccacgttgggacaagtca

SEQ ID NO: 538007 - DNA, 20 bp, mouse
gcccgaggtccgcggttcct

SEQ ID NO: 538008 - DNA, 20 bp, mouse
gtgcctgccggagccacgtt

SEQ ID NO: 538009 - DNA, 20 bp, mouse
gctgcggtcgcaccccagaa

SEQ ID NO: 538010 - DNA, 20 bp, mouse
gtgacagcgcccgaggtccg

SEQ ID NO: 538011 - DNA, 20 bp, mouse
ggccgtgacttgtcccaacg

SEQ ID NO: 538012 - DNA, 20 bp, mouse
ggccgcaaagctgggaacag

SEQ ID NO: 538013 - DNA, 20 bp, mouse
gcgatggggaatcaactctg

SEQ ID NO: 538014 - DNA, 20 bp, mouse
gcgccagggtccgaacccag

SEQ ID NO: 538015 - DNA, 20 bp, mouse
gcctgggctgacagcgcccg

SEQ ID NO: 538016 - DNA, 20 bp, mouse
gctgcagctgcacttccggt

SEQ ID NO: 538017 - DNA, 20 bp, mouse
gcgggaaccaatcctcctgg

SEQ ID NO: 538018 - DNA, 20 bp, mouse
ggggccccgagctaccgggg

SEQ ID NO: 538019 - DNA, 20 bp, mouse
ggcccgggaaccaatcctcc

SEQ ID NO: 538020 - DNA, 20 bp, mouse
ggacaccagcaaagccgcca

SEQ ID NO: 538021 - DNA, 20 bp, mouse
gtaatccgggccgggagggg

SEQ ID NO: 538022 - DNA, 20 bp, mouse
ggtcggtaccgacggaggga

SEQ ID NO: 538023 - DNA, 20 bp, mouse
gcccccgccgccaggaggat

SEQ ID NO: 538024 - DNA, 20 bp, mouse
gaccagcaaagccgccaggg

SEQ ID NO: 538025 - DNA, 20 bp, mouse
gggacgcccccgccgccagg

SEQ ID NO: 538026 - DNA, 20 bp, mouse
gaacctgctccggtccaaca

SEQ ID NO: 538027 - DNA, 20 bp, mouse
gcacaaccgcggagccatgt

SEQ ID NO: 538028 - DNA, 20 bp, mouse
gcagagatgatgcacaaccg

SEQ ID NO: 538029 - DNA, 20 bp, mouse
gcatctctgcagcggcacgg

SEQ ID NO: 538030 - DNA, 20 bp, mouse
gccggtccaacatggctccg

SEQ ID NO: 538031 - DNA, 20 bp, mouse
gcagcctcaggcctacatcc

SEQ ID NO: 538032 - DNA, 20 bp, mouse
gccgcgaggtccccagcacg

SEQ ID NO: 538033 - DNA, 20 bp, mouse
gcatcatctctgcagcggca

SEQ ID NO: 538034 - DNA, 20 bp, mouse
gcagagagctaccaggatgt

SEQ ID NO: 538035 - DNA, 20 bp, mouse
gcagccactgggctgaggcg

SEQ ID NO: 538036 - DNA, 20 bp, mouse
ggtagtggagcgcacactaa

SEQ ID NO: 538037 - DNA, 20 bp, mouse
gctgtgaaatgtaggtcatg

SEQ ID NO: 538038 - DNA, 20 bp, mouse
gcactaatggtgtgttgctt

SEQ ID NO: 538039 - DNA, 20 bp, mouse
gtccttcttggacagcagag

SEQ ID NO: 538040 - DNA, 20 bp, mouse
gcacaaggtggatcctcgga

SEQ ID NO: 538041 - DNA, 20 bp, mouse
gcatgaggctaggggagcat

SEQ ID NO: 538042 - DNA, 20 bp, mouse
gcttgtggacaaagagggaa

SEQ ID NO: 538043 - DNA, 20 bp, mouse
gaatgtaggtcatgaggcta

SEQ ID NO: 538044 - DNA, 20 bp, mouse
gttggacagcagagtggagt

SEQ ID NO: 538045 - DNA, 20 bp, mouse
gtggagtgggcgtccttccg

SEQ ID NO: 538046 - DNA, 20 bp, mouse
gtctgctacccggagaagtg

SEQ ID NO: 538047 - DNA, 20 bp, mouse
gagcggcaccgcacttctcc

SEQ ID NO: 538048 - DNA, 20 bp, mouse
ggggaaggggctctgcggag

SEQ ID NO: 538049 - DNA, 20 bp, mouse
gtagcagaggacccacttta

SEQ ID NO: 538050 - DNA, 20 bp, mouse
gatccacgctggactgggaa

SEQ ID NO: 538051 - DNA, 20 bp, mouse
gacaccacagaccataaagt

SEQ ID NO: 538052 - DNA, 20 bp, mouse
ggctctggtgcatcaggtag

SEQ ID NO: 538053 - DNA, 20 bp, mouse
gaagtgggcggagctgagtg

SEQ ID NO: 538054 - DNA, 20 bp, mouse
gggttgccagcggggaaagt

SEQ ID NO: 538055 - DNA, 20 bp, mouse
gagcctaaggaggctttcac

SEQ ID NO: 538056 - DNA, 20 bp, mouse
gtcggagcgcgagcatggtg

SEQ ID NO: 538057 - DNA, 20 bp, mouse
gcgcgtatccgagcgcccgg

SEQ ID NO: 538058 - DNA, 20 bp, mouse
ggcccgcgcaccaggaagcg

SEQ ID NO: 538059 - DNA, 20 bp, mouse
gccatgctcgcgctccgaag

SEQ ID NO: 538060 - DNA, 20 bp, mouse
ggcgcaggaagaccgccgcc

SEQ ID NO: 538061 - DNA, 20 bp, mouse
gcggggccagcgctgtcctt

SEQ ID NO: 538062 - DNA, 20 bp, mouse
gcccccgcggcccctacctg

SEQ ID NO: 538063 - DNA, 20 bp, mouse
gcgctgtccttaggccgctt

SEQ ID NO: 538064 - DNA, 20 bp, mouse
gctgaggcgtcagaacccgc

SEQ ID NO: 538065 - DNA, 20 bp, mouse
gcgcgctccgaagcggccta

SEQ ID NO: 538066 - DNA, 20 bp, mouse
gggtggagccggcaacatgg

SEQ ID NO: 538067 - DNA, 20 bp, mouse
gaggctcggcctcccgctca

SEQ ID NO: 538068 - DNA, 20 bp, mouse
gagcggtggagccggcaaca

SEQ ID NO: 538069 - DNA, 20 bp, mouse
gcggctgcgacactcagctt

SEQ ID NO: 538070 - DNA, 20 bp, mouse
ggccgacgcccggcgcagag

SEQ ID NO: 538071 - DNA, 20 bp, mouse
gcccggagttctcgacccag

SEQ ID NO: 538072 - DNA, 20 bp, mouse
gcgcagagtggcagcagcag

SEQ ID NO: 538073 - DNA, 20 bp, mouse
gccaaggaggcgcgcgtcgt

SEQ ID NO: 538074 - DNA, 20 bp, mouse
gttctgcgaggtagcgacga

SEQ ID NO: 538075 - DNA, 20 bp, mouse
ggagctcgtggacacgtaca

SEQ ID NO: 538076 - DNA, 20 bp, mouse
gcaggagcgcaggagcaagt

SEQ ID NO: 538077 - DNA, 20 bp, mouse
ggagcgcaggagcaagtggg

SEQ ID NO: 538078 - DNA, 20 bp, mouse
gtgagatccgaccccgtgaa

SEQ ID NO: 538079 - DNA, 20 bp, mouse
gggaaggacgcgctaatcag

SEQ ID NO: 538080 - DNA, 20 bp, mouse
gtcggatctcaagagctgcc

SEQ ID NO: 538081 - DNA, 20 bp, mouse
gtgccaggagccaggagcgc

SEQ ID NO: 538082 - DNA, 20 bp, mouse
gcaccgcagcgggcagggtt

SEQ ID NO: 538083 - DNA, 20 bp, mouse
gctagatctccaccatctca

SEQ ID NO: 538084 - DNA, 20 bp, mouse
gacagccaaaaccattcacg

SEQ ID NO: 538085 - DNA, 20 bp, mouse
gcatctcatggtgggtagat

SEQ ID NO: 538086 - DNA, 20 bp, mouse
gactagacatggctcttcca

SEQ ID NO: 538087 - DNA, 20 bp, mouse
gtgtggcctgcggtgcaccg

SEQ ID NO: 538088 - DNA, 20 bp, mouse
ggcgcggcgaagcccagggg

SEQ ID NO: 538089 - DNA, 20 bp, mouse
gaagagccatgtctagtaag

SEQ ID NO: 538090 - DNA, 20 bp, mouse
gatgtctagtaagtggctcg

SEQ ID NO: 538091 - DNA, 20 bp, mouse
ggcggaggagattgactggc

SEQ ID NO: 538092 - DNA, 20 bp, mouse
gggaagtcagagccacgagt

SEQ ID NO: 538093 - DNA, 20 bp, mouse
gcgcacggccagccgcccct

SEQ ID NO: 538094 - DNA, 20 bp, mouse
gcgagtgacgggcctattac

SEQ ID NO: 538095 - DNA, 20 bp, mouse
gccgcagcgtgcagaaggcg

SEQ ID NO: 538096 - DNA, 20 bp, mouse
ggtgcagcactgcccagctg

SEQ ID NO: 538097 - DNA, 20 bp, mouse
ggtggtgggccgggaagcgg

SEQ ID NO: 538098 - DNA, 20 bp, mouse
gggcggccgagccacgtggt

SEQ ID NO: 538099 - DNA, 20 bp, mouse
gcggcggctgccgagcgccc

SEQ ID NO: 538100 - DNA, 20 bp, mouse
ggacggccggccgcagacaa

SEQ ID NO: 538101 - DNA, 20 bp, mouse
gggccggccgcagacaaagg

SEQ ID NO: 538102 - DNA, 20 bp, mouse
gcccccgcaggcaccgagcg

SEQ ID NO: 538103 - DNA, 20 bp, mouse
gcccggagggaggcgaggga

SEQ ID NO: 538104 - DNA, 20 bp, mouse
gcggccgccaccccggaggg

SEQ ID NO: 538105 - DNA, 20 bp, mouse
ggcggtggggccggcgacta

SEQ ID NO: 538106 - DNA, 20 bp, mouse
gcacgcggagcgcagaacag

SEQ ID NO: 538107 - DNA, 20 bp, mouse
gggtgcgcgggctcccgggg

SEQ ID NO: 538108 - DNA, 20 bp, mouse
gacgggtgcgcgggctcccg

SEQ ID NO: 538109 - DNA, 20 bp, mouse
ggagtgcagtgaacgagtaa

SEQ ID NO: 538110 - DNA, 20 bp, mouse
gcagatgccccagggctcgg

SEQ ID NO: 538111 - DNA, 20 bp, mouse
gagcgcagaacagaggcgcc

SEQ ID NO: 538112 - DNA, 20 bp, mouse
gcctcgacggtggccgacgt

SEQ ID NO: 538113 - DNA, 20 bp, mouse
gtccctgcccactctctcaa

SEQ ID NO: 538114 - DNA, 20 bp, mouse
gcaggggtctcggaaaccat

SEQ ID NO: 538115 - DNA, 20 bp, mouse
ggcgcacccgtgcgtgggga

SEQ ID NO: 538116 - DNA, 20 bp, mouse
gaccctcgcgctaggaggta

SEQ ID NO: 538117 - DNA, 20 bp, mouse
gcctggcagacgcactgcac

SEQ ID NO: 538118 - DNA, 20 bp, mouse
ggcgccgcttgagagagatc

SEQ ID NO: 538119 - DNA, 20 bp, mouse
gaatctgcgtgcagggcggg

SEQ ID NO: 538120 - DNA, 20 bp, mouse
ggggcgggcggaggtcagcg

SEQ ID NO: 538121 - DNA, 20 bp, mouse
gcctgcacgcagattaacaa

SEQ ID NO: 538122 - DNA, 20 bp, mouse
gacaagacgatcctccccag

SEQ ID NO: 538123 - DNA, 20 bp, mouse
gagccgaccctcgcgctagg

SEQ ID NO: 538124 - DNA, 20 bp, mouse
gaggcacagataacctggaa

SEQ ID NO: 538125 - DNA, 20 bp, mouse
gtccctacctcctagcgcga

SEQ ID NO: 538126 - DNA, 20 bp, mouse
gtggcagcaaaggctcccac

SEQ ID NO: 538127 - DNA, 20 bp, mouse
gcggccggagcaaaagccca

SEQ ID NO: 538128 - DNA, 20 bp, mouse
ggagcgcaagaagcgtgcag

SEQ ID NO: 538129 - DNA, 20 bp, mouse
gggaggattccagcccactc

SEQ ID NO: 538130 - DNA, 20 bp, mouse
ggagcctttgctgccagagt

SEQ ID NO: 538131 - DNA, 20 bp, mouse
gcgtgcaaggggagctgtca

SEQ ID NO: 538132 - DNA, 20 bp, mouse
ggcaagaagcgtgcagcggc

SEQ ID NO: 538133 - DNA, 20 bp, mouse
ggtccagagtgcctaatcag

SEQ ID NO: 538134 - DNA, 20 bp, mouse
gctctgcagctggtgagtcc

SEQ ID NO: 538135 - DNA, 20 bp, mouse
gtggtattcacttcgcccgt

SEQ ID NO: 538136 - DNA, 20 bp, mouse
gcctgaacgggaggcctccg

SEQ ID NO: 538137 - DNA, 20 bp, mouse
ggaagcgtcgcagtccatcg

SEQ ID NO: 538138 - DNA, 20 bp, mouse
ggcttcagcttcccccacca

SEQ ID NO: 538139 - DNA, 20 bp, mouse
gctgcaagctctaggaccct

SEQ ID NO: 538140 - DNA, 20 bp, mouse
gactctgggtccgggggaag

SEQ ID NO: 538141 - DNA, 20 bp, mouse
gaggggtttaccgctgtaca

SEQ ID NO: 538142 - DNA, 20 bp, mouse
gaccaaggggcgggacaagg

SEQ ID NO: 538143 - DNA, 20 bp, mouse
gtgttggcggcaaggactct

SEQ ID NO: 538144 - DNA, 20 bp, mouse
gcaaaggtcccggacaccta

SEQ ID NO: 538145 - DNA, 20 bp, mouse
ggagcccgatacaggagcca

SEQ ID NO: 538146 - DNA, 20 bp, mouse
gggaataaccgccaccgcgg

SEQ ID NO: 538147 - DNA, 20 bp, mouse
gcgccttcaatcaaccaccg

SEQ ID NO: 538148 - DNA, 20 bp, mouse
gtagggcgagatcgggatac

SEQ ID NO: 538149 - DNA, 20 bp, mouse
gcaccgcggtggttgattga

SEQ ID NO: 538150 - DNA, 20 bp, mouse
ggatcgggatacaggcgaca

SEQ ID NO: 538151 - DNA, 20 bp, mouse
gtcctcattagggcgagatc

SEQ ID NO: 538152 - DNA, 20 bp, mouse
ggccctaatgaggacactct

SEQ ID NO: 538153 - DNA, 20 bp, mouse
gtctcctcagcggtcctgag

SEQ ID NO: 538154 - DNA, 20 bp, mouse
ggcgcaggcgcactagagac

SEQ ID NO: 538155 - DNA, 20 bp, mouse
gggacgccctgagcaccccg

SEQ ID NO: 538156 - DNA, 20 bp, mouse
gcgccgagcgcagccttagg

SEQ ID NO: 538157 - DNA, 20 bp, mouse
gagtccggccgcggcgacgg

SEQ ID NO: 538158 - DNA, 20 bp, mouse
gcggcgcgcggactgtgagg

SEQ ID NO: 538159 - DNA, 20 bp, mouse
ggctcggcgcgcggactgtg

SEQ ID NO: 538160 - DNA, 20 bp, mouse
gcggcgggagccggaaagaa

SEQ ID NO: 538161 - DNA, 20 bp, mouse
gcgcgtcccggcgccgccta

SEQ ID NO: 538162 - DNA, 20 bp, mouse
ggccggcagcggcccatcaa

SEQ ID NO: 538163 - DNA, 20 bp, mouse
gggccaatgggcgctcaggg

SEQ ID NO: 538164 - DNA, 20 bp, mouse
gtccctgcgcttgcacacgg

SEQ ID NO: 538165 - DNA, 20 bp, mouse
gagcgcagggagagcccgga

SEQ ID NO: 538166 - DNA, 20 bp, mouse
ggcccggcaaccggagacac

SEQ ID NO: 538167 - DNA, 20 bp, mouse
gccgagctgagagcaactcg

SEQ ID NO: 538168 - DNA, 20 bp, mouse
gggacacagggaagacggaa

SEQ ID NO: 538169 - DNA, 20 bp, mouse
ggatccggggccgggcagtc

SEQ ID NO: 538170 - DNA, 20 bp, mouse
gagtctggcgaggcttggcc

SEQ ID NO: 538171 - DNA, 20 bp, mouse
gaactcgtggagcctggatc

SEQ ID NO: 538172 - DNA, 20 bp, mouse
gggcacggtcggaggacaca

SEQ ID NO: 538173 - DNA, 20 bp, mouse
gctgcccgcgccggtgtctc

SEQ ID NO: 538174 - DNA, 20 bp, mouse
gcaaggcgtgtcccaatcga

SEQ ID NO: 538175 - DNA, 20 bp, mouse
gtcgccagactgcccggccc

SEQ ID NO: 538176 - DNA, 20 bp, mouse
gttctctggctcagaagacg

SEQ ID NO: 538177 - DNA, 20 bp, mouse
ggaagaatcagatcagacag

SEQ ID NO: 538178 - DNA, 20 bp, mouse
gccacggccgggagcagaca

SEQ ID NO: 538179 - DNA, 20 bp, mouse
gagcaaacagggccagggac

SEQ ID NO: 538180 - DNA, 20 bp, mouse
gagatcagacagaggactcc

SEQ ID NO: 538181 - DNA, 20 bp, mouse
gcacagatgacccagactgt

SEQ ID NO: 538182 - DNA, 20 bp, mouse
gcagagctgcaagcaagtaa

SEQ ID NO: 538183 - DNA, 20 bp, mouse
ggctcagaagacgaggaatt

SEQ ID NO: 538184 - DNA, 20 bp, mouse
ggcaagcagcggctttgtcc

SEQ ID NO: 538185 - DNA, 20 bp, mouse
gacagggccagggaccggca

SEQ ID NO: 538186 - DNA, 20 bp, mouse
gggccggaggaagcaggtcg

SEQ ID NO: 538187 - DNA, 20 bp, mouse
ggtcggggaccggctccaga

SEQ ID NO: 538188 - DNA, 20 bp, mouse
gagcagcacgcaggtcaccg

SEQ ID NO: 538189 - DNA, 20 bp, mouse
ggcaggtcaccgcggtccga

SEQ ID NO: 538190 - DNA, 20 bp, mouse
gcggtccgaaggcgtccctc

SEQ ID NO: 538191 - DNA, 20 bp, mouse
ggaggaagcaggtcggggac

SEQ ID NO: 538192 - DNA, 20 bp, mouse
gcaaggctgcggaaagtgag

SEQ ID NO: 538193 - DNA, 20 bp, mouse
gacaccaacctgacactgca

SEQ ID NO: 538194 - DNA, 20 bp, mouse
gcgtcacgtcaaggggccgg

SEQ ID NO: 538195 - DNA, 20 bp, mouse
gggagcactgctgagagctt

SEQ ID NO: 538196 - DNA, 20 bp, mouse
ggtgggccggaccatgggag

SEQ ID NO: 538197 - DNA, 20 bp, mouse
gctgaggtgccccccggagt

SEQ ID NO: 538198 - DNA, 20 bp, mouse
gtggtccggcccactccggg

SEQ ID NO: 538199 - DNA, 20 bp, mouse
gctcccgctgaggtgccccc

SEQ ID NO: 538200 - DNA, 20 bp, mouse
gcccatggtccggcccactc

SEQ ID NO: 538201 - DNA, 20 bp, mouse
gaagacggccctcttcctct

SEQ ID NO: 538202 - DNA, 20 bp, mouse
gaggaagagggccgtcttta

SEQ ID NO: 538203 - DNA, 20 bp, mouse
gggcagctcgaccgtaaaga

SEQ ID NO: 538204 - DNA, 20 bp, mouse
ggcccttcaggggtactctg

SEQ ID NO: 538205 - DNA, 20 bp, mouse
gccccgcagcactcccgctg

SEQ ID NO: 538206 - DNA, 20 bp, mouse
gtggcgggccgtgacgtcag

SEQ ID NO: 538207 - DNA, 20 bp, mouse
gtcagtggcccaatcctaca

SEQ ID NO: 538208 - DNA, 20 bp, mouse
gccccaactcgggatccaaa

SEQ ID NO: 538209 - DNA, 20 bp, mouse
gggcccaatcctacatggaa

SEQ ID NO: 538210 - DNA, 20 bp, mouse
ggggtgggttgtgtcaggag

SEQ ID NO: 538211 - DNA, 20 bp, mouse
ggtcagtgttcagcttggtg

SEQ ID NO: 538212 - DNA, 20 bp, mouse
gagggaagaaacggggtcca

SEQ ID NO: 538213 - DNA, 20 bp, mouse
gaaaaggtatcgttcattgg

SEQ ID NO: 538214 - DNA, 20 bp, mouse
gctgggctacagagtgggac

SEQ ID NO: 538215 - DNA, 20 bp, mouse
gacattgtagttcttctgca

SEQ ID NO: 538216 - DNA, 20 bp, mouse
gagcgcgaggagctggtcca

SEQ ID NO: 538217 - DNA, 20 bp, mouse
gctatagccacgaaagtgac

SEQ ID NO: 538218 - DNA, 20 bp, mouse
gccacacactgagagagtag

SEQ ID NO: 538219 - DNA, 20 bp, mouse
gggtccgcagaggtgctgtg

SEQ ID NO: 538220 - DNA, 20 bp, mouse
gcacctgcacagctatcccg

SEQ ID NO: 538221 - DNA, 20 bp, mouse
gcgggtcggctgagtgatgg

SEQ ID NO: 538222 - DNA, 20 bp, mouse
gatgcgggtcggctgagtga

SEQ ID NO: 538223 - DNA, 20 bp, mouse
gtatggggcacactaggcag

SEQ ID NO: 538224 - DNA, 20 bp, mouse
gtgggtcccagggtccgcag

SEQ ID NO: 538225 - DNA, 20 bp, mouse
gcacgaaagtgactggcagt

SEQ ID NO: 538226 - DNA, 20 bp, mouse
gcggagcctaacgtcaccaa

SEQ ID NO: 538227 - DNA, 20 bp, mouse
gggccctcacggggaagagg

SEQ ID NO: 538228 - DNA, 20 bp, mouse
gcggcgagctgcggacaggg

SEQ ID NO: 538229 - DNA, 20 bp, mouse
gacagggaggagggcgctga

SEQ ID NO: 538230 - DNA, 20 bp, mouse
gggaagaggtggcgttccgt

SEQ ID NO: 538231 - DNA, 20 bp, mouse
ggccaggtgagaagctcgac

SEQ ID NO: 538232 - DNA, 20 bp, mouse
gcagcctaggagcaatcccg

SEQ ID NO: 538233 - DNA, 20 bp, mouse
gtcgccggctggccctcacg

SEQ ID NO: 538234 - DNA, 20 bp, mouse
gcgagctgcggacagggagg

SEQ ID NO: 538235 - DNA, 20 bp, mouse
gtcacctggccgcacagctc

SEQ ID NO: 538236 - DNA, 20 bp, mouse
gcagcagagcgggaacagct

SEQ ID NO: 538237 - DNA, 20 bp, mouse
gcggcgggcgcctgaagcgg

SEQ ID NO: 538238 - DNA, 20 bp, mouse
gagcgggaacagctgggctg

SEQ ID NO: 538239 - DNA, 20 bp, mouse
ggctacagctcgggacacta

SEQ ID NO: 538240 - DNA, 20 bp, mouse
gcgggcgcctgaagcggtgg

SEQ ID NO: 538241 - DNA, 20 bp, mouse
ggcgcctgaagcggtggcgg

SEQ ID NO: 538242 - DNA, 20 bp, mouse
gctccagcccggggaaagat

SEQ ID NO: 538243 - DNA, 20 bp, mouse
gagggcccagtagcacgcag

SEQ ID NO: 538244 - DNA, 20 bp, mouse
gggatctaggatgtccaaca

SEQ ID NO: 538245 - DNA, 20 bp, mouse
ggcgcggcgggcgcctgaag

SEQ ID NO: 538246 - DNA, 20 bp, mouse
gcccgaggccagccgtactg

SEQ ID NO: 538247 - DNA, 20 bp, mouse
gaggccagccgtactggggt

SEQ ID NO: 538248 - DNA, 20 bp, mouse
ggcgagacgcaccggcggga

SEQ ID NO: 538249 - DNA, 20 bp, mouse
ggttcgcggctggagagctg

SEQ ID NO: 538250 - DNA, 20 bp, mouse
ggccgtactggggtcggggc

SEQ ID NO: 538251 - DNA, 20 bp, mouse
gccagggcagcgagacgcac

SEQ ID NO: 538252 - DNA, 20 bp, mouse
gccgcgggaggcgggcatgt

SEQ ID NO: 538253 - DNA, 20 bp, mouse
gggcagcgagacgcaccggc

SEQ ID NO: 538254 - DNA, 20 bp, mouse
ggcggggaaattccagttcg

SEQ ID NO: 538255 - DNA, 20 bp, mouse
gcctacttggaagaggacag

SEQ ID NO: 538256 - DNA, 20 bp, mouse
gcggcggagtgcgagagctg

SEQ ID NO: 538257 - DNA, 20 bp, mouse
gagcacgccgtggggcacca

SEQ ID NO: 538258 - DNA, 20 bp, mouse
ggacatcttgagtcccctgg

SEQ ID NO: 538259 - DNA, 20 bp, mouse
gcccgccgccgtcatgtggt

SEQ ID NO: 538260 - DNA, 20 bp, mouse
gaggaaagctacaagaaagt

SEQ ID NO: 538261 - DNA, 20 bp, mouse
gccgttgcagtagcccccca

SEQ ID NO: 538262 - DNA, 20 bp, mouse
gttgcagtagccccccacgg

SEQ ID NO: 538263 - DNA, 20 bp, mouse
ggccgcctaccacatgacgg

SEQ ID NO: 538264 - DNA, 20 bp, mouse
gcatcgacatgattcggcgt

SEQ ID NO: 538265 - DNA, 20 bp, mouse
gaccgccgcctaccacatga

SEQ ID NO: 538266 - DNA, 20 bp, mouse
gccgccggagccggagctga

SEQ ID NO: 538267 - DNA, 20 bp, mouse
ggccaaggtgccgtcagctc

SEQ ID NO: 538268 - DNA, 20 bp, mouse
ggccgccaccgcgcgcggag

SEQ ID NO: 538269 - DNA, 20 bp, mouse
ggccggagctgacggcacct

SEQ ID NO: 538270 - DNA, 20 bp, mouse
ggtgccgtcagctccggctc

SEQ ID NO: 538271 - DNA, 20 bp, mouse
ggaagagagaggcaccgggt

SEQ ID NO: 538272 - DNA, 20 bp, mouse
gctggtggcgaggaaaaaat

SEQ ID NO: 538273 - DNA, 20 bp, mouse
ggccgctccgcgcgcggtgg

SEQ ID NO: 538274 - DNA, 20 bp, mouse
gaatgagaggacactgtggg

SEQ ID NO: 538275 - DNA, 20 bp, mouse
gggactgatcgctcaggcaa

SEQ ID NO: 538276 - DNA, 20 bp, mouse
gcaaagtcgaagagccccgg

SEQ ID NO: 538277 - DNA, 20 bp, mouse
ggaggaggctgacaaggcgc

SEQ ID NO: 538278 - DNA, 20 bp, mouse
gagcagaggccagaatacca

SEQ ID NO: 538279 - DNA, 20 bp, mouse
ggattcagcttggtaagcag

SEQ ID NO: 538280 - DNA, 20 bp, mouse
gggagccgtaaggagctgga

SEQ ID NO: 538281 - DNA, 20 bp, mouse
gagtcgaagagccccggggg

SEQ ID NO: 538282 - DNA, 20 bp, mouse
gtagacggtgatcttcgggg

SEQ ID NO: 538283 - DNA, 20 bp, mouse
gagatggcgcctaatgagaa

SEQ ID NO: 538284 - DNA, 20 bp, mouse
ggagctgtccccgcagcgcg

SEQ ID NO: 538285 - DNA, 20 bp, mouse
gcaggagactcacccctcaa

SEQ ID NO: 538286 - DNA, 20 bp, mouse
gcaggtcccggccaatggag

SEQ ID NO: 538287 - DNA, 20 bp, mouse
gacccccaggtcccggccaa

SEQ ID NO: 538288 - DNA, 20 bp, mouse
gccggccccagtccttgcag

SEQ ID NO: 538289 - DNA, 20 bp, mouse
ggctcgactccgcaccaccg

SEQ ID NO: 538290 - DNA, 20 bp, mouse
gcagtctaaatcccctccat

SEQ ID NO: 538291 - DNA, 20 bp, mouse
gcttcttctggactccgcgg

SEQ ID NO: 538292 - DNA, 20 bp, mouse
gaacccagacccccaggtcc

SEQ ID NO: 538293 - DNA, 20 bp, mouse
ggtcgagcttttgacagacg

SEQ ID NO: 538294 - DNA, 20 bp, mouse
gcagcatgcagggtgccgag

SEQ ID NO: 538295 - DNA, 20 bp, mouse
ggctcttcttctggactccg

SEQ ID NO: 538296 - DNA, 20 bp, mouse
gcgctgccgccgggccgaag

SEQ ID NO: 538297 - DNA, 20 bp, mouse
gggcccggcggcagcgccag

SEQ ID NO: 538298 - DNA, 20 bp, mouse
ggccagtggagagctgtccg

SEQ ID NO: 538299 - DNA, 20 bp, mouse
ggccgcggacagctctccac

SEQ ID NO: 538300 - DNA, 20 bp, mouse
gcgccgccacttcggcccgg

SEQ ID NO: 538301 - DNA, 20 bp, mouse
gccgagatcccgcagctcgg

SEQ ID NO: 538302 - DNA, 20 bp, mouse
ggccatggccggacacaacg

SEQ ID NO: 538303 - DNA, 20 bp, mouse
gagttcggcggcgtcatgga

SEQ ID NO: 538304 - DNA, 20 bp, mouse
gggccgccgcctgcgaggag

SEQ ID NO: 538305 - DNA, 20 bp, mouse
gcgccgccgccacttcggcc

SEQ ID NO: 538306 - DNA, 20 bp, mouse
gctgccgcgcgccacatcca

SEQ ID NO: 538307 - DNA, 20 bp, mouse
gaggtagcgcggagcaccag

SEQ ID NO: 538308 - DNA, 20 bp, mouse
gcgccacatccagggcagag

SEQ ID NO: 538309 - DNA, 20 bp, mouse
ggggcggcgggcaccatgcg

SEQ ID NO: 538310 - DNA, 20 bp, mouse
gaaggcggccagcatgcagg

SEQ ID NO: 538311 - DNA, 20 bp, mouse
ggggaggctgtccccagggg

SEQ ID NO: 538312 - DNA, 20 bp, mouse
gcagcgtagcctggcgtctg

SEQ ID NO: 538313 - DNA, 20 bp, mouse
gaggtttcacagcgccaggt

SEQ ID NO: 538314 - DNA, 20 bp, mouse
ggcctactctggccccgagg

SEQ ID NO: 538315 - DNA, 20 bp, mouse
ggcgggagcaggctggagta

SEQ ID NO: 538316 - DNA, 20 bp, mouse
gtggtttgagagcagcgaca

SEQ ID NO: 538317 - DNA, 20 bp, mouse
gtgcacctgggagacagtcc

SEQ ID NO: 538318 - DNA, 20 bp, mouse
gaggattcgagcccatctcc

SEQ ID NO: 538319 - DNA, 20 bp, mouse
gtctcccaggtgcaccgaaa

SEQ ID NO: 538320 - DNA, 20 bp, mouse
gatgggctcgaatcctgtgg

SEQ ID NO: 538321 - DNA, 20 bp, mouse
gacttacgtggctcccccac

SEQ ID NO: 538322 - DNA, 20 bp, mouse
gttattagaggggcgactgt

SEQ ID NO: 538323 - DNA, 20 bp, mouse
ggaaagagcgcttacttacg

SEQ ID NO: 538324 - DNA, 20 bp, mouse
ggttcaggttagtcaggtaa

SEQ ID NO: 538325 - DNA, 20 bp, mouse
ggcagtggtgatgaggtagg

SEQ ID NO: 538326 - DNA, 20 bp, mouse
gaccctggacaccccgactg

SEQ ID NO: 538327 - DNA, 20 bp, mouse
gacagcccttgctactcgga

SEQ ID NO: 538328 - DNA, 20 bp, mouse
gaccgcagtcggggtgtcca

SEQ ID NO: 538329 - DNA, 20 bp, mouse
gaaagccctccgagtagcaa

SEQ ID NO: 538330 - DNA, 20 bp, mouse
gggtggccatggccgaggag

SEQ ID NO: 538331 - DNA, 20 bp, mouse
ggtgaagccgaggcgtccag

SEQ ID NO: 538332 - DNA, 20 bp, mouse
ggagtgctggagcgaagccg

SEQ ID NO: 538333 - DNA, 20 bp, mouse
gggatgcgaagcctagggtg

SEQ ID NO: 538334 - DNA, 20 bp, mouse
gggctcactcacacaggtag

SEQ ID NO: 538335 - DNA, 20 bp, mouse
gattaacagcccttgctact

SEQ ID NO: 538336 - DNA, 20 bp, mouse
ggagccccgagagccacggg

SEQ ID NO: 538337 - DNA, 20 bp, mouse
gagcggagccccgagagcca

SEQ ID NO: 538338 - DNA, 20 bp, mouse
gcgagagccacgggtggagg

SEQ ID NO: 538339 - DNA, 20 bp, mouse
gagcggaggagggatgctta

SEQ ID NO: 538340 - DNA, 20 bp, mouse
gccccgagagccacgggtgg

SEQ ID NO: 538341 - DNA, 20 bp, mouse
ggcgggtggccgcagtcctt

SEQ ID NO: 538342 - DNA, 20 bp, mouse
gcactcgccggaccctagga

SEQ ID NO: 538343 - DNA, 20 bp, mouse
gggcccggtgatagcaaaag

SEQ ID NO: 538344 - DNA, 20 bp, mouse
gcaaaagcggcgcgcagcgg

SEQ ID NO: 538345 - DNA, 20 bp, mouse
gcagagcccgacaaagcagg

SEQ ID NO: 538346 - DNA, 20 bp, mouse
gctgcgggcgccagaggagt

SEQ ID NO: 538347 - DNA, 20 bp, mouse
gccctaaaatcggagaagag

SEQ ID NO: 538348 - DNA, 20 bp, mouse
gcagctgaggcccctaaaat

SEQ ID NO: 538349 - DNA, 20 bp, mouse
gtcggagccggcagccagga

SEQ ID NO: 538350 - DNA, 20 bp, mouse
gggccggcgagaattgtcaa

SEQ ID NO: 538351 - DNA, 20 bp, mouse
gccctgagcgaagagaacga

SEQ ID NO: 538352 - DNA, 20 bp, mouse
gaggggcgcccggcaccagg

SEQ ID NO: 538353 - DNA, 20 bp, mouse
gccggaggcgactgcagacg

SEQ ID NO: 538354 - DNA, 20 bp, mouse
gctcgccggcctctccccag

SEQ ID NO: 538355 - DNA, 20 bp, mouse
ggccagcccagaggggaaga

SEQ ID NO: 538356 - DNA, 20 bp, mouse
ggccaaactgaccctctcgg

SEQ ID NO: 538357 - DNA, 20 bp, mouse
gccgaactgtcaggcccaga

SEQ ID NO: 538358 - DNA, 20 bp, mouse
gctggccaaactgaccctct

SEQ ID NO: 538359 - DNA, 20 bp, mouse
ggttcggatgaagctctcaa

SEQ ID NO: 538360 - DNA, 20 bp, mouse
ggcgtcccccagctaaagag

SEQ ID NO: 538361 - DNA, 20 bp, mouse
gaagggaagagccgccgaga

SEQ ID NO: 538362 - DNA, 20 bp, mouse
ggccgccgagagggtcagtt

SEQ ID NO: 538363 - DNA, 20 bp, mouse
gggaggggaagtaggctcgt

SEQ ID NO: 538364 - DNA, 20 bp, mouse
ggagcttcatccgaactgtc

SEQ ID NO: 538365 - DNA, 20 bp, mouse
gcgtggctcggaggggaagt

SEQ ID NO: 538366 - DNA, 20 bp, mouse
gtgggcggcggtcagagaga

SEQ ID NO: 538367 - DNA, 20 bp, mouse
gaaggcagggatactaaggg

SEQ ID NO: 538368 - DNA, 20 bp, mouse
gatactaagggcggcgggag

SEQ ID NO: 538369 - DNA, 20 bp, mouse
gagagaaggcagggatacta

SEQ ID NO: 538370 - DNA, 20 bp, mouse
ggggaaagcgagaggaccga

SEQ ID NO: 538371 - DNA, 20 bp, mouse
gggctgttgcgctgaatggg

SEQ ID NO: 538372 - DNA, 20 bp, mouse
gcggcggtcagagagaaggc

SEQ ID NO: 538373 - DNA, 20 bp, mouse
gtgttgcgctgaatgggcgg

SEQ ID NO: 538374 - DNA, 20 bp, mouse
ggcagggatactaagggcgg

SEQ ID NO: 538375 - DNA, 20 bp, mouse
ggaacgccgacggcccctac

SEQ ID NO: 538376 - DNA, 20 bp, mouse
gtgcccgctgggcctaagga

SEQ ID NO: 538377 - DNA, 20 bp, mouse
gtctctgcccgctgggccta

SEQ ID NO: 538378 - DNA, 20 bp, mouse
gtcaggtgtccagagaaggt

SEQ ID NO: 538379 - DNA, 20 bp, mouse
gaaaccgggtgctctgagta

SEQ ID NO: 538380 - DNA, 20 bp, mouse
gtggcccagaacctcatgac

SEQ ID NO: 538381 - DNA, 20 bp, mouse
gacccctccttaggcccagc

SEQ ID NO: 538382 - DNA, 20 bp, mouse
gatggaaagcacccctcctt

SEQ ID NO: 538383 - DNA, 20 bp, mouse
ggcagtctgaggctcggggt

SEQ ID NO: 538384 - DNA, 20 bp, mouse
gcggcccttcctcagagatg

SEQ ID NO: 538385 - DNA, 20 bp, mouse
ggaggaagggccgagccaga

SEQ ID NO: 538386 - DNA, 20 bp, mouse
gcccacgtggaggagaaccg

SEQ ID NO: 538387 - DNA, 20 bp, mouse
gtgtccggcgtgatgtccac

SEQ ID NO: 538388 - DNA, 20 bp, mouse
gacgtggaggagaaccgagg

SEQ ID NO: 538389 - DNA, 20 bp, mouse
gtccacgtggggacgcagga

SEQ ID NO: 538390 - DNA, 20 bp, mouse
gggtaccccacgcggagacc

SEQ ID NO: 538391 - DNA, 20 bp, mouse
gctgggtccccggaacaccg

SEQ ID NO: 538392 - DNA, 20 bp, mouse
gggcggcaggcgacgtgcag

SEQ ID NO: 538393 - DNA, 20 bp, mouse
gtaggtgtacgcgcacgggg

SEQ ID NO: 538394 - DNA, 20 bp, mouse
gtccactggcacgtcgaacg

SEQ ID NO: 538395 - DNA, 20 bp, mouse
gtcgtacagttccaggatga

SEQ ID NO: 538396 - DNA, 20 bp, mouse
gtatgtttggagagctatga

SEQ ID NO: 538397 - DNA, 20 bp, mouse
gagagctatgatggcatgtg

SEQ ID NO: 538398 - DNA, 20 bp, mouse
gcatgtggccaaattatgtt

SEQ ID NO: 538399 - DNA, 20 bp, mouse
ggtgtggtccacaggggatc

SEQ ID NO: 538400 - DNA, 20 bp, mouse
gcgttccggatgtcagacca

SEQ ID NO: 538401 - DNA, 20 bp, mouse
gcagagagtcaatggggcac

SEQ ID NO: 538402 - DNA, 20 bp, mouse
gtagctctccaaacataatt

SEQ ID NO: 538403 - DNA, 20 bp, mouse
gcatatgccgctccaccaac

SEQ ID NO: 538404 - DNA, 20 bp, mouse
gctaactttggcaagattag

SEQ ID NO: 538405 - DNA, 20 bp, mouse
ggtccccagaatatcattga

SEQ ID NO: 538406 - DNA, 20 bp, mouse
gctcctggctctgcgcgcca

SEQ ID NO: 538407 - DNA, 20 bp, mouse
gcgggcgggagggagatccg

SEQ ID NO: 538408 - DNA, 20 bp, mouse
ggagagtgatgatccgccgg

SEQ ID NO: 538409 - DNA, 20 bp, mouse
gtctcgagctgggatggacg

SEQ ID NO: 538410 - DNA, 20 bp, mouse
ggatccagccggaatcctcg

SEQ ID NO: 538411 - DNA, 20 bp, mouse
gctcgaggcagaggtcggtg

SEQ ID NO: 538412 - DNA, 20 bp, mouse
gccagccggaatcctcgggg

SEQ ID NO: 538413 - DNA, 20 bp, mouse
gggatcatcactctcgagct

SEQ ID NO: 538414 - DNA, 20 bp, mouse
ggaaatgctcagtagccagg

SEQ ID NO: 538415 - DNA, 20 bp, mouse
ggccaggagtccgggcctcc

SEQ ID NO: 538416 - DNA, 20 bp, mouse
ggctgccggagagctgatct

SEQ ID NO: 538417 - DNA, 20 bp, mouse
ggatctcggagattcgggtg

SEQ ID NO: 538418 - DNA, 20 bp, mouse
gatctccgagatcagctctc

SEQ ID NO: 538419 - DNA, 20 bp, mouse
gcttggcctggaggcgatat

SEQ ID NO: 538420 - DNA, 20 bp, mouse
gggcctggaggcgatatggg

SEQ ID NO: 538421 - DNA, 20 bp, mouse
ggagctgatctcggagattc

SEQ ID NO: 538422 - DNA, 20 bp, mouse
ggaccacccatatcgcctcc

SEQ ID NO: 538423 - DNA, 20 bp, mouse
ggggaggtcaggggtaccta

SEQ ID NO: 538424 - DNA, 20 bp, mouse
ggggtgcggagcccttggcc

SEQ ID NO: 538425 - DNA, 20 bp, mouse
gaaacgattgaaccaggcca

SEQ ID NO: 538426 - DNA, 20 bp, mouse
gctgtggagaaagcgaccgt

SEQ ID NO: 538427 - DNA, 20 bp, mouse
gccgctggctccgctctatc

SEQ ID NO: 538428 - DNA, 20 bp, mouse
gaagaggagagagaaaaccc

SEQ ID NO: 538429 - DNA, 20 bp, mouse
gctagcaaagccggatagag

SEQ ID NO: 538430 - DNA, 20 bp, mouse
gccgcgcgacggcccctgca

SEQ ID NO: 538431 - DNA, 20 bp, mouse
gcctcctcagcacaagccgg

SEQ ID NO: 538432 - DNA, 20 bp, mouse
ggaagagaaagcggtcacgg

SEQ ID NO: 538433 - DNA, 20 bp, mouse
gggtcccggggccaaagaat

SEQ ID NO: 538434 - DNA, 20 bp, mouse
ggagggaatgaaagagcggt

SEQ ID NO: 538435 - DNA, 20 bp, mouse
gcagacacagggaaccgccc

SEQ ID NO: 538436 - DNA, 20 bp, mouse
gcagctggcgcgtggtcctc

SEQ ID NO: 538437 - DNA, 20 bp, mouse
gggtaggtgcaggaggcggg

SEQ ID NO: 538438 - DNA, 20 bp, mouse
gcgtggtcctccggcttggt

SEQ ID NO: 538439 - DNA, 20 bp, mouse
gatcctgggtgggtgtagta

SEQ ID NO: 538440 - DNA, 20 bp, mouse
gcttggtaggtgcaggaggc

SEQ ID NO: 538441 - DNA, 20 bp, mouse
gcctgcacctaccaagccgg

SEQ ID NO: 538442 - DNA, 20 bp, mouse
gcgagcccggaagccgagag

SEQ ID NO: 538443 - DNA, 20 bp, mouse
gggcgcgtggtcctccggct

SEQ ID NO: 538444 - DNA, 20 bp, mouse
gtcccagaggcatcctgggt

SEQ ID NO: 538445 - DNA, 20 bp, mouse
gctgcccgctctcggcttcc

SEQ ID NO: 538446 - DNA, 20 bp, mouse
gccttctctgaagagatcag

SEQ ID NO: 538447 - DNA, 20 bp, mouse
ggtcagtggcaggtcagctg

SEQ ID NO: 538448 - DNA, 20 bp, mouse
gtcagctgaggctgagacct

SEQ ID NO: 538449 - DNA, 20 bp, mouse
ggaatgccttgggtagtcag

SEQ ID NO: 538450 - DNA, 20 bp, mouse
gtatcacactgatcacgcca

SEQ ID NO: 538451 - DNA, 20 bp, mouse
gcttggtctgtccagagctg

SEQ ID NO: 538452 - DNA, 20 bp, mouse
gtcctggggactacaggatg

SEQ ID NO: 538453 - DNA, 20 bp, mouse
gggtctgtcactcccagccc

SEQ ID NO: 538454 - DNA, 20 bp, mouse
gaagctgctagggagggtag

SEQ ID NO: 538455 - DNA, 20 bp, mouse
ggctgctccagggtgctaaa

SEQ ID NO: 538456 - DNA, 20 bp, mouse
gagcaagagaagaacccacc

SEQ ID NO: 538457 - DNA, 20 bp, mouse
gtgcttggccaggtacctcg

SEQ ID NO: 538458 - DNA, 20 bp, mouse
gagagacaactgtagaaaaa

SEQ ID NO: 538459 - DNA, 20 bp, mouse
gtacctcggggagagggaat

SEQ ID NO: 538460 - DNA, 20 bp, mouse
gggaaacttggtttgagggt

SEQ ID NO: 538461 - DNA, 20 bp, mouse
ggtctccatagtaaatacaa

SEQ ID NO: 538462 - DNA, 20 bp, mouse
ggcaatccagttgccttcga

SEQ ID NO: 538463 - DNA, 20 bp, mouse
ggcaggcaaatcagcccaat

SEQ ID NO: 538464 - DNA, 20 bp, mouse
gtttctacagttgtctctca

SEQ ID NO: 538465 - DNA, 20 bp, mouse
gaatacaaaggcgttctcta

SEQ ID NO: 538466 - DNA, 20 bp, mouse
gcagcctgttgagctgacgg

SEQ ID NO: 538467 - DNA, 20 bp, mouse
gggatgacctcagggttgga

SEQ ID NO: 538468 - DNA, 20 bp, mouse
gctgacggtggatgacctca

SEQ ID NO: 538469 - DNA, 20 bp, mouse
gtagctgcagtccaggtcca

SEQ ID NO: 538470 - DNA, 20 bp, mouse
gccaggccacaaggctgtac

SEQ ID NO: 538471 - DNA, 20 bp, mouse
gtatgagccctccaaccctg

SEQ ID NO: 538472 - DNA, 20 bp, mouse
ggaacagcctgttgagctga

SEQ ID NO: 538473 - DNA, 20 bp, mouse
gaggtccttcctcccgacca

SEQ ID NO: 538474 - DNA, 20 bp, mouse
ggcatctggggcccaagaga

SEQ ID NO: 538475 - DNA, 20 bp, mouse
gttcctcccgaccatggacc

SEQ ID NO: 538476 - DNA, 20 bp, mouse
gctggcgttggtacagtaag

SEQ ID NO: 538477 - DNA, 20 bp, mouse
ggtaccaacgccagatctca

SEQ ID NO: 538478 - DNA, 20 bp, mouse
gagaccttgagatctggcgt

SEQ ID NO: 538479 - DNA, 20 bp, mouse
gtgacttagaccttgagatc

SEQ ID NO: 538480 - DNA, 20 bp, mouse
gggagtccagggaaaatggt

SEQ ID NO: 538481 - DNA, 20 bp, mouse
gctgtgactgggcggcttgg

SEQ ID NO: 538482 - DNA, 20 bp, mouse
gtgaaaacccccggagtcca

SEQ ID NO: 538483 - DNA, 20 bp, mouse
gccccggagtccagggaaaa

SEQ ID NO: 538484 - DNA, 20 bp, mouse
gttcactgagggctgtgact

SEQ ID NO: 538485 - DNA, 20 bp, mouse
ggaaagtctgtccgatggag

SEQ ID NO: 538486 - DNA, 20 bp, mouse
gtagcagagaagcaatgggt

SEQ ID NO: 538487 - DNA, 20 bp, mouse
ggggttataggaataagatt

SEQ ID NO: 538488 - DNA, 20 bp, mouse
gaggaataagattgggacag

SEQ ID NO: 538489 - DNA, 20 bp, mouse
gctcattgacaagcaaaagg

SEQ ID NO: 538490 - DNA, 20 bp, mouse
ggctgtagacggcaacatgg

SEQ ID NO: 538491 - DNA, 20 bp, mouse
gacctacctggaagaactcg

SEQ ID NO: 538492 - DNA, 20 bp, mouse
ggcccacatggggacaaggg

SEQ ID NO: 538493 - DNA, 20 bp, mouse
gacctgtgggagcgaggaca

SEQ ID NO: 538494 - DNA, 20 bp, mouse
ggtaggtagacagtcgatag

SEQ ID NO: 538495 - DNA, 20 bp, mouse
gctggctgtagacggcaaca

SEQ ID NO: 538496 - DNA, 20 bp, mouse
gctaaagagcatcaactgga

SEQ ID NO: 538497 - DNA, 20 bp, mouse
gaaactaagtatgatgacta

SEQ ID NO: 538498 - DNA, 20 bp, mouse
gattcctaaagagcatcaac

SEQ ID NO: 538499 - DNA, 20 bp, mouse
ggtactgttcctcttactgc

SEQ ID NO: 538500 - DNA, 20 bp, mouse
gtgactcacagaactgtcca

SEQ ID NO: 538501 - DNA, 20 bp, mouse
gcttaatgcatgaagggcca

SEQ ID NO: 538502 - DNA, 20 bp, mouse
ggtatggttgagagtaggtc

SEQ ID NO: 538503 - DNA, 20 bp, mouse
gcttgagtatggttgagagt

SEQ ID NO: 538504 - DNA, 20 bp, mouse
gatagcaaaacctggcataa

SEQ ID NO: 538505 - DNA, 20 bp, mouse
gaatgaaattcacttaacat

SEQ ID NO: 538506 - DNA, 20 bp, mouse
gagaggagcagggtgagtag

SEQ ID NO: 538507 - DNA, 20 bp, mouse
gtgcctgccttcctgaaaat

SEQ ID NO: 538508 - DNA, 20 bp, mouse
gactccagtgggccccatag

SEQ ID NO: 538509 - DNA, 20 bp, mouse
gctctgatgggtgatagact

SEQ ID NO: 538510 - DNA, 20 bp, mouse
gctccattcccagtgttcag

SEQ ID NO: 538511 - DNA, 20 bp, mouse
gctctggcccattttcagga

SEQ ID NO: 538512 - DNA, 20 bp, mouse
ggagaccagtttcttagctg

SEQ ID NO: 538513 - DNA, 20 bp, mouse
gtgggccccatagaggagca

SEQ ID NO: 538514 - DNA, 20 bp, mouse
ggatctcggcctgaaaacca

SEQ ID NO: 538515 - DNA, 20 bp, mouse
gacttagacctgggaggata

SEQ ID NO: 538516 - DNA, 20 bp, mouse
gtgcccaacttactgaaagt

SEQ ID NO: 538517 - DNA, 20 bp, mouse
gggcccactttcagtaagtt

SEQ ID NO: 538518 - DNA, 20 bp, mouse
gagaggaagtgcatctgtgc

SEQ ID NO: 538519 - DNA, 20 bp, mouse
ggtctggcctcacctcacta

SEQ ID NO: 538520 - DNA, 20 bp, mouse
gcatactccttagtgaggtg

SEQ ID NO: 538521 - DNA, 20 bp, mouse
gctgcagattcagggcagac

SEQ ID NO: 538522 - DNA, 20 bp, mouse
ggaagagtggggtaagtact

SEQ ID NO: 538523 - DNA, 20 bp, mouse
gggtcctggtttcaaggaca

SEQ ID NO: 538524 - DNA, 20 bp, mouse
gtgatgagttattcagaggg

SEQ ID NO: 538525 - DNA, 20 bp, mouse
gtatgacaggcacaattaca

SEQ ID NO: 538526 - DNA, 20 bp, mouse
ggactgagtgaaagctggtg

SEQ ID NO: 538527 - DNA, 20 bp, mouse
gtgagtgaaagctggtgtgg

SEQ ID NO: 538528 - DNA, 20 bp, mouse
gctcacagtgctgccggtgt

SEQ ID NO: 538529 - DNA, 20 bp, mouse
gcagtgctgccggtgtagga

SEQ ID NO: 538530 - DNA, 20 bp, mouse
gaccccagcagtcagacagg

SEQ ID NO: 538531 - DNA, 20 bp, mouse
gtaagagtgccttcctacac

SEQ ID NO: 538532 - DNA, 20 bp, mouse
gtgtgagactgagtgaaagc

SEQ ID NO: 538533 - DNA, 20 bp, mouse
gattgaagaccagtcagcat

SEQ ID NO: 538534 - DNA, 20 bp, mouse
gccctcctgtctgactgctg

SEQ ID NO: 538535 - DNA, 20 bp, mouse
ggctaaagatgcctttgaac

SEQ ID NO: 538536 - DNA, 20 bp, mouse
gtgaggtgcggcaggagaca

SEQ ID NO: 538537 - DNA, 20 bp, mouse
ggtacccaaggctgctatct

SEQ ID NO: 538538 - DNA, 20 bp, mouse
gtactcagggtggcagaggg

SEQ ID NO: 538539 - DNA, 20 bp, mouse
gaaacagcatctactcaggg

SEQ ID NO: 538540 - DNA, 20 bp, mouse
gggcaggtcttagcagcagg

SEQ ID NO: 538541 - DNA, 20 bp, mouse
ggccttgggtacaaataaag

SEQ ID NO: 538542 - DNA, 20 bp, mouse
gcagagtggataaaaggtcc

SEQ ID NO: 538543 - DNA, 20 bp, mouse
gtcacccagatagcagcctt

SEQ ID NO: 538544 - DNA, 20 bp, mouse
gagatgctgtttaagtccta

SEQ ID NO: 538545 - DNA, 20 bp, mouse
gagggtggactgcctgtgag

SEQ ID NO: 538546 - DNA, 20 bp, mouse
gtctggtcagacacgagtcc

SEQ ID NO: 538547 - DNA, 20 bp, mouse
gccattaacacaatcagatg

SEQ ID NO: 538548 - DNA, 20 bp, mouse
ggtcctagcctcgtcaccat

SEQ ID NO: 538549 - DNA, 20 bp, mouse
gctaagggtaccccatagat

SEQ ID NO: 538550 - DNA, 20 bp, mouse
gcgtgtctgaccagaaccca

SEQ ID NO: 538551 - DNA, 20 bp, mouse
gtcggggcttaggtccacac

SEQ ID NO: 538552 - DNA, 20 bp, mouse
gagccccgagaccctcgaaa

SEQ ID NO: 538553 - DNA, 20 bp, mouse
gaagctggctcagtatctag

SEQ ID NO: 538554 - DNA, 20 bp, mouse
gctaatattgaaacctctaa

SEQ ID NO: 538555 - DNA, 20 bp, mouse
gagacgtatgtcctgagcca

SEQ ID NO: 538556 - DNA, 20 bp, mouse
gcaagcatacaagagaaaag

SEQ ID NO: 538557 - DNA, 20 bp, mouse
gcagctgctgccctatatta

SEQ ID NO: 538558 - DNA, 20 bp, mouse
gaaaaatgatgcccacacac

SEQ ID NO: 538559 - DNA, 20 bp, mouse
gccaggttagtccttaatat

SEQ ID NO: 538560 - DNA, 20 bp, mouse
ggctgggctcaagacattgg

SEQ ID NO: 538561 - DNA, 20 bp, mouse
gggaggagccggtgctaatg

SEQ ID NO: 538562 - DNA, 20 bp, mouse
gttagctgggctcaagacat

SEQ ID NO: 538563 - DNA, 20 bp, mouse
ggagtagccaggatgcttta

SEQ ID NO: 538564 - DNA, 20 bp, mouse
ggtccaaataaccatgacaa

SEQ ID NO: 538565 - DNA, 20 bp, mouse
gagagtaccataaagcatcc

SEQ ID NO: 538566 - DNA, 20 bp, mouse
ggactaacttggaagtccta

SEQ ID NO: 538567 - DNA, 20 bp, mouse
gcaggtattaaggactaact

SEQ ID NO: 538568 - DNA, 20 bp, mouse
ggcccagccaacagtctctt

SEQ ID NO: 538569 - DNA, 20 bp, mouse
gaagatactttgtggtactg

SEQ ID NO: 538570 - DNA, 20 bp, mouse
ggggaagtcaagatactttg

SEQ ID NO: 538571 - DNA, 20 bp, mouse
ggtttgtctacacatgaggg

SEQ ID NO: 538572 - DNA, 20 bp, mouse
gcaatgtgtagacatcatga

SEQ ID NO: 538573 - DNA, 20 bp, mouse
gatctgttgtcatagttatt

SEQ ID NO: 538574 - DNA, 20 bp, mouse
gaagtctgcagacttgtctt

SEQ ID NO: 538575 - DNA, 20 bp, mouse
gggagaagaatgtgctcttt

SEQ ID NO: 538576 - DNA, 20 bp, mouse
gttgctgactcaccgccctg

SEQ ID NO: 538577 - DNA, 20 bp, mouse
gctggtgtgtcaaggcacga

SEQ ID NO: 538578 - DNA, 20 bp, mouse
gaaagaaaataagtgcatac

SEQ ID NO: 538579 - DNA, 20 bp, mouse
ggggtagccaagacactttc

SEQ ID NO: 538580 - DNA, 20 bp, mouse
ggtgtgtcaaggcacgaggg

SEQ ID NO: 538581 - DNA, 20 bp, mouse
gcagtttgcatcctgtgtct

SEQ ID NO: 538582 - DNA, 20 bp, mouse
gtttctttattatttgagga

SEQ ID NO: 538583 - DNA, 20 bp, mouse
gcagtcctgctgactttatc

SEQ ID NO: 538584 - DNA, 20 bp, mouse
gggatatttgagcatgtaga

SEQ ID NO: 538585 - DNA, 20 bp, mouse
gtttagacttactttttagc

SEQ ID NO: 538586 - DNA, 20 bp, mouse
gcaatggccctagagtagat

SEQ ID NO: 538587 - DNA, 20 bp, mouse
gttcatgcccatctactcta

SEQ ID NO: 538588 - DNA, 20 bp, mouse
gatgggatattcttatgctt

SEQ ID NO: 538589 - DNA, 20 bp, mouse
gtctcttccttaagacacga

SEQ ID NO: 538590 - DNA, 20 bp, mouse
gaggcaggatctcatggaga

SEQ ID NO: 538591 - DNA, 20 bp, mouse
gctcttccaagtaccacata

SEQ ID NO: 538592 - DNA, 20 bp, mouse
gaatcttccagaagatgaat

SEQ ID NO: 538593 - DNA, 20 bp, mouse
gatgaataggcaggatctca

SEQ ID NO: 538594 - DNA, 20 bp, mouse
gttctgattttggccttatg

SEQ ID NO: 538595 - DNA, 20 bp, mouse
gtatgaggagaagaaagcct

SEQ ID NO: 538596 - DNA, 20 bp, mouse
gggtatgacctggaagacct

SEQ ID NO: 538597 - DNA, 20 bp, mouse
gtatatggcaactggaacgg

SEQ ID NO: 538598 - DNA, 20 bp, mouse
gcaggtcataccttaatata

SEQ ID NO: 538599 - DNA, 20 bp, mouse
gttctggtgggtcgaaaaaa

SEQ ID NO: 538600 - DNA, 20 bp, mouse
gagaggagcagatactcctg

SEQ ID NO: 538601 - DNA, 20 bp, mouse
gaagtaaatccaaataacca

SEQ ID NO: 538602 - DNA, 20 bp, mouse
ggagcaagtgttggatgatt

SEQ ID NO: 538603 - DNA, 20 bp, mouse
gaaattactgctataagtct

SEQ ID NO: 538604 - DNA, 20 bp, mouse
gatccaaataaccacggcag

SEQ ID NO: 538605 - DNA, 20 bp, mouse
gatttggatttactttagct

SEQ ID NO: 538606 - DNA, 20 bp, mouse
ggagtcagtgagtccaagag

SEQ ID NO: 538607 - DNA, 20 bp, mouse
gcagcagaagtagaaagtgt

SEQ ID NO: 538608 - DNA, 20 bp, mouse
gatggtgtttctgcaaggca

SEQ ID NO: 538609 - DNA, 20 bp, mouse
gttgtagattcttcccctct

SEQ ID NO: 538610 - DNA, 20 bp, mouse
gtgcaaggcatggctggaat

SEQ ID NO: 538611 - DNA, 20 bp, mouse
gaattttttggagcaatcat

SEQ ID NO: 538612 - DNA, 20 bp, mouse
gatgatctcgatataacttt

SEQ ID NO: 538613 - DNA, 20 bp, mouse
gctcctctataggagccgag

SEQ ID NO: 538614 - DNA, 20 bp, mouse
ggaggggctgggccactctc

SEQ ID NO: 538615 - DNA, 20 bp, mouse
gagcccctcggctcctatag

SEQ ID NO: 538616 - DNA, 20 bp, mouse
gagaccagtgagagctaagg

SEQ ID NO: 538617 - DNA, 20 bp, mouse
gaagtaggatctgcacttag

SEQ ID NO: 538618 - DNA, 20 bp, mouse
gttaccggtttgcagaaagt

SEQ ID NO: 538619 - DNA, 20 bp, mouse
gcacttagaggtgagctcct

SEQ ID NO: 538620 - DNA, 20 bp, mouse
gaataagacagaaattaccc

SEQ ID NO: 538621 - DNA, 20 bp, mouse
gctgcctccttagctctcac

SEQ ID NO: 538622 - DNA, 20 bp, mouse
ggcaaccaagaaatccaggt

SEQ ID NO: 538623 - DNA, 20 bp, mouse
gtttagaccagtgagagcta

SEQ ID NO: 538624 - DNA, 20 bp, mouse
ggaaggcaaccaagaaatcc

SEQ ID NO: 538625 - DNA, 20 bp, mouse
gcaaaatgtggcccagacat

SEQ ID NO: 538626 - DNA, 20 bp, mouse
gcagggtggacatagaagat

SEQ ID NO: 538627 - DNA, 20 bp, mouse
gaggctcccaagttaagcac

SEQ ID NO: 538628 - DNA, 20 bp, mouse
gtacaacccgtgcttaactt

SEQ ID NO: 538629 - DNA, 20 bp, mouse
ggctaaactggtctcattct

SEQ ID NO: 538630 - DNA, 20 bp, mouse
ggagagcacagacccacgta

SEQ ID NO: 538631 - DNA, 20 bp, mouse
gagtacaagacctgctctag

SEQ ID NO: 538632 - DNA, 20 bp, mouse
gagcagaggtgatcctttct

SEQ ID NO: 538633 - DNA, 20 bp, mouse
ggagaactttcaagttaact

SEQ ID NO: 538634 - DNA, 20 bp, mouse
ggaggctccagcggcatcca

SEQ ID NO: 538635 - DNA, 20 bp, mouse
gcagactcagtccctggtgt

SEQ ID NO: 538636 - DNA, 20 bp, mouse
ggcacctacttgatagaagg

SEQ ID NO: 538637 - DNA, 20 bp, mouse
ggtacacagtctctacaaat

SEQ ID NO: 538638 - DNA, 20 bp, mouse
gtttaaagggaagaaatctc

SEQ ID NO: 538639 - DNA, 20 bp, mouse
gttcccttaggctgatgaga

SEQ ID NO: 538640 - DNA, 20 bp, mouse
gaaaagtctatatttccctt

SEQ ID NO: 538641 - DNA, 20 bp, mouse
ggctatttgagttgcatctg

SEQ ID NO: 538642 - DNA, 20 bp, mouse
ggtggcacctacttgataga

SEQ ID NO: 538643 - DNA, 20 bp, mouse
ggagccatctcatcagccta

SEQ ID NO: 538644 - DNA, 20 bp, mouse
ggttcctccttctatcaagt

SEQ ID NO: 538645 - DNA, 20 bp, mouse
ggcaactcaaatagctgcct

SEQ ID NO: 538646 - DNA, 20 bp, mouse
gtgatggactcatctgggta

SEQ ID NO: 538647 - DNA, 20 bp, mouse
gggtcactgtcccaagatga

SEQ ID NO: 538648 - DNA, 20 bp, mouse
gcagatgagtccatcatctt

SEQ ID NO: 538649 - DNA, 20 bp, mouse
gtacacacattatccaggaa

SEQ ID NO: 538650 - DNA, 20 bp, mouse
gagaaaggagaggtaagtat

SEQ ID NO: 538651 - DNA, 20 bp, mouse
gcattatccaggaaaggcat

SEQ ID NO: 538652 - DNA, 20 bp, mouse
gaggtaagtatggggagaaa

SEQ ID NO: 538653 - DNA, 20 bp, mouse
gaagaaagaatctcctactt

SEQ ID NO: 538654 - DNA, 20 bp, mouse
gtaaacttaaacctatctcc

SEQ ID NO: 538655 - DNA, 20 bp, mouse
gccatatcccatgcctttcc

SEQ ID NO: 538656 - DNA, 20 bp, mouse
gtgcagttgttgcttgaaaa

SEQ ID NO: 538657 - DNA, 20 bp, mouse
gcagtataaagataaaagta

SEQ ID NO: 538658 - DNA, 20 bp, mouse
gtgttgaaaatttgggacaa

SEQ ID NO: 538659 - DNA, 20 bp, mouse
gtttaactaactggggaaca

SEQ ID NO: 538660 - DNA, 20 bp, mouse
gatagaacctacaacttaat

SEQ ID NO: 538661 - DNA, 20 bp, mouse
gattctcagtgttgaaaatt

SEQ ID NO: 538662 - DNA, 20 bp, mouse
gcttaataggtgtgcaaggc

SEQ ID NO: 538663 - DNA, 20 bp, mouse
gtgcacacctattaagttgt

SEQ ID NO: 538664 - DNA, 20 bp, mouse
gtaaaagtatggatagagtt

SEQ ID NO: 538665 - DNA, 20 bp, mouse
gtatgtagttctgacgggtc

SEQ ID NO: 538666 - DNA, 20 bp, mouse
gtagatgagtcaaccatctt

SEQ ID NO: 538667 - DNA, 20 bp, mouse
gccaagacaggtatgggata

SEQ ID NO: 538668 - DNA, 20 bp, mouse
gaggagaggtaagtgagtat

SEQ ID NO: 538669 - DNA, 20 bp, mouse
gaaatgatctcagactctag

SEQ ID NO: 538670 - DNA, 20 bp, mouse
gcattatccaagacaggtat

SEQ ID NO: 538671 - DNA, 20 bp, mouse
gtaatcttagtccaggagag

SEQ ID NO: 538672 - DNA, 20 bp, mouse
gtacacacattatccaagac

SEQ ID NO: 538673 - DNA, 20 bp, mouse
gcctcatattgaacaggatg

SEQ ID NO: 538674 - DNA, 20 bp, mouse
gcttgggaggactgccttag

SEQ ID NO: 538675 - DNA, 20 bp, mouse
gatgtttgattgatagtctt

SEQ ID NO: 538676 - DNA, 20 bp, mouse
gcccgtcgccgtggcccgga

SEQ ID NO: 538677 - DNA, 20 bp, mouse
gcgagcgagccggggaagct

SEQ ID NO: 538678 - DNA, 20 bp, mouse
gaccagggcctaggcaacct

SEQ ID NO: 538679 - DNA, 20 bp, mouse
ggcgctgaatacaggcctac

SEQ ID NO: 538680 - DNA, 20 bp, mouse
gggggaagctcggagccagc

SEQ ID NO: 538681 - DNA, 20 bp, mouse
gagcaaagacccgcagaagg

SEQ ID NO: 538682 - DNA, 20 bp, mouse
gacgcaggcctccttccctc

SEQ ID NO: 538683 - DNA, 20 bp, mouse
gccgggcggggtgccagagt

SEQ ID NO: 538684 - DNA, 20 bp, mouse
gcctgggtaaaggcctaact

SEQ ID NO: 538685 - DNA, 20 bp, mouse
ggcaaagtgaagctgccagt

SEQ ID NO: 538686 - DNA, 20 bp, mouse
gctgaggaccaaggagaatg

SEQ ID NO: 538687 - DNA, 20 bp, mouse
gctccctgcttgccgggtca

SEQ ID NO: 538688 - DNA, 20 bp, mouse
gggtcatggctgtgccaaac

SEQ ID NO: 538689 - DNA, 20 bp, mouse
gcaccctcggggcaacctct

SEQ ID NO: 538690 - DNA, 20 bp, mouse
ggggcgaccggtaagtgtta

SEQ ID NO: 538691 - DNA, 20 bp, mouse
gccgggagatcccagttgaa

SEQ ID NO: 538692 - DNA, 20 bp, mouse
gaatgaggcatgcttatagg

SEQ ID NO: 538693 - DNA, 20 bp, mouse
ggttatcttagccatgtcta

SEQ ID NO: 538694 - DNA, 20 bp, mouse
gatccggttaccagtcggtt

SEQ ID NO: 538695 - DNA, 20 bp, mouse
gggagactacctgccaggga

SEQ ID NO: 538696 - DNA, 20 bp, mouse
gcgcctctgtgggaaaggag

SEQ ID NO: 538697 - DNA, 20 bp, mouse
gagtgcagtgagcacgacgt

SEQ ID NO: 538698 - DNA, 20 bp, mouse
gacccaccgagatgatgatt

SEQ ID NO: 538699 - DNA, 20 bp, mouse
gggcatggtttcttttccca

SEQ ID NO: 538700 - DNA, 20 bp, mouse
gaaactcctgcgagttccct

SEQ ID NO: 538701 - DNA, 20 bp, mouse
gcttttcccagggaactcgc

SEQ ID NO: 538702 - DNA, 20 bp, mouse
ggactcagatgggaccaccg

SEQ ID NO: 538703 - DNA, 20 bp, mouse
ggagggatggtatcacacag

SEQ ID NO: 538704 - DNA, 20 bp, mouse
ggagctggtacccgaggtgt

SEQ ID NO: 538705 - DNA, 20 bp, mouse
gcgctctcattcgcctctgt

SEQ ID NO: 538706 - DNA, 20 bp, mouse
ggccggccaggacgcactac

SEQ ID NO: 538707 - DNA, 20 bp, mouse
gtaccagcagctccgtgaca

SEQ ID NO: 538708 - DNA, 20 bp, mouse
gggtagccggtagtgcgtcc

SEQ ID NO: 538709 - DNA, 20 bp, mouse
ggggcgaaatacacccacag

SEQ ID NO: 538710 - DNA, 20 bp, mouse
gcctatcgcgagatcttcgt

SEQ ID NO: 538711 - DNA, 20 bp, mouse
gcccacagcgggcaacccgc

SEQ ID NO: 538712 - DNA, 20 bp, mouse
ggccaacagcggccagacga

SEQ ID NO: 538713 - DNA, 20 bp, mouse
gatcaaggggagggaaggac

SEQ ID NO: 538714 - DNA, 20 bp, mouse
ggccggtagtgcgtcctggc

SEQ ID NO: 538715 - DNA, 20 bp, mouse
gtcttcgtaggtgtgtagcg

SEQ ID NO: 538716 - DNA, 20 bp, mouse
gtcatctgaaggggtaagag

SEQ ID NO: 538717 - DNA, 20 bp, mouse
gtgcgggcagtcgcagccgg

SEQ ID NO: 538718 - DNA, 20 bp, mouse
ggaactgcggccacggacaa

SEQ ID NO: 538719 - DNA, 20 bp, mouse
ggcgagccggacaggaactg

SEQ ID NO: 538720 - DNA, 20 bp, mouse
gtaaagccttgtcatctgaa

SEQ ID NO: 538721 - DNA, 20 bp, mouse
gggggtcaagttgagagtca

SEQ ID NO: 538722 - DNA, 20 bp, mouse
gggacaaaggcgagcccacg

SEQ ID NO: 538723 - DNA, 20 bp, mouse
ggccctgccgcgagccggac

SEQ ID NO: 538724 - DNA, 20 bp, mouse
gtcagcttgatacgccacgt

SEQ ID NO: 538725 - DNA, 20 bp, mouse
ggatgacaaggctttaccgc

SEQ ID NO: 538726 - DNA, 20 bp, mouse
ggcctgatggggtccagcgg

SEQ ID NO: 538727 - DNA, 20 bp, mouse
gcaagcctgatggggtccag

SEQ ID NO: 538728 - DNA, 20 bp, mouse
ggcccccgctggaccccatc

SEQ ID NO: 538729 - DNA, 20 bp, mouse
ggctccaagatagcctacca

SEQ ID NO: 538730 - DNA, 20 bp, mouse
gaccatggagacgtctagac

SEQ ID NO: 538731 - DNA, 20 bp, mouse
ggggtccagcgggggctggt

SEQ ID NO: 538732 - DNA, 20 bp, mouse
gatgaaggtgcgctcactgt

SEQ ID NO: 538733 - DNA, 20 bp, mouse
gtccctgcttgcttatccac

SEQ ID NO: 538734 - DNA, 20 bp, mouse
ggtgcgctcactgttggcca

SEQ ID NO: 538735 - DNA, 20 bp, mouse
gtgctccaaagactcaacac

SEQ ID NO: 538736 - DNA, 20 bp, mouse
ggaacgaccaccagccggcg

SEQ ID NO: 538737 - DNA, 20 bp, mouse
gagccttaccgaaagccggt

SEQ ID NO: 538738 - DNA, 20 bp, mouse
gttaccgaaagccggtgggt

SEQ ID NO: 538739 - DNA, 20 bp, mouse
gctctctccgcgccggctgg

SEQ ID NO: 538740 - DNA, 20 bp, mouse
gcggagagaggagggacgcg

SEQ ID NO: 538741 - DNA, 20 bp, mouse
ggtccctcctctctccgcgc

SEQ ID NO: 538742 - DNA, 20 bp, mouse
ggacgagagacgccacaccc

SEQ ID NO: 538743 - DNA, 20 bp, mouse
ggcggtggcaggaacccacg

SEQ ID NO: 538744 - DNA, 20 bp, mouse
ggaatagaacgaccaccagc

SEQ ID NO: 538745 - DNA, 20 bp, mouse
gcctgtggtgagctgatgtc

SEQ ID NO: 538746 - DNA, 20 bp, mouse
gcgcccgggtgctcacctga

SEQ ID NO: 538747 - DNA, 20 bp, mouse
ggtcagcaccagacagatca

SEQ ID NO: 538748 - DNA, 20 bp, mouse
gagcaccagacagatcatgg

SEQ ID NO: 538749 - DNA, 20 bp, mouse
gctgtaggctgcgggagtac

SEQ ID NO: 538750 - DNA, 20 bp, mouse
gctgaagctagtgcaggtgt

SEQ ID NO: 538751 - DNA, 20 bp, mouse
ggagcaggtggatccgggaa

SEQ ID NO: 538752 - DNA, 20 bp, mouse
gttgctaacctcttcccctc

SEQ ID NO: 538753 - DNA, 20 bp, mouse
gtccgccgccatgatctgtc

SEQ ID NO: 538754 - DNA, 20 bp, mouse
gtgcgtcgctttgagaggaa

SEQ ID NO: 538755 - DNA, 20 bp, mouse
gtccgggaagggaatcggga

SEQ ID NO: 538756 - DNA, 20 bp, mouse
gcggcgccagcccgcaacat

SEQ ID NO: 538757 - DNA, 20 bp, mouse
gcgccgcgacgcgcccgaaa

SEQ ID NO: 538758 - DNA, 20 bp, mouse
gctctgcgcggcgttcagtg

SEQ ID NO: 538759 - DNA, 20 bp, mouse
gccacgggcacaggactcac

SEQ ID NO: 538760 - DNA, 20 bp, mouse
ggcgcacgtgcggcagccaa

SEQ ID NO: 538761 - DNA, 20 bp, mouse
gcatccgcctagttccccac

SEQ ID NO: 538762 - DNA, 20 bp, mouse
gcgctgcgggcgctgttgtg

SEQ ID NO: 538763 - DNA, 20 bp, mouse
gggaactggggcgcaccagc

SEQ ID NO: 538764 - DNA, 20 bp, mouse
ggaaaaggctgcccatgttg

SEQ ID NO: 538765 - DNA, 20 bp, mouse
ggtgcccgtggggaactagg

SEQ ID NO: 538766 - DNA, 20 bp, mouse
gctgcgtggagatttcccga

SEQ ID NO: 538767 - DNA, 20 bp, mouse
gaacagagtaagtaaagctt

SEQ ID NO: 538768 - DNA, 20 bp, mouse
gagagtaagtaaagcttggg

SEQ ID NO: 538769 - DNA, 20 bp, mouse
gagcttgggagggtcctgcg

SEQ ID NO: 538770 - DNA, 20 bp, mouse
ggatgagtccccgagccctc

SEQ ID NO: 538771 - DNA, 20 bp, mouse
gtggtcagcgtcgctctcag

SEQ ID NO: 538772 - DNA, 20 bp, mouse
gagccctagccgcttgactg

SEQ ID NO: 538773 - DNA, 20 bp, mouse
gctagccgcttgactgaggt

SEQ ID NO: 538774 - DNA, 20 bp, mouse
ggccctctgcagccaccgtt

SEQ ID NO: 538775 - DNA, 20 bp, mouse
ggctttgggtctcttagcaa

SEQ ID NO: 538776 - DNA, 20 bp, mouse
gcggtctccaaagcgagccc

SEQ ID NO: 538777 - DNA, 20 bp, mouse
gagcgtgggcgctaaagtag

SEQ ID NO: 538778 - DNA, 20 bp, mouse
ggaggattggcgggagtacc

SEQ ID NO: 538779 - DNA, 20 bp, mouse
ggaataactgagtctggtgt

SEQ ID NO: 538780 - DNA, 20 bp, mouse
gccagaacccgggctcgctt

SEQ ID NO: 538781 - DNA, 20 bp, mouse
gcaagttgcctggccaactg

SEQ ID NO: 538782 - DNA, 20 bp, mouse
gggaccggcgatctgtagag

SEQ ID NO: 538783 - DNA, 20 bp, mouse
gttgggagccaagacttagg

SEQ ID NO: 538784 - DNA, 20 bp, mouse
gcccgggttctgggttcacc

SEQ ID NO: 538785 - DNA, 20 bp, mouse
gggtgaccaggaggattggc

SEQ ID NO: 538786 - DNA, 20 bp, mouse
ggggtctcggagcctttcat

SEQ ID NO: 538787 - DNA, 20 bp, mouse
gtgctgagatctacaaacta

SEQ ID NO: 538788 - DNA, 20 bp, mouse
gaactatggtaagtgttata

SEQ ID NO: 538789 - DNA, 20 bp, mouse
ggaaatagattcctgtacac

SEQ ID NO: 538790 - DNA, 20 bp, mouse
ggccagagtaaccggatcat

SEQ ID NO: 538791 - DNA, 20 bp, mouse
gggctccgagaccctggtta

SEQ ID NO: 538792 - DNA, 20 bp, mouse
gcaagaaaaggggtgcgcag

SEQ ID NO: 538793 - DNA, 20 bp, mouse
gtatggtaagtgttataggg

SEQ ID NO: 538794 - DNA, 20 bp, mouse
ggtaaccggatcattggtgg

SEQ ID NO: 538795 - DNA, 20 bp, mouse
gtgtaacagaaagtaaatgg

SEQ ID NO: 538796 - DNA, 20 bp, mouse
ggcaggtccagtcaaaggga

SEQ ID NO: 538797 - DNA, 20 bp, mouse
gtcaccccctggaagatgaa

SEQ ID NO: 538798 - DNA, 20 bp, mouse
gcccagcaggtccagtcaaa

SEQ ID NO: 538799 - DNA, 20 bp, mouse
gtcttccagggggtgatgct

SEQ ID NO: 538800 - DNA, 20 bp, mouse
gggcctcgagggctgaacgt

SEQ ID NO: 538801 - DNA, 20 bp, mouse
gcttgcccttcatcttccag

SEQ ID NO: 538802 - DNA, 20 bp, mouse
gtatgcctagcatcaccccc

SEQ ID NO: 538803 - DNA, 20 bp, mouse
ggcccgggctgaaggtggca

SEQ ID NO: 538804 - DNA, 20 bp, mouse
gggtcccagtctaacagaaa

SEQ ID NO: 538805 - DNA, 20 bp, mouse
gagggccggccgggcctcga

SEQ ID NO: 538806 - DNA, 20 bp, mouse
ggaggtagagttcagttcta

SEQ ID NO: 538807 - DNA, 20 bp, mouse
gcgggagctgcgcagcgagc

SEQ ID NO: 538808 - DNA, 20 bp, mouse
gtgggaccgcagggacgcgg

SEQ ID NO: 538809 - DNA, 20 bp, mouse
gtggtgggaccgcagggacg

SEQ ID NO: 538810 - DNA, 20 bp, mouse
ggagttcagttctaaggcac

SEQ ID NO: 538811 - DNA, 20 bp, mouse
gcaggaagggaagcaaccca

SEQ ID NO: 538812 - DNA, 20 bp, mouse
gggacccagaccccgagtcg

SEQ ID NO: 538813 - DNA, 20 bp, mouse
gtgagtgcttgatccatcct

SEQ ID NO: 538814 - DNA, 20 bp, mouse
gttctaaggcaccggcttcc

SEQ ID NO: 538815 - DNA, 20 bp, mouse
gcgcgggtggtgggaccgca

SEQ ID NO: 538816 - DNA, 20 bp, mouse
ggtcctccaggagacaacct

SEQ ID NO: 538817 - DNA, 20 bp, mouse
gggccgaggttgtctcctgg

SEQ ID NO: 538818 - DNA, 20 bp, mouse
gcaaacggccctagtcctcc

SEQ ID NO: 538819 - DNA, 20 bp, mouse
gccgggccgaggttgtctcc

SEQ ID NO: 538820 - DNA, 20 bp, mouse
gcgtctcctaggacctcggt

SEQ ID NO: 538821 - DNA, 20 bp, mouse
ggccaatgagagcaaggcgg

SEQ ID NO: 538822 - DNA, 20 bp, mouse
gtccaggccaccccaagtgg

SEQ ID NO: 538823 - DNA, 20 bp, mouse
gcggcccggacgccagcgca

SEQ ID NO: 538824 - DNA, 20 bp, mouse
ggttccctgcgctggcgtcc

SEQ ID NO: 538825 - DNA, 20 bp, mouse
gggggccaatgagagcaagg

SEQ ID NO: 538826 - DNA, 20 bp, mouse
ggtctctcgcactgatccag

SEQ ID NO: 538827 - DNA, 20 bp, mouse
gcaggccagcaggataacgt

SEQ ID NO: 538828 - DNA, 20 bp, mouse
gtctgcagacggagaaagga

SEQ ID NO: 538829 - DNA, 20 bp, mouse
gaaggaaggcgaggctccgg

SEQ ID NO: 538830 - DNA, 20 bp, mouse
gcatatcgagacacaaaaag

SEQ ID NO: 538831 - DNA, 20 bp, mouse
gccggcgcacccctccggag

SEQ ID NO: 538832 - DNA, 20 bp, mouse
gattggcgagagtagagcag

SEQ ID NO: 538833 - DNA, 20 bp, mouse
gtatgtctgcagacggagaa

SEQ ID NO: 538834 - DNA, 20 bp, mouse
ggtcctcccgcccaccccgg

SEQ ID NO: 538835 - DNA, 20 bp, mouse
gggcgtgcgcccctccggag

SEQ ID NO: 538836 - DNA, 20 bp, mouse
gagtcttagggcgatctgcg

SEQ ID NO: 538837 - DNA, 20 bp, mouse
ggctccgctcagagtcaaca

SEQ ID NO: 538838 - DNA, 20 bp, mouse
gtggtcgagcagcagatccg

SEQ ID NO: 538839 - DNA, 20 bp, mouse
gaggcccacgtgactctcgg

SEQ ID NO: 538840 - DNA, 20 bp, mouse
gtctgcggggtgacccatcc

SEQ ID NO: 538841 - DNA, 20 bp, mouse
ggtcaagactagttagtctt

SEQ ID NO: 538842 - DNA, 20 bp, mouse
gatctgctgctcgaccagga

SEQ ID NO: 538843 - DNA, 20 bp, mouse
gtcagagtcaacagggaccg

SEQ ID NO: 538844 - DNA, 20 bp, mouse
ggactaactagtcttgaccc

SEQ ID NO: 538845 - DNA, 20 bp, mouse
gctagtcttgacccaggctg

SEQ ID NO: 538846 - DNA, 20 bp, mouse
gagtccccagaccacaactc

SEQ ID NO: 538847 - DNA, 20 bp, mouse
gggtctggggacttggtact

SEQ ID NO: 538848 - DNA, 20 bp, mouse
gcgcgtcccgagattctgtc

SEQ ID NO: 538849 - DNA, 20 bp, mouse
gtcacccgagttgtggtctg

SEQ ID NO: 538850 - DNA, 20 bp, mouse
ggtgacaaaaggctaaaaca

SEQ ID NO: 538851 - DNA, 20 bp, mouse
gtcagggaccggacgtctca

SEQ ID NO: 538852 - DNA, 20 bp, mouse
gcctttgtttgtaggaagaa

SEQ ID NO: 538853 - DNA, 20 bp, mouse
gtcgggacgcgttcagggac

SEQ ID NO: 538854 - DNA, 20 bp, mouse
gtcccgccaaagcccattct

SEQ ID NO: 538855 - DNA, 20 bp, mouse
gatggctgataggaaactgg

SEQ ID NO: 538856 - DNA, 20 bp, mouse
ggtgagcaccgggcagtggt

SEQ ID NO: 538857 - DNA, 20 bp, mouse
gcgctgcctaggtgagcacc

SEQ ID NO: 538858 - DNA, 20 bp, mouse
gcagtgggtactcaccgaag

SEQ ID NO: 538859 - DNA, 20 bp, mouse
ggccctcaggccctgcgtag

SEQ ID NO: 538860 - DNA, 20 bp, mouse
gggaggctatgaaagcgcag

SEQ ID NO: 538861 - DNA, 20 bp, mouse
ggtgtctagggaaaccgcgg

SEQ ID NO: 538862 - DNA, 20 bp, mouse
gatcgtgtctagggaaaccg

SEQ ID NO: 538863 - DNA, 20 bp, mouse
gctcaggccctgcgtagggg

SEQ ID NO: 538864 - DNA, 20 bp, mouse
ggagcatctaagtcccaccg

SEQ ID NO: 538865 - DNA, 20 bp, mouse
gtgtgtacgcagcaggcagt

SEQ ID NO: 538866 - DNA, 20 bp, mouse
ggtgcagcaggggccacctc

SEQ ID NO: 538867 - DNA, 20 bp, mouse
ggagcttggtgaccactgag

SEQ ID NO: 538868 - DNA, 20 bp, mouse
ggtttcatcttggggactgg

SEQ ID NO: 538869 - DNA, 20 bp, mouse
gggtcacactccaggcccta

SEQ ID NO: 538870 - DNA, 20 bp, mouse
gcctcatgcctgcagaccat

SEQ ID NO: 538871 - DNA, 20 bp, mouse
gccaagatgaaactcatcat

SEQ ID NO: 538872 - DNA, 20 bp, mouse
gcattggagggtgagcccta

SEQ ID NO: 538873 - DNA, 20 bp, mouse
gaccactgaggggacaggga

SEQ ID NO: 538874 - DNA, 20 bp, mouse
gactcatcataggcattgga

SEQ ID NO: 538875 - DNA, 20 bp, mouse
gggtgaccactgaggggaca

SEQ ID NO: 538876 - DNA, 20 bp, mouse
gagatacgttctgttcagag

SEQ ID NO: 538877 - DNA, 20 bp, mouse
gcctgcatctatccagccca

SEQ ID NO: 538878 - DNA, 20 bp, mouse
gggaggacagatgtgaaggt

SEQ ID NO: 538879 - DNA, 20 bp, mouse
gggtgatgagcatttcccga

SEQ ID NO: 538880 - DNA, 20 bp, mouse
gaacaggaggacagatgtga

SEQ ID NO: 538881 - DNA, 20 bp, mouse
gatctctgcctctggaccct

SEQ ID NO: 538882 - DNA, 20 bp, mouse
gcaggattggagaatagtgg

SEQ ID NO: 538883 - DNA, 20 bp, mouse
gcagtccccttacctgagga

SEQ ID NO: 538884 - DNA, 20 bp, mouse
gctaaccggagtgatggaca

SEQ ID NO: 538885 - DNA, 20 bp, mouse
gagcagtagatgaacaggat

SEQ ID NO: 538886 - DNA, 20 bp, mouse
gctctcgcaacccaagatgg

SEQ ID NO: 538887 - DNA, 20 bp, mouse
gtcagtggcaacgaaggtgc

SEQ ID NO: 538888 - DNA, 20 bp, mouse
gcggctctcgcaacccaaga

SEQ ID NO: 538889 - DNA, 20 bp, mouse
gtcgctaggtaggatctcaa

SEQ ID NO: 538890 - DNA, 20 bp, mouse
gcccacaagctgggtatctg

SEQ ID NO: 538891 - DNA, 20 bp, mouse
gccatcatcagtggcaacga

SEQ ID NO: 538892 - DNA, 20 bp, mouse
gtggggtgcggggaagtcac

SEQ ID NO: 538893 - DNA, 20 bp, mouse
gagagggcggccgaacctag

SEQ ID NO: 538894 - DNA, 20 bp, mouse
gggccgccctctgagacgaa

SEQ ID NO: 538895 - DNA, 20 bp, mouse
gcgtgcctaaagcaagggag

SEQ ID NO: 538896 - DNA, 20 bp, mouse
gccatcgcggcggctccgaa

SEQ ID NO: 538897 - DNA, 20 bp, mouse
gctgtcctccgccatcgcgg

SEQ ID NO: 538898 - DNA, 20 bp, mouse
gcggcggctccgaacggctg

SEQ ID NO: 538899 - DNA, 20 bp, mouse
gtcgctgtcctccgccatcg

SEQ ID NO: 538900 - DNA, 20 bp, mouse
gcagcaagcaaggcgcgaca

SEQ ID NO: 538901 - DNA, 20 bp, mouse
ggcgggagcccctagaccgg

SEQ ID NO: 538902 - DNA, 20 bp, mouse
gggagccgccgcgatggcgg

SEQ ID NO: 538903 - DNA, 20 bp, mouse
gggctcccgcacgccacgag

SEQ ID NO: 538904 - DNA, 20 bp, mouse
ggtcctggtcgtccagctct

SEQ ID NO: 538905 - DNA, 20 bp, mouse
gctagaccggaggctccgtt

SEQ ID NO: 538906 - DNA, 20 bp, mouse
gaggcgcacaggacacgctg

SEQ ID NO: 538907 - DNA, 20 bp, mouse
gtcagcaagaggaggcgcac

SEQ ID NO: 538908 - DNA, 20 bp, mouse
gtcctgcggacagccctgga

SEQ ID NO: 538909 - DNA, 20 bp, mouse
gtccaagcggctctggactg

SEQ ID NO: 538910 - DNA, 20 bp, mouse
gacatctccttccctccaag

SEQ ID NO: 538911 - DNA, 20 bp, mouse
gcgggctgcagactccataa

SEQ ID NO: 538912 - DNA, 20 bp, mouse
gaaaacacccgcacaacaca

SEQ ID NO: 538913 - DNA, 20 bp, mouse
gcgcgcggagatggtcactt

SEQ ID NO: 538914 - DNA, 20 bp, mouse
ggggctgtccgcaggacaat

SEQ ID NO: 538915 - DNA, 20 bp, mouse
gccagagccgcttggaggga

SEQ ID NO: 538916 - DNA, 20 bp, mouse
gcctcagggcctcatcggta

SEQ ID NO: 538917 - DNA, 20 bp, mouse
gttcagcctcagggcctcat

SEQ ID NO: 538918 - DNA, 20 bp, mouse
gtcagatcctcaggttgata

SEQ ID NO: 538919 - DNA, 20 bp, mouse
gaagtggccctatcaacctg

SEQ ID NO: 538920 - DNA, 20 bp, mouse
gcggtaaggttcagatcctc

SEQ ID NO: 538921 - DNA, 20 bp, mouse
gactgatattgcagaccagg

SEQ ID NO: 538922 - DNA, 20 bp, mouse
gaatgcttcaaggagccccc

SEQ ID NO: 538923 - DNA, 20 bp, mouse
gtgaagaggtagaagttggt

SEQ ID NO: 538924 - DNA, 20 bp, mouse
gcaggtacgtgacacagatg

SEQ ID NO: 538925 - DNA, 20 bp, mouse
gtcttcgtggtgggcactct

SEQ ID NO: 538926 - DNA, 20 bp, mouse
gcgtgagaggagagccctag

SEQ ID NO: 538927 - DNA, 20 bp, mouse
gagaaagagtctgaaagccg

SEQ ID NO: 538928 - DNA, 20 bp, mouse
gcaagagcaagggatacccg

SEQ ID NO: 538929 - DNA, 20 bp, mouse
ggcgcatagaccacagacac

SEQ ID NO: 538930 - DNA, 20 bp, mouse
gactgcgcttgggtccacac

SEQ ID NO: 538931 - DNA, 20 bp, mouse
gaggatagcatcagcctcta

SEQ ID NO: 538932 - DNA, 20 bp, mouse
gcacagacactggaagggat

SEQ ID NO: 538933 - DNA, 20 bp, mouse
gcgcttgggtccacacaggt

SEQ ID NO: 538934 - DNA, 20 bp, mouse
gaacagcacagaggagtact

SEQ ID NO: 538935 - DNA, 20 bp, mouse
gccaccggcccaaacaggaa

SEQ ID NO: 538936 - DNA, 20 bp, mouse
gggtgggtggtcgagagcaa

SEQ ID NO: 538937 - DNA, 20 bp, mouse
gctccgagaccagtagacct

SEQ ID NO: 538938 - DNA, 20 bp, mouse
gcatggttccgaaagtgggt

SEQ ID NO: 538939 - DNA, 20 bp, mouse
gcgagagcaagggttcgccg

SEQ ID NO: 538940 - DNA, 20 bp, mouse
gggttccgaaagtgggtggg

SEQ ID NO: 538941 - DNA, 20 bp, mouse
gttcggaaccatggccgcag

SEQ ID NO: 538942 - DNA, 20 bp, mouse
gcggccatggttccgaaagt

SEQ ID NO: 538943 - DNA, 20 bp, mouse
gacttaaggcacggccaccg

SEQ ID NO: 538944 - DNA, 20 bp, mouse
gcgccgaggtctactggtct

SEQ ID NO: 538945 - DNA, 20 bp, mouse
ggccgggaacaaagactcag

SEQ ID NO: 538946 - DNA, 20 bp, mouse
ggcacggagctgagacacga

SEQ ID NO: 538947 - DNA, 20 bp, mouse
gcttagataagtgtccttgg

SEQ ID NO: 538948 - DNA, 20 bp, mouse
ggctgagacacgatggaatc

SEQ ID NO: 538949 - DNA, 20 bp, mouse
gggacaggagagcatcaggc

SEQ ID NO: 538950 - DNA, 20 bp, mouse
gccaagagactgtctaatag

SEQ ID NO: 538951 - DNA, 20 bp, mouse
gacatctgtctctaagggat

SEQ ID NO: 538952 - DNA, 20 bp, mouse
gtagacagacaaacttaccc

SEQ ID NO: 538953 - DNA, 20 bp, mouse
gtctaagggatgggccgagc

SEQ ID NO: 538954 - DNA, 20 bp, mouse
ggagtaacattgtgtcttgg

SEQ ID NO: 538955 - DNA, 20 bp, mouse
gatttttccaagtaatcccg

SEQ ID NO: 538956 - DNA, 20 bp, mouse
gcttcagcggccacccggag

SEQ ID NO: 538957 - DNA, 20 bp, mouse
gggccctggcagagacaaag

SEQ ID NO: 538958 - DNA, 20 bp, mouse
ggctgtaagcgtgcatctgg

SEQ ID NO: 538959 - DNA, 20 bp, mouse
gcgcagcagctggtcccctc

SEQ ID NO: 538960 - DNA, 20 bp, mouse
ggcagctggtcccctccggg

SEQ ID NO: 538961 - DNA, 20 bp, mouse
gcccgatcgccagtctgcaa

SEQ ID NO: 538962 - DNA, 20 bp, mouse
ggagctagcagacccggggt

SEQ ID NO: 538963 - DNA, 20 bp, mouse
gcgccgagctagcagacccg

SEQ ID NO: 538964 - DNA, 20 bp, mouse
ggcggcgaccacgtgacaca

SEQ ID NO: 538965 - DNA, 20 bp, mouse
gccagccctgcagcgcctag

SEQ ID NO: 538966 - DNA, 20 bp, mouse
gtatgcagaaggcccggaca

SEQ ID NO: 538967 - DNA, 20 bp, mouse
ggcccgcaagccaggcgcgc

SEQ ID NO: 538968 - DNA, 20 bp, mouse
ggctgggccgtagcacgcag

SEQ ID NO: 538969 - DNA, 20 bp, mouse
gcatgtggacagcgcgagga

SEQ ID NO: 538970 - DNA, 20 bp, mouse
gcaggcgcgcgggcagcatg

SEQ ID NO: 538971 - DNA, 20 bp, mouse
gccgctccgggacgtactcc

SEQ ID NO: 538972 - DNA, 20 bp, mouse
gtggcttgcgggctgctctg

SEQ ID NO: 538973 - DNA, 20 bp, mouse
ggtgctacggcccagcacgg

SEQ ID NO: 538974 - DNA, 20 bp, mouse
gattgcagcagcgggaggag

SEQ ID NO: 538975 - DNA, 20 bp, mouse
gcggtcgccgtggagctcgg

SEQ ID NO: 538976 - DNA, 20 bp, mouse
ggcgccggtggagcacgttg

SEQ ID NO: 538977 - DNA, 20 bp, mouse
gcagccacaacgtgctccac

SEQ ID NO: 538978 - DNA, 20 bp, mouse
gtgctccaccggcgccatgt

SEQ ID NO: 538979 - DNA, 20 bp, mouse
gacagccaacatggcgccgg

SEQ ID NO: 538980 - DNA, 20 bp, mouse
gctgtccttgacagccaaca

SEQ ID NO: 538981 - DNA, 20 bp, mouse
gagcacgttgtggctgatgc

SEQ ID NO: 538982 - DNA, 20 bp, mouse
ggatgccggagctttcttga

SEQ ID NO: 538983 - DNA, 20 bp, mouse
gcgcgcctctgcaggtactg

SEQ ID NO: 538984 - DNA, 20 bp, mouse
gtcaagcccaggccccgcgg

SEQ ID NO: 538985 - DNA, 20 bp, mouse
ggccgcacgtactctgggag

SEQ ID NO: 538986 - DNA, 20 bp, mouse
ggcctgggccatggaaccta

SEQ ID NO: 538987 - DNA, 20 bp, mouse
gaccagggcgagctcaggag

SEQ ID NO: 538988 - DNA, 20 bp, mouse
gtgcagggtgagcacccatt

SEQ ID NO: 538989 - DNA, 20 bp, mouse
gccgcgcgcctgtggtacca

SEQ ID NO: 538990 - DNA, 20 bp, mouse
gcactaaggccaatccccaa

SEQ ID NO: 538991 - DNA, 20 bp, mouse
ggtggtaccagggcgagctc

SEQ ID NO: 538992 - DNA, 20 bp, mouse
gagcttctccgtaggttcca

SEQ ID NO: 538993 - DNA, 20 bp, mouse
gtcttgcagagcttctccgt

SEQ ID NO: 538994 - DNA, 20 bp, mouse
gccctctcctgagctcgccc

SEQ ID NO: 538995 - DNA, 20 bp, mouse
gtccgtaggttccatggccc

SEQ ID NO: 538996 - DNA, 20 bp, mouse
gggagcgcgagacgcagcca

SEQ ID NO: 538997 - DNA, 20 bp, mouse
gcccaggccactcacctgcg

SEQ ID NO: 538998 - DNA, 20 bp, mouse
gcgcgctccccgcaggtgag

SEQ ID NO: 538999 - DNA, 20 bp, mouse
gagccgcgtggaaccgggag

SEQ ID NO: 539000 - DNA, 20 bp, mouse
gcattctgggcccggaagtg

SEQ ID NO: 539001 - DNA, 20 bp, mouse
gcaccgcgtcaggatcggaa

SEQ ID NO: 539002 - DNA, 20 bp, mouse
ggatccgagtcggagctgga

SEQ ID NO: 539003 - DNA, 20 bp, mouse
gcacgcggctgggcgcgcca

SEQ ID NO: 539004 - DNA, 20 bp, mouse
gaagtgcggcgcacgcggct

SEQ ID NO: 539005 - DNA, 20 bp, mouse
gcgcctggaggacctcagtg

SEQ ID NO: 539006 - DNA, 20 bp, mouse
gctcggacagaggaacacgc

SEQ ID NO: 539007 - DNA, 20 bp, mouse
ggcgtcttccggtttgggaa

SEQ ID NO: 539008 - DNA, 20 bp, mouse
ggtttccggcggcagaaagg

SEQ ID NO: 539009 - DNA, 20 bp, mouse
gatggagcatagatcggcta

SEQ ID NO: 539010 - DNA, 20 bp, mouse
gtcagtctgacaccattcgg

SEQ ID NO: 539011 - DNA, 20 bp, mouse
ggcaggcctaaggatgaagg

SEQ ID NO: 539012 - DNA, 20 bp, mouse
gggctagggagcaccaagtt

SEQ ID NO: 539013 - DNA, 20 bp, mouse
ggtccgagtgatcttgtctg

SEQ ID NO: 539014 - DNA, 20 bp, mouse
gaagcagccacaactcccgg

SEQ ID NO: 539015 - DNA, 20 bp, mouse
gctcgcaggcctaaggatga

SEQ ID NO: 539016 - DNA, 20 bp, mouse
ggaaccgggagcagcatcgg

SEQ ID NO: 539017 - DNA, 20 bp, mouse
gcaggaaccgggagcagcat

SEQ ID NO: 539018 - DNA, 20 bp, mouse
gatggagcggcacccagctt

SEQ ID NO: 539019 - DNA, 20 bp, mouse
gccgggagcagcatcggcgg

SEQ ID NO: 539020 - DNA, 20 bp, mouse
ggaggctcgggtgacgtcac

SEQ ID NO: 539021 - DNA, 20 bp, mouse
ggagctcggccgcctcctgg

SEQ ID NO: 539022 - DNA, 20 bp, mouse
gcctggagctcgccgaagct

SEQ ID NO: 539023 - DNA, 20 bp, mouse
gacacggggaggccccgaca

SEQ ID NO: 539024 - DNA, 20 bp, mouse
gggctcctcggactgaacac

SEQ ID NO: 539025 - DNA, 20 bp, mouse
ggtcagtgggagtcgcgacg

SEQ ID NO: 539026 - DNA, 20 bp, mouse
ggcccacccgagcccaggcg

SEQ ID NO: 539027 - DNA, 20 bp, mouse
ggcggtccgggatcaggagc

SEQ ID NO: 539028 - DNA, 20 bp, mouse
ggccgcgcctgggctcgggt

SEQ ID NO: 539029 - DNA, 20 bp, mouse
gcaggagctggctgtgtcta

SEQ ID NO: 539030 - DNA, 20 bp, mouse
gcctgatcccggaccgcgag

SEQ ID NO: 539031 - DNA, 20 bp, mouse
ggggagggcgctaccgctcg

SEQ ID NO: 539032 - DNA, 20 bp, mouse
gatcgggcgggacaacagct

SEQ ID NO: 539033 - DNA, 20 bp, mouse
gctctcagcaaggggatccg

SEQ ID NO: 539034 - DNA, 20 bp, mouse
ggccctagttcagagatcag

SEQ ID NO: 539035 - DNA, 20 bp, mouse
gctccggggagggaacaggg

SEQ ID NO: 539036 - DNA, 20 bp, mouse
gatccccacgctgcagctgg

SEQ ID NO: 539037 - DNA, 20 bp, mouse
gcaccgccagctgcagcgtg

SEQ ID NO: 539038 - DNA, 20 bp, mouse
gtgtggtctgcgggtgatcg

SEQ ID NO: 539039 - DNA, 20 bp, mouse
ggatgtctcgaggggagcca

SEQ ID NO: 539040 - DNA, 20 bp, mouse
ggtcaccgcaaaactggcga

SEQ ID NO: 539041 - DNA, 20 bp, mouse
ggggcgggagtagatcactg

SEQ ID NO: 539042 - DNA, 20 bp, mouse
gggtggctgggacaacggag

SEQ ID NO: 539043 - DNA, 20 bp, mouse
gaagcatcgacggagtagat

SEQ ID NO: 539044 - DNA, 20 bp, mouse
gtgtggagtcaccgcaaaac

SEQ ID NO: 539045 - DNA, 20 bp, mouse
ggcctcgcctcagacttcaa

SEQ ID NO: 539046 - DNA, 20 bp, mouse
gggctgtgggcactcatggt

SEQ ID NO: 539047 - DNA, 20 bp, mouse
ggggtggagtagagcccaac

SEQ ID NO: 539048 - DNA, 20 bp, mouse
gagaaggatgcggaggctgt

SEQ ID NO: 539049 - DNA, 20 bp, mouse
gtggcctcgccagcacttaa

SEQ ID NO: 539050 - DNA, 20 bp, mouse
gcttcttcttcaagcctgtt

SEQ ID NO: 539051 - DNA, 20 bp, mouse
ggctgcccccgtgtccacag

SEQ ID NO: 539052 - DNA, 20 bp, mouse
gcagcctccaggcgcaaggt

SEQ ID NO: 539053 - DNA, 20 bp, mouse
gaggcagcgggtctcggtag

SEQ ID NO: 539054 - DNA, 20 bp, mouse
gccagaggggacggtgacga

SEQ ID NO: 539055 - DNA, 20 bp, mouse
gggcaaagcggccgcggtcg

SEQ ID NO: 539056 - DNA, 20 bp, mouse
gtctgcccggcggactccag

SEQ ID NO: 539057 - DNA, 20 bp, mouse
ggcccggcggactccagcgg

SEQ ID NO: 539058 - DNA, 20 bp, mouse
gcgcagccggctctgcccgg

SEQ ID NO: 539059 - DNA, 20 bp, mouse
gaccgccgctggagtccgcc

SEQ ID NO: 539060 - DNA, 20 bp, mouse
gcggcggcgtccgcgcacgt

SEQ ID NO: 539061 - DNA, 20 bp, mouse
gcagcgcagccggctctgcc

SEQ ID NO: 539062 - DNA, 20 bp, mouse
ggccgagcgaccggaggagg

SEQ ID NO: 539063 - DNA, 20 bp, mouse
ggcagcccgggagaacagcg

SEQ ID NO: 539064 - DNA, 20 bp, mouse
gcaagacgccgagcgaccgg

SEQ ID NO: 539065 - DNA, 20 bp, mouse
ggcccgccggagctcacagg

SEQ ID NO: 539066 - DNA, 20 bp, mouse
gccaggaacggcaccaccaa

SEQ ID NO: 539067 - DNA, 20 bp, mouse
gcagagccatagcccaggaa

SEQ ID NO: 539068 - DNA, 20 bp, mouse
ggcacgcagtcacagaacgc

SEQ ID NO: 539069 - DNA, 20 bp, mouse
gtaccatcggctgaccgtgg

SEQ ID NO: 539070 - DNA, 20 bp, mouse
gatccaaacccgaggcgaac

SEQ ID NO: 539071 - DNA, 20 bp, mouse
gaccctagcatccaaacccg

SEQ ID NO: 539072 - DNA, 20 bp, mouse
ggggggcgagaactcacctc

SEQ ID NO: 539073 - DNA, 20 bp, mouse
gctagggtattcgggtgggc

SEQ ID NO: 539074 - DNA, 20 bp, mouse
gtgtatctctaacttaccat

SEQ ID NO: 539075 - DNA, 20 bp, mouse
ggacataaaaccagccacca

SEQ ID NO: 539076 - DNA, 20 bp, mouse
gctcgcgagaggaagcacaa

SEQ ID NO: 539077 - DNA, 20 bp, mouse
ggctgccgggaagcatgccc

SEQ ID NO: 539078 - DNA, 20 bp, mouse
gcaacccaaaatggcaaccc

SEQ ID NO: 539079 - DNA, 20 bp, mouse
gccgggcctgagggattcct

SEQ ID NO: 539080 - DNA, 20 bp, mouse
gctgtccccggggaaagggg

SEQ ID NO: 539081 - DNA, 20 bp, mouse
gggaagcatgcccgggctgt

SEQ ID NO: 539082 - DNA, 20 bp, mouse
gcgttgtctactggagtctt

SEQ ID NO: 539083 - DNA, 20 bp, mouse
ggcgagagcgaccgacacca

SEQ ID NO: 539084 - DNA, 20 bp, mouse
gcgggcgtgacagagacccg

SEQ ID NO: 539085 - DNA, 20 bp, mouse
gcgcctctgtccgaagccgg

SEQ ID NO: 539086 - DNA, 20 bp, mouse
ggagctccagctacatccag

SEQ ID NO: 539087 - DNA, 20 bp, mouse
ggtaaacagcgagggaggag

SEQ ID NO: 539088 - DNA, 20 bp, mouse
gcagccaagcctgagaccag

SEQ ID NO: 539089 - DNA, 20 bp, mouse
gacgactgggagccagctat

SEQ ID NO: 539090 - DNA, 20 bp, mouse
gccggaagaaccctccgcgt

SEQ ID NO: 539091 - DNA, 20 bp, mouse
gcccattgcagtgaagcttc

SEQ ID NO: 539092 - DNA, 20 bp, mouse
gcgggcgactccatcccccg

SEQ ID NO: 539093 - DNA, 20 bp, mouse
ggactccatcccccgaggtg

SEQ ID NO: 539094 - DNA, 20 bp, mouse
ggaaaagagatggagacgac

SEQ ID NO: 539095 - DNA, 20 bp, mouse
gtcagaagcggccacgctgc

SEQ ID NO: 539096 - DNA, 20 bp, mouse
gccggagttgagcctcaccg

SEQ ID NO: 539097 - DNA, 20 bp, mouse
gtgaggctcaactccggagt

SEQ ID NO: 539098 - DNA, 20 bp, mouse
gactgtcatctgccccggtg

SEQ ID NO: 539099 - DNA, 20 bp, mouse
ggtttcggatagtcccactc

SEQ ID NO: 539100 - DNA, 20 bp, mouse
gagctctaggactgagtgga

SEQ ID NO: 539101 - DNA, 20 bp, mouse
ggcagatgacagtgcagaaa

SEQ ID NO: 539102 - DNA, 20 bp, mouse
gtggagtcgggcttgtggtc

SEQ ID NO: 539103 - DNA, 20 bp, mouse
gctaggactgagtggagggc

SEQ ID NO: 539104 - DNA, 20 bp, mouse
gctgaagctctaggactgag

SEQ ID NO: 539105 - DNA, 20 bp, mouse
gtctgcactgtcatctgccc

SEQ ID NO: 539106 - DNA, 20 bp, mouse
gttctcctggaagattctcg

SEQ ID NO: 539107 - DNA, 20 bp, mouse
ggagtggtccgagcccacca

SEQ ID NO: 539108 - DNA, 20 bp, mouse
gaggcgagaggttcagtgtg

SEQ ID NO: 539109 - DNA, 20 bp, mouse
ggggctgtcagtccgggctg

SEQ ID NO: 539110 - DNA, 20 bp, mouse
gtggtccgagcccaccaggg

SEQ ID NO: 539111 - DNA, 20 bp, mouse
ggccgccccgagaatcttcc

SEQ ID NO: 539112 - DNA, 20 bp, mouse
gagcgcccgggctgtcagtc

SEQ ID NO: 539113 - DNA, 20 bp, mouse
gtcctggaagattctcgggg

SEQ ID NO: 539114 - DNA, 20 bp, mouse
gcgcagcgagcctccctggt

SEQ ID NO: 539115 - DNA, 20 bp, mouse
ggcggcggcgctggaaccag

SEQ ID NO: 539116 - DNA, 20 bp, mouse
ggaaggctatgctctctcta

SEQ ID NO: 539117 - DNA, 20 bp, mouse
gcccagtgcacagccccctg

SEQ ID NO: 539118 - DNA, 20 bp, mouse
gtctctaaggtgcatgatat

SEQ ID NO: 539119 - DNA, 20 bp, mouse
gttggagatatatgcatgaa

SEQ ID NO: 539120 - DNA, 20 bp, mouse
gggctcttccaagcaccatc

SEQ ID NO: 539121 - DNA, 20 bp, mouse
gtctttctaacatcctcagg

SEQ ID NO: 539122 - DNA, 20 bp, mouse
gttgcaggaggtagatacaa

SEQ ID NO: 539123 - DNA, 20 bp, mouse
gaccattcccagttaatcgt

SEQ ID NO: 539124 - DNA, 20 bp, mouse
gatgttagaaagaaggtttc

SEQ ID NO: 539125 - DNA, 20 bp, mouse
gtcttgctggatgaaagact

SEQ ID NO: 539126 - DNA, 20 bp, mouse
ggcccacgtgggaagctacg

SEQ ID NO: 539127 - DNA, 20 bp, mouse
gggaagctacggggtagatc

SEQ ID NO: 539128 - DNA, 20 bp, mouse
gagagacctgctgtgaagat

SEQ ID NO: 539129 - DNA, 20 bp, mouse
gcgtcggtgctgctctccgg

SEQ ID NO: 539130 - DNA, 20 bp, mouse
gcggcttggatgccaagtgc

SEQ ID NO: 539131 - DNA, 20 bp, mouse
ggctcgtcggtgctgctctc

SEQ ID NO: 539132 - DNA, 20 bp, mouse
gtagaaaaaagattactcca

SEQ ID NO: 539133 - DNA, 20 bp, mouse
gctacggggtagatccggct

SEQ ID NO: 539134 - DNA, 20 bp, mouse
gcggtgctgctctccggcgg

SEQ ID NO: 539135 - DNA, 20 bp, mouse
gtgggtcctcagttgctcgt

SEQ ID NO: 539136 - DNA, 20 bp, mouse
gaccatggcaaacggaaagg

SEQ ID NO: 539137 - DNA, 20 bp, mouse
ggcgccggctgaggcgatgg

SEQ ID NO: 539138 - DNA, 20 bp, mouse
gtgcaccatggcaaacggaa

SEQ ID NO: 539139 - DNA, 20 bp, mouse
ggcgaaagtcagctcctccg

SEQ ID NO: 539140 - DNA, 20 bp, mouse
ggagcccctggacgaggagg

SEQ ID NO: 539141 - DNA, 20 bp, mouse
ggcccaggcggaagcccggg

SEQ ID NO: 539142 - DNA, 20 bp, mouse
ggcggacgacgaagccccgg

SEQ ID NO: 539143 - DNA, 20 bp, mouse
ggccgagcccctggacgagg

SEQ ID NO: 539144 - DNA, 20 bp, mouse
ggcgatggtggacgaggacc

SEQ ID NO: 539145 - DNA, 20 bp, mouse
gatggtggacgaggaccagg

SEQ ID NO: 539146 - DNA, 20 bp, mouse
ggagtcggacaagcgccctg

SEQ ID NO: 539147 - DNA, 20 bp, mouse
gcgccgggcttgagctgagt

SEQ ID NO: 539148 - DNA, 20 bp, mouse
ggtccgactcagctcaagcc

SEQ ID NO: 539149 - DNA, 20 bp, mouse
gaagcgagatcactaaatag

SEQ ID NO: 539150 - DNA, 20 bp, mouse
gcggcagaagcccaaagcaa

SEQ ID NO: 539151 - DNA, 20 bp, mouse
ggggcggtggctaccaagaa

SEQ ID NO: 539152 - DNA, 20 bp, mouse
ggaaatcaggaaccacgcgg

SEQ ID NO: 539153 - DNA, 20 bp, mouse
gccaagaaggggtacactgt

SEQ ID NO: 539154 - DNA, 20 bp, mouse
gtgagaagtgatgggctatt

SEQ ID NO: 539155 - DNA, 20 bp, mouse
gtctcttcgagaagccccta

SEQ ID NO: 539156 - DNA, 20 bp, mouse
gtacccgcagccaggaagag

SEQ ID NO: 539157 - DNA, 20 bp, mouse
gggagtcggaggtgttacac

SEQ ID NO: 539158 - DNA, 20 bp, mouse
gacaagcatggcggagtcgg

SEQ ID NO: 539159 - DNA, 20 bp, mouse
gagagcggctcggagcccgc

SEQ ID NO: 539160 - DNA, 20 bp, mouse
ggggacaagcatggcggagt

SEQ ID NO: 539161 - DNA, 20 bp, mouse
gaggggttccgggacaagca

SEQ ID NO: 539162 - DNA, 20 bp, mouse
gcgagatcgtcccgccggag

SEQ ID NO: 539163 - DNA, 20 bp, mouse
ggtcggaggtgttacaccgg

SEQ ID NO: 539164 - DNA, 20 bp, mouse
ggccacgtgcgcgcccgcgg

SEQ ID NO: 539165 - DNA, 20 bp, mouse
gaaaccgacggcggccccgg

SEQ ID NO: 539166 - DNA, 20 bp, mouse
gcccggagcatggcggatac

SEQ ID NO: 539167 - DNA, 20 bp, mouse
ggaaggtccgcagagaagct

SEQ ID NO: 539168 - DNA, 20 bp, mouse
gcgttttacccggagcatgg

SEQ ID NO: 539169 - DNA, 20 bp, mouse
gcgggatagccaactctcgg

SEQ ID NO: 539170 - DNA, 20 bp, mouse
gctgcgggatagccaactct

SEQ ID NO: 539171 - DNA, 20 bp, mouse
ggccggtatccgccatgctc

SEQ ID NO: 539172 - DNA, 20 bp, mouse
gagtcgtgccgcgtgcgcaa

SEQ ID NO: 539173 - DNA, 20 bp, mouse
gccctccgggagcattgggt

SEQ ID NO: 539174 - DNA, 20 bp, mouse
gggagctagctagtcagaca

SEQ ID NO: 539175 - DNA, 20 bp, mouse
gtcggctttagaagttaagg

SEQ ID NO: 539176 - DNA, 20 bp, mouse
gggaagttaacggcgtctat

SEQ ID NO: 539177 - DNA, 20 bp, mouse
gggaacgtcccggaagttaa

SEQ ID NO: 539178 - DNA, 20 bp, mouse
gtaacggcgtctataggcat

SEQ ID NO: 539179 - DNA, 20 bp, mouse
gagccgcaaggagcttcgta

SEQ ID NO: 539180 - DNA, 20 bp, mouse
ggtgatgccgcggaacgtcc

SEQ ID NO: 539181 - DNA, 20 bp, mouse
gatgctctcttgaaacgtag

SEQ ID NO: 539182 - DNA, 20 bp, mouse
gtaaggagaagcgacacctg

SEQ ID NO: 539183 - DNA, 20 bp, mouse
gctccgggtcaggggaccaa

SEQ ID NO: 539184 - DNA, 20 bp, mouse
gcgggtcaggggaccaaggg

SEQ ID NO: 539185 - DNA, 20 bp, mouse
gaacgtagcggcgtccgccg

SEQ ID NO: 539186 - DNA, 20 bp, mouse
gcggctgcgtgcggtgtgag

SEQ ID NO: 539187 - DNA, 20 bp, mouse
gctgcgtgcggtgtgagggg

SEQ ID NO: 539188 - DNA, 20 bp, mouse
gcgggcgggttgcggagggt

SEQ ID NO: 539189 - DNA, 20 bp, mouse
gcggccgcgcgtagccgggt

SEQ ID NO: 539190 - DNA, 20 bp, mouse
gatcggctccgaggacatcg

SEQ ID NO: 539191 - DNA, 20 bp, mouse
gaggagcgggaaggccgaga

SEQ ID NO: 539192 - DNA, 20 bp, mouse
gggaaggagccggctgcgtg

SEQ ID NO: 539193 - DNA, 20 bp, mouse
gtgtcagcccagcgaggaga

SEQ ID NO: 539194 - DNA, 20 bp, mouse
gcgtgcgggccggtgtgccg

SEQ ID NO: 539195 - DNA, 20 bp, mouse
gcagccgagagcctggccaa

SEQ ID NO: 539196 - DNA, 20 bp, mouse
gggtcgcgcgctcttttctc

SEQ ID NO: 539197 - DNA, 20 bp, mouse
gcgctctggcccccatgggt

SEQ ID NO: 539198 - DNA, 20 bp, mouse
gctgaagtcgaggttagagg

SEQ ID NO: 539199 - DNA, 20 bp, mouse
gtccgtcggctcgtttccgg

SEQ ID NO: 539200 - DNA, 20 bp, mouse
ggggaggtaccgagctccgt

SEQ ID NO: 539201 - DNA, 20 bp, mouse
gtcttttctcgggacggtgg

SEQ ID NO: 539202 - DNA, 20 bp, mouse
gcttcgcagcccacccatgg

SEQ ID NO: 539203 - DNA, 20 bp, mouse
gctatgggttccgaaggccc

SEQ ID NO: 539204 - DNA, 20 bp, mouse
gcatccccaaactcaccctc

SEQ ID NO: 539205 - DNA, 20 bp, mouse
gaccgccggaaacgagccga

SEQ ID NO: 539206 - DNA, 20 bp, mouse
gggcgcactcggagtaaacg

SEQ ID NO: 539207 - DNA, 20 bp, mouse
gctgctcgttgaggtaatat

SEQ ID NO: 539208 - DNA, 20 bp, mouse
gccactgagtggagccatgt

SEQ ID NO: 539209 - DNA, 20 bp, mouse
ggcctgcgcagcccactgag

SEQ ID NO: 539210 - DNA, 20 bp, mouse
gttggcgcacgcgattgaag

SEQ ID NO: 539211 - DNA, 20 bp, mouse
gccatgtcggagccaaaacg

SEQ ID NO: 539212 - DNA, 20 bp, mouse
ggagccaaaacgtggtagat

SEQ ID NO: 539213 - DNA, 20 bp, mouse
gctgaggccaggagatcgcg

SEQ ID NO: 539214 - DNA, 20 bp, mouse
ggcgatcgccctgctcgttg

SEQ ID NO: 539215 - DNA, 20 bp, mouse
gcactcggagtaaacgcggc

SEQ ID NO: 539216 - DNA, 20 bp, mouse
gcacgagcgcgggacacccc

SEQ ID NO: 539217 - DNA, 20 bp, mouse
gggcatagtacgcagaacct

SEQ ID NO: 539218 - DNA, 20 bp, mouse
gcgcactgtcgtccaaagtg

SEQ ID NO: 539219 - DNA, 20 bp, mouse
gcattcactccgccacactt

SEQ ID NO: 539220 - DNA, 20 bp, mouse
gtaagctcctcggtagggta

SEQ ID NO: 539221 - DNA, 20 bp, mouse
gacggcgacagctccagcag

SEQ ID NO: 539222 - DNA, 20 bp, mouse
gcccgggcaggcccacatcg

SEQ ID NO: 539223 - DNA, 20 bp, mouse
gtggcggagtgaatgtcatg

SEQ ID NO: 539224 - DNA, 20 bp, mouse
gcgcgctcgtgccatcagga

SEQ ID NO: 539225 - DNA, 20 bp, mouse
gactcgagagcggtctccag

SEQ ID NO: 539226 - DNA, 20 bp, mouse
gtgggctgggatctaaggtg

SEQ ID NO: 539227 - DNA, 20 bp, mouse
ggacggagactattaacacg

SEQ ID NO: 539228 - DNA, 20 bp, mouse
gggctaagggaaagactcgg

SEQ ID NO: 539229 - DNA, 20 bp, mouse
gggcagcgccacggattgag

SEQ ID NO: 539230 - DNA, 20 bp, mouse
gccttgcgcgcacgggtgga

SEQ ID NO: 539231 - DNA, 20 bp, mouse
gacacgcggctctgagagcg

SEQ ID NO: 539232 - DNA, 20 bp, mouse
gtccgtgcggcagaacctgg

SEQ ID NO: 539233 - DNA, 20 bp, mouse
gtcgtcggaaggcagcgcca

SEQ ID NO: 539234 - DNA, 20 bp, mouse
ggaatccttgcgcgcacggg

SEQ ID NO: 539235 - DNA, 20 bp, mouse
gcgtgcgcgcaaggattctt

SEQ ID NO: 539236 - DNA, 20 bp, mouse
ggtcagccggaaccaggtct

SEQ ID NO: 539237 - DNA, 20 bp, mouse
gccgctccacgtgcactggg

SEQ ID NO: 539238 - DNA, 20 bp, mouse
gactggggggaagaactcag

SEQ ID NO: 539239 - DNA, 20 bp, mouse
gggctcggctcgcctagacc

SEQ ID NO: 539240 - DNA, 20 bp, mouse
gacgtggagcgggccttgac

SEQ ID NO: 539241 - DNA, 20 bp, mouse
ggacccggcacctccagtca

SEQ ID NO: 539242 - DNA, 20 bp, mouse
ggctcgcctagacctggttc

SEQ ID NO: 539243 - DNA, 20 bp, mouse
gccaggacccacccatctag

SEQ ID NO: 539244 - DNA, 20 bp, mouse
gatcctgcagacgcacctga

SEQ ID NO: 539245 - DNA, 20 bp, mouse
gccgatgccactagatgggt

SEQ ID NO: 539246 - DNA, 20 bp, mouse
gcggagcaggcgccatggtg

SEQ ID NO: 539247 - DNA, 20 bp, mouse
gccaccaccactcctcacca

SEQ ID NO: 539248 - DNA, 20 bp, mouse
gctgttggcgctgaaggaag

SEQ ID NO: 539249 - DNA, 20 bp, mouse
ggggcacggagcaggcgcca

SEQ ID NO: 539250 - DNA, 20 bp, mouse
gggcgcgcggaaccagactg

SEQ ID NO: 539251 - DNA, 20 bp, mouse
gcaccgagctcacccacctg

SEQ ID NO: 539252 - DNA, 20 bp, mouse
gccgcattgcgagctgggca

SEQ ID NO: 539253 - DNA, 20 bp, mouse
gcaaacccagacgcacgcta

SEQ ID NO: 539254 - DNA, 20 bp, mouse
ggggggagctctagaatgag

SEQ ID NO: 539255 - DNA, 20 bp, mouse
ggctagccgcattgcgagct

SEQ ID NO: 539256 - DNA, 20 bp, mouse
gtgctccacgaggagaggtg

SEQ ID NO: 539257 - DNA, 20 bp, mouse
gcgctccacacctctcctcg

SEQ ID NO: 539258 - DNA, 20 bp, mouse
gtttgctgctccacgaggag

SEQ ID NO: 539259 - DNA, 20 bp, mouse
gaaacgccgtcgcctccccg

SEQ ID NO: 539260 - DNA, 20 bp, mouse
gacatgatgagaccaggtca

SEQ ID NO: 539261 - DNA, 20 bp, mouse
gttcgtccgcggggaggcga

SEQ ID NO: 539262 - DNA, 20 bp, mouse
gcgctaggccttggacgcgg

SEQ ID NO: 539263 - DNA, 20 bp, mouse
gtgatgagaccaggtcaggg

SEQ ID NO: 539264 - DNA, 20 bp, mouse
gggtctgttcgtccgcgggg

SEQ ID NO: 539265 - DNA, 20 bp, mouse
gaacgtggtctgttcgtccg

SEQ ID NO: 539266 - DNA, 20 bp, mouse
gtgcaaccgggaagcgtgaa

SEQ ID NO: 539267 - DNA, 20 bp, mouse
gggttgtgggagctgcaacc

SEQ ID NO: 539268 - DNA, 20 bp, mouse
gctggtcccaaagcacgcat

SEQ ID NO: 539269 - DNA, 20 bp, mouse
gccggccggcacccgagaac

SEQ ID NO: 539270 - DNA, 20 bp, mouse
gggagcgcgccggcggttgt

SEQ ID NO: 539271 - DNA, 20 bp, mouse
gtggcgtcgcgctttgtgag

SEQ ID NO: 539272 - DNA, 20 bp, mouse
gcgccgccgaagaacgaggt

SEQ ID NO: 539273 - DNA, 20 bp, mouse
gcccaaagcacgcatggggt

SEQ ID NO: 539274 - DNA, 20 bp, mouse
ggagcctccgggctcagatg

SEQ ID NO: 539275 - DNA, 20 bp, mouse
gcgtgcggagcaggcccccg

SEQ ID NO: 539276 - DNA, 20 bp, mouse
ggagcggctacttagcacag

SEQ ID NO: 539277 - DNA, 20 bp, mouse
ggcacagcggctgctactag

SEQ ID NO: 539278 - DNA, 20 bp, mouse
gagctcagtgagggtcgtga

SEQ ID NO: 539279 - DNA, 20 bp, mouse
gagtagccgctcgcgccctg

SEQ ID NO: 539280 - DNA, 20 bp, mouse
gtccaacagcgccacagggt

SEQ ID NO: 539281 - DNA, 20 bp, mouse
gccgcgcagcgagctcagtg

SEQ ID NO: 539282 - DNA, 20 bp, mouse
ggcggctgcatcaatacgca

SEQ ID NO: 539283 - DNA, 20 bp, mouse
gtctggaagctcctaccctg

SEQ ID NO: 539284 - DNA, 20 bp, mouse
gggtccctgagaaggtacat

SEQ ID NO: 539285 - DNA, 20 bp, mouse
gtgcgcaacctggctcaccc

SEQ ID NO: 539286 - DNA, 20 bp, mouse
gggcccgggacgaggaagaa

SEQ ID NO: 539287 - DNA, 20 bp, mouse
gcggagcagggtgcctgtca

SEQ ID NO: 539288 - DNA, 20 bp, mouse
gagctcggcgcgcacggccc

SEQ ID NO: 539289 - DNA, 20 bp, mouse
ggctggcgcgagcagctcgg

SEQ ID NO: 539290 - DNA, 20 bp, mouse
ggatccggcgtctccgtgac

SEQ ID NO: 539291 - DNA, 20 bp, mouse
gccgcgctctgactacgggg

SEQ ID NO: 539292 - DNA, 20 bp, mouse
gcgcgggctggcagccgatc

SEQ ID NO: 539293 - DNA, 20 bp, mouse
gccagaagcgggactagacc

SEQ ID NO: 539294 - DNA, 20 bp, mouse
gcgcaggaggagccgcgggc

SEQ ID NO: 539295 - DNA, 20 bp, mouse
gtgcgcgccgagctcgggat

SEQ ID NO: 539296 - DNA, 20 bp, mouse
gctcagtcccttcaccaagg

SEQ ID NO: 539297 - DNA, 20 bp, mouse
gccagggtcacaactttaca

SEQ ID NO: 539298 - DNA, 20 bp, mouse
gagtgacactgtgtcccgtg

SEQ ID NO: 539299 - DNA, 20 bp, mouse
ggactgagactctggcccca

SEQ ID NO: 539300 - DNA, 20 bp, mouse
ggagttgaagactgagactc

SEQ ID NO: 539301 - DNA, 20 bp, mouse
ggctgttagagacacttctg

SEQ ID NO: 539302 - DNA, 20 bp, mouse
gagggtctgccagttgaaca

SEQ ID NO: 539303 - DNA, 20 bp, mouse
gagttgactaggctactccg

SEQ ID NO: 539304 - DNA, 20 bp, mouse
gagtccagccacaaaaagag

SEQ ID NO: 539305 - DNA, 20 bp, mouse
gaagctccgaataggctggg

SEQ ID NO: 539306 - DNA, 20 bp, mouse
gtgggcaacttgaagagtgt

SEQ ID NO: 539307 - DNA, 20 bp, mouse
gtgagcagtcggcagagttg

SEQ ID NO: 539308 - DNA, 20 bp, mouse
gagttgaggtcagctggcat

SEQ ID NO: 539309 - DNA, 20 bp, mouse
gacagggtggcccaggctcc

SEQ ID NO: 539310 - DNA, 20 bp, mouse
ggcaccagaccacaggtgag

SEQ ID NO: 539311 - DNA, 20 bp, mouse
ggccacgtgcccctcacctg

SEQ ID NO: 539312 - DNA, 20 bp, mouse
gccgaccagcaccagaccac

SEQ ID NO: 539313 - DNA, 20 bp, mouse
gctaggctccggtgctggag

SEQ ID NO: 539314 - DNA, 20 bp, mouse
gtgggccaccctgtggccta

SEQ ID NO: 539315 - DNA, 20 bp, mouse
gtaaacccagcccgagccct

SEQ ID NO: 539316 - DNA, 20 bp, mouse
gtacctcaagagcggttatc

SEQ ID NO: 539317 - DNA, 20 bp, mouse
ggtaagctgcaggcggtgag

SEQ ID NO: 539318 - DNA, 20 bp, mouse
gctcccacaagaaggaaact

SEQ ID NO: 539319 - DNA, 20 bp, mouse
gctgcagcttacctcaagag

SEQ ID NO: 539320 - DNA, 20 bp, mouse
gtctacaaccagccaggatg

SEQ ID NO: 539321 - DNA, 20 bp, mouse
gagacagtacaaggcatcct

SEQ ID NO: 539322 - DNA, 20 bp, mouse
gccgcagtagaggagtgatg

SEQ ID NO: 539323 - DNA, 20 bp, mouse
gtctagacaatggtgaggag

SEQ ID NO: 539324 - DNA, 20 bp, mouse
gggaggggaatgagcagtag

SEQ ID NO: 539325 - DNA, 20 bp, mouse
gcttcaactacgtcccgaac

SEQ ID NO: 539326 - DNA, 20 bp, mouse
gagcatgctggatcgagcgt

SEQ ID NO: 539327 - DNA, 20 bp, mouse
gtcaccgaacagtccgtcag

SEQ ID NO: 539328 - DNA, 20 bp, mouse
ggctgtggaacagaagtctg

SEQ ID NO: 539329 - DNA, 20 bp, mouse
ggacccactgacggactgtt

SEQ ID NO: 539330 - DNA, 20 bp, mouse
gcccctagcctcgtacacac

SEQ ID NO: 539331 - DNA, 20 bp, mouse
gagacagcatttcaacatga

SEQ ID NO: 539332 - DNA, 20 bp, mouse
ggccccgtctggatccaagt

SEQ ID NO: 539333 - DNA, 20 bp, mouse
gctggacgctgcaatcaatc

SEQ ID NO: 539334 - DNA, 20 bp, mouse
gtcctacttggatccagacg

SEQ ID NO: 539335 - DNA, 20 bp, mouse
gcgctgcaatcaatcaggtt

SEQ ID NO: 539336 - DNA, 20 bp, mouse
gtagtgcctctgccgcggga

SEQ ID NO: 539337 - DNA, 20 bp, mouse
gtgggccctacaaggcaccc

SEQ ID NO: 539338 - DNA, 20 bp, mouse
gagcggcgctgggccctaca

SEQ ID NO: 539339 - DNA, 20 bp, mouse
gggcggcgctgggctctcag

SEQ ID NO: 539340 - DNA, 20 bp, mouse
ggcccacccgccaggaaaga

SEQ ID NO: 539341 - DNA, 20 bp, mouse
gcgcgctcgccgcaagaggt

SEQ ID NO: 539342 - DNA, 20 bp, mouse
gccgctctggctctcaactc

SEQ ID NO: 539343 - DNA, 20 bp, mouse
ggcaagggcgtcaggagccg

SEQ ID NO: 539344 - DNA, 20 bp, mouse
gcactagtgaggctctgagc

SEQ ID NO: 539345 - DNA, 20 bp, mouse
ggcagtgaaggaacgagccc

SEQ ID NO: 539346 - DNA, 20 bp, mouse
gctggctgcgcggagtgcag

SEQ ID NO: 539347 - DNA, 20 bp, mouse
gcaggccgccgcccgaagtt

SEQ ID NO: 539348 - DNA, 20 bp, mouse
gcccgcggctcgctgagtcc

SEQ ID NO: 539349 - DNA, 20 bp, mouse
gctttcagccaaacttcggg

SEQ ID NO: 539350 - DNA, 20 bp, mouse
ggagtgcaggggcggcgcag

SEQ ID NO: 539351 - DNA, 20 bp, mouse
gcagagagggatggtctccc

SEQ ID NO: 539352 - DNA, 20 bp, mouse
gccgtagcgcagagacagag

SEQ ID NO: 539353 - DNA, 20 bp, mouse
gaagactcgaggcccggacg

SEQ ID NO: 539354 - DNA, 20 bp, mouse
gagcagcgcccgcagcgcgg

SEQ ID NO: 539355 - DNA, 20 bp, mouse
ggaaactttcagccaaactt

SEQ ID NO: 539356 - DNA, 20 bp, mouse
gagggctccgggcacgtccc

SEQ ID NO: 539357 - DNA, 20 bp, mouse
gcagcccgacagcctcactt

SEQ ID NO: 539358 - DNA, 20 bp, mouse
gggctgcaggtgagggatca

SEQ ID NO: 539359 - DNA, 20 bp, mouse
ggatcagggactcggagggt

SEQ ID NO: 539360 - DNA, 20 bp, mouse
gctcacttcggcgaagttgg

SEQ ID NO: 539361 - DNA, 20 bp, mouse
gctgctgctagcggggctgg

SEQ ID NO: 539362 - DNA, 20 bp, mouse
gcaaggccatcaggcgacga

SEQ ID NO: 539363 - DNA, 20 bp, mouse
gagcctcacttcggcgaagt

SEQ ID NO: 539364 - DNA, 20 bp, mouse
gccccccaggattaaagccg

SEQ ID NO: 539365 - DNA, 20 bp, mouse
ggcaggggcagcgcccgcat

SEQ ID NO: 539366 - DNA, 20 bp, mouse
gggaggaagaagggcggtag

SEQ ID NO: 539367 - DNA, 20 bp, mouse
gtgaggcgtgcagcaggctc

SEQ ID NO: 539368 - DNA, 20 bp, mouse
gctggccacaagggctctga

SEQ ID NO: 539369 - DNA, 20 bp, mouse
gcaggaaacagctcagactg

SEQ ID NO: 539370 - DNA, 20 bp, mouse
gtccctgtcatcctgaccag

SEQ ID NO: 539371 - DNA, 20 bp, mouse
gggagggctgactgactccg

SEQ ID NO: 539372 - DNA, 20 bp, mouse
gggatctcctctccctcttc

SEQ ID NO: 539373 - DNA, 20 bp, mouse
gccaagtcccaggctctgaa

SEQ ID NO: 539374 - DNA, 20 bp, mouse
gacctctggtcaggatgaca

SEQ ID NO: 539375 - DNA, 20 bp, mouse
ggggaccctcagagcccttg

SEQ ID NO: 539376 - DNA, 20 bp, mouse
gggctgtgcaaggagctcaa

SEQ ID NO: 539377 - DNA, 20 bp, mouse
ggaccctgaggggacctccc

SEQ ID NO: 539378 - DNA, 20 bp, mouse
gaccctgtggagcacaccca

SEQ ID NO: 539379 - DNA, 20 bp, mouse
ggaggtggtcaccttactaa

SEQ ID NO: 539380 - DNA, 20 bp, mouse
ggacattgcgcgaccctgag

SEQ ID NO: 539381 - DNA, 20 bp, mouse
ggtctcccgttcctttagta

SEQ ID NO: 539382 - DNA, 20 bp, mouse
gtagacgcccacgctcaggt

SEQ ID NO: 539383 - DNA, 20 bp, mouse
gggtcaccttactaaaggaa

SEQ ID NO: 539384 - DNA, 20 bp, mouse
gcagcctgggaggtcccctc

SEQ ID NO: 539385 - DNA, 20 bp, mouse
gagtcggcgcgggacaactg

SEQ ID NO: 539386 - DNA, 20 bp, mouse
gccgagggcaatgcagactc

SEQ ID NO: 539387 - DNA, 20 bp, mouse
gcagcgacttccaggaccta

SEQ ID NO: 539388 - DNA, 20 bp, mouse
gctctggagtcgggcgctac

SEQ ID NO: 539389 - DNA, 20 bp, mouse
gggagtgacattgccatggg

SEQ ID NO: 539390 - DNA, 20 bp, mouse
gtcgggcccgcgccaatgag

SEQ ID NO: 539391 - DNA, 20 bp, mouse
ggtgtgggctctcggcgtcg

SEQ ID NO: 539392 - DNA, 20 bp, mouse
gtccgcgcgtagccggccga

SEQ ID NO: 539393 - DNA, 20 bp, mouse
gtccggcctgtggccacctg

SEQ ID NO: 539394 - DNA, 20 bp, mouse
gccagcgggaagctctccac

SEQ ID NO: 539395 - DNA, 20 bp, mouse
ggccggagtgacattgccat

SEQ ID NO: 539396 - DNA, 20 bp, mouse
gcagccagacctgggtgaag

SEQ ID NO: 539397 - DNA, 20 bp, mouse
ggagcaggaagcctaggcag

SEQ ID NO: 539398 - DNA, 20 bp, mouse
ggctgttacaggctggagat

SEQ ID NO: 539399 - DNA, 20 bp, mouse
gtgcctgctagggctgttac

SEQ ID NO: 539400 - DNA, 20 bp, mouse
gtgagcccgggacggaccag

SEQ ID NO: 539401 - DNA, 20 bp, mouse
gagcctgtaacagccctagc

SEQ ID NO: 539402 - DNA, 20 bp, mouse
ggctcatgttctgcctgcta

SEQ ID NO: 539403 - DNA, 20 bp, mouse
gaggaggtccaagtaatcgg

SEQ ID NO: 539404 - DNA, 20 bp, mouse
gtcaggggcgaaccaaggca

SEQ ID NO: 539405 - DNA, 20 bp, mouse
gctgccccttcacccaggtc

SEQ ID NO: 539406 - DNA, 20 bp, mouse
ggctaggagcgggaatggag

SEQ ID NO: 539407 - DNA, 20 bp, mouse
gaggagggcgagtgaatgag

SEQ ID NO: 539408 - DNA, 20 bp, mouse
ggcggcggacccggctaacg

SEQ ID NO: 539409 - DNA, 20 bp, mouse
gtgtcggctaggagcgggaa

SEQ ID NO: 539410 - DNA, 20 bp, mouse
ggccgctgcaccgggagaag

SEQ ID NO: 539411 - DNA, 20 bp, mouse
gcagagcgggagtgaatgag

SEQ ID NO: 539412 - DNA, 20 bp, mouse
gcggcgcggagcagcgcagg

SEQ ID NO: 539413 - DNA, 20 bp, mouse
ggcaggcggcacacgcgccc

SEQ ID NO: 539414 - DNA, 20 bp, mouse
gagcagctgcagtgcagtgt

SEQ ID NO: 539415 - DNA, 20 bp, mouse
gcgagtgaatgagcgggagg

SEQ ID NO: 539416 - DNA, 20 bp, mouse
gcgagggcagcagcagagac

SEQ ID NO: 539417 - DNA, 20 bp, mouse
gtcgctagtgggggcccggg

SEQ ID NO: 539418 - DNA, 20 bp, mouse
gggaggggccaggacgctgt

SEQ ID NO: 539419 - DNA, 20 bp, mouse
gtctgggatggagaactgag

SEQ ID NO: 539420 - DNA, 20 bp, mouse
gggccggagataagaagcgg

SEQ ID NO: 539421 - DNA, 20 bp, mouse
gcctagctgagaagatgctc

SEQ ID NO: 539422 - DNA, 20 bp, mouse
gcggagataagaagcggagg

SEQ ID NO: 539423 - DNA, 20 bp, mouse
ggggggccggagataagaag

SEQ ID NO: 539424 - DNA, 20 bp, mouse
ggccggtcactgagccagtg

SEQ ID NO: 539425 - DNA, 20 bp, mouse
gccaagcgcagcaacacggg

SEQ ID NO: 539426 - DNA, 20 bp, mouse
gttctctggagaggtccttc

SEQ ID NO: 539427 - DNA, 20 bp, mouse
gagaatccagattgctccta

SEQ ID NO: 539428 - DNA, 20 bp, mouse
gccattgtcaaatggaggtt

SEQ ID NO: 539429 - DNA, 20 bp, mouse
gatccagattgctcctaggg

SEQ ID NO: 539430 - DNA, 20 bp, mouse
gcaatctggattctctggag

SEQ ID NO: 539431 - DNA, 20 bp, mouse
gctctcatccggcctagagt

SEQ ID NO: 539432 - DNA, 20 bp, mouse
gaaactggctggttaaccac

SEQ ID NO: 539433 - DNA, 20 bp, mouse
gtctgagtaggtgtgcatat

SEQ ID NO: 539434 - DNA, 20 bp, mouse
gtcttgatgtcaatattata

SEQ ID NO: 539435 - DNA, 20 bp, mouse
gtagggatgttagccgagta

SEQ ID NO: 539436 - DNA, 20 bp, mouse
gacgcacaggctcaaatgga

SEQ ID NO: 539437 - DNA, 20 bp, mouse
gcgttcagaatccagcacac

SEQ ID NO: 539438 - DNA, 20 bp, mouse
gacggaaaggaataacgtgt

SEQ ID NO: 539439 - DNA, 20 bp, mouse
gcaggctcaaatggacggaa

SEQ ID NO: 539440 - DNA, 20 bp, mouse
gaccatggtgtgaagagtca

SEQ ID NO: 539441 - DNA, 20 bp, mouse
gtgcaacgcacaggctcaaa

SEQ ID NO: 539442 - DNA, 20 bp, mouse
gtcctaagcatgcaacgcac

SEQ ID NO: 539443 - DNA, 20 bp, mouse
ggcgttgcatgcttaggaaa

SEQ ID NO: 539444 - DNA, 20 bp, mouse
gaacgagagtgggtccttcg

SEQ ID NO: 539445 - DNA, 20 bp, mouse
gagtaagagaagtgtcatgc

SEQ ID NO: 539446 - DNA, 20 bp, mouse
gcggtcctgagcaccgagca

SEQ ID NO: 539447 - DNA, 20 bp, mouse
ggagctggctggccaacgaa

SEQ ID NO: 539448 - DNA, 20 bp, mouse
gcggcatggcggtgtcctgg

SEQ ID NO: 539449 - DNA, 20 bp, mouse
gctcggtgctcaggaccgaa

SEQ ID NO: 539450 - DNA, 20 bp, mouse
gggccggggcagcagatcca

SEQ ID NO: 539451 - DNA, 20 bp, mouse
gcctccatcctaccaggcag

SEQ ID NO: 539452 - DNA, 20 bp, mouse
ggcagcactccccgcgccgg

SEQ ID NO: 539453 - DNA, 20 bp, mouse
gtctcagaatgtgtactggt

SEQ ID NO: 539454 - DNA, 20 bp, mouse
gcggcggcatggcggtgtcc

SEQ ID NO: 539455 - DNA, 20 bp, mouse
gaaggagcgatcagtggccg

SEQ ID NO: 539456 - DNA, 20 bp, mouse
gtaggcggggcgtgagagag

SEQ ID NO: 539457 - DNA, 20 bp, mouse
gagtagatggcccaaggctt

SEQ ID NO: 539458 - DNA, 20 bp, mouse
gccctagagagctcatggag

SEQ ID NO: 539459 - DNA, 20 bp, mouse
ggaccctctcctcagtgcta

SEQ ID NO: 539460 - DNA, 20 bp, mouse
gtctctaggggatcagatac

SEQ ID NO: 539461 - DNA, 20 bp, mouse
ggacttgtttaagtagttct

SEQ ID NO: 539462 - DNA, 20 bp, mouse
ggagagaggggcctaagcct

SEQ ID NO: 539463 - DNA, 20 bp, mouse
gtccaccagggatgtgagag

SEQ ID NO: 539464 - DNA, 20 bp, mouse
gctgatggcaggggatcccg

SEQ ID NO: 539465 - DNA, 20 bp, mouse
ggtccttgaaactgagtaga

SEQ ID NO: 539466 - DNA, 20 bp, mouse
gtgcaccaaggctacagcat

SEQ ID NO: 539467 - DNA, 20 bp, mouse
gtacagcatgggctgatact

SEQ ID NO: 539468 - DNA, 20 bp, mouse
gcttcaagcatccatagtca

SEQ ID NO: 539469 - DNA, 20 bp, mouse
gcttgggcttgccatgacta

SEQ ID NO: 539470 - DNA, 20 bp, mouse
gtctgtgtgaggaaaggtag

SEQ ID NO: 539471 - DNA, 20 bp, mouse
gagtcggtccatttgcacca

SEQ ID NO: 539472 - DNA, 20 bp, mouse
gagatggagagaacccccta

SEQ ID NO: 539473 - DNA, 20 bp, mouse
ggagctcctacaggcagaag

SEQ ID NO: 539474 - DNA, 20 bp, mouse
ggcctgtaggagctcttcta

SEQ ID NO: 539475 - DNA, 20 bp, mouse
ggtgcaaatggaccgactcc

SEQ ID NO: 539476 - DNA, 20 bp, mouse
gtggctcagacacctaaggg

SEQ ID NO: 539477 - DNA, 20 bp, mouse
gcaggccgaggcggcactgg

SEQ ID NO: 539478 - DNA, 20 bp, mouse
ggaggcggcactggcggctg

SEQ ID NO: 539479 - DNA, 20 bp, mouse
gcaccgagaagcgtgtaggt

SEQ ID NO: 539480 - DNA, 20 bp, mouse
gcgcttggctcagacaccta

SEQ ID NO: 539481 - DNA, 20 bp, mouse
gtgtaggtgggcacgtcgta

SEQ ID NO: 539482 - DNA, 20 bp, mouse
gggaagcctgaaccccacca

SEQ ID NO: 539483 - DNA, 20 bp, mouse
ggcaagagtacccgcagagc

SEQ ID NO: 539484 - DNA, 20 bp, mouse
ggtgtctgagccaagcgatg

SEQ ID NO: 539485 - DNA, 20 bp, mouse
gaaggcaccgagaagcgtgt

SEQ ID NO: 539486 - DNA, 20 bp, mouse
gtccagaggaagaacgttac

SEQ ID NO: 539487 - DNA, 20 bp, mouse
ggccagtaacgttcttcctc

SEQ ID NO: 539488 - DNA, 20 bp, mouse
gatcggggattgatgatcaa

SEQ ID NO: 539489 - DNA, 20 bp, mouse
ggtctctgaggtttgagttt

SEQ ID NO: 539490 - DNA, 20 bp, mouse
ggatcatcaatccccgataa

SEQ ID NO: 539491 - DNA, 20 bp, mouse
gacttacagggccgttatcg

SEQ ID NO: 539492 - DNA, 20 bp, mouse
ggttactggctgtacttaca

SEQ ID NO: 539493 - DNA, 20 bp, mouse
gaccagaagcaacagaatgt

SEQ ID NO: 539494 - DNA, 20 bp, mouse
gacaaaagcacaagtccctt

SEQ ID NO: 539495 - DNA, 20 bp, mouse
gggtgctttggaagtggaca

SEQ ID NO: 539496 - DNA, 20 bp, mouse
gaagtctgcgaggccgccgt

SEQ ID NO: 539497 - DNA, 20 bp, mouse
gggccgctccatagaccccg

SEQ ID NO: 539498 - DNA, 20 bp, mouse
gcggctctcggcgcccacgg

SEQ ID NO: 539499 - DNA, 20 bp, mouse
gcgccccggggtctatggag

SEQ ID NO: 539500 - DNA, 20 bp, mouse
gcggcgtggggtccactggg

SEQ ID NO: 539501 - DNA, 20 bp, mouse
gcatagaccccggggcgcgc

SEQ ID NO: 539502 - DNA, 20 bp, mouse
ggcccctccacgccacccag

SEQ ID NO: 539503 - DNA, 20 bp, mouse
gactttgagaccacggacag

SEQ ID NO: 539504 - DNA, 20 bp, mouse
ggtccactgggtggcgtgga

SEQ ID NO: 539505 - DNA, 20 bp, mouse
gaccgccgggatccagaaag

SEQ ID NO: 539506 - DNA, 20 bp, mouse
gcggagccccgagaccccgg

SEQ ID NO: 539507 - DNA, 20 bp, mouse
gacccgagggacccgcgcag

SEQ ID NO: 539508 - DNA, 20 bp, mouse
ggctcgcgccgcaaactctt

SEQ ID NO: 539509 - DNA, 20 bp, mouse
gccgcggagccccgagaccc

SEQ ID NO: 539510 - DNA, 20 bp, mouse
ggagtttgcggcgcgagcgg

SEQ ID NO: 539511 - DNA, 20 bp, mouse
ggccaggccgggcaccgact

SEQ ID NO: 539512 - DNA, 20 bp, mouse
gcgctgccgccggggtctcg

SEQ ID NO: 539513 - DNA, 20 bp, mouse
gctcgccaagagagaggact

SEQ ID NO: 539514 - DNA, 20 bp, mouse
gtcttgggcgcgtagagctg

SEQ ID NO: 539515 - DNA, 20 bp, mouse
ggcgggtccctcgggtcctg

SEQ ID NO: 539516 - DNA, 20 bp, mouse
ggtggccgcggctcactaat

SEQ ID NO: 539517 - DNA, 20 bp, mouse
ggcaccggccggtaccccag

SEQ ID NO: 539518 - DNA, 20 bp, mouse
ggcaccccgcagaacgtcca

SEQ ID NO: 539519 - DNA, 20 bp, mouse
gggctcactaatgggattgc

SEQ ID NO: 539520 - DNA, 20 bp, mouse
ggcctctccgccgcgcacag

SEQ ID NO: 539521 - DNA, 20 bp, mouse
gccctccttctatagcacag

SEQ ID NO: 539522 - DNA, 20 bp, mouse
gccgccgcgcacagtggccg

SEQ ID NO: 539523 - DNA, 20 bp, mouse
gaccccagtacccgagacgg

SEQ ID NO: 539524 - DNA, 20 bp, mouse
gactactcaccgctgctggt

SEQ ID NO: 539525 - DNA, 20 bp, mouse
gagcgtgcaggtgacggccg

SEQ ID NO: 539526 - DNA, 20 bp, mouse
ggccgagcggagcccaggag

SEQ ID NO: 539527 - DNA, 20 bp, mouse
gtcgctctcgctccactcct

SEQ ID NO: 539528 - DNA, 20 bp, mouse
ggcgaaaagaccgggaagca

SEQ ID NO: 539529 - DNA, 20 bp, mouse
gtccactcctgggctccgct

SEQ ID NO: 539530 - DNA, 20 bp, mouse
gtcctttcccgatgcaccgg

SEQ ID NO: 539531 - DNA, 20 bp, mouse
gggcggatcgaggcaggcga

SEQ ID NO: 539532 - DNA, 20 bp, mouse
gccttgtccgcttcagccaa

SEQ ID NO: 539533 - DNA, 20 bp, mouse
gagctgacggggaccaggga

SEQ ID NO: 539534 - DNA, 20 bp, mouse
ggccgagattcggaacctca

SEQ ID NO: 539535 - DNA, 20 bp, mouse
ggcacgctgtgctagacaag

SEQ ID NO: 539536 - DNA, 20 bp, mouse
gccagtggaaccgggagatg

SEQ ID NO: 539537 - DNA, 20 bp, mouse
ggcacagggagcggcctgaa

SEQ ID NO: 539538 - DNA, 20 bp, mouse
ggcgggttcagcacctccag

SEQ ID NO: 539539 - DNA, 20 bp, mouse
gatccgagctgcacagggag

SEQ ID NO: 539540 - DNA, 20 bp, mouse
ggcaaacacggcgacagccc

SEQ ID NO: 539541 - DNA, 20 bp, mouse
ggtggggaagctctgaggag

SEQ ID NO: 539542 - DNA, 20 bp, mouse
gccagcctggctacatccga

SEQ ID NO: 539543 - DNA, 20 bp, mouse
gcagcacctccagtggaacc

SEQ ID NO: 539544 - DNA, 20 bp, mouse
gccggcgccgccgcatctcc

SEQ ID NO: 539545 - DNA, 20 bp, mouse
ggaaagaccaggggctgagg

SEQ ID NO: 539546 - DNA, 20 bp, mouse
gcagctccatggcccggtgt

SEQ ID NO: 539547 - DNA, 20 bp, mouse
gaggagcagcgccagggcag

SEQ ID NO: 539548 - DNA, 20 bp, mouse
ggggccatggagctgtgaca

SEQ ID NO: 539549 - DNA, 20 bp, mouse
gtgtaccacgcgagggctgg

SEQ ID NO: 539550 - DNA, 20 bp, mouse
ggcccggtgtaggacgctgg

SEQ ID NO: 539551 - DNA, 20 bp, mouse
gggccaccagcgtcctacac

SEQ ID NO: 539552 - DNA, 20 bp, mouse
gagcgtcctacaccgggcca

SEQ ID NO: 539553 - DNA, 20 bp, mouse
ggcgggcttgtaccacgcga

SEQ ID NO: 539554 - DNA, 20 bp, mouse
gatggagctgtgacaggggc

SEQ ID NO: 539555 - DNA, 20 bp, mouse
gagtctccagcactccgggt

SEQ ID NO: 539556 - DNA, 20 bp, mouse
gtgcagatccctgtaaacgt

SEQ ID NO: 539557 - DNA, 20 bp, mouse
gctgctgagtggaatcctgg

SEQ ID NO: 539558 - DNA, 20 bp, mouse
gcaggcactgctaccgccag

SEQ ID NO: 539559 - DNA, 20 bp, mouse
gccgctgccgcagccactgg

SEQ ID NO: 539560 - DNA, 20 bp, mouse
gagcagccccgcgaaactcg

SEQ ID NO: 539561 - DNA, 20 bp, mouse
ggggctgctgagtggaatcc

SEQ ID NO: 539562 - DNA, 20 bp, mouse
gcatgacggcgaggaagtag

SEQ ID NO: 539563 - DNA, 20 bp, mouse
ggtttcgcggggctgctgag

SEQ ID NO: 539564 - DNA, 20 bp, mouse
gggaagtccgcgatgttgat

SEQ ID NO: 539565 - DNA, 20 bp, mouse
gctgctaccgccagtggctg

SEQ ID NO: 539566 - DNA, 20 bp, mouse
gccggcgcctgaccaaggag

SEQ ID NO: 539567 - DNA, 20 bp, mouse
gcggaaccggcgcctgacca

SEQ ID NO: 539568 - DNA, 20 bp, mouse
ggaggagaaggcgacctcta

SEQ ID NO: 539569 - DNA, 20 bp, mouse
gcaccgcgacccgagcgtcg

SEQ ID NO: 539570 - DNA, 20 bp, mouse
gccccgcgcggcgacagcat

SEQ ID NO: 539571 - DNA, 20 bp, mouse
gcagcaggccgagggccggg

SEQ ID NO: 539572 - DNA, 20 bp, mouse
gtggcgggcggtttcggaac

SEQ ID NO: 539573 - DNA, 20 bp, mouse
gtcttgccccctccttggtc

SEQ ID NO: 539574 - DNA, 20 bp, mouse
ggacccgagcgtcgcggcac

SEQ ID NO: 539575 - DNA, 20 bp, mouse
gagagcacagggcagcgtga

SEQ ID NO: 539576 - DNA, 20 bp, mouse
gagccggggaagctgaggac

SEQ ID NO: 539577 - DNA, 20 bp, mouse
ggagacagccggggaagctg

SEQ ID NO: 539578 - DNA, 20 bp, mouse
gatcaaggaaaagcaggacc

SEQ ID NO: 539579 - DNA, 20 bp, mouse
gaccaggccttggagacagc

SEQ ID NO: 539580 - DNA, 20 bp, mouse
ggaaaagcaggaccaggcct

SEQ ID NO: 539581 - DNA, 20 bp, mouse
ggaagggatagaggtcagag

SEQ ID NO: 539582 - DNA, 20 bp, mouse
gccttaatgtgcaaactcag

SEQ ID NO: 539583 - DNA, 20 bp, mouse
ggagggttatcactaagagg

SEQ ID NO: 539584 - DNA, 20 bp, mouse
ggacgagggttatcactaag

SEQ ID NO: 539585 - DNA, 20 bp, mouse
gtccttggtgcctcccatta

SEQ ID NO: 539586 - DNA, 20 bp, mouse
ggccagcagcaggatcgtgg

SEQ ID NO: 539587 - DNA, 20 bp, mouse
ggcggccagaaaacgcatcg

SEQ ID NO: 539588 - DNA, 20 bp, mouse
gaaagctctgcaatctagga

SEQ ID NO: 539589 - DNA, 20 bp, mouse
ggtttatcttgtgactgctc

SEQ ID NO: 539590 - DNA, 20 bp, mouse
ggaagtgcaggggctccgcc

SEQ ID NO: 539591 - DNA, 20 bp, mouse
gctggaacgtggaattgact

SEQ ID NO: 539592 - DNA, 20 bp, mouse
gtatgaaagctctgcaatct

SEQ ID NO: 539593 - DNA, 20 bp, mouse
ggccgccacgatcctgctgc

SEQ ID NO: 539594 - DNA, 20 bp, mouse
ggtctcctcgagtgggctca

SEQ ID NO: 539595 - DNA, 20 bp, mouse
gccactcgaggagacccccg

SEQ ID NO: 539596 - DNA, 20 bp, mouse
gagatggagctgtctgcagt

SEQ ID NO: 539597 - DNA, 20 bp, mouse
gacagctccatcttgctcag

SEQ ID NO: 539598 - DNA, 20 bp, mouse
gcgggagcagggagtattat

SEQ ID NO: 539599 - DNA, 20 bp, mouse
ggtaggcgagcgggtcttcg

SEQ ID NO: 539600 - DNA, 20 bp, mouse
gctgtctgcagtaggcgagc

SEQ ID NO: 539601 - DNA, 20 bp, mouse
gcaccaccgcggggaacaca

SEQ ID NO: 539602 - DNA, 20 bp, mouse
gaggcggcaagaagacacct

SEQ ID NO: 539603 - DNA, 20 bp, mouse
gaagatgcagggacgcgagg

SEQ ID NO: 539604 - DNA, 20 bp, mouse
gcggatccggcgtttaatga

SEQ ID NO: 539605 - DNA, 20 bp, mouse
gagggagtattatgggctgt

SEQ ID NO: 539606 - DNA, 20 bp, mouse
gcgggcagcatggcacccca

SEQ ID NO: 539607 - DNA, 20 bp, mouse
gagccgggaagcgagagggg

SEQ ID NO: 539608 - DNA, 20 bp, mouse
gcagtcgcagttcccggagt

SEQ ID NO: 539609 - DNA, 20 bp, mouse
gcgggctcggtacccactcc

SEQ ID NO: 539610 - DNA, 20 bp, mouse
ggagaagccgggaagcgaga

SEQ ID NO: 539611 - DNA, 20 bp, mouse
ggagcgctcgctcacccggg

SEQ ID NO: 539612 - DNA, 20 bp, mouse
gtgctctccggcctcatcct

SEQ ID NO: 539613 - DNA, 20 bp, mouse
gcaggctgttgggtgctccg

SEQ ID NO: 539614 - DNA, 20 bp, mouse
gtgccatgctgcccgggtag

SEQ ID NO: 539615 - DNA, 20 bp, mouse
gtgcttcagcgccgctaccc

SEQ ID NO: 539616 - DNA, 20 bp, mouse
gcccggccggggtcgtgggg

SEQ ID NO: 539617 - DNA, 20 bp, mouse
ggccgagccgggccggagca

SEQ ID NO: 539618 - DNA, 20 bp, mouse
ggagcagggcgcagggtgct

SEQ ID NO: 539619 - DNA, 20 bp, mouse
gcagccccgggtcaccgagg

SEQ ID NO: 539620 - DNA, 20 bp, mouse
ggaaggcagagctgccactg

SEQ ID NO: 539621 - DNA, 20 bp, mouse
ggagagccacacatgcctgg

SEQ ID NO: 539622 - DNA, 20 bp, mouse
ggcgaggcgcagtcccacga

SEQ ID NO: 539623 - DNA, 20 bp, mouse
gaagagtggacaacatctgg

SEQ ID NO: 539624 - DNA, 20 bp, mouse
gctgcagccccgggtcaccg

SEQ ID NO: 539625 - DNA, 20 bp, mouse
gacgagcctggtgatgaagt

SEQ ID NO: 539626 - DNA, 20 bp, mouse
gggagaagcggcccttcgag

SEQ ID NO: 539627 - DNA, 20 bp, mouse
ggggcgggggacagacccag

SEQ ID NO: 539628 - DNA, 20 bp, mouse
gaggagcaggcggcgagcga

SEQ ID NO: 539629 - DNA, 20 bp, mouse
gcccgagggtcgcagtacct

SEQ ID NO: 539630 - DNA, 20 bp, mouse
gttgatgggcgacacctcgg

SEQ ID NO: 539631 - DNA, 20 bp, mouse
gcgcctgccgagagccgccg

SEQ ID NO: 539632 - DNA, 20 bp, mouse
gcccggcccaggcacccgct

SEQ ID NO: 539633 - DNA, 20 bp, mouse
gcctccgcccccttccccgt

SEQ ID NO: 539634 - DNA, 20 bp, mouse
ggcgagaggagcggctgagg

SEQ ID NO: 539635 - DNA, 20 bp, mouse
ggggctgcctacggggaagg

SEQ ID NO: 539636 - DNA, 20 bp, mouse
gggcagcatggactccaagt

SEQ ID NO: 539637 - DNA, 20 bp, mouse
gaagaccgtgggcactcagg

SEQ ID NO: 539638 - DNA, 20 bp, mouse
gaattggggccacactgaag

SEQ ID NO: 539639 - DNA, 20 bp, mouse
ggctccctgcctcttcagtg

SEQ ID NO: 539640 - DNA, 20 bp, mouse
gaagtctggcttctaaggga

SEQ ID NO: 539641 - DNA, 20 bp, mouse
gctactgctgctgctgaatt

SEQ ID NO: 539642 - DNA, 20 bp, mouse
gttctaggggaaacttgcgt

SEQ ID NO: 539643 - DNA, 20 bp, mouse
gtgaagaccttagcagcctg

SEQ ID NO: 539644 - DNA, 20 bp, mouse
ggaacacgaaagagggaccc

SEQ ID NO: 539645 - DNA, 20 bp, mouse
gggaaggctgggctccttct

SEQ ID NO: 539646 - DNA, 20 bp, mouse
gcaggaagcgctcactccct

SEQ ID NO: 539647 - DNA, 20 bp, mouse
ggcggaccgcggcgctggga

SEQ ID NO: 539648 - DNA, 20 bp, mouse
gcggggcgggcagcagagtc

SEQ ID NO: 539649 - DNA, 20 bp, mouse
gtggagggtaagtgacacta

SEQ ID NO: 539650 - DNA, 20 bp, mouse
gagcagagtccggcggaccg

SEQ ID NO: 539651 - DNA, 20 bp, mouse
gccggtgaagcggggacgaa

SEQ ID NO: 539652 - DNA, 20 bp, mouse
ggctcactccctggggtgca

SEQ ID NO: 539653 - DNA, 20 bp, mouse
gggctatagacccaagagta

SEQ ID NO: 539654 - DNA, 20 bp, mouse
gtcaccggacgctcgcaggc

SEQ ID NO: 539655 - DNA, 20 bp, mouse
gaagtgacactagggtaggg

SEQ ID NO: 539656 - DNA, 20 bp, mouse
gtctgagagtgcagcaagag

SEQ ID NO: 539657 - DNA, 20 bp, mouse
gtctgcagcggggctgacgc

SEQ ID NO: 539658 - DNA, 20 bp, mouse
gcaggtgacctaggtgcgac

SEQ ID NO: 539659 - DNA, 20 bp, mouse
gcggagagtgcagagcccgc

SEQ ID NO: 539660 - DNA, 20 bp, mouse
gggaacaggtgagggcacgg

SEQ ID NO: 539661 - DNA, 20 bp, mouse
gctctcagaactgcactggt

SEQ ID NO: 539662 - DNA, 20 bp, mouse
gcttgcccaggaacaggtga

SEQ ID NO: 539663 - DNA, 20 bp, mouse
gtagccacttccctctgcag

SEQ ID NO: 539664 - DNA, 20 bp, mouse
gttcatgtcacggagactag

SEQ ID NO: 539665 - DNA, 20 bp, mouse
ggcagcggggctgacgccgg

SEQ ID NO: 539666 - DNA, 20 bp, mouse
ggtcagggaaaccaaagcta

SEQ ID NO: 539667 - DNA, 20 bp, mouse
ggaagctgcaggtaggtccg

SEQ ID NO: 539668 - DNA, 20 bp, mouse
gcagcttcagctcctgcccg

SEQ ID NO: 539669 - DNA, 20 bp, mouse
gggtcccgccggcggcggct

SEQ ID NO: 539670 - DNA, 20 bp, mouse
ggatgtgggaccctctaccc

SEQ ID NO: 539671 - DNA, 20 bp, mouse
ggatgctcgcccggcggccg

SEQ ID NO: 539672 - DNA, 20 bp, mouse
gtgcgggtcaactaagaatt

SEQ ID NO: 539673 - DNA, 20 bp, mouse
ggccgccggcgggaccgcgc

SEQ ID NO: 539674 - DNA, 20 bp, mouse
gagtttagacaagggcctga

SEQ ID NO: 539675 - DNA, 20 bp, mouse
gtgagggatgaggagtgttg

SEQ ID NO: 539676 - DNA, 20 bp, mouse
gagccggccgcgggcatcat

SEQ ID NO: 539677 - DNA, 20 bp, mouse
ggtgggactcaccagcgacg

SEQ ID NO: 539678 - DNA, 20 bp, mouse
gcgctggtgagtcccactgg

SEQ ID NO: 539679 - DNA, 20 bp, mouse
gctgaggctgagagtcggct

SEQ ID NO: 539680 - DNA, 20 bp, mouse
ggaggcctgcgagatcccgg

SEQ ID NO: 539681 - DNA, 20 bp, mouse
ggtgatcgaggacacgtacg

SEQ ID NO: 539682 - DNA, 20 bp, mouse
gcgatcacctccccgccagt

SEQ ID NO: 539683 - DNA, 20 bp, mouse
ggcgccagcttcaagtccac

SEQ ID NO: 539684 - DNA, 20 bp, mouse
gcccgagctagagtatgcgg

SEQ ID NO: 539685 - DNA, 20 bp, mouse
ggtgcccgagctagagtatg

SEQ ID NO: 539686 - DNA, 20 bp, mouse
gaggcccgggctccacgcgt

SEQ ID NO: 539687 - DNA, 20 bp, mouse
ggcggaacccgaggagtcgt

SEQ ID NO: 539688 - DNA, 20 bp, mouse
ggggtccagtgctgaccgag

SEQ ID NO: 539689 - DNA, 20 bp, mouse
ggcgtgggtggcggtggatt

SEQ ID NO: 539690 - DNA, 20 bp, mouse
ggtggattgggtgaccccct

SEQ ID NO: 539691 - DNA, 20 bp, mouse
ggggctccacgcgtgggtgg

SEQ ID NO: 539692 - DNA, 20 bp, mouse
gtgagtgagcggtatccctc

SEQ ID NO: 539693 - DNA, 20 bp, mouse
gtggcagcagagcctcgaag

SEQ ID NO: 539694 - DNA, 20 bp, mouse
gagcggtatccctcaggccc

SEQ ID NO: 539695 - DNA, 20 bp, mouse
gtgaccccctcggtcagcac

SEQ ID NO: 539696 - DNA, 20 bp, mouse
ggacagtcacagacaatggt

SEQ ID NO: 539697 - DNA, 20 bp, mouse
gcagcagaatgagttcacac

SEQ ID NO: 539698 - DNA, 20 bp, mouse
gcggctgctctaagtccagc

SEQ ID NO: 539699 - DNA, 20 bp, mouse
gctgcgacagtcacagacaa

SEQ ID NO: 539700 - DNA, 20 bp, mouse
gtcgcgggaatgctgaccac

SEQ ID NO: 539701 - DNA, 20 bp, mouse
gtgttaacgggggagaaagg

SEQ ID NO: 539702 - DNA, 20 bp, mouse
ggagaaagaactgttaacgg

SEQ ID NO: 539703 - DNA, 20 bp, mouse
ggcattcccgcgagcagcag

SEQ ID NO: 539704 - DNA, 20 bp, mouse
gctctttgagtacctgtgag

SEQ ID NO: 539705 - DNA, 20 bp, mouse
gtttgggttcgtgaacctgc

SEQ ID NO: 539706 - DNA, 20 bp, mouse
gctgccagcagctggctccg

SEQ ID NO: 539707 - DNA, 20 bp, mouse
gagagcggcagagcaccggg

SEQ ID NO: 539708 - DNA, 20 bp, mouse
gagcagagcggcagagcacc

SEQ ID NO: 539709 - DNA, 20 bp, mouse
gctgtccattctcaatgcag

SEQ ID NO: 539710 - DNA, 20 bp, mouse
ggggcggacagcgacccgag

SEQ ID NO: 539711 - DNA, 20 bp, mouse
gacctcgtccacgtccacta

SEQ ID NO: 539712 - DNA, 20 bp, mouse
gagagcgagcgaccagagga

SEQ ID NO: 539713 - DNA, 20 bp, mouse
gctggagagcgagcgaccag

SEQ ID NO: 539714 - DNA, 20 bp, mouse
ggcattgagaatggacagca

SEQ ID NO: 539715 - DNA, 20 bp, mouse
gcccatcggctcagaaagct

SEQ ID NO: 539716 - DNA, 20 bp, mouse
ggcgcggcgccaccgagcag

SEQ ID NO: 539717 - DNA, 20 bp, mouse
gacttcactcctctgctcgg

SEQ ID NO: 539718 - DNA, 20 bp, mouse
gggtggcgccgcgctcacct

SEQ ID NO: 539719 - DNA, 20 bp, mouse
ggcgcaaccgcgctgctcag

SEQ ID NO: 539720 - DNA, 20 bp, mouse
ggagtgaagtcaggtacgct

SEQ ID NO: 539721 - DNA, 20 bp, mouse
gaagtcaggtacgctgggca

SEQ ID NO: 539722 - DNA, 20 bp, mouse
gctgacttcactcctctgct

SEQ ID NO: 539723 - DNA, 20 bp, mouse
gtcactggccccaggcggca

SEQ ID NO: 539724 - DNA, 20 bp, mouse
gataggtgtattagagctaa

SEQ ID NO: 539725 - DNA, 20 bp, mouse
gacgctgggcagggtagctt

SEQ ID NO: 539726 - DNA, 20 bp, mouse
gaagcaccggacatcggcac

SEQ ID NO: 539727 - DNA, 20 bp, mouse
gccgggcggcgaagctggag

SEQ ID NO: 539728 - DNA, 20 bp, mouse
gtgagcgaagcaccggacat

SEQ ID NO: 539729 - DNA, 20 bp, mouse
gcaccggacatcggcactgg

SEQ ID NO: 539730 - DNA, 20 bp, mouse
gccgagcccggagactggag

SEQ ID NO: 539731 - DNA, 20 bp, mouse
gagtgtgttgagcgaagcac

SEQ ID NO: 539732 - DNA, 20 bp, mouse
gctccgccagtgccgatgtc

SEQ ID NO: 539733 - DNA, 20 bp, mouse
gggaggccgagcggtcggaa

SEQ ID NO: 539734 - DNA, 20 bp, mouse
gctccgccaggcggagagag

SEQ ID NO: 539735 - DNA, 20 bp, mouse
gccgagcggtcggaacggag

SEQ ID NO: 539736 - DNA, 20 bp, mouse
gacggaatcacgccaaggaa

SEQ ID NO: 539737 - DNA, 20 bp, mouse
gatccagaggaggctcgcgg

SEQ ID NO: 539738 - DNA, 20 bp, mouse
ggcaggacggaatcacgcca

SEQ ID NO: 539739 - DNA, 20 bp, mouse
gtgcagggcctggtgatggg

SEQ ID NO: 539740 - DNA, 20 bp, mouse
gggctctccgcacgtatata

SEQ ID NO: 539741 - DNA, 20 bp, mouse
gtagcctcgggtgttaggag

SEQ ID NO: 539742 - DNA, 20 bp, mouse
ggagcaaggaggaatctccc

SEQ ID NO: 539743 - DNA, 20 bp, mouse
gcacacgccaggcctcggct

SEQ ID NO: 539744 - DNA, 20 bp, mouse
ggcctggcgtgtggggaacg

SEQ ID NO: 539745 - DNA, 20 bp, mouse
gcctgtggcgcgaacttgag

SEQ ID NO: 539746 - DNA, 20 bp, mouse
gggcccaggggagatatacc

SEQ ID NO: 539747 - DNA, 20 bp, mouse
gcgaggtgctaacctactcc

SEQ ID NO: 539748 - DNA, 20 bp, mouse
gggggagatatacccggagt

SEQ ID NO: 539749 - DNA, 20 bp, mouse
ggttacagccggaaacaacc

SEQ ID NO: 539750 - DNA, 20 bp, mouse
gaggcgcgagacatcttgtg

SEQ ID NO: 539751 - DNA, 20 bp, mouse
ggacacgtgacccaaggcta

SEQ ID NO: 539752 - DNA, 20 bp, mouse
gttgtttccggctgtaaccg

SEQ ID NO: 539753 - DNA, 20 bp, mouse
gtgaagtgctgaacccgtgg

SEQ ID NO: 539754 - DNA, 20 bp, mouse
ggacctgatgcaaataaact

SEQ ID NO: 539755 - DNA, 20 bp, mouse
gctgcgcgtgcgtggaacaa

SEQ ID NO: 539756 - DNA, 20 bp, mouse
gcagctgcgcccggccacag

SEQ ID NO: 539757 - DNA, 20 bp, mouse
gcactcgggaagaaccggtt

SEQ ID NO: 539758 - DNA, 20 bp, mouse
ggtggacgggcatcccactc

SEQ ID NO: 539759 - DNA, 20 bp, mouse
ggagccagcgagtgtcgcct

SEQ ID NO: 539760 - DNA, 20 bp, mouse
gcatcccactcgggaagaac

SEQ ID NO: 539761 - DNA, 20 bp, mouse
gtcgcccagaacacgtggac

SEQ ID NO: 539762 - DNA, 20 bp, mouse
ggccggccgccatgctgaaa

SEQ ID NO: 539763 - DNA, 20 bp, mouse
gcgggagtggcagagtggta

SEQ ID NO: 539764 - DNA, 20 bp, mouse
gtcggtattgaacgcgggag

SEQ ID NO: 539765 - DNA, 20 bp, mouse
ggctcacggccgtttcagca

SEQ ID NO: 539766 - DNA, 20 bp, mouse
gcttcacagcttgatggcag

SEQ ID NO: 539767 - DNA, 20 bp, mouse
gcatcagcttcacagcttga

SEQ ID NO: 539768 - DNA, 20 bp, mouse
ggctccgttcaggtttaata

SEQ ID NO: 539769 - DNA, 20 bp, mouse
gtgatgctgttgctccgttc

SEQ ID NO: 539770 - DNA, 20 bp, mouse
gatctgtcatctcatagtca

SEQ ID NO: 539771 - DNA, 20 bp, mouse
ggaacctggtcaataatggg

SEQ ID NO: 539772 - DNA, 20 bp, mouse
gccagttcctagttccagga

SEQ ID NO: 539773 - DNA, 20 bp, mouse
gtaaccacagccacaattgg

SEQ ID NO: 539774 - DNA, 20 bp, mouse
gctttcaacaattagaggga

SEQ ID NO: 539775 - DNA, 20 bp, mouse
gcactttcaatgtttagagg

SEQ ID NO: 539776 - DNA, 20 bp, mouse
ggcgggtgccgcgccgaagg

SEQ ID NO: 539777 - DNA, 20 bp, mouse
gctccactcgaggtccctga

SEQ ID NO: 539778 - DNA, 20 bp, mouse
gctcccggccgccttcggcg

SEQ ID NO: 539779 - DNA, 20 bp, mouse
ggcgcagccgggcaggtctg

SEQ ID NO: 539780 - DNA, 20 bp, mouse
gcgaggtccctgagggaaag

SEQ ID NO: 539781 - DNA, 20 bp, mouse
gacttcgacgggaggtgagg

SEQ ID NO: 539782 - DNA, 20 bp, mouse
gttccctcagggacctcgag

SEQ ID NO: 539783 - DNA, 20 bp, mouse
gggcatggctgtgctcctag

SEQ ID NO: 539784 - DNA, 20 bp, mouse
gggtggctgccgacttcgac

SEQ ID NO: 539785 - DNA, 20 bp, mouse
gcagccgggcaggtctgcgg

SEQ ID NO: 539786 - DNA, 20 bp, mouse
gagagagaaagaaaccagag

SEQ ID NO: 539787 - DNA, 20 bp, mouse
ggccctgagtgagcagactg

SEQ ID NO: 539788 - DNA, 20 bp, mouse
gagtccagggaggcacctcg

SEQ ID NO: 539789 - DNA, 20 bp, mouse
gaaggagcccatgctggcgt

SEQ ID NO: 539790 - DNA, 20 bp, mouse
gaggaagtgggacacagact

SEQ ID NO: 539791 - DNA, 20 bp, mouse
gaacctgctagaccacctgg

SEQ ID NO: 539792 - DNA, 20 bp, mouse
ggccttctcaaagagctggg

SEQ ID NO: 539793 - DNA, 20 bp, mouse
gccccgacccacgccagcat

SEQ ID NO: 539794 - DNA, 20 bp, mouse
ggagcactgccgtctctcag

SEQ ID NO: 539795 - DNA, 20 bp, mouse
gaagccaaaaggccaagacg

SEQ ID NO: 539796 - DNA, 20 bp, mouse
ggcttggggaggcgagacaa

SEQ ID NO: 539797 - DNA, 20 bp, mouse
ggtgcacaagctgcttgggg

SEQ ID NO: 539798 - DNA, 20 bp, mouse
gtccatgccgcagaagcgat

SEQ ID NO: 539799 - DNA, 20 bp, mouse
ggataggagtgacctcccag

SEQ ID NO: 539800 - DNA, 20 bp, mouse
ggcctggcccatcgcttctg

SEQ ID NO: 539801 - DNA, 20 bp, mouse
ggcactggtgtcttcaacaa

SEQ ID NO: 539802 - DNA, 20 bp, mouse
gccagtgcacaagctgcttg

SEQ ID NO: 539803 - DNA, 20 bp, mouse
gcactgagggtctgcctgaa

SEQ ID NO: 539804 - DNA, 20 bp, mouse
gtcccagcggtgacagataa

SEQ ID NO: 539805 - DNA, 20 bp, mouse
gtgcggcatggatctcctga

SEQ ID NO: 539806 - DNA, 20 bp, mouse
gtgccggtgagcagtcggat

SEQ ID NO: 539807 - DNA, 20 bp, mouse
gcggtgagcagtcggatagg

SEQ ID NO: 539808 - DNA, 20 bp, mouse
ggcagtcggataggcggatg

SEQ ID NO: 539809 - DNA, 20 bp, mouse
ggccggcgccgcacagcagt

SEQ ID NO: 539810 - DNA, 20 bp, mouse
gcacaggtcctactgctgtg

SEQ ID NO: 539811 - DNA, 20 bp, mouse
ggggagcagagaacccggaa

SEQ ID NO: 539812 - DNA, 20 bp, mouse
gtgagggagcaagtccgagg

SEQ ID NO: 539813 - DNA, 20 bp, mouse
gaggattgccaagcgagcac

SEQ ID NO: 539814 - DNA, 20 bp, mouse
gccgggacaccaccgaaggt

SEQ ID NO: 539815 - DNA, 20 bp, mouse
gaagcccgggacaccaccga

SEQ ID NO: 539816 - DNA, 20 bp, mouse
gtggagagcgagagaacgag

SEQ ID NO: 539817 - DNA, 20 bp, mouse
gcgggtgcgccagcgaggaa

SEQ ID NO: 539818 - DNA, 20 bp, mouse
ggcgatctaagaagagcgag

SEQ ID NO: 539819 - DNA, 20 bp, mouse
gctaagaagagcgaggggag

SEQ ID NO: 539820 - DNA, 20 bp, mouse
gcccttctggcatactcctg

SEQ ID NO: 539821 - DNA, 20 bp, mouse
gagcacccgaagggagtccg

SEQ ID NO: 539822 - DNA, 20 bp, mouse
gggctgggttgaagccgcag

SEQ ID NO: 539823 - DNA, 20 bp, mouse
ggagcgagcgcagcacccga

SEQ ID NO: 539824 - DNA, 20 bp, mouse
ggcctcagcgagcgcagcga

SEQ ID NO: 539825 - DNA, 20 bp, mouse
gcccgagccgtagcgaggga

SEQ ID NO: 539826 - DNA, 20 bp, mouse
gacctgggtcgggaaggagt

SEQ ID NO: 539827 - DNA, 20 bp, mouse
ggacaattccaagccgagaa

SEQ ID NO: 539828 - DNA, 20 bp, mouse
gaagggaggaatctgagcct

SEQ ID NO: 539829 - DNA, 20 bp, mouse
ggaccacgcaagaagaggat

SEQ ID NO: 539830 - DNA, 20 bp, mouse
gcacgcaagaagaggatggg

SEQ ID NO: 539831 - DNA, 20 bp, mouse
gaattccaagccgagaaggg

SEQ ID NO: 539832 - DNA, 20 bp, mouse
gctggggaccacgcaagaag

SEQ ID NO: 539833 - DNA, 20 bp, mouse
gaaggaagaagagaccaagg

SEQ ID NO: 539834 - DNA, 20 bp, mouse
gggtccagggactaaggata

SEQ ID NO: 539835 - DNA, 20 bp, mouse
ggcctggagcctggggaaga

SEQ ID NO: 539836 - DNA, 20 bp, mouse
gtcaatgggatcaaacgcga

SEQ ID NO: 539837 - DNA, 20 bp, mouse
ggaaagccgcgcgaatcaat

SEQ ID NO: 539838 - DNA, 20 bp, mouse
gtccaagtgcttgtaattga

SEQ ID NO: 539839 - DNA, 20 bp, mouse
gatgggatcaaacgcgaagg

SEQ ID NO: 539840 - DNA, 20 bp, mouse
gaaacctagggacattgtag

SEQ ID NO: 539841 - DNA, 20 bp, mouse
gaggctatttggcttagagg

SEQ ID NO: 539842 - DNA, 20 bp, mouse
gtagcctatgtgcaaaggga

SEQ ID NO: 539843 - DNA, 20 bp, mouse
ggagggcgagccggcggcca

SEQ ID NO: 539844 - DNA, 20 bp, mouse
gaccgtcaattacaagcact

SEQ ID NO: 539845 - DNA, 20 bp, mouse
gaaaagagctgggaggaaaa

SEQ ID NO: 539846 - DNA, 20 bp, mouse
gaggcccgggtaggtcacac

SEQ ID NO: 539847 - DNA, 20 bp, mouse
gaagagaaagaggcccgggt

SEQ ID NO: 539848 - DNA, 20 bp, mouse
gcctagtccgggagtgtgga

SEQ ID NO: 539849 - DNA, 20 bp, mouse
ggcaggcgctgttgagttga

SEQ ID NO: 539850 - DNA, 20 bp, mouse
gagggtattccaaggcgtag

SEQ ID NO: 539851 - DNA, 20 bp, mouse
gtttttgacagggtattcca

SEQ ID NO: 539852 - DNA, 20 bp, mouse
gcctgcgcagggcgactcag

SEQ ID NO: 539853 - DNA, 20 bp, mouse
gtgttgagttgacggctcgt

SEQ ID NO: 539854 - DNA, 20 bp, mouse
ggatgaaccacaacccctcc

SEQ ID NO: 539855 - DNA, 20 bp, mouse
gcaaacctgtgtgacctacc

SEQ ID NO: 539856 - DNA, 20 bp, mouse
gcgggcccgcagggacacgg

SEQ ID NO: 539857 - DNA, 20 bp, mouse
ggcctgagaggaactcgcgt

SEQ ID NO: 539858 - DNA, 20 bp, mouse
gtagggaccgcaaaagccga

SEQ ID NO: 539859 - DNA, 20 bp, mouse
ggcccgggcgtgcgcctgag

SEQ ID NO: 539860 - DNA, 20 bp, mouse
gggcaggcgccgggcccgca

SEQ ID NO: 539861 - DNA, 20 bp, mouse
gagagtgagcgccgaggccg

SEQ ID NO: 539862 - DNA, 20 bp, mouse
ggaccgcaaaagccgaaggc

SEQ ID NO: 539863 - DNA, 20 bp, mouse
gcttcaggtaccccttccag

SEQ ID NO: 539864 - DNA, 20 bp, mouse
gcgcgtcccagacaagtaag

SEQ ID NO: 539865 - DNA, 20 bp, mouse
gtcctctcaggcgcacgccc

SEQ ID NO: 539866 - DNA, 20 bp, mouse
gggctcagacagcaaacgtg

SEQ ID NO: 539867 - DNA, 20 bp, mouse
gcggaaaatccaaaatgatt

SEQ ID NO: 539868 - DNA, 20 bp, mouse
gttccgagacctgcgcagat

SEQ ID NO: 539869 - DNA, 20 bp, mouse
gacagcaaacgtgaggaaat

SEQ ID NO: 539870 - DNA, 20 bp, mouse
gaacccatctgcgcaggtct

SEQ ID NO: 539871 - DNA, 20 bp, mouse
gtatccggtcctctcttcca

SEQ ID NO: 539872 - DNA, 20 bp, mouse
gggcagtgacgcccttacct

SEQ ID NO: 539873 - DNA, 20 bp, mouse
gttgctgtctgagcctgctt

SEQ ID NO: 539874 - DNA, 20 bp, mouse
ggaagaaaagatagaacctt

SEQ ID NO: 539875 - DNA, 20 bp, mouse
gtctatctaaccatcagaaa

SEQ ID NO: 539876 - DNA, 20 bp, mouse
ggtggatcttccttgtcgtc

SEQ ID NO: 539877 - DNA, 20 bp, mouse
gagagttctgcctgacgaca

SEQ ID NO: 539878 - DNA, 20 bp, mouse
gtgcaggatcataactgcag

SEQ ID NO: 539879 - DNA, 20 bp, mouse
gtgccagccaacctcacaga

SEQ ID NO: 539880 - DNA, 20 bp, mouse
gaatagccagaagccttgag

SEQ ID NO: 539881 - DNA, 20 bp, mouse
ggagagagttcagttagccg

SEQ ID NO: 539882 - DNA, 20 bp, mouse
gagcatcggcacagtctggt

SEQ ID NO: 539883 - DNA, 20 bp, mouse
ggtaagtgccctggcttcag

SEQ ID NO: 539884 - DNA, 20 bp, mouse
gttcagaggctggaacaggt

SEQ ID NO: 539885 - DNA, 20 bp, mouse
gctattgctcaccagaacgc

SEQ ID NO: 539886 - DNA, 20 bp, mouse
gagcaagagcgagagggcca

SEQ ID NO: 539887 - DNA, 20 bp, mouse
ggagaccagcaagagcgaga

SEQ ID NO: 539888 - DNA, 20 bp, mouse
gacgctgcggcggtaggagg

SEQ ID NO: 539889 - DNA, 20 bp, mouse
gcgcgcgagggagtgaacga

SEQ ID NO: 539890 - DNA, 20 bp, mouse
ggctgcgcgctctccggcta

SEQ ID NO: 539891 - DNA, 20 bp, mouse
ggtgcttcgcggagaggtgg

SEQ ID NO: 539892 - DNA, 20 bp, mouse
gcggagagcgcgcagcgaat

SEQ ID NO: 539893 - DNA, 20 bp, mouse
ggcgcgctctccggctaggg

SEQ ID NO: 539894 - DNA, 20 bp, mouse
gtgtcgggctcgtcgctccc

SEQ ID NO: 539895 - DNA, 20 bp, mouse
ggcagcgggcgacccggctg

SEQ ID NO: 539896 - DNA, 20 bp, mouse
gcgcggccgagaagactgtg

SEQ ID NO: 539897 - DNA, 20 bp, mouse
gcagagggcgagcagcgcac

SEQ ID NO: 539898 - DNA, 20 bp, mouse
gactgtgcggcgtagaagcg

SEQ ID NO: 539899 - DNA, 20 bp, mouse
gtggggatcgggctgagacc

SEQ ID NO: 539900 - DNA, 20 bp, mouse
gtcgggctgagaccgggatc

SEQ ID NO: 539901 - DNA, 20 bp, mouse
gccgcccgcagccacggacg

SEQ ID NO: 539902 - DNA, 20 bp, mouse
gaagcgcggtgctagagcgc

SEQ ID NO: 539903 - DNA, 20 bp, mouse
gagcagcgcacaggtgcgtg

SEQ ID NO: 539904 - DNA, 20 bp, mouse
ggccccagccagcccgatcc

SEQ ID NO: 539905 - DNA, 20 bp, mouse
gaccgggatcgggctggctg

SEQ ID NO: 539906 - DNA, 20 bp, mouse
gaccgcgtgcagcacggaaa

SEQ ID NO: 539907 - DNA, 20 bp, mouse
ggtccgagcgcggcactcga

SEQ ID NO: 539908 - DNA, 20 bp, mouse
gcccaggacagcccgatacc

SEQ ID NO: 539909 - DNA, 20 bp, mouse
gtgctggcgctgctgaccgt

SEQ ID NO: 539910 - DNA, 20 bp, mouse
gcaacgcggtgcacacgaag

SEQ ID NO: 539911 - DNA, 20 bp, mouse
gggagagcgggtttttgcga

SEQ ID NO: 539912 - DNA, 20 bp, mouse
gggctcgcagctcctcctcg

SEQ ID NO: 539913 - DNA, 20 bp, mouse
ggccagaacgccgcgcaaag

SEQ ID NO: 539914 - DNA, 20 bp, mouse
ggaagcggctgccaggtatc

SEQ ID NO: 539915 - DNA, 20 bp, mouse
ggagggaaccgcgtgcagca

SEQ ID NO: 539916 - DNA, 20 bp, mouse
gctcagagcggcggcagtag

SEQ ID NO: 539917 - DNA, 20 bp, mouse
gggagcgcgggagccggaac

SEQ ID NO: 539918 - DNA, 20 bp, mouse
gccgccgcgcgggctcagag

SEQ ID NO: 539919 - DNA, 20 bp, mouse
gacagctccggctcccactc

SEQ ID NO: 539920 - DNA, 20 bp, mouse
gccgctcgcgcgctgcccgg

SEQ ID NO: 539921 - DNA, 20 bp, mouse
gagaggaagcgactgagcag

SEQ ID NO: 539922 - DNA, 20 bp, mouse
ggcgcagggcccgggagcgc

SEQ ID NO: 539923 - DNA, 20 bp, mouse
gctggcgatgatgcagatga

SEQ ID NO: 539924 - DNA, 20 bp, mouse
gggagccggagctgtcgccg

SEQ ID NO: 539925 - DNA, 20 bp, mouse
gtgcggacccgagccaccgg

SEQ ID NO: 539926 - DNA, 20 bp, mouse
gttgcagactcatagacacc

SEQ ID NO: 539927 - DNA, 20 bp, mouse
gtttcgtctaagtctaaatt

SEQ ID NO: 539928 - DNA, 20 bp, mouse
ggtctatgagtctgcaagaa

SEQ ID NO: 539929 - DNA, 20 bp, mouse
gtaggttaatatgttcagcc

SEQ ID NO: 539930 - DNA, 20 bp, mouse
ggagactttgaaacttacct

SEQ ID NO: 539931 - DNA, 20 bp, mouse
gtattgatcgtcagtcgtat

SEQ ID NO: 539932 - DNA, 20 bp, mouse
gatacatacacactaacaac

SEQ ID NO: 539933 - DNA, 20 bp, mouse
gatagaatatctgttgtaat

SEQ ID NO: 539934 - DNA, 20 bp, mouse
gcgattcattttattgactg

SEQ ID NO: 539935 - DNA, 20 bp, mouse
gatacttacactaatctaac

SEQ ID NO: 539936 - DNA, 20 bp, mouse
gtctccgagaacgagaacgt

SEQ ID NO: 539937 - DNA, 20 bp, mouse
gccggggcggggccactgaa

SEQ ID NO: 539938 - DNA, 20 bp, mouse
ggagggttaggacaagaact

SEQ ID NO: 539939 - DNA, 20 bp, mouse
gtgtagtcgcaccaactgac

SEQ ID NO: 539940 - DNA, 20 bp, mouse
gagccccatgagcagcccgg

SEQ ID NO: 539941 - DNA, 20 bp, mouse
ggggcacggcgccactggta

SEQ ID NO: 539942 - DNA, 20 bp, mouse
gacgtcaattgccccttgga

SEQ ID NO: 539943 - DNA, 20 bp, mouse
ggctccgacgttctcgttct

SEQ ID NO: 539944 - DNA, 20 bp, mouse
gaattgccccttggagggtt

SEQ ID NO: 539945 - DNA, 20 bp, mouse
gggtccagcagccccgccca

SEQ ID NO: 539946 - DNA, 20 bp, mouse
ggcgggcagtcgtcgctgag

SEQ ID NO: 539947 - DNA, 20 bp, mouse
gtggatctcttctctcacag

SEQ ID NO: 539948 - DNA, 20 bp, mouse
gagagaagagatccaccggt

SEQ ID NO: 539949 - DNA, 20 bp, mouse
ggctctccgcatcccaccgg

SEQ ID NO: 539950 - DNA, 20 bp, mouse
gcccgctctccgcatcccac

SEQ ID NO: 539951 - DNA, 20 bp, mouse
ggcggcgggtgctctgctct

SEQ ID NO: 539952 - DNA, 20 bp, mouse
gcccagattggagggtcccg

SEQ ID NO: 539953 - DNA, 20 bp, mouse
gttgatcctggcactcaccg

SEQ ID NO: 539954 - DNA, 20 bp, mouse
ggagatccaccggtgggatg

SEQ ID NO: 539955 - DNA, 20 bp, mouse
gattggagggtcccggggaa

SEQ ID NO: 539956 - DNA, 20 bp, mouse
gcgggacgagtgtcactgga

SEQ ID NO: 539957 - DNA, 20 bp, mouse
ggaagcgggacgagtgtcac

SEQ ID NO: 539958 - DNA, 20 bp, mouse
gactcgtcccgcttcaacag

SEQ ID NO: 539959 - DNA, 20 bp, mouse
gtctaggagagtaggaggag

SEQ ID NO: 539960 - DNA, 20 bp, mouse
gtgacttctaggagagtagg

SEQ ID NO: 539961 - DNA, 20 bp, mouse
gccctgacttctaggagagt

SEQ ID NO: 539962 - DNA, 20 bp, mouse
gactacctcctgctccgact

SEQ ID NO: 539963 - DNA, 20 bp, mouse
gctgttcacctctgttgaag

SEQ ID NO: 539964 - DNA, 20 bp, mouse
gcctaaagattgaggaagat

SEQ ID NO: 539965 - DNA, 20 bp, mouse
gtgatggggtgaggtatgag

SEQ ID NO: 539966 - DNA, 20 bp, mouse
ggtccaccgagaagccgagc

SEQ ID NO: 539967 - DNA, 20 bp, mouse
gtgcctgctcggcttctcgg

SEQ ID NO: 539968 - DNA, 20 bp, mouse
gagaagcaggagcggcaaag

SEQ ID NO: 539969 - DNA, 20 bp, mouse
ggtctggagacagtcctggg

SEQ ID NO: 539970 - DNA, 20 bp, mouse
gccagtctggagacagtcct

SEQ ID NO: 539971 - DNA, 20 bp, mouse
gacagctcagagccccgggt

SEQ ID NO: 539972 - DNA, 20 bp, mouse
gtgcggggtccctgatcgag

SEQ ID NO: 539973 - DNA, 20 bp, mouse
gcagagccccgggtaggagt

SEQ ID NO: 539974 - DNA, 20 bp, mouse
gccccacccactcctacccg

SEQ ID NO: 539975 - DNA, 20 bp, mouse
gtggaacactggaactaggt

SEQ ID NO: 539976 - DNA, 20 bp, mouse
gctcttgctgaatcccgctg

SEQ ID NO: 539977 - DNA, 20 bp, mouse
gccctcagcgtcctggaaga

SEQ ID NO: 539978 - DNA, 20 bp, mouse
ggagtcagtattcgccccag

SEQ ID NO: 539979 - DNA, 20 bp, mouse
gcaggcaaggaccagcggtg

SEQ ID NO: 539980 - DNA, 20 bp, mouse
gagcagcgccctcagcgtcc

SEQ ID NO: 539981 - DNA, 20 bp, mouse
gcgccaggtgagtgcatctg

SEQ ID NO: 539982 - DNA, 20 bp, mouse
gatctacagacagtagacca

SEQ ID NO: 539983 - DNA, 20 bp, mouse
ggtcaaggtacccatcttcc

SEQ ID NO: 539984 - DNA, 20 bp, mouse
gcctggctaggaagccctcc

SEQ ID NO: 539985 - DNA, 20 bp, mouse
gctcctcacctgggacgtgg

SEQ ID NO: 539986 - DNA, 20 bp, mouse
gggagtccaggcacccgcag

SEQ ID NO: 539987 - DNA, 20 bp, mouse
gcaggcacccgcagcggcca

SEQ ID NO: 539988 - DNA, 20 bp, mouse
gggcaggcgaggcctggagt

SEQ ID NO: 539989 - DNA, 20 bp, mouse
ggccgcgtaccccggagtcc

SEQ ID NO: 539990 - DNA, 20 bp, mouse
gggacgtgggcttctcgtag

SEQ ID NO: 539991 - DNA, 20 bp, mouse
gctgcttgagatggaagcgg

SEQ ID NO: 539992 - DNA, 20 bp, mouse
gggcctggagtgggtacctc

SEQ ID NO: 539993 - DNA, 20 bp, mouse
ggaacccaggatagggacgt

SEQ ID NO: 539994 - DNA, 20 bp, mouse
gcagagggacctgccagact

SEQ ID NO: 539995 - DNA, 20 bp, mouse
gtgggtacctcgggatgccc

SEQ ID NO: 539996 - DNA, 20 bp, mouse
gggagttggagtcactatct

SEQ ID NO: 539997 - DNA, 20 bp, mouse
gagctacgataaatacatca

SEQ ID NO: 539998 - DNA, 20 bp, mouse
gcacttcagaagctattccc

SEQ ID NO: 539999 - DNA, 20 bp, mouse
gagaagctattccctggagt

SEQ ID NO: 540000 - DNA, 20 bp, mouse
gggccactgcggagcatgaa

SEQ ID NO: 540001 - DNA, 20 bp, mouse
gcactgcggagcatgaaggg

SEQ ID NO: 540002 - DNA, 20 bp, mouse
ggggcaggaaaaagaagtat

SEQ ID NO: 540003 - DNA, 20 bp, mouse
gtggaattctgtgatccagt

SEQ ID NO: 540004 - DNA, 20 bp, mouse
gctctagaatgcaccatagt

SEQ ID NO: 540005 - DNA, 20 bp, mouse
gacgataaatacatcagggc

SEQ ID NO: 540006 - DNA, 20 bp, mouse
gctcttcggagagatcctta

SEQ ID NO: 540007 - DNA, 20 bp, mouse
gtactctgaggaggatgtag

SEQ ID NO: 540008 - DNA, 20 bp, mouse
gtagcctgtagccagcccta

SEQ ID NO: 540009 - DNA, 20 bp, mouse
gccaaacgcggtacagggag

SEQ ID NO: 540010 - DNA, 20 bp, mouse
gtcggagagatccttagggc

SEQ ID NO: 540011 - DNA, 20 bp, mouse
gaagagctttagggtcgtct

SEQ ID NO: 540012 - DNA, 20 bp, mouse
ggactaaccgaggctcatcc

SEQ ID NO: 540013 - DNA, 20 bp, mouse
gctgaggaggatgtaggggc

SEQ ID NO: 540014 - DNA, 20 bp, mouse
gtggcagctctgttaaggaa

SEQ ID NO: 540015 - DNA, 20 bp, mouse
gatctctccgaagagcttta

SEQ ID NO: 540016 - DNA, 20 bp, mouse
ggcattctggccctagacac

SEQ ID NO: 540017 - DNA, 20 bp, mouse
gtgcgtgtgttccctccagg

SEQ ID NO: 540018 - DNA, 20 bp, mouse
ggtgacacagccagtgtcta

SEQ ID NO: 540019 - DNA, 20 bp, mouse
gcgaggcaccctgggaacac

SEQ ID NO: 540020 - DNA, 20 bp, mouse
ggcaggacctggacccagtg

SEQ ID NO: 540021 - DNA, 20 bp, mouse
gaaaggacgcgcatgcccca

SEQ ID NO: 540022 - DNA, 20 bp, mouse
gaaaacggccctgggcgcag

SEQ ID NO: 540023 - DNA, 20 bp, mouse
gaggcaagctctaggcattc

SEQ ID NO: 540024 - DNA, 20 bp, mouse
ggcgcagcggcaaagcgtgc

SEQ ID NO: 540025 - DNA, 20 bp, mouse
gctgtagaccggtgttccca

SEQ ID NO: 540026 - DNA, 20 bp, mouse
ggcagcgcagagcccctggt

SEQ ID NO: 540027 - DNA, 20 bp, mouse
ggaggatgctgccctgccac

SEQ ID NO: 540028 - DNA, 20 bp, mouse
gggcgggtgaggaccacccg

SEQ ID NO: 540029 - DNA, 20 bp, mouse
gctacaggagcctcaggcca

SEQ ID NO: 540030 - DNA, 20 bp, mouse
ggatgctgccctgccacggg

SEQ ID NO: 540031 - DNA, 20 bp, mouse
ggctcatcagtagattgtag

SEQ ID NO: 540032 - DNA, 20 bp, mouse
gcctcaggccatggcgggtg

SEQ ID NO: 540033 - DNA, 20 bp, mouse
gaagcagcagcggtacaaga

SEQ ID NO: 540034 - DNA, 20 bp, mouse
ggtcccaagcggcggccact

SEQ ID NO: 540035 - DNA, 20 bp, mouse
ggcccctctctgcccaccag

SEQ ID NO: 540036 - DNA, 20 bp, mouse
gacctgcagagccctggcat

SEQ ID NO: 540037 - DNA, 20 bp, mouse
gatgagctccggccagtcag

SEQ ID NO: 540038 - DNA, 20 bp, mouse
ggcatgggcagacccctgac

SEQ ID NO: 540039 - DNA, 20 bp, mouse
gcctgccccatgaggatcag

SEQ ID NO: 540040 - DNA, 20 bp, mouse
ggaaggacggcaggttcctg

SEQ ID NO: 540041 - DNA, 20 bp, mouse
ggatgctgtgaccttcgagg

SEQ ID NO: 540042 - DNA, 20 bp, mouse
gagatactaaccatgagctc

SEQ ID NO: 540043 - DNA, 20 bp, mouse
ggccgccgctgatcctcatg

SEQ ID NO: 540044 - DNA, 20 bp, mouse
ggtcttggctaggacatcca

SEQ ID NO: 540045 - DNA, 20 bp, mouse
gagagagagggccagatagc

SEQ ID NO: 540046 - DNA, 20 bp, mouse
gctgcaaccaggaagtaagt

SEQ ID NO: 540047 - DNA, 20 bp, mouse
gctgctgaggaaacgtagca

SEQ ID NO: 540048 - DNA, 20 bp, mouse
gccaggaagtaagtaggtga

SEQ ID NO: 540049 - DNA, 20 bp, mouse
gggcaaaaggcggttgagat

SEQ ID NO: 540050 - DNA, 20 bp, mouse
ggaaaggctcgggcaaaagg

SEQ ID NO: 540051 - DNA, 20 bp, mouse
gtgcagccctccagaagggt

SEQ ID NO: 540052 - DNA, 20 bp, mouse
gagccctctgtcccagggaa

SEQ ID NO: 540053 - DNA, 20 bp, mouse
gccagaagggtaggacgctg

SEQ ID NO: 540054 - DNA, 20 bp, mouse
gccgggtgcaaaagtcccaa

SEQ ID NO: 540055 - DNA, 20 bp, mouse
gaggaagagaagctgcaacc

SEQ ID NO: 540056 - DNA, 20 bp, mouse
ggggccgcacggcacaagcg

SEQ ID NO: 540057 - DNA, 20 bp, mouse
gatgtaggagggaggctcgg

SEQ ID NO: 540058 - DNA, 20 bp, mouse
ggctgaacgcaggtaaatgt

SEQ ID NO: 540059 - DNA, 20 bp, mouse
gaccgtgcacgtggccagtg

SEQ ID NO: 540060 - DNA, 20 bp, mouse
ggggtgcgggcggctcctgg

SEQ ID NO: 540061 - DNA, 20 bp, mouse
ggggccggaggaacacgtgg

SEQ ID NO: 540062 - DNA, 20 bp, mouse
gggggtgtgcgcggatcaca

SEQ ID NO: 540063 - DNA, 20 bp, mouse
gcatgagcaccgggtgcggg

SEQ ID NO: 540064 - DNA, 20 bp, mouse
ggtcacggcggaggccccgg

SEQ ID NO: 540065 - DNA, 20 bp, mouse
ggggcccacatcatgagcac

SEQ ID NO: 540066 - DNA, 20 bp, mouse
ggttgcttcgagctactccc

SEQ ID NO: 540067 - DNA, 20 bp, mouse
ggcggggttgccggaagaag

SEQ ID NO: 540068 - DNA, 20 bp, mouse
ggcccccgcccaccaaccat

SEQ ID NO: 540069 - DNA, 20 bp, mouse
ggcgggggcgggacacagat

SEQ ID NO: 540070 - DNA, 20 bp, mouse
ggcggggcctggaacaaggt

SEQ ID NO: 540071 - DNA, 20 bp, mouse
gaggtgggcgtgactctacg

SEQ ID NO: 540072 - DNA, 20 bp, mouse
gctctccgtgcaccaggggg

SEQ ID NO: 540073 - DNA, 20 bp, mouse
gctgcaccggcgatcgggag

SEQ ID NO: 540074 - DNA, 20 bp, mouse
gatcaccggtgcggacacag

SEQ ID NO: 540075 - DNA, 20 bp, mouse
gcccctctccgtgcaccagg

SEQ ID NO: 540076 - DNA, 20 bp, mouse
ggcaaagagcctccagggtg

SEQ ID NO: 540077 - DNA, 20 bp, mouse
gcagggagaagcagtaatgt

SEQ ID NO: 540078 - DNA, 20 bp, mouse
gacgcagccgggaagtctgg

SEQ ID NO: 540079 - DNA, 20 bp, mouse
gaatactaggacttcagtaa

SEQ ID NO: 540080 - DNA, 20 bp, mouse
gcccaggccaccagacttcc

SEQ ID NO: 540081 - DNA, 20 bp, mouse
gattcggcgagtctgctcag

SEQ ID NO: 540082 - DNA, 20 bp, mouse
ggccaaggggtccttcctac

SEQ ID NO: 540083 - DNA, 20 bp, mouse
ggaggctgctgggattaggg

SEQ ID NO: 540084 - DNA, 20 bp, mouse
gaaggggagggactgccaag

SEQ ID NO: 540085 - DNA, 20 bp, mouse
gagagtcttgggtcgccagt

SEQ ID NO: 540086 - DNA, 20 bp, mouse
gagttgccgtgaggaagcta

SEQ ID NO: 540087 - DNA, 20 bp, mouse
gggatggtgatgcagtttca

SEQ ID NO: 540088 - DNA, 20 bp, mouse
gaccatccttagcttcctca

SEQ ID NO: 540089 - DNA, 20 bp, mouse
gcagtaggagagcccacgta

SEQ ID NO: 540090 - DNA, 20 bp, mouse
gggcaactgagaaggagccg

SEQ ID NO: 540091 - DNA, 20 bp, mouse
gccgaggtaagaagcgacag

SEQ ID NO: 540092 - DNA, 20 bp, mouse
gtccttctgacggagaccta

SEQ ID NO: 540093 - DNA, 20 bp, mouse
gcacaaatcctgacagccgg

SEQ ID NO: 540094 - DNA, 20 bp, mouse
gctgcactgggcaaatacat

SEQ ID NO: 540095 - DNA, 20 bp, mouse
gggtgaagactaatctgaat

SEQ ID NO: 540096 - DNA, 20 bp, mouse
gaggccgcctgtggtcaccc

SEQ ID NO: 540097 - DNA, 20 bp, mouse
gaagcctgggtgaccacagg

SEQ ID NO: 540098 - DNA, 20 bp, mouse
gtatgccggaaggccgcctg

SEQ ID NO: 540099 - DNA, 20 bp, mouse
ggagatgctgaagcttatgc

SEQ ID NO: 540100 - DNA, 20 bp, mouse
gtcttctctggggtgagatg

SEQ ID NO: 540101 - DNA, 20 bp, mouse
gtgctgaagcttatgccgga

SEQ ID NO: 540102 - DNA, 20 bp, mouse
ggtgtctctcaaggtagcgg

SEQ ID NO: 540103 - DNA, 20 bp, mouse
gagaactcggttcttctctg

SEQ ID NO: 540104 - DNA, 20 bp, mouse
gagatgtccaaggctctaag

SEQ ID NO: 540105 - DNA, 20 bp, mouse
gtccaagagcagcctgcaag

SEQ ID NO: 540106 - DNA, 20 bp, mouse
gtgcccagctgggaagtcaa

SEQ ID NO: 540107 - DNA, 20 bp, mouse
gtctcattccatgaggagga

SEQ ID NO: 540108 - DNA, 20 bp, mouse
gctcttctcattccatgagg

SEQ ID NO: 540109 - DNA, 20 bp, mouse
ggcacttccctgcttatcag

SEQ ID NO: 540110 - DNA, 20 bp, mouse
gaaaacaaatactcacaatt

SEQ ID NO: 540111 - DNA, 20 bp, mouse
ggtccgttgacttcccagct

SEQ ID NO: 540112 - DNA, 20 bp, mouse
gggggacgttgcatccactt

SEQ ID NO: 540113 - DNA, 20 bp, mouse
gaatccctctgagcttctat

SEQ ID NO: 540114 - DNA, 20 bp, mouse
gtgagctgattgttatttag

SEQ ID NO: 540115 - DNA, 20 bp, mouse
gtgttaatgtgatccatcca

SEQ ID NO: 540116 - DNA, 20 bp, mouse
gcttaggctatgttgtccac

SEQ ID NO: 540117 - DNA, 20 bp, mouse
gctgtgggcaagaacaagta

SEQ ID NO: 540118 - DNA, 20 bp, mouse
gtggacctggggtgtactgt

SEQ ID NO: 540119 - DNA, 20 bp, mouse
gtagctgagggtgagaatcg

SEQ ID NO: 540120 - DNA, 20 bp, mouse
gctatgttgtccacaggcat

SEQ ID NO: 540121 - DNA, 20 bp, mouse
gcatagcctaaggttagctg

SEQ ID NO: 540122 - DNA, 20 bp, mouse
gaggtcaggcccctagggag

SEQ ID NO: 540123 - DNA, 20 bp, mouse
gatgtgcagccaggtagcca

SEQ ID NO: 540124 - DNA, 20 bp, mouse
gttcaaggtggaccccaagg

SEQ ID NO: 540125 - DNA, 20 bp, mouse
ggacttgggagtgccaactg

SEQ ID NO: 540126 - DNA, 20 bp, mouse
gcaggaactgccaggaatta

SEQ ID NO: 540127 - DNA, 20 bp, mouse
ggaccgcagtccctaattcc

SEQ ID NO: 540128 - DNA, 20 bp, mouse
gtggcaccgaggatacctag

SEQ ID NO: 540129 - DNA, 20 bp, mouse
gagaggccccatgcaagaga

SEQ ID NO: 540130 - DNA, 20 bp, mouse
gtgccaggaattagggactg

SEQ ID NO: 540131 - DNA, 20 bp, mouse
gggcagcaggccacaagatc

SEQ ID NO: 540132 - DNA, 20 bp, mouse
gagggtcagcgaggaggcct

SEQ ID NO: 540133 - DNA, 20 bp, mouse
ggggagcccggtgtcaggct

SEQ ID NO: 540134 - DNA, 20 bp, mouse
gctgctttccttgagatctc

SEQ ID NO: 540135 - DNA, 20 bp, mouse
ggaaagcagggtcagcgagg

SEQ ID NO: 540136 - DNA, 20 bp, mouse
ggcaccgccaagccgagggt

SEQ ID NO: 540137 - DNA, 20 bp, mouse
ggagttcgtgaccccaccct

SEQ ID NO: 540138 - DNA, 20 bp, mouse
gccacgcaccgccaagccga

SEQ ID NO: 540139 - DNA, 20 bp, mouse
gccgggagctgggacactca

SEQ ID NO: 540140 - DNA, 20 bp, mouse
ggaggggacccgaggccaag

SEQ ID NO: 540141 - DNA, 20 bp, mouse
ggcagaggcgaggggacccg

SEQ ID NO: 540142 - DNA, 20 bp, mouse
gggagggaccatgtaccccg

SEQ ID NO: 540143 - DNA, 20 bp, mouse
gcattagcgcggtggagaag

SEQ ID NO: 540144 - DNA, 20 bp, mouse
ggagctgcggggcgcaggac

SEQ ID NO: 540145 - DNA, 20 bp, mouse
gccggagagccggacattag

SEQ ID NO: 540146 - DNA, 20 bp, mouse
gtggcgccgggaagaggaag

SEQ ID NO: 540147 - DNA, 20 bp, mouse
gccgccgcccgcgcgctggg

SEQ ID NO: 540148 - DNA, 20 bp, mouse
gcctcctcccagcgcgcggg

SEQ ID NO: 540149 - DNA, 20 bp, mouse
ggcctccgcggcctccatgg

SEQ ID NO: 540150 - DNA, 20 bp, mouse
gaggtcagagttcgtgaccc

SEQ ID NO: 540151 - DNA, 20 bp, mouse
ggccctgccctcctagccgg

SEQ ID NO: 540152 - DNA, 20 bp, mouse
ggggcgccggccgcagacac

SEQ ID NO: 540153 - DNA, 20 bp, mouse
gtcgggcgccaccacaaccg

SEQ ID NO: 540154 - DNA, 20 bp, mouse
gccggcgcccccggctagga

SEQ ID NO: 540155 - DNA, 20 bp, mouse
gagcgcggcacggcggagga

SEQ ID NO: 540156 - DNA, 20 bp, mouse
gtaaaccaaccgagccccag

SEQ ID NO: 540157 - DNA, 20 bp, mouse
gtagatctgcagagccgctg

SEQ ID NO: 540158 - DNA, 20 bp, mouse
gtgggcgatctgggaaccgg

SEQ ID NO: 540159 - DNA, 20 bp, mouse
gagagccgctggggctcggt

SEQ ID NO: 540160 - DNA, 20 bp, mouse
gaggtgggcgatctgggaac

SEQ ID NO: 540161 - DNA, 20 bp, mouse
gacgaacccggaaccgcgtg

SEQ ID NO: 540162 - DNA, 20 bp, mouse
gatgacaaggtgggcgatct

SEQ ID NO: 540163 - DNA, 20 bp, mouse
gctctgcagatctacgaacc

SEQ ID NO: 540164 - DNA, 20 bp, mouse
gcggccacctctatatgaca

SEQ ID NO: 540165 - DNA, 20 bp, mouse
ggcgcgggggcggaagaact

SEQ ID NO: 540166 - DNA, 20 bp, mouse
ggggacagccgcgcacgcag

SEQ ID NO: 540167 - DNA, 20 bp, mouse
gccacacaggcgtgcagagt

SEQ ID NO: 540168 - DNA, 20 bp, mouse
gttgctgggagatcttccaa

SEQ ID NO: 540169 - DNA, 20 bp, mouse
gcacagggtaatgaacttcg

SEQ ID NO: 540170 - DNA, 20 bp, mouse
gcgacaggcacaaagtcaca

SEQ ID NO: 540171 - DNA, 20 bp, mouse
ggatcttccaaggggagagg

SEQ ID NO: 540172 - DNA, 20 bp, mouse
gagacccggcccgcagcgac

SEQ ID NO: 540173 - DNA, 20 bp, mouse
gatcacagccgcagtctcag

SEQ ID NO: 540174 - DNA, 20 bp, mouse
gggagccccggcgccgagag

SEQ ID NO: 540175 - DNA, 20 bp, mouse
gggccagatccgagtttccg

SEQ ID NO: 540176 - DNA, 20 bp, mouse
gtacaaggcaagggaagtag

SEQ ID NO: 540177 - DNA, 20 bp, mouse
ggtggtgagaacgcttcaga

SEQ ID NO: 540178 - DNA, 20 bp, mouse
gtggaggccgccacagacac

SEQ ID NO: 540179 - DNA, 20 bp, mouse
gtgaagcgttctcaccaccc

SEQ ID NO: 540180 - DNA, 20 bp, mouse
gtatccgatgagctctacag

SEQ ID NO: 540181 - DNA, 20 bp, mouse
gcggatatggatggtcctaa

SEQ ID NO: 540182 - DNA, 20 bp, mouse
ggccacagacacaggcatag

SEQ ID NO: 540183 - DNA, 20 bp, mouse
gtagcaagcaggctaccctt

SEQ ID NO: 540184 - DNA, 20 bp, mouse
ggaaacgctcctaacttaca

SEQ ID NO: 540185 - DNA, 20 bp, mouse
gctcctaacttacaaggcaa

SEQ ID NO: 540186 - DNA, 20 bp, mouse
gacaactagtagaatatgta

SEQ ID NO: 540187 - DNA, 20 bp, mouse
gcgagagagacatccaaagt

SEQ ID NO: 540188 - DNA, 20 bp, mouse
gcgataagaagaatactgag

SEQ ID NO: 540189 - DNA, 20 bp, mouse
gcatttttgggcgatctcca

SEQ ID NO: 540190 - DNA, 20 bp, mouse
gagagctagttaaaaaaccc

SEQ ID NO: 540191 - DNA, 20 bp, mouse
ggaaaatgcttgagaaaata

SEQ ID NO: 540192 - DNA, 20 bp, mouse
gaaataagtgctcttcagct

SEQ ID NO: 540193 - DNA, 20 bp, mouse
ggacgaattcacagcgaaat

SEQ ID NO: 540194 - DNA, 20 bp, mouse
gttcgctgtgaattcgtcgc

SEQ ID NO: 540195 - DNA, 20 bp, mouse
ggatagggcaagaggagagt

SEQ ID NO: 540196 - DNA, 20 bp, mouse
gctggcttcaagacagaagt

SEQ ID NO: 540197 - DNA, 20 bp, mouse
ggagctgcaagtcgattgtc

SEQ ID NO: 540198 - DNA, 20 bp, mouse
gggggagggcaaggggacag

SEQ ID NO: 540199 - DNA, 20 bp, mouse
ggggagcagaacgtggagag

SEQ ID NO: 540200 - DNA, 20 bp, mouse
ggctttccgtccagagggga

SEQ ID NO: 540201 - DNA, 20 bp, mouse
gtgtgtgcgagggtgcgaga

SEQ ID NO: 540202 - DNA, 20 bp, mouse
gcgcgggagggcgccccggg

SEQ ID NO: 540203 - DNA, 20 bp, mouse
ggacgcggcccccatagata

SEQ ID NO: 540204 - DNA, 20 bp, mouse
gccttgccctcccctctgga

SEQ ID NO: 540205 - DNA, 20 bp, mouse
gacgaggtgcccggctctca

SEQ ID NO: 540206 - DNA, 20 bp, mouse
ggccggcgccgatggaacgc

SEQ ID NO: 540207 - DNA, 20 bp, mouse
gtgcgcctgggcccgagcct

SEQ ID NO: 540208 - DNA, 20 bp, mouse
gtccaggcgatagagctgag

SEQ ID NO: 540209 - DNA, 20 bp, mouse
gtggaacgcgggtgtcaggc

SEQ ID NO: 540210 - DNA, 20 bp, mouse
gccgatggaacgcgggtgtc

SEQ ID NO: 540211 - DNA, 20 bp, mouse
gcgccgccggccccgcgctg

SEQ ID NO: 540212 - DNA, 20 bp, mouse
gtcggcggggagacgatcca

SEQ ID NO: 540213 - DNA, 20 bp, mouse
gtcaggccggccgcagcgcg

SEQ ID NO: 540214 - DNA, 20 bp, mouse
ggcgtgcccgcggtcgacgg

SEQ ID NO: 540215 - DNA, 20 bp, mouse
gtcgccctggcgctcgccgc

SEQ ID NO: 540216 - DNA, 20 bp, mouse
gtagcagaggggctacggga

SEQ ID NO: 540217 - DNA, 20 bp, mouse
gccccacccccgcatcgtct

SEQ ID NO: 540218 - DNA, 20 bp, mouse
gggccgctctcgggacagga

SEQ ID NO: 540219 - DNA, 20 bp, mouse
gggccgcccagacgatgcgg

SEQ ID NO: 540220 - DNA, 20 bp, mouse
ggccgccagagcccccgagg

SEQ ID NO: 540221 - DNA, 20 bp, mouse
ggtgtgtcactctagcagag

SEQ ID NO: 540222 - DNA, 20 bp, mouse
gcgcgcgctgggcgagaaga

SEQ ID NO: 540223 - DNA, 20 bp, mouse
gctacgggatggcacggaaa

SEQ ID NO: 540224 - DNA, 20 bp, mouse
ggctttgcaacttctcccgg

SEQ ID NO: 540225 - DNA, 20 bp, mouse
gcggggccgcccagacgatg

SEQ ID NO: 540226 - DNA, 20 bp, mouse
gaagcttgtgcaagtcacct

SEQ ID NO: 540227 - DNA, 20 bp, mouse
gcgggtgcgcaggagctgag

SEQ ID NO: 540228 - DNA, 20 bp, mouse
ggagaggacgaccctggcca

SEQ ID NO: 540229 - DNA, 20 bp, mouse
gaagccgctgcgtaatccgg

SEQ ID NO: 540230 - DNA, 20 bp, mouse
ggtgcctccggattacgcag

SEQ ID NO: 540231 - DNA, 20 bp, mouse
gacagcagcgcttggcgccc

SEQ ID NO: 540232 - DNA, 20 bp, mouse
gcgcagcaggggtgtcgtgg

SEQ ID NO: 540233 - DNA, 20 bp, mouse
gcgccaagcgctgctgtctt

SEQ ID NO: 540234 - DNA, 20 bp, mouse
ggacggcgagaggacgaccc

SEQ ID NO: 540235 - DNA, 20 bp, mouse
gtgtgtaggggtgcgcagtg

SEQ ID NO: 540236 - DNA, 20 bp, mouse
gccgctaccccagccctggg

SEQ ID NO: 540237 - DNA, 20 bp, mouse
gcacccgctaccccagccct

SEQ ID NO: 540238 - DNA, 20 bp, mouse
gcgcctgcagcggggaagcg

SEQ ID NO: 540239 - DNA, 20 bp, mouse
gtggctcgccgcctccaata

SEQ ID NO: 540240 - DNA, 20 bp, mouse
gcgggagcccgccagtccag

SEQ ID NO: 540241 - DNA, 20 bp, mouse
gcagcaagctggcgagctgg

SEQ ID NO: 540242 - DNA, 20 bp, mouse
gcagtcgccctactgacggt

SEQ ID NO: 540243 - DNA, 20 bp, mouse
gaggcggcgagccagcaagc

SEQ ID NO: 540244 - DNA, 20 bp, mouse
gacccgccggtccccagcag

SEQ ID NO: 540245 - DNA, 20 bp, mouse
ggactgtgcagataccctat

SEQ ID NO: 540246 - DNA, 20 bp, mouse
ggagtgtgctagaaggactg

SEQ ID NO: 540247 - DNA, 20 bp, mouse
gaggaggctgcgaaagttgg

SEQ ID NO: 540248 - DNA, 20 bp, mouse
ggcgggaccaggctgcgact

SEQ ID NO: 540249 - DNA, 20 bp, mouse
gtgcaggaggctgcgaaagt

SEQ ID NO: 540250 - DNA, 20 bp, mouse
ggccaggggagccccagtgc

SEQ ID NO: 540251 - DNA, 20 bp, mouse
gacgcgcgggcgaaaaggaa

SEQ ID NO: 540252 - DNA, 20 bp, mouse
gtgtgggtcgggctcgccag

SEQ ID NO: 540253 - DNA, 20 bp, mouse
ggcggagcgcacgcgggacc

SEQ ID NO: 540254 - DNA, 20 bp, mouse
gttacgaggaggggtgtgta

SEQ ID NO: 540255 - DNA, 20 bp, mouse
gcgggtcggcttacgaggag

SEQ ID NO: 540256 - DNA, 20 bp, mouse
ggctcgagccacataaacaa

SEQ ID NO: 540257 - DNA, 20 bp, mouse
gccagcccggccgcaggaga

SEQ ID NO: 540258 - DNA, 20 bp, mouse
ggctgtgcggagccgcgggg

SEQ ID NO: 540259 - DNA, 20 bp, mouse
gccagggccagtccgccccg

SEQ ID NO: 540260 - DNA, 20 bp, mouse
gagctccgcgtccctctctc

SEQ ID NO: 540261 - DNA, 20 bp, mouse
gctggtacgcggagaccggg

SEQ ID NO: 540262 - DNA, 20 bp, mouse
gataaacaaaggcacattgg

SEQ ID NO: 540263 - DNA, 20 bp, mouse
gcgagccgcggagcgcgaag

SEQ ID NO: 540264 - DNA, 20 bp, mouse
ggcggagctgtgcggagccg

SEQ ID NO: 540265 - DNA, 20 bp, mouse
gtccctggtacgcggagacc

SEQ ID NO: 540266 - DNA, 20 bp, mouse
ggagcccggccgggctgacg

SEQ ID NO: 540267 - DNA, 20 bp, mouse
gccgcggccaagcgcgtcag

SEQ ID NO: 540268 - DNA, 20 bp, mouse
ggcgggcggcgacaatgaac

SEQ ID NO: 540269 - DNA, 20 bp, mouse
ggcgccggctgcacgcgtca

SEQ ID NO: 540270 - DNA, 20 bp, mouse
gcgagtccccgggcgcggag

SEQ ID NO: 540271 - DNA, 20 bp, mouse
gaccgcggggacagaagtcg

SEQ ID NO: 540272 - DNA, 20 bp, mouse
gcccggactgcaggacgagc

SEQ ID NO: 540273 - DNA, 20 bp, mouse
gtgggtgtggagcgccagag

SEQ ID NO: 540274 - DNA, 20 bp, mouse
gcccaggtcgccgagtcccc

SEQ ID NO: 540275 - DNA, 20 bp, mouse
ggcagtccgggcgcgcggca

SEQ ID NO: 540276 - DNA, 20 bp, mouse
ggtctgtgtatggggagcgg

SEQ ID NO: 540277 - DNA, 20 bp, mouse
ggcagccggacgcccctcca

SEQ ID NO: 540278 - DNA, 20 bp, mouse
gacccagcggctcccagagg

SEQ ID NO: 540279 - DNA, 20 bp, mouse
gcgagggagccgggtgagag

SEQ ID NO: 540280 - DNA, 20 bp, mouse
gctgcggtgcacaaacccag

SEQ ID NO: 540281 - DNA, 20 bp, mouse
gtgtgtatggggagcggagg

SEQ ID NO: 540282 - DNA, 20 bp, mouse
ggtgagcgcgcgggagagag

SEQ ID NO: 540283 - DNA, 20 bp, mouse
ggagcccgcagtgtccgtgg

SEQ ID NO: 540284 - DNA, 20 bp, mouse
gtgtgtgcaagtgaaggagc

SEQ ID NO: 540285 - DNA, 20 bp, mouse
ggcgcggcgcggcgcgacac

SEQ ID NO: 540286 - DNA, 20 bp, mouse
gcaggtagggcagtggctag

SEQ ID NO: 540287 - DNA, 20 bp, mouse
gagcaggcagtggccagtct

SEQ ID NO: 540288 - DNA, 20 bp, mouse
ggaccagcgcccaccaatct

SEQ ID NO: 540289 - DNA, 20 bp, mouse
gcattctgtagagcaggcag

SEQ ID NO: 540290 - DNA, 20 bp, mouse
gccgctgcccgcccgctgct

SEQ ID NO: 540291 - DNA, 20 bp, mouse
gttcttcacccagcagcggg

SEQ ID NO: 540292 - DNA, 20 bp, mouse
gaaacttcttcacccagcag

SEQ ID NO: 540293 - DNA, 20 bp, mouse
gactgccctacctgaggcct

SEQ ID NO: 540294 - DNA, 20 bp, mouse
gcggagcaaggcactgaaga

SEQ ID NO: 540295 - DNA, 20 bp, mouse
gaggaaaggacgatcggaca

SEQ ID NO: 540296 - DNA, 20 bp, mouse
gagtccaggagaacacggac

SEQ ID NO: 540297 - DNA, 20 bp, mouse
ggtgaaagttaagaaaaagg

SEQ ID NO: 540298 - DNA, 20 bp, mouse
ggctccagtccgtgttctcc

SEQ ID NO: 540299 - DNA, 20 bp, mouse
gtacagcaggtcatacatgc

SEQ ID NO: 540300 - DNA, 20 bp, mouse
gacattcttagcgaaattat

SEQ ID NO: 540301 - DNA, 20 bp, mouse
gcagccagatgttaagagag

SEQ ID NO: 540302 - DNA, 20 bp, mouse
ggaaattattggcagtcctt

SEQ ID NO: 540303 - DNA, 20 bp, mouse
gtttttcttaactttcacta

SEQ ID NO: 540304 - DNA, 20 bp, mouse
gtgtctgctagtttggatac

SEQ ID NO: 540305 - DNA, 20 bp, mouse
gttagaaaccatcatgaaac

SEQ ID NO: 540306 - DNA, 20 bp, mouse
gcagcggcgcgtgacgtcag

SEQ ID NO: 540307 - DNA, 20 bp, mouse
gcggcgcgtgacgtcagagg

SEQ ID NO: 540308 - DNA, 20 bp, mouse
gggagctggccagtgctgag

SEQ ID NO: 540309 - DNA, 20 bp, mouse
gaggggcccagagagtgcgg

SEQ ID NO: 540310 - DNA, 20 bp, mouse
gctcggccgccgcactctct

SEQ ID NO: 540311 - DNA, 20 bp, mouse
gggagcagcgaagcccgaga

SEQ ID NO: 540312 - DNA, 20 bp, mouse
ggggacgaacggccacctag

SEQ ID NO: 540313 - DNA, 20 bp, mouse
gggagagtgcgagcccaggg

SEQ ID NO: 540314 - DNA, 20 bp, mouse
gacgaaggcgcaagtcatgg

SEQ ID NO: 540315 - DNA, 20 bp, mouse
gaccaggacgacgactacga

SEQ ID NO: 540316 - DNA, 20 bp, mouse
gcgacgggagtccctggaga

SEQ ID NO: 540317 - DNA, 20 bp, mouse
ggatcctggcaccctcggag

SEQ ID NO: 540318 - DNA, 20 bp, mouse
gtctgcggccacccctccga

SEQ ID NO: 540319 - DNA, 20 bp, mouse
gactcagctaggaagacgac

SEQ ID NO: 540320 - DNA, 20 bp, mouse
gggaagacgacgggagtccc

SEQ ID NO: 540321 - DNA, 20 bp, mouse
gcttgccttggctcactctt

SEQ ID NO: 540322 - DNA, 20 bp, mouse
gtgccaggatccactcagct

SEQ ID NO: 540323 - DNA, 20 bp, mouse
gaccggaacctgccctctcc

SEQ ID NO: 540324 - DNA, 20 bp, mouse
gggggtggccgcagaaggtt

SEQ ID NO: 540325 - DNA, 20 bp, mouse
gttcctagctgagtggatcc

SEQ ID NO: 540326 - DNA, 20 bp, mouse
ggtcccgaggagtttcatag

SEQ ID NO: 540327 - DNA, 20 bp, mouse
gagtggaagttggattccga

SEQ ID NO: 540328 - DNA, 20 bp, mouse
ggaaggctccaggcgtcccg

SEQ ID NO: 540329 - DNA, 20 bp, mouse
gcgaggagtttcatagtggt

SEQ ID NO: 540330 - DNA, 20 bp, mouse
ggtggtaccgacccaagtgg

SEQ ID NO: 540331 - DNA, 20 bp, mouse
gtccactagaacctccactt

SEQ ID NO: 540332 - DNA, 20 bp, mouse
gctagaacctccacttgggt

SEQ ID NO: 540333 - DNA, 20 bp, mouse
gaaggtggtaccgacccaag

SEQ ID NO: 540334 - DNA, 20 bp, mouse
gtgaaactcctcgggacgcc

SEQ ID NO: 540335 - DNA, 20 bp, mouse
ggttggattccgaaggctcc

SEQ ID NO: 540336 - DNA, 20 bp, mouse
gtcgtggtcccttcgaggtt

SEQ ID NO: 540337 - DNA, 20 bp, mouse
gcgcagtcgtggtcccttcg

SEQ ID NO: 540338 - DNA, 20 bp, mouse
ggagcgaagcctaacctcga

SEQ ID NO: 540339 - DNA, 20 bp, mouse
ggaacgcccggagtgcgcag

SEQ ID NO: 540340 - DNA, 20 bp, mouse
gtgctggttcgcagaacctg

SEQ ID NO: 540341 - DNA, 20 bp, mouse
gcgtaaaagacggcgagaag

SEQ ID NO: 540342 - DNA, 20 bp, mouse
ggacgcgggtggagttcagc

SEQ ID NO: 540343 - DNA, 20 bp, mouse
gcagaacctggggcagccgg

SEQ ID NO: 540344 - DNA, 20 bp, mouse
ggccgcgacactcgcagtcg

SEQ ID NO: 540345 - DNA, 20 bp, mouse
gaaaagacggcgagaagcgg

SEQ ID NO: 540346 - DNA, 20 bp, mouse
gaacagcccccgccagggag

SEQ ID NO: 540347 - DNA, 20 bp, mouse
gcggaagtgccgctccctgg

SEQ ID NO: 540348 - DNA, 20 bp, mouse
gaagtgccgctccctggcgg

SEQ ID NO: 540349 - DNA, 20 bp, mouse
gtggcgggggctgttcatgg

SEQ ID NO: 540350 - DNA, 20 bp, mouse
gggccggaagtgccgctccc

SEQ ID NO: 540351 - DNA, 20 bp, mouse
ggcgcctagtgattacgtag

SEQ ID NO: 540352 - DNA, 20 bp, mouse
gccgcagaccccgcctcggg

SEQ ID NO: 540353 - DNA, 20 bp, mouse
gccctggcgggggctgttca

SEQ ID NO: 540354 - DNA, 20 bp, mouse
gtagtgattacgtagcgggt

SEQ ID NO: 540355 - DNA, 20 bp, mouse
gacttggcgagctgaaacaa

SEQ ID NO: 540356 - DNA, 20 bp, mouse
ggcgacgtcggaggcggaag

SEQ ID NO: 540357 - DNA, 20 bp, mouse
gcgcgacgcgacgtcggagg

SEQ ID NO: 540358 - DNA, 20 bp, mouse
gccccgcgacgcgacgtcgg

SEQ ID NO: 540359 - DNA, 20 bp, mouse
ggccccccgcgacgcgacgt

SEQ ID NO: 540360 - DNA, 20 bp, mouse
gggagccgcgagctcatgga

SEQ ID NO: 540361 - DNA, 20 bp, mouse
gggctgagtcggggaccggt

SEQ ID NO: 540362 - DNA, 20 bp, mouse
gggtcaagcggcactgaagg

SEQ ID NO: 540363 - DNA, 20 bp, mouse
gcagatgccacgggccccga

SEQ ID NO: 540364 - DNA, 20 bp, mouse
gtggcgcggctgtcgctctt

SEQ ID NO: 540365 - DNA, 20 bp, mouse
ggggctctcactgccggctc

SEQ ID NO: 540366 - DNA, 20 bp, mouse
gagggagtcgctgggatccg

SEQ ID NO: 540367 - DNA, 20 bp, mouse
gagctccagctcgggttccg

SEQ ID NO: 540368 - DNA, 20 bp, mouse
gcagctgtgagggagtcgct

SEQ ID NO: 540369 - DNA, 20 bp, mouse
gctgcggagcgcagctgtga

SEQ ID NO: 540370 - DNA, 20 bp, mouse
gggagctgaagcgcaggctg

SEQ ID NO: 540371 - DNA, 20 bp, mouse
gggagtcgggaggtgagctc

SEQ ID NO: 540372 - DNA, 20 bp, mouse
gcgacgggccgggctaggtc

SEQ ID NO: 540373 - DNA, 20 bp, mouse
gccggcccgtcgcagctgag

SEQ ID NO: 540374 - DNA, 20 bp, mouse
gaggtgagctccggagaaag

SEQ ID NO: 540375 - DNA, 20 bp, mouse
gccggagaaagaggccctgg

SEQ ID NO: 540376 - DNA, 20 bp, mouse
gcaattcccggagccgagga

SEQ ID NO: 540377 - DNA, 20 bp, mouse
gggccgccgcgagccctcct

SEQ ID NO: 540378 - DNA, 20 bp, mouse
gctcggctccgggaattggg

SEQ ID NO: 540379 - DNA, 20 bp, mouse
ggacgagagcgacatcctgg

SEQ ID NO: 540380 - DNA, 20 bp, mouse
gagcgcccagcagcccaacc

SEQ ID NO: 540381 - DNA, 20 bp, mouse
gagccgaggagggctcgcgg

SEQ ID NO: 540382 - DNA, 20 bp, mouse
ggcggtagtagggatccaag

SEQ ID NO: 540383 - DNA, 20 bp, mouse
gactgtagctcgatccaggg

SEQ ID NO: 540384 - DNA, 20 bp, mouse
gcggagccgaggagggctcg

SEQ ID NO: 540385 - DNA, 20 bp, mouse
gcttctgccagcggccacac

SEQ ID NO: 540386 - DNA, 20 bp, mouse
gcgtgcagaaacggagactg

SEQ ID NO: 540387 - DNA, 20 bp, mouse
ggtccgagcctgagacgcgc

SEQ ID NO: 540388 - DNA, 20 bp, mouse
gcagctggaggcgacagctt

SEQ ID NO: 540389 - DNA, 20 bp, mouse
gctgagacgcgcgggcgcga

SEQ ID NO: 540390 - DNA, 20 bp, mouse
gacgcggctggagcagaaca

SEQ ID NO: 540391 - DNA, 20 bp, mouse
ggaggacgcgcgcttcgcct

SEQ ID NO: 540392 - DNA, 20 bp, mouse
gcagcttgggagaaagaggt

SEQ ID NO: 540393 - DNA, 20 bp, mouse
ggcttcgcctgggtcgctgg

SEQ ID NO: 540394 - DNA, 20 bp, mouse
ggcgctactgcctaagaccc

SEQ ID NO: 540395 - DNA, 20 bp, mouse
ggcgtctcaggctcggactc

SEQ ID NO: 540396 - DNA, 20 bp, mouse
gtcaggcctgtcctccccag

SEQ ID NO: 540397 - DNA, 20 bp, mouse
gcatcggctgtcaggagggt

SEQ ID NO: 540398 - DNA, 20 bp, mouse
gcccagccgctggggaggac

SEQ ID NO: 540399 - DNA, 20 bp, mouse
gtgcagtctgtgtcaccggg

SEQ ID NO: 540400 - DNA, 20 bp, mouse
gctaggagcggatgaatctg

SEQ ID NO: 540401 - DNA, 20 bp, mouse
gcgcgtcccaggggcgacgg

SEQ ID NO: 540402 - DNA, 20 bp, mouse
gctcctcctccgcgtcccag

SEQ ID NO: 540403 - DNA, 20 bp, mouse
gtcacaccgcaacttcctcc

SEQ ID NO: 540404 - DNA, 20 bp, mouse
gagtcggtgtgagcgaggcc

SEQ ID NO: 540405 - DNA, 20 bp, mouse
ggaagttgcggtgtgaggcc

SEQ ID NO: 540406 - DNA, 20 bp, mouse
gggaacagcgccatgatcac

SEQ ID NO: 540407 - DNA, 20 bp, mouse
ggtagtgcggcctgtgatca

SEQ ID NO: 540408 - DNA, 20 bp, mouse
gccagacggcgccatttctg

SEQ ID NO: 540409 - DNA, 20 bp, mouse
gctgaatgccccatcaccgg

SEQ ID NO: 540410 - DNA, 20 bp, mouse
gcagcgccgcggagaactct

SEQ ID NO: 540411 - DNA, 20 bp, mouse
gagtgaggcctccggtgatg

SEQ ID NO: 540412 - DNA, 20 bp, mouse
gttcctgaatgccccatcac

SEQ ID NO: 540413 - DNA, 20 bp, mouse
gtagcgccagacatcatcgt

SEQ ID NO: 540414 - DNA, 20 bp, mouse
gaccactcctgcctcagaaa

SEQ ID NO: 540415 - DNA, 20 bp, mouse
gtgtatcccagagttctccg

SEQ ID NO: 540416 - DNA, 20 bp, mouse
gagagagtgaacagggagcg

SEQ ID NO: 540417 - DNA, 20 bp, mouse
gaaagcagcgctcccagctg

SEQ ID NO: 540418 - DNA, 20 bp, mouse
gagggtccagctaagagcaa

SEQ ID NO: 540419 - DNA, 20 bp, mouse
ggtgcagcctcggaaaagga

SEQ ID NO: 540420 - DNA, 20 bp, mouse
gagaagtgcagcctcggaaa

SEQ ID NO: 540421 - DNA, 20 bp, mouse
gggagagagcgcgcaaggca

SEQ ID NO: 540422 - DNA, 20 bp, mouse
gcctcggaaaaggaggggaa

SEQ ID NO: 540423 - DNA, 20 bp, mouse
gcaacttgtgcattaaacaa

SEQ ID NO: 540424 - DNA, 20 bp, mouse
gagagctaaagctgacacct

SEQ ID NO: 540425 - DNA, 20 bp, mouse
gaaagagtaatcaagtgtaa

SEQ ID NO: 540426 - DNA, 20 bp, mouse
gtagggcactcacctcagag

SEQ ID NO: 540427 - DNA, 20 bp, mouse
gggcgcggtcgcagtctcca

SEQ ID NO: 540428 - DNA, 20 bp, mouse
gcgcagcctcctgccaccag

SEQ ID NO: 540429 - DNA, 20 bp, mouse
gcgctcgccattgccgctgg

SEQ ID NO: 540430 - DNA, 20 bp, mouse
gctcctgccaccagcggcaa

SEQ ID NO: 540431 - DNA, 20 bp, mouse
gagagcggctgcgctaccgt

SEQ ID NO: 540432 - DNA, 20 bp, mouse
gcggccgggagaacccgagg

SEQ ID NO: 540433 - DNA, 20 bp, mouse
gagctggagattgcgcggta

SEQ ID NO: 540434 - DNA, 20 bp, mouse
gggagaacccgaggcggtag

SEQ ID NO: 540435 - DNA, 20 bp, mouse
gccaggcaggccgaatccgg

SEQ ID NO: 540436 - DNA, 20 bp, mouse
gggccaggcccaggagtcca

SEQ ID NO: 540437 - DNA, 20 bp, mouse
gctttaggccagcaatgcag

SEQ ID NO: 540438 - DNA, 20 bp, mouse
gctccctcagacatgtctgg

SEQ ID NO: 540439 - DNA, 20 bp, mouse
gtggaagcggagcgtctcag

SEQ ID NO: 540440 - DNA, 20 bp, mouse
gatcccccagacatgtctga

SEQ ID NO: 540441 - DNA, 20 bp, mouse
gcagctccctcagacatgtc

SEQ ID NO: 540442 - DNA, 20 bp, mouse
gccggaagcccatcgagaga

SEQ ID NO: 540443 - DNA, 20 bp, mouse
ggtctgagggagctggcggg

SEQ ID NO: 540444 - DNA, 20 bp, mouse
gaaccccccagggtcaaggt

SEQ ID NO: 540445 - DNA, 20 bp, mouse
gtcggatgagaccagaacag

SEQ ID NO: 540446 - DNA, 20 bp, mouse
gcggggaggtggcccagcca

SEQ ID NO: 540447 - DNA, 20 bp, mouse
gcaggggacaggcggcaagt

SEQ ID NO: 540448 - DNA, 20 bp, mouse
gaagtcctggcgcacaggga

SEQ ID NO: 540449 - DNA, 20 bp, mouse
ggcgcctcgaagccctccac

SEQ ID NO: 540450 - DNA, 20 bp, mouse
gggtggcccagccagggcag

SEQ ID NO: 540451 - DNA, 20 bp, mouse
gctccaccggcagcccgggg

SEQ ID NO: 540452 - DNA, 20 bp, mouse
gcaaatggcctggccagatg

SEQ ID NO: 540453 - DNA, 20 bp, mouse
gcctgtgcgccaggacttgg

SEQ ID NO: 540454 - DNA, 20 bp, mouse
ggccctccaccggcagcccg

SEQ ID NO: 540455 - DNA, 20 bp, mouse
ggggccgcgatgcgcagccc

SEQ ID NO: 540456 - DNA, 20 bp, mouse
gcccccgagggccgcgccag

SEQ ID NO: 540457 - DNA, 20 bp, mouse
ggccgaggagggcaccgcgg

SEQ ID NO: 540458 - DNA, 20 bp, mouse
gagggccgcgccagaggcat

SEQ ID NO: 540459 - DNA, 20 bp, mouse
gccgccgcctcagccgagga

SEQ ID NO: 540460 - DNA, 20 bp, mouse
ggccgccgcggtgccctcct

SEQ ID NO: 540461 - DNA, 20 bp, mouse
gccggacggcggcggagaag

SEQ ID NO: 540462 - DNA, 20 bp, mouse
gcgtaactcccggggaggtt

SEQ ID NO: 540463 - DNA, 20 bp, mouse
gccgcggccgctgcctgagc

SEQ ID NO: 540464 - DNA, 20 bp, mouse
gcgatgaagccgatgaacag

SEQ ID NO: 540465 - DNA, 20 bp, mouse
ggacggcggcggagaagggg

SEQ ID NO: 540466 - DNA, 20 bp, mouse
gcacaagtgtttgaacactg

SEQ ID NO: 540467 - DNA, 20 bp, mouse
gttcagtgtgggcgaggtca

SEQ ID NO: 540468 - DNA, 20 bp, mouse
gacagtaaatgtataatcac

SEQ ID NO: 540469 - DNA, 20 bp, mouse
gagcttgcaatcccaatgta

SEQ ID NO: 540470 - DNA, 20 bp, mouse
gatttatgtcacttcagtgt

SEQ ID NO: 540471 - DNA, 20 bp, mouse
gcaaaattaaagtcttctaa

SEQ ID NO: 540472 - DNA, 20 bp, mouse
gtggtgtctgagatttggca

SEQ ID NO: 540473 - DNA, 20 bp, mouse
gtgaatgttcttatatgaag

SEQ ID NO: 540474 - DNA, 20 bp, mouse
gagggcgtttgtcaattgat

SEQ ID NO: 540475 - DNA, 20 bp, mouse
gggaatataaatttctgttg

SEQ ID NO: 540476 - DNA, 20 bp, mouse
ggcgggagaccggacccaag

SEQ ID NO: 540477 - DNA, 20 bp, mouse
gggcacacgagaacccctgg

SEQ ID NO: 540478 - DNA, 20 bp, mouse
ggggtttgtacgatgctggg

SEQ ID NO: 540479 - DNA, 20 bp, mouse
gggagcctggcgcagagcgg

SEQ ID NO: 540480 - DNA, 20 bp, mouse
gcccatgggccagacaatct

SEQ ID NO: 540481 - DNA, 20 bp, mouse
gaaggattctgcgctggtcg

SEQ ID NO: 540482 - DNA, 20 bp, mouse
gccagggcttggctcagatc

SEQ ID NO: 540483 - DNA, 20 bp, mouse
ggaagacctaggaacaatgt

SEQ ID NO: 540484 - DNA, 20 bp, mouse
gaagtgggtgcggaagacct

SEQ ID NO: 540485 - DNA, 20 bp, mouse
gacccctggggggtgagtga

SEQ ID NO: 540486 - DNA, 20 bp, mouse
ggcagcagagccccgaactc

SEQ ID NO: 540487 - DNA, 20 bp, mouse
gcgggaggcgacggcgaccg

SEQ ID NO: 540488 - DNA, 20 bp, mouse
gcggcgcagaacacccaggg

SEQ ID NO: 540489 - DNA, 20 bp, mouse
gccgggcccgcgagttccag

SEQ ID NO: 540490 - DNA, 20 bp, mouse
gtcccggcgcagaacaccca

SEQ ID NO: 540491 - DNA, 20 bp, mouse
gccgtcgcctcccgagttcg

SEQ ID NO: 540492 - DNA, 20 bp, mouse
gcgcagggcacggctaacct

SEQ ID NO: 540493 - DNA, 20 bp, mouse
ggccccggcacgggtgacat

SEQ ID NO: 540494 - DNA, 20 bp, mouse
gacgtaggctggggaacctg

SEQ ID NO: 540495 - DNA, 20 bp, mouse
ggggcaccacaggggcgtcg

SEQ ID NO: 540496 - DNA, 20 bp, mouse
gagtagagggagcgaggttc

SEQ ID NO: 540497 - DNA, 20 bp, mouse
gctccctctactgcaatctc

SEQ ID NO: 540498 - DNA, 20 bp, mouse
ggtctcttgaggctgtccag

SEQ ID NO: 540499 - DNA, 20 bp, mouse
gttccagagattgcagtaga

SEQ ID NO: 540500 - DNA, 20 bp, mouse
gctgcggctctccctctgac

SEQ ID NO: 540501 - DNA, 20 bp, mouse
gctgacaggagggtctcagc

SEQ ID NO: 540502 - DNA, 20 bp, mouse
ggagcaccgggcaagaggcc

SEQ ID NO: 540503 - DNA, 20 bp, mouse
ggaaagcagacagggtgtat

SEQ ID NO: 540504 - DNA, 20 bp, mouse
ggattgcagtagagggagcg

SEQ ID NO: 540505 - DNA, 20 bp, mouse
gtgaagggaggtggtctaaa

SEQ ID NO: 540506 - DNA, 20 bp, mouse
gggttgaaggtgcttggcag

SEQ ID NO: 540507 - DNA, 20 bp, mouse
gtccaggagctcgaggttga

SEQ ID NO: 540508 - DNA, 20 bp, mouse
gctgggctcgtccaaggaca

SEQ ID NO: 540509 - DNA, 20 bp, mouse
gactcaggactcctcaccga

SEQ ID NO: 540510 - DNA, 20 bp, mouse
gagcccgaaggagccgacta

SEQ ID NO: 540511 - DNA, 20 bp, mouse
gcggagcacccgccagggag

SEQ ID NO: 540512 - DNA, 20 bp, mouse
ggtgcttggcaggggacacc

SEQ ID NO: 540513 - DNA, 20 bp, mouse
ggcaccttgatagatagata

SEQ ID NO: 540514 - DNA, 20 bp, mouse
gtggcccagaggcccgtgac

SEQ ID NO: 540515 - DNA, 20 bp, mouse
gcagcgccggatgaagcagg

SEQ ID NO: 540516 - DNA, 20 bp, mouse
gagagacgaagaagccagaa

SEQ ID NO: 540517 - DNA, 20 bp, mouse
gaagccagaagggtgctccg

SEQ ID NO: 540518 - DNA, 20 bp, mouse
gactgcgtctgaggtgaagg

SEQ ID NO: 540519 - DNA, 20 bp, mouse
gggtcccgggaagggaggat

SEQ ID NO: 540520 - DNA, 20 bp, mouse
gtcgccgcggagcacccttc

SEQ ID NO: 540521 - DNA, 20 bp, mouse
gtcttcgtctctcggacgga

SEQ ID NO: 540522 - DNA, 20 bp, mouse
gccgcggcgagagcgcagag

SEQ ID NO: 540523 - DNA, 20 bp, mouse
gggcttcttcgtctctcgga

SEQ ID NO: 540524 - DNA, 20 bp, mouse
gggaggcgggaaagtaagtt

SEQ ID NO: 540525 - DNA, 20 bp, mouse
gcctggcctaggctactcga

SEQ ID NO: 540526 - DNA, 20 bp, mouse
gccctgtattcagaacaagg

SEQ ID NO: 540527 - DNA, 20 bp, mouse
gggaagctgagggctcatga

SEQ ID NO: 540528 - DNA, 20 bp, mouse
gacgagtcagggtgaaggta

SEQ ID NO: 540529 - DNA, 20 bp, mouse
gtactccatagagcaggggc

SEQ ID NO: 540530 - DNA, 20 bp, mouse
gatggagtatttagtctcca

SEQ ID NO: 540531 - DNA, 20 bp, mouse
gttcagaacaagggggctgt

SEQ ID NO: 540532 - DNA, 20 bp, mouse
ggactgcagggatcagggga

SEQ ID NO: 540533 - DNA, 20 bp, mouse
ggcccagaggacactcttaa

SEQ ID NO: 540534 - DNA, 20 bp, mouse
gggctctatatgaccctcaa

SEQ ID NO: 540535 - DNA, 20 bp, mouse
gggtggtgtaccgagagact

SEQ ID NO: 540536 - DNA, 20 bp, mouse
ggcgctgctcgccatggcac

SEQ ID NO: 540537 - DNA, 20 bp, mouse
gagcagcagcgccggtgcca

SEQ ID NO: 540538 - DNA, 20 bp, mouse
gagggcgagctgaagcggag

SEQ ID NO: 540539 - DNA, 20 bp, mouse
ggcgagctgaagcggagagg

SEQ ID NO: 540540 - DNA, 20 bp, mouse
ggatccagggcgagctgaag

SEQ ID NO: 540541 - DNA, 20 bp, mouse
gaggaggagccgaagcagcg

SEQ ID NO: 540542 - DNA, 20 bp, mouse
ggagggatcccggagtctgg

SEQ ID NO: 540543 - DNA, 20 bp, mouse
gagccgaagcagcgtggcga

SEQ ID NO: 540544 - DNA, 20 bp, mouse
gtgggcagggccagcagtcg

SEQ ID NO: 540545 - DNA, 20 bp, mouse
gggaaaccgccaaagctggg

SEQ ID NO: 540546 - DNA, 20 bp, mouse
ggagactttatgcactggga

SEQ ID NO: 540547 - DNA, 20 bp, mouse
gggtaagtggccgcccggta

SEQ ID NO: 540548 - DNA, 20 bp, mouse
gggatgggacttaagttgaa

SEQ ID NO: 540549 - DNA, 20 bp, mouse
gctctggggtaggcaatctc

SEQ ID NO: 540550 - DNA, 20 bp, mouse
gctggccagcaagtcccctt

SEQ ID NO: 540551 - DNA, 20 bp, mouse
gtgtcgctcccggaacttgt

SEQ ID NO: 540552 - DNA, 20 bp, mouse
ggttagtttagagaacgcgg

SEQ ID NO: 540553 - DNA, 20 bp, mouse
ggtcgcctaccaagccgtac

SEQ ID NO: 540554 - DNA, 20 bp, mouse
gccgcccggtacggcttggt

SEQ ID NO: 540555 - DNA, 20 bp, mouse
gctgcagactccctgagtcg

SEQ ID NO: 540556 - DNA, 20 bp, mouse
gacagggtagccgctgacag

SEQ ID NO: 540557 - DNA, 20 bp, mouse
gctgacagcggcggcgccag

SEQ ID NO: 540558 - DNA, 20 bp, mouse
gagtagcagcaacagcgtca

SEQ ID NO: 540559 - DNA, 20 bp, mouse
ggggtagccgctgacagcgg

SEQ ID NO: 540560 - DNA, 20 bp, mouse
gagcctagtgcaggagcgag

SEQ ID NO: 540561 - DNA, 20 bp, mouse
gtgcactaggcttacagcca

SEQ ID NO: 540562 - DNA, 20 bp, mouse
gagcagttgcacatcatccc

SEQ ID NO: 540563 - DNA, 20 bp, mouse
gtctggaagcaggaggtcgt

SEQ ID NO: 540564 - DNA, 20 bp, mouse
ggacgctcacactcaccgag

SEQ ID NO: 540565 - DNA, 20 bp, mouse
gagcaacagcgtcagggcac

SEQ ID NO: 540566 - DNA, 20 bp, mouse
ggacaacccggacctcctct

SEQ ID NO: 540567 - DNA, 20 bp, mouse
gccgaggagctggcgcccag

SEQ ID NO: 540568 - DNA, 20 bp, mouse
gctggaagaggaacaagtgt

SEQ ID NO: 540569 - DNA, 20 bp, mouse
gaggaggtccgggttgtctg

SEQ ID NO: 540570 - DNA, 20 bp, mouse
gtcttggcggggaaggctag

SEQ ID NO: 540571 - DNA, 20 bp, mouse
gtctggacgggttggagccg

SEQ ID NO: 540572 - DNA, 20 bp, mouse
gcgagcgtggcgcacagcaa

SEQ ID NO: 540573 - DNA, 20 bp, mouse
ggtccgggttgtctgcggga

SEQ ID NO: 540574 - DNA, 20 bp, mouse
gctccttcccgcagacaacc

SEQ ID NO: 540575 - DNA, 20 bp, mouse
gcgcttgattctggacgggt

SEQ ID NO: 540576 - DNA, 20 bp, mouse
ggtctctggaggggagtgcg

SEQ ID NO: 540577 - DNA, 20 bp, mouse
gggcgaggggggagccggag

SEQ ID NO: 540578 - DNA, 20 bp, mouse
ggaagcacagacactcggcc

SEQ ID NO: 540579 - DNA, 20 bp, mouse
gcggcctgaaaaggcgaggg

SEQ ID NO: 540580 - DNA, 20 bp, mouse
ggcacccgggacacacacgc

SEQ ID NO: 540581 - DNA, 20 bp, mouse
gtgcttcagaggatgtgccg

SEQ ID NO: 540582 - DNA, 20 bp, mouse
gaagctggagcctcccccgg

SEQ ID NO: 540583 - DNA, 20 bp, mouse
gccgcttggccagtctctgg

SEQ ID NO: 540584 - DNA, 20 bp, mouse
gtcagaggatgtgccggggg

SEQ ID NO: 540585 - DNA, 20 bp, mouse
gaagcgggtgtaaccgccgg

SEQ ID NO: 540586 - DNA, 20 bp, mouse
gctgatgccccagagcgagt

SEQ ID NO: 540587 - DNA, 20 bp, mouse
gcgagtaggcagcgcagcag

SEQ ID NO: 540588 - DNA, 20 bp, mouse
ggcggggcgcatcgtctcca

SEQ ID NO: 540589 - DNA, 20 bp, mouse
ggcgctgcctactcgctctg

SEQ ID NO: 540590 - DNA, 20 bp, mouse
ggcggcaagtgctgtccagg

SEQ ID NO: 540591 - DNA, 20 bp, mouse
gaggcccaggcggctccgcg

SEQ ID NO: 540592 - DNA, 20 bp, mouse
gaagtgctgtccaggaggct

SEQ ID NO: 540593 - DNA, 20 bp, mouse
ggcagcggcaagtgctgtcc

SEQ ID NO: 540594 - DNA, 20 bp, mouse
gcacttgcggaaggaaccaa

SEQ ID NO: 540595 - DNA, 20 bp, mouse
gtcactgctcccgcaggccc

SEQ ID NO: 540596 - DNA, 20 bp, mouse
gggagaggcgggagtggcga

SEQ ID NO: 540597 - DNA, 20 bp, mouse
ggacaggtaaagcagcggga

SEQ ID NO: 540598 - DNA, 20 bp, mouse
gctgggctgcgcgggcacgt

SEQ ID NO: 540599 - DNA, 20 bp, mouse
gccacgggtcggggattgga

SEQ ID NO: 540600 - DNA, 20 bp, mouse
gcggcagtggcggcggtgat

SEQ ID NO: 540601 - DNA, 20 bp, mouse
gaccagagaatgaggtgaag

SEQ ID NO: 540602 - DNA, 20 bp, mouse
ggaagaggggaatctggggt

SEQ ID NO: 540603 - DNA, 20 bp, mouse
gagctgcagatctctcgctg

SEQ ID NO: 540604 - DNA, 20 bp, mouse
gggagggacaggtaaagcag

SEQ ID NO: 540605 - DNA, 20 bp, mouse
ggcacgtgattgacagccag

SEQ ID NO: 540606 - DNA, 20 bp, mouse
gtccggagacgcaggtccag

SEQ ID NO: 540607 - DNA, 20 bp, mouse
gcagctccgacagcttctgt

SEQ ID NO: 540608 - DNA, 20 bp, mouse
gcggagccaacagaagctgt

SEQ ID NO: 540609 - DNA, 20 bp, mouse
gaccccagggcttatagaca

SEQ ID NO: 540610 - DNA, 20 bp, mouse
gacctctggacctgcgtctc

SEQ ID NO: 540611 - DNA, 20 bp, mouse
gtactggggatgccagaggt

SEQ ID NO: 540612 - DNA, 20 bp, mouse
ggcaggggcgctaagggtag

SEQ ID NO: 540613 - DNA, 20 bp, mouse
gctgttggctccggagacgc

SEQ ID NO: 540614 - DNA, 20 bp, mouse
gaggtgggcaggggcgctaa

SEQ ID NO: 540615 - DNA, 20 bp, mouse
gatggtcaggtcagagagtg

SEQ ID NO: 540616 - DNA, 20 bp, mouse
gggctcagtgaaccccgggg

SEQ ID NO: 540617 - DNA, 20 bp, mouse
ggggccacgcgaggagcgcc

SEQ ID NO: 540618 - DNA, 20 bp, mouse
gctggagcgcgctcaggacg

SEQ ID NO: 540619 - DNA, 20 bp, mouse
gcacaggcatcgagagtcgt

SEQ ID NO: 540620 - DNA, 20 bp, mouse
ggccggcctgaggtgcgcgg

SEQ ID NO: 540621 - DNA, 20 bp, mouse
gccggaggaggccaccgcac

SEQ ID NO: 540622 - DNA, 20 bp, mouse
gtccggatcgcggggaccgg

SEQ ID NO: 540623 - DNA, 20 bp, mouse
gaccccggggtggcgcgcgt

SEQ ID NO: 540624 - DNA, 20 bp, mouse
gtggcaggtaagcagagtcc

SEQ ID NO: 540625 - DNA, 20 bp, mouse
gacggagcccggcactgacc

SEQ ID NO: 540626 - DNA, 20 bp, mouse
gtatctccaagagtgaggaa

SEQ ID NO: 540627 - DNA, 20 bp, mouse
ggcgtctatctccaagagtg

SEQ ID NO: 540628 - DNA, 20 bp, mouse
gcgagctaaggggaataacc

SEQ ID NO: 540629 - DNA, 20 bp, mouse
gggaataaccaggcaggtaa

SEQ ID NO: 540630 - DNA, 20 bp, mouse
gagcctgacgcctcggaaaa

SEQ ID NO: 540631 - DNA, 20 bp, mouse
gttcctgaggtctaaggata

SEQ ID NO: 540632 - DNA, 20 bp, mouse
gtcctggcccagttacaaca

SEQ ID NO: 540633 - DNA, 20 bp, mouse
gggtaaaagcgaatttcctg

SEQ ID NO: 540634 - DNA, 20 bp, mouse
gctgctgctgcctttttccg

SEQ ID NO: 540635 - DNA, 20 bp, mouse
gtactgcacaaattaagggt

SEQ ID NO: 540636 - DNA, 20 bp, mouse
gcgtccccggaaggcaacga

SEQ ID NO: 540637 - DNA, 20 bp, mouse
gccccggaaggcaacgacgg

SEQ ID NO: 540638 - DNA, 20 bp, mouse
ggggctcgtatggaaggtgg

SEQ ID NO: 540639 - DNA, 20 bp, mouse
gacgtgtccacgtccccgga

SEQ ID NO: 540640 - DNA, 20 bp, mouse
ggacgtggacacgtgagccc

SEQ ID NO: 540641 - DNA, 20 bp, mouse
ggccccggctactgagtcca

SEQ ID NO: 540642 - DNA, 20 bp, mouse
ggctcacgtgtccacgtccc

SEQ ID NO: 540643 - DNA, 20 bp, mouse
gaaggcaacgacggcggctg

SEQ ID NO: 540644 - DNA, 20 bp, mouse
gagtccatggcactgtgaat

SEQ ID NO: 540645 - DNA, 20 bp, mouse
gtccgtggcttggagttcgg

SEQ ID NO: 540646 - DNA, 20 bp, mouse
gtggaggaggagtaatcggg

SEQ ID NO: 540647 - DNA, 20 bp, mouse
gcggtctagcagcagaccct

SEQ ID NO: 540648 - DNA, 20 bp, mouse
gaagccaaggcccagtgctg

SEQ ID NO: 540649 - DNA, 20 bp, mouse
gctagcagcagaccctggga

SEQ ID NO: 540650 - DNA, 20 bp, mouse
ggggaggtgagccaggcaaa

SEQ ID NO: 540651 - DNA, 20 bp, mouse
ggctcagggtgctgtaatgg

SEQ ID NO: 540652 - DNA, 20 bp, mouse
gtaatggaggaggagtaatc

SEQ ID NO: 540653 - DNA, 20 bp, mouse
ggaccgtcaaacctcagcac

SEQ ID NO: 540654 - DNA, 20 bp, mouse
gcagggtgctgtaatggagg

SEQ ID NO: 540655 - DNA, 20 bp, mouse
gtgtcgggtgaggcaaatca

SEQ ID NO: 540656 - DNA, 20 bp, mouse
gctccactcggccttcttaa

SEQ ID NO: 540657 - DNA, 20 bp, mouse
gtaggaacggaaagacgtca

SEQ ID NO: 540658 - DNA, 20 bp, mouse
gtgtcggggagagaggaccg

SEQ ID NO: 540659 - DNA, 20 bp, mouse
ggaagctgcatctcacgcca

SEQ ID NO: 540660 - DNA, 20 bp, mouse
gtagcgtggttgggctgtcg

SEQ ID NO: 540661 - DNA, 20 bp, mouse
ggagagaggaccgtggtagg

SEQ ID NO: 540662 - DNA, 20 bp, mouse
gggggagagaggaccgtggt

SEQ ID NO: 540663 - DNA, 20 bp, mouse
ggacccggaacacaaatctt

SEQ ID NO: 540664 - DNA, 20 bp, mouse
gctcggacgcgggcgacgaa

SEQ ID NO: 540665 - DNA, 20 bp, mouse
gtaggttggcactgacgcca

SEQ ID NO: 540666 - DNA, 20 bp, mouse
ggcccggggagagagacgag

SEQ ID NO: 540667 - DNA, 20 bp, mouse
ggcggaggaggaataggccg

SEQ ID NO: 540668 - DNA, 20 bp, mouse
gtctctctccccgggcgaga

SEQ ID NO: 540669 - DNA, 20 bp, mouse
ggagcggaggacaccgagag

SEQ ID NO: 540670 - DNA, 20 bp, mouse
gcggggagagagacgagggg

SEQ ID NO: 540671 - DNA, 20 bp, mouse
gggcccgctggtagtgatgg

SEQ ID NO: 540672 - DNA, 20 bp, mouse
ggtaactagtgcgcaggggt

SEQ ID NO: 540673 - DNA, 20 bp, mouse
gccccagccaagctacctga

SEQ ID NO: 540674 - DNA, 20 bp, mouse
ggctacctgagggcaagcag

SEQ ID NO: 540675 - DNA, 20 bp, mouse
ggttcgctgccttctcgccc

SEQ ID NO: 540676 - DNA, 20 bp, mouse
ggccggttgtctgcaagctg

SEQ ID NO: 540677 - DNA, 20 bp, mouse
gcacacgcagcagcctctaa

SEQ ID NO: 540678 - DNA, 20 bp, mouse
gaccggcaaccagagaagtc

SEQ ID NO: 540679 - DNA, 20 bp, mouse
gcaagcccgcaactcttacc

SEQ ID NO: 540680 - DNA, 20 bp, mouse
gacctcagcttgcagacaac

SEQ ID NO: 540681 - DNA, 20 bp, mouse
ggagacctcgaaactggagt

SEQ ID NO: 540682 - DNA, 20 bp, mouse
ggagtcactttagctctcag

SEQ ID NO: 540683 - DNA, 20 bp, mouse
gcatatctatcagtagaaaa

SEQ ID NO: 540684 - DNA, 20 bp, mouse
gctaaaccgggtaagagttg

SEQ ID NO: 540685 - DNA, 20 bp, mouse
ggaagctgagacctcgaaac

SEQ ID NO: 540686 - DNA, 20 bp, mouse
ggacgtgtccgcgaagatgg

SEQ ID NO: 540687 - DNA, 20 bp, mouse
ggagtgcggagctgcaacct

SEQ ID NO: 540688 - DNA, 20 bp, mouse
ggacgaagagacaaccctcg

SEQ ID NO: 540689 - DNA, 20 bp, mouse
gacccggcccgccatcttcg

SEQ ID NO: 540690 - DNA, 20 bp, mouse
gaggcgagacagtgtagctg

SEQ ID NO: 540691 - DNA, 20 bp, mouse
ggaagagacaaccctcgggg

SEQ ID NO: 540692 - DNA, 20 bp, mouse
gggaagcactggagacccgg

SEQ ID NO: 540693 - DNA, 20 bp, mouse
ggaggtcagagcaacgctgg

SEQ ID NO: 540694 - DNA, 20 bp, mouse
gagtggcggccgggcagccc

SEQ ID NO: 540695 - DNA, 20 bp, mouse
ggagccccaggggatgacaa

SEQ ID NO: 540696 - DNA, 20 bp, mouse
ggaagtgcacggggcgaaga

SEQ ID NO: 540697 - DNA, 20 bp, mouse
gcgagcccgcaggaaaacag

SEQ ID NO: 540698 - DNA, 20 bp, mouse
gccgctgggcgcctgctcgt

SEQ ID NO: 540699 - DNA, 20 bp, mouse
gggagcggcaggacgcgttg

SEQ ID NO: 540700 - DNA, 20 bp, mouse
gcggctctgcgatccctacg

SEQ ID NO: 540701 - DNA, 20 bp, mouse
ggctggacgcggtagaacgg

SEQ ID NO: 540702 - DNA, 20 bp, mouse
gaagatggcggaggagcggc

SEQ ID NO: 540703 - DNA, 20 bp, mouse
ggcgcacagtcatccctgcg

SEQ ID NO: 540704 - DNA, 20 bp, mouse
ggacgcggtagaacggcggg

SEQ ID NO: 540705 - DNA, 20 bp, mouse
gtgtgcgcttcggccgcgta

SEQ ID NO: 540706 - DNA, 20 bp, mouse
ggcctggctccggaagatct

SEQ ID NO: 540707 - DNA, 20 bp, mouse
gagcgggcgacactgagcct

SEQ ID NO: 540708 - DNA, 20 bp, mouse
gatcttccggagccaggcgt

SEQ ID NO: 540709 - DNA, 20 bp, mouse
gctcccgcgcacagcaatgg

SEQ ID NO: 540710 - DNA, 20 bp, mouse
gccgctcccgcgcacagcaa

SEQ ID NO: 540711 - DNA, 20 bp, mouse
ggggctccaagcgcgctccg

SEQ ID NO: 540712 - DNA, 20 bp, mouse
gaggccagtgccacccgaca

SEQ ID NO: 540713 - DNA, 20 bp, mouse
gccgcgcacagcaatggcgg

SEQ ID NO: 540714 - DNA, 20 bp, mouse
ggtacgcgtccagaaaggct

SEQ ID NO: 540715 - DNA, 20 bp, mouse
gtgagtgcgggtggcgaacg

SEQ ID NO: 540716 - DNA, 20 bp, mouse
gtccggatccaggcacgcga

SEQ ID NO: 540717 - DNA, 20 bp, mouse
ggagtcaagccaatatgtag

SEQ ID NO: 540718 - DNA, 20 bp, mouse
ggccctcgcgtgcctggatc

SEQ ID NO: 540719 - DNA, 20 bp, mouse
gtccctcctcagccagagcg

SEQ ID NO: 540720 - DNA, 20 bp, mouse
gcagcaccacgctctggctg

SEQ ID NO: 540721 - DNA, 20 bp, mouse
gtcaagccaatatgtagagg

SEQ ID NO: 540722 - DNA, 20 bp, mouse
gtccggagcttctgagaacg

SEQ ID NO: 540723 - DNA, 20 bp, mouse
gccagtgccgcacagtaagt

SEQ ID NO: 540724 - DNA, 20 bp, mouse
gcggagttgtggggatgaca

SEQ ID NO: 540725 - DNA, 20 bp, mouse
gtactgtgcggcactggtgg

SEQ ID NO: 540726 - DNA, 20 bp, mouse
ggtttaaaccgggaagatgg

SEQ ID NO: 540727 - DNA, 20 bp, mouse
ggcatcgtggtcctgcgggg

SEQ ID NO: 540728 - DNA, 20 bp, mouse
ggtggcctgagggtctgagg

SEQ ID NO: 540729 - DNA, 20 bp, mouse
gtgggcatcgtggtcctgcg

SEQ ID NO: 540730 - DNA, 20 bp, mouse
gcgcactcggaagtcctcta

SEQ ID NO: 540731 - DNA, 20 bp, mouse
gtgaggcggcctgggcatcg

SEQ ID NO: 540732 - DNA, 20 bp, mouse
gacaggaagcagcacccagg

SEQ ID NO: 540733 - DNA, 20 bp, mouse
ggcgctgcgggacgcacagt

SEQ ID NO: 540734 - DNA, 20 bp, mouse
gatcttcccggtttaaacta

SEQ ID NO: 540735 - DNA, 20 bp, mouse
ggcgggacgcacagtgggta

SEQ ID NO: 540736 - DNA, 20 bp, mouse
ggcgctgcagaggttagtcg

SEQ ID NO: 540737 - DNA, 20 bp, mouse
gaggttagtcggggcagtgt

SEQ ID NO: 540738 - DNA, 20 bp, mouse
gtgactcaggcccggaggag

SEQ ID NO: 540739 - DNA, 20 bp, mouse
gaggggcgcgcagtgacctg

SEQ ID NO: 540740 - DNA, 20 bp, mouse
ggtcggggcagtgtaggacg

SEQ ID NO: 540741 - DNA, 20 bp, mouse
ggcaggtctcaggctcacgt

SEQ ID NO: 540742 - DNA, 20 bp, mouse
gcgccgtgactcaggcccgg

SEQ ID NO: 540743 - DNA, 20 bp, mouse
ggactgctcgggacagtcgg

SEQ ID NO: 540744 - DNA, 20 bp, mouse
gtccccacgcgaggatgctg

SEQ ID NO: 540745 - DNA, 20 bp, mouse
gcatcctcgcgtggggactc

SEQ ID NO: 540746 - DNA, 20 bp, mouse
ggaccagagcgggcatctgt

SEQ ID NO: 540747 - DNA, 20 bp, mouse
gctggaggcgggctccgata

SEQ ID NO: 540748 - DNA, 20 bp, mouse
gtggtttgcggtacgtatga

SEQ ID NO: 540749 - DNA, 20 bp, mouse
gtcggagcccgcctccaggg

SEQ ID NO: 540750 - DNA, 20 bp, mouse
ggcttccggcgtgatctcgc

SEQ ID NO: 540751 - DNA, 20 bp, mouse
gatcacgccggaagccatat

SEQ ID NO: 540752 - DNA, 20 bp, mouse
gaccagtaggagctccagtc

SEQ ID NO: 540753 - DNA, 20 bp, mouse
gcaaaccagcgagatcacgc

SEQ ID NO: 540754 - DNA, 20 bp, mouse
gggtacgtatgaaggctttg

SEQ ID NO: 540755 - DNA, 20 bp, mouse
gagcgggcatctgtgggcaa

SEQ ID NO: 540756 - DNA, 20 bp, mouse
ggggctgaggaaaggagtcg

SEQ ID NO: 540757 - DNA, 20 bp, mouse
gacccgcagcaactagacgg

SEQ ID NO: 540758 - DNA, 20 bp, mouse
gggtctgggcgtgcgacgtt

SEQ ID NO: 540759 - DNA, 20 bp, mouse
gtttcctcagcccacttctg

SEQ ID NO: 540760 - DNA, 20 bp, mouse
ggtccccagagcacagaggg

SEQ ID NO: 540761 - DNA, 20 bp, mouse
ggccggctagacccctatca

SEQ ID NO: 540762 - DNA, 20 bp, mouse
gggcgggaggcaaccttctt

SEQ ID NO: 540763 - DNA, 20 bp, mouse
gctagttgctgcgggtgaag

SEQ ID NO: 540764 - DNA, 20 bp, mouse
gtccaggaggaaccgtgata

SEQ ID NO: 540765 - DNA, 20 bp, mouse
ggttcctcctggatcttacc

SEQ ID NO: 540766 - DNA, 20 bp, mouse
gtcgccttgcaacttcggag

SEQ ID NO: 540767 - DNA, 20 bp, mouse
gccggccccggccctcagac

SEQ ID NO: 540768 - DNA, 20 bp, mouse
ggccccggccctcagaccgg

SEQ ID NO: 540769 - DNA, 20 bp, mouse
gcgatgtctggcgacagcag

SEQ ID NO: 540770 - DNA, 20 bp, mouse
gggcgaattggcgcgatgtc

SEQ ID NO: 540771 - DNA, 20 bp, mouse
gtggaggccgagtacgacca

SEQ ID NO: 540772 - DNA, 20 bp, mouse
gccgaagttgcaaggcgaat

SEQ ID NO: 540773 - DNA, 20 bp, mouse
gccttgcaacttcggagcgg

SEQ ID NO: 540774 - DNA, 20 bp, mouse
ggccgccgccaaggtcgcgt

SEQ ID NO: 540775 - DNA, 20 bp, mouse
ggcagcggccgccggtctga

SEQ ID NO: 540776 - DNA, 20 bp, mouse
gcagcgcgtccagccactgt

SEQ ID NO: 540777 - DNA, 20 bp, mouse
gcagggtcagggtcagactt

SEQ ID NO: 540778 - DNA, 20 bp, mouse
gagagcgcggctggacccgg

SEQ ID NO: 540779 - DNA, 20 bp, mouse
gcagccactgtaggagagcg

SEQ ID NO: 540780 - DNA, 20 bp, mouse
ggcgctaggtctcagcctca

SEQ ID NO: 540781 - DNA, 20 bp, mouse
gcttaggcccaggccccgca

SEQ ID NO: 540782 - DNA, 20 bp, mouse
gctcggtagcggccaaagta

SEQ ID NO: 540783 - DNA, 20 bp, mouse
gcagggtcagacttaggccc

SEQ ID NO: 540784 - DNA, 20 bp, mouse
gcggcccactcaccttactt

SEQ ID NO: 540785 - DNA, 20 bp, mouse
gtgctgccggctaccctctg

SEQ ID NO: 540786 - DNA, 20 bp, mouse
gagccgcgtgggccatgggg

SEQ ID NO: 540787 - DNA, 20 bp, mouse
gtgcagccgcgtgggccatg

SEQ ID NO: 540788 - DNA, 20 bp, mouse
gcgccgccccatggcccacg

SEQ ID NO: 540789 - DNA, 20 bp, mouse
gagcgtgcgtgcggtttggt

SEQ ID NO: 540790 - DNA, 20 bp, mouse
ggcccacgcggctgcacacg

SEQ ID NO: 540791 - DNA, 20 bp, mouse
ggccctgccaggaaagcgac

SEQ ID NO: 540792 - DNA, 20 bp, mouse
gagcagccgccgcagcctga

SEQ ID NO: 540793 - DNA, 20 bp, mouse
ggcgaggaagacgccagcga

SEQ ID NO: 540794 - DNA, 20 bp, mouse
gaggaagacgccagcgacgg

SEQ ID NO: 540795 - DNA, 20 bp, mouse
ggtgcagcgtgcgtgcggtt

SEQ ID NO: 540796 - DNA, 20 bp, mouse
gtctagcggagacccgtagt

SEQ ID NO: 540797 - DNA, 20 bp, mouse
ggcctgagctcgccaactac

SEQ ID NO: 540798 - DNA, 20 bp, mouse
gtaccccgcgcgaactctag

SEQ ID NO: 540799 - DNA, 20 bp, mouse
gctcgcaggacccggaagta

SEQ ID NO: 540800 - DNA, 20 bp, mouse
gcatcaccggggtgcaccca

SEQ ID NO: 540801 - DNA, 20 bp, mouse
gggtgcaccccggtgatgag

SEQ ID NO: 540802 - DNA, 20 bp, mouse
gccgggctgaagccaccgag

SEQ ID NO: 540803 - DNA, 20 bp, mouse
ggcggggaccatgctgactc

SEQ ID NO: 540804 - DNA, 20 bp, mouse
gacccgtagttggcgagctc

SEQ ID NO: 540805 - DNA, 20 bp, mouse
gaagccaccgagaggcaggg

SEQ ID NO: 540806 - DNA, 20 bp, mouse
gtccgaacacatcttaagac

SEQ ID NO: 540807 - DNA, 20 bp, mouse
gttggcgttgttagttgaca

SEQ ID NO: 540808 - DNA, 20 bp, mouse
ggcccgtcttaagatgtgtt

SEQ ID NO: 540809 - DNA, 20 bp, mouse
ggggctgcttagaatatcag

SEQ ID NO: 540810 - DNA, 20 bp, mouse
ggccgtgacttaacagagag

SEQ ID NO: 540811 - DNA, 20 bp, mouse
gcggaagctgctgaagctcg

SEQ ID NO: 540812 - DNA, 20 bp, mouse
gctgcttacgcaacaggaag

SEQ ID NO: 540813 - DNA, 20 bp, mouse
gtgagtgacgggaaacgcaa

SEQ ID NO: 540814 - DNA, 20 bp, mouse
gattcgggacatgaactcca

SEQ ID NO: 540815 - DNA, 20 bp, mouse
gtgagacaagagctccaaga

SEQ ID NO: 540816 - DNA, 20 bp, mouse
gcttgaggcggggagagcat

SEQ ID NO: 540817 - DNA, 20 bp, mouse
gccggcgtggaaagccgcca

SEQ ID NO: 540818 - DNA, 20 bp, mouse
gtgtcgtagagcgcttgagg

SEQ ID NO: 540819 - DNA, 20 bp, mouse
gccggccagcaccgccgcgg

SEQ ID NO: 540820 - DNA, 20 bp, mouse
ggagagcatggggctgtacg

SEQ ID NO: 540821 - DNA, 20 bp, mouse
gccgccagggctccctcaag

SEQ ID NO: 540822 - DNA, 20 bp, mouse
gcaggttctgtgcgacacag

SEQ ID NO: 540823 - DNA, 20 bp, mouse
ggaatacaccaaccccttga

SEQ ID NO: 540824 - DNA, 20 bp, mouse
gcagggctccctcaaggggt

SEQ ID NO: 540825 - DNA, 20 bp, mouse
gaggcccgcgtggggtgcag

SEQ ID NO: 540826 - DNA, 20 bp, mouse
gagcatgtcagagtggatct

SEQ ID NO: 540827 - DNA, 20 bp, mouse
gctttctgttccgaagctgg

SEQ ID NO: 540828 - DNA, 20 bp, mouse
gtgccggaagtgacgaaccc

SEQ ID NO: 540829 - DNA, 20 bp, mouse
gaaaaccgcgcccccagctt

SEQ ID NO: 540830 - DNA, 20 bp, mouse
gtgcgacactgcgccaaata

SEQ ID NO: 540831 - DNA, 20 bp, mouse
gcactgcgccaaatagggct

SEQ ID NO: 540832 - DNA, 20 bp, mouse
gagttgtccaagaaaatgtt

SEQ ID NO: 540833 - DNA, 20 bp, mouse
gtgggcacgaacagaaggct

SEQ ID NO: 540834 - DNA, 20 bp, mouse
ggaacagaaagtcgcttcct

SEQ ID NO: 540835 - DNA, 20 bp, mouse
gaaggctgggcatcgagtgc

SEQ ID NO: 540836 - DNA, 20 bp, mouse
gcggtcagcagcgagggacg

SEQ ID NO: 540837 - DNA, 20 bp, mouse
gacgcggtggccaggcctcg

SEQ ID NO: 540838 - DNA, 20 bp, mouse
gctcaggcggtcagcagcga

SEQ ID NO: 540839 - DNA, 20 bp, mouse
gagagcagcggtcatccccg

SEQ ID NO: 540840 - DNA, 20 bp, mouse
ggcgccagctgaggttcctc

SEQ ID NO: 540841 - DNA, 20 bp, mouse
gctgccactctgaagaaacg

SEQ ID NO: 540842 - DNA, 20 bp, mouse
gcagaggaccgcgccagctg

SEQ ID NO: 540843 - DNA, 20 bp, mouse
gcccaacactgggacaggaa

SEQ ID NO: 540844 - DNA, 20 bp, mouse
gccagctgaggttcctcagg

SEQ ID NO: 540845 - DNA, 20 bp, mouse
gttcttcagagtggcaggag

SEQ ID NO: 540846 - DNA, 20 bp, mouse
gctcgtgaggcagccctagt

SEQ ID NO: 540847 - DNA, 20 bp, mouse
gtgcctcacgagctccggga

SEQ ID NO: 540848 - DNA, 20 bp, mouse
ggaggcagccctagtgggta

SEQ ID NO: 540849 - DNA, 20 bp, mouse
ggaccgtcccggagctcgtg

SEQ ID NO: 540850 - DNA, 20 bp, mouse
gcttgctgccttacccacta

SEQ ID NO: 540851 - DNA, 20 bp, mouse
gggagctctgggtccctaag

SEQ ID NO: 540852 - DNA, 20 bp, mouse
gccgaacccggtgggtggtg

SEQ ID NO: 540853 - DNA, 20 bp, mouse
gggctctggggctgaagacg

SEQ ID NO: 540854 - DNA, 20 bp, mouse
gccgcatccagggttcagtg

SEQ ID NO: 540855 - DNA, 20 bp, mouse
ggcccgcgccagctacgtcc

SEQ ID NO: 540856 - DNA, 20 bp, mouse
gtgtgctctgcggagacacc

SEQ ID NO: 540857 - DNA, 20 bp, mouse
gacaccgggcgtggcaatgg

SEQ ID NO: 540858 - DNA, 20 bp, mouse
ggagacaccgggcgtggcaa

SEQ ID NO: 540859 - DNA, 20 bp, mouse
gggcggtaggagacccgatg

SEQ ID NO: 540860 - DNA, 20 bp, mouse
ggacccgatggggaacctct

SEQ ID NO: 540861 - DNA, 20 bp, mouse
gcagagcacagcggcaagca

SEQ ID NO: 540862 - DNA, 20 bp, mouse
gtctgcggagacaccgggcg

SEQ ID NO: 540863 - DNA, 20 bp, mouse
gtgtccaccagcacgcgcac

SEQ ID NO: 540864 - DNA, 20 bp, mouse
ggcacggaagatgccagacc

SEQ ID NO: 540865 - DNA, 20 bp, mouse
gcgagcagtacggagctctg

SEQ ID NO: 540866 - DNA, 20 bp, mouse
gtcggcaccgggctgaggga

SEQ ID NO: 540867 - DNA, 20 bp, mouse
ggagtcggagcatggaacca

SEQ ID NO: 540868 - DNA, 20 bp, mouse
gggccggatagaatccgagt

SEQ ID NO: 540869 - DNA, 20 bp, mouse
gagtggagacgcggagctct

SEQ ID NO: 540870 - DNA, 20 bp, mouse
gagggaggcgcgtcccgggt

SEQ ID NO: 540871 - DNA, 20 bp, mouse
gcggattctatccggcccgg

SEQ ID NO: 540872 - DNA, 20 bp, mouse
gacgggaagggccatttcta

SEQ ID NO: 540873 - DNA, 20 bp, mouse
ggacgcggagctctcggcac

SEQ ID NO: 540874 - DNA, 20 bp, mouse
gtgctgggcacattctgggg

SEQ ID NO: 540875 - DNA, 20 bp, mouse
gaactgctgggcacattctg

SEQ ID NO: 540876 - DNA, 20 bp, mouse
gactgagccagcgaagtgat

SEQ ID NO: 540877 - DNA, 20 bp, mouse
gccagcgaagtgataggaaa

SEQ ID NO: 540878 - DNA, 20 bp, mouse
gcattctcagagagtaaaaa

SEQ ID NO: 540879 - DNA, 20 bp, mouse
gacaggctgacacactaggt

SEQ ID NO: 540880 - DNA, 20 bp, mouse
gacaaagaaagaggtggtgt

SEQ ID NO: 540881 - DNA, 20 bp, mouse
gaatcttggtttagcatcag

SEQ ID NO: 540882 - DNA, 20 bp, mouse
gtaccagaaagctgagaaca

SEQ ID NO: 540883 - DNA, 20 bp, mouse
ggtaaatacaatgactctat

SEQ ID NO: 540884 - DNA, 20 bp, mouse
gatgagcatatgttcaacac

SEQ ID NO: 540885 - DNA, 20 bp, mouse
gactcagctcactccaatct

SEQ ID NO: 540886 - DNA, 20 bp, mouse
gactcaccggccgcaccgca

SEQ ID NO: 540887 - DNA, 20 bp, mouse
gcgggtgccgccgcactcac

SEQ ID NO: 540888 - DNA, 20 bp, mouse
gggattgctgccgtgcggtg

SEQ ID NO: 540889 - DNA, 20 bp, mouse
gagtgcggcggcacccgcgg

SEQ ID NO: 540890 - DNA, 20 bp, mouse
gcgctaggattgctgccgtg

SEQ ID NO: 540891 - DNA, 20 bp, mouse
ggcgcgcgccgaggcggctg

SEQ ID NO: 540892 - DNA, 20 bp, mouse
gagcggacgctgggaaacaa

SEQ ID NO: 540893 - DNA, 20 bp, mouse
gcaggctcgcagcccatgag

SEQ ID NO: 540894 - DNA, 20 bp, mouse
ggcggcgagcgagcaggctg

SEQ ID NO: 540895 - DNA, 20 bp, mouse
gagaccaggggaaccgagag

SEQ ID NO: 540896 - DNA, 20 bp, mouse
gtccgcgggtacgagcccag

SEQ ID NO: 540897 - DNA, 20 bp, mouse
ggagcacgcgggcctgtcaa

SEQ ID NO: 540898 - DNA, 20 bp, mouse
ggctcgtacccgcggatccc

SEQ ID NO: 540899 - DNA, 20 bp, mouse
gcgcggaagcccgggatccg

SEQ ID NO: 540900 - DNA, 20 bp, mouse
gggggctccggggaagtgtg

SEQ ID NO: 540901 - DNA, 20 bp, mouse
gggcccgcgtgctctcggcg

SEQ ID NO: 540902 - DNA, 20 bp, mouse
gttccgcgccgagagcacgc

SEQ ID NO: 540903 - DNA, 20 bp, mouse
ggcccctgggctcgtacccg

SEQ ID NO: 540904 - DNA, 20 bp, mouse
gaggaggccccgcccagaag

SEQ ID NO: 540905 - DNA, 20 bp, mouse
gggccgcgcggtccattgac

SEQ ID NO: 540906 - DNA, 20 bp, mouse
gcaccaggccagcggcgtga

SEQ ID NO: 540907 - DNA, 20 bp, mouse
gaggaggtgaggccacgggc

SEQ ID NO: 540908 - DNA, 20 bp, mouse
ggccagcggcgtgatggcgg

SEQ ID NO: 540909 - DNA, 20 bp, mouse
gctgatgcggcagcccggac

SEQ ID NO: 540910 - DNA, 20 bp, mouse
gttgtgggcgcccttcgcag

SEQ ID NO: 540911 - DNA, 20 bp, mouse
ggtgaggccacgggcgggga

SEQ ID NO: 540912 - DNA, 20 bp, mouse
ggacgggtgcaggaaattgt

SEQ ID NO: 540913 - DNA, 20 bp, mouse
gacgccgctggcctggtggg

SEQ ID NO: 540914 - DNA, 20 bp, mouse
gctgacccgagagccgcgat

SEQ ID NO: 540915 - DNA, 20 bp, mouse
ggcgcagtgtggctgtaagg

SEQ ID NO: 540916 - DNA, 20 bp, mouse
ggcgggtaacgcagaccgga

SEQ ID NO: 540917 - DNA, 20 bp, mouse
gagcggcgggtaacgcagac

SEQ ID NO: 540918 - DNA, 20 bp, mouse
ggagcatgcgagaagttgcc

SEQ ID NO: 540919 - DNA, 20 bp, mouse
gaccacgtcgcaggcgccca

SEQ ID NO: 540920 - DNA, 20 bp, mouse
gagccatggcagggcagcgg

SEQ ID NO: 540921 - DNA, 20 bp, mouse
ggctctcgggcaggttgtag

SEQ ID NO: 540922 - DNA, 20 bp, mouse
gacccgccgctgccctgcca

SEQ ID NO: 540923 - DNA, 20 bp, mouse
ggtaacgcagaccggaaggc

SEQ ID NO: 540924 - DNA, 20 bp, mouse
gggcggaagtgtactttcag

SEQ ID NO: 540925 - DNA, 20 bp, mouse
gtggcacggacagcctctaa

SEQ ID NO: 540926 - DNA, 20 bp, mouse
gctcaggctgatctcattgt

SEQ ID NO: 540927 - DNA, 20 bp, mouse
gtaggaggctgcagacctca

SEQ ID NO: 540928 - DNA, 20 bp, mouse
gaatagctgctgggtttagg

SEQ ID NO: 540929 - DNA, 20 bp, mouse
gccccagcccaggataccag

SEQ ID NO: 540930 - DNA, 20 bp, mouse
gtgagtgacgtcgaagtcta

SEQ ID NO: 540931 - DNA, 20 bp, mouse
gaaccccaggactcagtctg

SEQ ID NO: 540932 - DNA, 20 bp, mouse
gagggggcagaaggtctaca

SEQ ID NO: 540933 - DNA, 20 bp, mouse
gaggataccaggggaacccc

SEQ ID NO: 540934 - DNA, 20 bp, mouse
gaggtcacactcggtcctgt

SEQ ID NO: 540935 - DNA, 20 bp, mouse
gtgccccagactgagtcctg

SEQ ID NO: 540936 - DNA, 20 bp, mouse
gagaggcagcatggccacgg

SEQ ID NO: 540937 - DNA, 20 bp, mouse
gaagctgccagtggcacgga

SEQ ID NO: 540938 - DNA, 20 bp, mouse
gccggcacttgctcagacgt

SEQ ID NO: 540939 - DNA, 20 bp, mouse
gcttagaggcagcatggcca

SEQ ID NO: 540940 - DNA, 20 bp, mouse
ggaactgccggcgtgcgtcc

SEQ ID NO: 540941 - DNA, 20 bp, mouse
gggcagccggggcagagcac

SEQ ID NO: 540942 - DNA, 20 bp, mouse
gagcatggccacggtggcag

SEQ ID NO: 540943 - DNA, 20 bp, mouse
gacccgaggggtcctcgagt

SEQ ID NO: 540944 - DNA, 20 bp, mouse
ggccagcgtcgcgaggctcc

SEQ ID NO: 540945 - DNA, 20 bp, mouse
ggccgctgcgagagttccaa

SEQ ID NO: 540946 - DNA, 20 bp, mouse
ggtgcgagaagcagccactt

SEQ ID NO: 540947 - DNA, 20 bp, mouse
gagccacttgggtaccttag

SEQ ID NO: 540948 - DNA, 20 bp, mouse
gggccgctaaggtacccaag

SEQ ID NO: 540949 - DNA, 20 bp, mouse
gcggccgcgggacgcatggc

SEQ ID NO: 540950 - DNA, 20 bp, mouse
gctggctagagcgcgttgag

SEQ ID NO: 540951 - DNA, 20 bp, mouse
gttagcggccgcgggacgca

SEQ ID NO: 540952 - DNA, 20 bp, mouse
gggccacgccgcccacacac

SEQ ID NO: 540953 - DNA, 20 bp, mouse
gagtttagtagaggccccgg

SEQ ID NO: 540954 - DNA, 20 bp, mouse
gctagagcgcgttgagcggg

SEQ ID NO: 540955 - DNA, 20 bp, mouse
gtagccagccatgcgtcccg

SEQ ID NO: 540956 - DNA, 20 bp, mouse
ggaggagcggggcgatgcat

SEQ ID NO: 540957 - DNA, 20 bp, mouse
gcgccacgaagggcaggtcg

SEQ ID NO: 540958 - DNA, 20 bp, mouse
gtgcgcgtccgtgtccgcgg

SEQ ID NO: 540959 - DNA, 20 bp, mouse
gtctgggtgtcggagcagta

SEQ ID NO: 540960 - DNA, 20 bp, mouse
gggtgtcggagcagtacgga

SEQ ID NO: 540961 - DNA, 20 bp, mouse
ggcctgcgcgtccgtgtccg

SEQ ID NO: 540962 - DNA, 20 bp, mouse
gagaagaagtggatactgaa

SEQ ID NO: 540963 - DNA, 20 bp, mouse
ggcagcctccaccgcggaca

SEQ ID NO: 540964 - DNA, 20 bp, mouse
gacggatcctgggaggacta

SEQ ID NO: 540965 - DNA, 20 bp, mouse
gtcgccccgctcctcgcccg

SEQ ID NO: 540966 - DNA, 20 bp, mouse
gccagctccacagcggaccg

SEQ ID NO: 540967 - DNA, 20 bp, mouse
ggctgcccatccaccagcag

SEQ ID NO: 540968 - DNA, 20 bp, mouse
gaccagcagtggcatcgtct

SEQ ID NO: 540969 - DNA, 20 bp, mouse
ggatgccactgctggtggat

SEQ ID NO: 540970 - DNA, 20 bp, mouse
gacagcgcgaggacactcgg

SEQ ID NO: 540971 - DNA, 20 bp, mouse
ggagcagcccgaagagatcg

SEQ ID NO: 540972 - DNA, 20 bp, mouse
gcgtctgccacggtccgctg

SEQ ID NO: 540973 - DNA, 20 bp, mouse
ggcctagacgatgccactgc

SEQ ID NO: 540974 - DNA, 20 bp, mouse
gggtgagacgaggcccagag

SEQ ID NO: 540975 - DNA, 20 bp, mouse
ggccccagctagcaccgcgg

SEQ ID NO: 540976 - DNA, 20 bp, mouse
gtgcgcggagctgctgggta

SEQ ID NO: 540977 - DNA, 20 bp, mouse
gagcggtgggaaaaaacgag

SEQ ID NO: 540978 - DNA, 20 bp, mouse
gaccgtggcagaagtaacca

SEQ ID NO: 540979 - DNA, 20 bp, mouse
ggccgggctatctcgcgggg

SEQ ID NO: 540980 - DNA, 20 bp, mouse
gccgccacgtccccttaccg

SEQ ID NO: 540981 - DNA, 20 bp, mouse
gggcggtgcgcggagctgct

SEQ ID NO: 540982 - DNA, 20 bp, mouse
gtagtggctgcggcaggggt

SEQ ID NO: 540983 - DNA, 20 bp, mouse
gtcacgggactcagagttga

SEQ ID NO: 540984 - DNA, 20 bp, mouse
gaccgccccgcgagatagcc

SEQ ID NO: 540985 - DNA, 20 bp, mouse
gtgcgccgggctatctcgcg

SEQ ID NO: 540986 - DNA, 20 bp, mouse
gtcttcctccggatccgatc

SEQ ID NO: 540987 - DNA, 20 bp, mouse
gaaacctccaaagtgctgtg

SEQ ID NO: 540988 - DNA, 20 bp, mouse
ggcagcctgatcggatccgg

SEQ ID NO: 540989 - DNA, 20 bp, mouse
ggtcagccaggataatgatg

SEQ ID NO: 540990 - DNA, 20 bp, mouse
gctgccacacagcactttgg

SEQ ID NO: 540991 - DNA, 20 bp, mouse
gaccctgccacacagcactt

SEQ ID NO: 540992 - DNA, 20 bp, mouse
gtctgcagcctgatcggatc

SEQ ID NO: 540993 - DNA, 20 bp, mouse
gcagagaggatggagagtcg

SEQ ID NO: 540994 - DNA, 20 bp, mouse
gggcttgggcgtgctctgtg

SEQ ID NO: 540995 - DNA, 20 bp, mouse
ggaagctgcggggcgaaagg

SEQ ID NO: 540996 - DNA, 20 bp, mouse
gcgagctgccagcgagccgg

SEQ ID NO: 540997 - DNA, 20 bp, mouse
gcaggacggaagtctcccag

SEQ ID NO: 540998 - DNA, 20 bp, mouse
gggagccgcagcggcgccag

SEQ ID NO: 540999 - DNA, 20 bp, mouse
ggtccgagctgccagcgagc

SEQ ID NO: 541000 - DNA, 20 bp, mouse
gggtttggcggaggaaactg

SEQ ID NO: 541001 - DNA, 20 bp, mouse
gggcgaggagctcttacctg

SEQ ID NO: 541002 - DNA, 20 bp, mouse
ggacggaagtctcccagagg

SEQ ID NO: 541003 - DNA, 20 bp, mouse
gtcggacgcccgctgctcgc

SEQ ID NO: 541004 - DNA, 20 bp, mouse
gccgtgtagtctgccagagg

SEQ ID NO: 541005 - DNA, 20 bp, mouse
gaggccctcccaagcgcaaa

SEQ ID NO: 541006 - DNA, 20 bp, mouse
gagcccaggcatgaactcag

SEQ ID NO: 541007 - DNA, 20 bp, mouse
gtgcgcgttgagcaagtggt

SEQ ID NO: 541008 - DNA, 20 bp, mouse
gagcaagtggtgggatcgcg

SEQ ID NO: 541009 - DNA, 20 bp, mouse
gaaggcagctgcctactccg

SEQ ID NO: 541010 - DNA, 20 bp, mouse
gctggccctacaagagaggg

SEQ ID NO: 541011 - DNA, 20 bp, mouse
ggtgggatcgcggggctgct

SEQ ID NO: 541012 - DNA, 20 bp, mouse
gagcctggccctacaagaga

SEQ ID NO: 541013 - DNA, 20 bp, mouse
gatgaactcaggggtgcgga

SEQ ID NO: 541014 - DNA, 20 bp, mouse
gactctaggcgccgcggagt

SEQ ID NO: 541015 - DNA, 20 bp, mouse
gtccgcggcgcctagagttt

SEQ ID NO: 541016 - DNA, 20 bp, mouse
gaagtagagcacgcaagagg

SEQ ID NO: 541017 - DNA, 20 bp, mouse
gacgcaagaggcggcacgga

SEQ ID NO: 541018 - DNA, 20 bp, mouse
gggaatcgtagaccacatct

SEQ ID NO: 541019 - DNA, 20 bp, mouse
ggcaagcaggcgcacaggtg

SEQ ID NO: 541020 - DNA, 20 bp, mouse
gggcaggcaagcaggcgcac

SEQ ID NO: 541021 - DNA, 20 bp, mouse
ggccaggaaggagaagcgca

SEQ ID NO: 541022 - DNA, 20 bp, mouse
ggaccgcgcgatgcactggg

SEQ ID NO: 541023 - DNA, 20 bp, mouse
gaagccggcttcctgcaatc

SEQ ID NO: 541024 - DNA, 20 bp, mouse
gctcggcgccagaaacaatc

SEQ ID NO: 541025 - DNA, 20 bp, mouse
gtgtggaaactggttctcgg

SEQ ID NO: 541026 - DNA, 20 bp, mouse
ggtctggtccggtagagtgg

SEQ ID NO: 541027 - DNA, 20 bp, mouse
gggccgcgaggtgtctggtc

SEQ ID NO: 541028 - DNA, 20 bp, mouse
gggtgtctggtccggtagag

SEQ ID NO: 541029 - DNA, 20 bp, mouse
ggcagccgccaccactctac

SEQ ID NO: 541030 - DNA, 20 bp, mouse
gcgtgtgcggacaaaggcag

SEQ ID NO: 541031 - DNA, 20 bp, mouse
gtaccggaccagacacctcg

SEQ ID NO: 541032 - DNA, 20 bp, mouse
gaagtgacgtgtgcggacaa

SEQ ID NO: 541033 - DNA, 20 bp, mouse
gtggcggctgctgtgggcta

SEQ ID NO: 541034 - DNA, 20 bp, mouse
ggcagaggccgcgaggtgtc

SEQ ID NO: 541035 - DNA, 20 bp, mouse
gctcggggaagtgacgtgtg

SEQ ID NO: 541036 - DNA, 20 bp, mouse
ggcggcggcagagccttcgg

SEQ ID NO: 541037 - DNA, 20 bp, mouse
gctcctagcgcgagtggtgg

SEQ ID NO: 541038 - DNA, 20 bp, mouse
gcactcgcgctaggagtggg

SEQ ID NO: 541039 - DNA, 20 bp, mouse
gctagcgcgagtggtggcgg

SEQ ID NO: 541040 - DNA, 20 bp, mouse
ggtcgtcactcgggaggaag

SEQ ID NO: 541041 - DNA, 20 bp, mouse
gtcctacgcggaatccccag

SEQ ID NO: 541042 - DNA, 20 bp, mouse
gcccgctggggattccgcgt

SEQ ID NO: 541043 - DNA, 20 bp, mouse
gggccgcgtcgtcactcggg

SEQ ID NO: 541044 - DNA, 20 bp, mouse
gtagctgcggatgggcagat

SEQ ID NO: 541045 - DNA, 20 bp, mouse
gcagggcagcactcggaccg

SEQ ID NO: 541046 - DNA, 20 bp, mouse
gtcccgggaagggccttggg

SEQ ID NO: 541047 - DNA, 20 bp, mouse
gccagcacaggcccagaagt

SEQ ID NO: 541048 - DNA, 20 bp, mouse
gtcacccacggagggccagg

SEQ ID NO: 541049 - DNA, 20 bp, mouse
gcacgcccggggccgagcac

SEQ ID NO: 541050 - DNA, 20 bp, mouse
gccaggaggagcaggtctcc

SEQ ID NO: 541051 - DNA, 20 bp, mouse
ggcggaggcaccgggagcgg

SEQ ID NO: 541052 - DNA, 20 bp, mouse
gcccaggccccgcccgccca

SEQ ID NO: 541053 - DNA, 20 bp, mouse
ggcacgcagagtagcggact

SEQ ID NO: 541054 - DNA, 20 bp, mouse
ggactaggctctctcttcga

SEQ ID NO: 541055 - DNA, 20 bp, mouse
gacgcttcaggcctagcagg

SEQ ID NO: 541056 - DNA, 20 bp, mouse
gcagaaggtgggaaaagcgg

SEQ ID NO: 541057 - DNA, 20 bp, mouse
ggagcctcggcggccacaga

SEQ ID NO: 541058 - DNA, 20 bp, mouse
gcggtcccgtccttctccat

SEQ ID NO: 541059 - DNA, 20 bp, mouse
ggcggcggccgggaagtgaa

SEQ ID NO: 541060 - DNA, 20 bp, mouse
gcctcggcggccacagaagg

SEQ ID NO: 541061 - DNA, 20 bp, mouse
gggacgggaccgagcctcgg

SEQ ID NO: 541062 - DNA, 20 bp, mouse
ggaggaggacagccgggagg

SEQ ID NO: 541063 - DNA, 20 bp, mouse
gtctccatgggcagttccat

SEQ ID NO: 541064 - DNA, 20 bp, mouse
gctcgctcagtgggcaccgt

SEQ ID NO: 541065 - DNA, 20 bp, mouse
gcaggccggctatgatcccg

SEQ ID NO: 541066 - DNA, 20 bp, mouse
gaagcacttggagggctctc

SEQ ID NO: 541067 - DNA, 20 bp, mouse
gtgtaggagaagcacttgga

SEQ ID NO: 541068 - DNA, 20 bp, mouse
gcacttggagggctctcggg

SEQ ID NO: 541069 - DNA, 20 bp, mouse
gtctcctacagaagagtgtg

SEQ ID NO: 541070 - DNA, 20 bp, mouse
gcatccccacactcttctgt

SEQ ID NO: 541071 - DNA, 20 bp, mouse
gggaggtgcatgctgaagag

SEQ ID NO: 541072 - DNA, 20 bp, mouse
gcttctgtaggagaagcact

SEQ ID NO: 541073 - DNA, 20 bp, mouse
gggatgggcctgccactgag

SEQ ID NO: 541074 - DNA, 20 bp, mouse
gtgtggggatgaccgactac

SEQ ID NO: 541075 - DNA, 20 bp, mouse
ggtgttgagagccggaaggt

SEQ ID NO: 541076 - DNA, 20 bp, mouse
ggaagccgcagccctcggag

SEQ ID NO: 541077 - DNA, 20 bp, mouse
ggaacacgccacccctccga

SEQ ID NO: 541078 - DNA, 20 bp, mouse
ggagccgggaccctgacagg

SEQ ID NO: 541079 - DNA, 20 bp, mouse
gcgagcgacgaaacagcccc

SEQ ID NO: 541080 - DNA, 20 bp, mouse
ggggtcccggctccgagagg

SEQ ID NO: 541081 - DNA, 20 bp, mouse
gtgcagggcgggataccccg

SEQ ID NO: 541082 - DNA, 20 bp, mouse
gggataccccggggctacgg

SEQ ID NO: 541083 - DNA, 20 bp, mouse
gcgcgacaaggctgccccag

SEQ ID NO: 541084 - DNA, 20 bp, mouse
gcagctctcggcaaacttag

SEQ ID NO: 541085 - DNA, 20 bp, mouse
gcgcgggtcgctagaggaga

SEQ ID NO: 541086 - DNA, 20 bp, mouse
gtacgcagcccggatcagac

SEQ ID NO: 541087 - DNA, 20 bp, mouse
gcgatggtgaccgtgagtga

SEQ ID NO: 541088 - DNA, 20 bp, mouse
gttatctcccggtctgatcc

SEQ ID NO: 541089 - DNA, 20 bp, mouse
gcgggagataaaagccccga

SEQ ID NO: 541090 - DNA, 20 bp, mouse
ggcagcggcgaagcccaccc

SEQ ID NO: 541091 - DNA, 20 bp, mouse
gtggcaagaggatttagcct

SEQ ID NO: 541092 - DNA, 20 bp, mouse
gggtggccaccctcagatct

SEQ ID NO: 541093 - DNA, 20 bp, mouse
gggagacgcgggccagggaa

SEQ ID NO: 541094 - DNA, 20 bp, mouse
gctgagggtggccaccgcag

SEQ ID NO: 541095 - DNA, 20 bp, mouse
gccgctccaagttaatgccg

SEQ ID NO: 541096 - DNA, 20 bp, mouse
ggacccccacgcacatgtcg

SEQ ID NO: 541097 - DNA, 20 bp, mouse
gtccagagcggggcggtcgg

SEQ ID NO: 541098 - DNA, 20 bp, mouse
gtgcggggtggtccagagcg

SEQ ID NO: 541099 - DNA, 20 bp, mouse
gggcggtcgggggtcagaat

SEQ ID NO: 541100 - DNA, 20 bp, mouse
gcctcagtggcgcgagaccc

SEQ ID NO: 541101 - DNA, 20 bp, mouse
ggagggaaggccaggaggac

SEQ ID NO: 541102 - DNA, 20 bp, mouse
gcgtgccgcgacatgtgcgt

SEQ ID NO: 541103 - DNA, 20 bp, mouse
gtctgggtcacctggaggcc

SEQ ID NO: 541104 - DNA, 20 bp, mouse
gacccccgaccgccccgctc

SEQ ID NO: 541105 - DNA, 20 bp, mouse
gtggtccagagcggggcggt

SEQ ID NO: 541106 - DNA, 20 bp, mouse
gcatgcgcaggtacggtcca

SEQ ID NO: 541107 - DNA, 20 bp, mouse
gagcacagagaagggagttt

SEQ ID NO: 541108 - DNA, 20 bp, mouse
ggacttaccatgcgcaggta

SEQ ID NO: 541109 - DNA, 20 bp, mouse
gccattgcacacagagggtg

SEQ ID NO: 541110 - DNA, 20 bp, mouse
gacggtccatggtggccaga

SEQ ID NO: 541111 - DNA, 20 bp, mouse
gtgggggacttaccatgcgc

SEQ ID NO: 541112 - DNA, 20 bp, mouse
gccagcactgagaacggtaa

SEQ ID NO: 541113 - DNA, 20 bp, mouse
gccagacacaccgtccatgt

SEQ ID NO: 541114 - DNA, 20 bp, mouse
gctctcgcacatctcaccag

SEQ ID NO: 541115 - DNA, 20 bp, mouse
ggtctgcatacccacatgga

SEQ ID NO: 541116 - DNA, 20 bp, mouse
gtggcctcgcagcatcgcgg

SEQ ID NO: 541117 - DNA, 20 bp, mouse
ggcagctaggagcgcacgga

SEQ ID NO: 541118 - DNA, 20 bp, mouse
gaggccgcggagggtatcca

SEQ ID NO: 541119 - DNA, 20 bp, mouse
gcgctggcctcgcagcatcg

SEQ ID NO: 541120 - DNA, 20 bp, mouse
gctgcgcggcccgagcaagg

SEQ ID NO: 541121 - DNA, 20 bp, mouse
gcggctgcgcggcccgagca

SEQ ID NO: 541122 - DNA, 20 bp, mouse
gggcggcagctaggagcgca

SEQ ID NO: 541123 - DNA, 20 bp, mouse
gggcggcgcccgccttgctc

SEQ ID NO: 541124 - DNA, 20 bp, mouse
gacctcgcgacaggatgcgg

SEQ ID NO: 541125 - DNA, 20 bp, mouse
gctgtcccgtgggcccctcg

SEQ ID NO: 541126 - DNA, 20 bp, mouse
ggcctcccgtagcaagcgca

SEQ ID NO: 541127 - DNA, 20 bp, mouse
gagccaaggaccctccaaag

SEQ ID NO: 541128 - DNA, 20 bp, mouse
gagcagctgaagcagcgact

SEQ ID NO: 541129 - DNA, 20 bp, mouse
gtccctgcgcttgctacggg

SEQ ID NO: 541130 - DNA, 20 bp, mouse
gcccacctggggagcaactg

SEQ ID NO: 541131 - DNA, 20 bp, mouse
ggcggagtggagcgtaccag

SEQ ID NO: 541132 - DNA, 20 bp, mouse
gcgcttgctacgggaggccg

SEQ ID NO: 541133 - DNA, 20 bp, mouse
ggcagcgactgggctctaac

SEQ ID NO: 541134 - DNA, 20 bp, mouse
ggctgctccgagccacaagg

SEQ ID NO: 541135 - DNA, 20 bp, mouse
ggcgactgggctctaaccgg

SEQ ID NO: 541136 - DNA, 20 bp, mouse
ggtcagagctgcagcagtcg

SEQ ID NO: 541137 - DNA, 20 bp, mouse
gcacgcgcggagctggagga

SEQ ID NO: 541138 - DNA, 20 bp, mouse
gtcaccaagtcccacctcct

SEQ ID NO: 541139 - DNA, 20 bp, mouse
gggttgtaacaacagacggt

SEQ ID NO: 541140 - DNA, 20 bp, mouse
ggcgtctggctggactatgt

SEQ ID NO: 541141 - DNA, 20 bp, mouse
ggccgccgccgccaccgggt

SEQ ID NO: 541142 - DNA, 20 bp, mouse
gctgcagcagtcgcggcgaa

SEQ ID NO: 541143 - DNA, 20 bp, mouse
gagcggccgcctgacttaca

SEQ ID NO: 541144 - DNA, 20 bp, mouse
gccctgcaaagtctcggagt

SEQ ID NO: 541145 - DNA, 20 bp, mouse
gagccgcggggagcgcctag

SEQ ID NO: 541146 - DNA, 20 bp, mouse
gcactttgaaagccagctga

SEQ ID NO: 541147 - DNA, 20 bp, mouse
gaaagccagctgaaggcaag

SEQ ID NO: 541148 - DNA, 20 bp, mouse
gtcaaagtgagtgaactgtg

SEQ ID NO: 541149 - DNA, 20 bp, mouse
gctggtgtgcctgactctcc

SEQ ID NO: 541150 - DNA, 20 bp, mouse
gctcacaactccctgaagtg

SEQ ID NO: 541151 - DNA, 20 bp, mouse
gtactcaggtaaatgaatcc

SEQ ID NO: 541152 - DNA, 20 bp, mouse
gccttcagtgtctgagtgtg

SEQ ID NO: 541153 - DNA, 20 bp, mouse
gagagaaatccctcacttca

SEQ ID NO: 541154 - DNA, 20 bp, mouse
gtcgcagtctgctgctactc

SEQ ID NO: 541155 - DNA, 20 bp, mouse
gactccaggagctgaaagcc

SEQ ID NO: 541156 - DNA, 20 bp, mouse
gagcagaagagggagaacga

SEQ ID NO: 541157 - DNA, 20 bp, mouse
ggcaggaggtgtgcgaagtc

SEQ ID NO: 541158 - DNA, 20 bp, mouse
gaggtgtgcgaagtcgggtg

SEQ ID NO: 541159 - DNA, 20 bp, mouse
gcaggctccggcgcagcagg

SEQ ID NO: 541160 - DNA, 20 bp, mouse
ggaagagctccaagcagaag

SEQ ID NO: 541161 - DNA, 20 bp, mouse
gcgcgcagccgccagctcag

SEQ ID NO: 541162 - DNA, 20 bp, mouse
gagggtgtggaagctaaggg

SEQ ID NO: 541163 - DNA, 20 bp, mouse
gtcggtagcagccccgatct

SEQ ID NO: 541164 - DNA, 20 bp, mouse
gcagatgaggaggcgctcag

SEQ ID NO: 541165 - DNA, 20 bp, mouse
gtccgagcctgcctagatcg

SEQ ID NO: 541166 - DNA, 20 bp, mouse
gggccaccacgagacagaga

SEQ ID NO: 541167 - DNA, 20 bp, mouse
gcagcagcctgtggcccccg

SEQ ID NO: 541168 - DNA, 20 bp, mouse
ggagatcgccgaagacccag

SEQ ID NO: 541169 - DNA, 20 bp, mouse
gcactggggctgggcctcgg

SEQ ID NO: 541170 - DNA, 20 bp, mouse
ggctgggcctcgggggccac

SEQ ID NO: 541171 - DNA, 20 bp, mouse
gcagcagggctgacagtgcc

SEQ ID NO: 541172 - DNA, 20 bp, mouse
gtgagcctggaggcgcggct

SEQ ID NO: 541173 - DNA, 20 bp, mouse
ggaacagcaccttggcccag

SEQ ID NO: 541174 - DNA, 20 bp, mouse
ggtggtagcgcaggcgcccg

SEQ ID NO: 541175 - DNA, 20 bp, mouse
gctccatctctgtctcgtgg

SEQ ID NO: 541176 - DNA, 20 bp, mouse
ggaggtggcagcgatgtcag

SEQ ID NO: 541177 - DNA, 20 bp, mouse
ggtggcagcgatgtcagggg

SEQ ID NO: 541178 - DNA, 20 bp, mouse
gggccagccgcggcaatctg

SEQ ID NO: 541179 - DNA, 20 bp, mouse
gtggtgttggcgagaaggag

SEQ ID NO: 541180 - DNA, 20 bp, mouse
gtccccaccgagggaaaccg

SEQ ID NO: 541181 - DNA, 20 bp, mouse
gcggcagccagagccaggtc

SEQ ID NO: 541182 - DNA, 20 bp, mouse
ggccgccgctagtgccccag

SEQ ID NO: 541183 - DNA, 20 bp, mouse
ggcgatgtcaggggaggcgg

SEQ ID NO: 541184 - DNA, 20 bp, mouse
ggcagcgatgtcaggggagg

SEQ ID NO: 541185 - DNA, 20 bp, mouse
gagggcaggtcccggcacag

SEQ ID NO: 541186 - DNA, 20 bp, mouse
gccgcgaggtggagtgggtc

SEQ ID NO: 541187 - DNA, 20 bp, mouse
ggcagccgaggacaccgcaa

SEQ ID NO: 541188 - DNA, 20 bp, mouse
gcgtctccaggaactcgtag

SEQ ID NO: 541189 - DNA, 20 bp, mouse
ggctgtgacctctgagcccg

SEQ ID NO: 541190 - DNA, 20 bp, mouse
gggggaccgcgaggtggagt

SEQ ID NO: 541191 - DNA, 20 bp, mouse
gagtaaggccaccgactcca

SEQ ID NO: 541192 - DNA, 20 bp, mouse
ggctgggcaagggcacctac

SEQ ID NO: 541193 - DNA, 20 bp, mouse
gtttctagcgtgctcgggtg

SEQ ID NO: 541194 - DNA, 20 bp, mouse
ggaagaagcaggcggtgaag

SEQ ID NO: 541195 - DNA, 20 bp, mouse
gggccaccgactccatggtg

SEQ ID NO: 541196 - DNA, 20 bp, mouse
gggcagtggcgcaggtgaga

SEQ ID NO: 541197 - DNA, 20 bp, mouse
ggtcgcagctggctcggcag

SEQ ID NO: 541198 - DNA, 20 bp, mouse
gggcgcaggtgagacggctg

SEQ ID NO: 541199 - DNA, 20 bp, mouse
gaggaggcgaggacaagtgt

SEQ ID NO: 541200 - DNA, 20 bp, mouse
gcggcaggtcgcagctggct

SEQ ID NO: 541201 - DNA, 20 bp, mouse
gtgactgccggggctgacag

SEQ ID NO: 541202 - DNA, 20 bp, mouse
ggagtgcccggatgcggcaa

SEQ ID NO: 541203 - DNA, 20 bp, mouse
gggcgatctgaagcatcgaa

SEQ ID NO: 541204 - DNA, 20 bp, mouse
gcgcgttccgctgtcagccc

SEQ ID NO: 541205 - DNA, 20 bp, mouse
gtggggccaaggggcttgaa

SEQ ID NO: 541206 - DNA, 20 bp, mouse
gagcgcagcccgggcaagag

SEQ ID NO: 541207 - DNA, 20 bp, mouse
ggagctatcgcaggacgtgt

SEQ ID NO: 541208 - DNA, 20 bp, mouse
gtcctgcgatagctcaccgt

SEQ ID NO: 541209 - DNA, 20 bp, mouse
gaagagcggcagcatggagg

SEQ ID NO: 541210 - DNA, 20 bp, mouse
ggcgctcgccggaacctcag

SEQ ID NO: 541211 - DNA, 20 bp, mouse
gccagggatgccccaaccag

SEQ ID NO: 541212 - DNA, 20 bp, mouse
ggcagcctgcgggaagacga

SEQ ID NO: 541213 - DNA, 20 bp, mouse
ggtagacagggaaccgaagg

SEQ ID NO: 541214 - DNA, 20 bp, mouse
gccgggcaagagcggcagca

SEQ ID NO: 541215 - DNA, 20 bp, mouse
gcagagtggttcggtcccag

SEQ ID NO: 541216 - DNA, 20 bp, mouse
ggaccgacctgcacgctcac

SEQ ID NO: 541217 - DNA, 20 bp, mouse
ggcaactagtagcggaatgg

SEQ ID NO: 541218 - DNA, 20 bp, mouse
gaaagcaactagtagcggaa

SEQ ID NO: 541219 - DNA, 20 bp, mouse
gcgcgaaaagcaactagtag

SEQ ID NO: 541220 - DNA, 20 bp, mouse
gtgccggtgagcgtgcaggt

SEQ ID NO: 541221 - DNA, 20 bp, mouse
gctgctgccggtgagcgtgc

SEQ ID NO: 541222 - DNA, 20 bp, mouse
gaggctgcgaaagtttggag

SEQ ID NO: 541223 - DNA, 20 bp, mouse
ggcaggtcggtcaaacgcga

SEQ ID NO: 541224 - DNA, 20 bp, mouse
ggggcccccaattctcggaa

SEQ ID NO: 541225 - DNA, 20 bp, mouse
gtgaggctgagacaggtctg

SEQ ID NO: 541226 - DNA, 20 bp, mouse
ggccgcgcgccatggggacc

SEQ ID NO: 541227 - DNA, 20 bp, mouse
ggcaagagccgcgcgccatg

SEQ ID NO: 541228 - DNA, 20 bp, mouse
gtagcgggtttgctacaagg

SEQ ID NO: 541229 - DNA, 20 bp, mouse
gagtggccgcgccaccaccc

SEQ ID NO: 541230 - DNA, 20 bp, mouse
ggctcttgctcgggccggga

SEQ ID NO: 541231 - DNA, 20 bp, mouse
gtggcgcgcggctcttgctc

SEQ ID NO: 541232 - DNA, 20 bp, mouse
ggccaggtccccatggcgcg

SEQ ID NO: 541233 - DNA, 20 bp, mouse
gacgccaagtgcttccatcc

SEQ ID NO: 541234 - DNA, 20 bp, mouse
gtgtcccgagtatggatgtg

SEQ ID NO: 541235 - DNA, 20 bp, mouse
gccaaagctcggcacccccg

SEQ ID NO: 541236 - DNA, 20 bp, mouse
gtctctgcgggtggaaaagt

SEQ ID NO: 541237 - DNA, 20 bp, mouse
gtcagcactggagaggtgag

SEQ ID NO: 541238 - DNA, 20 bp, mouse
gtaaaaaacgccctcagcac

SEQ ID NO: 541239 - DNA, 20 bp, mouse
gcagaagccgtgggcaagag

SEQ ID NO: 541240 - DNA, 20 bp, mouse
gactcagggagccggaatga

SEQ ID NO: 541241 - DNA, 20 bp, mouse
gcggattgcgctccaggaaa

SEQ ID NO: 541242 - DNA, 20 bp, mouse
gctccagcccctcttgccca

SEQ ID NO: 541243 - DNA, 20 bp, mouse
gaggggggttcagaagccgt

SEQ ID NO: 541244 - DNA, 20 bp, mouse
ggagccggaatgagggtctg

SEQ ID NO: 541245 - DNA, 20 bp, mouse
gaaggccagcaacctccgcc

SEQ ID NO: 541246 - DNA, 20 bp, mouse
ggctcgcggcgggcatcagt

SEQ ID NO: 541247 - DNA, 20 bp, mouse
gagagcaaggcggagggccg

SEQ ID NO: 541248 - DNA, 20 bp, mouse
gtggatcagagcaaggcgga

SEQ ID NO: 541249 - DNA, 20 bp, mouse
gtagcacgagcaggcagagt

SEQ ID NO: 541250 - DNA, 20 bp, mouse
gtctgtagctagaagagtgg

SEQ ID NO: 541251 - DNA, 20 bp, mouse
ggcatcagccgggaatcgat

SEQ ID NO: 541252 - DNA, 20 bp, mouse
gagactggggcggggtacgt

SEQ ID NO: 541253 - DNA, 20 bp, mouse
gggtccagagacctcaccag

SEQ ID NO: 541254 - DNA, 20 bp, mouse
gaaactggtgtgctcgcggc

SEQ ID NO: 541255 - DNA, 20 bp, mouse
ggcgggcacgcattaggctg

SEQ ID NO: 541256 - DNA, 20 bp, mouse
gctggcttctcaagagtcgg

SEQ ID NO: 541257 - DNA, 20 bp, mouse
gggggggctcgtcagatcca

SEQ ID NO: 541258 - DNA, 20 bp, mouse
ggactccgcactgacctgac

SEQ ID NO: 541259 - DNA, 20 bp, mouse
gtcgaggcgcgaccaagtcg

SEQ ID NO: 541260 - DNA, 20 bp, mouse
gtgaagagacgggggagcgg

SEQ ID NO: 541261 - DNA, 20 bp, mouse
gatccattttgaagagacgg

SEQ ID NO: 541262 - DNA, 20 bp, mouse
gctcccccgtctcttcaaaa

SEQ ID NO: 541263 - DNA, 20 bp, mouse
gggtcctcggctcctcgact

SEQ ID NO: 541264 - DNA, 20 bp, mouse
gaggctccaacagggcccag

SEQ ID NO: 541265 - DNA, 20 bp, mouse
gggtgagtggcgaaggacct

SEQ ID NO: 541266 - DNA, 20 bp, mouse
gacggttcgcgcgggcccaa

SEQ ID NO: 541267 - DNA, 20 bp, mouse
ggctgcggaaggctagcgag

SEQ ID NO: 541268 - DNA, 20 bp, mouse
ggcgatgcccgcgctcccca

SEQ ID NO: 541269 - DNA, 20 bp, mouse
gaacgcgagtgcggagctcg

SEQ ID NO: 541270 - DNA, 20 bp, mouse
ggggcgcagcacgatgggag

SEQ ID NO: 541271 - DNA, 20 bp, mouse
gaggaggaggagcgcttcga

SEQ ID NO: 541272 - DNA, 20 bp, mouse
ggctcggggcgcagcacgat

SEQ ID NO: 541273 - DNA, 20 bp, mouse
gcgcgaaccgtggggagcgc

SEQ ID NO: 541274 - DNA, 20 bp, mouse
ggctagcgaggggagccgtt

SEQ ID NO: 541275 - DNA, 20 bp, mouse
gccatggcgcagcagcacga

SEQ ID NO: 541276 - DNA, 20 bp, mouse
gcgcttcactcctggaactg

SEQ ID NO: 541277 - DNA, 20 bp, mouse
gtaaggcgcggaaggaaagg

SEQ ID NO: 541278 - DNA, 20 bp, mouse
gttgatgcaggtgggatcgg

SEQ ID NO: 541279 - DNA, 20 bp, mouse
ggcaggagccagagatgtat

SEQ ID NO: 541280 - DNA, 20 bp, mouse
gtggcgccgcagagtcgtct

SEQ ID NO: 541281 - DNA, 20 bp, mouse
ggaaggaaccgggtgcgaga

SEQ ID NO: 541282 - DNA, 20 bp, mouse
gtggaactgaggctgggaaa

SEQ ID NO: 541283 - DNA, 20 bp, mouse
gcaagctccagctggtagca

SEQ ID NO: 541284 - DNA, 20 bp, mouse
gcgaagcggggatccagcag

SEQ ID NO: 541285 - DNA, 20 bp, mouse
gccgcagagtcgtctgggat

SEQ ID NO: 541286 - DNA, 20 bp, mouse
gctccgggagagcactacac

SEQ ID NO: 541287 - DNA, 20 bp, mouse
ggcccagagcctagtcccgc

SEQ ID NO: 541288 - DNA, 20 bp, mouse
gcgggagagcactacaccgg

SEQ ID NO: 541289 - DNA, 20 bp, mouse
gccgctgcgctcctcaaacg

SEQ ID NO: 541290 - DNA, 20 bp, mouse
gccacgcaggcacacggctc

SEQ ID NO: 541291 - DNA, 20 bp, mouse
gcattctgaagacgccacgc

SEQ ID NO: 541292 - DNA, 20 bp, mouse
gaggatctcgcggccaccca

SEQ ID NO: 541293 - DNA, 20 bp, mouse
ggcactacaccggcgggact

SEQ ID NO: 541294 - DNA, 20 bp, mouse
gggtggccgcgagatcctca

SEQ ID NO: 541295 - DNA, 20 bp, mouse
gagtgaccccaaggcgccga

SEQ ID NO: 541296 - DNA, 20 bp, mouse
gcgagggacgcgaacacagt

SEQ ID NO: 541297 - DNA, 20 bp, mouse
gtcagcagccccgggctcca

SEQ ID NO: 541298 - DNA, 20 bp, mouse
gtgctgcaggatgcccaaca

SEQ ID NO: 541299 - DNA, 20 bp, mouse
gccatggctctgctgcccga

SEQ ID NO: 541300 - DNA, 20 bp, mouse
gagtgggcaccgcctcacac

SEQ ID NO: 541301 - DNA, 20 bp, mouse
gccaatcagccggtgtgagg

SEQ ID NO: 541302 - DNA, 20 bp, mouse
gtgaagggtgggctacggag

SEQ ID NO: 541303 - DNA, 20 bp, mouse
gtttatgaccaggccctgtt

SEQ ID NO: 541304 - DNA, 20 bp, mouse
gtggccaatcagccggtgtg

SEQ ID NO: 541305 - DNA, 20 bp, mouse
gccggaagtggccaatcagc

SEQ ID NO: 541306 - DNA, 20 bp, mouse
gtcccgggcgaatgagatct

SEQ ID NO: 541307 - DNA, 20 bp, mouse
gtggggcgcgaaggtatgga

SEQ ID NO: 541308 - DNA, 20 bp, mouse
gtggctggggcgcgaaggta

SEQ ID NO: 541309 - DNA, 20 bp, mouse
gcgaaggtatggatggtccc

SEQ ID NO: 541310 - DNA, 20 bp, mouse
gcctgaggtcgggaagacca

SEQ ID NO: 541311 - DNA, 20 bp, mouse
gccccagccaaagtttcccg

SEQ ID NO: 541312 - DNA, 20 bp, mouse
gagggaaactacagagagta

SEQ ID NO: 541313 - DNA, 20 bp, mouse
gagcctcgcgttggaagcga

SEQ ID NO: 541314 - DNA, 20 bp, mouse
gaactttggctggggcgcga

SEQ ID NO: 541315 - DNA, 20 bp, mouse
gactgggcaggcctgaggtc

SEQ ID NO: 541316 - DNA, 20 bp, mouse
gccgcgcagccgaggagcaa

SEQ ID NO: 541317 - DNA, 20 bp, mouse
gctgcaagcgacctcagagg

SEQ ID NO: 541318 - DNA, 20 bp, mouse
ggcagggagagggcccggcg

SEQ ID NO: 541319 - DNA, 20 bp, mouse
gcgagccagcggagacgagg

SEQ ID NO: 541320 - DNA, 20 bp, mouse
gtgccgagccagcggagacg

SEQ ID NO: 541321 - DNA, 20 bp, mouse
ggcagccgaggagcaaaggc

SEQ ID NO: 541322 - DNA, 20 bp, mouse
ggcaaaggctggcagggaga

SEQ ID NO: 541323 - DNA, 20 bp, mouse
gcgcggacctacgaccccga

SEQ ID NO: 541324 - DNA, 20 bp, mouse
gcagctgcaagcgacctcag

SEQ ID NO: 541325 - DNA, 20 bp, mouse
gcgaggagcaaaggctggca

SEQ ID NO: 541326 - DNA, 20 bp, mouse
gaccgagctgctggaggatt

SEQ ID NO: 541327 - DNA, 20 bp, mouse
ggggaagactcggtcagcat

SEQ ID NO: 541328 - DNA, 20 bp, mouse
gctggaggattgggaagact

SEQ ID NO: 541329 - DNA, 20 bp, mouse
gagactcggtcagcatcggc

SEQ ID NO: 541330 - DNA, 20 bp, mouse
gccgcgcagccgaggagcaa

SEQ ID NO: 541331 - DNA, 20 bp, mouse
ggcagccgaggagcaaaggc

SEQ ID NO: 541332 - DNA, 20 bp, mouse
gctgcaagcgacctcagagg

SEQ ID NO: 541333 - DNA, 20 bp, mouse
ggcaaaggctggcagggaga

SEQ ID NO: 541334 - DNA, 20 bp, mouse
gcgaggagcaaaggctggca

SEQ ID NO: 541335 - DNA, 20 bp, mouse
ggcagggagagggcccggcg

SEQ ID NO: 541336 - DNA, 20 bp, mouse
gattgcgacggaagactcct

SEQ ID NO: 541337 - DNA, 20 bp, mouse
gaaagaaaccaggattgcga

SEQ ID NO: 541338 - DNA, 20 bp, mouse
gcctctgccggaagtccgga

SEQ ID NO: 541339 - DNA, 20 bp, mouse
gactagcgctactaacccaa

SEQ ID NO: 541340 - DNA, 20 bp, mouse
ggaaggctgactccaacgcc

SEQ ID NO: 541341 - DNA, 20 bp, mouse
gctaacccaagggattatga

SEQ ID NO: 541342 - DNA, 20 bp, mouse
gtggccctctgccggaagtc

SEQ ID NO: 541343 - DNA, 20 bp, mouse
gctgacaactaagtttgccg

SEQ ID NO: 541344 - DNA, 20 bp, mouse
gctcccataaaggtatgcga

SEQ ID NO: 541345 - DNA, 20 bp, mouse
ggagtcttccgtcgcaatcc

SEQ ID NO: 541346 - DNA, 20 bp, mouse
gccaggggcgtgcagaccat

SEQ ID NO: 541347 - DNA, 20 bp, mouse
gtctcgaaaagagtgagtac

SEQ ID NO: 541348 - DNA, 20 bp, mouse
ggcaaagcgtcaatcccact

SEQ ID NO: 541349 - DNA, 20 bp, mouse
gtttagaggtactcaatgtt

SEQ ID NO: 541350 - DNA, 20 bp, mouse
ggaccgtgaagtctgcaaca

SEQ ID NO: 541351 - DNA, 20 bp, mouse
ggtgcaactaggatgtagta

SEQ ID NO: 541352 - DNA, 20 bp, mouse
gaagattcaggaggaaccca

SEQ ID NO: 541353 - DNA, 20 bp, mouse
gcggtttctcgagatttgaa

SEQ ID NO: 541354 - DNA, 20 bp, mouse
gtcctagttgcacttagaac

SEQ ID NO: 541355 - DNA, 20 bp, mouse
gtgttgggtacaaaaacgtc

SEQ ID NO: 541356 - DNA, 20 bp, mouse
gccgtcgatgcgctccatgg

SEQ ID NO: 541357 - DNA, 20 bp, mouse
gcgcagagcagattcttccg

SEQ ID NO: 541358 - DNA, 20 bp, mouse
gaccccgtcgatgcgctcca

SEQ ID NO: 541359 - DNA, 20 bp, mouse
ggtagggcgaatgggcacag

SEQ ID NO: 541360 - DNA, 20 bp, mouse
ggcccgccggcttcgatccg

SEQ ID NO: 541361 - DNA, 20 bp, mouse
gggccgcaggtagggcgaat

SEQ ID NO: 541362 - DNA, 20 bp, mouse
ggcggagtcgtgagctcggg

SEQ ID NO: 541363 - DNA, 20 bp, mouse
gggcgcgtctacgcacttct

SEQ ID NO: 541364 - DNA, 20 bp, mouse
gaatctgctctgcgccacca

SEQ ID NO: 541365 - DNA, 20 bp, mouse
gttccgcggatcgaagccgg

SEQ ID NO: 541366 - DNA, 20 bp, mouse
gagaggccttcagatcttac

SEQ ID NO: 541367 - DNA, 20 bp, mouse
gtgcttggctttaacctggt

SEQ ID NO: 541368 - DNA, 20 bp, mouse
gcctggtgggcaaactagtc

SEQ ID NO: 541369 - DNA, 20 bp, mouse
ggatctgaaggcctctgagc

SEQ ID NO: 541370 - DNA, 20 bp, mouse
ggctctccagtaagatctga

SEQ ID NO: 541371 - DNA, 20 bp, mouse
gaactgaaggtctctggctg

SEQ ID NO: 541372 - DNA, 20 bp, mouse
gccttctgcagtgtactgaa

SEQ ID NO: 541373 - DNA, 20 bp, mouse
ggcattgcttggctttaacc

SEQ ID NO: 541374 - DNA, 20 bp, mouse
gagccagttggccacccata

SEQ ID NO: 541375 - DNA, 20 bp, mouse
gaggttagtctacaaagata

SEQ ID NO: 541376 - DNA, 20 bp, mouse
gggaagtgcgagcctcgaga

SEQ ID NO: 541377 - DNA, 20 bp, mouse
ggtgcgagcctcgagatgga

SEQ ID NO: 541378 - DNA, 20 bp, mouse
gcagtccggcccgagcgcca

SEQ ID NO: 541379 - DNA, 20 bp, mouse
gccgatgcccctccatctcg

SEQ ID NO: 541380 - DNA, 20 bp, mouse
gaaagcgcatctgcatctgg

SEQ ID NO: 541381 - DNA, 20 bp, mouse
gatggaggggcatcggaaag

SEQ ID NO: 541382 - DNA, 20 bp, mouse
gcacttccgggttcttgcag

SEQ ID NO: 541383 - DNA, 20 bp, mouse
ggggctcgcgagccctgggg

SEQ ID NO: 541384 - DNA, 20 bp, mouse
gggccgcgatgtgtgagctg

SEQ ID NO: 541385 - DNA, 20 bp, mouse
ggtagtcagagcgttcaacg

SEQ ID NO: 541386 - DNA, 20 bp, mouse
gttcagctccggaaccgtcg

SEQ ID NO: 541387 - DNA, 20 bp, mouse
ggagctgaaacagatcagtc

SEQ ID NO: 541388 - DNA, 20 bp, mouse
gatcaagatgtcgaccacga

SEQ ID NO: 541389 - DNA, 20 bp, mouse
gctgaaacagatcagtcggg

SEQ ID NO: 541390 - DNA, 20 bp, mouse
ggggtcgcgcatgctcgttt

SEQ ID NO: 541391 - DNA, 20 bp, mouse
ggctatacgccgccaacccc

SEQ ID NO: 541392 - DNA, 20 bp, mouse
gtcaggacgtggggtccact

SEQ ID NO: 541393 - DNA, 20 bp, mouse
ggggcaagcagggcggatac

SEQ ID NO: 541394 - DNA, 20 bp, mouse
gacaggcttgggacgcccag

SEQ ID NO: 541395 - DNA, 20 bp, mouse
gacggtgtggaccctcagtc

SEQ ID NO: 541396 - DNA, 20 bp, mouse
gaggcgcaacagcaaccgtg

SEQ ID NO: 541397 - DNA, 20 bp, mouse
gggtgaccagagctgcgcga

SEQ ID NO: 541398 - DNA, 20 bp, mouse
ggaaccagcagggaacgtga

SEQ ID NO: 541399 - DNA, 20 bp, mouse
gtgactccaggcgcccggcg

SEQ ID NO: 541400 - DNA, 20 bp, mouse
gtgtgaagctcactgactcc

SEQ ID NO: 541401 - DNA, 20 bp, mouse
gctgcgcgatggctgccgca

SEQ ID NO: 541402 - DNA, 20 bp, mouse
gagcggtggccagagctgcg

SEQ ID NO: 541403 - DNA, 20 bp, mouse
gacaggccagctcccaccgt

SEQ ID NO: 541404 - DNA, 20 bp, mouse
ggaggcttccaatccaggtt

SEQ ID NO: 541405 - DNA, 20 bp, mouse
gctggtccagagccgcaaaa

SEQ ID NO: 541406 - DNA, 20 bp, mouse
gggacctgccagacccccgg

SEQ ID NO: 541407 - DNA, 20 bp, mouse
gccgggacctgccagacccc

SEQ ID NO: 541408 - DNA, 20 bp, mouse
ggtcttggccctcaagtcag

SEQ ID NO: 541409 - DNA, 20 bp, mouse
gcccaccgcagctcaggtcc

SEQ ID NO: 541410 - DNA, 20 bp, mouse
gccagacccccggaggcaag

SEQ ID NO: 541411 - DNA, 20 bp, mouse
gtcccggcttgccacctccc

SEQ ID NO: 541412 - DNA, 20 bp, mouse
gggccatcaagtctccgggg

SEQ ID NO: 541413 - DNA, 20 bp, mouse
gcccggccgcttgcctccgg

SEQ ID NO: 541414 - DNA, 20 bp, mouse
gcgtggccatcaagtctccg

SEQ ID NO: 541415 - DNA, 20 bp, mouse
ggcagccgcacgggaaacag

SEQ ID NO: 541416 - DNA, 20 bp, mouse
gaagtggccgggtcgtagag

SEQ ID NO: 541417 - DNA, 20 bp, mouse
ggacccggccacttcctaag

SEQ ID NO: 541418 - DNA, 20 bp, mouse
gcaggccctcaacatttata

SEQ ID NO: 541419 - DNA, 20 bp, mouse
gtggacaccactctacgacc

SEQ ID NO: 541420 - DNA, 20 bp, mouse
gcgtccttcagatccccctt

SEQ ID NO: 541421 - DNA, 20 bp, mouse
gtcagatcccccttaggaag

SEQ ID NO: 541422 - DNA, 20 bp, mouse
gaagccggccgggctcgagt

SEQ ID NO: 541423 - DNA, 20 bp, mouse
gatcccccttaggaagtggc

SEQ ID NO: 541424 - DNA, 20 bp, mouse
ggccgacagctcacccgact

SEQ ID NO: 541425 - DNA, 20 bp, mouse
gcagcctgctgccaacatca

SEQ ID NO: 541426 - DNA, 20 bp, mouse
gtgggtcggaagaatcccag

SEQ ID NO: 541427 - DNA, 20 bp, mouse
ggcactcacccgtagcccag

SEQ ID NO: 541428 - DNA, 20 bp, mouse
ggctacgggtgagtgctgtg

SEQ ID NO: 541429 - DNA, 20 bp, mouse
ggcctcctgcctctgggcta

SEQ ID NO: 541430 - DNA, 20 bp, mouse
gcccgtagcccagaggcagg

SEQ ID NO: 541431 - DNA, 20 bp, mouse
ggcaggaggcggtcctcgaa

SEQ ID NO: 541432 - DNA, 20 bp, mouse
ggtccccgcagcaacaggtc

SEQ ID NO: 541433 - DNA, 20 bp, mouse
gtcacccgtagcccagaggc

SEQ ID NO: 541434 - DNA, 20 bp, mouse
gggttcagtggtgagggcgt

SEQ ID NO: 541435 - DNA, 20 bp, mouse
gctgtgcaccagagaggact

SEQ ID NO: 541436 - DNA, 20 bp, mouse
gctcgactgttaatggcggg

SEQ ID NO: 541437 - DNA, 20 bp, mouse
gcagtcgagagcaagaggcg

SEQ ID NO: 541438 - DNA, 20 bp, mouse
gagaggcgcggaacacacgc

SEQ ID NO: 541439 - DNA, 20 bp, mouse
ggctctcgactgttaatggc

SEQ ID NO: 541440 - DNA, 20 bp, mouse
gtaggaaaactgccaagtcg

SEQ ID NO: 541441 - DNA, 20 bp, mouse
ggaaagcgcgcatcccggaa

SEQ ID NO: 541442 - DNA, 20 bp, mouse
gtgagggaggagcgcgcact

SEQ ID NO: 541443 - DNA, 20 bp, mouse
gcgccgcacttacagattaa

SEQ ID NO: 541444 - DNA, 20 bp, mouse
gcaacccgcatccggcgtga

SEQ ID NO: 541445 - DNA, 20 bp, mouse
gggggtcgagaaacaggtct

SEQ ID NO: 541446 - DNA, 20 bp, mouse
gagatcaagcgtgtccaggt

SEQ ID NO: 541447 - DNA, 20 bp, mouse
ggatcaagcttccagatcct

SEQ ID NO: 541448 - DNA, 20 bp, mouse
gaggagtcctacctccaacc

SEQ ID NO: 541449 - DNA, 20 bp, mouse
gacacgcttgatctactccc

SEQ ID NO: 541450 - DNA, 20 bp, mouse
gtcaagcgtgtccaggttgg

SEQ ID NO: 541451 - DNA, 20 bp, mouse
ggagtagatcaagcgtgtcc

SEQ ID NO: 541452 - DNA, 20 bp, mouse
gcggggtccatagtctgaca

SEQ ID NO: 541453 - DNA, 20 bp, mouse
gggagcactcaggagttctg

SEQ ID NO: 541454 - DNA, 20 bp, mouse
gttgggacagcaggattcca

SEQ ID NO: 541455 - DNA, 20 bp, mouse
gtgctcgcaataagtagtca

SEQ ID NO: 541456 - DNA, 20 bp, mouse
ggcggcgcggtcgtcgtcgg

SEQ ID NO: 541457 - DNA, 20 bp, mouse
gtgacgcagcgcgtccaaaa

SEQ ID NO: 541458 - DNA, 20 bp, mouse
ggcgcggtcgtcgtcggggg

SEQ ID NO: 541459 - DNA, 20 bp, mouse
ggccccaggctcgatcgaga

SEQ ID NO: 541460 - DNA, 20 bp, mouse
gaggccctgcgccgccgtca

SEQ ID NO: 541461 - DNA, 20 bp, mouse
gtgcggggcctcggagtcca

SEQ ID NO: 541462 - DNA, 20 bp, mouse
gatggcggcgcggtcgtcgt

SEQ ID NO: 541463 - DNA, 20 bp, mouse
gccgccgcggagccgtgtag

SEQ ID NO: 541464 - DNA, 20 bp, mouse
gttccgcagcgagagcgagg

SEQ ID NO: 541465 - DNA, 20 bp, mouse
gtcatcctccgggcccgggt

SEQ ID NO: 541466 - DNA, 20 bp, mouse
gcgtgccacgcggagacagt

SEQ ID NO: 541467 - DNA, 20 bp, mouse
gggaagcgacggtgcagacc

SEQ ID NO: 541468 - DNA, 20 bp, mouse
ggcggcggcacggacacgga

SEQ ID NO: 541469 - DNA, 20 bp, mouse
gagccgcgctcttcccccgg

SEQ ID NO: 541470 - DNA, 20 bp, mouse
ggcttccaactgtctccgcg

SEQ ID NO: 541471 - DNA, 20 bp, mouse
gagaccgggcagagacgccg

SEQ ID NO: 541472 - DNA, 20 bp, mouse
gacgagccgcgctcttcccc

SEQ ID NO: 541473 - DNA, 20 bp, mouse
gtaaatgcgggcgaaggggg

SEQ ID NO: 541474 - DNA, 20 bp, mouse
gcgggcgccggtgggacggg

SEQ ID NO: 541475 - DNA, 20 bp, mouse
gcatcctcggcgtctctgcc

SEQ ID NO: 541476 - DNA, 20 bp, mouse
ggcggtggcgcctgattcta

SEQ ID NO: 541477 - DNA, 20 bp, mouse
ggcgccaccgctagagacac

SEQ ID NO: 541478 - DNA, 20 bp, mouse
ggaggcgccggtgtctctag

SEQ ID NO: 541479 - DNA, 20 bp, mouse
ggaggaaaggaaaaaggatc

SEQ ID NO: 541480 - DNA, 20 bp, mouse
ggcgccggtgtctctagcgg

SEQ ID NO: 541481 - DNA, 20 bp, mouse
gagggcgcgagcacaaccga

SEQ ID NO: 541482 - DNA, 20 bp, mouse
gatcctccttgcaccacgag

SEQ ID NO: 541483 - DNA, 20 bp, mouse
ggagcgcgagacgagaaccc

SEQ ID NO: 541484 - DNA, 20 bp, mouse
gagcttctacgggtgcctgg

SEQ ID NO: 541485 - DNA, 20 bp, mouse
gcttgcaccacgagaggcgc

SEQ ID NO: 541486 - DNA, 20 bp, mouse
ggctaggtgcagccatgtgg

SEQ ID NO: 541487 - DNA, 20 bp, mouse
gccgcccgcgtaaagcaatg

SEQ ID NO: 541488 - DNA, 20 bp, mouse
gggtgaggaggacccgctac

SEQ ID NO: 541489 - DNA, 20 bp, mouse
gccctgcaagagcctccgga

SEQ ID NO: 541490 - DNA, 20 bp, mouse
gaaggctaggtgcagccatg

SEQ ID NO: 541491 - DNA, 20 bp, mouse
gaatgtggagaaccagtagc

SEQ ID NO: 541492 - DNA, 20 bp, mouse
gtctcgggccccggaaacca

SEQ ID NO: 541493 - DNA, 20 bp, mouse
gcgcgggcggagccaggctc

SEQ ID NO: 541494 - DNA, 20 bp, mouse
gtgcaagagcctccggaagg

SEQ ID NO: 541495 - DNA, 20 bp, mouse
gaggggagaacggaaaggct

SEQ ID NO: 541496 - DNA, 20 bp, mouse
ggtctcctgctgctagtaag

SEQ ID NO: 541497 - DNA, 20 bp, mouse
gactagcagcaggagacttc

SEQ ID NO: 541498 - DNA, 20 bp, mouse
gccggagagctttacctgac

SEQ ID NO: 541499 - DNA, 20 bp, mouse
gcggctggaggggagccctg

SEQ ID NO: 541500 - DNA, 20 bp, mouse
gtcgcgaccttgtggactcc

SEQ ID NO: 541501 - DNA, 20 bp, mouse
gggctgatgtcgcgaccttg

SEQ ID NO: 541502 - DNA, 20 bp, mouse
gtcttcaggaacccccacag

SEQ ID NO: 541503 - DNA, 20 bp, mouse
gactgcagggtggatagata

SEQ ID NO: 541504 - DNA, 20 bp, mouse
gggcgtgtcctcatctccca

SEQ ID NO: 541505 - DNA, 20 bp, mouse
gcgcgtgtgtgaatcttgtt

SEQ ID NO: 541506 - DNA, 20 bp, mouse
ggacgtccgggacacagtgg

SEQ ID NO: 541507 - DNA, 20 bp, mouse
gccagacgtccgggacacag

SEQ ID NO: 541508 - DNA, 20 bp, mouse
gcagcgctgctcgtcctccg

SEQ ID NO: 541509 - DNA, 20 bp, mouse
gcctccgcggacaggccatc

SEQ ID NO: 541510 - DNA, 20 bp, mouse
gctgcctgatggcctgtccg

SEQ ID NO: 541511 - DNA, 20 bp, mouse
ggggatcagcccgctaggga

SEQ ID NO: 541512 - DNA, 20 bp, mouse
ggcagcatgtcccagacgtc

SEQ ID NO: 541513 - DNA, 20 bp, mouse
gtctgggacatgctgcctga

SEQ ID NO: 541514 - DNA, 20 bp, mouse
ggcctggttgggagacacaa

SEQ ID NO: 541515 - DNA, 20 bp, mouse
gtgcaccactgggacaccat

SEQ ID NO: 541516 - DNA, 20 bp, mouse
ggcccgcgagggttcggagg

SEQ ID NO: 541517 - DNA, 20 bp, mouse
gcctggcgcgcggcccgcga

SEQ ID NO: 541518 - DNA, 20 bp, mouse
gaggttcggggctcaaggcg

SEQ ID NO: 541519 - DNA, 20 bp, mouse
gagggccaccgagagcgaca

SEQ ID NO: 541520 - DNA, 20 bp, mouse
gggtaccccgattctaggac

SEQ ID NO: 541521 - DNA, 20 bp, mouse
ggatggccggccgctccctg

SEQ ID NO: 541522 - DNA, 20 bp, mouse
gcgcgcggcccgcgagggtt

SEQ ID NO: 541523 - DNA, 20 bp, mouse
ggccaccgagagcgacacgg

SEQ ID NO: 541524 - DNA, 20 bp, mouse
ggcagcccgtcctagaatcg

SEQ ID NO: 541525 - DNA, 20 bp, mouse
gcccgctggctgcaggttcg

SEQ ID NO: 541526 - DNA, 20 bp, mouse
gctggaggcctagcagctca

SEQ ID NO: 541527 - DNA, 20 bp, mouse
gacggtcagcggctttcggt

SEQ ID NO: 541528 - DNA, 20 bp, mouse
ggggccggcctcacaaaaaa

SEQ ID NO: 541529 - DNA, 20 bp, mouse
gcccgctcaaactcacctgg

SEQ ID NO: 541530 - DNA, 20 bp, mouse
ggctagtctcaggaatatag

SEQ ID NO: 541531 - DNA, 20 bp, mouse
ggaaaaatgacaacggtcag

SEQ ID NO: 541532 - DNA, 20 bp, mouse
gccggtttgaaaaatgacaa

SEQ ID NO: 541533 - DNA, 20 bp, mouse
gggtgcaaggccaaggatcg

SEQ ID NO: 541534 - DNA, 20 bp, mouse
gaggggttcgagaccaacct

SEQ ID NO: 541535 - DNA, 20 bp, mouse
gggaagcgcgctgtgcggaa

SEQ ID NO: 541536 - DNA, 20 bp, mouse
gggggccgaaggccacacgg

SEQ ID NO: 541537 - DNA, 20 bp, mouse
gtccggggccgaaggccaca

SEQ ID NO: 541538 - DNA, 20 bp, mouse
gggcgcgggagtcagatccg

SEQ ID NO: 541539 - DNA, 20 bp, mouse
ggggctcgctgcttgctagg

SEQ ID NO: 541540 - DNA, 20 bp, mouse
gcgctgcttgctaggtggca

SEQ ID NO: 541541 - DNA, 20 bp, mouse
gacggtggaagcgctccgga

SEQ ID NO: 541542 - DNA, 20 bp, mouse
ggaagaatctgagcatcgaa

SEQ ID NO: 541543 - DNA, 20 bp, mouse
gccgccactggggacgacag

SEQ ID NO: 541544 - DNA, 20 bp, mouse
gcgagcccaaagtgcaactg

SEQ ID NO: 541545 - DNA, 20 bp, mouse
ggctcggagcagagccggaa

SEQ ID NO: 541546 - DNA, 20 bp, mouse
ggaaagcggctgggactccc

SEQ ID NO: 541547 - DNA, 20 bp, mouse
ggagtcccagccgctttcaa

SEQ ID NO: 541548 - DNA, 20 bp, mouse
gacctgcagcatggagccga

SEQ ID NO: 541549 - DNA, 20 bp, mouse
gtcccagccgctttcaatgg

SEQ ID NO: 541550 - DNA, 20 bp, mouse
gggctccatgctgcaggtat

SEQ ID NO: 541551 - DNA, 20 bp, mouse
gtcctccattgaaagcggct

SEQ ID NO: 541552 - DNA, 20 bp, mouse
gtgcgggctgctgcaccgtc

SEQ ID NO: 541553 - DNA, 20 bp, mouse
ggcgggacgcacacccggac

SEQ ID NO: 541554 - DNA, 20 bp, mouse
gggcccgcgcccgggaagaa

SEQ ID NO: 541555 - DNA, 20 bp, mouse
gggagccgagggcagcccca

SEQ ID NO: 541556 - DNA, 20 bp, mouse
gcaccagcggtgtgtagatg

SEQ ID NO: 541557 - DNA, 20 bp, mouse
gagccaggaagaacctatag

SEQ ID NO: 541558 - DNA, 20 bp, mouse
gaccactccagtataaccaa

SEQ ID NO: 541559 - DNA, 20 bp, mouse
gagctggatagggcccttag

SEQ ID NO: 541560 - DNA, 20 bp, mouse
gagccacatctacacaccgc

SEQ ID NO: 541561 - DNA, 20 bp, mouse
gatgtggctctgctcacttc

SEQ ID NO: 541562 - DNA, 20 bp, mouse
gagggtcccggatctactat

SEQ ID NO: 541563 - DNA, 20 bp, mouse
gatcaaagactagctggata

SEQ ID NO: 541564 - DNA, 20 bp, mouse
gtagcaccgatgcagtcata

SEQ ID NO: 541565 - DNA, 20 bp, mouse
gaggatcctatagtagatcc

SEQ ID NO: 541566 - DNA, 20 bp, mouse
ggctggctagagccctcaac

SEQ ID NO: 541567 - DNA, 20 bp, mouse
gcaggcagggcgctctgagg

SEQ ID NO: 541568 - DNA, 20 bp, mouse
gctagggtggccaagtccta

SEQ ID NO: 541569 - DNA, 20 bp, mouse
gtagagccctcaacaggcac

SEQ ID NO: 541570 - DNA, 20 bp, mouse
gccctgcggagaacaggcta

SEQ ID NO: 541571 - DNA, 20 bp, mouse
gcggcgcaggccttgtacag

SEQ ID NO: 541572 - DNA, 20 bp, mouse
ggctctgggcctgcccgata

SEQ ID NO: 541573 - DNA, 20 bp, mouse
gcttgctacgcagaaggtag

SEQ ID NO: 541574 - DNA, 20 bp, mouse
ggggcaggcagggcgctctg

SEQ ID NO: 541575 - DNA, 20 bp, mouse
gccgcggctagaaactgcct

SEQ ID NO: 541576 - DNA, 20 bp, mouse
gggccagccgtccacatcag

SEQ ID NO: 541577 - DNA, 20 bp, mouse
gagttaacatgaacaaacta

SEQ ID NO: 541578 - DNA, 20 bp, mouse
gatgaagaaggagtccgcac

SEQ ID NO: 541579 - DNA, 20 bp, mouse
ggaagctacactttccagtg

SEQ ID NO: 541580 - DNA, 20 bp, mouse
gcaaactacggcaaagcttc

SEQ ID NO: 541581 - DNA, 20 bp, mouse
ggatgtggacggctggcctc

SEQ ID NO: 541582 - DNA, 20 bp, mouse
gaagtgtagcttcccagtta

SEQ ID NO: 541583 - DNA, 20 bp, mouse
ggccaaataatccagtagca

SEQ ID NO: 541584 - DNA, 20 bp, mouse
gtgccgctttgctgttctga

SEQ ID NO: 541585 - DNA, 20 bp, mouse
gatctttgtggttctctgtg

SEQ ID NO: 541586 - DNA, 20 bp, mouse
gcccggaacggaatcctccc

SEQ ID NO: 541587 - DNA, 20 bp, mouse
gtgctgatgtggcgaagggt

SEQ ID NO: 541588 - DNA, 20 bp, mouse
ggggaagccgggcccaaccg

SEQ ID NO: 541589 - DNA, 20 bp, mouse
gccgcgctgcgggacatcca

SEQ ID NO: 541590 - DNA, 20 bp, mouse
ggcggcggctcggtctgacg

SEQ ID NO: 541591 - DNA, 20 bp, mouse
ggcggcggccagcgtgagaa

SEQ ID NO: 541592 - DNA, 20 bp, mouse
gagccagctcggctcccggg

SEQ ID NO: 541593 - DNA, 20 bp, mouse
gatcctcccgggagccgagc

SEQ ID NO: 541594 - DNA, 20 bp, mouse
gtgatgtggcgaagggtggg

SEQ ID NO: 541595 - DNA, 20 bp, mouse
gtgcatcccgcaccagccgc

SEQ ID NO: 541596 - DNA, 20 bp, mouse
gagagttgcaaggttctagg

SEQ ID NO: 541597 - DNA, 20 bp, mouse
ggagcgggaaggctgaaacg

SEQ ID NO: 541598 - DNA, 20 bp, mouse
ggcgagcgccgagaagaccc

SEQ ID NO: 541599 - DNA, 20 bp, mouse
ggtgcttccggagagcggga

SEQ ID NO: 541600 - DNA, 20 bp, mouse
ggacctgtccatggcttcag

SEQ ID NO: 541601 - DNA, 20 bp, mouse
ggaccgctgaagccatggac

SEQ ID NO: 541602 - DNA, 20 bp, mouse
gagcgccgagaagacccggg

SEQ ID NO: 541603 - DNA, 20 bp, mouse
gcaaagagttgcaaggttct

SEQ ID NO: 541604 - DNA, 20 bp, mouse
gcgggaaggctgaaacgcgg

SEQ ID NO: 541605 - DNA, 20 bp, mouse
ggccatggacaggtcagtcc

SEQ ID NO: 541606 - DNA, 20 bp, mouse
gcggagcttgaacacctgag

SEQ ID NO: 541607 - DNA, 20 bp, mouse
ggtgagctcacggtaagtgg

SEQ ID NO: 541608 - DNA, 20 bp, mouse
ggtggaggaagcggcactcg

SEQ ID NO: 541609 - DNA, 20 bp, mouse
gcctgcgggcgagaacagca

SEQ ID NO: 541610 - DNA, 20 bp, mouse
gttcgcggagaggagacgct

SEQ ID NO: 541611 - DNA, 20 bp, mouse
gagcttgaacacctgagggg

SEQ ID NO: 541612 - DNA, 20 bp, mouse
gggccctggggttcgcggag

SEQ ID NO: 541613 - DNA, 20 bp, mouse
ggcccccttacgtcatctct

SEQ ID NO: 541614 - DNA, 20 bp, mouse
gcagggccggggacccgacg

SEQ ID NO: 541615 - DNA, 20 bp, mouse
gaggctccacctccccgctg

SEQ ID NO: 541616 - DNA, 20 bp, mouse
gcggtcgagctaggcctcag

SEQ ID NO: 541617 - DNA, 20 bp, mouse
ggtaataggcgcaagagcgg

SEQ ID NO: 541618 - DNA, 20 bp, mouse
gacgactgcagggacgacga

SEQ ID NO: 541619 - DNA, 20 bp, mouse
gataggcgcaagagcggcgg

SEQ ID NO: 541620 - DNA, 20 bp, mouse
gaggagcctctagcagcggg

SEQ ID NO: 541621 - DNA, 20 bp, mouse
gactgcagggacgacgacgg

SEQ ID NO: 541622 - DNA, 20 bp, mouse
gtcccgggcgggagaggcag

SEQ ID NO: 541623 - DNA, 20 bp, mouse
gacggccagggcgactgaag

SEQ ID NO: 541624 - DNA, 20 bp, mouse
gactgcggcagcgacggcca

SEQ ID NO: 541625 - DNA, 20 bp, mouse
gggggcggccgcctcaacag

SEQ ID NO: 541626 - DNA, 20 bp, mouse
gccgcgcgcgttccgaggag

SEQ ID NO: 541627 - DNA, 20 bp, mouse
gtagaaacactccaaacccg

SEQ ID NO: 541628 - DNA, 20 bp, mouse
gcgtacagagaagaagacag

SEQ ID NO: 541629 - DNA, 20 bp, mouse
gggtttggagtgtttctata

SEQ ID NO: 541630 - DNA, 20 bp, mouse
gtttttctcacggttctcca

SEQ ID NO: 541631 - DNA, 20 bp, mouse
gcccagcaccgatggcatgt

SEQ ID NO: 541632 - DNA, 20 bp, mouse
gtcacggttctccacgggtt

SEQ ID NO: 541633 - DNA, 20 bp, mouse
ggcgcggaaaacgaataact

SEQ ID NO: 541634 - DNA, 20 bp, mouse
gtcggtgctgggctctatga

SEQ ID NO: 541635 - DNA, 20 bp, mouse
gccggaagtgcgtcatgacc

SEQ ID NO: 541636 - DNA, 20 bp, mouse
gggcggcgggatccctggaa

SEQ ID NO: 541637 - DNA, 20 bp, mouse
gggagcttcgtggaactgag

SEQ ID NO: 541638 - DNA, 20 bp, mouse
gcacggcgacggcgggaaga

SEQ ID NO: 541639 - DNA, 20 bp, mouse
gtccctggaacggagcttcg

SEQ ID NO: 541640 - DNA, 20 bp, mouse
gccgtcaggcctcacggcga

SEQ ID NO: 541641 - DNA, 20 bp, mouse
ggtgaggcctgacgggacaa

SEQ ID NO: 541642 - DNA, 20 bp, mouse
gtccacgaagctccgttcca

SEQ ID NO: 541643 - DNA, 20 bp, mouse
gggacaagggcgggtcacgt

SEQ ID NO: 541644 - DNA, 20 bp, mouse
gaggcctgacgggacaaggg

SEQ ID NO: 541645 - DNA, 20 bp, mouse
gcaggcctcacggcgacggc

SEQ ID NO: 541646 - DNA, 20 bp, mouse
gctcacacacggcccaccag

SEQ ID NO: 541647 - DNA, 20 bp, mouse
ggccgcgcgcgcgaagatgg

SEQ ID NO: 541648 - DNA, 20 bp, mouse
gcgtgtgtgaggtgcggagt

SEQ ID NO: 541649 - DNA, 20 bp, mouse
gtgggccgcgcgcgcgaaga

SEQ ID NO: 541650 - DNA, 20 bp, mouse
gacgtgggtacggcgcatgg

SEQ ID NO: 541651 - DNA, 20 bp, mouse
gcagggaccacggagagaga

SEQ ID NO: 541652 - DNA, 20 bp, mouse
ggcgcagggacagcaaggaa

SEQ ID NO: 541653 - DNA, 20 bp, mouse
ggtgcctacaggcaacgtgg

SEQ ID NO: 541654 - DNA, 20 bp, mouse
gtggaggatcccagtcacgt

SEQ ID NO: 541655 - DNA, 20 bp, mouse
gtgcccgcgggaagaaatcg

SEQ ID NO: 541656 - DNA, 20 bp, mouse
ggacccgcggggacccacgg

SEQ ID NO: 541657 - DNA, 20 bp, mouse
gtctcagtcctcctccaaga

SEQ ID NO: 541658 - DNA, 20 bp, mouse
ggagcgcggcgggcccgcga

SEQ ID NO: 541659 - DNA, 20 bp, mouse
gcgctgttggcggtaaattc

SEQ ID NO: 541660 - DNA, 20 bp, mouse
ggtccccgcgggtccctcgc

SEQ ID NO: 541661 - DNA, 20 bp, mouse
ggccatctaccgccgaggta

SEQ ID NO: 541662 - DNA, 20 bp, mouse
gcgtcgacgcctgaacacaa

SEQ ID NO: 541663 - DNA, 20 bp, mouse
gcgccccccgtgggtccccg

SEQ ID NO: 541664 - DNA, 20 bp, mouse
gacacctgaaggatattggg

SEQ ID NO: 541665 - DNA, 20 bp, mouse
gtccaagatggcggcgctgt

SEQ ID NO: 541666 - DNA, 20 bp, mouse
ggctagcgaggccgggagga

SEQ ID NO: 541667 - DNA, 20 bp, mouse
gagcgccggctgcactagtg

SEQ ID NO: 541668 - DNA, 20 bp, mouse
gggcccgcgcgcctcaccag

SEQ ID NO: 541669 - DNA, 20 bp, mouse
ggaggcccgcgccatcctcc

SEQ ID NO: 541670 - DNA, 20 bp, mouse
gcccgggcgctagcgaggcc

SEQ ID NO: 541671 - DNA, 20 bp, mouse
gctagtgcagccggcgctct

SEQ ID NO: 541672 - DNA, 20 bp, mouse
gcgaggccgggaggatggcg

SEQ ID NO: 541673 - DNA, 20 bp, mouse
gcccagcgcgcgccggtgga

SEQ ID NO: 541674 - DNA, 20 bp, mouse
gtgtgatcgcgggccatgga

SEQ ID NO: 541675 - DNA, 20 bp, mouse
gctgctgttgctgcaggtag

SEQ ID NO: 541676 - DNA, 20 bp, mouse
gtgagtgggaagctgagacc

SEQ ID NO: 541677 - DNA, 20 bp, mouse
gcggcgtcgcggagccccaa

SEQ ID NO: 541678 - DNA, 20 bp, mouse
gtggccacctgtagttgagt

SEQ ID NO: 541679 - DNA, 20 bp, mouse
ggctgcgcctctagcaagaa

SEQ ID NO: 541680 - DNA, 20 bp, mouse
gaagaagaggtgtggagcca

SEQ ID NO: 541681 - DNA, 20 bp, mouse
ggaaaaggagcccgaagctt

SEQ ID NO: 541682 - DNA, 20 bp, mouse
gtccgcgacgccgaagcttc

SEQ ID NO: 541683 - DNA, 20 bp, mouse
ggcccgaagcttcggcgtcg

SEQ ID NO: 541684 - DNA, 20 bp, mouse
gtacatctggtgagcgaacc

SEQ ID NO: 541685 - DNA, 20 bp, mouse
gcagcttcccactcaactac

SEQ ID NO: 541686 - DNA, 20 bp, mouse
ggcgctgccgctgccacccg

SEQ ID NO: 541687 - DNA, 20 bp, mouse
ggtgtttgaaaggccgcggg

SEQ ID NO: 541688 - DNA, 20 bp, mouse
ggagctgcggacgctctgtg

SEQ ID NO: 541689 - DNA, 20 bp, mouse
gcggcagaggcgaggctcca

SEQ ID NO: 541690 - DNA, 20 bp, mouse
gaacacagctcaggccgctc

SEQ ID NO: 541691 - DNA, 20 bp, mouse
gctgcaggagcagccggcag

SEQ ID NO: 541692 - DNA, 20 bp, mouse
gcgccgcgggcgctgaggga

SEQ ID NO: 541693 - DNA, 20 bp, mouse
gcccgcgacacgcagagctg

SEQ ID NO: 541694 - DNA, 20 bp, mouse
gagctacttgaacaccctga

SEQ ID NO: 541695 - DNA, 20 bp, mouse
gtacttgaacaccctgaagg

SEQ ID NO: 541696 - DNA, 20 bp, mouse
gaggggccagctccagtaag

SEQ ID NO: 541697 - DNA, 20 bp, mouse
gggtgaggttgtcactgcag

SEQ ID NO: 541698 - DNA, 20 bp, mouse
gcctgggctgtgctcttctc

SEQ ID NO: 541699 - DNA, 20 bp, mouse
ggctgtgctcttctctggaa

SEQ ID NO: 541700 - DNA, 20 bp, mouse
ggtctccacaacatgaactg

SEQ ID NO: 541701 - DNA, 20 bp, mouse
gcccagcctaggactccaca

SEQ ID NO: 541702 - DNA, 20 bp, mouse
gtggcaaaggaacccagcct

SEQ ID NO: 541703 - DNA, 20 bp, mouse
gtggagacagagcccagcgg

SEQ ID NO: 541704 - DNA, 20 bp, mouse
gagacagagcccagcggtgg

SEQ ID NO: 541705 - DNA, 20 bp, mouse
gatcagctctcaccttacaa

SEQ ID NO: 541706 - DNA, 20 bp, mouse
gcgcaacccataaggctgag

SEQ ID NO: 541707 - DNA, 20 bp, mouse
ggctgtggccggtgacatct

SEQ ID NO: 541708 - DNA, 20 bp, mouse
gcggtccactcacccaacgt

SEQ ID NO: 541709 - DNA, 20 bp, mouse
gtcacacgccacggagggag

SEQ ID NO: 541710 - DNA, 20 bp, mouse
gggaagttgcgcaacccata

SEQ ID NO: 541711 - DNA, 20 bp, mouse
ggcggtggtacccgggaacc

SEQ ID NO: 541712 - DNA, 20 bp, mouse
gaagcatgcacgaggatggg

SEQ ID NO: 541713 - DNA, 20 bp, mouse
ggaggtgtcacacgccacgg

SEQ ID NO: 541714 - DNA, 20 bp, mouse
gcggttactacagcgaccag

SEQ ID NO: 541715 - DNA, 20 bp, mouse
gcatctgggcggtggtaccc

SEQ ID NO: 541716 - DNA, 20 bp, mouse
gcgatacgcacctaaagcag

SEQ ID NO: 541717 - DNA, 20 bp, mouse
gaaagcaggggaggcgacct

SEQ ID NO: 541718 - DNA, 20 bp, mouse
ggccctggccacctatggtc

SEQ ID NO: 541719 - DNA, 20 bp, mouse
gtacgcacctaaagcagggg

SEQ ID NO: 541720 - DNA, 20 bp, mouse
gcgcacgccctggccaccta

SEQ ID NO: 541721 - DNA, 20 bp, mouse
gaggctctcccgaccatagg

SEQ ID NO: 541722 - DNA, 20 bp, mouse
gaggggaggcgacctgggca

SEQ ID NO: 541723 - DNA, 20 bp, mouse
gagcacaagctggcgatccc

SEQ ID NO: 541724 - DNA, 20 bp, mouse
ggcaaggctctcccgaccat

SEQ ID NO: 541725 - DNA, 20 bp, mouse
ggcttgtgctgcttccccag

SEQ ID NO: 541726 - DNA, 20 bp, mouse
gtggtctgcaggctcccgga

SEQ ID NO: 541727 - DNA, 20 bp, mouse
gaccagggctctcaagtagc

SEQ ID NO: 541728 - DNA, 20 bp, mouse
gggaaggcactggccgccag

SEQ ID NO: 541729 - DNA, 20 bp, mouse
ggcaggctcccggaaggcac

SEQ ID NO: 541730 - DNA, 20 bp, mouse
gcccgtggcaaaggtctctg

SEQ ID NO: 541731 - DNA, 20 bp, mouse
ggacggtatgactacagact

SEQ ID NO: 541732 - DNA, 20 bp, mouse
ggccggggcccgcccaaacc

SEQ ID NO: 541733 - DNA, 20 bp, mouse
gatcagaactgcgcaggaag

SEQ ID NO: 541734 - DNA, 20 bp, mouse
gacgggctcttgggacaatg

SEQ ID NO: 541735 - DNA, 20 bp, mouse
ggcatctcagacaaacgata

SEQ ID NO: 541736 - DNA, 20 bp, mouse
gcggcggcggcagtcaaggt

SEQ ID NO: 541737 - DNA, 20 bp, mouse
gacggtgaagagagcgcccg

SEQ ID NO: 541738 - DNA, 20 bp, mouse
ggtagcagcttcgggctgag

SEQ ID NO: 541739 - DNA, 20 bp, mouse
gacgcaccggaatctcccag

SEQ ID NO: 541740 - DNA, 20 bp, mouse
ggtccattcgagttacaaga

SEQ ID NO: 541741 - DNA, 20 bp, mouse
gcggcagtcaaggtaggtga

SEQ ID NO: 541742 - DNA, 20 bp, mouse
gcggcaggcccggcccggtc

SEQ ID NO: 541743 - DNA, 20 bp, mouse
gacgcctccgaaccaatcgg

SEQ ID NO: 541744 - DNA, 20 bp, mouse
gttccctccgattggttcgg

SEQ ID NO: 541745 - DNA, 20 bp, mouse
ggcctcggccctgctcgccg

SEQ ID NO: 541746 - DNA, 20 bp, mouse
gaggtgcccgaagtgcccga

SEQ ID NO: 541747 - DNA, 20 bp, mouse
gggcacctctacagccaccg

SEQ ID NO: 541748 - DNA, 20 bp, mouse
gaagtgctgctcccgcgaca

SEQ ID NO: 541749 - DNA, 20 bp, mouse
gtcccagccggacagaagag

SEQ ID NO: 541750 - DNA, 20 bp, mouse
gcgcgggagcagcacttaga

SEQ ID NO: 541751 - DNA, 20 bp, mouse
ggggctccttcgggcacttc

SEQ ID NO: 541752 - DNA, 20 bp, mouse
gttccttggaggaagaaggt

SEQ ID NO: 541753 - DNA, 20 bp, mouse
ggggtcccgggaaatgagag

SEQ ID NO: 541754 - DNA, 20 bp, mouse
gagccggacagaagagcgga

SEQ ID NO: 541755 - DNA, 20 bp, mouse
gacagccaccgcggcaccgg

SEQ ID NO: 541756 - DNA, 20 bp, mouse
gcgaaaaggcgaggaggcaa

SEQ ID NO: 541757 - DNA, 20 bp, mouse
gtggcggcgaaaaggcgagg

SEQ ID NO: 541758 - DNA, 20 bp, mouse
gaaggcagttggcgagggag

SEQ ID NO: 541759 - DNA, 20 bp, mouse
ggcggttactcactccatgg

SEQ ID NO: 541760 - DNA, 20 bp, mouse
gccatggcggcgaaaaggcg

SEQ ID NO: 541761 - DNA, 20 bp, mouse
gtcactccatggcggcgaaa

SEQ ID NO: 541762 - DNA, 20 bp, mouse
ggcggtgagcgcggagacgg

SEQ ID NO: 541763 - DNA, 20 bp, mouse
gagccccgcgagctctgaaa

SEQ ID NO: 541764 - DNA, 20 bp, mouse
gccctcgcgcggccccgacg

SEQ ID NO: 541765 - DNA, 20 bp, mouse
gtgagcggagagtgaaggcg

SEQ ID NO: 541766 - DNA, 20 bp, mouse
gcagcgagcgagttcagcca

SEQ ID NO: 541767 - DNA, 20 bp, mouse
gcgagcgagttcagccacgg

SEQ ID NO: 541768 - DNA, 20 bp, mouse
ggctcgccgcgaaaagcctg

SEQ ID NO: 541769 - DNA, 20 bp, mouse
ggcggaagggtaggactcac

SEQ ID NO: 541770 - DNA, 20 bp, mouse
gggaattggcgacctggtaa

SEQ ID NO: 541771 - DNA, 20 bp, mouse
ggcagtggacgcggaagggt

SEQ ID NO: 541772 - DNA, 20 bp, mouse
ggaagggtaggactcacggg

SEQ ID NO: 541773 - DNA, 20 bp, mouse
gttgtcccgcaggcttttcg

SEQ ID NO: 541774 - DNA, 20 bp, mouse
gaccttcagcgggtccggag

SEQ ID NO: 541775 - DNA, 20 bp, mouse
gcggagcagtggacgcggaa

SEQ ID NO: 541776 - DNA, 20 bp, mouse
ggcagggtcccagccgcggg

SEQ ID NO: 541777 - DNA, 20 bp, mouse
gaggcctgagcgcagagaag

SEQ ID NO: 541778 - DNA, 20 bp, mouse
gcatagcgccgtgccccccg

SEQ ID NO: 541779 - DNA, 20 bp, mouse
ggagaagcggccgcgcggca

SEQ ID NO: 541780 - DNA, 20 bp, mouse
gccctggagggggtcctctt

SEQ ID NO: 541781 - DNA, 20 bp, mouse
ggagcccgcagtaactgtaa

SEQ ID NO: 541782 - DNA, 20 bp, mouse
gcgcggcagggtcccagccg

SEQ ID NO: 541783 - DNA, 20 bp, mouse
ggtgcgtcccgcatgtaggg

SEQ ID NO: 541784 - DNA, 20 bp, mouse
ggcagctgtctgtgagcggg

SEQ ID NO: 541785 - DNA, 20 bp, mouse
gatggtggcaactgtgtcca

SEQ ID NO: 541786 - DNA, 20 bp, mouse
gtacctgtcagatacgagtg

SEQ ID NO: 541787 - DNA, 20 bp, mouse
gtcagatacgagtgtggcaa

SEQ ID NO: 541788 - DNA, 20 bp, mouse
gctgttcgtaataaccgctt

SEQ ID NO: 541789 - DNA, 20 bp, mouse
gcgtatctgacaggtaggtg

SEQ ID NO: 541790 - DNA, 20 bp, mouse
gtctttggcacggatgctcc

SEQ ID NO: 541791 - DNA, 20 bp, mouse
ggtggcaaaggcagcatctt

SEQ ID NO: 541792 - DNA, 20 bp, mouse
gagtcgatcactgagcatca

SEQ ID NO: 541793 - DNA, 20 bp, mouse
gtctctcacagtaatcccgg

SEQ ID NO: 541794 - DNA, 20 bp, mouse
gtgtaagatcttggccatga

SEQ ID NO: 541795 - DNA, 20 bp, mouse
gctagcctgggcagccagag

SEQ ID NO: 541796 - DNA, 20 bp, mouse
gccatcgcccaagggcccca

SEQ ID NO: 541797 - DNA, 20 bp, mouse
ggagccgcaagaacacgacg

SEQ ID NO: 541798 - DNA, 20 bp, mouse
gagctgttagttcaagatgg

SEQ ID NO: 541799 - DNA, 20 bp, mouse
gcggctgccgtggggccctt

SEQ ID NO: 541800 - DNA, 20 bp, mouse
gacagctccccatcgcccaa

SEQ ID NO: 541801 - DNA, 20 bp, mouse
gctaacagctcaggattgag

SEQ ID NO: 541802 - DNA, 20 bp, mouse
gctggtcttcggcctcggag

SEQ ID NO: 541803 - DNA, 20 bp, mouse
ggcggcagagacgggcacga

SEQ ID NO: 541804 - DNA, 20 bp, mouse
gcaaatgcggcggcagagac

SEQ ID NO: 541805 - DNA, 20 bp, mouse
gtgttcttgcggctccgcga

SEQ ID NO: 541806 - DNA, 20 bp, mouse
gggcggcgtagtgaagaagc

SEQ ID NO: 541807 - DNA, 20 bp, mouse
gcgagcggcgcgagaagcgg

SEQ ID NO: 541808 - DNA, 20 bp, mouse
ggtagtgaagaagccggcag

SEQ ID NO: 541809 - DNA, 20 bp, mouse
gccgaactcgggcccagggt

SEQ ID NO: 541810 - DNA, 20 bp, mouse
gctcgccgagtgctgtgact

SEQ ID NO: 541811 - DNA, 20 bp, mouse
gacgcctggcagccgtgggt

SEQ ID NO: 541812 - DNA, 20 bp, mouse
gcgagcgtggtcctccccac

SEQ ID NO: 541813 - DNA, 20 bp, mouse
gcgacagagcaccagtgggg

SEQ ID NO: 541814 - DNA, 20 bp, mouse
gactgcctcagccaatcagg

SEQ ID NO: 541815 - DNA, 20 bp, mouse
gaaggccaggccccgaactc

SEQ ID NO: 541816 - DNA, 20 bp, mouse
ggaggtgagcagcccgcggt

SEQ ID NO: 541817 - DNA, 20 bp, mouse
gaagcggcggtcggtggcag

SEQ ID NO: 541818 - DNA, 20 bp, mouse
gctgcgcgctgcgcccgaag

SEQ ID NO: 541819 - DNA, 20 bp, mouse
gcgcccggcacgagactcgg

SEQ ID NO: 541820 - DNA, 20 bp, mouse
gcgcgctgcgcccgaagcgg

SEQ ID NO: 541821 - DNA, 20 bp, mouse
ggcgcgcccggcacgagact

SEQ ID NO: 541822 - DNA, 20 bp, mouse
gcgcagatgccggtacagag

SEQ ID NO: 541823 - DNA, 20 bp, mouse
gccttcgggcctgcgtgagg

SEQ ID NO: 541824 - DNA, 20 bp, mouse
gagcgaggttcactcaatgt

SEQ ID NO: 541825 - DNA, 20 bp, mouse
gacagttggatcccctccca

SEQ ID NO: 541826 - DNA, 20 bp, mouse
gtgcccagcgggtaccgggt

SEQ ID NO: 541827 - DNA, 20 bp, mouse
gccgctgggcaccagctatg

SEQ ID NO: 541828 - DNA, 20 bp, mouse
gggcaaggcgagggcggagt

SEQ ID NO: 541829 - DNA, 20 bp, mouse
gtatgtggcacgtccctctt

SEQ ID NO: 541830 - DNA, 20 bp, mouse
gacaaccccaagcggcggtg

SEQ ID NO: 541831 - DNA, 20 bp, mouse
ggggaaacaaccccaagcgg

SEQ ID NO: 541832 - DNA, 20 bp, mouse
gttcccacccggtacccgct

SEQ ID NO: 541833 - DNA, 20 bp, mouse
ggagggacgtgccacatagc

SEQ ID NO: 541834 - DNA, 20 bp, mouse
gcccaagcggcggtgcggca

SEQ ID NO: 541835 - DNA, 20 bp, mouse
ggaccgtcgcgtctaggtaa

SEQ ID NO: 541836 - DNA, 20 bp, mouse
gccagcagcggtctccgaag

SEQ ID NO: 541837 - DNA, 20 bp, mouse
gccgcgagcagggtcgagct

SEQ ID NO: 541838 - DNA, 20 bp, mouse
gtcgccggcgaccgcgagca

SEQ ID NO: 541839 - DNA, 20 bp, mouse
gctggagcctgggccctcgc

SEQ ID NO: 541840 - DNA, 20 bp, mouse
gcggtcgccggcgagggccc

SEQ ID NO: 541841 - DNA, 20 bp, mouse
gaaaaactggcatatggtca

SEQ ID NO: 541842 - DNA, 20 bp, mouse
ggcccaggctccagcaaccg

SEQ ID NO: 541843 - DNA, 20 bp, mouse
gcgcagcagcagccaccctc

SEQ ID NO: 541844 - DNA, 20 bp, mouse
gggtgagacgtcgcatgcca

SEQ ID NO: 541845 - DNA, 20 bp, mouse
gctcccagaccgtcacctga

SEQ ID NO: 541846 - DNA, 20 bp, mouse
ggagagcagactaggcataa

SEQ ID NO: 541847 - DNA, 20 bp, mouse
gataagtagggtgagaaact

SEQ ID NO: 541848 - DNA, 20 bp, mouse
gaggtgtgtgaggttaggac

SEQ ID NO: 541849 - DNA, 20 bp, mouse
gagctaggaaaggtaaaccg

SEQ ID NO: 541850 - DNA, 20 bp, mouse
gctcctgctccaccagtcgg

SEQ ID NO: 541851 - DNA, 20 bp, mouse
ggcctggcccatccctgtgt

SEQ ID NO: 541852 - DNA, 20 bp, mouse
gcagtcgggggaggtcggaa

SEQ ID NO: 541853 - DNA, 20 bp, mouse
gcagcaacctctaaacctag

SEQ ID NO: 541854 - DNA, 20 bp, mouse
ggaagcagatgggctgacca

SEQ ID NO: 541855 - DNA, 20 bp, mouse
gtgcttctcactgggtaccc

SEQ ID NO: 541856 - DNA, 20 bp, mouse
gcggagacagaaggacgagt

SEQ ID NO: 541857 - DNA, 20 bp, mouse
gtccttgggccggagacaga

SEQ ID NO: 541858 - DNA, 20 bp, mouse
ggacagaaggacgagttgga

SEQ ID NO: 541859 - DNA, 20 bp, mouse
gccggcggagtgaccagcgg

SEQ ID NO: 541860 - DNA, 20 bp, mouse
gcgggctcgagtccttgggc

SEQ ID NO: 541861 - DNA, 20 bp, mouse
ggcggagtgaccagcggcgg

SEQ ID NO: 541862 - DNA, 20 bp, mouse
ggggcggagcgcatcggcga

SEQ ID NO: 541863 - DNA, 20 bp, mouse
gcctcttcgaagccgacggt

SEQ ID NO: 541864 - DNA, 20 bp, mouse
gacgcagcaagggccggacg

SEQ ID NO: 541865 - DNA, 20 bp, mouse
gggcggcgggcggagcgcat

SEQ ID NO: 541866 - DNA, 20 bp, mouse
gcgggggctaggtgaggtgt

SEQ ID NO: 541867 - DNA, 20 bp, mouse
gtggcggcgggggctaggtg

SEQ ID NO: 541868 - DNA, 20 bp, mouse
ggcgccacaggagtatgacg

SEQ ID NO: 541869 - DNA, 20 bp, mouse
gaggtgttggcagtggcgag

SEQ ID NO: 541870 - DNA, 20 bp, mouse
gaagcgaacgcggagccagg

SEQ ID NO: 541871 - DNA, 20 bp, mouse
gactctccatgtactaacgg

SEQ ID NO: 541872 - DNA, 20 bp, mouse
gcgccagcgcagccgaggat

SEQ ID NO: 541873 - DNA, 20 bp, mouse
ggagccaggaggtgagcgtg

SEQ ID NO: 541874 - DNA, 20 bp, mouse
gcacctggaactggatctgg

SEQ ID NO: 541875 - DNA, 20 bp, mouse
gcaggaaccggcgtcatcac

SEQ ID NO: 541876 - DNA, 20 bp, mouse
gggcttgtcaacgtcttggg

SEQ ID NO: 541877 - DNA, 20 bp, mouse
gactgagaggaaacccccga

SEQ ID NO: 541878 - DNA, 20 bp, mouse
gggcggggtagaagagacca

SEQ ID NO: 541879 - DNA, 20 bp, mouse
gaaacagagcggctcaaaac

SEQ ID NO: 541880 - DNA, 20 bp, mouse
ggtcggcttgtcaacgtctt

SEQ ID NO: 541881 - DNA, 20 bp, mouse
gcgctctgttttgagttgtg

SEQ ID NO: 541882 - DNA, 20 bp, mouse
gtgcaggtcgctgtacttaa

SEQ ID NO: 541883 - DNA, 20 bp, mouse
gggcctccgggctaacatga

SEQ ID NO: 541884 - DNA, 20 bp, mouse
gtcatcgcgttctgcaatct

SEQ ID NO: 541885 - DNA, 20 bp, mouse
gccaaaataacgtccctcgg

SEQ ID NO: 541886 - DNA, 20 bp, mouse
gcagcgggacgggcgaggga

SEQ ID NO: 541887 - DNA, 20 bp, mouse
gtccctgagtgcagcgggac

SEQ ID NO: 541888 - DNA, 20 bp, mouse
gcccccacggcggcccgaag

SEQ ID NO: 541889 - DNA, 20 bp, mouse
gcgcggccgcagacaatccg

SEQ ID NO: 541890 - DNA, 20 bp, mouse
gggacgggcgagggaaggca

SEQ ID NO: 541891 - DNA, 20 bp, mouse
ggctcgcagcgcgggaggag

SEQ ID NO: 541892 - DNA, 20 bp, mouse
ggccccaacactcacccgtg

SEQ ID NO: 541893 - DNA, 20 bp, mouse
gggcgtataaggagcatact

SEQ ID NO: 541894 - DNA, 20 bp, mouse
ggcccgtcccgctgcactca

SEQ ID NO: 541895 - DNA, 20 bp, mouse
gatgctgagagcctgatgga

SEQ ID NO: 541896 - DNA, 20 bp, mouse
ggaagaaggaagagggcgct

SEQ ID NO: 541897 - DNA, 20 bp, mouse
gggcttgtctcccatcctgg

SEQ ID NO: 541898 - DNA, 20 bp, mouse
gctgctgtccttcccatgta

SEQ ID NO: 541899 - DNA, 20 bp, mouse
gggtcagccgaagttgtgca

SEQ ID NO: 541900 - DNA, 20 bp, mouse
gggcttgccctgcacaactt

SEQ ID NO: 541901 - DNA, 20 bp, mouse
gccagccccacgggtctcag

SEQ ID NO: 541902 - DNA, 20 bp, mouse
gccccacgggtctcagaggt

SEQ ID NO: 541903 - DNA, 20 bp, mouse
gcagaggtgggtgaccctcc

SEQ ID NO: 541904 - DNA, 20 bp, mouse
ggtgggtgaccctccaggat

SEQ ID NO: 541905 - DNA, 20 bp, mouse
gacccacctctgagacccgt

SEQ ID NO: 541906 - DNA, 20 bp, mouse
gacagatgatatctaaggaa

SEQ ID NO: 541907 - DNA, 20 bp, mouse
gccaacagtgacagtctgga

SEQ ID NO: 541908 - DNA, 20 bp, mouse
ggaatgaaacacttgagtct

SEQ ID NO: 541909 - DNA, 20 bp, mouse
gctccaacagatgatatcta

SEQ ID NO: 541910 - DNA, 20 bp, mouse
ggataatccatggggatctg

SEQ ID NO: 541911 - DNA, 20 bp, mouse
gcagatggaagtaagactag

SEQ ID NO: 541912 - DNA, 20 bp, mouse
ggatgatatctaaggaaggg

SEQ ID NO: 541913 - DNA, 20 bp, mouse
gttggagctgggttattgcc

SEQ ID NO: 541914 - DNA, 20 bp, mouse
gatggggatctgaggcacca

SEQ ID NO: 541915 - DNA, 20 bp, mouse
ggatttgtccctaggtaaag

SEQ ID NO: 541916 - DNA, 20 bp, mouse
gaacaagaggcgcccgtgcg

SEQ ID NO: 541917 - DNA, 20 bp, mouse
gggtgctagggaccacgcgt

SEQ ID NO: 541918 - DNA, 20 bp, mouse
gtcccaggcctgtttctcta

SEQ ID NO: 541919 - DNA, 20 bp, mouse
gctacgaaaaccccgggtct

SEQ ID NO: 541920 - DNA, 20 bp, mouse
gagtctttcccggtaacaag

SEQ ID NO: 541921 - DNA, 20 bp, mouse
gtcctgtctacgaaaacccc

SEQ ID NO: 541922 - DNA, 20 bp, mouse
gcacaaacgaggtctagggt

SEQ ID NO: 541923 - DNA, 20 bp, mouse
gacggcggcgagcgcggctg

SEQ ID NO: 541924 - DNA, 20 bp, mouse
gcggctgtggcagtctttcc

SEQ ID NO: 541925 - DNA, 20 bp, mouse
ggtgggcggggtttccggta

SEQ ID NO: 541926 - DNA, 20 bp, mouse
ggccctccatggcagcaaga

SEQ ID NO: 541927 - DNA, 20 bp, mouse
gaagagggaagcgggcatct

SEQ ID NO: 541928 - DNA, 20 bp, mouse
gttccaaatgacgccctcca

SEQ ID NO: 541929 - DNA, 20 bp, mouse
gtgggaagtgtgggacccac

SEQ ID NO: 541930 - DNA, 20 bp, mouse
gtggaagtctctaggagaag

SEQ ID NO: 541931 - DNA, 20 bp, mouse
gtggagtagacgctgcaaaa

SEQ ID NO: 541932 - DNA, 20 bp, mouse
gtgccatggagggcgtcatt

SEQ ID NO: 541933 - DNA, 20 bp, mouse
gttccctcttgctgccatgg

SEQ ID NO: 541934 - DNA, 20 bp, mouse
gtctgctccctgggaagtgt

SEQ ID NO: 541935 - DNA, 20 bp, mouse
gaggagaagcgggtgaaaga

SEQ ID NO: 541936 - DNA, 20 bp, mouse
ggcacaggcaggtacagggg

SEQ ID NO: 541937 - DNA, 20 bp, mouse
ggattctgtcctgagcgcta

SEQ ID NO: 541938 - DNA, 20 bp, mouse
gcgaggagccctacgtccgt

SEQ ID NO: 541939 - DNA, 20 bp, mouse
gatgcggtggcgccggtcgt

SEQ ID NO: 541940 - DNA, 20 bp, mouse
gcatggcacaggcaggtaca

SEQ ID NO: 541941 - DNA, 20 bp, mouse
ggccctacgtccgtaggtag

SEQ ID NO: 541942 - DNA, 20 bp, mouse
gaccgctacctacggacgta

SEQ ID NO: 541943 - DNA, 20 bp, mouse
gaaggctccttggcgtttgg

SEQ ID NO: 541944 - DNA, 20 bp, mouse
ggcgcggccaccgctaccta

SEQ ID NO: 541945 - DNA, 20 bp, mouse
gctgacgccaccaaacgcca

SEQ ID NO: 541946 - DNA, 20 bp, mouse
gcaccaacgactacactgaa

SEQ ID NO: 541947 - DNA, 20 bp, mouse
gggcggcggcggcatatctg

SEQ ID NO: 541948 - DNA, 20 bp, mouse
gagccgttcagtgtagtcgt

SEQ ID NO: 541949 - DNA, 20 bp, mouse
gagaatctgcaaggcaggta

SEQ ID NO: 541950 - DNA, 20 bp, mouse
gtgtagtcgttggtgtaatg

SEQ ID NO: 541951 - DNA, 20 bp, mouse
gatctcgcccgtagtagggt

SEQ ID NO: 541952 - DNA, 20 bp, mouse
ggaggaacggctcagtttcc

SEQ ID NO: 541953 - DNA, 20 bp, mouse
gctgaggtgagggctctcca

SEQ ID NO: 541954 - DNA, 20 bp, mouse
gaggaaggacacgacaccag

SEQ ID NO: 541955 - DNA, 20 bp, mouse
ggtggcccgctgagatgctg

SEQ ID NO: 541956 - DNA, 20 bp, mouse
gtctaggcaggaacagggtg

SEQ ID NO: 541957 - DNA, 20 bp, mouse
ggagaaagacgacagacagc

SEQ ID NO: 541958 - DNA, 20 bp, mouse
ggaacagggtggggtcggag

SEQ ID NO: 541959 - DNA, 20 bp, mouse
ggccatatgagaagacaaag

SEQ ID NO: 541960 - DNA, 20 bp, mouse
gaagggattccatcttgtaa

SEQ ID NO: 541961 - DNA, 20 bp, mouse
gcgagcaactcacccatggt

SEQ ID NO: 541962 - DNA, 20 bp, mouse
gacttctctaggcaggaaca

SEQ ID NO: 541963 - DNA, 20 bp, mouse
ggggatgaaacttcctgtaa

SEQ ID NO: 541964 - DNA, 20 bp, mouse
gaaacttgaggacctaccat

SEQ ID NO: 541965 - DNA, 20 bp, mouse
gcatcccatagagcataggg

SEQ ID NO: 541966 - DNA, 20 bp, mouse
ggactggcataggagcccac

SEQ ID NO: 541967 - DNA, 20 bp, mouse
gctcctatgccagtccactt

SEQ ID NO: 541968 - DNA, 20 bp, mouse
gcacaaggctgctaccgtgt

SEQ ID NO: 541969 - DNA, 20 bp, mouse
ggccagtccacttgggactt

SEQ ID NO: 541970 - DNA, 20 bp, mouse
gtggaaaccacatggaatgt

SEQ ID NO: 541971 - DNA, 20 bp, mouse
gtgtaggtagacaggcaaat

SEQ ID NO: 541972 - DNA, 20 bp, mouse
ggtgcagggttgaagtgatg

SEQ ID NO: 541973 - DNA, 20 bp, mouse
gcagcctgtgctccactaaa

SEQ ID NO: 541974 - DNA, 20 bp, mouse
ggctccactaaagggagcaa

SEQ ID NO: 541975 - DNA, 20 bp, mouse
gccatggccgtctaaatgcc

SEQ ID NO: 541976 - DNA, 20 bp, mouse
ggtgggctcgcaacagctac

SEQ ID NO: 541977 - DNA, 20 bp, mouse
ggccgcgcggaccagcgagc

SEQ ID NO: 541978 - DNA, 20 bp, mouse
gtgcggtgggccaggatgtc

SEQ ID NO: 541979 - DNA, 20 bp, mouse
gcgcgtgccggggctgcggt

SEQ ID NO: 541980 - DNA, 20 bp, mouse
gcggcagcggaggctgagag

SEQ ID NO: 541981 - DNA, 20 bp, mouse
gcgcagccccggcacgcggg

SEQ ID NO: 541982 - DNA, 20 bp, mouse
gtgtagggcagcgccagcca

SEQ ID NO: 541983 - DNA, 20 bp, mouse
gcgcaggcgaccgtagaagg

SEQ ID NO: 541984 - DNA, 20 bp, mouse
gggaccaagaccagcggcag

SEQ ID NO: 541985 - DNA, 20 bp, mouse
gccagcctggccgccttcta

SEQ ID NO: 541986 - DNA, 20 bp, mouse
gcccagagagggatccgatg

SEQ ID NO: 541987 - DNA, 20 bp, mouse
ggccacatcggatccctctc

SEQ ID NO: 541988 - DNA, 20 bp, mouse
ggccatggtagcagtatgca

SEQ ID NO: 541989 - DNA, 20 bp, mouse
gtccttgcatactgctacca

SEQ ID NO: 541990 - DNA, 20 bp, mouse
gtcctgggacacatagacca

SEQ ID NO: 541991 - DNA, 20 bp, mouse
gccccagggaagaccaggga

SEQ ID NO: 541992 - DNA, 20 bp, mouse
gtggagcctgctgattctca

SEQ ID NO: 541993 - DNA, 20 bp, mouse
gcgtaggttagagaatcgtc

SEQ ID NO: 541994 - DNA, 20 bp, mouse
gctgagggtattattcttgg

SEQ ID NO: 541995 - DNA, 20 bp, mouse
ggggggccctgagaatcagc

SEQ ID NO: 541996 - DNA, 20 bp, mouse
gcaggtggccgtgcagccca

SEQ ID NO: 541997 - DNA, 20 bp, mouse
gcagtggagagacgagccct

SEQ ID NO: 541998 - DNA, 20 bp, mouse
gccacgagctcggcgtgaag

SEQ ID NO: 541999 - DNA, 20 bp, mouse
gtgtagaagtcgcagagcag

SEQ ID NO: 542000 - DNA, 20 bp, mouse
gagacgagccctgggctgca

SEQ ID NO: 542001 - DNA, 20 bp, mouse
ggtggcgctgcagaacaagg

SEQ ID NO: 542002 - DNA, 20 bp, mouse
gaggcgcctagtgctgcggg

SEQ ID NO: 542003 - DNA, 20 bp, mouse
ggccgagctcgtggcgatgg

SEQ ID NO: 542004 - DNA, 20 bp, mouse
gtcatcttccagctaacagg

SEQ ID NO: 542005 - DNA, 20 bp, mouse
gccgcagaacagagcaggag

SEQ ID NO: 542006 - DNA, 20 bp, mouse
gctgttcaccacgaatcggg

SEQ ID NO: 542007 - DNA, 20 bp, mouse
gacgaatcgggaggaagctc

SEQ ID NO: 542008 - DNA, 20 bp, mouse
ggaacaggaacaggctacta

SEQ ID NO: 542009 - DNA, 20 bp, mouse
gaggaacaggctactaaggt

SEQ ID NO: 542010 - DNA, 20 bp, mouse
gattcgtggtgaacaggaac

SEQ ID NO: 542011 - DNA, 20 bp, mouse
gaggttggcgatctttgcaa

SEQ ID NO: 542012 - DNA, 20 bp, mouse
ggaggaggatgcttagtcct

SEQ ID NO: 542013 - DNA, 20 bp, mouse
ggctatctagagaggctcct

SEQ ID NO: 542014 - DNA, 20 bp, mouse
gccccgtagcgaagccagtc

SEQ ID NO: 542015 - DNA, 20 bp, mouse
ggatcagaaagtacatacct

SEQ ID NO: 542016 - DNA, 20 bp, mouse
gtggcgcggaggcccccgat

SEQ ID NO: 542017 - DNA, 20 bp, mouse
gatgtggacgctccgatcgg

SEQ ID NO: 542018 - DNA, 20 bp, mouse
gcggagcgtccacatcccgt

SEQ ID NO: 542019 - DNA, 20 bp, mouse
gccgctgcagagaggatgca

SEQ ID NO: 542020 - DNA, 20 bp, mouse
ggcgtccacatcccgtggga

SEQ ID NO: 542021 - DNA, 20 bp, mouse
gtcgccgctcgccctcccac

SEQ ID NO: 542022 - DNA, 20 bp, mouse
gcatcccgtgggagggcgag

SEQ ID NO: 542023 - DNA, 20 bp, mouse
ggggagagaacagcctggcg

SEQ ID NO: 542024 - DNA, 20 bp, mouse
gggtccgcgcgcggaacaca

SEQ ID NO: 542025 - DNA, 20 bp, mouse
gcacccggccggggacgtta

SEQ ID NO: 542026 - DNA, 20 bp, mouse
gtcggaatggtggtgaccca

SEQ ID NO: 542027 - DNA, 20 bp, mouse
gtgctggagccaattcggaa

SEQ ID NO: 542028 - DNA, 20 bp, mouse
gggtcaccaccattccgaat

SEQ ID NO: 542029 - DNA, 20 bp, mouse
ggtgtatgctggagccaatt

SEQ ID NO: 542030 - DNA, 20 bp, mouse
gtggagccaattcggaatgg

SEQ ID NO: 542031 - DNA, 20 bp, mouse
gaacctgagagcgtgtatgc

SEQ ID NO: 542032 - DNA, 20 bp, mouse
ggagagactgacctagtatg

SEQ ID NO: 542033 - DNA, 20 bp, mouse
gagcactcgggtaagcatcc

SEQ ID NO: 542034 - DNA, 20 bp, mouse
gtttctaggagagtctgggg

SEQ ID NO: 542035 - DNA, 20 bp, mouse
ggcagtcacacagtggggaa

SEQ ID NO: 542036 - DNA, 20 bp, mouse
ggctgtgtggatccactcat

SEQ ID NO: 542037 - DNA, 20 bp, mouse
ggggcatgaacagcagacaa

SEQ ID NO: 542038 - DNA, 20 bp, mouse
ggtcccacggagaacggtat

SEQ ID NO: 542039 - DNA, 20 bp, mouse
gcctgatggaccccaacaca

SEQ ID NO: 542040 - DNA, 20 bp, mouse
gggagaacatctacaaggac

SEQ ID NO: 542041 - DNA, 20 bp, mouse
gtcttgaattgccccatgag

SEQ ID NO: 542042 - DNA, 20 bp, mouse
ggcaggggagaacatctaca

SEQ ID NO: 542043 - DNA, 20 bp, mouse
gaacaagaatctaggctgtg

SEQ ID NO: 542044 - DNA, 20 bp, mouse
gtactgctgagggatatttg

SEQ ID NO: 542045 - DNA, 20 bp, mouse
gtgtcttcttgcccaacata

SEQ ID NO: 542046 - DNA, 20 bp, mouse
ggaagccagcgcccgaacgg

SEQ ID NO: 542047 - DNA, 20 bp, mouse
gcgaacggcggaggccagaa

SEQ ID NO: 542048 - DNA, 20 bp, mouse
gtcggaagccagcgcccgaa

SEQ ID NO: 542049 - DNA, 20 bp, mouse
gcacagagagagcagctcac

SEQ ID NO: 542050 - DNA, 20 bp, mouse
gtctggctgccagagacagt

SEQ ID NO: 542051 - DNA, 20 bp, mouse
gagcagctcacaggctggtt

SEQ ID NO: 542052 - DNA, 20 bp, mouse
ggccagcgcccgaacggcgg

SEQ ID NO: 542053 - DNA, 20 bp, mouse
gttaggaggccaactgtctc

SEQ ID NO: 542054 - DNA, 20 bp, mouse
gggcgggaggctgggactaa

SEQ ID NO: 542055 - DNA, 20 bp, mouse
gaggctgggactaaaggcgg

SEQ ID NO: 542056 - DNA, 20 bp, mouse
gagcctgggactacaaggag

SEQ ID NO: 542057 - DNA, 20 bp, mouse
gggactacaaggagaggcag

SEQ ID NO: 542058 - DNA, 20 bp, mouse
ggtggagatgcgagagatga

SEQ ID NO: 542059 - DNA, 20 bp, mouse
gtgccagctggcgcgatctc

SEQ ID NO: 542060 - DNA, 20 bp, mouse
gagcctagaggcgagtggaa

SEQ ID NO: 542061 - DNA, 20 bp, mouse
ggctgctcacgacagagtca

SEQ ID NO: 542062 - DNA, 20 bp, mouse
gtggaggtctgaggattcga

SEQ ID NO: 542063 - DNA, 20 bp, mouse
ggagtggaagggcttagtga

SEQ ID NO: 542064 - DNA, 20 bp, mouse
gcacttcgtgcagaaggcta

SEQ ID NO: 542065 - DNA, 20 bp, mouse
gagtaaggcaatctgaactc

SEQ ID NO: 542066 - DNA, 20 bp, mouse
ggccgagcgcctgtctggag

SEQ ID NO: 542067 - DNA, 20 bp, mouse
gcgcccggagcgtctcgaag

SEQ ID NO: 542068 - DNA, 20 bp, mouse
gtgactctgccgctccagac

SEQ ID NO: 542069 - DNA, 20 bp, mouse
gtgggtgagagccgagcctc

SEQ ID NO: 542070 - DNA, 20 bp, mouse
gtgcacagctggaccgaagg

SEQ ID NO: 542071 - DNA, 20 bp, mouse
gcgaaggggctccggctgag

SEQ ID NO: 542072 - DNA, 20 bp, mouse
gcgcaggtccccagcacatc

SEQ ID NO: 542073 - DNA, 20 bp, mouse
gcccatgctccggtccccgg

SEQ ID NO: 542074 - DNA, 20 bp, mouse
gctgaaggagcagtccggga

SEQ ID NO: 542075 - DNA, 20 bp, mouse
gcgagcctctggaaacaagc

SEQ ID NO: 542076 - DNA, 20 bp, mouse
gctccttaggaaggtaaggg

SEQ ID NO: 542077 - DNA, 20 bp, mouse
gtggctccttaggaaggtaa

SEQ ID NO: 542078 - DNA, 20 bp, mouse
gtcccgagtccggcaggact

SEQ ID NO: 542079 - DNA, 20 bp, mouse
ggctcagggtgagggacgcc

SEQ ID NO: 542080 - DNA, 20 bp, mouse
ggcagggcgggtcccgagtc

SEQ ID NO: 542081 - DNA, 20 bp, mouse
gccgctccgcgctcagtccg

SEQ ID NO: 542082 - DNA, 20 bp, mouse
gtccggcaggactgggctca

SEQ ID NO: 542083 - DNA, 20 bp, mouse
gggtaagggtggcagagcca

SEQ ID NO: 542084 - DNA, 20 bp, mouse
gtcggcccgcggactgagcg

SEQ ID NO: 542085 - DNA, 20 bp, mouse
ggggtggcagagccaaggtg

SEQ ID NO: 542086 - DNA, 20 bp, mouse
gctcaggcggagcctctggg

SEQ ID NO: 542087 - DNA, 20 bp, mouse
gtgagaagccgacgtccagg

SEQ ID NO: 542088 - DNA, 20 bp, mouse
gacgtccaggaggcgaggaa

SEQ ID NO: 542089 - DNA, 20 bp, mouse
ggcgcgcgggaagccactac

SEQ ID NO: 542090 - DNA, 20 bp, mouse
ggcctgagaagccgacgtcc

SEQ ID NO: 542091 - DNA, 20 bp, mouse
gcttctcaggcggagcctct

SEQ ID NO: 542092 - DNA, 20 bp, mouse
gagccgacgtccaggaggcg

SEQ ID NO: 542093 - DNA, 20 bp, mouse
gttgcagagacaccacgtgg

SEQ ID NO: 542094 - DNA, 20 bp, mouse
gtggccgtctggcaacgccg

SEQ ID NO: 542095 - DNA, 20 bp, mouse
gtggagttggacctcagaaa

SEQ ID NO: 542096 - DNA, 20 bp, mouse
gccgaggagcaagcaagcta

SEQ ID NO: 542097 - DNA, 20 bp, mouse
gacaaaacgaacctcgccaa

SEQ ID NO: 542098 - DNA, 20 bp, mouse
gccccggaagtagctcagtc

SEQ ID NO: 542099 - DNA, 20 bp, mouse
gcactgccaaggccatcagg

SEQ ID NO: 542100 - DNA, 20 bp, mouse
gtagggctcgggcagcggag

SEQ ID NO: 542101 - DNA, 20 bp, mouse
ggctacttccgggggacaat

SEQ ID NO: 542102 - DNA, 20 bp, mouse
gtgggtcctttggctgtgga

SEQ ID NO: 542103 - DNA, 20 bp, mouse
gcgcgctcgtctgggtcctt

SEQ ID NO: 542104 - DNA, 20 bp, mouse
gagcaagcaagctagggctc

SEQ ID NO: 542105 - DNA, 20 bp, mouse
gcttccgggggacaatgggc

SEQ ID NO: 542106 - DNA, 20 bp, mouse
gcgagaggcggagacaccca

SEQ ID NO: 542107 - DNA, 20 bp, mouse
gtctgcggcagggcccagtt

SEQ ID NO: 542108 - DNA, 20 bp, mouse
gcccagggtagcaggacaag

SEQ ID NO: 542109 - DNA, 20 bp, mouse
gggaggcggggctgtctctg

SEQ ID NO: 542110 - DNA, 20 bp, mouse
ggcgcccggcaggccaggta

SEQ ID NO: 542111 - DNA, 20 bp, mouse
ggcgccggcccccccatgcc

SEQ ID NO: 542112 - DNA, 20 bp, mouse
gtgggtgctaccaagcggtg

SEQ ID NO: 542113 - DNA, 20 bp, mouse
gccgccagggtgggattcaa

SEQ ID NO: 542114 - DNA, 20 bp, mouse
gagactgggggagccgaact

SEQ ID NO: 542115 - DNA, 20 bp, mouse
ggcgctgcaccaggaggtta

SEQ ID NO: 542116 - DNA, 20 bp, mouse
gtgcatacatacagaaggtt

SEQ ID NO: 542117 - DNA, 20 bp, mouse
gaaggagaaagagcatctct

SEQ ID NO: 542118 - DNA, 20 bp, mouse
gcgtccctgctggacctgga

SEQ ID NO: 542119 - DNA, 20 bp, mouse
gctccttgcatacatacaga

SEQ ID NO: 542120 - DNA, 20 bp, mouse
gagggcatagctaatgggtg

SEQ ID NO: 542121 - DNA, 20 bp, mouse
gagaggcagtggcagaagac

SEQ ID NO: 542122 - DNA, 20 bp, mouse
gcgagaccagccctgagaga

SEQ ID NO: 542123 - DNA, 20 bp, mouse
gagcgcaagctggttgtcat

SEQ ID NO: 542124 - DNA, 20 bp, mouse
gtcgacattcggagaaaaga

SEQ ID NO: 542125 - DNA, 20 bp, mouse
ggcagtcaccaagctggcta

SEQ ID NO: 542126 - DNA, 20 bp, mouse
ggaaagcgtgagaagtgtca

SEQ ID NO: 542127 - DNA, 20 bp, mouse
ggtgctgcggcggaaaggga

SEQ ID NO: 542128 - DNA, 20 bp, mouse
gaggggccccgggaaaatac

SEQ ID NO: 542129 - DNA, 20 bp, mouse
gtgcagggctaggtggctgg

SEQ ID NO: 542130 - DNA, 20 bp, mouse
gcacttctcacgctttccag

SEQ ID NO: 542131 - DNA, 20 bp, mouse
gggcgcgcctcaaggagggg

SEQ ID NO: 542132 - DNA, 20 bp, mouse
gatcgaagccccgggtacac

SEQ ID NO: 542133 - DNA, 20 bp, mouse
gacgctttccaggggccgga

SEQ ID NO: 542134 - DNA, 20 bp, mouse
gacccacagcagggaggcgg

SEQ ID NO: 542135 - DNA, 20 bp, mouse
gcagctgcagccaaaagtaa

SEQ ID NO: 542136 - DNA, 20 bp, mouse
ggtgcgggcagaattcccaa

SEQ ID NO: 542137 - DNA, 20 bp, mouse
gtgggtcctgagtgatacct

SEQ ID NO: 542138 - DNA, 20 bp, mouse
gttcccaagggacccctcct

SEQ ID NO: 542139 - DNA, 20 bp, mouse
gagaaataaaggctggagca

SEQ ID NO: 542140 - DNA, 20 bp, mouse
gtgggtcttagcctgattaa

SEQ ID NO: 542141 - DNA, 20 bp, mouse
gtgaaagaagaaataaaggc

SEQ ID NO: 542142 - DNA, 20 bp, mouse
ggaggggctgggggcactat

SEQ ID NO: 542143 - DNA, 20 bp, mouse
gagcaggtcgaaggctaccc

SEQ ID NO: 542144 - DNA, 20 bp, mouse
gaacaacccaggtatcactc

SEQ ID NO: 542145 - DNA, 20 bp, mouse
gtagggatcctacagctgag

SEQ ID NO: 542146 - DNA, 20 bp, mouse
gagggaaagccgatcctgac

SEQ ID NO: 542147 - DNA, 20 bp, mouse
gaggcaagctagcgaagtga

SEQ ID NO: 542148 - DNA, 20 bp, mouse
gcagctacccagcgggacag

SEQ ID NO: 542149 - DNA, 20 bp, mouse
gtaggctctttgtctgagaa

SEQ ID NO: 542150 - DNA, 20 bp, mouse
gctgacaggttgagaaatga

SEQ ID NO: 542151 - DNA, 20 bp, mouse
gtacgctctgagaagtaagt

SEQ ID NO: 542152 - DNA, 20 bp, mouse
ggttagtctagcacacttct

SEQ ID NO: 542153 - DNA, 20 bp, mouse
ggtgtccttgcgaattctca

SEQ ID NO: 542154 - DNA, 20 bp, mouse
gatgcctagagtagactcta

SEQ ID NO: 542155 - DNA, 20 bp, mouse
gataccttagagtctactct

SEQ ID NO: 542156 - DNA, 20 bp, mouse
gacgcaccccgagtcccgga

SEQ ID NO: 542157 - DNA, 20 bp, mouse
ggtccggagctcaggaatcg

SEQ ID NO: 542158 - DNA, 20 bp, mouse
ggggcgccgtccgggactcg

SEQ ID NO: 542159 - DNA, 20 bp, mouse
gacgtgcagcgaattcacgt

SEQ ID NO: 542160 - DNA, 20 bp, mouse
gggctaggggacacgcacgg

SEQ ID NO: 542161 - DNA, 20 bp, mouse
ggcgcgccgaggggacgtcg

SEQ ID NO: 542162 - DNA, 20 bp, mouse
ggaggggagactcaacccgg

SEQ ID NO: 542163 - DNA, 20 bp, mouse
gggcggctaggggacacgca

SEQ ID NO: 542164 - DNA, 20 bp, mouse
gtcaggaatcggggcggcta

SEQ ID NO: 542165 - DNA, 20 bp, mouse
gctagaggggagactcaacc

SEQ ID NO: 542166 - DNA, 20 bp, mouse
gcccagagggtgggtcccag

SEQ ID NO: 542167 - DNA, 20 bp, mouse
ggcattcggccccagagggt

SEQ ID NO: 542168 - DNA, 20 bp, mouse
gttcgggatgaaaccctcgt

SEQ ID NO: 542169 - DNA, 20 bp, mouse
gttccggcgggaaattccgt

SEQ ID NO: 542170 - DNA, 20 bp, mouse
gccgagatgccgaccccgac

SEQ ID NO: 542171 - DNA, 20 bp, mouse
gtccactgggacccaccctc

SEQ ID NO: 542172 - DNA, 20 bp, mouse
gctcggtacgcatgcctgag

SEQ ID NO: 542173 - DNA, 20 bp, mouse
gcgcccgctctcggtagtaa

SEQ ID NO: 542174 - DNA, 20 bp, mouse
gcttcttctccagtcggggt

SEQ ID NO: 542175 - DNA, 20 bp, mouse
gcccagggttgccctcctta

SEQ ID NO: 542176 - DNA, 20 bp, mouse
gaacagacgtgggtccttgg

SEQ ID NO: 542177 - DNA, 20 bp, mouse
gtcagggttgggagccatgg

SEQ ID NO: 542178 - DNA, 20 bp, mouse
gagagtggctggtcagggtt

SEQ ID NO: 542179 - DNA, 20 bp, mouse
gcttggagagtggctggtca

SEQ ID NO: 542180 - DNA, 20 bp, mouse
gccttctccaaaacagacgt

SEQ ID NO: 542181 - DNA, 20 bp, mouse
ggcgatgggttcttccccca

SEQ ID NO: 542182 - DNA, 20 bp, mouse
ggcagagcattcttggagag

SEQ ID NO: 542183 - DNA, 20 bp, mouse
gagcattcttggagagtggc

SEQ ID NO: 542184 - DNA, 20 bp, mouse
gcaaaacagacgtgggtcct

SEQ ID NO: 542185 - DNA, 20 bp, mouse
gtggatctgccccaccccca

SEQ ID NO: 542186 - DNA, 20 bp, mouse
ggcccagggaagaatgtgta

SEQ ID NO: 542187 - DNA, 20 bp, mouse
gatgtgtaaggaaactgacc

SEQ ID NO: 542188 - DNA, 20 bp, mouse
gcctagacctgcaagtccag

SEQ ID NO: 542189 - DNA, 20 bp, mouse
gtccttacacattcttccct

SEQ ID NO: 542190 - DNA, 20 bp, mouse
ggaaagctcaggcttggatg

SEQ ID NO: 542191 - DNA, 20 bp, mouse
gaaactgacctggctttctc

SEQ ID NO: 542192 - DNA, 20 bp, mouse
gagctcaggcttggatgggg

SEQ ID NO: 542193 - DNA, 20 bp, mouse
gtttcttaagatccggccca

SEQ ID NO: 542194 - DNA, 20 bp, mouse
gtgtagggtgtgagtaggag

SEQ ID NO: 542195 - DNA, 20 bp, mouse
gcctgagctttcttaagatc

SEQ ID NO: 542196 - DNA, 20 bp, mouse
gaaatcgtggagactatcaa

SEQ ID NO: 542197 - DNA, 20 bp, mouse
ggttctgttgttaaaaatcg

SEQ ID NO: 542198 - DNA, 20 bp, mouse
gtgggctccttgatcctctg

SEQ ID NO: 542199 - DNA, 20 bp, mouse
gaacagaccccagaggatca

SEQ ID NO: 542200 - DNA, 20 bp, mouse
gccacaacctgctgtgatgg

SEQ ID NO: 542201 - DNA, 20 bp, mouse
gggtccacaacctgctgtga

SEQ ID NO: 542202 - DNA, 20 bp, mouse
gctatgttcaggatgcctcc

SEQ ID NO: 542203 - DNA, 20 bp, mouse
ggcaggtaaacagaccccag

SEQ ID NO: 542204 - DNA, 20 bp, mouse
gcctctgcacctgccccctc

SEQ ID NO: 542205 - DNA, 20 bp, mouse
gttacctgctggcatttctt

SEQ ID NO: 542206 - DNA, 20 bp, mouse
gagcctgagctcatcgggat

SEQ ID NO: 542207 - DNA, 20 bp, mouse
gccatagctgggtctacatg

SEQ ID NO: 542208 - DNA, 20 bp, mouse
ggtagacccagctatggcac

SEQ ID NO: 542209 - DNA, 20 bp, mouse
gccattagcctgagctcatc

SEQ ID NO: 542210 - DNA, 20 bp, mouse
gtgagctcatcgggatgggg

SEQ ID NO: 542211 - DNA, 20 bp, mouse
gcaccctatgagggtcgcca

SEQ ID NO: 542212 - DNA, 20 bp, mouse
ggaccccactgctggataac

SEQ ID NO: 542213 - DNA, 20 bp, mouse
gcctggcctcaggatggcga

SEQ ID NO: 542214 - DNA, 20 bp, mouse
ggagttccctcgccatcctg

SEQ ID NO: 542215 - DNA, 20 bp, mouse
gcttcagaaccccaatctgg

SEQ ID NO: 542216 - DNA, 20 bp, mouse
gacacttcctggccataaaa

SEQ ID NO: 542217 - DNA, 20 bp, mouse
gatggaagctggaatcggga

SEQ ID NO: 542218 - DNA, 20 bp, mouse
gatggacaactggcttccag

SEQ ID NO: 542219 - DNA, 20 bp, mouse
gagcccaagctcaccaggat

SEQ ID NO: 542220 - DNA, 20 bp, mouse
gagcctgcagtccttagtgg

SEQ ID NO: 542221 - DNA, 20 bp, mouse
ggagcagacgtggacttcat

SEQ ID NO: 542222 - DNA, 20 bp, mouse
ggtctgctctggcctcagca

SEQ ID NO: 542223 - DNA, 20 bp, mouse
gaagctcaccaggatggggt

SEQ ID NO: 542224 - DNA, 20 bp, mouse
gctggcctcagcatggaagc

SEQ ID NO: 542225 - DNA, 20 bp, mouse
ggtaactaacacccccacta

SEQ ID NO: 542226 - DNA, 20 bp, mouse
gctggagagtggcaggtcaa

SEQ ID NO: 542227 - DNA, 20 bp, mouse
gaaagcagtttgctggagag

SEQ ID NO: 542228 - DNA, 20 bp, mouse
gccttctacaatacagacat

SEQ ID NO: 542229 - DNA, 20 bp, mouse
gcaatacagacatggggcct

SEQ ID NO: 542230 - DNA, 20 bp, mouse
gcaaactgctttactgttct

SEQ ID NO: 542231 - DNA, 20 bp, mouse
gggcgatgggttctcccccc

SEQ ID NO: 542232 - DNA, 20 bp, mouse
gtacagacatggggcctggg

SEQ ID NO: 542233 - DNA, 20 bp, mouse
gcagtttgctggagagtggc

SEQ ID NO: 542234 - DNA, 20 bp, mouse
gtctacttcccatttcagcc

SEQ ID NO: 542235 - DNA, 20 bp, mouse
gcacacagcagtgcaaaggt

SEQ ID NO: 542236 - DNA, 20 bp, mouse
gaggtttttcgccatcctga

SEQ ID NO: 542237 - DNA, 20 bp, mouse
gagcaatccgagtgctgcta

SEQ ID NO: 542238 - DNA, 20 bp, mouse
ggaaggtgatgtcaccaagg

SEQ ID NO: 542239 - DNA, 20 bp, mouse
gtctctgcagcactccggct

SEQ ID NO: 542240 - DNA, 20 bp, mouse
ggggtctacatgagaatact

SEQ ID NO: 542241 - DNA, 20 bp, mouse
gccaatgagctcagactaat

SEQ ID NO: 542242 - DNA, 20 bp, mouse
ggaaaaaccttagcagcact

SEQ ID NO: 542243 - DNA, 20 bp, mouse
gattgctctctgcagcactc

SEQ ID NO: 542244 - DNA, 20 bp, mouse
gtcatagagggtcacctcct

SEQ ID NO: 542245 - DNA, 20 bp, mouse
gagcactccggcttggaggt

SEQ ID NO: 542246 - DNA, 20 bp, mouse
gctggtcttgtcaattgtcg

SEQ ID NO: 542247 - DNA, 20 bp, mouse
gaagaccagctagcaacgat

SEQ ID NO: 542248 - DNA, 20 bp, mouse
ggctagcaacgatgggaaac

SEQ ID NO: 542249 - DNA, 20 bp, mouse
gctaaggtgaggctcagggt

SEQ ID NO: 542250 - DNA, 20 bp, mouse
gaagctagaagggtatatcc

SEQ ID NO: 542251 - DNA, 20 bp, mouse
gagcttctgcgatggcaccg

SEQ ID NO: 542252 - DNA, 20 bp, mouse
gggccttctgccctgcaccc

SEQ ID NO: 542253 - DNA, 20 bp, mouse
gagcactgtagctcaagtcc

SEQ ID NO: 542254 - DNA, 20 bp, mouse
gctgcgcagcaggtcccaga

SEQ ID NO: 542255 - DNA, 20 bp, mouse
gaacccgggtgcagggcaga

SEQ ID NO: 542256 - DNA, 20 bp, mouse
gacggctgctgtgaactcag

SEQ ID NO: 542257 - DNA, 20 bp, mouse
ggcttatccagagctccggc

SEQ ID NO: 542258 - DNA, 20 bp, mouse
gctgagagtaccggtcaaca

SEQ ID NO: 542259 - DNA, 20 bp, mouse
ggaccccagagcaccccgta

SEQ ID NO: 542260 - DNA, 20 bp, mouse
gcacacgccagccggagctc

SEQ ID NO: 542261 - DNA, 20 bp, mouse
ggaaactctactgagagtac

SEQ ID NO: 542262 - DNA, 20 bp, mouse
gggaacaggtccatgttgac

SEQ ID NO: 542263 - DNA, 20 bp, mouse
ggtgccccaccctctcacct

SEQ ID NO: 542264 - DNA, 20 bp, mouse
gtccggctggcgtgtggaac

SEQ ID NO: 542265 - DNA, 20 bp, mouse
gcctgagcctcgctgatctg

SEQ ID NO: 542266 - DNA, 20 bp, mouse
ggcctgcctgaggtagctga

SEQ ID NO: 542267 - DNA, 20 bp, mouse
gagctcctgggcgactgcca

SEQ ID NO: 542268 - DNA, 20 bp, mouse
gactgaccgtcagctacctc

SEQ ID NO: 542269 - DNA, 20 bp, mouse
gtgcagccactgagccacaa

SEQ ID NO: 542270 - DNA, 20 bp, mouse
gcgggaagccgtacagctcc

SEQ ID NO: 542271 - DNA, 20 bp, mouse
ggacagtggagcagttcctg

SEQ ID NO: 542272 - DNA, 20 bp, mouse
gggagtccagcttggaggcc

SEQ ID NO: 542273 - DNA, 20 bp, mouse
gggcttcccggcctccaagc

SEQ ID NO: 542274 - DNA, 20 bp, mouse
gctggagaccgtgcagacag

SEQ ID NO: 542275 - DNA, 20 bp, mouse
gcgcgtgctcaaggtactca

SEQ ID NO: 542276 - DNA, 20 bp, mouse
ggttctctggaggagacaat

SEQ ID NO: 542277 - DNA, 20 bp, mouse
gtgcctgggagagaatcgag

SEQ ID NO: 542278 - DNA, 20 bp, mouse
gagcttcctgcagcgttctc

SEQ ID NO: 542279 - DNA, 20 bp, mouse
gtggtctagactgtccccag

SEQ ID NO: 542280 - DNA, 20 bp, mouse
ggctcagaggatttatctag

SEQ ID NO: 542281 - DNA, 20 bp, mouse
gctcctggaccaagaagtca

SEQ ID NO: 542282 - DNA, 20 bp, mouse
gcaagttcacaagccccaca

SEQ ID NO: 542283 - DNA, 20 bp, mouse
gaggggtcgcatacaggtcg

SEQ ID NO: 542284 - DNA, 20 bp, mouse
gtggtgaaggtaagcacaca

SEQ ID NO: 542285 - DNA, 20 bp, mouse
ggaacgggtccatttcagct

SEQ ID NO: 542286 - DNA, 20 bp, mouse
gagtcgctctggcccagccc

SEQ ID NO: 542287 - DNA, 20 bp, mouse
gtacagtcagtgtcgcttag

SEQ ID NO: 542288 - DNA, 20 bp, mouse
ggcgggctcggcgtgaggac

SEQ ID NO: 542289 - DNA, 20 bp, mouse
gttgggctcactgtccccgg

SEQ ID NO: 542290 - DNA, 20 bp, mouse
gaggtacgacgtacgcgccg

SEQ ID NO: 542291 - DNA, 20 bp, mouse
gtcagccacgaagcgcgatg

SEQ ID NO: 542292 - DNA, 20 bp, mouse
ggagtgggccctagtcgctc

SEQ ID NO: 542293 - DNA, 20 bp, mouse
gcccttagccgagtcccccg

SEQ ID NO: 542294 - DNA, 20 bp, mouse
gctcggcgtgaggacgggcg

SEQ ID NO: 542295 - DNA, 20 bp, mouse
ggaccaagtccgagctcctt

SEQ ID NO: 542296 - DNA, 20 bp, mouse
gtccggcgccagataagtct

SEQ ID NO: 542297 - DNA, 20 bp, mouse
gcgtccgcgtaggccccaga

SEQ ID NO: 542298 - DNA, 20 bp, mouse
ggccggcgccattttgcgaa

SEQ ID NO: 542299 - DNA, 20 bp, mouse
ggtttctggaaggttcgcgg

SEQ ID NO: 542300 - DNA, 20 bp, mouse
gcgtcctgcgctgccctctg

SEQ ID NO: 542301 - DNA, 20 bp, mouse
ggattgtggccgccacaaag

SEQ ID NO: 542302 - DNA, 20 bp, mouse
gctgccctctggggcctacg

SEQ ID NO: 542303 - DNA, 20 bp, mouse
gtaaaagtgggcgtcggcgc

SEQ ID NO: 542304 - DNA, 20 bp, mouse
gctgctcgccgttcgcaaaa

SEQ ID NO: 542305 - DNA, 20 bp, mouse
ggtgacgacgcatataaaag

SEQ ID NO: 542306 - DNA, 20 bp, mouse
gctcggcccgcggcctgaca

SEQ ID NO: 542307 - DNA, 20 bp, mouse
gagcggatggagccccctgg

SEQ ID NO: 542308 - DNA, 20 bp, mouse
gctaagtccctgtcaggccg

SEQ ID NO: 542309 - DNA, 20 bp, mouse
ggggatggcgagaggaacag

SEQ ID NO: 542310 - DNA, 20 bp, mouse
ggaggagggcactcggcccg

SEQ ID NO: 542311 - DNA, 20 bp, mouse
gggagctgcggagggaggat

SEQ ID NO: 542312 - DNA, 20 bp, mouse
ggcggccggggagggtcagt

SEQ ID NO: 542313 - DNA, 20 bp, mouse
gcccaggacaggtaacggcc

SEQ ID NO: 542314 - DNA, 20 bp, mouse
gtccgggcgaggagaaaacc

SEQ ID NO: 542315 - DNA, 20 bp, mouse
gaaggcctctggagctgcgg

SEQ ID NO: 542316 - DNA, 20 bp, mouse
gaggggcgggacctgttaca

SEQ ID NO: 542317 - DNA, 20 bp, mouse
gcccctcttgatataagaaa

SEQ ID NO: 542318 - DNA, 20 bp, mouse
gacctcactttgccgcaggg

SEQ ID NO: 542319 - DNA, 20 bp, mouse
ggcctccctgcggcaaagtg

SEQ ID NO: 542320 - DNA, 20 bp, mouse
ggcggcaaagtgaggttcag

SEQ ID NO: 542321 - DNA, 20 bp, mouse
gaggcgaatggtgaccagaa

SEQ ID NO: 542322 - DNA, 20 bp, mouse
gagagaaactgccttgtaac

SEQ ID NO: 542323 - DNA, 20 bp, mouse
ggtcctgggtagctgaagtc

SEQ ID NO: 542324 - DNA, 20 bp, mouse
gttcagcggataagtcgcag

SEQ ID NO: 542325 - DNA, 20 bp, mouse
gcttctcccggagggtgatc

SEQ ID NO: 542326 - DNA, 20 bp, mouse
gtcacctctgggaagagcgg

SEQ ID NO: 542327 - DNA, 20 bp, mouse
gctcgcaaccggaactggtt

SEQ ID NO: 542328 - DNA, 20 bp, mouse
gtctgggaagagcggaggaa

SEQ ID NO: 542329 - DNA, 20 bp, mouse
gtccttctcgcaaccggaac

SEQ ID NO: 542330 - DNA, 20 bp, mouse
gctggttcggcaatcttggc

SEQ ID NO: 542331 - DNA, 20 bp, mouse
gggaactggttcggcaatct

SEQ ID NO: 542332 - DNA, 20 bp, mouse
gtggctggctgctcctgctt

SEQ ID NO: 542333 - DNA, 20 bp, mouse
ggagtgaatccggagagtaa

SEQ ID NO: 542334 - DNA, 20 bp, mouse
gtgaggataaccatacacac

SEQ ID NO: 542335 - DNA, 20 bp, mouse
gctttcacctctgggaagag

SEQ ID NO: 542336 - DNA, 20 bp, mouse
gcctaaaaggactctagcac

SEQ ID NO: 542337 - DNA, 20 bp, mouse
gtaagtgtgtggaccagaag

SEQ ID NO: 542338 - DNA, 20 bp, mouse
gaacaactaataaaggtcca

SEQ ID NO: 542339 - DNA, 20 bp, mouse
gtaataaaggtccatggaac

SEQ ID NO: 542340 - DNA, 20 bp, mouse
gttaaatgaatctccctaaa

SEQ ID NO: 542341 - DNA, 20 bp, mouse
gagattgtccagtagaaagg

SEQ ID NO: 542342 - DNA, 20 bp, mouse
gtatcaccaatgctcttgga

SEQ ID NO: 542343 - DNA, 20 bp, mouse
gctcatccatccaagagcat

SEQ ID NO: 542344 - DNA, 20 bp, mouse
gaatgtaaaaaaaaggagag

SEQ ID NO: 542345 - DNA, 20 bp, mouse
gcatcatgaatgtaaaaaaa

SEQ ID NO: 542346 - DNA, 20 bp, mouse
gctacaagttccccactgtg

SEQ ID NO: 542347 - DNA, 20 bp, mouse
gccataagtcagatccaaaa

SEQ ID NO: 542348 - DNA, 20 bp, mouse
gagatccaaaagggtatgca

SEQ ID NO: 542349 - DNA, 20 bp, mouse
gatctgacttatggcattct

SEQ ID NO: 542350 - DNA, 20 bp, mouse
gcataccgtgcatacccttt

SEQ ID NO: 542351 - DNA, 20 bp, mouse
gccctagctcgtacctccca

SEQ ID NO: 542352 - DNA, 20 bp, mouse
gaacctccagcagaaagata

SEQ ID NO: 542353 - DNA, 20 bp, mouse
gtcggagagcggacagagag

SEQ ID NO: 542354 - DNA, 20 bp, mouse
gtagatgaaatgccccacag

SEQ ID NO: 542355 - DNA, 20 bp, mouse
gggacactccagaatagcag

SEQ ID NO: 542356 - DNA, 20 bp, mouse
gtgaagaatagagcacctag

SEQ ID NO: 542357 - DNA, 20 bp, mouse
gcccgtacatatgaacagta

SEQ ID NO: 542358 - DNA, 20 bp, mouse
gtaggcagaggtccaagtcc

SEQ ID NO: 542359 - DNA, 20 bp, mouse
gagaacccgacatcaaccaa

SEQ ID NO: 542360 - DNA, 20 bp, mouse
gtagaagcaggcctctccat

SEQ ID NO: 542361 - DNA, 20 bp, mouse
gtccttactgttcatatgta

SEQ ID NO: 542362 - DNA, 20 bp, mouse
gaggcctgcttctaggacga

SEQ ID NO: 542363 - DNA, 20 bp, mouse
gccgacatcaaccaatggag

SEQ ID NO: 542364 - DNA, 20 bp, mouse
ggggctgaatgaaatattta

SEQ ID NO: 542365 - DNA, 20 bp, mouse
gttcatagattgcccaatcc

SEQ ID NO: 542366 - DNA, 20 bp, mouse
gcaatgctcctcccacacgt

SEQ ID NO: 542367 - DNA, 20 bp, mouse
gaccaccagaggagtatcaa

SEQ ID NO: 542368 - DNA, 20 bp, mouse
ggcatgggctttaccaccag

SEQ ID NO: 542369 - DNA, 20 bp, mouse
gggtggagccaacgtgtggg

SEQ ID NO: 542370 - DNA, 20 bp, mouse
gtgaagaatagagcacctag

SEQ ID NO: 542371 - DNA, 20 bp, mouse
gtttgaatattgtaagtagg

SEQ ID NO: 542372 - DNA, 20 bp, mouse
ggagcattggattccaagtt

SEQ ID NO: 542373 - DNA, 20 bp, mouse
gtaggcagaggtccaagtcc

SEQ ID NO: 542374 - DNA, 20 bp, mouse
gccctttgatactcctctgg

SEQ ID NO: 542375 - DNA, 20 bp, mouse
gagaacccgacatcaaccaa

SEQ ID NO: 542376 - DNA, 20 bp, mouse
ggaagaaagaaggagaatct

SEQ ID NO: 542377 - DNA, 20 bp, mouse
gagattgtccagaagaaaga

SEQ ID NO: 542378 - DNA, 20 bp, mouse
gtcaataacaggggttatct

SEQ ID NO: 542379 - DNA, 20 bp, mouse
gtatgcacagggcaaatttt

SEQ ID NO: 542380 - DNA, 20 bp, mouse
ggaaaggtagagcctgtggg

SEQ ID NO: 542381 - DNA, 20 bp, mouse
ggatgaaaggtagagcctgt

SEQ ID NO: 542382 - DNA, 20 bp, mouse
gtttcaaaacaactaatgaa

SEQ ID NO: 542383 - DNA, 20 bp, mouse
gctatataggaccctcccac

SEQ ID NO: 542384 - DNA, 20 bp, mouse
ggtagaattaaaacagacat

SEQ ID NO: 542385 - DNA, 20 bp, mouse
gaagactgggtgtggccact

SEQ ID NO: 542386 - DNA, 20 bp, mouse
ggcaacttacctgaaatcag

SEQ ID NO: 542387 - DNA, 20 bp, mouse
gtaaaataggccctgtagag

SEQ ID NO: 542388 - DNA, 20 bp, mouse
gtcaagtgcagggatagggg

SEQ ID NO: 542389 - DNA, 20 bp, mouse
gactaggagaaagttaccgt

SEQ ID NO: 542390 - DNA, 20 bp, mouse
gcccatagttgtgaacactg

SEQ ID NO: 542391 - DNA, 20 bp, mouse
ggagtcaagtgcagggatag

SEQ ID NO: 542392 - DNA, 20 bp, mouse
gctgtgaatgagcaatccgg

SEQ ID NO: 542393 - DNA, 20 bp, mouse
gtaaagttgctgggtgaagt

SEQ ID NO: 542394 - DNA, 20 bp, mouse
gctcgggcctgggcctagaa

SEQ ID NO: 542395 - DNA, 20 bp, mouse
gaacgtgtgcatgtaggact

SEQ ID NO: 542396 - DNA, 20 bp, mouse
gatgaaattagtgaaataag

SEQ ID NO: 542397 - DNA, 20 bp, mouse
ggttatttcatggagttgca

SEQ ID NO: 542398 - DNA, 20 bp, mouse
gagaaagtcttgtaccatca

SEQ ID NO: 542399 - DNA, 20 bp, mouse
gagcagaaattttgccatga

SEQ ID NO: 542400 - DNA, 20 bp, mouse
gaattagtgaaataaggggt

SEQ ID NO: 542401 - DNA, 20 bp, mouse
gcatgctgcggtaaatgcag

SEQ ID NO: 542402 - DNA, 20 bp, mouse
gcttgctttgacatttggac

SEQ ID NO: 542403 - DNA, 20 bp, mouse
gatcttagagaacatctgat

SEQ ID NO: 542404 - DNA, 20 bp, mouse
gatctgaatgaaagtcagaa

SEQ ID NO: 542405 - DNA, 20 bp, mouse
gtgctgcttgctttgacatt

SEQ ID NO: 542406 - DNA, 20 bp, mouse
gctcggttgaacatctccag

SEQ ID NO: 542407 - DNA, 20 bp, mouse
gtctccagaggagcaaattt

SEQ ID NO: 542408 - DNA, 20 bp, mouse
gtgatcatgagcatggacat

SEQ ID NO: 542409 - DNA, 20 bp, mouse
ggatgttcaaccgaggacag

SEQ ID NO: 542410 - DNA, 20 bp, mouse
gccgaggacagtggttgtga

SEQ ID NO: 542411 - DNA, 20 bp, mouse
ggcaaatttaggaatcatga

SEQ ID NO: 542412 - DNA, 20 bp, mouse
gacctgagagaaaggcataa

SEQ ID NO: 542413 - DNA, 20 bp, mouse
gaaaagtgtacctgagagaa

SEQ ID NO: 542414 - DNA, 20 bp, mouse
gtgctgctggcattggtatt

SEQ ID NO: 542415 - DNA, 20 bp, mouse
gaagtttctgctgctggcat

SEQ ID NO: 542416 - DNA, 20 bp, mouse
ggaggtctacacgtcaaaga

SEQ ID NO: 542417 - DNA, 20 bp, mouse
gcccctcagcgtcaagcagt

SEQ ID NO: 542418 - DNA, 20 bp, mouse
gggggcctccctgaaaacat

SEQ ID NO: 542419 - DNA, 20 bp, mouse
ggagtcaaactcaaccttca

SEQ ID NO: 542420 - DNA, 20 bp, mouse
gatttagagcaggacgttcc

SEQ ID NO: 542421 - DNA, 20 bp, mouse
gtccttctgttagaagatag

SEQ ID NO: 542422 - DNA, 20 bp, mouse
gtcttctaacagaaggactc

SEQ ID NO: 542423 - DNA, 20 bp, mouse
gcagcgtcaagcagtaggcc

SEQ ID NO: 542424 - DNA, 20 bp, mouse
gtagaagaaagagcagattt

SEQ ID NO: 542425 - DNA, 20 bp, mouse
gtacacgtcaaagagggcac

SEQ ID NO: 542426 - DNA, 20 bp, mouse
gggtgggccaacaccaacca

SEQ ID NO: 542427 - DNA, 20 bp, mouse
gtggcccaccggttcaagtg

SEQ ID NO: 542428 - DNA, 20 bp, mouse
gagcatggaatggtcagatc

SEQ ID NO: 542429 - DNA, 20 bp, mouse
gcctggagcaggagaatgag

SEQ ID NO: 542430 - DNA, 20 bp, mouse
ggaaccccacttgaaccggt

SEQ ID NO: 542431 - DNA, 20 bp, mouse
gtcaagaaccccacttgaac

SEQ ID NO: 542432 - DNA, 20 bp, mouse
ggtgtatgctcttagaggtc

SEQ ID NO: 542433 - DNA, 20 bp, mouse
gaatgagtgggtcatgtcac

SEQ ID NO: 542434 - DNA, 20 bp, mouse
gttagccctgcaccccagca

SEQ ID NO: 542435 - DNA, 20 bp, mouse
ggccaacaccaaccagggtc

SEQ ID NO: 542436 - DNA, 20 bp, mouse
gtaatggaccactccttcag

SEQ ID NO: 542437 - DNA, 20 bp, mouse
gcgtgagctgggagaaggac

SEQ ID NO: 542438 - DNA, 20 bp, mouse
gaaggaccggcagccagtag

SEQ ID NO: 542439 - DNA, 20 bp, mouse
gttgccaacagataccacaa

SEQ ID NO: 542440 - DNA, 20 bp, mouse
gctttggccgcgtcaggaag

SEQ ID NO: 542441 - DNA, 20 bp, mouse
gcccaaccccactgacataa

SEQ ID NO: 542442 - DNA, 20 bp, mouse
gtccactcgcaggccgacgg

SEQ ID NO: 542443 - DNA, 20 bp, mouse
ggtggtccattatgtcagtg

SEQ ID NO: 542444 - DNA, 20 bp, mouse
gatctggcgctaggtgacag

SEQ ID NO: 542445 - DNA, 20 bp, mouse
gcgcgcgaggaacgccatag

SEQ ID NO: 542446 - DNA, 20 bp, mouse
ggccagggtccagggtaaag

SEQ ID NO: 542447 - DNA, 20 bp, mouse
gagcgggcgccgggaccggt

SEQ ID NO: 542448 - DNA, 20 bp, mouse
gaggccgggagccgagacca

SEQ ID NO: 542449 - DNA, 20 bp, mouse
gtccagggtaaagaggcgag

SEQ ID NO: 542450 - DNA, 20 bp, mouse
gagccgagaccagggcgtgg

SEQ ID NO: 542451 - DNA, 20 bp, mouse
ggcggtcacaggagtcccac

SEQ ID NO: 542452 - DNA, 20 bp, mouse
gagggctgcggccagggtcc

SEQ ID NO: 542453 - DNA, 20 bp, mouse
gcgtagcagggctgcggcca

SEQ ID NO: 542454 - DNA, 20 bp, mouse
gctgctacgcggcaattccc

SEQ ID NO: 542455 - DNA, 20 bp, mouse
gtaaagaggcgagcggtcac

SEQ ID NO: 542456 - DNA, 20 bp, mouse
ggaagtgaagctccactcga

SEQ ID NO: 542457 - DNA, 20 bp, mouse
gtcgttatgtgatcacaagg

SEQ ID NO: 542458 - DNA, 20 bp, mouse
gtcattcaacagccttcgag

SEQ ID NO: 542459 - DNA, 20 bp, mouse
gtggagcttcacttcacggt

SEQ ID NO: 542460 - DNA, 20 bp, mouse
gaaggaagacagatatgggt

SEQ ID NO: 542461 - DNA, 20 bp, mouse
ggagaactagatggcagaag

SEQ ID NO: 542462 - DNA, 20 bp, mouse
gaaggtgctcacatgaccag

SEQ ID NO: 542463 - DNA, 20 bp, mouse
ggcaggtgggctgcatggga

SEQ ID NO: 542464 - DNA, 20 bp, mouse
gatctcgttatgtgatcaca

SEQ ID NO: 542465 - DNA, 20 bp, mouse
gagattaaggaagacagata

SEQ ID NO: 542466 - DNA, 20 bp, mouse
gcgtggatggagcacaaccc

SEQ ID NO: 542467 - DNA, 20 bp, mouse
ggtctagtgtccagatccaa

SEQ ID NO: 542468 - DNA, 20 bp, mouse
gatccaaaggctctgagtcg

SEQ ID NO: 542469 - DNA, 20 bp, mouse
gaaaggctctgagtcgtgga

SEQ ID NO: 542470 - DNA, 20 bp, mouse
ggcagccccagagggagggt

SEQ ID NO: 542471 - DNA, 20 bp, mouse
gcacttgcagccccagaggg

SEQ ID NO: 542472 - DNA, 20 bp, mouse
ggacaacggggagtgtggaa

SEQ ID NO: 542473 - DNA, 20 bp, mouse
ggctgtgtcccaggacaacg

SEQ ID NO: 542474 - DNA, 20 bp, mouse
gttaatcgagtgccgagcca

SEQ ID NO: 542475 - DNA, 20 bp, mouse
gtgctgagaaatcttacacc

SEQ ID NO: 542476 - DNA, 20 bp, mouse
gtgcacagctgcgttcccgg

SEQ ID NO: 542477 - DNA, 20 bp, mouse
ggcagctgtgcaggaactgc

SEQ ID NO: 542478 - DNA, 20 bp, mouse
ggaactgcgggtggagccgt

SEQ ID NO: 542479 - DNA, 20 bp, mouse
gccggaagagcgcaaagcag

SEQ ID NO: 542480 - DNA, 20 bp, mouse
gccagacggggctctgggac

SEQ ID NO: 542481 - DNA, 20 bp, mouse
gcgggtggagccgttggcac

SEQ ID NO: 542482 - DNA, 20 bp, mouse
ggttatccgaggatcccact

SEQ ID NO: 542483 - DNA, 20 bp, mouse
gtcccggcggcagggccaga

SEQ ID NO: 542484 - DNA, 20 bp, mouse
ggggacaggtgacaccgagt

SEQ ID NO: 542485 - DNA, 20 bp, mouse
gcacgggcgctcggccgcta

SEQ ID NO: 542486 - DNA, 20 bp, mouse
gtcgtgtgtgggtgacatct

SEQ ID NO: 542487 - DNA, 20 bp, mouse
gcctgctggcgctcgtgtgt

SEQ ID NO: 542488 - DNA, 20 bp, mouse
ggacaacgcgggaagcgggg

SEQ ID NO: 542489 - DNA, 20 bp, mouse
gagtgcgaccggacacctcc

SEQ ID NO: 542490 - DNA, 20 bp, mouse
gcctccgggcaggaaaatgg

SEQ ID NO: 542491 - DNA, 20 bp, mouse
ggcgccagcaggccgacacc

SEQ ID NO: 542492 - DNA, 20 bp, mouse
ggcggacaacgcgggaagcg

SEQ ID NO: 542493 - DNA, 20 bp, mouse
gacgctgggagcaggacccg

SEQ ID NO: 542494 - DNA, 20 bp, mouse
gcaggcacagcggacaacgc

SEQ ID NO: 542495 - DNA, 20 bp, mouse
gacacctccgggcaggaaaa

SEQ ID NO: 542496 - DNA, 20 bp, mouse
ggggaggagcgagcgctgga

SEQ ID NO: 542497 - DNA, 20 bp, mouse
gctagcgacgcgcagaggtg

SEQ ID NO: 542498 - DNA, 20 bp, mouse
gcgggtgggtgctaccgagg

SEQ ID NO: 542499 - DNA, 20 bp, mouse
ggaaagatcgccaagaaaaa

SEQ ID NO: 542500 - DNA, 20 bp, mouse
ggtgcgggtgggtgctaccg

SEQ ID NO: 542501 - DNA, 20 bp, mouse
gtgggctcacaagtgcgggt

SEQ ID NO: 542502 - DNA, 20 bp, mouse
gttgagctagcgacgcgcag

SEQ ID NO: 542503 - DNA, 20 bp, mouse
gcgccaagaaaaaaggtgag

SEQ ID NO: 542504 - DNA, 20 bp, mouse
ggcacttgtgagcccacaga

SEQ ID NO: 542505 - DNA, 20 bp, mouse
gctcctgcgaccccaagcag

SEQ ID NO: 542506 - DNA, 20 bp, mouse
gcttggcggccggaatccca

SEQ ID NO: 542507 - DNA, 20 bp, mouse
ggtccagcgcacggagcaac

SEQ ID NO: 542508 - DNA, 20 bp, mouse
gcacctgccgagcccctagc

SEQ ID NO: 542509 - DNA, 20 bp, mouse
gcgcagcgcgggaggatctg

SEQ ID NO: 542510 - DNA, 20 bp, mouse
gcgcacggagcaaccggcta

SEQ ID NO: 542511 - DNA, 20 bp, mouse
ggggagagcggtccagcgca

SEQ ID NO: 542512 - DNA, 20 bp, mouse
gtgcctcgcacccaccttgg

SEQ ID NO: 542513 - DNA, 20 bp, mouse
gctctttccttaggcgacag

SEQ ID NO: 542514 - DNA, 20 bp, mouse
gggcgacagcggtggagttg

SEQ ID NO: 542515 - DNA, 20 bp, mouse
gcgggcggcggcaggtgcac

SEQ ID NO: 542516 - DNA, 20 bp, mouse
ggacaccaaaagccacaaat

SEQ ID NO: 542517 - DNA, 20 bp, mouse
gtcccttccttcctgtatta

SEQ ID NO: 542518 - DNA, 20 bp, mouse
gggggaaccctaatacagga

SEQ ID NO: 542519 - DNA, 20 bp, mouse
gatggtctctgcctagaact

SEQ ID NO: 542520 - DNA, 20 bp, mouse
gcacataaacagaggccagg

SEQ ID NO: 542521 - DNA, 20 bp, mouse
gtacaccttcacataaacag

SEQ ID NO: 542522 - DNA, 20 bp, mouse
gccttcttctaaagtccttc

SEQ ID NO: 542523 - DNA, 20 bp, mouse
gtctgccaatttgtggcttt

SEQ ID NO: 542524 - DNA, 20 bp, mouse
gaccctaatacaggaaggaa

SEQ ID NO: 542525 - DNA, 20 bp, mouse
ggaagggaaggagggacaaa

SEQ ID NO: 542526 - DNA, 20 bp, mouse
gtcgcctaggcggagaggaa

SEQ ID NO: 542527 - DNA, 20 bp, mouse
gggagcccgggagccagccg

SEQ ID NO: 542528 - DNA, 20 bp, mouse
gtatccgtctgagagaaggg

SEQ ID NO: 542529 - DNA, 20 bp, mouse
gctcagacggatactgccag

SEQ ID NO: 542530 - DNA, 20 bp, mouse
gtcctagggcgagcagagta

SEQ ID NO: 542531 - DNA, 20 bp, mouse
gagctccccggctggctccc

SEQ ID NO: 542532 - DNA, 20 bp, mouse
gtcccggctctaaagctccc

SEQ ID NO: 542533 - DNA, 20 bp, mouse
gctgcctcgcctaggcggag

SEQ ID NO: 542534 - DNA, 20 bp, mouse
gtggtcagtctctctcctcc

SEQ ID NO: 542535 - DNA, 20 bp, mouse
gaggcgccgctctctctctc

SEQ ID NO: 542536 - DNA, 20 bp, mouse
gaagactatgaggaccatca

SEQ ID NO: 542537 - DNA, 20 bp, mouse
gcagccacggaacacctctt

SEQ ID NO: 542538 - DNA, 20 bp, mouse
gagccacgacaggtactcag

SEQ ID NO: 542539 - DNA, 20 bp, mouse
gaagccaaagaggtgttccg

SEQ ID NO: 542540 - DNA, 20 bp, mouse
ggctgcaggaactgaatgag

SEQ ID NO: 542541 - DNA, 20 bp, mouse
gcacgacaggtactcagcgg

SEQ ID NO: 542542 - DNA, 20 bp, mouse
ggaagaggaagtgtggggat

SEQ ID NO: 542543 - DNA, 20 bp, mouse
ggacgtaccccaagccaaag

SEQ ID NO: 542544 - DNA, 20 bp, mouse
gtcctggaaaataatagcag

SEQ ID NO: 542545 - DNA, 20 bp, mouse
ggtctttgaaagctgtgttc

SEQ ID NO: 542546 - DNA, 20 bp, mouse
gggaagaagcttcacttaca

SEQ ID NO: 542547 - DNA, 20 bp, mouse
gctatctgacagcagcaaga

SEQ ID NO: 542548 - DNA, 20 bp, mouse
gggttattgactatattcta

SEQ ID NO: 542549 - DNA, 20 bp, mouse
gtataaggagatactttcag

SEQ ID NO: 542550 - DNA, 20 bp, mouse
gtggccagcctggcctcctt

SEQ ID NO: 542551 - DNA, 20 bp, mouse
ggctgtcagatagggtatga

SEQ ID NO: 542552 - DNA, 20 bp, mouse
gtcatgggaagctagatcta

SEQ ID NO: 542553 - DNA, 20 bp, mouse
gggggtggttgcaatagtag

SEQ ID NO: 542554 - DNA, 20 bp, mouse
gcaggaactaaaacaccatg

SEQ ID NO: 542555 - DNA, 20 bp, mouse
ggtacctcaagatcaaacac

SEQ ID NO: 542556 - DNA, 20 bp, mouse
ggtgctcggcgtataagtag

SEQ ID NO: 542557 - DNA, 20 bp, mouse
gagggactgacaaagcccga

SEQ ID NO: 542558 - DNA, 20 bp, mouse
gagcggcgcgtcgcaccgtc

SEQ ID NO: 542559 - DNA, 20 bp, mouse
gggagcagctgccttcaggg

SEQ ID NO: 542560 - DNA, 20 bp, mouse
gacgcgaagagggctcccat

SEQ ID NO: 542561 - DNA, 20 bp, mouse
gagccctcggatccccccat

SEQ ID NO: 542562 - DNA, 20 bp, mouse
gcgaagagggctcccatggg

SEQ ID NO: 542563 - DNA, 20 bp, mouse
gtacgccgagcacgtcgtca

SEQ ID NO: 542564 - DNA, 20 bp, mouse
gtcccggccggaaccgatcg

SEQ ID NO: 542565 - DNA, 20 bp, mouse
ggtctccatgacgacgtgct

SEQ ID NO: 542566 - DNA, 20 bp, mouse
gtttgggaaatggcactcag

SEQ ID NO: 542567 - DNA, 20 bp, mouse
gcaggtcgcagcagcagtac

SEQ ID NO: 542568 - DNA, 20 bp, mouse
gggatcgcttggagtagcag

SEQ ID NO: 542569 - DNA, 20 bp, mouse
gagcagaggcagtagggata

SEQ ID NO: 542570 - DNA, 20 bp, mouse
ggtgcatgtataagtcacac

SEQ ID NO: 542571 - DNA, 20 bp, mouse
gtgtgagtacctttgggaaa

SEQ ID NO: 542572 - DNA, 20 bp, mouse
gcaggcagcacgggtagtag

SEQ ID NO: 542573 - DNA, 20 bp, mouse
gcgggtagtagaggtcacac

SEQ ID NO: 542574 - DNA, 20 bp, mouse
gaaagtaagtgaatcatgtg

SEQ ID NO: 542575 - DNA, 20 bp, mouse
ggtacagcttgtagtcacac

SEQ ID NO: 542576 - DNA, 20 bp, mouse
gatccgccgcggcgtctcca

SEQ ID NO: 542577 - DNA, 20 bp, mouse
gccgttagcgggaggaggaa

SEQ ID NO: 542578 - DNA, 20 bp, mouse
gatgaagtcgttgaagtcgg

SEQ ID NO: 542579 - DNA, 20 bp, mouse
ggatggcccggagaggacgg

SEQ ID NO: 542580 - DNA, 20 bp, mouse
gtcgtgccatggagacgccg

SEQ ID NO: 542581 - DNA, 20 bp, mouse
gagccggactgcatccgccg

SEQ ID NO: 542582 - DNA, 20 bp, mouse
ggcccgaggacagcagagga

SEQ ID NO: 542583 - DNA, 20 bp, mouse
gcgtggcctctcaccaagag

SEQ ID NO: 542584 - DNA, 20 bp, mouse
gggaggccagggtcgtgcca

SEQ ID NO: 542585 - DNA, 20 bp, mouse
ggcccgcgcccaacgaggag

SEQ ID NO: 542586 - DNA, 20 bp, mouse
ggcaacgttgagctccaagg

SEQ ID NO: 542587 - DNA, 20 bp, mouse
ggctgacgagtcaccagaac

SEQ ID NO: 542588 - DNA, 20 bp, mouse
gcggagagtgcagagagagt

SEQ ID NO: 542589 - DNA, 20 bp, mouse
gtcaccagaacaggcagcgg

SEQ ID NO: 542590 - DNA, 20 bp, mouse
gctagcaacgttgagctcca

SEQ ID NO: 542591 - DNA, 20 bp, mouse
gaccacaccgcgggaagcag

SEQ ID NO: 542592 - DNA, 20 bp, mouse
gaggccgccgctgcctgttc

SEQ ID NO: 542593 - DNA, 20 bp, mouse
ggctcaacgttgctagtaac

SEQ ID NO: 542594 - DNA, 20 bp, mouse
ggcgggccgcgcgtgaccct

SEQ ID NO: 542595 - DNA, 20 bp, mouse
gagaggcctccggccattgt

SEQ ID NO: 542596 - DNA, 20 bp, mouse
gtgcctggcacagacaccag

SEQ ID NO: 542597 - DNA, 20 bp, mouse
gtaggacccagcctcctcac

SEQ ID NO: 542598 - DNA, 20 bp, mouse
gggacaggccaccggtgagg

SEQ ID NO: 542599 - DNA, 20 bp, mouse
gactccctaaaaaggaacat

SEQ ID NO: 542600 - DNA, 20 bp, mouse
gcaccggtggcctgtccccc

SEQ ID NO: 542601 - DNA, 20 bp, mouse
gaatgggcttagagcagctt

SEQ ID NO: 542602 - DNA, 20 bp, mouse
ggggctggtcaaagaaccct

SEQ ID NO: 542603 - DNA, 20 bp, mouse
gggccaccggtgaggaggct

SEQ ID NO: 542604 - DNA, 20 bp, mouse
ggccaggcaactccctaaaa

SEQ ID NO: 542605 - DNA, 20 bp, mouse
gccagctccaagataagggt

SEQ ID NO: 542606 - DNA, 20 bp, mouse
gacctgtggaaggaattcct

SEQ ID NO: 542607 - DNA, 20 bp, mouse
ggtagcaagggcggatgcag

SEQ ID NO: 542608 - DNA, 20 bp, mouse
gctgtggaccagcaggaccg

SEQ ID NO: 542609 - DNA, 20 bp, mouse
gggcttgcagcacctgtgga

SEQ ID NO: 542610 - DNA, 20 bp, mouse
gctggggaagtgtgtctcct

SEQ ID NO: 542611 - DNA, 20 bp, mouse
gcaacgaacaccggtagcaa

SEQ ID NO: 542612 - DNA, 20 bp, mouse
gttatggcttgcagcacctg

SEQ ID NO: 542613 - DNA, 20 bp, mouse
gtgcccgaagcaaaaaggga

SEQ ID NO: 542614 - DNA, 20 bp, mouse
gtcctaggaattccttccac

SEQ ID NO: 542615 - DNA, 20 bp, mouse
gcacctcccgcaagacccag

SEQ ID NO: 542616 - DNA, 20 bp, mouse
gcagccagtacaggaggcgg

SEQ ID NO: 542617 - DNA, 20 bp, mouse
ggaagtgcagccagtacagg

SEQ ID NO: 542618 - DNA, 20 bp, mouse
gtgtactggctgcacttctg

SEQ ID NO: 542619 - DNA, 20 bp, mouse
ggagacaccgagacagctag

SEQ ID NO: 542620 - DNA, 20 bp, mouse
gcagagcgggccctaggata

SEQ ID NO: 542621 - DNA, 20 bp, mouse
ggtgcagccagtacaggagg

SEQ ID NO: 542622 - DNA, 20 bp, mouse
gcgacccccgcctcctgtac

SEQ ID NO: 542623 - DNA, 20 bp, mouse
gactggctgcacttctgtgg

SEQ ID NO: 542624 - DNA, 20 bp, mouse
gggcttcagctgttgagccg

SEQ ID NO: 542625 - DNA, 20 bp, mouse
gcaccgagacagctagggga

SEQ ID NO: 542626 - DNA, 20 bp, mouse
gggtgaacaggacctcgtgt

SEQ ID NO: 542627 - DNA, 20 bp, mouse
gtagcccaggagccccagta

SEQ ID NO: 542628 - DNA, 20 bp, mouse
gcaccagagtagcaggacac

SEQ ID NO: 542629 - DNA, 20 bp, mouse
gggacacaggaacccacacg

SEQ ID NO: 542630 - DNA, 20 bp, mouse
gaccctcagctgcgacccag

SEQ ID NO: 542631 - DNA, 20 bp, mouse
gtagtagaggcattatctgt

SEQ ID NO: 542632 - DNA, 20 bp, mouse
gcttgtggcaccagagtagc

SEQ ID NO: 542633 - DNA, 20 bp, mouse
ggcctctgggtcgcagctga

SEQ ID NO: 542634 - DNA, 20 bp, mouse
gcgccgggccaggggtactg

SEQ ID NO: 542635 - DNA, 20 bp, mouse
gacgaggtcctgttcaccat

SEQ ID NO: 542636 - DNA, 20 bp, mouse
ggagctccagatccaagaga

SEQ ID NO: 542637 - DNA, 20 bp, mouse
ggcagttagggtctgctcag

SEQ ID NO: 542638 - DNA, 20 bp, mouse
gctctctgctccatattcca

SEQ ID NO: 542639 - DNA, 20 bp, mouse
gagtgtctgagcaagaatgg

SEQ ID NO: 542640 - DNA, 20 bp, mouse
ggaggtgtgaaccaggatgg

SEQ ID NO: 542641 - DNA, 20 bp, mouse
gagctcaggtgcctgaaaag

SEQ ID NO: 542642 - DNA, 20 bp, mouse
gatatggagcagagagacgg

SEQ ID NO: 542643 - DNA, 20 bp, mouse
gccctaactgccatggaata

SEQ ID NO: 542644 - DNA, 20 bp, mouse
ggagcagaccctaactgcca

SEQ ID NO: 542645 - DNA, 20 bp, mouse
gggcgaggtgtgaaccagga

SEQ ID NO: 542646 - DNA, 20 bp, mouse
ggcagacaacatggataaag

SEQ ID NO: 542647 - DNA, 20 bp, mouse
gtgactgcgctgaagctggg

SEQ ID NO: 542648 - DNA, 20 bp, mouse
gtgcccgggaaagtacagga

SEQ ID NO: 542649 - DNA, 20 bp, mouse
gttcatgcccgggaaagtac

SEQ ID NO: 542650 - DNA, 20 bp, mouse
gctccgtcctgtactttccc

SEQ ID NO: 542651 - DNA, 20 bp, mouse
gtgaaaaatccagctaaaag

SEQ ID NO: 542652 - DNA, 20 bp, mouse
gagagagtgattaacgagtc

SEQ ID NO: 542653 - DNA, 20 bp, mouse
gacagtggacaggcgcagtg

SEQ ID NO: 542654 - DNA, 20 bp, mouse
ggattgactgcgctgaagct

SEQ ID NO: 542655 - DNA, 20 bp, mouse
gttactcctgagcgctacaa

SEQ ID NO: 542656 - DNA, 20 bp, mouse
gtaagagcgcgcaggcgtca

SEQ ID NO: 542657 - DNA, 20 bp, mouse
gggccaaagcctgggcggtt

SEQ ID NO: 542658 - DNA, 20 bp, mouse
gtcacggagggccaaagcct

SEQ ID NO: 542659 - DNA, 20 bp, mouse
gcccacggtatgggaagggt

SEQ ID NO: 542660 - DNA, 20 bp, mouse
gagcgcgcaggcgtcacgga

SEQ ID NO: 542661 - DNA, 20 bp, mouse
ggcagtgtagggatgagcta

SEQ ID NO: 542662 - DNA, 20 bp, mouse
ggccggccgagcgggccgag

SEQ ID NO: 542663 - DNA, 20 bp, mouse
ggccgagcggccggagcggg

SEQ ID NO: 542664 - DNA, 20 bp, mouse
gtcctcccacggtatgggaa

SEQ ID NO: 542665 - DNA, 20 bp, mouse
ggaggagtccgaccgtggag

SEQ ID NO: 542666 - DNA, 20 bp, mouse
gcactcgggtggagctgaac

SEQ ID NO: 542667 - DNA, 20 bp, mouse
ggaagcgccgacaccactcc

SEQ ID NO: 542668 - DNA, 20 bp, mouse
ggagagtttggagcccggag

SEQ ID NO: 542669 - DNA, 20 bp, mouse
gtgtcggcgcttcactcggg

SEQ ID NO: 542670 - DNA, 20 bp, mouse
gttggagcccggagtggtgt

SEQ ID NO: 542671 - DNA, 20 bp, mouse
gggagcccgtctgccgcaca

SEQ ID NO: 542672 - DNA, 20 bp, mouse
gggcagacgggctccgtcca

SEQ ID NO: 542673 - DNA, 20 bp, mouse
ggtggtgtcggcgcttcact

SEQ ID NO: 542674 - DNA, 20 bp, mouse
gccaggcgggcggagattgg

SEQ ID NO: 542675 - DNA, 20 bp, mouse
ggtaaccttgtgcggcagac

SEQ ID NO: 542676 - DNA, 20 bp, mouse
gggtccggggactgagcgga

SEQ ID NO: 542677 - DNA, 20 bp, mouse
ggaacgctgcacttagtcta

SEQ ID NO: 542678 - DNA, 20 bp, mouse
gtccggggggctgaaggtcc

SEQ ID NO: 542679 - DNA, 20 bp, mouse
ggtcgcgccgccgctctcac

SEQ ID NO: 542680 - DNA, 20 bp, mouse
gcgagggtgcgcgctcacgg

SEQ ID NO: 542681 - DNA, 20 bp, mouse
gccgggccacgcggtccggg

SEQ ID NO: 542682 - DNA, 20 bp, mouse
gggccagccggtgagagcgg

SEQ ID NO: 542683 - DNA, 20 bp, mouse
ggctcctctccaggccacta

SEQ ID NO: 542684 - DNA, 20 bp, mouse
gcgcgctgtatcaattacct

SEQ ID NO: 542685 - DNA, 20 bp, mouse
gcggcctgaagccccactat

SEQ ID NO: 542686 - DNA, 20 bp, mouse
ggacccacgccaaggaagtc

SEQ ID NO: 542687 - DNA, 20 bp, mouse
ggcgctgggccaggatccgc

SEQ ID NO: 542688 - DNA, 20 bp, mouse
gcttcccgttcatcttctca

SEQ ID NO: 542689 - DNA, 20 bp, mouse
gggtgcacagacccacgcca

SEQ ID NO: 542690 - DNA, 20 bp, mouse
ggtcctgacttccttggcgt

SEQ ID NO: 542691 - DNA, 20 bp, mouse
gcgcggcagcaagaggtgtg

SEQ ID NO: 542692 - DNA, 20 bp, mouse
ggtaatggggtgctgtaggg

SEQ ID NO: 542693 - DNA, 20 bp, mouse
gggaagtgaatacgctccgg

SEQ ID NO: 542694 - DNA, 20 bp, mouse
gaccatggctgaacggtgtc

SEQ ID NO: 542695 - DNA, 20 bp, mouse
ggccggaagtgaatacgctc

SEQ ID NO: 542696 - DNA, 20 bp, mouse
gcatggcgactgccgcccag

SEQ ID NO: 542697 - DNA, 20 bp, mouse
gcggcagaagcgccgctggg

SEQ ID NO: 542698 - DNA, 20 bp, mouse
gggcagtcgccatggcgaag

SEQ ID NO: 542699 - DNA, 20 bp, mouse
gcccgtagcgcgccacgtac

SEQ ID NO: 542700 - DNA, 20 bp, mouse
gtggcgcggccgcttcgcca

SEQ ID NO: 542701 - DNA, 20 bp, mouse
gcctggcgcggagccctcgg

SEQ ID NO: 542702 - DNA, 20 bp, mouse
gcgcgccacgtacaggttct

SEQ ID NO: 542703 - DNA, 20 bp, mouse
ggagggactaacgtgaccct

SEQ ID NO: 542704 - DNA, 20 bp, mouse
ggtacgggtgagctcgggtt

SEQ ID NO: 542705 - DNA, 20 bp, mouse
gacggaaggactcgctacgg

SEQ ID NO: 542706 - DNA, 20 bp, mouse
gagcgaaagcgaggcgggaa

SEQ ID NO: 542707 - DNA, 20 bp, mouse
ggccagacgagagcaatcgg

SEQ ID NO: 542708 - DNA, 20 bp, mouse
gcaggggtgggacctaacag

SEQ ID NO: 542709 - DNA, 20 bp, mouse
gtgcgacagcgaaagcgagg

SEQ ID NO: 542710 - DNA, 20 bp, mouse
gccgggcccagcacaatcgg

SEQ ID NO: 542711 - DNA, 20 bp, mouse
gacgagagccaccaaactcg

SEQ ID NO: 542712 - DNA, 20 bp, mouse
gagcgaggcgggaacggggt

SEQ ID NO: 542713 - DNA, 20 bp, mouse
gccggcgcgcgaccaggtag

SEQ ID NO: 542714 - DNA, 20 bp, mouse
gtgcctgagagtggcaggtc

SEQ ID NO: 542715 - DNA, 20 bp, mouse
gagctgcgacagcgaaagcg

SEQ ID NO: 542716 - DNA, 20 bp, mouse
ggggtccagcctgtcgagta

SEQ ID NO: 542717 - DNA, 20 bp, mouse
gctgtcgagtatggacgacc

SEQ ID NO: 542718 - DNA, 20 bp, mouse
gccggaatgcgattccacct

SEQ ID NO: 542719 - DNA, 20 bp, mouse
ggaatgcgattccacctggg

SEQ ID NO: 542720 - DNA, 20 bp, mouse
gcccagaaggacaaccctgg

SEQ ID NO: 542721 - DNA, 20 bp, mouse
gaggctggacccgctttccg

SEQ ID NO: 542722 - DNA, 20 bp, mouse
gcccaggccgctgtccccta

SEQ ID NO: 542723 - DNA, 20 bp, mouse
gacctgggaggacgagagcg

SEQ ID NO: 542724 - DNA, 20 bp, mouse
ggtcttcccggaggggatag

SEQ ID NO: 542725 - DNA, 20 bp, mouse
ggtcacttctgagccagtgg

SEQ ID NO: 542726 - DNA, 20 bp, mouse
ggtggagtcgcagtcctcca

SEQ ID NO: 542727 - DNA, 20 bp, mouse
ggagtcgcagtcctccacgg

SEQ ID NO: 542728 - DNA, 20 bp, mouse
gacctcccgagagagccgga

SEQ ID NO: 542729 - DNA, 20 bp, mouse
gcgcctgcgccccgagcgag

SEQ ID NO: 542730 - DNA, 20 bp, mouse
gctgtgcgccggagcgccgg

SEQ ID NO: 542731 - DNA, 20 bp, mouse
gcggtagcgcgctagggccc

SEQ ID NO: 542732 - DNA, 20 bp, mouse
gtcccgccctgcatccccgg

SEQ ID NO: 542733 - DNA, 20 bp, mouse
gcggccccgggacccacggt

SEQ ID NO: 542734 - DNA, 20 bp, mouse
gtacgcggccccgggaccca

SEQ ID NO: 542735 - DNA, 20 bp, mouse
ggggctgcggtagcgcgcta

SEQ ID NO: 542736 - DNA, 20 bp, mouse
gtgcgagaggctttcctacg

SEQ ID NO: 542737 - DNA, 20 bp, mouse
gctgcacgggagagcggagt

SEQ ID NO: 542738 - DNA, 20 bp, mouse
gtgaatttccctctcctcgt

SEQ ID NO: 542739 - DNA, 20 bp, mouse
gtagcagccccagcccatta

SEQ ID NO: 542740 - DNA, 20 bp, mouse
gggcgtgctgcacgggagag

SEQ ID NO: 542741 - DNA, 20 bp, mouse
gaccgggagtgtagcaccgt

SEQ ID NO: 542742 - DNA, 20 bp, mouse
ggaggctttcctacgaggag

SEQ ID NO: 542743 - DNA, 20 bp, mouse
gccaggaacggaataacatt

SEQ ID NO: 542744 - DNA, 20 bp, mouse
ggggtttggtggtgtgcgag

SEQ ID NO: 542745 - DNA, 20 bp, mouse
gctgagaagtcaacatccta

SEQ ID NO: 542746 - DNA, 20 bp, mouse
gtcacttgggactaatgcac

SEQ ID NO: 542747 - DNA, 20 bp, mouse
gctcattcactctctcactt

SEQ ID NO: 542748 - DNA, 20 bp, mouse
gtatctggttgaagtccttg

SEQ ID NO: 542749 - DNA, 20 bp, mouse
gttcaaccagatactaaggt

SEQ ID NO: 542750 - DNA, 20 bp, mouse
gcctattgaggaaaaccaca

SEQ ID NO: 542751 - DNA, 20 bp, mouse
gcagggatgaatacctattg

SEQ ID NO: 542752 - DNA, 20 bp, mouse
gacaagcctaccttagtatc

SEQ ID NO: 542753 - DNA, 20 bp, mouse
gcagtttgtcaaaaatccag

SEQ ID NO: 542754 - DNA, 20 bp, mouse
gtacaaacagactcacttgg

SEQ ID NO: 542755 - DNA, 20 bp, mouse
ggtactggaaagattctttg

SEQ ID NO: 542756 - DNA, 20 bp, mouse
gaatactgaactcgaatctt

SEQ ID NO: 542757 - DNA, 20 bp, mouse
gctcgaatcttaggaactct

SEQ ID NO: 542758 - DNA, 20 bp, mouse
gttttgaagggctcaggggg

SEQ ID NO: 542759 - DNA, 20 bp, mouse
gtccagatggcgtcttccgt

SEQ ID NO: 542760 - DNA, 20 bp, mouse
gtgtcttgaaatggcggcga

SEQ ID NO: 542761 - DNA, 20 bp, mouse
gagacggcgccagaccccaa

SEQ ID NO: 542762 - DNA, 20 bp, mouse
gacgtctgccagagtagaat

SEQ ID NO: 542763 - DNA, 20 bp, mouse
gacctctcactgtcttgaaa

SEQ ID NO: 542764 - DNA, 20 bp, mouse
gctgtcggccacgttgccca

SEQ ID NO: 542765 - DNA, 20 bp, mouse
ggcccttcaaaacactgata

SEQ ID NO: 542766 - DNA, 20 bp, mouse
gctccaagaagcgaagactg

SEQ ID NO: 542767 - DNA, 20 bp, mouse
gcgcgcgcttcaaagaaata

SEQ ID NO: 542768 - DNA, 20 bp, mouse
gtgtgaggaagatagaccag

SEQ ID NO: 542769 - DNA, 20 bp, mouse
gcaccgcgcgcaatgaaaca

SEQ ID NO: 542770 - DNA, 20 bp, mouse
gcttggagcgtgcgagaaag

SEQ ID NO: 542771 - DNA, 20 bp, mouse
gcaggcagccgcaggtcgac

SEQ ID NO: 542772 - DNA, 20 bp, mouse
gcaagagtcacgacgtgact

SEQ ID NO: 542773 - DNA, 20 bp, mouse
ggagtgggacactcaggtgg

SEQ ID NO: 542774 - DNA, 20 bp, mouse
ggtgtcccactccatggagg

SEQ ID NO: 542775 - DNA, 20 bp, mouse
gtccatggagtgggacactc

SEQ ID NO: 542776 - DNA, 20 bp, mouse
gctggctggtcactccctct

SEQ ID NO: 542777 - DNA, 20 bp, mouse
gaagagcagccggctagaga

SEQ ID NO: 542778 - DNA, 20 bp, mouse
gtctggcagagacatacctg

SEQ ID NO: 542779 - DNA, 20 bp, mouse
gtcccaaggagcccaagacc

SEQ ID NO: 542780 - DNA, 20 bp, mouse
gagtaaagccccctctggtc

SEQ ID NO: 542781 - DNA, 20 bp, mouse
gcttagatacagctgcctag

SEQ ID NO: 542782 - DNA, 20 bp, mouse
gctgggattgatcccttcag

SEQ ID NO: 542783 - DNA, 20 bp, mouse
gggagtgaccagccaggtct

SEQ ID NO: 542784 - DNA, 20 bp, mouse
gggaagtagctaccctccca

SEQ ID NO: 542785 - DNA, 20 bp, mouse
gagggaaagaacgcaactgt

SEQ ID NO: 542786 - DNA, 20 bp, mouse
gtaagtgcttgagagaacaa

SEQ ID NO: 542787 - DNA, 20 bp, mouse
gggaatcttctatccactcc

SEQ ID NO: 542788 - DNA, 20 bp, mouse
gggagaactgttgttacacc

SEQ ID NO: 542789 - DNA, 20 bp, mouse
gaatatccctctggactctt

SEQ ID NO: 542790 - DNA, 20 bp, mouse
gcactcaggcaggaagctaa

SEQ ID NO: 542791 - DNA, 20 bp, mouse
gtgagtggctaggacttcca

SEQ ID NO: 542792 - DNA, 20 bp, mouse
ggacaccaaggtgactgtgg

SEQ ID NO: 542793 - DNA, 20 bp, mouse
gggtgacaccaaggtgactg

SEQ ID NO: 542794 - DNA, 20 bp, mouse
gttaggggagaatatccctc

SEQ ID NO: 542795 - DNA, 20 bp, mouse
gggccttaaatacagcccta

SEQ ID NO: 542796 - DNA, 20 bp, mouse
gtcgccggcagccggaggtg

SEQ ID NO: 542797 - DNA, 20 bp, mouse
gggtcccggactgcaaagac

SEQ ID NO: 542798 - DNA, 20 bp, mouse
gctccggctgccggcgacac

SEQ ID NO: 542799 - DNA, 20 bp, mouse
gtaacgatcgcacggggtcc

SEQ ID NO: 542800 - DNA, 20 bp, mouse
gagtccccgaaggagcccgt

SEQ ID NO: 542801 - DNA, 20 bp, mouse
gccagtcctggagcctacaa

SEQ ID NO: 542802 - DNA, 20 bp, mouse
gccgggctaacgatcgcacg

SEQ ID NO: 542803 - DNA, 20 bp, mouse
gcactggcccgggagcccac

SEQ ID NO: 542804 - DNA, 20 bp, mouse
gctgcaaagaccggtgtcgc

SEQ ID NO: 542805 - DNA, 20 bp, mouse
ggccaatgccgggtcaggag

SEQ ID NO: 542806 - DNA, 20 bp, mouse
ggagaccacagcacaccgag

SEQ ID NO: 542807 - DNA, 20 bp, mouse
gtcagcgatgctccttccag

SEQ ID NO: 542808 - DNA, 20 bp, mouse
ggaactcgatggtgaatctc

SEQ ID NO: 542809 - DNA, 20 bp, mouse
gcaccacgcagagggacagg

SEQ ID NO: 542810 - DNA, 20 bp, mouse
gtcagatgcccagacaggtt

SEQ ID NO: 542811 - DNA, 20 bp, mouse
gcacagcacaccgagaggca

SEQ ID NO: 542812 - DNA, 20 bp, mouse
gagcctgctcaaataggaga

SEQ ID NO: 542813 - DNA, 20 bp, mouse
ggtgaatctcaggagtgttc

SEQ ID NO: 542814 - DNA, 20 bp, mouse
gggcagtcatgctaagacca

SEQ ID NO: 542815 - DNA, 20 bp, mouse
gacggaaagcctgctcaaat

SEQ ID NO: 542816 - DNA, 20 bp, mouse
ggcgcgcggggacgctgcag

SEQ ID NO: 542817 - DNA, 20 bp, mouse
gcgccgcgctcagaacccgg

SEQ ID NO: 542818 - DNA, 20 bp, mouse
gcggtggcccttctcgagag

SEQ ID NO: 542819 - DNA, 20 bp, mouse
gcgcgctccgctctcgagaa

SEQ ID NO: 542820 - DNA, 20 bp, mouse
gccgcgccgcgctcagaacc

SEQ ID NO: 542821 - DNA, 20 bp, mouse
gaggcggcgggcaccacggc

SEQ ID NO: 542822 - DNA, 20 bp, mouse
gtattgaggcccaccagcga

SEQ ID NO: 542823 - DNA, 20 bp, mouse
gcctcaggcggcgggcacca

SEQ ID NO: 542824 - DNA, 20 bp, mouse
gcgcggggacgctgcagcgg

SEQ ID NO: 542825 - DNA, 20 bp, mouse
gacagggaggcagagaccgg

SEQ ID NO: 542826 - DNA, 20 bp, mouse
gttgcttgcccggggaaggg

SEQ ID NO: 542827 - DNA, 20 bp, mouse
ggcaaggcgcacgggtccct

SEQ ID NO: 542828 - DNA, 20 bp, mouse
gccgggcaagcaaggcgcac

SEQ ID NO: 542829 - DNA, 20 bp, mouse
gcgcgccctgcagagctcgg

SEQ ID NO: 542830 - DNA, 20 bp, mouse
ggcggtgccaaaagtttgct

SEQ ID NO: 542831 - DNA, 20 bp, mouse
gcagcccagccctgcccgag

SEQ ID NO: 542832 - DNA, 20 bp, mouse
gcaaaagtttgctcggtgag

SEQ ID NO: 542833 - DNA, 20 bp, mouse
gaggcagtcgcgccggaacc

SEQ ID NO: 542834 - DNA, 20 bp, mouse
gcgccttgcttgcccgggga

SEQ ID NO: 542835 - DNA, 20 bp, mouse
gcctgggtgctggcgaccgg

SEQ ID NO: 542836 - DNA, 20 bp, mouse
gggtatgtgtaagaagccag

SEQ ID NO: 542837 - DNA, 20 bp, mouse
ggcggtgttcttgagttgag

SEQ ID NO: 542838 - DNA, 20 bp, mouse
gttgagcggcaggctacctc

SEQ ID NO: 542839 - DNA, 20 bp, mouse
gtctgggggcctgatgggtc

SEQ ID NO: 542840 - DNA, 20 bp, mouse
gtaagcggccagcgaggtaa

SEQ ID NO: 542841 - DNA, 20 bp, mouse
gatgcggggacgccaggagg

SEQ ID NO: 542842 - DNA, 20 bp, mouse
gcatcgccgcctccagacgg

SEQ ID NO: 542843 - DNA, 20 bp, mouse
gcatctgtaaagtggttctg

SEQ ID NO: 542844 - DNA, 20 bp, mouse
gccgcgttatggagacagac

SEQ ID NO: 542845 - DNA, 20 bp, mouse
gtttccagcctccctcacca

SEQ ID NO: 542846 - DNA, 20 bp, mouse
gggtgtggagacctgaacaa

SEQ ID NO: 542847 - DNA, 20 bp, mouse
ggagtgattgctgagaggtg

SEQ ID NO: 542848 - DNA, 20 bp, mouse
gaaggggagaaggtagaccg

SEQ ID NO: 542849 - DNA, 20 bp, mouse
ggttggctgtctaacagaag

SEQ ID NO: 542850 - DNA, 20 bp, mouse
ggaatgatcgccccccaggg

SEQ ID NO: 542851 - DNA, 20 bp, mouse
gaccggggcgcaccaggtgg

SEQ ID NO: 542852 - DNA, 20 bp, mouse
gtccgcaggcatctcagagt

SEQ ID NO: 542853 - DNA, 20 bp, mouse
ggcggaatgatcgcccccca

SEQ ID NO: 542854 - DNA, 20 bp, mouse
gaaagagagtgattgctgag

SEQ ID NO: 542855 - DNA, 20 bp, mouse
ggcacctcggccagcacccg

SEQ ID NO: 542856 - DNA, 20 bp, mouse
ggaggtcagagttgtccggg

SEQ ID NO: 542857 - DNA, 20 bp, mouse
gtgagggagttgctgagact

SEQ ID NO: 542858 - DNA, 20 bp, mouse
ggcagaggtcagagttgtcc

SEQ ID NO: 542859 - DNA, 20 bp, mouse
gagagccaaggcagaactga

SEQ ID NO: 542860 - DNA, 20 bp, mouse
gcctccgggaggcacttctt

SEQ ID NO: 542861 - DNA, 20 bp, mouse
gaattcccgggaatgtgcag

SEQ ID NO: 542862 - DNA, 20 bp, mouse
ggccagcatcttaacttaga

SEQ ID NO: 542863 - DNA, 20 bp, mouse
gcacttcttgggcagaaggt

SEQ ID NO: 542864 - DNA, 20 bp, mouse
gctgcctggttgcctccggg

SEQ ID NO: 542865 - DNA, 20 bp, mouse
gggaggtgtggtcaattccc

SEQ ID NO: 542866 - DNA, 20 bp, mouse
gctgtgcatggccaagctga

SEQ ID NO: 542867 - DNA, 20 bp, mouse
gccatgcacagaccctctcc

SEQ ID NO: 542868 - DNA, 20 bp, mouse
gtggttgcagagagctccgg

SEQ ID NO: 542869 - DNA, 20 bp, mouse
gaggttcagagtgtacgggt

SEQ ID NO: 542870 - DNA, 20 bp, mouse
gctgtaagtagccattagcc

SEQ ID NO: 542871 - DNA, 20 bp, mouse
gcaccgggtagaataacaag

SEQ ID NO: 542872 - DNA, 20 bp, mouse
gaacgactcaggggtccggg

SEQ ID NO: 542873 - DNA, 20 bp, mouse
ggagtgtacgggttggggaa

SEQ ID NO: 542874 - DNA, 20 bp, mouse
gacgtaaggcctgcagagac

SEQ ID NO: 542875 - DNA, 20 bp, mouse
ggggtccgggtggtgatctc

SEQ ID NO: 542876 - DNA, 20 bp, mouse
gagcgtgcgcgcagaggtgt

SEQ ID NO: 542877 - DNA, 20 bp, mouse
ggcctcaactgtaggtacct

SEQ ID NO: 542878 - DNA, 20 bp, mouse
gctacctagcgtgcgcgcag

SEQ ID NO: 542879 - DNA, 20 bp, mouse
gcgcgcacgctaggtagcgc

SEQ ID NO: 542880 - DNA, 20 bp, mouse
ggccgcttccatggctggat

SEQ ID NO: 542881 - DNA, 20 bp, mouse
ggcgccccctcggcagagct

SEQ ID NO: 542882 - DNA, 20 bp, mouse
ggtcggagcccatccagcca

SEQ ID NO: 542883 - DNA, 20 bp, mouse
gcctgtgtggcccgacagta

SEQ ID NO: 542884 - DNA, 20 bp, mouse
gaggacagctgccgcttcca

SEQ ID NO: 542885 - DNA, 20 bp, mouse
gtggcccgacagtaaggtac

SEQ ID NO: 542886 - DNA, 20 bp, mouse
gggctagcgccgggaaactc

SEQ ID NO: 542887 - DNA, 20 bp, mouse
ggccgcagcagcgtgagctc

SEQ ID NO: 542888 - DNA, 20 bp, mouse
ggccacagcgcaggaggcaa

SEQ ID NO: 542889 - DNA, 20 bp, mouse
gcatcttgcgcccagtctcc

SEQ ID NO: 542890 - DNA, 20 bp, mouse
gccgggaaactcgggacacc

SEQ ID NO: 542891 - DNA, 20 bp, mouse
gacagtggccacagcgcagg

SEQ ID NO: 542892 - DNA, 20 bp, mouse
gactcgggacacccggagac

SEQ ID NO: 542893 - DNA, 20 bp, mouse
ggaggtgactgagggagcag

SEQ ID NO: 542894 - DNA, 20 bp, mouse
ggagggcgccggctcgacga

SEQ ID NO: 542895 - DNA, 20 bp, mouse
gcaggtggaaggctagcgcc

SEQ ID NO: 542896 - DNA, 20 bp, mouse
gactcctctggccccactta

SEQ ID NO: 542897 - DNA, 20 bp, mouse
gccccatggcagccttaagt

SEQ ID NO: 542898 - DNA, 20 bp, mouse
gtaggtgcaactagctgtca

SEQ ID NO: 542899 - DNA, 20 bp, mouse
gcagccttaagtggggccag

SEQ ID NO: 542900 - DNA, 20 bp, mouse
gggtgctgctgtccctgaag

SEQ ID NO: 542901 - DNA, 20 bp, mouse
gctctgggagtgacaagatc

SEQ ID NO: 542902 - DNA, 20 bp, mouse
gcatggacgggaccccttca

SEQ ID NO: 542903 - DNA, 20 bp, mouse
gccccacttaaggctgccat

SEQ ID NO: 542904 - DNA, 20 bp, mouse
gcagattagatggaataagg

SEQ ID NO: 542905 - DNA, 20 bp, mouse
gccgaatgcacacactcctc

SEQ ID NO: 542906 - DNA, 20 bp, mouse
gctgtgtctacagtgactaa

SEQ ID NO: 542907 - DNA, 20 bp, mouse
gggagttaagggatgattat

SEQ ID NO: 542908 - DNA, 20 bp, mouse
gaacagaggtgcggagttaa

SEQ ID NO: 542909 - DNA, 20 bp, mouse
gacttccaaatcctgacaaa

SEQ ID NO: 542910 - DNA, 20 bp, mouse
gataatagcaaagtcttcag

SEQ ID NO: 542911 - DNA, 20 bp, mouse
gggttggtgtccacaatata

SEQ ID NO: 542912 - DNA, 20 bp, mouse
gttgaattcaaagtacccat

SEQ ID NO: 542913 - DNA, 20 bp, mouse
gatctttactcagagtgcat

SEQ ID NO: 542914 - DNA, 20 bp, mouse
gtcttctagcctgagagtat

SEQ ID NO: 542915 - DNA, 20 bp, mouse
gaggtgaggattacagctga

SEQ ID NO: 542916 - DNA, 20 bp, mouse
ggaaccttcaatatcagttt

SEQ ID NO: 542917 - DNA, 20 bp, mouse
gccttcaatatcagtttggg

SEQ ID NO: 542918 - DNA, 20 bp, mouse
gagcaagaaatatgaagacc

SEQ ID NO: 542919 - DNA, 20 bp, mouse
gtatggaggctgtgtggccc

SEQ ID NO: 542920 - DNA, 20 bp, mouse
gcagtgcaggtcaaaggcta

SEQ ID NO: 542921 - DNA, 20 bp, mouse
gagaagatgagttcaagtgc

SEQ ID NO: 542922 - DNA, 20 bp, mouse
gttgggaggaggcttcattt

SEQ ID NO: 542923 - DNA, 20 bp, mouse
gtcaatatcagtttgggagg

SEQ ID NO: 542924 - DNA, 20 bp, mouse
gtgtagtcgaaggtctgttc

SEQ ID NO: 542925 - DNA, 20 bp, mouse
gtctactctataactctctt

SEQ ID NO: 542926 - DNA, 20 bp, mouse
ggaggttatctgtaatgcca

SEQ ID NO: 542927 - DNA, 20 bp, mouse
gccaacaacatacagagatg

SEQ ID NO: 542928 - DNA, 20 bp, mouse
gtttcttccattggtcagtt

SEQ ID NO: 542929 - DNA, 20 bp, mouse
gctgtatgttgttggttgtt

SEQ ID NO: 542930 - DNA, 20 bp, mouse
gtgcctgagtttctcttccg

SEQ ID NO: 542931 - DNA, 20 bp, mouse
gtgccacggaagagaaactc

SEQ ID NO: 542932 - DNA, 20 bp, mouse
gacagatcccaactgaccaa

SEQ ID NO: 542933 - DNA, 20 bp, mouse
gcacatctacaaaggacagt

SEQ ID NO: 542934 - DNA, 20 bp, mouse
ggaagatgacaatcttctga

SEQ ID NO: 542935 - DNA, 20 bp, mouse
ggatgacaatcttctgatgg

SEQ ID NO: 542936 - DNA, 20 bp, mouse
gataggccttataagcactg

SEQ ID NO: 542937 - DNA, 20 bp, mouse
gatggaccacagtgcttata

SEQ ID NO: 542938 - DNA, 20 bp, mouse
gaataaatgcagaagtagta

SEQ ID NO: 542939 - DNA, 20 bp, mouse
gacatatctatcataagcca

SEQ ID NO: 542940 - DNA, 20 bp, mouse
gtgtcaggaagaggacaatt

SEQ ID NO: 542941 - DNA, 20 bp, mouse
gatttggagatggaaggagg

SEQ ID NO: 542942 - DNA, 20 bp, mouse
gataaacacagagaaatgtc

SEQ ID NO: 542943 - DNA, 20 bp, mouse
gacaatttggagatggaagg

SEQ ID NO: 542944 - DNA, 20 bp, mouse
ggaggagcaggcatccacaa

SEQ ID NO: 542945 - DNA, 20 bp, mouse
gacagagaaatgtcaggaag

SEQ ID NO: 542946 - DNA, 20 bp, mouse
gcagctagagaataatgctt

SEQ ID NO: 542947 - DNA, 20 bp, mouse
gagagtaagtacctgaaatg

SEQ ID NO: 542948 - DNA, 20 bp, mouse
gtgtctgcaaagccagtact

SEQ ID NO: 542949 - DNA, 20 bp, mouse
gctgtgtcacttccaagtac

SEQ ID NO: 542950 - DNA, 20 bp, mouse
gcttaggtttccctcatttc

SEQ ID NO: 542951 - DNA, 20 bp, mouse
gcatagcagtgatctttggg

SEQ ID NO: 542952 - DNA, 20 bp, mouse
gctagcatagcagtgatctt

SEQ ID NO: 542953 - DNA, 20 bp, mouse
gattgaaacaatgtggaaca

SEQ ID NO: 542954 - DNA, 20 bp, mouse
gctctgtgaagtttgacaag

SEQ ID NO: 542955 - DNA, 20 bp, mouse
gtattatatagatttgggct

SEQ ID NO: 542956 - DNA, 20 bp, mouse
gtgggatgtccacaagcaca

SEQ ID NO: 542957 - DNA, 20 bp, mouse
gatgctgatggattttgtta

SEQ ID NO: 542958 - DNA, 20 bp, mouse
gacaaagaatgacatctgtg

SEQ ID NO: 542959 - DNA, 20 bp, mouse
ggtgaatagcagagcctgga

SEQ ID NO: 542960 - DNA, 20 bp, mouse
gactggtgaatagcagagcc

SEQ ID NO: 542961 - DNA, 20 bp, mouse
gtatctctacagcaccttcc

SEQ ID NO: 542962 - DNA, 20 bp, mouse
gctctttatcttgtcctcaa

SEQ ID NO: 542963 - DNA, 20 bp, mouse
ggatataattggatgacatg

SEQ ID NO: 542964 - DNA, 20 bp, mouse
gtgtaggcgagagtccagct

SEQ ID NO: 542965 - DNA, 20 bp, mouse
gatctgtcccaagatgctga

SEQ ID NO: 542966 - DNA, 20 bp, mouse
ggaagacctgcagattaggg

SEQ ID NO: 542967 - DNA, 20 bp, mouse
gggcggatgagaactataca

SEQ ID NO: 542968 - DNA, 20 bp, mouse
gacaggaagacctgcagatt

SEQ ID NO: 542969 - DNA, 20 bp, mouse
gagacgaaccttattaatgg

SEQ ID NO: 542970 - DNA, 20 bp, mouse
gaagtctgtgagcatcttgg

SEQ ID NO: 542971 - DNA, 20 bp, mouse
gtggctactgaatacaacag

SEQ ID NO: 542972 - DNA, 20 bp, mouse
gttaataaggttcgtctcta

SEQ ID NO: 542973 - DNA, 20 bp, mouse
gttctcatccgccattaata

SEQ ID NO: 542974 - DNA, 20 bp, mouse
gttaccatgacgggaaactt

SEQ ID NO: 542975 - DNA, 20 bp, mouse
gagataccaccctaatctgc

SEQ ID NO: 542976 - DNA, 20 bp, mouse
gaatttatggccagaaggac

SEQ ID NO: 542977 - DNA, 20 bp, mouse
gggcactgttacagtagaat

SEQ ID NO: 542978 - DNA, 20 bp, mouse
ggttatgaaaagtaaattta

SEQ ID NO: 542979 - DNA, 20 bp, mouse
ggcatgttgaccagtccttc

SEQ ID NO: 542980 - DNA, 20 bp, mouse
gttatcaatataactggaaa

SEQ ID NO: 542981 - DNA, 20 bp, mouse
gaagtaaatttatggccaga

SEQ ID NO: 542982 - DNA, 20 bp, mouse
gtagacatcacctataagaa

SEQ ID NO: 542983 - DNA, 20 bp, mouse
gaggagaaattcagtgactg

SEQ ID NO: 542984 - DNA, 20 bp, mouse
gactaattgtcctttcttat

SEQ ID NO: 542985 - DNA, 20 bp, mouse
gtatatctgttactcccagg

SEQ ID NO: 542986 - DNA, 20 bp, mouse
gtagtatcttctgcatcact

SEQ ID NO: 542987 - DNA, 20 bp, mouse
ggtgtttcctagcaatgtca

SEQ ID NO: 542988 - DNA, 20 bp, mouse
gtgcccctctccatccctct

SEQ ID NO: 542989 - DNA, 20 bp, mouse
gtaaagcaggggattcgaga

SEQ ID NO: 542990 - DNA, 20 bp, mouse
gttcagagatgcaggtcacc

SEQ ID NO: 542991 - DNA, 20 bp, mouse
ggtctatactccaaagatcc

SEQ ID NO: 542992 - DNA, 20 bp, mouse
gtatattccctgacattgct

SEQ ID NO: 542993 - DNA, 20 bp, mouse
gtgctcaagctatgtcacga

SEQ ID NO: 542994 - DNA, 20 bp, mouse
gtactatttgtcatgtttct

SEQ ID NO: 542995 - DNA, 20 bp, mouse
gactagcaacacattcacat

SEQ ID NO: 542996 - DNA, 20 bp, mouse
gacaggaccttctgtatcac

SEQ ID NO: 542997 - DNA, 20 bp, mouse
ggtagacagaagacaatcca

SEQ ID NO: 542998 - DNA, 20 bp, mouse
gtccaaggtccaggaatgat

SEQ ID NO: 542999 - DNA, 20 bp, mouse
ggttagtgagttcatcatgt

SEQ ID NO: 543000 - DNA, 20 bp, mouse
gtgcaggtttctaggatctt

SEQ ID NO: 543001 - DNA, 20 bp, mouse
gacagatcctgtgatacaga

SEQ ID NO: 543002 - DNA, 20 bp, mouse
ggttccatttcatatagcca

SEQ ID NO: 543003 - DNA, 20 bp, mouse
gttgtggtagcctcatatgt

SEQ ID NO: 543004 - DNA, 20 bp, mouse
gttgcagattaacataatga

SEQ ID NO: 543005 - DNA, 20 bp, mouse
gacctatcattcctggacct

SEQ ID NO: 543006 - DNA, 20 bp, mouse
gcagaaccagctgcatgaca

SEQ ID NO: 543007 - DNA, 20 bp, mouse
gcctaggtgagatttcctag

SEQ ID NO: 543008 - DNA, 20 bp, mouse
gtgcaggtcactaagatctt

SEQ ID NO: 543009 - DNA, 20 bp, mouse
ggtttgttgtgaatcctacc

SEQ ID NO: 543010 - DNA, 20 bp, mouse
gatctttggtgtatagactg

SEQ ID NO: 543011 - DNA, 20 bp, mouse
ggtgagatttcctagtggaa

SEQ ID NO: 543012 - DNA, 20 bp, mouse
gtatattgttccattccact

SEQ ID NO: 543013 - DNA, 20 bp, mouse
gattgcagatcaacacaatg

SEQ ID NO: 543014 - DNA, 20 bp, mouse
gttagttggagtctcatatt

SEQ ID NO: 543015 - DNA, 20 bp, mouse
gctttgagatagcgacatag

SEQ ID NO: 543016 - DNA, 20 bp, mouse
gtagaatcagctgccaatgg

SEQ ID NO: 543017 - DNA, 20 bp, mouse
gtccctgcatccttctacac

SEQ ID NO: 543018 - DNA, 20 bp, mouse
ggtgcagcctggaatcgatg

SEQ ID NO: 543019 - DNA, 20 bp, mouse
gtacatccatgttgacagag

SEQ ID NO: 543020 - DNA, 20 bp, mouse
gcagaagaataaactcagtc

SEQ ID NO: 543021 - DNA, 20 bp, mouse
gaggggaaatccagtgtaga

SEQ ID NO: 543022 - DNA, 20 bp, mouse
gtcagtgtaggctgctacac

SEQ ID NO: 543023 - DNA, 20 bp, mouse
gctctgtgctgggttagtgg

SEQ ID NO: 543024 - DNA, 20 bp, mouse
gctacttgatgaccttgtta

SEQ ID NO: 543025 - DNA, 20 bp, mouse
gattggcagctgattctatt

SEQ ID NO: 543026 - DNA, 20 bp, mouse
ggtcagaggtgaatcccaag

SEQ ID NO: 543027 - DNA, 20 bp, mouse
gacaaacaggaccaattgtg

SEQ ID NO: 543028 - DNA, 20 bp, mouse
gtggcctgagaataaatcag

SEQ ID NO: 543029 - DNA, 20 bp, mouse
gtacatatggctaagatctt

SEQ ID NO: 543030 - DNA, 20 bp, mouse
gataagagtctttacaacca

SEQ ID NO: 543031 - DNA, 20 bp, mouse
gtctgaccctaccacacaat

SEQ ID NO: 543032 - DNA, 20 bp, mouse
gaatgagaaacatcacaaac

SEQ ID NO: 543033 - DNA, 20 bp, mouse
gttgtagcagcgtcttatat

SEQ ID NO: 543034 - DNA, 20 bp, mouse
gtagcagcgtcttatatggg

SEQ ID NO: 543035 - DNA, 20 bp, mouse
gtgttacctgctggctgcta

SEQ ID NO: 543036 - DNA, 20 bp, mouse
gagagaaccagctgtacctt

SEQ ID NO: 543037 - DNA, 20 bp, mouse
gaagctactggaccaagaaa

SEQ ID NO: 543038 - DNA, 20 bp, mouse
gagcatctgcggaacattag

SEQ ID NO: 543039 - DNA, 20 bp, mouse
gtctgatcccaaggtacagc

SEQ ID NO: 543040 - DNA, 20 bp, mouse
gcgtggcacagctggcaaaa

SEQ ID NO: 543041 - DNA, 20 bp, mouse
gagatgctttccaacatggt

SEQ ID NO: 543042 - DNA, 20 bp, mouse
gccgcagatgctttccaaca

SEQ ID NO: 543043 - DNA, 20 bp, mouse
gacacattcaatcattccaa

SEQ ID NO: 543044 - DNA, 20 bp, mouse
gtctatatgttgtcagtggt

SEQ ID NO: 543045 - DNA, 20 bp, mouse
gatggctgccagttggatac

SEQ ID NO: 543046 - DNA, 20 bp, mouse
ggagtagcccaggtcaacaa

SEQ ID NO: 543047 - DNA, 20 bp, mouse
gcacattgaccaggtagaca

SEQ ID NO: 543048 - DNA, 20 bp, mouse
ggcccaggtcaacaaaggag

SEQ ID NO: 543049 - DNA, 20 bp, mouse
gtgactgaatttgtctttat

SEQ ID NO: 543050 - DNA, 20 bp, mouse
gaaagatgatctgcagctga

SEQ ID NO: 543051 - DNA, 20 bp, mouse
gtcaatgtgatagggaatgt

SEQ ID NO: 543052 - DNA, 20 bp, mouse
gctacctggtcaatgtgata

SEQ ID NO: 543053 - DNA, 20 bp, mouse
ggatgctgagtgctatgtcc

SEQ ID NO: 543054 - DNA, 20 bp, mouse
gaatagctgatgagtagccc

SEQ ID NO: 543055 - DNA, 20 bp, mouse
gctcatcagctattgctccc

SEQ ID NO: 543056 - DNA, 20 bp, mouse
gaatctatggctagaacgac

SEQ ID NO: 543057 - DNA, 20 bp, mouse
gcacttcctgggtagcactg

SEQ ID NO: 543058 - DNA, 20 bp, mouse
gttaaaccctattctctttg

SEQ ID NO: 543059 - DNA, 20 bp, mouse
gatctttggcagtgtcacag

SEQ ID NO: 543060 - DNA, 20 bp, mouse
gtcacatgactgttactatc

SEQ ID NO: 543061 - DNA, 20 bp, mouse
gaacgactggttaacatgca

SEQ ID NO: 543062 - DNA, 20 bp, mouse
gtagacatcacctataagaa

SEQ ID NO: 543063 - DNA, 20 bp, mouse
gtatatctgttactcccagg

SEQ ID NO: 543064 - DNA, 20 bp, mouse
gaggagaaattcagtgactg

SEQ ID NO: 543065 - DNA, 20 bp, mouse
gactaattgtcctttcttat

SEQ ID NO: 543066 - DNA, 20 bp, mouse
gcaacacagatggtcaggag

SEQ ID NO: 543067 - DNA, 20 bp, mouse
ggtgacagaagaagaataag

SEQ ID NO: 543068 - DNA, 20 bp, mouse
gaagatgctagtgaacctca

SEQ ID NO: 543069 - DNA, 20 bp, mouse
gagaggcatcaacaaaagaa

SEQ ID NO: 543070 - DNA, 20 bp, mouse
gtcttgtattccaacacaga

SEQ ID NO: 543071 - DNA, 20 bp, mouse
gagaggacaccttgcaagtc

SEQ ID NO: 543072 - DNA, 20 bp, mouse
ggatcaggaataatgcaaag

SEQ ID NO: 543073 - DNA, 20 bp, mouse
gcagacaatccagacttgca

SEQ ID NO: 543074 - DNA, 20 bp, mouse
gttttcttcggttccttctt

SEQ ID NO: 543075 - DNA, 20 bp, mouse
gagatggtcaggagtggaaa

SEQ ID NO: 543076 - DNA, 20 bp, mouse
gtgatggatttcattcttgt

SEQ ID NO: 543077 - DNA, 20 bp, mouse
ggatcagcacaatcatacac

SEQ ID NO: 543078 - DNA, 20 bp, mouse
gatcactgcagtgttgttta

SEQ ID NO: 543079 - DNA, 20 bp, mouse
gtttatcttataacactgac

SEQ ID NO: 543080 - DNA, 20 bp, mouse
gatggcactagaccattatg

SEQ ID NO: 543081 - DNA, 20 bp, mouse
gagcataggaaatgatcttc

SEQ ID NO: 543082 - DNA, 20 bp, mouse
gtcacagacagcccagtgct

SEQ ID NO: 543083 - DNA, 20 bp, mouse
ggatcaccagagcaatgaag

SEQ ID NO: 543084 - DNA, 20 bp, mouse
gctgcagtgttgtttaagga

SEQ ID NO: 543085 - DNA, 20 bp, mouse
gtacaaaggagaggtggcca

SEQ ID NO: 543086 - DNA, 20 bp, mouse
gtgatggactttattcttgt

SEQ ID NO: 543087 - DNA, 20 bp, mouse
gttaaaccatactgcaatga

SEQ ID NO: 543088 - DNA, 20 bp, mouse
ggtcatttttgttatcacac

SEQ ID NO: 543089 - DNA, 20 bp, mouse
gtcaggaagccaaacacata

SEQ ID NO: 543090 - DNA, 20 bp, mouse
gtttttgttatcacactggc

SEQ ID NO: 543091 - DNA, 20 bp, mouse
gtttttaataccctgtaaga

SEQ ID NO: 543092 - DNA, 20 bp, mouse
gaaagtccatcattgcagta

SEQ ID NO: 543093 - DNA, 20 bp, mouse
gatggcactagaccgttatg

SEQ ID NO: 543094 - DNA, 20 bp, mouse
gtcgcattcccatatgtgtt

SEQ ID NO: 543095 - DNA, 20 bp, mouse
gtcacagacagcccagtgct

SEQ ID NO: 543096 - DNA, 20 bp, mouse
gaatatgaaggcatactcag

SEQ ID NO: 543097 - DNA, 20 bp, mouse
gtctccattagagaatatga

SEQ ID NO: 543098 - DNA, 20 bp, mouse
gtgtgatgaggtaaattgtg

SEQ ID NO: 543099 - DNA, 20 bp, mouse
ggaagtaagggaatgtaacc

SEQ ID NO: 543100 - DNA, 20 bp, mouse
gcatactaccccagaagtaa

SEQ ID NO: 543101 - DNA, 20 bp, mouse
gatgccttcatattctctaa

SEQ ID NO: 543102 - DNA, 20 bp, mouse
gctgacacacttggcatgtg

SEQ ID NO: 543103 - DNA, 20 bp, mouse
gagtatggtgggcacaatgc

SEQ ID NO: 543104 - DNA, 20 bp, mouse
ggaagactatttcttacatt

SEQ ID NO: 543105 - DNA, 20 bp, mouse
gattttgtgctgtaatgtag

SEQ ID NO: 543106 - DNA, 20 bp, mouse
gtggtgcagctacgagcgag

SEQ ID NO: 543107 - DNA, 20 bp, mouse
gaatgtcactcctcagatgt

SEQ ID NO: 543108 - DNA, 20 bp, mouse
gagcgagaggcagacgcttc

SEQ ID NO: 543109 - DNA, 20 bp, mouse
gttgcaaatccataaatgta

SEQ ID NO: 543110 - DNA, 20 bp, mouse
gtactatatgctcacagtga

SEQ ID NO: 543111 - DNA, 20 bp, mouse
gtatggatttgcaaatggcc

SEQ ID NO: 543112 - DNA, 20 bp, mouse
gtagctgcaccatacattta

SEQ ID NO: 543113 - DNA, 20 bp, mouse
gattttgcttgtgtataaca

SEQ ID NO: 543114 - DNA, 20 bp, mouse
gcatcaggatggtctgtgcc

SEQ ID NO: 543115 - DNA, 20 bp, mouse
gtcagtaagacaaaatgtta

SEQ ID NO: 543116 - DNA, 20 bp, mouse
gatctgaggggcaacagtgg

SEQ ID NO: 543117 - DNA, 20 bp, mouse
gaacatctgaggggcaacag

SEQ ID NO: 543118 - DNA, 20 bp, mouse
gtgctcgatctgtcaatcct

SEQ ID NO: 543119 - DNA, 20 bp, mouse
ggtaagcttggaactagaca

SEQ ID NO: 543120 - DNA, 20 bp, mouse
gcaccagggcaataaaaaag

SEQ ID NO: 543121 - DNA, 20 bp, mouse
gtggccacacagtacattta

SEQ ID NO: 543122 - DNA, 20 bp, mouse
gaagccgtaaatgtactgtg

SEQ ID NO: 543123 - DNA, 20 bp, mouse
gtctttaacatctgtaagct

SEQ ID NO: 543124 - DNA, 20 bp, mouse
gagagtctgtctctctcttg

SEQ ID NO: 543125 - DNA, 20 bp, mouse
gggttaactttttatccaag

SEQ ID NO: 543126 - DNA, 20 bp, mouse
ggagttctgggcgatctgtg

SEQ ID NO: 543127 - DNA, 20 bp, mouse
gttaggcaacatgggcatgg

SEQ ID NO: 543128 - DNA, 20 bp, mouse
ggtcttaggcaacatgggca

SEQ ID NO: 543129 - DNA, 20 bp, mouse
gaatataaacaaacagaaac

SEQ ID NO: 543130 - DNA, 20 bp, mouse
gattttagtgctgtttgtga

SEQ ID NO: 543131 - DNA, 20 bp, mouse
ggaggagaggctggagttct

SEQ ID NO: 543132 - DNA, 20 bp, mouse
gtcaccgtcttaggcaacat

SEQ ID NO: 543133 - DNA, 20 bp, mouse
ggaaattggtcaacatctgt

SEQ ID NO: 543134 - DNA, 20 bp, mouse
gaaggagaagtgcaatgaaa

SEQ ID NO: 543135 - DNA, 20 bp, mouse
gtggataaagcagccaatga

SEQ ID NO: 543136 - DNA, 20 bp, mouse
gaaacacagacccagatctc

SEQ ID NO: 543137 - DNA, 20 bp, mouse
gtgcagaaacatggtagtta

SEQ ID NO: 543138 - DNA, 20 bp, mouse
gttaggcaacatgggcttga

SEQ ID NO: 543139 - DNA, 20 bp, mouse
ggttgcctaagacggtgaca

SEQ ID NO: 543140 - DNA, 20 bp, mouse
gcacagaattcattttactg

SEQ ID NO: 543141 - DNA, 20 bp, mouse
ggaggagaggctggagttct

SEQ ID NO: 543142 - DNA, 20 bp, mouse
gtggggcatctcctgagatc

SEQ ID NO: 543143 - DNA, 20 bp, mouse
gttttagtgctgtttgtgtg

SEQ ID NO: 543144 - DNA, 20 bp, mouse
ggtttcaagctgcagaaaca

SEQ ID NO: 543145 - DNA, 20 bp, mouse
gtcaccgtcttaggcaacat

SEQ ID NO: 543146 - DNA, 20 bp, mouse
gtatgtctctcactcccaaa

SEQ ID NO: 543147 - DNA, 20 bp, mouse
gggcactgttacagtggagt

SEQ ID NO: 543148 - DNA, 20 bp, mouse
gcagggattctgtggtaccc

SEQ ID NO: 543149 - DNA, 20 bp, mouse
ggtaacagtgccaaaaatgc

SEQ ID NO: 543150 - DNA, 20 bp, mouse
gtgctttgtttgtagagaga

SEQ ID NO: 543151 - DNA, 20 bp, mouse
ggccatcactgctagcagca

SEQ ID NO: 543152 - DNA, 20 bp, mouse
gccagatggtcacagccata

SEQ ID NO: 543153 - DNA, 20 bp, mouse
gagaaaagcaatggtccaga

SEQ ID NO: 543154 - DNA, 20 bp, mouse
gaacaaagcaatttccctct

SEQ ID NO: 543155 - DNA, 20 bp, mouse
gtctgtcatcatgaattggc

SEQ ID NO: 543156 - DNA, 20 bp, mouse
gtatatgaggcaatagttta

SEQ ID NO: 543157 - DNA, 20 bp, mouse
gtagttctaatgccaggaag

SEQ ID NO: 543158 - DNA, 20 bp, mouse
ggtttagggatcagtccaca

SEQ ID NO: 543159 - DNA, 20 bp, mouse
gtgcaaataactcatccttg

SEQ ID NO: 543160 - DNA, 20 bp, mouse
gaattgagaataaggcatag

SEQ ID NO: 543161 - DNA, 20 bp, mouse
ggaatattgaattgagaata

SEQ ID NO: 543162 - DNA, 20 bp, mouse
ggttgtgatctgcctcttcc

SEQ ID NO: 543163 - DNA, 20 bp, mouse
gggataataactaaagaccc

SEQ ID NO: 543164 - DNA, 20 bp, mouse
gtgggcaaactccctattac

SEQ ID NO: 543165 - DNA, 20 bp, mouse
ggtttttatgacctgtaata

SEQ ID NO: 543166 - DNA, 20 bp, mouse
ggtcagaggcaattactcca

SEQ ID NO: 543167 - DNA, 20 bp, mouse
gagcatcttgggagtcacat

SEQ ID NO: 543168 - DNA, 20 bp, mouse
gctcatctaagtgaacatgc

SEQ ID NO: 543169 - DNA, 20 bp, mouse
gtgcctctgaccattttctt

SEQ ID NO: 543170 - DNA, 20 bp, mouse
gtaaggaagccatagatata

SEQ ID NO: 543171 - DNA, 20 bp, mouse
gtcactgtgggagggaatct

SEQ ID NO: 543172 - DNA, 20 bp, mouse
gacagtagcaagatgtccaa

SEQ ID NO: 543173 - DNA, 20 bp, mouse
gagtgatcagatagatcacc

SEQ ID NO: 543174 - DNA, 20 bp, mouse
gctatctgatcactgtggga

SEQ ID NO: 543175 - DNA, 20 bp, mouse
gttgctggtccctatatcta

SEQ ID NO: 543176 - DNA, 20 bp, mouse
gagttttcctgaattcaggt

SEQ ID NO: 543177 - DNA, 20 bp, mouse
gagaggaacgatgggaataa

SEQ ID NO: 543178 - DNA, 20 bp, mouse
ggaacgatgggaataaggga

SEQ ID NO: 543179 - DNA, 20 bp, mouse
gaacagtagagttccaacca

SEQ ID NO: 543180 - DNA, 20 bp, mouse
gagtttgaatagtcatcgtg

SEQ ID NO: 543181 - DNA, 20 bp, mouse
gcttattgaacagtagtcta

SEQ ID NO: 543182 - DNA, 20 bp, mouse
ggaataagggagggcttaaa

SEQ ID NO: 543183 - DNA, 20 bp, mouse
gttcactcctacctgaattc

SEQ ID NO: 543184 - DNA, 20 bp, mouse
gtacaatttggcaacaagag

SEQ ID NO: 543185 - DNA, 20 bp, mouse
ggggaaagaagaggaacgat

SEQ ID NO: 543186 - DNA, 20 bp, mouse
gcacatggctagtgagaccc

SEQ ID NO: 543187 - DNA, 20 bp, mouse
gagcatctttggggtcacat

SEQ ID NO: 543188 - DNA, 20 bp, mouse
gtcacagttgcaggcaacct

SEQ ID NO: 543189 - DNA, 20 bp, mouse
ggagaagcacatatccacaa

SEQ ID NO: 543190 - DNA, 20 bp, mouse
gtgcaatgaagaggtaacat

SEQ ID NO: 543191 - DNA, 20 bp, mouse
gtggaccaagcatgcagagt

SEQ ID NO: 543192 - DNA, 20 bp, mouse
gttgtttctagtggtatatg

SEQ ID NO: 543193 - DNA, 20 bp, mouse
gatggaccaatgcaatgaag

SEQ ID NO: 543194 - DNA, 20 bp, mouse
gaccatgtggacttacaacc

SEQ ID NO: 543195 - DNA, 20 bp, mouse
ggtgaagtttctcgtcatga

SEQ ID NO: 543196 - DNA, 20 bp, mouse
gctgggcttaaccagcagaa

SEQ ID NO: 543197 - DNA, 20 bp, mouse
gacttgcagttcctttctgc

SEQ ID NO: 543198 - DNA, 20 bp, mouse
gttggaaagcctctgctcta

SEQ ID NO: 543199 - DNA, 20 bp, mouse
gttaccatggtgggcaacat

SEQ ID NO: 543200 - DNA, 20 bp, mouse
gtctacatagttaccatggt

SEQ ID NO: 543201 - DNA, 20 bp, mouse
ggtcagaaacccatatatgt

SEQ ID NO: 543202 - DNA, 20 bp, mouse
gatggtctacatagttacca

SEQ ID NO: 543203 - DNA, 20 bp, mouse
gaagatttccacatgaacaa

SEQ ID NO: 543204 - DNA, 20 bp, mouse
gggcagcaaaatgtccaggg

SEQ ID NO: 543205 - DNA, 20 bp, mouse
gtatggcagcaaaatgtcca

SEQ ID NO: 543206 - DNA, 20 bp, mouse
gtctcacagctggttgcaac

SEQ ID NO: 543207 - DNA, 20 bp, mouse
gcactgccagcaactcaggg

SEQ ID NO: 543208 - DNA, 20 bp, mouse
gggaactttagagcagagac

SEQ ID NO: 543209 - DNA, 20 bp, mouse
ggtgccaccttctgagaaga

SEQ ID NO: 543210 - DNA, 20 bp, mouse
gactcactgccagcaactca

SEQ ID NO: 543211 - DNA, 20 bp, mouse
ggttccctcttctcagaagg

SEQ ID NO: 543212 - DNA, 20 bp, mouse
gggagtgcagctctcacagc

SEQ ID NO: 543213 - DNA, 20 bp, mouse
gctaactgccaggctctgat

SEQ ID NO: 543214 - DNA, 20 bp, mouse
gtggcaccaccctgagttgc

SEQ ID NO: 543215 - DNA, 20 bp, mouse
gttaccttggtcagattgtt

SEQ ID NO: 543216 - DNA, 20 bp, mouse
gaaacatagacattatatta

SEQ ID NO: 543217 - DNA, 20 bp, mouse
gcacgtggaggtctatattc

SEQ ID NO: 543218 - DNA, 20 bp, mouse
gaatgtctatgttttctgca

SEQ ID NO: 543219 - DNA, 20 bp, mouse
gttcattgctctggtgcacg

SEQ ID NO: 543220 - DNA, 20 bp, mouse
gacaaggcgtcaggaactcc

SEQ ID NO: 543221 - DNA, 20 bp, mouse
gcggttacatctgtaaaatt

SEQ ID NO: 543222 - DNA, 20 bp, mouse
gaatccaacaagaaggaatt

SEQ ID NO: 543223 - DNA, 20 bp, mouse
gccttcttgttggattgaca

SEQ ID NO: 543224 - DNA, 20 bp, mouse
ggagaacaacacatccacaa

SEQ ID NO: 543225 - DNA, 20 bp, mouse
gcacaaaggacaaatgactt

SEQ ID NO: 543226 - DNA, 20 bp, mouse
ggaaaacagacactatatta

SEQ ID NO: 543227 - DNA, 20 bp, mouse
gcataggactctgaagctgc

SEQ ID NO: 543228 - DNA, 20 bp, mouse
gctcgtggaggtttttattc

SEQ ID NO: 543229 - DNA, 20 bp, mouse
gattgctctggtgctcgtgg

SEQ ID NO: 543230 - DNA, 20 bp, mouse
gatggccacgtagcgatcga

SEQ ID NO: 543231 - DNA, 20 bp, mouse
gttcattgctctggtgctcg

SEQ ID NO: 543232 - DNA, 20 bp, mouse
gatggccttcgatcgctacg

SEQ ID NO: 543233 - DNA, 20 bp, mouse
gacaaggcgtcaggaactcc

SEQ ID NO: 543234 - DNA, 20 bp, mouse
gcggttacatctgtaaaatt

SEQ ID NO: 543235 - DNA, 20 bp, mouse
gccttcttgttggattgaca

SEQ ID NO: 543236 - DNA, 20 bp, mouse
gctctttctgctcattctag

SEQ ID NO: 543237 - DNA, 20 bp, mouse
gtgaccaccatatacagaag

SEQ ID NO: 543238 - DNA, 20 bp, mouse
gaatcctcttctgtatatgg

SEQ ID NO: 543239 - DNA, 20 bp, mouse
gtgtaatcctcttctgtata

SEQ ID NO: 543240 - DNA, 20 bp, mouse
gtcggtagcccccaagtttc

SEQ ID NO: 543241 - DNA, 20 bp, mouse
gctaatagaaattatcagtg

SEQ ID NO: 543242 - DNA, 20 bp, mouse
gagggatgatttcactaatc

SEQ ID NO: 543243 - DNA, 20 bp, mouse
gaacttgggggctaccgaag

SEQ ID NO: 543244 - DNA, 20 bp, mouse
gggagagtctccagaaactt

SEQ ID NO: 543245 - DNA, 20 bp, mouse
gatgatttcactaatcagga

SEQ ID NO: 543246 - DNA, 20 bp, mouse
gaggcatgaggaccacatag

SEQ ID NO: 543247 - DNA, 20 bp, mouse
gttgtacaatccatggctga

SEQ ID NO: 543248 - DNA, 20 bp, mouse
ggaaaaacttgtacaatcca

SEQ ID NO: 543249 - DNA, 20 bp, mouse
gactagaaacacagcaaaga

SEQ ID NO: 543250 - DNA, 20 bp, mouse
gtatttcagttcattcttga

SEQ ID NO: 543251 - DNA, 20 bp, mouse
ggaactgttaccttcagcca

SEQ ID NO: 543252 - DNA, 20 bp, mouse
ggtggggcttgcacaggcag

SEQ ID NO: 543253 - DNA, 20 bp, mouse
gttcactgtggggcttgcac

SEQ ID NO: 543254 - DNA, 20 bp, mouse
gtgaggaccacatagaggag

SEQ ID NO: 543255 - DNA, 20 bp, mouse
gagagggtgacctcaagctc

SEQ ID NO: 543256 - DNA, 20 bp, mouse
ggtcatctgtcaggcctacg

SEQ ID NO: 543257 - DNA, 20 bp, mouse
gtacatcagttcatcctcgt

SEQ ID NO: 543258 - DNA, 20 bp, mouse
gtaaacacttgtacagtcta

SEQ ID NO: 543259 - DNA, 20 bp, mouse
ggaggaccacatagagcaga

SEQ ID NO: 543260 - DNA, 20 bp, mouse
ggtggggcttgttcaggcag

SEQ ID NO: 543261 - DNA, 20 bp, mouse
gttcactgtggggcttgttc

SEQ ID NO: 543262 - DNA, 20 bp, mouse
gtggaaccctctgctctatg

SEQ ID NO: 543263 - DNA, 20 bp, mouse
ggaaagtttataattgtgct

SEQ ID NO: 543264 - DNA, 20 bp, mouse
gttgctagcacatacattta

SEQ ID NO: 543265 - DNA, 20 bp, mouse
gagaggatgacctcaagctc

SEQ ID NO: 543266 - DNA, 20 bp, mouse
ggagtaacatctatctacga

SEQ ID NO: 543267 - DNA, 20 bp, mouse
gcgaatcggcttctgaattt

SEQ ID NO: 543268 - DNA, 20 bp, mouse
gaagattcatgagtccgaat

SEQ ID NO: 543269 - DNA, 20 bp, mouse
gaagtcaataaaagccaggt

SEQ ID NO: 543270 - DNA, 20 bp, mouse
ggtgtttggagtgacagaag

SEQ ID NO: 543271 - DNA, 20 bp, mouse
gaggcatgcggaccgcatag

SEQ ID NO: 543272 - DNA, 20 bp, mouse
gagcttcaggtcagtctctt

SEQ ID NO: 543273 - DNA, 20 bp, mouse
gctagtgttgtgggtaatgt

SEQ ID NO: 543274 - DNA, 20 bp, mouse
gattacccacaacactagtt

SEQ ID NO: 543275 - DNA, 20 bp, mouse
gaataaaagccaggtgggtt

SEQ ID NO: 543276 - DNA, 20 bp, mouse
ggccaaaagcaaccattcag

SEQ ID NO: 543277 - DNA, 20 bp, mouse
ggcatttggcgtgacacagg

SEQ ID NO: 543278 - DNA, 20 bp, mouse
ggattagaaggattacaaag

SEQ ID NO: 543279 - DNA, 20 bp, mouse
ggtcatgagtaacctagggt

SEQ ID NO: 543280 - DNA, 20 bp, mouse
gtctgaatgcagagtctccg

SEQ ID NO: 543281 - DNA, 20 bp, mouse
gagcgcatttggcgtgacac

SEQ ID NO: 543282 - DNA, 20 bp, mouse
gtattaacacaaccaaccct

SEQ ID NO: 543283 - DNA, 20 bp, mouse
gtcagtgtcatgagtaacct

SEQ ID NO: 543284 - DNA, 20 bp, mouse
gtgagaatgacatagagcaa

SEQ ID NO: 543285 - DNA, 20 bp, mouse
ggtcttcctgctgtctgtaa

SEQ ID NO: 543286 - DNA, 20 bp, mouse
gaggaagctgtagctatagg

SEQ ID NO: 543287 - DNA, 20 bp, mouse
gcagctcctcgcgatctgtg

SEQ ID NO: 543288 - DNA, 20 bp, mouse
gttaggaccatatagagtag

SEQ ID NO: 543289 - DNA, 20 bp, mouse
gaccaggaagctgtagctat

SEQ ID NO: 543290 - DNA, 20 bp, mouse
gaaacactcagctgtcataa

SEQ ID NO: 543291 - DNA, 20 bp, mouse
ggcagattcctggggacatt

SEQ ID NO: 543292 - DNA, 20 bp, mouse
gtcacaacacttggcaacct

SEQ ID NO: 543293 - DNA, 20 bp, mouse
gatatggtcctaatgtcccc

SEQ ID NO: 543294 - DNA, 20 bp, mouse
gggcatgaaacagtgctacc

SEQ ID NO: 543295 - DNA, 20 bp, mouse
gtgcatctgttctaatgact

SEQ ID NO: 543296 - DNA, 20 bp, mouse
gtgtcagaaggtagataact

SEQ ID NO: 543297 - DNA, 20 bp, mouse
gtgaactcacaacttttaca

SEQ ID NO: 543298 - DNA, 20 bp, mouse
gacacaggatgaaacgacaa

SEQ ID NO: 543299 - DNA, 20 bp, mouse
gtacgaatgtgccactcagc

SEQ ID NO: 543300 - DNA, 20 bp, mouse
gaggaatcctcccagctgag

SEQ ID NO: 543301 - DNA, 20 bp, mouse
gtcagaccttccagaacttc

SEQ ID NO: 543302 - DNA, 20 bp, mouse
gtgacatgagataaatttct

SEQ ID NO: 543303 - DNA, 20 bp, mouse
gtgtcgctcacatacttcta

SEQ ID NO: 543304 - DNA, 20 bp, mouse
gaaagtggaacctgaagttc

SEQ ID NO: 543305 - DNA, 20 bp, mouse
gtgtgagcgacaccaacaga

SEQ ID NO: 543306 - DNA, 20 bp, mouse
gcatggcaggaaaagtacgt

SEQ ID NO: 543307 - DNA, 20 bp, mouse
gggcaggaaaagtacgttgg

SEQ ID NO: 543308 - DNA, 20 bp, mouse
ggtacgttgggggctggtac

SEQ ID NO: 543309 - DNA, 20 bp, mouse
gggaaaagtacgttgggggc

SEQ ID NO: 543310 - DNA, 20 bp, mouse
gctgatgggcaatctgggca

SEQ ID NO: 543311 - DNA, 20 bp, mouse
gtgggactcaccaacaaccc

SEQ ID NO: 543312 - DNA, 20 bp, mouse
gaaccacagtgcgaggatcc

SEQ ID NO: 543313 - DNA, 20 bp, mouse
ggacctggatcctcgcactg

SEQ ID NO: 543314 - DNA, 20 bp, mouse
ggctttgaggcctgggttgt

SEQ ID NO: 543315 - DNA, 20 bp, mouse
ggaaatccaaccacagtgcg

SEQ ID NO: 543316 - DNA, 20 bp, mouse
gaggttgtgtctccccatcg

SEQ ID NO: 543317 - DNA, 20 bp, mouse
gaaattcagtcaccactgta

SEQ ID NO: 543318 - DNA, 20 bp, mouse
gttggttattctacatccgt

SEQ ID NO: 543319 - DNA, 20 bp, mouse
gtttctaataaaccacgatg

SEQ ID NO: 543320 - DNA, 20 bp, mouse
gtttcactgataggaaactt

SEQ ID NO: 543321 - DNA, 20 bp, mouse
gaagttatgttgggtactag

SEQ ID NO: 543322 - DNA, 20 bp, mouse
gcaaatgtgcaataaagata

SEQ ID NO: 543323 - DNA, 20 bp, mouse
gatgtcacaaaagttatgtt

SEQ ID NO: 543324 - DNA, 20 bp, mouse
ggtgactgaatttgtcctga

SEQ ID NO: 543325 - DNA, 20 bp, mouse
gtctatctaatttcactgat

SEQ ID NO: 543326 - DNA, 20 bp, mouse
gtggcactgttgagttcctg

SEQ ID NO: 543327 - DNA, 20 bp, mouse
gtctgacaagaattacacac

SEQ ID NO: 543328 - DNA, 20 bp, mouse
gttgtcagaatgaattcatc

SEQ ID NO: 543329 - DNA, 20 bp, mouse
gtgaaggcgagagtccaact

SEQ ID NO: 543330 - DNA, 20 bp, mouse
gatgtagaatgccatctgca

SEQ ID NO: 543331 - DNA, 20 bp, mouse
gatgatggtaaattttgtgg

SEQ ID NO: 543332 - DNA, 20 bp, mouse
gcagagacgctgtcatgttc

SEQ ID NO: 543333 - DNA, 20 bp, mouse
ggtcatttaccccaagatga

SEQ ID NO: 543334 - DNA, 20 bp, mouse
gtattattttatcagacacc

SEQ ID NO: 543335 - DNA, 20 bp, mouse
gtatgcttgtgccgtgcaga

SEQ ID NO: 543336 - DNA, 20 bp, mouse
gggtgattgcatagatagtg

SEQ ID NO: 543337 - DNA, 20 bp, mouse
gttaattttggaacatccaa

SEQ ID NO: 543338 - DNA, 20 bp, mouse
gatgaagcatgccatttgtg

SEQ ID NO: 543339 - DNA, 20 bp, mouse
gtatgcttgtgccacacaaa

SEQ ID NO: 543340 - DNA, 20 bp, mouse
gtgaggaagactgcaaacag

SEQ ID NO: 543341 - DNA, 20 bp, mouse
gagtctgtgtgactcccatc

SEQ ID NO: 543342 - DNA, 20 bp, mouse
gcagttggcattgttatatt

SEQ ID NO: 543343 - DNA, 20 bp, mouse
gatcttggggcagatggcag

SEQ ID NO: 543344 - DNA, 20 bp, mouse
gtgtgtggcacaagcataat

SEQ ID NO: 543345 - DNA, 20 bp, mouse
gccaactgagttcatcctga

SEQ ID NO: 543346 - DNA, 20 bp, mouse
gtaattttagatcatccaat

SEQ ID NO: 543347 - DNA, 20 bp, mouse
gggtgattgcatagatagca

SEQ ID NO: 543348 - DNA, 20 bp, mouse
ggacgctgtcaagtgctcat

SEQ ID NO: 543349 - DNA, 20 bp, mouse
gtatgcttgtgccacacaga

SEQ ID NO: 543350 - DNA, 20 bp, mouse
gcaaggaagactgcaaacag

SEQ ID NO: 543351 - DNA, 20 bp, mouse
gactctgtgtgactcccatc

SEQ ID NO: 543352 - DNA, 20 bp, mouse
gcagttggcattgttatatt

SEQ ID NO: 543353 - DNA, 20 bp, mouse
gatcttggggcagatggcag

SEQ ID NO: 543354 - DNA, 20 bp, mouse
gtgtgtggcacaagcataat

SEQ ID NO: 543355 - DNA, 20 bp, mouse
ggcacaagcataataggtga

SEQ ID NO: 543356 - DNA, 20 bp, mouse
ggacagcaagaagccttcgg

SEQ ID NO: 543357 - DNA, 20 bp, mouse
gacaggcatctacaaatgat

SEQ ID NO: 543358 - DNA, 20 bp, mouse
gtcactgggtcagtcatagg

SEQ ID NO: 543359 - DNA, 20 bp, mouse
gttaccttgttagggaatct

SEQ ID NO: 543360 - DNA, 20 bp, mouse
gtacaaatgataggcaactg

SEQ ID NO: 543361 - DNA, 20 bp, mouse
ggagtgctggttaccaccga

SEQ ID NO: 543362 - DNA, 20 bp, mouse
gatgcccagattccctaaca

SEQ ID NO: 543363 - DNA, 20 bp, mouse
ggttaacaactgccacataa

SEQ ID NO: 543364 - DNA, 20 bp, mouse
gggacacagtatacagcaat

SEQ ID NO: 543365 - DNA, 20 bp, mouse
gcttctttcaaacctgagga

SEQ ID NO: 543366 - DNA, 20 bp, mouse
ggacggtgctgtagaggtac

SEQ ID NO: 543367 - DNA, 20 bp, mouse
gagcctggacggtgctgtag

SEQ ID NO: 543368 - DNA, 20 bp, mouse
gggctctactggtcaccagt

SEQ ID NO: 543369 - DNA, 20 bp, mouse
gttcagtgataataaacata

SEQ ID NO: 543370 - DNA, 20 bp, mouse
gagtcaaaatgatcataccc

SEQ ID NO: 543371 - DNA, 20 bp, mouse
gttttttatcttgtctgcaa

SEQ ID NO: 543372 - DNA, 20 bp, mouse
ggcacattcacagaaagaaa

SEQ ID NO: 543373 - DNA, 20 bp, mouse
gagcaccgtccaggctctac

SEQ ID NO: 543374 - DNA, 20 bp, mouse
ggactttgtcatgtgcttgt

SEQ ID NO: 543375 - DNA, 20 bp, mouse
gactgcatagatgatgaaga

SEQ ID NO: 543376 - DNA, 20 bp, mouse
gactgatgggcatcactgac

SEQ ID NO: 543377 - DNA, 20 bp, mouse
gtgagaaacaagccgaacaa

SEQ ID NO: 543378 - DNA, 20 bp, mouse
gaggttgcgtttctccatct

SEQ ID NO: 543379 - DNA, 20 bp, mouse
gagggtatgctgggtcctag

SEQ ID NO: 543380 - DNA, 20 bp, mouse
gtgcaatcgggagtccacca

SEQ ID NO: 543381 - DNA, 20 bp, mouse
gaatttgctctaagcctaga

SEQ ID NO: 543382 - DNA, 20 bp, mouse
ggaaataaggaactgccact

SEQ ID NO: 543383 - DNA, 20 bp, mouse
gtaatgacactatagaaata

SEQ ID NO: 543384 - DNA, 20 bp, mouse
gaggacccagcataccctat

SEQ ID NO: 543385 - DNA, 20 bp, mouse
gatctcactgttgggcaaca

SEQ ID NO: 543386 - DNA, 20 bp, mouse
gaggaagagtccaaataaag

SEQ ID NO: 543387 - DNA, 20 bp, mouse
gagagatcatgtatataatg

SEQ ID NO: 543388 - DNA, 20 bp, mouse
gtcagggagatctgtgattc

SEQ ID NO: 543389 - DNA, 20 bp, mouse
gaactgcaggcccctttatt

SEQ ID NO: 543390 - DNA, 20 bp, mouse
gaccaaatataggaaattgt

SEQ ID NO: 543391 - DNA, 20 bp, mouse
gtgaagtatttcattctaac

SEQ ID NO: 543392 - DNA, 20 bp, mouse
ggattgtgtacagtagtgga

SEQ ID NO: 543393 - DNA, 20 bp, mouse
gatttcctgagtagtctaga

SEQ ID NO: 543394 - DNA, 20 bp, mouse
ggacagaatgaaaacttcag

SEQ ID NO: 543395 - DNA, 20 bp, mouse
gtggactgagcaccaaatat

SEQ ID NO: 543396 - DNA, 20 bp, mouse
gtgaatgagttcatacttgt

SEQ ID NO: 543397 - DNA, 20 bp, mouse
gccttaccaagttggatgag

SEQ ID NO: 543398 - DNA, 20 bp, mouse
ggcaatcttcaaagcacact

SEQ ID NO: 543399 - DNA, 20 bp, mouse
ggctgtgggaccaaaaacgt

SEQ ID NO: 543400 - DNA, 20 bp, mouse
ggaaagaatagtacaaaaaa

SEQ ID NO: 543401 - DNA, 20 bp, mouse
ggaatgcacaccaattatag

SEQ ID NO: 543402 - DNA, 20 bp, mouse
gttttccatctagagagttc

SEQ ID NO: 543403 - DNA, 20 bp, mouse
gtgcaacctctcatccaact

SEQ ID NO: 543404 - DNA, 20 bp, mouse
gttcaaagcacactgggttc

SEQ ID NO: 543405 - DNA, 20 bp, mouse
ggcacaccaattatagggga

SEQ ID NO: 543406 - DNA, 20 bp, mouse
gaggaatcctccaagctgcg

SEQ ID NO: 543407 - DNA, 20 bp, mouse
gaatgtgccacgcagcttgg

SEQ ID NO: 543408 - DNA, 20 bp, mouse
ggccaaagttgatgatcgcc

SEQ ID NO: 543409 - DNA, 20 bp, mouse
gacggagttcatactcatgg

SEQ ID NO: 543410 - DNA, 20 bp, mouse
ggggaatctcactcatgtca

SEQ ID NO: 543411 - DNA, 20 bp, mouse
gtgaacatataatggcaaca

SEQ ID NO: 543412 - DNA, 20 bp, mouse
gtctgaccgtccagaactgc

SEQ ID NO: 543413 - DNA, 20 bp, mouse
ggtcacggagttcatactca

SEQ ID NO: 543414 - DNA, 20 bp, mouse
gacacaaggtgtcacaacaa

SEQ ID NO: 543415 - DNA, 20 bp, mouse
gagtgagaaacaccagcaga

SEQ ID NO: 543416 - DNA, 20 bp, mouse
gtaatggaggctgcagttca

SEQ ID NO: 543417 - DNA, 20 bp, mouse
gggaggctgcagttcagggc

SEQ ID NO: 543418 - DNA, 20 bp, mouse
gggaaaagtacaaataatgg

SEQ ID NO: 543419 - DNA, 20 bp, mouse
gggacttccataatcctgaa

SEQ ID NO: 543420 - DNA, 20 bp, mouse
gtctggagtccaccaaggta

SEQ ID NO: 543421 - DNA, 20 bp, mouse
gagatatcagatagattatg

SEQ ID NO: 543422 - DNA, 20 bp, mouse
gacctctctactacagacct

SEQ ID NO: 543423 - DNA, 20 bp, mouse
gggttctccattcaggatta

SEQ ID NO: 543424 - DNA, 20 bp, mouse
gaggttatggttctccattc

SEQ ID NO: 543425 - DNA, 20 bp, mouse
gtgaggaaaagtacaaataa

SEQ ID NO: 543426 - DNA, 20 bp, mouse
gcctcactggtcgataactt

SEQ ID NO: 543427 - DNA, 20 bp, mouse
gtggtacctgaaactcatgg

SEQ ID NO: 543428 - DNA, 20 bp, mouse
gtgcagcctggaatccacta

SEQ ID NO: 543429 - DNA, 20 bp, mouse
gatactgtagagatagggaa

SEQ ID NO: 543430 - DNA, 20 bp, mouse
gaaagatgattggatagcac

SEQ ID NO: 543431 - DNA, 20 bp, mouse
gcctggaatccactatggta

SEQ ID NO: 543432 - DNA, 20 bp, mouse
gctatccaatcatctttctt

SEQ ID NO: 543433 - DNA, 20 bp, mouse
gatgataatccttaccatag

SEQ ID NO: 543434 - DNA, 20 bp, mouse
gcaattatactgtagagata

SEQ ID NO: 543435 - DNA, 20 bp, mouse
gatcatttatctgacctcac

SEQ ID NO: 543436 - DNA, 20 bp, mouse
gacgcagctgggaggatttc

SEQ ID NO: 543437 - DNA, 20 bp, mouse
ggtatcagagatcttcatgc

SEQ ID NO: 543438 - DNA, 20 bp, mouse
gggaggatttctggttttca

SEQ ID NO: 543439 - DNA, 20 bp, mouse
gtatgaatgtgccacgcagc

SEQ ID NO: 543440 - DNA, 20 bp, mouse
gtcacggagttcatactcat

SEQ ID NO: 543441 - DNA, 20 bp, mouse
ggggaatctcactcatgtca

SEQ ID NO: 543442 - DNA, 20 bp, mouse
gtgaacatataatggcaaca

SEQ ID NO: 543443 - DNA, 20 bp, mouse
gactgaccgtccagaactgc

SEQ ID NO: 543444 - DNA, 20 bp, mouse
gacacaaggtgtcacaacaa

SEQ ID NO: 543445 - DNA, 20 bp, mouse
ggtggcacattcatagtata

SEQ ID NO: 543446 - DNA, 20 bp, mouse
gacaatgaggattgcagctc

SEQ ID NO: 543447 - DNA, 20 bp, mouse
gggcatgattgtccttacaa

SEQ ID NO: 543448 - DNA, 20 bp, mouse
gtgatttctctaattagaac

SEQ ID NO: 543449 - DNA, 20 bp, mouse
gcctggagtccaccattgta

SEQ ID NO: 543450 - DNA, 20 bp, mouse
gagttactactgtgcggttt

SEQ ID NO: 543451 - DNA, 20 bp, mouse
gtatcactggtgggaaattt

SEQ ID NO: 543452 - DNA, 20 bp, mouse
gtgaggattgcagctcaggg

SEQ ID NO: 543453 - DNA, 20 bp, mouse
gacaggctgtctcataaact

SEQ ID NO: 543454 - DNA, 20 bp, mouse
ggctgtctcataaactagga

SEQ ID NO: 543455 - DNA, 20 bp, mouse
gctcatctatctgatatcac

SEQ ID NO: 543456 - DNA, 20 bp, mouse
gttgtcttatgactgttatg

SEQ ID NO: 543457 - DNA, 20 bp, mouse
gaaagatgattggatatcac

SEQ ID NO: 543458 - DNA, 20 bp, mouse
gtgacatgatgacagtatag

SEQ ID NO: 543459 - DNA, 20 bp, mouse
gaccttgctactactgatct

SEQ ID NO: 543460 - DNA, 20 bp, mouse
gtttatctgacctcactgtt

SEQ ID NO: 543461 - DNA, 20 bp, mouse
ggagaaatataatctcacaa

SEQ ID NO: 543462 - DNA, 20 bp, mouse
gcccaagttgccaaacagtg

SEQ ID NO: 543463 - DNA, 20 bp, mouse
gcaattatactatagagata

SEQ ID NO: 543464 - DNA, 20 bp, mouse
gaccaagatcagtagtagca

SEQ ID NO: 543465 - DNA, 20 bp, mouse
gcatactaaagaaagatgat

SEQ ID NO: 543466 - DNA, 20 bp, mouse
gtcttactacagttcattat

SEQ ID NO: 543467 - DNA, 20 bp, mouse
gtttccaagggatcagatcg

SEQ ID NO: 543468 - DNA, 20 bp, mouse
gcaagggatcagatcggggt

SEQ ID NO: 543469 - DNA, 20 bp, mouse
gtgaactgtagtaagactcc

SEQ ID NO: 543470 - DNA, 20 bp, mouse
gaaatgggtagaacaggggg

SEQ ID NO: 543471 - DNA, 20 bp, mouse
gattagaaatgggtagaaca

SEQ ID NO: 543472 - DNA, 20 bp, mouse
ggcccagcaagtagagacag

SEQ ID NO: 543473 - DNA, 20 bp, mouse
gagaggaaaatattaaagag

SEQ ID NO: 543474 - DNA, 20 bp, mouse
gttccagtgacccagagaaa

SEQ ID NO: 543475 - DNA, 20 bp, mouse
gctcagtcagctctcactag

SEQ ID NO: 543476 - DNA, 20 bp, mouse
gaaaagagtatgttggctcc

SEQ ID NO: 543477 - DNA, 20 bp, mouse
ggaattactcataaatctga

SEQ ID NO: 543478 - DNA, 20 bp, mouse
gagagtatgttggctcctgg

SEQ ID NO: 543479 - DNA, 20 bp, mouse
gcatactgaagaaagacaat

SEQ ID NO: 543480 - DNA, 20 bp, mouse
gaaggtatgggattgccacc

SEQ ID NO: 543481 - DNA, 20 bp, mouse
gtggggcctgcagttcaggg

SEQ ID NO: 543482 - DNA, 20 bp, mouse
ggtctgcaatgtcttatgac

SEQ ID NO: 543483 - DNA, 20 bp, mouse
gtatgtcaaaaagagtatgt

SEQ ID NO: 543484 - DNA, 20 bp, mouse
gatcatttatctgatcacac

SEQ ID NO: 543485 - DNA, 20 bp, mouse
gatttatctgatcacactgg

SEQ ID NO: 543486 - DNA, 20 bp, mouse
ggcggtcagtgatgcccctg

SEQ ID NO: 543487 - DNA, 20 bp, mouse
gtgcagccttgattccacta

SEQ ID NO: 543488 - DNA, 20 bp, mouse
gagtcactactgtgaggttt

SEQ ID NO: 543489 - DNA, 20 bp, mouse
ggtttttgaatgaatgcaga

SEQ ID NO: 543490 - DNA, 20 bp, mouse
gaccaagatctgtgatagct

SEQ ID NO: 543491 - DNA, 20 bp, mouse
gatgtcacaaactgtatgtt

SEQ ID NO: 543492 - DNA, 20 bp, mouse
gacctagctatcacagatct

SEQ ID NO: 543493 - DNA, 20 bp, mouse
gagaaataaatacactgtaa

SEQ ID NO: 543494 - DNA, 20 bp, mouse
gcctcaccatagtggaatca

SEQ ID NO: 543495 - DNA, 20 bp, mouse
gagtgactgaatttatcctc

SEQ ID NO: 543496 - DNA, 20 bp, mouse
gtacatatgatgaaatgaca

SEQ ID NO: 543497 - DNA, 20 bp, mouse
ggaaacacattgggaaatga

SEQ ID NO: 543498 - DNA, 20 bp, mouse
gttagtgtctcactatctgg

SEQ ID NO: 543499 - DNA, 20 bp, mouse
gtaggtcgcaatgtttgtat

SEQ ID NO: 543500 - DNA, 20 bp, mouse
gcccatgctaagaaacacat

SEQ ID NO: 543501 - DNA, 20 bp, mouse
gtcatttcatcatatgtatg

SEQ ID NO: 543502 - DNA, 20 bp, mouse
gaaggcagcattttcacaat

SEQ ID NO: 543503 - DNA, 20 bp, mouse
gttgagagggcaaaagctac

SEQ ID NO: 543504 - DNA, 20 bp, mouse
gatttttactgaagttgaga

SEQ ID NO: 543505 - DNA, 20 bp, mouse
gttgttagtgtctcactatc

SEQ ID NO: 543506 - DNA, 20 bp, mouse
gtcccagcaagtaaagacct

SEQ ID NO: 543507 - DNA, 20 bp, mouse
gttctctgggtagtcccaag

SEQ ID NO: 543508 - DNA, 20 bp, mouse
ggacctggtcccttgtcaat

SEQ ID NO: 543509 - DNA, 20 bp, mouse
gttacttgctgggactttta

SEQ ID NO: 543510 - DNA, 20 bp, mouse
gacttctttatcatcttcct

SEQ ID NO: 543511 - DNA, 20 bp, mouse
gaaagaaatacaattgagtc

SEQ ID NO: 543512 - DNA, 20 bp, mouse
gagaagtgctgccacttctc

SEQ ID NO: 543513 - DNA, 20 bp, mouse
gaccaagtctccagtgtttt

SEQ ID NO: 543514 - DNA, 20 bp, mouse
gctgactgcagttcatcctt

SEQ ID NO: 543515 - DNA, 20 bp, mouse
gacccagagaaccagagaag

SEQ ID NO: 543516 - DNA, 20 bp, mouse
gtagaacccaacatacttta

SEQ ID NO: 543517 - DNA, 20 bp, mouse
gatgtcccataaagtatgtt

SEQ ID NO: 543518 - DNA, 20 bp, mouse
gaatatttatggtgactaca

SEQ ID NO: 543519 - DNA, 20 bp, mouse
ggttctcagtgattcccatc

SEQ ID NO: 543520 - DNA, 20 bp, mouse
ggaattcagtcacaactgtt

SEQ ID NO: 543521 - DNA, 20 bp, mouse
gtgtgtagcacaaagagagt

SEQ ID NO: 543522 - DNA, 20 bp, mouse
gattgccaatcactgaggtc

SEQ ID NO: 543523 - DNA, 20 bp, mouse
gtgtagcttggcgtctacat

SEQ ID NO: 543524 - DNA, 20 bp, mouse
gactgagaaccctgagctgc

SEQ ID NO: 543525 - DNA, 20 bp, mouse
gccaagattgccaatcactg

SEQ ID NO: 543526 - DNA, 20 bp, mouse
gtctgaggacatctcatcac

SEQ ID NO: 543527 - DNA, 20 bp, mouse
gtttgtgttatcagtatcta

SEQ ID NO: 543528 - DNA, 20 bp, mouse
ggtgtttgaaggatattaca

SEQ ID NO: 543529 - DNA, 20 bp, mouse
ggttcagtcaggaaagaata

SEQ ID NO: 543530 - DNA, 20 bp, mouse
gtaacttaagttgatagaga

SEQ ID NO: 543531 - DNA, 20 bp, mouse
gacaatgcttaagtgtttga

SEQ ID NO: 543532 - DNA, 20 bp, mouse
gattcatgggtgaagttctg

SEQ ID NO: 543533 - DNA, 20 bp, mouse
ggacatctcatcacaggtaa

SEQ ID NO: 543534 - DNA, 20 bp, mouse
gcacaggtaagggatgcagc

SEQ ID NO: 543535 - DNA, 20 bp, mouse
ggatatttaaagataaaaat

SEQ ID NO: 543536 - DNA, 20 bp, mouse
gatgtcacataaagtatgtt

SEQ ID NO: 543537 - DNA, 20 bp, mouse
ggttctcagtgattcccatc

SEQ ID NO: 543538 - DNA, 20 bp, mouse
ggaattcagtcacaactgtt

SEQ ID NO: 543539 - DNA, 20 bp, mouse
gtgtgtagcacaaagagagt

SEQ ID NO: 543540 - DNA, 20 bp, mouse
gattgccaatcactgaggtc

SEQ ID NO: 543541 - DNA, 20 bp, mouse
ggccaatgtatttctttctt

SEQ ID NO: 543542 - DNA, 20 bp, mouse
gtgtagcttggcgtctacat

SEQ ID NO: 543543 - DNA, 20 bp, mouse
gactgagaaccctgagctgc

SEQ ID NO: 543544 - DNA, 20 bp, mouse
gccaagattgccaatcactg

SEQ ID NO: 543545 - DNA, 20 bp, mouse
gcaggttttctgatagagaa

SEQ ID NO: 543546 - DNA, 20 bp, mouse
gactgaggacatctcattac

SEQ ID NO: 543547 - DNA, 20 bp, mouse
gtttatgttatcagtgtcta

SEQ ID NO: 543548 - DNA, 20 bp, mouse
ggtttttacttctaatatat

SEQ ID NO: 543549 - DNA, 20 bp, mouse
gatccttctctgtcaactta

SEQ ID NO: 543550 - DNA, 20 bp, mouse
ggacatctcattacaggtaa

SEQ ID NO: 543551 - DNA, 20 bp, mouse
ggatagtcaaagataaaaat

SEQ ID NO: 543552 - DNA, 20 bp, mouse
gattcatgggtgaagtactg

SEQ ID NO: 543553 - DNA, 20 bp, mouse
gtacaggtaagggatgcagc

SEQ ID NO: 543554 - DNA, 20 bp, mouse
gtgttcagtcaggaaagaat

SEQ ID NO: 543555 - DNA, 20 bp, mouse
gttatcagtgtctatggaaa

SEQ ID NO: 543556 - DNA, 20 bp, mouse
ggtcatctacctgacctcag

SEQ ID NO: 543557 - DNA, 20 bp, mouse
gcattgcagacaaaataaaa

SEQ ID NO: 543558 - DNA, 20 bp, mouse
gccaagattgccaaccactg

SEQ ID NO: 543559 - DNA, 20 bp, mouse
ggaagacctgtcatcagcag

SEQ ID NO: 543560 - DNA, 20 bp, mouse
gaccaatgtatttctttctt

SEQ ID NO: 543561 - DNA, 20 bp, mouse
ggaattcagtcacaactgtt

SEQ ID NO: 543562 - DNA, 20 bp, mouse
ggttctcagtgattcccatc

SEQ ID NO: 543563 - DNA, 20 bp, mouse
gggtgtagcacaaagagagt

SEQ ID NO: 543564 - DNA, 20 bp, mouse
gattgccaaccactgaggtc

SEQ ID NO: 543565 - DNA, 20 bp, mouse
gtgtagcttggcgtctacat

SEQ ID NO: 543566 - DNA, 20 bp, mouse
gtgaagagcagcccaaagag

SEQ ID NO: 543567 - DNA, 20 bp, mouse
gagctgcaggccccactctt

SEQ ID NO: 543568 - DNA, 20 bp, mouse
gtgagtgaattcattttgaa

SEQ ID NO: 543569 - DNA, 20 bp, mouse
ggatgacagtatagagaaga

SEQ ID NO: 543570 - DNA, 20 bp, mouse
gaatctgaactatacctgca

SEQ ID NO: 543571 - DNA, 20 bp, mouse
gatctatctgatctcagcag

SEQ ID NO: 543572 - DNA, 20 bp, mouse
gaaatacactgtagatatat

SEQ ID NO: 543573 - DNA, 20 bp, mouse
gttggatattctacagccat

SEQ ID NO: 543574 - DNA, 20 bp, mouse
gatatgttgggtacttgtgg

SEQ ID NO: 543575 - DNA, 20 bp, mouse
gactaacatttttggtccaa

SEQ ID NO: 543576 - DNA, 20 bp, mouse
ggaagaaggaaaggatctcc

SEQ ID NO: 543577 - DNA, 20 bp, mouse
gtcacagaatttatactgat

SEQ ID NO: 543578 - DNA, 20 bp, mouse
ggaatagcaggcgtctactg

SEQ ID NO: 543579 - DNA, 20 bp, mouse
ggtgataacagtagaatagc

SEQ ID NO: 543580 - DNA, 20 bp, mouse
ggctcactacatacataaga

SEQ ID NO: 543581 - DNA, 20 bp, mouse
gtttacagacaatgctgacc

SEQ ID NO: 543582 - DNA, 20 bp, mouse
gaaagtcaactaccatttgt

SEQ ID NO: 543583 - DNA, 20 bp, mouse
gcatgctgttattcacacgg

SEQ ID NO: 543584 - DNA, 20 bp, mouse
gtacatgggattgtgcaggc

SEQ ID NO: 543585 - DNA, 20 bp, mouse
gtacataagagggttgtgaa

SEQ ID NO: 543586 - DNA, 20 bp, mouse
ggctgtgggacctaagatgt

SEQ ID NO: 543587 - DNA, 20 bp, mouse
gatgatcattctaaccacag

SEQ ID NO: 543588 - DNA, 20 bp, mouse
gattttcttataaaaactaa

SEQ ID NO: 543589 - DNA, 20 bp, mouse
gaaatgtgcagtacaaatag

SEQ ID NO: 543590 - DNA, 20 bp, mouse
gaccaaggtctgtgatagcc

SEQ ID NO: 543591 - DNA, 20 bp, mouse
gtctacttgagctcaatgtt

SEQ ID NO: 543592 - DNA, 20 bp, mouse
gatgtcgcaaagggtgtgtc

SEQ ID NO: 543593 - DNA, 20 bp, mouse
gcatgatgacagtgtagagg

SEQ ID NO: 543594 - DNA, 20 bp, mouse
gcaaagggtgtgtcaggtgc

SEQ ID NO: 543595 - DNA, 20 bp, mouse
gcactgtcatcatgtcgcaa

SEQ ID NO: 543596 - DNA, 20 bp, mouse
gccgattagtgatgcctatc

SEQ ID NO: 543597 - DNA, 20 bp, mouse
gtgaaagatttcatcctgat

SEQ ID NO: 543598 - DNA, 20 bp, mouse
gactaatcggcctgagctga

SEQ ID NO: 543599 - DNA, 20 bp, mouse
gatttactaatatgactgca

SEQ ID NO: 543600 - DNA, 20 bp, mouse
gatgatcatactcacaatag

SEQ ID NO: 543601 - DNA, 20 bp, mouse
gtagtaattgcttatctgta

SEQ ID NO: 543602 - DNA, 20 bp, mouse
gtctatctgatctcattaat

SEQ ID NO: 543603 - DNA, 20 bp, mouse
gacaatggacccttcagctc

SEQ ID NO: 543604 - DNA, 20 bp, mouse
gacttggctgtcactgatct

SEQ ID NO: 543605 - DNA, 20 bp, mouse
ggacaaaataaaaagctcac

SEQ ID NO: 543606 - DNA, 20 bp, mouse
gatggagaactccacttcag

SEQ ID NO: 543607 - DNA, 20 bp, mouse
gagtggagttctccatcact

SEQ ID NO: 543608 - DNA, 20 bp, mouse
ggttctccatcactaggtag

SEQ ID NO: 543609 - DNA, 20 bp, mouse
gggctgcagcttttgaacac

SEQ ID NO: 543610 - DNA, 20 bp, mouse
gagaaactcatccactgaag

SEQ ID NO: 543611 - DNA, 20 bp, mouse
gggccctacgcctcgagaga

SEQ ID NO: 543612 - DNA, 20 bp, mouse
ggaaggttgatgagaacctt

SEQ ID NO: 543613 - DNA, 20 bp, mouse
ggagctgagtgatgcagcct

SEQ ID NO: 543614 - DNA, 20 bp, mouse
ggatagcagtgtagcgaagt

SEQ ID NO: 543615 - DNA, 20 bp, mouse
gctggatatttgttactcat

SEQ ID NO: 543616 - DNA, 20 bp, mouse
gtggggcctgcaattcagag

SEQ ID NO: 543617 - DNA, 20 bp, mouse
ggtggtcactgatacccatt

SEQ ID NO: 543618 - DNA, 20 bp, mouse
gcaaggaacagcccaaataa

SEQ ID NO: 543619 - DNA, 20 bp, mouse
gaccattgaggtcatgtata

SEQ ID NO: 543620 - DNA, 20 bp, mouse
ggccatatacatgacctcaa

SEQ ID NO: 543621 - DNA, 20 bp, mouse
gattgcaggccccattattt

SEQ ID NO: 543622 - DNA, 20 bp, mouse
gcaaatgtgcagtagagata

SEQ ID NO: 543623 - DNA, 20 bp, mouse
gagaaagaaagctagttgtg

SEQ ID NO: 543624 - DNA, 20 bp, mouse
gatcattgttctcaccacag

SEQ ID NO: 543625 - DNA, 20 bp, mouse
gatgtcccaaaaactatgtt

SEQ ID NO: 543626 - DNA, 20 bp, mouse
gcttcagtcatgttctttaa

SEQ ID NO: 543627 - DNA, 20 bp, mouse
gcaggaaagacaaaacactt

SEQ ID NO: 543628 - DNA, 20 bp, mouse
gggccactgtatacagaagt

SEQ ID NO: 543629 - DNA, 20 bp, mouse
gtgtagaatagcaagcatcc

SEQ ID NO: 543630 - DNA, 20 bp, mouse
gtgagtggcaggtatactct

SEQ ID NO: 543631 - DNA, 20 bp, mouse
gaggtatactctgggtgaca

SEQ ID NO: 543632 - DNA, 20 bp, mouse
gtttatctcttcactctggt

SEQ ID NO: 543633 - DNA, 20 bp, mouse
gctggtaggaaactttggac

SEQ ID NO: 543634 - DNA, 20 bp, mouse
gtttggtcattggggattgt

SEQ ID NO: 543635 - DNA, 20 bp, mouse
ggttgttacacccaaaatgt

SEQ ID NO: 543636 - DNA, 20 bp, mouse
gaagcccaaggatgtgatag

SEQ ID NO: 543637 - DNA, 20 bp, mouse
gttactctcataggcaactt

SEQ ID NO: 543638 - DNA, 20 bp, mouse
gatcttcggagtgacaacgg

SEQ ID NO: 543639 - DNA, 20 bp, mouse
ggtgacaacggtggaataac

SEQ ID NO: 543640 - DNA, 20 bp, mouse
gttcttcgtacagtgtaacc

SEQ ID NO: 543641 - DNA, 20 bp, mouse
gatgtccactatcacatcct

SEQ ID NO: 543642 - DNA, 20 bp, mouse
gggtggaataacaggcatct

SEQ ID NO: 543643 - DNA, 20 bp, mouse
gaacatcttcggagtgacaa

SEQ ID NO: 543644 - DNA, 20 bp, mouse
gcatctctgttacacaacca

SEQ ID NO: 543645 - DNA, 20 bp, mouse
ggcttgtcattggagattcc

SEQ ID NO: 543646 - DNA, 20 bp, mouse
gtacagtagtgggtcgtgaa

SEQ ID NO: 543647 - DNA, 20 bp, mouse
gtacaaaagacaatgcactg

SEQ ID NO: 543648 - DNA, 20 bp, mouse
gatttcctattagagtaaaa

SEQ ID NO: 543649 - DNA, 20 bp, mouse
gtcactccaaatatgttagt

SEQ ID NO: 543650 - DNA, 20 bp, mouse
gtttacctttttactctaat

SEQ ID NO: 543651 - DNA, 20 bp, mouse
gtctgtgatgtttttcatat

SEQ ID NO: 543652 - DNA, 20 bp, mouse
gagtaaaaaggtaaattgct

SEQ ID NO: 543653 - DNA, 20 bp, mouse
gaaggtaaattgctaggaag

SEQ ID NO: 543654 - DNA, 20 bp, mouse
ggctcactgcatacagtagt

SEQ ID NO: 543655 - DNA, 20 bp, mouse
gtgagtggtaaatagactcg

SEQ ID NO: 543656 - DNA, 20 bp, mouse
gtgaattcactatttttcct

SEQ ID NO: 543657 - DNA, 20 bp, mouse
gtatagaggaaatctactaa

SEQ ID NO: 543658 - DNA, 20 bp, mouse
gcatgaaaatgctgtagtat

SEQ ID NO: 543659 - DNA, 20 bp, mouse
ggtttgcttattcttaactt

SEQ ID NO: 543660 - DNA, 20 bp, mouse
gcatcgtacaaattttattc

SEQ ID NO: 543661 - DNA, 20 bp, mouse
gttttagaaaatattgattt

SEQ ID NO: 543662 - DNA, 20 bp, mouse
gtaatagtttctggaatctt

SEQ ID NO: 543663 - DNA, 20 bp, mouse
gtgattaaatttatattccc

SEQ ID NO: 543664 - DNA, 20 bp, mouse
gttgactgttaaaagttttt

SEQ ID NO: 543665 - DNA, 20 bp, mouse
gattcagaaagatgcagtaa

SEQ ID NO: 543666 - DNA, 20 bp, mouse
gaacctgagttcatgcttgt

SEQ ID NO: 543667 - DNA, 20 bp, mouse
ggaactcaggttcatttgta

SEQ ID NO: 543668 - DNA, 20 bp, mouse
ggtgcttaaccaaaagacag

SEQ ID NO: 543669 - DNA, 20 bp, mouse
gggttcatttgtagggttac

SEQ ID NO: 543670 - DNA, 20 bp, mouse
gtctatagctccaacgatgt

SEQ ID NO: 543671 - DNA, 20 bp, mouse
gcattcagaacctgctaaga

SEQ ID NO: 543672 - DNA, 20 bp, mouse
gaaccaaaagacagtggcag

SEQ ID NO: 543673 - DNA, 20 bp, mouse
gtcactgtgtcctacatcgt

SEQ ID NO: 543674 - DNA, 20 bp, mouse
ggtcccacaagcatgaactc

SEQ ID NO: 543675 - DNA, 20 bp, mouse
ggacagtgagcatgtatatc

SEQ ID NO: 543676 - DNA, 20 bp, mouse
gaatagaggaaatctactca

SEQ ID NO: 543677 - DNA, 20 bp, mouse
gggagacataagttctatta

SEQ ID NO: 543678 - DNA, 20 bp, mouse
gttataaaaatcattgattt

SEQ ID NO: 543679 - DNA, 20 bp, mouse
gtatgcaggtctcagtcaga

SEQ ID NO: 543680 - DNA, 20 bp, mouse
gcactgaacaaaatttatgc

SEQ ID NO: 543681 - DNA, 20 bp, mouse
gttgacagttgaaaaatttt

SEQ ID NO: 543682 - DNA, 20 bp, mouse
gaattttcaaaaaataatag

SEQ ID NO: 543683 - DNA, 20 bp, mouse
gaagtattcttaaaatttga

SEQ ID NO: 543684 - DNA, 20 bp, mouse
gattcagaaagatacagtga

SEQ ID NO: 543685 - DNA, 20 bp, mouse
gttattgttaatgggattga

SEQ ID NO: 543686 - DNA, 20 bp, mouse
ggtcccatgaggatgaaatc

SEQ ID NO: 543687 - DNA, 20 bp, mouse
gcacatatgacccagtaagg

SEQ ID NO: 543688 - DNA, 20 bp, mouse
gaaacacatatgacccagta

SEQ ID NO: 543689 - DNA, 20 bp, mouse
gacactcagtagctgccaaa

SEQ ID NO: 543690 - DNA, 20 bp, mouse
gataggccattgaagacaaa

SEQ ID NO: 543691 - DNA, 20 bp, mouse
gctgtagtgccctccttact

SEQ ID NO: 543692 - DNA, 20 bp, mouse
ggcaagttttctaaagtttt

SEQ ID NO: 543693 - DNA, 20 bp, mouse
gggactgacagattccaagg

SEQ ID NO: 543694 - DNA, 20 bp, mouse
gcaggagaaaaagcacagat

SEQ ID NO: 543695 - DNA, 20 bp, mouse
ggatgacagtagagtaactg

SEQ ID NO: 543696 - DNA, 20 bp, mouse
gagagtggaaactccagcca

SEQ ID NO: 543697 - DNA, 20 bp, mouse
gcaggcgagtttgttctctt

SEQ ID NO: 543698 - DNA, 20 bp, mouse
gacctgtcgaaggacatgac

SEQ ID NO: 543699 - DNA, 20 bp, mouse
gggatacagccgccaactga

SEQ ID NO: 543700 - DNA, 20 bp, mouse
ggtgcataatgactgagtaa

SEQ ID NO: 543701 - DNA, 20 bp, mouse
gtaatgactgagtaatggag

SEQ ID NO: 543702 - DNA, 20 bp, mouse
gtaagtttaccagcatttgt

SEQ ID NO: 543703 - DNA, 20 bp, mouse
gactggcagtagaacacact

SEQ ID NO: 543704 - DNA, 20 bp, mouse
gtaatggagaggccgacata

SEQ ID NO: 543705 - DNA, 20 bp, mouse
gggtaaacttacgcagcatt

SEQ ID NO: 543706 - DNA, 20 bp, mouse
gtctcttaagagcagtccta

SEQ ID NO: 543707 - DNA, 20 bp, mouse
gggcactcttagattctcca

SEQ ID NO: 543708 - DNA, 20 bp, mouse
gaggaaggcataagggccag

SEQ ID NO: 543709 - DNA, 20 bp, mouse
ggtgcaaactgggggacagg

SEQ ID NO: 543710 - DNA, 20 bp, mouse
gttctgtcccaaaatgtgag

SEQ ID NO: 543711 - DNA, 20 bp, mouse
gggatgtttgtgcaaactgg

SEQ ID NO: 543712 - DNA, 20 bp, mouse
gagttaatctctaaaagtat

SEQ ID NO: 543713 - DNA, 20 bp, mouse
gcattttgggacagaaagtt

SEQ ID NO: 543714 - DNA, 20 bp, mouse
ggtcccaaaatgtgagaggc

SEQ ID NO: 543715 - DNA, 20 bp, mouse
gaatgcagaaaacagtcagg

SEQ ID NO: 543716 - DNA, 20 bp, mouse
gagttgagtaactgagatcg

SEQ ID NO: 543717 - DNA, 20 bp, mouse
gtgataactgggtattgtaa

SEQ ID NO: 543718 - DNA, 20 bp, mouse
gtcttgtggacatgataact

SEQ ID NO: 543719 - DNA, 20 bp, mouse
gtgagtgaaacaaccaataa

SEQ ID NO: 543720 - DNA, 20 bp, mouse
gtcactgtgctggggaacgc

SEQ ID NO: 543721 - DNA, 20 bp, mouse
gtccatagttccaatcatat

SEQ ID NO: 543722 - DNA, 20 bp, mouse
gttcgttcacaatgaacacc

SEQ ID NO: 543723 - DNA, 20 bp, mouse
gcatataggaaccagtgaga

SEQ ID NO: 543724 - DNA, 20 bp, mouse
gatacaaaatatattaacag

SEQ ID NO: 543725 - DNA, 20 bp, mouse
gtcctatatgattggaacta

SEQ ID NO: 543726 - DNA, 20 bp, mouse
ggctgtctgagacttcagca

SEQ ID NO: 543727 - DNA, 20 bp, mouse
gaagttcagcattgtctgtg

SEQ ID NO: 543728 - DNA, 20 bp, mouse
gtgagtgacatgtagactct

SEQ ID NO: 543729 - DNA, 20 bp, mouse
ggtgtctcttttcatcctga

SEQ ID NO: 543730 - DNA, 20 bp, mouse
gtgcaaaataccaccaacat

SEQ ID NO: 543731 - DNA, 20 bp, mouse
gacctagaaaatagtacatt

SEQ ID NO: 543732 - DNA, 20 bp, mouse
ggactgatctcagtagtcat

SEQ ID NO: 543733 - DNA, 20 bp, mouse
gtcattgcctccaatgttgg

SEQ ID NO: 543734 - DNA, 20 bp, mouse
gtaaaatctattagcatttt

SEQ ID NO: 543735 - DNA, 20 bp, mouse
gcatctgtgctacacatcca

SEQ ID NO: 543736 - DNA, 20 bp, mouse
gtcgtatatgacggagtcct

SEQ ID NO: 543737 - DNA, 20 bp, mouse
gacgaatacaaaaactacac

SEQ ID NO: 543738 - DNA, 20 bp, mouse
gtttttgtattcgtatatga

SEQ ID NO: 543739 - DNA, 20 bp, mouse
gattggtcatcgaggattca

SEQ ID NO: 543740 - DNA, 20 bp, mouse
gtaactctgattggaaatct

SEQ ID NO: 543741 - DNA, 20 bp, mouse
ggcagtaagaatgtctccaa

SEQ ID NO: 543742 - DNA, 20 bp, mouse
ggttagtactgaagaaaagc

SEQ ID NO: 543743 - DNA, 20 bp, mouse
gctgattggaaatctaggtt

SEQ ID NO: 543744 - DNA, 20 bp, mouse
gtatatgttgtaactctgat

SEQ ID NO: 543745 - DNA, 20 bp, mouse
ggctgtagattgccaaataa

SEQ ID NO: 543746 - DNA, 20 bp, mouse
gtgacagtcttcatgttcag

SEQ ID NO: 543747 - DNA, 20 bp, mouse
gtaatcacagaatatagtaa

SEQ ID NO: 543748 - DNA, 20 bp, mouse
gcagaaggtgtgcaactggc

SEQ ID NO: 543749 - DNA, 20 bp, mouse
gaaggatattgatttctgtg

SEQ ID NO: 543750 - DNA, 20 bp, mouse
gcagtaataccatacatgat

SEQ ID NO: 543751 - DNA, 20 bp, mouse
gacagactgacttgtaattc

SEQ ID NO: 543752 - DNA, 20 bp, mouse
gggaaatcaactactgcctt

SEQ ID NO: 543753 - DNA, 20 bp, mouse
gataagccatggatcccaga

SEQ ID NO: 543754 - DNA, 20 bp, mouse
gttgtgaagcctatcatgta

SEQ ID NO: 543755 - DNA, 20 bp, mouse
ggtcccagaaggtgtgcaac

SEQ ID NO: 543756 - DNA, 20 bp, mouse
gtataaaggagtcacatcaa

SEQ ID NO: 543757 - DNA, 20 bp, mouse
gagggtcctcggtcagaccc

SEQ ID NO: 543758 - DNA, 20 bp, mouse
gatcctcctgggtctgaccg

SEQ ID NO: 543759 - DNA, 20 bp, mouse
ggagtacagtattcagtaca

SEQ ID NO: 543760 - DNA, 20 bp, mouse
ggtattcagtacagggtcct

SEQ ID NO: 543761 - DNA, 20 bp, mouse
gaaatccaaaaaagccaagt

SEQ ID NO: 543762 - DNA, 20 bp, mouse
gcaaggtagatgcaaaacgt

SEQ ID NO: 543763 - DNA, 20 bp, mouse
gctcaagtgggtaagtgagt

SEQ ID NO: 543764 - DNA, 20 bp, mouse
gatggcaagataccgatcat

SEQ ID NO: 543765 - DNA, 20 bp, mouse
ggtcaggaacatgttgacaa

SEQ ID NO: 543766 - DNA, 20 bp, mouse
gaccaagacatacaattaca

SEQ ID NO: 543767 - DNA, 20 bp, mouse
gacgatctgtcagtcccaaa

SEQ ID NO: 543768 - DNA, 20 bp, mouse
gagaagttcagtagcaatgt

SEQ ID NO: 543769 - DNA, 20 bp, mouse
gaacgaaggaagtggtacat

SEQ ID NO: 543770 - DNA, 20 bp, mouse
gacagatcgtgatgaactta

SEQ ID NO: 543771 - DNA, 20 bp, mouse
gggaaatgacatagatcaaa

SEQ ID NO: 543772 - DNA, 20 bp, mouse
ggccatgtaattgtatgtct

SEQ ID NO: 543773 - DNA, 20 bp, mouse
gatgcatgcagaaaatgaga

SEQ ID NO: 543774 - DNA, 20 bp, mouse
gaacaaatgacagagaacga

SEQ ID NO: 543775 - DNA, 20 bp, mouse
gtaagttagtgggtttacaa

SEQ ID NO: 543776 - DNA, 20 bp, mouse
gaatgatgactctcagatcc

SEQ ID NO: 543777 - DNA, 20 bp, mouse
gagagtttggaatcatacag

SEQ ID NO: 543778 - DNA, 20 bp, mouse
gtttacatctcatgataaca

SEQ ID NO: 543779 - DNA, 20 bp, mouse
gacctaaaaatatttcttcc

SEQ ID NO: 543780 - DNA, 20 bp, mouse
gtattgaaaatatgagagtt

SEQ ID NO: 543781 - DNA, 20 bp, mouse
gcagtatacataactacaga

SEQ ID NO: 543782 - DNA, 20 bp, mouse
gtcaaggaattcatgctcct

SEQ ID NO: 543783 - DNA, 20 bp, mouse
ggtttgcgattgccacataa

SEQ ID NO: 543784 - DNA, 20 bp, mouse
ggtgtatctcatcatacttg

SEQ ID NO: 543785 - DNA, 20 bp, mouse
gtcctggaagaaatattttt

SEQ ID NO: 543786 - DNA, 20 bp, mouse
gcttaacagaaaatcccgat

SEQ ID NO: 543787 - DNA, 20 bp, mouse
gtgaaggaattcatactcct

SEQ ID NO: 543788 - DNA, 20 bp, mouse
gagagaggaatctgccaatc

SEQ ID NO: 543789 - DNA, 20 bp, mouse
gaactgaaaccatggaccca

SEQ ID NO: 543790 - DNA, 20 bp, mouse
ggtatgattccctgggtcca

SEQ ID NO: 543791 - DNA, 20 bp, mouse
gtcacaactgtatgattccc

SEQ ID NO: 543792 - DNA, 20 bp, mouse
gttcttgcatgttacttgtg

SEQ ID NO: 543793 - DNA, 20 bp, mouse
gacaataagtctactgagac

SEQ ID NO: 543794 - DNA, 20 bp, mouse
ggggaatgatcttcttgatc

SEQ ID NO: 543795 - DNA, 20 bp, mouse
ggacaggaggatgacttctg

SEQ ID NO: 543796 - DNA, 20 bp, mouse
gagcctcatgctggacatgt

SEQ ID NO: 543797 - DNA, 20 bp, mouse
gggctgctaaccagctgcac

SEQ ID NO: 543798 - DNA, 20 bp, mouse
gaacccacatgtccagcatg

SEQ ID NO: 543799 - DNA, 20 bp, mouse
gctggttagcagcctcatgc

SEQ ID NO: 543800 - DNA, 20 bp, mouse
gaaccagctgacatcatgga

SEQ ID NO: 543801 - DNA, 20 bp, mouse
ggtgtagcagatgtcaataa

SEQ ID NO: 543802 - DNA, 20 bp, mouse
gtgtaggtgggaatcagcta

SEQ ID NO: 543803 - DNA, 20 bp, mouse
gtgggtcacacagcctccat

SEQ ID NO: 543804 - DNA, 20 bp, mouse
gccaagatgatgaattcaga

SEQ ID NO: 543805 - DNA, 20 bp, mouse
gatactgcaattcattcagg

SEQ ID NO: 543806 - DNA, 20 bp, mouse
gcctgactgaaaatcctaat

SEQ ID NO: 543807 - DNA, 20 bp, mouse
gggtgtgagtgaattcattc

SEQ ID NO: 543808 - DNA, 20 bp, mouse
gtactgaaaacatggcaatt

SEQ ID NO: 543809 - DNA, 20 bp, mouse
gagaaattgagcagcatctt

SEQ ID NO: 543810 - DNA, 20 bp, mouse
gggttcttgcaagttacttg

SEQ ID NO: 543811 - DNA, 20 bp, mouse
gcatcattcttgtaggtaac

SEQ ID NO: 543812 - DNA, 20 bp, mouse
gaagtagactactgaaaaca

SEQ ID NO: 543813 - DNA, 20 bp, mouse
gtggcaatttggaatcatac

SEQ ID NO: 543814 - DNA, 20 bp, mouse
gtacattggtgtatgaagtt

SEQ ID NO: 543815 - DNA, 20 bp, mouse
gactgaaaatcctaattggc

SEQ ID NO: 543816 - DNA, 20 bp, mouse
gttgtatactgcatcttctt

SEQ ID NO: 543817 - DNA, 20 bp, mouse
gaaaatagcatgagtcttaa

SEQ ID NO: 543818 - DNA, 20 bp, mouse
gtgccattgcagccaggata

SEQ ID NO: 543819 - DNA, 20 bp, mouse
gcgataaatataaactctgt

SEQ ID NO: 543820 - DNA, 20 bp, mouse
gagcggaagcgtgacctcac

SEQ ID NO: 543821 - DNA, 20 bp, mouse
gtagcatgagtcttaatggc

SEQ ID NO: 543822 - DNA, 20 bp, mouse
gaatgagatgctcttcttgg

SEQ ID NO: 543823 - DNA, 20 bp, mouse
gtctacattggtgtctcgaa

SEQ ID NO: 543824 - DNA, 20 bp, mouse
gagggatacatgcaccagtg

SEQ ID NO: 543825 - DNA, 20 bp, mouse
gccactgctttactctacat

SEQ ID NO: 543826 - DNA, 20 bp, mouse
gttctgttggggactttgta

SEQ ID NO: 543827 - DNA, 20 bp, mouse
gatgtggagtggttctgttg

SEQ ID NO: 543828 - DNA, 20 bp, mouse
ggaatgctacaaatgtggag

SEQ ID NO: 543829 - DNA, 20 bp, mouse
gttgtagcattcatcttact

SEQ ID NO: 543830 - DNA, 20 bp, mouse
gtgttggggactttgtaggg

SEQ ID NO: 543831 - DNA, 20 bp, mouse
gcatgggagtttgcagggaa

SEQ ID NO: 543832 - DNA, 20 bp, mouse
ggtcagaataaagcactcag

SEQ ID NO: 543833 - DNA, 20 bp, mouse
gagagatctgttaataacct

SEQ ID NO: 543834 - DNA, 20 bp, mouse
gtctatctaattattctgat

SEQ ID NO: 543835 - DNA, 20 bp, mouse
gcagctggctgttggataag

SEQ ID NO: 543836 - DNA, 20 bp, mouse
gtgtctattcctgatcctgg

SEQ ID NO: 543837 - DNA, 20 bp, mouse
gttcagtagcccccaggatc

SEQ ID NO: 543838 - DNA, 20 bp, mouse
gatcatcattctaatcacaa

SEQ ID NO: 543839 - DNA, 20 bp, mouse
gccttggaactcatgactac

SEQ ID NO: 543840 - DNA, 20 bp, mouse
gccaggaaccaactactaac

SEQ ID NO: 543841 - DNA, 20 bp, mouse
gtctacatgattatccttct

SEQ ID NO: 543842 - DNA, 20 bp, mouse
gtgtgtacccagttagtagt

SEQ ID NO: 543843 - DNA, 20 bp, mouse
gagaacaaattctataggta

SEQ ID NO: 543844 - DNA, 20 bp, mouse
gactaactgggtacacacct

SEQ ID NO: 543845 - DNA, 20 bp, mouse
ggataatcatgtagatgaag

SEQ ID NO: 543846 - DNA, 20 bp, mouse
gttcagtgccacccaggata

SEQ ID NO: 543847 - DNA, 20 bp, mouse
gtctacatgtctatccttct

SEQ ID NO: 543848 - DNA, 20 bp, mouse
gtgtgtttattccttatcct

SEQ ID NO: 543849 - DNA, 20 bp, mouse
ggtttattccttatcctggg

SEQ ID NO: 543850 - DNA, 20 bp, mouse
ggaagcattcagtgccaccc

SEQ ID NO: 543851 - DNA, 20 bp, mouse
gtcttgtgattaaaatgatg

SEQ ID NO: 543852 - DNA, 20 bp, mouse
gtcagtctttacaacttcta

SEQ ID NO: 543853 - DNA, 20 bp, mouse
gtttcttcttaaaccaaatt

SEQ ID NO: 543854 - DNA, 20 bp, mouse
gccaagagaacaaattctat

SEQ ID NO: 543855 - DNA, 20 bp, mouse
gttattctgcgtgatgtctc

SEQ ID NO: 543856 - DNA, 20 bp, mouse
gtagagaatattgtagaggg

SEQ ID NO: 543857 - DNA, 20 bp, mouse
gaagtagagaatattgtaga

SEQ ID NO: 543858 - DNA, 20 bp, mouse
gtgggattcctgtacaaatt

SEQ ID NO: 543859 - DNA, 20 bp, mouse
gagaataaattccatcaatg

SEQ ID NO: 543860 - DNA, 20 bp, mouse
ggctagcaagaggcactctg

SEQ ID NO: 543861 - DNA, 20 bp, mouse
gacagctggtagctgcctct

SEQ ID NO: 543862 - DNA, 20 bp, mouse
gggaatcccactgatccaag

SEQ ID NO: 543863 - DNA, 20 bp, mouse
gtaatgttcctcatttgcag

SEQ ID NO: 543864 - DNA, 20 bp, mouse
gctctgtggctcccaacata

SEQ ID NO: 543865 - DNA, 20 bp, mouse
gtggatctatatacactaaa

SEQ ID NO: 543866 - DNA, 20 bp, mouse
gggcaccccagctaggaaag

SEQ ID NO: 543867 - DNA, 20 bp, mouse
gaggagaaaaacaaccacag

SEQ ID NO: 543868 - DNA, 20 bp, mouse
gtattccactttcctagctg

SEQ ID NO: 543869 - DNA, 20 bp, mouse
gtctctgacttagaccctgt

SEQ ID NO: 543870 - DNA, 20 bp, mouse
ggcaaatggtatactaaagt

SEQ ID NO: 543871 - DNA, 20 bp, mouse
gtatactaaagtgggtacta

SEQ ID NO: 543872 - DNA, 20 bp, mouse
ggaggatggaatagttaggg

SEQ ID NO: 543873 - DNA, 20 bp, mouse
gcacttagttctgaggcaaa

SEQ ID NO: 543874 - DNA, 20 bp, mouse
gagggagggcgacggtgatc

SEQ ID NO: 543875 - DNA, 20 bp, mouse
gtgacttagaccctgttggc

SEQ ID NO: 543876 - DNA, 20 bp, mouse
gactgaggttgcattatcca

SEQ ID NO: 543877 - DNA, 20 bp, mouse
gctctgagtgttccatctgt

SEQ ID NO: 543878 - DNA, 20 bp, mouse
gctcagtggctgccagaatt

SEQ ID NO: 543879 - DNA, 20 bp, mouse
gatctttggacacaagacag

SEQ ID NO: 543880 - DNA, 20 bp, mouse
gttgtagagaatgcggggaa

SEQ ID NO: 543881 - DNA, 20 bp, mouse
gtgtatgtggttatcttaat

SEQ ID NO: 543882 - DNA, 20 bp, mouse
gcttgctataacaagtatag

SEQ ID NO: 543883 - DNA, 20 bp, mouse
gccgcattctctacaatctt

SEQ ID NO: 543884 - DNA, 20 bp, mouse
gctgtgggctcttggctcgg

SEQ ID NO: 543885 - DNA, 20 bp, mouse
ggtgacacagtttctcttac

SEQ ID NO: 543886 - DNA, 20 bp, mouse
gatgaaacacactgacatca

SEQ ID NO: 543887 - DNA, 20 bp, mouse
gcagcagggtcctggctcgg

SEQ ID NO: 543888 - DNA, 20 bp, mouse
ggtatcagtcattctcccta

SEQ ID NO: 543889 - DNA, 20 bp, mouse
gcaccccaaacagaaagctc

SEQ ID NO: 543890 - DNA, 20 bp, mouse
gttcagtggctgccaacatt

SEQ ID NO: 543891 - DNA, 20 bp, mouse
gtcagtgtgtttcatctgtg

SEQ ID NO: 543892 - DNA, 20 bp, mouse
gaaatgctgtacagaaccct

SEQ ID NO: 543893 - DNA, 20 bp, mouse
gtgtagtgtagggtcaagct

SEQ ID NO: 543894 - DNA, 20 bp, mouse
gagcataatcaagtacatta

SEQ ID NO: 543895 - DNA, 20 bp, mouse
gaggtttgcccaacctgaaa

SEQ ID NO: 543896 - DNA, 20 bp, mouse
gctggcctgatgagatgaac

SEQ ID NO: 543897 - DNA, 20 bp, mouse
gagtaaattcactaaacaca

SEQ ID NO: 543898 - DNA, 20 bp, mouse
gtgtacagcacaggacaaca

SEQ ID NO: 543899 - DNA, 20 bp, mouse
gataggccatgactgtcagg

SEQ ID NO: 543900 - DNA, 20 bp, mouse
gaaggtccatgagcatcctt

SEQ ID NO: 543901 - DNA, 20 bp, mouse
gtgatgtccctcaactccag

SEQ ID NO: 543902 - DNA, 20 bp, mouse
gtgaccaagggataatgcaa

SEQ ID NO: 543903 - DNA, 20 bp, mouse
gcatacccgttcatctcatc

SEQ ID NO: 543904 - DNA, 20 bp, mouse
gacaatcccaaggatgctca

SEQ ID NO: 543905 - DNA, 20 bp, mouse
gaagcatccactggagttga

SEQ ID NO: 543906 - DNA, 20 bp, mouse
gataaattcaatcagcgaag

SEQ ID NO: 543907 - DNA, 20 bp, mouse
gaggatctgtacacagttag

SEQ ID NO: 543908 - DNA, 20 bp, mouse
gtgattgaatttatcctact

SEQ ID NO: 543909 - DNA, 20 bp, mouse
gtggacctgtgtactcagaa

SEQ ID NO: 543910 - DNA, 20 bp, mouse
gacataggggtctgcagagc

SEQ ID NO: 543911 - DNA, 20 bp, mouse
gatctccaatggattctgtt

SEQ ID NO: 543912 - DNA, 20 bp, mouse
gacaattccaaggatgcttg

SEQ ID NO: 543913 - DNA, 20 bp, mouse
ggttttatccttatgcttgg

SEQ ID NO: 543914 - DNA, 20 bp, mouse
ggacatcagaaaaaccaagt

SEQ ID NO: 543915 - DNA, 20 bp, mouse
gacagacagtaaataaaaca

SEQ ID NO: 543916 - DNA, 20 bp, mouse
gggaaatctaaccaatctga

SEQ ID NO: 543917 - DNA, 20 bp, mouse
gtagtccaaatagaacccac

SEQ ID NO: 543918 - DNA, 20 bp, mouse
ggatgttcctgatctccagt

SEQ ID NO: 543919 - DNA, 20 bp, mouse
gcaaggttgaagaccattct

SEQ ID NO: 543920 - DNA, 20 bp, mouse
gtggaatcccaattcagata

SEQ ID NO: 543921 - DNA, 20 bp, mouse
gatctccagtgggttctatt

SEQ ID NO: 543922 - DNA, 20 bp, mouse
gagaacaaattccttcagat

SEQ ID NO: 543923 - DNA, 20 bp, mouse
gtgattggctcctggataag

SEQ ID NO: 543924 - DNA, 20 bp, mouse
gaactagaggataatgcagg

SEQ ID NO: 543925 - DNA, 20 bp, mouse
ggtttcatcctattaggcaa

SEQ ID NO: 543926 - DNA, 20 bp, mouse
gcatctgtagggatgatcaa

SEQ ID NO: 543927 - DNA, 20 bp, mouse
gtctgtgaatttcatctgta

SEQ ID NO: 543928 - DNA, 20 bp, mouse
gcaagacagaagcatttctg

SEQ ID NO: 543929 - DNA, 20 bp, mouse
gctcagtagctcccagcata

SEQ ID NO: 543930 - DNA, 20 bp, mouse
gtttacttgatcatattgat

SEQ ID NO: 543931 - DNA, 20 bp, mouse
gaatgttaaacagaatccta

SEQ ID NO: 543932 - DNA, 20 bp, mouse
ggctactgagtgtttcctgc

SEQ ID NO: 543933 - DNA, 20 bp, mouse
gtgtgtttcttccttatgct

SEQ ID NO: 543934 - DNA, 20 bp, mouse
gaggaaggtcagaaaatccc

SEQ ID NO: 543935 - DNA, 20 bp, mouse
gaaggtcagaaaatcccagg

SEQ ID NO: 543936 - DNA, 20 bp, mouse
gttggaatgtacaggatgtg

SEQ ID NO: 543937 - DNA, 20 bp, mouse
ggaagagcacataaattgca

SEQ ID NO: 543938 - DNA, 20 bp, mouse
gagctggatgtagagcttcg

SEQ ID NO: 543939 - DNA, 20 bp, mouse
gtttacatctggataaaccc

SEQ ID NO: 543940 - DNA, 20 bp, mouse
gcttcagatgtactttttag

SEQ ID NO: 543941 - DNA, 20 bp, mouse
gtgtactttttaggggtctt

SEQ ID NO: 543942 - DNA, 20 bp, mouse
gcaaatgtcatttttacatc

SEQ ID NO: 543943 - DNA, 20 bp, mouse
gtttcttgttgaaagaaaag

SEQ ID NO: 543944 - DNA, 20 bp, mouse
gtacagttatgccgtaaaca

SEQ ID NO: 543945 - DNA, 20 bp, mouse
ggaatagcagatgtcacaaa

SEQ ID NO: 543946 - DNA, 20 bp, mouse
gctcagtggctccaagcata

SEQ ID NO: 543947 - DNA, 20 bp, mouse
gacttacaagggattctgtt

SEQ ID NO: 543948 - DNA, 20 bp, mouse
ggccactgagtgttttctgc

SEQ ID NO: 543949 - DNA, 20 bp, mouse
gtgtatcagtcactcttcct

SEQ ID NO: 543950 - DNA, 20 bp, mouse
gataatttacttgatcatat

SEQ ID NO: 543951 - DNA, 20 bp, mouse
gtgtgtttcttccttatgct

SEQ ID NO: 543952 - DNA, 20 bp, mouse
gatgaaattcacagaaatca

SEQ ID NO: 543953 - DNA, 20 bp, mouse
ggccagcagaaaacactcag

SEQ ID NO: 543954 - DNA, 20 bp, mouse
gaatcccttgtaagttagga

SEQ ID NO: 543955 - DNA, 20 bp, mouse
gagaccttcctaacttacaa

SEQ ID NO: 543956 - DNA, 20 bp, mouse
gcaactgggtggcacagctg

SEQ ID NO: 543957 - DNA, 20 bp, mouse
gaatgctaaacagaatccta

SEQ ID NO: 543958 - DNA, 20 bp, mouse
gctcagtggctgccagcata

SEQ ID NO: 543959 - DNA, 20 bp, mouse
gataatttacttgatcatat

SEQ ID NO: 543960 - DNA, 20 bp, mouse
gatgaaattcacagaaatca

SEQ ID NO: 543961 - DNA, 20 bp, mouse
gaatcccttgtaagttagga

SEQ ID NO: 543962 - DNA, 20 bp, mouse
gagaccttcctaacttacaa

SEQ ID NO: 543963 - DNA, 20 bp, mouse
gaggaagaaacacaactggg

SEQ ID NO: 543964 - DNA, 20 bp, mouse
gttcacagaaatcagggcag

SEQ ID NO: 543965 - DNA, 20 bp, mouse
gtgtttcagtcactctccct

SEQ ID NO: 543966 - DNA, 20 bp, mouse
gtagtcaaaggtataactaa

SEQ ID NO: 543967 - DNA, 20 bp, mouse
gtaagtaagtttggctttta

SEQ ID NO: 543968 - DNA, 20 bp, mouse
gtgtaacttattgtagtcaa

SEQ ID NO: 543969 - DNA, 20 bp, mouse
ggaaagagttttcatgttac

SEQ ID NO: 543970 - DNA, 20 bp, mouse
gagacagtgttaagtaagtt

SEQ ID NO: 543971 - DNA, 20 bp, mouse
ggtcttttataaattaatac

SEQ ID NO: 543972 - DNA, 20 bp, mouse
gtctagatatatatgataga

SEQ ID NO: 543973 - DNA, 20 bp, mouse
gaaataaaacaatatttgaa

SEQ ID NO: 543974 - DNA, 20 bp, mouse
ggtgtgaatatctgaaataa

SEQ ID NO: 543975 - DNA, 20 bp, mouse
gaacggctaagaattaaatc

SEQ ID NO: 543976 - DNA, 20 bp, mouse
gacatgggtgtatgcagctg

SEQ ID NO: 543977 - DNA, 20 bp, mouse
ggcagagcacagccccagaa

SEQ ID NO: 543978 - DNA, 20 bp, mouse
gtgaaagaaagaatggatat

SEQ ID NO: 543979 - DNA, 20 bp, mouse
gtatagactgaaagaaagaa

SEQ ID NO: 543980 - DNA, 20 bp, mouse
gctatctcatcaatcttctg

SEQ ID NO: 543981 - DNA, 20 bp, mouse
gacaagtcaattcctttctg

SEQ ID NO: 543982 - DNA, 20 bp, mouse
gtagagcaaggggttgctaa

SEQ ID NO: 543983 - DNA, 20 bp, mouse
ggctttgatacatacaactt

SEQ ID NO: 543984 - DNA, 20 bp, mouse
gaggaagtgtttcatgttca

SEQ ID NO: 543985 - DNA, 20 bp, mouse
gaacatgaaacacttcctgc

SEQ ID NO: 543986 - DNA, 20 bp, mouse
ggaaggtcactctcatgtca

SEQ ID NO: 543987 - DNA, 20 bp, mouse
gtagatgaattcatcttctt

SEQ ID NO: 543988 - DNA, 20 bp, mouse
gaagatgaattcatctactg

SEQ ID NO: 543989 - DNA, 20 bp, mouse
gagataaacaagtaggagtg

SEQ ID NO: 543990 - DNA, 20 bp, mouse
ggcaaagcacaaccaacaat

SEQ ID NO: 543991 - DNA, 20 bp, mouse
gactctcatgtcagggttct

SEQ ID NO: 543992 - DNA, 20 bp, mouse
gaattaagatgatcatccca

SEQ ID NO: 543993 - DNA, 20 bp, mouse
gagaaatcgattcccattgt

SEQ ID NO: 543994 - DNA, 20 bp, mouse
gttggtggatcttttagttg

SEQ ID NO: 543995 - DNA, 20 bp, mouse
gagtaggagtgtggtgaaga

SEQ ID NO: 543996 - DNA, 20 bp, mouse
ggttttcaaactgcattctt

SEQ ID NO: 543997 - DNA, 20 bp, mouse
gtctgaatgcacaggatgtg

SEQ ID NO: 543998 - DNA, 20 bp, mouse
gacaaattcagtaaaaacag

SEQ ID NO: 543999 - DNA, 20 bp, mouse
gacagaaggacagattgctc

SEQ ID NO: 544000 - DNA, 20 bp, mouse
gtctttggatctggatatcc

SEQ ID NO: 544001 - DNA, 20 bp, mouse
gaaactgcattctttggatc

SEQ ID NO: 544002 - DNA, 20 bp, mouse
gttaggactttctggcagac

SEQ ID NO: 544003 - DNA, 20 bp, mouse
gtattcaactgtattttttc

SEQ ID NO: 544004 - DNA, 20 bp, mouse
gttgtcttgttaggactttc

SEQ ID NO: 544005 - DNA, 20 bp, mouse
gttactgaatttgtcttgtt

SEQ ID NO: 544006 - DNA, 20 bp, mouse
gatcttgggagagacggtgg

SEQ ID NO: 544007 - DNA, 20 bp, mouse
gagcatcttgggagagacgg

SEQ ID NO: 544008 - DNA, 20 bp, mouse
ggacagaatttgtcttctta

SEQ ID NO: 544009 - DNA, 20 bp, mouse
ggcagatgtcacaaaatgac

SEQ ID NO: 544010 - DNA, 20 bp, mouse
gtcgcaattgtatagagtag

SEQ ID NO: 544011 - DNA, 20 bp, mouse
ggtaattgctaatctaggaa

SEQ ID NO: 544012 - DNA, 20 bp, mouse
gtcggaatgtacagcttgta

SEQ ID NO: 544013 - DNA, 20 bp, mouse
gacaaaatgacaggttgctc

SEQ ID NO: 544014 - DNA, 20 bp, mouse
gatggtcatattgattaaac

SEQ ID NO: 544015 - DNA, 20 bp, mouse
gttgtcttcttagggctttc

SEQ ID NO: 544016 - DNA, 20 bp, mouse
gccaggactagagatattag

SEQ ID NO: 544017 - DNA, 20 bp, mouse
gacttgtctatacctgatcc

SEQ ID NO: 544018 - DNA, 20 bp, mouse
gaatgtactaagatagactt

SEQ ID NO: 544019 - DNA, 20 bp, mouse
gtaagatagacttgggaagt

SEQ ID NO: 544020 - DNA, 20 bp, mouse
gaaagttgagaaatatcatt

SEQ ID NO: 544021 - DNA, 20 bp, mouse
gatcacagatttctaaaatg

SEQ ID NO: 544022 - DNA, 20 bp, mouse
gatatctctagtcctggatc

SEQ ID NO: 544023 - DNA, 20 bp, mouse
gattatattagaaatggaca

SEQ ID NO: 544024 - DNA, 20 bp, mouse
gctgctttcataaatgaatt

SEQ ID NO: 544025 - DNA, 20 bp, mouse
gtgaaagcagatatgaaaca

SEQ ID NO: 544026 - DNA, 20 bp, mouse
gataaccctagcatgaaagt

SEQ ID NO: 544027 - DNA, 20 bp, mouse
gtaccgactacatacatcag

SEQ ID NO: 544028 - DNA, 20 bp, mouse
gacactgaatttgttttact

SEQ ID NO: 544029 - DNA, 20 bp, mouse
gtcagcatctacaaagatac

SEQ ID NO: 544030 - DNA, 20 bp, mouse
gaagatgctagttgacctaa

SEQ ID NO: 544031 - DNA, 20 bp, mouse
gtagctggagtttacctagt

SEQ ID NO: 544032 - DNA, 20 bp, mouse
gatcctctgatgtatgtagt

SEQ ID NO: 544033 - DNA, 20 bp, mouse
gaaaacaaattcagtgtttg

SEQ ID NO: 544034 - DNA, 20 bp, mouse
ggattttctgcttgaccatt

SEQ ID NO: 544035 - DNA, 20 bp, mouse
gagaaaatcattccttttgt

SEQ ID NO: 544036 - DNA, 20 bp, mouse
ggtaagacaaaggtctctta

SEQ ID NO: 544037 - DNA, 20 bp, mouse
gttcccaacagaagaaactc

SEQ ID NO: 544038 - DNA, 20 bp, mouse
ggtccacagcatacataagg

SEQ ID NO: 544039 - DNA, 20 bp, mouse
gcgtttgtcagaagaatagt

SEQ ID NO: 544040 - DNA, 20 bp, mouse
gaggaggtctaagagcatct

SEQ ID NO: 544041 - DNA, 20 bp, mouse
gtggattattatcttcaagg

SEQ ID NO: 544042 - DNA, 20 bp, mouse
gaattgagacaatcaggagt

SEQ ID NO: 544043 - DNA, 20 bp, mouse
gaattggattattatcttca

SEQ ID NO: 544044 - DNA, 20 bp, mouse
gaacagccaacaaaagaaat

SEQ ID NO: 544045 - DNA, 20 bp, mouse
gactttcatttcaggcttat

SEQ ID NO: 544046 - DNA, 20 bp, mouse
gtgggtattagtagtaagta

SEQ ID NO: 544047 - DNA, 20 bp, mouse
gtacccaagagaaagaattc

SEQ ID NO: 544048 - DNA, 20 bp, mouse
gatcctgggtccaactgcgg

SEQ ID NO: 544049 - DNA, 20 bp, mouse
gagtagtgagataaacaagc

SEQ ID NO: 544050 - DNA, 20 bp, mouse
gactaggtctaccagcatcc

SEQ ID NO: 544051 - DNA, 20 bp, mouse
ggcagttggacccaggatgc

SEQ ID NO: 544052 - DNA, 20 bp, mouse
ggcagaaaacaaccagtaaa

SEQ ID NO: 544053 - DNA, 20 bp, mouse
gacctgacaagtactataga

SEQ ID NO: 544054 - DNA, 20 bp, mouse
gggtttgatacatacaacac

SEQ ID NO: 544055 - DNA, 20 bp, mouse
gtgaatgtttctcggctact

SEQ ID NO: 544056 - DNA, 20 bp, mouse
gggaattaccagtaaccctg

SEQ ID NO: 544057 - DNA, 20 bp, mouse
ggttactggtaattcccaaa

SEQ ID NO: 544058 - DNA, 20 bp, mouse
gccaaagaatcatggataag

SEQ ID NO: 544059 - DNA, 20 bp, mouse
ggaccaaaaccaaagaatca

SEQ ID NO: 544060 - DNA, 20 bp, mouse
ggcatagcacagccaagaaa

SEQ ID NO: 544061 - DNA, 20 bp, mouse
gtaaaaacacttttacctca

SEQ ID NO: 544062 - DNA, 20 bp, mouse
ggtatgcagtagacatgtcc

SEQ ID NO: 544063 - DNA, 20 bp, mouse
gtgtctactgcatacaaaag

SEQ ID NO: 544064 - DNA, 20 bp, mouse
gataaacaccagtcaataat

SEQ ID NO: 544065 - DNA, 20 bp, mouse
gctaatctgctgacaaatct

SEQ ID NO: 544066 - DNA, 20 bp, mouse
gtggtttgcctggggtgaga

SEQ ID NO: 544067 - DNA, 20 bp, mouse
gtctttacatggtttgcctg

SEQ ID NO: 544068 - DNA, 20 bp, mouse
ggcagatatttttctttaca

SEQ ID NO: 544069 - DNA, 20 bp, mouse
gtgtcccagaaagtgtaggt

SEQ ID NO: 544070 - DNA, 20 bp, mouse
gggaactgtcaacatactga

SEQ ID NO: 544071 - DNA, 20 bp, mouse
gacacatgatgatctcatag

SEQ ID NO: 544072 - DNA, 20 bp, mouse
gcagcccacctacactttct

SEQ ID NO: 544073 - DNA, 20 bp, mouse
gcatgtgtcccagaaagtgt

SEQ ID NO: 544074 - DNA, 20 bp, mouse
ggtgggctgtgacagctgta

SEQ ID NO: 544075 - DNA, 20 bp, mouse
ggatctcatagtggagagga

SEQ ID NO: 544076 - DNA, 20 bp, mouse
gatgtctacaacatacatca

SEQ ID NO: 544077 - DNA, 20 bp, mouse
gagctggtaacaaaatctac

SEQ ID NO: 544078 - DNA, 20 bp, mouse
gtcaacatctataaagacac

SEQ ID NO: 544079 - DNA, 20 bp, mouse
gaagatgctggtagatttac

SEQ ID NO: 544080 - DNA, 20 bp, mouse
gataaactccagccagaagc

SEQ ID NO: 544081 - DNA, 20 bp, mouse
gaacagcagtggaataacag

SEQ ID NO: 544082 - DNA, 20 bp, mouse
gagtagaataaattcagtga

SEQ ID NO: 544083 - DNA, 20 bp, mouse
gagaataaattcagtgatgg

SEQ ID NO: 544084 - DNA, 20 bp, mouse
gaaagataaagatttgtgtt

SEQ ID NO: 544085 - DNA, 20 bp, mouse
gacaaatctttatctttttt

SEQ ID NO: 544086 - DNA, 20 bp, mouse
gatcttggacccaattgcag

SEQ ID NO: 544087 - DNA, 20 bp, mouse
gtttccaagagaaggagttc

SEQ ID NO: 544088 - DNA, 20 bp, mouse
gactctattggacatatcta

SEQ ID NO: 544089 - DNA, 20 bp, mouse
ggtattagcactttcatgtc

SEQ ID NO: 544090 - DNA, 20 bp, mouse
gtatggcatatatcacgggg

SEQ ID NO: 544091 - DNA, 20 bp, mouse
ggtaaacaccagccaggaat

SEQ ID NO: 544092 - DNA, 20 bp, mouse
gcagctactcctctgcaatt

SEQ ID NO: 544093 - DNA, 20 bp, mouse
gtatctatggcatatatcac

SEQ ID NO: 544094 - DNA, 20 bp, mouse
ggaaaggcacaaacaacaat

SEQ ID NO: 544095 - DNA, 20 bp, mouse
gggcacaaacaacaatggga

SEQ ID NO: 544096 - DNA, 20 bp, mouse
gattagtatgaattcagtaa

SEQ ID NO: 544097 - DNA, 20 bp, mouse
gatcttgggcccaactgctg

SEQ ID NO: 544098 - DNA, 20 bp, mouse
ggttgggcccaagatgttaa

SEQ ID NO: 544099 - DNA, 20 bp, mouse
gctgttcacaatatttctac

SEQ ID NO: 544100 - DNA, 20 bp, mouse
gatatgtccattaacatctt

SEQ ID NO: 544101 - DNA, 20 bp, mouse
gtaaactccagccactaaca

SEQ ID NO: 544102 - DNA, 20 bp, mouse
ggattctgaatgtatattgc

SEQ ID NO: 544103 - DNA, 20 bp, mouse
gtcaatctcattgggaatct

SEQ ID NO: 544104 - DNA, 20 bp, mouse
gatggcctggtaccggtcaa

SEQ ID NO: 544105 - DNA, 20 bp, mouse
gacattggggtttgtagctg

SEQ ID NO: 544106 - DNA, 20 bp, mouse
gtctgtagaaaggatttagt

SEQ ID NO: 544107 - DNA, 20 bp, mouse
gatgaaacatgatgaaattg

SEQ ID NO: 544108 - DNA, 20 bp, mouse
gcagtgcagacagaatccct

SEQ ID NO: 544109 - DNA, 20 bp, mouse
gtgatcaaaggatagtgcaa

SEQ ID NO: 544110 - DNA, 20 bp, mouse
gctgctcttcccaatctcca

SEQ ID NO: 544111 - DNA, 20 bp, mouse
gtttttgagttcatgatcaa

SEQ ID NO: 544112 - DNA, 20 bp, mouse
gtgatacaatttgttctgct

SEQ ID NO: 544113 - DNA, 20 bp, mouse
gtagtgcaaagggttgcaaa

SEQ ID NO: 544114 - DNA, 20 bp, mouse
gcttttcaacatttggacac

SEQ ID NO: 544115 - DNA, 20 bp, mouse
gcatgggtttatgcaatgta

SEQ ID NO: 544116 - DNA, 20 bp, mouse
ggctcttcatgattcatctg

SEQ ID NO: 544117 - DNA, 20 bp, mouse
gaatgttgaacagaatcctt

SEQ ID NO: 544118 - DNA, 20 bp, mouse
gtgatacagtttgtgctcat

SEQ ID NO: 544119 - DNA, 20 bp, mouse
gtgtatcagtgactgtccca

SEQ ID NO: 544120 - DNA, 20 bp, mouse
gataatcataataatcagta

SEQ ID NO: 544121 - DNA, 20 bp, mouse
gggacatcagtgaaatgctt

SEQ ID NO: 544122 - DNA, 20 bp, mouse
gcattggtttctgtaatgct

SEQ ID NO: 544123 - DNA, 20 bp, mouse
gatagaaatccttggaggtt

SEQ ID NO: 544124 - DNA, 20 bp, mouse
gaaatccttggaggttgggc

SEQ ID NO: 544125 - DNA, 20 bp, mouse
gctgacctgcccaacctcca

SEQ ID NO: 544126 - DNA, 20 bp, mouse
ggcacagcacaaccaaaaaa

SEQ ID NO: 544127 - DNA, 20 bp, mouse
ggcgattggcccaaaaatgc

SEQ ID NO: 544128 - DNA, 20 bp, mouse
gtgtctactgctagcagtaa

SEQ ID NO: 544129 - DNA, 20 bp, mouse
gattggcccaaaaatgctgg

SEQ ID NO: 544130 - DNA, 20 bp, mouse
gtagagcaatggattgctaa

SEQ ID NO: 544131 - DNA, 20 bp, mouse
gactgtgaacatgtctagca

SEQ ID NO: 544132 - DNA, 20 bp, mouse
gtttgctattctacagcgat

SEQ ID NO: 544133 - DNA, 20 bp, mouse
gaccatctgttgttgccacc

SEQ ID NO: 544134 - DNA, 20 bp, mouse
gagaaatcaattcctttttt

SEQ ID NO: 544135 - DNA, 20 bp, mouse
gtgttttatgcttatgactg

SEQ ID NO: 544136 - DNA, 20 bp, mouse
gtgtactacagcatctacaa

SEQ ID NO: 544137 - DNA, 20 bp, mouse
gtatctactgcatatagcaa

SEQ ID NO: 544138 - DNA, 20 bp, mouse
gtgtatgctgctggcaatga

SEQ ID NO: 544139 - DNA, 20 bp, mouse
ggtaaactacagccagaagt

SEQ ID NO: 544140 - DNA, 20 bp, mouse
ggtaattgaattgctgctct

SEQ ID NO: 544141 - DNA, 20 bp, mouse
ggttggaccaaagatgttat

SEQ ID NO: 544142 - DNA, 20 bp, mouse
gaaggtgtgttaccaacttc

SEQ ID NO: 544143 - DNA, 20 bp, mouse
ggcagtagatatgtccagca

SEQ ID NO: 544144 - DNA, 20 bp, mouse
gggcaatgatggcgtttgat

SEQ ID NO: 544145 - DNA, 20 bp, mouse
ggcaattcaattacttttct

SEQ ID NO: 544146 - DNA, 20 bp, mouse
gctgcatgcaaataatcaaa

SEQ ID NO: 544147 - DNA, 20 bp, mouse
ggcggtagatatgtccagag

SEQ ID NO: 544148 - DNA, 20 bp, mouse
gagtagcacacactcagcat

SEQ ID NO: 544149 - DNA, 20 bp, mouse
ggtggtatgctatcagctcc

SEQ ID NO: 544150 - DNA, 20 bp, mouse
gctcctggctgtggtttatc

SEQ ID NO: 544151 - DNA, 20 bp, mouse
ggtggtttatctggttggaa

SEQ ID NO: 544152 - DNA, 20 bp, mouse
gtggctgtggtttatctggt

SEQ ID NO: 544153 - DNA, 20 bp, mouse
gataaaacaaagaagaatgg

SEQ ID NO: 544154 - DNA, 20 bp, mouse
ggcacagcacagtcaataaa

SEQ ID NO: 544155 - DNA, 20 bp, mouse
gaattcttattgaaaatctt

SEQ ID NO: 544156 - DNA, 20 bp, mouse
gttggaaagtattagtagta

SEQ ID NO: 544157 - DNA, 20 bp, mouse
gaggtgagtacagactcttt

SEQ ID NO: 544158 - DNA, 20 bp, mouse
gtctgtactcacctggcatt

SEQ ID NO: 544159 - DNA, 20 bp, mouse
gcaagaatgctccaaatgcc

SEQ ID NO: 544160 - DNA, 20 bp, mouse
ggaagaaaaacacagcaaat

SEQ ID NO: 544161 - DNA, 20 bp, mouse
gtatgaaggacagcatacag

SEQ ID NO: 544162 - DNA, 20 bp, mouse
gcacagcaaataggagactc

SEQ ID NO: 544163 - DNA, 20 bp, mouse
gtggatgatcactaaatccc

SEQ ID NO: 544164 - DNA, 20 bp, mouse
gagactgaattctatctcct

SEQ ID NO: 544165 - DNA, 20 bp, mouse
gagatccacaagtaatttgg

SEQ ID NO: 544166 - DNA, 20 bp, mouse
gaggtcacattcgctctctt

SEQ ID NO: 544167 - DNA, 20 bp, mouse
ggacataaatctaacttctg

SEQ ID NO: 544168 - DNA, 20 bp, mouse
ggccagaaacaacaagaaga

SEQ ID NO: 544169 - DNA, 20 bp, mouse
gctacagcttcagtgtggtg

SEQ ID NO: 544170 - DNA, 20 bp, mouse
gatacatcctaaaaatgaaa

SEQ ID NO: 544171 - DNA, 20 bp, mouse
ggaaccttgttgtagaagat

SEQ ID NO: 544172 - DNA, 20 bp, mouse
gtcagaatcatgatgtcttc

SEQ ID NO: 544173 - DNA, 20 bp, mouse
ggcttggatcatatgcatgg

SEQ ID NO: 544174 - DNA, 20 bp, mouse
gcatgggggtgtgcagtttg

SEQ ID NO: 544175 - DNA, 20 bp, mouse
gcatgactactgtgtacagc

SEQ ID NO: 544176 - DNA, 20 bp, mouse
gcatgtagcagacatggaag

SEQ ID NO: 544177 - DNA, 20 bp, mouse
gagaatgaactctgccataa

SEQ ID NO: 544178 - DNA, 20 bp, mouse
gagaagtagtaaggtcgtct

SEQ ID NO: 544179 - DNA, 20 bp, mouse
gaattgccatgtagcagaca

SEQ ID NO: 544180 - DNA, 20 bp, mouse
ggaggtaaactgtaccttta

SEQ ID NO: 544181 - DNA, 20 bp, mouse
gtgacagtcatagcaaacct

SEQ ID NO: 544182 - DNA, 20 bp, mouse
gtctctttgcagaagtagta

SEQ ID NO: 544183 - DNA, 20 bp, mouse
gacaggacaccagtacaaga

SEQ ID NO: 544184 - DNA, 20 bp, mouse
gtgatgacagtgtacaatag

SEQ ID NO: 544185 - DNA, 20 bp, mouse
gctacttctgcaaagagaaa

SEQ ID NO: 544186 - DNA, 20 bp, mouse
ggaggaaaactgcagcactg

SEQ ID NO: 544187 - DNA, 20 bp, mouse
ggagaacaccactcagctcg

SEQ ID NO: 544188 - DNA, 20 bp, mouse
gggcggtgactccataaatg

SEQ ID NO: 544189 - DNA, 20 bp, mouse
gtaaaggcagcagatggatg

SEQ ID NO: 544190 - DNA, 20 bp, mouse
gattcccaggttggccaggg

SEQ ID NO: 544191 - DNA, 20 bp, mouse
ggacaaagccatatcatccc

SEQ ID NO: 544192 - DNA, 20 bp, mouse
gatacatgccagggatgata

SEQ ID NO: 544193 - DNA, 20 bp, mouse
ggatagccgtatatagtagt

SEQ ID NO: 544194 - DNA, 20 bp, mouse
ggtcattcccaggttggcca

SEQ ID NO: 544195 - DNA, 20 bp, mouse
gaacacttaaaggcagcaga

SEQ ID NO: 544196 - DNA, 20 bp, mouse
gcacagtgaaacaaagacta

SEQ ID NO: 544197 - DNA, 20 bp, mouse
gccttggcagtggataatcc

SEQ ID NO: 544198 - DNA, 20 bp, mouse
ggagagtaaaatctgagagt

SEQ ID NO: 544199 - DNA, 20 bp, mouse
gaatgcacactctagaagca

SEQ ID NO: 544200 - DNA, 20 bp, mouse
gtgcttaactacattgtatt

SEQ ID NO: 544201 - DNA, 20 bp, mouse
gttaactacattgtatttgg

SEQ ID NO: 544202 - DNA, 20 bp, mouse
ggaataatatatttattcct

SEQ ID NO: 544203 - DNA, 20 bp, mouse
gtcaaaaaagcaattgtgtt

SEQ ID NO: 544204 - DNA, 20 bp, mouse
gtatatttattccttggcag

SEQ ID NO: 544205 - DNA, 20 bp, mouse
gacttataacatttactgcc

SEQ ID NO: 544206 - DNA, 20 bp, mouse
gagctgagtacagaccctct

SEQ ID NO: 544207 - DNA, 20 bp, mouse
gctggaaagtgttagttgta

SEQ ID NO: 544208 - DNA, 20 bp, mouse
gaattacagtatagagcagg

SEQ ID NO: 544209 - DNA, 20 bp, mouse
gttgggggcaatgacagagg

SEQ ID NO: 544210 - DNA, 20 bp, mouse
gtatgaaggacagcatccag

SEQ ID NO: 544211 - DNA, 20 bp, mouse
gcacagcaaataggagactc

SEQ ID NO: 544212 - DNA, 20 bp, mouse
gtggatgatcactgaatccc

SEQ ID NO: 544213 - DNA, 20 bp, mouse
gagactgaattctatctcct

SEQ ID NO: 544214 - DNA, 20 bp, mouse
gggagaaaaacacagcaaat

SEQ ID NO: 544215 - DNA, 20 bp, mouse
gatcagagtaatggagtaga

SEQ ID NO: 544216 - DNA, 20 bp, mouse
gagtcccagaaagtgtacgt

SEQ ID NO: 544217 - DNA, 20 bp, mouse
ggtgggcagtgacaagtgta

SEQ ID NO: 544218 - DNA, 20 bp, mouse
gcagtatgttgacagttcat

SEQ ID NO: 544219 - DNA, 20 bp, mouse
gtatgttgacagttcattgg

SEQ ID NO: 544220 - DNA, 20 bp, mouse
gagaatagctacctcacccc

SEQ ID NO: 544221 - DNA, 20 bp, mouse
gacagttcattggcgggaag

SEQ ID NO: 544222 - DNA, 20 bp, mouse
gtagtaataaaatttatagt

SEQ ID NO: 544223 - DNA, 20 bp, mouse
gatacaagatctgcagctca

SEQ ID NO: 544224 - DNA, 20 bp, mouse
gtgagcggatttctcctcat

SEQ ID NO: 544225 - DNA, 20 bp, mouse
gaggagaaatccgctcattg

SEQ ID NO: 544226 - DNA, 20 bp, mouse
gtatgaaggataacatacag

SEQ ID NO: 544227 - DNA, 20 bp, mouse
gttccattattattatacct

SEQ ID NO: 544228 - DNA, 20 bp, mouse
gatcccaggtataataataa

SEQ ID NO: 544229 - DNA, 20 bp, mouse
gattttggtttctgcatccc

SEQ ID NO: 544230 - DNA, 20 bp, mouse
gaactgaatacagactctct

SEQ ID NO: 544231 - DNA, 20 bp, mouse
gtctgtattcagttggcatt

SEQ ID NO: 544232 - DNA, 20 bp, mouse
gaattacagtataaagcagg

SEQ ID NO: 544233 - DNA, 20 bp, mouse
gggagaaaaacacagcaaac

SEQ ID NO: 544234 - DNA, 20 bp, mouse
gtggatgatcactaaatccc

SEQ ID NO: 544235 - DNA, 20 bp, mouse
gcacagcaaacaggagactc

SEQ ID NO: 544236 - DNA, 20 bp, mouse
gtgacatatggaaataacag

SEQ ID NO: 544237 - DNA, 20 bp, mouse
ggtaatctgagaagctcaat

SEQ ID NO: 544238 - DNA, 20 bp, mouse
gtttccatatgtcagtaaca

SEQ ID NO: 544239 - DNA, 20 bp, mouse
gtagaataaactacatattc

SEQ ID NO: 544240 - DNA, 20 bp, mouse
gaagccatgttactgacata

SEQ ID NO: 544241 - DNA, 20 bp, mouse
gtctgcatcagtctagtggt

SEQ ID NO: 544242 - DNA, 20 bp, mouse
gatgcagagtttctgagaca

SEQ ID NO: 544243 - DNA, 20 bp, mouse
gaaactctgcatcagtctag

SEQ ID NO: 544244 - DNA, 20 bp, mouse
ggagaggcatctctatttct

SEQ ID NO: 544245 - DNA, 20 bp, mouse
gatacattctaaaaatgaga

SEQ ID NO: 544246 - DNA, 20 bp, mouse
gtagtctgtgaagcccaaca

SEQ ID NO: 544247 - DNA, 20 bp, mouse
ggcctatcagtagacagctg

SEQ ID NO: 544248 - DNA, 20 bp, mouse
gtgtctactgataggcatta

SEQ ID NO: 544249 - DNA, 20 bp, mouse
gcactgtagtgggaaacctt

SEQ ID NO: 544250 - DNA, 20 bp, mouse
gcatagcaaaggagaatcaa

SEQ ID NO: 544251 - DNA, 20 bp, mouse
gataggcattatggtgccaa

SEQ ID NO: 544252 - DNA, 20 bp, mouse
ggatgagtgctatcatccca

SEQ ID NO: 544253 - DNA, 20 bp, mouse
gagattatcttctccctgtt

SEQ ID NO: 544254 - DNA, 20 bp, mouse
gcactcacatttctttccat

SEQ ID NO: 544255 - DNA, 20 bp, mouse
gaaagggggatctgaagctc

SEQ ID NO: 544256 - DNA, 20 bp, mouse
gtcatagagcaccaggagaa

SEQ ID NO: 544257 - DNA, 20 bp, mouse
gaaaatctgaataaacttac

SEQ ID NO: 544258 - DNA, 20 bp, mouse
ggagagagtcaccattctcc

SEQ ID NO: 544259 - DNA, 20 bp, mouse
ggcctatcagtagacagctg

SEQ ID NO: 544260 - DNA, 20 bp, mouse
ggcctcagctgtctactgat

SEQ ID NO: 544261 - DNA, 20 bp, mouse
gtttgtttcttaactgccaa

SEQ ID NO: 544262 - DNA, 20 bp, mouse
gtcttaattcatagagcacc

SEQ ID NO: 544263 - DNA, 20 bp, mouse
gttactttataataccaatg

SEQ ID NO: 544264 - DNA, 20 bp, mouse
ggcaaataatcaaactagaa

SEQ ID NO: 544265 - DNA, 20 bp, mouse
gggtattataaagtaatata

SEQ ID NO: 544266 - DNA, 20 bp, mouse
gatttccagtggcaccatag

SEQ ID NO: 544267 - DNA, 20 bp, mouse
gagattaactttgtcctgtt

SEQ ID NO: 544268 - DNA, 20 bp, mouse
ggatgagcactgtcatgcca

SEQ ID NO: 544269 - DNA, 20 bp, mouse
gacatgattttgtattaaac

SEQ ID NO: 544270 - DNA, 20 bp, mouse
gctgtctcagctgtccacta

SEQ ID NO: 544271 - DNA, 20 bp, mouse
gcactcacatttatttccag

SEQ ID NO: 544272 - DNA, 20 bp, mouse
gctgtccactatggtgccac

SEQ ID NO: 544273 - DNA, 20 bp, mouse
gtaggaaaaggggaatctga

SEQ ID NO: 544274 - DNA, 20 bp, mouse
ggtacataaagagaaagatt

SEQ ID NO: 544275 - DNA, 20 bp, mouse
gaaagagaaagattaggaaa

SEQ ID NO: 544276 - DNA, 20 bp, mouse
gctgctcaggatgaattctg

SEQ ID NO: 544277 - DNA, 20 bp, mouse
ggagggaaatcgaagcatgg

SEQ ID NO: 544278 - DNA, 20 bp, mouse
ggaagccaagtgtggaatga

SEQ ID NO: 544279 - DNA, 20 bp, mouse
gcaacacaggaatgcgatga

SEQ ID NO: 544280 - DNA, 20 bp, mouse
ggtgttgcagactgctgctc

SEQ ID NO: 544281 - DNA, 20 bp, mouse
gcaggaacaggggcaattgg

SEQ ID NO: 544282 - DNA, 20 bp, mouse
gtcaagaataccaggaacag

SEQ ID NO: 544283 - DNA, 20 bp, mouse
gaatgagggaaatcgaagca

SEQ ID NO: 544284 - DNA, 20 bp, mouse
gatttccctcattccacact

SEQ ID NO: 544285 - DNA, 20 bp, mouse
ggaatgcgatgatggcatgc

SEQ ID NO: 544286 - DNA, 20 bp, mouse
ggccatctactcagtaacat

SEQ ID NO: 544287 - DNA, 20 bp, mouse
ggtatctttcaaagcatgca

SEQ ID NO: 544288 - DNA, 20 bp, mouse
gctactcagtaacattggtg

SEQ ID NO: 544289 - DNA, 20 bp, mouse
ggaatgtggtcgcagaagtc

SEQ ID NO: 544290 - DNA, 20 bp, mouse
gtttataatctgaaaagtga

SEQ ID NO: 544291 - DNA, 20 bp, mouse
ggcagagcacagaattgaaa

SEQ ID NO: 544292 - DNA, 20 bp, mouse
gctgggacatatatgattgg

SEQ ID NO: 544293 - DNA, 20 bp, mouse
ggtagatggccaagaacagg

SEQ ID NO: 544294 - DNA, 20 bp, mouse
gtgagtagatggccaagaac

SEQ ID NO: 544295 - DNA, 20 bp, mouse
gaaaccaaccaagatgaatg

SEQ ID NO: 544296 - DNA, 20 bp, mouse
gactttccagattaaacatg

SEQ ID NO: 544297 - DNA, 20 bp, mouse
gaaaatgagacttatggaac

SEQ ID NO: 544298 - DNA, 20 bp, mouse
gttcttcctcatgtttaatc

SEQ ID NO: 544299 - DNA, 20 bp, mouse
gcttatggaactggagagag

SEQ ID NO: 544300 - DNA, 20 bp, mouse
gaaagtgatggcttatgaag

SEQ ID NO: 544301 - DNA, 20 bp, mouse
gctactcagtaacactgatg

SEQ ID NO: 544302 - DNA, 20 bp, mouse
gagcagtagaaactcatgtg

SEQ ID NO: 544303 - DNA, 20 bp, mouse
ggaagagaaaatgagactta

SEQ ID NO: 544304 - DNA, 20 bp, mouse
gtgtttaatctggaaagtga

SEQ ID NO: 544305 - DNA, 20 bp, mouse
gttacaactgtgtagagtaa

SEQ ID NO: 544306 - DNA, 20 bp, mouse
gagaggggtggctgtaggtg

SEQ ID NO: 544307 - DNA, 20 bp, mouse
ggtcattatcataaggaaga

SEQ ID NO: 544308 - DNA, 20 bp, mouse
gaaggaagaggggtggctgt

SEQ ID NO: 544309 - DNA, 20 bp, mouse
gttatcataaggaagagggg

SEQ ID NO: 544310 - DNA, 20 bp, mouse
gtaaccacatttattctggt

SEQ ID NO: 544311 - DNA, 20 bp, mouse
gaaacccaccagaataaatg

SEQ ID NO: 544312 - DNA, 20 bp, mouse
gctctggtttatcatttcat

SEQ ID NO: 544313 - DNA, 20 bp, mouse
gaaatgtggttacagaactc

SEQ ID NO: 544314 - DNA, 20 bp, mouse
ggtaaatggtcattatcata

SEQ ID NO: 544315 - DNA, 20 bp, mouse
gtctgtaaccacatttattc

SEQ ID NO: 544316 - DNA, 20 bp, mouse
gctcttttcagaaaaaagga

SEQ ID NO: 544317 - DNA, 20 bp, mouse
gatcactcttttcagaaaaa

SEQ ID NO: 544318 - DNA, 20 bp, mouse
gcaattaacaagagctcggg

SEQ ID NO: 544319 - DNA, 20 bp, mouse
gtcggcaaacagcagcatag

SEQ ID NO: 544320 - DNA, 20 bp, mouse
gagaggatcttctcaagttg

SEQ ID NO: 544321 - DNA, 20 bp, mouse
ggtggtgatttcatcctggt

SEQ ID NO: 544322 - DNA, 20 bp, mouse
gtgacaattaacaagagctc

SEQ ID NO: 544323 - DNA, 20 bp, mouse
gcctacctcctgacactggt

SEQ ID NO: 544324 - DNA, 20 bp, mouse
gcctgtggcagtaattgtct

SEQ ID NO: 544325 - DNA, 20 bp, mouse
gtcgggtggtgatttcatcc

SEQ ID NO: 544326 - DNA, 20 bp, mouse
ggcatacttgtggttataaa

SEQ ID NO: 544327 - DNA, 20 bp, mouse
gtagctgggacatacatgat

SEQ ID NO: 544328 - DNA, 20 bp, mouse
gctactcagtaacattgatg

SEQ ID NO: 544329 - DNA, 20 bp, mouse
ggaatgtggtcgcagaagtc

SEQ ID NO: 544330 - DNA, 20 bp, mouse
ggcagagcacagaattgaaa

SEQ ID NO: 544331 - DNA, 20 bp, mouse
gtttataatctgaaaagtga

SEQ ID NO: 544332 - DNA, 20 bp, mouse
gctgggacatacatgattgg

SEQ ID NO: 544333 - DNA, 20 bp, mouse
gtgagtagatggtcaagaac

SEQ ID NO: 544334 - DNA, 20 bp, mouse
gaaaccaaccaagatgaatg

SEQ ID NO: 544335 - DNA, 20 bp, mouse
gcgaccacattcatcttggt

SEQ ID NO: 544336 - DNA, 20 bp, mouse
gagatctctaacaattttgg

SEQ ID NO: 544337 - DNA, 20 bp, mouse
gagttatatgtggggaggtc

SEQ ID NO: 544338 - DNA, 20 bp, mouse
gaaggaagagaggtggctgg

SEQ ID NO: 544339 - DNA, 20 bp, mouse
gagagaggtggctggaggtg

SEQ ID NO: 544340 - DNA, 20 bp, mouse
gttaccataaggaagagagg

SEQ ID NO: 544341 - DNA, 20 bp, mouse
ggtaaatggtcattaccata

SEQ ID NO: 544342 - DNA, 20 bp, mouse
gtcattaccataaggaagag

SEQ ID NO: 544343 - DNA, 20 bp, mouse
gcataaggaagagaggtggc

SEQ ID NO: 544344 - DNA, 20 bp, mouse
gaaaccgaccagaataaatg

SEQ ID NO: 544345 - DNA, 20 bp, mouse
gtaaccacatttattctggt

SEQ ID NO: 544346 - DNA, 20 bp, mouse
gatcaagtgaatcagagtac

SEQ ID NO: 544347 - DNA, 20 bp, mouse
ggagtcgtatttgtcttcgt

SEQ ID NO: 544348 - DNA, 20 bp, mouse
gtcagagtatccgaacttac

SEQ ID NO: 544349 - DNA, 20 bp, mouse
gataaaggcacctgtaagtt

SEQ ID NO: 544350 - DNA, 20 bp, mouse
gttagaccttctgataacag

SEQ ID NO: 544351 - DNA, 20 bp, mouse
gggcacagagcccaccccat

SEQ ID NO: 544352 - DNA, 20 bp, mouse
gacagatccatgtccctcaa

SEQ ID NO: 544353 - DNA, 20 bp, mouse
gtaactggaacttacctatg

SEQ ID NO: 544354 - DNA, 20 bp, mouse
ggcatttggaaccttttata

SEQ ID NO: 544355 - DNA, 20 bp, mouse
gattcacttgatgctgcatt

SEQ ID NO: 544356 - DNA, 20 bp, mouse
gcacagaatttattctccta

SEQ ID NO: 544357 - DNA, 20 bp, mouse
gatacataggctgattgatg

SEQ ID NO: 544358 - DNA, 20 bp, mouse
gttctgcctgctcataagga

SEQ ID NO: 544359 - DNA, 20 bp, mouse
gtcttcactatgcacttctt

SEQ ID NO: 544360 - DNA, 20 bp, mouse
gtcctttggtcaatttctcc

SEQ ID NO: 544361 - DNA, 20 bp, mouse
ggtcataagccattcctgta

SEQ ID NO: 544362 - DNA, 20 bp, mouse
gctacaccatccttatgagc

SEQ ID NO: 544363 - DNA, 20 bp, mouse
gtgcgtcatgcaaccattgt

SEQ ID NO: 544364 - DNA, 20 bp, mouse
ggtagggtaagaagactgcc

SEQ ID NO: 544365 - DNA, 20 bp, mouse
gaaaagtcgatttcctacaa

SEQ ID NO: 544366 - DNA, 20 bp, mouse
ggaaggtcagtgagaaactt

SEQ ID NO: 544367 - DNA, 20 bp, mouse
gtcactgaatttatactgtt

SEQ ID NO: 544368 - DNA, 20 bp, mouse
gaacttgggtgtcactgtgg

SEQ ID NO: 544369 - DNA, 20 bp, mouse
ggcaagcagtgaccatggca

SEQ ID NO: 544370 - DNA, 20 bp, mouse
ggcacagcaagcagtgacca

SEQ ID NO: 544371 - DNA, 20 bp, mouse
gataaattcagtgatattat

SEQ ID NO: 544372 - DNA, 20 bp, mouse
gttgtaatttctatggaata

SEQ ID NO: 544373 - DNA, 20 bp, mouse
gggggaggctgatagcaagg

SEQ ID NO: 544374 - DNA, 20 bp, mouse
ggctgatagcaaggaggctc

SEQ ID NO: 544375 - DNA, 20 bp, mouse
ggcacaggtctgacaaagca

SEQ ID NO: 544376 - DNA, 20 bp, mouse
gacctcggatctcacttaca

SEQ ID NO: 544377 - DNA, 20 bp, mouse
gaccttgtaagtgagatccg

SEQ ID NO: 544378 - DNA, 20 bp, mouse
ggagatccgaggtatctctc

SEQ ID NO: 544379 - DNA, 20 bp, mouse
gactcattcgggttgagtaa

SEQ ID NO: 544380 - DNA, 20 bp, mouse
gttcgggttgagtaatggag

SEQ ID NO: 544381 - DNA, 20 bp, mouse
ggggaatgggatgtatagta

SEQ ID NO: 544382 - DNA, 20 bp, mouse
gtgggatgtatagtagggtt

SEQ ID NO: 544383 - DNA, 20 bp, mouse
gcccttcccgagagatacct

SEQ ID NO: 544384 - DNA, 20 bp, mouse
gtccgaggtatctctcggga

SEQ ID NO: 544385 - DNA, 20 bp, mouse
gcatgaaactaatgccaaat

SEQ ID NO: 544386 - DNA, 20 bp, mouse
gatcacaaagtgataaataa

SEQ ID NO: 544387 - DNA, 20 bp, mouse
ggtaaatcagtcaggagttt

SEQ ID NO: 544388 - DNA, 20 bp, mouse
gatgggtaatgttctcataa

SEQ ID NO: 544389 - DNA, 20 bp, mouse
gatcacatgcactcagctca

SEQ ID NO: 544390 - DNA, 20 bp, mouse
gttgcagcttgttgtactgg

SEQ ID NO: 544391 - DNA, 20 bp, mouse
gttctgccagtaaatcagtc

SEQ ID NO: 544392 - DNA, 20 bp, mouse
gatcttcattctcacagcaa

SEQ ID NO: 544393 - DNA, 20 bp, mouse
gtccttgcagcttgttgtac

SEQ ID NO: 544394 - DNA, 20 bp, mouse
gttaatctatctgtcttttc

SEQ ID NO: 544395 - DNA, 20 bp, mouse
gtctgtttcactgaactatg

SEQ ID NO: 544396 - DNA, 20 bp, mouse
gtgatgaccatgtagtagag

SEQ ID NO: 544397 - DNA, 20 bp, mouse
gataataaatggaatgcaag

SEQ ID NO: 544398 - DNA, 20 bp, mouse
gggaagcccagataaaaaca

SEQ ID NO: 544399 - DNA, 20 bp, mouse
gttgtatagacaataataaa

SEQ ID NO: 544400 - DNA, 20 bp, mouse
gaatacttcagtgttctgct

SEQ ID NO: 544401 - DNA, 20 bp, mouse
gataacctggggaaaggagt

SEQ ID NO: 544402 - DNA, 20 bp, mouse
gtgggcaacaccaccaaccc

SEQ ID NO: 544403 - DNA, 20 bp, mouse
ggcagatccccaatcaattt

SEQ ID NO: 544404 - DNA, 20 bp, mouse
gagactagcatcataacctg

SEQ ID NO: 544405 - DNA, 20 bp, mouse
gagcagattccaagacaaga

SEQ ID NO: 544406 - DNA, 20 bp, mouse
ggccatgactgtcaggatta

SEQ ID NO: 544407 - DNA, 20 bp, mouse
gcctaattgagaaaaggatc

SEQ ID NO: 544408 - DNA, 20 bp, mouse
gaaattctgatatgttcctc

SEQ ID NO: 544409 - DNA, 20 bp, mouse
gggaagcccagataaaaaca

SEQ ID NO: 544410 - DNA, 20 bp, mouse
gttgtatagacaataataaa

SEQ ID NO: 544411 - DNA, 20 bp, mouse
gataataaatggaatgccag

SEQ ID NO: 544412 - DNA, 20 bp, mouse
gaatacttcagtgttctgct

SEQ ID NO: 544413 - DNA, 20 bp, mouse
gataacctggggaaaggagt

SEQ ID NO: 544414 - DNA, 20 bp, mouse
gaggagattccaagacaaga

SEQ ID NO: 544415 - DNA, 20 bp, mouse
gtgggcaacaccaccaaccc

SEQ ID NO: 544416 - DNA, 20 bp, mouse
gaggacaacttatctactga

SEQ ID NO: 544417 - DNA, 20 bp, mouse
gcatcgtttcatttgaatgt

SEQ ID NO: 544418 - DNA, 20 bp, mouse
gacttacagaaagcttttaa

SEQ ID NO: 544419 - DNA, 20 bp, mouse
gagaaagcttttaagggaag

SEQ ID NO: 544420 - DNA, 20 bp, mouse
gcaagatgagctaccaagat

SEQ ID NO: 544421 - DNA, 20 bp, mouse
gtgaatagctttcaagatga

SEQ ID NO: 544422 - DNA, 20 bp, mouse
gtacatttctcttttctata

SEQ ID NO: 544423 - DNA, 20 bp, mouse
ggtttcatttcaggtgttca

SEQ ID NO: 544424 - DNA, 20 bp, mouse
gttgatttgttaaatttgtc

SEQ ID NO: 544425 - DNA, 20 bp, mouse
gtagtcttctgtttcatttc

SEQ ID NO: 544426 - DNA, 20 bp, mouse
gtagttatgcatcttatcag

SEQ ID NO: 544427 - DNA, 20 bp, mouse
gatcagtggctgtaataggt

SEQ ID NO: 544428 - DNA, 20 bp, mouse
gtcttatcagtggctgtaat

SEQ ID NO: 544429 - DNA, 20 bp, mouse
gcttaatggtcatcacgatg

SEQ ID NO: 544430 - DNA, 20 bp, mouse
gagtgattcttgcctgggta

SEQ ID NO: 544431 - DNA, 20 bp, mouse
gtaatgagccaacgtatttg

SEQ ID NO: 544432 - DNA, 20 bp, mouse
ggggcgtctatgatcaatct

SEQ ID NO: 544433 - DNA, 20 bp, mouse
gatattagtgattcttgcct

SEQ ID NO: 544434 - DNA, 20 bp, mouse
gtgaatacaagaccctaccc

SEQ ID NO: 544435 - DNA, 20 bp, mouse
gttatagttgtatatctgag

SEQ ID NO: 544436 - DNA, 20 bp, mouse
gagaagcccagatcaggata

SEQ ID NO: 544437 - DNA, 20 bp, mouse
gttgcacagagtataataaa

SEQ ID NO: 544438 - DNA, 20 bp, mouse
gattcccacacaagatggca

SEQ ID NO: 544439 - DNA, 20 bp, mouse
ggaagatctccaatcagttt

SEQ ID NO: 544440 - DNA, 20 bp, mouse
gactacatctaatggagata

SEQ ID NO: 544441 - DNA, 20 bp, mouse
gttaccttgccatcttgtgt

SEQ ID NO: 544442 - DNA, 20 bp, mouse
gaggtgccatatcctgatct

SEQ ID NO: 544443 - DNA, 20 bp, mouse
ggtcaaaggccatggctgtt

SEQ ID NO: 544444 - DNA, 20 bp, mouse
gctcagtcatttatcttcta

SEQ ID NO: 544445 - DNA, 20 bp, mouse
gggtcatcatgagcagaagc

SEQ ID NO: 544446 - DNA, 20 bp, mouse
gtgatgtcaatgtctgcagt

SEQ ID NO: 544447 - DNA, 20 bp, mouse
gaatgaattcagtcatcgta

SEQ ID NO: 544448 - DNA, 20 bp, mouse
gtaatgagccaacatatctg

SEQ ID NO: 544449 - DNA, 20 bp, mouse
gatcaaggaatttcaacatc

SEQ ID NO: 544450 - DNA, 20 bp, mouse
gatgccatttctttctttgt

SEQ ID NO: 544451 - DNA, 20 bp, mouse
ggggcatctgcaatcaatct

SEQ ID NO: 544452 - DNA, 20 bp, mouse
gatggggaactttctcataa

SEQ ID NO: 544453 - DNA, 20 bp, mouse
gatgatttttttctgcaata

SEQ ID NO: 544454 - DNA, 20 bp, mouse
ggactgaattcattctgttt

SEQ ID NO: 544455 - DNA, 20 bp, mouse
gtaacctacaaagaaagaaa

SEQ ID NO: 544456 - DNA, 20 bp, mouse
gttgggtcttagagagaacc

SEQ ID NO: 544457 - DNA, 20 bp, mouse
gagcagaaaacagtttccga

SEQ ID NO: 544458 - DNA, 20 bp, mouse
gaaacagtttccgaaggtcc

SEQ ID NO: 544459 - DNA, 20 bp, mouse
ggatctgtctgcaaagagat

SEQ ID NO: 544460 - DNA, 20 bp, mouse
gactagggacaaaaaaagtg

SEQ ID NO: 544461 - DNA, 20 bp, mouse
gtgacagagttcatactttt

SEQ ID NO: 544462 - DNA, 20 bp, mouse
gtttttttgtccctagtaga

SEQ ID NO: 544463 - DNA, 20 bp, mouse
gagaaaacatgccatctact

SEQ ID NO: 544464 - DNA, 20 bp, mouse
gttaggaaatatgctcatta

SEQ ID NO: 544465 - DNA, 20 bp, mouse
ggataatagtattttcagaa

SEQ ID NO: 544466 - DNA, 20 bp, mouse
gattctgtgttagtcccatg

SEQ ID NO: 544467 - DNA, 20 bp, mouse
ggaatgctgttgggcatctc

SEQ ID NO: 544468 - DNA, 20 bp, mouse
ggctagtaatatctttttct

SEQ ID NO: 544469 - DNA, 20 bp, mouse
gtagaagacagcacatatgg

SEQ ID NO: 544470 - DNA, 20 bp, mouse
gacaggaaacctgctcatag

SEQ ID NO: 544471 - DNA, 20 bp, mouse
gacctctgcactatgcctcc

SEQ ID NO: 544472 - DNA, 20 bp, mouse
gcacatatggtggttcatcc

SEQ ID NO: 544473 - DNA, 20 bp, mouse
gtctctcagttgaatgctgt

SEQ ID NO: 544474 - DNA, 20 bp, mouse
gcactagaagacagcacata

SEQ ID NO: 544475 - DNA, 20 bp, mouse
gatcttagggattgtgcaag

SEQ ID NO: 544476 - DNA, 20 bp, mouse
gattctgttgggagttacaa

SEQ ID NO: 544477 - DNA, 20 bp, mouse
gtacaagggacccagagctg

SEQ ID NO: 544478 - DNA, 20 bp, mouse
gcatgggtgacctcagacta

SEQ ID NO: 544479 - DNA, 20 bp, mouse
ggggtgtgctgcttgatggt

SEQ ID NO: 544480 - DNA, 20 bp, mouse
gcatgagtgacaaagataaa

SEQ ID NO: 544481 - DNA, 20 bp, mouse
gcctagggtgtgctgcttga

SEQ ID NO: 544482 - DNA, 20 bp, mouse
gtatggactccctttctgag

SEQ ID NO: 544483 - DNA, 20 bp, mouse
gttgatggtaggaggagctt

SEQ ID NO: 544484 - DNA, 20 bp, mouse
gaaccagaagccctagtctg

SEQ ID NO: 544485 - DNA, 20 bp, mouse
gcaatattttcctcagctct

SEQ ID NO: 544486 - DNA, 20 bp, mouse
gcacagagaaagttagatgg

SEQ ID NO: 544487 - DNA, 20 bp, mouse
ggggcacagagaaagttaga

SEQ ID NO: 544488 - DNA, 20 bp, mouse
gctttagttcactttctata

SEQ ID NO: 544489 - DNA, 20 bp, mouse
gttaagctattttctgagaa

SEQ ID NO: 544490 - DNA, 20 bp, mouse
gtaattctccaatgttgtgc

SEQ ID NO: 544491 - DNA, 20 bp, mouse
gttcaatcccagcacaacat

SEQ ID NO: 544492 - DNA, 20 bp, mouse
ggtggctaatcagaagcaaa

SEQ ID NO: 544493 - DNA, 20 bp, mouse
gttagaaaaagattattagg

SEQ ID NO: 544494 - DNA, 20 bp, mouse
gatttaacatctccatctca

SEQ ID NO: 544495 - DNA, 20 bp, mouse
gtgagaatgtggtaaggaga

SEQ ID NO: 544496 - DNA, 20 bp, mouse
gtgctcggaacatggatcgg

SEQ ID NO: 544497 - DNA, 20 bp, mouse
gaacaggtcaataatcatct

SEQ ID NO: 544498 - DNA, 20 bp, mouse
gctccactatatgactatga

SEQ ID NO: 544499 - DNA, 20 bp, mouse
gctatatgactatgatggac

SEQ ID NO: 544500 - DNA, 20 bp, mouse
ggcctcaaggacttattcca

SEQ ID NO: 544501 - DNA, 20 bp, mouse
gggtctttctcagaaccctg

SEQ ID NO: 544502 - DNA, 20 bp, mouse
ggcacactttttcaacctca

SEQ ID NO: 544503 - DNA, 20 bp, mouse
gatcttgggtgctgtgactg

SEQ ID NO: 544504 - DNA, 20 bp, mouse
gtgttgctcggaacatggat

SEQ ID NO: 544505 - DNA, 20 bp, mouse
gacattatttacttcttcca

SEQ ID NO: 544506 - DNA, 20 bp, mouse
gtggtggccacagtctgtgt

SEQ ID NO: 544507 - DNA, 20 bp, mouse
gcttaatagtaacaatgata

SEQ ID NO: 544508 - DNA, 20 bp, mouse
ggaatccacaattgttctcg

SEQ ID NO: 544509 - DNA, 20 bp, mouse
gtaagacaagcccggccctt

SEQ ID NO: 544510 - DNA, 20 bp, mouse
gatagaggcctctttcagca

SEQ ID NO: 544511 - DNA, 20 bp, mouse
ggtggattccctgctgaaag

SEQ ID NO: 544512 - DNA, 20 bp, mouse
gacatgggactcccaagggc

SEQ ID NO: 544513 - DNA, 20 bp, mouse
gcaggtctgtggaatgctgg

SEQ ID NO: 544514 - DNA, 20 bp, mouse
gtcatgaatcgccaggtctg

SEQ ID NO: 544515 - DNA, 20 bp, mouse
gtaaatgaaacgtgaagact

SEQ ID NO: 544516 - DNA, 20 bp, mouse
ggctgcaggtgatggtgaat

SEQ ID NO: 544517 - DNA, 20 bp, mouse
gtgctatctggctatcttaa

SEQ ID NO: 544518 - DNA, 20 bp, mouse
gagcctgggaatcacagtag

SEQ ID NO: 544519 - DNA, 20 bp, mouse
gcccaggctcatcagagact

SEQ ID NO: 544520 - DNA, 20 bp, mouse
gcattggttgttctattagg

SEQ ID NO: 544521 - DNA, 20 bp, mouse
gatacattggttgttctatt

SEQ ID NO: 544522 - DNA, 20 bp, mouse
gttgttcctgctttgctatc

SEQ ID NO: 544523 - DNA, 20 bp, mouse
gcacctctactgtgattccc

SEQ ID NO: 544524 - DNA, 20 bp, mouse
ggtcacagagttcattttca

SEQ ID NO: 544525 - DNA, 20 bp, mouse
gctcttcacttcccacttgc

SEQ ID NO: 544526 - DNA, 20 bp, mouse
gttccacacctgctagcaag

SEQ ID NO: 544527 - DNA, 20 bp, mouse
ggtgatggtgagaaggatga

SEQ ID NO: 544528 - DNA, 20 bp, mouse
ggctgcaggtgatggtgaga

SEQ ID NO: 544529 - DNA, 20 bp, mouse
gcacctccactgtgattccc

SEQ ID NO: 544530 - DNA, 20 bp, mouse
ggttccccattaagacagcc

SEQ ID NO: 544531 - DNA, 20 bp, mouse
gtgctacctggctgtcttaa

SEQ ID NO: 544532 - DNA, 20 bp, mouse
gtgtgattcccaggctcatc

SEQ ID NO: 544533 - DNA, 20 bp, mouse
ggtcacagagttcattttca

SEQ ID NO: 544534 - DNA, 20 bp, mouse
gtcactgcccacttgctagc

SEQ ID NO: 544535 - DNA, 20 bp, mouse
gagcctgggaatcacagtgg

SEQ ID NO: 544536 - DNA, 20 bp, mouse
gttaggcatgcagaagtgat

SEQ ID NO: 544537 - DNA, 20 bp, mouse
ggtctgcttcacatccacag

SEQ ID NO: 544538 - DNA, 20 bp, mouse
gatgcagaagtgatgggatt

SEQ ID NO: 544539 - DNA, 20 bp, mouse
gatcaatttaggggccactg

SEQ ID NO: 544540 - DNA, 20 bp, mouse
gaagtctattatcaatttag

SEQ ID NO: 544541 - DNA, 20 bp, mouse
gatacattggctgctcacta

SEQ ID NO: 544542 - DNA, 20 bp, mouse
gggttgttcttattactatt

SEQ ID NO: 544543 - DNA, 20 bp, mouse
gcagaaaaataaattctgtg

SEQ ID NO: 544544 - DNA, 20 bp, mouse
gttctttgacattctcatta

SEQ ID NO: 544545 - DNA, 20 bp, mouse
gataaaagcaccaatagctg

SEQ ID NO: 544546 - DNA, 20 bp, mouse
gatagaggcctccttctgta

SEQ ID NO: 544547 - DNA, 20 bp, mouse
gctgaatatcaatgtgacag

SEQ ID NO: 544548 - DNA, 20 bp, mouse
ggtggattccttacagaagg

SEQ ID NO: 544549 - DNA, 20 bp, mouse
gataagcaagttgcccagta

SEQ ID NO: 544550 - DNA, 20 bp, mouse
gattgtggattccttacaga

SEQ ID NO: 544551 - DNA, 20 bp, mouse
gtttcctgctcttttacatg

SEQ ID NO: 544552 - DNA, 20 bp, mouse
gtgaactaaagaatgcacgc

SEQ ID NO: 544553 - DNA, 20 bp, mouse
gggtccccatgtaaaagagc

SEQ ID NO: 544554 - DNA, 20 bp, mouse
gcaagacaagccaggctctt

SEQ ID NO: 544555 - DNA, 20 bp, mouse
gtgcacgcaggatcccatcc

SEQ ID NO: 544556 - DNA, 20 bp, mouse
ggatgcagcgagggagatgg

SEQ ID NO: 544557 - DNA, 20 bp, mouse
gcaaacactcgcagggacac

SEQ ID NO: 544558 - DNA, 20 bp, mouse
gtcagatgcagcgagggaga

SEQ ID NO: 544559 - DNA, 20 bp, mouse
gaccagcacaaacactcgca

SEQ ID NO: 544560 - DNA, 20 bp, mouse
gagtggggtcagatgcagcg

SEQ ID NO: 544561 - DNA, 20 bp, mouse
gtgtacgtggtgactgtcct

SEQ ID NO: 544562 - DNA, 20 bp, mouse
gtccctgcgagtgtttgtgc

SEQ ID NO: 544563 - DNA, 20 bp, mouse
ggggggaggtgcactgaccc

SEQ ID NO: 544564 - DNA, 20 bp, mouse
gtcgcagggacactggagtg

SEQ ID NO: 544565 - DNA, 20 bp, mouse
gccatttctgtgcactgctg

SEQ ID NO: 544566 - DNA, 20 bp, mouse
gattagctattctttctttc

SEQ ID NO: 544567 - DNA, 20 bp, mouse
gttgaagaaccttgtaactg

SEQ ID NO: 544568 - DNA, 20 bp, mouse
gaaaggccatagctgccagt

SEQ ID NO: 544569 - DNA, 20 bp, mouse
gtgttgcctactggcagcta

SEQ ID NO: 544570 - DNA, 20 bp, mouse
gacttgtctctcctggaaat

SEQ ID NO: 544571 - DNA, 20 bp, mouse
gtggactggtgcatatggca

SEQ ID NO: 544572 - DNA, 20 bp, mouse
gccctcgggcctcagttaca

SEQ ID NO: 544573 - DNA, 20 bp, mouse
gaagaacatgaggagaatca

SEQ ID NO: 544574 - DNA, 20 bp, mouse
gactcattcgggttgcatag

SEQ ID NO: 544575 - DNA, 20 bp, mouse
gcgggttgcatagtggagtg

SEQ ID NO: 544576 - DNA, 20 bp, mouse
gttcatttttatgggtcttt

SEQ ID NO: 544577 - DNA, 20 bp, mouse
gcccctccactgtgattcct

SEQ ID NO: 544578 - DNA, 20 bp, mouse
ggcctaggaatcacagtgga

SEQ ID NO: 544579 - DNA, 20 bp, mouse
gatgagcctaggaatcacag

SEQ ID NO: 544580 - DNA, 20 bp, mouse
ggtgatggtgagaaagatga

SEQ ID NO: 544581 - DNA, 20 bp, mouse
gcctaggctcatcagggact

SEQ ID NO: 544582 - DNA, 20 bp, mouse
ggttccccattaagacagcc

SEQ ID NO: 544583 - DNA, 20 bp, mouse
gtgctacctggctgtcttaa

SEQ ID NO: 544584 - DNA, 20 bp, mouse
gatcacagagttcattttta

SEQ ID NO: 544585 - DNA, 20 bp, mouse
ggaggtccatgagggaaaga

SEQ ID NO: 544586 - DNA, 20 bp, mouse
gtgatgactgagtaacgcaa

SEQ ID NO: 544587 - DNA, 20 bp, mouse
gtgtgacaatcaagttcagt

SEQ ID NO: 544588 - DNA, 20 bp, mouse
gagaaaaggacaaataaaat

SEQ ID NO: 544589 - DNA, 20 bp, mouse
ggaaaaacaggaatcagaaa

SEQ ID NO: 544590 - DNA, 20 bp, mouse
gcattgtgtcagtcccagag

SEQ ID NO: 544591 - DNA, 20 bp, mouse
gcaagttcagtcggacactt

SEQ ID NO: 544592 - DNA, 20 bp, mouse
ggcgttactcagtcatcatg

SEQ ID NO: 544593 - DNA, 20 bp, mouse
gttactcagtcatcatgagg

SEQ ID NO: 544594 - DNA, 20 bp, mouse
ggctgtggatgttgaaaaac

SEQ ID NO: 544595 - DNA, 20 bp, mouse
gtgattatagttgcctggat

SEQ ID NO: 544596 - DNA, 20 bp, mouse
gtgctgattcactacataaa

SEQ ID NO: 544597 - DNA, 20 bp, mouse
ggactgtttcataaattaga

SEQ ID NO: 544598 - DNA, 20 bp, mouse
gtacaaattcttttcattat

SEQ ID NO: 544599 - DNA, 20 bp, mouse
ggtgaatcagcaatcacttt

SEQ ID NO: 544600 - DNA, 20 bp, mouse
ggaccgagtttgttctcctg

SEQ ID NO: 544601 - DNA, 20 bp, mouse
gcagattctgtgtgagcccc

SEQ ID NO: 544602 - DNA, 20 bp, mouse
gactttaggtgtattgacag

SEQ ID NO: 544603 - DNA, 20 bp, mouse
gatcctagtgggagtgtcat

SEQ ID NO: 544604 - DNA, 20 bp, mouse
gcatagggtaccccaacagt

SEQ ID NO: 544605 - DNA, 20 bp, mouse
ggcatcaataaaagagagat

SEQ ID NO: 544606 - DNA, 20 bp, mouse
ggactgtctcataaactaga

SEQ ID NO: 544607 - DNA, 20 bp, mouse
gacaagattttctgcaactg

SEQ ID NO: 544608 - DNA, 20 bp, mouse
gaagtatcagcaagcagttt

SEQ ID NO: 544609 - DNA, 20 bp, mouse
gtgctgatactttccataaa

SEQ ID NO: 544610 - DNA, 20 bp, mouse
gtttaatagatttcctttta

SEQ ID NO: 544611 - DNA, 20 bp, mouse
gtctatgttttctctgtggc

SEQ ID NO: 544612 - DNA, 20 bp, mouse
gagtttaggtgtattgacag

SEQ ID NO: 544613 - DNA, 20 bp, mouse
gcggattctgtgtgagcccc

SEQ ID NO: 544614 - DNA, 20 bp, mouse
gatcctagtgggagtgtcat

SEQ ID NO: 544615 - DNA, 20 bp, mouse
gcatagggtaccccaacagt

SEQ ID NO: 544616 - DNA, 20 bp, mouse
gaagttcagtcgaacacttg

SEQ ID NO: 544617 - DNA, 20 bp, mouse
gtcttcttagttttctatat

SEQ ID NO: 544618 - DNA, 20 bp, mouse
gttacccagtcatcatgagg

SEQ ID NO: 544619 - DNA, 20 bp, mouse
ggaaaagcaggaatcagcaa

SEQ ID NO: 544620 - DNA, 20 bp, mouse
ggcattacccagtcatcatg

SEQ ID NO: 544621 - DNA, 20 bp, mouse
ggctgtggacgttgaaaagc

SEQ ID NO: 544622 - DNA, 20 bp, mouse
gtgattatagttgcctggat

SEQ ID NO: 544623 - DNA, 20 bp, mouse
gcctgccgcctcatgatgac

SEQ ID NO: 544624 - DNA, 20 bp, mouse
gcatttatttggctgcatgg

SEQ ID NO: 544625 - DNA, 20 bp, mouse
ggtctttgtcctcattttca

SEQ ID NO: 544626 - DNA, 20 bp, mouse
gtgatgactgggtatcgtaa

SEQ ID NO: 544627 - DNA, 20 bp, mouse
gcaagatgacacagacctgc

SEQ ID NO: 544628 - DNA, 20 bp, mouse
gtgattattcttgcctggat

SEQ ID NO: 544629 - DNA, 20 bp, mouse
gcatcttgattattcttgcc

SEQ ID NO: 544630 - DNA, 20 bp, mouse
gccagtcatcatgagccggc

SEQ ID NO: 544631 - DNA, 20 bp, mouse
ggaaaagcaggaatcagcaa

SEQ ID NO: 544632 - DNA, 20 bp, mouse
gatctttgtcctcattctca

SEQ ID NO: 544633 - DNA, 20 bp, mouse
ggatcccctgaagcagaaaa

SEQ ID NO: 544634 - DNA, 20 bp, mouse
gatactactaggattgacac

SEQ ID NO: 544635 - DNA, 20 bp, mouse
gtcacgaagtttatactact

SEQ ID NO: 544636 - DNA, 20 bp, mouse
ggtgtgtttgattatttaga

SEQ ID NO: 544637 - DNA, 20 bp, mouse
gacacagaagcaatgggata

SEQ ID NO: 544638 - DNA, 20 bp, mouse
gcagtaagataaattctgta

SEQ ID NO: 544639 - DNA, 20 bp, mouse
gatcaaagagatcaatgctt

SEQ ID NO: 544640 - DNA, 20 bp, mouse
ggtgaagcaaacatccatga

SEQ ID NO: 544641 - DNA, 20 bp, mouse
gtgccttgacatcctcatta

SEQ ID NO: 544642 - DNA, 20 bp, mouse
gtatgttacatccttgtgat

SEQ ID NO: 544643 - DNA, 20 bp, mouse
gctgggacttttccataatg

SEQ ID NO: 544644 - DNA, 20 bp, mouse
ggttgttcttcttactatca

SEQ ID NO: 544645 - DNA, 20 bp, mouse
gaaaaactgagcctatcaca

SEQ ID NO: 544646 - DNA, 20 bp, mouse
gcaagacaagccagaccctt

SEQ ID NO: 544647 - DNA, 20 bp, mouse
gtgaactaaagaatgaacac

SEQ ID NO: 544648 - DNA, 20 bp, mouse
gtgtttttgcttttttacat

SEQ ID NO: 544649 - DNA, 20 bp, mouse
ggtgttggtggccatagcct

SEQ ID NO: 544650 - DNA, 20 bp, mouse
gtctttagttcagatatttc

SEQ ID NO: 544651 - DNA, 20 bp, mouse
gtcactaatgagaaacaatg

SEQ ID NO: 544652 - DNA, 20 bp, mouse
gaagcaaaaacacaacaaat

SEQ ID NO: 544653 - DNA, 20 bp, mouse
gattttacttggtttgacac

SEQ ID NO: 544654 - DNA, 20 bp, mouse
gataggattttcttcctaaa

SEQ ID NO: 544655 - DNA, 20 bp, mouse
gacaattgttcttggagcta

SEQ ID NO: 544656 - DNA, 20 bp, mouse
ggtggctaatcagaaacgaa

SEQ ID NO: 544657 - DNA, 20 bp, mouse
ggggcacagagaaagcctga

SEQ ID NO: 544658 - DNA, 20 bp, mouse
gttcaatcccagcacaatat

SEQ ID NO: 544659 - DNA, 20 bp, mouse
gtaattctccaatattgtgc

SEQ ID NO: 544660 - DNA, 20 bp, mouse
gcacagagaaagcctgaagg

SEQ ID NO: 544661 - DNA, 20 bp, mouse
gtttctgattagccaccttc

SEQ ID NO: 544662 - DNA, 20 bp, mouse
gctttctctaagtccagtat

SEQ ID NO: 544663 - DNA, 20 bp, mouse
gttagaaaaagattattagg

SEQ ID NO: 544664 - DNA, 20 bp, mouse
gattgaacatctccatctca

SEQ ID NO: 544665 - DNA, 20 bp, mouse
gacagctaagttgccaatac

SEQ ID NO: 544666 - DNA, 20 bp, mouse
gaatgctgggctacagacaa

SEQ ID NO: 544667 - DNA, 20 bp, mouse
gtaacagaattcatattcct

SEQ ID NO: 544668 - DNA, 20 bp, mouse
ggggagtccacaaccatctt

SEQ ID NO: 544669 - DNA, 20 bp, mouse
gaactattttctggacttta

SEQ ID NO: 544670 - DNA, 20 bp, mouse
ggctctgtggcacacttatg

SEQ ID NO: 544671 - DNA, 20 bp, mouse
gagagaagcatgcatccaat

SEQ ID NO: 544672 - DNA, 20 bp, mouse
gttatggggatagcatggac

SEQ ID NO: 544673 - DNA, 20 bp, mouse
gatcacaccaaagatggttg

SEQ ID NO: 544674 - DNA, 20 bp, mouse
gtggggcagtctatcaatgc

SEQ ID NO: 544675 - DNA, 20 bp, mouse
gatagttttcttctcataca

SEQ ID NO: 544676 - DNA, 20 bp, mouse
gactctggtggggatagcat

SEQ ID NO: 544677 - DNA, 20 bp, mouse
gctgttacaatagtttggtt

SEQ ID NO: 544678 - DNA, 20 bp, mouse
gtctacatggcaacaattgg

SEQ ID NO: 544679 - DNA, 20 bp, mouse
ggaactctgttacaatagtt

SEQ ID NO: 544680 - DNA, 20 bp, mouse
gcagagtcaacaatcatctt

SEQ ID NO: 544681 - DNA, 20 bp, mouse
ggtcataagccatggatatt

SEQ ID NO: 544682 - DNA, 20 bp, mouse
ggtgattgtcctaatatcca

SEQ ID NO: 544683 - DNA, 20 bp, mouse
ggtggggatagcatgggcag

SEQ ID NO: 544684 - DNA, 20 bp, mouse
gtctgcactcctgcactgct

SEQ ID NO: 544685 - DNA, 20 bp, mouse
gtactattttctgaacagtt

SEQ ID NO: 544686 - DNA, 20 bp, mouse
gagtaagaactcagtgacaa

SEQ ID NO: 544687 - DNA, 20 bp, mouse
gatcacaccaaaggtaactg

SEQ ID NO: 544688 - DNA, 20 bp, mouse
gtcctctgtcatcacaccaa

SEQ ID NO: 544689 - DNA, 20 bp, mouse
ggcaagtccacagttacctt

SEQ ID NO: 544690 - DNA, 20 bp, mouse
gttctcaacaatacagtcaa

SEQ ID NO: 544691 - DNA, 20 bp, mouse
gataatggaagagtagtaca

SEQ ID NO: 544692 - DNA, 20 bp, mouse
gggctctgtggaattctgat

SEQ ID NO: 544693 - DNA, 20 bp, mouse
gagtgcacgactacatatga

SEQ ID NO: 544694 - DNA, 20 bp, mouse
gtatgtagtcgtgcacttct

SEQ ID NO: 544695 - DNA, 20 bp, mouse
gcatctacattgcaacagtt

SEQ ID NO: 544696 - DNA, 20 bp, mouse
gtggcagagaagtgaggaca

SEQ ID NO: 544697 - DNA, 20 bp, mouse
gacaaggctagcaatgggta

SEQ ID NO: 544698 - DNA, 20 bp, mouse
ggtgaggacaaggctagcaa

SEQ ID NO: 544699 - DNA, 20 bp, mouse
gttgcaaagtgcacattcag

SEQ ID NO: 544700 - DNA, 20 bp, mouse
gggttccctaatagaggtag

SEQ ID NO: 544701 - DNA, 20 bp, mouse
gatccacggaaaagcacata

SEQ ID NO: 544702 - DNA, 20 bp, mouse
gtgcaatagagattagaaga

SEQ ID NO: 544703 - DNA, 20 bp, mouse
gctctccactacctctatta

SEQ ID NO: 544704 - DNA, 20 bp, mouse
gagacaatttatcaatttag

SEQ ID NO: 544705 - DNA, 20 bp, mouse
gttttcacacaactgatcca

SEQ ID NO: 544706 - DNA, 20 bp, mouse
ggttatgcatgattctccaa

SEQ ID NO: 544707 - DNA, 20 bp, mouse
gtgtggacatgacttatgag

SEQ ID NO: 544708 - DNA, 20 bp, mouse
gagtgcaggactgtagacaa

SEQ ID NO: 544709 - DNA, 20 bp, mouse
gtctacagtcctgcactact

SEQ ID NO: 544710 - DNA, 20 bp, mouse
ggttgcccacaagagttgca

SEQ ID NO: 544711 - DNA, 20 bp, mouse
gctctttcatcatgaatcgg

SEQ ID NO: 544712 - DNA, 20 bp, mouse
ggtcacacctaagatgattg

SEQ ID NO: 544713 - DNA, 20 bp, mouse
gtgcaagaatcctccagccc

SEQ ID NO: 544714 - DNA, 20 bp, mouse
gctctgtggcactctggttg

SEQ ID NO: 544715 - DNA, 20 bp, mouse
ggtttaccttgcaactcttg

SEQ ID NO: 544716 - DNA, 20 bp, mouse
gagtacgaactcagttacaa

SEQ ID NO: 544717 - DNA, 20 bp, mouse
gatcgtgggtgtgacaatag

SEQ ID NO: 544718 - DNA, 20 bp, mouse
gataaatctataatcatcgt

SEQ ID NO: 544719 - DNA, 20 bp, mouse
ggaactcagttacaatggtt

SEQ ID NO: 544720 - DNA, 20 bp, mouse
gtaggagcttctcaactttt

SEQ ID NO: 544721 - DNA, 20 bp, mouse
ggctctgtggcatcctagtg

SEQ ID NO: 544722 - DNA, 20 bp, mouse
gctccacagcactgaagaag

SEQ ID NO: 544723 - DNA, 20 bp, mouse
ggctgtggaggtgatcattc

SEQ ID NO: 544724 - DNA, 20 bp, mouse
ggtaactgagttcgtactcc

SEQ ID NO: 544725 - DNA, 20 bp, mouse
gggaggcaacatgacaattg

SEQ ID NO: 544726 - DNA, 20 bp, mouse
gtaccgagttcataatctta

SEQ ID NO: 544727 - DNA, 20 bp, mouse
ggaactcggtaacagaactc

SEQ ID NO: 544728 - DNA, 20 bp, mouse
ggtctacatggcaactgtag

SEQ ID NO: 544729 - DNA, 20 bp, mouse
gttcttccatccttactcgg

SEQ ID NO: 544730 - DNA, 20 bp, mouse
gtctactgttacacccaaga

SEQ ID NO: 544731 - DNA, 20 bp, mouse
gacaatattttttcaatttt

SEQ ID NO: 544732 - DNA, 20 bp, mouse
ggtatttctattggtctaca

SEQ ID NO: 544733 - DNA, 20 bp, mouse
gttgtttgttgtatttctat

SEQ ID NO: 544734 - DNA, 20 bp, mouse
ggttttgcataattcttaag

SEQ ID NO: 544735 - DNA, 20 bp, mouse
gagccctaagattatgaact

SEQ ID NO: 544736 - DNA, 20 bp, mouse
gtagcattttctccacattc

SEQ ID NO: 544737 - DNA, 20 bp, mouse
ggtatgtacaatcttgttga

SEQ ID NO: 544738 - DNA, 20 bp, mouse
gagcagtctacaattatctt

SEQ ID NO: 544739 - DNA, 20 bp, mouse
gtgtagactgcttctatgaa

SEQ ID NO: 544740 - DNA, 20 bp, mouse
gagaagaagtgcatgcatcc

SEQ ID NO: 544741 - DNA, 20 bp, mouse
gggggcagaagtgattgtct

SEQ ID NO: 544742 - DNA, 20 bp, mouse
gctttcacagaacctgaatg

SEQ ID NO: 544743 - DNA, 20 bp, mouse
ggtgattgtcttggcatcca

SEQ ID NO: 544744 - DNA, 20 bp, mouse
gacagtccacttcttcactg

SEQ ID NO: 544745 - DNA, 20 bp, mouse
gttctgccccagtgaagaag

SEQ ID NO: 544746 - DNA, 20 bp, mouse
gtactgagttcataatcttg

SEQ ID NO: 544747 - DNA, 20 bp, mouse
gatcatcttgggtatgacag

SEQ ID NO: 544748 - DNA, 20 bp, mouse
ggaactcagtaacaaaactc

SEQ ID NO: 544749 - DNA, 20 bp, mouse
gggaagagacacatagatcc

SEQ ID NO: 544750 - DNA, 20 bp, mouse
ggagacacatagatccagga

SEQ ID NO: 544751 - DNA, 20 bp, mouse
ggtctatcttgcaactatag

SEQ ID NO: 544752 - DNA, 20 bp, mouse
gtttttccatccttacccgg

SEQ ID NO: 544753 - DNA, 20 bp, mouse
gcaaaatgctacagagcctc

SEQ ID NO: 544754 - DNA, 20 bp, mouse
gctatttttccatccttacc

SEQ ID NO: 544755 - DNA, 20 bp, mouse
gcagtattttctcaactatt

SEQ ID NO: 544756 - DNA, 20 bp, mouse
gtagtattttctccacatac

SEQ ID NO: 544757 - DNA, 20 bp, mouse
gcagagcctccgagtcatga

SEQ ID NO: 544758 - DNA, 20 bp, mouse
ggcagtctacaattatcttt

SEQ ID NO: 544759 - DNA, 20 bp, mouse
gctcttccatcatgactcgg

SEQ ID NO: 544760 - DNA, 20 bp, mouse
gtggtagtggtgtcttgggc

SEQ ID NO: 544761 - DNA, 20 bp, mouse
gattttggtagtggtgtctt

SEQ ID NO: 544762 - DNA, 20 bp, mouse
gcggaggctctgtggaattt

SEQ ID NO: 544763 - DNA, 20 bp, mouse
gctctgtggaattttggtag

SEQ ID NO: 544764 - DNA, 20 bp, mouse
gtagtggtgtcttgggcagg

SEQ ID NO: 544765 - DNA, 20 bp, mouse
gctttcacagaacctgtatg

SEQ ID NO: 544766 - DNA, 20 bp, mouse
gggggtatgtagggctgcac

SEQ ID NO: 544767 - DNA, 20 bp, mouse
gatgcaacacgaatgagtcg

SEQ ID NO: 544768 - DNA, 20 bp, mouse
gtcattacaattcttgcaga

SEQ ID NO: 544769 - DNA, 20 bp, mouse
gaagtacattggggtatgta

SEQ ID NO: 544770 - DNA, 20 bp, mouse
gacaaggctctgtaacatct

SEQ ID NO: 544771 - DNA, 20 bp, mouse
gttacagagccttgtaagtg

SEQ ID NO: 544772 - DNA, 20 bp, mouse
ggaggcccgagggatctcac

SEQ ID NO: 544773 - DNA, 20 bp, mouse
gatctccaggagagacaaat

SEQ ID NO: 544774 - DNA, 20 bp, mouse
gccgagggatctcacgggaa

SEQ ID NO: 544775 - DNA, 20 bp, mouse
gccatgaaactatggccaaa

SEQ ID NO: 544776 - DNA, 20 bp, mouse
ggaagtgcaagtatccaata

SEQ ID NO: 544777 - DNA, 20 bp, mouse
gtatacctagcaacaatcgg

SEQ ID NO: 544778 - DNA, 20 bp, mouse
ggggagaacccagcaatgca

SEQ ID NO: 544779 - DNA, 20 bp, mouse
gggtgcagaggtcattgtct

SEQ ID NO: 544780 - DNA, 20 bp, mouse
gctctttgtggtatttctgt

SEQ ID NO: 544781 - DNA, 20 bp, mouse
gtggtatacctagcaacaat

SEQ ID NO: 544782 - DNA, 20 bp, mouse
ggttgcctccgattgttgct

SEQ ID NO: 544783 - DNA, 20 bp, mouse
gagagtatattctcaatttt

SEQ ID NO: 544784 - DNA, 20 bp, mouse
gttgggggtagcctggacag

SEQ ID NO: 544785 - DNA, 20 bp, mouse
gcacttcttcactggtgcag

SEQ ID NO: 544786 - DNA, 20 bp, mouse
gtgtgttctgagaaagaccc

SEQ ID NO: 544787 - DNA, 20 bp, mouse
gtaacacctaagatgatcgt

SEQ ID NO: 544788 - DNA, 20 bp, mouse
ggtgttggtaggcatagcat

SEQ ID NO: 544789 - DNA, 20 bp, mouse
gtaatggacaggtagtgcaa

SEQ ID NO: 544790 - DNA, 20 bp, mouse
gcgtaggcttcttctatgaa

SEQ ID NO: 544791 - DNA, 20 bp, mouse
gaccgcagtaaagaagtgta

SEQ ID NO: 544792 - DNA, 20 bp, mouse
gcctcttgctcataatggac

SEQ ID NO: 544793 - DNA, 20 bp, mouse
gtgcatgattctcgagaaga

SEQ ID NO: 544794 - DNA, 20 bp, mouse
gaagtgtatggcaaacaatt

SEQ ID NO: 544795 - DNA, 20 bp, mouse
gtaggcatagcatgggctgg

SEQ ID NO: 544796 - DNA, 20 bp, mouse
gtgcatggttctcaagaaga

SEQ ID NO: 544797 - DNA, 20 bp, mouse
gagaggaagtgcaagcatcc

SEQ ID NO: 544798 - DNA, 20 bp, mouse
gctcaactcctgcaaagaag

SEQ ID NO: 544799 - DNA, 20 bp, mouse
gctctgtggcactctcgtaa

SEQ ID NO: 544800 - DNA, 20 bp, mouse
gtaatggtggcctggacagg

SEQ ID NO: 544801 - DNA, 20 bp, mouse
gtcgtaatggtggcctggac

SEQ ID NO: 544802 - DNA, 20 bp, mouse
gtgtggcactctcgtaatgg

SEQ ID NO: 544803 - DNA, 20 bp, mouse
gtgggggaactcaacagtgc

SEQ ID NO: 544804 - DNA, 20 bp, mouse
ggtgattatcttgacatcta

SEQ ID NO: 544805 - DNA, 20 bp, mouse
gcactctcgtaatggtggcc

SEQ ID NO: 544806 - DNA, 20 bp, mouse
ggttaagcataattcttaaa

SEQ ID NO: 544807 - DNA, 20 bp, mouse
gattctggtagggatagcct

SEQ ID NO: 544808 - DNA, 20 bp, mouse
ggactctgtgtcattctggt

SEQ ID NO: 544809 - DNA, 20 bp, mouse
gggaggcaacatagtaattg

SEQ ID NO: 544810 - DNA, 20 bp, mouse
gcagaatgacacagagtctc

SEQ ID NO: 544811 - DNA, 20 bp, mouse
gatctcctttgaatgttgta

SEQ ID NO: 544812 - DNA, 20 bp, mouse
gttgtctttcctttcattcc

SEQ ID NO: 544813 - DNA, 20 bp, mouse
ggcatgcatccaggaatgaa

SEQ ID NO: 544814 - DNA, 20 bp, mouse
ggtcactgagttcatacttc

SEQ ID NO: 544815 - DNA, 20 bp, mouse
gtattcagtcctgcactttt

SEQ ID NO: 544816 - DNA, 20 bp, mouse
gaactggtcttcttgttggt

SEQ ID NO: 544817 - DNA, 20 bp, mouse
gtcagaactggtcttcttgt

SEQ ID NO: 544818 - DNA, 20 bp, mouse
ggcacagtcaacacaaggtg

SEQ ID NO: 544819 - DNA, 20 bp, mouse
gagaccagttctgacagcga

SEQ ID NO: 544820 - DNA, 20 bp, mouse
gaactgacctcagtagaaac

SEQ ID NO: 544821 - DNA, 20 bp, mouse
gacacaaggtgaggctcatt

SEQ ID NO: 544822 - DNA, 20 bp, mouse
gaaatttggatgctgtggtt

SEQ ID NO: 544823 - DNA, 20 bp, mouse
gctatggaaatcctcattga

SEQ ID NO: 544824 - DNA, 20 bp, mouse
ggaaatcctcattgaaggta

SEQ ID NO: 544825 - DNA, 20 bp, mouse
gatattccttaccttcaatg

SEQ ID NO: 544826 - DNA, 20 bp, mouse
gatcatcttgggtgtgatta

SEQ ID NO: 544827 - DNA, 20 bp, mouse
gatcctagtcggaatagctt

SEQ ID NO: 544828 - DNA, 20 bp, mouse
gtagtcggaatagcttgggc

SEQ ID NO: 544829 - DNA, 20 bp, mouse
gggaagaaacacatgcatcc

SEQ ID NO: 544830 - DNA, 20 bp, mouse
gctgcaaagtgaagataatt

SEQ ID NO: 544831 - DNA, 20 bp, mouse
gtcggaatagcttgggcagg

SEQ ID NO: 544832 - DNA, 20 bp, mouse
ggaaacacatgcatccagga

SEQ ID NO: 544833 - DNA, 20 bp, mouse
ggtcactgagttcatactgc

SEQ ID NO: 544834 - DNA, 20 bp, mouse
ggtccacttcttcacagggg

SEQ ID NO: 544835 - DNA, 20 bp, mouse
gggaggaaacatcataattg

SEQ ID NO: 544836 - DNA, 20 bp, mouse
gaatcttgtgatggtgtcct

SEQ ID NO: 544837 - DNA, 20 bp, mouse
gttcatgattcataatatga

SEQ ID NO: 544838 - DNA, 20 bp, mouse
gctctgtggcaatcttgtga

SEQ ID NO: 544839 - DNA, 20 bp, mouse
ggaactcagtgacacagctc

SEQ ID NO: 544840 - DNA, 20 bp, mouse
gtcactgagttcatattcct

SEQ ID NO: 544841 - DNA, 20 bp, mouse
ggtgatagtactgtcagcca

SEQ ID NO: 544842 - DNA, 20 bp, mouse
gctcttccatcatgaaccgg

SEQ ID NO: 544843 - DNA, 20 bp, mouse
gaagattgccacagagcctc

SEQ ID NO: 544844 - DNA, 20 bp, mouse
gtgatggtgtcctgggcagg

SEQ ID NO: 544845 - DNA, 20 bp, mouse
gcacttcttcactgggatgg

SEQ ID NO: 544846 - DNA, 20 bp, mouse
ggaactcagtgacactactg

SEQ ID NO: 544847 - DNA, 20 bp, mouse
gtggtgatgttgtcttgggc

SEQ ID NO: 544848 - DNA, 20 bp, mouse
gttaatattcctgtcctttc

SEQ ID NO: 544849 - DNA, 20 bp, mouse
gcattttggtgatgttgtct

SEQ ID NO: 544850 - DNA, 20 bp, mouse
gaggagactctgtggcattt

SEQ ID NO: 544851 - DNA, 20 bp, mouse
ggaagtgcaagcatccagaa

SEQ ID NO: 544852 - DNA, 20 bp, mouse
ggtcataggccatggctgaa

SEQ ID NO: 544853 - DNA, 20 bp, mouse
gtgatgttgtcttgggcagg

SEQ ID NO: 544854 - DNA, 20 bp, mouse
gtcatgaccaggagactctg

SEQ ID NO: 544855 - DNA, 20 bp, mouse
ggtgcacttcttcactggga

SEQ ID NO: 544856 - DNA, 20 bp, mouse
gtaattaaatgaatttgaac

SEQ ID NO: 544857 - DNA, 20 bp, mouse
gaggtctaccatcatcttag

SEQ ID NO: 544858 - DNA, 20 bp, mouse
gggtagacctcttctatgaa

SEQ ID NO: 544859 - DNA, 20 bp, mouse
gactgtcacccctaagatga

SEQ ID NO: 544860 - DNA, 20 bp, mouse
gttgctattcactttttcac

SEQ ID NO: 544861 - DNA, 20 bp, mouse
gcactttttcactggaatag

SEQ ID NO: 544862 - DNA, 20 bp, mouse
gacagtatgttctcaacatt

SEQ ID NO: 544863 - DNA, 20 bp, mouse
ggtgattattttgtcagcca

SEQ ID NO: 544864 - DNA, 20 bp, mouse
gttacagtattctgttttac

SEQ ID NO: 544865 - DNA, 20 bp, mouse
gtgattttgcattgttttca

SEQ ID NO: 544866 - DNA, 20 bp, mouse
gcaaaaccagagttttataa

SEQ ID NO: 544867 - DNA, 20 bp, mouse
gggctctgtggtactctagt

SEQ ID NO: 544868 - DNA, 20 bp, mouse
gaaattatacattctctatt

SEQ ID NO: 544869 - DNA, 20 bp, mouse
gcaatagagacaagaaggcc

SEQ ID NO: 544870 - DNA, 20 bp, mouse
gtagtgggagtggcctggac

SEQ ID NO: 544871 - DNA, 20 bp, mouse
ggcatccaatagagacaaga

SEQ ID NO: 544872 - DNA, 20 bp, mouse
gtgggcattcatcttttcct

SEQ ID NO: 544873 - DNA, 20 bp, mouse
gtgtggtactctagtgggag

SEQ ID NO: 544874 - DNA, 20 bp, mouse
ggtgactgttgtttctactc

SEQ ID NO: 544875 - DNA, 20 bp, mouse
gtttctactccggcactgct

SEQ ID NO: 544876 - DNA, 20 bp, mouse
ggtagtgacttcattctggt

SEQ ID NO: 544877 - DNA, 20 bp, mouse
gagatcagcctcagttggaa

SEQ ID NO: 544878 - DNA, 20 bp, mouse
gttgtctacaccaggtgacg

SEQ ID NO: 544879 - DNA, 20 bp, mouse
ggtcagtagtgacttcattc

SEQ ID NO: 544880 - DNA, 20 bp, mouse
gcccaccagagtgagaagat

SEQ ID NO: 544881 - DNA, 20 bp, mouse
gacagatgtcaacaaaggag

SEQ ID NO: 544882 - DNA, 20 bp, mouse
gcccacagctgtgatagtct

SEQ ID NO: 544883 - DNA, 20 bp, mouse
gtcacctggtgtagacaaga

SEQ ID NO: 544884 - DNA, 20 bp, mouse
gagcagttgggggacaatac

SEQ ID NO: 544885 - DNA, 20 bp, mouse
gagttgggggacaatactgg

SEQ ID NO: 544886 - DNA, 20 bp, mouse
gcatactcggggactaacaa

SEQ ID NO: 544887 - DNA, 20 bp, mouse
ggagtatgctggctgatggt

SEQ ID NO: 544888 - DNA, 20 bp, mouse
ggagtagatgacatccaaaa

SEQ ID NO: 544889 - DNA, 20 bp, mouse
gacatgggagacctcagatt

SEQ ID NO: 544890 - DNA, 20 bp, mouse
gtgggtcatgcagccttcta

SEQ ID NO: 544891 - DNA, 20 bp, mouse
gctgatggtgggaggtgctt

SEQ ID NO: 544892 - DNA, 20 bp, mouse
gagtaggtttcccaaaagtg

SEQ ID NO: 544893 - DNA, 20 bp, mouse
gtatgctggctgatggtggg

SEQ ID NO: 544894 - DNA, 20 bp, mouse
gacactaccatctccctaga

SEQ ID NO: 544895 - DNA, 20 bp, mouse
gtttaccagctcacatcaaa

SEQ ID NO: 544896 - DNA, 20 bp, mouse
gcacattactgggaggactg

SEQ ID NO: 544897 - DNA, 20 bp, mouse
ggtggtaacagaggtgtaga

SEQ ID NO: 544898 - DNA, 20 bp, mouse
gggactgtggagctccattc

SEQ ID NO: 544899 - DNA, 20 bp, mouse
gcagaggaggacaatatcct

SEQ ID NO: 544900 - DNA, 20 bp, mouse
gcaaattcagtcacattact

SEQ ID NO: 544901 - DNA, 20 bp, mouse
ggaaggctttatatcctgaa

SEQ ID NO: 544902 - DNA, 20 bp, mouse
gcaccaccaggagtctgcag

SEQ ID NO: 544903 - DNA, 20 bp, mouse
gacattggagctgaaagggt

SEQ ID NO: 544904 - DNA, 20 bp, mouse
gaattgaccttctctaccag

SEQ ID NO: 544905 - DNA, 20 bp, mouse
gtgtcctcctctggtagaga

SEQ ID NO: 544906 - DNA, 20 bp, mouse
ggggagagcccagcagtgta

SEQ ID NO: 544907 - DNA, 20 bp, mouse
gtgttgaacacttcttgggt

SEQ ID NO: 544908 - DNA, 20 bp, mouse
gttttgaagatttggattct

SEQ ID NO: 544909 - DNA, 20 bp, mouse
ggtctgtggcacgctggtgg

SEQ ID NO: 544910 - DNA, 20 bp, mouse
gaaggtctgtggcacgctgg

SEQ ID NO: 544911 - DNA, 20 bp, mouse
gagcgtgccacagaccttcc

SEQ ID NO: 544912 - DNA, 20 bp, mouse
ggttgtttacattgcaacta

SEQ ID NO: 544913 - DNA, 20 bp, mouse
gtgtaacaatcctcctgccc

SEQ ID NO: 544914 - DNA, 20 bp, mouse
gttgcatgattttgaaggaa

SEQ ID NO: 544915 - DNA, 20 bp, mouse
gctttttgttgaacacttct

SEQ ID NO: 544916 - DNA, 20 bp, mouse
ggctggggagcgctgaagtg

SEQ ID NO: 544917 - DNA, 20 bp, mouse
ggttctgagtcagtcccatg

SEQ ID NO: 544918 - DNA, 20 bp, mouse
gatcttaggaatgatagaag

SEQ ID NO: 544919 - DNA, 20 bp, mouse
gtaggacacagcaattgtgg

SEQ ID NO: 544920 - DNA, 20 bp, mouse
ggaagaattctctgcagctg

SEQ ID NO: 544921 - DNA, 20 bp, mouse
gctgaagtgaggagttagcc

SEQ ID NO: 544922 - DNA, 20 bp, mouse
gacctctgcactatgtgaca

SEQ ID NO: 544923 - DNA, 20 bp, mouse
gtatccaacataccccgact

SEQ ID NO: 544924 - DNA, 20 bp, mouse
ggactaggacacagcaattg

SEQ ID NO: 544925 - DNA, 20 bp, mouse
gaggaaacctgctcattgtc

SEQ ID NO: 544926 - DNA, 20 bp, mouse
gcataggagagccgagggag

SEQ ID NO: 544927 - DNA, 20 bp, mouse
gcagaatccagaaggccaaa

SEQ ID NO: 544928 - DNA, 20 bp, mouse
ggcacactcagaagagcata

SEQ ID NO: 544929 - DNA, 20 bp, mouse
gatacaagcccggaaggaga

SEQ ID NO: 544930 - DNA, 20 bp, mouse
gtcatggctagccactccct

SEQ ID NO: 544931 - DNA, 20 bp, mouse
gtgagtcatacaagcccgga

SEQ ID NO: 544932 - DNA, 20 bp, mouse
ggaagtacataggagagccg

SEQ ID NO: 544933 - DNA, 20 bp, mouse
gataatcattttgggagcaa

SEQ ID NO: 544934 - DNA, 20 bp, mouse
ggctgaggttattcttctgg

SEQ ID NO: 544935 - DNA, 20 bp, mouse
gtgctgggggcctggattgg

SEQ ID NO: 544936 - DNA, 20 bp, mouse
ggtagacacgtaaatgccac

SEQ ID NO: 544937 - DNA, 20 bp, mouse
gtatatcaatctagttacaa

SEQ ID NO: 544938 - DNA, 20 bp, mouse
gcgacttttttgcattcctg

SEQ ID NO: 544939 - DNA, 20 bp, mouse
gtatgactttcagggatcaa

SEQ ID NO: 544940 - DNA, 20 bp, mouse
gtatatttaatgcaagtgaa

SEQ ID NO: 544941 - DNA, 20 bp, mouse
gtacttttgaactcaaatat

SEQ ID NO: 544942 - DNA, 20 bp, mouse
gcaagaattcttacatgaga

SEQ ID NO: 544943 - DNA, 20 bp, mouse
gtcatactttagtttgctga

SEQ ID NO: 544944 - DNA, 20 bp, mouse
gaactaaagtatgactttca

SEQ ID NO: 544945 - DNA, 20 bp, mouse
gtcccataaatatgttagct

SEQ ID NO: 544946 - DNA, 20 bp, mouse
ggagggactggcaatcactg

SEQ ID NO: 544947 - DNA, 20 bp, mouse
gaacttgggtgatgtggaag

SEQ ID NO: 544948 - DNA, 20 bp, mouse
gataatcaacttgggtgatg

SEQ ID NO: 544949 - DNA, 20 bp, mouse
gcactgtggccacaataagc

SEQ ID NO: 544950 - DNA, 20 bp, mouse
gtaagtgctcaataaagagt

SEQ ID NO: 544951 - DNA, 20 bp, mouse
gatgatggtcaaatagtgaa

SEQ ID NO: 544952 - DNA, 20 bp, mouse
ggtaggccatcaccaccagc

SEQ ID NO: 544953 - DNA, 20 bp, mouse
gcaaatctgccggttcatga

SEQ ID NO: 544954 - DNA, 20 bp, mouse
gaatgagatagtctttttgt

SEQ ID NO: 544955 - DNA, 20 bp, mouse
gacaatgctttctgtccagc

SEQ ID NO: 544956 - DNA, 20 bp, mouse
ggcctgactcagagtcctga

SEQ ID NO: 544957 - DNA, 20 bp, mouse
ggccttcaggactctgagtc

SEQ ID NO: 544958 - DNA, 20 bp, mouse
ggtaagtctataatcatatt

SEQ ID NO: 544959 - DNA, 20 bp, mouse
ggtcatctatgttgtgacaa

SEQ ID NO: 544960 - DNA, 20 bp, mouse
gcatgggggcatctaaactt

SEQ ID NO: 544961 - DNA, 20 bp, mouse
ggcatgagccagcttttcat

SEQ ID NO: 544962 - DNA, 20 bp, mouse
gatcatatttggtgtaactg

SEQ ID NO: 544963 - DNA, 20 bp, mouse
gatgatggtcagataatgta

SEQ ID NO: 544964 - DNA, 20 bp, mouse
gcacacacgttggttcatga

SEQ ID NO: 544965 - DNA, 20 bp, mouse
gtcataggacacttgtttgg

SEQ ID NO: 544966 - DNA, 20 bp, mouse
gatttcagggatagtcacaa

SEQ ID NO: 544967 - DNA, 20 bp, mouse
ggcagaggtccagaagagaa

SEQ ID NO: 544968 - DNA, 20 bp, mouse
gtcagggatagtcacaatgg

SEQ ID NO: 544969 - DNA, 20 bp, mouse
gtgtaaaatatccaatttca

SEQ ID NO: 544970 - DNA, 20 bp, mouse
gagtgctcgtagtatagcag

SEQ ID NO: 544971 - DNA, 20 bp, mouse
gggggtctaggcgggaaact

SEQ ID NO: 544972 - DNA, 20 bp, mouse
gtaaggttgaccaacatctg

SEQ ID NO: 544973 - DNA, 20 bp, mouse
gaggtgtctccagccaaggc

SEQ ID NO: 544974 - DNA, 20 bp, mouse
ggtcaagctgggggtctagg

SEQ ID NO: 544975 - DNA, 20 bp, mouse
gatggagatattaccaaata

SEQ ID NO: 544976 - DNA, 20 bp, mouse
gaattaatcaggagtgaatt

SEQ ID NO: 544977 - DNA, 20 bp, mouse
gttaattggaacagattaaa

SEQ ID NO: 544978 - DNA, 20 bp, mouse
gggtcatgtttacaatttcg

SEQ ID NO: 544979 - DNA, 20 bp, mouse
gcactgtctccacaatgagt

SEQ ID NO: 544980 - DNA, 20 bp, mouse
ggtaggccatgaagaccaaa

SEQ ID NO: 544981 - DNA, 20 bp, mouse
gatcctgtgtaagacccagc

SEQ ID NO: 544982 - DNA, 20 bp, mouse
gtttccgtttcagcttgcat

SEQ ID NO: 544983 - DNA, 20 bp, mouse
ggtcttccttttggtcttca

SEQ ID NO: 544984 - DNA, 20 bp, mouse
gaatttggagataagaactc

SEQ ID NO: 544985 - DNA, 20 bp, mouse
gatcctgctgggtcttacac

SEQ ID NO: 544986 - DNA, 20 bp, mouse
ggcctcactcaagatcatgt

SEQ ID NO: 544987 - DNA, 20 bp, mouse
ggcatccagaagtgacagat

SEQ ID NO: 544988 - DNA, 20 bp, mouse
gatgatcttgagtgaggccc

SEQ ID NO: 544989 - DNA, 20 bp, mouse
ggacctcagcaccaccaagt

SEQ ID NO: 544990 - DNA, 20 bp, mouse
gtccaacatgatcttgagtg

SEQ ID NO: 544991 - DNA, 20 bp, mouse
ggactttcaagaaggtcaat

SEQ ID NO: 544992 - DNA, 20 bp, mouse
gacattggagtccctaagga

SEQ ID NO: 544993 - DNA, 20 bp, mouse
gccaggaaaccaccaatagg

SEQ ID NO: 544994 - DNA, 20 bp, mouse
gagcccaggaaaccaccaat

SEQ ID NO: 544995 - DNA, 20 bp, mouse
gaagtacattggagtcccta

SEQ ID NO: 544996 - DNA, 20 bp, mouse
gtcccccttaaaaggtcaat

SEQ ID NO: 544997 - DNA, 20 bp, mouse
gtcccattgaccttttaagg

SEQ ID NO: 544998 - DNA, 20 bp, mouse
gtgaaataatcccccttaaa

SEQ ID NO: 544999 - DNA, 20 bp, mouse
gtagaagaatgcacaccctc

SEQ ID NO: 545000 - DNA, 20 bp, mouse
gctgtcccattgacctttta

SEQ ID NO: 545001 - DNA, 20 bp, mouse
gcactgtaagtgcaatgagc

SEQ ID NO: 545002 - DNA, 20 bp, mouse
gttgaccatcatgaaccaga

SEQ ID NO: 545003 - DNA, 20 bp, mouse
gcttacattgtgacaatgtt

SEQ ID NO: 545004 - DNA, 20 bp, mouse
gttcttctattgctgatagc

SEQ ID NO: 545005 - DNA, 20 bp, mouse
gacaagtctataatcaaatt

SEQ ID NO: 545006 - DNA, 20 bp, mouse
ggttctctgtaatgatggat

SEQ ID NO: 545007 - DNA, 20 bp, mouse
ggtatcactattgtatatac

SEQ ID NO: 545008 - DNA, 20 bp, mouse
gctctagttctctgtaatga

SEQ ID NO: 545009 - DNA, 20 bp, mouse
gctccacaaaatgtactaca

SEQ ID NO: 545010 - DNA, 20 bp, mouse
ggggttaatgccatacctaa

SEQ ID NO: 545011 - DNA, 20 bp, mouse
gatataagcacctttaggta

SEQ ID NO: 545012 - DNA, 20 bp, mouse
ggagaaaaggcttcacgtga

SEQ ID NO: 545013 - DNA, 20 bp, mouse
gaattagctttatgcattaa

SEQ ID NO: 545014 - DNA, 20 bp, mouse
gatgaaagtgaccaaatttg

SEQ ID NO: 545015 - DNA, 20 bp, mouse
gttactgctccttttagcat

SEQ ID NO: 545016 - DNA, 20 bp, mouse
gcccagcaggatcttgagta

SEQ ID NO: 545017 - DNA, 20 bp, mouse
gcccagcattgtcacaatgt

SEQ ID NO: 545018 - DNA, 20 bp, mouse
gttctcctacaaaggtcaat

SEQ ID NO: 545019 - DNA, 20 bp, mouse
gctgtcccattgacctttgt

SEQ ID NO: 545020 - DNA, 20 bp, mouse
gaataaacctataatcaaat

SEQ ID NO: 545021 - DNA, 20 bp, mouse
gtctcacccaatttgattat

SEQ ID NO: 545022 - DNA, 20 bp, mouse
gcaccgtcactgcaatgagc

SEQ ID NO: 545023 - DNA, 20 bp, mouse
gataaggcttttttcccagc

SEQ ID NO: 545024 - DNA, 20 bp, mouse
gaacctgctcattgcagtga

SEQ ID NO: 545025 - DNA, 20 bp, mouse
gacctacattgtgacaatgc

SEQ ID NO: 545026 - DNA, 20 bp, mouse
gagctcctaagaacagaatc

SEQ ID NO: 545027 - DNA, 20 bp, mouse
gtctaatataatccactgac

SEQ ID NO: 545028 - DNA, 20 bp, mouse
gtacattggagaacccaagg

SEQ ID NO: 545029 - DNA, 20 bp, mouse
gcttgcctctctatcactct

SEQ ID NO: 545030 - DNA, 20 bp, mouse
ggactgtcaccacaataagc

SEQ ID NO: 545031 - DNA, 20 bp, mouse
ggttgatattgttattctgg

SEQ ID NO: 545032 - DNA, 20 bp, mouse
gctcatctacattgtaacca

SEQ ID NO: 545033 - DNA, 20 bp, mouse
gtgataattgcctggactgg

SEQ ID NO: 545034 - DNA, 20 bp, mouse
gtgttgataattgcctggac

SEQ ID NO: 545035 - DNA, 20 bp, mouse
gtgtaagccactgcactatt

SEQ ID NO: 545036 - DNA, 20 bp, mouse
ggcccagtgaaaggttcaat

SEQ ID NO: 545037 - DNA, 20 bp, mouse
gatcctgagtgagccccaaa

SEQ ID NO: 545038 - DNA, 20 bp, mouse
gttgataacagcccagtgaa

SEQ ID NO: 545039 - DNA, 20 bp, mouse
gctcccattgaacctttcac

SEQ ID NO: 545040 - DNA, 20 bp, mouse
gaaatcttgatcttatgaga

SEQ ID NO: 545041 - DNA, 20 bp, mouse
gagttgaataaacaatgtcc

SEQ ID NO: 545042 - DNA, 20 bp, mouse
gactgagattgtcattctgg

SEQ ID NO: 545043 - DNA, 20 bp, mouse
gcaccatcagcacaatgagc

SEQ ID NO: 545044 - DNA, 20 bp, mouse
gataatactttttgacctgc

SEQ ID NO: 545045 - DNA, 20 bp, mouse
gaacctgctcattgtgctga

SEQ ID NO: 545046 - DNA, 20 bp, mouse
ggcctcactcaggatcctac

SEQ ID NO: 545047 - DNA, 20 bp, mouse
ggcaagtcagatgactaaat

SEQ ID NO: 545048 - DNA, 20 bp, mouse
gcattggggaattcaaggag

SEQ ID NO: 545049 - DNA, 20 bp, mouse
gtgtacattgtgactattgt

SEQ ID NO: 545050 - DNA, 20 bp, mouse
gctaagtctttaagcaactt

SEQ ID NO: 545051 - DNA, 20 bp, mouse
gataggccatcaccaccaga

SEQ ID NO: 545052 - DNA, 20 bp, mouse
gaagtacattggggaattca

SEQ ID NO: 545053 - DNA, 20 bp, mouse
gcaggtttgtatctcacttt

SEQ ID NO: 545054 - DNA, 20 bp, mouse
gtttggtggtagcctgggtt

SEQ ID NO: 545055 - DNA, 20 bp, mouse
gtcacttttggtggtagcct

SEQ ID NO: 545056 - DNA, 20 bp, mouse
ggtccagggtctcaatgtcc

SEQ ID NO: 545057 - DNA, 20 bp, mouse
gtgccaggacattgagaccc

SEQ ID NO: 545058 - DNA, 20 bp, mouse
gaaaacatgtggtctctgtg

SEQ ID NO: 545059 - DNA, 20 bp, mouse
ggtttaaggaaatctgtcca

SEQ ID NO: 545060 - DNA, 20 bp, mouse
gcaaaaggctttagttaagg

SEQ ID NO: 545061 - DNA, 20 bp, mouse
gcatcaaaaggctttagtta

SEQ ID NO: 545062 - DNA, 20 bp, mouse
gaaatacaaaattaacaaca

SEQ ID NO: 545063 - DNA, 20 bp, mouse
gtcacagttttgatgagttg

SEQ ID NO: 545064 - DNA, 20 bp, mouse
ggtttttaagaaagagtgct

SEQ ID NO: 545065 - DNA, 20 bp, mouse
gttcagtgttcctatacttc

SEQ ID NO: 545066 - DNA, 20 bp, mouse
gctatctgaccataatgaaa

SEQ ID NO: 545067 - DNA, 20 bp, mouse
gcggcaggtttgcattctct

SEQ ID NO: 545068 - DNA, 20 bp, mouse
gcaggtttgcattctcttgg

SEQ ID NO: 545069 - DNA, 20 bp, mouse
gctgaccataatgaaacggc

SEQ ID NO: 545070 - DNA, 20 bp, mouse
gtctcttggtggtggtgtcc

SEQ ID NO: 545071 - DNA, 20 bp, mouse
gcaaacctgccgtttcatta

SEQ ID NO: 545072 - DNA, 20 bp, mouse
gatctacattgtgaaaatag

SEQ ID NO: 545073 - DNA, 20 bp, mouse
gtcccatttactcttcaata

SEQ ID NO: 545074 - DNA, 20 bp, mouse
ggtttgcattctcttggtgg

SEQ ID NO: 545075 - DNA, 20 bp, mouse
gaccttattgaagagtaaat

SEQ ID NO: 545076 - DNA, 20 bp, mouse
gactatcaacttgggtgtga

SEQ ID NO: 545077 - DNA, 20 bp, mouse
ggttgacattgtcattctgc

SEQ ID NO: 545078 - DNA, 20 bp, mouse
gtgtgcaagacctcccgccc

SEQ ID NO: 545079 - DNA, 20 bp, mouse
gattgtcattctgctggcaa

SEQ ID NO: 545080 - DNA, 20 bp, mouse
gagggtatgtattctcttct

SEQ ID NO: 545081 - DNA, 20 bp, mouse
gtcttggtgatggcctgggc

SEQ ID NO: 545082 - DNA, 20 bp, mouse
ggtcctgctgggcttcactc

SEQ ID NO: 545083 - DNA, 20 bp, mouse
gacctgatagatgaataaat

SEQ ID NO: 545084 - DNA, 20 bp, mouse
gatcctgagtgaagcccagc

SEQ ID NO: 545085 - DNA, 20 bp, mouse
ggggcaacctgctcatcgta

SEQ ID NO: 545086 - DNA, 20 bp, mouse
gcactcttgagactctattt

SEQ ID NO: 545087 - DNA, 20 bp, mouse
gcatgggagaatgcagacgt

SEQ ID NO: 545088 - DNA, 20 bp, mouse
gcatacctgttggccatcat

SEQ ID NO: 545089 - DNA, 20 bp, mouse
gcgttggtccaaggtgatga

SEQ ID NO: 545090 - DNA, 20 bp, mouse
ggaatgcagacgttggtcca

SEQ ID NO: 545091 - DNA, 20 bp, mouse
gtgaatgtgagcttcaagac

SEQ ID NO: 545092 - DNA, 20 bp, mouse
gtaattgtctcatactgcag

SEQ ID NO: 545093 - DNA, 20 bp, mouse
gagaatagctacttctgatg

SEQ ID NO: 545094 - DNA, 20 bp, mouse
gcacagtgatgtcttatgac

SEQ ID NO: 545095 - DNA, 20 bp, mouse
gcaaactcactcatggacaa

SEQ ID NO: 545096 - DNA, 20 bp, mouse
gtttcagtgattaagagttc

SEQ ID NO: 545097 - DNA, 20 bp, mouse
gttgtggagcacttattcgg

SEQ ID NO: 545098 - DNA, 20 bp, mouse
gacattattgaagagtaaat

SEQ ID NO: 545099 - DNA, 20 bp, mouse
ggttgtactttttggaagaa

SEQ ID NO: 545100 - DNA, 20 bp, mouse
gtttggaagaatggaagtct

SEQ ID NO: 545101 - DNA, 20 bp, mouse
ggtaaatctgtaagcaactt

SEQ ID NO: 545102 - DNA, 20 bp, mouse
gcacttattcggtggttctg

SEQ ID NO: 545103 - DNA, 20 bp, mouse
gggttctgaggtcttcattt

SEQ ID NO: 545104 - DNA, 20 bp, mouse
gtgtctggttcagctttttg

SEQ ID NO: 545105 - DNA, 20 bp, mouse
gctgatgaagttgtactttt

SEQ ID NO: 545106 - DNA, 20 bp, mouse
gttgaggtacagtctcagca

SEQ ID NO: 545107 - DNA, 20 bp, mouse
ggaagtgaagcactcaaatg

SEQ ID NO: 545108 - DNA, 20 bp, mouse
gcatttgggtagtctcatct

SEQ ID NO: 545109 - DNA, 20 bp, mouse
gtcttcattcttagcatttc

SEQ ID NO: 545110 - DNA, 20 bp, mouse
ggtcatttgataatttttct

SEQ ID NO: 545111 - DNA, 20 bp, mouse
gtttatgatactcttttgag

SEQ ID NO: 545112 - DNA, 20 bp, mouse
gtttttacagtaagtatgga

SEQ ID NO: 545113 - DNA, 20 bp, mouse
gcttactgtaaaaaacattt

SEQ ID NO: 545114 - DNA, 20 bp, mouse
gtttgttgtgatgtatgaca

SEQ ID NO: 545115 - DNA, 20 bp, mouse
gtgttttatggaaatatact

SEQ ID NO: 545116 - DNA, 20 bp, mouse
gtgatcctgttaacaggtca

SEQ ID NO: 545117 - DNA, 20 bp, mouse
gattgtcattctagttgcaa

SEQ ID NO: 545118 - DNA, 20 bp, mouse
gcctgttaacaggtcatggg

SEQ ID NO: 545119 - DNA, 20 bp, mouse
gccaggccatcaccaagaag

SEQ ID NO: 545120 - DNA, 20 bp, mouse
gtgtacattgcaacaatggt

SEQ ID NO: 545121 - DNA, 20 bp, mouse
gctgatgtacattgcaacaa

SEQ ID NO: 545122 - DNA, 20 bp, mouse
gagggtatgtatcctcttct

SEQ ID NO: 545123 - DNA, 20 bp, mouse
ggcctgatagatgaataaat

SEQ ID NO: 545124 - DNA, 20 bp, mouse
ggtcctgctgggcttcactc

SEQ ID NO: 545125 - DNA, 20 bp, mouse
gtctttcagacaaagagctc

SEQ ID NO: 545126 - DNA, 20 bp, mouse
gtcccatttactcttcaagg

SEQ ID NO: 545127 - DNA, 20 bp, mouse
gtaggttttggtcacaatta

SEQ ID NO: 545128 - DNA, 20 bp, mouse
gtcatgaagatgaatttttt

SEQ ID NO: 545129 - DNA, 20 bp, mouse
gtcaaggaggattttattag

SEQ ID NO: 545130 - DNA, 20 bp, mouse
gctgtcccatttactcttca

SEQ ID NO: 545131 - DNA, 20 bp, mouse
gagaatggaagtctaggttt

SEQ ID NO: 545132 - DNA, 20 bp, mouse
gctatttgaccataatgaat

SEQ ID NO: 545133 - DNA, 20 bp, mouse
gatgaatttttttggcagaa

SEQ ID NO: 545134 - DNA, 20 bp, mouse
gaggatcctgagtgagacca

SEQ ID NO: 545135 - DNA, 20 bp, mouse
gaagtacattggggatccca

SEQ ID NO: 545136 - DNA, 20 bp, mouse
gttgattatcatgaatcgac

SEQ ID NO: 545137 - DNA, 20 bp, mouse
ggttgatattgtcattctcg

SEQ ID NO: 545138 - DNA, 20 bp, mouse
gcgggtatgtattcttttct

SEQ ID NO: 545139 - DNA, 20 bp, mouse
gtgtacaaaacctcccaccc

SEQ ID NO: 545140 - DNA, 20 bp, mouse
gtcttggtgatggcctgggt

SEQ ID NO: 545141 - DNA, 20 bp, mouse
gtgtacattgcaacaatggt

SEQ ID NO: 545142 - DNA, 20 bp, mouse
gctgatgtacattgcaacaa

SEQ ID NO: 545143 - DNA, 20 bp, mouse
gtggtgatggcctgggtggg

SEQ ID NO: 545144 - DNA, 20 bp, mouse
ggtcctgctgggcttcactc

SEQ ID NO: 545145 - DNA, 20 bp, mouse
ggcctgatagatgaataaat

SEQ ID NO: 545146 - DNA, 20 bp, mouse
ggcctcataagaagagtaaa

SEQ ID NO: 545147 - DNA, 20 bp, mouse
gctcctggtgatggcaacct

SEQ ID NO: 545148 - DNA, 20 bp, mouse
gggagggtttgcacactcca

SEQ ID NO: 545149 - DNA, 20 bp, mouse
gtggtgatggcaacctgggt

SEQ ID NO: 545150 - DNA, 20 bp, mouse
gcccatttactcttcttatg

SEQ ID NO: 545151 - DNA, 20 bp, mouse
gtaagtgttccacaaagagt

SEQ ID NO: 545152 - DNA, 20 bp, mouse
ggatggcaacctgggttgga

SEQ ID NO: 545153 - DNA, 20 bp, mouse
gataatgctttttggccaac

SEQ ID NO: 545154 - DNA, 20 bp, mouse
gcaccgggtttgcattctcc

SEQ ID NO: 545155 - DNA, 20 bp, mouse
ggcaactgagatcttccttc

SEQ ID NO: 545156 - DNA, 20 bp, mouse
gccagtattaataatgaccc

SEQ ID NO: 545157 - DNA, 20 bp, mouse
gcaagcttaatgtatttgtt

SEQ ID NO: 545158 - DNA, 20 bp, mouse
gaatggaaattagtgtgcca

SEQ ID NO: 545159 - DNA, 20 bp, mouse
gttatatgtaaaacatttaa

SEQ ID NO: 545160 - DNA, 20 bp, mouse
gagctaatatctcttgaggg

SEQ ID NO: 545161 - DNA, 20 bp, mouse
gctccaacatttaatataaa

SEQ ID NO: 545162 - DNA, 20 bp, mouse
gatattagctaaatatgtct

SEQ ID NO: 545163 - DNA, 20 bp, mouse
gtttagctaatatctcttga

SEQ ID NO: 545164 - DNA, 20 bp, mouse
gatttaatataaaaggtagg

SEQ ID NO: 545165 - DNA, 20 bp, mouse
gggtggaaagtctcacctgc

SEQ ID NO: 545166 - DNA, 20 bp, mouse
gtgaacacatggagaataaa

SEQ ID NO: 545167 - DNA, 20 bp, mouse
gatgaatgacactgaacaca

SEQ ID NO: 545168 - DNA, 20 bp, mouse
gataagccatcactgtcaac

SEQ ID NO: 545169 - DNA, 20 bp, mouse
gtgtacatgataacaatttc

SEQ ID NO: 545170 - DNA, 20 bp, mouse
gtgtatctatcaaggagagg

SEQ ID NO: 545171 - DNA, 20 bp, mouse
gagctttggagctgaagaag

SEQ ID NO: 545172 - DNA, 20 bp, mouse
ggggagtccgcaatcagctt

SEQ ID NO: 545173 - DNA, 20 bp, mouse
gtatcaaggagaggtggctc

SEQ ID NO: 545174 - DNA, 20 bp, mouse
gaattgtatctatcaaggag

SEQ ID NO: 545175 - DNA, 20 bp, mouse
ggtgtaaattgtatctatca

SEQ ID NO: 545176 - DNA, 20 bp, mouse
gggcctctcagagaatccaa

SEQ ID NO: 545177 - DNA, 20 bp, mouse
gaggcccaagaggacaaagt

SEQ ID NO: 545178 - DNA, 20 bp, mouse
gcccaccatagtcaaaacat

SEQ ID NO: 545179 - DNA, 20 bp, mouse
gtaacctactttgtcctctt

SEQ ID NO: 545180 - DNA, 20 bp, mouse
gcacctttggattctctgag

SEQ ID NO: 545181 - DNA, 20 bp, mouse
gagtaggttacattgttcct

SEQ ID NO: 545182 - DNA, 20 bp, mouse
ggaaagaataaatggaacca

SEQ ID NO: 545183 - DNA, 20 bp, mouse
gtaactaccagtaacagcct

SEQ ID NO: 545184 - DNA, 20 bp, mouse
gggtgagcccaggctgttac

SEQ ID NO: 545185 - DNA, 20 bp, mouse
ggaaatacattggtgagccc

SEQ ID NO: 545186 - DNA, 20 bp, mouse
ggagggctgcacgttctgtc

SEQ ID NO: 545187 - DNA, 20 bp, mouse
ggtaactgacacaattgcta

SEQ ID NO: 545188 - DNA, 20 bp, mouse
gattgtgtcagttacaaaga

SEQ ID NO: 545189 - DNA, 20 bp, mouse
gcttttttaaagcatgagtt

SEQ ID NO: 545190 - DNA, 20 bp, mouse
ggtggctaatctccataaca

SEQ ID NO: 545191 - DNA, 20 bp, mouse
gggtaggttaaacctctgga

SEQ ID NO: 545192 - DNA, 20 bp, mouse
gaggaggtaggttaaacctc

SEQ ID NO: 545193 - DNA, 20 bp, mouse
gctgcaaagaagctctcaaa

SEQ ID NO: 545194 - DNA, 20 bp, mouse
ggctgcacgttctgtctggc

SEQ ID NO: 545195 - DNA, 20 bp, mouse
ggtttatatcaacatagaag

SEQ ID NO: 545196 - DNA, 20 bp, mouse
gagtttaggggtgctaacag

SEQ ID NO: 545197 - DNA, 20 bp, mouse
ggaatctgctatcagtttag

SEQ ID NO: 545198 - DNA, 20 bp, mouse
gtgggagtgtcatggctagg

SEQ ID NO: 545199 - DNA, 20 bp, mouse
gaataatgacgtagaagtta

SEQ ID NO: 545200 - DNA, 20 bp, mouse
gaataaaggatagataagcc

SEQ ID NO: 545201 - DNA, 20 bp, mouse
gatcatcctgctgacagtaa

SEQ ID NO: 545202 - DNA, 20 bp, mouse
gagactatgtagcctgctag

SEQ ID NO: 545203 - DNA, 20 bp, mouse
gatgcatccattaaatggga

SEQ ID NO: 545204 - DNA, 20 bp, mouse
ggagtcatgcatccattaaa

SEQ ID NO: 545205 - DNA, 20 bp, mouse
gagaagaccatcccatttaa

SEQ ID NO: 545206 - DNA, 20 bp, mouse
gattgcttttgcagggcata

SEQ ID NO: 545207 - DNA, 20 bp, mouse
gcaaaactattgcttttgca

SEQ ID NO: 545208 - DNA, 20 bp, mouse
gctcataatgaattctgaac

SEQ ID NO: 545209 - DNA, 20 bp, mouse
gcttaagtgttatagtctta

SEQ ID NO: 545210 - DNA, 20 bp, mouse
gcaaaagcaatagttttgca

SEQ ID NO: 545211 - DNA, 20 bp, mouse
gtttctgcaacattgctttg

SEQ ID NO: 545212 - DNA, 20 bp, mouse
ggaattcattatgagtaaaa

SEQ ID NO: 545213 - DNA, 20 bp, mouse
gaatttttaatagatttata

SEQ ID NO: 545214 - DNA, 20 bp, mouse
gagaaccaactaagattaca

SEQ ID NO: 545215 - DNA, 20 bp, mouse
ggtgttatagtcttaaggtg

SEQ ID NO: 545216 - DNA, 20 bp, mouse
gtttactataacactatgaa

SEQ ID NO: 545217 - DNA, 20 bp, mouse
gtgttctggttctattaagt

SEQ ID NO: 545218 - DNA, 20 bp, mouse
gtatagattttgaatcagaa

SEQ ID NO: 545219 - DNA, 20 bp, mouse
gaattctgcttagggacatt

SEQ ID NO: 545220 - DNA, 20 bp, mouse
gttttaaagactaggctaga

SEQ ID NO: 545221 - DNA, 20 bp, mouse
gttagtcattttaggagtag

SEQ ID NO: 545222 - DNA, 20 bp, mouse
gtacttaatattgaattgtc

SEQ ID NO: 545223 - DNA, 20 bp, mouse
ggacttgagtgaaaagtgga

SEQ ID NO: 545224 - DNA, 20 bp, mouse
ggaaacttactgattccaaa

SEQ ID NO: 545225 - DNA, 20 bp, mouse
gatctgaaatcaattccttt

SEQ ID NO: 545226 - DNA, 20 bp, mouse
ggtgttgacagaggaataac

SEQ ID NO: 545227 - DNA, 20 bp, mouse
ggtcatctacatcatctcca

SEQ ID NO: 545228 - DNA, 20 bp, mouse
gtgatggttgtatagtgtaa

SEQ ID NO: 545229 - DNA, 20 bp, mouse
gacataggggagcccagcga

SEQ ID NO: 545230 - DNA, 20 bp, mouse
gctgctggtaggagtggtat

SEQ ID NO: 545231 - DNA, 20 bp, mouse
gtggtaggagtggtatgggt

SEQ ID NO: 545232 - DNA, 20 bp, mouse
ggagtaacacacaaactaca

SEQ ID NO: 545233 - DNA, 20 bp, mouse
ggaaatgctccccaaagacc

SEQ ID NO: 545234 - DNA, 20 bp, mouse
gtcactgccagtccatcgct

SEQ ID NO: 545235 - DNA, 20 bp, mouse
gatttctttggaggtgctga

SEQ ID NO: 545236 - DNA, 20 bp, mouse
ggtagtgttcgtgacatttt

SEQ ID NO: 545237 - DNA, 20 bp, mouse
gcacacagatggagaataaa

SEQ ID NO: 545238 - DNA, 20 bp, mouse
ggatagtgaccacaatgagg

SEQ ID NO: 545239 - DNA, 20 bp, mouse
ggatgatagtgaccacaatg

SEQ ID NO: 545240 - DNA, 20 bp, mouse
gattaaccatatcacacaga

SEQ ID NO: 545241 - DNA, 20 bp, mouse
gattctccatctgtgtgata

SEQ ID NO: 545242 - DNA, 20 bp, mouse
ggggcagccacactgtaaaa

SEQ ID NO: 545243 - DNA, 20 bp, mouse
gataggccatcactgtcaat

SEQ ID NO: 545244 - DNA, 20 bp, mouse
gtcagatcctttttacagtg

SEQ ID NO: 545245 - DNA, 20 bp, mouse
gtgtatctatcaaggagagg

SEQ ID NO: 545246 - DNA, 20 bp, mouse
gaggttgccaatgagggtaa

SEQ ID NO: 545247 - DNA, 20 bp, mouse
ggttctgtgtcagcccaagc

SEQ ID NO: 545248 - DNA, 20 bp, mouse
gccatctacgaaggataaga

SEQ ID NO: 545249 - DNA, 20 bp, mouse
gcaagagtttctgcacatct

SEQ ID NO: 545250 - DNA, 20 bp, mouse
ggagcagcagccatctacga

SEQ ID NO: 545251 - DNA, 20 bp, mouse
gagcccaggccgtggaaacc

SEQ ID NO: 545252 - DNA, 20 bp, mouse
gtcatctctagcccgacact

SEQ ID NO: 545253 - DNA, 20 bp, mouse
gatcattttgggggccatgg

SEQ ID NO: 545254 - DNA, 20 bp, mouse
gctacatgatcacaatgaac

SEQ ID NO: 545255 - DNA, 20 bp, mouse
gaatcccccagcccaggccg

SEQ ID NO: 545256 - DNA, 20 bp, mouse
gtccaaggaaaggtacacat

SEQ ID NO: 545257 - DNA, 20 bp, mouse
gctttctccaaggaagccca

SEQ ID NO: 545258 - DNA, 20 bp, mouse
gaatcaatgaaggtgtccct

SEQ ID NO: 545259 - DNA, 20 bp, mouse
gtcctatgtgtacctttcct

SEQ ID NO: 545260 - DNA, 20 bp, mouse
gtgtatctgcctggatgatt

SEQ ID NO: 545261 - DNA, 20 bp, mouse
ggagaaagatttgaaatagc

SEQ ID NO: 545262 - DNA, 20 bp, mouse
gctgaaagtctggaacaaaa

SEQ ID NO: 545263 - DNA, 20 bp, mouse
gtacaatcctgtgaatatga

SEQ ID NO: 545264 - DNA, 20 bp, mouse
gaagtattcaaaaaattggt

SEQ ID NO: 545265 - DNA, 20 bp, mouse
gtcctcaaatagcaaagaac

SEQ ID NO: 545266 - DNA, 20 bp, mouse
gctgaactaacccaaggaaa

SEQ ID NO: 545267 - DNA, 20 bp, mouse
ggattacagcagcccccacc

SEQ ID NO: 545268 - DNA, 20 bp, mouse
gcttaggattcatccatgga

SEQ ID NO: 545269 - DNA, 20 bp, mouse
gtctgtgtgtattcctggtg

SEQ ID NO: 545270 - DNA, 20 bp, mouse
gcaaaatctgtatccctcca

SEQ ID NO: 545271 - DNA, 20 bp, mouse
gtgggccacagaatggtaac

SEQ ID NO: 545272 - DNA, 20 bp, mouse
gattgctcatccttttcctt

SEQ ID NO: 545273 - DNA, 20 bp, mouse
ggggatacagattttgttta

SEQ ID NO: 545274 - DNA, 20 bp, mouse
gagggctgggctgatgaaga

SEQ ID NO: 545275 - DNA, 20 bp, mouse
gcacagaggtcggttcatga

SEQ ID NO: 545276 - DNA, 20 bp, mouse
gctctgggtgagtttctaag

SEQ ID NO: 545277 - DNA, 20 bp, mouse
gaagagacactacttgctct

SEQ ID NO: 545278 - DNA, 20 bp, mouse
gttactatatctctaataat

SEQ ID NO: 545279 - DNA, 20 bp, mouse
gcactctgcataatattcct

SEQ ID NO: 545280 - DNA, 20 bp, mouse
gaattggctcacaagctctc

SEQ ID NO: 545281 - DNA, 20 bp, mouse
gtttctaagaggtaagttaa

SEQ ID NO: 545282 - DNA, 20 bp, mouse
gtatgagtgacaaagtgcat

SEQ ID NO: 545283 - DNA, 20 bp, mouse
gccaaaacaattgtccaaag

SEQ ID NO: 545284 - DNA, 20 bp, mouse
gagaataacttgattagact

SEQ ID NO: 545285 - DNA, 20 bp, mouse
gatatacatggaaatacatg

SEQ ID NO: 545286 - DNA, 20 bp, mouse
gggtagcagctggaatcgtg

SEQ ID NO: 545287 - DNA, 20 bp, mouse
ggggccacagaagggtaatt

SEQ ID NO: 545288 - DNA, 20 bp, mouse
ggaatcgtggggtttgttca

SEQ ID NO: 545289 - DNA, 20 bp, mouse
gttttcttagtggtagcagc

SEQ ID NO: 545290 - DNA, 20 bp, mouse
gtaagaaaatacatacatgt

SEQ ID NO: 545291 - DNA, 20 bp, mouse
gtagcccaattacccttctg

SEQ ID NO: 545292 - DNA, 20 bp, mouse
gtagatcattttgggtgtga

SEQ ID NO: 545293 - DNA, 20 bp, mouse
gatcatcttgctgatttcca

SEQ ID NO: 545294 - DNA, 20 bp, mouse
gcatacatgtcggttcatga

SEQ ID NO: 545295 - DNA, 20 bp, mouse
ggtcttgggtcaggcccagg

SEQ ID NO: 545296 - DNA, 20 bp, mouse
gacagaagaatccaaacaaa

SEQ ID NO: 545297 - DNA, 20 bp, mouse
gacattgttcccagactctt

SEQ ID NO: 545298 - DNA, 20 bp, mouse
gcaaggagaaggagttaaag

SEQ ID NO: 545299 - DNA, 20 bp, mouse
gttcttcttcctaagagtct

SEQ ID NO: 545300 - DNA, 20 bp, mouse
gtttaaatatttctctagca

SEQ ID NO: 545301 - DNA, 20 bp, mouse
gttgattcatgctatgcttc

SEQ ID NO: 545302 - DNA, 20 bp, mouse
gatttccaccttatccattc

SEQ ID NO: 545303 - DNA, 20 bp, mouse
ggaaaattaataaagtaagt

SEQ ID NO: 545304 - DNA, 20 bp, mouse
gttgtgtgtttccaaggaga

SEQ ID NO: 545305 - DNA, 20 bp, mouse
ggtgttattatctattattg

SEQ ID NO: 545306 - DNA, 20 bp, mouse
gcagatgaccatatgcacag

SEQ ID NO: 545307 - DNA, 20 bp, mouse
ggattacagcggcacccacc

SEQ ID NO: 545308 - DNA, 20 bp, mouse
gcacagaggttggctcatga

SEQ ID NO: 545309 - DNA, 20 bp, mouse
gatcatcttgttgattgcca

SEQ ID NO: 545310 - DNA, 20 bp, mouse
gtgatggtcatgtagtgtaa

SEQ ID NO: 545311 - DNA, 20 bp, mouse
gtgggtgccgctgtaatctt

SEQ ID NO: 545312 - DNA, 20 bp, mouse
ggaggctgtactaaattgat

SEQ ID NO: 545313 - DNA, 20 bp, mouse
gccaccaggaatacacacag

SEQ ID NO: 545314 - DNA, 20 bp, mouse
gcatctgaaaagaaaccata

SEQ ID NO: 545315 - DNA, 20 bp, mouse
gcaggaatacacacagaggt

SEQ ID NO: 545316 - DNA, 20 bp, mouse
gagtttaggcgccaaagaag

SEQ ID NO: 545317 - DNA, 20 bp, mouse
gcgccaccagcacgacacaa

SEQ ID NO: 545318 - DNA, 20 bp, mouse
gaaaactctgtaatattgtg

SEQ ID NO: 545319 - DNA, 20 bp, mouse
gacctgctattcctcttctt

SEQ ID NO: 545320 - DNA, 20 bp, mouse
gtcagtatccttggaatcta

SEQ ID NO: 545321 - DNA, 20 bp, mouse
ggccaaagaagaggaatagc

SEQ ID NO: 545322 - DNA, 20 bp, mouse
gggtatttccatagattcca

SEQ ID NO: 545323 - DNA, 20 bp, mouse
gagagtcgtcccttcataca

SEQ ID NO: 545324 - DNA, 20 bp, mouse
ggaatagcaggtgtcaataa

SEQ ID NO: 545325 - DNA, 20 bp, mouse
gacacaaaggtgcctggtca

SEQ ID NO: 545326 - DNA, 20 bp, mouse
gggactctcttctaacaaag

SEQ ID NO: 545327 - DNA, 20 bp, mouse
gctctcttctaacaaagagg

SEQ ID NO: 545328 - DNA, 20 bp, mouse
ggccatgaggaagctagttt

SEQ ID NO: 545329 - DNA, 20 bp, mouse
gatgtgtgtgcagtcctcgt

SEQ ID NO: 545330 - DNA, 20 bp, mouse
gatgaggaagctagtttggg

SEQ ID NO: 545331 - DNA, 20 bp, mouse
gagtcctcgtaggaacagca

SEQ ID NO: 545332 - DNA, 20 bp, mouse
gtatccatgctgttcctacg

SEQ ID NO: 545333 - DNA, 20 bp, mouse
gatgagaagtatttgggcaa

SEQ ID NO: 545334 - DNA, 20 bp, mouse
gacatttcggttcataatgc

SEQ ID NO: 545335 - DNA, 20 bp, mouse
gggaaagatgagaagtattt

SEQ ID NO: 545336 - DNA, 20 bp, mouse
ggactgagttcatttttctg

SEQ ID NO: 545337 - DNA, 20 bp, mouse
gtatccatgctgttcccatg

SEQ ID NO: 545338 - DNA, 20 bp, mouse
ggggctctcttccaatcaag

SEQ ID NO: 545339 - DNA, 20 bp, mouse
ggtgtgtgtgcagtcctcat

SEQ ID NO: 545340 - DNA, 20 bp, mouse
gcatgatgctagtatagtgc

SEQ ID NO: 545341 - DNA, 20 bp, mouse
gagccatgagggagcaaggt

SEQ ID NO: 545342 - DNA, 20 bp, mouse
gcacccaccttgctccctca

SEQ ID NO: 545343 - DNA, 20 bp, mouse
gtgtcagccatgagggagca

SEQ ID NO: 545344 - DNA, 20 bp, mouse
gagtttgggagctgttgtgg

SEQ ID NO: 545345 - DNA, 20 bp, mouse
gttgtgtatgtcagccatga

SEQ ID NO: 545346 - DNA, 20 bp, mouse
gagagatgagaagtccataa

SEQ ID NO: 545347 - DNA, 20 bp, mouse
ggttccctgctgaatccaat

SEQ ID NO: 545348 - DNA, 20 bp, mouse
gatacctattggattcagca

SEQ ID NO: 545349 - DNA, 20 bp, mouse
gtatgggcagtgcatgctgc

SEQ ID NO: 545350 - DNA, 20 bp, mouse
gtgtttgtctattgttgtga

SEQ ID NO: 545351 - DNA, 20 bp, mouse
ggaaacatgacaacagtgag

SEQ ID NO: 545352 - DNA, 20 bp, mouse
gctgaagcacctttccatta

SEQ ID NO: 545353 - DNA, 20 bp, mouse
gtgcaggtttttttcttcac

SEQ ID NO: 545354 - DNA, 20 bp, mouse
gtttcttcacaggtttagcc

SEQ ID NO: 545355 - DNA, 20 bp, mouse
gagaatggccacctcactcc

SEQ ID NO: 545356 - DNA, 20 bp, mouse
gctggccatggattcagttg

SEQ ID NO: 545357 - DNA, 20 bp, mouse
gttctcctcaactgaatcca

SEQ ID NO: 545358 - DNA, 20 bp, mouse
gtcagtcacgttattttccc

SEQ ID NO: 545359 - DNA, 20 bp, mouse
gacgttattttccctggcca

SEQ ID NO: 545360 - DNA, 20 bp, mouse
gttcttccatttcttgggag

SEQ ID NO: 545361 - DNA, 20 bp, mouse
gtggctgtttcttggctggg

SEQ ID NO: 545362 - DNA, 20 bp, mouse
gcgtgctggtggctgtttct

SEQ ID NO: 545363 - DNA, 20 bp, mouse
gaatgaccattgcaacaatg

SEQ ID NO: 545364 - DNA, 20 bp, mouse
gaatggcctcattgttgcaa

SEQ ID NO: 545365 - DNA, 20 bp, mouse
ggctgagatatttttgcttg

SEQ ID NO: 545366 - DNA, 20 bp, mouse
gcacatgtgagctgacccaa

SEQ ID NO: 545367 - DNA, 20 bp, mouse
gaacttaggggcaactgtag

SEQ ID NO: 545368 - DNA, 20 bp, mouse
ggttattttcatggaccatt

SEQ ID NO: 545369 - DNA, 20 bp, mouse
gctcagttacgttattttca

SEQ ID NO: 545370 - DNA, 20 bp, mouse
gatcattttgctagtgatga

SEQ ID NO: 545371 - DNA, 20 bp, mouse
gaagtcagtgatgaacttag

SEQ ID NO: 545372 - DNA, 20 bp, mouse
gttcaacaacaccaaagaaa

SEQ ID NO: 545373 - DNA, 20 bp, mouse
gcaggatccagaggttcaga

SEQ ID NO: 545374 - DNA, 20 bp, mouse
gagcacaccttctgaacctc

SEQ ID NO: 545375 - DNA, 20 bp, mouse
gtaactgagttaattttcac

SEQ ID NO: 545376 - DNA, 20 bp, mouse
gtcagcaacccccaagaaat

SEQ ID NO: 545377 - DNA, 20 bp, mouse
gataagccatcaccacaagc

SEQ ID NO: 545378 - DNA, 20 bp, mouse
gaagtgtgtcacatgttggt

SEQ ID NO: 545379 - DNA, 20 bp, mouse
gttaaaaccatctccctgaa

SEQ ID NO: 545380 - DNA, 20 bp, mouse
gatcactgacttacttgtta

SEQ ID NO: 545381 - DNA, 20 bp, mouse
gaacttagggacaattgtag

SEQ ID NO: 545382 - DNA, 20 bp, mouse
gatctccctgaagggctgtc

SEQ ID NO: 545383 - DNA, 20 bp, mouse
gcacacgtgaattgactcca

SEQ ID NO: 545384 - DNA, 20 bp, mouse
gggcaacagtcttattgttg

SEQ ID NO: 545385 - DNA, 20 bp, mouse
gttcttctcccatttcttgg

SEQ ID NO: 545386 - DNA, 20 bp, mouse
gtctgtaggttgatagtccc

SEQ ID NO: 545387 - DNA, 20 bp, mouse
gtatctgaatttatattcct

SEQ ID NO: 545388 - DNA, 20 bp, mouse
ggatactgtgacctgagtac

SEQ ID NO: 545389 - DNA, 20 bp, mouse
gacatccccccagtagatgg

SEQ ID NO: 545390 - DNA, 20 bp, mouse
gttgtcctccatctactggg

SEQ ID NO: 545391 - DNA, 20 bp, mouse
gcatgggtgaatgtaaatga

SEQ ID NO: 545392 - DNA, 20 bp, mouse
gctcacatccccccagtaga

SEQ ID NO: 545393 - DNA, 20 bp, mouse
gaaatattgtgttggtctgt

SEQ ID NO: 545394 - DNA, 20 bp, mouse
gcaaagagaaaatattgtgt

SEQ ID NO: 545395 - DNA, 20 bp, mouse
gcctgaccatcatgaaccca

SEQ ID NO: 545396 - DNA, 20 bp, mouse
gaatgaaataaattacaccg

SEQ ID NO: 545397 - DNA, 20 bp, mouse
ggagatggtattatgcccag

SEQ ID NO: 545398 - DNA, 20 bp, mouse
gatcttgggtacggttaagg

SEQ ID NO: 545399 - DNA, 20 bp, mouse
gggtattatgcccagaggac

SEQ ID NO: 545400 - DNA, 20 bp, mouse
gagccccagatagaagcaat

SEQ ID NO: 545401 - DNA, 20 bp, mouse
ggctcatgatggttaaatag

SEQ ID NO: 545402 - DNA, 20 bp, mouse
ggatttctgacctgtcctct

SEQ ID NO: 545403 - DNA, 20 bp, mouse
gtacattcagtggcccaact

SEQ ID NO: 545404 - DNA, 20 bp, mouse
gtgcctattgcttctatctg

SEQ ID NO: 545405 - DNA, 20 bp, mouse
gtggacaacaaaacctagtt

SEQ ID NO: 545406 - DNA, 20 bp, mouse
ggaattcagatatctcagag

SEQ ID NO: 545407 - DNA, 20 bp, mouse
gtgtttacttcagaattctt

SEQ ID NO: 545408 - DNA, 20 bp, mouse
gcttgggctttgtgactctt

SEQ ID NO: 545409 - DNA, 20 bp, mouse
ggatcactaagaaaaatgcc

SEQ ID NO: 545410 - DNA, 20 bp, mouse
gacagaagtcaatgaacgag

SEQ ID NO: 545411 - DNA, 20 bp, mouse
gatgaaggtcagtgataatt

SEQ ID NO: 545412 - DNA, 20 bp, mouse
gtgatggcgtcatggatgat

SEQ ID NO: 545413 - DNA, 20 bp, mouse
gatggtactgcttgtatcaa

SEQ ID NO: 545414 - DNA, 20 bp, mouse
gtttggacacttctttggag

SEQ ID NO: 545415 - DNA, 20 bp, mouse
ggctcatgatgttggagtaa

SEQ ID NO: 545416 - DNA, 20 bp, mouse
ggctagcgtaaacacaacaa

SEQ ID NO: 545417 - DNA, 20 bp, mouse
gaagtaccatagagaaggca

SEQ ID NO: 545418 - DNA, 20 bp, mouse
gagggtattgcccagcacga

SEQ ID NO: 545419 - DNA, 20 bp, mouse
gagcaccagatagaagcata

SEQ ID NO: 545420 - DNA, 20 bp, mouse
gttcatcatctagaaaaatc

SEQ ID NO: 545421 - DNA, 20 bp, mouse
ggcaactgagatggtattgt

SEQ ID NO: 545422 - DNA, 20 bp, mouse
gtttatgtggccatcgtgct

SEQ ID NO: 545423 - DNA, 20 bp, mouse
ggaagcataaggcacattct

SEQ ID NO: 545424 - DNA, 20 bp, mouse
gtgtgccttatgcttctatc

SEQ ID NO: 545425 - DNA, 20 bp, mouse
gttgataataaacgctaatt

SEQ ID NO: 545426 - DNA, 20 bp, mouse
gctaggactctctagttctt

SEQ ID NO: 545427 - DNA, 20 bp, mouse
gatcttgggaactgtagtgg

SEQ ID NO: 545428 - DNA, 20 bp, mouse
gagtcatttagttgatccat

SEQ ID NO: 545429 - DNA, 20 bp, mouse
gtgatgctcaagtagcgcag

SEQ ID NO: 545430 - DNA, 20 bp, mouse
gctgtctttgaacgatgtgt

SEQ ID NO: 545431 - DNA, 20 bp, mouse
gacatcgttcaaagacaggt

SEQ ID NO: 545432 - DNA, 20 bp, mouse
gttgaaactgctcatgccga

SEQ ID NO: 545433 - DNA, 20 bp, mouse
gtctacatcggaatcatttt

SEQ ID NO: 545434 - DNA, 20 bp, mouse
gtctgttttatccacattat

SEQ ID NO: 545435 - DNA, 20 bp, mouse
gcattctctatgctctacat

SEQ ID NO: 545436 - DNA, 20 bp, mouse
gtagtacaccttgtggtaaa

SEQ ID NO: 545437 - DNA, 20 bp, mouse
ggcttcttccatttaccaca

SEQ ID NO: 545438 - DNA, 20 bp, mouse
gaccctctacatgatgactg

SEQ ID NO: 545439 - DNA, 20 bp, mouse
gtaccacagtcatcatgtag

SEQ ID NO: 545440 - DNA, 20 bp, mouse
gaactcattagtacaccttg

SEQ ID NO: 545441 - DNA, 20 bp, mouse
gttgtgatatcatggaccat

SEQ ID NO: 545442 - DNA, 20 bp, mouse
ggagggtggaaaatggcagc

SEQ ID NO: 545443 - DNA, 20 bp, mouse
ggaagaagcaaaccagactg

SEQ ID NO: 545444 - DNA, 20 bp, mouse
gaaactcagacaccacagtc

SEQ ID NO: 545445 - DNA, 20 bp, mouse
ggggggtggtaactgaggaa

SEQ ID NO: 545446 - DNA, 20 bp, mouse
gcgttagtgttgttatttaa

SEQ ID NO: 545447 - DNA, 20 bp, mouse
gccattttctgtcctctatc

SEQ ID NO: 545448 - DNA, 20 bp, mouse
gtctatctggtgactttggt

SEQ ID NO: 545449 - DNA, 20 bp, mouse
gtggctcatgcagccgccaa

SEQ ID NO: 545450 - DNA, 20 bp, mouse
ggggtgtatttactgaggaa

SEQ ID NO: 545451 - DNA, 20 bp, mouse
gagtttgggtgtatttactg

SEQ ID NO: 545452 - DNA, 20 bp, mouse
ggtcctctatctggtgactt

SEQ ID NO: 545453 - DNA, 20 bp, mouse
gaaatgatagattagctaac

SEQ ID NO: 545454 - DNA, 20 bp, mouse
ggaagactctaatcaaactg

SEQ ID NO: 545455 - DNA, 20 bp, mouse
gttgtgatatcatggattgt

SEQ ID NO: 545456 - DNA, 20 bp, mouse
gttcctttgtagggtatatg

SEQ ID NO: 545457 - DNA, 20 bp, mouse
gcattaaataaataactcta

SEQ ID NO: 545458 - DNA, 20 bp, mouse
gtgcctcatataccctacaa

SEQ ID NO: 545459 - DNA, 20 bp, mouse
gtaccacagccatcaggtag

SEQ ID NO: 545460 - DNA, 20 bp, mouse
gccctgaaaaataaactcag

SEQ ID NO: 545461 - DNA, 20 bp, mouse
gacagccatcaggtagagga

SEQ ID NO: 545462 - DNA, 20 bp, mouse
ggggggtggttactgaagaa

SEQ ID NO: 545463 - DNA, 20 bp, mouse
ggttgcctaccacagccatc

SEQ ID NO: 545464 - DNA, 20 bp, mouse
ggagatctatggtcagtttg

SEQ ID NO: 545465 - DNA, 20 bp, mouse
gtaaaaccatttcctttgta

SEQ ID NO: 545466 - DNA, 20 bp, mouse
gttactacaaagtgttctaa

SEQ ID NO: 545467 - DNA, 20 bp, mouse
gttgtgatctcgtggaccat

SEQ ID NO: 545468 - DNA, 20 bp, mouse
gctggctcgttgtgatctcg

SEQ ID NO: 545469 - DNA, 20 bp, mouse
gtaccacagccattagatag

SEQ ID NO: 545470 - DNA, 20 bp, mouse
gctttgtagtaaatggaaga

SEQ ID NO: 545471 - DNA, 20 bp, mouse
ggatggaaaatggcagcaga

SEQ ID NO: 545472 - DNA, 20 bp, mouse
gacagccattagatagagga

SEQ ID NO: 545473 - DNA, 20 bp, mouse
gttttccatcctctatctaa

SEQ ID NO: 545474 - DNA, 20 bp, mouse
ggaagaaggaaaccagactg

SEQ ID NO: 545475 - DNA, 20 bp, mouse
gaaactcagacaccacagtc

SEQ ID NO: 545476 - DNA, 20 bp, mouse
ggatccattgactggaacag

SEQ ID NO: 545477 - DNA, 20 bp, mouse
gtctcctctgttccagtcaa

SEQ ID NO: 545478 - DNA, 20 bp, mouse
ggagatcatcttgggcactg

SEQ ID NO: 545479 - DNA, 20 bp, mouse
ggaaagtccaacatcaatga

SEQ ID NO: 545480 - DNA, 20 bp, mouse
gtacataggagactgtaaac

SEQ ID NO: 545481 - DNA, 20 bp, mouse
gtctatgtaagcatcatcgt

SEQ ID NO: 545482 - DNA, 20 bp, mouse
gacatcaatgagggacagat

SEQ ID NO: 545483 - DNA, 20 bp, mouse
gcttacatagagcaaagaga

SEQ ID NO: 545484 - DNA, 20 bp, mouse
gcttttgaatttgtgttgtt

SEQ ID NO: 545485 - DNA, 20 bp, mouse
gtctgctccatccacattat

SEQ ID NO: 545486 - DNA, 20 bp, mouse
ggggggtggttactgagcaa

SEQ ID NO: 545487 - DNA, 20 bp, mouse
ggcacaaatccaacaatcca

SEQ ID NO: 545488 - DNA, 20 bp, mouse
gctggttccttgtgattcca

SEQ ID NO: 545489 - DNA, 20 bp, mouse
gaacaatccatggaatcaca

SEQ ID NO: 545490 - DNA, 20 bp, mouse
ggaagactctaatcatactg

SEQ ID NO: 545491 - DNA, 20 bp, mouse
ggatggaaaatggcagtaag

SEQ ID NO: 545492 - DNA, 20 bp, mouse
ggaagtgcacacagacgatc

SEQ ID NO: 545493 - DNA, 20 bp, mouse
gtggctcatacaccctacaa

SEQ ID NO: 545494 - DNA, 20 bp, mouse
gcattaaataaataacacta

SEQ ID NO: 545495 - DNA, 20 bp, mouse
gtaccacagccatcaggtag

SEQ ID NO: 545496 - DNA, 20 bp, mouse
ggtttcttccatttactaca

SEQ ID NO: 545497 - DNA, 20 bp, mouse
gtccactacagcagcatcat

SEQ ID NO: 545498 - DNA, 20 bp, mouse
gatcagtatcagttgactca

SEQ ID NO: 545499 - DNA, 20 bp, mouse
gatggcatgtataaagccaa

SEQ ID NO: 545500 - DNA, 20 bp, mouse
gagtcaactgatactgattt

SEQ ID NO: 545501 - DNA, 20 bp, mouse
gtaccacagccattagatag

SEQ ID NO: 545502 - DNA, 20 bp, mouse
ggatggaaaatggcagcagg

SEQ ID NO: 545503 - DNA, 20 bp, mouse
gacagccattagatagagga

SEQ ID NO: 545504 - DNA, 20 bp, mouse
gttttccatcctctatctaa

SEQ ID NO: 545505 - DNA, 20 bp, mouse
gttgtgatatcatggaccat

SEQ ID NO: 545506 - DNA, 20 bp, mouse
gtgggacttgcacaatcgtt

SEQ ID NO: 545507 - DNA, 20 bp, mouse
ggtcccagcaaaacaaattc

SEQ ID NO: 545508 - DNA, 20 bp, mouse
gagaatccccacataaaata

SEQ ID NO: 545509 - DNA, 20 bp, mouse
gtccattggatcagaaagtt

SEQ ID NO: 545510 - DNA, 20 bp, mouse
gtagagcagaagcattaact

SEQ ID NO: 545511 - DNA, 20 bp, mouse
gtgatcatcaggtagtgaag

SEQ ID NO: 545512 - DNA, 20 bp, mouse
ggcccaagtcaatgagcgaa

SEQ ID NO: 545513 - DNA, 20 bp, mouse
gttcatctacaacaattcct

SEQ ID NO: 545514 - DNA, 20 bp, mouse
gttggaacacagattttctt

SEQ ID NO: 545515 - DNA, 20 bp, mouse
gaagcattaacttggtccat

SEQ ID NO: 545516 - DNA, 20 bp, mouse
gttctggaatcaatcaacat

SEQ ID NO: 545517 - DNA, 20 bp, mouse
gtacataggcgaatggaggt

SEQ ID NO: 545518 - DNA, 20 bp, mouse
gaaagtacataggcgaatgg

SEQ ID NO: 545519 - DNA, 20 bp, mouse
gatgggactctccaattctc

SEQ ID NO: 545520 - DNA, 20 bp, mouse
gagagtctctgcacttgcct

SEQ ID NO: 545521 - DNA, 20 bp, mouse
gtcaaaggccatggctacaa

SEQ ID NO: 545522 - DNA, 20 bp, mouse
gatctgaagttcccgagaat

SEQ ID NO: 545523 - DNA, 20 bp, mouse
gtaactgtagtgtagcttag

SEQ ID NO: 545524 - DNA, 20 bp, mouse
gcagaaagtacataggcgaa

SEQ ID NO: 545525 - DNA, 20 bp, mouse
gccccccaaaaaagtgaagg

SEQ ID NO: 545526 - DNA, 20 bp, mouse
gattagatatgaaaatccgt

SEQ ID NO: 545527 - DNA, 20 bp, mouse
gtagaaacaatccattccca

SEQ ID NO: 545528 - DNA, 20 bp, mouse
gatatgaaaatccgtgggaa

SEQ ID NO: 545529 - DNA, 20 bp, mouse
ggcagttgacactcatctcc

SEQ ID NO: 545530 - DNA, 20 bp, mouse
gctttctctgttaacattag

SEQ ID NO: 545531 - DNA, 20 bp, mouse
gattctgtctctgatgtaac

SEQ ID NO: 545532 - DNA, 20 bp, mouse
gttgcagagccttgtgagtg

SEQ ID NO: 545533 - DNA, 20 bp, mouse
ggagacagaatctttctctg

SEQ ID NO: 545534 - DNA, 20 bp, mouse
gaaggattcttgcagatgaa

SEQ ID NO: 545535 - DNA, 20 bp, mouse
gagaacagtaagtcattaga

SEQ ID NO: 545536 - DNA, 20 bp, mouse
ggaagacacactgagtaaaa

SEQ ID NO: 545537 - DNA, 20 bp, mouse
gcatctcttcatattcatga

SEQ ID NO: 545538 - DNA, 20 bp, mouse
gattgaagtcttactcttca

SEQ ID NO: 545539 - DNA, 20 bp, mouse
ggatgaaggcaatcacacta

SEQ ID NO: 545540 - DNA, 20 bp, mouse
ggggactttccagctcacag

SEQ ID NO: 545541 - DNA, 20 bp, mouse
gtgtcagaatttatactctg

SEQ ID NO: 545542 - DNA, 20 bp, mouse
gcactgagtaaaatggatga

SEQ ID NO: 545543 - DNA, 20 bp, mouse
gtgaatatgaagagatgcac

SEQ ID NO: 545544 - DNA, 20 bp, mouse
gtgtacaaatccagttgtcc

SEQ ID NO: 545545 - DNA, 20 bp, mouse
gtgttcacttcctggacaac

SEQ ID NO: 545546 - DNA, 20 bp, mouse
gccacatgtcaacaaaagac

SEQ ID NO: 545547 - DNA, 20 bp, mouse
gcaaactgctgcatctctta

SEQ ID NO: 545548 - DNA, 20 bp, mouse
ggacctgaatattctttgaa

SEQ ID NO: 545549 - DNA, 20 bp, mouse
ggaatgcagatgggtgtcag

SEQ ID NO: 545550 - DNA, 20 bp, mouse
gtcccccatgtacttcttgc

SEQ ID NO: 545551 - DNA, 20 bp, mouse
gcagtttggtgttgacttcc

SEQ ID NO: 545552 - DNA, 20 bp, mouse
gtgtcagaatttatactctg

SEQ ID NO: 545553 - DNA, 20 bp, mouse
ggcccattcaaagaatattc

SEQ ID NO: 545554 - DNA, 20 bp, mouse
gtgggtgtcagtggttatta

SEQ ID NO: 545555 - DNA, 20 bp, mouse
ggtcagtggttattaaggtc

SEQ ID NO: 545556 - DNA, 20 bp, mouse
ggaggacaatctgaatataa

SEQ ID NO: 545557 - DNA, 20 bp, mouse
gatcaatcaacggaagatat

SEQ ID NO: 545558 - DNA, 20 bp, mouse
gacaatctgaatataatgga

SEQ ID NO: 545559 - DNA, 20 bp, mouse
gcaacggaagatatgggata

SEQ ID NO: 545560 - DNA, 20 bp, mouse
gggaggagagatgatactgt

SEQ ID NO: 545561 - DNA, 20 bp, mouse
gtataatggatggaggcaac

SEQ ID NO: 545562 - DNA, 20 bp, mouse
gggagagatgatactgttgg

SEQ ID NO: 545563 - DNA, 20 bp, mouse
ggcaatgggtaaaaaagacc

SEQ ID NO: 545564 - DNA, 20 bp, mouse
ggacctgaatattttttgag

SEQ ID NO: 545565 - DNA, 20 bp, mouse
gtttatctgttcattgtgtc

SEQ ID NO: 545566 - DNA, 20 bp, mouse
gctcctcaaacacaactcct

SEQ ID NO: 545567 - DNA, 20 bp, mouse
gctctcctgaagcaatgcag

SEQ ID NO: 545568 - DNA, 20 bp, mouse
gtcaggagaggtggtattgt

SEQ ID NO: 545569 - DNA, 20 bp, mouse
gaaaaatctatgatcatcct

SEQ ID NO: 545570 - DNA, 20 bp, mouse
gcagtgggaaaaaaagatct

SEQ ID NO: 545571 - DNA, 20 bp, mouse
gatgatcatagattttttca

SEQ ID NO: 545572 - DNA, 20 bp, mouse
gttacatggtataagtcacg

SEQ ID NO: 545573 - DNA, 20 bp, mouse
gtttcccactgcattgcttc

SEQ ID NO: 545574 - DNA, 20 bp, mouse
ggtggtattgttggctttaa

SEQ ID NO: 545575 - DNA, 20 bp, mouse
ggtcagttgttattaagatt

SEQ ID NO: 545576 - DNA, 20 bp, mouse
gacttgaagattcttggagt

SEQ ID NO: 545577 - DNA, 20 bp, mouse
gctaaggacactgaataaaa

SEQ ID NO: 545578 - DNA, 20 bp, mouse
gggaggagagatggtattgt

SEQ ID NO: 545579 - DNA, 20 bp, mouse
gtatcccattgtattgctgg

SEQ ID NO: 545580 - DNA, 20 bp, mouse
gttttatcccattgtattgc

SEQ ID NO: 545581 - DNA, 20 bp, mouse
gggacaattggattcataca

SEQ ID NO: 545582 - DNA, 20 bp, mouse
gggagagatggtattgttgg

SEQ ID NO: 545583 - DNA, 20 bp, mouse
gggtataagctactttttag

SEQ ID NO: 545584 - DNA, 20 bp, mouse
ggtcagtggtgattaagatt

SEQ ID NO: 545585 - DNA, 20 bp, mouse
gtgtcagaatttgtactctt

SEQ ID NO: 545586 - DNA, 20 bp, mouse
gaatggagtgaatgagtcca

SEQ ID NO: 545587 - DNA, 20 bp, mouse
gactgctacaagctggctca

SEQ ID NO: 545588 - DNA, 20 bp, mouse
gatttttggtgtggtaactg

SEQ ID NO: 545589 - DNA, 20 bp, mouse
gtctatgaccatttttggtg

SEQ ID NO: 545590 - DNA, 20 bp, mouse
gctgcagaactgctacaagc

SEQ ID NO: 545591 - DNA, 20 bp, mouse
gatggtcatagactttctca

SEQ ID NO: 545592 - DNA, 20 bp, mouse
gtttatctgctcattatttc

SEQ ID NO: 545593 - DNA, 20 bp, mouse
gagcacaaattctgacaccg

SEQ ID NO: 545594 - DNA, 20 bp, mouse
ggttcatgattgtgaaatag

SEQ ID NO: 545595 - DNA, 20 bp, mouse
gctgaaaagatgcactggat

SEQ ID NO: 545596 - DNA, 20 bp, mouse
ggtcttagagaagagaatca

SEQ ID NO: 545597 - DNA, 20 bp, mouse
gccacaagtacaccgcacag

SEQ ID NO: 545598 - DNA, 20 bp, mouse
ggacataagcacatttcaga

SEQ ID NO: 545599 - DNA, 20 bp, mouse
gtatcctgttaaacagtagt

SEQ ID NO: 545600 - DNA, 20 bp, mouse
gtgttggtaaaatagataca

SEQ ID NO: 545601 - DNA, 20 bp, mouse
gtgattcttaacctcaatca

SEQ ID NO: 545602 - DNA, 20 bp, mouse
gaggatagagcccctttaca

SEQ ID NO: 545603 - DNA, 20 bp, mouse
ggagcatattccatgtaaag

SEQ ID NO: 545604 - DNA, 20 bp, mouse
gcctcaatcatggtagttgt

SEQ ID NO: 545605 - DNA, 20 bp, mouse
gtggaatatgctcagtatgt

SEQ ID NO: 545606 - DNA, 20 bp, mouse
gtcctctgtcatagggatat

SEQ ID NO: 545607 - DNA, 20 bp, mouse
gtcccatatccctatgacag

SEQ ID NO: 545608 - DNA, 20 bp, mouse
gaggaaactgaattcatgac

SEQ ID NO: 545609 - DNA, 20 bp, mouse
ggatggcagagtaacggagt

SEQ ID NO: 545610 - DNA, 20 bp, mouse
ggtcataggacatcaccact

SEQ ID NO: 545611 - DNA, 20 bp, mouse
gggacatcaccactaggaga

SEQ ID NO: 545612 - DNA, 20 bp, mouse
gaacgatggccagatgagac

SEQ ID NO: 545613 - DNA, 20 bp, mouse
gaggcagatgagccccacga

SEQ ID NO: 545614 - DNA, 20 bp, mouse
gtggggaatggaaccatcgt

SEQ ID NO: 545615 - DNA, 20 bp, mouse
gtggagagtttgcagcacca

SEQ ID NO: 545616 - DNA, 20 bp, mouse
gcatcactctactcacaaaa

SEQ ID NO: 545617 - DNA, 20 bp, mouse
gcactctactcacaaaaagg

SEQ ID NO: 545618 - DNA, 20 bp, mouse
gcaattaacaagagctcagg

SEQ ID NO: 545619 - DNA, 20 bp, mouse
ggaaatagtacatgggcgtt

SEQ ID NO: 545620 - DNA, 20 bp, mouse
ggtggtgatttcatcctggt

SEQ ID NO: 545621 - DNA, 20 bp, mouse
gagaggatcttctcaagttg

SEQ ID NO: 545622 - DNA, 20 bp, mouse
ggattagcaccagcacaaag

SEQ ID NO: 545623 - DNA, 20 bp, mouse
gcctacctcctgacactggt

SEQ ID NO: 545624 - DNA, 20 bp, mouse
gtcaggtggtgatttcatcc

SEQ ID NO: 545625 - DNA, 20 bp, mouse
gcctgtggcagtaattgtct

SEQ ID NO: 545626 - DNA, 20 bp, mouse
ggatggaagtaatcgctccc

SEQ ID NO: 545627 - DNA, 20 bp, mouse
gctgcaaaggaaatgatctt

SEQ ID NO: 545628 - DNA, 20 bp, mouse
gactgccaaaagctgactca

SEQ ID NO: 545629 - DNA, 20 bp, mouse
gtaatagtgaaatagtgaag

SEQ ID NO: 545630 - DNA, 20 bp, mouse
ggagcctgaaaagatgtgct

SEQ ID NO: 545631 - DNA, 20 bp, mouse
gtgactcatggcatgcacaa

SEQ ID NO: 545632 - DNA, 20 bp, mouse
gctgaaaagatgtgctgggt

SEQ ID NO: 545633 - DNA, 20 bp, mouse
ggtgatcatcttaggagtgg

SEQ ID NO: 545634 - DNA, 20 bp, mouse
gctctactgcaccaacacaa

SEQ ID NO: 545635 - DNA, 20 bp, mouse
ggggttggtgttaacttcct

SEQ ID NO: 545636 - DNA, 20 bp, mouse
ggacacatgagtaaaatgga

SEQ ID NO: 545637 - DNA, 20 bp, mouse
gtgaagacacatgagtaaaa

SEQ ID NO: 545638 - DNA, 20 bp, mouse
gatgatcacagactttttca

SEQ ID NO: 545639 - DNA, 20 bp, mouse
ggtcttcagaaacaaccttc

SEQ ID NO: 545640 - DNA, 20 bp, mouse
gtcaggaaatattgtcatca

SEQ ID NO: 545641 - DNA, 20 bp, mouse
ggcttgaatattctgtgagt

SEQ ID NO: 545642 - DNA, 20 bp, mouse
gacatgagtaaaatggatgg

SEQ ID NO: 545643 - DNA, 20 bp, mouse
gacataggggaatgaagatg

SEQ ID NO: 545644 - DNA, 20 bp, mouse
ggtgcatgccttgagtcacc

SEQ ID NO: 545645 - DNA, 20 bp, mouse
ggatggaggtaatcactccc

SEQ ID NO: 545646 - DNA, 20 bp, mouse
gagttggctgaaccaatgga

SEQ ID NO: 545647 - DNA, 20 bp, mouse
ggtccagttggctgaaccaa

SEQ ID NO: 545648 - DNA, 20 bp, mouse
gtgtggttctccccatccat

SEQ ID NO: 545649 - DNA, 20 bp, mouse
gagccagctggaacaatgag

SEQ ID NO: 545650 - DNA, 20 bp, mouse
gcatacacgtggactcatga

SEQ ID NO: 545651 - DNA, 20 bp, mouse
gttagttggtggagtggaga

SEQ ID NO: 545652 - DNA, 20 bp, mouse
gtcttctttatccatttagt

SEQ ID NO: 545653 - DNA, 20 bp, mouse
ggaaacaaaacacatacacg

SEQ ID NO: 545654 - DNA, 20 bp, mouse
gtgggtgctgcttggggcct

SEQ ID NO: 545655 - DNA, 20 bp, mouse
gcaatgagtggctaatgccc

SEQ ID NO: 545656 - DNA, 20 bp, mouse
gataaaaacctggatctccc

SEQ ID NO: 545657 - DNA, 20 bp, mouse
gtattagcaggcacatccgt

SEQ ID NO: 545658 - DNA, 20 bp, mouse
ggatcattggcccaaatcag

SEQ ID NO: 545659 - DNA, 20 bp, mouse
gtcaaattcctgggagatcc

SEQ ID NO: 545660 - DNA, 20 bp, mouse
gtgatggtcagatagcgtaa

SEQ ID NO: 545661 - DNA, 20 bp, mouse
ggttggggctctcaaattcc

SEQ ID NO: 545662 - DNA, 20 bp, mouse
gagccaattgggctgatgaa

SEQ ID NO: 545663 - DNA, 20 bp, mouse
gtctatgtatccagtttgac

SEQ ID NO: 545664 - DNA, 20 bp, mouse
ggtgtctgaatttgtgctgt

SEQ ID NO: 545665 - DNA, 20 bp, mouse
gtcacccatgtactttctac

SEQ ID NO: 545666 - DNA, 20 bp, mouse
gagttgaatactccaggagt

SEQ ID NO: 545667 - DNA, 20 bp, mouse
gcttgccacataaaacgtgg

SEQ ID NO: 545668 - DNA, 20 bp, mouse
gttctcctccacgttttatg

SEQ ID NO: 545669 - DNA, 20 bp, mouse
gagaaatagttgaatactcc

SEQ ID NO: 545670 - DNA, 20 bp, mouse
gatgcttgccacataaaacg

SEQ ID NO: 545671 - DNA, 20 bp, mouse
gttgttttcagtggctgcct

SEQ ID NO: 545672 - DNA, 20 bp, mouse
ggcactgccaacacaaccaa

SEQ ID NO: 545673 - DNA, 20 bp, mouse
gtgccacagtgaacacgatg

SEQ ID NO: 545674 - DNA, 20 bp, mouse
gactgattcactctttccat

SEQ ID NO: 545675 - DNA, 20 bp, mouse
gctctttccattggttgtgt

SEQ ID NO: 545676 - DNA, 20 bp, mouse
gaattgaatactccaagagt

SEQ ID NO: 545677 - DNA, 20 bp, mouse
gatgctagccacaaaaaaca

SEQ ID NO: 545678 - DNA, 20 bp, mouse
gaaacaagatgcatgtcctc

SEQ ID NO: 545679 - DNA, 20 bp, mouse
gttctcctccatgttttttg

SEQ ID NO: 545680 - DNA, 20 bp, mouse
gctagccacaaaaaacatgg

SEQ ID NO: 545681 - DNA, 20 bp, mouse
gtcactgccaatacaaccaa

SEQ ID NO: 545682 - DNA, 20 bp, mouse
gctctttccattggttgtat

SEQ ID NO: 545683 - DNA, 20 bp, mouse
gttgttttcagtgactgcct

SEQ ID NO: 545684 - DNA, 20 bp, mouse
gcatgtcctcgggctcataa

SEQ ID NO: 545685 - DNA, 20 bp, mouse
gtgccacagtgaacacgatg

SEQ ID NO: 545686 - DNA, 20 bp, mouse
gagttggatgtcccaagagt

SEQ ID NO: 545687 - DNA, 20 bp, mouse
gtatccacaaagccaatgga

SEQ ID NO: 545688 - DNA, 20 bp, mouse
gctgggactcaccaactctt

SEQ ID NO: 545689 - DNA, 20 bp, mouse
gtcactatccacaaagccaa

SEQ ID NO: 545690 - DNA, 20 bp, mouse
gcattggagagtgtaaatga

SEQ ID NO: 545691 - DNA, 20 bp, mouse
gtaatgattagataatgaag

SEQ ID NO: 545692 - DNA, 20 bp, mouse
gtcttcattcatttcatcgg

SEQ ID NO: 545693 - DNA, 20 bp, mouse
ggagatcataaatcatcttg

SEQ ID NO: 545694 - DNA, 20 bp, mouse
gtttatgtagcaagcatgac

SEQ ID NO: 545695 - DNA, 20 bp, mouse
gatgccttccattggctttg

SEQ ID NO: 545696 - DNA, 20 bp, mouse
gtgatgtcggaagcaatgta

SEQ ID NO: 545697 - DNA, 20 bp, mouse
gtagctaagaggaaatacaa

SEQ ID NO: 545698 - DNA, 20 bp, mouse
gcctcgggatcactaatata

SEQ ID NO: 545699 - DNA, 20 bp, mouse
ggggatcactaatatatggg

SEQ ID NO: 545700 - DNA, 20 bp, mouse
gcgaatgatgattctgatgt

SEQ ID NO: 545701 - DNA, 20 bp, mouse
gatcagagtttgtgttcctc

SEQ ID NO: 545702 - DNA, 20 bp, mouse
gaaatgtcacagatcatctt

SEQ ID NO: 545703 - DNA, 20 bp, mouse
gtcttcagtcatgcagttgg

SEQ ID NO: 545704 - DNA, 20 bp, mouse
ggaattcagatgaggatcca

SEQ ID NO: 545705 - DNA, 20 bp, mouse
gaaagaacagacacactcgt

SEQ ID NO: 545706 - DNA, 20 bp, mouse
gtaaagccattggtgtgatg

SEQ ID NO: 545707 - DNA, 20 bp, mouse
gccactccccatcacaccaa

SEQ ID NO: 545708 - DNA, 20 bp, mouse
gccaatggctttattctggt

SEQ ID NO: 545709 - DNA, 20 bp, mouse
gtctggtaggcttctctgag

SEQ ID NO: 545710 - DNA, 20 bp, mouse
gatctgggggacagtagaag

SEQ ID NO: 545711 - DNA, 20 bp, mouse
ggagtggccacgactggaaa

SEQ ID NO: 545712 - DNA, 20 bp, mouse
gctctgtagaccccaagcta

SEQ ID NO: 545713 - DNA, 20 bp, mouse
ggtatagcagagatccaaaa

SEQ ID NO: 545714 - DNA, 20 bp, mouse
ggaagagccatttccagtcg

SEQ ID NO: 545715 - DNA, 20 bp, mouse
gagatccaaaaaggaaagat

SEQ ID NO: 545716 - DNA, 20 bp, mouse
gtagtagctacaggcaacaa

SEQ ID NO: 545717 - DNA, 20 bp, mouse
ggagccagactaagaagcaa

SEQ ID NO: 545718 - DNA, 20 bp, mouse
gtacaggcaacaagggagag

SEQ ID NO: 545719 - DNA, 20 bp, mouse
gtgagggtttgttacaacta

SEQ ID NO: 545720 - DNA, 20 bp, mouse
ggggcccttgcttcttagtc

SEQ ID NO: 545721 - DNA, 20 bp, mouse
ggagaggcacaacaaggatt

SEQ ID NO: 545722 - DNA, 20 bp, mouse
gtgacttaaaggtgaaaaaa

SEQ ID NO: 545723 - DNA, 20 bp, mouse
gcaagggcccaaagagcctt

SEQ ID NO: 545724 - DNA, 20 bp, mouse
gcaactatggttcagatgca

SEQ ID NO: 545725 - DNA, 20 bp, mouse
gaaagccaattctatagtga

SEQ ID NO: 545726 - DNA, 20 bp, mouse
gggtgaagcaaactgctctg

SEQ ID NO: 545727 - DNA, 20 bp, mouse
ggcaccacggttgtcaccag

SEQ ID NO: 545728 - DNA, 20 bp, mouse
gctgggactctccaactcat

SEQ ID NO: 545729 - DNA, 20 bp, mouse
gcctaataggaagtacatag

SEQ ID NO: 545730 - DNA, 20 bp, mouse
gcctatttcagatagcacca

SEQ ID NO: 545731 - DNA, 20 bp, mouse
gttgcttcacccattgcctc

SEQ ID NO: 545732 - DNA, 20 bp, mouse
gcataggggattgtaactga

SEQ ID NO: 545733 - DNA, 20 bp, mouse
gcttgccacgtagaatatac

SEQ ID NO: 545734 - DNA, 20 bp, mouse
ggatggaaagattgcctaat

SEQ ID NO: 545735 - DNA, 20 bp, mouse
gctcggtgccacctactgca

SEQ ID NO: 545736 - DNA, 20 bp, mouse
gctcgctatgtagaacatgg

SEQ ID NO: 545737 - DNA, 20 bp, mouse
gtgcaatagagcaaactcca

SEQ ID NO: 545738 - DNA, 20 bp, mouse
gttgggactctccaatagat

SEQ ID NO: 545739 - DNA, 20 bp, mouse
gtggctttatccattgctgt

SEQ ID NO: 545740 - DNA, 20 bp, mouse
gtctttattcatgctattgg

SEQ ID NO: 545741 - DNA, 20 bp, mouse
gatacaacctccaaatgaga

SEQ ID NO: 545742 - DNA, 20 bp, mouse
gtctacatagcgagtgtgat

SEQ ID NO: 545743 - DNA, 20 bp, mouse
gcatatttgtggtctcatga

SEQ ID NO: 545744 - DNA, 20 bp, mouse
ggctattgggggcacggaaa

SEQ ID NO: 545745 - DNA, 20 bp, mouse
gcttggacttattcactcag

SEQ ID NO: 545746 - DNA, 20 bp, mouse
gtgcccataaagccaaagga

SEQ ID NO: 545747 - DNA, 20 bp, mouse
gtgccttcctttggctttat

SEQ ID NO: 545748 - DNA, 20 bp, mouse
gctgaccattatgagcccaa

SEQ ID NO: 545749 - DNA, 20 bp, mouse
ggtacataggagagtgtaag

SEQ ID NO: 545750 - DNA, 20 bp, mouse
gtatggaggagaacacaaaa

SEQ ID NO: 545751 - DNA, 20 bp, mouse
gagttgaatattccaagaat

SEQ ID NO: 545752 - DNA, 20 bp, mouse
gcttgccacataaaatatgg

SEQ ID NO: 545753 - DNA, 20 bp, mouse
gtcactgattgtgttcactg

SEQ ID NO: 545754 - DNA, 20 bp, mouse
gtagtaaacttgccattctg

SEQ ID NO: 545755 - DNA, 20 bp, mouse
gcttgttttcagtggcctcc

SEQ ID NO: 545756 - DNA, 20 bp, mouse
gagcagcagttggatattcc

SEQ ID NO: 545757 - DNA, 20 bp, mouse
gcttgccacatacaacactg

SEQ ID NO: 545758 - DNA, 20 bp, mouse
gataacaaagccaatgaaga

SEQ ID NO: 545759 - DNA, 20 bp, mouse
gaatgattcaccctcttcat

SEQ ID NO: 545760 - DNA, 20 bp, mouse
gtcatggtcaggtaatgaag

SEQ ID NO: 545761 - DNA, 20 bp, mouse
gcacatctgggggctcatca

SEQ ID NO: 545762 - DNA, 20 bp, mouse
gtgcataagaccaactaccc

SEQ ID NO: 545763 - DNA, 20 bp, mouse
gcataggagaatgtagctga

SEQ ID NO: 545764 - DNA, 20 bp, mouse
gtaaatcatcttgggtgaag

SEQ ID NO: 545765 - DNA, 20 bp, mouse
gaaagaagatgcacatctgg

SEQ ID NO: 545766 - DNA, 20 bp, mouse
gacttgcatcttccaggagt

SEQ ID NO: 545767 - DNA, 20 bp, mouse
gtgtcagaatttatgttcgt

SEQ ID NO: 545768 - DNA, 20 bp, mouse
gcatgagagaatgtaagtgg

SEQ ID NO: 545769 - DNA, 20 bp, mouse
gagaagcacttgcatcttcc

SEQ ID NO: 545770 - DNA, 20 bp, mouse
ggtggtgctgctcataggca

SEQ ID NO: 545771 - DNA, 20 bp, mouse
ggccactgtgaaaatgatga

SEQ ID NO: 545772 - DNA, 20 bp, mouse
gtttgcttcggtgttttata

SEQ ID NO: 545773 - DNA, 20 bp, mouse
ggtacatgagagaatgtaag

SEQ ID NO: 545774 - DNA, 20 bp, mouse
gatcttagtgtctgcctggg

SEQ ID NO: 545775 - DNA, 20 bp, mouse
gcacatttttgcattcataa

SEQ ID NO: 545776 - DNA, 20 bp, mouse
ggggggagcaaacctctctg

SEQ ID NO: 545777 - DNA, 20 bp, mouse
gtgacatacatgctaatggg

SEQ ID NO: 545778 - DNA, 20 bp, mouse
gagaagaagctggatgtccc

SEQ ID NO: 545779 - DNA, 20 bp, mouse
gcttggactcaccaactcct

SEQ ID NO: 545780 - DNA, 20 bp, mouse
ggaacacaaagagaagaagc

SEQ ID NO: 545781 - DNA, 20 bp, mouse
gcttgccacataaaacacag

SEQ ID NO: 545782 - DNA, 20 bp, mouse
gtactgacatacatgctaat

SEQ ID NO: 545783 - DNA, 20 bp, mouse
gtatcagagtttgtatttct

SEQ ID NO: 545784 - DNA, 20 bp, mouse
gtgtcagtactacctggaga

SEQ ID NO: 545785 - DNA, 20 bp, mouse
gcatgtatgtcagtactacc

SEQ ID NO: 545786 - DNA, 20 bp, mouse
ggatgatttatgacctcttc

SEQ ID NO: 545787 - DNA, 20 bp, mouse
gagccaattgggccacagaa

SEQ ID NO: 545788 - DNA, 20 bp, mouse
gttgggccacagaatggata

SEQ ID NO: 545789 - DNA, 20 bp, mouse
gtggctcttgcttggatcat

SEQ ID NO: 545790 - DNA, 20 bp, mouse
gattggccttatccattctg

SEQ ID NO: 545791 - DNA, 20 bp, mouse
ggatggaggaaatcactcag

SEQ ID NO: 545792 - DNA, 20 bp, mouse
gttatgtggcaagtatgctg

SEQ ID NO: 545793 - DNA, 20 bp, mouse
gactaggcctcaccaattca

SEQ ID NO: 545794 - DNA, 20 bp, mouse
gaattctccatgaattggtg

SEQ ID NO: 545795 - DNA, 20 bp, mouse
gtactgtgaagaacagaaaa

SEQ ID NO: 545796 - DNA, 20 bp, mouse
gaaattaagttttaactaaa

SEQ ID NO: 545797 - DNA, 20 bp, mouse
ggatggaggaaatcactcaa

SEQ ID NO: 545798 - DNA, 20 bp, mouse
gcacctgaagggcacaaaag

SEQ ID NO: 545799 - DNA, 20 bp, mouse
gttcctcttttgtgcccttc

SEQ ID NO: 545800 - DNA, 20 bp, mouse
gtatcagaatttttgttgct

SEQ ID NO: 545801 - DNA, 20 bp, mouse
ggagttgactatcacctgaa

SEQ ID NO: 545802 - DNA, 20 bp, mouse
ggcttgcacaagttgatgga

SEQ ID NO: 545803 - DNA, 20 bp, mouse
gtcaagcttgcacaagttga

SEQ ID NO: 545804 - DNA, 20 bp, mouse
gtgcacaagttgatggatgg

SEQ ID NO: 545805 - DNA, 20 bp, mouse
ggacacacctgtatcaatga

SEQ ID NO: 545806 - DNA, 20 bp, mouse
gcttgtcagagaagccacgg

SEQ ID NO: 545807 - DNA, 20 bp, mouse
gcggaggatgaaatcaccat

SEQ ID NO: 545808 - DNA, 20 bp, mouse
gcagtttgcaatgacaccca

SEQ ID NO: 545809 - DNA, 20 bp, mouse
gaaagtaccttctctaaata

SEQ ID NO: 545810 - DNA, 20 bp, mouse
gaggaagatgtagagctgag

SEQ ID NO: 545811 - DNA, 20 bp, mouse
gtgagtggcacagccactat

SEQ ID NO: 545812 - DNA, 20 bp, mouse
ggacaagccatatttagaga

SEQ ID NO: 545813 - DNA, 20 bp, mouse
gacaagaagcacacattcag

SEQ ID NO: 545814 - DNA, 20 bp, mouse
ggtgaaacaaatatctaata

SEQ ID NO: 545815 - DNA, 20 bp, mouse
gtaataaggaaagattggaa

SEQ ID NO: 545816 - DNA, 20 bp, mouse
gccagaaaatgccactatgg

SEQ ID NO: 545817 - DNA, 20 bp, mouse
gggatgtataacagacctct

SEQ ID NO: 545818 - DNA, 20 bp, mouse
ggtaagtccaccagcattcg

SEQ ID NO: 545819 - DNA, 20 bp, mouse
gtaactgagttttttctatt

SEQ ID NO: 545820 - DNA, 20 bp, mouse
gagttttttctattaggatt

SEQ ID NO: 545821 - DNA, 20 bp, mouse
gacagacctctaggcatgaa

SEQ ID NO: 545822 - DNA, 20 bp, mouse
gtactggtatgcactcaaca

SEQ ID NO: 545823 - DNA, 20 bp, mouse
gggacttactgcgggaacat

SEQ ID NO: 545824 - DNA, 20 bp, mouse
gtaacactcagtgcttccca

SEQ ID NO: 545825 - DNA, 20 bp, mouse
gggcagtaatgtcatatgac

SEQ ID NO: 545826 - DNA, 20 bp, mouse
ggatttgggctcatgatctg

SEQ ID NO: 545827 - DNA, 20 bp, mouse
gtactacacaggatacatgg

SEQ ID NO: 545828 - DNA, 20 bp, mouse
gggcaaaagagcaaacatac

SEQ ID NO: 545829 - DNA, 20 bp, mouse
ggtcactggaagtaactgta

SEQ ID NO: 545830 - DNA, 20 bp, mouse
gaagagcaaacatactggaa

SEQ ID NO: 545831 - DNA, 20 bp, mouse
ggcctctggaccagagagaa

SEQ ID NO: 545832 - DNA, 20 bp, mouse
ggagagatgggtaccgaagt

SEQ ID NO: 545833 - DNA, 20 bp, mouse
gtacccatatctatgagatt

SEQ ID NO: 545834 - DNA, 20 bp, mouse
ggcccaaatctcatagatat

SEQ ID NO: 545835 - DNA, 20 bp, mouse
ggaaaaactgtaacccatgg

SEQ ID NO: 545836 - DNA, 20 bp, mouse
ggagcaatcagtggatacta

SEQ ID NO: 545837 - DNA, 20 bp, mouse
gcacaggctggcaaggagat

SEQ ID NO: 545838 - DNA, 20 bp, mouse
gaggagagtcataacataaa

SEQ ID NO: 545839 - DNA, 20 bp, mouse
gtgggttttggagatctcca

SEQ ID NO: 545840 - DNA, 20 bp, mouse
ggtgtgaagggagcaatcag

SEQ ID NO: 545841 - DNA, 20 bp, mouse
ggtgtagctgatctctagga

SEQ ID NO: 545842 - DNA, 20 bp, mouse
ggctagctggaaacaacccc

SEQ ID NO: 545843 - DNA, 20 bp, mouse
gatgctgtggacattgttat

SEQ ID NO: 545844 - DNA, 20 bp, mouse
gctagcattggcctcttggt

SEQ ID NO: 545845 - DNA, 20 bp, mouse
gtcaagatcatgagtaagat

SEQ ID NO: 545846 - DNA, 20 bp, mouse
gaatggagaattcatctaca

SEQ ID NO: 545847 - DNA, 20 bp, mouse
ggttatctgtcataccaaga

SEQ ID NO: 545848 - DNA, 20 bp, mouse
gcataggtgtatggaggcgg

SEQ ID NO: 545849 - DNA, 20 bp, mouse
gtgattctcagccatgtcaa

SEQ ID NO: 545850 - DNA, 20 bp, mouse
ggatgaattctccattgaca

SEQ ID NO: 545851 - DNA, 20 bp, mouse
gttggatgcatggctcaaat

SEQ ID NO: 545852 - DNA, 20 bp, mouse
ggtaacatcctgctaccaag

SEQ ID NO: 545853 - DNA, 20 bp, mouse
gatacataggtgtatggagg

SEQ ID NO: 545854 - DNA, 20 bp, mouse
gagcaggatgttaccttggt

SEQ ID NO: 545855 - DNA, 20 bp, mouse
gaattagtaccacaagccct

SEQ ID NO: 545856 - DNA, 20 bp, mouse
ggctagtgtgatatactgat

SEQ ID NO: 545857 - DNA, 20 bp, mouse
gtagcttgtagaagagactc

SEQ ID NO: 545858 - DNA, 20 bp, mouse
gatgtctgtgaaggataggt

SEQ ID NO: 545859 - DNA, 20 bp, mouse
ggaagtacatgggactgtaa

SEQ ID NO: 545860 - DNA, 20 bp, mouse
ggcagagaaacagtgtgaag

SEQ ID NO: 545861 - DNA, 20 bp, mouse
gatcctacaaaggagatggt

SEQ ID NO: 545862 - DNA, 20 bp, mouse
gactacagtccctaaaatat

SEQ ID NO: 545863 - DNA, 20 bp, mouse
ggcagatgtctgtgaaggat

SEQ ID NO: 545864 - DNA, 20 bp, mouse
gacagcagaaccatgcacca

SEQ ID NO: 545865 - DNA, 20 bp, mouse
ggaatccagagatagcagtt

SEQ ID NO: 545866 - DNA, 20 bp, mouse
gcattcttgtgggactctct

SEQ ID NO: 545867 - DNA, 20 bp, mouse
gatgatcaagggtacaacac

SEQ ID NO: 545868 - DNA, 20 bp, mouse
gtgtccagaagacaacactc

SEQ ID NO: 545869 - DNA, 20 bp, mouse
gatcaagggtacaacactgg

SEQ ID NO: 545870 - DNA, 20 bp, mouse
gaagacaacactctgggatg

SEQ ID NO: 545871 - DNA, 20 bp, mouse
gatgaagaaaatgaattacc

SEQ ID NO: 545872 - DNA, 20 bp, mouse
gggtatagtttccaatttcc

SEQ ID NO: 545873 - DNA, 20 bp, mouse
gaatctatcataagccataa

SEQ ID NO: 545874 - DNA, 20 bp, mouse
gtgggtaaaacaggagctgt

SEQ ID NO: 545875 - DNA, 20 bp, mouse
gttcagggctttcttagcac

SEQ ID NO: 545876 - DNA, 20 bp, mouse
gaaattcagagcttaaggtg

SEQ ID NO: 545877 - DNA, 20 bp, mouse
gaatatgtagcaaatttcaa

SEQ ID NO: 545878 - DNA, 20 bp, mouse
ggcagagcacatcccaggaa

SEQ ID NO: 545879 - DNA, 20 bp, mouse
gaatggcagataggttccga

SEQ ID NO: 545880 - DNA, 20 bp, mouse
gatagttgtatggcctgcta

SEQ ID NO: 545881 - DNA, 20 bp, mouse
gtcccaggaatggcattcgc

SEQ ID NO: 545882 - DNA, 20 bp, mouse
gtggctctggcatgcatcag

SEQ ID NO: 545883 - DNA, 20 bp, mouse
gctggagacaggtgtcaata

SEQ ID NO: 545884 - DNA, 20 bp, mouse
gcatttgcagagcacatccc

SEQ ID NO: 545885 - DNA, 20 bp, mouse
gaggtgtggtttttcttcaa

SEQ ID NO: 545886 - DNA, 20 bp, mouse
gtgtactttcttcgttgtca

SEQ ID NO: 545887 - DNA, 20 bp, mouse
gtgagctcaggtaaatgaga

SEQ ID NO: 545888 - DNA, 20 bp, mouse
gatactgtcatccttaactg

SEQ ID NO: 545889 - DNA, 20 bp, mouse
gtatgcacaagccccagtta

SEQ ID NO: 545890 - DNA, 20 bp, mouse
gcccaactttggttctgctc

SEQ ID NO: 545891 - DNA, 20 bp, mouse
gtagcgcaatggatagcata

SEQ ID NO: 545892 - DNA, 20 bp, mouse
gaatgggctcatcatcctgc

SEQ ID NO: 545893 - DNA, 20 bp, mouse
gtgctctggaatcatccaca

SEQ ID NO: 545894 - DNA, 20 bp, mouse
gtctggaatcatccacatgg

SEQ ID NO: 545895 - DNA, 20 bp, mouse
gggaatcatccacatggtgg

SEQ ID NO: 545896 - DNA, 20 bp, mouse
gtcacaagcaatggatcatg

SEQ ID NO: 545897 - DNA, 20 bp, mouse
gtttccatagtcacaagcaa

SEQ ID NO: 545898 - DNA, 20 bp, mouse
ggatccattgcttgtgacta

SEQ ID NO: 545899 - DNA, 20 bp, mouse
gacatagggctatggagaca

SEQ ID NO: 545900 - DNA, 20 bp, mouse
ggaagaaatacatagggcta

SEQ ID NO: 545901 - DNA, 20 bp, mouse
gtcaagaaagttagtgttat

SEQ ID NO: 545902 - DNA, 20 bp, mouse
gggtctttgtagagccccaa

SEQ ID NO: 545903 - DNA, 20 bp, mouse
gaaaggttaattaacatctg

SEQ ID NO: 545904 - DNA, 20 bp, mouse
gttatttcttccacacaatg

SEQ ID NO: 545905 - DNA, 20 bp, mouse
gaatatagacacgagaatga

SEQ ID NO: 545906 - DNA, 20 bp, mouse
gacagtctctaccatgtggg

SEQ ID NO: 545907 - DNA, 20 bp, mouse
gctgttggttgtggggtcgc

SEQ ID NO: 545908 - DNA, 20 bp, mouse
gcttacagtctctaccatgt

SEQ ID NO: 545909 - DNA, 20 bp, mouse
gtgctgtcaaatgtatgcag

SEQ ID NO: 545910 - DNA, 20 bp, mouse
gtgtcctagaaccacccaca

SEQ ID NO: 545911 - DNA, 20 bp, mouse
gcatttgacagcagggtctt

SEQ ID NO: 545912 - DNA, 20 bp, mouse
gtgtttgttttcagtgccct

SEQ ID NO: 545913 - DNA, 20 bp, mouse
gtctacctgagctcagtact

SEQ ID NO: 545914 - DNA, 20 bp, mouse
gctcagaccatctcctttgt

SEQ ID NO: 545915 - DNA, 20 bp, mouse
ggagctcagtactgggcaac

SEQ ID NO: 545916 - DNA, 20 bp, mouse
gtgctgccaaccgtatgcag

SEQ ID NO: 545917 - DNA, 20 bp, mouse
gtggaatcatccaaaatgca

SEQ ID NO: 545918 - DNA, 20 bp, mouse
gtgcagatgtttatgttcgg

SEQ ID NO: 545919 - DNA, 20 bp, mouse
gtgtttatgttcggtggcct

SEQ ID NO: 545920 - DNA, 20 bp, mouse
gggcatggtggtggtaacaa

SEQ ID NO: 545921 - DNA, 20 bp, mouse
gtctcacagaccttgcattt

SEQ ID NO: 545922 - DNA, 20 bp, mouse
gtgcagccagcagccagtaa

SEQ ID NO: 545923 - DNA, 20 bp, mouse
gcaactggggcctctgcata

SEQ ID NO: 545924 - DNA, 20 bp, mouse
gctcaaaccatctcctttac

SEQ ID NO: 545925 - DNA, 20 bp, mouse
gcagcagggtcttgtatttg

SEQ ID NO: 545926 - DNA, 20 bp, mouse
gctgagtctccaagcaggct

SEQ ID NO: 545927 - DNA, 20 bp, mouse
ggccagctgagtctccaagc

SEQ ID NO: 545928 - DNA, 20 bp, mouse
gatgtgggtgaggtagacca

SEQ ID NO: 545929 - DNA, 20 bp, mouse
gaagaagaacaggcaatgag

SEQ ID NO: 545930 - DNA, 20 bp, mouse
gaggcagggaagcaagtcta

SEQ ID NO: 545931 - DNA, 20 bp, mouse
gcttgtggaagagattaacc

SEQ ID NO: 545932 - DNA, 20 bp, mouse
ggtgattcctgcatcccacc

SEQ ID NO: 545933 - DNA, 20 bp, mouse
gtacatagttgaaagggtgg

SEQ ID NO: 545934 - DNA, 20 bp, mouse
ggatatttacatagttgaaa

SEQ ID NO: 545935 - DNA, 20 bp, mouse
gaatagtaaatgtataaaga

SEQ ID NO: 545936 - DNA, 20 bp, mouse
gcagcaactagcaaatgaga

SEQ ID NO: 545937 - DNA, 20 bp, mouse
gaccaaaaacaaacatctgc

SEQ ID NO: 545938 - DNA, 20 bp, mouse
gaacatctggggcatggtag

SEQ ID NO: 545939 - DNA, 20 bp, mouse
gtttgttttcgatgattcca

SEQ ID NO: 545940 - DNA, 20 bp, mouse
gacaaagctcatatccaata

SEQ ID NO: 545941 - DNA, 20 bp, mouse
ggctcatatccaatagggag

SEQ ID NO: 545942 - DNA, 20 bp, mouse
ggcctgcagatgtttgtttt

SEQ ID NO: 545943 - DNA, 20 bp, mouse
gatgtttgtttttggtgccc

SEQ ID NO: 545944 - DNA, 20 bp, mouse
gtaagccatcacaacaaaaa

SEQ ID NO: 545945 - DNA, 20 bp, mouse
gtgctgccaaccgcatgcac

SEQ ID NO: 545946 - DNA, 20 bp, mouse
gatgagggtgatgcagacca

SEQ ID NO: 545947 - DNA, 20 bp, mouse
gaagaagaaaaggcaataag

SEQ ID NO: 545948 - DNA, 20 bp, mouse
ggggcagggttgcaggtcta

SEQ ID NO: 545949 - DNA, 20 bp, mouse
gcttgtggaagtgactaacc

SEQ ID NO: 545950 - DNA, 20 bp, mouse
gtccagagatgtgatattgc

SEQ ID NO: 545951 - DNA, 20 bp, mouse
gtgtcaggtacacaatcaaa

SEQ ID NO: 545952 - DNA, 20 bp, mouse
gttaaatgagtaaagtagaa

SEQ ID NO: 545953 - DNA, 20 bp, mouse
gcacaatcaaaaggagtgtc

SEQ ID NO: 545954 - DNA, 20 bp, mouse
ggttgcaggtctatggtgtc

SEQ ID NO: 545955 - DNA, 20 bp, mouse
gtacagaccttgagcatgac

SEQ ID NO: 545956 - DNA, 20 bp, mouse
gctaccatgtggaggatgtc

SEQ ID NO: 545957 - DNA, 20 bp, mouse
gtgtcctgacatcctccaca

SEQ ID NO: 545958 - DNA, 20 bp, mouse
gtgggacctgtgcatacgtt

SEQ ID NO: 545959 - DNA, 20 bp, mouse
ggatgctctctgtcataccc

SEQ ID NO: 545960 - DNA, 20 bp, mouse
gctgttggttgtggaatcac

SEQ ID NO: 545961 - DNA, 20 bp, mouse
gggctgcagatgtacgtgtt

SEQ ID NO: 545962 - DNA, 20 bp, mouse
gcatctcctttgctagctgc

SEQ ID NO: 545963 - DNA, 20 bp, mouse
gatcatcatgctggtatgcc

SEQ ID NO: 545964 - DNA, 20 bp, mouse
gagcatcctctttgttgtca

SEQ ID NO: 545965 - DNA, 20 bp, mouse
gtcaggacaaaaccaaagtt

SEQ ID NO: 545966 - DNA, 20 bp, mouse
gggcaatgtgaccagagtcc

SEQ ID NO: 545967 - DNA, 20 bp, mouse
gatagccccatgagtagtgt

SEQ ID NO: 545968 - DNA, 20 bp, mouse
gccttgtggacaagcccaat

SEQ ID NO: 545969 - DNA, 20 bp, mouse
gtgggcttgtccacaaggct

SEQ ID NO: 545970 - DNA, 20 bp, mouse
gaggacaaactcctggactc

SEQ ID NO: 545971 - DNA, 20 bp, mouse
gagtcaggaagatgacaaac

SEQ ID NO: 545972 - DNA, 20 bp, mouse
gatggagaagtcacttgagt

SEQ ID NO: 545973 - DNA, 20 bp, mouse
gtcccttattcccagccttg

SEQ ID NO: 545974 - DNA, 20 bp, mouse
gctactcatggggctatgga

SEQ ID NO: 545975 - DNA, 20 bp, mouse
gcatgcccacactactcatg

SEQ ID NO: 545976 - DNA, 20 bp, mouse
gatgctctcagctataccca

SEQ ID NO: 545977 - DNA, 20 bp, mouse
ggtatgcaacaaagaggaaa

SEQ ID NO: 545978 - DNA, 20 bp, mouse
gatgtatatgttcagtgccc

SEQ ID NO: 545979 - DNA, 20 bp, mouse
gcaccatgtggatgtttcca

SEQ ID NO: 545980 - DNA, 20 bp, mouse
gtggggcctgtgcatacgat

SEQ ID NO: 545981 - DNA, 20 bp, mouse
gcccaactttggttctgcct

SEQ ID NO: 545982 - DNA, 20 bp, mouse
gaagaaagtatgcaacaaag

SEQ ID NO: 545983 - DNA, 20 bp, mouse
gagcatcctctttgttgtga

SEQ ID NO: 545984 - DNA, 20 bp, mouse
gctgttggttgtgggatcac

SEQ ID NO: 545985 - DNA, 20 bp, mouse
ggttgcccaggactgagttc

SEQ ID NO: 545986 - DNA, 20 bp, mouse
gacggagctgtgattctcat

SEQ ID NO: 545987 - DNA, 20 bp, mouse
gcacaagcgtagagaggtag

SEQ ID NO: 545988 - DNA, 20 bp, mouse
ggagctgtgattctcatagg

SEQ ID NO: 545989 - DNA, 20 bp, mouse
gattactggagaaacccaga

SEQ ID NO: 545990 - DNA, 20 bp, mouse
gtgggccacacacccagaat

SEQ ID NO: 545991 - DNA, 20 bp, mouse
gactaacatctgaggcactg

SEQ ID NO: 545992 - DNA, 20 bp, mouse
gcgggagtccaggtggatca

SEQ ID NO: 545993 - DNA, 20 bp, mouse
gtggtgttaggcatcactga

SEQ ID NO: 545994 - DNA, 20 bp, mouse
ggataaccttatatctgagt

SEQ ID NO: 545995 - DNA, 20 bp, mouse
gattgcccacaagcgtagag

SEQ ID NO: 545996 - DNA, 20 bp, mouse
gcaaggttggttagcatctg

SEQ ID NO: 545997 - DNA, 20 bp, mouse
gcttctttactataggtgaa

SEQ ID NO: 545998 - DNA, 20 bp, mouse
gccacacagtggatactaac

SEQ ID NO: 545999 - DNA, 20 bp, mouse
gggtctttgtggaacttcca

SEQ ID NO: 546000 - DNA, 20 bp, mouse
gtttgtggaacttccaaggt

SEQ ID NO: 546001 - DNA, 20 bp, mouse
gtatccactgtgtggctgac

SEQ ID NO: 546002 - DNA, 20 bp, mouse
gccagaagagtttattctgc

SEQ ID NO: 546003 - DNA, 20 bp, mouse
gatttcctatgctgtctcag

SEQ ID NO: 546004 - DNA, 20 bp, mouse
ggtgtagcacatgtctagaa

SEQ ID NO: 546005 - DNA, 20 bp, mouse
gctctgtaccccccattatg

SEQ ID NO: 546006 - DNA, 20 bp, mouse
gggaaggccatgcacagtcg

SEQ ID NO: 546007 - DNA, 20 bp, mouse
gcaggactgtaaataagtag

SEQ ID NO: 546008 - DNA, 20 bp, mouse
gatctggggcacggtcgtgg

SEQ ID NO: 546009 - DNA, 20 bp, mouse
ggcataactcagatccagga

SEQ ID NO: 546010 - DNA, 20 bp, mouse
gaacatctggggcacggtcg

SEQ ID NO: 546011 - DNA, 20 bp, mouse
ggcacagatgaggccacaaa

SEQ ID NO: 546012 - DNA, 20 bp, mouse
gggccatgcacagtcgaggc

SEQ ID NO: 546013 - DNA, 20 bp, mouse
gaaggatccaattggtcctg

SEQ ID NO: 546014 - DNA, 20 bp, mouse
ggcaaagactgtgtagacaa

SEQ ID NO: 546015 - DNA, 20 bp, mouse
ggctcatcttgactccatag

SEQ ID NO: 546016 - DNA, 20 bp, mouse
ggagaagaggtgtggtccta

SEQ ID NO: 546017 - DNA, 20 bp, mouse
gggtgtggtcctagggctca

SEQ ID NO: 546018 - DNA, 20 bp, mouse
gctgtcacaaaggtctgatt

SEQ ID NO: 546019 - DNA, 20 bp, mouse
gaacaagtaaattatcagaa

SEQ ID NO: 546020 - DNA, 20 bp, mouse
ggtgtagcctaagtccaaca

SEQ ID NO: 546021 - DNA, 20 bp, mouse
ggccagatgtgccaacatct

SEQ ID NO: 546022 - DNA, 20 bp, mouse
ggatgaccttgtacctgagt

SEQ ID NO: 546023 - DNA, 20 bp, mouse
gtacctgtctatggacatga

SEQ ID NO: 546024 - DNA, 20 bp, mouse
gtgccatcatgtccatagac

SEQ ID NO: 546025 - DNA, 20 bp, mouse
gcatgagcccatgtctatgt

SEQ ID NO: 546026 - DNA, 20 bp, mouse
ggagcgccatgcagaccctt

SEQ ID NO: 546027 - DNA, 20 bp, mouse
ggccatgcagacccttagga

SEQ ID NO: 546028 - DNA, 20 bp, mouse
gggattcgctggagaagccc

SEQ ID NO: 546029 - DNA, 20 bp, mouse
gactctgacctgggattcgc

SEQ ID NO: 546030 - DNA, 20 bp, mouse
gtgtgtggaggcgagagtct

SEQ ID NO: 546031 - DNA, 20 bp, mouse
gcccaggagatggtcctcct

SEQ ID NO: 546032 - DNA, 20 bp, mouse
gagcaggaagatgaacatct

SEQ ID NO: 546033 - DNA, 20 bp, mouse
gcgagagtctaggtaaatca

SEQ ID NO: 546034 - DNA, 20 bp, mouse
gtctacatgatcaccctcct

SEQ ID NO: 546035 - DNA, 20 bp, mouse
gccccagatgctggttaaca

SEQ ID NO: 546036 - DNA, 20 bp, mouse
gtgtccttggtgctgaacca

SEQ ID NO: 546037 - DNA, 20 bp, mouse
gctgaaccacggtccataac

SEQ ID NO: 546038 - DNA, 20 bp, mouse
gacaacggctacgctatccg

SEQ ID NO: 546039 - DNA, 20 bp, mouse
gggaccgtggttcagcacca

SEQ ID NO: 546040 - DNA, 20 bp, mouse
ggtccacgtgcactgctctg

SEQ ID NO: 546041 - DNA, 20 bp, mouse
ggctctgtggttcagtacca

SEQ ID NO: 546042 - DNA, 20 bp, mouse
gcagctttgggcagtgtcca

SEQ ID NO: 546043 - DNA, 20 bp, mouse
gccaaaaggcacgctgtcct

SEQ ID NO: 546044 - DNA, 20 bp, mouse
gccacggttctgaaaccaaa

SEQ ID NO: 546045 - DNA, 20 bp, mouse
gggtgtcctgttatggaccg

SEQ ID NO: 546046 - DNA, 20 bp, mouse
gtcaggcccacgagtagggt

SEQ ID NO: 546047 - DNA, 20 bp, mouse
gtcctggtcatcagacctat

SEQ ID NO: 546048 - DNA, 20 bp, mouse
ggacctcaggcccacgagta

SEQ ID NO: 546049 - DNA, 20 bp, mouse
gccgtccttgatgtctttac

SEQ ID NO: 546050 - DNA, 20 bp, mouse
gatctctacaactggccaat

SEQ ID NO: 546051 - DNA, 20 bp, mouse
gatggagagatctctacaac

SEQ ID NO: 546052 - DNA, 20 bp, mouse
ggccaataggtctgatgacc

SEQ ID NO: 546053 - DNA, 20 bp, mouse
gaatgggtttataaatacac

SEQ ID NO: 546054 - DNA, 20 bp, mouse
ggataactaacatattctct

SEQ ID NO: 546055 - DNA, 20 bp, mouse
gatgaaaaggacacatggta

SEQ ID NO: 546056 - DNA, 20 bp, mouse
gggtcagcaggtagagactc

SEQ ID NO: 546057 - DNA, 20 bp, mouse
gacagtcccacgagtaaggt

SEQ ID NO: 546058 - DNA, 20 bp, mouse
ggtccacagtcccacgagta

SEQ ID NO: 546059 - DNA, 20 bp, mouse
gagcacaaactgttggactc

SEQ ID NO: 546060 - DNA, 20 bp, mouse
gactcaggaagacaacaaac

SEQ ID NO: 546061 - DNA, 20 bp, mouse
gaggttttcctacaaggctg

SEQ ID NO: 546062 - DNA, 20 bp, mouse
gttataaaggaaatgtggta

SEQ ID NO: 546063 - DNA, 20 bp, mouse
ggctgttaggttttcctaca

SEQ ID NO: 546064 - DNA, 20 bp, mouse
gccttgtcttcgtggctggg

SEQ ID NO: 546065 - DNA, 20 bp, mouse
gtgtgtcatgcaagttataa

SEQ ID NO: 546066 - DNA, 20 bp, mouse
gatagacccacaagtaaggt

SEQ ID NO: 546067 - DNA, 20 bp, mouse
ggtcatgttggccagctcca

SEQ ID NO: 546068 - DNA, 20 bp, mouse
ggagatgattaacttgctca

SEQ ID NO: 546069 - DNA, 20 bp, mouse
ggtccatagacccacaagta

SEQ ID NO: 546070 - DNA, 20 bp, mouse
gagtgtgaagggaatgtggt

SEQ ID NO: 546071 - DNA, 20 bp, mouse
gagttaatcatctcaacatc

SEQ ID NO: 546072 - DNA, 20 bp, mouse
gttcagaagttcctcttgct

SEQ ID NO: 546073 - DNA, 20 bp, mouse
gtgtgtcatgcagagtgtga

SEQ ID NO: 546074 - DNA, 20 bp, mouse
ggagctggccaacatgacca

SEQ ID NO: 546075 - DNA, 20 bp, mouse
gaagaacagatgataacaat

SEQ ID NO: 546076 - DNA, 20 bp, mouse
ggtggcgcttcccagaaggg

SEQ ID NO: 546077 - DNA, 20 bp, mouse
gagggtggcgcttcccagaa

SEQ ID NO: 546078 - DNA, 20 bp, mouse
gtcgcgtgctcggctctgat

SEQ ID NO: 546079 - DNA, 20 bp, mouse
gctcggctctgattggccca

SEQ ID NO: 546080 - DNA, 20 bp, mouse
gtgcagggcacagctcgtgg

SEQ ID NO: 546081 - DNA, 20 bp, mouse
ggcatgggcccaggattcgc

SEQ ID NO: 546082 - DNA, 20 bp, mouse
gcaagcatcgggcgtagtga

SEQ ID NO: 546083 - DNA, 20 bp, mouse
gcacagtacctgcgaatcct

SEQ ID NO: 546084 - DNA, 20 bp, mouse
ggaagagcgctgcaagcatc

SEQ ID NO: 546085 - DNA, 20 bp, mouse
gctgtgtttaaggaccaggg

SEQ ID NO: 546086 - DNA, 20 bp, mouse
ggctattactatagaatcca

SEQ ID NO: 546087 - DNA, 20 bp, mouse
gagattgcagagaatgatat

SEQ ID NO: 546088 - DNA, 20 bp, mouse
gtaatagccaatgaatcatg

SEQ ID NO: 546089 - DNA, 20 bp, mouse
ggtaaagcctcatgattcat

SEQ ID NO: 546090 - DNA, 20 bp, mouse
gttactatagaatccagggt

SEQ ID NO: 546091 - DNA, 20 bp, mouse
gtggttttgcagatcgtcct

SEQ ID NO: 546092 - DNA, 20 bp, mouse
ggttacgccgattcattatg

SEQ ID NO: 546093 - DNA, 20 bp, mouse
gaatatagacatgagaatga

SEQ ID NO: 546094 - DNA, 20 bp, mouse
gctctgtacctcccattgtg

SEQ ID NO: 546095 - DNA, 20 bp, mouse
gggtctttgtagagccccaa

SEQ ID NO: 546096 - DNA, 20 bp, mouse
gactgtggagagattggcca

SEQ ID NO: 546097 - DNA, 20 bp, mouse
gtggtagccaccagggcccg

SEQ ID NO: 546098 - DNA, 20 bp, mouse
gaccactaccagggacacac

SEQ ID NO: 546099 - DNA, 20 bp, mouse
gagtttccagagacacacca

SEQ ID NO: 546100 - DNA, 20 bp, mouse
ggctgggagggatatctctt

SEQ ID NO: 546101 - DNA, 20 bp, mouse
gacagagatccactagggag

SEQ ID NO: 546102 - DNA, 20 bp, mouse
gagccaccagggcccgaggc

SEQ ID NO: 546103 - DNA, 20 bp, mouse
gtatgtcaggggtctgtaga

SEQ ID NO: 546104 - DNA, 20 bp, mouse
gacacaggtctgagaactca

SEQ ID NO: 546105 - DNA, 20 bp, mouse
gatacctggctgcggttctg

SEQ ID NO: 546106 - DNA, 20 bp, mouse
gcataggcgtgtcaaacaca

SEQ ID NO: 546107 - DNA, 20 bp, mouse
ggtgacagtcactaggtaca

SEQ ID NO: 546108 - DNA, 20 bp, mouse
ggtgtcaaacacatggaacc

SEQ ID NO: 546109 - DNA, 20 bp, mouse
gaggtgggagtcggcagtga

SEQ ID NO: 546110 - DNA, 20 bp, mouse
gtatgcaaactgcatcaccc

SEQ ID NO: 546111 - DNA, 20 bp, mouse
gaagtagtaaaaagtatacc

SEQ ID NO: 546112 - DNA, 20 bp, mouse
gttactacttttttcggtac

SEQ ID NO: 546113 - DNA, 20 bp, mouse
ggtttccagtgacagtcact

SEQ ID NO: 546114 - DNA, 20 bp, mouse
gtcatgaacacaagacgctg

SEQ ID NO: 546115 - DNA, 20 bp, mouse
ggccttgctctgtgtgtgaa

SEQ ID NO: 546116 - DNA, 20 bp, mouse
gtcagtccaagagtcatcat

SEQ ID NO: 546117 - DNA, 20 bp, mouse
ggtccaagagtcatcatagg

SEQ ID NO: 546118 - DNA, 20 bp, mouse
gtgcctcctatgatgactct

SEQ ID NO: 546119 - DNA, 20 bp, mouse
gctcagtagatactgcatgg

SEQ ID NO: 546120 - DNA, 20 bp, mouse
ggccttgtgtccaggtgtgt

SEQ ID NO: 546121 - DNA, 20 bp, mouse
ggagctcagtagatactgca

SEQ ID NO: 546122 - DNA, 20 bp, mouse
gtgggtccctagcccagact

SEQ ID NO: 546123 - DNA, 20 bp, mouse
gagcccagactgggaatgct

SEQ ID NO: 546124 - DNA, 20 bp, mouse
gctcacacaagaaagcagga

SEQ ID NO: 546125 - DNA, 20 bp, mouse
gaagatatctgtgaagatcc

SEQ ID NO: 546126 - DNA, 20 bp, mouse
gttaagctggacagcacaga

SEQ ID NO: 546127 - DNA, 20 bp, mouse
ggcaaggtcactctgaacta

SEQ ID NO: 546128 - DNA, 20 bp, mouse
ggagaactgaatgaaatctg

SEQ ID NO: 546129 - DNA, 20 bp, mouse
gccgaagctgtgtcttatat

SEQ ID NO: 546130 - DNA, 20 bp, mouse
gtcagccaaagggtaatcag

SEQ ID NO: 546131 - DNA, 20 bp, mouse
ggccaaagggtaatcagagg

SEQ ID NO: 546132 - DNA, 20 bp, mouse
ggcctcctctgattaccctt

SEQ ID NO: 546133 - DNA, 20 bp, mouse
gaggtcttaagtctctatag

SEQ ID NO: 546134 - DNA, 20 bp, mouse
gtcacctggattcaaggcta

SEQ ID NO: 546135 - DNA, 20 bp, mouse
ggaacacaggatatattgca

SEQ ID NO: 546136 - DNA, 20 bp, mouse
gaatgactgtgtaatataat

SEQ ID NO: 546137 - DNA, 20 bp, mouse
gaatgaggaattgaaggtgt

SEQ ID NO: 546138 - DNA, 20 bp, mouse
gtacaaaaatgaggaattga

SEQ ID NO: 546139 - DNA, 20 bp, mouse
ggctctgtaagaaggcatgt

SEQ ID NO: 546140 - DNA, 20 bp, mouse
gaaggaacagtacaaaaatg

SEQ ID NO: 546141 - DNA, 20 bp, mouse
gacatgtgactgatggaatc

SEQ ID NO: 546142 - DNA, 20 bp, mouse
gcatagacacatgtgactga

SEQ ID NO: 546143 - DNA, 20 bp, mouse
ggttcccaagcactgttacc

SEQ ID NO: 546144 - DNA, 20 bp, mouse
gtgtaggatgctaacaaccc

SEQ ID NO: 546145 - DNA, 20 bp, mouse
gatacagtctgcatatgtaa

SEQ ID NO: 546146 - DNA, 20 bp, mouse
ggctctccagtgaccacaga

SEQ ID NO: 546147 - DNA, 20 bp, mouse
gggtgagtttcagaactctg

SEQ ID NO: 546148 - DNA, 20 bp, mouse
gagtccttgttagtgtaata

SEQ ID NO: 546149 - DNA, 20 bp, mouse
gctgaatggaagcaggaact

SEQ ID NO: 546150 - DNA, 20 bp, mouse
gctttaacactctcttgtaa

SEQ ID NO: 546151 - DNA, 20 bp, mouse
gaaaccctattacactaaca

SEQ ID NO: 546152 - DNA, 20 bp, mouse
gttctttgtgctgtatggac

SEQ ID NO: 546153 - DNA, 20 bp, mouse
gttcggttctttgtgctgta

SEQ ID NO: 546154 - DNA, 20 bp, mouse
gtctgtcatcaatgaaactt

SEQ ID NO: 546155 - DNA, 20 bp, mouse
gtgaaggtcaggagaagata

SEQ ID NO: 546156 - DNA, 20 bp, mouse
ggtcttctgtgaatcccagg

SEQ ID NO: 546157 - DNA, 20 bp, mouse
gcccaaagaagaaggactgc

SEQ ID NO: 546158 - DNA, 20 bp, mouse
gtggaaagagaaaaccaaac

SEQ ID NO: 546159 - DNA, 20 bp, mouse
gatgtcagctatggacaggt

SEQ ID NO: 546160 - DNA, 20 bp, mouse
gagaaccttggggatagtgg

SEQ ID NO: 546161 - DNA, 20 bp, mouse
gagaagcaacccaaagaaga

SEQ ID NO: 546162 - DNA, 20 bp, mouse
gtgcagaaccttggggatag

SEQ ID NO: 546163 - DNA, 20 bp, mouse
ggtgaagccgatgtcagcta

SEQ ID NO: 546164 - DNA, 20 bp, mouse
gagctatggacaggttggag

SEQ ID NO: 546165 - DNA, 20 bp, mouse
ggccgatgtcagctatggac

SEQ ID NO: 546166 - DNA, 20 bp, mouse
gtagtccccaggaagggtac

SEQ ID NO: 546167 - DNA, 20 bp, mouse
gtccccaggaagggtacagg

SEQ ID NO: 546168 - DNA, 20 bp, mouse
gacctcctgtacccttcctg

SEQ ID NO: 546169 - DNA, 20 bp, mouse
ggacatatgagtttctctca

SEQ ID NO: 546170 - DNA, 20 bp, mouse
ggaatggcaccaacaatgag

SEQ ID NO: 546171 - DNA, 20 bp, mouse
gagtttctctcaaggacagc

SEQ ID NO: 546172 - DNA, 20 bp, mouse
gaagtcagtgcttagtcccc

SEQ ID NO: 546173 - DNA, 20 bp, mouse
ggagacaaagaatactatgt

SEQ ID NO: 546174 - DNA, 20 bp, mouse
ggaccaactgtagattggat

SEQ ID NO: 546175 - DNA, 20 bp, mouse
gaagaatactatgttggaag

SEQ ID NO: 546176 - DNA, 20 bp, mouse
gttctgtggaacccaaggcc

SEQ ID NO: 546177 - DNA, 20 bp, mouse
gttgtgctccagcaactcgg

SEQ ID NO: 546178 - DNA, 20 bp, mouse
gcctttgtgctccagcaact

SEQ ID NO: 546179 - DNA, 20 bp, mouse
gggtacagcctccgagttgc

SEQ ID NO: 546180 - DNA, 20 bp, mouse
gttttcattttcctggcctt

SEQ ID NO: 546181 - DNA, 20 bp, mouse
ggccaatgagagcatctcac

SEQ ID NO: 546182 - DNA, 20 bp, mouse
gtggccacactcatattaaa

SEQ ID NO: 546183 - DNA, 20 bp, mouse
gtcccgtgagatgctctcat

SEQ ID NO: 546184 - DNA, 20 bp, mouse
ggtgcatgatgactgagtag

SEQ ID NO: 546185 - DNA, 20 bp, mouse
gcccggaaggtgatcagcta

SEQ ID NO: 546186 - DNA, 20 bp, mouse
gtaacaaaatgcacactctt

SEQ ID NO: 546187 - DNA, 20 bp, mouse
gagtttttctggagctcccc

SEQ ID NO: 546188 - DNA, 20 bp, mouse
ggttcatgatgagggtgtag

SEQ ID NO: 546189 - DNA, 20 bp, mouse
gtcagatgctgtttaacctg

SEQ ID NO: 546190 - DNA, 20 bp, mouse
gcagaagagtaacaaaaaga

SEQ ID NO: 546191 - DNA, 20 bp, mouse
gacatggggctgtggagacg

SEQ ID NO: 546192 - DNA, 20 bp, mouse
gactctttggttcatgatga

SEQ ID NO: 546193 - DNA, 20 bp, mouse
gatggttagcaaagcccagt

SEQ ID NO: 546194 - DNA, 20 bp, mouse
gctgtggagacgagggtcta

SEQ ID NO: 546195 - DNA, 20 bp, mouse
gcaaaagaattcatcctact

SEQ ID NO: 546196 - DNA, 20 bp, mouse
gttctgtgcaacccaaagcc

SEQ ID NO: 546197 - DNA, 20 bp, mouse
gttgtgctccagcgactcgg

SEQ ID NO: 546198 - DNA, 20 bp, mouse
gggtacagcctccgagtcgc

SEQ ID NO: 546199 - DNA, 20 bp, mouse
gcctttgtgctccagcgact

SEQ ID NO: 546200 - DNA, 20 bp, mouse
ggccaatgagagcatctcac

SEQ ID NO: 546201 - DNA, 20 bp, mouse
gtggccacactcatattaaa

SEQ ID NO: 546202 - DNA, 20 bp, mouse
gtcccgtgagatgctctcat

SEQ ID NO: 546203 - DNA, 20 bp, mouse
ggtgcatgatgactgagtag

SEQ ID NO: 546204 - DNA, 20 bp, mouse
gcccggaaggtgatcagcta

SEQ ID NO: 546205 - DNA, 20 bp, mouse
gacatgcagccgccaactgg

SEQ ID NO: 546206 - DNA, 20 bp, mouse
gagcatgtggttgcaagtga

SEQ ID NO: 546207 - DNA, 20 bp, mouse
ggataagttctaggtgagga

SEQ ID NO: 546208 - DNA, 20 bp, mouse
gagaggataagttctaggtg

SEQ ID NO: 546209 - DNA, 20 bp, mouse
gggagagaactaccacaaag

SEQ ID NO: 546210 - DNA, 20 bp, mouse
gcacaaagaggataagttct

SEQ ID NO: 546211 - DNA, 20 bp, mouse
ggaggttgtagagcatctgt

SEQ ID NO: 546212 - DNA, 20 bp, mouse
gtcttttgaaggcttcatcc

SEQ ID NO: 546213 - DNA, 20 bp, mouse
gtggttgcaagtgatggaaa

SEQ ID NO: 546214 - DNA, 20 bp, mouse
gcaaccacatgctacctagg

SEQ ID NO: 546215 - DNA, 20 bp, mouse
gccagctgcccgcagagacg

SEQ ID NO: 546216 - DNA, 20 bp, mouse
gccatactcagagctgtcgt

SEQ ID NO: 546217 - DNA, 20 bp, mouse
ggagtaccatctccaggcga

SEQ ID NO: 546218 - DNA, 20 bp, mouse
gagtatggtttcatcttaga

SEQ ID NO: 546219 - DNA, 20 bp, mouse
ggatcgccctcgcctggaga

SEQ ID NO: 546220 - DNA, 20 bp, mouse
gcagcctcacacacagctgt

SEQ ID NO: 546221 - DNA, 20 bp, mouse
gacattggagtgtgaagccg

SEQ ID NO: 546222 - DNA, 20 bp, mouse
gctctacactgccaatcgac

SEQ ID NO: 546223 - DNA, 20 bp, mouse
gacactgccaatcgacagga

SEQ ID NO: 546224 - DNA, 20 bp, mouse
gggtgtgtatattggaccct

SEQ ID NO: 546225 - DNA, 20 bp, mouse
ggcacccacagctgtgtgtg

SEQ ID NO: 546226 - DNA, 20 bp, mouse
ggggcttctcagacagaccg

SEQ ID NO: 546227 - DNA, 20 bp, mouse
gcagcaggatgaactgttcc

SEQ ID NO: 546228 - DNA, 20 bp, mouse
gtggcagctctggttgatca

SEQ ID NO: 546229 - DNA, 20 bp, mouse
gagtcaccaggtagaagatg

SEQ ID NO: 546230 - DNA, 20 bp, mouse
ggaactgttcctggcagctc

SEQ ID NO: 546231 - DNA, 20 bp, mouse
gcatgggggtgtgaagacag

SEQ ID NO: 546232 - DNA, 20 bp, mouse
gggaactggtagtgaaacag

SEQ ID NO: 546233 - DNA, 20 bp, mouse
gtggttgatcatggcattaa

SEQ ID NO: 546234 - DNA, 20 bp, mouse
gtaatgaccgagtagtgaag

SEQ ID NO: 546235 - DNA, 20 bp, mouse
gtctacctggtgactttagt

SEQ ID NO: 546236 - DNA, 20 bp, mouse
gaagttggccagggcatcaa

SEQ ID NO: 546237 - DNA, 20 bp, mouse
gtctctatatctcttcatac

SEQ ID NO: 546238 - DNA, 20 bp, mouse
gcatctgagccaggcatcca

SEQ ID NO: 546239 - DNA, 20 bp, mouse
gaggtctaccaaggacaaat

SEQ ID NO: 546240 - DNA, 20 bp, mouse
gaatggctaacaagatgagg

SEQ ID NO: 546241 - DNA, 20 bp, mouse
gtggccaacttgaaaaaccc

SEQ ID NO: 546242 - DNA, 20 bp, mouse
gaccaatggctaacaagatg

SEQ ID NO: 546243 - DNA, 20 bp, mouse
gtcctgttaaatagagacat

SEQ ID NO: 546244 - DNA, 20 bp, mouse
gcagaggcatggggtcataa

SEQ ID NO: 546245 - DNA, 20 bp, mouse
gtaggagatggactgagact

SEQ ID NO: 546246 - DNA, 20 bp, mouse
gtcaggaggacaaagaagag

SEQ ID NO: 546247 - DNA, 20 bp, mouse
gcgattcactgacatttcaa

SEQ ID NO: 546248 - DNA, 20 bp, mouse
gaaggggcctgataaaatca

SEQ ID NO: 546249 - DNA, 20 bp, mouse
gtgtgaacatgtaggaggtc

SEQ ID NO: 546250 - DNA, 20 bp, mouse
gatttgagggacagtcgtag

SEQ ID NO: 546251 - DNA, 20 bp, mouse
gcccagcaatgtgaacatgt

SEQ ID NO: 546252 - DNA, 20 bp, mouse
gtaatgacagagtacctcag

SEQ ID NO: 546253 - DNA, 20 bp, mouse
gggctgtgtgcaagcctctg

SEQ ID NO: 546254 - DNA, 20 bp, mouse
ggggctttaccaagtaccca

SEQ ID NO: 546255 - DNA, 20 bp, mouse
ggaacatgtaggaggtcagg

SEQ ID NO: 546256 - DNA, 20 bp, mouse
gtcgactggaaaatcccaga

SEQ ID NO: 546257 - DNA, 20 bp, mouse
ggagatgatgtgctccagtt

SEQ ID NO: 546258 - DNA, 20 bp, mouse
gttccattgctccttaggaa

SEQ ID NO: 546259 - DNA, 20 bp, mouse
gagcctttcctaaggagcaa

SEQ ID NO: 546260 - DNA, 20 bp, mouse
gaatgctagtagtataacag

SEQ ID NO: 546261 - DNA, 20 bp, mouse
gtgctccagttggggtcgac

SEQ ID NO: 546262 - DNA, 20 bp, mouse
gtttatttccattgctcctt

SEQ ID NO: 546263 - DNA, 20 bp, mouse
ggtccagggcaaagaagaac

SEQ ID NO: 546264 - DNA, 20 bp, mouse
gtctatattgtgactctggt

SEQ ID NO: 546265 - DNA, 20 bp, mouse
gctgccgagaccacccaacc

SEQ ID NO: 546266 - DNA, 20 bp, mouse
gtgattaccaaataatgcaa

SEQ ID NO: 546267 - DNA, 20 bp, mouse
gtgtaagcccttgcattatt

SEQ ID NO: 546268 - DNA, 20 bp, mouse
gtgtgtcaagatgatagtca

SEQ ID NO: 546269 - DNA, 20 bp, mouse
gtcatcttgacacatagacg

SEQ ID NO: 546270 - DNA, 20 bp, mouse
gagatgatagtcatggtctg

SEQ ID NO: 546271 - DNA, 20 bp, mouse
gatggtctggggtattagtt

SEQ ID NO: 546272 - DNA, 20 bp, mouse
ggtgcataatattacagagt

SEQ ID NO: 546273 - DNA, 20 bp, mouse
gtccagagaggatcatttcc

SEQ ID NO: 546274 - DNA, 20 bp, mouse
ggatcatttccaggtgaggg

SEQ ID NO: 546275 - DNA, 20 bp, mouse
ggaaggtgacaactccagag

SEQ ID NO: 546276 - DNA, 20 bp, mouse
gtttcaatgcaagttgggaa

SEQ ID NO: 546277 - DNA, 20 bp, mouse
gagagaacaacttccagatg

SEQ ID NO: 546278 - DNA, 20 bp, mouse
ggaggttaaatagcagctgg

SEQ ID NO: 546279 - DNA, 20 bp, mouse
gaccaacagaacacactctg

SEQ ID NO: 546280 - DNA, 20 bp, mouse
gaagggtactttatttttct

SEQ ID NO: 546281 - DNA, 20 bp, mouse
gccagcagttggcaaaaacg

SEQ ID NO: 546282 - DNA, 20 bp, mouse
gtctacatgatgacactgat

SEQ ID NO: 546283 - DNA, 20 bp, mouse
ggaaaatttcaatgcaagtt

SEQ ID NO: 546284 - DNA, 20 bp, mouse
gttttctaaatggcctcatc

SEQ ID NO: 546285 - DNA, 20 bp, mouse
gtgttttctttgggccccag

SEQ ID NO: 546286 - DNA, 20 bp, mouse
gcaagcaccattatgaagag

SEQ ID NO: 546287 - DNA, 20 bp, mouse
ggggtttctccagccatcca

SEQ ID NO: 546288 - DNA, 20 bp, mouse
ggggcatttccagccatgga

SEQ ID NO: 546289 - DNA, 20 bp, mouse
ggaaatgcccctcttcataa

SEQ ID NO: 546290 - DNA, 20 bp, mouse
gcaaccacagtaatgaacct

SEQ ID NO: 546291 - DNA, 20 bp, mouse
gtgatcgctgggtaccttag

SEQ ID NO: 546292 - DNA, 20 bp, mouse
gccaagccatggacacgagg

SEQ ID NO: 546293 - DNA, 20 bp, mouse
gttacctaggttcattactg

SEQ ID NO: 546294 - DNA, 20 bp, mouse
gaagattccgaagcagctga

SEQ ID NO: 546295 - DNA, 20 bp, mouse
gtggagcactttcattacct

SEQ ID NO: 546296 - DNA, 20 bp, mouse
ggatggagacaatgagacta

SEQ ID NO: 546297 - DNA, 20 bp, mouse
gggagacaatgagactatgg

SEQ ID NO: 546298 - DNA, 20 bp, mouse
gtgttggcaaacgaccttac

SEQ ID NO: 546299 - DNA, 20 bp, mouse
gctttccagagagccccaga

SEQ ID NO: 546300 - DNA, 20 bp, mouse
gaaagtatcaccagccagta

SEQ ID NO: 546301 - DNA, 20 bp, mouse
gggcaaacgaccttactggc

SEQ ID NO: 546302 - DNA, 20 bp, mouse
ggctctggtgaaccacgtgt

SEQ ID NO: 546303 - DNA, 20 bp, mouse
gggcagaattcctccttctg

SEQ ID NO: 546304 - DNA, 20 bp, mouse
gtctggaaagtcagagcagg

SEQ ID NO: 546305 - DNA, 20 bp, mouse
gggacttgcttcccaacacg

SEQ ID NO: 546306 - DNA, 20 bp, mouse
gcccagaaggaggaattcta

SEQ ID NO: 546307 - DNA, 20 bp, mouse
gattgctgggcagtcaaagg

SEQ ID NO: 546308 - DNA, 20 bp, mouse
gcctccttctgggaattgct

SEQ ID NO: 546309 - DNA, 20 bp, mouse
gttctctctgaccatatcta

SEQ ID NO: 546310 - DNA, 20 bp, mouse
ggaattctatggctgttgac

SEQ ID NO: 546311 - DNA, 20 bp, mouse
gactttctcccccatagata

SEQ ID NO: 546312 - DNA, 20 bp, mouse
ggccatagaattcctccttc

SEQ ID NO: 546313 - DNA, 20 bp, mouse
gcatcttcggaatgttcttg

SEQ ID NO: 546314 - DNA, 20 bp, mouse
ggtacttggtcaccgtttgt

SEQ ID NO: 546315 - DNA, 20 bp, mouse
gggaattgctgggcagtcaa

SEQ ID NO: 546316 - DNA, 20 bp, mouse
ggttcataatgagagtgtag

SEQ ID NO: 546317 - DNA, 20 bp, mouse
gggtttttctggagcttccc

SEQ ID NO: 546318 - DNA, 20 bp, mouse
gtgacaaaatgcatactctt

SEQ ID NO: 546319 - DNA, 20 bp, mouse
gaaaataaatcaaaggagaa

SEQ ID NO: 546320 - DNA, 20 bp, mouse
gcagaaaggagagattcttg

SEQ ID NO: 546321 - DNA, 20 bp, mouse
gggctgactggagtgatctt

SEQ ID NO: 546322 - DNA, 20 bp, mouse
gtagagacgagggtctaagg

SEQ ID NO: 546323 - DNA, 20 bp, mouse
gacatggggctgtagagacg

SEQ ID NO: 546324 - DNA, 20 bp, mouse
gtttgtcagtatctattatg

SEQ ID NO: 546325 - DNA, 20 bp, mouse
gatggttagcaaagcccagt

SEQ ID NO: 546326 - DNA, 20 bp, mouse
gctgcctggtgtaggttcta

SEQ ID NO: 546327 - DNA, 20 bp, mouse
gatagtatactcacaaacta

SEQ ID NO: 546328 - DNA, 20 bp, mouse
gatgaggtctttcttaagaa

SEQ ID NO: 546329 - DNA, 20 bp, mouse
gttaagctaaagggactgag

SEQ ID NO: 546330 - DNA, 20 bp, mouse
gaattgaggaagtatagttt

SEQ ID NO: 546331 - DNA, 20 bp, mouse
gcagtccctttagcttaaat

SEQ ID NO: 546332 - DNA, 20 bp, mouse
gttaaattggtataaaattg

SEQ ID NO: 546333 - DNA, 20 bp, mouse
gtataccaatttaagctaaa

SEQ ID NO: 546334 - DNA, 20 bp, mouse
gttatataattacactcctg

SEQ ID NO: 546335 - DNA, 20 bp, mouse
ggtgccatagaacctacacc

SEQ ID NO: 546336 - DNA, 20 bp, mouse
gtcaacaccaccttaaaagg

SEQ ID NO: 546337 - DNA, 20 bp, mouse
ggcttcaacaccaccttaaa

SEQ ID NO: 546338 - DNA, 20 bp, mouse
gaaggtggcttcattttgat

SEQ ID NO: 546339 - DNA, 20 bp, mouse
gcaggaaagagaggttgtta

SEQ ID NO: 546340 - DNA, 20 bp, mouse
gatgaagccaccttttaagg

SEQ ID NO: 546341 - DNA, 20 bp, mouse
gaaaagatatgttccagttg

SEQ ID NO: 546342 - DNA, 20 bp, mouse
gatacacccagcatagctca

SEQ ID NO: 546343 - DNA, 20 bp, mouse
gaaatattgacaagaagctg

SEQ ID NO: 546344 - DNA, 20 bp, mouse
gtcttcatagtgctcttact

SEQ ID NO: 546345 - DNA, 20 bp, mouse
gaaaatgaagccacctttta

SEQ ID NO: 546346 - DNA, 20 bp, mouse
gtagaaggtttcctgttggt

SEQ ID NO: 546347 - DNA, 20 bp, mouse
ggtctgagaagcctaccaac

SEQ ID NO: 546348 - DNA, 20 bp, mouse
gagcttagaaggtttcctgt

SEQ ID NO: 546349 - DNA, 20 bp, mouse
gggaggataagttccagttg

SEQ ID NO: 546350 - DNA, 20 bp, mouse
gtctacagtctgtgaaagga

SEQ ID NO: 546351 - DNA, 20 bp, mouse
ggtcttctacagtctgtgaa

SEQ ID NO: 546352 - DNA, 20 bp, mouse
ggtttcaatctcagcttaga

SEQ ID NO: 546353 - DNA, 20 bp, mouse
gagtttgggcacagtgctac

SEQ ID NO: 546354 - DNA, 20 bp, mouse
gctgatagtctgatcacctc

SEQ ID NO: 546355 - DNA, 20 bp, mouse
gaaagactgattagaagttt

SEQ ID NO: 546356 - DNA, 20 bp, mouse
ggaagatttatgagaagctg

SEQ ID NO: 546357 - DNA, 20 bp, mouse
gtgcagtcgaaggtccattt

SEQ ID NO: 546358 - DNA, 20 bp, mouse
gttttcatatctcttgcact

SEQ ID NO: 546359 - DNA, 20 bp, mouse
gccaatgcctgacagagaag

SEQ ID NO: 546360 - DNA, 20 bp, mouse
gtggctcttgcttcatgggt

SEQ ID NO: 546361 - DNA, 20 bp, mouse
ggcattggctcttgcttcat

SEQ ID NO: 546362 - DNA, 20 bp, mouse
gatgcacccccttctctgtc

SEQ ID NO: 546363 - DNA, 20 bp, mouse
gactgagtgtgtgctcttag

SEQ ID NO: 546364 - DNA, 20 bp, mouse
gtgtgtgctcttagtggtga

SEQ ID NO: 546365 - DNA, 20 bp, mouse
ggcaagagatatgaaaagct

SEQ ID NO: 546366 - DNA, 20 bp, mouse
gtatgtgcacaaacaacagg

SEQ ID NO: 546367 - DNA, 20 bp, mouse
gtgtgtgctcctggtagtga

SEQ ID NO: 546368 - DNA, 20 bp, mouse
gagcaagatatatgaacagc

SEQ ID NO: 546369 - DNA, 20 bp, mouse
ggattcgtgatctttatagt

SEQ ID NO: 546370 - DNA, 20 bp, mouse
ggtgaagcagaggtccagaa

SEQ ID NO: 546371 - DNA, 20 bp, mouse
gtgcagtcgaaggtctattc

SEQ ID NO: 546372 - DNA, 20 bp, mouse
gagctcctcatcaacctcta

SEQ ID NO: 546373 - DNA, 20 bp, mouse
gggtcctgtcttgtccatag

SEQ ID NO: 546374 - DNA, 20 bp, mouse
gaaacagcatttcctgaacc

SEQ ID NO: 546375 - DNA, 20 bp, mouse
gtgttcatatatcttgctct

SEQ ID NO: 546376 - DNA, 20 bp, mouse
gaagtcctcggaggttgatg

SEQ ID NO: 546377 - DNA, 20 bp, mouse
gccagtgccctgcagaggat

SEQ ID NO: 546378 - DNA, 20 bp, mouse
gacacaagagagtttcattt

SEQ ID NO: 546379 - DNA, 20 bp, mouse
gcaacctccgaggacttgac

SEQ ID NO: 546380 - DNA, 20 bp, mouse
gcttgcaagaacaatgatgg

SEQ ID NO: 546381 - DNA, 20 bp, mouse
gtaatgctggtatagtggag

SEQ ID NO: 546382 - DNA, 20 bp, mouse
gcataggtttgtgcagtcga

SEQ ID NO: 546383 - DNA, 20 bp, mouse
ggatggtcctgtcaagtcct

SEQ ID NO: 546384 - DNA, 20 bp, mouse
gatgaaactctcttgtgtac

SEQ ID NO: 546385 - DNA, 20 bp, mouse
ggaactctctgatccaaaca

SEQ ID NO: 546386 - DNA, 20 bp, mouse
gaaaagacaagttccaggtg

SEQ ID NO: 546387 - DNA, 20 bp, mouse
gttctcagattggcctcacc

SEQ ID NO: 546388 - DNA, 20 bp, mouse
gtgccagggcaagaaaaatg

SEQ ID NO: 546389 - DNA, 20 bp, mouse
gtgcactggtcaaaggcaat

SEQ ID NO: 546390 - DNA, 20 bp, mouse
gtgagttgccaaagagagtg

SEQ ID NO: 546391 - DNA, 20 bp, mouse
gcacagctggggatgcataa

SEQ ID NO: 546392 - DNA, 20 bp, mouse
gcttcaatttcagttcagac

SEQ ID NO: 546393 - DNA, 20 bp, mouse
gacagagtgtgtgctattgg

SEQ ID NO: 546394 - DNA, 20 bp, mouse
gccccagctgtgtcatacac

SEQ ID NO: 546395 - DNA, 20 bp, mouse
gacacacctttcatagctga

SEQ ID NO: 546396 - DNA, 20 bp, mouse
gaggtccaggaaagaaagat

SEQ ID NO: 546397 - DNA, 20 bp, mouse
gggaaaggcttcatattagt

SEQ ID NO: 546398 - DNA, 20 bp, mouse
gtgttcaagtgaaaggcgat

SEQ ID NO: 546399 - DNA, 20 bp, mouse
gagacactctgtggagacca

SEQ ID NO: 546400 - DNA, 20 bp, mouse
gcttgagagagcaatgatgg

SEQ ID NO: 546401 - DNA, 20 bp, mouse
gatgaagcctttccctaaac

SEQ ID NO: 546402 - DNA, 20 bp, mouse
gaactttcaatgccagttta

SEQ ID NO: 546403 - DNA, 20 bp, mouse
ggaccaaggcaaggaaaatg

SEQ ID NO: 546404 - DNA, 20 bp, mouse
ggcttctcattaacctctgt

SEQ ID NO: 546405 - DNA, 20 bp, mouse
gtgcaccctcagctgtgtca

SEQ ID NO: 546406 - DNA, 20 bp, mouse
gggaaacaggacagctgtca

SEQ ID NO: 546407 - DNA, 20 bp, mouse
gcctatggagccaggtgcct

SEQ ID NO: 546408 - DNA, 20 bp, mouse
gaagtgcagggcacactggt

SEQ ID NO: 546409 - DNA, 20 bp, mouse
gagctcatagcagtggccta

SEQ ID NO: 546410 - DNA, 20 bp, mouse
gagcagtggcctatggagcc

SEQ ID NO: 546411 - DNA, 20 bp, mouse
gcccccaactgtgacaatat

SEQ ID NO: 546412 - DNA, 20 bp, mouse
ggcatgagccgtgaagtgca

SEQ ID NO: 546413 - DNA, 20 bp, mouse
gcgtgaagtgcagggcacac

SEQ ID NO: 546414 - DNA, 20 bp, mouse
gggagacacacaagcattgg

SEQ ID NO: 546415 - DNA, 20 bp, mouse
gacagtccacacctgccagg

SEQ ID NO: 546416 - DNA, 20 bp, mouse
ggagaaggagttccagttga

SEQ ID NO: 546417 - DNA, 20 bp, mouse
gaggagcacactctctgtgg

SEQ ID NO: 546418 - DNA, 20 bp, mouse
gggtgcacacgaaaggctat

SEQ ID NO: 546419 - DNA, 20 bp, mouse
gtagtgagaggcagagaacg

SEQ ID NO: 546420 - DNA, 20 bp, mouse
gaatgctggtggtatagcac

SEQ ID NO: 546421 - DNA, 20 bp, mouse
gggttctgtcatatccctgg

SEQ ID NO: 546422 - DNA, 20 bp, mouse
gggtggctaaagcaaggaaa

SEQ ID NO: 546423 - DNA, 20 bp, mouse
gagcttctgattaacctcca

SEQ ID NO: 546424 - DNA, 20 bp, mouse
ggatggtcgtgtagtgcagt

SEQ ID NO: 546425 - DNA, 20 bp, mouse
gttcaatacgagttttagac

SEQ ID NO: 546426 - DNA, 20 bp, mouse
gtgggccacacaccttccat

SEQ ID NO: 546427 - DNA, 20 bp, mouse
gttaatgccagtttgggtaa

SEQ ID NO: 546428 - DNA, 20 bp, mouse
gatgaagcctttacccaaac

SEQ ID NO: 546429 - DNA, 20 bp, mouse
gacggcacacagctgcatag

SEQ ID NO: 546430 - DNA, 20 bp, mouse
gacacaccttccataggtga

SEQ ID NO: 546431 - DNA, 20 bp, mouse
gaaagaatgagttctaattg

SEQ ID NO: 546432 - DNA, 20 bp, mouse
gtaaagcttcccatagcctc

SEQ ID NO: 546433 - DNA, 20 bp, mouse
gacagagagtatgcttctag

SEQ ID NO: 546434 - DNA, 20 bp, mouse
gggccatcatgagacctgtc

SEQ ID NO: 546435 - DNA, 20 bp, mouse
gagaagagatagctaaagcc

SEQ ID NO: 546436 - DNA, 20 bp, mouse
gaaagcttcaacatcagttt

SEQ ID NO: 546437 - DNA, 20 bp, mouse
gtcaacatcagtttgggtaa

SEQ ID NO: 546438 - DNA, 20 bp, mouse
gtgcagttgaaggtccattc

SEQ ID NO: 546439 - DNA, 20 bp, mouse
gagatgcattaaattgtctt

SEQ ID NO: 546440 - DNA, 20 bp, mouse
gctactccctaactctcttt

SEQ ID NO: 546441 - DNA, 20 bp, mouse
gtcttcataactcttgctct

SEQ ID NO: 546442 - DNA, 20 bp, mouse
gaatttaatgcatctgatga

SEQ ID NO: 546443 - DNA, 20 bp, mouse
gatgcatctgatgaaggaaa

SEQ ID NO: 546444 - DNA, 20 bp, mouse
gattaaattgtctttggcta

SEQ ID NO: 546445 - DNA, 20 bp, mouse
gcaatgcctggcagagaacg

SEQ ID NO: 546446 - DNA, 20 bp, mouse
gccttcaacaccagtttggg

SEQ ID NO: 546447 - DNA, 20 bp, mouse
ggaaccttcaacaccagttt

SEQ ID NO: 546448 - DNA, 20 bp, mouse
gatgaagcctcctcccaaac

SEQ ID NO: 546449 - DNA, 20 bp, mouse
gagcaagaaatataaacagc

SEQ ID NO: 546450 - DNA, 20 bp, mouse
gttgttcaggtcaaaggcta

SEQ ID NO: 546451 - DNA, 20 bp, mouse
gagctcctcatcaacctgca

SEQ ID NO: 546452 - DNA, 20 bp, mouse
gggtcctgtcttgtccatgc

SEQ ID NO: 546453 - DNA, 20 bp, mouse
gtcaacaccagtttgggagg

SEQ ID NO: 546454 - DNA, 20 bp, mouse
gttgggaggaggcttcattt

SEQ ID NO: 546455 - DNA, 20 bp, mouse
gtctactctataactctctt

SEQ ID NO: 546456 - DNA, 20 bp, mouse
gaggccggcaaggatgaagc

SEQ ID NO: 546457 - DNA, 20 bp, mouse
ggaaagagtcataaggtgag

SEQ ID NO: 546458 - DNA, 20 bp, mouse
gtgcacagtggtacccaaga

SEQ ID NO: 546459 - DNA, 20 bp, mouse
ggtggccgaacaggccggca

SEQ ID NO: 546460 - DNA, 20 bp, mouse
gcacctggatgaccatcaag

SEQ ID NO: 546461 - DNA, 20 bp, mouse
gataaggtgagtggccgaac

SEQ ID NO: 546462 - DNA, 20 bp, mouse
gttcccgcctgagagaaagt

SEQ ID NO: 546463 - DNA, 20 bp, mouse
ggaaagttggttgccatctt

SEQ ID NO: 546464 - DNA, 20 bp, mouse
gtcatccttgccggcctgtt

SEQ ID NO: 546465 - DNA, 20 bp, mouse
gctggatgaccatcaagagg

SEQ ID NO: 546466 - DNA, 20 bp, mouse
gcagtggagagtgggtgaag

SEQ ID NO: 546467 - DNA, 20 bp, mouse
gaagagatgcagtggagagt

SEQ ID NO: 546468 - DNA, 20 bp, mouse
gcgctccctaacaatggcct

SEQ ID NO: 546469 - DNA, 20 bp, mouse
gtcccagcgctccctaacaa

SEQ ID NO: 546470 - DNA, 20 bp, mouse
ggccatccgtggcacaatgg

SEQ ID NO: 546471 - DNA, 20 bp, mouse
gcatgagccagcagacacgg

SEQ ID NO: 546472 - DNA, 20 bp, mouse
gccctaacaatggcctgggc

SEQ ID NO: 546473 - DNA, 20 bp, mouse
ggaaagtcagcagccatccg

SEQ ID NO: 546474 - DNA, 20 bp, mouse
gaaagtgagagatgagagtc

SEQ ID NO: 546475 - DNA, 20 bp, mouse
ggcctgcccaggccattgtt

SEQ ID NO: 546476 - DNA, 20 bp, mouse
gaagaggaggcagttctata

SEQ ID NO: 546477 - DNA, 20 bp, mouse
gcaggtgagagacagatggt

SEQ ID NO: 546478 - DNA, 20 bp, mouse
gaagcttctacatggacaag

SEQ ID NO: 546479 - DNA, 20 bp, mouse
ggcaggcagccatcagtgag

SEQ ID NO: 546480 - DNA, 20 bp, mouse
gggaggcagttctataaggc

SEQ ID NO: 546481 - DNA, 20 bp, mouse
gactaaaggccactcactga

SEQ ID NO: 546482 - DNA, 20 bp, mouse
gcaggatggtatgaacaccc

SEQ ID NO: 546483 - DNA, 20 bp, mouse
ggttagtgagatggtcgtga

SEQ ID NO: 546484 - DNA, 20 bp, mouse
gttactaggtgaaagaggac

SEQ ID NO: 546485 - DNA, 20 bp, mouse
gtgaaatagagtccccagga

SEQ ID NO: 546486 - DNA, 20 bp, mouse
gccagaacccccaggtgcag

SEQ ID NO: 546487 - DNA, 20 bp, mouse
gcataggagaacctagggtg

SEQ ID NO: 546488 - DNA, 20 bp, mouse
gtcgctgactccctgcatga

SEQ ID NO: 546489 - DNA, 20 bp, mouse
gaggtgcagaggatgttgtt

SEQ ID NO: 546490 - DNA, 20 bp, mouse
ggttgcccccaacagagacc

SEQ ID NO: 546491 - DNA, 20 bp, mouse
gaagtacataggagaaccta

SEQ ID NO: 546492 - DNA, 20 bp, mouse
gagtttgggtgtcatacaag

SEQ ID NO: 546493 - DNA, 20 bp, mouse
ggggagtcagcgatgagttt

SEQ ID NO: 546494 - DNA, 20 bp, mouse
gtctttgtggctcatttatt

SEQ ID NO: 546495 - DNA, 20 bp, mouse
gaagcagccctcaaaagaga

SEQ ID NO: 546496 - DNA, 20 bp, mouse
gtcagatgaccaaccagaat

SEQ ID NO: 546497 - DNA, 20 bp, mouse
ggaagagatccaagaaagat

SEQ ID NO: 546498 - DNA, 20 bp, mouse
ggtcttcatttcagacaccc

SEQ ID NO: 546499 - DNA, 20 bp, mouse
gtccaagaagtcgaacactg

SEQ ID NO: 546500 - DNA, 20 bp, mouse
gagtagccatatgtgtgatg

SEQ ID NO: 546501 - DNA, 20 bp, mouse
gagaactggaatctttaggg

SEQ ID NO: 546502 - DNA, 20 bp, mouse
gaacactggggtgtcagaac

SEQ ID NO: 546503 - DNA, 20 bp, mouse
gatagtattcctattctggt

SEQ ID NO: 546504 - DNA, 20 bp, mouse
gcagggttcagaattacaac

SEQ ID NO: 546505 - DNA, 20 bp, mouse
ggggaactgctcttatagtc

SEQ ID NO: 546506 - DNA, 20 bp, mouse
gcaggaagaagacaccctgt

SEQ ID NO: 546507 - DNA, 20 bp, mouse
ggacaccctgtaggttgggg

SEQ ID NO: 546508 - DNA, 20 bp, mouse
gggggtggttggaaaatccc

SEQ ID NO: 546509 - DNA, 20 bp, mouse
gtgagagaggcagccctcaa

SEQ ID NO: 546510 - DNA, 20 bp, mouse
gactagcatgactggaatgg

SEQ ID NO: 546511 - DNA, 20 bp, mouse
gtccaaccaccccaacctac

SEQ ID NO: 546512 - DNA, 20 bp, mouse
gctcatgatagtggccacca

SEQ ID NO: 546513 - DNA, 20 bp, mouse
ggagaactggataccgaaga

SEQ ID NO: 546514 - DNA, 20 bp, mouse
gcattggagtgtggagtgca

SEQ ID NO: 546515 - DNA, 20 bp, mouse
gttcactagcatgactggaa

SEQ ID NO: 546516 - DNA, 20 bp, mouse
ggccggagaaaccttcaaac

SEQ ID NO: 546517 - DNA, 20 bp, mouse
gaacaggaactctgttacaa

SEQ ID NO: 546518 - DNA, 20 bp, mouse
ggtatcagagatagacaata

SEQ ID NO: 546519 - DNA, 20 bp, mouse
gatgcgtggtataatagtca

SEQ ID NO: 546520 - DNA, 20 bp, mouse
gaggtttctccggctttggt

SEQ ID NO: 546521 - DNA, 20 bp, mouse
ggctaggaaaatagcaaaaa

SEQ ID NO: 546522 - DNA, 20 bp, mouse
ggcttcaggaaatgaggcaa

SEQ ID NO: 546523 - DNA, 20 bp, mouse
ggttcatgtttgactcatta

SEQ ID NO: 546524 - DNA, 20 bp, mouse
ggatgactgaataccttagg

SEQ ID NO: 546525 - DNA, 20 bp, mouse
gggaggtcagaaagcatgcg

SEQ ID NO: 546526 - DNA, 20 bp, mouse
gactgaccacgagtatactg

SEQ ID NO: 546527 - DNA, 20 bp, mouse
gtttctccacagtatactcg

SEQ ID NO: 546528 - DNA, 20 bp, mouse
gtctttagatttcagatttg

SEQ ID NO: 546529 - DNA, 20 bp, mouse
gtatatatcctgactctggc

SEQ ID NO: 546530 - DNA, 20 bp, mouse
gcagttggttttcttcattg

SEQ ID NO: 546531 - DNA, 20 bp, mouse
ggtcctatatatcctgactc

SEQ ID NO: 546532 - DNA, 20 bp, mouse
gtctcttacatgtgtgcagt

SEQ ID NO: 546533 - DNA, 20 bp, mouse
gggtttggctcagacctaca

SEQ ID NO: 546534 - DNA, 20 bp, mouse
ggacattgccagccagagtc

SEQ ID NO: 546535 - DNA, 20 bp, mouse
gtgaagttgagagaacactt

SEQ ID NO: 546536 - DNA, 20 bp, mouse
gaagagagccaactgcacag

SEQ ID NO: 546537 - DNA, 20 bp, mouse
ggtcagcgtcaggatatata

SEQ ID NO: 546538 - DNA, 20 bp, mouse
gcagttggctctcttcattg

SEQ ID NO: 546539 - DNA, 20 bp, mouse
ggatctgaaatctaaaaaga

SEQ ID NO: 546540 - DNA, 20 bp, mouse
gttcttgctctcactagtcc

SEQ ID NO: 546541 - DNA, 20 bp, mouse
gtttttagatttcagatcga

SEQ ID NO: 546542 - DNA, 20 bp, mouse
ggacattgccagtcagcgtc

SEQ ID NO: 546543 - DNA, 20 bp, mouse
gtattttttttccttggatt

SEQ ID NO: 546544 - DNA, 20 bp, mouse
gatcttcagtctgtgccaca

SEQ ID NO: 546545 - DNA, 20 bp, mouse
gagtgagagcaagaaccctg

SEQ ID NO: 546546 - DNA, 20 bp, mouse
ggtgatatctgtagaataac

SEQ ID NO: 546547 - DNA, 20 bp, mouse
gtacagaagtgggtcatgaa

SEQ ID NO: 546548 - DNA, 20 bp, mouse
gcataggatgcaatgataag

SEQ ID NO: 546549 - DNA, 20 bp, mouse
gtcaccccaaatatgctagt

SEQ ID NO: 546550 - DNA, 20 bp, mouse
gaaagcctactagcatattt

SEQ ID NO: 546551 - DNA, 20 bp, mouse
gtttacatttttactctgat

SEQ ID NO: 546552 - DNA, 20 bp, mouse
gttcatgagattccaaaatg

SEQ ID NO: 546553 - DNA, 20 bp, mouse
gtctgtgatgttcctcattt

SEQ ID NO: 546554 - DNA, 20 bp, mouse
gtaagtggtatatagactcg

SEQ ID NO: 546555 - DNA, 20 bp, mouse
ggcaaaatcatttcatttta

SEQ ID NO: 546556 - DNA, 20 bp, mouse
gcatggccacatcagtccac

SEQ ID NO: 546557 - DNA, 20 bp, mouse
ggaagagaagatgttggcca

SEQ ID NO: 546558 - DNA, 20 bp, mouse
gtccttgttggctgccaccg

SEQ ID NO: 546559 - DNA, 20 bp, mouse
gaagacgggcacaggtcata

SEQ ID NO: 546560 - DNA, 20 bp, mouse
gcctgtgcccgtcttgtcct

SEQ ID NO: 546561 - DNA, 20 bp, mouse
ggcacatcctgcaaagctga

SEQ ID NO: 546562 - DNA, 20 bp, mouse
ggcacaggtcatagggcaca

SEQ ID NO: 546563 - DNA, 20 bp, mouse
gtttaggcacgccacacaga

SEQ ID NO: 546564 - DNA, 20 bp, mouse
gagggataatgacagaagag

SEQ ID NO: 546565 - DNA, 20 bp, mouse
ggctaagagcacagcctcgg

SEQ ID NO: 546566 - DNA, 20 bp, mouse
gctgctatggccatgagtgg

SEQ ID NO: 546567 - DNA, 20 bp, mouse
gccatagcagtctacaggaa

SEQ ID NO: 546568 - DNA, 20 bp, mouse
gcatggccatagcagtctac

SEQ ID NO: 546569 - DNA, 20 bp, mouse
gagactgctatggccatgag

SEQ ID NO: 546570 - DNA, 20 bp, mouse
gtaggtgcccagcaccagac

SEQ ID NO: 546571 - DNA, 20 bp, mouse
gcttctgctgcccccactca

SEQ ID NO: 546572 - DNA, 20 bp, mouse
gtggtgctgggcacctactg

SEQ ID NO: 546573 - DNA, 20 bp, mouse
gcgtgctggtgggatttggg

SEQ ID NO: 546574 - DNA, 20 bp, mouse
gtgctgggcacctactgtgg

SEQ ID NO: 546575 - DNA, 20 bp, mouse
gtccttgttggctaccactg

SEQ ID NO: 546576 - DNA, 20 bp, mouse
gctgcaaggacactggagta

SEQ ID NO: 546577 - DNA, 20 bp, mouse
gaccagcacgaaggcctgca

SEQ ID NO: 546578 - DNA, 20 bp, mouse
gacagctgtggccatgaatg

SEQ ID NO: 546579 - DNA, 20 bp, mouse
gtccttgcaggccttcgtgc

SEQ ID NO: 546580 - DNA, 20 bp, mouse
gagtaaggcttccatttctg

SEQ ID NO: 546581 - DNA, 20 bp, mouse
gaatggggtcagctgaagag

SEQ ID NO: 546582 - DNA, 20 bp, mouse
gccaaatcccaccagcacga

SEQ ID NO: 546583 - DNA, 20 bp, mouse
gacaaggcaagcacagactg

SEQ ID NO: 546584 - DNA, 20 bp, mouse
gcttcagctgaccccattca

SEQ ID NO: 546585 - DNA, 20 bp, mouse
gcaggacggtcaccatgtac

SEQ ID NO: 546586 - DNA, 20 bp, mouse
gccatgagtaagaaaagttg

SEQ ID NO: 546587 - DNA, 20 bp, mouse
gaagaaaagttgtggataga

SEQ ID NO: 546588 - DNA, 20 bp, mouse
gacatacagggtcaggaaca

SEQ ID NO: 546589 - DNA, 20 bp, mouse
gtccttgcaggggtttgtgt

SEQ ID NO: 546590 - DNA, 20 bp, mouse
gtgtatgtagtgaccgtcct

SEQ ID NO: 546591 - DNA, 20 bp, mouse
gccttcagttgtaaccagaa

SEQ ID NO: 546592 - DNA, 20 bp, mouse
gccatttctgtgcacttgtg

SEQ ID NO: 546593 - DNA, 20 bp, mouse
ggaagagagaaagatggtca

SEQ ID NO: 546594 - DNA, 20 bp, mouse
gggtcactacatacagggtc

SEQ ID NO: 546595 - DNA, 20 bp, mouse
gtgcaggggtttgtgttggt

SEQ ID NO: 546596 - DNA, 20 bp, mouse
ggccacagctggtttaaagg

SEQ ID NO: 546597 - DNA, 20 bp, mouse
gaggaggcactgagagaaaa

SEQ ID NO: 546598 - DNA, 20 bp, mouse
gaaccagctgtggctcaagt

SEQ ID NO: 546599 - DNA, 20 bp, mouse
gtgagccacagctggtttaa

SEQ ID NO: 546600 - DNA, 20 bp, mouse
ggcgaggacgtgggactcca

SEQ ID NO: 546601 - DNA, 20 bp, mouse
ggtcccacgtcctcgcacat

SEQ ID NO: 546602 - DNA, 20 bp, mouse
gtccccatgtgcgaggacgt

SEQ ID NO: 546603 - DNA, 20 bp, mouse
gggcccacttgagccacagc

SEQ ID NO: 546604 - DNA, 20 bp, mouse
ggagagcatggaaatttcta

SEQ ID NO: 546605 - DNA, 20 bp, mouse
gaccggcagatctccaaggt

SEQ ID NO: 546606 - DNA, 20 bp, mouse
gttaatcacagagactgtga

SEQ ID NO: 546607 - DNA, 20 bp, mouse
gctctattttttcatctccc

SEQ ID NO: 546608 - DNA, 20 bp, mouse
gtaggaaagacaaggaaccc

SEQ ID NO: 546609 - DNA, 20 bp, mouse
gggaaacgcatctctttcac

SEQ ID NO: 546610 - DNA, 20 bp, mouse
gtagtacatgggtctgtgca

SEQ ID NO: 546611 - DNA, 20 bp, mouse
gaaggcacttgcaaaagaga

SEQ ID NO: 546612 - DNA, 20 bp, mouse
gagcaggtattgcagctcag

SEQ ID NO: 546613 - DNA, 20 bp, mouse
ggcaggtgcacagggatgag

SEQ ID NO: 546614 - DNA, 20 bp, mouse
gtccaccagcacaaagaggt

SEQ ID NO: 546615 - DNA, 20 bp, mouse
gttgcagctcaggggctgtg

SEQ ID NO: 546616 - DNA, 20 bp, mouse
gctctacttcttcagctccc

SEQ ID NO: 546617 - DNA, 20 bp, mouse
gtggccttctcttttgctag

SEQ ID NO: 546618 - DNA, 20 bp, mouse
gtaggaaagacaaggatccc

SEQ ID NO: 546619 - DNA, 20 bp, mouse
gacacactctgtacatacca

SEQ ID NO: 546620 - DNA, 20 bp, mouse
gagcaggtattgcagctcag

SEQ ID NO: 546621 - DNA, 20 bp, mouse
ggcaggtgcacagggatgag

SEQ ID NO: 546622 - DNA, 20 bp, mouse
gtccaccagcacaaagaggt

SEQ ID NO: 546623 - DNA, 20 bp, mouse
gttgcagctcaggggctgtg

SEQ ID NO: 546624 - DNA, 20 bp, mouse
gaggatgaaggtgctgacct

SEQ ID NO: 546625 - DNA, 20 bp, mouse
gtacatgggtctgtggaggg

SEQ ID NO: 546626 - DNA, 20 bp, mouse
gcccagcaacagggacccca

SEQ ID NO: 546627 - DNA, 20 bp, mouse
gaagatgaaacccagcaaca

SEQ ID NO: 546628 - DNA, 20 bp, mouse
gatgagcacagtcaactgca

SEQ ID NO: 546629 - DNA, 20 bp, mouse
ggccctggggtccctgttgc

SEQ ID NO: 546630 - DNA, 20 bp, mouse
gtgatgagggtatagcgcag

SEQ ID NO: 546631 - DNA, 20 bp, mouse
gcagggaccccagggccagc

SEQ ID NO: 546632 - DNA, 20 bp, mouse
gctcagggagtttggagaag

SEQ ID NO: 546633 - DNA, 20 bp, mouse
ggatcagcatctgcacctca

SEQ ID NO: 546634 - DNA, 20 bp, mouse
gatgctggccagagtcaggg

SEQ ID NO: 546635 - DNA, 20 bp, mouse
gtttggagaaggggcggaag

SEQ ID NO: 546636 - DNA, 20 bp, mouse
gctgccactggcacaggtga

SEQ ID NO: 546637 - DNA, 20 bp, mouse
gtaggttcaatctatcctca

SEQ ID NO: 546638 - DNA, 20 bp, mouse
gttgggtctgccactggcac

SEQ ID NO: 546639 - DNA, 20 bp, mouse
gatagattgaacctacctgg

SEQ ID NO: 546640 - DNA, 20 bp, mouse
gaggatagattgaacctacc

SEQ ID NO: 546641 - DNA, 20 bp, mouse
ggggccatcacctgtgccag

SEQ ID NO: 546642 - DNA, 20 bp, mouse
gaatgcgttgggtctgccac

SEQ ID NO: 546643 - DNA, 20 bp, mouse
gggcacaggtgatggccctg

SEQ ID NO: 546644 - DNA, 20 bp, mouse
gtgatgagggtatatcgcag

SEQ ID NO: 546645 - DNA, 20 bp, mouse
gttgtgtgtccagttggccc

SEQ ID NO: 546646 - DNA, 20 bp, mouse
gctccatcagacctagtaca

SEQ ID NO: 546647 - DNA, 20 bp, mouse
ggactgtgagcccaatggtg

SEQ ID NO: 546648 - DNA, 20 bp, mouse
gtaatatagcttagtgacat

SEQ ID NO: 546649 - DNA, 20 bp, mouse
ggaatgctagctagagtcag

SEQ ID NO: 546650 - DNA, 20 bp, mouse
gttccttgtactaggtctga

SEQ ID NO: 546651 - DNA, 20 bp, mouse
gacagtcagatcctccaagg

SEQ ID NO: 546652 - DNA, 20 bp, mouse
ggcttcttgctgctgtatct

SEQ ID NO: 546653 - DNA, 20 bp, mouse
ggacacagtcagatcctcca

SEQ ID NO: 546654 - DNA, 20 bp, mouse
ggtcagtggagcaatgttgg

SEQ ID NO: 546655 - DNA, 20 bp, mouse
gagagtcagtggagcaatgt

SEQ ID NO: 546656 - DNA, 20 bp, mouse
gggagtcagttcacgtgtgt

SEQ ID NO: 546657 - DNA, 20 bp, mouse
gtcaacaacaccaaagaaat

SEQ ID NO: 546658 - DNA, 20 bp, mouse
ggttgaagtcattttgctag

SEQ ID NO: 546659 - DNA, 20 bp, mouse
ggtcattttgctagtggtga

SEQ ID NO: 546660 - DNA, 20 bp, mouse
gggcaacagtcttattcttg

SEQ ID NO: 546661 - DNA, 20 bp, mouse
gaacttagggacaattgtag

SEQ ID NO: 546662 - DNA, 20 bp, mouse
gtcggttacattatttttgt

SEQ ID NO: 546663 - DNA, 20 bp, mouse
gacattatttttgttggcca

SEQ ID NO: 546664 - DNA, 20 bp, mouse
gtattcttttcccatttctt

SEQ ID NO: 546665 - DNA, 20 bp, mouse
gcaggatccagaggttcaga

SEQ ID NO: 546666 - DNA, 20 bp, mouse
gccccagggtcaggtgagaa

SEQ ID NO: 546667 - DNA, 20 bp, mouse
gccatctgcaccccagggtc

SEQ ID NO: 546668 - DNA, 20 bp, mouse
gcgaaagaagaattgtacct

SEQ ID NO: 546669 - DNA, 20 bp, mouse
gaggtcttgtacattcccca

SEQ ID NO: 546670 - DNA, 20 bp, mouse
ggccaaggccagtggtgcaa

SEQ ID NO: 546671 - DNA, 20 bp, mouse
gtccattctcacctgaccct

SEQ ID NO: 546672 - DNA, 20 bp, mouse
ggtcaggtacatcaccaaga

SEQ ID NO: 546673 - DNA, 20 bp, mouse
gtgggtaccacaaccagtga

SEQ ID NO: 546674 - DNA, 20 bp, mouse
gctgcaaagaaaaatgatag

SEQ ID NO: 546675 - DNA, 20 bp, mouse
ggaaggtttgccaaggccag

SEQ ID NO: 546676 - DNA, 20 bp, mouse
gaagacataagaccaggctc

SEQ ID NO: 546677 - DNA, 20 bp, mouse
ggtgtgcagacgggactcaa

SEQ ID NO: 546678 - DNA, 20 bp, mouse
gatcacagccccaaaggtct

SEQ ID NO: 546679 - DNA, 20 bp, mouse
gtcctccatcacagccccaa

SEQ ID NO: 546680 - DNA, 20 bp, mouse
ggaccatcatgagtagtaag

SEQ ID NO: 546681 - DNA, 20 bp, mouse
gacagccccaaaggtcttgg

SEQ ID NO: 546682 - DNA, 20 bp, mouse
gaggtccaccaagacctttg

SEQ ID NO: 546683 - DNA, 20 bp, mouse
gaaggaaaatcgtgattcga

SEQ ID NO: 546684 - DNA, 20 bp, mouse
ggtacgtgacaactctgctt

SEQ ID NO: 546685 - DNA, 20 bp, mouse
gaatataaattcttttactc

SEQ ID NO: 546686 - DNA, 20 bp, mouse
gtaagatccacaagaacctt

SEQ ID NO: 546687 - DNA, 20 bp, mouse
gaagggagatttaatggaga

SEQ ID NO: 546688 - DNA, 20 bp, mouse
ggcgcttacttgctgacttt

SEQ ID NO: 546689 - DNA, 20 bp, mouse
gggagatggaaaactacacc

SEQ ID NO: 546690 - DNA, 20 bp, mouse
gctgactttgggtaaggcca

SEQ ID NO: 546691 - DNA, 20 bp, mouse
ggaaaaaaagggagatttaa

SEQ ID NO: 546692 - DNA, 20 bp, mouse
gaaaataagttctttgatcc

SEQ ID NO: 546693 - DNA, 20 bp, mouse
ggagatggtctttctgtttg

SEQ ID NO: 546694 - DNA, 20 bp, mouse
gtacttgctgactttgggta

SEQ ID NO: 546695 - DNA, 20 bp, mouse
gactgcccccaaggttcttg

SEQ ID NO: 546696 - DNA, 20 bp, mouse
ggagatggaaaactatacca

SEQ ID NO: 546697 - DNA, 20 bp, mouse
gtgtcacatacaccaggaga

SEQ ID NO: 546698 - DNA, 20 bp, mouse
ggaaggtccaccagaacctt

SEQ ID NO: 546699 - DNA, 20 bp, mouse
gatgctcacttcttgacttt

SEQ ID NO: 546700 - DNA, 20 bp, mouse
gcacttcttgactttgggtc

SEQ ID NO: 546701 - DNA, 20 bp, mouse
gttgactttgggtcaggcca

SEQ ID NO: 546702 - DNA, 20 bp, mouse
gaaaataagttctttcaccc

SEQ ID NO: 546703 - DNA, 20 bp, mouse
gaaaaggagaattaatgaga

SEQ ID NO: 546704 - DNA, 20 bp, mouse
ggtgtgaaggcgagactcac

SEQ ID NO: 546705 - DNA, 20 bp, mouse
gatccactcccccaataagg

SEQ ID NO: 546706 - DNA, 20 bp, mouse
gaagtccaagagccttaaaa

SEQ ID NO: 546707 - DNA, 20 bp, mouse
gaagagaaagagtgaactcc

SEQ ID NO: 546708 - DNA, 20 bp, mouse
gttgttgagagcctaatatg

SEQ ID NO: 546709 - DNA, 20 bp, mouse
gcatgtagcagccacatatt

SEQ ID NO: 546710 - DNA, 20 bp, mouse
gctcttctgaaaatggagca

SEQ ID NO: 546711 - DNA, 20 bp, mouse
ggtacactagatacatcacc

SEQ ID NO: 546712 - DNA, 20 bp, mouse
gacagtgagtaaaggcattt

SEQ ID NO: 546713 - DNA, 20 bp, mouse
gcatgcaataacataattct

SEQ ID NO: 546714 - DNA, 20 bp, mouse
gcatttaggatctagcgtta

SEQ ID NO: 546715 - DNA, 20 bp, mouse
gtaggctctcaacaaattcc

SEQ ID NO: 546716 - DNA, 20 bp, mouse
gcagttcttgagactgggta

SEQ ID NO: 546717 - DNA, 20 bp, mouse
gaggaggaagtaacattcaa

SEQ ID NO: 546718 - DNA, 20 bp, mouse
gaagctcagttcttgagact

SEQ ID NO: 546719 - DNA, 20 bp, mouse
gacctttggaacagtaatgg

SEQ ID NO: 546720 - DNA, 20 bp, mouse
ggtgtggaggcgggactccc

SEQ ID NO: 546721 - DNA, 20 bp, mouse
gcaggtcacagtgaccatga

SEQ ID NO: 546722 - DNA, 20 bp, mouse
gtctattgtttatataacaa

SEQ ID NO: 546723 - DNA, 20 bp, mouse
ggcaaatgtccaacacagag

SEQ ID NO: 546724 - DNA, 20 bp, mouse
gactgttccaaaggtcttag

SEQ ID NO: 546725 - DNA, 20 bp, mouse
gaacccaggaggctgcgatg

SEQ ID NO: 546726 - DNA, 20 bp, mouse
gccggatgcgagtaagtgcc

SEQ ID NO: 546727 - DNA, 20 bp, mouse
gcttactcgcatccgggaac

SEQ ID NO: 546728 - DNA, 20 bp, mouse
gaaagatccaccaggaactt

SEQ ID NO: 546729 - DNA, 20 bp, mouse
gacccaggaggccaccacca

SEQ ID NO: 546730 - DNA, 20 bp, mouse
gcacattggtgtggtttatc

SEQ ID NO: 546731 - DNA, 20 bp, mouse
gaagacgaattctttcacat

SEQ ID NO: 546732 - DNA, 20 bp, mouse
gaggcgagactcagcagtga

SEQ ID NO: 546733 - DNA, 20 bp, mouse
gatgaggagagaggtatggt

SEQ ID NO: 546734 - DNA, 20 bp, mouse
gagtgatggtaaccacaatg

SEQ ID NO: 546735 - DNA, 20 bp, mouse
ggcactatgtaaccattatg

SEQ ID NO: 546736 - DNA, 20 bp, mouse
gtaacagacaacagatctta

SEQ ID NO: 546737 - DNA, 20 bp, mouse
gagaagaataccatctcttt

SEQ ID NO: 546738 - DNA, 20 bp, mouse
gtagtgccatggctcacaca

SEQ ID NO: 546739 - DNA, 20 bp, mouse
gtaataactttgtatgttag

SEQ ID NO: 546740 - DNA, 20 bp, mouse
gatctcttttggaggatgca

SEQ ID NO: 546741 - DNA, 20 bp, mouse
gattgatttctgttattcga

SEQ ID NO: 546742 - DNA, 20 bp, mouse
gctcagagttcacaaaaaat

SEQ ID NO: 546743 - DNA, 20 bp, mouse
gatacaccctgtgtgagcca

SEQ ID NO: 546744 - DNA, 20 bp, mouse
gataaaactcatcaacattt

SEQ ID NO: 546745 - DNA, 20 bp, mouse
gatggggtttgctagtgcca

SEQ ID NO: 546746 - DNA, 20 bp, mouse
gtgtggaagtaacaaagcag

SEQ ID NO: 546747 - DNA, 20 bp, mouse
gacaaagcagaggtctataa

SEQ ID NO: 546748 - DNA, 20 bp, mouse
gaggatgaactgggttattg

SEQ ID NO: 546749 - DNA, 20 bp, mouse
gctacattatgactatgacc

SEQ ID NO: 546750 - DNA, 20 bp, mouse
gaagcagaactgtgattcta

SEQ ID NO: 546751 - DNA, 20 bp, mouse
ggctacacagcaggactcac

SEQ ID NO: 546752 - DNA, 20 bp, mouse
gctagcactgaagagatgat

SEQ ID NO: 546753 - DNA, 20 bp, mouse
gtataaaggagagattactg

SEQ ID NO: 546754 - DNA, 20 bp, mouse
gaagttggaaagcatcttgg

SEQ ID NO: 546755 - DNA, 20 bp, mouse
gccatctgagcacatagtgt

SEQ ID NO: 546756 - DNA, 20 bp, mouse
gaggggctaggagaaaaata

SEQ ID NO: 546757 - DNA, 20 bp, mouse
ggctaggagaaaaataggga

SEQ ID NO: 546758 - DNA, 20 bp, mouse
ggtttagttagatttattgg

SEQ ID NO: 546759 - DNA, 20 bp, mouse
gatatttcaagtaatttttg

SEQ ID NO: 546760 - DNA, 20 bp, mouse
gttcaagtaatttttgagga

SEQ ID NO: 546761 - DNA, 20 bp, mouse
gatggggagaatcaaatcag

SEQ ID NO: 546762 - DNA, 20 bp, mouse
ggggagaatcaaatcagcgg

SEQ ID NO: 546763 - DNA, 20 bp, mouse
gatagttgattctaactaca

SEQ ID NO: 546764 - DNA, 20 bp, mouse
gtctgaacagcagatcattt

SEQ ID NO: 546765 - DNA, 20 bp, mouse
gatctcctatgtattaaaat

SEQ ID NO: 546766 - DNA, 20 bp, mouse
gacactaactaggatcatgg

SEQ ID NO: 546767 - DNA, 20 bp, mouse
gaaaacactaactaggatca

SEQ ID NO: 546768 - DNA, 20 bp, mouse
ggctacacagctggatttat

SEQ ID NO: 546769 - DNA, 20 bp, mouse
ggctgatagtttgccttttt

SEQ ID NO: 546770 - DNA, 20 bp, mouse
gtttataggttctgtatctc

SEQ ID NO: 546771 - DNA, 20 bp, mouse
gtcatggaggcaatgattaa

SEQ ID NO: 546772 - DNA, 20 bp, mouse
gtgctgtaatatacagtgta

SEQ ID NO: 546773 - DNA, 20 bp, mouse
gatcctagttagtgttttgg

SEQ ID NO: 546774 - DNA, 20 bp, mouse
ggtatattacagcactgacc

SEQ ID NO: 546775 - DNA, 20 bp, mouse
gtttcaacttcttccaaaaa

SEQ ID NO: 546776 - DNA, 20 bp, mouse
gggttgtaatatacaggatg

SEQ ID NO: 546777 - DNA, 20 bp, mouse
gggtcagggttgtaatatac

SEQ ID NO: 546778 - DNA, 20 bp, mouse
gattaccaaggcaatgatta

SEQ ID NO: 546779 - DNA, 20 bp, mouse
ggctacacagcaggaatcat

SEQ ID NO: 546780 - DNA, 20 bp, mouse
gccatctgagcgcaaagtgt

SEQ ID NO: 546781 - DNA, 20 bp, mouse
gatcatgggttctctatctc

SEQ ID NO: 546782 - DNA, 20 bp, mouse
gaagggacaggttccaggtc

SEQ ID NO: 546783 - DNA, 20 bp, mouse
gtgcttttcctggaagaggt

SEQ ID NO: 546784 - DNA, 20 bp, mouse
gctttccttaatcattgcct

SEQ ID NO: 546785 - DNA, 20 bp, mouse
gtactttatgtttgccacaa

SEQ ID NO: 546786 - DNA, 20 bp, mouse
gcgagacgatgcctggaggg

SEQ ID NO: 546787 - DNA, 20 bp, mouse
gctccgagacgatgcctgga

SEQ ID NO: 546788 - DNA, 20 bp, mouse
gaaaatctgagaatcccaca

SEQ ID NO: 546789 - DNA, 20 bp, mouse
gtgtggagagataacttccc

SEQ ID NO: 546790 - DNA, 20 bp, mouse
gtgcatggtgcacccaacaa

SEQ ID NO: 546791 - DNA, 20 bp, mouse
gagagaaccagcttgagctt

SEQ ID NO: 546792 - DNA, 20 bp, mouse
gagtgctccgagacgatgcc

SEQ ID NO: 546793 - DNA, 20 bp, mouse
gcagagtgacggggacatga

SEQ ID NO: 546794 - DNA, 20 bp, mouse
gcataggtgtgtgtaggtaa

SEQ ID NO: 546795 - DNA, 20 bp, mouse
gcccaagagaccagtactat

SEQ ID NO: 546796 - DNA, 20 bp, mouse
gggcccagaggtagattcat

SEQ ID NO: 546797 - DNA, 20 bp, mouse
ggaagatgctgtctgataga

SEQ ID NO: 546798 - DNA, 20 bp, mouse
gcccccatgaatctacctct

SEQ ID NO: 546799 - DNA, 20 bp, mouse
ggtgggaagaaacattagcg

SEQ ID NO: 546800 - DNA, 20 bp, mouse
gagaggacaatctgcagctg

SEQ ID NO: 546801 - DNA, 20 bp, mouse
gagcatcttaggggctatgg

SEQ ID NO: 546802 - DNA, 20 bp, mouse
gtgagggatggatagagtag

SEQ ID NO: 546803 - DNA, 20 bp, mouse
gggtactgagtgctgtctcc

SEQ ID NO: 546804 - DNA, 20 bp, mouse
gatcttaggggctatggagg

SEQ ID NO: 546805 - DNA, 20 bp, mouse
gcagatggtgggtgacatga

SEQ ID NO: 546806 - DNA, 20 bp, mouse
gtgcgttcgtcagtcctagg

SEQ ID NO: 546807 - DNA, 20 bp, mouse
ggaacagaacagagatgaca

SEQ ID NO: 546808 - DNA, 20 bp, mouse
gtggtgcgttcgtcagtcct

SEQ ID NO: 546809 - DNA, 20 bp, mouse
ggtgccctgtgggaaaaata

SEQ ID NO: 546810 - DNA, 20 bp, mouse
gggttcccaaataacattga

SEQ ID NO: 546811 - DNA, 20 bp, mouse
gacgaacgcaccagaactga

SEQ ID NO: 546812 - DNA, 20 bp, mouse
ggaaccagaatgtgccctgt

SEQ ID NO: 546813 - DNA, 20 bp, mouse
gtttcccacagggcacattc

SEQ ID NO: 546814 - DNA, 20 bp, mouse
gctgattatgataaacagag

SEQ ID NO: 546815 - DNA, 20 bp, mouse
gacagttggagtcatgatgg

SEQ ID NO: 546816 - DNA, 20 bp, mouse
gtctgtggaatatatgagag

SEQ ID NO: 546817 - DNA, 20 bp, mouse
gcattcaggtggcttagtga

SEQ ID NO: 546818 - DNA, 20 bp, mouse
gttctgagaatcttcaacca

SEQ ID NO: 546819 - DNA, 20 bp, mouse
ggaagtaagatacccttcta

SEQ ID NO: 546820 - DNA, 20 bp, mouse
ggaaaatattaacattcagg

SEQ ID NO: 546821 - DNA, 20 bp, mouse
ggaagaaaaccggtgtgttt

SEQ ID NO: 546822 - DNA, 20 bp, mouse
gaactcacaggtatcatcag

SEQ ID NO: 546823 - DNA, 20 bp, mouse
ggcttagtgatggccaaaca

SEQ ID NO: 546824 - DNA, 20 bp, mouse
gtaagtggaggaaggtacac

SEQ ID NO: 546825 - DNA, 20 bp, mouse
gatttgtagaatataagtgg

SEQ ID NO: 546826 - DNA, 20 bp, mouse
ggctgtagctcccaagatgg

SEQ ID NO: 546827 - DNA, 20 bp, mouse
ggagtatcccagatctacaa

SEQ ID NO: 546828 - DNA, 20 bp, mouse
gggagaggaacctgaagatt

SEQ ID NO: 546829 - DNA, 20 bp, mouse
gggtgtaagagccaatggtt

SEQ ID NO: 546830 - DNA, 20 bp, mouse
gccgccatgcagcagtgtgt

SEQ ID NO: 546831 - DNA, 20 bp, mouse
gataaaaatatcaggaggag

SEQ ID NO: 546832 - DNA, 20 bp, mouse
gcactctgattggaaatgga

SEQ ID NO: 546833 - DNA, 20 bp, mouse
gggtggctgcacttcagtca

SEQ ID NO: 546834 - DNA, 20 bp, mouse
gtcccagatctacaaaggac

SEQ ID NO: 546835 - DNA, 20 bp, mouse
gaggcctacacactgctgca

SEQ ID NO: 546836 - DNA, 20 bp, mouse
gtgtctattgaaaggagacc

SEQ ID NO: 546837 - DNA, 20 bp, mouse
gccataacacacaatgcttg

SEQ ID NO: 546838 - DNA, 20 bp, mouse
gcttctttctctttgctaca

SEQ ID NO: 546839 - DNA, 20 bp, mouse
ggactgagttcattctcaca

SEQ ID NO: 546840 - DNA, 20 bp, mouse
gagagtggtatctggagctc

SEQ ID NO: 546841 - DNA, 20 bp, mouse
gtggtggtggtgtactgcag

SEQ ID NO: 546842 - DNA, 20 bp, mouse
gcttacaaagaagaagaatt

SEQ ID NO: 546843 - DNA, 20 bp, mouse
gactacagaaagcttcctct

SEQ ID NO: 546844 - DNA, 20 bp, mouse
gccaatggagaatagtacag

SEQ ID NO: 546845 - DNA, 20 bp, mouse
ggcagccacataatccccaa

SEQ ID NO: 546846 - DNA, 20 bp, mouse
ggaagctcagtcatcactgt

SEQ ID NO: 546847 - DNA, 20 bp, mouse
gaaccaaggacagattacca

SEQ ID NO: 546848 - DNA, 20 bp, mouse
gaaaacatttttaaagaata

SEQ ID NO: 546849 - DNA, 20 bp, mouse
gcaggggaagctgcatgcct

SEQ ID NO: 546850 - DNA, 20 bp, mouse
gcaccgtggtgggaaaccta

SEQ ID NO: 546851 - DNA, 20 bp, mouse
gtcttctccatagtaataaa

SEQ ID NO: 546852 - DNA, 20 bp, mouse
ggaaggaaggtgataaacag

SEQ ID NO: 546853 - DNA, 20 bp, mouse
gttaaaactttaaaattcca

SEQ ID NO: 546854 - DNA, 20 bp, mouse
gatttttccctttattacta

SEQ ID NO: 546855 - DNA, 20 bp, mouse
gttcatatttttaagttcca

SEQ ID NO: 546856 - DNA, 20 bp, mouse
gcaccagagaaagattacca

SEQ ID NO: 546857 - DNA, 20 bp, mouse
ggggctactaataggaaaca

SEQ ID NO: 546858 - DNA, 20 bp, mouse
gtcatgaatgggctactaat

SEQ ID NO: 546859 - DNA, 20 bp, mouse
gttccttggtaatctttctc

SEQ ID NO: 546860 - DNA, 20 bp, mouse
gaaaacatgttttaagaata

SEQ ID NO: 546861 - DNA, 20 bp, mouse
ggtagcccattcatgactgt

SEQ ID NO: 546862 - DNA, 20 bp, mouse
gcacacccacagtcatgaat

SEQ ID NO: 546863 - DNA, 20 bp, mouse
gcaccgtggtgggaaaccta

SEQ ID NO: 546864 - DNA, 20 bp, mouse
gtcttctccatagtaataaa

SEQ ID NO: 546865 - DNA, 20 bp, mouse
ggaaggaaggtgataaacag

SEQ ID NO: 546866 - DNA, 20 bp, mouse
gtgggtgccacaagtgttat

SEQ ID NO: 546867 - DNA, 20 bp, mouse
gccacaagtgttatgggata

SEQ ID NO: 546868 - DNA, 20 bp, mouse
gtattctccattggggatta

SEQ ID NO: 546869 - DNA, 20 bp, mouse
gacccaattcttcttcttcg

SEQ ID NO: 546870 - DNA, 20 bp, mouse
ggccaagagaaagctttctg

SEQ ID NO: 546871 - DNA, 20 bp, mouse
gatgttcccagtgtggatag

SEQ ID NO: 546872 - DNA, 20 bp, mouse
gaccacagaaagctttctct

SEQ ID NO: 546873 - DNA, 20 bp, mouse
ggaattcctctatccacact

SEQ ID NO: 546874 - DNA, 20 bp, mouse
gccacactgggaacattttc

SEQ ID NO: 546875 - DNA, 20 bp, mouse
gcccacgaagaagaagaatt

SEQ ID NO: 546876 - DNA, 20 bp, mouse
ggatatcagtcaatcccaaa

SEQ ID NO: 546877 - DNA, 20 bp, mouse
ggactgaacgtgacgaacag

SEQ ID NO: 546878 - DNA, 20 bp, mouse
gacctttggagtcacagcgg

SEQ ID NO: 546879 - DNA, 20 bp, mouse
gcagagggacttgcagctct

SEQ ID NO: 546880 - DNA, 20 bp, mouse
gaacacagtctgccagagag

SEQ ID NO: 546881 - DNA, 20 bp, mouse
ggaaacccaaccatcacctt

SEQ ID NO: 546882 - DNA, 20 bp, mouse
gaatttcaaaatgtcatact

SEQ ID NO: 546883 - DNA, 20 bp, mouse
ggtgactacatttatccttt

SEQ ID NO: 546884 - DNA, 20 bp, mouse
ggcagactcaaacaaacccc

SEQ ID NO: 546885 - DNA, 20 bp, mouse
ggtgattgcctgttattcct

SEQ ID NO: 546886 - DNA, 20 bp, mouse
gggcctgcgaggatgaactc

SEQ ID NO: 546887 - DNA, 20 bp, mouse
gaaggtcgttgtagtggggt

SEQ ID NO: 546888 - DNA, 20 bp, mouse
ggtctcagcagaatgctgtg

SEQ ID NO: 546889 - DNA, 20 bp, mouse
ggaaaaaggtcgttgtagtg

SEQ ID NO: 546890 - DNA, 20 bp, mouse
gtgccctccctgtcacctcc

SEQ ID NO: 546891 - DNA, 20 bp, mouse
gggcacagaggcattttcag

SEQ ID NO: 546892 - DNA, 20 bp, mouse
gggagtagcagaaatctata

SEQ ID NO: 546893 - DNA, 20 bp, mouse
gattttgggagtaataacag

SEQ ID NO: 546894 - DNA, 20 bp, mouse
gtagactccaggaggtgaca

SEQ ID NO: 546895 - DNA, 20 bp, mouse
gactccaggaggtgacaggg

SEQ ID NO: 546896 - DNA, 20 bp, mouse
gtgaatgcattcatactctt

SEQ ID NO: 546897 - DNA, 20 bp, mouse
gttgaatatgatgaacaggg

SEQ ID NO: 546898 - DNA, 20 bp, mouse
gctaactgacaacccagacc

SEQ ID NO: 546899 - DNA, 20 bp, mouse
gaacacagtctgccaaggag

SEQ ID NO: 546900 - DNA, 20 bp, mouse
gcaggggggcttccaggtct

SEQ ID NO: 546901 - DNA, 20 bp, mouse
gttcctcagtcacctctcct

SEQ ID NO: 546902 - DNA, 20 bp, mouse
gacttttggagtcacagcag

SEQ ID NO: 546903 - DNA, 20 bp, mouse
ggatgaacaggggggcttcc

SEQ ID NO: 546904 - DNA, 20 bp, mouse
ggaagcccaaccatcacttt

SEQ ID NO: 546905 - DNA, 20 bp, mouse
ggagattgaatatgatgaac

SEQ ID NO: 546906 - DNA, 20 bp, mouse
ggcattgtaggagaccacct

SEQ ID NO: 546907 - DNA, 20 bp, mouse
gacatcaatgaggtaaatga

SEQ ID NO: 546908 - DNA, 20 bp, mouse
ggagggtgaacatgatacaa

SEQ ID NO: 546909 - DNA, 20 bp, mouse
gagaatgaactctctcactt

SEQ ID NO: 546910 - DNA, 20 bp, mouse
gtgatgtggttggaaacacg

SEQ ID NO: 546911 - DNA, 20 bp, mouse
gatcctggtagagtaatgca

SEQ ID NO: 546912 - DNA, 20 bp, mouse
gcatcaattatctggaagta

SEQ ID NO: 546913 - DNA, 20 bp, mouse
gatgtccccaacatgaaaaa

SEQ ID NO: 546914 - DNA, 20 bp, mouse
gaagaggtaattttccccag

SEQ ID NO: 546915 - DNA, 20 bp, mouse
gaacacggggctgataatgt

SEQ ID NO: 546916 - DNA, 20 bp, mouse
gggaggaacgtgatagagag

SEQ ID NO: 546917 - DNA, 20 bp, mouse
gtcatagctggattccttac

SEQ ID NO: 546918 - DNA, 20 bp, mouse
gtcttcaacagtaactccaa

SEQ ID NO: 546919 - DNA, 20 bp, mouse
gctaggtaacctgtctttag

SEQ ID NO: 546920 - DNA, 20 bp, mouse
gacaaaagtccactaaagac

SEQ ID NO: 546921 - DNA, 20 bp, mouse
gataggccattgaggctaaa

SEQ ID NO: 546922 - DNA, 20 bp, mouse
gtgttcttttttgcaaactt

SEQ ID NO: 546923 - DNA, 20 bp, mouse
gaactaccttttagcctcaa

SEQ ID NO: 546924 - DNA, 20 bp, mouse
gagtatagatggaagcactg

SEQ ID NO: 546925 - DNA, 20 bp, mouse
gtgtgtgcatctttagtcat

SEQ ID NO: 546926 - DNA, 20 bp, mouse
gtcatagctggatttcttat

SEQ ID NO: 546927 - DNA, 20 bp, mouse
gctaggtaacctgtccttgg

SEQ ID NO: 546928 - DNA, 20 bp, mouse
gaatgcatctacagtataaa

SEQ ID NO: 546929 - DNA, 20 bp, mouse
gtgtgtgtgtgtctactcat

SEQ ID NO: 546930 - DNA, 20 bp, mouse
gataggccattgagaccaaa

SEQ ID NO: 546931 - DNA, 20 bp, mouse
gagtataaatggaagcattg

SEQ ID NO: 546932 - DNA, 20 bp, mouse
gaactaccttttggtctcaa

SEQ ID NO: 546933 - DNA, 20 bp, mouse
gacagaagtccaccaaggac

SEQ ID NO: 546934 - DNA, 20 bp, mouse
gttcctaggtaacctgtcct

SEQ ID NO: 546935 - DNA, 20 bp, mouse
ggaaatccagctatgacttt

SEQ ID NO: 546936 - DNA, 20 bp, mouse
ggaagctcagtcatgacact

SEQ ID NO: 546937 - DNA, 20 bp, mouse
ggattaaaagatgtctctga

SEQ ID NO: 546938 - DNA, 20 bp, mouse
gactcttgtagtcatagtgc

SEQ ID NO: 546939 - DNA, 20 bp, mouse
gtgaatgcctccatcaacac

SEQ ID NO: 546940 - DNA, 20 bp, mouse
gtttgtagcattctgtactg

SEQ ID NO: 546941 - DNA, 20 bp, mouse
gggagaaatatcaagaagag

SEQ ID NO: 546942 - DNA, 20 bp, mouse
gcagggtgatggtgtaaatg

SEQ ID NO: 546943 - DNA, 20 bp, mouse
ggtgtttccagtgttgatgg

SEQ ID NO: 546944 - DNA, 20 bp, mouse
gactgtggaaaattatctct

SEQ ID NO: 546945 - DNA, 20 bp, mouse
gaaagtgtttccagtgttga

SEQ ID NO: 546946 - DNA, 20 bp, mouse
gagctgcaggtctggatcat

SEQ ID NO: 546947 - DNA, 20 bp, mouse
gtggtacgcttcatcctgat

SEQ ID NO: 546948 - DNA, 20 bp, mouse
gatcatcggtgagtcccatc

SEQ ID NO: 546949 - DNA, 20 bp, mouse
gatggagaacgggacagaaa

SEQ ID NO: 546950 - DNA, 20 bp, mouse
gtcatggctggattcattat

SEQ ID NO: 546951 - DNA, 20 bp, mouse
gcagccccaggttccctaca

SEQ ID NO: 546952 - DNA, 20 bp, mouse
gctaagtaacctgtccctag

SEQ ID NO: 546953 - DNA, 20 bp, mouse
ggagaagaaatgtgatgaag

SEQ ID NO: 546954 - DNA, 20 bp, mouse
ggcgcacacacgtgttgtca

SEQ ID NO: 546955 - DNA, 20 bp, mouse
ggtttaactcacagaaggta

SEQ ID NO: 546956 - DNA, 20 bp, mouse
gaagcaaaatgagtacaata

SEQ ID NO: 546957 - DNA, 20 bp, mouse
gtcatagctggaatcctcac

SEQ ID NO: 546958 - DNA, 20 bp, mouse
gagagtctaagagaatcaat

SEQ ID NO: 546959 - DNA, 20 bp, mouse
gggtaacagtatagatgagg

SEQ ID NO: 546960 - DNA, 20 bp, mouse
gaaaggtaacagtatagatg

SEQ ID NO: 546961 - DNA, 20 bp, mouse
ggaagtgacatggttcatcc

SEQ ID NO: 546962 - DNA, 20 bp, mouse
gggtttagtggttatagctc

SEQ ID NO: 546963 - DNA, 20 bp, mouse
gtttgctttaaaattcttta

SEQ ID NO: 546964 - DNA, 20 bp, mouse
gtctatactgttacctttgt

SEQ ID NO: 546965 - DNA, 20 bp, mouse
ggttacctttgtaggaaacc

SEQ ID NO: 546966 - DNA, 20 bp, mouse
ggaaaagatagtgactattg

SEQ ID NO: 546967 - DNA, 20 bp, mouse
gagtcataaagaattttagg

SEQ ID NO: 546968 - DNA, 20 bp, mouse
gtgcctttttccatgttctc

SEQ ID NO: 546969 - DNA, 20 bp, mouse
gagtagtcataaagaatttt

SEQ ID NO: 546970 - DNA, 20 bp, mouse
gtgaacaaattcttcctttc

SEQ ID NO: 546971 - DNA, 20 bp, mouse
gaatgaaggacagactactg

SEQ ID NO: 546972 - DNA, 20 bp, mouse
gtgcctgagaacatggaaaa

SEQ ID NO: 546973 - DNA, 20 bp, mouse
ggatgctactgtaaagtaag

SEQ ID NO: 546974 - DNA, 20 bp, mouse
gagagtggcagttgcagttc

SEQ ID NO: 546975 - DNA, 20 bp, mouse
gaatgctggtgaaatttgtg

SEQ ID NO: 546976 - DNA, 20 bp, mouse
gttgtggaaaacaatgacac

SEQ ID NO: 546977 - DNA, 20 bp, mouse
gtcatagctgggctgctaat

SEQ ID NO: 546978 - DNA, 20 bp, mouse
gcactcctaaagtcatagct

SEQ ID NO: 546979 - DNA, 20 bp, mouse
gtaacagagttcattttgct

SEQ ID NO: 546980 - DNA, 20 bp, mouse
gagagtaacaaacgtccacc

SEQ ID NO: 546981 - DNA, 20 bp, mouse
gtagataaactgagacattg

SEQ ID NO: 546982 - DNA, 20 bp, mouse
gacatttgaagtcatggttg

SEQ ID NO: 546983 - DNA, 20 bp, mouse
ggtctgatcatggggtgcta

SEQ ID NO: 546984 - DNA, 20 bp, mouse
gatacatacatttgaagtca

SEQ ID NO: 546985 - DNA, 20 bp, mouse
gatgatcctgctgattttct

SEQ ID NO: 546986 - DNA, 20 bp, mouse
gggtaatgaagagtggaagc

SEQ ID NO: 546987 - DNA, 20 bp, mouse
ggattaattgatatcattga

SEQ ID NO: 546988 - DNA, 20 bp, mouse
gaatcaacaggataatccct

SEQ ID NO: 546989 - DNA, 20 bp, mouse
gctacatcatcactctggtg

SEQ ID NO: 546990 - DNA, 20 bp, mouse
gtcatggctggatttcttac

SEQ ID NO: 546991 - DNA, 20 bp, mouse
gtggatttcttacaggagat

SEQ ID NO: 546992 - DNA, 20 bp, mouse
gtatgtgtttttctagttat

SEQ ID NO: 546993 - DNA, 20 bp, mouse
gaatacatccactgtataga

SEQ ID NO: 546994 - DNA, 20 bp, mouse
gttattggctgttacatttg

SEQ ID NO: 546995 - DNA, 20 bp, mouse
gagctggagttgtgggtcat

SEQ ID NO: 546996 - DNA, 20 bp, mouse
gtcatggctgggcttctatt

SEQ ID NO: 546997 - DNA, 20 bp, mouse
gcttctgtccagtttttcaa

SEQ ID NO: 546998 - DNA, 20 bp, mouse
gtgagcagcacagctattgt

SEQ ID NO: 546999 - DNA, 20 bp, mouse
ggatgacaccattgaaaaac

SEQ ID NO: 547000 - DNA, 20 bp, mouse
gcacaccaaaagtcatggct

SEQ ID NO: 547001 - DNA, 20 bp, mouse
gaatcagcagaatcaacccc

SEQ ID NO: 547002 - DNA, 20 bp, mouse
gctcatctacattttcaccc

SEQ ID NO: 547003 - DNA, 20 bp, mouse
gttgattctgctgattcttt

SEQ ID NO: 547004 - DNA, 20 bp, mouse
gggagaaaaatgatgaagag

SEQ ID NO: 547005 - DNA, 20 bp, mouse
gtgagtgtctcagtttacct

SEQ ID NO: 547006 - DNA, 20 bp, mouse
gtcatgagtgggctcctaaa

SEQ ID NO: 547007 - DNA, 20 bp, mouse
ggattagaagtatcatgaag

SEQ ID NO: 547008 - DNA, 20 bp, mouse
gggagcccactcatgacttt

SEQ ID NO: 547009 - DNA, 20 bp, mouse
gtcacacccaaagtcatgag

SEQ ID NO: 547010 - DNA, 20 bp, mouse
gcttttaaatgtaacagtga

SEQ ID NO: 547011 - DNA, 20 bp, mouse
gacagtggaaaatttcctgt

SEQ ID NO: 547012 - DNA, 20 bp, mouse
gtgattgcctccattcacat

SEQ ID NO: 547013 - DNA, 20 bp, mouse
gctataggttcctatgcctg

SEQ ID NO: 547014 - DNA, 20 bp, mouse
ggtcatctgtgagtccaagc

SEQ ID NO: 547015 - DNA, 20 bp, mouse
gacacctgaagtcatagtgg

SEQ ID NO: 547016 - DNA, 20 bp, mouse
ggagtaaataacatccacca

SEQ ID NO: 547017 - DNA, 20 bp, mouse
ggatgttatttactcttcag

SEQ ID NO: 547018 - DNA, 20 bp, mouse
gtggtggtagcatagtatag

SEQ ID NO: 547019 - DNA, 20 bp, mouse
gtcatggctggtctcataat

SEQ ID NO: 547020 - DNA, 20 bp, mouse
ggatgaaaaggggaagttgc

SEQ ID NO: 547021 - DNA, 20 bp, mouse
gcatgggctgctatgctctt

SEQ ID NO: 547022 - DNA, 20 bp, mouse
ggaagaaaaatgatgaaaag

SEQ ID NO: 547023 - DNA, 20 bp, mouse
ggtatttccaagataaactg

SEQ ID NO: 547024 - DNA, 20 bp, mouse
gtatgtatgtgtttcatcat

SEQ ID NO: 547025 - DNA, 20 bp, mouse
gatgatgtcatctaacaaat

SEQ ID NO: 547026 - DNA, 20 bp, mouse
gcaccgtggtggggaatctg

SEQ ID NO: 547027 - DNA, 20 bp, mouse
gatttgaagttctgggtcat

SEQ ID NO: 547028 - DNA, 20 bp, mouse
gtttctaggtaacttatctc

SEQ ID NO: 547029 - DNA, 20 bp, mouse
gtgtgtacgtggctgatcat

SEQ ID NO: 547030 - DNA, 20 bp, mouse
ggagtggaatttgaagttct

SEQ ID NO: 547031 - DNA, 20 bp, mouse
gaagagattattcaacatga

SEQ ID NO: 547032 - DNA, 20 bp, mouse
ggactacaagtgtgtgtacg

SEQ ID NO: 547033 - DNA, 20 bp, mouse
gttatacaatcaccgtggtg

SEQ ID NO: 547034 - DNA, 20 bp, mouse
ggtgaaatgtatctcctatg

SEQ ID NO: 547035 - DNA, 20 bp, mouse
gtttgcagcatttattactg

SEQ ID NO: 547036 - DNA, 20 bp, mouse
gaatgaaaaggggaaactgt

SEQ ID NO: 547037 - DNA, 20 bp, mouse
gcagtcatgactgggctaat

SEQ ID NO: 547038 - DNA, 20 bp, mouse
gaggagaaactgtgtaacat

SEQ ID NO: 547039 - DNA, 20 bp, mouse
gttcaaaaaaccacaggtat

SEQ ID NO: 547040 - DNA, 20 bp, mouse
ggaggcattcaaaaaaccac

SEQ ID NO: 547041 - DNA, 20 bp, mouse
gtgtgcatctgtctttgtat

SEQ ID NO: 547042 - DNA, 20 bp, mouse
ggtataggttcctatacctg

SEQ ID NO: 547043 - DNA, 20 bp, mouse
gaaggggaaactgtaggcct

SEQ ID NO: 547044 - DNA, 20 bp, mouse
gaggagaaatgtaatgaaaa

SEQ ID NO: 547045 - DNA, 20 bp, mouse
gagtatgaagacgagagtcc

SEQ ID NO: 547046 - DNA, 20 bp, mouse
gggtaaaagtgtcataccac

SEQ ID NO: 547047 - DNA, 20 bp, mouse
gtctcaaatcatgagacctg

SEQ ID NO: 547048 - DNA, 20 bp, mouse
ggctgttcaaaaacaagaaa

SEQ ID NO: 547049 - DNA, 20 bp, mouse
gagctaccacagcagggagt

SEQ ID NO: 547050 - DNA, 20 bp, mouse
gactatccagaacacagaat

SEQ ID NO: 547051 - DNA, 20 bp, mouse
ggttctggatagtggaagtg

SEQ ID NO: 547052 - DNA, 20 bp, mouse
gagaaattgcagatatgaat

SEQ ID NO: 547053 - DNA, 20 bp, mouse
gaaacacctactccctgctg

SEQ ID NO: 547054 - DNA, 20 bp, mouse
gagacaagtataatatttct

SEQ ID NO: 547055 - DNA, 20 bp, mouse
gatacaaagctaccacagca

SEQ ID NO: 547056 - DNA, 20 bp, mouse
gtgacggtcataggccatcg

SEQ ID NO: 547057 - DNA, 20 bp, mouse
ggtcataggccatcgaggca

SEQ ID NO: 547058 - DNA, 20 bp, mouse
gagtttgatccttgcctcga

SEQ ID NO: 547059 - DNA, 20 bp, mouse
gaccttgggggtgattgctg

SEQ ID NO: 547060 - DNA, 20 bp, mouse
gttactgaatttattcttgc

SEQ ID NO: 547061 - DNA, 20 bp, mouse
gtagtcatcaattactttga

SEQ ID NO: 547062 - DNA, 20 bp, mouse
gcacctgctgctacatgtgt

SEQ ID NO: 547063 - DNA, 20 bp, mouse
ggcacacccatttaatgata

SEQ ID NO: 547064 - DNA, 20 bp, mouse
gaaactttcaatagcaataa

SEQ ID NO: 547065 - DNA, 20 bp, mouse
gtaagaccatatcattaaat

SEQ ID NO: 547066 - DNA, 20 bp, mouse
gcaggtgacaatcagaatac

SEQ ID NO: 547067 - DNA, 20 bp, mouse
gcaggtggtacttgtcatga

SEQ ID NO: 547068 - DNA, 20 bp, mouse
gagtgaagataataaataaa

SEQ ID NO: 547069 - DNA, 20 bp, mouse
gtactgaatttattctcgtg

SEQ ID NO: 547070 - DNA, 20 bp, mouse
ggcaagagcaacatgaatag

SEQ ID NO: 547071 - DNA, 20 bp, mouse
ggtgacaatcagaatacagg

SEQ ID NO: 547072 - DNA, 20 bp, mouse
gaaactttcaatagcaataa

SEQ ID NO: 547073 - DNA, 20 bp, mouse
gaattgccaaataactttga

SEQ ID NO: 547074 - DNA, 20 bp, mouse
gattctccatcaaagttatt

SEQ ID NO: 547075 - DNA, 20 bp, mouse
gcatgatggtagtgtagtgc

SEQ ID NO: 547076 - DNA, 20 bp, mouse
gcaccaccgagagattacag

SEQ ID NO: 547077 - DNA, 20 bp, mouse
gttcctctgtaatctctcgg

SEQ ID NO: 547078 - DNA, 20 bp, mouse
gtttttcctctgtaatctct

SEQ ID NO: 547079 - DNA, 20 bp, mouse
gtcacttggtgctacacttg

SEQ ID NO: 547080 - DNA, 20 bp, mouse
gctgcattctaattgtcact

SEQ ID NO: 547081 - DNA, 20 bp, mouse
gatgatcatactgattctgc

SEQ ID NO: 547082 - DNA, 20 bp, mouse
gaccttgggggtgattgctg

SEQ ID NO: 547083 - DNA, 20 bp, mouse
gtagtcatcaattactttga

SEQ ID NO: 547084 - DNA, 20 bp, mouse
ggcacacccatttaatgata

SEQ ID NO: 547085 - DNA, 20 bp, mouse
gtaagaccatatcattaaat

SEQ ID NO: 547086 - DNA, 20 bp, mouse
gtactgaatttattctcatg

SEQ ID NO: 547087 - DNA, 20 bp, mouse
ggcaagagcaacatgaatag

SEQ ID NO: 547088 - DNA, 20 bp, mouse
gaattgccaaataactttga

SEQ ID NO: 547089 - DNA, 20 bp, mouse
gcacttgctgctacatgtgt

SEQ ID NO: 547090 - DNA, 20 bp, mouse
gaaactttcaatagcaccaa

SEQ ID NO: 547091 - DNA, 20 bp, mouse
gattctccatcaaagttatt

SEQ ID NO: 547092 - DNA, 20 bp, mouse
gtgttcttctttgtagcctt

SEQ ID NO: 547093 - DNA, 20 bp, mouse
gcaccagggagaggttacag

SEQ ID NO: 547094 - DNA, 20 bp, mouse
gcaaaggaatctgaagctct

SEQ ID NO: 547095 - DNA, 20 bp, mouse
gttcctctgtaacctctccc

SEQ ID NO: 547096 - DNA, 20 bp, mouse
gaaaataggagtaaaacgga

SEQ ID NO: 547097 - DNA, 20 bp, mouse
gatggttgtaagtagagcaa

SEQ ID NO: 547098 - DNA, 20 bp, mouse
gagtgatggtttcattctag

SEQ ID NO: 547099 - DNA, 20 bp, mouse
gagaatttagagttgaattc

SEQ ID NO: 547100 - DNA, 20 bp, mouse
gtggcttttctgatgcatca

SEQ ID NO: 547101 - DNA, 20 bp, mouse
gctttttgatcttgaagtga

SEQ ID NO: 547102 - DNA, 20 bp, mouse
gagcagagctctagctgtgg

SEQ ID NO: 547103 - DNA, 20 bp, mouse
ggagctctagctgtggaggg

SEQ ID NO: 547104 - DNA, 20 bp, mouse
gcacagcagagctctagctg

SEQ ID NO: 547105 - DNA, 20 bp, mouse
gtgacctaacacacataact

SEQ ID NO: 547106 - DNA, 20 bp, mouse
gagaccacctctgaagataa

SEQ ID NO: 547107 - DNA, 20 bp, mouse
gtcttcagaggtggtcttgg

SEQ ID NO: 547108 - DNA, 20 bp, mouse
gaattatccattatcttcag

SEQ ID NO: 547109 - DNA, 20 bp, mouse
gtatccattatcttcagagg

SEQ ID NO: 547110 - DNA, 20 bp, mouse
ggtccagccatctcttacaa

SEQ ID NO: 547111 - DNA, 20 bp, mouse
gtccttcagtagaacccaga

SEQ ID NO: 547112 - DNA, 20 bp, mouse
gtaataatagcttggttagt

SEQ ID NO: 547113 - DNA, 20 bp, mouse
gctggagactttactctttg

SEQ ID NO: 547114 - DNA, 20 bp, mouse
gatgagtgaatttccgagca

SEQ ID NO: 547115 - DNA, 20 bp, mouse
ggagcttggtaataatagct

SEQ ID NO: 547116 - DNA, 20 bp, mouse
gaaactctccgtaataacaa

SEQ ID NO: 547117 - DNA, 20 bp, mouse
gtttgtagcctttgttatta

SEQ ID NO: 547118 - DNA, 20 bp, mouse
gattacggagagttttatcc

SEQ ID NO: 547119 - DNA, 20 bp, mouse
gttctgaatcatttttatat

SEQ ID NO: 547120 - DNA, 20 bp, mouse
gtttgcacactgctgcataa

SEQ ID NO: 547121 - DNA, 20 bp, mouse
ggtctgaatttattcttgtt

SEQ ID NO: 547122 - DNA, 20 bp, mouse
gataaaggagtttgcaggag

SEQ ID NO: 547123 - DNA, 20 bp, mouse
gcaccagagagaggttactg

SEQ ID NO: 547124 - DNA, 20 bp, mouse
gtagtagtggagtaatgcaa

SEQ ID NO: 547125 - DNA, 20 bp, mouse
ggataaataaaggagtttgc

SEQ ID NO: 547126 - DNA, 20 bp, mouse
gaaacactcagtaatagcaa

SEQ ID NO: 547127 - DNA, 20 bp, mouse
gttgctggatcttacttgag

SEQ ID NO: 547128 - DNA, 20 bp, mouse
gatggaatgtgaaggaaaca

SEQ ID NO: 547129 - DNA, 20 bp, mouse
gattactgagtgttttattc

SEQ ID NO: 547130 - DNA, 20 bp, mouse
gaacccttctatcactttgg

SEQ ID NO: 547131 - DNA, 20 bp, mouse
gagaaacccttctatcactt

SEQ ID NO: 547132 - DNA, 20 bp, mouse
gggctacaaagaaaaacatc

SEQ ID NO: 547133 - DNA, 20 bp, mouse
ggtcagaatttattcttctt

SEQ ID NO: 547134 - DNA, 20 bp, mouse
gcacccccaaagtgatagaa

SEQ ID NO: 547135 - DNA, 20 bp, mouse
gtgttttattctggcctcaa

SEQ ID NO: 547136 - DNA, 20 bp, mouse
gactgttgaaagtttcatgc

SEQ ID NO: 547137 - DNA, 20 bp, mouse
ggtctgaatttattcttgtt

SEQ ID NO: 547138 - DNA, 20 bp, mouse
gataaaggaatttgcaggaa

SEQ ID NO: 547139 - DNA, 20 bp, mouse
gaaactttcaacagtagcaa

SEQ ID NO: 547140 - DNA, 20 bp, mouse
gagtttcatgctggcctcaa

SEQ ID NO: 547141 - DNA, 20 bp, mouse
gcaccagagagaggttactg

SEQ ID NO: 547142 - DNA, 20 bp, mouse
gtagtagtggagtaatgcaa

SEQ ID NO: 547143 - DNA, 20 bp, mouse
ggataaataaaggaatttgc

SEQ ID NO: 547144 - DNA, 20 bp, mouse
gatcgtagttgtcatagtag

SEQ ID NO: 547145 - DNA, 20 bp, mouse
gaatgtgaaggaaacatgaa

SEQ ID NO: 547146 - DNA, 20 bp, mouse
gcactcccaaggtaatagaa

SEQ ID NO: 547147 - DNA, 20 bp, mouse
ggggattaacagatgcccca

SEQ ID NO: 547148 - DNA, 20 bp, mouse
gggcatctgttaatcccaca

SEQ ID NO: 547149 - DNA, 20 bp, mouse
gccaaggttaccaaacaatg

SEQ ID NO: 547150 - DNA, 20 bp, mouse
gtaaagggacctgtagccct

SEQ ID NO: 547151 - DNA, 20 bp, mouse
gcttagtaacctctcactgg

SEQ ID NO: 547152 - DNA, 20 bp, mouse
gaaggagaggtggaaagtga

SEQ ID NO: 547153 - DNA, 20 bp, mouse
gtttcttagtaacctctcac

SEQ ID NO: 547154 - DNA, 20 bp, mouse
gcatattgttgttgtcatgg

SEQ ID NO: 547155 - DNA, 20 bp, mouse
gtatgtaccctgctcattgt

SEQ ID NO: 547156 - DNA, 20 bp, mouse
gtgtgtgtgggatgcccagt

SEQ ID NO: 547157 - DNA, 20 bp, mouse
gtgaacttgcaaagattaaa

SEQ ID NO: 547158 - DNA, 20 bp, mouse
gtagcgtagagggtagcata

SEQ ID NO: 547159 - DNA, 20 bp, mouse
gaaattcttaatagacattg

SEQ ID NO: 547160 - DNA, 20 bp, mouse
gtgggacacacaacctgcat

SEQ ID NO: 547161 - DNA, 20 bp, mouse
gggctggagtatttcctgag

SEQ ID NO: 547162 - DNA, 20 bp, mouse
gtatgactgagtagcgtaga

SEQ ID NO: 547163 - DNA, 20 bp, mouse
gaacctgcataggagatggc

SEQ ID NO: 547164 - DNA, 20 bp, mouse
gtctacatcttcactctcgt

SEQ ID NO: 547165 - DNA, 20 bp, mouse
gaactgctgtccccatggcc

SEQ ID NO: 547166 - DNA, 20 bp, mouse
gagctctggacgttttggat

SEQ ID NO: 547167 - DNA, 20 bp, mouse
gagcagagcatacgtagctc

SEQ ID NO: 547168 - DNA, 20 bp, mouse
gtacgtagctctggacgttt

SEQ ID NO: 547169 - DNA, 20 bp, mouse
gggctgtggattcaatgact

SEQ ID NO: 547170 - DNA, 20 bp, mouse
gtggacgttttggataggca

SEQ ID NO: 547171 - DNA, 20 bp, mouse
gacatagctctatccctgag

SEQ ID NO: 547172 - DNA, 20 bp, mouse
gctggatggagaccacaata

SEQ ID NO: 547173 - DNA, 20 bp, mouse
gtgatgagagggtactgcaa

SEQ ID NO: 547174 - DNA, 20 bp, mouse
gaagaaccactcattgttca

SEQ ID NO: 547175 - DNA, 20 bp, mouse
gataggccatgatagccagg

SEQ ID NO: 547176 - DNA, 20 bp, mouse
gaggagcattggtgaagaca

SEQ ID NO: 547177 - DNA, 20 bp, mouse
gaggagtcccagattggtta

SEQ ID NO: 547178 - DNA, 20 bp, mouse
ggcctggaattcaggagcat

SEQ ID NO: 547179 - DNA, 20 bp, mouse
gacttgtccttaaccaatct

SEQ ID NO: 547180 - DNA, 20 bp, mouse
gttgcagaagatatgttgac

SEQ ID NO: 547181 - DNA, 20 bp, mouse
ggccagcgatataggcttct

SEQ ID NO: 547182 - DNA, 20 bp, mouse
gatcagtacctcccagagtg

SEQ ID NO: 547183 - DNA, 20 bp, mouse
gggcaacactgccatcatct

SEQ ID NO: 547184 - DNA, 20 bp, mouse
gaccaatgctcctgaattcc

SEQ ID NO: 547185 - DNA, 20 bp, mouse
gacccagaagcctatatcgc

SEQ ID NO: 547186 - DNA, 20 bp, mouse
gctcagtagtctgtctgtct

SEQ ID NO: 547187 - DNA, 20 bp, mouse
gtgttcttctttgtaactct

SEQ ID NO: 547188 - DNA, 20 bp, mouse
gatgctttctaacatctttg

SEQ ID NO: 547189 - DNA, 20 bp, mouse
gccagatggtgatgggctct

SEQ ID NO: 547190 - DNA, 20 bp, mouse
ggagaagagcctggaattca

SEQ ID NO: 547191 - DNA, 20 bp, mouse
ggtctgtcctcaatcagtct

SEQ ID NO: 547192 - DNA, 20 bp, mouse
gagtggtcccagactgattg

SEQ ID NO: 547193 - DNA, 20 bp, mouse
ggaggctgtagtgtagaggg

SEQ ID NO: 547194 - DNA, 20 bp, mouse
gcacactagacatgctgact

SEQ ID NO: 547195 - DNA, 20 bp, mouse
gggtaatgcagccatcatct

SEQ ID NO: 547196 - DNA, 20 bp, mouse
gcacggaacacgaactctgg

SEQ ID NO: 547197 - DNA, 20 bp, mouse
gcatataagccatcaatcat

SEQ ID NO: 547198 - DNA, 20 bp, mouse
gcggaacattggttaagaca

SEQ ID NO: 547199 - DNA, 20 bp, mouse
ggaccagatttgttgaagaa

SEQ ID NO: 547200 - DNA, 20 bp, mouse
gcacaccacccagataatgg

SEQ ID NO: 547201 - DNA, 20 bp, mouse
gggcaataccaccattatct

SEQ ID NO: 547202 - DNA, 20 bp, mouse
ggaggatcatcaagtagaga

SEQ ID NO: 547203 - DNA, 20 bp, mouse
gcacaaatgacagactgccc

SEQ ID NO: 547204 - DNA, 20 bp, mouse
gaagatgttggaaagaatca

SEQ ID NO: 547205 - DNA, 20 bp, mouse
gaaaaaaagccaatgattga

SEQ ID NO: 547206 - DNA, 20 bp, mouse
gaaaaagtaatactattcag

SEQ ID NO: 547207 - DNA, 20 bp, mouse
gagcctggttggagagaccc

SEQ ID NO: 547208 - DNA, 20 bp, mouse
gctgcagattagaatgaata

SEQ ID NO: 547209 - DNA, 20 bp, mouse
gttagggactgaagtcgaag

SEQ ID NO: 547210 - DNA, 20 bp, mouse
gctcctgggtctctccaacc

SEQ ID NO: 547211 - DNA, 20 bp, mouse
gagatgtatatccaaaccaa

SEQ ID NO: 547212 - DNA, 20 bp, mouse
gtgtgtaatgcagccctcat

SEQ ID NO: 547213 - DNA, 20 bp, mouse
gaggataaattcagagatgc

SEQ ID NO: 547214 - DNA, 20 bp, mouse
ggggactgaagtcgaagagg

SEQ ID NO: 547215 - DNA, 20 bp, mouse
gagcaaaagataggttggca

SEQ ID NO: 547216 - DNA, 20 bp, mouse
gcagcacagccagcatctga

SEQ ID NO: 547217 - DNA, 20 bp, mouse
gaggtaaacttctagatgga

SEQ ID NO: 547218 - DNA, 20 bp, mouse
gattcactgaacatcctgag

SEQ ID NO: 547219 - DNA, 20 bp, mouse
gaacttctagatggatggct

SEQ ID NO: 547220 - DNA, 20 bp, mouse
gttctagatggatggctggg

SEQ ID NO: 547221 - DNA, 20 bp, mouse
gagaaagaactcagtcacga

SEQ ID NO: 547222 - DNA, 20 bp, mouse
gctaccctgctggggaatac

SEQ ID NO: 547223 - DNA, 20 bp, mouse
gattccccagcagggtagcg

SEQ ID NO: 547224 - DNA, 20 bp, mouse
gctggtaactggggcatatg

SEQ ID NO: 547225 - DNA, 20 bp, mouse
gtctagaagtttacctgtga

SEQ ID NO: 547226 - DNA, 20 bp, mouse
gcaacacagagagatgactc

SEQ ID NO: 547227 - DNA, 20 bp, mouse
ggaattcagttactgttgtg

SEQ ID NO: 547228 - DNA, 20 bp, mouse
gaaatagtcgatactgaata

SEQ ID NO: 547229 - DNA, 20 bp, mouse
gccagcatggccaggatctg

SEQ ID NO: 547230 - DNA, 20 bp, mouse
gctgaagctggacatccatc

SEQ ID NO: 547231 - DNA, 20 bp, mouse
gtgggcagcacaatgattat

SEQ ID NO: 547232 - DNA, 20 bp, mouse
gatgcccaagttccctagga

SEQ ID NO: 547233 - DNA, 20 bp, mouse
gaaagaggaacctcccactc

SEQ ID NO: 547234 - DNA, 20 bp, mouse
ggtgatgacactggtgtagc

SEQ ID NO: 547235 - DNA, 20 bp, mouse
gagtacagaatgtttcctgt

SEQ ID NO: 547236 - DNA, 20 bp, mouse
gggacagcaacagctcctct

SEQ ID NO: 547237 - DNA, 20 bp, mouse
gaggcagccggtgatggagg

SEQ ID NO: 547238 - DNA, 20 bp, mouse
gatcagaatgaagctcccag

SEQ ID NO: 547239 - DNA, 20 bp, mouse
gagcagccagcccccagcag

SEQ ID NO: 547240 - DNA, 20 bp, mouse
ggggactgaactggtagtaa

SEQ ID NO: 547241 - DNA, 20 bp, mouse
ggtaaaggcaaggtctagag

SEQ ID NO: 547242 - DNA, 20 bp, mouse
gtgctgtccacctccatcac

SEQ ID NO: 547243 - DNA, 20 bp, mouse
ggtctctgaccatccccatc

SEQ ID NO: 547244 - DNA, 20 bp, mouse
gagcatctgagggactgaac

SEQ ID NO: 547245 - DNA, 20 bp, mouse
gcgtcaacaagtaagaggcc

SEQ ID NO: 547246 - DNA, 20 bp, mouse
ggactgagttcatcatctct

SEQ ID NO: 547247 - DNA, 20 bp, mouse
gattttaggggtgattattg

SEQ ID NO: 547248 - DNA, 20 bp, mouse
gaaaaatgtcatctcctatc

SEQ ID NO: 547249 - DNA, 20 bp, mouse
gtagaactctcaggaagaaa

SEQ ID NO: 547250 - DNA, 20 bp, mouse
gatgatgaactcagtcactc

SEQ ID NO: 547251 - DNA, 20 bp, mouse
ggattattgtggagtagcag

SEQ ID NO: 547252 - DNA, 20 bp, mouse
gactttctgcatgctaagag

SEQ ID NO: 547253 - DNA, 20 bp, mouse
gtatatggcatgggcttcat

SEQ ID NO: 547254 - DNA, 20 bp, mouse
gtaccatccaggaacagact

SEQ ID NO: 547255 - DNA, 20 bp, mouse
gtgagtcatacattcctgat

SEQ ID NO: 547256 - DNA, 20 bp, mouse
ggctaaggtgaatctcactt

SEQ ID NO: 547257 - DNA, 20 bp, mouse
gctcagtgaatgctatgagg

SEQ ID NO: 547258 - DNA, 20 bp, mouse
gcactgagcatcctgaatgg

SEQ ID NO: 547259 - DNA, 20 bp, mouse
gttgctctcttaagtaccac

SEQ ID NO: 547260 - DNA, 20 bp, mouse
ggtcactgttcctcagacaa

SEQ ID NO: 547261 - DNA, 20 bp, mouse
ggtggagcctgcgatccatg

SEQ ID NO: 547262 - DNA, 20 bp, mouse
gtcactttgctagggaactc

SEQ ID NO: 547263 - DNA, 20 bp, mouse
gaaagagggagcccccattc

SEQ ID NO: 547264 - DNA, 20 bp, mouse
gctatctcttcactttgcta

SEQ ID NO: 547265 - DNA, 20 bp, mouse
gggctgtgctgttggagcat

SEQ ID NO: 547266 - DNA, 20 bp, mouse
gtcaggtgaatttggcttta

SEQ ID NO: 547267 - DNA, 20 bp, mouse
gaccatcttattactcccca

SEQ ID NO: 547268 - DNA, 20 bp, mouse
gtgtcatggccatcgcataa

SEQ ID NO: 547269 - DNA, 20 bp, mouse
gggccatcgcataaaggagc

SEQ ID NO: 547270 - DNA, 20 bp, mouse
gtggttgctgcagcatattc

SEQ ID NO: 547271 - DNA, 20 bp, mouse
gaacccgctcctttatgcga

SEQ ID NO: 547272 - DNA, 20 bp, mouse
gtcagctgctggagaccttg

SEQ ID NO: 547273 - DNA, 20 bp, mouse
ggacaccacagactcgtctg

SEQ ID NO: 547274 - DNA, 20 bp, mouse
gggtgcaatggtaaatactg

SEQ ID NO: 547275 - DNA, 20 bp, mouse
gccagccccagacgagtctg

SEQ ID NO: 547276 - DNA, 20 bp, mouse
ggtggtcattaaagcctatt

SEQ ID NO: 547277 - DNA, 20 bp, mouse
gtgggcagcacaacatctat

SEQ ID NO: 547278 - DNA, 20 bp, mouse
gatatatctgtggagtgtgt

SEQ ID NO: 547279 - DNA, 20 bp, mouse
gcatgggccctagaaaatgt

SEQ ID NO: 547280 - DNA, 20 bp, mouse
gtagtaggagcatatatctg

SEQ ID NO: 547281 - DNA, 20 bp, mouse
gaatgttggagtttagtagt

SEQ ID NO: 547282 - DNA, 20 bp, mouse
ggtgcatgtggtacgcagaa

SEQ ID NO: 547283 - DNA, 20 bp, mouse
gtaaactccaacattttcta

SEQ ID NO: 547284 - DNA, 20 bp, mouse
gtaagaaataccagcaatag

SEQ ID NO: 547285 - DNA, 20 bp, mouse
gtgggagattccactattgc

SEQ ID NO: 547286 - DNA, 20 bp, mouse
gcacagctgctggagatctt

SEQ ID NO: 547287 - DNA, 20 bp, mouse
gtcaggtgatcttggcttta

SEQ ID NO: 547288 - DNA, 20 bp, mouse
gttattttctcaggtgatct

SEQ ID NO: 547289 - DNA, 20 bp, mouse
gaaccccctcctttatgcca

SEQ ID NO: 547290 - DNA, 20 bp, mouse
gcttcaggcagagctacagt

SEQ ID NO: 547291 - DNA, 20 bp, mouse
gggccatggcataaaggagg

SEQ ID NO: 547292 - DNA, 20 bp, mouse
gcactcagtactagcataaa

SEQ ID NO: 547293 - DNA, 20 bp, mouse
gattcccaggtttccagcaa

SEQ ID NO: 547294 - DNA, 20 bp, mouse
gatcttggggaataataaga

SEQ ID NO: 547295 - DNA, 20 bp, mouse
gtttatctcatcaccattgc

SEQ ID NO: 547296 - DNA, 20 bp, mouse
gtgggcagcacaacgtccat

SEQ ID NO: 547297 - DNA, 20 bp, mouse
ggtaaaacagtcgtttccta

SEQ ID NO: 547298 - DNA, 20 bp, mouse
gatagtcgttttccttatga

SEQ ID NO: 547299 - DNA, 20 bp, mouse
gtcaccatgctgggaaactt

SEQ ID NO: 547300 - DNA, 20 bp, mouse
ggtaaagaaaccacaactga

SEQ ID NO: 547301 - DNA, 20 bp, mouse
gtaacggaattcattctaat

SEQ ID NO: 547302 - DNA, 20 bp, mouse
gatatttaatttccatcata

SEQ ID NO: 547303 - DNA, 20 bp, mouse
gtgggagattccactatttc

SEQ ID NO: 547304 - DNA, 20 bp, mouse
gaataacattaccacagtaa

SEQ ID NO: 547305 - DNA, 20 bp, mouse
gactgtggtaatgttattct

SEQ ID NO: 547306 - DNA, 20 bp, mouse
gtctaattcacgagaaggtg

SEQ ID NO: 547307 - DNA, 20 bp, mouse
gaggccacttatggaccccg

SEQ ID NO: 547308 - DNA, 20 bp, mouse
gctcgcatttccaagtccat

SEQ ID NO: 547309 - DNA, 20 bp, mouse
ggctgcaaagctcacaccag

SEQ ID NO: 547310 - DNA, 20 bp, mouse
gtacgcggaactacagacta

SEQ ID NO: 547311 - DNA, 20 bp, mouse
gttatttctaattcacgaga

SEQ ID NO: 547312 - DNA, 20 bp, mouse
gtggttccacagagttgtct

SEQ ID NO: 547313 - DNA, 20 bp, mouse
gacagacccagacaactctg

SEQ ID NO: 547314 - DNA, 20 bp, mouse
gtctgtactagactttgggt

SEQ ID NO: 547315 - DNA, 20 bp, mouse
ggggaagtcatcatgagcca

SEQ ID NO: 547316 - DNA, 20 bp, mouse
gttgtcgtgtcagggcagag

SEQ ID NO: 547317 - DNA, 20 bp, mouse
ggagcctgcttgtcgtgtca

SEQ ID NO: 547318 - DNA, 20 bp, mouse
gttcagacccagcgatgagg

SEQ ID NO: 547319 - DNA, 20 bp, mouse
ggggtcttgttgcacacttt

SEQ ID NO: 547320 - DNA, 20 bp, mouse
gactggtacagctctgaaac

SEQ ID NO: 547321 - DNA, 20 bp, mouse
gaagagatgaatgtcgcatc

SEQ ID NO: 547322 - DNA, 20 bp, mouse
gtatttgcatagtgagacaa

SEQ ID NO: 547323 - DNA, 20 bp, mouse
gggaatccctcctcatcgct

SEQ ID NO: 547324 - DNA, 20 bp, mouse
gagactgaagttgtgcgaca

SEQ ID NO: 547325 - DNA, 20 bp, mouse
gcacgacaagcaggctctcc

SEQ ID NO: 547326 - DNA, 20 bp, mouse
gaagagatgaatatcacatc

SEQ ID NO: 547327 - DNA, 20 bp, mouse
ggcagtaagggttcctagga

SEQ ID NO: 547328 - DNA, 20 bp, mouse
ggagctgtaaaagtttatca

SEQ ID NO: 547329 - DNA, 20 bp, mouse
ggactgaaattatgggacaa

SEQ ID NO: 547330 - DNA, 20 bp, mouse
gtattggcatagtgagaaga

SEQ ID NO: 547331 - DNA, 20 bp, mouse
ggctcacagctactcatcct

SEQ ID NO: 547332 - DNA, 20 bp, mouse
gggctcttgttgcacatttt

SEQ ID NO: 547333 - DNA, 20 bp, mouse
gtccagctgactgaaattat

SEQ ID NO: 547334 - DNA, 20 bp, mouse
gaatgtgcaacaagagcctt

SEQ ID NO: 547335 - DNA, 20 bp, mouse
ggatttctcaccttctccat

SEQ ID NO: 547336 - DNA, 20 bp, mouse
ggagcgttccggaggatctg

SEQ ID NO: 547337 - DNA, 20 bp, mouse
gtccggaacgctcattagat

SEQ ID NO: 547338 - DNA, 20 bp, mouse
gctgggcctcactgacaact

SEQ ID NO: 547339 - DNA, 20 bp, mouse
gccggaggatctggggatgg

SEQ ID NO: 547340 - DNA, 20 bp, mouse
gagacgtggcgtgaagacta

SEQ ID NO: 547341 - DNA, 20 bp, mouse
gacatgggattgtggagacg

SEQ ID NO: 547342 - DNA, 20 bp, mouse
gccctcaagcatcttgggca

SEQ ID NO: 547343 - DNA, 20 bp, mouse
gtcccatctaatgagcgttc

SEQ ID NO: 547344 - DNA, 20 bp, mouse
ggactatggtaacaacaatg

SEQ ID NO: 547345 - DNA, 20 bp, mouse
gtcacattggagtaatgcaa

SEQ ID NO: 547346 - DNA, 20 bp, mouse
ggaaccatgaagttagacaa

SEQ ID NO: 547347 - DNA, 20 bp, mouse
gtttcccttgtctaacttca

SEQ ID NO: 547348 - DNA, 20 bp, mouse
ggcgtccagcgatgtgtttc

SEQ ID NO: 547349 - DNA, 20 bp, mouse
gccagcaaggctatcccatt

SEQ ID NO: 547350 - DNA, 20 bp, mouse
ggagctgcacaaccaccaaa

SEQ ID NO: 547351 - DNA, 20 bp, mouse
gtgaagtttaaaataagtcg

SEQ ID NO: 547352 - DNA, 20 bp, mouse
gtgcagagagggaggaggta

SEQ ID NO: 547353 - DNA, 20 bp, mouse
ggacaagggaaatgcagaga

SEQ ID NO: 547354 - DNA, 20 bp, mouse
gaagggaaatgcagagaggg

SEQ ID NO: 547355 - DNA, 20 bp, mouse
gaacacatcgctggacgctg

SEQ ID NO: 547356 - DNA, 20 bp, mouse
gaagttgtgcacaattctag

SEQ ID NO: 547357 - DNA, 20 bp, mouse
gtgaagtttaatataatccg

SEQ ID NO: 547358 - DNA, 20 bp, mouse
gaatgcgataaccttgctgg

SEQ ID NO: 547359 - DNA, 20 bp, mouse
gccaaatgcgataaccttgc

SEQ ID NO: 547360 - DNA, 20 bp, mouse
gtgtgcacaattctagtggc

SEQ ID NO: 547361 - DNA, 20 bp, mouse
ggcttgaatagacccatgga

SEQ ID NO: 547362 - DNA, 20 bp, mouse
gagtagcttgaatagaccca

SEQ ID NO: 547363 - DNA, 20 bp, mouse
gggtggctggctccatccat

SEQ ID NO: 547364 - DNA, 20 bp, mouse
gctcctcagtcattgttcct

SEQ ID NO: 547365 - DNA, 20 bp, mouse
gaattctagtggctggagct

SEQ ID NO: 547366 - DNA, 20 bp, mouse
ggtggtgtataggaaacact

SEQ ID NO: 547367 - DNA, 20 bp, mouse
gaagttgagtatcttgctgg

SEQ ID NO: 547368 - DNA, 20 bp, mouse
gataggccatagtggtgtat

SEQ ID NO: 547369 - DNA, 20 bp, mouse
gtgtttcctatacaccacta

SEQ ID NO: 547370 - DNA, 20 bp, mouse
ggctaagttgagtatcttgc

SEQ ID NO: 547371 - DNA, 20 bp, mouse
gctgggaacttcccagaaag

SEQ ID NO: 547372 - DNA, 20 bp, mouse
gacaggaatgtcctcagcct

SEQ ID NO: 547373 - DNA, 20 bp, mouse
ggggtggctggctcaatcca

SEQ ID NO: 547374 - DNA, 20 bp, mouse
gatcccatttgggggatgtg

SEQ ID NO: 547375 - DNA, 20 bp, mouse
ggatgtacatggggcgcgca

SEQ ID NO: 547376 - DNA, 20 bp, mouse
gcaagctccagccacgagca

SEQ ID NO: 547377 - DNA, 20 bp, mouse
gtgttatctctacaccacta

SEQ ID NO: 547378 - DNA, 20 bp, mouse
gtgagtaccttgctcgtggc

SEQ ID NO: 547379 - DNA, 20 bp, mouse
gtacagtactgcccagaaag

SEQ ID NO: 547380 - DNA, 20 bp, mouse
gaagttgagtaccttgctcg

SEQ ID NO: 547381 - DNA, 20 bp, mouse
ggaatgtcctcagcccggga

SEQ ID NO: 547382 - DNA, 20 bp, mouse
gcccccaccctcccgggctg

SEQ ID NO: 547383 - DNA, 20 bp, mouse
ggggtggctggcttaatcca

SEQ ID NO: 547384 - DNA, 20 bp, mouse
gagctgcgtgtcggtgcaga

SEQ ID NO: 547385 - DNA, 20 bp, mouse
ggatgtacatggggcgagca

SEQ ID NO: 547386 - DNA, 20 bp, mouse
gacaagtggaaactacacct

SEQ ID NO: 547387 - DNA, 20 bp, mouse
gaatcctaacaggataaatt

SEQ ID NO: 547388 - DNA, 20 bp, mouse
gcctgttaggatttccaaca

SEQ ID NO: 547389 - DNA, 20 bp, mouse
gaatgactgaggaataacaa

SEQ ID NO: 547390 - DNA, 20 bp, mouse
gtttggagttcaggccgtgt

SEQ ID NO: 547391 - DNA, 20 bp, mouse
gatgttgggaacaatgactg

SEQ ID NO: 547392 - DNA, 20 bp, mouse
gaggataaattcggtgacca

SEQ ID NO: 547393 - DNA, 20 bp, mouse
gtgatcatggaatttacaag

SEQ ID NO: 547394 - DNA, 20 bp, mouse
gtcaccgaatttatcctgtt

SEQ ID NO: 547395 - DNA, 20 bp, mouse
ggccatagcagccaagataa

SEQ ID NO: 547396 - DNA, 20 bp, mouse
gagtcctggacctctaatgg

SEQ ID NO: 547397 - DNA, 20 bp, mouse
gtaaagtcctggacctctaa

SEQ ID NO: 547398 - DNA, 20 bp, mouse
gaacaaaatgaccaatatct

SEQ ID NO: 547399 - DNA, 20 bp, mouse
gtatccaccattagaggtcc

SEQ ID NO: 547400 - DNA, 20 bp, mouse
gtgaaactatccaccattag

SEQ ID NO: 547401 - DNA, 20 bp, mouse
ggagaatatgtataaagtcc

SEQ ID NO: 547402 - DNA, 20 bp, mouse
gaatatttttacttatagac

SEQ ID NO: 547403 - DNA, 20 bp, mouse
gtatcaacagtgtatttgtg

SEQ ID NO: 547404 - DNA, 20 bp, mouse
gtggaagaaagaatgaatat

SEQ ID NO: 547405 - DNA, 20 bp, mouse
gattttgttactgaaaaaaa

SEQ ID NO: 547406 - DNA, 20 bp, mouse
gggatgctccacacagatag

SEQ ID NO: 547407 - DNA, 20 bp, mouse
gtagtggtgttgcttctggt

SEQ ID NO: 547408 - DNA, 20 bp, mouse
ggtgaatgtggtatccacca

SEQ ID NO: 547409 - DNA, 20 bp, mouse
gagcaacaccactatctgtg

SEQ ID NO: 547410 - DNA, 20 bp, mouse
gcagatagtggtgttgcttc

SEQ ID NO: 547411 - DNA, 20 bp, mouse
gtgtctgtgggtcctgtgag

SEQ ID NO: 547412 - DNA, 20 bp, mouse
gagtgagcaggtagatgaag

SEQ ID NO: 547413 - DNA, 20 bp, mouse
gatcttcctgggcctctcac

SEQ ID NO: 547414 - DNA, 20 bp, mouse
gtgggtcctgtgagaggccc

SEQ ID NO: 547415 - DNA, 20 bp, mouse
gggaagtggacaagcacctg

SEQ ID NO: 547416 - DNA, 20 bp, mouse
gctgcaatgaacagagctaa

SEQ ID NO: 547417 - DNA, 20 bp, mouse
gttcattgcagtctacctgt

SEQ ID NO: 547418 - DNA, 20 bp, mouse
gcccagggcaatgaagagtt

SEQ ID NO: 547419 - DNA, 20 bp, mouse
gtaccatgtagtggagtggt

SEQ ID NO: 547420 - DNA, 20 bp, mouse
gtctactcccccaagtccca

SEQ ID NO: 547421 - DNA, 20 bp, mouse
gaggacaagaccatcactta

SEQ ID NO: 547422 - DNA, 20 bp, mouse
ggtgcatgattaccatgtag

SEQ ID NO: 547423 - DNA, 20 bp, mouse
ggacgctgtttaacttcaag

SEQ ID NO: 547424 - DNA, 20 bp, mouse
gtgccgaccactccactaca

SEQ ID NO: 547425 - DNA, 20 bp, mouse
gttctccaacagacctcagc

SEQ ID NO: 547426 - DNA, 20 bp, mouse
gtctgttcatcctttaacac

SEQ ID NO: 547427 - DNA, 20 bp, mouse
gtctatctgatcaccatggc

SEQ ID NO: 547428 - DNA, 20 bp, mouse
ggtcctccattcaaatctaa

SEQ ID NO: 547429 - DNA, 20 bp, mouse
gctcctttagatttgaatgg

SEQ ID NO: 547430 - DNA, 20 bp, mouse
gctctgcaataccaaaagtg

SEQ ID NO: 547431 - DNA, 20 bp, mouse
gtctacttcttcctcacttt

SEQ ID NO: 547432 - DNA, 20 bp, mouse
gctgtgaagagcaggaagag

SEQ ID NO: 547433 - DNA, 20 bp, mouse
gtttctcctttagatttgaa

SEQ ID NO: 547434 - DNA, 20 bp, mouse
gatagattcctgtgaagagc

SEQ ID NO: 547435 - DNA, 20 bp, mouse
ggaactcagtcactgtgcag

SEQ ID NO: 547436 - DNA, 20 bp, mouse
gataggctttgtaagcacta

SEQ ID NO: 547437 - DNA, 20 bp, mouse
gtgtcaggaagaggacaatt

SEQ ID NO: 547438 - DNA, 20 bp, mouse
gatttggagatggaaggagg

SEQ ID NO: 547439 - DNA, 20 bp, mouse
ggaggagcaggcatccacaa

SEQ ID NO: 547440 - DNA, 20 bp, mouse
gtcataacaggttgatccac

SEQ ID NO: 547441 - DNA, 20 bp, mouse
gacaatttggagatggaagg

SEQ ID NO: 547442 - DNA, 20 bp, mouse
gataaacacagagaaatgtc

SEQ ID NO: 547443 - DNA, 20 bp, mouse
ggatgtggagtcgagtgtcc

SEQ ID NO: 547444 - DNA, 20 bp, mouse
gacatgtcagacaacatctt

SEQ ID NO: 547445 - DNA, 20 bp, mouse
gtgatgagagtatacagcaa

SEQ ID NO: 547446 - DNA, 20 bp, mouse
gatgagaccgcccccctgtc

SEQ ID NO: 547447 - DNA, 20 bp, mouse
ggagaatgaagccggacagg

SEQ ID NO: 547448 - DNA, 20 bp, mouse
gcaggagaatgaagccggac

SEQ ID NO: 547449 - DNA, 20 bp, mouse
gatgaagccggacagggggg

SEQ ID NO: 547450 - DNA, 20 bp, mouse
ggtctcattggatctgtcca

SEQ ID NO: 547451 - DNA, 20 bp, mouse
gcccatggctgccagttcct

SEQ ID NO: 547452 - DNA, 20 bp, mouse
ggatctgtccatggtacatt

SEQ ID NO: 547453 - DNA, 20 bp, mouse
gtttcaaaccgaatgtacca

SEQ ID NO: 547454 - DNA, 20 bp, mouse
gttagtgataccacctgccc

SEQ ID NO: 547455 - DNA, 20 bp, mouse
gataccacctgcccaggaac

SEQ ID NO: 547456 - DNA, 20 bp, mouse
ggttgcaccctgagtacggg

SEQ ID NO: 547457 - DNA, 20 bp, mouse
gcaggttgcaccctgagtac

SEQ ID NO: 547458 - DNA, 20 bp, mouse
gcagaacgtgtgactcccaa

SEQ ID NO: 547459 - DNA, 20 bp, mouse
ggtgtgactcccaaagggtc

SEQ ID NO: 547460 - DNA, 20 bp, mouse
gctcagggtgcaacctgcaa

SEQ ID NO: 547461 - DNA, 20 bp, mouse
ggtgcttgtatcagaaacag

SEQ ID NO: 547462 - DNA, 20 bp, mouse
gaggtccagcctgacccttt

SEQ ID NO: 547463 - DNA, 20 bp, mouse
ggtacggggggcaggtgctg

SEQ ID NO: 547464 - DNA, 20 bp, mouse
gcacctgccccccgtactca

SEQ ID NO: 547465 - DNA, 20 bp, mouse
ggactcccaaagggtcaggc

SEQ ID NO: 547466 - DNA, 20 bp, mouse
gtcccgtcttgagagagcag

SEQ ID NO: 547467 - DNA, 20 bp, mouse
ggaaggagccaatcagtcta

SEQ ID NO: 547468 - DNA, 20 bp, mouse
gtcagctaccgtagactgat

SEQ ID NO: 547469 - DNA, 20 bp, mouse
gtccaggactaagggaatcg

SEQ ID NO: 547470 - DNA, 20 bp, mouse
ggggaagagaacatgcgaaa

SEQ ID NO: 547471 - DNA, 20 bp, mouse
gagagaacatgcgaaatgga

SEQ ID NO: 547472 - DNA, 20 bp, mouse
gcaggatcaggatgtgggca

SEQ ID NO: 547473 - DNA, 20 bp, mouse
ggctcatcaggatcaggatg

SEQ ID NO: 547474 - DNA, 20 bp, mouse
gaggactaagggaatcgagg

SEQ ID NO: 547475 - DNA, 20 bp, mouse
gcagcaagcacttgctcatc

SEQ ID NO: 547476 - DNA, 20 bp, mouse
gactaagggaacggaggagg

SEQ ID NO: 547477 - DNA, 20 bp, mouse
gtcaaggactaagggaacgg

SEQ ID NO: 547478 - DNA, 20 bp, mouse
gctttcagtattcctaggaa

SEQ ID NO: 547479 - DNA, 20 bp, mouse
gctctccgcccaccccaaac

SEQ ID NO: 547480 - DNA, 20 bp, mouse
gtctgttacagtcgtctggt

SEQ ID NO: 547481 - DNA, 20 bp, mouse
ggtgggcggagaggcccaac

SEQ ID NO: 547482 - DNA, 20 bp, mouse
gaggactaagggaacggagg

SEQ ID NO: 547483 - DNA, 20 bp, mouse
gaaattctgttacagtcgtc

SEQ ID NO: 547484 - DNA, 20 bp, mouse
gggttttctccagtttgggg

SEQ ID NO: 547485 - DNA, 20 bp, mouse
gaagaaggttttctccagtt

SEQ ID NO: 547486 - DNA, 20 bp, mouse
gatgaagctggacacagggg

SEQ ID NO: 547487 - DNA, 20 bp, mouse
gtgaaacataggaggaaaca

SEQ ID NO: 547488 - DNA, 20 bp, mouse
ggacacaggggtggtcttgt

SEQ ID NO: 547489 - DNA, 20 bp, mouse
gcccatggccgccggctcct

SEQ ID NO: 547490 - DNA, 20 bp, mouse
ggctaaagatatctgcactg

SEQ ID NO: 547491 - DNA, 20 bp, mouse
ggatggtcttcctgggggtc

SEQ ID NO: 547492 - DNA, 20 bp, mouse
ggaggacgacattgcccagc

SEQ ID NO: 547493 - DNA, 20 bp, mouse
gccagatacccaggagccgg

SEQ ID NO: 547494 - DNA, 20 bp, mouse
ggtgatgcttccagataccc

SEQ ID NO: 547495 - DNA, 20 bp, mouse
ggtgggcggagagacccagg

SEQ ID NO: 547496 - DNA, 20 bp, mouse
gcaggctggaaagcatccgt

SEQ ID NO: 547497 - DNA, 20 bp, mouse
gcgcagcctgccaaggatat

SEQ ID NO: 547498 - DNA, 20 bp, mouse
gttctatgggtgtctaaaag

SEQ ID NO: 547499 - DNA, 20 bp, mouse
gtgatagagttcgtcttcct

SEQ ID NO: 547500 - DNA, 20 bp, mouse
ggttaggaaaaccacaaaga

SEQ ID NO: 547501 - DNA, 20 bp, mouse
gtcctgggattctccagctt

SEQ ID NO: 547502 - DNA, 20 bp, mouse
ggtgagcagaaagcagttgt

SEQ ID NO: 547503 - DNA, 20 bp, mouse
gcacactggtcattgtccca

SEQ ID NO: 547504 - DNA, 20 bp, mouse
gtacaaccttcccatatcct

SEQ ID NO: 547505 - DNA, 20 bp, mouse
ggccagagttaaaatgtaga

SEQ ID NO: 547506 - DNA, 20 bp, mouse
gccaggaagaggagcaagag

SEQ ID NO: 547507 - DNA, 20 bp, mouse
ggcttcccacccagatacaa

SEQ ID NO: 547508 - DNA, 20 bp, mouse
gtctatgccatgggactcat

SEQ ID NO: 547509 - DNA, 20 bp, mouse
gtatgtagatccccaggaag

SEQ ID NO: 547510 - DNA, 20 bp, mouse
gctctgcagccattgtatct

SEQ ID NO: 547511 - DNA, 20 bp, mouse
gggtgattatgtagatcccc

SEQ ID NO: 547512 - DNA, 20 bp, mouse
ggtggtttttgtctatgcca

SEQ ID NO: 547513 - DNA, 20 bp, mouse
gcctcagagggctaactaac

SEQ ID NO: 547514 - DNA, 20 bp, mouse
gcacgagtgacaggttactg

SEQ ID NO: 547515 - DNA, 20 bp, mouse
ggacagagtttatcctcaga

SEQ ID NO: 547516 - DNA, 20 bp, mouse
gctgcctggagagtcccaga

SEQ ID NO: 547517 - DNA, 20 bp, mouse
gagctgggctaaaaatctat

SEQ ID NO: 547518 - DNA, 20 bp, mouse
gagtaccttagggacagtgg

SEQ ID NO: 547519 - DNA, 20 bp, mouse
gtcagagacactggactggt

SEQ ID NO: 547520 - DNA, 20 bp, mouse
gtgggctaaaaatctatggg

SEQ ID NO: 547521 - DNA, 20 bp, mouse
gaggcacccagagaacgaaa

SEQ ID NO: 547522 - DNA, 20 bp, mouse
gcaggacccaacaacaagaa

SEQ ID NO: 547523 - DNA, 20 bp, mouse
ggtctctgagttcctccttc

SEQ ID NO: 547524 - DNA, 20 bp, mouse
gagaaaggcacaaagctgat

SEQ ID NO: 547525 - DNA, 20 bp, mouse
gcttgttgttgggtcctgga

SEQ ID NO: 547526 - DNA, 20 bp, mouse
ggaaatattagacatttata

SEQ ID NO: 547527 - DNA, 20 bp, mouse
gacactgtgtcattctagct

SEQ ID NO: 547528 - DNA, 20 bp, mouse
ggaacatgctcatgatacaa

SEQ ID NO: 547529 - DNA, 20 bp, mouse
ggaagaagatacccagaatt

SEQ ID NO: 547530 - DNA, 20 bp, mouse
gtgttttttgttggccgcaa

SEQ ID NO: 547531 - DNA, 20 bp, mouse
gtggattccacagccaacca

SEQ ID NO: 547532 - DNA, 20 bp, mouse
gtataagaagaatctttcat

SEQ ID NO: 547533 - DNA, 20 bp, mouse
gttcataggaaattctatca

SEQ ID NO: 547534 - DNA, 20 bp, mouse
gttttcttttccctaattct

SEQ ID NO: 547535 - DNA, 20 bp, mouse
gtgtgtcattctagcttgga

SEQ ID NO: 547536 - DNA, 20 bp, mouse
ggaacatactgatgatgcaa

SEQ ID NO: 547537 - DNA, 20 bp, mouse
gggtgtggagttgggcatcc

SEQ ID NO: 547538 - DNA, 20 bp, mouse
gctcataggaaattctgtca

SEQ ID NO: 547539 - DNA, 20 bp, mouse
gggccatgaagaagatagcc

SEQ ID NO: 547540 - DNA, 20 bp, mouse
ggagaatagggtaccttaat

SEQ ID NO: 547541 - DNA, 20 bp, mouse
gtttgtgactcatgagaata

SEQ ID NO: 547542 - DNA, 20 bp, mouse
gtttttcttttctctcatcc

SEQ ID NO: 547543 - DNA, 20 bp, mouse
gatcatcagtatgttcactg

SEQ ID NO: 547544 - DNA, 20 bp, mouse
gtggctgagaaggatataca

SEQ ID NO: 547545 - DNA, 20 bp, mouse
gaaggccgtttggggtactg

SEQ ID NO: 547546 - DNA, 20 bp, mouse
gctcagaacatgccatagtc

SEQ ID NO: 547547 - DNA, 20 bp, mouse
gcaaaagtagcaggcctgtt

SEQ ID NO: 547548 - DNA, 20 bp, mouse
ggatgagcatcaaaagtagc

SEQ ID NO: 547549 - DNA, 20 bp, mouse
ggccatagtcaggaagaaga

SEQ ID NO: 547550 - DNA, 20 bp, mouse
gatacatttaaatggagaaa

SEQ ID NO: 547551 - DNA, 20 bp, mouse
gtcttctctctggctttgtg

SEQ ID NO: 547552 - DNA, 20 bp, mouse
gtccttcttcttcctgacta

SEQ ID NO: 547553 - DNA, 20 bp, mouse
gcaagtgattttactctgtt

SEQ ID NO: 547554 - DNA, 20 bp, mouse
gatcatctttgtcttctctc

SEQ ID NO: 547555 - DNA, 20 bp, mouse
ggataagtgtatttgctttt

SEQ ID NO: 547556 - DNA, 20 bp, mouse
gtgttcccaccatcaaaaat

SEQ ID NO: 547557 - DNA, 20 bp, mouse
gggaacagacctatttttga

SEQ ID NO: 547558 - DNA, 20 bp, mouse
gtatgtgtggcatagtggag

SEQ ID NO: 547559 - DNA, 20 bp, mouse
ggatgaggaggatcatggac

SEQ ID NO: 547560 - DNA, 20 bp, mouse
gcagacctatttttgatggt

SEQ ID NO: 547561 - DNA, 20 bp, mouse
ggtatgagcacaggaattaa

SEQ ID NO: 547562 - DNA, 20 bp, mouse
ggataccattttagggacaa

SEQ ID NO: 547563 - DNA, 20 bp, mouse
gtgaaatccacacccaatga

SEQ ID NO: 547564 - DNA, 20 bp, mouse
gttgattataactatccatt

SEQ ID NO: 547565 - DNA, 20 bp, mouse
gtaaatacatctccttcatt

SEQ ID NO: 547566 - DNA, 20 bp, mouse
ggatgagcatcataagtagt

SEQ ID NO: 547567 - DNA, 20 bp, mouse
gcataagtagtaggccagtt

SEQ ID NO: 547568 - DNA, 20 bp, mouse
gcaagtgatttcattctctt

SEQ ID NO: 547569 - DNA, 20 bp, mouse
gtcttctttctggccttgtt

SEQ ID NO: 547570 - DNA, 20 bp, mouse
gatcatacttgtcttctttc

SEQ ID NO: 547571 - DNA, 20 bp, mouse
gaagccctcagaacctgcca

SEQ ID NO: 547572 - DNA, 20 bp, mouse
gggaatatgaagggcataga

SEQ ID NO: 547573 - DNA, 20 bp, mouse
gataaagaaatacattttca

SEQ ID NO: 547574 - DNA, 20 bp, mouse
gatacattttcatggagaaa

SEQ ID NO: 547575 - DNA, 20 bp, mouse
gttgaccatggcaggttctg

SEQ ID NO: 547576 - DNA, 20 bp, mouse
gcctgcagccaggagcctac

SEQ ID NO: 547577 - DNA, 20 bp, mouse
ggcaaaaactgtgtgtacta

SEQ ID NO: 547578 - DNA, 20 bp, mouse
ggatgagggataactccagt

SEQ ID NO: 547579 - DNA, 20 bp, mouse
ggaaggagagatgactaagc

SEQ ID NO: 547580 - DNA, 20 bp, mouse
gagaagagaacagtcccaag

SEQ ID NO: 547581 - DNA, 20 bp, mouse
gggacatggctgccaggaga

SEQ ID NO: 547582 - DNA, 20 bp, mouse
gaacagcgacttcatcctct

SEQ ID NO: 547583 - DNA, 20 bp, mouse
ggataactccagtaggctcc

SEQ ID NO: 547584 - DNA, 20 bp, mouse
gtgtgtgtactatggagttg

SEQ ID NO: 547585 - DNA, 20 bp, mouse
gatatttttcatttttatta

SEQ ID NO: 547586 - DNA, 20 bp, mouse
gggaaactggacaactgtca

SEQ ID NO: 547587 - DNA, 20 bp, mouse
ggggaacccggagaaccaag

SEQ ID NO: 547588 - DNA, 20 bp, mouse
gagcttgtcctatgaagtac

SEQ ID NO: 547589 - DNA, 20 bp, mouse
gtagctgggcacaggatctt

SEQ ID NO: 547590 - DNA, 20 bp, mouse
gcaagcttgagaagctcatg

SEQ ID NO: 547591 - DNA, 20 bp, mouse
gtcagagtactcaacatctt

SEQ ID NO: 547592 - DNA, 20 bp, mouse
gtaggtaaatgatcaaaaac

SEQ ID NO: 547593 - DNA, 20 bp, mouse
gtcttcggctcatgattatt

SEQ ID NO: 547594 - DNA, 20 bp, mouse
gacagtggctactgggaacc

SEQ ID NO: 547595 - DNA, 20 bp, mouse
gtcatgcaaaagaatgacct

SEQ ID NO: 547596 - DNA, 20 bp, mouse
gtttaacgacttcatcctct

SEQ ID NO: 547597 - DNA, 20 bp, mouse
gcagcacagggtagcaaagt

SEQ ID NO: 547598 - DNA, 20 bp, mouse
gagaagagaacagtcccaag

SEQ ID NO: 547599 - DNA, 20 bp, mouse
gtctttgcaggtaaaataga

SEQ ID NO: 547600 - DNA, 20 bp, mouse
gggacatggctgccaggaga

SEQ ID NO: 547601 - DNA, 20 bp, mouse
gtaacgaatgatctctttgc

SEQ ID NO: 547602 - DNA, 20 bp, mouse
gatatttttcatttttatta

SEQ ID NO: 547603 - DNA, 20 bp, mouse
gaaaatagaaggaaatatga

SEQ ID NO: 547604 - DNA, 20 bp, mouse
gcacagggtagcaaagtggg

SEQ ID NO: 547605 - DNA, 20 bp, mouse
gtggattaggaggatcatga

SEQ ID NO: 547606 - DNA, 20 bp, mouse
gagaggagaacagtcccaaa

SEQ ID NO: 547607 - DNA, 20 bp, mouse
ggttaagcttatctttgaag

SEQ ID NO: 547608 - DNA, 20 bp, mouse
ggtgtagtacaaaagctgtg

SEQ ID NO: 547609 - DNA, 20 bp, mouse
gacaaaagctgtgtggacta

SEQ ID NO: 547610 - DNA, 20 bp, mouse
gaacagcgacttcatccttt

SEQ ID NO: 547611 - DNA, 20 bp, mouse
ggataacttcagtgggctcc

SEQ ID NO: 547612 - DNA, 20 bp, mouse
gggacatgactgccaagaga

SEQ ID NO: 547613 - DNA, 20 bp, mouse
gtgatgagggataacttcag

SEQ ID NO: 547614 - DNA, 20 bp, mouse
ggaaggagagatgactgagc

SEQ ID NO: 547615 - DNA, 20 bp, mouse
gtgtgtggactatggagttg

SEQ ID NO: 547616 - DNA, 20 bp, mouse
gaatgagagctcaaaggtgt

SEQ ID NO: 547617 - DNA, 20 bp, mouse
gtgaaccaatgagagctcaa

SEQ ID NO: 547618 - DNA, 20 bp, mouse
ggagaatcaagaatgcttga

SEQ ID NO: 547619 - DNA, 20 bp, mouse
gatgatagggaatatgggct

SEQ ID NO: 547620 - DNA, 20 bp, mouse
ggagagctcaaaggtgttgg

SEQ ID NO: 547621 - DNA, 20 bp, mouse
gcagtctgcagtttcaacag

SEQ ID NO: 547622 - DNA, 20 bp, mouse
gcagagcttcttggacatca

SEQ ID NO: 547623 - DNA, 20 bp, mouse
gaaactcatgtttcattgtg

SEQ ID NO: 547624 - DNA, 20 bp, mouse
gattttaggggtaatagcat

SEQ ID NO: 547625 - DNA, 20 bp, mouse
gaacatgagtttatcctcac

SEQ ID NO: 547626 - DNA, 20 bp, mouse
gctctgaaaataaaaagttg

SEQ ID NO: 547627 - DNA, 20 bp, mouse
gtaagctttctttggttcaa

SEQ ID NO: 547628 - DNA, 20 bp, mouse
ggtgtgaagagaacgttctt

SEQ ID NO: 547629 - DNA, 20 bp, mouse
gaacatttttaagctttctt

SEQ ID NO: 547630 - DNA, 20 bp, mouse
gatgatagggaatatgggtc

SEQ ID NO: 547631 - DNA, 20 bp, mouse
ggacttattttggtttactc

SEQ ID NO: 547632 - DNA, 20 bp, mouse
gaaactcacgtttcatggtg

SEQ ID NO: 547633 - DNA, 20 bp, mouse
gaggacaaactcacgtttca

SEQ ID NO: 547634 - DNA, 20 bp, mouse
gtattttcagagatcaggaa

SEQ ID NO: 547635 - DNA, 20 bp, mouse
gctttttattttcagagatc

SEQ ID NO: 547636 - DNA, 20 bp, mouse
gtgcatctgaaagcataatg

SEQ ID NO: 547637 - DNA, 20 bp, mouse
gtaaaaacttggtaagctca

SEQ ID NO: 547638 - DNA, 20 bp, mouse
gaactccttcactaaaaact

SEQ ID NO: 547639 - DNA, 20 bp, mouse
gtggcaagatatgtttgtat

SEQ ID NO: 547640 - DNA, 20 bp, mouse
gcctctggttgctttcatta

SEQ ID NO: 547641 - DNA, 20 bp, mouse
gaattgcaattcctatagtt

SEQ ID NO: 547642 - DNA, 20 bp, mouse
gttttgctttaccaaactat

SEQ ID NO: 547643 - DNA, 20 bp, mouse
gctaatttgatggtcaaaat

SEQ ID NO: 547644 - DNA, 20 bp, mouse
gaatttctgctgactacctc

SEQ ID NO: 547645 - DNA, 20 bp, mouse
gggtatcaacatttttactg

SEQ ID NO: 547646 - DNA, 20 bp, mouse
gactgaggacaactactcct

SEQ ID NO: 547647 - DNA, 20 bp, mouse
gaggatgaactctgttgcca

SEQ ID NO: 547648 - DNA, 20 bp, mouse
gacagaagtgtctttaagtc

SEQ ID NO: 547649 - DNA, 20 bp, mouse
gtatgtgaatcatggaatgt

SEQ ID NO: 547650 - DNA, 20 bp, mouse
gcgaggttctatgtagatca

SEQ ID NO: 547651 - DNA, 20 bp, mouse
ggtggtctgagaatcctatg

SEQ ID NO: 547652 - DNA, 20 bp, mouse
ggaggagctgaagatgactg

SEQ ID NO: 547653 - DNA, 20 bp, mouse
gggctcctgtggtcatttga

SEQ ID NO: 547654 - DNA, 20 bp, mouse
gtcagctcctctgttgacaa

SEQ ID NO: 547655 - DNA, 20 bp, mouse
gaagaaccctatgtgaatca

SEQ ID NO: 547656 - DNA, 20 bp, mouse
gcccaccaggatgaattgtg

SEQ ID NO: 547657 - DNA, 20 bp, mouse
gagacaccctacatgaagaa

SEQ ID NO: 547658 - DNA, 20 bp, mouse
gtgatttccattcttcatgt

SEQ ID NO: 547659 - DNA, 20 bp, mouse
gagaatggaaatcaggttac

SEQ ID NO: 547660 - DNA, 20 bp, mouse
gaccacacaattcatcctgg

SEQ ID NO: 547661 - DNA, 20 bp, mouse
gttgaccacacaattcatcc

SEQ ID NO: 547662 - DNA, 20 bp, mouse
gtctccattcagatgagtat

SEQ ID NO: 547663 - DNA, 20 bp, mouse
ggtgcctatactcatctgaa

SEQ ID NO: 547664 - DNA, 20 bp, mouse
gatagatgacagagaacagc

SEQ ID NO: 547665 - DNA, 20 bp, mouse
gtcatgtagggtgtctctta

SEQ ID NO: 547666 - DNA, 20 bp, mouse
gccagcaataaaatagacta

SEQ ID NO: 547667 - DNA, 20 bp, mouse
gagtggactagaaccaagac

SEQ ID NO: 547668 - DNA, 20 bp, mouse
gaataaaatagactaaggca

SEQ ID NO: 547669 - DNA, 20 bp, mouse
gctaaggcatggacttatga

SEQ ID NO: 547670 - DNA, 20 bp, mouse
ggagttaaaacagatccaag

SEQ ID NO: 547671 - DNA, 20 bp, mouse
ggactagaaccaagactgga

SEQ ID NO: 547672 - DNA, 20 bp, mouse
gtgaggaccttgggagaaac

SEQ ID NO: 547673 - DNA, 20 bp, mouse
ggtcagtgaccttccagtct

SEQ ID NO: 547674 - DNA, 20 bp, mouse
ggcatagagatgacacagtc

SEQ ID NO: 547675 - DNA, 20 bp, mouse
gtgtagtacaaacacttgag

SEQ ID NO: 547676 - DNA, 20 bp, mouse
gctacagtggctgtatccta

SEQ ID NO: 547677 - DNA, 20 bp, mouse
gtggagttatatcttctctc

SEQ ID NO: 547678 - DNA, 20 bp, mouse
gtcttctctcaggtgaagga

SEQ ID NO: 547679 - DNA, 20 bp, mouse
gccctctagttggagaactc

SEQ ID NO: 547680 - DNA, 20 bp, mouse
gtatatcttctctcaggtga

SEQ ID NO: 547681 - DNA, 20 bp, mouse
gcagaatggcaagggctacg

SEQ ID NO: 547682 - DNA, 20 bp, mouse
gttggtcagagagggcaatc

SEQ ID NO: 547683 - DNA, 20 bp, mouse
ggggtcagaagataaccaga

SEQ ID NO: 547684 - DNA, 20 bp, mouse
gtcctgagttctccaactag

SEQ ID NO: 547685 - DNA, 20 bp, mouse
gagccactgtaggtggtaaa

SEQ ID NO: 547686 - DNA, 20 bp, mouse
gctgtgaactcaaaatatga

SEQ ID NO: 547687 - DNA, 20 bp, mouse
gcaggatatgttcagttgag

SEQ ID NO: 547688 - DNA, 20 bp, mouse
gctattcatcagaagagaat

SEQ ID NO: 547689 - DNA, 20 bp, mouse
gtatccaggtaagacattaa

SEQ ID NO: 547690 - DNA, 20 bp, mouse
gctgaagagtttttcagatc

SEQ ID NO: 547691 - DNA, 20 bp, mouse
gtgacaaggaacataataac

SEQ ID NO: 547692 - DNA, 20 bp, mouse
gacatacccaaattatgaca

SEQ ID NO: 547693 - DNA, 20 bp, mouse
ggaatagttgtatttcatac

SEQ ID NO: 547694 - DNA, 20 bp, mouse
gaatggccctgtcataattt

SEQ ID NO: 547695 - DNA, 20 bp, mouse
ggggccattaatgtcttacc

SEQ ID NO: 547696 - DNA, 20 bp, mouse
gagagaactgatagcaacaa

SEQ ID NO: 547697 - DNA, 20 bp, mouse
gcaaatgcggtgcaagggaa

SEQ ID NO: 547698 - DNA, 20 bp, mouse
gctctcttgatatataggta

SEQ ID NO: 547699 - DNA, 20 bp, mouse
gctacaccctttcatttcag

SEQ ID NO: 547700 - DNA, 20 bp, mouse
ggaaggcctaatactttata

SEQ ID NO: 547701 - DNA, 20 bp, mouse
gggtgaccttataaagtatt

SEQ ID NO: 547702 - DNA, 20 bp, mouse
gatcagttctctgaatttgc

SEQ ID NO: 547703 - DNA, 20 bp, mouse
gtttaagaaaacaggataat

SEQ ID NO: 547704 - DNA, 20 bp, mouse
ggcgatcaaatgcggtgcaa

SEQ ID NO: 547705 - DNA, 20 bp, mouse
gatcgctctcaaattcctga

SEQ ID NO: 547706 - DNA, 20 bp, mouse
ggacagagtttgttctcaca

SEQ ID NO: 547707 - DNA, 20 bp, mouse
ggtcactgcggatgatatcc

SEQ ID NO: 547708 - DNA, 20 bp, mouse
gatgtccagtaagcagcaca

SEQ ID NO: 547709 - DNA, 20 bp, mouse
ggatgagagcaatcagacct

SEQ ID NO: 547710 - DNA, 20 bp, mouse
gatatatcatcaagaatagt

SEQ ID NO: 547711 - DNA, 20 bp, mouse
gaacatattaggagtcactg

SEQ ID NO: 547712 - DNA, 20 bp, mouse
gtaataaccggataaagtaa

SEQ ID NO: 547713 - DNA, 20 bp, mouse
gtactagtttcagtattcat

SEQ ID NO: 547714 - DNA, 20 bp, mouse
gtacaaaagccaaactccca

SEQ ID NO: 547715 - DNA, 20 bp, mouse
ggtggtcccgccaaatgcga

SEQ ID NO: 547716 - DNA, 20 bp, mouse
gactgcactaggagccacag

SEQ ID NO: 547717 - DNA, 20 bp, mouse
ggtggtaggaactgctccca

SEQ ID NO: 547718 - DNA, 20 bp, mouse
gggagcagttcctaccactg

SEQ ID NO: 547719 - DNA, 20 bp, mouse
gacaggaaagcagtagccct

SEQ ID NO: 547720 - DNA, 20 bp, mouse
ggaaacaaagacaatcctac

SEQ ID NO: 547721 - DNA, 20 bp, mouse
ggatatctttactaagtgtt

SEQ ID NO: 547722 - DNA, 20 bp, mouse
gcttacctatagcctggaag

SEQ ID NO: 547723 - DNA, 20 bp, mouse
ggctgttcacagaaagaatg

SEQ ID NO: 547724 - DNA, 20 bp, mouse
gtcagcctcttccaggctat

SEQ ID NO: 547725 - DNA, 20 bp, mouse
gttctttcttacctatagcc

SEQ ID NO: 547726 - DNA, 20 bp, mouse
gaggatcctctgaaattccc

SEQ ID NO: 547727 - DNA, 20 bp, mouse
gatagctaataaacctaaaa

SEQ ID NO: 547728 - DNA, 20 bp, mouse
gtgcaaaggacaggttggaa

SEQ ID NO: 547729 - DNA, 20 bp, mouse
gttaataatggaattacatc

SEQ ID NO: 547730 - DNA, 20 bp, mouse
gcaaaactaaaaatccacag

SEQ ID NO: 547731 - DNA, 20 bp, mouse
ggtaaagcagatgtctgcaa

SEQ ID NO: 547732 - DNA, 20 bp, mouse
gaaaggaaaggttgccatag

SEQ ID NO: 547733 - DNA, 20 bp, mouse
gaatatacagacaaagaaca

SEQ ID NO: 547734 - DNA, 20 bp, mouse
gagatgggaatctgtaatgg

SEQ ID NO: 547735 - DNA, 20 bp, mouse
ggaacaaaaatagtccaaaa

SEQ ID NO: 547736 - DNA, 20 bp, mouse
gtgtttcttgttgggagcta

SEQ ID NO: 547737 - DNA, 20 bp, mouse
gccagaaaaaacaagaacaa

SEQ ID NO: 547738 - DNA, 20 bp, mouse
gacaagggcacctgtagctc

SEQ ID NO: 547739 - DNA, 20 bp, mouse
gtctatctcattactattgt

SEQ ID NO: 547740 - DNA, 20 bp, mouse
gactacagaatgtttcttgt

SEQ ID NO: 547741 - DNA, 20 bp, mouse
ggacagagtttgtgcttaca

SEQ ID NO: 547742 - DNA, 20 bp, mouse
gacagagtctccagagctac

SEQ ID NO: 547743 - DNA, 20 bp, mouse
gggtgccactgtggatgata

SEQ ID NO: 547744 - DNA, 20 bp, mouse
ggataagagcaattagacca

SEQ ID NO: 547745 - DNA, 20 bp, mouse
gagaaatcgagtaacatctt

SEQ ID NO: 547746 - DNA, 20 bp, mouse
gtttgtagtgagtgcaacca

SEQ ID NO: 547747 - DNA, 20 bp, mouse
gttcatgctttaattcacga

SEQ ID NO: 547748 - DNA, 20 bp, mouse
gataaatgaccaaaaacagc

SEQ ID NO: 547749 - DNA, 20 bp, mouse
gcccctgttcctgctgtttt

SEQ ID NO: 547750 - DNA, 20 bp, mouse
ggccagtgaggacatggaaa

SEQ ID NO: 547751 - DNA, 20 bp, mouse
ggagacagccagtgaggaca

SEQ ID NO: 547752 - DNA, 20 bp, mouse
gtcattcagtttgttctctc

SEQ ID NO: 547753 - DNA, 20 bp, mouse
ggaacagggggattttccac

SEQ ID NO: 547754 - DNA, 20 bp, mouse
gcataggaatgtgaaggtga

SEQ ID NO: 547755 - DNA, 20 bp, mouse
gaaatgtcttgtagcatctt

SEQ ID NO: 547756 - DNA, 20 bp, mouse
gaaagatatcattttattct

SEQ ID NO: 547757 - DNA, 20 bp, mouse
ggccagtgaggacatggaaa

SEQ ID NO: 547758 - DNA, 20 bp, mouse
ggagacagccagtgaggaca

SEQ ID NO: 547759 - DNA, 20 bp, mouse
gtccatttccatgtcctcac

SEQ ID NO: 547760 - DNA, 20 bp, mouse
gtcattcagtttgttctctc

SEQ ID NO: 547761 - DNA, 20 bp, mouse
ggaacagggggattttccac

SEQ ID NO: 547762 - DNA, 20 bp, mouse
gaaatgtcttgtagcatctt

SEQ ID NO: 547763 - DNA, 20 bp, mouse
gcttgggagtttagcatttg

SEQ ID NO: 547764 - DNA, 20 bp, mouse
gtttggaatcagtgcaacca

SEQ ID NO: 547765 - DNA, 20 bp, mouse
gtgatacagtttttttcatt

SEQ ID NO: 547766 - DNA, 20 bp, mouse
gtgtctgattttgttctcaa

SEQ ID NO: 547767 - DNA, 20 bp, mouse
gagaagaacaggagaaacag

SEQ ID NO: 547768 - DNA, 20 bp, mouse
ggcaagaagagatgtcatgg

SEQ ID NO: 547769 - DNA, 20 bp, mouse
ggagaacaaaatcagacacc

SEQ ID NO: 547770 - DNA, 20 bp, mouse
ggacataaatgaagaagaac

SEQ ID NO: 547771 - DNA, 20 bp, mouse
gagcatcctgggagtcactg

SEQ ID NO: 547772 - DNA, 20 bp, mouse
gacagcaagaagagatgtca

SEQ ID NO: 547773 - DNA, 20 bp, mouse
gatggaggtgaacagaagcc

SEQ ID NO: 547774 - DNA, 20 bp, mouse
gttgttaatatcttagacaa

SEQ ID NO: 547775 - DNA, 20 bp, mouse
gtgggccatgcattcagaga

SEQ ID NO: 547776 - DNA, 20 bp, mouse
gtatatctttgtgattccag

SEQ ID NO: 547777 - DNA, 20 bp, mouse
ggtgacaaatgaattcatcc

SEQ ID NO: 547778 - DNA, 20 bp, mouse
gggatcccatggtcatttga

SEQ ID NO: 547779 - DNA, 20 bp, mouse
gacaaatgaattcatcctgg

SEQ ID NO: 547780 - DNA, 20 bp, mouse
gcctgctatgtaggatccca

SEQ ID NO: 547781 - DNA, 20 bp, mouse
gattccagtggcaacagaga

SEQ ID NO: 547782 - DNA, 20 bp, mouse
ggtgatctgagaaccccacc

SEQ ID NO: 547783 - DNA, 20 bp, mouse
gcaccatggtggggaatcta

SEQ ID NO: 547784 - DNA, 20 bp, mouse
gcttcttttctgtggacaga

SEQ ID NO: 547785 - DNA, 20 bp, mouse
gggcaacagagaaggtgaga

SEQ ID NO: 547786 - DNA, 20 bp, mouse
gggacacccagtaaggacat

SEQ ID NO: 547787 - DNA, 20 bp, mouse
gctattcccatgtccttact

SEQ ID NO: 547788 - DNA, 20 bp, mouse
gactcagtcatctgccacag

SEQ ID NO: 547789 - DNA, 20 bp, mouse
gaaagagatcagtttgctct

SEQ ID NO: 547790 - DNA, 20 bp, mouse
gaaaagtctaagagcatctt

SEQ ID NO: 547791 - DNA, 20 bp, mouse
gtcctatgtacttatttctt

SEQ ID NO: 547792 - DNA, 20 bp, mouse
gcataggaatgtgaaggtga

SEQ ID NO: 547793 - DNA, 20 bp, mouse
gcttgggagtttagcatttg

SEQ ID NO: 547794 - DNA, 20 bp, mouse
gtgatacagtttttttcatt

SEQ ID NO: 547795 - DNA, 20 bp, mouse
gtaagtacataggaatgtga

SEQ ID NO: 547796 - DNA, 20 bp, mouse
ggtagaaaaccagactgtgg

SEQ ID NO: 547797 - DNA, 20 bp, mouse
ggtcacagaagatgaagcac

SEQ ID NO: 547798 - DNA, 20 bp, mouse
gtgaaatgaaatctcccctt

SEQ ID NO: 547799 - DNA, 20 bp, mouse
ggatgagagcaatgagccca

SEQ ID NO: 547800 - DNA, 20 bp, mouse
gacagtagaaaaccagactg

SEQ ID NO: 547801 - DNA, 20 bp, mouse
gtataatggaagaataaata

SEQ ID NO: 547802 - DNA, 20 bp, mouse
gtcccaaacaatcactataa

SEQ ID NO: 547803 - DNA, 20 bp, mouse
gcaccatggtgggcaacctt

SEQ ID NO: 547804 - DNA, 20 bp, mouse
gctccccttaggaacacatc

SEQ ID NO: 547805 - DNA, 20 bp, mouse
gaccatggtgatgaggtaga

SEQ ID NO: 547806 - DNA, 20 bp, mouse
ggcctttaacttgggatggt

SEQ ID NO: 547807 - DNA, 20 bp, mouse
gacagggcagcctttaactt

SEQ ID NO: 547808 - DNA, 20 bp, mouse
ggcaccaagtaagtatgcca

SEQ ID NO: 547809 - DNA, 20 bp, mouse
gatcactgaatttatcttca

SEQ ID NO: 547810 - DNA, 20 bp, mouse
gtgtactcagtttatagccg

SEQ ID NO: 547811 - DNA, 20 bp, mouse
gttgaacaaagcactcagcc

SEQ ID NO: 547812 - DNA, 20 bp, mouse
gggcagcctttaacttggga

SEQ ID NO: 547813 - DNA, 20 bp, mouse
gaaaagttgagaagcatttt

SEQ ID NO: 547814 - DNA, 20 bp, mouse
gaccgaccatcccaagttaa

SEQ ID NO: 547815 - DNA, 20 bp, mouse
ggtcataggccatcacagaa

SEQ ID NO: 547816 - DNA, 20 bp, mouse
gaacttggtcttgatgctaa

SEQ ID NO: 547817 - DNA, 20 bp, mouse
gcaggacatgaagtaggtcc

SEQ ID NO: 547818 - DNA, 20 bp, mouse
ggatgatgtgagtactgaac

SEQ ID NO: 547819 - DNA, 20 bp, mouse
gacttcatgtcctgatatct

SEQ ID NO: 547820 - DNA, 20 bp, mouse
gtcaaggattacagcaacta

SEQ ID NO: 547821 - DNA, 20 bp, mouse
gtaggactcacctagatatc

SEQ ID NO: 547822 - DNA, 20 bp, mouse
gcttttcctgcaaagaaggg

SEQ ID NO: 547823 - DNA, 20 bp, mouse
gtgttgcatgaatatttcat

SEQ ID NO: 547824 - DNA, 20 bp, mouse
gggactaaaagacagacatt

SEQ ID NO: 547825 - DNA, 20 bp, mouse
gttcttaagttccacattcc

SEQ ID NO: 547826 - DNA, 20 bp, mouse
ggactcagatgatgactaaa

SEQ ID NO: 547827 - DNA, 20 bp, mouse
ggttcccatctattcagcat

SEQ ID NO: 547828 - DNA, 20 bp, mouse
gtctattcagcataggtata

SEQ ID NO: 547829 - DNA, 20 bp, mouse
gtagatgggaacagaatctt

SEQ ID NO: 547830 - DNA, 20 bp, mouse
gagaatgggaagtgtgagca

SEQ ID NO: 547831 - DNA, 20 bp, mouse
gcaggaaggtaaatgagcta

SEQ ID NO: 547832 - DNA, 20 bp, mouse
gctgagagattctagtgcca

SEQ ID NO: 547833 - DNA, 20 bp, mouse
gaatgtacattgctattact

SEQ ID NO: 547834 - DNA, 20 bp, mouse
gtcagacattctgggtaagt

SEQ ID NO: 547835 - DNA, 20 bp, mouse
gtgcagagtatcataagact

SEQ ID NO: 547836 - DNA, 20 bp, mouse
ggcctttagcgtgggatggt

SEQ ID NO: 547837 - DNA, 20 bp, mouse
gacagggcagcctttagcgt

SEQ ID NO: 547838 - DNA, 20 bp, mouse
ggcagaaggaaaccgcactc

SEQ ID NO: 547839 - DNA, 20 bp, mouse
gggcagcctttagcgtggga

SEQ ID NO: 547840 - DNA, 20 bp, mouse
gaccgaccatcccacgctaa

SEQ ID NO: 547841 - DNA, 20 bp, mouse
gacaccaagtaagtatgtca

SEQ ID NO: 547842 - DNA, 20 bp, mouse
gaaaaagttgagaatcattc

SEQ ID NO: 547843 - DNA, 20 bp, mouse
gaaactcagtgaccagagtg

SEQ ID NO: 547844 - DNA, 20 bp, mouse
ggtcataggccatcacagat

SEQ ID NO: 547845 - DNA, 20 bp, mouse
gtgagcaaagcactcaacca

SEQ ID NO: 547846 - DNA, 20 bp, mouse
gacgctcagtgagtcctgtg

SEQ ID NO: 547847 - DNA, 20 bp, mouse
gtgattgtccaagtcagata

SEQ ID NO: 547848 - DNA, 20 bp, mouse
ggcggaaagaaattggaccc

SEQ ID NO: 547849 - DNA, 20 bp, mouse
ggtagatgatgaggaaaacc

SEQ ID NO: 547850 - DNA, 20 bp, mouse
gaaattgacaagcatcctgg

SEQ ID NO: 547851 - DNA, 20 bp, mouse
gcaccaccggataaaggagg

SEQ ID NO: 547852 - DNA, 20 bp, mouse
gagatatggcggaaagaaat

SEQ ID NO: 547853 - DNA, 20 bp, mouse
ggatgagagcaatcagtcca

SEQ ID NO: 547854 - DNA, 20 bp, mouse
ggaggtgcaaacatcagcaa

SEQ ID NO: 547855 - DNA, 20 bp, mouse
ggcttgttggacatcaccac

SEQ ID NO: 547856 - DNA, 20 bp, mouse
gatggaggtgaacaggaccc

SEQ ID NO: 547857 - DNA, 20 bp, mouse
gggctgatgtgatgttatgg

SEQ ID NO: 547858 - DNA, 20 bp, mouse
gtgatgttatggaggtgaac

SEQ ID NO: 547859 - DNA, 20 bp, mouse
ggagaataaacgcagtcacc

SEQ ID NO: 547860 - DNA, 20 bp, mouse
gctgcaagttcccatgttct

SEQ ID NO: 547861 - DNA, 20 bp, mouse
gacatcagccttctcactga

SEQ ID NO: 547862 - DNA, 20 bp, mouse
gagaagaacaccaagaacat

SEQ ID NO: 547863 - DNA, 20 bp, mouse
gacatgggaacttgcagctc

SEQ ID NO: 547864 - DNA, 20 bp, mouse
ggaaggctgatgtgatgtta

SEQ ID NO: 547865 - DNA, 20 bp, mouse
gtgactgcgtttattctcag

SEQ ID NO: 547866 - DNA, 20 bp, mouse
gtgggcaaaacactcacccc

SEQ ID NO: 547867 - DNA, 20 bp, mouse
gtaagaatgacataatatcc

SEQ ID NO: 547868 - DNA, 20 bp, mouse
ggcatcctgagaggatgtga

SEQ ID NO: 547869 - DNA, 20 bp, mouse
ggagaacaaactcagtcatc

SEQ ID NO: 547870 - DNA, 20 bp, mouse
ggaaacaaaaaaaataaaat

SEQ ID NO: 547871 - DNA, 20 bp, mouse
gaagaagaacaccaggaaga

SEQ ID NO: 547872 - DNA, 20 bp, mouse
ggtcacagaggatgacgtgc

SEQ ID NO: 547873 - DNA, 20 bp, mouse
ggacgtgcaggcatcagcaa

SEQ ID NO: 547874 - DNA, 20 bp, mouse
gataggccattgctaccagg

SEQ ID NO: 547875 - DNA, 20 bp, mouse
gataatcccacatgaactat

SEQ ID NO: 547876 - DNA, 20 bp, mouse
gttcatctatgtcatcacta

SEQ ID NO: 547877 - DNA, 20 bp, mouse
gtaatcctgagggggtgtga

SEQ ID NO: 547878 - DNA, 20 bp, mouse
gtgactgagtttgttcttag

SEQ ID NO: 547879 - DNA, 20 bp, mouse
gagaacaaactcagtcaaca

SEQ ID NO: 547880 - DNA, 20 bp, mouse
gaagaagaacaccaggaaga

SEQ ID NO: 547881 - DNA, 20 bp, mouse
gcctgagggggtgtgatgga

SEQ ID NO: 547882 - DNA, 20 bp, mouse
gagaatgacatgatatctgt

SEQ ID NO: 547883 - DNA, 20 bp, mouse
ggtcacagaggatgacgtgc

SEQ ID NO: 547884 - DNA, 20 bp, mouse
ggacgtgcaggcatcagcaa

SEQ ID NO: 547885 - DNA, 20 bp, mouse
gaagcaaaaaaaataatatt

SEQ ID NO: 547886 - DNA, 20 bp, mouse
gtttacaaaaccaattatat

SEQ ID NO: 547887 - DNA, 20 bp, mouse
gacactctgagagaggatca

SEQ ID NO: 547888 - DNA, 20 bp, mouse
ggaaagaacaccaggaggag

SEQ ID NO: 547889 - DNA, 20 bp, mouse
ggatgagaaagaacaccagg

SEQ ID NO: 547890 - DNA, 20 bp, mouse
gctcatctatgtcaccacta

SEQ ID NO: 547891 - DNA, 20 bp, mouse
gaatttcataagcatttttg

SEQ ID NO: 547892 - DNA, 20 bp, mouse
gtaattggttttgtaaactg

SEQ ID NO: 547893 - DNA, 20 bp, mouse
gccaaggttgcccaccatag

SEQ ID NO: 547894 - DNA, 20 bp, mouse
gtcagtatatcctatataat

SEQ ID NO: 547895 - DNA, 20 bp, mouse
ggcagaaaacactctgagag

SEQ ID NO: 547896 - DNA, 20 bp, mouse
ggggtgtgatggagctgaac

SEQ ID NO: 547897 - DNA, 20 bp, mouse
gagaatgacatgatatccat

SEQ ID NO: 547898 - DNA, 20 bp, mouse
ggagaaagaacaccaggaac

SEQ ID NO: 547899 - DNA, 20 bp, mouse
gtacatggtctacttcatgt

SEQ ID NO: 547900 - DNA, 20 bp, mouse
gtgtagaagtccaattagat

SEQ ID NO: 547901 - DNA, 20 bp, mouse
gctcatctatgttatcacca

SEQ ID NO: 547902 - DNA, 20 bp, mouse
gtaggtgtatcctatctaat

SEQ ID NO: 547903 - DNA, 20 bp, mouse
gaactgaatacagagtctgt

SEQ ID NO: 547904 - DNA, 20 bp, mouse
gactgcggaatgtttcatcc

SEQ ID NO: 547905 - DNA, 20 bp, mouse
gttttgtttaagtgcaactg

SEQ ID NO: 547906 - DNA, 20 bp, mouse
gcaagggcagctggtactgt

SEQ ID NO: 547907 - DNA, 20 bp, mouse
ggtgagggccacacagtaaa

SEQ ID NO: 547908 - DNA, 20 bp, mouse
gggccacacagtaaagggag

SEQ ID NO: 547909 - DNA, 20 bp, mouse
ggcagccaccgtaggagatg

SEQ ID NO: 547910 - DNA, 20 bp, mouse
gtaacagagttcatccttca

SEQ ID NO: 547911 - DNA, 20 bp, mouse
gagggccttgggcataatgg

SEQ ID NO: 547912 - DNA, 20 bp, mouse
ggccttgggcataatggagg

SEQ ID NO: 547913 - DNA, 20 bp, mouse
gttatgcccaaggccctgag

SEQ ID NO: 547914 - DNA, 20 bp, mouse
ggtaggccatgacagtgagg

SEQ ID NO: 547915 - DNA, 20 bp, mouse
gtctctgatatcctcagtca

SEQ ID NO: 547916 - DNA, 20 bp, mouse
gcgtttgtagcgtctagtgt

SEQ ID NO: 547917 - DNA, 20 bp, mouse
gtaggcgtagcggccaccag

SEQ ID NO: 547918 - DNA, 20 bp, mouse
ggatagatgcctgaaccact

SEQ ID NO: 547919 - DNA, 20 bp, mouse
gtggctccgcctaggcgtag

SEQ ID NO: 547920 - DNA, 20 bp, mouse
ggttaaggttgttagagtta

SEQ ID NO: 547921 - DNA, 20 bp, mouse
gtttagtgagcggaaatctt

SEQ ID NO: 547922 - DNA, 20 bp, mouse
gcaatacttgatggagtaca

SEQ ID NO: 547923 - DNA, 20 bp, mouse
gtgatatgctcgactgaatc

SEQ ID NO: 547924 - DNA, 20 bp, mouse
gaagtatactgtactccatt

SEQ ID NO: 547925 - DNA, 20 bp, mouse
gttgatggagtacaaggtta

SEQ ID NO: 547926 - DNA, 20 bp, mouse
gatggaacagctgatggcag

SEQ ID NO: 547927 - DNA, 20 bp, mouse
gaaggaataggacatgggtc

SEQ ID NO: 547928 - DNA, 20 bp, mouse
ggtaggccagcaaatgcatc

SEQ ID NO: 547929 - DNA, 20 bp, mouse
gtgcaatcggtggtccacgc

SEQ ID NO: 547930 - DNA, 20 bp, mouse
gcttgtggtttttgtcctgg

SEQ ID NO: 547931 - DNA, 20 bp, mouse
ggcctacttggcttccatca

SEQ ID NO: 547932 - DNA, 20 bp, mouse
gataattagcatcacctgcg

SEQ ID NO: 547933 - DNA, 20 bp, mouse
ggaaaaaaacagttgccccc

SEQ ID NO: 547934 - DNA, 20 bp, mouse
gggccacagggaacccctca

SEQ ID NO: 547935 - DNA, 20 bp, mouse
ggaagagatggaacagctga

SEQ ID NO: 547936 - DNA, 20 bp, mouse
ggggctgatggcaaaagaag

SEQ ID NO: 547937 - DNA, 20 bp, mouse
gaggtttgtctaccagatca

SEQ ID NO: 547938 - DNA, 20 bp, mouse
gagccacaaggaagccctcc

SEQ ID NO: 547939 - DNA, 20 bp, mouse
ggcaaaaggagaaactcctg

SEQ ID NO: 547940 - DNA, 20 bp, mouse
gcgaggatcggaccacgtga

SEQ ID NO: 547941 - DNA, 20 bp, mouse
gtggaatgagacaacagtcc

SEQ ID NO: 547942 - DNA, 20 bp, mouse
ggccaggagcttcgggataa

SEQ ID NO: 547943 - DNA, 20 bp, mouse
gcagcaggtgcacgaggaag

SEQ ID NO: 547944 - DNA, 20 bp, mouse
gtttgtctaccagatcaagg

SEQ ID NO: 547945 - DNA, 20 bp, mouse
ggccatgtggaagaaaattg

SEQ ID NO: 547946 - DNA, 20 bp, mouse
gcgggtactggtgcagatga

SEQ ID NO: 547947 - DNA, 20 bp, mouse
gcattcccactgtctaagac

SEQ ID NO: 547948 - DNA, 20 bp, mouse
gtcttcatcacaccttgaac

SEQ ID NO: 547949 - DNA, 20 bp, mouse
gacagcaggaaatccctcca

SEQ ID NO: 547950 - DNA, 20 bp, mouse
ggtgtgatgaagacaaaata

SEQ ID NO: 547951 - DNA, 20 bp, mouse
gcccaaaggagaaaacaccg

SEQ ID NO: 547952 - DNA, 20 bp, mouse
ggtaaaacaagactccccaa

SEQ ID NO: 547953 - DNA, 20 bp, mouse
gctttaccggtcttagacag

SEQ ID NO: 547954 - DNA, 20 bp, mouse
gttcctgctgtccagcacct

SEQ ID NO: 547955 - DNA, 20 bp, mouse
gggaaacgggacaactgtcc

SEQ ID NO: 547956 - DNA, 20 bp, mouse
gaggaactcggccacaactg

SEQ ID NO: 547957 - DNA, 20 bp, mouse
ggctggagaaaccttcaaag

SEQ ID NO: 547958 - DNA, 20 bp, mouse
gagtcagaaggtacagcgtt

SEQ ID NO: 547959 - DNA, 20 bp, mouse
gtggccgagttcctctttga

SEQ ID NO: 547960 - DNA, 20 bp, mouse
gggcctggtaaggattaagg

SEQ ID NO: 547961 - DNA, 20 bp, mouse
gcaactgtggagtttttctt

SEQ ID NO: 547962 - DNA, 20 bp, mouse
ggctagcattcgtggaataa

SEQ ID NO: 547963 - DNA, 20 bp, mouse
ggaggcacgtgtagtcttca

SEQ ID NO: 547964 - DNA, 20 bp, mouse
gattcgtggaataatggcaa

SEQ ID NO: 547965 - DNA, 20 bp, mouse
gggccatctgcaatcctcta

SEQ ID NO: 547966 - DNA, 20 bp, mouse
ggggtctgcaagtagacaat

SEQ ID NO: 547967 - DNA, 20 bp, mouse
gactggaaggctggtcgtga

SEQ ID NO: 547968 - DNA, 20 bp, mouse
gcagccagccatggttatca

SEQ ID NO: 547969 - DNA, 20 bp, mouse
gtgtcagcagataggttacc

SEQ ID NO: 547970 - DNA, 20 bp, mouse
gccacatctctaggaaagag

SEQ ID NO: 547971 - DNA, 20 bp, mouse
gcctggccatacgcagtgat

SEQ ID NO: 547972 - DNA, 20 bp, mouse
gatgtactcagtgcagacaa

SEQ ID NO: 547973 - DNA, 20 bp, mouse
gacaagagcatctcattcaa

SEQ ID NO: 547974 - DNA, 20 bp, mouse
ggatgctcttgtccttgctg

SEQ ID NO: 547975 - DNA, 20 bp, mouse
gtaataacagggtagcgtag

SEQ ID NO: 547976 - DNA, 20 bp, mouse
ggagttcaaactccatctcg

SEQ ID NO: 547977 - DNA, 20 bp, mouse
gactaacctgagccacgaga

SEQ ID NO: 547978 - DNA, 20 bp, mouse
gtaggagcccccaatcagag

SEQ ID NO: 547979 - DNA, 20 bp, mouse
ggagcagcttctggagctgg

SEQ ID NO: 547980 - DNA, 20 bp, mouse
gggcgcagacagactacaga

SEQ ID NO: 547981 - DNA, 20 bp, mouse
gctatggtcggatagaggag

SEQ ID NO: 547982 - DNA, 20 bp, mouse
gttctggagctgggggtcac

SEQ ID NO: 547983 - DNA, 20 bp, mouse
gtcagagaggcacagacatt

SEQ ID NO: 547984 - DNA, 20 bp, mouse
ggatttctgctactcttcta

SEQ ID NO: 547985 - DNA, 20 bp, mouse
gcattgggagacactatggt

SEQ ID NO: 547986 - DNA, 20 bp, mouse
gtgcttctgggacaccccaa

SEQ ID NO: 547987 - DNA, 20 bp, mouse
ggttgtcacctctcatgcta

SEQ ID NO: 547988 - DNA, 20 bp, mouse
gagcatctgagggacagtgg

SEQ ID NO: 547989 - DNA, 20 bp, mouse
gtggcctgtcggaaatgccc

SEQ ID NO: 547990 - DNA, 20 bp, mouse
gcacgagctgctggcagagt

SEQ ID NO: 547991 - DNA, 20 bp, mouse
gcctgtcggaaatgcccagg

SEQ ID NO: 547992 - DNA, 20 bp, mouse
gaggaggataaagtcctttg

SEQ ID NO: 547993 - DNA, 20 bp, mouse
gctcatgctaaggcatcttc

SEQ ID NO: 547994 - DNA, 20 bp, mouse
gagctccagccatggcctgt

SEQ ID NO: 547995 - DNA, 20 bp, mouse
gcaggaggactgcaaagact

SEQ ID NO: 547996 - DNA, 20 bp, mouse
gcctaggctccaccaaagag

SEQ ID NO: 547997 - DNA, 20 bp, mouse
gcctatcatggtgaagatgt

SEQ ID NO: 547998 - DNA, 20 bp, mouse
gctggtccagtggaagaggt

SEQ ID NO: 547999 - DNA, 20 bp, mouse
ggcattgtgtatgcctgtat

SEQ ID NO: 548000 - DNA, 20 bp, mouse
gtgccttggacttattaaaa

SEQ ID NO: 548001 - DNA, 20 bp, mouse
gtcagaagcactccaaagag

SEQ ID NO: 548002 - DNA, 20 bp, mouse
gttcggtgcagctggtccag

SEQ ID NO: 548003 - DNA, 20 bp, mouse
gtgatgagcacatatcggag

SEQ ID NO: 548004 - DNA, 20 bp, mouse
ggggaaaagacaatatttga

SEQ ID NO: 548005 - DNA, 20 bp, mouse
gaatggtgcacgtgacacag

SEQ ID NO: 548006 - DNA, 20 bp, mouse
gcagggcagggtgtttagat

SEQ ID NO: 548007 - DNA, 20 bp, mouse
gtccaggttgttctgtccct

SEQ ID NO: 548008 - DNA, 20 bp, mouse
gcttgtggttccccaggacg

SEQ ID NO: 548009 - DNA, 20 bp, mouse
ggctcatggaccgcgtcctg

SEQ ID NO: 548010 - DNA, 20 bp, mouse
gggatcctaggatcattgga

SEQ ID NO: 548011 - DNA, 20 bp, mouse
ggaagccatccaatgatcct

SEQ ID NO: 548012 - DNA, 20 bp, mouse
ggatccaacaggttgatatc

SEQ ID NO: 548013 - DNA, 20 bp, mouse
gtcttatacatgtcactagg

SEQ ID NO: 548014 - DNA, 20 bp, mouse
gccaacaggttgatatcagg

SEQ ID NO: 548015 - DNA, 20 bp, mouse
gtgttcttatacatgtcact

SEQ ID NO: 548016 - DNA, 20 bp, mouse
gggagagtcagcatgacaca

SEQ ID NO: 548017 - DNA, 20 bp, mouse
gatggtgagtaaaaccggac

SEQ ID NO: 548018 - DNA, 20 bp, mouse
gcccttagccgtatgaacaa

SEQ ID NO: 548019 - DNA, 20 bp, mouse
gatctgatggtgagtaaaac

SEQ ID NO: 548020 - DNA, 20 bp, mouse
gtcccttgttcatacggcta

SEQ ID NO: 548021 - DNA, 20 bp, mouse
gtttcttcacattagtacag

SEQ ID NO: 548022 - DNA, 20 bp, mouse
gcagtctgtttgatatttgt

SEQ ID NO: 548023 - DNA, 20 bp, mouse
gagtttctctgtgtatacct

SEQ ID NO: 548024 - DNA, 20 bp, mouse
gatgaacaagggacagcagc

SEQ ID NO: 548025 - DNA, 20 bp, mouse
ggagtcagcatgacacaggg

SEQ ID NO: 548026 - DNA, 20 bp, mouse
ggtggtgcccaagatgctga

SEQ ID NO: 548027 - DNA, 20 bp, mouse
gagatgctgatggagcagag

SEQ ID NO: 548028 - DNA, 20 bp, mouse
gagatctgtctggtatttat

SEQ ID NO: 548029 - DNA, 20 bp, mouse
gagacagatctgggacctgt

SEQ ID NO: 548030 - DNA, 20 bp, mouse
ggaagtcttaaagagccatg

SEQ ID NO: 548031 - DNA, 20 bp, mouse
gtctttaagacttcagtatc

SEQ ID NO: 548032 - DNA, 20 bp, mouse
gagtagttgatactacattt

SEQ ID NO: 548033 - DNA, 20 bp, mouse
gcttcaagggatgggttgtt

SEQ ID NO: 548034 - DNA, 20 bp, mouse
gtttggtagctcaaggcaat

SEQ ID NO: 548035 - DNA, 20 bp, mouse
gatgttatcaactgcttcaa

SEQ ID NO: 548036 - DNA, 20 bp, mouse
gagaggaccatctccagccg

SEQ ID NO: 548037 - DNA, 20 bp, mouse
gtgtagccggaggtccatga

SEQ ID NO: 548038 - DNA, 20 bp, mouse
gctggggagtttattctcct

SEQ ID NO: 548039 - DNA, 20 bp, mouse
ggaccgtacagacaacaaag

SEQ ID NO: 548040 - DNA, 20 bp, mouse
ggaagaacaatgagagctct

SEQ ID NO: 548041 - DNA, 20 bp, mouse
ggtgccaccgagccaggcaa

SEQ ID NO: 548042 - DNA, 20 bp, mouse
ggaggttaatctggaactgg

SEQ ID NO: 548043 - DNA, 20 bp, mouse
gctgaacaggtcacagctga

SEQ ID NO: 548044 - DNA, 20 bp, mouse
ggaccagccccggctggaga

SEQ ID NO: 548045 - DNA, 20 bp, mouse
gttctctgaccagccccggc

SEQ ID NO: 548046 - DNA, 20 bp, mouse
gatactgtaaatgtaaggaa

SEQ ID NO: 548047 - DNA, 20 bp, mouse
gagagtgtgttgggttctag

SEQ ID NO: 548048 - DNA, 20 bp, mouse
gcatattgaagaaagttaac

SEQ ID NO: 548049 - DNA, 20 bp, mouse
gcaaatatactgtaaatgta

SEQ ID NO: 548050 - DNA, 20 bp, mouse
gaaaaaacaaaacttcacaa

SEQ ID NO: 548051 - DNA, 20 bp, mouse
gttgaatggaaatcattgca

SEQ ID NO: 548052 - DNA, 20 bp, mouse
gtatgtcacaaagagtgtgt

SEQ ID NO: 548053 - DNA, 20 bp, mouse
gatcatttatctgatcacac

SEQ ID NO: 548054 - DNA, 20 bp, mouse
gtgtgaaattctgttttgaa

SEQ ID NO: 548055 - DNA, 20 bp, mouse
gatttatctgatcacactgg

SEQ ID NO: 548056 - DNA, 20 bp, mouse
ggggactggaaaccattcaa

SEQ ID NO: 548057 - DNA, 20 bp, mouse
gatggtaactgaatttatct

SEQ ID NO: 548058 - DNA, 20 bp, mouse
ggagctgagtcatgcactca

SEQ ID NO: 548059 - DNA, 20 bp, mouse
gaaattcagttaccattgaa

SEQ ID NO: 548060 - DNA, 20 bp, mouse
gtctgcttctggctcaccgt

SEQ ID NO: 548061 - DNA, 20 bp, mouse
gctaccttctcacagtactg

SEQ ID NO: 548062 - DNA, 20 bp, mouse
gaccgtgggagtttacagtt

SEQ ID NO: 548063 - DNA, 20 bp, mouse
gctctgcaattgcgaaaaca

SEQ ID NO: 548064 - DNA, 20 bp, mouse
gatataatgagaagacaatg

SEQ ID NO: 548065 - DNA, 20 bp, mouse
gatgagaagacaatggggac

SEQ ID NO: 548066 - DNA, 20 bp, mouse
ggctggtgctctggtggtat

SEQ ID NO: 548067 - DNA, 20 bp, mouse
ggtgctctggtggtatgggc

SEQ ID NO: 548068 - DNA, 20 bp, mouse
gtgacagtttggttctttcc

SEQ ID NO: 548069 - DNA, 20 bp, mouse
gcaggaagatagatcatgcc

SEQ ID NO: 548070 - DNA, 20 bp, mouse
gatagggaatggatgatact

SEQ ID NO: 548071 - DNA, 20 bp, mouse
ggcatgttttgcaggaaatt

SEQ ID NO: 548072 - DNA, 20 bp, mouse
gccatactcacacagaggtt

SEQ ID NO: 548073 - DNA, 20 bp, mouse
gaatgaggacaatgatgacg

SEQ ID NO: 548074 - DNA, 20 bp, mouse
gaaagaagtacatttgtgca

SEQ ID NO: 548075 - DNA, 20 bp, mouse
gcacaatgttgtcagtgccc

SEQ ID NO: 548076 - DNA, 20 bp, mouse
gagaggccaccttcatacag

SEQ ID NO: 548077 - DNA, 20 bp, mouse
gtgcatgaggcagccaccta

SEQ ID NO: 548078 - DNA, 20 bp, mouse
ggccaccttcatacagaggt

SEQ ID NO: 548079 - DNA, 20 bp, mouse
ggccagccagaatcaaacta

SEQ ID NO: 548080 - DNA, 20 bp, mouse
gatcttgggaatggtagtcg

SEQ ID NO: 548081 - DNA, 20 bp, mouse
ggacagcaacaaagatcact

SEQ ID NO: 548082 - DNA, 20 bp, mouse
gtcttgttggagccacagaa

SEQ ID NO: 548083 - DNA, 20 bp, mouse
gcaatagaatgaaaaacaag

SEQ ID NO: 548084 - DNA, 20 bp, mouse
ggcaggagccggctgttagt

SEQ ID NO: 548085 - DNA, 20 bp, mouse
gggtcttcttctcactgact

SEQ ID NO: 548086 - DNA, 20 bp, mouse
gtagtgctcctaaatcagaa

SEQ ID NO: 548087 - DNA, 20 bp, mouse
gctgttgtctccatcaacat

SEQ ID NO: 548088 - DNA, 20 bp, mouse
gctcatttcctttctgattt

SEQ ID NO: 548089 - DNA, 20 bp, mouse
gaagaggtactgtgattctg

SEQ ID NO: 548090 - DNA, 20 bp, mouse
gctacactttggctgtaacc

SEQ ID NO: 548091 - DNA, 20 bp, mouse
gtttttgatgatctacactt

SEQ ID NO: 548092 - DNA, 20 bp, mouse
gaataataatccaatgttga

SEQ ID NO: 548093 - DNA, 20 bp, mouse
gtcaaaaacattacaaaaag

SEQ ID NO: 548094 - DNA, 20 bp, mouse
gtagcactgaagacatgatt

SEQ ID NO: 548095 - DNA, 20 bp, mouse
gtataatggagagattactg

SEQ ID NO: 548096 - DNA, 20 bp, mouse
gtggggaatggaatcatctt

SEQ ID NO: 548097 - DNA, 20 bp, mouse
gtgcattaggcatggaatga

SEQ ID NO: 548098 - DNA, 20 bp, mouse
gagaatgtttgcattaggca

SEQ ID NO: 548099 - DNA, 20 bp, mouse
gatctttggaataatctgcc

SEQ ID NO: 548100 - DNA, 20 bp, mouse
gtcacagaggtcactctact

SEQ ID NO: 548101 - DNA, 20 bp, mouse
gaatgaaagccaaccagaca

SEQ ID NO: 548102 - DNA, 20 bp, mouse
gcatgggtgtgtgcagtctg

SEQ ID NO: 548103 - DNA, 20 bp, mouse
gctccacagctaggtcagct

SEQ ID NO: 548104 - DNA, 20 bp, mouse
ggaggaaacactccacagct

SEQ ID NO: 548105 - DNA, 20 bp, mouse
gttccaagctgacctagctg

SEQ ID NO: 548106 - DNA, 20 bp, mouse
gttgtgcctgcctggtaacc

SEQ ID NO: 548107 - DNA, 20 bp, mouse
gcaggcaggcacaaccacgg

SEQ ID NO: 548108 - DNA, 20 bp, mouse
gaacccaggaccaggttacc

SEQ ID NO: 548109 - DNA, 20 bp, mouse
gcccatgacggttagtagaa

SEQ ID NO: 548110 - DNA, 20 bp, mouse
gtcctttctactaaccgtca

SEQ ID NO: 548111 - DNA, 20 bp, mouse
ggaaggtagagaagccaatg

SEQ ID NO: 548112 - DNA, 20 bp, mouse
gatcagctgaagatgaggga

SEQ ID NO: 548113 - DNA, 20 bp, mouse
gaggatgaactctgacacaa

SEQ ID NO: 548114 - DNA, 20 bp, mouse
gatgcgtgggatgatggcaa

SEQ ID NO: 548115 - DNA, 20 bp, mouse
gcaggtcagccaacatgcgt

SEQ ID NO: 548116 - DNA, 20 bp, mouse
ggaattaaaagtagaagtta

SEQ ID NO: 548117 - DNA, 20 bp, mouse
gtaaggaacattataaagat

SEQ ID NO: 548118 - DNA, 20 bp, mouse
gaggatgaattcagatgcac

SEQ ID NO: 548119 - DNA, 20 bp, mouse
gttcaaaagagttaaacaca

SEQ ID NO: 548120 - DNA, 20 bp, mouse
gattataaagataggttgtg

SEQ ID NO: 548121 - DNA, 20 bp, mouse
ggaattcagatgcactggtg

SEQ ID NO: 548122 - DNA, 20 bp, mouse
gagaggacagggtcatgatc

SEQ ID NO: 548123 - DNA, 20 bp, mouse
gttcctggccaatctctcct

SEQ ID NO: 548124 - DNA, 20 bp, mouse
ggatagtagaataatgtaat

SEQ ID NO: 548125 - DNA, 20 bp, mouse
gaaccaaggagagattggcc

SEQ ID NO: 548126 - DNA, 20 bp, mouse
gggtaagatgcaagtactga

SEQ ID NO: 548127 - DNA, 20 bp, mouse
ggatgcctgactcaatacat

SEQ ID NO: 548128 - DNA, 20 bp, mouse
gcattccaatgtattgagtc

SEQ ID NO: 548129 - DNA, 20 bp, mouse
gtgttgctccaagcattgct

SEQ ID NO: 548130 - DNA, 20 bp, mouse
gaaaaatgttaggaatattc

SEQ ID NO: 548131 - DNA, 20 bp, mouse
gtccaagcattgctaggaag

SEQ ID NO: 548132 - DNA, 20 bp, mouse
ggcatcttaccaaaaatgtt

SEQ ID NO: 548133 - DNA, 20 bp, mouse
gatttgatgagaatgagaca

SEQ ID NO: 548134 - DNA, 20 bp, mouse
gagcactgaaggcctgaaga

SEQ ID NO: 548135 - DNA, 20 bp, mouse
gcagtcagagtcagcactga

SEQ ID NO: 548136 - DNA, 20 bp, mouse
ggaattcagtgcagagggac

SEQ ID NO: 548137 - DNA, 20 bp, mouse
gctctgcactgaattcacat

SEQ ID NO: 548138 - DNA, 20 bp, mouse
gactctgagctcatgaagaa

SEQ ID NO: 548139 - DNA, 20 bp, mouse
gtgcactgaattcacattgg

SEQ ID NO: 548140 - DNA, 20 bp, mouse
gcagctcaagaccataagtg

SEQ ID NO: 548141 - DNA, 20 bp, mouse
gaaccaagaacacaacaaag

SEQ ID NO: 548142 - DNA, 20 bp, mouse
ggctgatatagcacatctct

SEQ ID NO: 548143 - DNA, 20 bp, mouse
gacatgggcgtgtgtagaga

SEQ ID NO: 548144 - DNA, 20 bp, mouse
gtctgtgaagacaacagagc

SEQ ID NO: 548145 - DNA, 20 bp, mouse
gcactctgtcagccccaaga

SEQ ID NO: 548146 - DNA, 20 bp, mouse
ggaattcctgtaagattgtt

SEQ ID NO: 548147 - DNA, 20 bp, mouse
gatcaaccaaacaatcttac

SEQ ID NO: 548148 - DNA, 20 bp, mouse
gaccatcatgggtttgactt

SEQ ID NO: 548149 - DNA, 20 bp, mouse
gttggttgatcattgttgtt

SEQ ID NO: 548150 - DNA, 20 bp, mouse
gacaaccgcatttcagacat

SEQ ID NO: 548151 - DNA, 20 bp, mouse
ggcaagcaacctgaccatca

SEQ ID NO: 548152 - DNA, 20 bp, mouse
gcaacatgtggccactgctt

SEQ ID NO: 548153 - DNA, 20 bp, mouse
gtatccttctcacagtgatg

SEQ ID NO: 548154 - DNA, 20 bp, mouse
gtatttgagggcattgcaga

SEQ ID NO: 548155 - DNA, 20 bp, mouse
gagaaagaccacaaagagac

SEQ ID NO: 548156 - DNA, 20 bp, mouse
gccttgactccagaggaata

SEQ ID NO: 548157 - DNA, 20 bp, mouse
gaattcatccttgactccag

SEQ ID NO: 548158 - DNA, 20 bp, mouse
gacccaccactataacagta

SEQ ID NO: 548159 - DNA, 20 bp, mouse
gctgaaccatactgttatag

SEQ ID NO: 548160 - DNA, 20 bp, mouse
gtaattttgccttattcctc

SEQ ID NO: 548161 - DNA, 20 bp, mouse
gttttaagcttgcgtcaaag

SEQ ID NO: 548162 - DNA, 20 bp, mouse
gcagcacccaactctcagaa

SEQ ID NO: 548163 - DNA, 20 bp, mouse
gagtcatgcatcctgtaaaa

SEQ ID NO: 548164 - DNA, 20 bp, mouse
gttttgcccattctgagagt

SEQ ID NO: 548165 - DNA, 20 bp, mouse
gagaatatcatcccttttac

SEQ ID NO: 548166 - DNA, 20 bp, mouse
gtgtcagagttcatacttat

SEQ ID NO: 548167 - DNA, 20 bp, mouse
gttaacagggaacaagccct

SEQ ID NO: 548168 - DNA, 20 bp, mouse
gacagtagttatgtctccca

SEQ ID NO: 548169 - DNA, 20 bp, mouse
gtgtgcagcaagcattaaca

SEQ ID NO: 548170 - DNA, 20 bp, mouse
gtgcttgctgcacacttgat

SEQ ID NO: 548171 - DNA, 20 bp, mouse
gtcagaaccagatgactttc

SEQ ID NO: 548172 - DNA, 20 bp, mouse
gacaacaccatctccttcac

SEQ ID NO: 548173 - DNA, 20 bp, mouse
gataagggccaccagagctc

SEQ ID NO: 548174 - DNA, 20 bp, mouse
ggggccaccagagctcaggc

SEQ ID NO: 548175 - DNA, 20 bp, mouse
ggacataccagcctgagctc

SEQ ID NO: 548176 - DNA, 20 bp, mouse
gacaagaataggatgaacag

SEQ ID NO: 548177 - DNA, 20 bp, mouse
gtggtgccctgactcataca

SEQ ID NO: 548178 - DNA, 20 bp, mouse
gaaaactcctcagcattgtg

SEQ ID NO: 548179 - DNA, 20 bp, mouse
gatgcatccttcataggata

SEQ ID NO: 548180 - DNA, 20 bp, mouse
gagaacaccatatcctatga

SEQ ID NO: 548181 - DNA, 20 bp, mouse
gtaggatgaacagaggcaac

SEQ ID NO: 548182 - DNA, 20 bp, mouse
gtgtgtagtttaacaagaat

SEQ ID NO: 548183 - DNA, 20 bp, mouse
gtgactgagttcattcttat

SEQ ID NO: 548184 - DNA, 20 bp, mouse
gctcaggtttcctaccacag

SEQ ID NO: 548185 - DNA, 20 bp, mouse
gatgaaagtcatgaagcaaa

SEQ ID NO: 548186 - DNA, 20 bp, mouse
gtgtagactactgaaagcat

SEQ ID NO: 548187 - DNA, 20 bp, mouse
gcttaacagaaaaccctaat

SEQ ID NO: 548188 - DNA, 20 bp, mouse
gtactgaaagcatgggaatt

SEQ ID NO: 548189 - DNA, 20 bp, mouse
gatcagaacacaagtctacg

SEQ ID NO: 548190 - DNA, 20 bp, mouse
ggacaggagtattacttctg

SEQ ID NO: 548191 - DNA, 20 bp, mouse
gggggatgatcattttgatt

SEQ ID NO: 548192 - DNA, 20 bp, mouse
ggagaggaacctgccaatta

SEQ ID NO: 548193 - DNA, 20 bp, mouse
gacagaaaaccctaattggc

SEQ ID NO: 548194 - DNA, 20 bp, mouse
gattccatgattcacacaat

SEQ ID NO: 548195 - DNA, 20 bp, mouse
gtgaaagaattcatactgat

SEQ ID NO: 548196 - DNA, 20 bp, mouse
gatagaaattatcaaagaat

SEQ ID NO: 548197 - DNA, 20 bp, mouse
gatagcacttgtgtgtgcta

SEQ ID NO: 548198 - DNA, 20 bp, mouse
ggtaacagcagtgggaaacc

SEQ ID NO: 548199 - DNA, 20 bp, mouse
gttctttgtgatctttgtgg

SEQ ID NO: 548200 - DNA, 20 bp, mouse
gtttttctttgtgatctttg

SEQ ID NO: 548201 - DNA, 20 bp, mouse
ggaatagcagagatcaacac

SEQ ID NO: 548202 - DNA, 20 bp, mouse
gttatcaaagaatgggcact

SEQ ID NO: 548203 - DNA, 20 bp, mouse
gactagcagtgagcaaagtc

SEQ ID NO: 548204 - DNA, 20 bp, mouse
gagcagtgagcaaagtctgg

SEQ ID NO: 548205 - DNA, 20 bp, mouse
gtgttggttgctttcatctt

SEQ ID NO: 548206 - DNA, 20 bp, mouse
gaccagggaaatgattgcca

SEQ ID NO: 548207 - DNA, 20 bp, mouse
gcccctggcaatcatttccc

SEQ ID NO: 548208 - DNA, 20 bp, mouse
ggactcactcaaccccatgg

SEQ ID NO: 548209 - DNA, 20 bp, mouse
gatctctgtgctgtttcccc

SEQ ID NO: 548210 - DNA, 20 bp, mouse
gcaagactcactcaacccca

SEQ ID NO: 548211 - DNA, 20 bp, mouse
gtatgatggaaaggttgcac

SEQ ID NO: 548212 - DNA, 20 bp, mouse
gaagagcagtattattatta

SEQ ID NO: 548213 - DNA, 20 bp, mouse
gaccatcagtacacaaagag

SEQ ID NO: 548214 - DNA, 20 bp, mouse
gagcatttttgggactgtac

SEQ ID NO: 548215 - DNA, 20 bp, mouse
ggcaaagatctatgatggaa

SEQ ID NO: 548216 - DNA, 20 bp, mouse
gtgattacaaagtaatgcaa

SEQ ID NO: 548217 - DNA, 20 bp, mouse
gagagggaaagtagtgggca

SEQ ID NO: 548218 - DNA, 20 bp, mouse
ggagatagagggaaagtagt

SEQ ID NO: 548219 - DNA, 20 bp, mouse
ggagtaagagagggagatag

SEQ ID NO: 548220 - DNA, 20 bp, mouse
gagtagtgggcagggtgaca

SEQ ID NO: 548221 - DNA, 20 bp, mouse
gacagtaagaagagtaagag

SEQ ID NO: 548222 - DNA, 20 bp, mouse
gtggagatggggatccagga

SEQ ID NO: 548223 - DNA, 20 bp, mouse
ggctaggagcagacactcaa

SEQ ID NO: 548224 - DNA, 20 bp, mouse
gtataaacactgaaagacta

SEQ ID NO: 548225 - DNA, 20 bp, mouse
gtgtatggagatggggatcc

SEQ ID NO: 548226 - DNA, 20 bp, mouse
gttatcctgggaaaatcaaa

SEQ ID NO: 548227 - DNA, 20 bp, mouse
ggtgtagcagacctccagaa

SEQ ID NO: 548228 - DNA, 20 bp, mouse
gtgaggatggggtatcggag

SEQ ID NO: 548229 - DNA, 20 bp, mouse
ggaaaatcaaacggtgatag

SEQ ID NO: 548230 - DNA, 20 bp, mouse
gctggcagatagctaggtag

SEQ ID NO: 548231 - DNA, 20 bp, mouse
ggagaggctggcagatagct

SEQ ID NO: 548232 - DNA, 20 bp, mouse
ggaaatattcagctgtaaga

SEQ ID NO: 548233 - DNA, 20 bp, mouse
gatcttggggacaatgttag

SEQ ID NO: 548234 - DNA, 20 bp, mouse
ggtgaacctgtcctttctgg

SEQ ID NO: 548235 - DNA, 20 bp, mouse
gcatgggagtgtgaagagca

SEQ ID NO: 548236 - DNA, 20 bp, mouse
gggtaaccagatacatgaca

SEQ ID NO: 548237 - DNA, 20 bp, mouse
gcagaacaatctctaacctc

SEQ ID NO: 548238 - DNA, 20 bp, mouse
gatctctaacctcgggtacc

SEQ ID NO: 548239 - DNA, 20 bp, mouse
gcagcctgtcacccaggaga

SEQ ID NO: 548240 - DNA, 20 bp, mouse
ggcacacccagaaaagataa

SEQ ID NO: 548241 - DNA, 20 bp, mouse
ggggattttcccggtacccg

SEQ ID NO: 548242 - DNA, 20 bp, mouse
ggccagaagtatacactctg

SEQ ID NO: 548243 - DNA, 20 bp, mouse
gggagcctttttttcctaga

SEQ ID NO: 548244 - DNA, 20 bp, mouse
ggtaccccatcatcatgaac

SEQ ID NO: 548245 - DNA, 20 bp, mouse
ggataagagtacagttaccc

SEQ ID NO: 548246 - DNA, 20 bp, mouse
gtgtgaaatagaaactacac

SEQ ID NO: 548247 - DNA, 20 bp, mouse
gcatgtattactgcggggac

SEQ ID NO: 548248 - DNA, 20 bp, mouse
ggtcagacatgtattactgc

SEQ ID NO: 548249 - DNA, 20 bp, mouse
gtttaaaagtattactgaca

SEQ ID NO: 548250 - DNA, 20 bp, mouse
gcttttaaatgggatataga

SEQ ID NO: 548251 - DNA, 20 bp, mouse
gtttgcatgaagaatttaag

SEQ ID NO: 548252 - DNA, 20 bp, mouse
gaaaagcagaccaggctcaa

SEQ ID NO: 548253 - DNA, 20 bp, mouse
ggcaaagaagagttgagtcc

SEQ ID NO: 548254 - DNA, 20 bp, mouse
ggtgaatggaaaagcagacc

SEQ ID NO: 548255 - DNA, 20 bp, mouse
gtgtccatcacagaaggagg

SEQ ID NO: 548256 - DNA, 20 bp, mouse
gagctggagttctggatact

SEQ ID NO: 548257 - DNA, 20 bp, mouse
ggagctgagtagatgaagat

SEQ ID NO: 548258 - DNA, 20 bp, mouse
gtgacagaattctttctcgt

SEQ ID NO: 548259 - DNA, 20 bp, mouse
gtgtagagcacaaccaagga

SEQ ID NO: 548260 - DNA, 20 bp, mouse
gtctgtagaacccaagccaa

SEQ ID NO: 548261 - DNA, 20 bp, mouse
ggagcacaaataggaaaagc

SEQ ID NO: 548262 - DNA, 20 bp, mouse
gtactttgttcatgattata

SEQ ID NO: 548263 - DNA, 20 bp, mouse
gctgtgtggtcctgggtcat

SEQ ID NO: 548264 - DNA, 20 bp, mouse
ggagcagactgtttcccagg

SEQ ID NO: 548265 - DNA, 20 bp, mouse
gtgtacttgataatcctcct

SEQ ID NO: 548266 - DNA, 20 bp, mouse
ggaagctactgagaattagg

SEQ ID NO: 548267 - DNA, 20 bp, mouse
ggaaggcgggcatcctccta

SEQ ID NO: 548268 - DNA, 20 bp, mouse
ggatcacccgaagctgcaga

SEQ ID NO: 548269 - DNA, 20 bp, mouse
gtctgtcaacatggaatcat

SEQ ID NO: 548270 - DNA, 20 bp, mouse
gcattggtcatctccatagg

SEQ ID NO: 548271 - DNA, 20 bp, mouse
gtgacagaatttctcttggt

SEQ ID NO: 548272 - DNA, 20 bp, mouse
gtaaaaccgtctgcagcttc

SEQ ID NO: 548273 - DNA, 20 bp, mouse
gagtgtgcaggcggatgtca

SEQ ID NO: 548274 - DNA, 20 bp, mouse
gcccagcatccagctgccat

SEQ ID NO: 548275 - DNA, 20 bp, mouse
ggctgggcttgttgactcag

SEQ ID NO: 548276 - DNA, 20 bp, mouse
ggctagccattagcaagtaa

SEQ ID NO: 548277 - DNA, 20 bp, mouse
gttcagaaatatcaaccaaa

SEQ ID NO: 548278 - DNA, 20 bp, mouse
gtctttgagtgaactaggga

SEQ ID NO: 548279 - DNA, 20 bp, mouse
gtacacaaggaataaactat

SEQ ID NO: 548280 - DNA, 20 bp, mouse
gtaaatctttgagtgaacta

SEQ ID NO: 548281 - DNA, 20 bp, mouse
ggacagggaatattctagat

SEQ ID NO: 548282 - DNA, 20 bp, mouse
gaatcgcctttacttgctaa

SEQ ID NO: 548283 - DNA, 20 bp, mouse
gtctagataggtgcatctat

SEQ ID NO: 548284 - DNA, 20 bp, mouse
gttgctaatggctagccctt

SEQ ID NO: 548285 - DNA, 20 bp, mouse
ggtgagaatgagatagcgtg

SEQ ID NO: 548286 - DNA, 20 bp, mouse
gtggctgaccgtggatgaca

SEQ ID NO: 548287 - DNA, 20 bp, mouse
ggcgcagtggatatgtgcta

SEQ ID NO: 548288 - DNA, 20 bp, mouse
gatccacggtcagccatcat

SEQ ID NO: 548289 - DNA, 20 bp, mouse
gttccaatgatggctgaccg

SEQ ID NO: 548290 - DNA, 20 bp, mouse
gtttttatccatgtcatcca

SEQ ID NO: 548291 - DNA, 20 bp, mouse
ggaattcagaaacaaacgtc

SEQ ID NO: 548292 - DNA, 20 bp, mouse
gtgttgtgtagcagatatcc

SEQ ID NO: 548293 - DNA, 20 bp, mouse
gtcttctgtcccttcaacat

SEQ ID NO: 548294 - DNA, 20 bp, mouse
gctgtttgttttgggcgcag

SEQ ID NO: 548295 - DNA, 20 bp, mouse
ggtgcagtgcagatgttctt

SEQ ID NO: 548296 - DNA, 20 bp, mouse
ggaaccaaagacggaaagac

SEQ ID NO: 548297 - DNA, 20 bp, mouse
gcttagagtgtcacgagcag

SEQ ID NO: 548298 - DNA, 20 bp, mouse
ggttcttggtggctttgagt

SEQ ID NO: 548299 - DNA, 20 bp, mouse
gagacaggcttggttcttgg

SEQ ID NO: 548300 - DNA, 20 bp, mouse
gtcagcatggccacacgtcc

SEQ ID NO: 548301 - DNA, 20 bp, mouse
ggaaatggctcaagagacac

SEQ ID NO: 548302 - DNA, 20 bp, mouse
gtcttctcatagtggagtcc

SEQ ID NO: 548303 - DNA, 20 bp, mouse
gaagcctgtctttccgtctt

SEQ ID NO: 548304 - DNA, 20 bp, mouse
ggcatcttagatgacctgaa

SEQ ID NO: 548305 - DNA, 20 bp, mouse
gctctaagtgggttcacttc

SEQ ID NO: 548306 - DNA, 20 bp, mouse
gtacggtgacttcaattctg

SEQ ID NO: 548307 - DNA, 20 bp, mouse
gagcagacacagcacaaata

SEQ ID NO: 548308 - DNA, 20 bp, mouse
gataggagtgagagcagaag

SEQ ID NO: 548309 - DNA, 20 bp, mouse
gtgaatatactaccataaaa

SEQ ID NO: 548310 - DNA, 20 bp, mouse
ggtcataggccatcatagag

SEQ ID NO: 548311 - DNA, 20 bp, mouse
gtaataatgggatatctcag

SEQ ID NO: 548312 - DNA, 20 bp, mouse
gcagattgcaggcagctcct

SEQ ID NO: 548313 - DNA, 20 bp, mouse
ggcacatcccgagaaggaaa

SEQ ID NO: 548314 - DNA, 20 bp, mouse
gagtgtgcagatgagaatca

SEQ ID NO: 548315 - DNA, 20 bp, mouse
gacacattcagtggagccca

SEQ ID NO: 548316 - DNA, 20 bp, mouse
gccacctggctgaccctcgt

SEQ ID NO: 548317 - DNA, 20 bp, mouse
gagcttcccgaagcccacga

SEQ ID NO: 548318 - DNA, 20 bp, mouse
gtcgggaagctgaaacacct

SEQ ID NO: 548319 - DNA, 20 bp, mouse
ggagggtcagccaggtggtc

SEQ ID NO: 548320 - DNA, 20 bp, mouse
gaagcccacgagggtcagcc

SEQ ID NO: 548321 - DNA, 20 bp, mouse
ggggctcagatctccatgag

SEQ ID NO: 548322 - DNA, 20 bp, mouse
gggaagctctgtaacagccg

SEQ ID NO: 548323 - DNA, 20 bp, mouse
ggctgccaaggccagagtga

SEQ ID NO: 548324 - DNA, 20 bp, mouse
ggatctccagcagggagaaa

SEQ ID NO: 548325 - DNA, 20 bp, mouse
gcactcggctgcagccagag

SEQ ID NO: 548326 - DNA, 20 bp, mouse
gctgcccatagagtagcggg

SEQ ID NO: 548327 - DNA, 20 bp, mouse
gagcagcttcggtaccgtga

SEQ ID NO: 548328 - DNA, 20 bp, mouse
ggaaaagtagagcctggatc

SEQ ID NO: 548329 - DNA, 20 bp, mouse
gaggcagccctctacagaga

SEQ ID NO: 548330 - DNA, 20 bp, mouse
gctgccacccgctactctat

SEQ ID NO: 548331 - DNA, 20 bp, mouse
ggcaggtccttcagcagctt

SEQ ID NO: 548332 - DNA, 20 bp, mouse
gaggacgtgccatccacaaa

SEQ ID NO: 548333 - DNA, 20 bp, mouse
gctctgcttctcatccgtca

SEQ ID NO: 548334 - DNA, 20 bp, mouse
gcatctgcccatagagtagc

SEQ ID NO: 548335 - DNA, 20 bp, mouse
gctaagtaacctgtccttcc

SEQ ID NO: 548336 - DNA, 20 bp, mouse
ggccatgacagagagcaggc

SEQ ID NO: 548337 - DNA, 20 bp, mouse
gaaaaagtagagccgggatc

SEQ ID NO: 548338 - DNA, 20 bp, mouse
gagcagtttcggtatcgtga

SEQ ID NO: 548339 - DNA, 20 bp, mouse
ggcctgcctgctctctgtca

SEQ ID NO: 548340 - DNA, 20 bp, mouse
gaggcagccttctattgaga

SEQ ID NO: 548341 - DNA, 20 bp, mouse
gaggcttgtggtcatctcat

SEQ ID NO: 548342 - DNA, 20 bp, mouse
gccattagtgattatttcct

SEQ ID NO: 548343 - DNA, 20 bp, mouse
gatcacctggccgtagagca

SEQ ID NO: 548344 - DNA, 20 bp, mouse
gcatcccctgctctacggcc

SEQ ID NO: 548345 - DNA, 20 bp, mouse
ggaaataatcactaatggcc

SEQ ID NO: 548346 - DNA, 20 bp, mouse
gtcgcgtgtctgctaggcaa

SEQ ID NO: 548347 - DNA, 20 bp, mouse
gtggaacacgagagagaagt

SEQ ID NO: 548348 - DNA, 20 bp, mouse
ggtgtctgctaggcaaagga

SEQ ID NO: 548349 - DNA, 20 bp, mouse
gtgtctggccctctttctta

SEQ ID NO: 548350 - DNA, 20 bp, mouse
ggcgtgagaccctaagaaag

SEQ ID NO: 548351 - DNA, 20 bp, mouse
gcccaagcaggataaactcg

SEQ ID NO: 548352 - DNA, 20 bp, mouse
gagacactcgcgtgtctgct

SEQ ID NO: 548353 - DNA, 20 bp, mouse
gagcatcaggttccccatga

SEQ ID NO: 548354 - DNA, 20 bp, mouse
ggttccaaaagaaacgtcaa

SEQ ID NO: 548355 - DNA, 20 bp, mouse
gcaggttccccatgagggtc

SEQ ID NO: 548356 - DNA, 20 bp, mouse
ggagtgcaggttgaatgtgg

SEQ ID NO: 548357 - DNA, 20 bp, mouse
gggaacaggacaaagagtgc

SEQ ID NO: 548358 - DNA, 20 bp, mouse
gatcttgggcgccgtgacag

SEQ ID NO: 548359 - DNA, 20 bp, mouse
gagaggagtgacagagatcc

SEQ ID NO: 548360 - DNA, 20 bp, mouse
gccggtggcgaagacgaaga

SEQ ID NO: 548361 - DNA, 20 bp, mouse
gtccatgagtttgttcttct

SEQ ID NO: 548362 - DNA, 20 bp, mouse
gctctgtcactcctctgtca

SEQ ID NO: 548363 - DNA, 20 bp, mouse
gacctggctgtagagcaaag

SEQ ID NO: 548364 - DNA, 20 bp, mouse
gggttgaatgtgggggtcgg

SEQ ID NO: 548365 - DNA, 20 bp, mouse
gaaagagtgcaggttgaatg

SEQ ID NO: 548366 - DNA, 20 bp, mouse
gatcatcagacagaccaagg

SEQ ID NO: 548367 - DNA, 20 bp, mouse
gtgcatcatcagacagacca

SEQ ID NO: 548368 - DNA, 20 bp, mouse
gggtcaggacatagatcaca

SEQ ID NO: 548369 - DNA, 20 bp, mouse
gggccaggcaacccttcaca

SEQ ID NO: 548370 - DNA, 20 bp, mouse
gctgaccatagagtagaggg

SEQ ID NO: 548371 - DNA, 20 bp, mouse
gtgagtagtataccttccct

SEQ ID NO: 548372 - DNA, 20 bp, mouse
gaaagcctcagtacccccaa

SEQ ID NO: 548373 - DNA, 20 bp, mouse
ggtccaggctctactctttg

SEQ ID NO: 548374 - DNA, 20 bp, mouse
gtctgccaggtgctagtgtg

SEQ ID NO: 548375 - DNA, 20 bp, mouse
gctatgtcctgaccctgaca

SEQ ID NO: 548376 - DNA, 20 bp, mouse
gaccccaaaagggagactcg

SEQ ID NO: 548377 - DNA, 20 bp, mouse
gcttgaagcagaccccaaaa

SEQ ID NO: 548378 - DNA, 20 bp, mouse
gtgagtcaaacaggaggcaa

SEQ ID NO: 548379 - DNA, 20 bp, mouse
gcagatggaccaacatctgt

SEQ ID NO: 548380 - DNA, 20 bp, mouse
gtacatctgagtcaaacagg

SEQ ID NO: 548381 - DNA, 20 bp, mouse
gtggaccaacatctgtggga

SEQ ID NO: 548382 - DNA, 20 bp, mouse
gttcctcgagtctccctttt

SEQ ID NO: 548383 - DNA, 20 bp, mouse
gagatacatctgagtcaaac

SEQ ID NO: 548384 - DNA, 20 bp, mouse
gtgtatctggtttttggtgt

SEQ ID NO: 548385 - DNA, 20 bp, mouse
ggagcaatgcccgtgtggaa

SEQ ID NO: 548386 - DNA, 20 bp, mouse
gtctatcctggtgccagtcc

SEQ ID NO: 548387 - DNA, 20 bp, mouse
gtagcagccatcgagagaga

SEQ ID NO: 548388 - DNA, 20 bp, mouse
ggtgactccttctctctcga

SEQ ID NO: 548389 - DNA, 20 bp, mouse
ggggtagaaggccaatagtt

SEQ ID NO: 548390 - DNA, 20 bp, mouse
gcagtcctggctggggtaga

SEQ ID NO: 548391 - DNA, 20 bp, mouse
gtcagtcacagccaaactat

SEQ ID NO: 548392 - DNA, 20 bp, mouse
gcctggtgccagtcctggct

SEQ ID NO: 548393 - DNA, 20 bp, mouse
gatttatagggctgtgggcc

SEQ ID NO: 548394 - DNA, 20 bp, mouse
gttggccttctaccccagcc

SEQ ID NO: 548395 - DNA, 20 bp, mouse
gcatatcgagtcaaatttcc

SEQ ID NO: 548396 - DNA, 20 bp, mouse
gtctatcctggtgccagtcc

SEQ ID NO: 548397 - DNA, 20 bp, mouse
gtagcagccatcgagagaga

SEQ ID NO: 548398 - DNA, 20 bp, mouse
ggtgactccttctctctcga

SEQ ID NO: 548399 - DNA, 20 bp, mouse
ggggtagaaggccaatagtt

SEQ ID NO: 548400 - DNA, 20 bp, mouse
gatttatagggctgtgggcc

SEQ ID NO: 548401 - DNA, 20 bp, mouse
gcagtcctggctggggtaga

SEQ ID NO: 548402 - DNA, 20 bp, mouse
gtcagtcacagccaaactat

SEQ ID NO: 548403 - DNA, 20 bp, mouse
gcctggtgccagtcctggct

SEQ ID NO: 548404 - DNA, 20 bp, mouse
gttggccttctaccccagcc

SEQ ID NO: 548405 - DNA, 20 bp, mouse
gaagcacacccgagagagag

SEQ ID NO: 548406 - DNA, 20 bp, mouse
gactcccatgtattacctgt

SEQ ID NO: 548407 - DNA, 20 bp, mouse
gagtcccagctagagccacc

SEQ ID NO: 548408 - DNA, 20 bp, mouse
gtttcctggtggctctagct

SEQ ID NO: 548409 - DNA, 20 bp, mouse
ggaggtcagagagccctatg

SEQ ID NO: 548410 - DNA, 20 bp, mouse
gtggatagcgcacttcaggg

SEQ ID NO: 548411 - DNA, 20 bp, mouse
ggactcagttcatcctcata

SEQ ID NO: 548412 - DNA, 20 bp, mouse
ggagtggatagcgcacttca

SEQ ID NO: 548413 - DNA, 20 bp, mouse
gcttggggacagtagctgat

SEQ ID NO: 548414 - DNA, 20 bp, mouse
gatcctgtggataaaggaga

SEQ ID NO: 548415 - DNA, 20 bp, mouse
gatctgatagatgatgacaa

SEQ ID NO: 548416 - DNA, 20 bp, mouse
gcagcaacaaattacatcag

SEQ ID NO: 548417 - DNA, 20 bp, mouse
gtctttctcgaactattttt

SEQ ID NO: 548418 - DNA, 20 bp, mouse
ggtttacattagaaatggta

SEQ ID NO: 548419 - DNA, 20 bp, mouse
ggcacagtttacattagaaa

SEQ ID NO: 548420 - DNA, 20 bp, mouse
gtgtattaacacttgttctt

SEQ ID NO: 548421 - DNA, 20 bp, mouse
ggtaaggaagtctgaattgt

SEQ ID NO: 548422 - DNA, 20 bp, mouse
gattcaagtttctgtcacat

SEQ ID NO: 548423 - DNA, 20 bp, mouse
gaattctaaaaatactatac

SEQ ID NO: 548424 - DNA, 20 bp, mouse
gaaattaataacaatatata

SEQ ID NO: 548425 - DNA, 20 bp, mouse
gactaatcataaaatacact

SEQ ID NO: 548426 - DNA, 20 bp, mouse
gtctaaaatcagttctagac

SEQ ID NO: 548427 - DNA, 20 bp, mouse
gcaatgcctgggtaagtata

SEQ ID NO: 548428 - DNA, 20 bp, mouse
gacaaaaaggggaaggtcaa

SEQ ID NO: 548429 - DNA, 20 bp, mouse
ggagtggaagaacaatgcct

SEQ ID NO: 548430 - DNA, 20 bp, mouse
gggtctccgtatacttaccc

SEQ ID NO: 548431 - DNA, 20 bp, mouse
gtggagtatggtacattaca

SEQ ID NO: 548432 - DNA, 20 bp, mouse
gggaattctatctaaaagta

SEQ ID NO: 548433 - DNA, 20 bp, mouse
gcttcattctcatttttgag

SEQ ID NO: 548434 - DNA, 20 bp, mouse
gacagcaatatcatggagta

SEQ ID NO: 548435 - DNA, 20 bp, mouse
ggaccttcccctttttgtac

SEQ ID NO: 548436 - DNA, 20 bp, mouse
gatgaactcggtaaccaagg

SEQ ID NO: 548437 - DNA, 20 bp, mouse
gaaggtggaattggtaacta

SEQ ID NO: 548438 - DNA, 20 bp, mouse
ggtggaattggtaactaggg

SEQ ID NO: 548439 - DNA, 20 bp, mouse
gttggtaactagggtggagt

SEQ ID NO: 548440 - DNA, 20 bp, mouse
ggtacatgggaagcctgtta

SEQ ID NO: 548441 - DNA, 20 bp, mouse
ggtggctggatgtgtagcac

SEQ ID NO: 548442 - DNA, 20 bp, mouse
gtgtgtagcacaggtctttt

SEQ ID NO: 548443 - DNA, 20 bp, mouse
gagcatgaactcggtaacca

SEQ ID NO: 548444 - DNA, 20 bp, mouse
gtcggtaaccaaggtggaat

SEQ ID NO: 548445 - DNA, 20 bp, mouse
gaaatcttccagcatgaact

SEQ ID NO: 548446 - DNA, 20 bp, mouse
gatgaaccctgttattctag

SEQ ID NO: 548447 - DNA, 20 bp, mouse
ggatgagcgtgatgagaagt

SEQ ID NO: 548448 - DNA, 20 bp, mouse
gaataaagaatacatccaac

SEQ ID NO: 548449 - DNA, 20 bp, mouse
gagtcgtaactgtatgctga

SEQ ID NO: 548450 - DNA, 20 bp, mouse
gtaatgacttcttttggagc

SEQ ID NO: 548451 - DNA, 20 bp, mouse
ggtgtgtgggctgttcttgc

SEQ ID NO: 548452 - DNA, 20 bp, mouse
ggtcatatgacatggctgtt

SEQ ID NO: 548453 - DNA, 20 bp, mouse
gtgtttttaatgacttcttt

SEQ ID NO: 548454 - DNA, 20 bp, mouse
gtgaactacagactgtgtgt

SEQ ID NO: 548455 - DNA, 20 bp, mouse
ggtcattaaaaacaattgga

SEQ ID NO: 548456 - DNA, 20 bp, mouse
ggatgataagattccccaac

SEQ ID NO: 548457 - DNA, 20 bp, mouse
gagtctttactttgggacta

SEQ ID NO: 548458 - DNA, 20 bp, mouse
gacaggagcatttctttggc

SEQ ID NO: 548459 - DNA, 20 bp, mouse
gcaagaacagcacagtgagt

SEQ ID NO: 548460 - DNA, 20 bp, mouse
ggatcacaggagcatttctt

SEQ ID NO: 548461 - DNA, 20 bp, mouse
gtttctttggctgggtgtgc

SEQ ID NO: 548462 - DNA, 20 bp, mouse
gaaggatagctggaaagttt

SEQ ID NO: 548463 - DNA, 20 bp, mouse
gaaacttccaggaagaactc

SEQ ID NO: 548464 - DNA, 20 bp, mouse
gaggaagaactcaggcacca

SEQ ID NO: 548465 - DNA, 20 bp, mouse
gagtctcagcaaaaacttcc

SEQ ID NO: 548466 - DNA, 20 bp, mouse
gtatgcaatcagttatagat

SEQ ID NO: 548467 - DNA, 20 bp, mouse
gtcttaaggaaattactggt

SEQ ID NO: 548468 - DNA, 20 bp, mouse
gaaataagagtagaaggtca

SEQ ID NO: 548469 - DNA, 20 bp, mouse
gtagagtatgatatactaca

SEQ ID NO: 548470 - DNA, 20 bp, mouse
gaaattactggttggctctc

SEQ ID NO: 548471 - DNA, 20 bp, mouse
ggtaagaagtgttagtcatg

SEQ ID NO: 548472 - DNA, 20 bp, mouse
gccctgtaaataagagtaga

SEQ ID NO: 548473 - DNA, 20 bp, mouse
gaaatcttactataatactg

SEQ ID NO: 548474 - DNA, 20 bp, mouse
gaatctttcaaatttagcaa

SEQ ID NO: 548475 - DNA, 20 bp, mouse
gaaatttagcaaggggttac

SEQ ID NO: 548476 - DNA, 20 bp, mouse
ggagagtttatacaggcatt

SEQ ID NO: 548477 - DNA, 20 bp, mouse
gcatcatagtctcaaagtac

SEQ ID NO: 548478 - DNA, 20 bp, mouse
ggaaagtgttcatacctgaa

SEQ ID NO: 548479 - DNA, 20 bp, mouse
gactatgatgaattctacca

SEQ ID NO: 548480 - DNA, 20 bp, mouse
gctcaaagtacaggtttatc

SEQ ID NO: 548481 - DNA, 20 bp, mouse
gatacctgaaaggataagtg

SEQ ID NO: 548482 - DNA, 20 bp, mouse
gttcttttgtgcatgtgtag

SEQ ID NO: 548483 - DNA, 20 bp, mouse
gttacctcacttatcctttc

SEQ ID NO: 548484 - DNA, 20 bp, mouse
gtcagtgagagagtttatac

SEQ ID NO: 548485 - DNA, 20 bp, mouse
ggatggtaagattcccgaac

SEQ ID NO: 548486 - DNA, 20 bp, mouse
gcagggtgatgagtgtgatg

SEQ ID NO: 548487 - DNA, 20 bp, mouse
gggtgatgagtgtgatgagg

SEQ ID NO: 548488 - DNA, 20 bp, mouse
ggggctattggagtactctt

SEQ ID NO: 548489 - DNA, 20 bp, mouse
gatgacttcttttgcatctg

SEQ ID NO: 548490 - DNA, 20 bp, mouse
gataaagaagatatccaaca

SEQ ID NO: 548491 - DNA, 20 bp, mouse
ggaaaaagtacataggtgtt

SEQ ID NO: 548492 - DNA, 20 bp, mouse
gagtcattaaaaacacttgg

SEQ ID NO: 548493 - DNA, 20 bp, mouse
gtgatggtctcatagtgtag

SEQ ID NO: 548494 - DNA, 20 bp, mouse
ggatgagtgtgatgaggagg

SEQ ID NO: 548495 - DNA, 20 bp, mouse
gcctgttattctagtgtcat

SEQ ID NO: 548496 - DNA, 20 bp, mouse
gaggatgaacaattccaccc

SEQ ID NO: 548497 - DNA, 20 bp, mouse
gatgataagagagctatgta

SEQ ID NO: 548498 - DNA, 20 bp, mouse
gcaactctctcactggccag

SEQ ID NO: 548499 - DNA, 20 bp, mouse
gagaaatcctgcactttcca

SEQ ID NO: 548500 - DNA, 20 bp, mouse
ggttcatccttggaaagtgc

SEQ ID NO: 548501 - DNA, 20 bp, mouse
gctggtggttcatgatcaca

SEQ ID NO: 548502 - DNA, 20 bp, mouse
gagtcacagaaatattcctc

SEQ ID NO: 548503 - DNA, 20 bp, mouse
gagagttgaaacaagcattt

SEQ ID NO: 548504 - DNA, 20 bp, mouse
ggatgataaggttcccgaac

SEQ ID NO: 548505 - DNA, 20 bp, mouse
gcttgtttcaactctctcac

SEQ ID NO: 548506 - DNA, 20 bp, mouse
gccatcagaccagagcaggg

SEQ ID NO: 548507 - DNA, 20 bp, mouse
ggatgggaaaccccaggaga

SEQ ID NO: 548508 - DNA, 20 bp, mouse
ggtctgagttccttctcctg

SEQ ID NO: 548509 - DNA, 20 bp, mouse
gagctactagcatggcacaa

SEQ ID NO: 548510 - DNA, 20 bp, mouse
gtgtgaaacacactcctcat

SEQ ID NO: 548511 - DNA, 20 bp, mouse
ggttccccagcactgtaata

SEQ ID NO: 548512 - DNA, 20 bp, mouse
gagcactgtaataaggtaca

SEQ ID NO: 548513 - DNA, 20 bp, mouse
gtcctcataggtaatgggta

SEQ ID NO: 548514 - DNA, 20 bp, mouse
gacacactcctcataggtaa

SEQ ID NO: 548515 - DNA, 20 bp, mouse
gataggtaatgggtatgggc

SEQ ID NO: 548516 - DNA, 20 bp, mouse
ggtcagcacaaagccagcgg

SEQ ID NO: 548517 - DNA, 20 bp, mouse
gggagatgggcagcgagcac

SEQ ID NO: 548518 - DNA, 20 bp, mouse
gactggaactactccaccgc

SEQ ID NO: 548519 - DNA, 20 bp, mouse
gagttcacagtgacagagag

SEQ ID NO: 548520 - DNA, 20 bp, mouse
gctgtccccaagatgatagt

SEQ ID NO: 548521 - DNA, 20 bp, mouse
gtgagcactgggtatcgcag

SEQ ID NO: 548522 - DNA, 20 bp, mouse
gcatgagcaggcacacccgg

SEQ ID NO: 548523 - DNA, 20 bp, mouse
gcaccatgctgaacaggaac

SEQ ID NO: 548524 - DNA, 20 bp, mouse
gtgtctggctgttgttaaaa

SEQ ID NO: 548525 - DNA, 20 bp, mouse
ggaaagcctactatcatctt

SEQ ID NO: 548526 - DNA, 20 bp, mouse
ggtgcaactcattagagata

SEQ ID NO: 548527 - DNA, 20 bp, mouse
ggtgttctcaactgacctgg

SEQ ID NO: 548528 - DNA, 20 bp, mouse
gcaaatcaaagacttacaga

SEQ ID NO: 548529 - DNA, 20 bp, mouse
gtgagttgcacaaagcctcc

SEQ ID NO: 548530 - DNA, 20 bp, mouse
gctggtgttctcaactgacc

SEQ ID NO: 548531 - DNA, 20 bp, mouse
gatggaagatacatcatcac

SEQ ID NO: 548532 - DNA, 20 bp, mouse
gagtgaaacaaggaattact

SEQ ID NO: 548533 - DNA, 20 bp, mouse
gtttcggactgagtgaaaca

SEQ ID NO: 548534 - DNA, 20 bp, mouse
gcttccatgcttatttatag

SEQ ID NO: 548535 - DNA, 20 bp, mouse
gcgaaaggtttaagaaggaa

SEQ ID NO: 548536 - DNA, 20 bp, mouse
gacagcacccaggtgatcgt

SEQ ID NO: 548537 - DNA, 20 bp, mouse
gcactcacctacgatcacct

SEQ ID NO: 548538 - DNA, 20 bp, mouse
ggctagcaagatgcactcag

SEQ ID NO: 548539 - DNA, 20 bp, mouse
ggccagcaacttaggcaccg

SEQ ID NO: 548540 - DNA, 20 bp, mouse
gaagtgagtaatgcagaggg

SEQ ID NO: 548541 - DNA, 20 bp, mouse
gccagatctccaggaacgat

SEQ ID NO: 548542 - DNA, 20 bp, mouse
gtacatgggtgtctgtaatg

SEQ ID NO: 548543 - DNA, 20 bp, mouse
ggctgcagtgaagaggagcc

SEQ ID NO: 548544 - DNA, 20 bp, mouse
gctggctacatgtgtcacaa

SEQ ID NO: 548545 - DNA, 20 bp, mouse
gttagaaacatcataaacaa

SEQ ID NO: 548546 - DNA, 20 bp, mouse
gctgttactctagtgtcatt

SEQ ID NO: 548547 - DNA, 20 bp, mouse
gatcatcacggtcatcactc

SEQ ID NO: 548548 - DNA, 20 bp, mouse
ggatgatgaactttgggatt

SEQ ID NO: 548549 - DNA, 20 bp, mouse
ggcattctcgttttttccca

SEQ ID NO: 548550 - DNA, 20 bp, mouse
gaatgtaattgttgtgagtt

SEQ ID NO: 548551 - DNA, 20 bp, mouse
gacaattacatttcgattct

SEQ ID NO: 548552 - DNA, 20 bp, mouse
gtaatgacttcgttctcagc

SEQ ID NO: 548553 - DNA, 20 bp, mouse
ggtcattaaaagtatctgaa

SEQ ID NO: 548554 - DNA, 20 bp, mouse
gtaacacagaggagagcaaa

SEQ ID NO: 548555 - DNA, 20 bp, mouse
gggttattgatgatgaactt

SEQ ID NO: 548556 - DNA, 20 bp, mouse
gtaactggattcatacttat

SEQ ID NO: 548557 - DNA, 20 bp, mouse
gccaatgtcactgcagtaac

SEQ ID NO: 548558 - DNA, 20 bp, mouse
gtatttttagtactatacct

SEQ ID NO: 548559 - DNA, 20 bp, mouse
gtaatgacctcataatgtag

SEQ ID NO: 548560 - DNA, 20 bp, mouse
ggttactcattaaaattccc

SEQ ID NO: 548561 - DNA, 20 bp, mouse
gtgaaatgcacatccaagta

SEQ ID NO: 548562 - DNA, 20 bp, mouse
gtgatgatgagcgtttcctg

SEQ ID NO: 548563 - DNA, 20 bp, mouse
ggcacatccaagtatggaaa

SEQ ID NO: 548564 - DNA, 20 bp, mouse
gtgcagtcccctacattatg

SEQ ID NO: 548565 - DNA, 20 bp, mouse
gtcatggctctccttggatc

SEQ ID NO: 548566 - DNA, 20 bp, mouse
ggtcaggagaaatccagtga

SEQ ID NO: 548567 - DNA, 20 bp, mouse
gcagtgaaggcagtgatatt

SEQ ID NO: 548568 - DNA, 20 bp, mouse
gcatatgctgctaacagata

SEQ ID NO: 548569 - DNA, 20 bp, mouse
gggcttccaggtatatccca

SEQ ID NO: 548570 - DNA, 20 bp, mouse
ggctgtcaaagaacgccgtc

SEQ ID NO: 548571 - DNA, 20 bp, mouse
gcagcatatgaaaagagttg

SEQ ID NO: 548572 - DNA, 20 bp, mouse
gaggagttacagactttatg

SEQ ID NO: 548573 - DNA, 20 bp, mouse
gtgatggcaccatagttcag

SEQ ID NO: 548574 - DNA, 20 bp, mouse
gcaggtgtggttattcatga

SEQ ID NO: 548575 - DNA, 20 bp, mouse
ggtttggagctgtaggtcaa

SEQ ID NO: 548576 - DNA, 20 bp, mouse
gtccagggaagcctaagaga

SEQ ID NO: 548577 - DNA, 20 bp, mouse
gctttctaggactttacttc

SEQ ID NO: 548578 - DNA, 20 bp, mouse
gtggactttaagtttcagtg

SEQ ID NO: 548579 - DNA, 20 bp, mouse
gtgatgtacctcctcaccat

SEQ ID NO: 548580 - DNA, 20 bp, mouse
gcatattaccaccaatggtg

SEQ ID NO: 548581 - DNA, 20 bp, mouse
ggtttcatgatctaaatgtc

SEQ ID NO: 548582 - DNA, 20 bp, mouse
gaatatggcaatcttgctat

SEQ ID NO: 548583 - DNA, 20 bp, mouse
gatacatgggcgtctgtaac

SEQ ID NO: 548584 - DNA, 20 bp, mouse
gtccttctcttaggcttccc

SEQ ID NO: 548585 - DNA, 20 bp, mouse
ggtccaattctctgtgatca

SEQ ID NO: 548586 - DNA, 20 bp, mouse
gccagaaggagaatatacat

SEQ ID NO: 548587 - DNA, 20 bp, mouse
gctcaaaagtctgaacttca

SEQ ID NO: 548588 - DNA, 20 bp, mouse
gattaccaagtagagccaca

SEQ ID NO: 548589 - DNA, 20 bp, mouse
ggaagttcatcatgcatgag

SEQ ID NO: 548590 - DNA, 20 bp, mouse
gaatagtactatagcgaagt

SEQ ID NO: 548591 - DNA, 20 bp, mouse
ggcacactggtctcattctg

SEQ ID NO: 548592 - DNA, 20 bp, mouse
gtgaaccactatacatgtgt

SEQ ID NO: 548593 - DNA, 20 bp, mouse
gtggtccttgggggctgaga

SEQ ID NO: 548594 - DNA, 20 bp, mouse
gatgagaccagtgtgcaccc

SEQ ID NO: 548595 - DNA, 20 bp, mouse
gccaattcctgggtgcacac

SEQ ID NO: 548596 - DNA, 20 bp, mouse
gttagatgtggaattgaata

SEQ ID NO: 548597 - DNA, 20 bp, mouse
gtcacttcagtgattggctg

SEQ ID NO: 548598 - DNA, 20 bp, mouse
gttatttattaattcaacca

SEQ ID NO: 548599 - DNA, 20 bp, mouse
ggaattaaattacaatcgac

SEQ ID NO: 548600 - DNA, 20 bp, mouse
gctgaaattgtggcacaaat

SEQ ID NO: 548601 - DNA, 20 bp, mouse
gttttgaagattgtatcctg

SEQ ID NO: 548602 - DNA, 20 bp, mouse
gagtcttaactctgaaattg

SEQ ID NO: 548603 - DNA, 20 bp, mouse
gctggtgattttttatgcca

SEQ ID NO: 548604 - DNA, 20 bp, mouse
ggaatgttcacaaaacaagc

SEQ ID NO: 548605 - DNA, 20 bp, mouse
gtcagtgattggctgtggtt

SEQ ID NO: 548606 - DNA, 20 bp, mouse
gatggggctgttcaacacag

SEQ ID NO: 548607 - DNA, 20 bp, mouse
gcccatgaaagtgaagtccg

SEQ ID NO: 548608 - DNA, 20 bp, mouse
gtcaacacagaggaaacctc

SEQ ID NO: 548609 - DNA, 20 bp, mouse
gggggacaacacatcatcca

SEQ ID NO: 548610 - DNA, 20 bp, mouse
gccggcggctcatgaggaca

SEQ ID NO: 548611 - DNA, 20 bp, mouse
gattataagataaatggaag

SEQ ID NO: 548612 - DNA, 20 bp, mouse
gaagaactcggctcccacca

SEQ ID NO: 548613 - DNA, 20 bp, mouse
gagcaacattataagataaa

SEQ ID NO: 548614 - DNA, 20 bp, mouse
ggataatcaactagcatctt

SEQ ID NO: 548615 - DNA, 20 bp, mouse
ggataatccaacagatccgg

SEQ ID NO: 548616 - DNA, 20 bp, mouse
gaagaactcagtcactaggg

SEQ ID NO: 548617 - DNA, 20 bp, mouse
gatgacaagggagctgagta

SEQ ID NO: 548618 - DNA, 20 bp, mouse
gagagagttgatacaggtac

SEQ ID NO: 548619 - DNA, 20 bp, mouse
ggtgcacacttgcaatgaca

SEQ ID NO: 548620 - DNA, 20 bp, mouse
gaaccacaggaatatgtctg

SEQ ID NO: 548621 - DNA, 20 bp, mouse
gggccattgtctcaaagtgc

SEQ ID NO: 548622 - DNA, 20 bp, mouse
gaacctgcactttgagacaa

SEQ ID NO: 548623 - DNA, 20 bp, mouse
gattctagttttttccatca

SEQ ID NO: 548624 - DNA, 20 bp, mouse
gtcagtcactagggtggaat

SEQ ID NO: 548625 - DNA, 20 bp, mouse
gttagtgagagagttgatac

SEQ ID NO: 548626 - DNA, 20 bp, mouse
gggtcactgcctgggtgggt

SEQ ID NO: 548627 - DNA, 20 bp, mouse
gggagaaggtgttaaatgta

SEQ ID NO: 548628 - DNA, 20 bp, mouse
gaaggtgttaaatgtatgga

SEQ ID NO: 548629 - DNA, 20 bp, mouse
gacatgtttatcacactgtg

SEQ ID NO: 548630 - DNA, 20 bp, mouse
gggctgtgataagagacagt

SEQ ID NO: 548631 - DNA, 20 bp, mouse
gaacacaatctgagcagaca

SEQ ID NO: 548632 - DNA, 20 bp, mouse
ggatgtcccacagctgagat

SEQ ID NO: 548633 - DNA, 20 bp, mouse
gtgtaaaagagcaagaaaaa

SEQ ID NO: 548634 - DNA, 20 bp, mouse
gtggtggtcactgcctgggt

SEQ ID NO: 548635 - DNA, 20 bp, mouse
gtagatagccccacccaccc

SEQ ID NO: 548636 - DNA, 20 bp, mouse
gggagaaggtgttgaatgtg

SEQ ID NO: 548637 - DNA, 20 bp, mouse
gacagaatgctttctactca

SEQ ID NO: 548638 - DNA, 20 bp, mouse
gaaggtgttgaatgtgtgga

SEQ ID NO: 548639 - DNA, 20 bp, mouse
gtctgaggatggctaggcac

SEQ ID NO: 548640 - DNA, 20 bp, mouse
ggatgtcccacagctgagat

SEQ ID NO: 548641 - DNA, 20 bp, mouse
ggtaaaagaacaagaaaaat

SEQ ID NO: 548642 - DNA, 20 bp, mouse
gtggtggtcactgcctgggt

SEQ ID NO: 548643 - DNA, 20 bp, mouse
ggatgatggagaagttcccc

SEQ ID NO: 548644 - DNA, 20 bp, mouse
gttacactttcggcatcctg

SEQ ID NO: 548645 - DNA, 20 bp, mouse
ggcattggtggtcactgcct

SEQ ID NO: 548646 - DNA, 20 bp, mouse
gggaaggggacagaaacaat

SEQ ID NO: 548647 - DNA, 20 bp, mouse
gcacagccgtgatgatggac

SEQ ID NO: 548648 - DNA, 20 bp, mouse
ggatgatggacaggttcccc

SEQ ID NO: 548649 - DNA, 20 bp, mouse
gttacacatttggcctcctg

SEQ ID NO: 548650 - DNA, 20 bp, mouse
gatgagcaagaaaactggta

SEQ ID NO: 548651 - DNA, 20 bp, mouse
gggggacagaaacaataggc

SEQ ID NO: 548652 - DNA, 20 bp, mouse
gtgtaaatgagcaagaaaac

SEQ ID NO: 548653 - DNA, 20 bp, mouse
ggatggacaggttccccagg

SEQ ID NO: 548654 - DNA, 20 bp, mouse
gatcccacagctgagattga

SEQ ID NO: 548655 - DNA, 20 bp, mouse
gtcttgctcatttacacatt

SEQ ID NO: 548656 - DNA, 20 bp, mouse
ggtacttcacacagcatcac

SEQ ID NO: 548657 - DNA, 20 bp, mouse
gtgctcacaagcaaccttct

SEQ ID NO: 548658 - DNA, 20 bp, mouse
gtgaataaggagaagcagga

SEQ ID NO: 548659 - DNA, 20 bp, mouse
gaggaggacgaagcccgctg

SEQ ID NO: 548660 - DNA, 20 bp, mouse
gggtgtggttaaagagtcct

SEQ ID NO: 548661 - DNA, 20 bp, mouse
gtggccttcaactctgtggt

SEQ ID NO: 548662 - DNA, 20 bp, mouse
ggtggttaaagagtcctagg

SEQ ID NO: 548663 - DNA, 20 bp, mouse
ggacatgatgctggtctcca

SEQ ID NO: 548664 - DNA, 20 bp, mouse
ggaataagtgggccctggtg

SEQ ID NO: 548665 - DNA, 20 bp, mouse
gtgaagtacgcatgcccaga

SEQ ID NO: 548666 - DNA, 20 bp, mouse
gacccccagtaacagcacag

SEQ ID NO: 548667 - DNA, 20 bp, mouse
ggcctctgtgctgttactgg

SEQ ID NO: 548668 - DNA, 20 bp, mouse
ggccatcttggggacaatgg

SEQ ID NO: 548669 - DNA, 20 bp, mouse
ggtattgcccatcagagagg

SEQ ID NO: 548670 - DNA, 20 bp, mouse
ggagcgagtgggcgtgtgtg

SEQ ID NO: 548671 - DNA, 20 bp, mouse
gctgaccaaacctgaaagac

SEQ ID NO: 548672 - DNA, 20 bp, mouse
gagggtattgcccatcagag

SEQ ID NO: 548673 - DNA, 20 bp, mouse
gaggcggacttcattcttct

SEQ ID NO: 548674 - DNA, 20 bp, mouse
gaacagaaagcaggagcgag

SEQ ID NO: 548675 - DNA, 20 bp, mouse
gtagcgcaggggaaagcata

SEQ ID NO: 548676 - DNA, 20 bp, mouse
gtgtttttctgaccctgggt

SEQ ID NO: 548677 - DNA, 20 bp, mouse
ggaaagggcgtggcctggtg

SEQ ID NO: 548678 - DNA, 20 bp, mouse
ggagggcttcagacccaccc

SEQ ID NO: 548679 - DNA, 20 bp, mouse
gaccttggttggtcttttcc

SEQ ID NO: 548680 - DNA, 20 bp, mouse
gctgcggtttcctgactcca

SEQ ID NO: 548681 - DNA, 20 bp, mouse
gtcctggaaaagaccaacca

SEQ ID NO: 548682 - DNA, 20 bp, mouse
ggtgaggactgtccttgagg

SEQ ID NO: 548683 - DNA, 20 bp, mouse
ggagatgactgtgaagagga

SEQ ID NO: 548684 - DNA, 20 bp, mouse
ggatggagatgactgtgaag

SEQ ID NO: 548685 - DNA, 20 bp, mouse
gaattgtcatttcctcctca

SEQ ID NO: 548686 - DNA, 20 bp, mouse
gagcctggacaccaggatga

SEQ ID NO: 548687 - DNA, 20 bp, mouse
gtttgcagatcgccacaaat

SEQ ID NO: 548688 - DNA, 20 bp, mouse
gccggtcagagaagccagta

SEQ ID NO: 548689 - DNA, 20 bp, mouse
gcaggaaggacaggtgtgtg

SEQ ID NO: 548690 - DNA, 20 bp, mouse
gtggctgaaggtgctgtcgt

SEQ ID NO: 548691 - DNA, 20 bp, mouse
ggaggttatagagcagctgt

SEQ ID NO: 548692 - DNA, 20 bp, mouse
ggttgcccagcagggtcagg

SEQ ID NO: 548693 - DNA, 20 bp, mouse
gttctctgaccggcctgagc

SEQ ID NO: 548694 - DNA, 20 bp, mouse
gtcagccatttcatccttac

SEQ ID NO: 548695 - DNA, 20 bp, mouse
gcctcaggtgcagtagagat

SEQ ID NO: 548696 - DNA, 20 bp, mouse
gggacagaattcaccttagt

SEQ ID NO: 548697 - DNA, 20 bp, mouse
gacctttgtgtttctgacct

SEQ ID NO: 548698 - DNA, 20 bp, mouse
gtactggaaaagaccaacta

SEQ ID NO: 548699 - DNA, 20 bp, mouse
ggaaagggcgtggccgggtg

SEQ ID NO: 548700 - DNA, 20 bp, mouse
gatgtacatcatgtcgatga

SEQ ID NO: 548701 - DNA, 20 bp, mouse
gcccaaggtcagaaacacaa

SEQ ID NO: 548702 - DNA, 20 bp, mouse
ggcaatcagtgtgaagagga

SEQ ID NO: 548703 - DNA, 20 bp, mouse
gctccaggcaccagcgacca

SEQ ID NO: 548704 - DNA, 20 bp, mouse
ggtgaggactgtccttgagg

SEQ ID NO: 548705 - DNA, 20 bp, mouse
ggatggcaatcagtgtgaag

SEQ ID NO: 548706 - DNA, 20 bp, mouse
gctaccactgtgcccaagat

SEQ ID NO: 548707 - DNA, 20 bp, mouse
gtggatctcacatcctaaaa

SEQ ID NO: 548708 - DNA, 20 bp, mouse
gtcacatcctaaaacggaaa

SEQ ID NO: 548709 - DNA, 20 bp, mouse
gcctaaaacggaaatggcct

SEQ ID NO: 548710 - DNA, 20 bp, mouse
gtatgtttatgagtcttgct

SEQ ID NO: 548711 - DNA, 20 bp, mouse
ggtatgcgctaaagcattga

SEQ ID NO: 548712 - DNA, 20 bp, mouse
ggacaggaaaccacagctgc

SEQ ID NO: 548713 - DNA, 20 bp, mouse
gctccaggcactggcgacca

SEQ ID NO: 548714 - DNA, 20 bp, mouse
gctccatggtcgccagtgcc

SEQ ID NO: 548715 - DNA, 20 bp, mouse
gatgaagttagctcccatct

SEQ ID NO: 548716 - DNA, 20 bp, mouse
gctcagtgaccccaaagaag

SEQ ID NO: 548717 - DNA, 20 bp, mouse
ggagtaggcccaaatgtcac

SEQ ID NO: 548718 - DNA, 20 bp, mouse
gcggctggtggctggttctt

SEQ ID NO: 548719 - DNA, 20 bp, mouse
gtacacttgaactgaactca

SEQ ID NO: 548720 - DNA, 20 bp, mouse
gtggtggctggttcttgggt

SEQ ID NO: 548721 - DNA, 20 bp, mouse
gcccaaatgtcaccggctgg

SEQ ID NO: 548722 - DNA, 20 bp, mouse
gctacacaactatcatgagt

SEQ ID NO: 548723 - DNA, 20 bp, mouse
gtgatagttgtgtagtaaag

SEQ ID NO: 548724 - DNA, 20 bp, mouse
gaggcccaaatgtcaccggc

SEQ ID NO: 548725 - DNA, 20 bp, mouse
gtggctggttcttgggtggg

SEQ ID NO: 548726 - DNA, 20 bp, mouse
gaactcttggagtctgaatg

SEQ ID NO: 548727 - DNA, 20 bp, mouse
gaggattcccacaatacaat

SEQ ID NO: 548728 - DNA, 20 bp, mouse
gggcacttattcacaactct

SEQ ID NO: 548729 - DNA, 20 bp, mouse
gctggaagtaactagagcat

SEQ ID NO: 548730 - DNA, 20 bp, mouse
gtatcagctaactcctctaa

SEQ ID NO: 548731 - DNA, 20 bp, mouse
ggattaggtacactgtgtca

SEQ ID NO: 548732 - DNA, 20 bp, mouse
gagtaactagagcatgggtt

SEQ ID NO: 548733 - DNA, 20 bp, mouse
gcacatgacaaagaaaatac

SEQ ID NO: 548734 - DNA, 20 bp, mouse
gctcagttccttcaggaagc

SEQ ID NO: 548735 - DNA, 20 bp, mouse
ggagttagctgatattgatc

SEQ ID NO: 548736 - DNA, 20 bp, mouse
gcatgtgtccatcctggaaa

SEQ ID NO: 548737 - DNA, 20 bp, mouse
ggtgtgcatgaatgcattga

SEQ ID NO: 548738 - DNA, 20 bp, mouse
gtgtgggacagacttcagct

SEQ ID NO: 548739 - DNA, 20 bp, mouse
gggacagacttcagcttggt

SEQ ID NO: 548740 - DNA, 20 bp, mouse
gggaagttagctgccacctt

SEQ ID NO: 548741 - DNA, 20 bp, mouse
ggatggttcagtctaaggca

SEQ ID NO: 548742 - DNA, 20 bp, mouse
ggctctgatggttcagtcta

SEQ ID NO: 548743 - DNA, 20 bp, mouse
gagcttggttggccttttcc

SEQ ID NO: 548744 - DNA, 20 bp, mouse
ggatggcaatcagtgtgaag

SEQ ID NO: 548745 - DNA, 20 bp, mouse
gcagtctaaggcatggagac

SEQ ID NO: 548746 - DNA, 20 bp, mouse
gccggtcagagaagcctata

SEQ ID NO: 548747 - DNA, 20 bp, mouse
gtgcggcgtggccaactccc

SEQ ID NO: 548748 - DNA, 20 bp, mouse
gcttgcagaccgccacaaag

SEQ ID NO: 548749 - DNA, 20 bp, mouse
gggagacatagccagggagt

SEQ ID NO: 548750 - DNA, 20 bp, mouse
gtgcgtgggcctggtctcag

SEQ ID NO: 548751 - DNA, 20 bp, mouse
ggtcacaggagacatagcca

SEQ ID NO: 548752 - DNA, 20 bp, mouse
gtctcagtggcctggagctg

SEQ ID NO: 548753 - DNA, 20 bp, mouse
ggctccaggccactgagacc

SEQ ID NO: 548754 - DNA, 20 bp, mouse
gcatcatcatcctggtatcc

SEQ ID NO: 548755 - DNA, 20 bp, mouse
ggggcctggtctcagtggcc

SEQ ID NO: 548756 - DNA, 20 bp, mouse
ggagggactgccactcaaga

SEQ ID NO: 548757 - DNA, 20 bp, mouse
gggtgaggagatagaagcac

SEQ ID NO: 548758 - DNA, 20 bp, mouse
ggacagcagcaggggtaccg

SEQ ID NO: 548759 - DNA, 20 bp, mouse
gctgccactcaagaaggttc

SEQ ID NO: 548760 - DNA, 20 bp, mouse
gagcagcaggggtaccgtgg

SEQ ID NO: 548761 - DNA, 20 bp, mouse
gcaaaacctatccaaggtca

SEQ ID NO: 548762 - DNA, 20 bp, mouse
gaagagagtagtggagcggg

SEQ ID NO: 548763 - DNA, 20 bp, mouse
gtgtccccaggaggccagtt

SEQ ID NO: 548764 - DNA, 20 bp, mouse
ggctcatgagaagagagtag

SEQ ID NO: 548765 - DNA, 20 bp, mouse
gtcacggagtttcagctctt

SEQ ID NO: 548766 - DNA, 20 bp, mouse
gacaaatgtgaacgggacgg

SEQ ID NO: 548767 - DNA, 20 bp, mouse
gtccattgaggaaagctagg

SEQ ID NO: 548768 - DNA, 20 bp, mouse
gcccccacatgaaaactctt

SEQ ID NO: 548769 - DNA, 20 bp, mouse
gccaaacgagaagaaatcga

SEQ ID NO: 548770 - DNA, 20 bp, mouse
gcgactccaagaacagggtg

SEQ ID NO: 548771 - DNA, 20 bp, mouse
gtcggtcgactccaagaaca

SEQ ID NO: 548772 - DNA, 20 bp, mouse
ggatggtgctggaattctcg

SEQ ID NO: 548773 - DNA, 20 bp, mouse
gttctcggggctcaggcctg

SEQ ID NO: 548774 - DNA, 20 bp, mouse
gtagcgatctatggccatca

SEQ ID NO: 548775 - DNA, 20 bp, mouse
gacagctgtggtcatattag

SEQ ID NO: 548776 - DNA, 20 bp, mouse
gacataaagacatcagcagg

SEQ ID NO: 548777 - DNA, 20 bp, mouse
gtgtctttatgttggatcct

SEQ ID NO: 548778 - DNA, 20 bp, mouse
gccaacataaagacatcagc

SEQ ID NO: 548779 - DNA, 20 bp, mouse
ggttgcctaggagacaaaca

SEQ ID NO: 548780 - DNA, 20 bp, mouse
gaggtccatgtttgtctcct

SEQ ID NO: 548781 - DNA, 20 bp, mouse
gcctctacctgacattagca

SEQ ID NO: 548782 - DNA, 20 bp, mouse
gttctgaccctgctaatgtc

SEQ ID NO: 548783 - DNA, 20 bp, mouse
gaacgccctcctgatcctgc

SEQ ID NO: 548784 - DNA, 20 bp, mouse
ggtagtgtagttgttcatcc

SEQ ID NO: 548785 - DNA, 20 bp, mouse
gcagcaggaggcacaccctg

SEQ ID NO: 548786 - DNA, 20 bp, mouse
gtgaggagatgaacttcgag

SEQ ID NO: 548787 - DNA, 20 bp, mouse
gccctcagtgtctaacacag

SEQ ID NO: 548788 - DNA, 20 bp, mouse
gaactttaactgcttcctca

SEQ ID NO: 548789 - DNA, 20 bp, mouse
ggcctctgtgttagacactg

SEQ ID NO: 548790 - DNA, 20 bp, mouse
ggtctaacacagaggctgcc

SEQ ID NO: 548791 - DNA, 20 bp, mouse
ggtgttttctcatctaacat

SEQ ID NO: 548792 - DNA, 20 bp, mouse
gctgaaagtcctaccttttc

SEQ ID NO: 548793 - DNA, 20 bp, mouse
gggctctcaggagcaactca

SEQ ID NO: 548794 - DNA, 20 bp, mouse
ggggtggagggaacagtgaa

SEQ ID NO: 548795 - DNA, 20 bp, mouse
gggaacagtgaatggctctc

SEQ ID NO: 548796 - DNA, 20 bp, mouse
gcagtcatcaggaaagattg

SEQ ID NO: 548797 - DNA, 20 bp, mouse
gccaagaatgatctcctcaa

SEQ ID NO: 548798 - DNA, 20 bp, mouse
gtcctggtatgccagtcatc

SEQ ID NO: 548799 - DNA, 20 bp, mouse
ggtgagtgccacagtgtaca

SEQ ID NO: 548800 - DNA, 20 bp, mouse
gcatcaggaaagattgtggc

SEQ ID NO: 548801 - DNA, 20 bp, mouse
gcatgggctggtgtaggcta

SEQ ID NO: 548802 - DNA, 20 bp, mouse
gaagaacatttggatcagac

SEQ ID NO: 548803 - DNA, 20 bp, mouse
gaaagtagctcgggttgtaa

SEQ ID NO: 548804 - DNA, 20 bp, mouse
gtaagagggacaaagtagct

SEQ ID NO: 548805 - DNA, 20 bp, mouse
gtcctgatgactggcatacc

SEQ ID NO: 548806 - DNA, 20 bp, mouse
ggacaggataccggagtgga

SEQ ID NO: 548807 - DNA, 20 bp, mouse
gacctgctagtgtcacatag

SEQ ID NO: 548808 - DNA, 20 bp, mouse
gtcctctatgtgacactagc

SEQ ID NO: 548809 - DNA, 20 bp, mouse
gggttcagaatttttccttc

SEQ ID NO: 548810 - DNA, 20 bp, mouse
ggatccaacagacagacatc

SEQ ID NO: 548811 - DNA, 20 bp, mouse
gccaacagacagacatcagg

SEQ ID NO: 548812 - DNA, 20 bp, mouse
gtccaggtggtgaggtccat

SEQ ID NO: 548813 - DNA, 20 bp, mouse
gaacgccctcctgatcctgc

SEQ ID NO: 548814 - DNA, 20 bp, mouse
ggtagtgtagttgttcatcc

SEQ ID NO: 548815 - DNA, 20 bp, mouse
gtgtctgtctgttggatcct

SEQ ID NO: 548816 - DNA, 20 bp, mouse
ggagtctgcaaaggacaggg

SEQ ID NO: 548817 - DNA, 20 bp, mouse
gggagagtctgcaaaggaca

SEQ ID NO: 548818 - DNA, 20 bp, mouse
gctgacaggagagtctgcaa

SEQ ID NO: 548819 - DNA, 20 bp, mouse
gctgcagtctgggccacact

SEQ ID NO: 548820 - DNA, 20 bp, mouse
ggcagtaaggaagcactaag

SEQ ID NO: 548821 - DNA, 20 bp, mouse
gctgggccacactgggcaag

SEQ ID NO: 548822 - DNA, 20 bp, mouse
gataaggcagtaaagaataa

SEQ ID NO: 548823 - DNA, 20 bp, mouse
gtcagatgcagctgcagtct

SEQ ID NO: 548824 - DNA, 20 bp, mouse
gaaacccaagaatgaagagg

SEQ ID NO: 548825 - DNA, 20 bp, mouse
gtttctcccaataataaata

SEQ ID NO: 548826 - DNA, 20 bp, mouse
gttggtatgtggaggtggat

SEQ ID NO: 548827 - DNA, 20 bp, mouse
ggtggaggtggattggtatg

SEQ ID NO: 548828 - DNA, 20 bp, mouse
gaaaaaagtacattggtatg

SEQ ID NO: 548829 - DNA, 20 bp, mouse
gaaagtacattggtatgtgg

SEQ ID NO: 548830 - DNA, 20 bp, mouse
gataggacatggcagcaaga

SEQ ID NO: 548831 - DNA, 20 bp, mouse
gtccaggtggtgaggtccat

SEQ ID NO: 548832 - DNA, 20 bp, mouse
gcctctacctgacattagca

SEQ ID NO: 548833 - DNA, 20 bp, mouse
gttctgaccctgctaatgtc

SEQ ID NO: 548834 - DNA, 20 bp, mouse
gcagcaggagacacaccctg

SEQ ID NO: 548835 - DNA, 20 bp, mouse
ggtagtgtagttgttcatcc

SEQ ID NO: 548836 - DNA, 20 bp, mouse
gccatgggctatgaggtcaa

SEQ ID NO: 548837 - DNA, 20 bp, mouse
gctgctctcagacctgagcc

SEQ ID NO: 548838 - DNA, 20 bp, mouse
ggtagtgaatctgtttccat

SEQ ID NO: 548839 - DNA, 20 bp, mouse
gacaggaaagtaaagtgggg

SEQ ID NO: 548840 - DNA, 20 bp, mouse
gaaaagaagttaactctggt

SEQ ID NO: 548841 - DNA, 20 bp, mouse
ggaggacctaggctcttcac

SEQ ID NO: 548842 - DNA, 20 bp, mouse
gtttgatccacacctggctc

SEQ ID NO: 548843 - DNA, 20 bp, mouse
gccagtgagtgattgactag

SEQ ID NO: 548844 - DNA, 20 bp, mouse
gcacatcgagaagggtgata

SEQ ID NO: 548845 - DNA, 20 bp, mouse
gtgcttgaaccatagtgcta

SEQ ID NO: 548846 - DNA, 20 bp, mouse
gagttgtcaggtacagaacc

SEQ ID NO: 548847 - DNA, 20 bp, mouse
ggcagaagactaagagcttg

SEQ ID NO: 548848 - DNA, 20 bp, mouse
gaagactaagagcttgagga

SEQ ID NO: 548849 - DNA, 20 bp, mouse
gccaggacacaactactaga

SEQ ID NO: 548850 - DNA, 20 bp, mouse
gtttgcagaagataaggccc

SEQ ID NO: 548851 - DNA, 20 bp, mouse
gactgtgaaaaaatactcct

SEQ ID NO: 548852 - DNA, 20 bp, mouse
gaggcaatttgcagaagata

SEQ ID NO: 548853 - DNA, 20 bp, mouse
gattttttcacagtttttgc

SEQ ID NO: 548854 - DNA, 20 bp, mouse
ggtctgagttcatccttctg

SEQ ID NO: 548855 - DNA, 20 bp, mouse
gtcgaatggggagccccaga

SEQ ID NO: 548856 - DNA, 20 bp, mouse
gcaggacagagtacaaagct

SEQ ID NO: 548857 - DNA, 20 bp, mouse
gggaaacacaccctgtatat

SEQ ID NO: 548858 - DNA, 20 bp, mouse
gagggtgtgcgcaagagcat

SEQ ID NO: 548859 - DNA, 20 bp, mouse
gtaagtccatcccatataca

SEQ ID NO: 548860 - DNA, 20 bp, mouse
gcttctagtagtaatatcat

SEQ ID NO: 548861 - DNA, 20 bp, mouse
gtaacatcatcatgaatctg

SEQ ID NO: 548862 - DNA, 20 bp, mouse
ggatgttataatgcagagga

SEQ ID NO: 548863 - DNA, 20 bp, mouse
gagagcattggttaaagata

SEQ ID NO: 548864 - DNA, 20 bp, mouse
ggcttggtcttctgctcgaa

SEQ ID NO: 548865 - DNA, 20 bp, mouse
gacacaccctgtatatggga

SEQ ID NO: 548866 - DNA, 20 bp, mouse
gtcgaatggggagtcccaag

SEQ ID NO: 548867 - DNA, 20 bp, mouse
gttggcagtagataaagtcc

SEQ ID NO: 548868 - DNA, 20 bp, mouse
gtcagtcgcatctccaaaaa

SEQ ID NO: 548869 - DNA, 20 bp, mouse
gtcttctaatagtagtatcc

SEQ ID NO: 548870 - DNA, 20 bp, mouse
ggcatatttatgaccatttt

SEQ ID NO: 548871 - DNA, 20 bp, mouse
ggcagaaaaacaagagaatg

SEQ ID NO: 548872 - DNA, 20 bp, mouse
gagagtgtgcacaagggagt

SEQ ID NO: 548873 - DNA, 20 bp, mouse
gaatgaaaagaaatacacct

SEQ ID NO: 548874 - DNA, 20 bp, mouse
gcagggcagagtacaggcct

SEQ ID NO: 548875 - DNA, 20 bp, mouse
gttgtgaatagtgcagaggg

SEQ ID NO: 548876 - DNA, 20 bp, mouse
gtttctagtagttgtgtctt

SEQ ID NO: 548877 - DNA, 20 bp, mouse
gctctcattatctctcttca

SEQ ID NO: 548878 - DNA, 20 bp, mouse
gaactactagaaaaagacag

SEQ ID NO: 548879 - DNA, 20 bp, mouse
gcatattcatgagcatcttt

SEQ ID NO: 548880 - DNA, 20 bp, mouse
gagggcattgcctgaagata

SEQ ID NO: 548881 - DNA, 20 bp, mouse
gtgtcttgggccttatcttc

SEQ ID NO: 548882 - DNA, 20 bp, mouse
gcgtgaaggccaagtggcta

SEQ ID NO: 548883 - DNA, 20 bp, mouse
gcaaggcagaatacaggcct

SEQ ID NO: 548884 - DNA, 20 bp, mouse
ggtacctgacaactatgctg

SEQ ID NO: 548885 - DNA, 20 bp, mouse
gcccagcatatgagatagat

SEQ ID NO: 548886 - DNA, 20 bp, mouse
gaggtacatggtcagaatca

SEQ ID NO: 548887 - DNA, 20 bp, mouse
gcagggaagagtaaataact

SEQ ID NO: 548888 - DNA, 20 bp, mouse
gcttggttctctggtcgaat

SEQ ID NO: 548889 - DNA, 20 bp, mouse
ggcctctgtgttcttctagt

SEQ ID NO: 548890 - DNA, 20 bp, mouse
gacacacccatcatatgaaa

SEQ ID NO: 548891 - DNA, 20 bp, mouse
ggtcacagttccaaagatgc

SEQ ID NO: 548892 - DNA, 20 bp, mouse
gcttctagtaggaatgttct

SEQ ID NO: 548893 - DNA, 20 bp, mouse
gtcagtccatttcatatgat

SEQ ID NO: 548894 - DNA, 20 bp, mouse
gagtaaataacttggttctc

SEQ ID NO: 548895 - DNA, 20 bp, mouse
gaggctcaaattcatgatga

SEQ ID NO: 548896 - DNA, 20 bp, mouse
gatagcaaaaaaatatacct

SEQ ID NO: 548897 - DNA, 20 bp, mouse
gcgcacaagggcattggcaa

SEQ ID NO: 548898 - DNA, 20 bp, mouse
gcttctagtacttgtatcct

SEQ ID NO: 548899 - DNA, 20 bp, mouse
ggcagaagataaggaatatg

SEQ ID NO: 548900 - DNA, 20 bp, mouse
gagctttcttcttacatcaa

SEQ ID NO: 548901 - DNA, 20 bp, mouse
gaagagaagggtgcgcacaa

SEQ ID NO: 548902 - DNA, 20 bp, mouse
gagggcattggcaatggata

SEQ ID NO: 548903 - DNA, 20 bp, mouse
gttggcaatggataaggccc

SEQ ID NO: 548904 - DNA, 20 bp, mouse
gttgtgaatagtgcagaggg

SEQ ID NO: 548905 - DNA, 20 bp, mouse
gtagtttgtgaatagtgcag

SEQ ID NO: 548906 - DNA, 20 bp, mouse
gacctgtcatatgccatgga

SEQ ID NO: 548907 - DNA, 20 bp, mouse
gctcatcagtcactgttcca

SEQ ID NO: 548908 - DNA, 20 bp, mouse
gaggttcaggttcatgatga

SEQ ID NO: 548909 - DNA, 20 bp, mouse
gagagcattgactaaagata

SEQ ID NO: 548910 - DNA, 20 bp, mouse
gttgactaaagataaggccc

SEQ ID NO: 548911 - DNA, 20 bp, mouse
gcagggcagagtacacagct

SEQ ID NO: 548912 - DNA, 20 bp, mouse
gaagagtttgagcatgagga

SEQ ID NO: 548913 - DNA, 20 bp, mouse
ggcagaagagtttgagcatg

SEQ ID NO: 548914 - DNA, 20 bp, mouse
ggcatattcacaagcatcct

SEQ ID NO: 548915 - DNA, 20 bp, mouse
gaggtacatggccaggatca

SEQ ID NO: 548916 - DNA, 20 bp, mouse
gagaagaaaagcatgactga

SEQ ID NO: 548917 - DNA, 20 bp, mouse
gcattgtggtatagtgtaga

SEQ ID NO: 548918 - DNA, 20 bp, mouse
gaggttctgactcatcattg

SEQ ID NO: 548919 - DNA, 20 bp, mouse
gttggcagtggataaggtcc

SEQ ID NO: 548920 - DNA, 20 bp, mouse
gttcttcttctgtgagtgaa

SEQ ID NO: 548921 - DNA, 20 bp, mouse
gtgtggtatagtgtagaggg

SEQ ID NO: 548922 - DNA, 20 bp, mouse
gaatacaggtcttggtcctc

SEQ ID NO: 548923 - DNA, 20 bp, mouse
gagggcattggcagtggata

SEQ ID NO: 548924 - DNA, 20 bp, mouse
gctgaatggggagccctaag

SEQ ID NO: 548925 - DNA, 20 bp, mouse
gcaggaacaaggcagaatac

SEQ ID NO: 548926 - DNA, 20 bp, mouse
ggggctccccatccaaccag

SEQ ID NO: 548927 - DNA, 20 bp, mouse
ggaactcagatgcactgctc

SEQ ID NO: 548928 - DNA, 20 bp, mouse
gttgctcctctggttggatg

SEQ ID NO: 548929 - DNA, 20 bp, mouse
gcaggtatgtagctagaaac

SEQ ID NO: 548930 - DNA, 20 bp, mouse
gtcttgtatagtggaggggg

SEQ ID NO: 548931 - DNA, 20 bp, mouse
gtacacctgggaaatgcacc

SEQ ID NO: 548932 - DNA, 20 bp, mouse
ggattcttgtatagtggagg

SEQ ID NO: 548933 - DNA, 20 bp, mouse
gcatgattcttgtatagtgg

SEQ ID NO: 548934 - DNA, 20 bp, mouse
gactcatgattcttgtatag

SEQ ID NO: 548935 - DNA, 20 bp, mouse
gcttactagtcattgaatcc

SEQ ID NO: 548936 - DNA, 20 bp, mouse
gtaataagtagggtctctaa

SEQ ID NO: 548937 - DNA, 20 bp, mouse
gggagacagtataataagta

SEQ ID NO: 548938 - DNA, 20 bp, mouse
gtgtggaaaagtagatccca

SEQ ID NO: 548939 - DNA, 20 bp, mouse
ggttttgttctgagttgatg

SEQ ID NO: 548940 - DNA, 20 bp, mouse
gatttctctctagaaggtat

SEQ ID NO: 548941 - DNA, 20 bp, mouse
gtcttagcaagacttaatgg

SEQ ID NO: 548942 - DNA, 20 bp, mouse
gtttgtcagtatatctatgt

SEQ ID NO: 548943 - DNA, 20 bp, mouse
gtatcatccatgcaaaagta

SEQ ID NO: 548944 - DNA, 20 bp, mouse
gccttctagagagaaatgga

SEQ ID NO: 548945 - DNA, 20 bp, mouse
gcatgataaaaactgtacat

SEQ ID NO: 548946 - DNA, 20 bp, mouse
gcttgctcctctggccggat

SEQ ID NO: 548947 - DNA, 20 bp, mouse
ggaattcagacaccatactc

SEQ ID NO: 548948 - DNA, 20 bp, mouse
ggggctccccatccggccag

SEQ ID NO: 548949 - DNA, 20 bp, mouse
ggagaagaataacatgaaaa

SEQ ID NO: 548950 - DNA, 20 bp, mouse
gatacactctgcataaggaa

SEQ ID NO: 548951 - DNA, 20 bp, mouse
gactctgcataaggaatgga

SEQ ID NO: 548952 - DNA, 20 bp, mouse
gtacaccaccatcatgagag

SEQ ID NO: 548953 - DNA, 20 bp, mouse
gctgtctcacaccctcctcc

SEQ ID NO: 548954 - DNA, 20 bp, mouse
gcttactcgtagctatatcc

SEQ ID NO: 548955 - DNA, 20 bp, mouse
gaactttctcctcacttcaa

SEQ ID NO: 548956 - DNA, 20 bp, mouse
gtttttctacaaggaatatc

SEQ ID NO: 548957 - DNA, 20 bp, mouse
gtctctgaattttttctaca

SEQ ID NO: 548958 - DNA, 20 bp, mouse
gctgatgcttgccttgtgtt

SEQ ID NO: 548959 - DNA, 20 bp, mouse
ggttgtttaatgttcagaca

SEQ ID NO: 548960 - DNA, 20 bp, mouse
gctgactcacactctcctca

SEQ ID NO: 548961 - DNA, 20 bp, mouse
gaccagtataggaaatggta

SEQ ID NO: 548962 - DNA, 20 bp, mouse
gttggtgagaacccaacaca

SEQ ID NO: 548963 - DNA, 20 bp, mouse
gtacagatgctctatactca

SEQ ID NO: 548964 - DNA, 20 bp, mouse
gaggtgtgggtcagagccaa

SEQ ID NO: 548965 - DNA, 20 bp, mouse
ggaaggacagtcgagccatg

SEQ ID NO: 548966 - DNA, 20 bp, mouse
gattcagttctggattgata

SEQ ID NO: 548967 - DNA, 20 bp, mouse
ggaaaatgagctgtatcata

SEQ ID NO: 548968 - DNA, 20 bp, mouse
gagtacatgccattcagttc

SEQ ID NO: 548969 - DNA, 20 bp, mouse
gagcagaagggtatgtaaaa

SEQ ID NO: 548970 - DNA, 20 bp, mouse
gatgcatcccgtatatgaga

SEQ ID NO: 548971 - DNA, 20 bp, mouse
gtatacgggatgcatttccc

SEQ ID NO: 548972 - DNA, 20 bp, mouse
gtgtaaaatggcactggcaa

SEQ ID NO: 548973 - DNA, 20 bp, mouse
gaaataggaaaaagtacacc

SEQ ID NO: 548974 - DNA, 20 bp, mouse
gactactgttaattgtgtcc

SEQ ID NO: 548975 - DNA, 20 bp, mouse
gtggattgatagggagcccc

SEQ ID NO: 548976 - DNA, 20 bp, mouse
gagagtagctgctgttgctc

SEQ ID NO: 548977 - DNA, 20 bp, mouse
gtttttcttcgaggaatatc

SEQ ID NO: 548978 - DNA, 20 bp, mouse
gtgggtcacagctaatagct

SEQ ID NO: 548979 - DNA, 20 bp, mouse
ggttggtgagaacccagcac

SEQ ID NO: 548980 - DNA, 20 bp, mouse
gtctctgaattttttcttcg

SEQ ID NO: 548981 - DNA, 20 bp, mouse
gctgatgcttgccctgtgct

SEQ ID NO: 548982 - DNA, 20 bp, mouse
gagacaaccagtataggaga

SEQ ID NO: 548983 - DNA, 20 bp, mouse
ggaaggacagtcgagtcatg

SEQ ID NO: 548984 - DNA, 20 bp, mouse
ggatctggacagcttcttcc

SEQ ID NO: 548985 - DNA, 20 bp, mouse
gtgtacttattcatgatgtt

SEQ ID NO: 548986 - DNA, 20 bp, mouse
ggaagtctgaagcaacagat

SEQ ID NO: 548987 - DNA, 20 bp, mouse
gaacaagaactacacagcat

SEQ ID NO: 548988 - DNA, 20 bp, mouse
gtggctgtgctgtaatggag

SEQ ID NO: 548989 - DNA, 20 bp, mouse
gatagaagaggctgctcccc

SEQ ID NO: 548990 - DNA, 20 bp, mouse
ggtacctggtcactatggtg

SEQ ID NO: 548991 - DNA, 20 bp, mouse
ggtgaaacaggcatcagtta

SEQ ID NO: 548992 - DNA, 20 bp, mouse
ggcttcagacttccttcttc

SEQ ID NO: 548993 - DNA, 20 bp, mouse
ggtcgaggccgccaaacatc

SEQ ID NO: 548994 - DNA, 20 bp, mouse
gtaggagatggtttgactct

SEQ ID NO: 548995 - DNA, 20 bp, mouse
gtgggactctctgaacagcc

SEQ ID NO: 548996 - DNA, 20 bp, mouse
gataactggacccaaatcaa

SEQ ID NO: 548997 - DNA, 20 bp, mouse
gagtaaccaggtaaattgtg

SEQ ID NO: 548998 - DNA, 20 bp, mouse
gcaagagaaggtcaccagta

SEQ ID NO: 548999 - DNA, 20 bp, mouse
gttttggtcctcaggccgag

SEQ ID NO: 549000 - DNA, 20 bp, mouse
gggactgtcccctcggcctg

SEQ ID NO: 549001 - DNA, 20 bp, mouse
gttacctggttactctaaca

SEQ ID NO: 549002 - DNA, 20 bp, mouse
gcagtagggcacatcgatga

SEQ ID NO: 549003 - DNA, 20 bp, mouse
ggatagtgacatagtggaag

SEQ ID NO: 549004 - DNA, 20 bp, mouse
gtaactccttccattgattt

SEQ ID NO: 549005 - DNA, 20 bp, mouse
gagatgagggtcagaacgga

SEQ ID NO: 549006 - DNA, 20 bp, mouse
gctgttcccagtgctccgag

SEQ ID NO: 549007 - DNA, 20 bp, mouse
gctgggcctctcggagcact

SEQ ID NO: 549008 - DNA, 20 bp, mouse
gggtaaacatccaaactcag

SEQ ID NO: 549009 - DNA, 20 bp, mouse
gaaaagatgccaaagagtaa

SEQ ID NO: 549010 - DNA, 20 bp, mouse
gagacaggcatccagcatag

SEQ ID NO: 549011 - DNA, 20 bp, mouse
gaaattcagaaacactactg

SEQ ID NO: 549012 - DNA, 20 bp, mouse
gtgggttagagcatatgaat

SEQ ID NO: 549013 - DNA, 20 bp, mouse
gtgaccaaggtgtagtgaag

SEQ ID NO: 549014 - DNA, 20 bp, mouse
gatcatctaccacagttcct

SEQ ID NO: 549015 - DNA, 20 bp, mouse
gccagcaggatgcagcatct

SEQ ID NO: 549016 - DNA, 20 bp, mouse
gagtcagtattgaggagtaa

SEQ ID NO: 549017 - DNA, 20 bp, mouse
gtgtaacatcttgggaactg

SEQ ID NO: 549018 - DNA, 20 bp, mouse
ggaagatgtacattggagta

SEQ ID NO: 549019 - DNA, 20 bp, mouse
ggagaggaatctgttcaact

SEQ ID NO: 549020 - DNA, 20 bp, mouse
gtaggaaatgacctttgtag

SEQ ID NO: 549021 - DNA, 20 bp, mouse
gttcctcagtaacctggcct

SEQ ID NO: 549022 - DNA, 20 bp, mouse
gtaccacatgtatttgatac

SEQ ID NO: 549023 - DNA, 20 bp, mouse
gctccagtatcaaatacatg

SEQ ID NO: 549024 - DNA, 20 bp, mouse
gctgtttttatggtgacaga

SEQ ID NO: 549025 - DNA, 20 bp, mouse
gacagatggacaacagcagc

SEQ ID NO: 549026 - DNA, 20 bp, mouse
gtctatatcacctgcaaaga

SEQ ID NO: 549027 - DNA, 20 bp, mouse
ggttgtccttatcatgtacc

SEQ ID NO: 549028 - DNA, 20 bp, mouse
gtgtacctggcagcagtttt

SEQ ID NO: 549029 - DNA, 20 bp, mouse
gggagatcagagttggaaaa

SEQ ID NO: 549030 - DNA, 20 bp, mouse
gcatgggggtctgaagcctg

SEQ ID NO: 549031 - DNA, 20 bp, mouse
gtctgatctcccctctttgc

SEQ ID NO: 549032 - DNA, 20 bp, mouse
gtgatatagaccataactta

SEQ ID NO: 549033 - DNA, 20 bp, mouse
gtgccatggcagccagtaag

SEQ ID NO: 549034 - DNA, 20 bp, mouse
gtgctgccaggtacatgata

SEQ ID NO: 549035 - DNA, 20 bp, mouse
gggccacttactggctgcca

SEQ ID NO: 549036 - DNA, 20 bp, mouse
gtgcagtaaatggtgatctt

SEQ ID NO: 549037 - DNA, 20 bp, mouse
gctctgggatcaaagagcca

SEQ ID NO: 549038 - DNA, 20 bp, mouse
gctatgcctaacatcacaca

SEQ ID NO: 549039 - DNA, 20 bp, mouse
ggatctttggtatacagtca

SEQ ID NO: 549040 - DNA, 20 bp, mouse
gcatgctgatctgcagtaaa

SEQ ID NO: 549041 - DNA, 20 bp, mouse
gtaaagtctttcaaatctct

SEQ ID NO: 549042 - DNA, 20 bp, mouse
gatggaataaataaaagtaa

SEQ ID NO: 549043 - DNA, 20 bp, mouse
ggatgtatagacacattcca

SEQ ID NO: 549044 - DNA, 20 bp, mouse
gtctgtatttactttacaaa

SEQ ID NO: 549045 - DNA, 20 bp, mouse
ggaataaataaaagtaaagg

SEQ ID NO: 549046 - DNA, 20 bp, mouse
ggtctacttgctgggtgcaa

SEQ ID NO: 549047 - DNA, 20 bp, mouse
gtgatttaaaccgtgattta

SEQ ID NO: 549048 - DNA, 20 bp, mouse
gagcatggaagtctacttgc

SEQ ID NO: 549049 - DNA, 20 bp, mouse
gtgtgtcatgcaacgattat

SEQ ID NO: 549050 - DNA, 20 bp, mouse
gaaataactggttgtatctc

SEQ ID NO: 549051 - DNA, 20 bp, mouse
gttttagtggccataaatca

SEQ ID NO: 549052 - DNA, 20 bp, mouse
gtgttgcttgttcagatccc

SEQ ID NO: 549053 - DNA, 20 bp, mouse
ggcacacactctctgtaaat

SEQ ID NO: 549054 - DNA, 20 bp, mouse
gagcatctgaggaatagtga

SEQ ID NO: 549055 - DNA, 20 bp, mouse
gacattgacctcatggatgg

SEQ ID NO: 549056 - DNA, 20 bp, mouse
gtgatgtagggcacgattta

SEQ ID NO: 549057 - DNA, 20 bp, mouse
gatttatggctactaaaaac

SEQ ID NO: 549058 - DNA, 20 bp, mouse
gagtgtgtgcaccagcatct

SEQ ID NO: 549059 - DNA, 20 bp, mouse
gatgcagcagttataggaaa

SEQ ID NO: 549060 - DNA, 20 bp, mouse
gtttatgacagtgggcagta

SEQ ID NO: 549061 - DNA, 20 bp, mouse
gtgtgtcatgcagcagttat

SEQ ID NO: 549062 - DNA, 20 bp, mouse
gcatgggggtatgaagcttg

SEQ ID NO: 549063 - DNA, 20 bp, mouse
ggttcacttgcttggtgcaa

SEQ ID NO: 549064 - DNA, 20 bp, mouse
ggtatggaagttcacttgct

SEQ ID NO: 549065 - DNA, 20 bp, mouse
gctcttttcctttatgacag

SEQ ID NO: 549066 - DNA, 20 bp, mouse
gttgctccttgggttctcaa

SEQ ID NO: 549067 - DNA, 20 bp, mouse
gataaaaagaggaaagtgtg

SEQ ID NO: 549068 - DNA, 20 bp, mouse
gagctgtggcagggtgactg

SEQ ID NO: 549069 - DNA, 20 bp, mouse
gaaataggaacaataaaaag

SEQ ID NO: 549070 - DNA, 20 bp, mouse
gcacgcaagagataatacat

SEQ ID NO: 549071 - DNA, 20 bp, mouse
gggagaatgtgaagcattcg

SEQ ID NO: 549072 - DNA, 20 bp, mouse
ggcctctccatgatagactt

SEQ ID NO: 549073 - DNA, 20 bp, mouse
gggtggtcagataaataaat

SEQ ID NO: 549074 - DNA, 20 bp, mouse
ggatagtcccaagtctatca

SEQ ID NO: 549075 - DNA, 20 bp, mouse
gtcccaagtctatcatggag

SEQ ID NO: 549076 - DNA, 20 bp, mouse
gtcctgtctcttaatatggt

SEQ ID NO: 549077 - DNA, 20 bp, mouse
gttcatagcattagcaaaca

SEQ ID NO: 549078 - DNA, 20 bp, mouse
gtgagaggcgagacatgaga

SEQ ID NO: 549079 - DNA, 20 bp, mouse
gattttcctgtctcttaata

SEQ ID NO: 549080 - DNA, 20 bp, mouse
gtccatggccattgatcgac

SEQ ID NO: 549081 - DNA, 20 bp, mouse
gggtcatccgctctgactcc

SEQ ID NO: 549082 - DNA, 20 bp, mouse
gaacacggatagctacctgc

SEQ ID NO: 549083 - DNA, 20 bp, mouse
gggtttctgcatccagggat

SEQ ID NO: 549084 - DNA, 20 bp, mouse
gtgatgaagatgccaaaaag

SEQ ID NO: 549085 - DNA, 20 bp, mouse
ggggtctctctaccaatccc

SEQ ID NO: 549086 - DNA, 20 bp, mouse
gtctgtctcaggataaattt

SEQ ID NO: 549087 - DNA, 20 bp, mouse
gtagctatcagtgttcccta

SEQ ID NO: 549088 - DNA, 20 bp, mouse
gacatgaggaggcagcgttg

SEQ ID NO: 549089 - DNA, 20 bp, mouse
ggtacttcttcatggcctta

SEQ ID NO: 549090 - DNA, 20 bp, mouse
gttgttcatgtctctgtctc

SEQ ID NO: 549091 - DNA, 20 bp, mouse
gatggagcctggaatcagag

SEQ ID NO: 549092 - DNA, 20 bp, mouse
gcatgaatgacaagttgcta

SEQ ID NO: 549093 - DNA, 20 bp, mouse
ggttgcagatggccaccagt

SEQ ID NO: 549094 - DNA, 20 bp, mouse
gatggccaccagtcggtcaa

SEQ ID NO: 549095 - DNA, 20 bp, mouse
gggtcatccgctctgattcc

SEQ ID NO: 549096 - DNA, 20 bp, mouse
ggctggtcagtcctaaaagg

SEQ ID NO: 549097 - DNA, 20 bp, mouse
gcaaccccaaacaacaggta

SEQ ID NO: 549098 - DNA, 20 bp, mouse
gaccagcaaccccaaacaac

SEQ ID NO: 549099 - DNA, 20 bp, mouse
gatctgtggcacgatgacag

SEQ ID NO: 549100 - DNA, 20 bp, mouse
gagtgaggcactgggcaaag

SEQ ID NO: 549101 - DNA, 20 bp, mouse
gtgcagaacagcaatgctcc

SEQ ID NO: 549102 - DNA, 20 bp, mouse
gcgacccatgagaattgtgt

SEQ ID NO: 549103 - DNA, 20 bp, mouse
gaagccatacctgttgtttg

SEQ ID NO: 549104 - DNA, 20 bp, mouse
ggtgtagtcgggcatctctc

SEQ ID NO: 549105 - DNA, 20 bp, mouse
gaggcgctgtcgcttgctgg

SEQ ID NO: 549106 - DNA, 20 bp, mouse
gaactcagcaggcataactc

SEQ ID NO: 549107 - DNA, 20 bp, mouse
gagcaggcataactctggac

SEQ ID NO: 549108 - DNA, 20 bp, mouse
ggagggcacaggctacataa

SEQ ID NO: 549109 - DNA, 20 bp, mouse
ggaactcagagaacttcacc

SEQ ID NO: 549110 - DNA, 20 bp, mouse
gggagcgccaggcatagacg

SEQ ID NO: 549111 - DNA, 20 bp, mouse
gagacgtggtgacataactg

SEQ ID NO: 549112 - DNA, 20 bp, mouse
gatagatgggcaggaatatc

SEQ ID NO: 549113 - DNA, 20 bp, mouse
ggatggtggcacgggacagt

SEQ ID NO: 549114 - DNA, 20 bp, mouse
gatcttggggccaatggcag

SEQ ID NO: 549115 - DNA, 20 bp, mouse
gtagagaagagggttcccaa

SEQ ID NO: 549116 - DNA, 20 bp, mouse
gcagagatcagccccagatg

SEQ ID NO: 549117 - DNA, 20 bp, mouse
gtcatttacacactccatgg

SEQ ID NO: 549118 - DNA, 20 bp, mouse
gagccagagacgagaagcca

SEQ ID NO: 549119 - DNA, 20 bp, mouse
ggctctgtctagcacaatgg

SEQ ID NO: 549120 - DNA, 20 bp, mouse
gagggctctgtctagcacaa

SEQ ID NO: 549121 - DNA, 20 bp, mouse
ggcaggtctcagaacaggac

SEQ ID NO: 549122 - DNA, 20 bp, mouse
ggtgtagcaggtctcagaac

SEQ ID NO: 549123 - DNA, 20 bp, mouse
gaagtacatgggcgtatgaa

SEQ ID NO: 549124 - DNA, 20 bp, mouse
gcaccgtgtagcgcagaggg

SEQ ID NO: 549125 - DNA, 20 bp, mouse
gctcagagtgaacaaataga

SEQ ID NO: 549126 - DNA, 20 bp, mouse
gagagaacggactgaatctc

SEQ ID NO: 549127 - DNA, 20 bp, mouse
gtggaaccagaaaaccacac

SEQ ID NO: 549128 - DNA, 20 bp, mouse
gcactgtatagtgcaagggg

SEQ ID NO: 549129 - DNA, 20 bp, mouse
ggattcagtccgttctcttt

SEQ ID NO: 549130 - DNA, 20 bp, mouse
gtatagacacttcatttaca

SEQ ID NO: 549131 - DNA, 20 bp, mouse
gattctctgaaagtcccaac

SEQ ID NO: 549132 - DNA, 20 bp, mouse
gcatgccaggagaagtagct

SEQ ID NO: 549133 - DNA, 20 bp, mouse
ggagcactgtatagtgcaag

SEQ ID NO: 549134 - DNA, 20 bp, mouse
gattccagaattttacctgt

SEQ ID NO: 549135 - DNA, 20 bp, mouse
gtcagtgcagttaaactctc

SEQ ID NO: 549136 - DNA, 20 bp, mouse
ggtagctgaagagccccatg

SEQ ID NO: 549137 - DNA, 20 bp, mouse
ggtgatgcgcctgggggatg

SEQ ID NO: 549138 - DNA, 20 bp, mouse
ggacatccagaagtgagagt

SEQ ID NO: 549139 - DNA, 20 bp, mouse
gtagacagtgatgcgcctgg

SEQ ID NO: 549140 - DNA, 20 bp, mouse
gggaagaacaagacaagatg

SEQ ID NO: 549141 - DNA, 20 bp, mouse
ggtctacagaagattcggta

SEQ ID NO: 549142 - DNA, 20 bp, mouse
gagcaggccaatgatgaaca

SEQ ID NO: 549143 - DNA, 20 bp, mouse
gtcactgtctacagaagatt

SEQ ID NO: 549144 - DNA, 20 bp, mouse
gatgaggaagaacatctgag

SEQ ID NO: 549145 - DNA, 20 bp, mouse
gctttggggatggtaaccag

SEQ ID NO: 549146 - DNA, 20 bp, mouse
gagggtgatggaggtcagga

SEQ ID NO: 549147 - DNA, 20 bp, mouse
ggtgatggaggtcaggatgg

SEQ ID NO: 549148 - DNA, 20 bp, mouse
gctgcagggtgatggaggtc

SEQ ID NO: 549149 - DNA, 20 bp, mouse
ggtcaggatggaggccacca

SEQ ID NO: 549150 - DNA, 20 bp, mouse
gtgagcacctggtagtgcag

SEQ ID NO: 549151 - DNA, 20 bp, mouse
gtgccaccccctgcactacc

SEQ ID NO: 549152 - DNA, 20 bp, mouse
ggtagctgaagagccccatg

SEQ ID NO: 549153 - DNA, 20 bp, mouse
gggaagaacaggacaagatg

SEQ ID NO: 549154 - DNA, 20 bp, mouse
gagcaggccaatgatgaaca

SEQ ID NO: 549155 - DNA, 20 bp, mouse
gggtggccatgaggaagaac

SEQ ID NO: 549156 - DNA, 20 bp, mouse
gggacagagtgtgacgcgtg

SEQ ID NO: 549157 - DNA, 20 bp, mouse
gaggtaagccagctcttctt

SEQ ID NO: 549158 - DNA, 20 bp, mouse
gccttgcacagacttttgta

SEQ ID NO: 549159 - DNA, 20 bp, mouse
gaaaagtctgtgcaaggcct

SEQ ID NO: 549160 - DNA, 20 bp, mouse
gcataggtgagtaaagtcgg

SEQ ID NO: 549161 - DNA, 20 bp, mouse
gccagaagcaaaccttccat

SEQ ID NO: 549162 - DNA, 20 bp, mouse
gaccaggcagtgagcctgga

SEQ ID NO: 549163 - DNA, 20 bp, mouse
ggacccagatactcactact

SEQ ID NO: 549164 - DNA, 20 bp, mouse
gaggcaaagccacttgtccc

SEQ ID NO: 549165 - DNA, 20 bp, mouse
gctggccttgggatgcttgg

SEQ ID NO: 549166 - DNA, 20 bp, mouse
ggtggtacatacacagatga

SEQ ID NO: 549167 - DNA, 20 bp, mouse
gatcataagcatagaaaaga

SEQ ID NO: 549168 - DNA, 20 bp, mouse
gcagggtaactccaggaccc

SEQ ID NO: 549169 - DNA, 20 bp, mouse
gaatatctcagggtaactcc

SEQ ID NO: 549170 - DNA, 20 bp, mouse
gcaggatgagcaatgtgagc

SEQ ID NO: 549171 - DNA, 20 bp, mouse
gggagcaggattttagacca

SEQ ID NO: 549172 - DNA, 20 bp, mouse
gtaagttggccagggttagg

SEQ ID NO: 549173 - DNA, 20 bp, mouse
ggggtaagttggccagggtt

SEQ ID NO: 549174 - DNA, 20 bp, mouse
ggttggccagggttaggtgg

SEQ ID NO: 549175 - DNA, 20 bp, mouse
gaccataacctcttggaggg

SEQ ID NO: 549176 - DNA, 20 bp, mouse
gtgcagtggaccacagacct

SEQ ID NO: 549177 - DNA, 20 bp, mouse
gtgtggtgtagacactgcag

SEQ ID NO: 549178 - DNA, 20 bp, mouse
gcagaaagttccaaggtctg

SEQ ID NO: 549179 - DNA, 20 bp, mouse
ggtcctgtgaatatgcaact

SEQ ID NO: 549180 - DNA, 20 bp, mouse
gttcccagttgcatattcac

SEQ ID NO: 549181 - DNA, 20 bp, mouse
gaatcacccttggccatcca

SEQ ID NO: 549182 - DNA, 20 bp, mouse
gatttaccttggatggccaa

SEQ ID NO: 549183 - DNA, 20 bp, mouse
gattcacaggacaatctttt

SEQ ID NO: 549184 - DNA, 20 bp, mouse
gtcaagctagtaacaggtct

SEQ ID NO: 549185 - DNA, 20 bp, mouse
gttactagcttgaaatgata

SEQ ID NO: 549186 - DNA, 20 bp, mouse
gtgcagctgtgtctcattgt

SEQ ID NO: 549187 - DNA, 20 bp, mouse
gagagtcccagtcactggaa

SEQ ID NO: 549188 - DNA, 20 bp, mouse
gacttgagagtcccagtcac

SEQ ID NO: 549189 - DNA, 20 bp, mouse
ggtgtgcacaagagagttga

SEQ ID NO: 549190 - DNA, 20 bp, mouse
gcttggcctttccagtgact

SEQ ID NO: 549191 - DNA, 20 bp, mouse
gaggctggtcatcacatcat

SEQ ID NO: 549192 - DNA, 20 bp, mouse
gttgtagatcatagttttaa

SEQ ID NO: 549193 - DNA, 20 bp, mouse
gttcagtcatcatgcatgca

SEQ ID NO: 549194 - DNA, 20 bp, mouse
gcagcaagaacaggacgaag

SEQ ID NO: 549195 - DNA, 20 bp, mouse
ggcataagatgcatccacca

SEQ ID NO: 549196 - DNA, 20 bp, mouse
gtttgttctttttggaggcc

SEQ ID NO: 549197 - DNA, 20 bp, mouse
ggctggtgctctgcagggat

SEQ ID NO: 549198 - DNA, 20 bp, mouse
gtgcagggatcggcaggccc

SEQ ID NO: 549199 - DNA, 20 bp, mouse
ggaactggttgaagagagtt

SEQ ID NO: 549200 - DNA, 20 bp, mouse
gcagttgctggtgctctgca

SEQ ID NO: 549201 - DNA, 20 bp, mouse
ggtgctctgcagggatcggc

SEQ ID NO: 549202 - DNA, 20 bp, mouse
gttcaaccagttcctcctcc

SEQ ID NO: 549203 - DNA, 20 bp, mouse
gttcagtatactaatcaccc

SEQ ID NO: 549204 - DNA, 20 bp, mouse
gacacactctactcttggct

SEQ ID NO: 549205 - DNA, 20 bp, mouse
gacttttttgttctttttgg

SEQ ID NO: 549206 - DNA, 20 bp, mouse
gtacaataccagtaacatag

SEQ ID NO: 549207 - DNA, 20 bp, mouse
ggaaacttggactaagcttc

SEQ ID NO: 549208 - DNA, 20 bp, mouse
gtttaacagtatgatgatct

SEQ ID NO: 549209 - DNA, 20 bp, mouse
gaatgttctcttcatgatga

SEQ ID NO: 549210 - DNA, 20 bp, mouse
gtcacaaacctctatgttac

SEQ ID NO: 549211 - DNA, 20 bp, mouse
gtttagtcaagaaaataaac

SEQ ID NO: 549212 - DNA, 20 bp, mouse
gtcattttatgtggagacac

SEQ ID NO: 549213 - DNA, 20 bp, mouse
gtctaaatgcagtccatcaa

SEQ ID NO: 549214 - DNA, 20 bp, mouse
gtgttaaactatgtgtctca

SEQ ID NO: 549215 - DNA, 20 bp, mouse
gtttctaaactttatcctgt

SEQ ID NO: 549216 - DNA, 20 bp, mouse
ggctggtactctggcaggat

SEQ ID NO: 549217 - DNA, 20 bp, mouse
gcaggtgctggtactctggc

SEQ ID NO: 549218 - DNA, 20 bp, mouse
gtcctctctagtatcctaat

SEQ ID NO: 549219 - DNA, 20 bp, mouse
gtccaggcttccaaaaagat

SEQ ID NO: 549220 - DNA, 20 bp, mouse
gatcacccagtttattctcc

SEQ ID NO: 549221 - DNA, 20 bp, mouse
gtccaatctttttggaagcc

SEQ ID NO: 549222 - DNA, 20 bp, mouse
gaccagacaaacacagagct

SEQ ID NO: 549223 - DNA, 20 bp, mouse
gcccaagctctgtgtttgtc

SEQ ID NO: 549224 - DNA, 20 bp, mouse
gtgtacttttccaatctttt

SEQ ID NO: 549225 - DNA, 20 bp, mouse
gaggcccaggagaataaact

SEQ ID NO: 549226 - DNA, 20 bp, mouse
gaataaacctagctctcccg

SEQ ID NO: 549227 - DNA, 20 bp, mouse
gtgtaagatggagtttatgg

SEQ ID NO: 549228 - DNA, 20 bp, mouse
gcaagagcagccctgtaaga

SEQ ID NO: 549229 - DNA, 20 bp, mouse
gtaacctcttttatattggt

SEQ ID NO: 549230 - DNA, 20 bp, mouse
ggaacccaccaatataaaag

SEQ ID NO: 549231 - DNA, 20 bp, mouse
gtaaaatcaatcatcatctt

SEQ ID NO: 549232 - DNA, 20 bp, mouse
ggagtaatttcataaaatac

SEQ ID NO: 549233 - DNA, 20 bp, mouse
gatataaaagaggttatgtg

SEQ ID NO: 549234 - DNA, 20 bp, mouse
gtttactatacttcatccta

SEQ ID NO: 549235 - DNA, 20 bp, mouse
gtttatggtggttgtgctaa

SEQ ID NO: 549236 - DNA, 20 bp, mouse
gtacaggtgctggtactctt

SEQ ID NO: 549237 - DNA, 20 bp, mouse
gtgtctgctagtgttatcct

SEQ ID NO: 549238 - DNA, 20 bp, mouse
gataagccatgaccaaaaga

SEQ ID NO: 549239 - DNA, 20 bp, mouse
ggctggtactcttggggtat

SEQ ID NO: 549240 - DNA, 20 bp, mouse
ggtactcttggggtatgggc

SEQ ID NO: 549241 - DNA, 20 bp, mouse
ggcagacacacacagagtgt

SEQ ID NO: 549242 - DNA, 20 bp, mouse
gcaggaacagggcatagtac

SEQ ID NO: 549243 - DNA, 20 bp, mouse
gataggagatggacgtgtcc

SEQ ID NO: 549244 - DNA, 20 bp, mouse
gtacagcacagtaaataccc

SEQ ID NO: 549245 - DNA, 20 bp, mouse
gctggagagcatccttcttt

SEQ ID NO: 549246 - DNA, 20 bp, mouse
gacccggcataggagatgga

SEQ ID NO: 549247 - DNA, 20 bp, mouse
gtctctggtggtgctcacct

SEQ ID NO: 549248 - DNA, 20 bp, mouse
ggaacatttgctgctgctct

SEQ ID NO: 549249 - DNA, 20 bp, mouse
gaggaggatgaactgaggga

SEQ ID NO: 549250 - DNA, 20 bp, mouse
ggcccaggaggatgaactga

SEQ ID NO: 549251 - DNA, 20 bp, mouse
gcatttgctgctgctctggg

SEQ ID NO: 549252 - DNA, 20 bp, mouse
gaggcacccggcataggaga

SEQ ID NO: 549253 - DNA, 20 bp, mouse
gcccatccatctcctatgcc

SEQ ID NO: 549254 - DNA, 20 bp, mouse
ggctgctgctctgggaggat

SEQ ID NO: 549255 - DNA, 20 bp, mouse
gtgtgtcaggcacccggcat

SEQ ID NO: 549256 - DNA, 20 bp, mouse
gtaacgaagagggtaacata

SEQ ID NO: 549257 - DNA, 20 bp, mouse
gtgatgctggtataacgaag

SEQ ID NO: 549258 - DNA, 20 bp, mouse
gtgcaatgtggaattcagca

SEQ ID NO: 549259 - DNA, 20 bp, mouse
gataagtacagtgtgcaatg

SEQ ID NO: 549260 - DNA, 20 bp, mouse
gctaggtttgcaaaaacatt

SEQ ID NO: 549261 - DNA, 20 bp, mouse
gcccattctctgtgtttgta

SEQ ID NO: 549262 - DNA, 20 bp, mouse
gttcagcatggtaagtaacc

SEQ ID NO: 549263 - DNA, 20 bp, mouse
gttgtatggtgtttatgtcc

SEQ ID NO: 549264 - DNA, 20 bp, mouse
gcataagaagaaagttctct

SEQ ID NO: 549265 - DNA, 20 bp, mouse
gaccatacaaacacagagaa

SEQ ID NO: 549266 - DNA, 20 bp, mouse
gggtgaccaggatctgaagc

SEQ ID NO: 549267 - DNA, 20 bp, mouse
gccttcctgaaaatttatct

SEQ ID NO: 549268 - DNA, 20 bp, mouse
gcgattcctgcttcagatcc

SEQ ID NO: 549269 - DNA, 20 bp, mouse
gtcaatgtaactgtggaaca

SEQ ID NO: 549270 - DNA, 20 bp, mouse
gcttattaccattacctatt

SEQ ID NO: 549271 - DNA, 20 bp, mouse
gaaacatgcccaataggtaa

SEQ ID NO: 549272 - DNA, 20 bp, mouse
gaaaattatcaatgtaactg

SEQ ID NO: 549273 - DNA, 20 bp, mouse
gcatcatgctatcataaaac

SEQ ID NO: 549274 - DNA, 20 bp, mouse
gatcctaaagtgttcttatt

SEQ ID NO: 549275 - DNA, 20 bp, mouse
ggatgggcagttttcaggta

SEQ ID NO: 549276 - DNA, 20 bp, mouse
gaagcccacatggattatta

SEQ ID NO: 549277 - DNA, 20 bp, mouse
gtctccataataatccatgt

SEQ ID NO: 549278 - DNA, 20 bp, mouse
gttctctcagatatccatca

SEQ ID NO: 549279 - DNA, 20 bp, mouse
ggctttctggggacaggtta

SEQ ID NO: 549280 - DNA, 20 bp, mouse
gtaatccatgtgggctttct

SEQ ID NO: 549281 - DNA, 20 bp, mouse
gtaatataattataggtgag

SEQ ID NO: 549282 - DNA, 20 bp, mouse
gctccagaataataacagta

SEQ ID NO: 549283 - DNA, 20 bp, mouse
gtgagagaatctgtaagtcc

SEQ ID NO: 549284 - DNA, 20 bp, mouse
gaatgcaaaggtaaattaat

SEQ ID NO: 549285 - DNA, 20 bp, mouse
gaattattcttcttgatagg

SEQ ID NO: 549286 - DNA, 20 bp, mouse
gaacaagtgctcgtactcag

SEQ ID NO: 549287 - DNA, 20 bp, mouse
ggctcgtactcaggggcaat

SEQ ID NO: 549288 - DNA, 20 bp, mouse
gtctctcagttcttactcct

SEQ ID NO: 549289 - DNA, 20 bp, mouse
ggatactggcataatgaagg

SEQ ID NO: 549290 - DNA, 20 bp, mouse
gattacaggaagatcatgcc

SEQ ID NO: 549291 - DNA, 20 bp, mouse
gagtcttgtgctgctgatct

SEQ ID NO: 549292 - DNA, 20 bp, mouse
ggtgtcagacatcctgcata

SEQ ID NO: 549293 - DNA, 20 bp, mouse
gtgcaacatggcatacaatg

SEQ ID NO: 549294 - DNA, 20 bp, mouse
gcatgatactggcataatga

SEQ ID NO: 549295 - DNA, 20 bp, mouse
ggtactcaggggcaatgggc

SEQ ID NO: 549296 - DNA, 20 bp, mouse
gaatatgggactaggatctc

SEQ ID NO: 549297 - DNA, 20 bp, mouse
gggactaggatctcaggctg

SEQ ID NO: 549298 - DNA, 20 bp, mouse
gactcagattctgaacatag

SEQ ID NO: 549299 - DNA, 20 bp, mouse
gctgcaattaatatgggact

SEQ ID NO: 549300 - DNA, 20 bp, mouse
gagtcatttgaacacatcgt

SEQ ID NO: 549301 - DNA, 20 bp, mouse
gaggatagtctagttttcta

SEQ ID NO: 549302 - DNA, 20 bp, mouse
gaacatgcttgtgggagtta

SEQ ID NO: 549303 - DNA, 20 bp, mouse
gtagtagttaacatgcttgt

SEQ ID NO: 549304 - DNA, 20 bp, mouse
gcagagaaagagagttactg

SEQ ID NO: 549305 - DNA, 20 bp, mouse
gaccacctgaaaagatactt

SEQ ID NO: 549306 - DNA, 20 bp, mouse
ggtttattaaaattactaca

SEQ ID NO: 549307 - DNA, 20 bp, mouse
gagctttatgatagcatcac

SEQ ID NO: 549308 - DNA, 20 bp, mouse
gaccctaaagagttgctatt

SEQ ID NO: 549309 - DNA, 20 bp, mouse
gtcaggtgatgtgaataccc

SEQ ID NO: 549310 - DNA, 20 bp, mouse
gggtgaccagattttgaagc

SEQ ID NO: 549311 - DNA, 20 bp, mouse
gcaagtgcaaccacgaaaca

SEQ ID NO: 549312 - DNA, 20 bp, mouse
gttgctattaggttgaaatg

SEQ ID NO: 549313 - DNA, 20 bp, mouse
gtggtgcctgcttcaaaatc

SEQ ID NO: 549314 - DNA, 20 bp, mouse
gatttatctagaatggcaga

SEQ ID NO: 549315 - DNA, 20 bp, mouse
gacctaatagcaactcttta

SEQ ID NO: 549316 - DNA, 20 bp, mouse
gaacaggtgtttgtactcta

SEQ ID NO: 549317 - DNA, 20 bp, mouse
ggtttgtactctagggaaat

SEQ ID NO: 549318 - DNA, 20 bp, mouse
gcccatccatcccctatgga

SEQ ID NO: 549319 - DNA, 20 bp, mouse
ggcaagcagggtgtgcatca

SEQ ID NO: 549320 - DNA, 20 bp, mouse
gcatatctccaaaagccata

SEQ ID NO: 549321 - DNA, 20 bp, mouse
ggcacaaatatacttcctta

SEQ ID NO: 549322 - DNA, 20 bp, mouse
ggcatattatgcagcatttt

SEQ ID NO: 549323 - DNA, 20 bp, mouse
gataattgtcctcattaaac

SEQ ID NO: 549324 - DNA, 20 bp, mouse
gtagacaagtacagagcttg

SEQ ID NO: 549325 - DNA, 20 bp, mouse
gtatacttccttatggcttt

SEQ ID NO: 549326 - DNA, 20 bp, mouse
gtggagggattggcaggcca

SEQ ID NO: 549327 - DNA, 20 bp, mouse
gtaggtgttggtactctgga

SEQ ID NO: 549328 - DNA, 20 bp, mouse
gcagggcatagaataggtgt

SEQ ID NO: 549329 - DNA, 20 bp, mouse
ggttggtactctggagggat

SEQ ID NO: 549330 - DNA, 20 bp, mouse
ggtactctggagggattggc

SEQ ID NO: 549331 - DNA, 20 bp, mouse
gtgtacctcactaccatctt

SEQ ID NO: 549332 - DNA, 20 bp, mouse
ggtttcccaagatggtagtg

SEQ ID NO: 549333 - DNA, 20 bp, mouse
gactagcatcatgagtccta

SEQ ID NO: 549334 - DNA, 20 bp, mouse
gctagaaaagtacagacctt

SEQ ID NO: 549335 - DNA, 20 bp, mouse
gttttctagtgctactgttg

SEQ ID NO: 549336 - DNA, 20 bp, mouse
gatcttggaattcctcctcc

SEQ ID NO: 549337 - DNA, 20 bp, mouse
gaagaaccaaactctcatct

SEQ ID NO: 549338 - DNA, 20 bp, mouse
gaatctgcataggatatcgt

SEQ ID NO: 549339 - DNA, 20 bp, mouse
gaagtcattggaagcatggc

SEQ ID NO: 549340 - DNA, 20 bp, mouse
gttttaagtcattggaagca

SEQ ID NO: 549341 - DNA, 20 bp, mouse
gcttttctatgccctgctcc

SEQ ID NO: 549342 - DNA, 20 bp, mouse
gtgatgagatgggcagaccc

SEQ ID NO: 549343 - DNA, 20 bp, mouse
ggaattccaagatgagagtt

SEQ ID NO: 549344 - DNA, 20 bp, mouse
gctgctgcataccctactca

SEQ ID NO: 549345 - DNA, 20 bp, mouse
gtgatgctggtataatgcaa

SEQ ID NO: 549346 - DNA, 20 bp, mouse
gatgatgatgaggttcccca

SEQ ID NO: 549347 - DNA, 20 bp, mouse
gccgttaaaagaagtcaaca

SEQ ID NO: 549348 - DNA, 20 bp, mouse
gtggttcaataggcaagccc

SEQ ID NO: 549349 - DNA, 20 bp, mouse
gttcaataggcaagcccagg

SEQ ID NO: 549350 - DNA, 20 bp, mouse
gaagaagtcaacatggaaag

SEQ ID NO: 549351 - DNA, 20 bp, mouse
gaacctgcatagggtatgga

SEQ ID NO: 549352 - DNA, 20 bp, mouse
gtacacaaagccaatgcttt

SEQ ID NO: 549353 - DNA, 20 bp, mouse
ggatgctagtatagtgtagg

SEQ ID NO: 549354 - DNA, 20 bp, mouse
gggcatagaaaaggtcttgc

SEQ ID NO: 549355 - DNA, 20 bp, mouse
gttctgcagcaatttgggaa

SEQ ID NO: 549356 - DNA, 20 bp, mouse
gagctcctcggcttgatgga

SEQ ID NO: 549357 - DNA, 20 bp, mouse
gagccgaggagctggaactg

SEQ ID NO: 549358 - DNA, 20 bp, mouse
gcatgggtacctgacctcca

SEQ ID NO: 549359 - DNA, 20 bp, mouse
gagaagaaacagcagcgggt

SEQ ID NO: 549360 - DNA, 20 bp, mouse
gagtctggggacagtgactg

SEQ ID NO: 549361 - DNA, 20 bp, mouse
ggcaaggtggccagcagtct

SEQ ID NO: 549362 - DNA, 20 bp, mouse
gtgtgccatccatcaagccg

SEQ ID NO: 549363 - DNA, 20 bp, mouse
gattgcccagggcattgagt

SEQ ID NO: 549364 - DNA, 20 bp, mouse
gaccgcacggtcataagaca

SEQ ID NO: 549365 - DNA, 20 bp, mouse
gaccatgctcagattgccca

SEQ ID NO: 549366 - DNA, 20 bp, mouse
gggcagcagaatctatgtca

SEQ ID NO: 549367 - DNA, 20 bp, mouse
gggtctgcctcacctagaag

SEQ ID NO: 549368 - DNA, 20 bp, mouse
gtacagaactggaaggactt

SEQ ID NO: 549369 - DNA, 20 bp, mouse
gtgaggcagacccacaatga

SEQ ID NO: 549370 - DNA, 20 bp, mouse
gatcacctccagtctcatta

SEQ ID NO: 549371 - DNA, 20 bp, mouse
gtctcactccataatgagac

SEQ ID NO: 549372 - DNA, 20 bp, mouse
gcatcttccacttctaggtg

SEQ ID NO: 549373 - DNA, 20 bp, mouse
ggacccccctccatcattgt

SEQ ID NO: 549374 - DNA, 20 bp, mouse
gggtaaagatcaacagacaa

SEQ ID NO: 549375 - DNA, 20 bp, mouse
ggttcctggcaaagttccca

SEQ ID NO: 549376 - DNA, 20 bp, mouse
gactgtcactggtggaagag

SEQ ID NO: 549377 - DNA, 20 bp, mouse
gttcattcaactgtcactgg

SEQ ID NO: 549378 - DNA, 20 bp, mouse
ggtgagaggcaggccccata

SEQ ID NO: 549379 - DNA, 20 bp, mouse
gacacaggaatcgtttccca

SEQ ID NO: 549380 - DNA, 20 bp, mouse
gagaggatgggccgcaaaac

SEQ ID NO: 549381 - DNA, 20 bp, mouse
gaagttcattcaactgtcac

SEQ ID NO: 549382 - DNA, 20 bp, mouse
gcgtagctacataagcaaga

SEQ ID NO: 549383 - DNA, 20 bp, mouse
gtagggaatgtgtctgtcat

SEQ ID NO: 549384 - DNA, 20 bp, mouse
ggacagacacattccctatg

SEQ ID NO: 549385 - DNA, 20 bp, mouse
gggtgttgtaggtgaggggg

SEQ ID NO: 549386 - DNA, 20 bp, mouse
gtcagtaacagtggttccgt

SEQ ID NO: 549387 - DNA, 20 bp, mouse
ggtgtgagacaagctccata

SEQ ID NO: 549388 - DNA, 20 bp, mouse
gtatggaactgtaagcctgt

SEQ ID NO: 549389 - DNA, 20 bp, mouse
gctcaggttgcctccaactg

SEQ ID NO: 549390 - DNA, 20 bp, mouse
gcattcgggtgctataggtg

SEQ ID NO: 549391 - DNA, 20 bp, mouse
gtggttcattcgggtgctat

SEQ ID NO: 549392 - DNA, 20 bp, mouse
gctgcactgaatggttcatt

SEQ ID NO: 549393 - DNA, 20 bp, mouse
gaattttggtggcctcatcc

SEQ ID NO: 549394 - DNA, 20 bp, mouse
gttccgttggctcttggctt

SEQ ID NO: 549395 - DNA, 20 bp, mouse
gaatgcactaacccacactg

SEQ ID NO: 549396 - DNA, 20 bp, mouse
gagacaaagcctagaatcaa

SEQ ID NO: 549397 - DNA, 20 bp, mouse
gtagtggttccattgattct

SEQ ID NO: 549398 - DNA, 20 bp, mouse
gaatgaactacactatacag

SEQ ID NO: 549399 - DNA, 20 bp, mouse
gatatggaattgtatgcttt

SEQ ID NO: 549400 - DNA, 20 bp, mouse
gatcttggtggctatgtcct

SEQ ID NO: 549401 - DNA, 20 bp, mouse
gataagccatggctgtcaac

SEQ ID NO: 549402 - DNA, 20 bp, mouse
gtgcaaggaggaaaaaccac

SEQ ID NO: 549403 - DNA, 20 bp, mouse
gaccaagagccgaaccaaca

SEQ ID NO: 549404 - DNA, 20 bp, mouse
gttcgggtgctgtaagtgag

SEQ ID NO: 549405 - DNA, 20 bp, mouse
gtccttgcatgcttctttaa

SEQ ID NO: 549406 - DNA, 20 bp, mouse
gccagcaggacacaaagttg

SEQ ID NO: 549407 - DNA, 20 bp, mouse
gatcttgggaatagttacag

SEQ ID NO: 549408 - DNA, 20 bp, mouse
gggccttgctacctaggaga

SEQ ID NO: 549409 - DNA, 20 bp, mouse
gggagatggccttgctacct

SEQ ID NO: 549410 - DNA, 20 bp, mouse
gtgtacttcatgatatcatt

SEQ ID NO: 549411 - DNA, 20 bp, mouse
gaaccatctcctaggtagca

SEQ ID NO: 549412 - DNA, 20 bp, mouse
gttaccccatcacagtgttt

SEQ ID NO: 549413 - DNA, 20 bp, mouse
gcccaggagagtgaaatcta

SEQ ID NO: 549414 - DNA, 20 bp, mouse
gggagaagaagatgtcaaca

SEQ ID NO: 549415 - DNA, 20 bp, mouse
gaaagtacatagggttatgg

SEQ ID NO: 549416 - DNA, 20 bp, mouse
ggtacctggtcactgtagca

SEQ ID NO: 549417 - DNA, 20 bp, mouse
gattccctgctacagtgacc

SEQ ID NO: 549418 - DNA, 20 bp, mouse
gattctcttcctgatcttcc

SEQ ID NO: 549419 - DNA, 20 bp, mouse
gttattgacttctctgctca

SEQ ID NO: 549420 - DNA, 20 bp, mouse
gagtgaccaggtacatcccc

SEQ ID NO: 549421 - DNA, 20 bp, mouse
gcactaagagtgagcagcgt

SEQ ID NO: 549422 - DNA, 20 bp, mouse
gccccagaggaggaactcaa

SEQ ID NO: 549423 - DNA, 20 bp, mouse
gactagggccttgggcacta

SEQ ID NO: 549424 - DNA, 20 bp, mouse
gagggccttgggcactatgg

SEQ ID NO: 549425 - DNA, 20 bp, mouse
gacgaggagtatgtcatcac

SEQ ID NO: 549426 - DNA, 20 bp, mouse
gttccattggctctaggctt

SEQ ID NO: 549427 - DNA, 20 bp, mouse
ggtcaaccccaactagcaga

SEQ ID NO: 549428 - DNA, 20 bp, mouse
gcaagatcctctggatagtg

SEQ ID NO: 549429 - DNA, 20 bp, mouse
gcttcttccatctgctagtt

SEQ ID NO: 549430 - DNA, 20 bp, mouse
gatatggaattgtacgctta

SEQ ID NO: 549431 - DNA, 20 bp, mouse
gtcagtaatagtggttccat

SEQ ID NO: 549432 - DNA, 20 bp, mouse
gaatgaaccacactatccag

SEQ ID NO: 549433 - DNA, 20 bp, mouse
gcgtagccaccaagatcctc

SEQ ID NO: 549434 - DNA, 20 bp, mouse
gtagtggttccattggctct

SEQ ID NO: 549435 - DNA, 20 bp, mouse
ggatcttggtggctacgtcc

SEQ ID NO: 549436 - DNA, 20 bp, mouse
gcccccaactgtgagcaagt

SEQ ID NO: 549437 - DNA, 20 bp, mouse
gtgtgagcaagtaggcgaag

SEQ ID NO: 549438 - DNA, 20 bp, mouse
gtaattaataaacaatacac

SEQ ID NO: 549439 - DNA, 20 bp, mouse
ggtcttataacaggaattca

SEQ ID NO: 549440 - DNA, 20 bp, mouse
ggagacgacccaacattgat

SEQ ID NO: 549441 - DNA, 20 bp, mouse
gacaagcgcacagttcccta

SEQ ID NO: 549442 - DNA, 20 bp, mouse
gtgtgtgaggcaggctccat

SEQ ID NO: 549443 - DNA, 20 bp, mouse
gtcactgtcccatcaatgtt

SEQ ID NO: 549444 - DNA, 20 bp, mouse
gatgcagccgacatccaaca

SEQ ID NO: 549445 - DNA, 20 bp, mouse
ggcctacttgctcacagttg

SEQ ID NO: 549446 - DNA, 20 bp, mouse
gaacctccgagagtcccagg

SEQ ID NO: 549447 - DNA, 20 bp, mouse
gctcctcctgggactctcgg

SEQ ID NO: 549448 - DNA, 20 bp, mouse
gaggaacctccgagagtccc

SEQ ID NO: 549449 - DNA, 20 bp, mouse
gggacaggaaggtccagaat

SEQ ID NO: 549450 - DNA, 20 bp, mouse
ggaactcagagtccccactc

SEQ ID NO: 549451 - DNA, 20 bp, mouse
gacaactgggaaatggacgg

SEQ ID NO: 549452 - DNA, 20 bp, mouse
gataggatgcgctgatgctc

SEQ ID NO: 549453 - DNA, 20 bp, mouse
ggccaggatgagattgtcca

SEQ ID NO: 549454 - DNA, 20 bp, mouse
gggctgtagtgtaatggagg

SEQ ID NO: 549455 - DNA, 20 bp, mouse
gaggccataaaggatagata

SEQ ID NO: 549456 - DNA, 20 bp, mouse
gagtgcctggaagggtcgag

SEQ ID NO: 549457 - DNA, 20 bp, mouse
gcctggaagggtcgagaggt

SEQ ID NO: 549458 - DNA, 20 bp, mouse
gggcgagtggccagtctggg

SEQ ID NO: 549459 - DNA, 20 bp, mouse
gaatctgagcggaagccacg

SEQ ID NO: 549460 - DNA, 20 bp, mouse
ggaaaggctcccaagagtct

SEQ ID NO: 549461 - DNA, 20 bp, mouse
gggaggagtttgtcttggtg

SEQ ID NO: 549462 - DNA, 20 bp, mouse
gcaagacaaactcctccacg

SEQ ID NO: 549463 - DNA, 20 bp, mouse
gctaccgtcctgggtaagaa

SEQ ID NO: 549464 - DNA, 20 bp, mouse
gtctgggaggcatgagacta

SEQ ID NO: 549465 - DNA, 20 bp, mouse
gtgagactagggtaacgaag

SEQ ID NO: 549466 - DNA, 20 bp, mouse
gagtgaccatatacaggcaa

SEQ ID NO: 549467 - DNA, 20 bp, mouse
gaggaagaccacaaagagcc

SEQ ID NO: 549468 - DNA, 20 bp, mouse
gctggtggatctgatagaca

SEQ ID NO: 549469 - DNA, 20 bp, mouse
gttacccacttgtacagacc

SEQ ID NO: 549470 - DNA, 20 bp, mouse
gtagaagaggatatctgagg

SEQ ID NO: 549471 - DNA, 20 bp, mouse
gacagcctgtgactgaaatg

SEQ ID NO: 549472 - DNA, 20 bp, mouse
gtggttgatcatcatttctt

SEQ ID NO: 549473 - DNA, 20 bp, mouse
ggccatcatgggtttaactt

SEQ ID NO: 549474 - DNA, 20 bp, mouse
gacagccgcatttcagtcac

SEQ ID NO: 549475 - DNA, 20 bp, mouse
ggcaggcaacctggccatca

SEQ ID NO: 549476 - DNA, 20 bp, mouse
gcaagcctgccactcctgtc

SEQ ID NO: 549477 - DNA, 20 bp, mouse
ggtcagagttagcaggtaca

SEQ ID NO: 549478 - DNA, 20 bp, mouse
ggataaccgagtacctcaag

SEQ ID NO: 549479 - DNA, 20 bp, mouse
ggtgtgtgcccagctagtat

SEQ ID NO: 549480 - DNA, 20 bp, mouse
gtcagagacagtgtatacat

SEQ ID NO: 549481 - DNA, 20 bp, mouse
ggtatacactgtctctgaag

SEQ ID NO: 549482 - DNA, 20 bp, mouse
gggatgctcgccagccttgt

SEQ ID NO: 549483 - DNA, 20 bp, mouse
gtggcttgaacccacaaggc

SEQ ID NO: 549484 - DNA, 20 bp, mouse
gcaggaaccccatactagct

SEQ ID NO: 549485 - DNA, 20 bp, mouse
gaatttgtattcctgaaagc

SEQ ID NO: 549486 - DNA, 20 bp, mouse
gcaaggacaatcattcagaa

SEQ ID NO: 549487 - DNA, 20 bp, mouse
gaggaaccaacaggatcaca

SEQ ID NO: 549488 - DNA, 20 bp, mouse
gggatggacatcaactgcca

SEQ ID NO: 549489 - DNA, 20 bp, mouse
ggtctcagagaaggatagga

SEQ ID NO: 549490 - DNA, 20 bp, mouse
gtggacatcaactgccatgg

SEQ ID NO: 549491 - DNA, 20 bp, mouse
gcggctggcataatgaagtg

SEQ ID NO: 549492 - DNA, 20 bp, mouse
ggcaatgtgacctgctggca

SEQ ID NO: 549493 - DNA, 20 bp, mouse
gattgtccttgtgatcctgt

SEQ ID NO: 549494 - DNA, 20 bp, mouse
gacagacagtgggattcata

SEQ ID NO: 549495 - DNA, 20 bp, mouse
gtctctggcctggttatggg

SEQ ID NO: 549496 - DNA, 20 bp, mouse
gtcctgagcagtggtccaat

SEQ ID NO: 549497 - DNA, 20 bp, mouse
gcatttctcacttggagatg

SEQ ID NO: 549498 - DNA, 20 bp, mouse
gtccaattggaccactgctc

SEQ ID NO: 549499 - DNA, 20 bp, mouse
gaaaatgaactcctgagcag

SEQ ID NO: 549500 - DNA, 20 bp, mouse
gcagcaaccgagggtcagct

SEQ ID NO: 549501 - DNA, 20 bp, mouse
ggatggtaggataatgaaga

SEQ ID NO: 549502 - DNA, 20 bp, mouse
gagtggtgtaccatatctcc

SEQ ID NO: 549503 - DNA, 20 bp, mouse
gcagatgacagaatctcccc

SEQ ID NO: 549504 - DNA, 20 bp, mouse
gggagatggggttctccaat

SEQ ID NO: 549505 - DNA, 20 bp, mouse
gatctttgggatggtggcag

SEQ ID NO: 549506 - DNA, 20 bp, mouse
ggatttccccagtttgaaga

SEQ ID NO: 549507 - DNA, 20 bp, mouse
gtgacagaattcctcttctc

SEQ ID NO: 549508 - DNA, 20 bp, mouse
gtgatagttgggtaccggag

SEQ ID NO: 549509 - DNA, 20 bp, mouse
gaacttccatcttcaaactg

SEQ ID NO: 549510 - DNA, 20 bp, mouse
gccggggagtcatgatagtt

SEQ ID NO: 549511 - DNA, 20 bp, mouse
gagtcatgatagttgggtac

SEQ ID NO: 549512 - DNA, 20 bp, mouse
gtggaaatccaagcaatctc

SEQ ID NO: 549513 - DNA, 20 bp, mouse
gtgccatctgtaatcctctc

SEQ ID NO: 549514 - DNA, 20 bp, mouse
ggacaacaatggctattgac

SEQ ID NO: 549515 - DNA, 20 bp, mouse
ggaagaagtacatctgtagc

SEQ ID NO: 549516 - DNA, 20 bp, mouse
gttttcagaagtttatcgga

SEQ ID NO: 549517 - DNA, 20 bp, mouse
gccgagggtgaaagagcctg

SEQ ID NO: 549518 - DNA, 20 bp, mouse
ggaggagcatgaggaagccg

SEQ ID NO: 549519 - DNA, 20 bp, mouse
gtatccacacaatctctggg

SEQ ID NO: 549520 - DNA, 20 bp, mouse
gcacaataatggccatcgac

SEQ ID NO: 549521 - DNA, 20 bp, mouse
gaagctttctgtgactccaa

SEQ ID NO: 549522 - DNA, 20 bp, mouse
gagatatccacacaatctct

SEQ ID NO: 549523 - DNA, 20 bp, mouse
ggctcctcccagagattgtg

SEQ ID NO: 549524 - DNA, 20 bp, mouse
gcatattttcagaagtttat

SEQ ID NO: 549525 - DNA, 20 bp, mouse
gaatgattgcatagcgaagt

SEQ ID NO: 549526 - DNA, 20 bp, mouse
gctggacaccttggaagtga

SEQ ID NO: 549527 - DNA, 20 bp, mouse
ggcccagctccaagaaggaa

SEQ ID NO: 549528 - DNA, 20 bp, mouse
ggaacaggaataatgagcaa

SEQ ID NO: 549529 - DNA, 20 bp, mouse
gaatgatgaattctattact

SEQ ID NO: 549530 - DNA, 20 bp, mouse
gcaggtaaatctggacacct

SEQ ID NO: 549531 - DNA, 20 bp, mouse
ggtgtagcccagctccaaga

SEQ ID NO: 549532 - DNA, 20 bp, mouse
gaatatagtagtgaagtaaa

SEQ ID NO: 549533 - DNA, 20 bp, mouse
gttcgctagcatcttgggaa

SEQ ID NO: 549534 - DNA, 20 bp, mouse
gaataatgagcaatgggcac

SEQ ID NO: 549535 - DNA, 20 bp, mouse
ggtgactgggtcattagggt

SEQ ID NO: 549536 - DNA, 20 bp, mouse
gagtcacctgttagattggg

SEQ ID NO: 549537 - DNA, 20 bp, mouse
ggagagtcacctgttagatt

SEQ ID NO: 549538 - DNA, 20 bp, mouse
gccagtccccccaatctaac

SEQ ID NO: 549539 - DNA, 20 bp, mouse
gcacagatgtacttcatgat

SEQ ID NO: 549540 - DNA, 20 bp, mouse
gatgtacttcatgataggct

SEQ ID NO: 549541 - DNA, 20 bp, mouse
gatcttgggaatagttacag

SEQ ID NO: 549542 - DNA, 20 bp, mouse
gggccttgctacctaggaga

SEQ ID NO: 549543 - DNA, 20 bp, mouse
gggagatggccttgctacct

SEQ ID NO: 549544 - DNA, 20 bp, mouse
gttaccccatcacagtgttt

SEQ ID NO: 549545 - DNA, 20 bp, mouse
gaaccatctcctaggtagca

SEQ ID NO: 549546 - DNA, 20 bp, mouse
gaagaagcacaaactcagtc

SEQ ID NO: 549547 - DNA, 20 bp, mouse
gcttcttggcttccccaatg

SEQ ID NO: 549548 - DNA, 20 bp, mouse
gtagcattcagaggccccaa

SEQ ID NO: 549549 - DNA, 20 bp, mouse
ggatccatgagagactgaag

SEQ ID NO: 549550 - DNA, 20 bp, mouse
gttagctagcatcttaggga

SEQ ID NO: 549551 - DNA, 20 bp, mouse
gtctgatgtgttccacattg

SEQ ID NO: 549552 - DNA, 20 bp, mouse
ggctagcatcttagggatgg

SEQ ID NO: 549553 - DNA, 20 bp, mouse
ggtaagaaggtagcattcag

SEQ ID NO: 549554 - DNA, 20 bp, mouse
gtgctgtggtcataattgaa

SEQ ID NO: 549555 - DNA, 20 bp, mouse
gcactgacaaagtggtacat

SEQ ID NO: 549556 - DNA, 20 bp, mouse
gagatgttgcagggtgccag

SEQ ID NO: 549557 - DNA, 20 bp, mouse
gctcggtcatgcccaaggag

SEQ ID NO: 549558 - DNA, 20 bp, mouse
gctttcattcccaggaatca

SEQ ID NO: 549559 - DNA, 20 bp, mouse
ggacatgatccatgattcct

SEQ ID NO: 549560 - DNA, 20 bp, mouse
gaaaactgcaagatgttgca

SEQ ID NO: 549561 - DNA, 20 bp, mouse
gttagttggggttacatggt

SEQ ID NO: 549562 - DNA, 20 bp, mouse
gggtacagaaacagttagtt

SEQ ID NO: 549563 - DNA, 20 bp, mouse
gggacagccctgaatctgcc

SEQ ID NO: 549564 - DNA, 20 bp, mouse
gacagttagttggggttaca

SEQ ID NO: 549565 - DNA, 20 bp, mouse
gtgctgcataccttgctcca

SEQ ID NO: 549566 - DNA, 20 bp, mouse
gaggaaggcaagaggtcgga

SEQ ID NO: 549567 - DNA, 20 bp, mouse
ggtgtagttgacatgatcca

SEQ ID NO: 549568 - DNA, 20 bp, mouse
gatgatccatggttccaagg

SEQ ID NO: 549569 - DNA, 20 bp, mouse
gcaaggaggaggtggagtta

SEQ ID NO: 549570 - DNA, 20 bp, mouse
gcacctcctccttggaacca

SEQ ID NO: 549571 - DNA, 20 bp, mouse
ggacatgatccatggttcca

SEQ ID NO: 549572 - DNA, 20 bp, mouse
ggaaaagccagctacccaag

SEQ ID NO: 549573 - DNA, 20 bp, mouse
gtggcttgcaggtgccactt

SEQ ID NO: 549574 - DNA, 20 bp, mouse
gtgctgcacaccctgctcca

SEQ ID NO: 549575 - DNA, 20 bp, mouse
gctaccatgcactcatgagc

SEQ ID NO: 549576 - DNA, 20 bp, mouse
gaggagcacacattcagtgt

SEQ ID NO: 549577 - DNA, 20 bp, mouse
ggcaaaagccaagaagagaa

SEQ ID NO: 549578 - DNA, 20 bp, mouse
ggtcataggacatcacaaca

SEQ ID NO: 549579 - DNA, 20 bp, mouse
gacacagacctttctcttct

SEQ ID NO: 549580 - DNA, 20 bp, mouse
gaggacgaactctgtgacca

SEQ ID NO: 549581 - DNA, 20 bp, mouse
gctctttcatagtaaaatgg

SEQ ID NO: 549582 - DNA, 20 bp, mouse
ggtggcagatagctacatac

SEQ ID NO: 549583 - DNA, 20 bp, mouse
ggtcacagagttcgtcctgc

SEQ ID NO: 549584 - DNA, 20 bp, mouse
gatggaggaaaatcagacca

SEQ ID NO: 549585 - DNA, 20 bp, mouse
gaagaactaggtgaatcctc

SEQ ID NO: 549586 - DNA, 20 bp, mouse
gaagaattacatgaattctt

SEQ ID NO: 549587 - DNA, 20 bp, mouse
gtctaggcagattagcccaa

SEQ ID NO: 549588 - DNA, 20 bp, mouse
gaacagtggccaaattggag

SEQ ID NO: 549589 - DNA, 20 bp, mouse
gacataggagagtgtagcct

SEQ ID NO: 549590 - DNA, 20 bp, mouse
gatcataggacatcaccaca

SEQ ID NO: 549591 - DNA, 20 bp, mouse
gatgtcaacagtggccaaat

SEQ ID NO: 549592 - DNA, 20 bp, mouse
ggctaatctgcctagagccc

SEQ ID NO: 549593 - DNA, 20 bp, mouse
gccagcaaaggagatgggct

SEQ ID NO: 549594 - DNA, 20 bp, mouse
ggctcccaaatgtcaaaaat

SEQ ID NO: 549595 - DNA, 20 bp, mouse
gagggaatgggtttaccctt

SEQ ID NO: 549596 - DNA, 20 bp, mouse
gatgggagccaaccaaacat

SEQ ID NO: 549597 - DNA, 20 bp, mouse
gactacaccagctctcatat

SEQ ID NO: 549598 - DNA, 20 bp, mouse
gaccagctctcatataggaa

SEQ ID NO: 549599 - DNA, 20 bp, mouse
gtcacagacttcatcctcgt

SEQ ID NO: 549600 - DNA, 20 bp, mouse
gcccattcctatatgagagc

SEQ ID NO: 549601 - DNA, 20 bp, mouse
gaggctgaagatgtacagca

SEQ ID NO: 549602 - DNA, 20 bp, mouse
gcataggggtgtgcagcttg

SEQ ID NO: 549603 - DNA, 20 bp, mouse
ggcataggatatgtcaagaa

SEQ ID NO: 549604 - DNA, 20 bp, mouse
gtaaggttggacaacatctt

SEQ ID NO: 549605 - DNA, 20 bp, mouse
ggcttcggagtgcttgattt

SEQ ID NO: 549606 - DNA, 20 bp, mouse
ggcagatggcaagtaaactt

SEQ ID NO: 549607 - DNA, 20 bp, mouse
gccttcaggaacttaaaaag

SEQ ID NO: 549608 - DNA, 20 bp, mouse
gctcatcactaaggacctta

SEQ ID NO: 549609 - DNA, 20 bp, mouse
gtggtgggtaacatgtgcta

SEQ ID NO: 549610 - DNA, 20 bp, mouse
ggtgagccatggcaaaacac

SEQ ID NO: 549611 - DNA, 20 bp, mouse
gactttggtactgagatttt

SEQ ID NO: 549612 - DNA, 20 bp, mouse
gggtgatggacagtaccttc

SEQ ID NO: 549613 - DNA, 20 bp, mouse
gcattaataaagatagtttg

SEQ ID NO: 549614 - DNA, 20 bp, mouse
ggcattagtgattttgcaga

SEQ ID NO: 549615 - DNA, 20 bp, mouse
gcatcacctgtgttttgcca

SEQ ID NO: 549616 - DNA, 20 bp, mouse
gcaggagacagcagccatta

SEQ ID NO: 549617 - DNA, 20 bp, mouse
gaggcactctatggaagcaa

SEQ ID NO: 549618 - DNA, 20 bp, mouse
gctgctgtctcctggatagt

SEQ ID NO: 549619 - DNA, 20 bp, mouse
gactaaaatcaggcactcta

SEQ ID NO: 549620 - DNA, 20 bp, mouse
gcctcaggatgagaattaaa

SEQ ID NO: 549621 - DNA, 20 bp, mouse
gtgcattatacatggaatga

SEQ ID NO: 549622 - DNA, 20 bp, mouse
gtaaatggacaagagccaaa

SEQ ID NO: 549623 - DNA, 20 bp, mouse
gtggatagttggcttccttt

SEQ ID NO: 549624 - DNA, 20 bp, mouse
gaatgagagccaatcagaca

SEQ ID NO: 549625 - DNA, 20 bp, mouse
ggacagtgtagtgaaggggg

SEQ ID NO: 549626 - DNA, 20 bp, mouse
gggtatggagtgaagccaag

SEQ ID NO: 549627 - DNA, 20 bp, mouse
ggggagtcgtagaatgagct

SEQ ID NO: 549628 - DNA, 20 bp, mouse
gtaggggcagtcagtgctgg

SEQ ID NO: 549629 - DNA, 20 bp, mouse
gtcttaggggcagtcagtgc

SEQ ID NO: 549630 - DNA, 20 bp, mouse
gtcgtagaatgagcttggta

SEQ ID NO: 549631 - DNA, 20 bp, mouse
ggatcaatgtatatttcaaa

SEQ ID NO: 549632 - DNA, 20 bp, mouse
gtggagagtgtttgtcatcc

SEQ ID NO: 549633 - DNA, 20 bp, mouse
ggtgacagagtgtgtgattc

SEQ ID NO: 549634 - DNA, 20 bp, mouse
gctccagagaggggtcaacc

SEQ ID NO: 549635 - DNA, 20 bp, mouse
gcaggagcatctccagagag

SEQ ID NO: 549636 - DNA, 20 bp, mouse
gtcacagaggtaactctgct

SEQ ID NO: 549637 - DNA, 20 bp, mouse
gtggaaagtgtgtaccatcc

SEQ ID NO: 549638 - DNA, 20 bp, mouse
gtgcattatgcacagaatga

SEQ ID NO: 549639 - DNA, 20 bp, mouse
ggaggaaacactccacactc

SEQ ID NO: 549640 - DNA, 20 bp, mouse
gttccaagcagacctgagtg

SEQ ID NO: 549641 - DNA, 20 bp, mouse
gcaggagacagctgccagga

SEQ ID NO: 549642 - DNA, 20 bp, mouse
gtatccaggagacagctgcc

SEQ ID NO: 549643 - DNA, 20 bp, mouse
gcagctgtctcctggatagc

SEQ ID NO: 549644 - DNA, 20 bp, mouse
gcagagagaaaagcccaaag

SEQ ID NO: 549645 - DNA, 20 bp, mouse
gatgcacagaatgaaggaga

SEQ ID NO: 549646 - DNA, 20 bp, mouse
gatcttaggggcagtgctgg

SEQ ID NO: 549647 - DNA, 20 bp, mouse
gtggagagtatgctccatcc

SEQ ID NO: 549648 - DNA, 20 bp, mouse
gcagcaagtagcagccagga

SEQ ID NO: 549649 - DNA, 20 bp, mouse
gagcatcttaggggcagtgc

SEQ ID NO: 549650 - DNA, 20 bp, mouse
ggatatggagtgaggccaag

SEQ ID NO: 549651 - DNA, 20 bp, mouse
gatgagcgtgatatggagtg

SEQ ID NO: 549652 - DNA, 20 bp, mouse
gtcttagaatgagcgtgata

SEQ ID NO: 549653 - DNA, 20 bp, mouse
gtctaagactcccattctgt

SEQ ID NO: 549654 - DNA, 20 bp, mouse
gggggcagtgctggaggcgt

SEQ ID NO: 549655 - DNA, 20 bp, mouse
gcacccagcaagtagcagcc

SEQ ID NO: 549656 - DNA, 20 bp, mouse
gaggatgaactgtgtgatca

SEQ ID NO: 549657 - DNA, 20 bp, mouse
ggatagcagtatatcggagt

SEQ ID NO: 549658 - DNA, 20 bp, mouse
ggtccaggcagataagtccc

SEQ ID NO: 549659 - DNA, 20 bp, mouse
gataggacatcaccaccagt

SEQ ID NO: 549660 - DNA, 20 bp, mouse
gtggcttggctggatccatg

SEQ ID NO: 549661 - DNA, 20 bp, mouse
gtgggaaatgggaccatcct

SEQ ID NO: 549662 - DNA, 20 bp, mouse
gtgcagccagcgaaagagat

SEQ ID NO: 549663 - DNA, 20 bp, mouse
gacggaatgtctcctactgg

SEQ ID NO: 549664 - DNA, 20 bp, mouse
gtctctttcacagggaaatg

SEQ ID NO: 549665 - DNA, 20 bp, mouse
ggctcatgatagcagtatat

SEQ ID NO: 549666 - DNA, 20 bp, mouse
gctgcatccgcgggctgagg

SEQ ID NO: 549667 - DNA, 20 bp, mouse
gtccacagggcctgtcacga

SEQ ID NO: 549668 - DNA, 20 bp, mouse
gtatgacagagaaccagaca

SEQ ID NO: 549669 - DNA, 20 bp, mouse
gaccgtcgtgacaggccctg

SEQ ID NO: 549670 - DNA, 20 bp, mouse
ggggattcctcctcagcccg

SEQ ID NO: 549671 - DNA, 20 bp, mouse
ggctgaggaggaatccctgc

SEQ ID NO: 549672 - DNA, 20 bp, mouse
gggggaacggagtcattctg

SEQ ID NO: 549673 - DNA, 20 bp, mouse
gacgtggaccagggctagga

SEQ ID NO: 549674 - DNA, 20 bp, mouse
gcaagaagcaacagccataa

SEQ ID NO: 549675 - DNA, 20 bp, mouse
gaacaacgtggaccagggct

SEQ ID NO: 549676 - DNA, 20 bp, mouse
ggatgtggacaaccagacac

SEQ ID NO: 549677 - DNA, 20 bp, mouse
ggtctccaagaaagacaggt

SEQ ID NO: 549678 - DNA, 20 bp, mouse
ggaacttggtgacccgtgtc

SEQ ID NO: 549679 - DNA, 20 bp, mouse
gtgtgtacttgatatggatg

SEQ ID NO: 549680 - DNA, 20 bp, mouse
gaaccccaccagaatgaact

SEQ ID NO: 549681 - DNA, 20 bp, mouse
gcgggtcaccaagttcattc

SEQ ID NO: 549682 - DNA, 20 bp, mouse
gacggtaacagagatgtacc

SEQ ID NO: 549683 - DNA, 20 bp, mouse
gagaagctgaacagcagctt

SEQ ID NO: 549684 - DNA, 20 bp, mouse
gggtggggtagtgtaatggg

SEQ ID NO: 549685 - DNA, 20 bp, mouse
gcaccaagttcattctggtg

SEQ ID NO: 549686 - DNA, 20 bp, mouse
gacatcatcaaggagaggat

SEQ ID NO: 549687 - DNA, 20 bp, mouse
gtctcaacatcatcaaggag

SEQ ID NO: 549688 - DNA, 20 bp, mouse
gttgagtctcaacatcatca

SEQ ID NO: 549689 - DNA, 20 bp, mouse
gcagggccccacacatctgt

SEQ ID NO: 549690 - DNA, 20 bp, mouse
gggtcaagaagcagcctatc

SEQ ID NO: 549691 - DNA, 20 bp, mouse
gttcttgaccctctacataa

SEQ ID NO: 549692 - DNA, 20 bp, mouse
gcatcagagccattatgtag

SEQ ID NO: 549693 - DNA, 20 bp, mouse
ggtccactgctatgtctttc

SEQ ID NO: 549694 - DNA, 20 bp, mouse
gtgagacatacattccttga

SEQ ID NO: 549695 - DNA, 20 bp, mouse
gaacctgaaagacatagcag

SEQ ID NO: 549696 - DNA, 20 bp, mouse
gtccagtgacaggaacactc

SEQ ID NO: 549697 - DNA, 20 bp, mouse
ggaatttatcaaccagactt

SEQ ID NO: 549698 - DNA, 20 bp, mouse
ggtccagttgtgaaattcat

SEQ ID NO: 549699 - DNA, 20 bp, mouse
ggacatacatggcaaggacc

SEQ ID NO: 549700 - DNA, 20 bp, mouse
gacctgagtgttcctgtcac

SEQ ID NO: 549701 - DNA, 20 bp, mouse
gaagtgagccagcatttgtg

SEQ ID NO: 549702 - DNA, 20 bp, mouse
gcttgggactttccagtgac

SEQ ID NO: 549703 - DNA, 20 bp, mouse
gacaacagttacgacataca

SEQ ID NO: 549704 - DNA, 20 bp, mouse
gagttacgacatacatggca

SEQ ID NO: 549705 - DNA, 20 bp, mouse
ggacagtatagtgcaatgga

SEQ ID NO: 549706 - DNA, 20 bp, mouse
ggaacaagacaaccagacat

SEQ ID NO: 549707 - DNA, 20 bp, mouse
gacttgagtgccccagtcat

SEQ ID NO: 549708 - DNA, 20 bp, mouse
gttggcctttccaatgactg

SEQ ID NO: 549709 - DNA, 20 bp, mouse
ggaattcatgcacccatgtc

SEQ ID NO: 549710 - DNA, 20 bp, mouse
gtgatctgcacagaaagtag

SEQ ID NO: 549711 - DNA, 20 bp, mouse
gagtgccccagtcattggaa

SEQ ID NO: 549712 - DNA, 20 bp, mouse
gtaatcagtacattttttaa

SEQ ID NO: 549713 - DNA, 20 bp, mouse
gaggctggtcatcacatcgt

SEQ ID NO: 549714 - DNA, 20 bp, mouse
gattcagtcatcatgcatac

SEQ ID NO: 549715 - DNA, 20 bp, mouse
gcagcaagaacaggacgaag

SEQ ID NO: 549716 - DNA, 20 bp, mouse
gccagtcactggacaggcca

SEQ ID NO: 549717 - DNA, 20 bp, mouse
ggtcactggacaggccaagg

SEQ ID NO: 549718 - DNA, 20 bp, mouse
ggcataagacacatccacca

SEQ ID NO: 549719 - DNA, 20 bp, mouse
gggctgcacagctcagaaat

SEQ ID NO: 549720 - DNA, 20 bp, mouse
gagtcctgtatgcattatgg

SEQ ID NO: 549721 - DNA, 20 bp, mouse
gtttctctctgggcttagga

SEQ ID NO: 549722 - DNA, 20 bp, mouse
gacaggactatgcagtagga

SEQ ID NO: 549723 - DNA, 20 bp, mouse
gcatagtcctgtatgcatta

SEQ ID NO: 549724 - DNA, 20 bp, mouse
gattgcacactgccacataa

SEQ ID NO: 549725 - DNA, 20 bp, mouse
gactccgccataatgcatac

SEQ ID NO: 549726 - DNA, 20 bp, mouse
gagagaaggggcttcagatg

SEQ ID NO: 549727 - DNA, 20 bp, mouse
ggcaataacaccataccccg

SEQ ID NO: 549728 - DNA, 20 bp, mouse
gtcaggtcagctagagaacg

SEQ ID NO: 549729 - DNA, 20 bp, mouse
gtccatgcactggagtcagg

SEQ ID NO: 549730 - DNA, 20 bp, mouse
gcccgtggctttctccttca

SEQ ID NO: 549731 - DNA, 20 bp, mouse
gagcgtgtagcagagttcaa

SEQ ID NO: 549732 - DNA, 20 bp, mouse
gctctgctacacgctagtgg

SEQ ID NO: 549733 - DNA, 20 bp, mouse
gagcaggttaccactcagag

SEQ ID NO: 549734 - DNA, 20 bp, mouse
gaggcgtgcacatagacctg

SEQ ID NO: 549735 - DNA, 20 bp, mouse
gggatacagctagtcctcca

SEQ ID NO: 549736 - DNA, 20 bp, mouse
ggtcagttagccagaagtac

SEQ ID NO: 549737 - DNA, 20 bp, mouse
gcatgagagaaaacatgacc

SEQ ID NO: 549738 - DNA, 20 bp, mouse
gtttctctcatggtgcaatt

SEQ ID NO: 549739 - DNA, 20 bp, mouse
ggtcacttgttaaacccata

SEQ ID NO: 549740 - DNA, 20 bp, mouse
gagtacaggaaatagaatca

SEQ ID NO: 549741 - DNA, 20 bp, mouse
gtaagtgagtttatccttat

SEQ ID NO: 549742 - DNA, 20 bp, mouse
gatggcctatgaccgctctg

SEQ ID NO: 549743 - DNA, 20 bp, mouse
gattacagacagccacagag

SEQ ID NO: 549744 - DNA, 20 bp, mouse
ggtcagagcaaaaaggagct

SEQ ID NO: 549745 - DNA, 20 bp, mouse
gcccagcagagtcagcaggt

SEQ ID NO: 549746 - DNA, 20 bp, mouse
ggactgctggccaggagtag

SEQ ID NO: 549747 - DNA, 20 bp, mouse
gactgctcttcctctactcc

SEQ ID NO: 549748 - DNA, 20 bp, mouse
ggtcagagcaaaaaagagct

SEQ ID NO: 549749 - DNA, 20 bp, mouse
gattgcccagcagagtcaac

SEQ ID NO: 549750 - DNA, 20 bp, mouse
ggtcactggagagacccatg

SEQ ID NO: 549751 - DNA, 20 bp, mouse
gaagagagacaatgcaacct

SEQ ID NO: 549752 - DNA, 20 bp, mouse
gcaggtagatgaccccaaag

SEQ ID NO: 549753 - DNA, 20 bp, mouse
gctctcttcatggagcagtt

SEQ ID NO: 549754 - DNA, 20 bp, mouse
ggcttggatgtgtttgtcac

SEQ ID NO: 549755 - DNA, 20 bp, mouse
ggttgcattgtctctcttca

SEQ ID NO: 549756 - DNA, 20 bp, mouse
gaagtgctgggttccacata

SEQ ID NO: 549757 - DNA, 20 bp, mouse
ggctagagcgaaaaagtgct

SEQ ID NO: 549758 - DNA, 20 bp, mouse
gagaaactcagttcctccta

SEQ ID NO: 549759 - DNA, 20 bp, mouse
gttttcgctctagccctagg

SEQ ID NO: 549760 - DNA, 20 bp, mouse
gactttttcgctctagccct

SEQ ID NO: 549761 - DNA, 20 bp, mouse
gattacagacagccacgtag

SEQ ID NO: 549762 - DNA, 20 bp, mouse
gccatctcttttgccctatg

SEQ ID NO: 549763 - DNA, 20 bp, mouse
gcccagcagagtcagcaggt

SEQ ID NO: 549764 - DNA, 20 bp, mouse
ggtcactggagagacccatg

SEQ ID NO: 549765 - DNA, 20 bp, mouse
gcaggtaggttaccccaaag

SEQ ID NO: 549766 - DNA, 20 bp, mouse
ggttaacgtaggaggaagaa

SEQ ID NO: 549767 - DNA, 20 bp, mouse
ggggcaactccatgaccaga

SEQ ID NO: 549768 - DNA, 20 bp, mouse
gggtccctagagcgaggtaa

SEQ ID NO: 549769 - DNA, 20 bp, mouse
ggaagcccccaaagcatcaa

SEQ ID NO: 549770 - DNA, 20 bp, mouse
ggtgtagctcttgggatcca

SEQ ID NO: 549771 - DNA, 20 bp, mouse
gcaggatttccaggagtgag

SEQ ID NO: 549772 - DNA, 20 bp, mouse
gaaacagatccttctggtca

SEQ ID NO: 549773 - DNA, 20 bp, mouse
gtgcatcaaacagatccttc

SEQ ID NO: 549774 - DNA, 20 bp, mouse
gaggatgtagtgtagctctt

SEQ ID NO: 549775 - DNA, 20 bp, mouse
gctctgtggtccctagagcg

SEQ ID NO: 549776 - DNA, 20 bp, mouse
gcatggtcgctaagttgcac

SEQ ID NO: 549777 - DNA, 20 bp, mouse
gtctgtgggacctttgccgt

SEQ ID NO: 549778 - DNA, 20 bp, mouse
gtaatgcaggggcaaacaga

SEQ ID NO: 549779 - DNA, 20 bp, mouse
ggatgcatttagtgcgcaga

SEQ ID NO: 549780 - DNA, 20 bp, mouse
gtggatactccactcaacaa

SEQ ID NO: 549781 - DNA, 20 bp, mouse
gcaggaacagtcttagactt

SEQ ID NO: 549782 - DNA, 20 bp, mouse
ggggactgaccattgttgag

SEQ ID NO: 549783 - DNA, 20 bp, mouse
gtcctagagctgtaatgcag

SEQ ID NO: 549784 - DNA, 20 bp, mouse
gtatccagttcatagaggta

SEQ ID NO: 549785 - DNA, 20 bp, mouse
gagttcatagaggtatggat

SEQ ID NO: 549786 - DNA, 20 bp, mouse
gccaacaagataaaattcag

SEQ ID NO: 549787 - DNA, 20 bp, mouse
ggcagcccccagagcatcac

SEQ ID NO: 549788 - DNA, 20 bp, mouse
gggactcagaactaaatgtt

SEQ ID NO: 549789 - DNA, 20 bp, mouse
gtgtgcccgtgatgctctgg

SEQ ID NO: 549790 - DNA, 20 bp, mouse
ggcaagttgcagaaaaagtt

SEQ ID NO: 549791 - DNA, 20 bp, mouse
gggcgtaggtttacagagcc

SEQ ID NO: 549792 - DNA, 20 bp, mouse
gccaagcaaagaaaactccg

SEQ ID NO: 549793 - DNA, 20 bp, mouse
gtgatgacactgtacctcaa

SEQ ID NO: 549794 - DNA, 20 bp, mouse
gagatatactttgcattcca

SEQ ID NO: 549795 - DNA, 20 bp, mouse
gacagctacataacgatcca

SEQ ID NO: 549796 - DNA, 20 bp, mouse
gaagcccctggagcatataa

SEQ ID NO: 549797 - DNA, 20 bp, mouse
gcctaacagaaaaaatttcg

SEQ ID NO: 549798 - DNA, 20 bp, mouse
gcaggacagagaggtgacca

SEQ ID NO: 549799 - DNA, 20 bp, mouse
gcgtcactgagtacaaaaga

SEQ ID NO: 549800 - DNA, 20 bp, mouse
ggacagccacggatgtgatg

SEQ ID NO: 549801 - DNA, 20 bp, mouse
gcgtctgtcgaagaagcccc

SEQ ID NO: 549802 - DNA, 20 bp, mouse
gggatgtgatgaggatctcc

SEQ ID NO: 549803 - DNA, 20 bp, mouse
gaagaaggaaggtcgcaaaa

SEQ ID NO: 549804 - DNA, 20 bp, mouse
gtgtcccttatatgctccag

SEQ ID NO: 549805 - DNA, 20 bp, mouse
gttcagagttaatattatta

SEQ ID NO: 549806 - DNA, 20 bp, mouse
ggaaccagggaaccgtacat

SEQ ID NO: 549807 - DNA, 20 bp, mouse
ggggccgggagatagccacc

SEQ ID NO: 549808 - DNA, 20 bp, mouse
gccgcctggtggctatctcc

SEQ ID NO: 549809 - DNA, 20 bp, mouse
gacacccatgtacggttccc

SEQ ID NO: 549810 - DNA, 20 bp, mouse
gtaccgaggctgcatggcac

SEQ ID NO: 549811 - DNA, 20 bp, mouse
gcagtgttgagtgttcatga

SEQ ID NO: 549812 - DNA, 20 bp, mouse
gagtactggtggtaactgca

SEQ ID NO: 549813 - DNA, 20 bp, mouse
gtggtaactgcatggattgt

SEQ ID NO: 549814 - DNA, 20 bp, mouse
gactcaacactgtgtagtac

SEQ ID NO: 549815 - DNA, 20 bp, mouse
ggatggtcttcttctcagag

SEQ ID NO: 549816 - DNA, 20 bp, mouse
gggaaccagggaacctcaca

SEQ ID NO: 549817 - DNA, 20 bp, mouse
ggtcataagccattactgag

SEQ ID NO: 549818 - DNA, 20 bp, mouse
gacacccatgtgaggttccc

SEQ ID NO: 549819 - DNA, 20 bp, mouse
ggaacagccagctttgtatg

SEQ ID NO: 549820 - DNA, 20 bp, mouse
ggtgacatagtggagaggtc

SEQ ID NO: 549821 - DNA, 20 bp, mouse
gaggtcgggaaatagccacc

SEQ ID NO: 549822 - DNA, 20 bp, mouse
gcaccagccccatacaaagc

SEQ ID NO: 549823 - DNA, 20 bp, mouse
gagccagctttgtatggggc

SEQ ID NO: 549824 - DNA, 20 bp, mouse
ggtcagagtttgtcttcctg

SEQ ID NO: 549825 - DNA, 20 bp, mouse
ggacagctggacaatcgagt

SEQ ID NO: 549826 - DNA, 20 bp, mouse
gtacattgtgttatctctct

SEQ ID NO: 549827 - DNA, 20 bp, mouse
ggttatctctctaggcacac

SEQ ID NO: 549828 - DNA, 20 bp, mouse
gatctctctaggcacacggg

SEQ ID NO: 549829 - DNA, 20 bp, mouse
gacattgtgaacagtcagtc

SEQ ID NO: 549830 - DNA, 20 bp, mouse
gcataggcatgtccagcctg

SEQ ID NO: 549831 - DNA, 20 bp, mouse
gatgcagccctggtacgaga

SEQ ID NO: 549832 - DNA, 20 bp, mouse
gaggatatttcccaccacag

SEQ ID NO: 549833 - DNA, 20 bp, mouse
gctgggagatggctatgtag

SEQ ID NO: 549834 - DNA, 20 bp, mouse
gtgtgtctacatcaccactg

SEQ ID NO: 549835 - DNA, 20 bp, mouse
ggaagaccgtcccacctccc

SEQ ID NO: 549836 - DNA, 20 bp, mouse
gttctacttggattcagagg

SEQ ID NO: 549837 - DNA, 20 bp, mouse
gttggattcagaggaggtcc

SEQ ID NO: 549838 - DNA, 20 bp, mouse
gttattctacttggattcag

SEQ ID NO: 549839 - DNA, 20 bp, mouse
gtctggaggaaggcatacat

SEQ ID NO: 549840 - DNA, 20 bp, mouse
gagagctctaggagcaattg

SEQ ID NO: 549841 - DNA, 20 bp, mouse
gactcacagagtatagaaga

SEQ ID NO: 549842 - DNA, 20 bp, mouse
ggccaggagaaatgcttctg

SEQ ID NO: 549843 - DNA, 20 bp, mouse
gggcatacataggagtatgg

SEQ ID NO: 549844 - DNA, 20 bp, mouse
gtagcagtggtggggaattt

SEQ ID NO: 549845 - DNA, 20 bp, mouse
gaaggaaaggctctggagga

SEQ ID NO: 549846 - DNA, 20 bp, mouse
gttcaaaaaagatggagcct

SEQ ID NO: 549847 - DNA, 20 bp, mouse
ggagcctgggaaccacacaa

SEQ ID NO: 549848 - DNA, 20 bp, mouse
gagaagatacaacaaagggt

SEQ ID NO: 549849 - DNA, 20 bp, mouse
gatgcagccagccacaggga

SEQ ID NO: 549850 - DNA, 20 bp, mouse
gcacaaagaagatacaacaa

SEQ ID NO: 549851 - DNA, 20 bp, mouse
gggtggtgaggtagacaccc

SEQ ID NO: 549852 - DNA, 20 bp, mouse
ggagagaactgccatccctg

SEQ ID NO: 549853 - DNA, 20 bp, mouse
ggaactctgttaccattgtg

SEQ ID NO: 549854 - DNA, 20 bp, mouse
gaccttgggagacatgagag

SEQ ID NO: 549855 - DNA, 20 bp, mouse
gctgacattgcccaatatgg

SEQ ID NO: 549856 - DNA, 20 bp, mouse
ggattgtgcttctctccacc

SEQ ID NO: 549857 - DNA, 20 bp, mouse
ggctgaagaggacaacttta

SEQ ID NO: 549858 - DNA, 20 bp, mouse
gaagctggatggtacaccca

SEQ ID NO: 549859 - DNA, 20 bp, mouse
ggcacctgagaaaagctgga

SEQ ID NO: 549860 - DNA, 20 bp, mouse
gtgtaggatcttatattggt

SEQ ID NO: 549861 - DNA, 20 bp, mouse
gaagcacaatctcctacctt

SEQ ID NO: 549862 - DNA, 20 bp, mouse
ggtaccatccagcttttctc

SEQ ID NO: 549863 - DNA, 20 bp, mouse
gtttctcaggtgcttttttt

SEQ ID NO: 549864 - DNA, 20 bp, mouse
gaaaagcacctgagaaaagc

SEQ ID NO: 549865 - DNA, 20 bp, mouse
gcaacaactatactatccca

SEQ ID NO: 549866 - DNA, 20 bp, mouse
gaggatgaactctgtgactg

SEQ ID NO: 549867 - DNA, 20 bp, mouse
gaggagaaagctgactatcc

SEQ ID NO: 549868 - DNA, 20 bp, mouse
gaccgaatgtcttcttcttg

SEQ ID NO: 549869 - DNA, 20 bp, mouse
ggtcagctttctcctgtctc

SEQ ID NO: 549870 - DNA, 20 bp, mouse
gaccacaagaagaagacatt

SEQ ID NO: 549871 - DNA, 20 bp, mouse
gctctttcatagtgaaatgg

SEQ ID NO: 549872 - DNA, 20 bp, mouse
gatcctctttcatagtgaaa

SEQ ID NO: 549873 - DNA, 20 bp, mouse
gactcaattcttgtaaaaaa

SEQ ID NO: 549874 - DNA, 20 bp, mouse
gaagaactaggtgaatcctc

SEQ ID NO: 549875 - DNA, 20 bp, mouse
ggacaatggccaggtgggac

SEQ ID NO: 549876 - DNA, 20 bp, mouse
ggttcccagacacattcacc

SEQ ID NO: 549877 - DNA, 20 bp, mouse
gtctacctggtgaatgtgtc

SEQ ID NO: 549878 - DNA, 20 bp, mouse
gaagctggatggtacaccca

SEQ ID NO: 549879 - DNA, 20 bp, mouse
gcttctctccagcaggaagt

SEQ ID NO: 549880 - DNA, 20 bp, mouse
ggcacctgagaaaagctgga

SEQ ID NO: 549881 - DNA, 20 bp, mouse
gtgtaggatcttatattggt

SEQ ID NO: 549882 - DNA, 20 bp, mouse
gaagcacaatctcctacctt

SEQ ID NO: 549883 - DNA, 20 bp, mouse
ggtaccatccagcttttctc

SEQ ID NO: 549884 - DNA, 20 bp, mouse
gttttctcaggtgcttttgt

SEQ ID NO: 549885 - DNA, 20 bp, mouse
gaaaagcacctgagaaaagc

SEQ ID NO: 549886 - DNA, 20 bp, mouse
gtaatcatgaataagtatga

SEQ ID NO: 549887 - DNA, 20 bp, mouse
gtgagtgttgaatagaggag

SEQ ID NO: 549888 - DNA, 20 bp, mouse
ggcagccagtaagaagcact

SEQ ID NO: 549889 - DNA, 20 bp, mouse
gtgcacaggtagccacagac

SEQ ID NO: 549890 - DNA, 20 bp, mouse
gcatgggctggtcctgtctg

SEQ ID NO: 549891 - DNA, 20 bp, mouse
gtcagccgagtgcttcttac

SEQ ID NO: 549892 - DNA, 20 bp, mouse
gttatcagtttgcacattgc

SEQ ID NO: 549893 - DNA, 20 bp, mouse
gcaggaccagcccatgtcca

SEQ ID NO: 549894 - DNA, 20 bp, mouse
gagcattataactgagactg

SEQ ID NO: 549895 - DNA, 20 bp, mouse
gggctgaggaatagatacat

SEQ ID NO: 549896 - DNA, 20 bp, mouse
gtaaggctagcccatgtcca

SEQ ID NO: 549897 - DNA, 20 bp, mouse
gagccaggtggctgaggaat

SEQ ID NO: 549898 - DNA, 20 bp, mouse
gtgcattataactgagaccg

SEQ ID NO: 549899 - DNA, 20 bp, mouse
ggctgaaaaccataccacgg

SEQ ID NO: 549900 - DNA, 20 bp, mouse
gtagctctgccaccgtggta

SEQ ID NO: 549901 - DNA, 20 bp, mouse
ggaacaattcacacaagaga

SEQ ID NO: 549902 - DNA, 20 bp, mouse
gatgattagctctgccaccg

SEQ ID NO: 549903 - DNA, 20 bp, mouse
gaaagactatacacagcttg

SEQ ID NO: 549904 - DNA, 20 bp, mouse
gtggctgaggaataggtaca

SEQ ID NO: 549905 - DNA, 20 bp, mouse
ggtctcagttataatgcata

SEQ ID NO: 549906 - DNA, 20 bp, mouse
gagaatgtagggtcctctgt

SEQ ID NO: 549907 - DNA, 20 bp, mouse
gaaaaggctatacagaatgt

SEQ ID NO: 549908 - DNA, 20 bp, mouse
gttcattttgggaccaacag

SEQ ID NO: 549909 - DNA, 20 bp, mouse
gcatccacataagagatgaa

SEQ ID NO: 549910 - DNA, 20 bp, mouse
gggttgaggaatagatacac

SEQ ID NO: 549911 - DNA, 20 bp, mouse
gagcattataaccgagacca

SEQ ID NO: 549912 - DNA, 20 bp, mouse
gtgacagagttattcatttt

SEQ ID NO: 549913 - DNA, 20 bp, mouse
gatgaataactctgtcatgc

SEQ ID NO: 549914 - DNA, 20 bp, mouse
gtctgtatcacagtattatt

SEQ ID NO: 549915 - DNA, 20 bp, mouse
gccacataagagatgaatgg

SEQ ID NO: 549916 - DNA, 20 bp, mouse
ggaactctgtcacagttgtg

SEQ ID NO: 549917 - DNA, 20 bp, mouse
ggtcactgtgatgcagaatt

SEQ ID NO: 549918 - DNA, 20 bp, mouse
gctacgtgtcatcctattta

SEQ ID NO: 549919 - DNA, 20 bp, mouse
gggatttcttggaaatagac

SEQ ID NO: 549920 - DNA, 20 bp, mouse
ggaaatcctttaaacattgt

SEQ ID NO: 549921 - DNA, 20 bp, mouse
gtcacaccaacaatgtttaa

SEQ ID NO: 549922 - DNA, 20 bp, mouse
gggtggctgtgtgaattcag

SEQ ID NO: 549923 - DNA, 20 bp, mouse
gggttttgagtctccatttc

SEQ ID NO: 549924 - DNA, 20 bp, mouse
gtctgcatcacagtgacatt

SEQ ID NO: 549925 - DNA, 20 bp, mouse
gtacaaaagccagatggcta

SEQ ID NO: 549926 - DNA, 20 bp, mouse
gcatttcacacctgagatgg

SEQ ID NO: 549927 - DNA, 20 bp, mouse
gcatacagtaacactctctg

SEQ ID NO: 549928 - DNA, 20 bp, mouse
ggtcactgcaatgcagaatt

SEQ ID NO: 549929 - DNA, 20 bp, mouse
gggaatcctgtaagcattat

SEQ ID NO: 549930 - DNA, 20 bp, mouse
ggagtgttactgtatgtcca

SEQ ID NO: 549931 - DNA, 20 bp, mouse
gaggatgaattctttcacag

SEQ ID NO: 549932 - DNA, 20 bp, mouse
gaatgtctacaagagctaga

SEQ ID NO: 549933 - DNA, 20 bp, mouse
gcagcatcatcagtttaata

SEQ ID NO: 549934 - DNA, 20 bp, mouse
gtcacacctataatgcttac

SEQ ID NO: 549935 - DNA, 20 bp, mouse
gtctgcattgcagtgacatt

SEQ ID NO: 549936 - DNA, 20 bp, mouse
gtgctcttaattgcttacat

SEQ ID NO: 549937 - DNA, 20 bp, mouse
ggaagacaacagaacctagc

SEQ ID NO: 549938 - DNA, 20 bp, mouse
ggttgcaaattgccatgaag

SEQ ID NO: 549939 - DNA, 20 bp, mouse
gtcttaattgcttacatagg

SEQ ID NO: 549940 - DNA, 20 bp, mouse
ggattgtatgtctttccacc

SEQ ID NO: 549941 - DNA, 20 bp, mouse
gaggtggttttcttaacaca

SEQ ID NO: 549942 - DNA, 20 bp, mouse
gtatctcatggctttccagg

SEQ ID NO: 549943 - DNA, 20 bp, mouse
gtcatggctttccaggagga

SEQ ID NO: 549944 - DNA, 20 bp, mouse
ggacatacaatctcctacat

SEQ ID NO: 549945 - DNA, 20 bp, mouse
gtaggttctgttgtcttctt

SEQ ID NO: 549946 - DNA, 20 bp, mouse
gtgattgcccatcctctagg

SEQ ID NO: 549947 - DNA, 20 bp, mouse
gctgtgattgcccatcctct

SEQ ID NO: 549948 - DNA, 20 bp, mouse
ggctggaaaaaccccacaga

SEQ ID NO: 549949 - DNA, 20 bp, mouse
gtgactacattccttctgtg

SEQ ID NO: 549950 - DNA, 20 bp, mouse
gattgctgccacctagagga

SEQ ID NO: 549951 - DNA, 20 bp, mouse
gcggggcaaaatcaccatag

SEQ ID NO: 549952 - DNA, 20 bp, mouse
ggcaagtccactaacattcg

SEQ ID NO: 549953 - DNA, 20 bp, mouse
gtaagcacatattcatctct

SEQ ID NO: 549954 - DNA, 20 bp, mouse
gacatctgggtagcacattc

SEQ ID NO: 549955 - DNA, 20 bp, mouse
ggccaacaactgtttcatca

SEQ ID NO: 549956 - DNA, 20 bp, mouse
ggtgggcttgactcagaaca

SEQ ID NO: 549957 - DNA, 20 bp, mouse
ggagagtcagccagcatctt

SEQ ID NO: 549958 - DNA, 20 bp, mouse
gataagcaggttgccagcca

SEQ ID NO: 549959 - DNA, 20 bp, mouse
ggccagcatcttaggagtca

SEQ ID NO: 549960 - DNA, 20 bp, mouse
gatcttaggagtcatggacg

SEQ ID NO: 549961 - DNA, 20 bp, mouse
gaggcagccagactgtgaag

SEQ ID NO: 549962 - DNA, 20 bp, mouse
gtcagcagcagcaaggccct

SEQ ID NO: 549963 - DNA, 20 bp, mouse
gtccatgactcctaagatgc

SEQ ID NO: 549964 - DNA, 20 bp, mouse
ggctggcaacctgcttatca

SEQ ID NO: 549965 - DNA, 20 bp, mouse
gtaatgatcgtgtagcgcag

SEQ ID NO: 549966 - DNA, 20 bp, mouse
gtatataaatgacaaaacat

SEQ ID NO: 549967 - DNA, 20 bp, mouse
gtccaggctccatctctgtc

SEQ ID NO: 549968 - DNA, 20 bp, mouse
gaatatgcaagtggcaatcc

SEQ ID NO: 549969 - DNA, 20 bp, mouse
gaggtattagaatggaatcc

SEQ ID NO: 549970 - DNA, 20 bp, mouse
gtaggtagttacatgtgtac

SEQ ID NO: 549971 - DNA, 20 bp, mouse
ggagccacacagccagccac

SEQ ID NO: 549972 - DNA, 20 bp, mouse
gtctattctgttactttaat

SEQ ID NO: 549973 - DNA, 20 bp, mouse
gtgaggggctttctcagaaa

SEQ ID NO: 549974 - DNA, 20 bp, mouse
gaatgagaacaatatgcaag

SEQ ID NO: 549975 - DNA, 20 bp, mouse
gggccaaatggctaaggaaa

SEQ ID NO: 549976 - DNA, 20 bp, mouse
ggagactgaaaatgacacca

SEQ ID NO: 549977 - DNA, 20 bp, mouse
ggcaccattgagtgaatgaa

SEQ ID NO: 549978 - DNA, 20 bp, mouse
gctacagtcactatataaac

SEQ ID NO: 549979 - DNA, 20 bp, mouse
gtgggctgctccgaattagg

SEQ ID NO: 549980 - DNA, 20 bp, mouse
ggctacatcagagccaagct

SEQ ID NO: 549981 - DNA, 20 bp, mouse
gagaaactgatgagcattat

SEQ ID NO: 549982 - DNA, 20 bp, mouse
gctgtgggctgctccgaatt

SEQ ID NO: 549983 - DNA, 20 bp, mouse
gttcactcaatggtgcctac

SEQ ID NO: 549984 - DNA, 20 bp, mouse
gcaaataggatgccccgagc

SEQ ID NO: 549985 - DNA, 20 bp, mouse
gtgaatgcttcatcattcac

SEQ ID NO: 549986 - DNA, 20 bp, mouse
gtgtagtcactgccacatca

SEQ ID NO: 549987 - DNA, 20 bp, mouse
ggctgtgatagagacagaat

SEQ ID NO: 549988 - DNA, 20 bp, mouse
gctctatcacagccttgatg

SEQ ID NO: 549989 - DNA, 20 bp, mouse
gtccgttgaatgcttccttt

SEQ ID NO: 549990 - DNA, 20 bp, mouse
gggtgaagaggacaactctg

SEQ ID NO: 549991 - DNA, 20 bp, mouse
ggccaaaaggaagcattcaa

SEQ ID NO: 549992 - DNA, 20 bp, mouse
gatgcttgtcaacttcctgt

SEQ ID NO: 549993 - DNA, 20 bp, mouse
ggtacatggggtgatggagt

SEQ ID NO: 549994 - DNA, 20 bp, mouse
ggattgtgcttctctccaac

SEQ ID NO: 549995 - DNA, 20 bp, mouse
gataagatcccacaaccagc

SEQ ID NO: 549996 - DNA, 20 bp, mouse
ggcagaagagtatgacttta

SEQ ID NO: 549997 - DNA, 20 bp, mouse
gtgtgtatccagttggttgc

SEQ ID NO: 549998 - DNA, 20 bp, mouse
gctatggctttcatatacaa

SEQ ID NO: 549999 - DNA, 20 bp, mouse
gcagcagctgtatgatccta

SEQ ID NO: 550000 - DNA, 20 bp, mouse
ggaactctgtcactgttgtc

SEQ ID NO: 550001 - DNA, 20 bp, mouse
gtggttgcaggatcttatgt

SEQ ID NO: 550002 - DNA, 20 bp, mouse
gttgcaggatcttatgtagg

SEQ ID NO: 550003 - DNA, 20 bp, mouse
ggatggtgtttttctcagtc

SEQ ID NO: 550004 - DNA, 20 bp, mouse
gagagtatgactttaaggac

SEQ ID NO: 550005 - DNA, 20 bp, mouse
ggagactccaatgagaagga

SEQ ID NO: 550006 - DNA, 20 bp, mouse
gtggttgtaggtacttatgt

SEQ ID NO: 550007 - DNA, 20 bp, mouse
gttgtaggtacttatgtagg

SEQ ID NO: 550008 - DNA, 20 bp, mouse
gctatggctttcatatacaa

SEQ ID NO: 550009 - DNA, 20 bp, mouse
gcagcagctgtatgatccta

SEQ ID NO: 550010 - DNA, 20 bp, mouse
ggaactctgtcactgttgtc

SEQ ID NO: 550011 - DNA, 20 bp, mouse
ggatggtgtttttctcagtc

SEQ ID NO: 550012 - DNA, 20 bp, mouse
gagagaatgactttaaggac

SEQ ID NO: 550013 - DNA, 20 bp, mouse
ggctgaagagaatgacttta

SEQ ID NO: 550014 - DNA, 20 bp, mouse
ggaaactccaatgagaagga

SEQ ID NO: 550015 - DNA, 20 bp, mouse
gggaagaaactccaatgaga

SEQ ID NO: 550016 - DNA, 20 bp, mouse
gtaggtcaacagtagctaag

SEQ ID NO: 550017 - DNA, 20 bp, mouse
gaactggatacagaatcgtg

SEQ ID NO: 550018 - DNA, 20 bp, mouse
gagtgtggttcccattgtcc

SEQ ID NO: 550019 - DNA, 20 bp, mouse
gggaagagactctaatgaga

SEQ ID NO: 550020 - DNA, 20 bp, mouse
gagaggacaattctaaggaa

SEQ ID NO: 550021 - DNA, 20 bp, mouse
gcagcagctatattatctca

SEQ ID NO: 550022 - DNA, 20 bp, mouse
gagtatgcttgtcaacttct

SEQ ID NO: 550023 - DNA, 20 bp, mouse
gcagaatcgtgtggacaatt

SEQ ID NO: 550024 - DNA, 20 bp, mouse
gtcatggctttcctggacaa

SEQ ID NO: 550025 - DNA, 20 bp, mouse
ggctgaagaggacaattcta

SEQ ID NO: 550026 - DNA, 20 bp, mouse
ggaccatccccagcagaggt

SEQ ID NO: 550027 - DNA, 20 bp, mouse
gatgagcacctgcagctcac

SEQ ID NO: 550028 - DNA, 20 bp, mouse
gacagtagtgctgttcgcca

SEQ ID NO: 550029 - DNA, 20 bp, mouse
gatcttggggaagatgacag

SEQ ID NO: 550030 - DNA, 20 bp, mouse
gggctcctcccacctctgct

SEQ ID NO: 550031 - DNA, 20 bp, mouse
gtaaaggcgcctgtccacaa

SEQ ID NO: 550032 - DNA, 20 bp, mouse
gttgcggaggaagtaataca

SEQ ID NO: 550033 - DNA, 20 bp, mouse
gctccagcatggcaaagttg

SEQ ID NO: 550034 - DNA, 20 bp, mouse
gtactgagtttattttgctg

SEQ ID NO: 550035 - DNA, 20 bp, mouse
gcagcatggcaaagttgcgg

SEQ ID NO: 550036 - DNA, 20 bp, mouse
ggtgtcagaattcattttgt

SEQ ID NO: 550037 - DNA, 20 bp, mouse
gttaagaaacccagcaatgt

SEQ ID NO: 550038 - DNA, 20 bp, mouse
gtgtaggatcctacattgct

SEQ ID NO: 550039 - DNA, 20 bp, mouse
ggaagcacaatttcatacct

SEQ ID NO: 550040 - DNA, 20 bp, mouse
ggcaactgaatgcttccttt

SEQ ID NO: 550041 - DNA, 20 bp, mouse
gcatggctttcctggagaat

SEQ ID NO: 550042 - DNA, 20 bp, mouse
ggaattctgacactgcagtg

SEQ ID NO: 550043 - DNA, 20 bp, mouse
gcaatttcataccttggatg

SEQ ID NO: 550044 - DNA, 20 bp, mouse
ggtaggatcctacaatcaac

SEQ ID NO: 550045 - DNA, 20 bp, mouse
gggtgaataggacaattcta

SEQ ID NO: 550046 - DNA, 20 bp, mouse
gagaagatgacacagagtgt

SEQ ID NO: 550047 - DNA, 20 bp, mouse
gacacgagtcgtacaagaga

SEQ ID NO: 550048 - DNA, 20 bp, mouse
gataggatgccccaactaag

SEQ ID NO: 550049 - DNA, 20 bp, mouse
gttcacaggcatgcacaggg

SEQ ID NO: 550050 - DNA, 20 bp, mouse
gactaagaggagacagattt

SEQ ID NO: 550051 - DNA, 20 bp, mouse
ggaacagagttgtgcttcac

SEQ ID NO: 550052 - DNA, 20 bp, mouse
gtgaatcctattaacattat

SEQ ID NO: 550053 - DNA, 20 bp, mouse
gatttgggaagacatatgtg

SEQ ID NO: 550054 - DNA, 20 bp, mouse
gttacacctataatgttaat

SEQ ID NO: 550055 - DNA, 20 bp, mouse
gatgctgatatttcctacta

SEQ ID NO: 550056 - DNA, 20 bp, mouse
gatggcttatgatcggttta

SEQ ID NO: 550057 - DNA, 20 bp, mouse
gaaaataccatttcctatct

SEQ ID NO: 550058 - DNA, 20 bp, mouse
gagaggatgactctaaagac

SEQ ID NO: 550059 - DNA, 20 bp, mouse
ggtacacccaagataggaaa

SEQ ID NO: 550060 - DNA, 20 bp, mouse
gaatggtatttttctccacc

SEQ ID NO: 550061 - DNA, 20 bp, mouse
gtggatggtacacccaagat

SEQ ID NO: 550062 - DNA, 20 bp, mouse
gccatggctttcctgcacaa

SEQ ID NO: 550063 - DNA, 20 bp, mouse
gggctaccatggcttatgat

SEQ ID NO: 550064 - DNA, 20 bp, mouse
gagtgtggttcccattgtgc

SEQ ID NO: 550065 - DNA, 20 bp, mouse
gtttttctccaccaggaagt

SEQ ID NO: 550066 - DNA, 20 bp, mouse
gttttactgggattaacaga

SEQ ID NO: 550067 - DNA, 20 bp, mouse
gcccacgactaactggatac

SEQ ID NO: 550068 - DNA, 20 bp, mouse
gttgcatgttctattcagtt

SEQ ID NO: 550069 - DNA, 20 bp, mouse
ggactctgtagatatttttg

SEQ ID NO: 550070 - DNA, 20 bp, mouse
gataagatcccacgactaac

SEQ ID NO: 550071 - DNA, 20 bp, mouse
gtcctgtatccagttagtcg

SEQ ID NO: 550072 - DNA, 20 bp, mouse
ggaggatgactctgaggatt

SEQ ID NO: 550073 - DNA, 20 bp, mouse
ggcacaagatgatggtaaag

SEQ ID NO: 550074 - DNA, 20 bp, mouse
ggatggtattttgctttacg

SEQ ID NO: 550075 - DNA, 20 bp, mouse
gggtaaagaggatgactctg

SEQ ID NO: 550076 - DNA, 20 bp, mouse
ggaactctgtcactatagta

SEQ ID NO: 550077 - DNA, 20 bp, mouse
ggcagcaactacgtgtctca

SEQ ID NO: 550078 - DNA, 20 bp, mouse
ggtgctgaggttcccggaca

SEQ ID NO: 550079 - DNA, 20 bp, mouse
ggtcgcaaggaaaacagctg

SEQ ID NO: 550080 - DNA, 20 bp, mouse
gctatctggtgaccgtgtcc

SEQ ID NO: 550081 - DNA, 20 bp, mouse
gagtgaaaaaggaagcatta

SEQ ID NO: 550082 - DNA, 20 bp, mouse
gcaatgtaggaaatggtatt

SEQ ID NO: 550083 - DNA, 20 bp, mouse
ggaagcactcaactgtcgca

SEQ ID NO: 550084 - DNA, 20 bp, mouse
gatacatggggtgatgaagc

SEQ ID NO: 550085 - DNA, 20 bp, mouse
gcaggcttctctggacattt

SEQ ID NO: 550086 - DNA, 20 bp, mouse
ggagcctggctgatttcttt

SEQ ID NO: 550087 - DNA, 20 bp, mouse
gaatggtatttctctcaatc

SEQ ID NO: 550088 - DNA, 20 bp, mouse
gtgtggcattcagcagagcc

SEQ ID NO: 550089 - DNA, 20 bp, mouse
gtgacccaaagaaatcagcc

SEQ ID NO: 550090 - DNA, 20 bp, mouse
ggaaataccatttcctacct

SEQ ID NO: 550091 - DNA, 20 bp, mouse
gcatgatgagggaagcatta

SEQ ID NO: 550092 - DNA, 20 bp, mouse
ggaactctgtcactgcagta

SEQ ID NO: 550093 - DNA, 20 bp, mouse
gagtatggttcccaacctcc

SEQ ID NO: 550094 - DNA, 20 bp, mouse
gcatggctttcctggaggtt

SEQ ID NO: 550095 - DNA, 20 bp, mouse
ggggtgtgacagatgatgaa

SEQ ID NO: 550096 - DNA, 20 bp, mouse
gggagcagttatgtgtctca

SEQ ID NO: 550097 - DNA, 20 bp, mouse
gtgacagagttttttttatt

SEQ ID NO: 550098 - DNA, 20 bp, mouse
ggtcccaaaaaaagcagccg

SEQ ID NO: 550099 - DNA, 20 bp, mouse
gaaactctgtcactgtagtg

SEQ ID NO: 550100 - DNA, 20 bp, mouse
gtgttctattcagtttacct

SEQ ID NO: 550101 - DNA, 20 bp, mouse
gtacctcggctgcttttttt

SEQ ID NO: 550102 - DNA, 20 bp, mouse
ggtattttgttttactagga

SEQ ID NO: 550103 - DNA, 20 bp, mouse
gggaagagactctgataaga

SEQ ID NO: 550104 - DNA, 20 bp, mouse
gcctgtatccagttggtggt

SEQ ID NO: 550105 - DNA, 20 bp, mouse
gataagatcctaccaccaac

SEQ ID NO: 550106 - DNA, 20 bp, mouse
gaatgtagagtaggctctgg

SEQ ID NO: 550107 - DNA, 20 bp, mouse
gctgatgttgaatgtagagt

SEQ ID NO: 550108 - DNA, 20 bp, mouse
gttgaatgtagagtaggctc

SEQ ID NO: 550109 - DNA, 20 bp, mouse
gaaccagctggctctaagga

SEQ ID NO: 550110 - DNA, 20 bp, mouse
gatggaaccagctggctcta

SEQ ID NO: 550111 - DNA, 20 bp, mouse
gcattcaacatcagcaagaa

SEQ ID NO: 550112 - DNA, 20 bp, mouse
gaacccagccacataaataa

SEQ ID NO: 550113 - DNA, 20 bp, mouse
gtttctcacctgctggttga

SEQ ID NO: 550114 - DNA, 20 bp, mouse
gaaggctgactgaagtgtga

SEQ ID NO: 550115 - DNA, 20 bp, mouse
gtcatctgccttcaaccagc

SEQ ID NO: 550116 - DNA, 20 bp, mouse
gcatcactagcagaacacag

SEQ ID NO: 550117 - DNA, 20 bp, mouse
gagtacacagcttgatcctc

SEQ ID NO: 550118 - DNA, 20 bp, mouse
gctgctagtgatggtgtcct

SEQ ID NO: 550119 - DNA, 20 bp, mouse
gtgcacaaggccattagaag

SEQ ID NO: 550120 - DNA, 20 bp, mouse
gaggctttgactcatgatag

SEQ ID NO: 550121 - DNA, 20 bp, mouse
ggatagtggtataatgcaga

SEQ ID NO: 550122 - DNA, 20 bp, mouse
ggctcatcattcttctcatt

SEQ ID NO: 550123 - DNA, 20 bp, mouse
gccaatccatctcacatgct

SEQ ID NO: 550124 - DNA, 20 bp, mouse
gatcattcttctcattaggc

SEQ ID NO: 550125 - DNA, 20 bp, mouse
gaaagagaagagtatgcaca

SEQ ID NO: 550126 - DNA, 20 bp, mouse
ggacaaagaggacaactcta

SEQ ID NO: 550127 - DNA, 20 bp, mouse
gtggatgccacatcctagat

SEQ ID NO: 550128 - DNA, 20 bp, mouse
gccatctcctatctaggatg

SEQ ID NO: 550129 - DNA, 20 bp, mouse
gagctggacacaaacctgtg

SEQ ID NO: 550130 - DNA, 20 bp, mouse
ggtgacaggattcattttat

SEQ ID NO: 550131 - DNA, 20 bp, mouse
ggctacaaattgctataaat

SEQ ID NO: 550132 - DNA, 20 bp, mouse
gggaaccacactgcagtgac

SEQ ID NO: 550133 - DNA, 20 bp, mouse
ggcacaagatgatgacaaag

SEQ ID NO: 550134 - DNA, 20 bp, mouse
ggaaacaccatctcctatct

SEQ ID NO: 550135 - DNA, 20 bp, mouse
gtttgtgtccagctgcttgt

SEQ ID NO: 550136 - DNA, 20 bp, mouse
gaggaagctggggtcagatc

SEQ ID NO: 550137 - DNA, 20 bp, mouse
ggaccatgctaatcccactg

SEQ ID NO: 550138 - DNA, 20 bp, mouse
gtagcatggtcatgtcagcg

SEQ ID NO: 550139 - DNA, 20 bp, mouse
ggaatggtggagtaatgcag

SEQ ID NO: 550140 - DNA, 20 bp, mouse
gtaatgcagagggtagcaaa

SEQ ID NO: 550141 - DNA, 20 bp, mouse
gccagatgtgcatgtgttcc

SEQ ID NO: 550142 - DNA, 20 bp, mouse
gtcttcatccataccttcat

SEQ ID NO: 550143 - DNA, 20 bp, mouse
gatccataccttcatgggga

SEQ ID NO: 550144 - DNA, 20 bp, mouse
gttgttctgaatgggatccc

SEQ ID NO: 550145 - DNA, 20 bp, mouse
gctgcatacatggaacagaa

SEQ ID NO: 550146 - DNA, 20 bp, mouse
gatagagcaaagtcaatggt

SEQ ID NO: 550147 - DNA, 20 bp, mouse
ggcccatgtccaccagagaa

SEQ ID NO: 550148 - DNA, 20 bp, mouse
gttcttaggtatcctttctc

SEQ ID NO: 550149 - DNA, 20 bp, mouse
gaaggtacatgggctgcttc

SEQ ID NO: 550150 - DNA, 20 bp, mouse
gaactcagacaccaggaact

SEQ ID NO: 550151 - DNA, 20 bp, mouse
gttaggtatcctttctctgg

SEQ ID NO: 550152 - DNA, 20 bp, mouse
gtgctctatctctcagcaat

SEQ ID NO: 550153 - DNA, 20 bp, mouse
gctgccagctgtgaatgccc

SEQ ID NO: 550154 - DNA, 20 bp, mouse
gagagatagagcaaagtcaa

SEQ ID NO: 550155 - DNA, 20 bp, mouse
gttcaatagttccaagttcc

SEQ ID NO: 550156 - DNA, 20 bp, mouse
gtgtaactgctgccggatca

SEQ ID NO: 550157 - DNA, 20 bp, mouse
gggtaaagagaacaactcta

SEQ ID NO: 550158 - DNA, 20 bp, mouse
gccacatcctaggtatgtaa

SEQ ID NO: 550159 - DNA, 20 bp, mouse
gtttggttgaatagagtagt

SEQ ID NO: 550160 - DNA, 20 bp, mouse
gttgggattaacagatgagc

SEQ ID NO: 550161 - DNA, 20 bp, mouse
gggggcagtgtaactgctgc

SEQ ID NO: 550162 - DNA, 20 bp, mouse
gttgtagtagcatacataag

SEQ ID NO: 550163 - DNA, 20 bp, mouse
ggtatgctactacaagcaac

SEQ ID NO: 550164 - DNA, 20 bp, mouse
gcagacttgtatagacattt

SEQ ID NO: 550165 - DNA, 20 bp, mouse
ggctgtgatggagacattac

SEQ ID NO: 550166 - DNA, 20 bp, mouse
ggatacccatgggacagtgt

SEQ ID NO: 550167 - DNA, 20 bp, mouse
gcatccttcaggatacccat

SEQ ID NO: 550168 - DNA, 20 bp, mouse
gtgtcccatgggtatcctga

SEQ ID NO: 550169 - DNA, 20 bp, mouse
ggtctgtatccagttgctag

SEQ ID NO: 550170 - DNA, 20 bp, mouse
gataagatcccactagcaac

SEQ ID NO: 550171 - DNA, 20 bp, mouse
gaacacctacactgtcccat

SEQ ID NO: 550172 - DNA, 20 bp, mouse
gagtgtggttcccatccttc

SEQ ID NO: 550173 - DNA, 20 bp, mouse
gttttggtggaataaagtag

SEQ ID NO: 550174 - DNA, 20 bp, mouse
gggtgaagaggacaacttta

SEQ ID NO: 550175 - DNA, 20 bp, mouse
gaaaagcacctgagccaagc

SEQ ID NO: 550176 - DNA, 20 bp, mouse
gaactacacagtggtaacag

SEQ ID NO: 550177 - DNA, 20 bp, mouse
gactaggagaatacagactg

SEQ ID NO: 550178 - DNA, 20 bp, mouse
gtaggtaggaagctcccact

SEQ ID NO: 550179 - DNA, 20 bp, mouse
gactgtggaggacatctgcg

SEQ ID NO: 550180 - DNA, 20 bp, mouse
gggcatattcctatcataga

SEQ ID NO: 550181 - DNA, 20 bp, mouse
gtcacacccatcatgctgaa

SEQ ID NO: 550182 - DNA, 20 bp, mouse
gtcctatcatagatggaacc

SEQ ID NO: 550183 - DNA, 20 bp, mouse
gctgcgtggcatagagcaga

SEQ ID NO: 550184 - DNA, 20 bp, mouse
gtatgataggaatatgccat

SEQ ID NO: 550185 - DNA, 20 bp, mouse
ggtaacagaggtgattcttt

SEQ ID NO: 550186 - DNA, 20 bp, mouse
gtcactgccactaggaggat

SEQ ID NO: 550187 - DNA, 20 bp, mouse
gagaagaaacatattcactg

SEQ ID NO: 550188 - DNA, 20 bp, mouse
ggacaaaaatcactgccact

SEQ ID NO: 550189 - DNA, 20 bp, mouse
gacatctgagtggcacactc

SEQ ID NO: 550190 - DNA, 20 bp, mouse
gtcaagtccactaacaggcg

SEQ ID NO: 550191 - DNA, 20 bp, mouse
gaaaatatatatcttgctct

SEQ ID NO: 550192 - DNA, 20 bp, mouse
gtcaggattggataatgcag

SEQ ID NO: 550193 - DNA, 20 bp, mouse
gatcctgccccgcctgttag

SEQ ID NO: 550194 - DNA, 20 bp, mouse
ggtccactaacaggcggggc

SEQ ID NO: 550195 - DNA, 20 bp, mouse
gtggataatgcagagggttg

SEQ ID NO: 550196 - DNA, 20 bp, mouse
gctgtctagtgagtcccaag

SEQ ID NO: 550197 - DNA, 20 bp, mouse
gagaaagaagaggttgtgtt

SEQ ID NO: 550198 - DNA, 20 bp, mouse
gcattggtgaatcatatgtt

SEQ ID NO: 550199 - DNA, 20 bp, mouse
ggtcattgtccccaaggcat

SEQ ID NO: 550200 - DNA, 20 bp, mouse
gcaagtccatctcttacacg

SEQ ID NO: 550201 - DNA, 20 bp, mouse
gtgtgtttgggttgttctta

SEQ ID NO: 550202 - DNA, 20 bp, mouse
gatatgattcaccaatgcct

SEQ ID NO: 550203 - DNA, 20 bp, mouse
gaaactattctccacagaca

SEQ ID NO: 550204 - DNA, 20 bp, mouse
ggatggccaggataatgaga

SEQ ID NO: 550205 - DNA, 20 bp, mouse
ggtcacagaatttatcctct

SEQ ID NO: 550206 - DNA, 20 bp, mouse
ggaactctgtgactacagtg

SEQ ID NO: 550207 - DNA, 20 bp, mouse
ggaagagatggctatgtcaa

SEQ ID NO: 550208 - DNA, 20 bp, mouse
gtgtcaacttcctggtggag

SEQ ID NO: 550209 - DNA, 20 bp, mouse
ggagcagtatatcctacatt

SEQ ID NO: 550210 - DNA, 20 bp, mouse
ggtatatcctacattgggtg

SEQ ID NO: 550211 - DNA, 20 bp, mouse
gtatactgctcctctccacc

SEQ ID NO: 550212 - DNA, 20 bp, mouse
gggatagtttagctgctgcc

SEQ ID NO: 550213 - DNA, 20 bp, mouse
ggtgtatccaattgcttgta

SEQ ID NO: 550214 - DNA, 20 bp, mouse
gataagaccctacaagcaat

SEQ ID NO: 550215 - DNA, 20 bp, mouse
gtcttctgtcacaccaaata

SEQ ID NO: 550216 - DNA, 20 bp, mouse
gttagggacatagtacatag

SEQ ID NO: 550217 - DNA, 20 bp, mouse
gtgtccctaagacaaacaca

SEQ ID NO: 550218 - DNA, 20 bp, mouse
ggggttccaatattgtaatg

SEQ ID NO: 550219 - DNA, 20 bp, mouse
gttccaatattgtaatgagg

SEQ ID NO: 550220 - DNA, 20 bp, mouse
ggaaccctgtgtttgtctta

SEQ ID NO: 550221 - DNA, 20 bp, mouse
gtgcctcctcattacaatat

SEQ ID NO: 550222 - DNA, 20 bp, mouse
gaattcaaacttggagttct

SEQ ID NO: 550223 - DNA, 20 bp, mouse
gcaggaattgaattcaaact

SEQ ID NO: 550224 - DNA, 20 bp, mouse
gactttcctagttatctatc

SEQ ID NO: 550225 - DNA, 20 bp, mouse
gtgtgcaaaacaacctccaa

SEQ ID NO: 550226 - DNA, 20 bp, mouse
gcaggaacaccacaaagagg

SEQ ID NO: 550227 - DNA, 20 bp, mouse
gtaacagaatttgtcctcat

SEQ ID NO: 550228 - DNA, 20 bp, mouse
gtctgcaaggaactggtgat

SEQ ID NO: 550229 - DNA, 20 bp, mouse
gacagagttcaggaagccat

SEQ ID NO: 550230 - DNA, 20 bp, mouse
gtgtgtcatgatggctgtgt

SEQ ID NO: 550231 - DNA, 20 bp, mouse
gtcagtagtgacaaaagcac

SEQ ID NO: 550232 - DNA, 20 bp, mouse
gtgattctcattaccctggt

SEQ ID NO: 550233 - DNA, 20 bp, mouse
ggatgagcaagatcatgcca

SEQ ID NO: 550234 - DNA, 20 bp, mouse
gaaacagcctgaaaaggaga

SEQ ID NO: 550235 - DNA, 20 bp, mouse
gaggacaaattctgttactg

SEQ ID NO: 550236 - DNA, 20 bp, mouse
gcatgtgtacttggagttca

SEQ ID NO: 550237 - DNA, 20 bp, mouse
ggaagtgagaaaatcccaac

SEQ ID NO: 550238 - DNA, 20 bp, mouse
gaatcattgggtaggttaga

SEQ ID NO: 550239 - DNA, 20 bp, mouse
gagaaagatgacagtaacaa

SEQ ID NO: 550240 - DNA, 20 bp, mouse
gagctccaaacatgtgtact

SEQ ID NO: 550241 - DNA, 20 bp, mouse
gcatggggatatgtaggctg

SEQ ID NO: 550242 - DNA, 20 bp, mouse
gaaattggtggtgtgctcat

SEQ ID NO: 550243 - DNA, 20 bp, mouse
ggctactgtgtcggtcacat

SEQ ID NO: 550244 - DNA, 20 bp, mouse
gatcatgacagctactgtgt

SEQ ID NO: 550245 - DNA, 20 bp, mouse
ggtggtgtgctcatgggtct

SEQ ID NO: 550246 - DNA, 20 bp, mouse
gtaatcacggggtaagatag

SEQ ID NO: 550247 - DNA, 20 bp, mouse
gttgcagaaacaggtacata

SEQ ID NO: 550248 - DNA, 20 bp, mouse
ggactactctgcagaccaca

SEQ ID NO: 550249 - DNA, 20 bp, mouse
gacttttgttcataatcacg

SEQ ID NO: 550250 - DNA, 20 bp, mouse
gagataaattttgcagaaac

SEQ ID NO: 550251 - DNA, 20 bp, mouse
ggtctgcagagtagtcatca

SEQ ID NO: 550252 - DNA, 20 bp, mouse
gaaattagttatgttctcat

SEQ ID NO: 550253 - DNA, 20 bp, mouse
gttatgttctcatgggtctc

SEQ ID NO: 550254 - DNA, 20 bp, mouse
gcacggggtaagatagagga

SEQ ID NO: 550255 - DNA, 20 bp, mouse
ggatgactgtactgaaacag

SEQ ID NO: 550256 - DNA, 20 bp, mouse
gctccactacagcaatgagg

SEQ ID NO: 550257 - DNA, 20 bp, mouse
gtgttcctaagaatgaccca

SEQ ID NO: 550258 - DNA, 20 bp, mouse
ggggctccactacagcaatg

SEQ ID NO: 550259 - DNA, 20 bp, mouse
gggagccctgggtcattctt

SEQ ID NO: 550260 - DNA, 20 bp, mouse
gatgcaggctccggtccagg

SEQ ID NO: 550261 - DNA, 20 bp, mouse
ggatatgcaggctccggtcc

SEQ ID NO: 550262 - DNA, 20 bp, mouse
gtgccccctcattgctgtag

SEQ ID NO: 550263 - DNA, 20 bp, mouse
ggtctgtcatcctcctggac

SEQ ID NO: 550264 - DNA, 20 bp, mouse
gcatggggatatgcaggctc

SEQ ID NO: 550265 - DNA, 20 bp, mouse
gaactccaaaggcaaatgtt

SEQ ID NO: 550266 - DNA, 20 bp, mouse
gctccactgcagcaacaaga

SEQ ID NO: 550267 - DNA, 20 bp, mouse
gagccccgagctgctcttag

SEQ ID NO: 550268 - DNA, 20 bp, mouse
gcgcctctaagagcagctcg

SEQ ID NO: 550269 - DNA, 20 bp, mouse
ggaggcgcaaaatataagag

SEQ ID NO: 550270 - DNA, 20 bp, mouse
gcatagggtaagacagagga

SEQ ID NO: 550271 - DNA, 20 bp, mouse
gaggaggatgacagcaacaa

SEQ ID NO: 550272 - DNA, 20 bp, mouse
gtgccctcttgttgctgcag

SEQ ID NO: 550273 - DNA, 20 bp, mouse
gtaatcatagggtaagacag

SEQ ID NO: 550274 - DNA, 20 bp, mouse
gaccagcatttcaggtgtaa

SEQ ID NO: 550275 - DNA, 20 bp, mouse
gggtcaccagataaattacc

SEQ ID NO: 550276 - DNA, 20 bp, mouse
gcactgggtaggtcagaggg

SEQ ID NO: 550277 - DNA, 20 bp, mouse
gttctccctaagaccaacat

SEQ ID NO: 550278 - DNA, 20 bp, mouse
gtaatcactgggtaggtcag

SEQ ID NO: 550279 - DNA, 20 bp, mouse
gtctgcagaaacaaatacat

SEQ ID NO: 550280 - DNA, 20 bp, mouse
gaaattggtgatgtgtccat

SEQ ID NO: 550281 - DNA, 20 bp, mouse
gtcatgatactcaagaccca

SEQ ID NO: 550282 - DNA, 20 bp, mouse
gcacatcaccaatttcacaa

SEQ ID NO: 550283 - DNA, 20 bp, mouse
gagctgttttgtcagtcaca

SEQ ID NO: 550284 - DNA, 20 bp, mouse
gttgctcataatcactgggt

SEQ ID NO: 550285 - DNA, 20 bp, mouse
gtccttttgctcataatcac

SEQ ID NO: 550286 - DNA, 20 bp, mouse
gcagatgtcctgaagactca

SEQ ID NO: 550287 - DNA, 20 bp, mouse
gtaactccttgcgatctgtg

SEQ ID NO: 550288 - DNA, 20 bp, mouse
ggaataagaacaccacaaag

SEQ ID NO: 550289 - DNA, 20 bp, mouse
gtgaggaaactatagctata

SEQ ID NO: 550290 - DNA, 20 bp, mouse
gtgtgaccatatacaataga

SEQ ID NO: 550291 - DNA, 20 bp, mouse
gtcacagcaataggcaatct

SEQ ID NO: 550292 - DNA, 20 bp, mouse
gtgtaaccctctattgtata

SEQ ID NO: 550293 - DNA, 20 bp, mouse
gatctgagccatgagtcttc

SEQ ID NO: 550294 - DNA, 20 bp, mouse
gggcaatctgggattgatct

SEQ ID NO: 550295 - DNA, 20 bp, mouse
gagtgtgaatcaatgccatg

SEQ ID NO: 550296 - DNA, 20 bp, mouse
gatgcccaccaggtagaaga

SEQ ID NO: 550297 - DNA, 20 bp, mouse
gctaccgtcttctacctggt

SEQ ID NO: 550298 - DNA, 20 bp, mouse
gaggtagaagggctctggca

SEQ ID NO: 550299 - DNA, 20 bp, mouse
gggctctaccgtcttctacc

SEQ ID NO: 550300 - DNA, 20 bp, mouse
gaggttctgttccactatgg

SEQ ID NO: 550301 - DNA, 20 bp, mouse
gcaagttgtagcctccatag

SEQ ID NO: 550302 - DNA, 20 bp, mouse
gtggaggctacaacttgcaa

SEQ ID NO: 550303 - DNA, 20 bp, mouse
ggatgagcaggtagaacaga

SEQ ID NO: 550304 - DNA, 20 bp, mouse
gtggaacagaacctgaggtc

SEQ ID NO: 550305 - DNA, 20 bp, mouse
gagatacatctgcaataagc

SEQ ID NO: 550306 - DNA, 20 bp, mouse
gtagagaggggatgccggta

SEQ ID NO: 550307 - DNA, 20 bp, mouse
gaaagatgaggaagacggga

SEQ ID NO: 550308 - DNA, 20 bp, mouse
gcatagcctgtaatgggtca

SEQ ID NO: 550309 - DNA, 20 bp, mouse
ggagttccctgacccattac

SEQ ID NO: 550310 - DNA, 20 bp, mouse
gcaggatgagcaggtagagg

SEQ ID NO: 550311 - DNA, 20 bp, mouse
gtggaaaacatagcctgtaa

SEQ ID NO: 550312 - DNA, 20 bp, mouse
gagactagcttctaccttac

SEQ ID NO: 550313 - DNA, 20 bp, mouse
ggagcgatttttgtagagag

SEQ ID NO: 550314 - DNA, 20 bp, mouse
gttttgtagagaggggatgc

SEQ ID NO: 550315 - DNA, 20 bp, mouse
ggggttccagcccgatgctc

SEQ ID NO: 550316 - DNA, 20 bp, mouse
ggttccagggtgctcagaag

SEQ ID NO: 550317 - DNA, 20 bp, mouse
gcatcacatgggacacttga

SEQ ID NO: 550318 - DNA, 20 bp, mouse
gcttgagggcacttgttcca

SEQ ID NO: 550319 - DNA, 20 bp, mouse
gaggccacttctgagcaccc

SEQ ID NO: 550320 - DNA, 20 bp, mouse
gtggcctctccagctagaaa

SEQ ID NO: 550321 - DNA, 20 bp, mouse
gaaacaagggcccatcacat

SEQ ID NO: 550322 - DNA, 20 bp, mouse
gtggccctttctagctggag

SEQ ID NO: 550323 - DNA, 20 bp, mouse
gggaggtcagcaagcagctt

SEQ ID NO: 550324 - DNA, 20 bp, mouse
gtgggtgaggcaccccgaga

SEQ ID NO: 550325 - DNA, 20 bp, mouse
ggtctcgagcacagacagat

SEQ ID NO: 550326 - DNA, 20 bp, mouse
gtaccaggctgccaagaagg

SEQ ID NO: 550327 - DNA, 20 bp, mouse
gcatctgtgggcacccacca

SEQ ID NO: 550328 - DNA, 20 bp, mouse
gggaagcccagcaagatgaa

SEQ ID NO: 550329 - DNA, 20 bp, mouse
gtttgaggacatggactacc

SEQ ID NO: 550330 - DNA, 20 bp, mouse
gatgtcctcaaaatacttaa

SEQ ID NO: 550331 - DNA, 20 bp, mouse
ggactaccaggctgccaaga

SEQ ID NO: 550332 - DNA, 20 bp, mouse
ggcacccaccagggagatga

SEQ ID NO: 550333 - DNA, 20 bp, mouse
ggaatggtcctggtgtggac

SEQ ID NO: 550334 - DNA, 20 bp, mouse
gccagcaagatgaatggtcc

SEQ ID NO: 550335 - DNA, 20 bp, mouse
gtggccatcatctccctggt

SEQ ID NO: 550336 - DNA, 20 bp, mouse
gggagcctgagaatcctaca

SEQ ID NO: 550337 - DNA, 20 bp, mouse
gtggctaagactccacctga

SEQ ID NO: 550338 - DNA, 20 bp, mouse
gactccacctgagggagcaa

SEQ ID NO: 550339 - DNA, 20 bp, mouse
gaggcttaggtggagcccca

SEQ ID NO: 550340 - DNA, 20 bp, mouse
ggaacagccctagaaggctt

SEQ ID NO: 550341 - DNA, 20 bp, mouse
ggctccacctaagccttcta

SEQ ID NO: 550342 - DNA, 20 bp, mouse
gcataggcttgtgcagtgag

SEQ ID NO: 550343 - DNA, 20 bp, mouse
gctgttcctcctggcaaaca

SEQ ID NO: 550344 - DNA, 20 bp, mouse
gcagccctagaaggcttagg

SEQ ID NO: 550345 - DNA, 20 bp, mouse
gagccaccatgtttgccagg

SEQ ID NO: 550346 - DNA, 20 bp, mouse
gcaaggagacaccaggtgtg

SEQ ID NO: 550347 - DNA, 20 bp, mouse
gtgagaagcactcctactca

SEQ ID NO: 550348 - DNA, 20 bp, mouse
gggttcagacagccgtgagt

SEQ ID NO: 550349 - DNA, 20 bp, mouse
gctgtgtcacagtaactccc

SEQ ID NO: 550350 - DNA, 20 bp, mouse
gggtgtgaaggcttgagttg

SEQ ID NO: 550351 - DNA, 20 bp, mouse
gttcctgacctggtttctag

SEQ ID NO: 550352 - DNA, 20 bp, mouse
gcaggtcaggaaaaagagtt

SEQ ID NO: 550353 - DNA, 20 bp, mouse
gagcccctagaaaccaggtc

SEQ ID NO: 550354 - DNA, 20 bp, mouse
gtactgtgacacagatggga

SEQ ID NO: 550355 - DNA, 20 bp, mouse
ggacacagatgggatggtca

SEQ ID NO: 550356 - DNA, 20 bp, mouse
ggaagaggtacccgaaggtg

SEQ ID NO: 550357 - DNA, 20 bp, mouse
ggaagagaagaggtacccga

SEQ ID NO: 550358 - DNA, 20 bp, mouse
gtactggacagcatgatgac

SEQ ID NO: 550359 - DNA, 20 bp, mouse
gattcatcataaagctggag

SEQ ID NO: 550360 - DNA, 20 bp, mouse
gtccaagcactgtagtgcag

SEQ ID NO: 550361 - DNA, 20 bp, mouse
gcacaatggccaagttgacc

SEQ ID NO: 550362 - DNA, 20 bp, mouse
gtcagaaatgcctcaccttc

SEQ ID NO: 550363 - DNA, 20 bp, mouse
gggacagcatgatgacagga

SEQ ID NO: 550364 - DNA, 20 bp, mouse
gataaagctggagaggcctc

SEQ ID NO: 550365 - DNA, 20 bp, mouse
ggtcccattcatcataaagc

SEQ ID NO: 550366 - DNA, 20 bp, mouse
ggtcagtgacctctataaaa

SEQ ID NO: 550367 - DNA, 20 bp, mouse
gctgcaagcagcaagtcttt

SEQ ID NO: 550368 - DNA, 20 bp, mouse
gcaaagatgcacattgtgct

SEQ ID NO: 550369 - DNA, 20 bp, mouse
gatgaagggtgctgggtcag

SEQ ID NO: 550370 - DNA, 20 bp, mouse
ggcacgactaaactctctga

SEQ ID NO: 550371 - DNA, 20 bp, mouse
gtgtctcttttggctaatag

SEQ ID NO: 550372 - DNA, 20 bp, mouse
gatagaggtcactgaccttc

SEQ ID NO: 550373 - DNA, 20 bp, mouse
gaaggaagacagagcatcag

SEQ ID NO: 550374 - DNA, 20 bp, mouse
gagtggagctccaaaacaaa

SEQ ID NO: 550375 - DNA, 20 bp, mouse
gatggtgacatgcaaacact

SEQ ID NO: 550376 - DNA, 20 bp, mouse
gacctagacagtgtttccca

SEQ ID NO: 550377 - DNA, 20 bp, mouse
gatggcgctggtaaaccagt

SEQ ID NO: 550378 - DNA, 20 bp, mouse
gggaaacactgtctaggttc

SEQ ID NO: 550379 - DNA, 20 bp, mouse
gaggataagagttgtagctt

SEQ ID NO: 550380 - DNA, 20 bp, mouse
gcatcagggaaagattgaca

SEQ ID NO: 550381 - DNA, 20 bp, mouse
gacagtgtttcccatggcgc

SEQ ID NO: 550382 - DNA, 20 bp, mouse
gtcagtacttcttttgccag

SEQ ID NO: 550383 - DNA, 20 bp, mouse
gacagaccttgccgctcatg

SEQ ID NO: 550384 - DNA, 20 bp, mouse
ggagttgtagcttgggcctc

SEQ ID NO: 550385 - DNA, 20 bp, mouse
gagagaacatcctggatcca

SEQ ID NO: 550386 - DNA, 20 bp, mouse
gaaagtagtatccgaaggtg

SEQ ID NO: 550387 - DNA, 20 bp, mouse
ggaggaaaagtagtatccga

SEQ ID NO: 550388 - DNA, 20 bp, mouse
gtactggacaccatggtggg

SEQ ID NO: 550389 - DNA, 20 bp, mouse
gagctactggacaccatggt

SEQ ID NO: 550390 - DNA, 20 bp, mouse
gatggtccttccccccacca

SEQ ID NO: 550391 - DNA, 20 bp, mouse
gcataggggtatgcagggtt

SEQ ID NO: 550392 - DNA, 20 bp, mouse
gtccaggtactataatgcag

SEQ ID NO: 550393 - DNA, 20 bp, mouse
gttcctggtcaacctggctg

SEQ ID NO: 550394 - DNA, 20 bp, mouse
gcttcttcacatggtcactg

SEQ ID NO: 550395 - DNA, 20 bp, mouse
ggaatggtagacgtagcacc

SEQ ID NO: 550396 - DNA, 20 bp, mouse
gagcttgggaacaacagtgg

SEQ ID NO: 550397 - DNA, 20 bp, mouse
gtgcaagagccaggatgtaa

SEQ ID NO: 550398 - DNA, 20 bp, mouse
gagcccctagaacccagatg

SEQ ID NO: 550399 - DNA, 20 bp, mouse
gcttcctcatctgggttcta

SEQ ID NO: 550400 - DNA, 20 bp, mouse
gagccatcagcctcaaccca

SEQ ID NO: 550401 - DNA, 20 bp, mouse
gcagtgtgttgtagtgcagt

SEQ ID NO: 550402 - DNA, 20 bp, mouse
ggccatttgagagtgagttc

SEQ ID NO: 550403 - DNA, 20 bp, mouse
gccacacaaaacctgcaagc

SEQ ID NO: 550404 - DNA, 20 bp, mouse
gctacaacacactgatgagc

SEQ ID NO: 550405 - DNA, 20 bp, mouse
gccaagtcttcttcctcatc

SEQ ID NO: 550406 - DNA, 20 bp, mouse
gggaagcactgtctaggcta

SEQ ID NO: 550407 - DNA, 20 bp, mouse
ggacttgtaccagagggcca

SEQ ID NO: 550408 - DNA, 20 bp, mouse
ggatcacgacttgtaccaga

SEQ ID NO: 550409 - DNA, 20 bp, mouse
gagagaacatcctggaccct

SEQ ID NO: 550410 - DNA, 20 bp, mouse
gtcacaactgactggtttac

SEQ ID NO: 550411 - DNA, 20 bp, mouse
gaaggatgagacttgcacct

SEQ ID NO: 550412 - DNA, 20 bp, mouse
ggttgatgaccccagggtcc

SEQ ID NO: 550413 - DNA, 20 bp, mouse
ggcctagacagtgcttccca

SEQ ID NO: 550414 - DNA, 20 bp, mouse
gactggtttactggagccat

SEQ ID NO: 550415 - DNA, 20 bp, mouse
gcatcagggcaaggttgact

SEQ ID NO: 550416 - DNA, 20 bp, mouse
gttgggactcaacatcgtca

SEQ ID NO: 550417 - DNA, 20 bp, mouse
gacatcgtcatggaaagtat

SEQ ID NO: 550418 - DNA, 20 bp, mouse
gcatggtagccaggttacac

SEQ ID NO: 550419 - DNA, 20 bp, mouse
gtggaaagtattgggtccac

SEQ ID NO: 550420 - DNA, 20 bp, mouse
gtctacacagtggctctaat

SEQ ID NO: 550421 - DNA, 20 bp, mouse
gtgattcccaaggctctgat

SEQ ID NO: 550422 - DNA, 20 bp, mouse
gctgattggcctagtgtttg

SEQ ID NO: 550423 - DNA, 20 bp, mouse
gggtattttcctcaaacact

SEQ ID NO: 550424 - DNA, 20 bp, mouse
gaagctgacagatacaccag

SEQ ID NO: 550425 - DNA, 20 bp, mouse
gaatgagtccacagctatgt

SEQ ID NO: 550426 - DNA, 20 bp, mouse
gcaggactttgacatagggt

SEQ ID NO: 550427 - DNA, 20 bp, mouse
gtccccaggactttgacata

SEQ ID NO: 550428 - DNA, 20 bp, mouse
ggccagagaggaaaatcaat

SEQ ID NO: 550429 - DNA, 20 bp, mouse
gatctcagagaagtgaggta

SEQ ID NO: 550430 - DNA, 20 bp, mouse
gaaagtcctggggactccaa

SEQ ID NO: 550431 - DNA, 20 bp, mouse
ggaattatctcagagaagtg

SEQ ID NO: 550432 - DNA, 20 bp, mouse
gagatcagtttatagagtct

SEQ ID NO: 550433 - DNA, 20 bp, mouse
ggaggtaagggctaaagtaa

SEQ ID NO: 550434 - DNA, 20 bp, mouse
gatgtttctgatagccagag

SEQ ID NO: 550435 - DNA, 20 bp, mouse
gcacactgaaatacacactg

SEQ ID NO: 550436 - DNA, 20 bp, mouse
gctgtgtgcagctctggccg

SEQ ID NO: 550437 - DNA, 20 bp, mouse
ggtgagcagcagcacttcag

SEQ ID NO: 550438 - DNA, 20 bp, mouse
gcagagctgcacacagctgt

SEQ ID NO: 550439 - DNA, 20 bp, mouse
gcatggttgctaagttgcat

SEQ ID NO: 550440 - DNA, 20 bp, mouse
gagctctggccgtggctgta

SEQ ID NO: 550441 - DNA, 20 bp, mouse
ggtggctttaatgggtaaca

SEQ ID NO: 550442 - DNA, 20 bp, mouse
gtggatactccacacaacaa

SEQ ID NO: 550443 - DNA, 20 bp, mouse
gattaaagccactgtgtaca

SEQ ID NO: 550444 - DNA, 20 bp, mouse
gtcttctttcttctgtggtc

SEQ ID NO: 550445 - DNA, 20 bp, mouse
gagcgccttgggcagcacag

SEQ ID NO: 550446 - DNA, 20 bp, mouse
gaaactgatacacacaatgg

SEQ ID NO: 550447 - DNA, 20 bp, mouse
gtagggccccacacagctgt

SEQ ID NO: 550448 - DNA, 20 bp, mouse
gagaggatgctgaccatgta

SEQ ID NO: 550449 - DNA, 20 bp, mouse
gcatcatcatggagagcacc

SEQ ID NO: 550450 - DNA, 20 bp, mouse
gccgatgaaccatacaacca

SEQ ID NO: 550451 - DNA, 20 bp, mouse
gggccctagccatggttgta

SEQ ID NO: 550452 - DNA, 20 bp, mouse
gccagctcttcttccttaca

SEQ ID NO: 550453 - DNA, 20 bp, mouse
gatacacacaatggtggacc

SEQ ID NO: 550454 - DNA, 20 bp, mouse
gctgtgtggggccctagcca

SEQ ID NO: 550455 - DNA, 20 bp, mouse
gtgggacatacatcccttga

SEQ ID NO: 550456 - DNA, 20 bp, mouse
gcaggaagtacgtctgagtt

SEQ ID NO: 550457 - DNA, 20 bp, mouse
ggtacgtctgagttaggcag

SEQ ID NO: 550458 - DNA, 20 bp, mouse
gaggcagtggacataagaga

SEQ ID NO: 550459 - DNA, 20 bp, mouse
gttccagaggatcaggctcc

SEQ ID NO: 550460 - DNA, 20 bp, mouse
gggggtgtgcaggcggggat

SEQ ID NO: 550461 - DNA, 20 bp, mouse
gaatgtggacacctttctgc

SEQ ID NO: 550462 - DNA, 20 bp, mouse
ggtcattggtgatgccaagc

SEQ ID NO: 550463 - DNA, 20 bp, mouse
gaggcggggatcggagatga

SEQ ID NO: 550464 - DNA, 20 bp, mouse
gcacattggcaaaagaaatc

SEQ ID NO: 550465 - DNA, 20 bp, mouse
gatggccctggacagatttg

SEQ ID NO: 550466 - DNA, 20 bp, mouse
gcagcctttgaactgataaa

SEQ ID NO: 550467 - DNA, 20 bp, mouse
gtcaccgtttatcagttcaa

SEQ ID NO: 550468 - DNA, 20 bp, mouse
gcatcatcatgaagagtatc

SEQ ID NO: 550469 - DNA, 20 bp, mouse
gggacaggaagcagcctatg

SEQ ID NO: 550470 - DNA, 20 bp, mouse
gccctggttggcctagtgtc

SEQ ID NO: 550471 - DNA, 20 bp, mouse
gtctgtgattcccaaggccc

SEQ ID NO: 550472 - DNA, 20 bp, mouse
gactaggccaaccagggcct

SEQ ID NO: 550473 - DNA, 20 bp, mouse
gcagaacctgacaaacacag

SEQ ID NO: 550474 - DNA, 20 bp, mouse
ggtctaccactgtgtttgtc

SEQ ID NO: 550475 - DNA, 20 bp, mouse
gtttctgactgcagagagtt

SEQ ID NO: 550476 - DNA, 20 bp, mouse
gtccagggaagcccaccaag

SEQ ID NO: 550477 - DNA, 20 bp, mouse
ggaggaagctgctgtaggaa

SEQ ID NO: 550478 - DNA, 20 bp, mouse
gagcccaggaccaaagtcaa

SEQ ID NO: 550479 - DNA, 20 bp, mouse
gggaccaaagtcaatgggtg

SEQ ID NO: 550480 - DNA, 20 bp, mouse
ggagcaatgagcacgtacat

SEQ ID NO: 550481 - DNA, 20 bp, mouse
gtcgcccttcctgcaatcca

SEQ ID NO: 550482 - DNA, 20 bp, mouse
gtctctcctggtgccagccc

SEQ ID NO: 550483 - DNA, 20 bp, mouse
gcttccctggattgcaggaa

SEQ ID NO: 550484 - DNA, 20 bp, mouse
gttaggcctcacggctgtgg

SEQ ID NO: 550485 - DNA, 20 bp, mouse
gggcaccaggagagaagatc

SEQ ID NO: 550486 - DNA, 20 bp, mouse
gtacttaccaggactcacac

SEQ ID NO: 550487 - DNA, 20 bp, mouse
gaagacgtagccaacctcaa

SEQ ID NO: 550488 - DNA, 20 bp, mouse
gcccctgcctgtgtgagtcc

SEQ ID NO: 550489 - DNA, 20 bp, mouse
gacataggctcctacttacc

SEQ ID NO: 550490 - DNA, 20 bp, mouse
ggatgagtgagacatctgag

SEQ ID NO: 550491 - DNA, 20 bp, mouse
gagtcagtccccagttgcca

SEQ ID NO: 550492 - DNA, 20 bp, mouse
ggattcagcctgctacaata

SEQ ID NO: 550493 - DNA, 20 bp, mouse
ggcactgggccagatgaact

SEQ ID NO: 550494 - DNA, 20 bp, mouse
gttagccaagcaggggtgtg

SEQ ID NO: 550495 - DNA, 20 bp, mouse
gggtggttgtgatagagagg

SEQ ID NO: 550496 - DNA, 20 bp, mouse
gagccctcaggcgtcatgtt

SEQ ID NO: 550497 - DNA, 20 bp, mouse
gtcatgttgggttggagcaa

SEQ ID NO: 550498 - DNA, 20 bp, mouse
ggacgcctgagggctcaggg

SEQ ID NO: 550499 - DNA, 20 bp, mouse
gcatgacgcctgagggctca

SEQ ID NO: 550500 - DNA, 20 bp, mouse
gagcatggggggcagcaccg

SEQ ID NO: 550501 - DNA, 20 bp, mouse
gatggggggcagcaccgtgg

SEQ ID NO: 550502 - DNA, 20 bp, mouse
gctcaggcgtcatgttgggt

SEQ ID NO: 550503 - DNA, 20 bp, mouse
gctggctggtctggtggtgt

SEQ ID NO: 550504 - DNA, 20 bp, mouse
gatgttctgcatctactttc

SEQ ID NO: 550505 - DNA, 20 bp, mouse
gccctgggaagcccatgagg

SEQ ID NO: 550506 - DNA, 20 bp, mouse
ggccagggatgcccaacaaa

SEQ ID NO: 550507 - DNA, 20 bp, mouse
gtttctctgcatgctggtgg

SEQ ID NO: 550508 - DNA, 20 bp, mouse
ggatattgacagggttttct

SEQ ID NO: 550509 - DNA, 20 bp, mouse
gcttacaacagtgtagttta

SEQ ID NO: 550510 - DNA, 20 bp, mouse
gaaggagtttgtgagaacgg

SEQ ID NO: 550511 - DNA, 20 bp, mouse
gttctcacaaactccttgat

SEQ ID NO: 550512 - DNA, 20 bp, mouse
gtcacaaggcccagtctcca

SEQ ID NO: 550513 - DNA, 20 bp, mouse
gttgattgggaaaatcagag

SEQ ID NO: 550514 - DNA, 20 bp, mouse
gttgggcatccctggcctag

SEQ ID NO: 550515 - DNA, 20 bp, mouse
gaaagaggtacatgggtcca

SEQ ID NO: 550516 - DNA, 20 bp, mouse
ggccggggatgcccagcaaa

SEQ ID NO: 550517 - DNA, 20 bp, mouse
gatgggtactgtaaaccata

SEQ ID NO: 550518 - DNA, 20 bp, mouse
gtgtgtgactaatatccgta

SEQ ID NO: 550519 - DNA, 20 bp, mouse
gtttctctgcatgctggcag

SEQ ID NO: 550520 - DNA, 20 bp, mouse
gaatccctgattgggaaaat

SEQ ID NO: 550521 - DNA, 20 bp, mouse
gctgattgggaaaatcggag

SEQ ID NO: 550522 - DNA, 20 bp, mouse
gtctcacaaaatccctgatt

SEQ ID NO: 550523 - DNA, 20 bp, mouse
gaggtcatctgtatcaatat

SEQ ID NO: 550524 - DNA, 20 bp, mouse
ggtgctggtcctctaggccg

SEQ ID NO: 550525 - DNA, 20 bp, mouse
gacacagtcttccatttgct

SEQ ID NO: 550526 - DNA, 20 bp, mouse
gggtggtggtagacaagatg

SEQ ID NO: 550527 - DNA, 20 bp, mouse
gagagccttgggcacggtgg

SEQ ID NO: 550528 - DNA, 20 bp, mouse
gagccgcagccagcatgcag

SEQ ID NO: 550529 - DNA, 20 bp, mouse
gtgtacaaatgacctggcct

SEQ ID NO: 550530 - DNA, 20 bp, mouse
gcccgcacgaaaccaaaata

SEQ ID NO: 550531 - DNA, 20 bp, mouse
gtggttcctgtgtagttaaa

SEQ ID NO: 550532 - DNA, 20 bp, mouse
gtggcaccttttaactacac

SEQ ID NO: 550533 - DNA, 20 bp, mouse
gttcttcatttcctacctgg

SEQ ID NO: 550534 - DNA, 20 bp, mouse
gcagtcatgtggtaattgtt

SEQ ID NO: 550535 - DNA, 20 bp, mouse
gcaccaggaacacatctggg

SEQ ID NO: 550536 - DNA, 20 bp, mouse
ggttgcctagcagagtgaag

SEQ ID NO: 550537 - DNA, 20 bp, mouse
gtgtacctcttcactctgct

SEQ ID NO: 550538 - DNA, 20 bp, mouse
gggagtgaagtgtggtgagc

SEQ ID NO: 550539 - DNA, 20 bp, mouse
gcctttctactcactgtcat

SEQ ID NO: 550540 - DNA, 20 bp, mouse
ggaaggtagagaagccaatg

SEQ ID NO: 550541 - DNA, 20 bp, mouse
gatcagctgaagatgaggga

SEQ ID NO: 550542 - DNA, 20 bp, mouse
gaggatgaactctgacacaa

SEQ ID NO: 550543 - DNA, 20 bp, mouse
gcaggcaggcacagccacgg

SEQ ID NO: 550544 - DNA, 20 bp, mouse
gatgcgtgggatgatggcaa

SEQ ID NO: 550545 - DNA, 20 bp, mouse
gcaggtcagccaacatgcgt

SEQ ID NO: 550546 - DNA, 20 bp, mouse
ggtggagtgaccaggagtgc

SEQ ID NO: 550547 - DNA, 20 bp, mouse
gagaggctgctagcatggac

SEQ ID NO: 550548 - DNA, 20 bp, mouse
ggaagagccgcaccatggtg

SEQ ID NO: 550549 - DNA, 20 bp, mouse
ggtgctgcacagaaatcgaa

SEQ ID NO: 550550 - DNA, 20 bp, mouse
gtgcagaacataatgactcc

SEQ ID NO: 550551 - DNA, 20 bp, mouse
gcctggaggcctcccatcac

SEQ ID NO: 550552 - DNA, 20 bp, mouse
gtgaatgtctccttctcgta

SEQ ID NO: 550553 - DNA, 20 bp, mouse
gtctgcaataccagcactcc

SEQ ID NO: 550554 - DNA, 20 bp, mouse
gaactgtccaccctacgaga

SEQ ID NO: 550555 - DNA, 20 bp, mouse
gccacacagatgaggttgat

SEQ ID NO: 550556 - DNA, 20 bp, mouse
gggccgaagaagagtatgta

SEQ ID NO: 550557 - DNA, 20 bp, mouse
gacaaagccttaaagagacg

SEQ ID NO: 550558 - DNA, 20 bp, mouse
gatgttgccaagaactgcta

SEQ ID NO: 550559 - DNA, 20 bp, mouse
gctgctgccccgtctcttta

SEQ ID NO: 550560 - DNA, 20 bp, mouse
gagaactgctagggcataca

SEQ ID NO: 550561 - DNA, 20 bp, mouse
gtgacccgtagtgcaatggt

SEQ ID NO: 550562 - DNA, 20 bp, mouse
gtgggtagcacaggctccaa

SEQ ID NO: 550563 - DNA, 20 bp, mouse
gggcaacatggcagtcctgt

SEQ ID NO: 550564 - DNA, 20 bp, mouse
gctcagagcgcaccaccaac

SEQ ID NO: 550565 - DNA, 20 bp, mouse
ggccgggaatccccatgagc

SEQ ID NO: 550566 - DNA, 20 bp, mouse
gcaacaagaaggccactggg

SEQ ID NO: 550567 - DNA, 20 bp, mouse
gatcacctcaacccacccag

SEQ ID NO: 550568 - DNA, 20 bp, mouse
gccaagcacagccaaggtat

SEQ ID NO: 550569 - DNA, 20 bp, mouse
gcgatccctgaaccagaaca

SEQ ID NO: 550570 - DNA, 20 bp, mouse
gcagtggccttcttgttgat

SEQ ID NO: 550571 - DNA, 20 bp, mouse
gtcttgttgatgggtatccc

SEQ ID NO: 550572 - DNA, 20 bp, mouse
gatgtaagtgctctaggcct

SEQ ID NO: 550573 - DNA, 20 bp, mouse
gcagttgccaagcacagcca

SEQ ID NO: 550574 - DNA, 20 bp, mouse
gatgttggcagcaatagatc

SEQ ID NO: 550575 - DNA, 20 bp, mouse
gggccaatcttgatgatgag

SEQ ID NO: 550576 - DNA, 20 bp, mouse
ggggagtgtgggatacatag

SEQ ID NO: 550577 - DNA, 20 bp, mouse
gtgtgcagggactccaatcc

SEQ ID NO: 550578 - DNA, 20 bp, mouse
gattagaaacgaacatgctt

SEQ ID NO: 550579 - DNA, 20 bp, mouse
gaataacagccaacatacac

SEQ ID NO: 550580 - DNA, 20 bp, mouse
gagaagatggccaatagttt

SEQ ID NO: 550581 - DNA, 20 bp, mouse
gtcagtacttacccatgcag

SEQ ID NO: 550582 - DNA, 20 bp, mouse
gatgttggctgttattgact

SEQ ID NO: 550583 - DNA, 20 bp, mouse
ggggcattgtagaagttgac

SEQ ID NO: 550584 - DNA, 20 bp, mouse
gtacttacccatgcagtggt

SEQ ID NO: 550585 - DNA, 20 bp, mouse
ggcgtctagaccaatgctgc

SEQ ID NO: 550586 - DNA, 20 bp, mouse
gactggagaccttgcacata

SEQ ID NO: 550587 - DNA, 20 bp, mouse
gatgctggctgtcattgacc

SEQ ID NO: 550588 - DNA, 20 bp, mouse
ggtgctcactcacacagtgg

SEQ ID NO: 550589 - DNA, 20 bp, mouse
gagaaaatcgccagaagttt

SEQ ID NO: 550590 - DNA, 20 bp, mouse
ggaacatacattatgaaaag

SEQ ID NO: 550591 - DNA, 20 bp, mouse
ggcaatggataagaaacatt

SEQ ID NO: 550592 - DNA, 20 bp, mouse
gtaaagaactcctctgagga

SEQ ID NO: 550593 - DNA, 20 bp, mouse
gaacatcaccatcctagctg

SEQ ID NO: 550594 - DNA, 20 bp, mouse
gaatgtaaagaactcctctg

SEQ ID NO: 550595 - DNA, 20 bp, mouse
gttggcataagcaggcatcc

SEQ ID NO: 550596 - DNA, 20 bp, mouse
gccatccacgggttcttgtc

SEQ ID NO: 550597 - DNA, 20 bp, mouse
ggatgccagacaagaacccg

SEQ ID NO: 550598 - DNA, 20 bp, mouse
ggcctgtcagaatgaagcta

SEQ ID NO: 550599 - DNA, 20 bp, mouse
gaccatagcttcattctgac

SEQ ID NO: 550600 - DNA, 20 bp, mouse
gagaatgaagctatggtgat

SEQ ID NO: 550601 - DNA, 20 bp, mouse
gatcttggtgatctcaccac

SEQ ID NO: 550602 - DNA, 20 bp, mouse
gagtcagagccaagatgcag

SEQ ID NO: 550603 - DNA, 20 bp, mouse
gatacttagcatagagggca

SEQ ID NO: 550604 - DNA, 20 bp, mouse
gaccatcctagcagttgtca

SEQ ID NO: 550605 - DNA, 20 bp, mouse
gtgcatcaaaaggaatctca

SEQ ID NO: 550606 - DNA, 20 bp, mouse
ggccaggggattccattgtg

SEQ ID NO: 550607 - DNA, 20 bp, mouse
gcttcctcttgggcatccca

SEQ ID NO: 550608 - DNA, 20 bp, mouse
gataagaagactgaaaccct

SEQ ID NO: 550609 - DNA, 20 bp, mouse
ggattccattgtgtggttgt

SEQ ID NO: 550610 - DNA, 20 bp, mouse
gtacatggtactcagtgaga

SEQ ID NO: 550611 - DNA, 20 bp, mouse
gagtctgaccagtgatgctg

SEQ ID NO: 550612 - DNA, 20 bp, mouse
gtcttctgtggtacctaaga

SEQ ID NO: 550613 - DNA, 20 bp, mouse
ggaattctcatgtaatgtaa

SEQ ID NO: 550614 - DNA, 20 bp, mouse
gtgaagatgctcaccatctt

SEQ ID NO: 550615 - DNA, 20 bp, mouse
ggctgctgtggatattgtta

SEQ ID NO: 550616 - DNA, 20 bp, mouse
gtggcgatgagagggaccaa

SEQ ID NO: 550617 - DNA, 20 bp, mouse
gcatgccagatacagagact

SEQ ID NO: 550618 - DNA, 20 bp, mouse
ggaagagaggaccaagtcaa

SEQ ID NO: 550619 - DNA, 20 bp, mouse
ggcagactccatggcagata

SEQ ID NO: 550620 - DNA, 20 bp, mouse
gcatttggggtggcgatgag

SEQ ID NO: 550621 - DNA, 20 bp, mouse
gagtagaaaataggctggat

SEQ ID NO: 550622 - DNA, 20 bp, mouse
ggatgggccaaacttccatt

SEQ ID NO: 550623 - DNA, 20 bp, mouse
gctttcccagtctctgtatc

SEQ ID NO: 550624 - DNA, 20 bp, mouse
gggcagatagggcatgaata

SEQ ID NO: 550625 - DNA, 20 bp, mouse
gggggaaagccagccaaaag

SEQ ID NO: 550626 - DNA, 20 bp, mouse
gggacagctgaggtgagtac

SEQ ID NO: 550627 - DNA, 20 bp, mouse
gtacaggaggaggcatgctt

SEQ ID NO: 550628 - DNA, 20 bp, mouse
gcagctgaggtgagtacagg

SEQ ID NO: 550629 - DNA, 20 bp, mouse
gtatcaagaggtgtcatgga

SEQ ID NO: 550630 - DNA, 20 bp, mouse
gtagcgaaggatagcagcag

SEQ ID NO: 550631 - DNA, 20 bp, mouse
gactatggagaggctagcga

SEQ ID NO: 550632 - DNA, 20 bp, mouse
gaagcacagcctgggatagg

SEQ ID NO: 550633 - DNA, 20 bp, mouse
gaagacacacaggctctttc

SEQ ID NO: 550634 - DNA, 20 bp, mouse
gcagcacacctggttcttca

SEQ ID NO: 550635 - DNA, 20 bp, mouse
gggtttcagtgtatggacaa

SEQ ID NO: 550636 - DNA, 20 bp, mouse
ggcccagaagggatcatcct

SEQ ID NO: 550637 - DNA, 20 bp, mouse
gggagacagctgaggactct

SEQ ID NO: 550638 - DNA, 20 bp, mouse
gtcatccttggagacagctg

SEQ ID NO: 550639 - DNA, 20 bp, mouse
ggttgatgaatggcccagaa

SEQ ID NO: 550640 - DNA, 20 bp, mouse
gagaaggagatgttgatgaa

SEQ ID NO: 550641 - DNA, 20 bp, mouse
gtccaaggatgatcccttct

SEQ ID NO: 550642 - DNA, 20 bp, mouse
gttctcatgattggcatccc

SEQ ID NO: 550643 - DNA, 20 bp, mouse
ggaggactctaccacagaga

SEQ ID NO: 550644 - DNA, 20 bp, mouse
gagtgctacagtgtacatga

SEQ ID NO: 550645 - DNA, 20 bp, mouse
gagacaggcattgaagtcga

SEQ ID NO: 550646 - DNA, 20 bp, mouse
gaggagggccactggcatca

SEQ ID NO: 550647 - DNA, 20 bp, mouse
gaggaggtgacatcacagga

SEQ ID NO: 550648 - DNA, 20 bp, mouse
gtctggagagaagaacagat

SEQ ID NO: 550649 - DNA, 20 bp, mouse
gctctgtaaaccagaaacag

SEQ ID NO: 550650 - DNA, 20 bp, mouse
ggacatcacaggagggccac

SEQ ID NO: 550651 - DNA, 20 bp, mouse
gaagggagggactgcaatga

SEQ ID NO: 550652 - DNA, 20 bp, mouse
gacagatcgatgcacagtgt

SEQ ID NO: 550653 - DNA, 20 bp, mouse
ggctgcacttagaacccttc

SEQ ID NO: 550654 - DNA, 20 bp, mouse
ggccactggcatcacggctc

SEQ ID NO: 550655 - DNA, 20 bp, mouse
gtaaaccagaaacagaggtc

SEQ ID NO: 550656 - DNA, 20 bp, mouse
gaggagggccactggcatca

SEQ ID NO: 550657 - DNA, 20 bp, mouse
gaggaggtgacatcacagga

SEQ ID NO: 550658 - DNA, 20 bp, mouse
gtctggagagaagaacagat

SEQ ID NO: 550659 - DNA, 20 bp, mouse
gctctgtaaaccagaaacag

SEQ ID NO: 550660 - DNA, 20 bp, mouse
ggacatcacaggagggccac

SEQ ID NO: 550661 - DNA, 20 bp, mouse
gaagggagggactgcaatga

SEQ ID NO: 550662 - DNA, 20 bp, mouse
gacagatcgatgcacagtgt

SEQ ID NO: 550663 - DNA, 20 bp, mouse
ggctgcacttagaacccttc

SEQ ID NO: 550664 - DNA, 20 bp, mouse
ggccactggcatcacggctc

SEQ ID NO: 550665 - DNA, 20 bp, mouse
gtaaaccagaaacagaggtc

SEQ ID NO: 550666 - DNA, 20 bp, mouse
gagtgaggaagaagactggt

SEQ ID NO: 550667 - DNA, 20 bp, mouse
gcagtgctctcgttgaagga

SEQ ID NO: 550668 - DNA, 20 bp, mouse
gtaggcagtgctctcgttga

SEQ ID NO: 550669 - DNA, 20 bp, mouse
ggaaggaagcagatgtctct

SEQ ID NO: 550670 - DNA, 20 bp, mouse
gtgttgaaaggcatagacct

SEQ ID NO: 550671 - DNA, 20 bp, mouse
gatggagatccaggtgtgag

SEQ ID NO: 550672 - DNA, 20 bp, mouse
gctgttcccagagatggcaa

SEQ ID NO: 550673 - DNA, 20 bp, mouse
gcatagacctaggtctgtga

SEQ ID NO: 550674 - DNA, 20 bp, mouse
gtcgatcaaaggccatcacc

SEQ ID NO: 550675 - DNA, 20 bp, mouse
gatcaaaggccatcaccagg

SEQ ID NO: 550676 - DNA, 20 bp, mouse
ggagtagcaattgttaccag

SEQ ID NO: 550677 - DNA, 20 bp, mouse
ggaccgaagcatacctaaga

SEQ ID NO: 550678 - DNA, 20 bp, mouse
gttttaagaaggacaaccat

SEQ ID NO: 550679 - DNA, 20 bp, mouse
gatagagaggaaataacaca

SEQ ID NO: 550680 - DNA, 20 bp, mouse
gacactgatactgactccta

SEQ ID NO: 550681 - DNA, 20 bp, mouse
gtccaatctgagctatttta

SEQ ID NO: 550682 - DNA, 20 bp, mouse
gccagtgagcaggaaaatga

SEQ ID NO: 550683 - DNA, 20 bp, mouse
ggaagctgtggtgttctgga

SEQ ID NO: 550684 - DNA, 20 bp, mouse
gatggagagcccgaggtcag

SEQ ID NO: 550685 - DNA, 20 bp, mouse
gcccaggcacaccagtgagc

SEQ ID NO: 550686 - DNA, 20 bp, mouse
gatagaatctggagtgctag

SEQ ID NO: 550687 - DNA, 20 bp, mouse
gcagagcacgcattatcact

SEQ ID NO: 550688 - DNA, 20 bp, mouse
gttctataaatgtgaatcca

SEQ ID NO: 550689 - DNA, 20 bp, mouse
ggattcacatttatagaatc

SEQ ID NO: 550690 - DNA, 20 bp, mouse
gaggcaaatgctacatatgc

SEQ ID NO: 550691 - DNA, 20 bp, mouse
gaatcatggtatatctaaga

SEQ ID NO: 550692 - DNA, 20 bp, mouse
gcctagagtctgctcacagc

SEQ ID NO: 550693 - DNA, 20 bp, mouse
gaggttcatgcagactatgc

SEQ ID NO: 550694 - DNA, 20 bp, mouse
gtgtgagcagactctaggcc

SEQ ID NO: 550695 - DNA, 20 bp, mouse
gctagaattagtaagaatca

SEQ ID NO: 550696 - DNA, 20 bp, mouse
gcaggcctgggataccagtg

SEQ ID NO: 550697 - DNA, 20 bp, mouse
gtaccagtgaggaggaaggt

SEQ ID NO: 550698 - DNA, 20 bp, mouse
ggcctgggataccagtgagg

SEQ ID NO: 550699 - DNA, 20 bp, mouse
gcacaaagagaagactggct

SEQ ID NO: 550700 - DNA, 20 bp, mouse
gggatgagcatagtgaagtc

SEQ ID NO: 550701 - DNA, 20 bp, mouse
gaaattgatttgaaacaatc

SEQ ID NO: 550702 - DNA, 20 bp, mouse
gccagacctgagctgctctc

SEQ ID NO: 550703 - DNA, 20 bp, mouse
ggacaagctcaagtctgtga

SEQ ID NO: 550704 - DNA, 20 bp, mouse
ggttcccagaaaggtaaagg

SEQ ID NO: 550705 - DNA, 20 bp, mouse
ggatcatgctgttcccagaa

SEQ ID NO: 550706 - DNA, 20 bp, mouse
gaacatgaagaacaggggat

SEQ ID NO: 550707 - DNA, 20 bp, mouse
gttgcttggaatcccagggt

SEQ ID NO: 550708 - DNA, 20 bp, mouse
gccaagcaacatgaagaaca

SEQ ID NO: 550709 - DNA, 20 bp, mouse
gagtaatcatcctctcatgg

SEQ ID NO: 550710 - DNA, 20 bp, mouse
gagccaacaaggccaggaag

SEQ ID NO: 550711 - DNA, 20 bp, mouse
gaggtcagtgatagccaaca

SEQ ID NO: 550712 - DNA, 20 bp, mouse
gtacttgaagccaccatgag

SEQ ID NO: 550713 - DNA, 20 bp, mouse
gcatagtaatcatcctctca

SEQ ID NO: 550714 - DNA, 20 bp, mouse
gtaaaatgctggccatacta

SEQ ID NO: 550715 - DNA, 20 bp, mouse
gtgactgtgaaaccatagta

SEQ ID NO: 550716 - DNA, 20 bp, mouse
gggtaggcatataaaacaca

SEQ ID NO: 550717 - DNA, 20 bp, mouse
gttgatgtcagtttgttgat

SEQ ID NO: 550718 - DNA, 20 bp, mouse
gaggtgggagtcaacaatga

SEQ ID NO: 550719 - DNA, 20 bp, mouse
gagtcaatatatacatgaag

SEQ ID NO: 550720 - DNA, 20 bp, mouse
gtgtatatattgactttcac

SEQ ID NO: 550721 - DNA, 20 bp, mouse
gcttcttactgcttttttca

SEQ ID NO: 550722 - DNA, 20 bp, mouse
gatataaaacacatggaaac

SEQ ID NO: 550723 - DNA, 20 bp, mouse
gtctcgtttctttgtttttt

SEQ ID NO: 550724 - DNA, 20 bp, mouse
ggtttgttgatgggtgagtg

SEQ ID NO: 550725 - DNA, 20 bp, mouse
gggaacagtccaaatatgac

SEQ ID NO: 550726 - DNA, 20 bp, mouse
ggtcctgcagcagctgacca

SEQ ID NO: 550727 - DNA, 20 bp, mouse
ggcctgggatcccaatcagt

SEQ ID NO: 550728 - DNA, 20 bp, mouse
ggaagagatttcgacctcgg

SEQ ID NO: 550729 - DNA, 20 bp, mouse
gatgattctcaatacctccg

SEQ ID NO: 550730 - DNA, 20 bp, mouse
ggatagctgtcaggtacatg

SEQ ID NO: 550731 - DNA, 20 bp, mouse
ggcatcagtggaaatcccca

SEQ ID NO: 550732 - DNA, 20 bp, mouse
ggacagacctagatcagaga

SEQ ID NO: 550733 - DNA, 20 bp, mouse
gaatgaagagatttcgacct

SEQ ID NO: 550734 - DNA, 20 bp, mouse
ggcgatcaaaggacataatg

SEQ ID NO: 550735 - DNA, 20 bp, mouse
ggtgcatatgctcaaagcct

SEQ ID NO: 550736 - DNA, 20 bp, mouse
ggccatggcgagcaagacag

SEQ ID NO: 550737 - DNA, 20 bp, mouse
gaggccaggcctagcagggt

SEQ ID NO: 550738 - DNA, 20 bp, mouse
ggcccactaatagaaaagtg

SEQ ID NO: 550739 - DNA, 20 bp, mouse
ggaaggtagatagtgatgag

SEQ ID NO: 550740 - DNA, 20 bp, mouse
gagcagggtgggcattaaca

SEQ ID NO: 550741 - DNA, 20 bp, mouse
gaggtatcttgggcggacaa

SEQ ID NO: 550742 - DNA, 20 bp, mouse
gatggtgcagcttccaggcc

SEQ ID NO: 550743 - DNA, 20 bp, mouse
gtagaaggcaggctgaggca

SEQ ID NO: 550744 - DNA, 20 bp, mouse
gaggattgtaccattgccaa

SEQ ID NO: 550745 - DNA, 20 bp, mouse
gagggtgggcattaacacgg

SEQ ID NO: 550746 - DNA, 20 bp, mouse
gcatagatggtagagtacaa

SEQ ID NO: 550747 - DNA, 20 bp, mouse
gtctggagccctcttagata

SEQ ID NO: 550748 - DNA, 20 bp, mouse
ggctagcatttgcagatatg

SEQ ID NO: 550749 - DNA, 20 bp, mouse
gtactggatggcattcccat

SEQ ID NO: 550750 - DNA, 20 bp, mouse
gacttgagcagaagtattac

SEQ ID NO: 550751 - DNA, 20 bp, mouse
gactagcactcctgactcaa

SEQ ID NO: 550752 - DNA, 20 bp, mouse
ggtactctaccatctatgct

SEQ ID NO: 550753 - DNA, 20 bp, mouse
gaatggtgccatatctaaga

SEQ ID NO: 550754 - DNA, 20 bp, mouse
gctgtatcatattgacttca

SEQ ID NO: 550755 - DNA, 20 bp, mouse
gagaatatgcctagcataga

SEQ ID NO: 550756 - DNA, 20 bp, mouse
gccatccacaggctcttgtc

SEQ ID NO: 550757 - DNA, 20 bp, mouse
gcctcaaagggaatctcagg

SEQ ID NO: 550758 - DNA, 20 bp, mouse
ggatgccagacaagagcctg

SEQ ID NO: 550759 - DNA, 20 bp, mouse
gtgcctgttagaatgaaaac

SEQ ID NO: 550760 - DNA, 20 bp, mouse
ggaatctcagggggcataga

SEQ ID NO: 550761 - DNA, 20 bp, mouse
gagaatgaaaactgggtgac

SEQ ID NO: 550762 - DNA, 20 bp, mouse
gacccagttttcattctaac

SEQ ID NO: 550763 - DNA, 20 bp, mouse
gacgcctcaaagggaatctc

SEQ ID NO: 550764 - DNA, 20 bp, mouse
gtcagggggcatagagggca

SEQ ID NO: 550765 - DNA, 20 bp, mouse
gaatcaaagccaacatgcag

SEQ ID NO: 550766 - DNA, 20 bp, mouse
gtccagggaaggccgtaagg

SEQ ID NO: 550767 - DNA, 20 bp, mouse
gtaatccagggaaggccgta

SEQ ID NO: 550768 - DNA, 20 bp, mouse
ggtgagcaagttctaatcca

SEQ ID NO: 550769 - DNA, 20 bp, mouse
gtcctccttacggccttccc

SEQ ID NO: 550770 - DNA, 20 bp, mouse
gactgtgggaagggttgtga

SEQ ID NO: 550771 - DNA, 20 bp, mouse
gtggtgtagagaccacaaac

SEQ ID NO: 550772 - DNA, 20 bp, mouse
ggcaagttctaatccaggga

SEQ ID NO: 550773 - DNA, 20 bp, mouse
gtagagaccacaaacaggaa

SEQ ID NO: 550774 - DNA, 20 bp, mouse
gctcccgggcatgaaaccaa

SEQ ID NO: 550775 - DNA, 20 bp, mouse
gatgaaaccaaaggacacca

SEQ ID NO: 550776 - DNA, 20 bp, mouse
gcaggcctgggattccaatc

SEQ ID NO: 550777 - DNA, 20 bp, mouse
gaagtcagagatggccaaca

SEQ ID NO: 550778 - DNA, 20 bp, mouse
gaaagatccggagcatggtg

SEQ ID NO: 550779 - DNA, 20 bp, mouse
ggatagagctgtatctgagg

SEQ ID NO: 550780 - DNA, 20 bp, mouse
ggggattccaatcaggaaga

SEQ ID NO: 550781 - DNA, 20 bp, mouse
ggacaggcccaagtcagaga

SEQ ID NO: 550782 - DNA, 20 bp, mouse
gccacgcatgagcatactcc

SEQ ID NO: 550783 - DNA, 20 bp, mouse
gatgagcatactccaggcct

SEQ ID NO: 550784 - DNA, 20 bp, mouse
gtcaccaccttcttcctgat

SEQ ID NO: 550785 - DNA, 20 bp, mouse
gtacatgggagcatggagtg

SEQ ID NO: 550786 - DNA, 20 bp, mouse
ggggatggagatccactcgt

SEQ ID NO: 550787 - DNA, 20 bp, mouse
gctaattgggataccaggac

SEQ ID NO: 550788 - DNA, 20 bp, mouse
gcgtgggcatattccagtcc

SEQ ID NO: 550789 - DNA, 20 bp, mouse
ggcattgggtgagattgcca

SEQ ID NO: 550790 - DNA, 20 bp, mouse
gactggaatatgcccacgag

SEQ ID NO: 550791 - DNA, 20 bp, mouse
gttcttctaattgggatacc

SEQ ID NO: 550792 - DNA, 20 bp, mouse
gtgttggctgtctctgatat

SEQ ID NO: 550793 - DNA, 20 bp, mouse
gtacatgggctcgtgaagag

SEQ ID NO: 550794 - DNA, 20 bp, mouse
ggatacagttctatcctcaa

SEQ ID NO: 550795 - DNA, 20 bp, mouse
gccatggataaagaactctt

SEQ ID NO: 550796 - DNA, 20 bp, mouse
gctccaggacccctaggaaa

SEQ ID NO: 550797 - DNA, 20 bp, mouse
gcttctaccttcttgctgag

SEQ ID NO: 550798 - DNA, 20 bp, mouse
gcctaggggtcctggagtca

SEQ ID NO: 550799 - DNA, 20 bp, mouse
gacatgggctcatggagtga

SEQ ID NO: 550800 - DNA, 20 bp, mouse
ggatgcctagcactgtaggg

SEQ ID NO: 550801 - DNA, 20 bp, mouse
gaaagatgcctagcactgta

SEQ ID NO: 550802 - DNA, 20 bp, mouse
ggctggagcacatgcatatc

SEQ ID NO: 550803 - DNA, 20 bp, mouse
ggtcctggagtcatggtaaa

SEQ ID NO: 550804 - DNA, 20 bp, mouse
gctgggtaaagcaagcatca

SEQ ID NO: 550805 - DNA, 20 bp, mouse
gtgctcgctctgactgacct

SEQ ID NO: 550806 - DNA, 20 bp, mouse
gaaggtctggaagaattcca

SEQ ID NO: 550807 - DNA, 20 bp, mouse
gcagaccttgaaagcctgtc

SEQ ID NO: 550808 - DNA, 20 bp, mouse
gaagccactttcttcctgac

SEQ ID NO: 550809 - DNA, 20 bp, mouse
gaggctgctgttgtaaagga

SEQ ID NO: 550810 - DNA, 20 bp, mouse
gcagagtcccaagtctgtga

SEQ ID NO: 550811 - DNA, 20 bp, mouse
gagaagattcccagcacagt

SEQ ID NO: 550812 - DNA, 20 bp, mouse
gggcatcagtccggatgaca

SEQ ID NO: 550813 - DNA, 20 bp, mouse
gatggagagtggcatcagtc

SEQ ID NO: 550814 - DNA, 20 bp, mouse
gtctggaagaattccatggc

SEQ ID NO: 550815 - DNA, 20 bp, mouse
ggatggtagaataacgcagt

SEQ ID NO: 550816 - DNA, 20 bp, mouse
gacccttcttaagcagctgt

SEQ ID NO: 550817 - DNA, 20 bp, mouse
gcatagattagtgcttacta

SEQ ID NO: 550818 - DNA, 20 bp, mouse
ggtgtgtgtgatgattgccc

SEQ ID NO: 550819 - DNA, 20 bp, mouse
gacatgcaagtaagttattt

SEQ ID NO: 550820 - DNA, 20 bp, mouse
gactgatatacttttacact

SEQ ID NO: 550821 - DNA, 20 bp, mouse
gcagctgttggatttgagag

SEQ ID NO: 550822 - DNA, 20 bp, mouse
gtccaacagctgcttaagaa

SEQ ID NO: 550823 - DNA, 20 bp, mouse
gcaggttctgtgttcaggac

SEQ ID NO: 550824 - DNA, 20 bp, mouse
gccagaaaggtaaagatatg

SEQ ID NO: 550825 - DNA, 20 bp, mouse
gtttattgttggcaccagaa

SEQ ID NO: 550826 - DNA, 20 bp, mouse
gatgcatcatatttcctgtg

SEQ ID NO: 550827 - DNA, 20 bp, mouse
ggtggagtctggggtgctca

SEQ ID NO: 550828 - DNA, 20 bp, mouse
gtctggggtgctcatggata

SEQ ID NO: 550829 - DNA, 20 bp, mouse
ggtgctcatggatatggcct

SEQ ID NO: 550830 - DNA, 20 bp, mouse
gcaagatgaaaaatgtagaa

SEQ ID NO: 550831 - DNA, 20 bp, mouse
gcaaaatgctggccatactc

SEQ ID NO: 550832 - DNA, 20 bp, mouse
ggaggacaggacaaggtcag

SEQ ID NO: 550833 - DNA, 20 bp, mouse
gtacatgacacagaatggaa

SEQ ID NO: 550834 - DNA, 20 bp, mouse
gatgatgcattctctcatgt

SEQ ID NO: 550835 - DNA, 20 bp, mouse
ggagatacatgggctcatgt

SEQ ID NO: 550836 - DNA, 20 bp, mouse
gctagaattcataagaatca

SEQ ID NO: 550837 - DNA, 20 bp, mouse
gtagagtgtgcattatcact

SEQ ID NO: 550838 - DNA, 20 bp, mouse
gctgttgccagagagggcgg

SEQ ID NO: 550839 - DNA, 20 bp, mouse
gccagccatgagcagactct

SEQ ID NO: 550840 - DNA, 20 bp, mouse
gcatgagcagactctaggcc

SEQ ID NO: 550841 - DNA, 20 bp, mouse
gacagaatctggagtgttag

SEQ ID NO: 550842 - DNA, 20 bp, mouse
gggttcacatgtacagaatc

SEQ ID NO: 550843 - DNA, 20 bp, mouse
gttctgtacatgtgaaccca

SEQ ID NO: 550844 - DNA, 20 bp, mouse
gatagtacataggttcatgc

SEQ ID NO: 550845 - DNA, 20 bp, mouse
gggaatgccagtcaacaaga

SEQ ID NO: 550846 - DNA, 20 bp, mouse
ggatgactgcagatgtggtg

SEQ ID NO: 550847 - DNA, 20 bp, mouse
gaaactaggtgctgttgtga

SEQ ID NO: 550848 - DNA, 20 bp, mouse
gatacatcatatttcctttg

SEQ ID NO: 550849 - DNA, 20 bp, mouse
gcagagtaacttcaccacaa

SEQ ID NO: 550850 - DNA, 20 bp, mouse
gaagatgaaaaatgtagagt

SEQ ID NO: 550851 - DNA, 20 bp, mouse
ggaggacaggacaaggtcag

SEQ ID NO: 550852 - DNA, 20 bp, mouse
gtacatgacacagaatggaa

SEQ ID NO: 550853 - DNA, 20 bp, mouse
gatgatgtattctctcatgt

SEQ ID NO: 550854 - DNA, 20 bp, mouse
ggagatacatgggctcatgt

SEQ ID NO: 550855 - DNA, 20 bp, mouse
gaggtcagtggtagccagca

SEQ ID NO: 550856 - DNA, 20 bp, mouse
gatttctttggttacttctt

SEQ ID NO: 550857 - DNA, 20 bp, mouse
gactagagtctgctcacggc

SEQ ID NO: 550858 - DNA, 20 bp, mouse
gtaggatgtgagcacagtaa

SEQ ID NO: 550859 - DNA, 20 bp, mouse
gcgtgagcagactctagtcc

SEQ ID NO: 550860 - DNA, 20 bp, mouse
gggttcacatgtacagaatc

SEQ ID NO: 550861 - DNA, 20 bp, mouse
gacagaatctggagtgttag

SEQ ID NO: 550862 - DNA, 20 bp, mouse
gttctgtacatgtgaaccca

SEQ ID NO: 550863 - DNA, 20 bp, mouse
gatagtacataggttcatgc

SEQ ID NO: 550864 - DNA, 20 bp, mouse
gggaatgccagtcaacaaga

SEQ ID NO: 550865 - DNA, 20 bp, mouse
gagtggcagagagcacggag

SEQ ID NO: 550866 - DNA, 20 bp, mouse
ggggatgaagatccaaatgt

SEQ ID NO: 550867 - DNA, 20 bp, mouse
gaggtcagagagagccaaca

SEQ ID NO: 550868 - DNA, 20 bp, mouse
ggtgggcagattccatccct

SEQ ID NO: 550869 - DNA, 20 bp, mouse
gtgcatggaatcaagatgga

SEQ ID NO: 550870 - DNA, 20 bp, mouse
gttctacgttccatttggtt

SEQ ID NO: 550871 - DNA, 20 bp, mouse
gagtatgcatggaatcaaga

SEQ ID NO: 550872 - DNA, 20 bp, mouse
gaccctggcactggtaagga

SEQ ID NO: 550873 - DNA, 20 bp, mouse
gcaggatggcaacagtgtac

SEQ ID NO: 550874 - DNA, 20 bp, mouse
gggaaaaccttaagcatggt

SEQ ID NO: 550875 - DNA, 20 bp, mouse
gatggacataccagtatgca

SEQ ID NO: 550876 - DNA, 20 bp, mouse
gccagcaacaagaaagtgga

SEQ ID NO: 550877 - DNA, 20 bp, mouse
gaaactgagtgtcattggga

SEQ ID NO: 550878 - DNA, 20 bp, mouse
gtgttggctaccattgactt

SEQ ID NO: 550879 - DNA, 20 bp, mouse
gagtctcttcacatctggat

SEQ ID NO: 550880 - DNA, 20 bp, mouse
gaatggtgctgtaccgaagt

SEQ ID NO: 550881 - DNA, 20 bp, mouse
gactagagtctcttcacatc

SEQ ID NO: 550882 - DNA, 20 bp, mouse
gtatacatgattgctctctt

SEQ ID NO: 550883 - DNA, 20 bp, mouse
gggcattgctgtgctagtga

SEQ ID NO: 550884 - DNA, 20 bp, mouse
gtcatcctataggaaaatgc

SEQ ID NO: 550885 - DNA, 20 bp, mouse
ggatgaaaaacatctgtatc

SEQ ID NO: 550886 - DNA, 20 bp, mouse
gtgaaagcgaaaccaagtcc

SEQ ID NO: 550887 - DNA, 20 bp, mouse
gagggcacagttatgatcac

SEQ ID NO: 550888 - DNA, 20 bp, mouse
gtcctggcaagtgcagtgct

SEQ ID NO: 550889 - DNA, 20 bp, mouse
gaatgtggtgagctcaaaac

SEQ ID NO: 550890 - DNA, 20 bp, mouse
ggaaacagcctcagagtctc

SEQ ID NO: 550891 - DNA, 20 bp, mouse
gtggaatcctgccttctggc

SEQ ID NO: 550892 - DNA, 20 bp, mouse
gcaaagtctttccagccaga

SEQ ID NO: 550893 - DNA, 20 bp, mouse
gaaatatttttagtgatggg

SEQ ID NO: 550894 - DNA, 20 bp, mouse
ggaacactcgagtattactg

SEQ ID NO: 550895 - DNA, 20 bp, mouse
gtccaggcttgggctaccag

SEQ ID NO: 550896 - DNA, 20 bp, mouse
gggaatgccaatgagaatga

SEQ ID NO: 550897 - DNA, 20 bp, mouse
gcctcaaccttcattctcat

SEQ ID NO: 550898 - DNA, 20 bp, mouse
gacaaggaaaccagactcca

SEQ ID NO: 550899 - DNA, 20 bp, mouse
gaatgtagcccatgcaaaaa

SEQ ID NO: 550900 - DNA, 20 bp, mouse
gaatcagaaatacttgagtg

SEQ ID NO: 550901 - DNA, 20 bp, mouse
ggcctggctattgtacttcg

SEQ ID NO: 550902 - DNA, 20 bp, mouse
ggcactgtaactggggcaat

SEQ ID NO: 550903 - DNA, 20 bp, mouse
gtttccatccctttttgcat

SEQ ID NO: 550904 - DNA, 20 bp, mouse
ggctacattttggcattagt

SEQ ID NO: 550905 - DNA, 20 bp, mouse
gttgacacgcactgtaactg

SEQ ID NO: 550906 - DNA, 20 bp, mouse
gctcattgggatcccaggtc

SEQ ID NO: 550907 - DNA, 20 bp, mouse
ggatgacaatccataataat

SEQ ID NO: 550908 - DNA, 20 bp, mouse
gaatgaggaaaaatgtatct

SEQ ID NO: 550909 - DNA, 20 bp, mouse
gccaagcatacggggcacag

SEQ ID NO: 550910 - DNA, 20 bp, mouse
gcaagataaatacagcagaa

SEQ ID NO: 550911 - DNA, 20 bp, mouse
gcatggatttcctccagacc

SEQ ID NO: 550912 - DNA, 20 bp, mouse
gagcacagatggctacataa

SEQ ID NO: 550913 - DNA, 20 bp, mouse
gagccaagtcgactgaagaa

SEQ ID NO: 550914 - DNA, 20 bp, mouse
gtcagcctccatgccagtaa

SEQ ID NO: 550915 - DNA, 20 bp, mouse
gagaatatgccaagcatacg

SEQ ID NO: 550916 - DNA, 20 bp, mouse
gttatacacaatgaactcag

SEQ ID NO: 550917 - DNA, 20 bp, mouse
gggagggtgcatggatatga

SEQ ID NO: 550918 - DNA, 20 bp, mouse
gcaattataacactttgaac

SEQ ID NO: 550919 - DNA, 20 bp, mouse
gctccactagtccacagcac

SEQ ID NO: 550920 - DNA, 20 bp, mouse
gtgcatggatatgaagggct

SEQ ID NO: 550921 - DNA, 20 bp, mouse
ggtctagatcttgcatgcta

SEQ ID NO: 550922 - DNA, 20 bp, mouse
gtagatcttgcatgctatgg

SEQ ID NO: 550923 - DNA, 20 bp, mouse
gaaaataaaaagtcaatgca

SEQ ID NO: 550924 - DNA, 20 bp, mouse
ggcatgctatggagggtgca

SEQ ID NO: 550925 - DNA, 20 bp, mouse
ggtggagggagcagaaacta

SEQ ID NO: 550926 - DNA, 20 bp, mouse
gcaagccaggaatgccaatg

SEQ ID NO: 550927 - DNA, 20 bp, mouse
gccaatgaggataaaggttg

SEQ ID NO: 550928 - DNA, 20 bp, mouse
gagccactgccaacatgcag

SEQ ID NO: 550929 - DNA, 20 bp, mouse
gataggaaacatccatgaag

SEQ ID NO: 550930 - DNA, 20 bp, mouse
gtgacacacactgtaactgg

SEQ ID NO: 550931 - DNA, 20 bp, mouse
gacactgtaactggaggaat

SEQ ID NO: 550932 - DNA, 20 bp, mouse
ggtctagctgttgtcattcg

SEQ ID NO: 550933 - DNA, 20 bp, mouse
gtctacgttttagcattaat

SEQ ID NO: 550934 - DNA, 20 bp, mouse
gggaatgccaatgaggataa

SEQ ID NO: 550935 - DNA, 20 bp, mouse
gaatcaggaagatctgagtg

SEQ ID NO: 550936 - DNA, 20 bp, mouse
ggggtgaaactgggtatcat

SEQ ID NO: 550937 - DNA, 20 bp, mouse
ggacttaggcatgaccaagc

SEQ ID NO: 550938 - DNA, 20 bp, mouse
gtcctgggatccccagcaat

SEQ ID NO: 550939 - DNA, 20 bp, mouse
gatccccagcaataggaaag

SEQ ID NO: 550940 - DNA, 20 bp, mouse
ggggaaagccaatccaggtg

SEQ ID NO: 550941 - DNA, 20 bp, mouse
gcagaagggaaagccaatcc

SEQ ID NO: 550942 - DNA, 20 bp, mouse
ggcttcagggtaatactctt

SEQ ID NO: 550943 - DNA, 20 bp, mouse
ggatggtgctatatcgaagt

SEQ ID NO: 550944 - DNA, 20 bp, mouse
gtgtatctgattgctctcct

SEQ ID NO: 550945 - DNA, 20 bp, mouse
gcaatagtcttcagggttgc

SEQ ID NO: 550946 - DNA, 20 bp, mouse
gcagcagatggaagagagag

SEQ ID NO: 550947 - DNA, 20 bp, mouse
gcccaggaatgcccagcaga

SEQ ID NO: 550948 - DNA, 20 bp, mouse
gaagcagtttcattattaga

SEQ ID NO: 550949 - DNA, 20 bp, mouse
gagatcaatgaaagagagga

SEQ ID NO: 550950 - DNA, 20 bp, mouse
gactttgttggtgagaatag

SEQ ID NO: 550951 - DNA, 20 bp, mouse
gtcagataaacaacaaagaa

SEQ ID NO: 550952 - DNA, 20 bp, mouse
gaatagaggtatacctaagt

SEQ ID NO: 550953 - DNA, 20 bp, mouse
gtccatctgctgggcattcc

SEQ ID NO: 550954 - DNA, 20 bp, mouse
ggggaatggtggaagtagag

SEQ ID NO: 550955 - DNA, 20 bp, mouse
gatccttctcagactcctgg

SEQ ID NO: 550956 - DNA, 20 bp, mouse
gctccatgcactgtaaggta

SEQ ID NO: 550957 - DNA, 20 bp, mouse
gccggactccatgcactgta

SEQ ID NO: 550958 - DNA, 20 bp, mouse
gatccataccttacagtgca

SEQ ID NO: 550959 - DNA, 20 bp, mouse
gttttattagaataggtaac

SEQ ID NO: 550960 - DNA, 20 bp, mouse
gttcgagcggtagtacttgt

SEQ ID NO: 550961 - DNA, 20 bp, mouse
gatggagtccggcattctat

SEQ ID NO: 550962 - DNA, 20 bp, mouse
gggttggtgtaagctacgct

SEQ ID NO: 550963 - DNA, 20 bp, mouse
ggtatggatgaagaagagtt

SEQ ID NO: 550964 - DNA, 20 bp, mouse
gtcttcctggctgtgctggc

SEQ ID NO: 550965 - DNA, 20 bp, mouse
ggtgtaagctacgctcggct

SEQ ID NO: 550966 - DNA, 20 bp, mouse
gccggactccatgccctgaa

SEQ ID NO: 550967 - DNA, 20 bp, mouse
gtcttcatccatacccttca

SEQ ID NO: 550968 - DNA, 20 bp, mouse
gatccatacccttcagggca

SEQ ID NO: 550969 - DNA, 20 bp, mouse
gtgtcacgttattggttttc

SEQ ID NO: 550970 - DNA, 20 bp, mouse
gctccatgccctgaagggta

SEQ ID NO: 550971 - DNA, 20 bp, mouse
gggttggtgtaagctatgct

SEQ ID NO: 550972 - DNA, 20 bp, mouse
ggtatggatgaagaagagtt

SEQ ID NO: 550973 - DNA, 20 bp, mouse
ggtgtaagctatgctcggct

SEQ ID NO: 550974 - DNA, 20 bp, mouse
gttctttacagtgtgtctgg

SEQ ID NO: 550975 - DNA, 20 bp, mouse
gtacaccctcaattcttggt

SEQ ID NO: 550976 - DNA, 20 bp, mouse
gcagcatcagcggtgagtag

SEQ ID NO: 550977 - DNA, 20 bp, mouse
ggattcggtgtcagcatcag

SEQ ID NO: 550978 - DNA, 20 bp, mouse
ggggttcaggtatgacaagt

SEQ ID NO: 550979 - DNA, 20 bp, mouse
gcagggacagtgattctgat

SEQ ID NO: 550980 - DNA, 20 bp, mouse
gctgcacatgctccagtcca

SEQ ID NO: 550981 - DNA, 20 bp, mouse
gcatcttaggggcaatggct

SEQ ID NO: 550982 - DNA, 20 bp, mouse
ggaggattcatcagctcaat

SEQ ID NO: 550983 - DNA, 20 bp, mouse
gaagatggccaacatcttag

SEQ ID NO: 550984 - DNA, 20 bp, mouse
ggtgtagactgcgttctgtg

SEQ ID NO: 550985 - DNA, 20 bp, mouse
gagaaaactgatgagtgtga

SEQ ID NO: 550986 - DNA, 20 bp, mouse
gagcagtagggaagcccatg

SEQ ID NO: 550987 - DNA, 20 bp, mouse
gttgcagccatggagcagta

SEQ ID NO: 550988 - DNA, 20 bp, mouse
ggggcttccctactgctcca

SEQ ID NO: 550989 - DNA, 20 bp, mouse
gaggatgaactcactgatgt

SEQ ID NO: 550990 - DNA, 20 bp, mouse
gtagcgaagaggccaacata

SEQ ID NO: 550991 - DNA, 20 bp, mouse
gacagtgacagatatatacc

SEQ ID NO: 550992 - DNA, 20 bp, mouse
gatataccaggcctccagaa

SEQ ID NO: 550993 - DNA, 20 bp, mouse
gcaactgaccatcagttctt

SEQ ID NO: 550994 - DNA, 20 bp, mouse
gaaaagtacacattcagtac

SEQ ID NO: 550995 - DNA, 20 bp, mouse
gagtactatgtcctttctgg

SEQ ID NO: 550996 - DNA, 20 bp, mouse
gtctatgtaatggctctaat

SEQ ID NO: 550997 - DNA, 20 bp, mouse
gttgagtcgtgacatcatga

SEQ ID NO: 550998 - DNA, 20 bp, mouse
gtgaagacaaggaccacaca

SEQ ID NO: 550999 - DNA, 20 bp, mouse
gtgggccatgcaccctttaa

SEQ ID NO: 551000 - DNA, 20 bp, mouse
gatctcctttaaagggtgca

SEQ ID NO: 551001 - DNA, 20 bp, mouse
gcagagccccacacaactgt

SEQ ID NO: 551002 - DNA, 20 bp, mouse
gttcttgtccctctatgtaa

SEQ ID NO: 551003 - DNA, 20 bp, mouse
gtgacagagtttatactgca

SEQ ID NO: 551004 - DNA, 20 bp, mouse
gcaacactggtctgatgaca

SEQ ID NO: 551005 - DNA, 20 bp, mouse
gtgaatgcatctatcaacac

SEQ ID NO: 551006 - DNA, 20 bp, mouse
gcagccaggatgaatatcaa

SEQ ID NO: 551007 - DNA, 20 bp, mouse
ggatatagagaaccatccat

SEQ ID NO: 551008 - DNA, 20 bp, mouse
gccatccatgggaggattcg

SEQ ID NO: 551009 - DNA, 20 bp, mouse
gcagcccttgatattcatcc

SEQ ID NO: 551010 - DNA, 20 bp, mouse
gatagagaaccatccatggg

SEQ ID NO: 551011 - DNA, 20 bp, mouse
gtagccaagaggagaaacat

SEQ ID NO: 551012 - DNA, 20 bp, mouse
gcatgggaggattcgaggtc

SEQ ID NO: 551013 - DNA, 20 bp, mouse
gtacatgaaggcatggtcac

SEQ ID NO: 551014 - DNA, 20 bp, mouse
ggggtacagtgactgttacc

SEQ ID NO: 551015 - DNA, 20 bp, mouse
ggcactggctatactggcaa

SEQ ID NO: 551016 - DNA, 20 bp, mouse
gaatcccaatccacacatga

SEQ ID NO: 551017 - DNA, 20 bp, mouse
gcctagaacaccttcatgtg

SEQ ID NO: 551018 - DNA, 20 bp, mouse
ggccgtgatgggagcagttg

SEQ ID NO: 551019 - DNA, 20 bp, mouse
ggaattgtggcatggcgcag

SEQ ID NO: 551020 - DNA, 20 bp, mouse
gtgctcccatcacggcgatg

SEQ ID NO: 551021 - DNA, 20 bp, mouse
gatcacggcgatgcggctgt

SEQ ID NO: 551022 - DNA, 20 bp, mouse
gcggctgtgggtgagaattg

SEQ ID NO: 551023 - DNA, 20 bp, mouse
gaccacaactgctcccatca

SEQ ID NO: 551024 - DNA, 20 bp, mouse
gacaccttcatgtgtggatt

SEQ ID NO: 551025 - DNA, 20 bp, mouse
ggtgggtgagaattgtggca

SEQ ID NO: 551026 - DNA, 20 bp, mouse
gcagcagatggaagagagag

SEQ ID NO: 551027 - DNA, 20 bp, mouse
gcccaggaatgcccagcaga

SEQ ID NO: 551028 - DNA, 20 bp, mouse
gaagcagtttcattattaga

SEQ ID NO: 551029 - DNA, 20 bp, mouse
gagatcaatgaaagagagga

SEQ ID NO: 551030 - DNA, 20 bp, mouse
gactttgttggtgagaacag

SEQ ID NO: 551031 - DNA, 20 bp, mouse
gtcggataaacaacaaagaa

SEQ ID NO: 551032 - DNA, 20 bp, mouse
gtccatctgctgggcattcc

SEQ ID NO: 551033 - DNA, 20 bp, mouse
ggggaatggtggaagtagag

SEQ ID NO: 551034 - DNA, 20 bp, mouse
gatccttctcagactcctgg

SEQ ID NO: 551035 - DNA, 20 bp, mouse
gaacagaggtatacctaagt

SEQ ID NO: 551036 - DNA, 20 bp, mouse
gcgactgttggtgagaatag

SEQ ID NO: 551037 - DNA, 20 bp, mouse
ggcatcgaaggtgatatcat

SEQ ID NO: 551038 - DNA, 20 bp, mouse
gaatcccaatccagacatgg

SEQ ID NO: 551039 - DNA, 20 bp, mouse
gagtcgcatcgccaagatgg

SEQ ID NO: 551040 - DNA, 20 bp, mouse
gcctagaacacctccatgtc

SEQ ID NO: 551041 - DNA, 20 bp, mouse
gatcttggcgatgcgactgt

SEQ ID NO: 551042 - DNA, 20 bp, mouse
gaatagtggtatgacgtagt

SEQ ID NO: 551043 - DNA, 20 bp, mouse
gaccacaactgcccccatct

SEQ ID NO: 551044 - DNA, 20 bp, mouse
gaacacctccatgtctggat

SEQ ID NO: 551045 - DNA, 20 bp, mouse
gtgacgtagtgggtcacaaa

SEQ ID NO: 551046 - DNA, 20 bp, mouse
gcctgtgagatagaatgtgg

SEQ ID NO: 551047 - DNA, 20 bp, mouse
gactataacagtcaaaccaa

SEQ ID NO: 551048 - DNA, 20 bp, mouse
gaatgtagataaggcagaat

SEQ ID NO: 551049 - DNA, 20 bp, mouse
ggccatgtccttgcctgcta

SEQ ID NO: 551050 - DNA, 20 bp, mouse
gtaccccaataatgtagata

SEQ ID NO: 551051 - DNA, 20 bp, mouse
gcactgacactggaatttga

SEQ ID NO: 551052 - DNA, 20 bp, mouse
gggaatagcactccgaagta

SEQ ID NO: 551053 - DNA, 20 bp, mouse
gtgaaaagtgataccatagc

SEQ ID NO: 551054 - DNA, 20 bp, mouse
gaatcgtagcatatcgcagg

SEQ ID NO: 551055 - DNA, 20 bp, mouse
gagtgataccatagcaggca

SEQ ID NO: 551056 - DNA, 20 bp, mouse
gtctgaatatcttctaatcc

SEQ ID NO: 551057 - DNA, 20 bp, mouse
gattagaagatattcagatt

SEQ ID NO: 551058 - DNA, 20 bp, mouse
gtaccgtgacagtacagagg

SEQ ID NO: 551059 - DNA, 20 bp, mouse
gggcagtagtggtctatgac

SEQ ID NO: 551060 - DNA, 20 bp, mouse
ggtcctcctctgtactgtca

SEQ ID NO: 551061 - DNA, 20 bp, mouse
ggcagggatgtataatgcag

SEQ ID NO: 551062 - DNA, 20 bp, mouse
ggtcaggcatgcagggaatg

SEQ ID NO: 551063 - DNA, 20 bp, mouse
ggttgagttctataaaagag

SEQ ID NO: 551064 - DNA, 20 bp, mouse
gagggaatgtggcttccaag

SEQ ID NO: 551065 - DNA, 20 bp, mouse
ggtgctggtcatggcagtag

SEQ ID NO: 551066 - DNA, 20 bp, mouse
gtaaggtcaagacaaacagg

SEQ ID NO: 551067 - DNA, 20 bp, mouse
ggtttgtcttgaccttactg

SEQ ID NO: 551068 - DNA, 20 bp, mouse
ggaaatacataggctggtgg

SEQ ID NO: 551069 - DNA, 20 bp, mouse
gtttcatttttctacctggt

SEQ ID NO: 551070 - DNA, 20 bp, mouse
gtttctggtttaatgaacac

SEQ ID NO: 551071 - DNA, 20 bp, mouse
gaaagccatagccaccagga

SEQ ID NO: 551072 - DNA, 20 bp, mouse
gacacccagcttaataacca

SEQ ID NO: 551073 - DNA, 20 bp, mouse
gtttgagtcagccatcctgg

SEQ ID NO: 551074 - DNA, 20 bp, mouse
gattttcagggacgtggaac

SEQ ID NO: 551075 - DNA, 20 bp, mouse
gaataaccatggctgttgtg

SEQ ID NO: 551076 - DNA, 20 bp, mouse
gtacatggtgcacaaaggaa

SEQ ID NO: 551077 - DNA, 20 bp, mouse
gcactgtctcaaggccaggg

SEQ ID NO: 551078 - DNA, 20 bp, mouse
gatacactgtctcaaggcca

SEQ ID NO: 551079 - DNA, 20 bp, mouse
gacatggtgactgtagtaga

SEQ ID NO: 551080 - DNA, 20 bp, mouse
ggtgctggaatgattggagt

SEQ ID NO: 551081 - DNA, 20 bp, mouse
ggccagagaggcaatgtaca

SEQ ID NO: 551082 - DNA, 20 bp, mouse
gaatgaagtgctggaatgat

SEQ ID NO: 551083 - DNA, 20 bp, mouse
gacataggctggtgcaggga

SEQ ID NO: 551084 - DNA, 20 bp, mouse
ggaatgattggagtaggaca

SEQ ID NO: 551085 - DNA, 20 bp, mouse
gccttgagacagtgtatctc

SEQ ID NO: 551086 - DNA, 20 bp, mouse
ggacagagtttatactagaa

SEQ ID NO: 551087 - DNA, 20 bp, mouse
gttgggactgaacatcatca

SEQ ID NO: 551088 - DNA, 20 bp, mouse
gcattagagcgattgtgtag

SEQ ID NO: 551089 - DNA, 20 bp, mouse
gcagggccccacagagctgt

SEQ ID NO: 551090 - DNA, 20 bp, mouse
gctctaagacttctcctgac

SEQ ID NO: 551091 - DNA, 20 bp, mouse
gtgattcctaaggccctgat

SEQ ID NO: 551092 - DNA, 20 bp, mouse
gttcagacactaggccaatc

SEQ ID NO: 551093 - DNA, 20 bp, mouse
gtctgtggggccctggccgt

SEQ ID NO: 551094 - DNA, 20 bp, mouse
gcttctgtggtccttgtctt

SEQ ID NO: 551095 - DNA, 20 bp, mouse
gggaccatacacccacggcc

SEQ ID NO: 551096 - DNA, 20 bp, mouse
gtcctgggccagagaatgat

SEQ ID NO: 551097 - DNA, 20 bp, mouse
gaatgagaagtctccagtcc

SEQ ID NO: 551098 - DNA, 20 bp, mouse
gacaggcaaagggagatgaa

SEQ ID NO: 551099 - DNA, 20 bp, mouse
gttaatggatcttcctggac

SEQ ID NO: 551100 - DNA, 20 bp, mouse
gtcatattaatggatcttcc

SEQ ID NO: 551101 - DNA, 20 bp, mouse
gaggcaatgtagaagctgag

SEQ ID NO: 551102 - DNA, 20 bp, mouse
ggaacgtaaattaagcagat

SEQ ID NO: 551103 - DNA, 20 bp, mouse
gcatccccttaccagtgtta

SEQ ID NO: 551104 - DNA, 20 bp, mouse
gttagaaattgccataacac

SEQ ID NO: 551105 - DNA, 20 bp, mouse
gcgtattggggccattggac

SEQ ID NO: 551106 - DNA, 20 bp, mouse
gacctggaatgcctgtaact

SEQ ID NO: 551107 - DNA, 20 bp, mouse
gtcctcaagaggataggggc

SEQ ID NO: 551108 - DNA, 20 bp, mouse
gacaatagctaaccctatct

SEQ ID NO: 551109 - DNA, 20 bp, mouse
gtgccagataacaattataa

SEQ ID NO: 551110 - DNA, 20 bp, mouse
ggcctgcccctatcctcttg

SEQ ID NO: 551111 - DNA, 20 bp, mouse
ggcaggcacctgcagagtta

SEQ ID NO: 551112 - DNA, 20 bp, mouse
gcactgtgattgccaagata

SEQ ID NO: 551113 - DNA, 20 bp, mouse
gacaggcattccaggtctgg

SEQ ID NO: 551114 - DNA, 20 bp, mouse
gggaatgcctgtaactagga

SEQ ID NO: 551115 - DNA, 20 bp, mouse
gtgtacactgcctccagacc

SEQ ID NO: 551116 - DNA, 20 bp, mouse
gccctggaatgcctgtaacc

SEQ ID NO: 551117 - DNA, 20 bp, mouse
gtcttcaagaggatagggag

SEQ ID NO: 551118 - DNA, 20 bp, mouse
ggtgattgccaagataggct

SEQ ID NO: 551119 - DNA, 20 bp, mouse
gagaggcacctgcacagtta

SEQ ID NO: 551120 - DNA, 20 bp, mouse
gacaatagccaagcctatct

SEQ ID NO: 551121 - DNA, 20 bp, mouse
gggaatgcctgtaaccagga

SEQ ID NO: 551122 - DNA, 20 bp, mouse
gcgccagataacaattatga

SEQ ID NO: 551123 - DNA, 20 bp, mouse
ggtacgaaccttaactgtgc

SEQ ID NO: 551124 - DNA, 20 bp, mouse
gagagagagacccagatcag

SEQ ID NO: 551125 - DNA, 20 bp, mouse
gacaggcattccagggctgg

SEQ ID NO: 551126 - DNA, 20 bp, mouse
gtgtacatcaggctcaggag

SEQ ID NO: 551127 - DNA, 20 bp, mouse
gcagtgaggatgaagacaga

SEQ ID NO: 551128 - DNA, 20 bp, mouse
gtcatcctcactggcctcag

SEQ ID NO: 551129 - DNA, 20 bp, mouse
gtgggtgcccgcctgtggct

SEQ ID NO: 551130 - DNA, 20 bp, mouse
gtcttaagcagtataggcaa

SEQ ID NO: 551131 - DNA, 20 bp, mouse
gggtgatgtacatcaggctc

SEQ ID NO: 551132 - DNA, 20 bp, mouse
gacccatggaagaagatgta

SEQ ID NO: 551133 - DNA, 20 bp, mouse
gcaatgtggtgatgtacatc

SEQ ID NO: 551134 - DNA, 20 bp, mouse
ggtggtattaaattcagaca

SEQ ID NO: 551135 - DNA, 20 bp, mouse
gactcacgagtcaccaggat

SEQ ID NO: 551136 - DNA, 20 bp, mouse
gtgcctgttagaagaagggt

SEQ ID NO: 551137 - DNA, 20 bp, mouse
gctgttagaagaagggtagg

SEQ ID NO: 551138 - DNA, 20 bp, mouse
gtaggtacatgacacatagt

SEQ ID NO: 551139 - DNA, 20 bp, mouse
gctgcacatcttctagtcca

SEQ ID NO: 551140 - DNA, 20 bp, mouse
gagggatgcctgttagaaga

SEQ ID NO: 551141 - DNA, 20 bp, mouse
gtgttggcagctacagatgt

SEQ ID NO: 551142 - DNA, 20 bp, mouse
gactagaagatgtgcagata

SEQ ID NO: 551143 - DNA, 20 bp, mouse
gtagaagaagggtaggtggc

SEQ ID NO: 551144 - DNA, 20 bp, mouse
gtgtagctgccaacatagat

SEQ ID NO: 551145 - DNA, 20 bp, mouse
gtatgtattgaggctcatga

SEQ ID NO: 551146 - DNA, 20 bp, mouse
gacattggtgtaatttaaag

SEQ ID NO: 551147 - DNA, 20 bp, mouse
gtcttctggtttagagctgg

SEQ ID NO: 551148 - DNA, 20 bp, mouse
gactagaatatgcacacata

SEQ ID NO: 551149 - DNA, 20 bp, mouse
gcaatcttctggtttagagc

SEQ ID NO: 551150 - DNA, 20 bp, mouse
gctagtaggcaaaataagca

SEQ ID NO: 551151 - DNA, 20 bp, mouse
gcatctggtataccatgatt

SEQ ID NO: 551152 - DNA, 20 bp, mouse
gaatgccatagctagcagta

SEQ ID NO: 551153 - DNA, 20 bp, mouse
gcaccaatgtcagagacatc

SEQ ID NO: 551154 - DNA, 20 bp, mouse
gtaccagatgtctctgacat

SEQ ID NO: 551155 - DNA, 20 bp, mouse
gagcgagtgccaacatagac

SEQ ID NO: 551156 - DNA, 20 bp, mouse
gggtgtaccaaatgtctcta

SEQ ID NO: 551157 - DNA, 20 bp, mouse
gatatcagcaagggccaaca

SEQ ID NO: 551158 - DNA, 20 bp, mouse
gcaccaaccttagagacatt

SEQ ID NO: 551159 - DNA, 20 bp, mouse
gtaccaaatgtctctaaggt

SEQ ID NO: 551160 - DNA, 20 bp, mouse
gattagaagatgcacacgtt

SEQ ID NO: 551161 - DNA, 20 bp, mouse
gcgtgtgcatcttctaatcc

SEQ ID NO: 551162 - DNA, 20 bp, mouse
gaagatcagaaatattaata

SEQ ID NO: 551163 - DNA, 20 bp, mouse
gccagcttgaaaccaaaaga

SEQ ID NO: 551164 - DNA, 20 bp, mouse
gtgtacatagtggccctaat

SEQ ID NO: 551165 - DNA, 20 bp, mouse
gcattctgcagattactgaa

SEQ ID NO: 551166 - DNA, 20 bp, mouse
gcaagagtcatggttatctt

SEQ ID NO: 551167 - DNA, 20 bp, mouse
gtggaaagaatcaagagtca

SEQ ID NO: 551168 - DNA, 20 bp, mouse
gggccagggccaacatagtt

SEQ ID NO: 551169 - DNA, 20 bp, mouse
gtatatacatagaaaagatg

SEQ ID NO: 551170 - DNA, 20 bp, mouse
gtccacagtgaccattccaa

SEQ ID NO: 551171 - DNA, 20 bp, mouse
gtaccagatgtctctgagaa

SEQ ID NO: 551172 - DNA, 20 bp, mouse
gtctggtatactactctcca

SEQ ID NO: 551173 - DNA, 20 bp, mouse
ggacaagaagatatcggcca

SEQ ID NO: 551174 - DNA, 20 bp, mouse
gacctttggaatggtcactg

SEQ ID NO: 551175 - DNA, 20 bp, mouse
gcatctggtacactatgatt

SEQ ID NO: 551176 - DNA, 20 bp, mouse
gaaactcggtaagagagctg

SEQ ID NO: 551177 - DNA, 20 bp, mouse
gctagtaacacacagataaa

SEQ ID NO: 551178 - DNA, 20 bp, mouse
ggttactagagaatcctaga

SEQ ID NO: 551179 - DNA, 20 bp, mouse
gaaggatgcaggacttcctc

SEQ ID NO: 551180 - DNA, 20 bp, mouse
gagcccattgcctaggaggg

SEQ ID NO: 551181 - DNA, 20 bp, mouse
gtctacctcaccaccctcct

SEQ ID NO: 551182 - DNA, 20 bp, mouse
gcagaatggataagacactg

SEQ ID NO: 551183 - DNA, 20 bp, mouse
gacacatccaacataggata

SEQ ID NO: 551184 - DNA, 20 bp, mouse
gatgagcccattgcctagga

SEQ ID NO: 551185 - DNA, 20 bp, mouse
gtgcaatcatggcctatgat

SEQ ID NO: 551186 - DNA, 20 bp, mouse
ggtaataaatttctaaacca

SEQ ID NO: 551187 - DNA, 20 bp, mouse
gcacaaactacactagttct

SEQ ID NO: 551188 - DNA, 20 bp, mouse
ggttctaggtttgctctgac

SEQ ID NO: 551189 - DNA, 20 bp, mouse
gtcacatagattataaagaa

SEQ ID NO: 551190 - DNA, 20 bp, mouse
gcccattaccgtgtgcacag

SEQ ID NO: 551191 - DNA, 20 bp, mouse
gtctatgtgacggtgttcct

SEQ ID NO: 551192 - DNA, 20 bp, mouse
ggtgttcctgggaaattgta

SEQ ID NO: 551193 - DNA, 20 bp, mouse
gcggtaatgggtatcctttg

SEQ ID NO: 551194 - DNA, 20 bp, mouse
gtatggtacttcatgtgatt

SEQ ID NO: 551195 - DNA, 20 bp, mouse
gaagtaccatacaatttccc

SEQ ID NO: 551196 - DNA, 20 bp, mouse
gttcaagtgaacctggacca

SEQ ID NO: 551197 - DNA, 20 bp, mouse
gtgtttggtagaaaatacca

SEQ ID NO: 551198 - DNA, 20 bp, mouse
gagcattgtaagttcttcca

SEQ ID NO: 551199 - DNA, 20 bp, mouse
gcagcagggtcaggacaaac

SEQ ID NO: 551200 - DNA, 20 bp, mouse
ggtttatagaatattaccct

SEQ ID NO: 551201 - DNA, 20 bp, mouse
gatccaacttgctgtatgtt

SEQ ID NO: 551202 - DNA, 20 bp, mouse
gtaccaaacatacagcaagt

SEQ ID NO: 551203 - DNA, 20 bp, mouse
gagaatgttcactgttggat

SEQ ID NO: 551204 - DNA, 20 bp, mouse
ggtaagttcttccatggtcc

SEQ ID NO: 551205 - DNA, 20 bp, mouse
gcttctggtttgatgcacac

SEQ ID NO: 551206 - DNA, 20 bp, mouse
gcccctcagataaaatgata

SEQ ID NO: 551207 - DNA, 20 bp, mouse
gcttcacaaggcaaacccta

SEQ ID NO: 551208 - DNA, 20 bp, mouse
ggatagggaacagttcctta

SEQ ID NO: 551209 - DNA, 20 bp, mouse
gaggtgttgagccaaattac

SEQ ID NO: 551210 - DNA, 20 bp, mouse
ggaagatgctaccagctgtg

SEQ ID NO: 551211 - DNA, 20 bp, mouse
gatctgcaatgcctgtaatt

SEQ ID NO: 551212 - DNA, 20 bp, mouse
ggagaaactatggataaaat

SEQ ID NO: 551213 - DNA, 20 bp, mouse
gttaatatcagtaaggatgg

SEQ ID NO: 551214 - DNA, 20 bp, mouse
gcctatatcttcatattgct

SEQ ID NO: 551215 - DNA, 20 bp, mouse
gaccttaatatcagtaagga

SEQ ID NO: 551216 - DNA, 20 bp, mouse
gcacggtgctgggaattctt

SEQ ID NO: 551217 - DNA, 20 bp, mouse
ggtaatttaagaacttcagg

SEQ ID NO: 551218 - DNA, 20 bp, mouse
ggcagtaatttaagaacttc

SEQ ID NO: 551219 - DNA, 20 bp, mouse
gcctctagatttgttcttac

SEQ ID NO: 551220 - DNA, 20 bp, mouse
gcttactggatttcctggcc

SEQ ID NO: 551221 - DNA, 20 bp, mouse
ggacatggcgaggaggacag

SEQ ID NO: 551222 - DNA, 20 bp, mouse
gaaagaagtagtagacttcc

SEQ ID NO: 551223 - DNA, 20 bp, mouse
gctccatgaaggacaaacca

SEQ ID NO: 551224 - DNA, 20 bp, mouse
gttgttcttactggatttcc

SEQ ID NO: 551225 - DNA, 20 bp, mouse
gctactgtgcacacggtgct

SEQ ID NO: 551226 - DNA, 20 bp, mouse
gtaccaatgtcagagatatc

SEQ ID NO: 551227 - DNA, 20 bp, mouse
gattggaagaatcacacata

SEQ ID NO: 551228 - DNA, 20 bp, mouse
gtattttgcctactagttct

SEQ ID NO: 551229 - DNA, 20 bp, mouse
gaaaagagatgcctgcagct

SEQ ID NO: 551230 - DNA, 20 bp, mouse
ggcagaatctgcaatactgc

SEQ ID NO: 551231 - DNA, 20 bp, mouse
gtgtgtgattcttccaatcc

SEQ ID NO: 551232 - DNA, 20 bp, mouse
gatgattgggatcccaggat

SEQ ID NO: 551233 - DNA, 20 bp, mouse
gtaccagatatctctgacat

SEQ ID NO: 551234 - DNA, 20 bp, mouse
gtgccaacatagacaggaat

SEQ ID NO: 551235 - DNA, 20 bp, mouse
gagcaagtgccaacatagac

SEQ ID NO: 551236 - DNA, 20 bp, mouse
gccttccagggtattgaatc

SEQ ID NO: 551237 - DNA, 20 bp, mouse
gggctgattcacaccttcca

SEQ ID NO: 551238 - DNA, 20 bp, mouse
ggatgcctgattcaataccc

SEQ ID NO: 551239 - DNA, 20 bp, mouse
gagccacatctgtaagaggc

SEQ ID NO: 551240 - DNA, 20 bp, mouse
gaaaaatgctagggatattc

SEQ ID NO: 551241 - DNA, 20 bp, mouse
gcctagcatttttggtaaga

SEQ ID NO: 551242 - DNA, 20 bp, mouse
gtccaagcattgctagaaag

SEQ ID NO: 551243 - DNA, 20 bp, mouse
gagcactgaaggcctgaaga

SEQ ID NO: 551244 - DNA, 20 bp, mouse
gcagtcagagtcagcactga

SEQ ID NO: 551245 - DNA, 20 bp, mouse
gtgactctgactgggattcc

SEQ ID NO: 551246 - DNA, 20 bp, mouse
ggcctgccatattaaaacta

SEQ ID NO: 551247 - DNA, 20 bp, mouse
gttgcacttgcaacatctct

SEQ ID NO: 551248 - DNA, 20 bp, mouse
gaagtgcaagtttaataata

SEQ ID NO: 551249 - DNA, 20 bp, mouse
gcttctggtttgatgaacat

SEQ ID NO: 551250 - DNA, 20 bp, mouse
gatcttcagagctgtagaac

SEQ ID NO: 551251 - DNA, 20 bp, mouse
gtccctagttttaatatggc

SEQ ID NO: 551252 - DNA, 20 bp, mouse
ggattgatgtatagtgcagt

SEQ ID NO: 551253 - DNA, 20 bp, mouse
gtgcaaacagaagacagaca

SEQ ID NO: 551254 - DNA, 20 bp, mouse
gctccagcttgacagtagta

SEQ ID NO: 551255 - DNA, 20 bp, mouse
gatccttactactgtcaagc

SEQ ID NO: 551256 - DNA, 20 bp, mouse
gtggtgctgtagttctgacc

SEQ ID NO: 551257 - DNA, 20 bp, mouse
gaagaggataaattctgata

SEQ ID NO: 551258 - DNA, 20 bp, mouse
gctggggaacctggtcatca

SEQ ID NO: 551259 - DNA, 20 bp, mouse
ggcatgtcagacagcattcg

SEQ ID NO: 551260 - DNA, 20 bp, mouse
gcccatgaccacgagcagga

SEQ ID NO: 551261 - DNA, 20 bp, mouse
gataaatgtgatggatcgat

SEQ ID NO: 551262 - DNA, 20 bp, mouse
gtgcatgataatgcaggggg

SEQ ID NO: 551263 - DNA, 20 bp, mouse
gcacaagccgagcacaacct

SEQ ID NO: 551264 - DNA, 20 bp, mouse
gctgtagttctgaccgggca

SEQ ID NO: 551265 - DNA, 20 bp, mouse
gaatgtgatggatcgatggg

SEQ ID NO: 551266 - DNA, 20 bp, mouse
gatgctgagaagcaaaaggg

SEQ ID NO: 551267 - DNA, 20 bp, mouse
gtagattcatcctttataga

SEQ ID NO: 551268 - DNA, 20 bp, mouse
gaaagttgttccctctataa

SEQ ID NO: 551269 - DNA, 20 bp, mouse
gtctacaaagtatgtgagat

SEQ ID NO: 551270 - DNA, 20 bp, mouse
gtctaactctgaaagtaagc

SEQ ID NO: 551271 - DNA, 20 bp, mouse
ggattgggagaaagataaat

SEQ ID NO: 551272 - DNA, 20 bp, mouse
gtgggagaaagataaatggg

SEQ ID NO: 551273 - DNA, 20 bp, mouse
gggaggatataagaaaacac

SEQ ID NO: 551274 - DNA, 20 bp, mouse
gacagagacacagatagaga

SEQ ID NO: 551275 - DNA, 20 bp, mouse
gtgaaacaaacagatagata

SEQ ID NO: 551276 - DNA, 20 bp, mouse
ggctctatcagtaatcccaa

SEQ ID NO: 551277 - DNA, 20 bp, mouse
gcatattagggaataactgt

SEQ ID NO: 551278 - DNA, 20 bp, mouse
gcctgtgaggtagaatgtag

SEQ ID NO: 551279 - DNA, 20 bp, mouse
gagttattccctaatatggg

SEQ ID NO: 551280 - DNA, 20 bp, mouse
ggtgaatgcctcccatatta

SEQ ID NO: 551281 - DNA, 20 bp, mouse
gcatgggctcgtggagtcta

SEQ ID NO: 551282 - DNA, 20 bp, mouse
gtagggaataactgtgggat

SEQ ID NO: 551283 - DNA, 20 bp, mouse
gggagtttgaggttgccatt

SEQ ID NO: 551284 - DNA, 20 bp, mouse
gacaatggtgctggagtttg

SEQ ID NO: 551285 - DNA, 20 bp, mouse
gtgttattccaacaaggtaa

SEQ ID NO: 551286 - DNA, 20 bp, mouse
gccactccaagagaagatag

SEQ ID NO: 551287 - DNA, 20 bp, mouse
gtggctgcaaagtcagggag

SEQ ID NO: 551288 - DNA, 20 bp, mouse
gcaaactgctctgacttcat

SEQ ID NO: 551289 - DNA, 20 bp, mouse
gccagaatggctgcaaagtc

SEQ ID NO: 551290 - DNA, 20 bp, mouse
ggtggtagagagacctagaa

SEQ ID NO: 551291 - DNA, 20 bp, mouse
ggtagagagacctagaaggg

SEQ ID NO: 551292 - DNA, 20 bp, mouse
gtcgggaagaagctcaaatt

SEQ ID NO: 551293 - DNA, 20 bp, mouse
gctgaggacatcagaagtag

SEQ ID NO: 551294 - DNA, 20 bp, mouse
ggagaagggcctgatatcat

SEQ ID NO: 551295 - DNA, 20 bp, mouse
gaaggtcactcaaacatgtc

SEQ ID NO: 551296 - DNA, 20 bp, mouse
ggccactgaggtagaacata

SEQ ID NO: 551297 - DNA, 20 bp, mouse
ggccctatgttctacctcag

SEQ ID NO: 551298 - DNA, 20 bp, mouse
gggaggagtacctcagtggg

SEQ ID NO: 551299 - DNA, 20 bp, mouse
gaccgttcagagggtaatga

SEQ ID NO: 551300 - DNA, 20 bp, mouse
gccccctgaggatgacacat

SEQ ID NO: 551301 - DNA, 20 bp, mouse
gtaatggaggagtacctcag

SEQ ID NO: 551302 - DNA, 20 bp, mouse
ggttcaaaggcttccaaacc

SEQ ID NO: 551303 - DNA, 20 bp, mouse
ggggctaaaatgagtaatgt

SEQ ID NO: 551304 - DNA, 20 bp, mouse
ggtgtctaccttgcccacca

SEQ ID NO: 551305 - DNA, 20 bp, mouse
gaaaaaatacccaccatggt

SEQ ID NO: 551306 - DNA, 20 bp, mouse
gagctgaagttggcacgtgg

SEQ ID NO: 551307 - DNA, 20 bp, mouse
gaatatagcgtagctgaagt

SEQ ID NO: 551308 - DNA, 20 bp, mouse
gcattccagacctgggaagc

SEQ ID NO: 551309 - DNA, 20 bp, mouse
gatgagcccattccagacct

SEQ ID NO: 551310 - DNA, 20 bp, mouse
gtcttggccgtgacagacct

SEQ ID NO: 551311 - DNA, 20 bp, mouse
gggcaccagacccaccatcc

SEQ ID NO: 551312 - DNA, 20 bp, mouse
gtctggaatgggctcatcat

SEQ ID NO: 551313 - DNA, 20 bp, mouse
gcgtagctgaagttggcacg

SEQ ID NO: 551314 - DNA, 20 bp, mouse
gcataagcccaggtctgtca

SEQ ID NO: 551315 - DNA, 20 bp, mouse
gatcaggctcttgaaaatga

SEQ ID NO: 551316 - DNA, 20 bp, mouse
ggaatgggaagatcagccaa

SEQ ID NO: 551317 - DNA, 20 bp, mouse
ggtaccatgcttccagacca

SEQ ID NO: 551318 - DNA, 20 bp, mouse
gtctggaagcatggtaccct

SEQ ID NO: 551319 - DNA, 20 bp, mouse
gtggccaggaacaagaacat

SEQ ID NO: 551320 - DNA, 20 bp, mouse
gcggtcagcaggaagtattt

SEQ ID NO: 551321 - DNA, 20 bp, mouse
gcggggcagagtcaggatgg

SEQ ID NO: 551322 - DNA, 20 bp, mouse
gcatatactataggcatcat

SEQ ID NO: 551323 - DNA, 20 bp, mouse
gggatggcggtgtatcggag

SEQ ID NO: 551324 - DNA, 20 bp, mouse
gaccagggaaaccggtcagc

SEQ ID NO: 551325 - DNA, 20 bp, mouse
ggagacaccaagctcggaga

SEQ ID NO: 551326 - DNA, 20 bp, mouse
ggatggctctgtgcggataa

SEQ ID NO: 551327 - DNA, 20 bp, mouse
gctctgtgcggataacggtt

SEQ ID NO: 551328 - DNA, 20 bp, mouse
gcccatggaggaagaagaac

SEQ ID NO: 551329 - DNA, 20 bp, mouse
gtacagtcatgcagctcctt

SEQ ID NO: 551330 - DNA, 20 bp, mouse
ggtgcggataacggttagga

SEQ ID NO: 551331 - DNA, 20 bp, mouse
gaagaagaactgggcaaaac

SEQ ID NO: 551332 - DNA, 20 bp, mouse
gggcctcaaagctgatttct

SEQ ID NO: 551333 - DNA, 20 bp, mouse
gaagtagaaaggatcatgag

SEQ ID NO: 551334 - DNA, 20 bp, mouse
gtagaggcagaataagggaa

SEQ ID NO: 551335 - DNA, 20 bp, mouse
gtggtgtagaggcagaataa

SEQ ID NO: 551336 - DNA, 20 bp, mouse
gggtgaggatgaagtagaaa

SEQ ID NO: 551337 - DNA, 20 bp, mouse
gtacagtcatgcaggtcctc

SEQ ID NO: 551338 - DNA, 20 bp, mouse
gctctgtgcggatgacagtt

SEQ ID NO: 551339 - DNA, 20 bp, mouse
ggtgcggatgacagttagga

SEQ ID NO: 551340 - DNA, 20 bp, mouse
gacactccctacagtcatgc

SEQ ID NO: 551341 - DNA, 20 bp, mouse
gtttgaggcctgctttgcac

SEQ ID NO: 551342 - DNA, 20 bp, mouse
gaagtagaaagggccatgag

SEQ ID NO: 551343 - DNA, 20 bp, mouse
gaagtaactaacaccactca

SEQ ID NO: 551344 - DNA, 20 bp, mouse
gggtgtagaggcagaagaag

SEQ ID NO: 551345 - DNA, 20 bp, mouse
gtagaggcagaagaagggga

SEQ ID NO: 551346 - DNA, 20 bp, mouse
gcaggactggaggcccaaca

SEQ ID NO: 551347 - DNA, 20 bp, mouse
gcagtcctggaatgccagtt

SEQ ID NO: 551348 - DNA, 20 bp, mouse
ggccagttaggaagattgat

SEQ ID NO: 551349 - DNA, 20 bp, mouse
gagttaggaagattgatagg

SEQ ID NO: 551350 - DNA, 20 bp, mouse
gtctctacggttggtgtcat

SEQ ID NO: 551351 - DNA, 20 bp, mouse
gtgctggccatcaccgaggt

SEQ ID NO: 551352 - DNA, 20 bp, mouse
gattaggctgttgcccacaa

SEQ ID NO: 551353 - DNA, 20 bp, mouse
gaatggagagccagccatgt

SEQ ID NO: 551354 - DNA, 20 bp, mouse
gcaatgtacatgatgaaaaa

SEQ ID NO: 551355 - DNA, 20 bp, mouse
ggagactcccacctcggtga

SEQ ID NO: 551356 - DNA, 20 bp, mouse
gtactcagcaacaagactat

SEQ ID NO: 551357 - DNA, 20 bp, mouse
ggtccttcaccagtccagat

SEQ ID NO: 551358 - DNA, 20 bp, mouse
gtagaagaacctatctggac

SEQ ID NO: 551359 - DNA, 20 bp, mouse
gtctcttagaagaacctatc

SEQ ID NO: 551360 - DNA, 20 bp, mouse
gcatctcacagatgtaaggg

SEQ ID NO: 551361 - DNA, 20 bp, mouse
gaagtccagggatagaaata

SEQ ID NO: 551362 - DNA, 20 bp, mouse
gtgtgtgagggttccatgag

SEQ ID NO: 551363 - DNA, 20 bp, mouse
gccacatctcacagatgtaa

SEQ ID NO: 551364 - DNA, 20 bp, mouse
gctcacagatgtaagggagg

SEQ ID NO: 551365 - DNA, 20 bp, mouse
gagaaacacacagcacactt

SEQ ID NO: 551366 - DNA, 20 bp, mouse
gacagctgacaggcattcct

SEQ ID NO: 551367 - DNA, 20 bp, mouse
gctaccatgctaggcttgaa

SEQ ID NO: 551368 - DNA, 20 bp, mouse
ggcattcctgggatgaacac

SEQ ID NO: 551369 - DNA, 20 bp, mouse
gcagccacactacagctgac

SEQ ID NO: 551370 - DNA, 20 bp, mouse
gatgcctgtcagctgtagtg

SEQ ID NO: 551371 - DNA, 20 bp, mouse
gcttggcctgtgttcatccc

SEQ ID NO: 551372 - DNA, 20 bp, mouse
gagaaggtagcaagtacggt

SEQ ID NO: 551373 - DNA, 20 bp, mouse
gaaacagaaggtagcaagta

SEQ ID NO: 551374 - DNA, 20 bp, mouse
gcggctattggtaagcacag

SEQ ID NO: 551375 - DNA, 20 bp, mouse
gtacggtaggaagtgtagat

SEQ ID NO: 551376 - DNA, 20 bp, mouse
ggtggaggctctccagacca

SEQ ID NO: 551377 - DNA, 20 bp, mouse
gcagaccagggataccagtc

SEQ ID NO: 551378 - DNA, 20 bp, mouse
ggggataccagtcaggagaa

SEQ ID NO: 551379 - DNA, 20 bp, mouse
ggagagcctccacccctggc

SEQ ID NO: 551380 - DNA, 20 bp, mouse
gtctggagagcctccacccc

SEQ ID NO: 551381 - DNA, 20 bp, mouse
gtcctgggttccccctgtga

SEQ ID NO: 551382 - DNA, 20 bp, mouse
gtgaacagcgccatcacagg

SEQ ID NO: 551383 - DNA, 20 bp, mouse
ggtatttgccccgagggcca

SEQ ID NO: 551384 - DNA, 20 bp, mouse
gggcagtgtggccattgaca

SEQ ID NO: 551385 - DNA, 20 bp, mouse
gcacggcatacatcacacaa

SEQ ID NO: 551386 - DNA, 20 bp, mouse
gcagagtctggagcactggc

SEQ ID NO: 551387 - DNA, 20 bp, mouse
gatgcccgtgtggcccacat

SEQ ID NO: 551388 - DNA, 20 bp, mouse
gatacccatgtgggccacac

SEQ ID NO: 551389 - DNA, 20 bp, mouse
gtgtagaaaaagacactccc

SEQ ID NO: 551390 - DNA, 20 bp, mouse
ggttctcatgagggttgctg

SEQ ID NO: 551391 - DNA, 20 bp, mouse
gatgaagcttaaggtgcttg

SEQ ID NO: 551392 - DNA, 20 bp, mouse
gagcatcgaaggcagtctct

SEQ ID NO: 551393 - DNA, 20 bp, mouse
gactgtacaaggttctcatg

SEQ ID NO: 551394 - DNA, 20 bp, mouse
gacagagtctgggattctac

SEQ ID NO: 551395 - DNA, 20 bp, mouse
gtgtatgttatctccatagt

SEQ ID NO: 551396 - DNA, 20 bp, mouse
gtaagaagaagttccagaat

SEQ ID NO: 551397 - DNA, 20 bp, mouse
gcactatagaaacagtgtag

SEQ ID NO: 551398 - DNA, 20 bp, mouse
gtgtagagaaagatacaccc

SEQ ID NO: 551399 - DNA, 20 bp, mouse
gctgctgtcactcaatgacc

SEQ ID NO: 551400 - DNA, 20 bp, mouse
ggcactgtggaatagtgcag

SEQ ID NO: 551401 - DNA, 20 bp, mouse
gaaaactgatctctcttaag

SEQ ID NO: 551402 - DNA, 20 bp, mouse
gatggagtctgggattctct

SEQ ID NO: 551403 - DNA, 20 bp, mouse
gttcctccttgatgatgaac

SEQ ID NO: 551404 - DNA, 20 bp, mouse
gctacactgaccacagtctt

SEQ ID NO: 551405 - DNA, 20 bp, mouse
ggtagaggacaccaagaagc

SEQ ID NO: 551406 - DNA, 20 bp, mouse
ggacgctgtaaagaacacca

SEQ ID NO: 551407 - DNA, 20 bp, mouse
gcatctaaggagttccagaa

SEQ ID NO: 551408 - DNA, 20 bp, mouse
gcatcttgacaggactgcca

SEQ ID NO: 551409 - DNA, 20 bp, mouse
gtgctgtcaggaaatgacct

SEQ ID NO: 551410 - DNA, 20 bp, mouse
ggtactgtggaatagcgcag

SEQ ID NO: 551411 - DNA, 20 bp, mouse
gtccacactgcctacagttc

SEQ ID NO: 551412 - DNA, 20 bp, mouse
gtttacagcgtctccatagt

SEQ ID NO: 551413 - DNA, 20 bp, mouse
gctggaactccttagatgct

SEQ ID NO: 551414 - DNA, 20 bp, mouse
gaaaacactcccagaactgt

SEQ ID NO: 551415 - DNA, 20 bp, mouse
ggtaaagaacaccaaggagc

SEQ ID NO: 551416 - DNA, 20 bp, mouse
gagcacgtgtccaatactgt

SEQ ID NO: 551417 - DNA, 20 bp, mouse
gctgccgcctttccttccat

SEQ ID NO: 551418 - DNA, 20 bp, mouse
gataggaataccaacagtat

SEQ ID NO: 551419 - DNA, 20 bp, mouse
gggtattcctatggaaggaa

SEQ ID NO: 551420 - DNA, 20 bp, mouse
gataaagctgggaacctgag

SEQ ID NO: 551421 - DNA, 20 bp, mouse
ggagtttcctatgatggata

SEQ ID NO: 551422 - DNA, 20 bp, mouse
gaatggaagccatggaaccc

SEQ ID NO: 551423 - DNA, 20 bp, mouse
gactcgggcatggaagcaaa

SEQ ID NO: 551424 - DNA, 20 bp, mouse
ggcattaaagttgatcactc

SEQ ID NO: 551425 - DNA, 20 bp, mouse
gagcctgtaagaataaagct

SEQ ID NO: 551426 - DNA, 20 bp, mouse
ggggatggcaatccagaggt

SEQ ID NO: 551427 - DNA, 20 bp, mouse
gcagttaggaagagagtgac

SEQ ID NO: 551428 - DNA, 20 bp, mouse
gtcttcctaactgggatccc

SEQ ID NO: 551429 - DNA, 20 bp, mouse
ggccatggcaaggagaaccg

SEQ ID NO: 551430 - DNA, 20 bp, mouse
gggtgggcgaactccagccc

SEQ ID NO: 551431 - DNA, 20 bp, mouse
ggctggagttcgcccacctc

SEQ ID NO: 551432 - DNA, 20 bp, mouse
gtgggcgaggcatccaccaa

SEQ ID NO: 551433 - DNA, 20 bp, mouse
ggagtggacacaaaacatct

SEQ ID NO: 551434 - DNA, 20 bp, mouse
gttagaatggagccatagaa

SEQ ID NO: 551435 - DNA, 20 bp, mouse
gggagacaatagccacacta

SEQ ID NO: 551436 - DNA, 20 bp, mouse
ggcctgggatccccaccaaa

SEQ ID NO: 551437 - DNA, 20 bp, mouse
ggtggaagtgctccaagcct

SEQ ID NO: 551438 - DNA, 20 bp, mouse
gtgatgtagatcacacagaa

SEQ ID NO: 551439 - DNA, 20 bp, mouse
gtgtgagcagttacaacccg

SEQ ID NO: 551440 - DNA, 20 bp, mouse
gccaccaaaaggaaaggccc

SEQ ID NO: 551441 - DNA, 20 bp, mouse
ggggaatgccaatccacacg

SEQ ID NO: 551442 - DNA, 20 bp, mouse
gagcacttccacgtgtggat

SEQ ID NO: 551443 - DNA, 20 bp, mouse
gtaggacaaagctatagtgg

SEQ ID NO: 551444 - DNA, 20 bp, mouse
gaacccggggcctttccttt

SEQ ID NO: 551445 - DNA, 20 bp, mouse
gagatagtagcatatctcaa

SEQ ID NO: 551446 - DNA, 20 bp, mouse
ggatgcccgagagagtgaag

SEQ ID NO: 551447 - DNA, 20 bp, mouse
gctggccccttcactctctc

SEQ ID NO: 551448 - DNA, 20 bp, mouse
gtcactctctcgggcatccc

SEQ ID NO: 551449 - DNA, 20 bp, mouse
gcatggtactgctcaagtcc

SEQ ID NO: 551450 - DNA, 20 bp, mouse
ggaatagtggtatacctcaa

SEQ ID NO: 551451 - DNA, 20 bp, mouse
gtctatctcgtggccatcct

SEQ ID NO: 551452 - DNA, 20 bp, mouse
gacaggtggtagacaatatg

SEQ ID NO: 551453 - DNA, 20 bp, mouse
gacttgagcagtaccatgtc

SEQ ID NO: 551454 - DNA, 20 bp, mouse
gattattcttcagatctcaa

SEQ ID NO: 551455 - DNA, 20 bp, mouse
gaggtcagtcatggccaaca

SEQ ID NO: 551456 - DNA, 20 bp, mouse
ggaggtgttgggtttggacc

SEQ ID NO: 551457 - DNA, 20 bp, mouse
gtcctcaagggcctgaggtt

SEQ ID NO: 551458 - DNA, 20 bp, mouse
gaagattggcaaggcaaagt

SEQ ID NO: 551459 - DNA, 20 bp, mouse
gcaaggcaaagttggagtga

SEQ ID NO: 551460 - DNA, 20 bp, mouse
gggctgagggtcagattata

SEQ ID NO: 551461 - DNA, 20 bp, mouse
gcccaaacctcaggcccttg

SEQ ID NO: 551462 - DNA, 20 bp, mouse
gtgaggctgggtagagagtt

SEQ ID NO: 551463 - DNA, 20 bp, mouse
gatagagaaacaatgaggct

SEQ ID NO: 551464 - DNA, 20 bp, mouse
gtagagagtttgggtccaga

SEQ ID NO: 551465 - DNA, 20 bp, mouse
ggactctgaccctagctctg

SEQ ID NO: 551466 - DNA, 20 bp, mouse
gcagcaagtagcatcatcaa

SEQ ID NO: 551467 - DNA, 20 bp, mouse
ggtgccgttgccaagtaata

SEQ ID NO: 551468 - DNA, 20 bp, mouse
gccaagtaatatggagatat

SEQ ID NO: 551469 - DNA, 20 bp, mouse
gagatcaaatatagttcttt

SEQ ID NO: 551470 - DNA, 20 bp, mouse
ggatgatgctacttgctgtg

SEQ ID NO: 551471 - DNA, 20 bp, mouse
ggtctgcaatgccttcaatg

SEQ ID NO: 551472 - DNA, 20 bp, mouse
gaaatgttgagccacattga

SEQ ID NO: 551473 - DNA, 20 bp, mouse
gtgccattcgcaacccacta

SEQ ID NO: 551474 - DNA, 20 bp, mouse
gctccacaatagagagagtg

SEQ ID NO: 551475 - DNA, 20 bp, mouse
gatcattgttattggaaagc

SEQ ID NO: 551476 - DNA, 20 bp, mouse
gggtatgccaacaagagtga

SEQ ID NO: 551477 - DNA, 20 bp, mouse
gtaacagcttaggttataca

SEQ ID NO: 551478 - DNA, 20 bp, mouse
gaggttatacatggcctctg

SEQ ID NO: 551479 - DNA, 20 bp, mouse
gttcttgagcctgaggacaa

SEQ ID NO: 551480 - DNA, 20 bp, mouse
gcagcatccttcactcttgt

SEQ ID NO: 551481 - DNA, 20 bp, mouse
gtctatgttgtggctattgt

SEQ ID NO: 551482 - DNA, 20 bp, mouse
gttcttgggacccaaaccaa

SEQ ID NO: 551483 - DNA, 20 bp, mouse
ggggaatcccaatccagatg

SEQ ID NO: 551484 - DNA, 20 bp, mouse
gaggtctgtgctggccagca

SEQ ID NO: 551485 - DNA, 20 bp, mouse
gtataaacatgggctcgtga

SEQ ID NO: 551486 - DNA, 20 bp, mouse
gccaggaggatgaaaaatcc

SEQ ID NO: 551487 - DNA, 20 bp, mouse
gatgtagccattatggtcat

SEQ ID NO: 551488 - DNA, 20 bp, mouse
gcagccctgggattcccagg

SEQ ID NO: 551489 - DNA, 20 bp, mouse
gatttaacccatgaccataa

SEQ ID NO: 551490 - DNA, 20 bp, mouse
gaggttgaatgtagccatta

SEQ ID NO: 551491 - DNA, 20 bp, mouse
gaatggcatgatagttacag

SEQ ID NO: 551492 - DNA, 20 bp, mouse
gcataaaaatgaggtagagt

SEQ ID NO: 551493 - DNA, 20 bp, mouse
gcaaggtagataataaagaa

SEQ ID NO: 551494 - DNA, 20 bp, mouse
ggggaacacaagtattacac

SEQ ID NO: 551495 - DNA, 20 bp, mouse
gatcttaataacaatctgat

SEQ ID NO: 551496 - DNA, 20 bp, mouse
gcagagagcatcatagtgca

SEQ ID NO: 551497 - DNA, 20 bp, mouse
gggtggaaggcagtttcatt

SEQ ID NO: 551498 - DNA, 20 bp, mouse
gtgagtgaggcagccatggt

SEQ ID NO: 551499 - DNA, 20 bp, mouse
gtatatcattataacagaca

SEQ ID NO: 551500 - DNA, 20 bp, mouse
gatgctgatcctgcatccca

SEQ ID NO: 551501 - DNA, 20 bp, mouse
gtgttttgcttggaatccct

SEQ ID NO: 551502 - DNA, 20 bp, mouse
gattccaagcaaaacaaatg

SEQ ID NO: 551503 - DNA, 20 bp, mouse
gggatggatgtatagtggag

SEQ ID NO: 551504 - DNA, 20 bp, mouse
gaagaccttcttcctaaaag

SEQ ID NO: 551505 - DNA, 20 bp, mouse
gttcatttctaaccactttt

SEQ ID NO: 551506 - DNA, 20 bp, mouse
gccctggtaaagtacctgaa

SEQ ID NO: 551507 - DNA, 20 bp, mouse
gagaagagaagcaggaacat

SEQ ID NO: 551508 - DNA, 20 bp, mouse
gtcagatgcttaagatgggg

SEQ ID NO: 551509 - DNA, 20 bp, mouse
gatcacggtgatgaagtaca

SEQ ID NO: 551510 - DNA, 20 bp, mouse
gttgtgcagggaacgttcca

SEQ ID NO: 551511 - DNA, 20 bp, mouse
gagggaacgttccatggaga

SEQ ID NO: 551512 - DNA, 20 bp, mouse
gatggagatggtgagaagaa

SEQ ID NO: 551513 - DNA, 20 bp, mouse
gggtggctggtgctgttgca

SEQ ID NO: 551514 - DNA, 20 bp, mouse
gcagagcaccttaggaatgg

SEQ ID NO: 551515 - DNA, 20 bp, mouse
gtgctctgcatattctggtt

SEQ ID NO: 551516 - DNA, 20 bp, mouse
ggaaagtcatgaaactggag

SEQ ID NO: 551517 - DNA, 20 bp, mouse
gacagagagccacaagtgtt

SEQ ID NO: 551518 - DNA, 20 bp, mouse
gctcctggccctgctgatgg

SEQ ID NO: 551519 - DNA, 20 bp, mouse
gtaggcgtccaactagagaa

SEQ ID NO: 551520 - DNA, 20 bp, mouse
gagaagaggcacaggacctt

SEQ ID NO: 551521 - DNA, 20 bp, mouse
gggcaagtgccaccagtcct

SEQ ID NO: 551522 - DNA, 20 bp, mouse
gagattaacatgccagaaaa

SEQ ID NO: 551523 - DNA, 20 bp, mouse
gaggataaggatgacaccct

SEQ ID NO: 551524 - DNA, 20 bp, mouse
gtgctcttggccatcctcat

SEQ ID NO: 551525 - DNA, 20 bp, mouse
gtcgatcatcaaaccagaag

SEQ ID NO: 551526 - DNA, 20 bp, mouse
ggatccaagtccgtgtgatt

SEQ ID NO: 551527 - DNA, 20 bp, mouse
ggtgtgattaggagactcca

SEQ ID NO: 551528 - DNA, 20 bp, mouse
gaaggaggcagccaaatcaa

SEQ ID NO: 551529 - DNA, 20 bp, mouse
gaacaccataagccagacca

SEQ ID NO: 551530 - DNA, 20 bp, mouse
gattaggagactccatggtc

SEQ ID NO: 551531 - DNA, 20 bp, mouse
gtggaagtgagagccacata

SEQ ID NO: 551532 - DNA, 20 bp, mouse
gatggaattgctctagacct

SEQ ID NO: 551533 - DNA, 20 bp, mouse
gtctcctaatcacacggact

SEQ ID NO: 551534 - DNA, 20 bp, mouse
gtgggcactgccacaatcgt

SEQ ID NO: 551535 - DNA, 20 bp, mouse
gtgcacaggaagaggtagac

SEQ ID NO: 551536 - DNA, 20 bp, mouse
gaggatgaactcagacacct

SEQ ID NO: 551537 - DNA, 20 bp, mouse
gtgggacttggaactattga

SEQ ID NO: 551538 - DNA, 20 bp, mouse
ggtagagcaaagtaaatggt

SEQ ID NO: 551539 - DNA, 20 bp, mouse
gttaggtatcctctctgtgg

SEQ ID NO: 551540 - DNA, 20 bp, mouse
gaactcagacacctgggact

SEQ ID NO: 551541 - DNA, 20 bp, mouse
ggcccatgtccaccacagag

SEQ ID NO: 551542 - DNA, 20 bp, mouse
gaaaggtagagcaaagtaaa

SEQ ID NO: 551543 - DNA, 20 bp, mouse
ggccatgcagaggaagatac

SEQ ID NO: 551544 - DNA, 20 bp, mouse
gttcttaggtatcctctctg

SEQ ID NO: 551545 - DNA, 20 bp, mouse
gtgctctacctttcagcaat

SEQ ID NO: 551546 - DNA, 20 bp, mouse
ggccatgggactgctcagat

SEQ ID NO: 551547 - DNA, 20 bp, mouse
ggagcccgcggcagtgcaga

SEQ ID NO: 551548 - DNA, 20 bp, mouse
gagtcccatggccatagtgt

SEQ ID NO: 551549 - DNA, 20 bp, mouse
gggcgactggatgcaggtag

SEQ ID NO: 551550 - DNA, 20 bp, mouse
gtgactcagaggtccacctc

SEQ ID NO: 551551 - DNA, 20 bp, mouse
ggcaacgcgggaccctcagc

SEQ ID NO: 551552 - DNA, 20 bp, mouse
gcccggatacatgtgcagca

SEQ ID NO: 551553 - DNA, 20 bp, mouse
gggtgtcactgagaggacgc

SEQ ID NO: 551554 - DNA, 20 bp, mouse
gtgggaccacgcaacgttag

SEQ ID NO: 551555 - DNA, 20 bp, mouse
gtccttgctgcacatgtatc

SEQ ID NO: 551556 - DNA, 20 bp, mouse
gtacatacatagaacagaat

SEQ ID NO: 551557 - DNA, 20 bp, mouse
gcacatgacaaggtctgtaa

SEQ ID NO: 551558 - DNA, 20 bp, mouse
gttcagaataaatgagactg

SEQ ID NO: 551559 - DNA, 20 bp, mouse
gtgaagcactgcacatgaca

SEQ ID NO: 551560 - DNA, 20 bp, mouse
gttcacagcgatggagtctg

SEQ ID NO: 551561 - DNA, 20 bp, mouse
gtgtatgtaatagctgtggt

SEQ ID NO: 551562 - DNA, 20 bp, mouse
gccagatgtgcatttcttcc

SEQ ID NO: 551563 - DNA, 20 bp, mouse
gtagctgtggtaggcaattg

SEQ ID NO: 551564 - DNA, 20 bp, mouse
gacaggattggtgaggatag

SEQ ID NO: 551565 - DNA, 20 bp, mouse
ggatagtggagtagtgcaga

SEQ ID NO: 551566 - DNA, 20 bp, mouse
ggaaagggatagagatccag

SEQ ID NO: 551567 - DNA, 20 bp, mouse
ggcccagaaagcccgtcagt

SEQ ID NO: 551568 - DNA, 20 bp, mouse
ggaaagcccgtcagtaggaa

SEQ ID NO: 551569 - DNA, 20 bp, mouse
gtgctgttgggccacatggt

SEQ ID NO: 551570 - DNA, 20 bp, mouse
gatgctcctttcctactgac

SEQ ID NO: 551571 - DNA, 20 bp, mouse
gaaggagcatcactgctgtt

SEQ ID NO: 551572 - DNA, 20 bp, mouse
gcttggaaatgattcaccac

SEQ ID NO: 551573 - DNA, 20 bp, mouse
gcaactgcgatcccaccatg

SEQ ID NO: 551574 - DNA, 20 bp, mouse
gccagagggagattgcacaa

SEQ ID NO: 551575 - DNA, 20 bp, mouse
ggctagtgagtgaatgaagt

SEQ ID NO: 551576 - DNA, 20 bp, mouse
gttcttgctattgtggacgt

SEQ ID NO: 551577 - DNA, 20 bp, mouse
ggctattgtggacgtgggtc

SEQ ID NO: 551578 - DNA, 20 bp, mouse
gagagctgttggaatctctg

SEQ ID NO: 551579 - DNA, 20 bp, mouse
gtatccacagctggcaacac

SEQ ID NO: 551580 - DNA, 20 bp, mouse
ggagccagtgttgccagctg

SEQ ID NO: 551581 - DNA, 20 bp, mouse
gtgtctgcatggctatagat

SEQ ID NO: 551582 - DNA, 20 bp, mouse
gataagatggctaaaatctt

SEQ ID NO: 551583 - DNA, 20 bp, mouse
gtcattctcatgggatttcc

SEQ ID NO: 551584 - DNA, 20 bp, mouse
gctattgaagagtatctcag

SEQ ID NO: 551585 - DNA, 20 bp, mouse
gagcaagaatgcccaggaaa

SEQ ID NO: 551586 - DNA, 20 bp, mouse
gtgaggtacataatgaagaa

SEQ ID NO: 551587 - DNA, 20 bp, mouse
gtattctcaatgggattcct

SEQ ID NO: 551588 - DNA, 20 bp, mouse
gggctggaggtattgacccc

SEQ ID NO: 551589 - DNA, 20 bp, mouse
gtgtgtgcagcttccaaccc

SEQ ID NO: 551590 - DNA, 20 bp, mouse
ggaggtattgaccccaggca

SEQ ID NO: 551591 - DNA, 20 bp, mouse
gcattgagaataaagtatct

SEQ ID NO: 551592 - DNA, 20 bp, mouse
ggttacctgtgacagcaatg

SEQ ID NO: 551593 - DNA, 20 bp, mouse
gtctactgatcaccatgcct

SEQ ID NO: 551594 - DNA, 20 bp, mouse
ggttggaagctgcacacatc

SEQ ID NO: 551595 - DNA, 20 bp, mouse
gaaagatgcataacatactg

SEQ ID NO: 551596 - DNA, 20 bp, mouse
gataatgactggcacgatga

SEQ ID NO: 551597 - DNA, 20 bp, mouse
gggcactgtggttgtacaca

SEQ ID NO: 551598 - DNA, 20 bp, mouse
gctccattccagtcaacatg

SEQ ID NO: 551599 - DNA, 20 bp, mouse
gtctttgtccacatgttgac

SEQ ID NO: 551600 - DNA, 20 bp, mouse
ggataaagaattctggagtc

SEQ ID NO: 551601 - DNA, 20 bp, mouse
ggacaaagaacatctggaca

SEQ ID NO: 551602 - DNA, 20 bp, mouse
gagtgaaggaaagtaaagcc

SEQ ID NO: 551603 - DNA, 20 bp, mouse
gcatgtggacaaagaacatc

SEQ ID NO: 551604 - DNA, 20 bp, mouse
gtggtcttgcaacattctta

SEQ ID NO: 551605 - DNA, 20 bp, mouse
gcacaaggtgacatcagtga

SEQ ID NO: 551606 - DNA, 20 bp, mouse
gtatactgaatggtatccgt

SEQ ID NO: 551607 - DNA, 20 bp, mouse
gagcatattgggtacagtag

SEQ ID NO: 551608 - DNA, 20 bp, mouse
gatatcagtgaaggagagca

SEQ ID NO: 551609 - DNA, 20 bp, mouse
gcataaggttatatcagtga

SEQ ID NO: 551610 - DNA, 20 bp, mouse
gccttcacagcaacagagtc

SEQ ID NO: 551611 - DNA, 20 bp, mouse
gctgaatggtatccgtgggc

SEQ ID NO: 551612 - DNA, 20 bp, mouse
gatgtgcatcttccagccca

SEQ ID NO: 551613 - DNA, 20 bp, mouse
gggtacagtagtggtacata

SEQ ID NO: 551614 - DNA, 20 bp, mouse
gtttaaatccaatcttcttg

SEQ ID NO: 551615 - DNA, 20 bp, mouse
gtagtcttgctactttcttg

SEQ ID NO: 551616 - DNA, 20 bp, mouse
gggggtcaagctggagctat

SEQ ID NO: 551617 - DNA, 20 bp, mouse
gagtgaaggagagtaaggcc

SEQ ID NO: 551618 - DNA, 20 bp, mouse
gtccagacataatgactgga

SEQ ID NO: 551619 - DNA, 20 bp, mouse
gatatgaacaaagaacattt

SEQ ID NO: 551620 - DNA, 20 bp, mouse
gctccttcactgatgttacc

SEQ ID NO: 551621 - DNA, 20 bp, mouse
gaacaaagaacatttgggca

SEQ ID NO: 551622 - DNA, 20 bp, mouse
gtctttgttcatatgttgac

SEQ ID NO: 551623 - DNA, 20 bp, mouse
gttgtcttgcaacattcttg

SEQ ID NO: 551624 - DNA, 20 bp, mouse
gaagaacatttgggcaaggc

SEQ ID NO: 551625 - DNA, 20 bp, mouse
gacatcagtgaaggagagta

SEQ ID NO: 551626 - DNA, 20 bp, mouse
gaagagggcattggggacag

SEQ ID NO: 551627 - DNA, 20 bp, mouse
gaggccaaggttgcctacta

SEQ ID NO: 551628 - DNA, 20 bp, mouse
gcattaagaatgaaagactg

SEQ ID NO: 551629 - DNA, 20 bp, mouse
gtatgcactgcttcgagacc

SEQ ID NO: 551630 - DNA, 20 bp, mouse
gtctcgaagcagtgcatata

SEQ ID NO: 551631 - DNA, 20 bp, mouse
gaaggtggcaagcccagctt

SEQ ID NO: 551632 - DNA, 20 bp, mouse
gcccagctttggcaatgaca

SEQ ID NO: 551633 - DNA, 20 bp, mouse
gggcttgccaccttcttgag

SEQ ID NO: 551634 - DNA, 20 bp, mouse
gaacacacctctcaagaagg

SEQ ID NO: 551635 - DNA, 20 bp, mouse
ggtatggttgcatagcgtag

SEQ ID NO: 551636 - DNA, 20 bp, mouse
gagtgcaaagttatgttcaa

SEQ ID NO: 551637 - DNA, 20 bp, mouse
gtctaccaggatttgaatat

SEQ ID NO: 551638 - DNA, 20 bp, mouse
gttaggtgttgtactcttat

SEQ ID NO: 551639 - DNA, 20 bp, mouse
gtagtcaagttgatctgcaa

SEQ ID NO: 551640 - DNA, 20 bp, mouse
gactggtacctgatgttata

SEQ ID NO: 551641 - DNA, 20 bp, mouse
gtcaagttgatctgcaatgg

SEQ ID NO: 551642 - DNA, 20 bp, mouse
gagatcaacttgactaagtt

SEQ ID NO: 551643 - DNA, 20 bp, mouse
gaggtgtgataaatttccag

SEQ ID NO: 551644 - DNA, 20 bp, mouse
gcacacctatattcaaatcc

SEQ ID NO: 551645 - DNA, 20 bp, mouse
gattcattcttgaatatata

SEQ ID NO: 551646 - DNA, 20 bp, mouse
ggaacataccacacatcctg

SEQ ID NO: 551647 - DNA, 20 bp, mouse
gggattggtgtaattatgaa

SEQ ID NO: 551648 - DNA, 20 bp, mouse
gcagatggggatggctatcc

SEQ ID NO: 551649 - DNA, 20 bp, mouse
gaggtctgctaatgccagca

SEQ ID NO: 551650 - DNA, 20 bp, mouse
gcataattacaccaatccac

SEQ ID NO: 551651 - DNA, 20 bp, mouse
gatgttctgattggaattcc

SEQ ID NO: 551652 - DNA, 20 bp, mouse
gtttgtgtatacaatgaagg

SEQ ID NO: 551653 - DNA, 20 bp, mouse
gtgggacacacaactaccaa

SEQ ID NO: 551654 - DNA, 20 bp, mouse
gagatttgtgtatacaatga

SEQ ID NO: 551655 - DNA, 20 bp, mouse
gtcttctggtttcattccag

SEQ ID NO: 551656 - DNA, 20 bp, mouse
gcccagcaagaggaaaaaag

SEQ ID NO: 551657 - DNA, 20 bp, mouse
ggcctggaactcccagcaag

SEQ ID NO: 551658 - DNA, 20 bp, mouse
gtcctcttgctgggagttcc

SEQ ID NO: 551659 - DNA, 20 bp, mouse
ggtggataggcctagatcaa

SEQ ID NO: 551660 - DNA, 20 bp, mouse
gagggaatgtccagttcaaa

SEQ ID NO: 551661 - DNA, 20 bp, mouse
gttgctaagaagtaaaacat

SEQ ID NO: 551662 - DNA, 20 bp, mouse
gtgctgggctccattgatct

SEQ ID NO: 551663 - DNA, 20 bp, mouse
gccttgaaaagttgcatgtg

SEQ ID NO: 551664 - DNA, 20 bp, mouse
gtcaatatgagaaataccag

SEQ ID NO: 551665 - DNA, 20 bp, mouse
ggggaattgtggatgtggat

SEQ ID NO: 551666 - DNA, 20 bp, mouse
gcagtggaagaaccatgtag

SEQ ID NO: 551667 - DNA, 20 bp, mouse
gctatctcattgcagtcctg

SEQ ID NO: 551668 - DNA, 20 bp, mouse
gaatggaatctaacatggct

SEQ ID NO: 551669 - DNA, 20 bp, mouse
ggtgtgcattttcaagccct

SEQ ID NO: 551670 - DNA, 20 bp, mouse
gtaaaacagcaccattcccc

SEQ ID NO: 551671 - DNA, 20 bp, mouse
ggtgctgcggagcctctaca

SEQ ID NO: 551672 - DNA, 20 bp, mouse
gtcattgcagtcctggggaa

SEQ ID NO: 551673 - DNA, 20 bp, mouse
gactggtgtttctcctactg

SEQ ID NO: 551674 - DNA, 20 bp, mouse
gaacaacataatgctttcca

SEQ ID NO: 551675 - DNA, 20 bp, mouse
gaggtcaatggaatctaaca

SEQ ID NO: 551676 - DNA, 20 bp, mouse
gtgagctacacagtccctaa

SEQ ID NO: 551677 - DNA, 20 bp, mouse
gtgcctggtgacatgttgtc

SEQ ID NO: 551678 - DNA, 20 bp, mouse
gctcctgacaacatgtcacc

SEQ ID NO: 551679 - DNA, 20 bp, mouse
gtactggctgttactgactt

SEQ ID NO: 551680 - DNA, 20 bp, mouse
gttctacttactggccatac

SEQ ID NO: 551681 - DNA, 20 bp, mouse
gggatagtgttatatcggag

SEQ ID NO: 551682 - DNA, 20 bp, mouse
gcactcggtatattctggtt

SEQ ID NO: 551683 - DNA, 20 bp, mouse
gggtgaggatagtgttatat

SEQ ID NO: 551684 - DNA, 20 bp, mouse
gcagagcactcggtatattc

SEQ ID NO: 551685 - DNA, 20 bp, mouse
gataatgcagattgttctgt

SEQ ID NO: 551686 - DNA, 20 bp, mouse
gaggtcaatggaatccagca

SEQ ID NO: 551687 - DNA, 20 bp, mouse
ggtgctgaggagcctataca

SEQ ID NO: 551688 - DNA, 20 bp, mouse
gtactggaagaaccatgtat

SEQ ID NO: 551689 - DNA, 20 bp, mouse
gtcaagaggagaaacactac

SEQ ID NO: 551690 - DNA, 20 bp, mouse
gaatggaatccagcatggct

SEQ ID NO: 551691 - DNA, 20 bp, mouse
gtactacttcctagccatgc

SEQ ID NO: 551692 - DNA, 20 bp, mouse
gtctatctcattgcaattct

SEQ ID NO: 551693 - DNA, 20 bp, mouse
ggctagaatatgcacacatc

SEQ ID NO: 551694 - DNA, 20 bp, mouse
ggtgtgcatattctagccct

SEQ ID NO: 551695 - DNA, 20 bp, mouse
gcttacaaatggcaacgtag

SEQ ID NO: 551696 - DNA, 20 bp, mouse
ggcctcagtgatattactgg

SEQ ID NO: 551697 - DNA, 20 bp, mouse
ggcccccagtaatatcactg

SEQ ID NO: 551698 - DNA, 20 bp, mouse
gccccggaatccccagcaac

SEQ ID NO: 551699 - DNA, 20 bp, mouse
gtgagcctcagtgatattac

SEQ ID NO: 551700 - DNA, 20 bp, mouse
gactgggggcattctgtagt

SEQ ID NO: 551701 - DNA, 20 bp, mouse
gctaccatccccaagatgtt

SEQ ID NO: 551702 - DNA, 20 bp, mouse
gttctgtagtaggttgatgt

SEQ ID NO: 551703 - DNA, 20 bp, mouse
gggattgtggtgtacctgag

SEQ ID NO: 551704 - DNA, 20 bp, mouse
ggctggaagctacacagttc

SEQ ID NO: 551705 - DNA, 20 bp, mouse
ggcatcgtactcctcgccat

SEQ ID NO: 551706 - DNA, 20 bp, mouse
gcaatcctggaatccctacc

SEQ ID NO: 551707 - DNA, 20 bp, mouse
gttatcctggtagggattcc

SEQ ID NO: 551708 - DNA, 20 bp, mouse
gctctttctttatcctggta

SEQ ID NO: 551709 - DNA, 20 bp, mouse
gtccgggagatcagtttcgg

SEQ ID NO: 551710 - DNA, 20 bp, mouse
gggattgtggtgtactggag

SEQ ID NO: 551711 - DNA, 20 bp, mouse
gattttggggatagtagatg

SEQ ID NO: 551712 - DNA, 20 bp, mouse
ggcccccgaaactgatctcc

SEQ ID NO: 551713 - DNA, 20 bp, mouse
gagatcaattatcgacaatg

SEQ ID NO: 551714 - DNA, 20 bp, mouse
gtatgaaaaatttccaatcc

SEQ ID NO: 551715 - DNA, 20 bp, mouse
ggaagatgcctaacattttg

SEQ ID NO: 551716 - DNA, 20 bp, mouse
gcctcctgatagggatccca

SEQ ID NO: 551717 - DNA, 20 bp, mouse
ggaagggaaagccaatccac

SEQ ID NO: 551718 - DNA, 20 bp, mouse
gaaggaggaagggtggaact

SEQ ID NO: 551719 - DNA, 20 bp, mouse
ggctggaagagttgcacctg

SEQ ID NO: 551720 - DNA, 20 bp, mouse
gaagagttgcacctgtggat

SEQ ID NO: 551721 - DNA, 20 bp, mouse
gatcttggggatagtagctg

SEQ ID NO: 551722 - DNA, 20 bp, mouse
ggtatcatactgtacctcag

SEQ ID NO: 551723 - DNA, 20 bp, mouse
gtgtcagtaccacagactcc

SEQ ID NO: 551724 - DNA, 20 bp, mouse
ggtggaggctgcgttcagtt

SEQ ID NO: 551725 - DNA, 20 bp, mouse
gatgttggcatgcactgatt

SEQ ID NO: 551726 - DNA, 20 bp, mouse
gggggatgggcaaagtaata

SEQ ID NO: 551727 - DNA, 20 bp, mouse
ggaagtctgaaactccagta

SEQ ID NO: 551728 - DNA, 20 bp, mouse
gtctgaaactccagtagggt

SEQ ID NO: 551729 - DNA, 20 bp, mouse
gtaccttggggatgacagtg

SEQ ID NO: 551730 - DNA, 20 bp, mouse
ggatgtccagcatggagagg

SEQ ID NO: 551731 - DNA, 20 bp, mouse
gagaacgacaccaaccctac

SEQ ID NO: 551732 - DNA, 20 bp, mouse
gagacctgacaaaacaattt

SEQ ID NO: 551733 - DNA, 20 bp, mouse
gagagccagagctgccagct

SEQ ID NO: 551734 - DNA, 20 bp, mouse
gaagagaaggctgagtggca

SEQ ID NO: 551735 - DNA, 20 bp, mouse
gcctgacaaaacaatttagg

SEQ ID NO: 551736 - DNA, 20 bp, mouse
ggagccattgaacttgatca

SEQ ID NO: 551737 - DNA, 20 bp, mouse
gggagctggtgcattactca

SEQ ID NO: 551738 - DNA, 20 bp, mouse
gttgatgagtagtatggatg

SEQ ID NO: 551739 - DNA, 20 bp, mouse
gccactagtgttaacacaga

SEQ ID NO: 551740 - DNA, 20 bp, mouse
gctgcactgactccaggcca

SEQ ID NO: 551741 - DNA, 20 bp, mouse
gtaacactagtggggatccc

SEQ ID NO: 551742 - DNA, 20 bp, mouse
gtcaccatgatcaagttcaa

SEQ ID NO: 551743 - DNA, 20 bp, mouse
gccagcactgcactgactcc

SEQ ID NO: 551744 - DNA, 20 bp, mouse
gaggcatcaaagaaaatctg

SEQ ID NO: 551745 - DNA, 20 bp, mouse
ggatagtagcatgtctgagg

SEQ ID NO: 551746 - DNA, 20 bp, mouse
gaaagaatggggatgggcaa

SEQ ID NO: 551747 - DNA, 20 bp, mouse
gggggatgggcaaaggaata

SEQ ID NO: 551748 - DNA, 20 bp, mouse
ggaagtctgaaactccagta

SEQ ID NO: 551749 - DNA, 20 bp, mouse
gtctgaaactccagtagggt

SEQ ID NO: 551750 - DNA, 20 bp, mouse
gtaccttggggatgacagtg

SEQ ID NO: 551751 - DNA, 20 bp, mouse
gagacctgacaaaacaattt

SEQ ID NO: 551752 - DNA, 20 bp, mouse
ggatgtccagcatggagagg

SEQ ID NO: 551753 - DNA, 20 bp, mouse
gagagccagagctgccagct

SEQ ID NO: 551754 - DNA, 20 bp, mouse
gagaacgacaccaaccctac

SEQ ID NO: 551755 - DNA, 20 bp, mouse
gaagagaaggctgagtggca

SEQ ID NO: 551756 - DNA, 20 bp, mouse
gaggggaaaaggaatagagt

SEQ ID NO: 551757 - DNA, 20 bp, mouse
gtcctgggagggtctgacct

SEQ ID NO: 551758 - DNA, 20 bp, mouse
ggaactaactatctggctga

SEQ ID NO: 551759 - DNA, 20 bp, mouse
gatctaaagaactaactatc

SEQ ID NO: 551760 - DNA, 20 bp, mouse
gtaggagggagggctaatat

SEQ ID NO: 551761 - DNA, 20 bp, mouse
gttgagcattttttttcttc

SEQ ID NO: 551762 - DNA, 20 bp, mouse
gcccaaggtcagaccctccc

SEQ ID NO: 551763 - DNA, 20 bp, mouse
gaaaagtgagtgtcctggga

SEQ ID NO: 551764 - DNA, 20 bp, mouse
gaatagagtgggacacagct

SEQ ID NO: 551765 - DNA, 20 bp, mouse
gcaagagccaaaaccaacag

SEQ ID NO: 551766 - DNA, 20 bp, mouse
gggtgtcagtcatgatcaga

SEQ ID NO: 551767 - DNA, 20 bp, mouse
gagcaacacttcctctatcc

SEQ ID NO: 551768 - DNA, 20 bp, mouse
ggactgacaccagaaaacct

SEQ ID NO: 551769 - DNA, 20 bp, mouse
gtgatggatgggtactgtag

SEQ ID NO: 551770 - DNA, 20 bp, mouse
gctttgtagcagccagaaat

SEQ ID NO: 551771 - DNA, 20 bp, mouse
gatagtaagaatcccatttc

SEQ ID NO: 551772 - DNA, 20 bp, mouse
gcagatgaggaggaagtcag

SEQ ID NO: 551773 - DNA, 20 bp, mouse
gatgatcagaaggcaacaca

SEQ ID NO: 551774 - DNA, 20 bp, mouse
gaagtcaggggccaggatag

SEQ ID NO: 551775 - DNA, 20 bp, mouse
gagagaggcctccatcctga

SEQ ID NO: 551776 - DNA, 20 bp, mouse
gatgaggaggaattcagaga

SEQ ID NO: 551777 - DNA, 20 bp, mouse
ggaatcgttggataatgcca

SEQ ID NO: 551778 - DNA, 20 bp, mouse
gtgacggtcgggtactgtag

SEQ ID NO: 551779 - DNA, 20 bp, mouse
gggaactgggagagaaatta

SEQ ID NO: 551780 - DNA, 20 bp, mouse
gctgatcagtgatgacggtc

SEQ ID NO: 551781 - DNA, 20 bp, mouse
ggagagaaattagggcattc

SEQ ID NO: 551782 - DNA, 20 bp, mouse
gatgggagcttcagaatcgt

SEQ ID NO: 551783 - DNA, 20 bp, mouse
gttgattgtaatttcttcca

SEQ ID NO: 551784 - DNA, 20 bp, mouse
gggcagaaagaatgggaact

SEQ ID NO: 551785 - DNA, 20 bp, mouse
gtgctatcttcattataagc

SEQ ID NO: 551786 - DNA, 20 bp, mouse
gggtagctggatctccagag

SEQ ID NO: 551787 - DNA, 20 bp, mouse
gagaggtaaaggatacccag

SEQ ID NO: 551788 - DNA, 20 bp, mouse
gaatggagaaatcatgactc

SEQ ID NO: 551789 - DNA, 20 bp, mouse
gcctgactccatagaggaga

SEQ ID NO: 551790 - DNA, 20 bp, mouse
gcatgctcatcagaagaaca

SEQ ID NO: 551791 - DNA, 20 bp, mouse
gcactagagcaaagaggtaa

SEQ ID NO: 551792 - DNA, 20 bp, mouse
ggtgagggctttgggtgcag

SEQ ID NO: 551793 - DNA, 20 bp, mouse
gttctctgtgctattgttca

SEQ ID NO: 551794 - DNA, 20 bp, mouse
gatgagccaggagcacagtg

SEQ ID NO: 551795 - DNA, 20 bp, mouse
gtcttagcaattctagctgg

SEQ ID NO: 551796 - DNA, 20 bp, mouse
gggctctttgctctttgtgt

SEQ ID NO: 551797 - DNA, 20 bp, mouse
gtctcatctggatagaacac

SEQ ID NO: 551798 - DNA, 20 bp, mouse
gaccagcacccctgactcca

SEQ ID NO: 551799 - DNA, 20 bp, mouse
gcacatactttcttcttgac

SEQ ID NO: 551800 - DNA, 20 bp, mouse
gctggtggcactgcgaggtg

SEQ ID NO: 551801 - DNA, 20 bp, mouse
ggccaccaggcctccaatct

SEQ ID NO: 551802 - DNA, 20 bp, mouse
ggaggcctggtggcactgcg

SEQ ID NO: 551803 - DNA, 20 bp, mouse
ggggaagggatatccaaaca

SEQ ID NO: 551804 - DNA, 20 bp, mouse
gtatccagatgagagaaagc

SEQ ID NO: 551805 - DNA, 20 bp, mouse
gattctctgccatggagtca

SEQ ID NO: 551806 - DNA, 20 bp, mouse
gacgcttagtatccagttca

SEQ ID NO: 551807 - DNA, 20 bp, mouse
ggtctctgggcagctagtac

SEQ ID NO: 551808 - DNA, 20 bp, mouse
ggctagtacaggcactggga

SEQ ID NO: 551809 - DNA, 20 bp, mouse
ggggcagctagtacaggcac

SEQ ID NO: 551810 - DNA, 20 bp, mouse
gactatggaaggatattgga

SEQ ID NO: 551811 - DNA, 20 bp, mouse
gagtgactatggaaggatat

SEQ ID NO: 551812 - DNA, 20 bp, mouse
gcaatgtaaagcagagccat

SEQ ID NO: 551813 - DNA, 20 bp, mouse
gcagaatgaactcagagact

SEQ ID NO: 551814 - DNA, 20 bp, mouse
gacattggctgatgcagggt

SEQ ID NO: 551815 - DNA, 20 bp, mouse
gtcttggctgcagtagatat

SEQ ID NO: 551816 - DNA, 20 bp, mouse
ggagctgttggtttcatgca

SEQ ID NO: 551817 - DNA, 20 bp, mouse
gcagaatgaactcagacacg

SEQ ID NO: 551818 - DNA, 20 bp, mouse
gcagggcagtacccatttcc

SEQ ID NO: 551819 - DNA, 20 bp, mouse
gacaaggcactcccggaaat

SEQ ID NO: 551820 - DNA, 20 bp, mouse
gcatgaaaccaacagctcag

SEQ ID NO: 551821 - DNA, 20 bp, mouse
gacgtggacctctgagctgt

SEQ ID NO: 551822 - DNA, 20 bp, mouse
gacattggctgatgcagggt

SEQ ID NO: 551823 - DNA, 20 bp, mouse
gtcttggctgcagtagatat

SEQ ID NO: 551824 - DNA, 20 bp, mouse
gcaatgtaaagcagagccat

SEQ ID NO: 551825 - DNA, 20 bp, mouse
gtcccaagaaactgatacat

SEQ ID NO: 551826 - DNA, 20 bp, mouse
ggaacaagacatccatgaaa

SEQ ID NO: 551827 - DNA, 20 bp, mouse
gacattgactgatgcaggtt

SEQ ID NO: 551828 - DNA, 20 bp, mouse
gtgatgtaaagtagagccat

SEQ ID NO: 551829 - DNA, 20 bp, mouse
gatgcttagtacccatttca

SEQ ID NO: 551830 - DNA, 20 bp, mouse
gtgtccatgatgctcaggag

SEQ ID NO: 551831 - DNA, 20 bp, mouse
gtcttggctgtagtggatat

SEQ ID NO: 551832 - DNA, 20 bp, mouse
gcttggtatcttggctgtag

SEQ ID NO: 551833 - DNA, 20 bp, mouse
gcacattgtccatgatgctc

SEQ ID NO: 551834 - DNA, 20 bp, mouse
ggctgtagtggatattggtt

SEQ ID NO: 551835 - DNA, 20 bp, mouse
gtactttacatcatagctct

SEQ ID NO: 551836 - DNA, 20 bp, mouse
gtggctccaggtaagtttat

SEQ ID NO: 551837 - DNA, 20 bp, mouse
ggtacacagagctcatgaat

SEQ ID NO: 551838 - DNA, 20 bp, mouse
gctgtgtacatctcactaaa

SEQ ID NO: 551839 - DNA, 20 bp, mouse
gtgaatgaaagtgaaaaaat

SEQ ID NO: 551840 - DNA, 20 bp, mouse
gcaggtaagtttatgggctt

SEQ ID NO: 551841 - DNA, 20 bp, mouse
gcattcagattgctatctca

SEQ ID NO: 551842 - DNA, 20 bp, mouse
gctcatgaataggatctttg

SEQ ID NO: 551843 - DNA, 20 bp, mouse
gagaaactgttaataaagta

SEQ ID NO: 551844 - DNA, 20 bp, mouse
gggggtgaagggttgtatca

SEQ ID NO: 551845 - DNA, 20 bp, mouse
ggtaaatagcagatactcgc

SEQ ID NO: 551846 - DNA, 20 bp, mouse
gtgcagcaggcaggcatcaa

SEQ ID NO: 551847 - DNA, 20 bp, mouse
gatttgatgagcaatatcaa

SEQ ID NO: 551848 - DNA, 20 bp, mouse
gagcaatatcaatggaaatg

SEQ ID NO: 551849 - DNA, 20 bp, mouse
gtggagctggtgcattactg

SEQ ID NO: 551850 - DNA, 20 bp, mouse
gtaacactagtggggatccc

SEQ ID NO: 551851 - DNA, 20 bp, mouse
gtcagcatgatcaagttcaa

SEQ ID NO: 551852 - DNA, 20 bp, mouse
gctgcactgattccaggcca

SEQ ID NO: 551853 - DNA, 20 bp, mouse
gccactagtgttaaaacaga

SEQ ID NO: 551854 - DNA, 20 bp, mouse
gccagcactgcactgattcc

SEQ ID NO: 551855 - DNA, 20 bp, mouse
ggatagtagcatgtctgagg

SEQ ID NO: 551856 - DNA, 20 bp, mouse
gaaactaatggagagacagt

SEQ ID NO: 551857 - DNA, 20 bp, mouse
gccgtgacgactaaaactaa

SEQ ID NO: 551858 - DNA, 20 bp, mouse
gagctgtgaggtctggtcaa

SEQ ID NO: 551859 - DNA, 20 bp, mouse
gtggacagaaagacatacat

SEQ ID NO: 551860 - DNA, 20 bp, mouse
gacatacatgggctcatgga

SEQ ID NO: 551861 - DNA, 20 bp, mouse
ggcgttcactcaggacaaca

SEQ ID NO: 551862 - DNA, 20 bp, mouse
ggctggagcagtaccacacc

SEQ ID NO: 551863 - DNA, 20 bp, mouse
gactcaggacaacaaggatg

SEQ ID NO: 551864 - DNA, 20 bp, mouse
gcaagcaggatgaacacagt

SEQ ID NO: 551865 - DNA, 20 bp, mouse
gaggcacagtggtggttgac

SEQ ID NO: 551866 - DNA, 20 bp, mouse
gtgtgctagttggcatccct

SEQ ID NO: 551867 - DNA, 20 bp, mouse
gcacaggggtatagacaacc

SEQ ID NO: 551868 - DNA, 20 bp, mouse
ggactgcagtgacatacatg

SEQ ID NO: 551869 - DNA, 20 bp, mouse
gtgggtgacacaggcatcaa

SEQ ID NO: 551870 - DNA, 20 bp, mouse
gtagcacaaaaaatgcaggg

SEQ ID NO: 551871 - DNA, 20 bp, mouse
gaaaaatgcagggtggatgg

SEQ ID NO: 551872 - DNA, 20 bp, mouse
gtatgataagcctccaaccc

SEQ ID NO: 551873 - DNA, 20 bp, mouse
gaactagcacaaaaaatgca

SEQ ID NO: 551874 - DNA, 20 bp, mouse
ggtgtggacaaagaagactt

SEQ ID NO: 551875 - DNA, 20 bp, mouse
ggttggaggcttatcatacc

SEQ ID NO: 551876 - DNA, 20 bp, mouse
gctgataggggaagaacaag

SEQ ID NO: 551877 - DNA, 20 bp, mouse
gcaggcccttcaccagttca

SEQ ID NO: 551878 - DNA, 20 bp, mouse
gtacatgagcccaaacacta

SEQ ID NO: 551879 - DNA, 20 bp, mouse
ggggatattgttcctgatag

SEQ ID NO: 551880 - DNA, 20 bp, mouse
gtggccaggagtagaaacat

SEQ ID NO: 551881 - DNA, 20 bp, mouse
gcccatccatgaactggtga

SEQ ID NO: 551882 - DNA, 20 bp, mouse
ggaagggcctggaatattac

SEQ ID NO: 551883 - DNA, 20 bp, mouse
gagcacagccagcaactctg

SEQ ID NO: 551884 - DNA, 20 bp, mouse
gtgtatctgctggccctact

SEQ ID NO: 551885 - DNA, 20 bp, mouse
gtgcaaacccatccatgaac

SEQ ID NO: 551886 - DNA, 20 bp, mouse
gagccctggaactccacctt

SEQ ID NO: 551887 - DNA, 20 bp, mouse
ggctttgggactgataactg

SEQ ID NO: 551888 - DNA, 20 bp, mouse
gggagttccagggctccatt

SEQ ID NO: 551889 - DNA, 20 bp, mouse
gctaaagagaacacacctaa

SEQ ID NO: 551890 - DNA, 20 bp, mouse
ggctcaagcaagaggtacat

SEQ ID NO: 551891 - DNA, 20 bp, mouse
ggtgtagatggtatatccca

SEQ ID NO: 551892 - DNA, 20 bp, mouse
gaacacacctaatggagccc

SEQ ID NO: 551893 - DNA, 20 bp, mouse
ggcacaaccaccaaaggtga

SEQ ID NO: 551894 - DNA, 20 bp, mouse
ggataactgaggcgagaaga

SEQ ID NO: 551895 - DNA, 20 bp, mouse
gcaagaggtacatgggaaca

SEQ ID NO: 551896 - DNA, 20 bp, mouse
gaagtctgcaactccaccct

SEQ ID NO: 551897 - DNA, 20 bp, mouse
gtagtggcacagagcagctc

SEQ ID NO: 551898 - DNA, 20 bp, mouse
ggttatggctaaaaagtaca

SEQ ID NO: 551899 - DNA, 20 bp, mouse
gcaagatgaatccacttccc

SEQ ID NO: 551900 - DNA, 20 bp, mouse
gtaccatgtatcttctgcta

SEQ ID NO: 551901 - DNA, 20 bp, mouse
gcagaagatacatggtaaca

SEQ ID NO: 551902 - DNA, 20 bp, mouse
gtagagcactgagagatgca

SEQ ID NO: 551903 - DNA, 20 bp, mouse
gttttagccataaccagcaa

SEQ ID NO: 551904 - DNA, 20 bp, mouse
gagcaatggactgctgcttc

SEQ ID NO: 551905 - DNA, 20 bp, mouse
gatacatggtaacatggagc

SEQ ID NO: 551906 - DNA, 20 bp, mouse
gagtagcttactcatggata

SEQ ID NO: 551907 - DNA, 20 bp, mouse
gaaagctaagaggaggtcat

SEQ ID NO: 551908 - DNA, 20 bp, mouse
gagacaaagtagcttactca

SEQ ID NO: 551909 - DNA, 20 bp, mouse
gtcactcacctgaatatctc

SEQ ID NO: 551910 - DNA, 20 bp, mouse
gttactcatggataaggttc

SEQ ID NO: 551911 - DNA, 20 bp, mouse
ggatggaggtggttgcaccc

SEQ ID NO: 551912 - DNA, 20 bp, mouse
gcactttccaggtggctctt

SEQ ID NO: 551913 - DNA, 20 bp, mouse
ggttacttgtggcatcaagg

SEQ ID NO: 551914 - DNA, 20 bp, mouse
gcctgttacttgtggcatca

SEQ ID NO: 551915 - DNA, 20 bp, mouse
gttacttcacaggaaactac

SEQ ID NO: 551916 - DNA, 20 bp, mouse
gagttcaggaattcaacttt

SEQ ID NO: 551917 - DNA, 20 bp, mouse
gggaattcaactttaggaag

SEQ ID NO: 551918 - DNA, 20 bp, mouse
ggcccatgtaccttctactt

SEQ ID NO: 551919 - DNA, 20 bp, mouse
gttgtggcacagagtagttc

SEQ ID NO: 551920 - DNA, 20 bp, mouse
gctaggcaaccaaagaaacc

SEQ ID NO: 551921 - DNA, 20 bp, mouse
gacctggtaaaatggagttc

SEQ ID NO: 551922 - DNA, 20 bp, mouse
gggtcagtgccagtgtgtac

SEQ ID NO: 551923 - DNA, 20 bp, mouse
gcactggcactgaccagcaa

SEQ ID NO: 551924 - DNA, 20 bp, mouse
gaggagagtcactgccattc

SEQ ID NO: 551925 - DNA, 20 bp, mouse
gtcattgaattggtactggg

SEQ ID NO: 551926 - DNA, 20 bp, mouse
gagctctggaactcgactgt

SEQ ID NO: 551927 - DNA, 20 bp, mouse
ggtcagggctaagaagtaca

SEQ ID NO: 551928 - DNA, 20 bp, mouse
gagggatgccaagatccatg

SEQ ID NO: 551929 - DNA, 20 bp, mouse
ggataactgatgtgaggagg

SEQ ID NO: 551930 - DNA, 20 bp, mouse
gtcttagccctgaccagcaa

SEQ ID NO: 551931 - DNA, 20 bp, mouse
ggctatatcctagagcactg

SEQ ID NO: 551932 - DNA, 20 bp, mouse
gatagccacctcatggatct

SEQ ID NO: 551933 - DNA, 20 bp, mouse
gatgtttctagagctggcac

SEQ ID NO: 551934 - DNA, 20 bp, mouse
gcagcagcccattgctggtc

SEQ ID NO: 551935 - DNA, 20 bp, mouse
gggatatggtattgtctttg

SEQ ID NO: 551936 - DNA, 20 bp, mouse
gcctggaactccacattggg

SEQ ID NO: 551937 - DNA, 20 bp, mouse
gagtcctggaactccacatt

SEQ ID NO: 551938 - DNA, 20 bp, mouse
gttacagcacagagcagatc

SEQ ID NO: 551939 - DNA, 20 bp, mouse
gagaatccccaccaagatga

SEQ ID NO: 551940 - DNA, 20 bp, mouse
gttgggaggtaccttcatct

SEQ ID NO: 551941 - DNA, 20 bp, mouse
gatgaaggtacctcccaatg

SEQ ID NO: 551942 - DNA, 20 bp, mouse
gagtcccaggatccatgatg

SEQ ID NO: 551943 - DNA, 20 bp, mouse
gatgacacagaatggagtcc

SEQ ID NO: 551944 - DNA, 20 bp, mouse
ggcacagccctctaatgata

SEQ ID NO: 551945 - DNA, 20 bp, mouse
gacctatgtaccttctgctt

SEQ ID NO: 551946 - DNA, 20 bp, mouse
gggtcagcaagtctgtggta

SEQ ID NO: 551947 - DNA, 20 bp, mouse
gttatgggtcagcaagtctg

SEQ ID NO: 551948 - DNA, 20 bp, mouse
ggatccctacatattcttat

SEQ ID NO: 551949 - DNA, 20 bp, mouse
gctgacccataagaatatgt

SEQ ID NO: 551950 - DNA, 20 bp, mouse
ggtggtaaggagcattcatc

SEQ ID NO: 551951 - DNA, 20 bp, mouse
gatcatcagatcagctagca

SEQ ID NO: 551952 - DNA, 20 bp, mouse
gctagctgatctgatgattg

SEQ ID NO: 551953 - DNA, 20 bp, mouse
ggatgattgcggagctggtg

SEQ ID NO: 551954 - DNA, 20 bp, mouse
ggatctgatgattgcggagc

SEQ ID NO: 551955 - DNA, 20 bp, mouse
gtcatttctgtacctagcat

SEQ ID NO: 551956 - DNA, 20 bp, mouse
gagttccaggaacatttgaa

SEQ ID NO: 551957 - DNA, 20 bp, mouse
gatgtggcacagagtatttc

SEQ ID NO: 551958 - DNA, 20 bp, mouse
gataaagaatcttcacataa

SEQ ID NO: 551959 - DNA, 20 bp, mouse
gtcttcacataatggagctt

SEQ ID NO: 551960 - DNA, 20 bp, mouse
ggtgttcatatcatggaccc

SEQ ID NO: 551961 - DNA, 20 bp, mouse
ggcttggagtgttcatatca

SEQ ID NO: 551962 - DNA, 20 bp, mouse
gttctggcctttatggccta

SEQ ID NO: 551963 - DNA, 20 bp, mouse
gctttggcagctttctctta

SEQ ID NO: 551964 - DNA, 20 bp, mouse
gagcaatgggatactgctcc

SEQ ID NO: 551965 - DNA, 20 bp, mouse
gatagccacatatctgccat

SEQ ID NO: 551966 - DNA, 20 bp, mouse
gggattgagccagagtagta

SEQ ID NO: 551967 - DNA, 20 bp, mouse
gtgaccacctgagcacatgc

SEQ ID NO: 551968 - DNA, 20 bp, mouse
gatattggaccttactactc

SEQ ID NO: 551969 - DNA, 20 bp, mouse
gaggattgacactgagatat

SEQ ID NO: 551970 - DNA, 20 bp, mouse
gactcctgcatgtgctcagg

SEQ ID NO: 551971 - DNA, 20 bp, mouse
gcagggagcagcatttactg

SEQ ID NO: 551972 - DNA, 20 bp, mouse
gtcttaataagcctcaaaag

SEQ ID NO: 551973 - DNA, 20 bp, mouse
gtggaaattagagcattcat

SEQ ID NO: 551974 - DNA, 20 bp, mouse
gaggcttattaagattcaag

SEQ ID NO: 551975 - DNA, 20 bp, mouse
gcctgaaaaatgctgtacag

SEQ ID NO: 551976 - DNA, 20 bp, mouse
gacaagcaaggaagtatata

SEQ ID NO: 551977 - DNA, 20 bp, mouse
gtagaataaattctaatata

SEQ ID NO: 551978 - DNA, 20 bp, mouse
gatacttccttgcttgtatc

SEQ ID NO: 551979 - DNA, 20 bp, mouse
gctgctgcctgatacaagca

SEQ ID NO: 551980 - DNA, 20 bp, mouse
gggaggataagaggacgctg

SEQ ID NO: 551981 - DNA, 20 bp, mouse
gacagctaagggacccatgt

SEQ ID NO: 551982 - DNA, 20 bp, mouse
ggaccagtaagaagggatct

SEQ ID NO: 551983 - DNA, 20 bp, mouse
gtagggaattagatttccca

SEQ ID NO: 551984 - DNA, 20 bp, mouse
gcaaggaagtatatagggtt

SEQ ID NO: 551985 - DNA, 20 bp, mouse
gttcaacctagcttcatcct

SEQ ID NO: 551986 - DNA, 20 bp, mouse
gggaactcgacgatgggcaa

SEQ ID NO: 551987 - DNA, 20 bp, mouse
gcaatggcttcatcttagtg

SEQ ID NO: 551988 - DNA, 20 bp, mouse
gagtttaggaactcgacgat

SEQ ID NO: 551989 - DNA, 20 bp, mouse
gttgtggcacaaagcagatc

SEQ ID NO: 551990 - DNA, 20 bp, mouse
ggtgtagatggtaaatccta

SEQ ID NO: 551991 - DNA, 20 bp, mouse
gctaaacatatcactcaaaa

SEQ ID NO: 551992 - DNA, 20 bp, mouse
gtgtttctagaactggtact

SEQ ID NO: 551993 - DNA, 20 bp, mouse
gtgttggctttaaccagcaa

SEQ ID NO: 551994 - DNA, 20 bp, mouse
ggttcatagttggtactata

SEQ ID NO: 551995 - DNA, 20 bp, mouse
gtggcatcagtgatagccct

SEQ ID NO: 551996 - DNA, 20 bp, mouse
ggtaactccaccttgagaag

SEQ ID NO: 551997 - DNA, 20 bp, mouse
ggtcaaagctaaaaggtaca

SEQ ID NO: 551998 - DNA, 20 bp, mouse
gacgtggagccgggtatcca

SEQ ID NO: 551999 - DNA, 20 bp, mouse
ggatgcaagactccatgaag

SEQ ID NO: 552000 - DNA, 20 bp, mouse
gagaagtggcttcatcttga

SEQ ID NO: 552001 - DNA, 20 bp, mouse
gattgcttgtcaaagctaaa

SEQ ID NO: 552002 - DNA, 20 bp, mouse
gagtaccaagtgtcaaagcc

SEQ ID NO: 552003 - DNA, 20 bp, mouse
gaaataaagatcacacagaa

SEQ ID NO: 552004 - DNA, 20 bp, mouse
gttcatcttgatgggtattt

SEQ ID NO: 552005 - DNA, 20 bp, mouse
gataggccataaaggacaga

SEQ ID NO: 552006 - DNA, 20 bp, mouse
gaagttgaaatcagttccta

SEQ ID NO: 552007 - DNA, 20 bp, mouse
gatgtggcacaaagcagttc

SEQ ID NO: 552008 - DNA, 20 bp, mouse
gagtgccaggaacatctgga

SEQ ID NO: 552009 - DNA, 20 bp, mouse
gctaaaaagaccacatataa

SEQ ID NO: 552010 - DNA, 20 bp, mouse
gtacatgggtacatgaagac

SEQ ID NO: 552011 - DNA, 20 bp, mouse
gtcctggcactgacactggg

SEQ ID NO: 552012 - DNA, 20 bp, mouse
ggaactgatttcaacttagt

SEQ ID NO: 552013 - DNA, 20 bp, mouse
ggatgctaggacccatgatg

SEQ ID NO: 552014 - DNA, 20 bp, mouse
gtccaaggctccattatatg

SEQ ID NO: 552015 - DNA, 20 bp, mouse
gcttatggtggccacatcat

SEQ ID NO: 552016 - DNA, 20 bp, mouse
gatgtacaaggctgtgacta

SEQ ID NO: 552017 - DNA, 20 bp, mouse
gtccagagctccattctggg

SEQ ID NO: 552018 - DNA, 20 bp, mouse
ggagttccagagctccattc

SEQ ID NO: 552019 - DNA, 20 bp, mouse
gtcaaagataccacccagaa

SEQ ID NO: 552020 - DNA, 20 bp, mouse
gacatcagttgtcaccccca

SEQ ID NO: 552021 - DNA, 20 bp, mouse
gctatcagccagcatactgt

SEQ ID NO: 552022 - DNA, 20 bp, mouse
gtgaagaccatgtaattgag

SEQ ID NO: 552023 - DNA, 20 bp, mouse
gtaggaggtacatgggtaca

SEQ ID NO: 552024 - DNA, 20 bp, mouse
gtggctctagcattgatgct

SEQ ID NO: 552025 - DNA, 20 bp, mouse
ggctgatagtgtctacatca

SEQ ID NO: 552026 - DNA, 20 bp, mouse
gggatgctccacacagatag

SEQ ID NO: 552027 - DNA, 20 bp, mouse
gtagtggtgttgcttctggt

SEQ ID NO: 552028 - DNA, 20 bp, mouse
ggtgaatgtggtatccacca

SEQ ID NO: 552029 - DNA, 20 bp, mouse
gagcaacaccactatctgtg

SEQ ID NO: 552030 - DNA, 20 bp, mouse
gcagatagtggtgttgcttc

SEQ ID NO: 552031 - DNA, 20 bp, mouse
gtgtctgtgggtcctgtgag

SEQ ID NO: 552032 - DNA, 20 bp, mouse
gagtgagcaggtagatgaag

SEQ ID NO: 552033 - DNA, 20 bp, mouse
gatcttcctgggcctctcac

SEQ ID NO: 552034 - DNA, 20 bp, mouse
gtgggtcctgtgagaggccc

SEQ ID NO: 552035 - DNA, 20 bp, mouse
gggaagtggacaagcacctg

SEQ ID NO: 552036 - DNA, 20 bp, mouse
gagtcgtgttgcttctagta

SEQ ID NO: 552037 - DNA, 20 bp, mouse
gagcaacacgactaattgta

SEQ ID NO: 552038 - DNA, 20 bp, mouse
gtgtgaatgtagcatctacc

SEQ ID NO: 552039 - DNA, 20 bp, mouse
gcactgggtatgtcttcagc

SEQ ID NO: 552040 - DNA, 20 bp, mouse
gcttgcagacagctacatat

SEQ ID NO: 552041 - DNA, 20 bp, mouse
gtgtctgtgggtcctgtgag

SEQ ID NO: 552042 - DNA, 20 bp, mouse
gagtgagcaggtagatgaag

SEQ ID NO: 552043 - DNA, 20 bp, mouse
gatcttcctgggcctctcac

SEQ ID NO: 552044 - DNA, 20 bp, mouse
gtgggtcctgtgagaggccc

SEQ ID NO: 552045 - DNA, 20 bp, mouse
gggaagtggacaagcacctg

SEQ ID NO: 552046 - DNA, 20 bp, mouse
gtggctacccggccctcgag

SEQ ID NO: 552047 - DNA, 20 bp, mouse
gggaggtggaccagcatcag

SEQ ID NO: 552048 - DNA, 20 bp, mouse
gcagccagaaccccacagta

SEQ ID NO: 552049 - DNA, 20 bp, mouse
gggaaagagtagccgctcga

SEQ ID NO: 552050 - DNA, 20 bp, mouse
ggagtagccgctcgagggcc

SEQ ID NO: 552051 - DNA, 20 bp, mouse
gtgctgggctccatactgtg

SEQ ID NO: 552052 - DNA, 20 bp, mouse
gaggctcagacacatctgga

SEQ ID NO: 552053 - DNA, 20 bp, mouse
ggccaacagcaggcactcgg

SEQ ID NO: 552054 - DNA, 20 bp, mouse
gaagaggcagagcacccagg

SEQ ID NO: 552055 - DNA, 20 bp, mouse
gcttccgggacgacaggagg

SEQ ID NO: 552056 - DNA, 20 bp, mouse
gcccaaggcgacttaaagag

SEQ ID NO: 552057 - DNA, 20 bp, mouse
ggagcaagtgggccaaacag

SEQ ID NO: 552058 - DNA, 20 bp, mouse
gaaggctggatggctctcag

SEQ ID NO: 552059 - DNA, 20 bp, mouse
gagggattgcacaatcccca

SEQ ID NO: 552060 - DNA, 20 bp, mouse
gcaagtgggccaaacagagg

SEQ ID NO: 552061 - DNA, 20 bp, mouse
gccgcaggagtctctgaagt

SEQ ID NO: 552062 - DNA, 20 bp, mouse
ggaagtgccctgtgtgccga

SEQ ID NO: 552063 - DNA, 20 bp, mouse
gcaggagtctctgaagtagg

SEQ ID NO: 552064 - DNA, 20 bp, mouse
gactttggggtgcttcaggg

SEQ ID NO: 552065 - DNA, 20 bp, mouse
gtgcaatccctcggcacaca

SEQ ID NO: 552066 - DNA, 20 bp, mouse
ggaagaggaagcacagacgt

SEQ ID NO: 552067 - DNA, 20 bp, mouse
gcagctgctgttggctagtg

SEQ ID NO: 552068 - DNA, 20 bp, mouse
gctccattaccagctgctgt

SEQ ID NO: 552069 - DNA, 20 bp, mouse
gagagaagcctgagaatcac

SEQ ID NO: 552070 - DNA, 20 bp, mouse
gttaggacccagtgattctc

SEQ ID NO: 552071 - DNA, 20 bp, mouse
gcgaggtttctggagttgag

SEQ ID NO: 552072 - DNA, 20 bp, mouse
gtatctttctccttacccag

SEQ ID NO: 552073 - DNA, 20 bp, mouse
gttctctcaggatacactcg

SEQ ID NO: 552074 - DNA, 20 bp, mouse
gtaaagagctaaggtttcta

SEQ ID NO: 552075 - DNA, 20 bp, mouse
gttctccttacccagaggcc

SEQ ID NO: 552076 - DNA, 20 bp, mouse
ggaagagactcaacagctac

SEQ ID NO: 552077 - DNA, 20 bp, mouse
gagattgtgagaaagcgagc

SEQ ID NO: 552078 - DNA, 20 bp, mouse
ggctttctcacaatctctgg

SEQ ID NO: 552079 - DNA, 20 bp, mouse
gaccaaagaaaaaggtaatt

SEQ ID NO: 552080 - DNA, 20 bp, mouse
ggtcacaattgtcccaactt

SEQ ID NO: 552081 - DNA, 20 bp, mouse
gtacaaagacaagaagagtc

SEQ ID NO: 552082 - DNA, 20 bp, mouse
gttgtgccactacagctaca

SEQ ID NO: 552083 - DNA, 20 bp, mouse
gtgtcccaacttaggtgaag

SEQ ID NO: 552084 - DNA, 20 bp, mouse
gtcccaattacctttttctt

SEQ ID NO: 552085 - DNA, 20 bp, mouse
gatgtatctttacactgaga

SEQ ID NO: 552086 - DNA, 20 bp, mouse
gtgctcattcccatggctac

SEQ ID NO: 552087 - DNA, 20 bp, mouse
gcggtggctacagggaatcc

SEQ ID NO: 552088 - DNA, 20 bp, mouse
gacttatccttcttagagat

SEQ ID NO: 552089 - DNA, 20 bp, mouse
gctcttggttcatgatgact

SEQ ID NO: 552090 - DNA, 20 bp, mouse
gcaagagacacgtgtcaaac

SEQ ID NO: 552091 - DNA, 20 bp, mouse
gttggggactctgattgcgc

SEQ ID NO: 552092 - DNA, 20 bp, mouse
ggtaaggtctgtatttcagt

SEQ ID NO: 552093 - DNA, 20 bp, mouse
gttatttatgctcattccca

SEQ ID NO: 552094 - DNA, 20 bp, mouse
gtctggtttcctgtagccat

SEQ ID NO: 552095 - DNA, 20 bp, mouse
gttgaagccaatctctaaga

SEQ ID NO: 552096 - DNA, 20 bp, mouse
ggcaaggtctgtatctcagt

SEQ ID NO: 552097 - DNA, 20 bp, mouse
gcaggaggcagcagccagtc

SEQ ID NO: 552098 - DNA, 20 bp, mouse
gcaagggacacgtgccagac

SEQ ID NO: 552099 - DNA, 20 bp, mouse
gcattttgggcagaatgact

SEQ ID NO: 552100 - DNA, 20 bp, mouse
gagatttgggggtatatgca

SEQ ID NO: 552101 - DNA, 20 bp, mouse
gttgaagccgatctccatga

SEQ ID NO: 552102 - DNA, 20 bp, mouse
gcagtggctacaggaaaccc

SEQ ID NO: 552103 - DNA, 20 bp, mouse
gtatacccccaaatctcctg

SEQ ID NO: 552104 - DNA, 20 bp, mouse
gcccttggttcatgatgatt

SEQ ID NO: 552105 - DNA, 20 bp, mouse
gctcaggaacttatccttca

SEQ ID NO: 552106 - DNA, 20 bp, mouse
gaacaaggaacatgagaagt

SEQ ID NO: 552107 - DNA, 20 bp, mouse
gatgcaggcaaatcagacac

SEQ ID NO: 552108 - DNA, 20 bp, mouse
gccgagagtcagcccgaaca

SEQ ID NO: 552109 - DNA, 20 bp, mouse
gagagcctgtggaacaatgt

SEQ ID NO: 552110 - DNA, 20 bp, mouse
gtgaagatacccccaatact

SEQ ID NO: 552111 - DNA, 20 bp, mouse
gaattatcatattcagagtt

SEQ ID NO: 552112 - DNA, 20 bp, mouse
gtttttttcatctatgaaca

SEQ ID NO: 552113 - DNA, 20 bp, mouse
gttatttctgggcatctata

SEQ ID NO: 552114 - DNA, 20 bp, mouse
gaaatgtttcccagtattgg

SEQ ID NO: 552115 - DNA, 20 bp, mouse
gtaggacatcacagccaaaa

SEQ ID NO: 552116 - DNA, 20 bp, mouse
gaccttcagtcatatagaag

SEQ ID NO: 552117 - DNA, 20 bp, mouse
ggccccttctatatgactga

SEQ ID NO: 552118 - DNA, 20 bp, mouse
ggtggagtcgagaatccatg

SEQ ID NO: 552119 - DNA, 20 bp, mouse
gtctgtacacccaatctgaa

SEQ ID NO: 552120 - DNA, 20 bp, mouse
gagatacaaaaacatctcaa

SEQ ID NO: 552121 - DNA, 20 bp, mouse
gcttattgtttctgacaaac

SEQ ID NO: 552122 - DNA, 20 bp, mouse
gggaagtgggacagcacttg

SEQ ID NO: 552123 - DNA, 20 bp, mouse
ggatgaggacaatgatgagc

SEQ ID NO: 552124 - DNA, 20 bp, mouse
gaaattcatctacaaagctc

SEQ ID NO: 552125 - DNA, 20 bp, mouse
gtaattgtctcccttcagat

SEQ ID NO: 552126 - DNA, 20 bp, mouse
gccagagtggccaagtagag

SEQ ID NO: 552127 - DNA, 20 bp, mouse
ggggccaccccgagaaacct

SEQ ID NO: 552128 - DNA, 20 bp, mouse
gctaggataacaaactcctg

SEQ ID NO: 552129 - DNA, 20 bp, mouse
gcctgcggcactgtccagtt

SEQ ID NO: 552130 - DNA, 20 bp, mouse
ggtagaggtggcctacacac

SEQ ID NO: 552131 - DNA, 20 bp, mouse
ggcagcactcggaggccctg

SEQ ID NO: 552132 - DNA, 20 bp, mouse
gggctcagaccagtgactca

SEQ ID NO: 552133 - DNA, 20 bp, mouse
gtgttatcctaggtttctcg

SEQ ID NO: 552134 - DNA, 20 bp, mouse
gggctcactgtctgcagtag

SEQ ID NO: 552135 - DNA, 20 bp, mouse
gagaccagtgactcaaggtg

SEQ ID NO: 552136 - DNA, 20 bp, mouse
gcagctcaggtataaaccta

SEQ ID NO: 552137 - DNA, 20 bp, mouse
gcatgtcaatgaaggagagg

SEQ ID NO: 552138 - DNA, 20 bp, mouse
gtcaggtataaacctatgga

SEQ ID NO: 552139 - DNA, 20 bp, mouse
gaagttattggaaattacaa

SEQ ID NO: 552140 - DNA, 20 bp, mouse
gaatatggccatgaagaacg

SEQ ID NO: 552141 - DNA, 20 bp, mouse
gtgtaatcaaccaaaatctt

SEQ ID NO: 552142 - DNA, 20 bp, mouse
gaggttttgtttccatccat

SEQ ID NO: 552143 - DNA, 20 bp, mouse
gagaaagtactgggctgtac

SEQ ID NO: 552144 - DNA, 20 bp, mouse
gccagtgacttcacctttgt

SEQ ID NO: 552145 - DNA, 20 bp, mouse
gactcatgaggacaggataa

SEQ ID NO: 552146 - DNA, 20 bp, mouse
gtgggtgggtgatgaggccc

SEQ ID NO: 552147 - DNA, 20 bp, mouse
gcagtccaggaaattttggg

SEQ ID NO: 552148 - DNA, 20 bp, mouse
gggctgtgtgcaaccctcta

SEQ ID NO: 552149 - DNA, 20 bp, mouse
gtctccatttccacagaaca

SEQ ID NO: 552150 - DNA, 20 bp, mouse
ggatcagtccaggaaatttt

SEQ ID NO: 552151 - DNA, 20 bp, mouse
ggttacagccaccacaaaga

SEQ ID NO: 552152 - DNA, 20 bp, mouse
gagtatccatgatggacaac

SEQ ID NO: 552153 - DNA, 20 bp, mouse
gagcataataatgaccaagt

SEQ ID NO: 552154 - DNA, 20 bp, mouse
gtctacctgacattgattgg

SEQ ID NO: 552155 - DNA, 20 bp, mouse
gactgtctatatctgtatca

SEQ ID NO: 552156 - DNA, 20 bp, mouse
gaaatattggactgctacta

SEQ ID NO: 552157 - DNA, 20 bp, mouse
ggcaggagtattattaaatg

SEQ ID NO: 552158 - DNA, 20 bp, mouse
gctaatgcccaaaattgaag

SEQ ID NO: 552159 - DNA, 20 bp, mouse
gaagtggaaataacagtatt

SEQ ID NO: 552160 - DNA, 20 bp, mouse
gatgttacaacaaacttaat

SEQ ID NO: 552161 - DNA, 20 bp, mouse
gtttgggaataccaaagttt

SEQ ID NO: 552162 - DNA, 20 bp, mouse
gtattaacctcttcaatttt

SEQ ID NO: 552163 - DNA, 20 bp, mouse
gatttttatgggactacagt

SEQ ID NO: 552164 - DNA, 20 bp, mouse
gttttgggcattagacatgc

SEQ ID NO: 552165 - DNA, 20 bp, mouse
gtactttttctgatataaag

SEQ ID NO: 552166 - DNA, 20 bp, mouse
gttcttcatgcatttctttg

SEQ ID NO: 552167 - DNA, 20 bp, mouse
gaataaatggattatgaaaa

SEQ ID NO: 552168 - DNA, 20 bp, mouse
gagtggaaagacacatgtcc

SEQ ID NO: 552169 - DNA, 20 bp, mouse
gtttccaagaagaaagtaca

SEQ ID NO: 552170 - DNA, 20 bp, mouse
gaagtacatgggagaatgaa

SEQ ID NO: 552171 - DNA, 20 bp, mouse
gtctatggtgctactgtggt

SEQ ID NO: 552172 - DNA, 20 bp, mouse
gatccttattatagtcacag

SEQ ID NO: 552173 - DNA, 20 bp, mouse
gatcttgggtgtcgtgacag

SEQ ID NO: 552174 - DNA, 20 bp, mouse
gccatttattcaattcagaa

SEQ ID NO: 552175 - DNA, 20 bp, mouse
ggatagtcatggccttcgac

SEQ ID NO: 552176 - DNA, 20 bp, mouse
gaaaatggctgaagaacatc

SEQ ID NO: 552177 - DNA, 20 bp, mouse
ggttcttcagccattttttg

SEQ ID NO: 552178 - DNA, 20 bp, mouse
gttcagcaccccccaaaaaa

SEQ ID NO: 552179 - DNA, 20 bp, mouse
ggaaagacacatgtctagga

SEQ ID NO: 552180 - DNA, 20 bp, mouse
gaaatacatgggagaatgaa

SEQ ID NO: 552181 - DNA, 20 bp, mouse
gaataaatggattataaaaa

SEQ ID NO: 552182 - DNA, 20 bp, mouse
gagtggaaagacacatgtct

SEQ ID NO: 552183 - DNA, 20 bp, mouse
gtctatggtgctactgtggt

SEQ ID NO: 552184 - DNA, 20 bp, mouse
gatccttattatagtcacag

SEQ ID NO: 552185 - DNA, 20 bp, mouse
gatcttgggtgtcgtgacag

SEQ ID NO: 552186 - DNA, 20 bp, mouse
gctcaccaccaccaaataga

SEQ ID NO: 552187 - DNA, 20 bp, mouse
gagctgaactgtgattgaaa

SEQ ID NO: 552188 - DNA, 20 bp, mouse
gttttctgtatccatctatt

SEQ ID NO: 552189 - DNA, 20 bp, mouse
gttgccttcagttatctgaa

SEQ ID NO: 552190 - DNA, 20 bp, mouse
gttctttcattcattgactt

SEQ ID NO: 552191 - DNA, 20 bp, mouse
gtttccattcagataactga

SEQ ID NO: 552192 - DNA, 20 bp, mouse
ggttgcccagcagtattgct

SEQ ID NO: 552193 - DNA, 20 bp, mouse
gtgagtctgaagtcactgtg

SEQ ID NO: 552194 - DNA, 20 bp, mouse
gaagtcagcaagcattttag

SEQ ID NO: 552195 - DNA, 20 bp, mouse
gttgggtctgtctagttcaa

SEQ ID NO: 552196 - DNA, 20 bp, mouse
gagtcactgtgaggatgatg

SEQ ID NO: 552197 - DNA, 20 bp, mouse
gtctgtgtccatcaatttgc

SEQ ID NO: 552198 - DNA, 20 bp, mouse
ggtgtccatcaatttgctgg

SEQ ID NO: 552199 - DNA, 20 bp, mouse
ggaccagagtgatacacaca

SEQ ID NO: 552200 - DNA, 20 bp, mouse
gggatgaaacccacaaacca

SEQ ID NO: 552201 - DNA, 20 bp, mouse
gcactctggtcatcatcccc

SEQ ID NO: 552202 - DNA, 20 bp, mouse
gtgccaactgactcattgta

SEQ ID NO: 552203 - DNA, 20 bp, mouse
gcgccgtgtgtgtatcactc

SEQ ID NO: 552204 - DNA, 20 bp, mouse
gttcaccaccagcaaattga

SEQ ID NO: 552205 - DNA, 20 bp, mouse
gatccatacaatgagtcagt

SEQ ID NO: 552206 - DNA, 20 bp, mouse
gtctttgttcatctctttac

SEQ ID NO: 552207 - DNA, 20 bp, mouse
gttgttcatctctttactgg

SEQ ID NO: 552208 - DNA, 20 bp, mouse
gcattctcgtctgcatttcc

SEQ ID NO: 552209 - DNA, 20 bp, mouse
ggtctgcatttcctggtttg

SEQ ID NO: 552210 - DNA, 20 bp, mouse
ggacgagaatgatacataca

SEQ ID NO: 552211 - DNA, 20 bp, mouse
gttaccttcaactatctgaa

SEQ ID NO: 552212 - DNA, 20 bp, mouse
gtttccattcagatagttga

SEQ ID NO: 552213 - DNA, 20 bp, mouse
gaagtcagcaagcatttttg

SEQ ID NO: 552214 - DNA, 20 bp, mouse
gttgtttcattcattgactt

SEQ ID NO: 552215 - DNA, 20 bp, mouse
gactcatgattgtcatgtag

SEQ ID NO: 552216 - DNA, 20 bp, mouse
ggctcacaataatgaatcca

SEQ ID NO: 552217 - DNA, 20 bp, mouse
gcggtgtggcaaagttagat

SEQ ID NO: 552218 - DNA, 20 bp, mouse
gtccacaagcatcttcggtg

SEQ ID NO: 552219 - DNA, 20 bp, mouse
gtgggactttctaaatcttg

SEQ ID NO: 552220 - DNA, 20 bp, mouse
gagcacaaactcagataccg

SEQ ID NO: 552221 - DNA, 20 bp, mouse
gtgactttacattggatata

SEQ ID NO: 552222 - DNA, 20 bp, mouse
ggcagatgtcaataaatgaa

SEQ ID NO: 552223 - DNA, 20 bp, mouse
ggccacaccgaagatgcttg

SEQ ID NO: 552224 - DNA, 20 bp, mouse
gtcttcttcatagctttgtt

SEQ ID NO: 552225 - DNA, 20 bp, mouse
gctacaatctaattatgaat

SEQ ID NO: 552226 - DNA, 20 bp, mouse
ggataacaccaattattcag

SEQ ID NO: 552227 - DNA, 20 bp, mouse
ggccttggtagtaatctctt

SEQ ID NO: 552228 - DNA, 20 bp, mouse
ggcccaagagattactacca

SEQ ID NO: 552229 - DNA, 20 bp, mouse
gaatctgtgccctgaatcca

SEQ ID NO: 552230 - DNA, 20 bp, mouse
gacaagactatatcattcag

SEQ ID NO: 552231 - DNA, 20 bp, mouse
gtcagacaccactgaataat

SEQ ID NO: 552232 - DNA, 20 bp, mouse
ggaataattggtgttatcca

SEQ ID NO: 552233 - DNA, 20 bp, mouse
gcacagctatgatgatgaga

SEQ ID NO: 552234 - DNA, 20 bp, mouse
gcatctctcctcctgtaaag

SEQ ID NO: 552235 - DNA, 20 bp, mouse
ggaaatacatcggtgagtgc

SEQ ID NO: 552236 - DNA, 20 bp, mouse
ggggctgtgttcaccctctt

SEQ ID NO: 552237 - DNA, 20 bp, mouse
gtcagatggaaatcacagtg

SEQ ID NO: 552238 - DNA, 20 bp, mouse
gatctagttacaatgaacag

SEQ ID NO: 552239 - DNA, 20 bp, mouse
gggccactgtgtagagtaga

SEQ ID NO: 552240 - DNA, 20 bp, mouse
gagagagggattgtcaattc

SEQ ID NO: 552241 - DNA, 20 bp, mouse
gaagtcatgactctgtcaga

SEQ ID NO: 552242 - DNA, 20 bp, mouse
ggcagagcaggtcagtatca

SEQ ID NO: 552243 - DNA, 20 bp, mouse
gcataccaccccccaagcat

SEQ ID NO: 552244 - DNA, 20 bp, mouse
gacaaaaatccacaaaagag

SEQ ID NO: 552245 - DNA, 20 bp, mouse
gtaggatcccaataccagca

SEQ ID NO: 552246 - DNA, 20 bp, mouse
gctgggactctctaattcct

SEQ ID NO: 552247 - DNA, 20 bp, mouse
gatcatcttgggagtagcaa

SEQ ID NO: 552248 - DNA, 20 bp, mouse
gtgaatccagatgatgaatg

SEQ ID NO: 552249 - DNA, 20 bp, mouse
gacccatgaggacaccacaa

SEQ ID NO: 552250 - DNA, 20 bp, mouse
gtgattgaggcatagcgcag

SEQ ID NO: 552251 - DNA, 20 bp, mouse
gctcagtaccagtgaacagg

SEQ ID NO: 552252 - DNA, 20 bp, mouse
gcaaaggcaatacacacctg

SEQ ID NO: 552253 - DNA, 20 bp, mouse
gacctggggacttatgattg

SEQ ID NO: 552254 - DNA, 20 bp, mouse
ggcctttgtggtgtcctcat

SEQ ID NO: 552255 - DNA, 20 bp, mouse
gaaaaatatctgtagttccc

SEQ ID NO: 552256 - DNA, 20 bp, mouse
gagtctacaggtagatggag

SEQ ID NO: 552257 - DNA, 20 bp, mouse
gagcagagtctacaggtaga

SEQ ID NO: 552258 - DNA, 20 bp, mouse
gtggtgttgcaaaggaggag

SEQ ID NO: 552259 - DNA, 20 bp, mouse
gagaagaatatctgaagctc

SEQ ID NO: 552260 - DNA, 20 bp, mouse
ggtccaagtaacacgaattc

SEQ ID NO: 552261 - DNA, 20 bp, mouse
gaacacgaattccggcactc

SEQ ID NO: 552262 - DNA, 20 bp, mouse
ggcatatgtcaatcagagaa

SEQ ID NO: 552263 - DNA, 20 bp, mouse
gcttaaccattccagagtgc

SEQ ID NO: 552264 - DNA, 20 bp, mouse
gtgccggaattcgtgttact

SEQ ID NO: 552265 - DNA, 20 bp, mouse
gtaattgttgaatagtagag

SEQ ID NO: 552266 - DNA, 20 bp, mouse
gtgactgggtcagtcctatg

SEQ ID NO: 552267 - DNA, 20 bp, mouse
ggcgctgaatgtcatgtgac

SEQ ID NO: 552268 - DNA, 20 bp, mouse
gcatcacatagcaggctcta

SEQ ID NO: 552269 - DNA, 20 bp, mouse
gattgtggctcccaggatgt

SEQ ID NO: 552270 - DNA, 20 bp, mouse
gtaacccttcaccccctcca

SEQ ID NO: 552271 - DNA, 20 bp, mouse
gggatgatcaggatatttcc

SEQ ID NO: 552272 - DNA, 20 bp, mouse
gaagaagtctaccaacatcc

SEQ ID NO: 552273 - DNA, 20 bp, mouse
gtctgatggtcaggatgatc

SEQ ID NO: 552274 - DNA, 20 bp, mouse
gagggtctgatctgatggtc

SEQ ID NO: 552275 - DNA, 20 bp, mouse
ggccaacaacatcacatagc

SEQ ID NO: 552276 - DNA, 20 bp, mouse
gtatttgttgatgttgtata

SEQ ID NO: 552277 - DNA, 20 bp, mouse
ggttgatgttgtatagggac

SEQ ID NO: 552278 - DNA, 20 bp, mouse
gtgacagtggagtaatacaa

SEQ ID NO: 552279 - DNA, 20 bp, mouse
gtcacagaattcatcttcac

SEQ ID NO: 552280 - DNA, 20 bp, mouse
gactctgggattcatgacag

SEQ ID NO: 552281 - DNA, 20 bp, mouse
ggttgtatagggactggcga

SEQ ID NO: 552282 - DNA, 20 bp, mouse
gagggtctgatatgatggtg

SEQ ID NO: 552283 - DNA, 20 bp, mouse
gggatgatgaagacatttcc

SEQ ID NO: 552284 - DNA, 20 bp, mouse
gaacatcacatagcagactc

SEQ ID NO: 552285 - DNA, 20 bp, mouse
gcccctctttatttattcct

SEQ ID NO: 552286 - DNA, 20 bp, mouse
gggtagcatagtggagaggg

SEQ ID NO: 552287 - DNA, 20 bp, mouse
ggtgagaataaattcggtca

SEQ ID NO: 552288 - DNA, 20 bp, mouse
gagaccagtgagaataaatt

SEQ ID NO: 552289 - DNA, 20 bp, mouse
gagaataaattcggtcacgg

SEQ ID NO: 552290 - DNA, 20 bp, mouse
ggtcagcaggaacatctcag

SEQ ID NO: 552291 - DNA, 20 bp, mouse
gtacatgggagaactcaaat

SEQ ID NO: 552292 - DNA, 20 bp, mouse
gagaggaataccaaatatca

SEQ ID NO: 552293 - DNA, 20 bp, mouse
gagataataaggatattcac

SEQ ID NO: 552294 - DNA, 20 bp, mouse
gcagagccggcggttcatga

SEQ ID NO: 552295 - DNA, 20 bp, mouse
ggcggcagatggcagcgtag

SEQ ID NO: 552296 - DNA, 20 bp, mouse
gagagtatcaagcgacctag

SEQ ID NO: 552297 - DNA, 20 bp, mouse
ggagctcccaggaagacgac

SEQ ID NO: 552298 - DNA, 20 bp, mouse
ggtacatgggtgactggaac

SEQ ID NO: 552299 - DNA, 20 bp, mouse
gctgggcctgtcgtcttcct

SEQ ID NO: 552300 - DNA, 20 bp, mouse
gttgatagtgatggtcgtcc

SEQ ID NO: 552301 - DNA, 20 bp, mouse
gatttcccaggacaataacc

SEQ ID NO: 552302 - DNA, 20 bp, mouse
gtggctgtacccaaaatgct

SEQ ID NO: 552303 - DNA, 20 bp, mouse
gaaaatagtacatgggtgac

SEQ ID NO: 552304 - DNA, 20 bp, mouse
gaagaaagaatacctgggcc

SEQ ID NO: 552305 - DNA, 20 bp, mouse
gaaagtgaagaaagaatacc

SEQ ID NO: 552306 - DNA, 20 bp, mouse
ggatgaagtgactcacagta

SEQ ID NO: 552307 - DNA, 20 bp, mouse
ggaagaagtacaactggagt

SEQ ID NO: 552308 - DNA, 20 bp, mouse
gacagtatgggaagcatttc

SEQ ID NO: 552309 - DNA, 20 bp, mouse
gtggagtaggcatcgagtga

SEQ ID NO: 552310 - DNA, 20 bp, mouse
ggacagtggggtagtgcagt

SEQ ID NO: 552311 - DNA, 20 bp, mouse
gcatagtggtcatgacagtg

SEQ ID NO: 552312 - DNA, 20 bp, mouse
gaggttgccacagaacatag

SEQ ID NO: 552313 - DNA, 20 bp, mouse
gctgtatttctctgcggcaa

SEQ ID NO: 552314 - DNA, 20 bp, mouse
gcagtgggcggcagattgcc

SEQ ID NO: 552315 - DNA, 20 bp, mouse
gtcatgaccactatgttctg

SEQ ID NO: 552316 - DNA, 20 bp, mouse
gtagaggtctgcagatggca

SEQ ID NO: 552317 - DNA, 20 bp, mouse
gcttcccctgccccaaggag

SEQ ID NO: 552318 - DNA, 20 bp, mouse
ggaggatttgcccctccttg

SEQ ID NO: 552319 - DNA, 20 bp, mouse
gaacttcctctctgacacga

SEQ ID NO: 552320 - DNA, 20 bp, mouse
gatttgcccctccttggggc

SEQ ID NO: 552321 - DNA, 20 bp, mouse
gtagcacacagcacatatga

SEQ ID NO: 552322 - DNA, 20 bp, mouse
ggagttgctggggctgctaa

SEQ ID NO: 552323 - DNA, 20 bp, mouse
gggtgacataccagatttct

SEQ ID NO: 552324 - DNA, 20 bp, mouse
gatggaagcattgcccatga

SEQ ID NO: 552325 - DNA, 20 bp, mouse
gatgaagccagtgatgatgc

SEQ ID NO: 552326 - DNA, 20 bp, mouse
ggctccaacaacaccatcac

SEQ ID NO: 552327 - DNA, 20 bp, mouse
ggtgttgttggagctgctga

SEQ ID NO: 552328 - DNA, 20 bp, mouse
gaagccagtgatggtgttgt

SEQ ID NO: 552329 - DNA, 20 bp, mouse
gaatgaccttgttttcagag

SEQ ID NO: 552330 - DNA, 20 bp, mouse
gaacttcctctctgaaaaca

SEQ ID NO: 552331 - DNA, 20 bp, mouse
gggtgacataacagatttcc

SEQ ID NO: 552332 - DNA, 20 bp, mouse
gcagcacacagcacatatga

SEQ ID NO: 552333 - DNA, 20 bp, mouse
gtgcaggaagcatccagcga

SEQ ID NO: 552334 - DNA, 20 bp, mouse
gagcattgcccatgagggta

SEQ ID NO: 552335 - DNA, 20 bp, mouse
gattgcccatgagggtaagg

SEQ ID NO: 552336 - DNA, 20 bp, mouse
gtgtctgaaaaaaacaatag

SEQ ID NO: 552337 - DNA, 20 bp, mouse
ggtggtgggatcctacgcat

SEQ ID NO: 552338 - DNA, 20 bp, mouse
gtacataggggaatgcagtt

SEQ ID NO: 552339 - DNA, 20 bp, mouse
gcagaaactctgtatcacac

SEQ ID NO: 552340 - DNA, 20 bp, mouse
gcatgtgaacccccatgcgt

SEQ ID NO: 552341 - DNA, 20 bp, mouse
gcttaaagtccctctcttct

SEQ ID NO: 552342 - DNA, 20 bp, mouse
ggtagaacacgtcagtgtca

SEQ ID NO: 552343 - DNA, 20 bp, mouse
ggggattattttcaccctct

SEQ ID NO: 552344 - DNA, 20 bp, mouse
gggttatgtcttttgcaaca

SEQ ID NO: 552345 - DNA, 20 bp, mouse
ggagaaacaccaagaagaga

SEQ ID NO: 552346 - DNA, 20 bp, mouse
gggtggtgctggagttgatg

SEQ ID NO: 552347 - DNA, 20 bp, mouse
gacacccatgtacctactgc

SEQ ID NO: 552348 - DNA, 20 bp, mouse
gatcatctttgcagtatgct

SEQ ID NO: 552349 - DNA, 20 bp, mouse
gccactggcttcattctctt

SEQ ID NO: 552350 - DNA, 20 bp, mouse
gtcaactccagcaccaccac

SEQ ID NO: 552351 - DNA, 20 bp, mouse
ggttgcccatgagggtaagc

SEQ ID NO: 552352 - DNA, 20 bp, mouse
gatgcaagtgttgcccatga

SEQ ID NO: 552353 - DNA, 20 bp, mouse
gagggtaagcaggtagacaa

SEQ ID NO: 552354 - DNA, 20 bp, mouse
gttggtgtcagagaggaaat

SEQ ID NO: 552355 - DNA, 20 bp, mouse
gggtaacataccagatctcc

SEQ ID NO: 552356 - DNA, 20 bp, mouse
gttgggcttcgcctacccca

SEQ ID NO: 552357 - DNA, 20 bp, mouse
gacccagcaactggtcacaa

SEQ ID NO: 552358 - DNA, 20 bp, mouse
gggtcacaagggtgtttcgg

SEQ ID NO: 552359 - DNA, 20 bp, mouse
gacatatccaatctccatga

SEQ ID NO: 552360 - DNA, 20 bp, mouse
gactggtcacaagggtgttt

SEQ ID NO: 552361 - DNA, 20 bp, mouse
gggcttcgcctaccccaggg

SEQ ID NO: 552362 - DNA, 20 bp, mouse
gacccccatgtaccttctgc

SEQ ID NO: 552363 - DNA, 20 bp, mouse
gaaaccaagcacccagcaac

SEQ ID NO: 552364 - DNA, 20 bp, mouse
gcacccttgtgaccagttgc

SEQ ID NO: 552365 - DNA, 20 bp, mouse
ggatgaccttggtgtctgaa

SEQ ID NO: 552366 - DNA, 20 bp, mouse
gaaaaggatgaagcctgtga

SEQ ID NO: 552367 - DNA, 20 bp, mouse
ggttgcccatgaggatgagt

SEQ ID NO: 552368 - DNA, 20 bp, mouse
gtctacctactcatcctcat

SEQ ID NO: 552369 - DNA, 20 bp, mouse
gaatgatcttgttgtcagag

SEQ ID NO: 552370 - DNA, 20 bp, mouse
ggaagaagatcacaaagaga

SEQ ID NO: 552371 - DNA, 20 bp, mouse
ggatggtgctggaattgctg

SEQ ID NO: 552372 - DNA, 20 bp, mouse
gagtgacataccagatttcc

SEQ ID NO: 552373 - DNA, 20 bp, mouse
gggcgcctagtcatgagaga

SEQ ID NO: 552374 - DNA, 20 bp, mouse
gtgcaggaagcatccagcga

SEQ ID NO: 552375 - DNA, 20 bp, mouse
gacaagatcatttccttcgc

SEQ ID NO: 552376 - DNA, 20 bp, mouse
gcaactccagcaccatcact

SEQ ID NO: 552377 - DNA, 20 bp, mouse
ggcgcccagtcatgagagca

SEQ ID NO: 552378 - DNA, 20 bp, mouse
gataaatctgggtcttcagc

SEQ ID NO: 552379 - DNA, 20 bp, mouse
gtcgataccttgctatctgc

SEQ ID NO: 552380 - DNA, 20 bp, mouse
ggtgatttaaatataaatct

SEQ ID NO: 552381 - DNA, 20 bp, mouse
gttatctatttgataatttc

SEQ ID NO: 552382 - DNA, 20 bp, mouse
gtagaggcctgcagatagca

SEQ ID NO: 552383 - DNA, 20 bp, mouse
gctggccaacttttctttcc

SEQ ID NO: 552384 - DNA, 20 bp, mouse
gagggtaaggaggtagacaa

SEQ ID NO: 552385 - DNA, 20 bp, mouse
gaatttctggtactttcaca

SEQ ID NO: 552386 - DNA, 20 bp, mouse
gcctgggtttcagtaatcag

SEQ ID NO: 552387 - DNA, 20 bp, mouse
gtccattccccagcaaggtc

SEQ ID NO: 552388 - DNA, 20 bp, mouse
gtgaccttttgagcaatagg

SEQ ID NO: 552389 - DNA, 20 bp, mouse
gtattgctcaaaaggtcatc

SEQ ID NO: 552390 - DNA, 20 bp, mouse
gactgagaaatgagtgatca

SEQ ID NO: 552391 - DNA, 20 bp, mouse
gattccccagcaaggtcagg

SEQ ID NO: 552392 - DNA, 20 bp, mouse
gttacctcctgaccttgctg

SEQ ID NO: 552393 - DNA, 20 bp, mouse
ggttcctcctattgctcaaa

SEQ ID NO: 552394 - DNA, 20 bp, mouse
gaaatagaattgaaggaagc

SEQ ID NO: 552395 - DNA, 20 bp, mouse
gtccaccatcccaaacatgt

SEQ ID NO: 552396 - DNA, 20 bp, mouse
gaacgtgtcagagggatcca

SEQ ID NO: 552397 - DNA, 20 bp, mouse
gttgaatcttccagggacca

SEQ ID NO: 552398 - DNA, 20 bp, mouse
ggtatgatttgaatcttcca

SEQ ID NO: 552399 - DNA, 20 bp, mouse
gttgtcttattgggattccc

SEQ ID NO: 552400 - DNA, 20 bp, mouse
ggccaggaacatatacatag

SEQ ID NO: 552401 - DNA, 20 bp, mouse
ggtgatcatgaacgtgtcag

SEQ ID NO: 552402 - DNA, 20 bp, mouse
gatcataagccatggcacag

SEQ ID NO: 552403 - DNA, 20 bp, mouse
gtcatgatcaccagactgtg

SEQ ID NO: 552404 - DNA, 20 bp, mouse
gattgggattccctggtccc

SEQ ID NO: 552405 - DNA, 20 bp, mouse
gcagtgggtagcagatggct

SEQ ID NO: 552406 - DNA, 20 bp, mouse
gtggcatctaaatatctgaa

SEQ ID NO: 552407 - DNA, 20 bp, mouse
ggcctcctagtcatgatagt

SEQ ID NO: 552408 - DNA, 20 bp, mouse
ggctagtatgttaggaatag

SEQ ID NO: 552409 - DNA, 20 bp, mouse
gtgtgctactgatctgttca

SEQ ID NO: 552410 - DNA, 20 bp, mouse
gttggtcttagacagaatgt

SEQ ID NO: 552411 - DNA, 20 bp, mouse
gagtatgttaggaatagtgg

SEQ ID NO: 552412 - DNA, 20 bp, mouse
gttgttctcttgggatttcc

SEQ ID NO: 552413 - DNA, 20 bp, mouse
gagtagggtaatgtaatggg

SEQ ID NO: 552414 - DNA, 20 bp, mouse
gcaccaaaaacaacacgaag

SEQ ID NO: 552415 - DNA, 20 bp, mouse
ggatagtagggtaatgtaat

SEQ ID NO: 552416 - DNA, 20 bp, mouse
gggccatcatttgtgcagtg

SEQ ID NO: 552417 - DNA, 20 bp, mouse
gaacgtgtcagagggatcca

SEQ ID NO: 552418 - DNA, 20 bp, mouse
gttgaatcttccagggacca

SEQ ID NO: 552419 - DNA, 20 bp, mouse
ggtgtgatttgaatcttcca

SEQ ID NO: 552420 - DNA, 20 bp, mouse
gttgtcttattgggattccc

SEQ ID NO: 552421 - DNA, 20 bp, mouse
ggccaggaacatatacatag

SEQ ID NO: 552422 - DNA, 20 bp, mouse
ggtgatcatgaacgtgtcag

SEQ ID NO: 552423 - DNA, 20 bp, mouse
gatcataagccatggcacag

SEQ ID NO: 552424 - DNA, 20 bp, mouse
gtcatgatcaccagactgtg

SEQ ID NO: 552425 - DNA, 20 bp, mouse
gattgggattccctggtccc

SEQ ID NO: 552426 - DNA, 20 bp, mouse
gtcaggaaacctagccagtg

SEQ ID NO: 552427 - DNA, 20 bp, mouse
gtccactaatagaggagatt

SEQ ID NO: 552428 - DNA, 20 bp, mouse
gagtttctaccccactggct

SEQ ID NO: 552429 - DNA, 20 bp, mouse
gacccaatctcctctattag

SEQ ID NO: 552430 - DNA, 20 bp, mouse
gaatctgtttccactaatag

SEQ ID NO: 552431 - DNA, 20 bp, mouse
gattttaactactccagatc

SEQ ID NO: 552432 - DNA, 20 bp, mouse
gtgtgttgagtgagcatcct

SEQ ID NO: 552433 - DNA, 20 bp, mouse
gcctaccagtgcaagtgtga

SEQ ID NO: 552434 - DNA, 20 bp, mouse
gacacttgcactggtaggtt

SEQ ID NO: 552435 - DNA, 20 bp, mouse
gggtataaatgacaactcag

SEQ ID NO: 552436 - DNA, 20 bp, mouse
gcagctgggaaagataataa

SEQ ID NO: 552437 - DNA, 20 bp, mouse
gcacgtgcgaaccagagtgt

SEQ ID NO: 552438 - DNA, 20 bp, mouse
gaaccagagtgtcggcacta

SEQ ID NO: 552439 - DNA, 20 bp, mouse
gctccgtagtgccgacactc

SEQ ID NO: 552440 - DNA, 20 bp, mouse
gggcactacggagtttgtcc

SEQ ID NO: 552441 - DNA, 20 bp, mouse
gcaaggggtaatgcagagga

SEQ ID NO: 552442 - DNA, 20 bp, mouse
gagacatgacggccaacagt

SEQ ID NO: 552443 - DNA, 20 bp, mouse
gagaagtgatcagaatctcg

SEQ ID NO: 552444 - DNA, 20 bp, mouse
gtttctctgagtttcaggat

SEQ ID NO: 552445 - DNA, 20 bp, mouse
gttagcaaggggtaatgcag

SEQ ID NO: 552446 - DNA, 20 bp, mouse
ggaagattcggagttctggg

SEQ ID NO: 552447 - DNA, 20 bp, mouse
gcatggctctaaccaacaca

SEQ ID NO: 552448 - DNA, 20 bp, mouse
ggatgagctgttccatgtgt

SEQ ID NO: 552449 - DNA, 20 bp, mouse
gttgtggtctgtgtgaaaca

SEQ ID NO: 552450 - DNA, 20 bp, mouse
gagaccctggggcatgatgg

SEQ ID NO: 552451 - DNA, 20 bp, mouse
gtaaccatgttcatcttctt

SEQ ID NO: 552452 - DNA, 20 bp, mouse
ggaactgagcaccacatccc

SEQ ID NO: 552453 - DNA, 20 bp, mouse
gcagagaccctggggcatga

SEQ ID NO: 552454 - DNA, 20 bp, mouse
gtagagcagggggttagaga

SEQ ID NO: 552455 - DNA, 20 bp, mouse
ggatggtggtgtagagcagg

SEQ ID NO: 552456 - DNA, 20 bp, mouse
gcaccacagagaagtgacgc

SEQ ID NO: 552457 - DNA, 20 bp, mouse
gccagctggctacccctctc

SEQ ID NO: 552458 - DNA, 20 bp, mouse
gggtagccagctggagacaa

SEQ ID NO: 552459 - DNA, 20 bp, mouse
gggaataaaaaaattaaaaa

SEQ ID NO: 552460 - DNA, 20 bp, mouse
gtaaaaagggaagccagaga

SEQ ID NO: 552461 - DNA, 20 bp, mouse
ggctggcaagagggatggtg

SEQ ID NO: 552462 - DNA, 20 bp, mouse
gcatttccccaaagcagact

SEQ ID NO: 552463 - DNA, 20 bp, mouse
gagagtccgccagcgtaagg

SEQ ID NO: 552464 - DNA, 20 bp, mouse
gggaggtcagccaacatccg

SEQ ID NO: 552465 - DNA, 20 bp, mouse
gaagcagctggcaagaggga

SEQ ID NO: 552466 - DNA, 20 bp, mouse
gcacaaacatcttcatcccc

SEQ ID NO: 552467 - DNA, 20 bp, mouse
gcaagagcagagaaccagat

SEQ ID NO: 552468 - DNA, 20 bp, mouse
ggactcatcaaagtgatggg

SEQ ID NO: 552469 - DNA, 20 bp, mouse
ggctgactcatcaaagtgat

SEQ ID NO: 552470 - DNA, 20 bp, mouse
gctggttctctgctcttggc

SEQ ID NO: 552471 - DNA, 20 bp, mouse
gaacagagtctgtacccatc

SEQ ID NO: 552472 - DNA, 20 bp, mouse
gtcttggctggctgggttga

SEQ ID NO: 552473 - DNA, 20 bp, mouse
ggacatccgtgagtcctaga

SEQ ID NO: 552474 - DNA, 20 bp, mouse
gttcatccttctaggactca

SEQ ID NO: 552475 - DNA, 20 bp, mouse
gagcagggtgaggacgagga

SEQ ID NO: 552476 - DNA, 20 bp, mouse
gacgaacatcttcattccca

SEQ ID NO: 552477 - DNA, 20 bp, mouse
ggacatccgtgagacctaga

SEQ ID NO: 552478 - DNA, 20 bp, mouse
gatcagggtgagaaagttag

SEQ ID NO: 552479 - DNA, 20 bp, mouse
gagatgaaaaagagtaatca

SEQ ID NO: 552480 - DNA, 20 bp, mouse
gtaggaaggagaagttccgg

SEQ ID NO: 552481 - DNA, 20 bp, mouse
gccaatcatgctgaatacat

SEQ ID NO: 552482 - DNA, 20 bp, mouse
gtaatgctgaccaggaccct

SEQ ID NO: 552483 - DNA, 20 bp, mouse
gggtgaggatgaggatggtc

SEQ ID NO: 552484 - DNA, 20 bp, mouse
ggtgttctgatgagcaccag

SEQ ID NO: 552485 - DNA, 20 bp, mouse
gttctaggaaggagaagttc

SEQ ID NO: 552486 - DNA, 20 bp, mouse
gatcattggttagtcctacc

SEQ ID NO: 552487 - DNA, 20 bp, mouse
gcccagacgccattgtgtag

SEQ ID NO: 552488 - DNA, 20 bp, mouse
gccaattacgctcaataagt

SEQ ID NO: 552489 - DNA, 20 bp, mouse
gcccagattcctctacacaa

SEQ ID NO: 552490 - DNA, 20 bp, mouse
ggcacatgcattgtaggtaa

SEQ ID NO: 552491 - DNA, 20 bp, mouse
gcaaaagggagaaatttctg

SEQ ID NO: 552492 - DNA, 20 bp, mouse
gtgtgaatgagacttccaaa

SEQ ID NO: 552493 - DNA, 20 bp, mouse
gcttattggctgttatttaa

SEQ ID NO: 552494 - DNA, 20 bp, mouse
gtaaagcttatgctataagg

SEQ ID NO: 552495 - DNA, 20 bp, mouse
ggccattgtgtagaggaatc

SEQ ID NO: 552496 - DNA, 20 bp, mouse
gtgtagaagtcatgagtgtt

SEQ ID NO: 552497 - DNA, 20 bp, mouse
gaatctgggaatgcatacag

SEQ ID NO: 552498 - DNA, 20 bp, mouse
gacattcaggctacattgcc

SEQ ID NO: 552499 - DNA, 20 bp, mouse
gtgtcagagtgataatggtg

SEQ ID NO: 552500 - DNA, 20 bp, mouse
gcctgtcacactcaatatat

SEQ ID NO: 552501 - DNA, 20 bp, mouse
gacaacaaaaaacaactgag

SEQ ID NO: 552502 - DNA, 20 bp, mouse
ggcacaagcattgtaagtaa

SEQ ID NO: 552503 - DNA, 20 bp, mouse
gccatcatgtacaggaatct

SEQ ID NO: 552504 - DNA, 20 bp, mouse
gaaaagtgtcagagtgataa

SEQ ID NO: 552505 - DNA, 20 bp, mouse
gttctgacacttctttcttc

SEQ ID NO: 552506 - DNA, 20 bp, mouse
gagtgatagttggatagaca

SEQ ID NO: 552507 - DNA, 20 bp, mouse
gatttatagcataattctaa

SEQ ID NO: 552508 - DNA, 20 bp, mouse
gtattctacacttcaaaaat

SEQ ID NO: 552509 - DNA, 20 bp, mouse
gtattcctagacatttaaat

SEQ ID NO: 552510 - DNA, 20 bp, mouse
gggagcttaccttgtattaa

SEQ ID NO: 552511 - DNA, 20 bp, mouse
gactttaatattactaagaa

SEQ ID NO: 552512 - DNA, 20 bp, mouse
gaatataatctgcattaaag

SEQ ID NO: 552513 - DNA, 20 bp, mouse
gtccagggaataattcttat

SEQ ID NO: 552514 - DNA, 20 bp, mouse
gaaaaagtagagattttcca

SEQ ID NO: 552515 - DNA, 20 bp, mouse
gatctgcattaaagtggtag

SEQ ID NO: 552516 - DNA, 20 bp, mouse
gaaatcaagagtcaactatg

SEQ ID NO: 552517 - DNA, 20 bp, mouse
gattcaacaagtaggtaaga

SEQ ID NO: 552518 - DNA, 20 bp, mouse
gtttgactcaggctaaaggg

SEQ ID NO: 552519 - DNA, 20 bp, mouse
gccagttatattcaacaagt

SEQ ID NO: 552520 - DNA, 20 bp, mouse
ggtaacgacattcattctcc

SEQ ID NO: 552521 - DNA, 20 bp, mouse
gcaaagaaggagtcttctgc

SEQ ID NO: 552522 - DNA, 20 bp, mouse
gctagattatacaagtatct

SEQ ID NO: 552523 - DNA, 20 bp, mouse
gtcggtgaaaaatgcttgac

SEQ ID NO: 552524 - DNA, 20 bp, mouse
gtcagttactccaaaaaggt

SEQ ID NO: 552525 - DNA, 20 bp, mouse
gacttgtataatctagcaac

SEQ ID NO: 552526 - DNA, 20 bp, mouse
ggttagtcccagcagaatga

SEQ ID NO: 552527 - DNA, 20 bp, mouse
gagtcccagcagaatgaagg

SEQ ID NO: 552528 - DNA, 20 bp, mouse
gtaaccaccttcattctgct

SEQ ID NO: 552529 - DNA, 20 bp, mouse
gaaattggaatctgaagttg

SEQ ID NO: 552530 - DNA, 20 bp, mouse
gtgatggttacataatgtag

SEQ ID NO: 552531 - DNA, 20 bp, mouse
gtatcgatcgtaggacataa

SEQ ID NO: 552532 - DNA, 20 bp, mouse
gagtttaggaacagagtgag

SEQ ID NO: 552533 - DNA, 20 bp, mouse
gtgggagtctaatatagtga

SEQ ID NO: 552534 - DNA, 20 bp, mouse
gcaacatagcaaccggagac

SEQ ID NO: 552535 - DNA, 20 bp, mouse
ggtaaatgaaatttctaata

SEQ ID NO: 552536 - DNA, 20 bp, mouse
gaaaccagaaatcagtgatg

SEQ ID NO: 552537 - DNA, 20 bp, mouse
ggatgaaagttgtgacagtg

SEQ ID NO: 552538 - DNA, 20 bp, mouse
gtcacaactttcatcttact

SEQ ID NO: 552539 - DNA, 20 bp, mouse
gaggtcagtaaaaaatactt

SEQ ID NO: 552540 - DNA, 20 bp, mouse
gtatgttatacaggtatctg

SEQ ID NO: 552541 - DNA, 20 bp, mouse
gtgaggatccactaagatga

SEQ ID NO: 552542 - DNA, 20 bp, mouse
ggttcctcatcactgatttc

SEQ ID NO: 552543 - DNA, 20 bp, mouse
gccagaaatgctcagtgagt

SEQ ID NO: 552544 - DNA, 20 bp, mouse
gactaagatgagggagatga

SEQ ID NO: 552545 - DNA, 20 bp, mouse
gacagatgaccagcaactgc

SEQ ID NO: 552546 - DNA, 20 bp, mouse
gtaggccaaggctaagtggg

SEQ ID NO: 552547 - DNA, 20 bp, mouse
gatttaggccaaggctaagt

SEQ ID NO: 552548 - DNA, 20 bp, mouse
ggaactgcagatttaggcca

SEQ ID NO: 552549 - DNA, 20 bp, mouse
gtaatccccccacttagcct

SEQ ID NO: 552550 - DNA, 20 bp, mouse
gtcacaactttcatcttact

SEQ ID NO: 552551 - DNA, 20 bp, mouse
gccagaaatgctcagtgagt

SEQ ID NO: 552552 - DNA, 20 bp, mouse
gaggtcagtaaaaaatactt

SEQ ID NO: 552553 - DNA, 20 bp, mouse
gtatgttatacaggtatctg

SEQ ID NO: 552554 - DNA, 20 bp, mouse
gacagatgaccagcaactgc

SEQ ID NO: 552555 - DNA, 20 bp, mouse
gaaaccagaaatcagtgatg

SEQ ID NO: 552556 - DNA, 20 bp, mouse
gatgcccaagagcagaaact

SEQ ID NO: 552557 - DNA, 20 bp, mouse
gtcaccgagtttctgctctt

SEQ ID NO: 552558 - DNA, 20 bp, mouse
gaaactcggtgataacagag

SEQ ID NO: 552559 - DNA, 20 bp, mouse
gctgagagtctagcaatgtg

SEQ ID NO: 552560 - DNA, 20 bp, mouse
gcctcacctcatggctggga

SEQ ID NO: 552561 - DNA, 20 bp, mouse
gaaatcacaaactgaagttc

SEQ ID NO: 552562 - DNA, 20 bp, mouse
gagcatgagcaatggaaaga

SEQ ID NO: 552563 - DNA, 20 bp, mouse
gttgtcctcacctcatggct

SEQ ID NO: 552564 - DNA, 20 bp, mouse
gtgagaaacagcatgagcaa

SEQ ID NO: 552565 - DNA, 20 bp, mouse
gagaaaccctcccagccatg

SEQ ID NO: 552566 - DNA, 20 bp, mouse
gtttctgtccctagattttt

SEQ ID NO: 552567 - DNA, 20 bp, mouse
ggtggataagcatgattaaa

SEQ ID NO: 552568 - DNA, 20 bp, mouse
gatgcctgagagcaaaaact

SEQ ID NO: 552569 - DNA, 20 bp, mouse
gttaccgagtttttgctctc

SEQ ID NO: 552570 - DNA, 20 bp, mouse
gttattgatcccaaaaatct

SEQ ID NO: 552571 - DNA, 20 bp, mouse
gtcctcacctcatggctgat

SEQ ID NO: 552572 - DNA, 20 bp, mouse
gagaaatcctatcagccatg

SEQ ID NO: 552573 - DNA, 20 bp, mouse
gagtatgagaaaccactcta

SEQ ID NO: 552574 - DNA, 20 bp, mouse
gtcagacacaccagaagtcc

SEQ ID NO: 552575 - DNA, 20 bp, mouse
gaaactcggtaaccatagag

SEQ ID NO: 552576 - DNA, 20 bp, mouse
gttactgagtttgtactctt

SEQ ID NO: 552577 - DNA, 20 bp, mouse
ggaggataagcataattaaa

SEQ ID NO: 552578 - DNA, 20 bp, mouse
gacatagcgatcgtaagaca

SEQ ID NO: 552579 - DNA, 20 bp, mouse
gagtatgagaaaccactcta

SEQ ID NO: 552580 - DNA, 20 bp, mouse
gtcagacacaccagaagtcc

SEQ ID NO: 552581 - DNA, 20 bp, mouse
gaaactcagtaaccatagag

SEQ ID NO: 552582 - DNA, 20 bp, mouse
gctcagacactcccagagaa

SEQ ID NO: 552583 - DNA, 20 bp, mouse
gtttaactgggaatctagca

SEQ ID NO: 552584 - DNA, 20 bp, mouse
gatacataggagtctttaac

SEQ ID NO: 552585 - DNA, 20 bp, mouse
gaaggataaaaatcacaacc

SEQ ID NO: 552586 - DNA, 20 bp, mouse
ggatgaatgttgttactgtg

SEQ ID NO: 552587 - DNA, 20 bp, mouse
gtattttgtactgatctttt

SEQ ID NO: 552588 - DNA, 20 bp, mouse
ggccagctgcccagcaactg

SEQ ID NO: 552589 - DNA, 20 bp, mouse
gtagcaccatcatgagcagt

SEQ ID NO: 552590 - DNA, 20 bp, mouse
gagacttatcctcagttgct

SEQ ID NO: 552591 - DNA, 20 bp, mouse
gatcatccgtcagtcccagt

SEQ ID NO: 552592 - DNA, 20 bp, mouse
gctatatgctgagtatgact

SEQ ID NO: 552593 - DNA, 20 bp, mouse
ggtaacaacattcatcctac

SEQ ID NO: 552594 - DNA, 20 bp, mouse
ggcttgaggcccaggctaag

SEQ ID NO: 552595 - DNA, 20 bp, mouse
gggtaagggatatgatcgtg

SEQ ID NO: 552596 - DNA, 20 bp, mouse
gatggagacaacaaacatgt

SEQ ID NO: 552597 - DNA, 20 bp, mouse
gaacatgtgggatgtgcagg

SEQ ID NO: 552598 - DNA, 20 bp, mouse
ggtcaccactgctaagacaa

SEQ ID NO: 552599 - DNA, 20 bp, mouse
ggtgacacttgtagtcacac

SEQ ID NO: 552600 - DNA, 20 bp, mouse
gtgcaggagatctgtaaaat

SEQ ID NO: 552601 - DNA, 20 bp, mouse
gtgggatgtgcaggtggaga

SEQ ID NO: 552602 - DNA, 20 bp, mouse
gatgtcctttgtcttagcag

SEQ ID NO: 552603 - DNA, 20 bp, mouse
gtatattaaaccatctgcaa

SEQ ID NO: 552604 - DNA, 20 bp, mouse
ggtgcaggtggagaaggctt

SEQ ID NO: 552605 - DNA, 20 bp, mouse
gagagagtgtctgtgtctaa

SEQ ID NO: 552606 - DNA, 20 bp, mouse
gtcgagggaccggttcccag

SEQ ID NO: 552607 - DNA, 20 bp, mouse
ggggagtgcccacaccctag

SEQ ID NO: 552608 - DNA, 20 bp, mouse
gtggagatcagcagagtcga

SEQ ID NO: 552609 - DNA, 20 bp, mouse
gcaggcaagtggagtcctcg

SEQ ID NO: 552610 - DNA, 20 bp, mouse
ggtatgtatggctcacccag

SEQ ID NO: 552611 - DNA, 20 bp, mouse
gtagcactgccgctgggaac

SEQ ID NO: 552612 - DNA, 20 bp, mouse
gcactgtgcctctagggtgt

SEQ ID NO: 552613 - DNA, 20 bp, mouse
gatggctcacccagaggcag

SEQ ID NO: 552614 - DNA, 20 bp, mouse
gagggtgtgggcactccccg

SEQ ID NO: 552615 - DNA, 20 bp, mouse
gctaattcactgtgcctcta

SEQ ID NO: 552616 - DNA, 20 bp, mouse
gaggatcatcagtgagtccc

SEQ ID NO: 552617 - DNA, 20 bp, mouse
ggaatgttgtaattgaagtg

SEQ ID NO: 552618 - DNA, 20 bp, mouse
gtgttaatgtcagggacact

SEQ ID NO: 552619 - DNA, 20 bp, mouse
gtagggatccactgtagtga

SEQ ID NO: 552620 - DNA, 20 bp, mouse
gtgacattaacatttaagtt

SEQ ID NO: 552621 - DNA, 20 bp, mouse
gaatactgtataagaatctt

SEQ ID NO: 552622 - DNA, 20 bp, mouse
gccagttacactcaataggt

SEQ ID NO: 552623 - DNA, 20 bp, mouse
gatcattaccctcactacag

SEQ ID NO: 552624 - DNA, 20 bp, mouse
gaaagcaagacctgcagctg

SEQ ID NO: 552625 - DNA, 20 bp, mouse
gtataagaatcttgggacac

SEQ ID NO: 552626 - DNA, 20 bp, mouse
ggggtctcacagatgatatt

SEQ ID NO: 552627 - DNA, 20 bp, mouse
gtgactggcacaagcaatat

SEQ ID NO: 552628 - DNA, 20 bp, mouse
ggcacaagcaatataggtaa

SEQ ID NO: 552629 - DNA, 20 bp, mouse
gtctataaacaacagttgac

SEQ ID NO: 552630 - DNA, 20 bp, mouse
gggcccaaacctagaccaat

SEQ ID NO: 552631 - DNA, 20 bp, mouse
gcaaacctagaccaattggt

SEQ ID NO: 552632 - DNA, 20 bp, mouse
gatcagtgctgctacccaac

SEQ ID NO: 552633 - DNA, 20 bp, mouse
gttctcccaccaattggtct

SEQ ID NO: 552634 - DNA, 20 bp, mouse
ggtgagacccaacaaaatga

SEQ ID NO: 552635 - DNA, 20 bp, mouse
ggtaacaaccttcattttgt

SEQ ID NO: 552636 - DNA, 20 bp, mouse
ggacccacaactgcaaattg

SEQ ID NO: 552637 - DNA, 20 bp, mouse
gaaccacaatttgcagttgt

SEQ ID NO: 552638 - DNA, 20 bp, mouse
gcaatggtcgtcaagaatct

SEQ ID NO: 552639 - DNA, 20 bp, mouse
gttatgtgatgagcctggtg

SEQ ID NO: 552640 - DNA, 20 bp, mouse
gtcttgacgaccattgtgac

SEQ ID NO: 552641 - DNA, 20 bp, mouse
gaacttgactttattctttt

SEQ ID NO: 552642 - DNA, 20 bp, mouse
ggtgaacatgatttccaaaa

SEQ ID NO: 552643 - DNA, 20 bp, mouse
gctcaattatgtgatgagcc

SEQ ID NO: 552644 - DNA, 20 bp, mouse
gtgtttttcattcttttgct

SEQ ID NO: 552645 - DNA, 20 bp, mouse
gctccgtaatttctcctttt

SEQ ID NO: 552646 - DNA, 20 bp, mouse
ggagtcccaagagtaaaggg

SEQ ID NO: 552647 - DNA, 20 bp, mouse
gtctcagctcttgggttact

SEQ ID NO: 552648 - DNA, 20 bp, mouse
gtcttcccccctttactctt

SEQ ID NO: 552649 - DNA, 20 bp, mouse
ggagtattctcactggagac

SEQ ID NO: 552650 - DNA, 20 bp, mouse
gtcttaatgagtattctcac

SEQ ID NO: 552651 - DNA, 20 bp, mouse
gagagctgagaaccagtaga

SEQ ID NO: 552652 - DNA, 20 bp, mouse
ggaatactcattaagaaccg

SEQ ID NO: 552653 - DNA, 20 bp, mouse
gagattatattcattttgct

SEQ ID NO: 552654 - DNA, 20 bp, mouse
ggtttgagtcccaagagtaa

SEQ ID NO: 552655 - DNA, 20 bp, mouse
gcacaactgcctgtattcca

SEQ ID NO: 552656 - DNA, 20 bp, mouse
gtaatggtgcccaagaacct

SEQ ID NO: 552657 - DNA, 20 bp, mouse
gtctgtataccaaggttctt

SEQ ID NO: 552658 - DNA, 20 bp, mouse
gaaactctgtagtttcagta

SEQ ID NO: 552659 - DNA, 20 bp, mouse
gaggaaagaaaccagccagg

SEQ ID NO: 552660 - DNA, 20 bp, mouse
gcacaactgtctgtatacca

SEQ ID NO: 552661 - DNA, 20 bp, mouse
gcagaaggtctgcaaaatgt

SEQ ID NO: 552662 - DNA, 20 bp, mouse
gattaggaaagaaaccagcc

SEQ ID NO: 552663 - DNA, 20 bp, mouse
gcttgcaaatggcgatgtac

SEQ ID NO: 552664 - DNA, 20 bp, mouse
gtattttttcttattctatt

SEQ ID NO: 552665 - DNA, 20 bp, mouse
gttggtctttgcctcctggc

SEQ ID NO: 552666 - DNA, 20 bp, mouse
gtggatcgtctgatatgccc

SEQ ID NO: 552667 - DNA, 20 bp, mouse
gaaactcagtaatcacagaa

SEQ ID NO: 552668 - DNA, 20 bp, mouse
gtcctgccagccatgaggca

SEQ ID NO: 552669 - DNA, 20 bp, mouse
gaacattaatggtggaaaga

SEQ ID NO: 552670 - DNA, 20 bp, mouse
gattactgagtttgtgctcc

SEQ ID NO: 552671 - DNA, 20 bp, mouse
gcatgaggcaaggacaagaa

SEQ ID NO: 552672 - DNA, 20 bp, mouse
gtcagacgatccagaagtcc

SEQ ID NO: 552673 - DNA, 20 bp, mouse
ggcttgaggaccaacattaa

SEQ ID NO: 552674 - DNA, 20 bp, mouse
gtgaggaccaacattaatgg

SEQ ID NO: 552675 - DNA, 20 bp, mouse
gtaatggtggaaagatggtc

SEQ ID NO: 552676 - DNA, 20 bp, mouse
ggtcatcagaaaggcctaag

SEQ ID NO: 552677 - DNA, 20 bp, mouse
gaatcacaatctgaaggtca

SEQ ID NO: 552678 - DNA, 20 bp, mouse
ggaggaaaatcacaatctga

SEQ ID NO: 552679 - DNA, 20 bp, mouse
gaatagaccccagaaatcta

SEQ ID NO: 552680 - DNA, 20 bp, mouse
gcaggcacacaacacaaaca

SEQ ID NO: 552681 - DNA, 20 bp, mouse
gcaagaaagcaaaattccgg

SEQ ID NO: 552682 - DNA, 20 bp, mouse
gtgggcagcacagttgttat

SEQ ID NO: 552683 - DNA, 20 bp, mouse
ggagcaaaagcataagaggt

SEQ ID NO: 552684 - DNA, 20 bp, mouse
ggctggagcaaaagcataag

SEQ ID NO: 552685 - DNA, 20 bp, mouse
gtatgtatccctagatttct

SEQ ID NO: 552686 - DNA, 20 bp, mouse
gtacatgggtgtcatcagat

SEQ ID NO: 552687 - DNA, 20 bp, mouse
gtaatactctctgcttctaa

SEQ ID NO: 552688 - DNA, 20 bp, mouse
gatcagatgggcatctgaga

SEQ ID NO: 552689 - DNA, 20 bp, mouse
gcaatagtgacaaggaatct

SEQ ID NO: 552690 - DNA, 20 bp, mouse
gccagtcacacttagcatgt

SEQ ID NO: 552691 - DNA, 20 bp, mouse
gtaggagtgagaaatttcga

SEQ ID NO: 552692 - DNA, 20 bp, mouse
gtgaacttgctacctctgtc

SEQ ID NO: 552693 - DNA, 20 bp, mouse
ggatccactgtggcagattg

SEQ ID NO: 552694 - DNA, 20 bp, mouse
gtgagccacgcaaccattgt

SEQ ID NO: 552695 - DNA, 20 bp, mouse
gataaagtctgtcactgctg

SEQ ID NO: 552696 - DNA, 20 bp, mouse
gcagcatgtatgtaagaaat

SEQ ID NO: 552697 - DNA, 20 bp, mouse
ggtcatctgttagtcccaga

SEQ ID NO: 552698 - DNA, 20 bp, mouse
gggaggcccaagataagagg

SEQ ID NO: 552699 - DNA, 20 bp, mouse
gtaacaacctttatccttct

SEQ ID NO: 552700 - DNA, 20 bp, mouse
gaaaggttgttattgacgag

SEQ ID NO: 552701 - DNA, 20 bp, mouse
gcgtaaggatgatgataatc

SEQ ID NO: 552702 - DNA, 20 bp, mouse
gtgacttgcacaagcattat

SEQ ID NO: 552703 - DNA, 20 bp, mouse
gttctatacagtatatcaag

SEQ ID NO: 552704 - DNA, 20 bp, mouse
gatggggatccaccaacgta

SEQ ID NO: 552705 - DNA, 20 bp, mouse
gatgaccatcatgaacccca

SEQ ID NO: 552706 - DNA, 20 bp, mouse
gtgagccaggcaagagctat

SEQ ID NO: 552707 - DNA, 20 bp, mouse
gaggcaagagctataggaga

SEQ ID NO: 552708 - DNA, 20 bp, mouse
gtaccacagtttccattcct

SEQ ID NO: 552709 - DNA, 20 bp, mouse
gcttgtgagcattgtaactg

SEQ ID NO: 552710 - DNA, 20 bp, mouse
gaatcaaaatgtttagcttt

SEQ ID NO: 552711 - DNA, 20 bp, mouse
ggagttcttcttcatactcc

SEQ ID NO: 552712 - DNA, 20 bp, mouse
ggaaaaattcagttgcaccc

SEQ ID NO: 552713 - DNA, 20 bp, mouse
gcaccacaataatgagcagc

SEQ ID NO: 552714 - DNA, 20 bp, mouse
ggaagaagaactcctgagcc

SEQ ID NO: 552715 - DNA, 20 bp, mouse
gcaatgctcacaaggaaccg

SEQ ID NO: 552716 - DNA, 20 bp, mouse
gatatactgtacaggaatct

SEQ ID NO: 552717 - DNA, 20 bp, mouse
ggaatgttgtcattactgtg

SEQ ID NO: 552718 - DNA, 20 bp, mouse
gttaagatgagagtccatca

SEQ ID NO: 552719 - DNA, 20 bp, mouse
gagtccagcaacagaggaca

SEQ ID NO: 552720 - DNA, 20 bp, mouse
gtgacaacattcatcttgct

SEQ ID NO: 552721 - DNA, 20 bp, mouse
gctgtacagtatatcaactg

SEQ ID NO: 552722 - DNA, 20 bp, mouse
gggtttctcataactacttt

SEQ ID NO: 552723 - DNA, 20 bp, mouse
gggtgagaatgatgattgtc

SEQ ID NO: 552724 - DNA, 20 bp, mouse
ggctgtaggatcatgccaag

SEQ ID NO: 552725 - DNA, 20 bp, mouse
gatatattctgagcataatg

SEQ ID NO: 552726 - DNA, 20 bp, mouse
ggaggtcagagaaccccagt

SEQ ID NO: 552727 - DNA, 20 bp, mouse
ggaagtaccaaccagaacag

SEQ ID NO: 552728 - DNA, 20 bp, mouse
gttagggtagagtagtgcag

SEQ ID NO: 552729 - DNA, 20 bp, mouse
gtgccctggaatcatggatg

SEQ ID NO: 552730 - DNA, 20 bp, mouse
gctgacctcagagcccttca

SEQ ID NO: 552731 - DNA, 20 bp, mouse
gcaggcccggtggttcatta

SEQ ID NO: 552732 - DNA, 20 bp, mouse
ggtgtagagaagctccacca

SEQ ID NO: 552733 - DNA, 20 bp, mouse
gtcaagtcagccagaactct

SEQ ID NO: 552734 - DNA, 20 bp, mouse
gcaactgagtttctcctact

SEQ ID NO: 552735 - DNA, 20 bp, mouse
gtgggctgcacagctcctga

SEQ ID NO: 552736 - DNA, 20 bp, mouse
gtgagccatgcaggagttat

SEQ ID NO: 552737 - DNA, 20 bp, mouse
gatctcctataactcctgca

SEQ ID NO: 552738 - DNA, 20 bp, mouse
gaagaacacctgagccatgc

SEQ ID NO: 552739 - DNA, 20 bp, mouse
ggtgttcttcttcatactct

SEQ ID NO: 552740 - DNA, 20 bp, mouse
gactctactgttcattattg

SEQ ID NO: 552741 - DNA, 20 bp, mouse
gcaatgctcacaaggaagcg

SEQ ID NO: 552742 - DNA, 20 bp, mouse
gtccttgtgagcattgtgac

SEQ ID NO: 552743 - DNA, 20 bp, mouse
gtcctgtcacaatgctcaca

SEQ ID NO: 552744 - DNA, 20 bp, mouse
ggtgagtgagtttattcttt

SEQ ID NO: 552745 - DNA, 20 bp, mouse
gaagcgaggaatggaaactg

SEQ ID NO: 552746 - DNA, 20 bp, mouse
gtgactgatacaagcagcat

SEQ ID NO: 552747 - DNA, 20 bp, mouse
gatacaagcagcataggcaa

SEQ ID NO: 552748 - DNA, 20 bp, mouse
gtaacaactttcattttgct

SEQ ID NO: 552749 - DNA, 20 bp, mouse
ggaattccaggcccaaacct

SEQ ID NO: 552750 - DNA, 20 bp, mouse
gccaaacctaggctaattgg

SEQ ID NO: 552751 - DNA, 20 bp, mouse
gatgggggtcaatcagagtg

SEQ ID NO: 552752 - DNA, 20 bp, mouse
gggcccaaacctaggctaat

SEQ ID NO: 552753 - DNA, 20 bp, mouse
gttctcccaccaattagcct

SEQ ID NO: 552754 - DNA, 20 bp, mouse
gtaagaaggagaaatttttg

SEQ ID NO: 552755 - DNA, 20 bp, mouse
ggggtctgacagatgacatt

SEQ ID NO: 552756 - DNA, 20 bp, mouse
gcaatgaatgtgtaatacaa

SEQ ID NO: 552757 - DNA, 20 bp, mouse
gcatcagtatacagagatgt

SEQ ID NO: 552758 - DNA, 20 bp, mouse
gaatgaggaattgaaggtgt

SEQ ID NO: 552759 - DNA, 20 bp, mouse
gtacaaaaatgaggaattga

SEQ ID NO: 552760 - DNA, 20 bp, mouse
ggctctgtaagaaggcatgt

SEQ ID NO: 552761 - DNA, 20 bp, mouse
gaaggaacagtacaaaaatg

SEQ ID NO: 552762 - DNA, 20 bp, mouse
gacatgtgactgatggaatc

SEQ ID NO: 552763 - DNA, 20 bp, mouse
gcatagacacatgtgactga

SEQ ID NO: 552764 - DNA, 20 bp, mouse
ggttcccaagcactgttacc

SEQ ID NO: 552765 - DNA, 20 bp, mouse
gtgtaggatgctaacaaccc

SEQ ID NO: 552766 - DNA, 20 bp, mouse
gacatagcagtctttaggtg

SEQ ID NO: 552767 - DNA, 20 bp, mouse
ggatgaatgttgttatggtg

SEQ ID NO: 552768 - DNA, 20 bp, mouse
ggatcagagttttcagttgt

SEQ ID NO: 552769 - DNA, 20 bp, mouse
gtcaacacaaaatatttgaa

SEQ ID NO: 552770 - DNA, 20 bp, mouse
gtattttgtgttgatctttt

SEQ ID NO: 552771 - DNA, 20 bp, mouse
gtagcaccatcatgagcagc

SEQ ID NO: 552772 - DNA, 20 bp, mouse
gaagacttatcctctgttgc

SEQ ID NO: 552773 - DNA, 20 bp, mouse
ggccagctgcccagcaacag

SEQ ID NO: 552774 - DNA, 20 bp, mouse
gctacgtgctgagtatgact

SEQ ID NO: 552775 - DNA, 20 bp, mouse
ggcttgaggcccaggctaag

SEQ ID NO: 552776 - DNA, 20 bp, mouse
gtcttaccccctttagtgtt

SEQ ID NO: 552777 - DNA, 20 bp, mouse
gcctcagctgctgggtgact

SEQ ID NO: 552778 - DNA, 20 bp, mouse
gaacagaatgtgtcacctac

SEQ ID NO: 552779 - DNA, 20 bp, mouse
gttgagtcccaacactaaag

SEQ ID NO: 552780 - DNA, 20 bp, mouse
gcctactggtcctcagctgc

SEQ ID NO: 552781 - DNA, 20 bp, mouse
ggaatgctcatcaagaaccg

SEQ ID NO: 552782 - DNA, 20 bp, mouse
gagattatattcattttact

SEQ ID NO: 552783 - DNA, 20 bp, mouse
gattctgttgttcatgatga

SEQ ID NO: 552784 - DNA, 20 bp, mouse
gcacaactgcctgtattcca

SEQ ID NO: 552785 - DNA, 20 bp, mouse
ggaatataatctctacagat

SEQ ID NO: 552786 - DNA, 20 bp, mouse
gtaatggtgcctaagaactt

SEQ ID NO: 552787 - DNA, 20 bp, mouse
ggaactctgtagtttctgta

SEQ ID NO: 552788 - DNA, 20 bp, mouse
gaagaacttgggtatagtga

SEQ ID NO: 552789 - DNA, 20 bp, mouse
gaatgctggtcttcgcctcc

SEQ ID NO: 552790 - DNA, 20 bp, mouse
gggtatagtgacggttgtga

SEQ ID NO: 552791 - DNA, 20 bp, mouse
gaggaaagaagtcagccagg

SEQ ID NO: 552792 - DNA, 20 bp, mouse
gaaattcagtgactcccaaa

SEQ ID NO: 552793 - DNA, 20 bp, mouse
gcagaaggtctgcacaatgc

SEQ ID NO: 552794 - DNA, 20 bp, mouse
gtattttttttcatcctttt

SEQ ID NO: 552795 - DNA, 20 bp, mouse
gatacagttgttgaaggaaa

SEQ ID NO: 552796 - DNA, 20 bp, mouse
gttgtgctcttgggaatatc

SEQ ID NO: 552797 - DNA, 20 bp, mouse
gtgtgaggaggataatggtt

SEQ ID NO: 552798 - DNA, 20 bp, mouse
gtaggaccagcataagtggt

SEQ ID NO: 552799 - DNA, 20 bp, mouse
gagagtccaacaatgtgagg

SEQ ID NO: 552800 - DNA, 20 bp, mouse
gaacaatgtgaggaggataa

SEQ ID NO: 552801 - DNA, 20 bp, mouse
gtaggaaatggtcttgactt

SEQ ID NO: 552802 - DNA, 20 bp, mouse
gactttaggaccagcataag

SEQ ID NO: 552803 - DNA, 20 bp, mouse
gtaagaaggagaaattacga

SEQ ID NO: 552804 - DNA, 20 bp, mouse
gcttacatagtaagcatcac

SEQ ID NO: 552805 - DNA, 20 bp, mouse
gattattgatgccaggaatc

SEQ ID NO: 552806 - DNA, 20 bp, mouse
gaaccacaatttgcaactgt

SEQ ID NO: 552807 - DNA, 20 bp, mouse
gcaatggctgtcaagaattt

SEQ ID NO: 552808 - DNA, 20 bp, mouse
gtcttgacagccattgtgac

SEQ ID NO: 552809 - DNA, 20 bp, mouse
gctccgtaatttctcctatc

SEQ ID NO: 552810 - DNA, 20 bp, mouse
gttacatgatgagcttggtg

SEQ ID NO: 552811 - DNA, 20 bp, mouse
ggacccacagttgcaaattg

SEQ ID NO: 552812 - DNA, 20 bp, mouse
ggtgaacatgatttccagat

SEQ ID NO: 552813 - DNA, 20 bp, mouse
gtgtttttctatcttttgct

SEQ ID NO: 552814 - DNA, 20 bp, mouse
gttccagataggagaaatta

SEQ ID NO: 552815 - DNA, 20 bp, mouse
gacggagaaagaaatacatt

SEQ ID NO: 552816 - DNA, 20 bp, mouse
gggagctgaggacaagtagg

SEQ ID NO: 552817 - DNA, 20 bp, mouse
ggtgaatgccatttccaaga

SEQ ID NO: 552818 - DNA, 20 bp, mouse
gagacatgttagaataaaga

SEQ ID NO: 552819 - DNA, 20 bp, mouse
gtgagttaaacaagatccat

SEQ ID NO: 552820 - DNA, 20 bp, mouse
gaatttctccttcttggaaa

SEQ ID NO: 552821 - DNA, 20 bp, mouse
gttacatcttgagcttgata

SEQ ID NO: 552822 - DNA, 20 bp, mouse
ggagacaaaacaatttccta

SEQ ID NO: 552823 - DNA, 20 bp, mouse
ggataaaaaccctgtcaccc

SEQ ID NO: 552824 - DNA, 20 bp, mouse
ggaacacaatctctactgac

SEQ ID NO: 552825 - DNA, 20 bp, mouse
gcctcagctcctgggtgaca

SEQ ID NO: 552826 - DNA, 20 bp, mouse
gggagctgaggaccagtatg

SEQ ID NO: 552827 - DNA, 20 bp, mouse
gagcaaagtgtgccacatac

SEQ ID NO: 552828 - DNA, 20 bp, mouse
gagattgtgttcattttgtt

SEQ ID NO: 552829 - DNA, 20 bp, mouse
gcctcagctcctggatgaca

SEQ ID NO: 552830 - DNA, 20 bp, mouse
gaatcagaatttgaagctga

SEQ ID NO: 552831 - DNA, 20 bp, mouse
ggataaaaaccctgtcatcc

SEQ ID NO: 552832 - DNA, 20 bp, mouse
ggaacacaatctctactgac

SEQ ID NO: 552833 - DNA, 20 bp, mouse
gttacatcttgagcttgatg

SEQ ID NO: 552834 - DNA, 20 bp, mouse
gaacattaaaggaggaaaga

SEQ ID NO: 552835 - DNA, 20 bp, mouse
gatcaagaatcgtggaatac

SEQ ID NO: 552836 - DNA, 20 bp, mouse
gaacatgagaaaccatacat

SEQ ID NO: 552837 - DNA, 20 bp, mouse
ggtcaatcccagaagaataa

SEQ ID NO: 552838 - DNA, 20 bp, mouse
gaaaggttgtcaccaatgta

SEQ ID NO: 552839 - DNA, 20 bp, mouse
gttgaggttggaatccaaca

SEQ ID NO: 552840 - DNA, 20 bp, mouse
gctatgctgaccaggaacct

SEQ ID NO: 552841 - DNA, 20 bp, mouse
ggcaaaagttaataattggt

SEQ ID NO: 552842 - DNA, 20 bp, mouse
gtgtgctatgccaaagataa

SEQ ID NO: 552843 - DNA, 20 bp, mouse
gcctcgcaaaagttaataat

SEQ ID NO: 552844 - DNA, 20 bp, mouse
gcagcacatatgtcataaat

SEQ ID NO: 552845 - DNA, 20 bp, mouse
gctggtcagcatagtgacca

SEQ ID NO: 552846 - DNA, 20 bp, mouse
gctgtgattgatgtcttatt

SEQ ID NO: 552847 - DNA, 20 bp, mouse
gctaagatctgaaattgggt

SEQ ID NO: 552848 - DNA, 20 bp, mouse
gatagctaagatctgaaatt

SEQ ID NO: 552849 - DNA, 20 bp, mouse
ggacagtgtcagggtaatga

SEQ ID NO: 552850 - DNA, 20 bp, mouse
gcttacactcagtaggtatg

SEQ ID NO: 552851 - DNA, 20 bp, mouse
gtgatgctgatcagaaatct

SEQ ID NO: 552852 - DNA, 20 bp, mouse
gtctgatcagcatcattaca

SEQ ID NO: 552853 - DNA, 20 bp, mouse
gctgaaggcccatgattaca

SEQ ID NO: 552854 - DNA, 20 bp, mouse
gtgtgccatgcaggcattat

SEQ ID NO: 552855 - DNA, 20 bp, mouse
gtacagggggaaaaacaatg

SEQ ID NO: 552856 - DNA, 20 bp, mouse
gtcaacatagaaaacatgaa

SEQ ID NO: 552857 - DNA, 20 bp, mouse
gtgggcagcacaagcattat

SEQ ID NO: 552858 - DNA, 20 bp, mouse
gaaatcacaacctgaagctc

SEQ ID NO: 552859 - DNA, 20 bp, mouse
gacagacgatcctgagcttc

SEQ ID NO: 552860 - DNA, 20 bp, mouse
gagacaaaccatcagagatg

SEQ ID NO: 552861 - DNA, 20 bp, mouse
gaggatcgtctgtcagaccc

SEQ ID NO: 552862 - DNA, 20 bp, mouse
gaacagtgtgagagtaatga

SEQ ID NO: 552863 - DNA, 20 bp, mouse
gagatgctgaccaaaaacct

SEQ ID NO: 552864 - DNA, 20 bp, mouse
gtgacatacttcatcctcct

SEQ ID NO: 552865 - DNA, 20 bp, mouse
gttggtcagcatcttaacta

SEQ ID NO: 552866 - DNA, 20 bp, mouse
gtaggcctgcgaacagtcag

SEQ ID NO: 552867 - DNA, 20 bp, mouse
ggaaaactgtcactcttgta

SEQ ID NO: 552868 - DNA, 20 bp, mouse
ggccatcattacactcaccc

SEQ ID NO: 552869 - DNA, 20 bp, mouse
gatcattacactcaccctgg

SEQ ID NO: 552870 - DNA, 20 bp, mouse
gcttcaggtgagtatccacc

SEQ ID NO: 552871 - DNA, 20 bp, mouse
gtgaacctctgactgttcgc

SEQ ID NO: 552872 - DNA, 20 bp, mouse
gcctttctcacattttattt

SEQ ID NO: 552873 - DNA, 20 bp, mouse
ggtgtaggaaaactctaaga

SEQ ID NO: 552874 - DNA, 20 bp, mouse
gtgagtcaaacaattaccat

SEQ ID NO: 552875 - DNA, 20 bp, mouse
gaaacaattaccataggaaa

SEQ ID NO: 552876 - DNA, 20 bp, mouse
gttaagatggggatccagta

SEQ ID NO: 552877 - DNA, 20 bp, mouse
gacattggagtcttaagatg

SEQ ID NO: 552878 - DNA, 20 bp, mouse
ggatcatgtagttccccatg

SEQ ID NO: 552879 - DNA, 20 bp, mouse
gaaactctatcttcaatgat

SEQ ID NO: 552880 - DNA, 20 bp, mouse
gatcatcttcctcaccctac

SEQ ID NO: 552881 - DNA, 20 bp, mouse
gtgagtcccaagagcaaacc

SEQ ID NO: 552882 - DNA, 20 bp, mouse
ggtatttccaggtttgctct

SEQ ID NO: 552883 - DNA, 20 bp, mouse
gttacatcttgagcctcatg

SEQ ID NO: 552884 - DNA, 20 bp, mouse
gggttcttagttgtatttcc

SEQ ID NO: 552885 - DNA, 20 bp, mouse
gagcacagagttttaccttc

SEQ ID NO: 552886 - DNA, 20 bp, mouse
ggaactctaactctcctgac

SEQ ID NO: 552887 - DNA, 20 bp, mouse
gaagaaatgaagaaccagtc

SEQ ID NO: 552888 - DNA, 20 bp, mouse
gttgaggtggggatccaaca

SEQ ID NO: 552889 - DNA, 20 bp, mouse
gtacataggagtcttgaggt

SEQ ID NO: 552890 - DNA, 20 bp, mouse
gatattttctataggtttgc

SEQ ID NO: 552891 - DNA, 20 bp, mouse
gaattacattttgagcatga

SEQ ID NO: 552892 - DNA, 20 bp, mouse
ggaactctgtggaccctagt

SEQ ID NO: 552893 - DNA, 20 bp, mouse
ggggatccaacagggtgagg

SEQ ID NO: 552894 - DNA, 20 bp, mouse
gtaatttttatattttctat

SEQ ID NO: 552895 - DNA, 20 bp, mouse
gtcctgagagaatgcttatc

SEQ ID NO: 552896 - DNA, 20 bp, mouse
ggatgctgaccaaaaaccta

SEQ ID NO: 552897 - DNA, 20 bp, mouse
ggctctaaacccatggccag

SEQ ID NO: 552898 - DNA, 20 bp, mouse
gggagctgatgatgagctgg

SEQ ID NO: 552899 - DNA, 20 bp, mouse
gctaaacccatggccagtgg

SEQ ID NO: 552900 - DNA, 20 bp, mouse
gctcatcatcagctcctggc

SEQ ID NO: 552901 - DNA, 20 bp, mouse
gaaatctagctctaaaccca

SEQ ID NO: 552902 - DNA, 20 bp, mouse
gaccaagaaaccagccagcc

SEQ ID NO: 552903 - DNA, 20 bp, mouse
gcagatcttgttactgatga

SEQ ID NO: 552904 - DNA, 20 bp, mouse
gtttttcctccactggccat

SEQ ID NO: 552905 - DNA, 20 bp, mouse
gtcatcagctcctggctggc

SEQ ID NO: 552906 - DNA, 20 bp, mouse
gaatcaaggccaataatcag

SEQ ID NO: 552907 - DNA, 20 bp, mouse
gcaaggccaataatcagtgg

SEQ ID NO: 552908 - DNA, 20 bp, mouse
gttacttgctgagtatgcta

SEQ ID NO: 552909 - DNA, 20 bp, mouse
gaaatcagagtctgtaactg

SEQ ID NO: 552910 - DNA, 20 bp, mouse
gattgtctgtcagtccaaga

SEQ ID NO: 552911 - DNA, 20 bp, mouse
gatgggatctagcagagtga

SEQ ID NO: 552912 - DNA, 20 bp, mouse
gagatagagtttatccttct

SEQ ID NO: 552913 - DNA, 20 bp, mouse
gaaactctatctgtcttgta

SEQ ID NO: 552914 - DNA, 20 bp, mouse
gagcaagtaatttagtaaaa

SEQ ID NO: 552915 - DNA, 20 bp, mouse
gtaagaaagagaaattacgg

SEQ ID NO: 552916 - DNA, 20 bp, mouse
gattatctgtcagtccaaga

SEQ ID NO: 552917 - DNA, 20 bp, mouse
gaaactctatctgtcttgta

SEQ ID NO: 552918 - DNA, 20 bp, mouse
gcaagaaagagaaattacgg

SEQ ID NO: 552919 - DNA, 20 bp, mouse
gatgggatctagcagagtga

SEQ ID NO: 552920 - DNA, 20 bp, mouse
gaaatcagagtctgtaactg

SEQ ID NO: 552921 - DNA, 20 bp, mouse
gagatagagtttatccttct

SEQ ID NO: 552922 - DNA, 20 bp, mouse
gcaatagagattaaaaatct

SEQ ID NO: 552923 - DNA, 20 bp, mouse
ggccaagaagaaaaactctg

SEQ ID NO: 552924 - DNA, 20 bp, mouse
gcagtggtgggaaaataacc

SEQ ID NO: 552925 - DNA, 20 bp, mouse
gagcaagtaatttagtaaaa

SEQ ID NO: 552926 - DNA, 20 bp, mouse
ggaaaactgtcacctctgta

SEQ ID NO: 552927 - DNA, 20 bp, mouse
ggccagcaagccaacaactg

SEQ ID NO: 552928 - DNA, 20 bp, mouse
ggattcaagcctaacacgag

SEQ ID NO: 552929 - DNA, 20 bp, mouse
gtcaagcctaacacgagtgg

SEQ ID NO: 552930 - DNA, 20 bp, mouse
gtctttccaccactcgtgtt

SEQ ID NO: 552931 - DNA, 20 bp, mouse
gacaatgaagaaccatacag

SEQ ID NO: 552932 - DNA, 20 bp, mouse
gtgagtcacacaattaccat

SEQ ID NO: 552933 - DNA, 20 bp, mouse
gcttgttactatggcaactg

SEQ ID NO: 552934 - DNA, 20 bp, mouse
gacacaattaccataggaaa

SEQ ID NO: 552935 - DNA, 20 bp, mouse
gtgacagttttcatcctagc

SEQ ID NO: 552936 - DNA, 20 bp, mouse
ggaaatgaagaaccagtctc

SEQ ID NO: 552937 - DNA, 20 bp, mouse
gatgaagaaccagtctctgg

SEQ ID NO: 552938 - DNA, 20 bp, mouse
ggaacactacctccagagac

SEQ ID NO: 552939 - DNA, 20 bp, mouse
ggaatgcttgtgaggaacct

SEQ ID NO: 552940 - DNA, 20 bp, mouse
gtcgttttgcttggactgac

SEQ ID NO: 552941 - DNA, 20 bp, mouse
gaggtagtgttcgttttgct

SEQ ID NO: 552942 - DNA, 20 bp, mouse
gtcctaaaagaatgcttgtg

SEQ ID NO: 552943 - DNA, 20 bp, mouse
gattttgtataatgcttgtg

SEQ ID NO: 552944 - DNA, 20 bp, mouse
gtcttaccccctttgctctt

SEQ ID NO: 552945 - DNA, 20 bp, mouse
gattcttcttttttctacta

SEQ ID NO: 552946 - DNA, 20 bp, mouse
gctacattacactctgcgga

SEQ ID NO: 552947 - DNA, 20 bp, mouse
ggaattcagtgcagagggac

SEQ ID NO: 552948 - DNA, 20 bp, mouse
gctctgcactgaattcacat

SEQ ID NO: 552949 - DNA, 20 bp, mouse
gactctgagctcatgaagaa

SEQ ID NO: 552950 - DNA, 20 bp, mouse
gtgcactgaattcacattgg

SEQ ID NO: 552951 - DNA, 20 bp, mouse
gcagctcaagaccataagtg

SEQ ID NO: 552952 - DNA, 20 bp, mouse
gaaccaagaacacaacaaag

SEQ ID NO: 552953 - DNA, 20 bp, mouse
ggctgatatagcacatctct

SEQ ID NO: 552954 - DNA, 20 bp, mouse
gacatgggcgtgtgtagaga

SEQ ID NO: 552955 - DNA, 20 bp, mouse
gtctgtgaagacaacagagc

SEQ ID NO: 552956 - DNA, 20 bp, mouse
gatttgcctgaagttaaaga

SEQ ID NO: 552957 - DNA, 20 bp, mouse
gatcttgggaacaaagacag

SEQ ID NO: 552958 - DNA, 20 bp, mouse
ggtttgccatctttaacttc

SEQ ID NO: 552959 - DNA, 20 bp, mouse
gcaaaaacgcaaaatttcgg

SEQ ID NO: 552960 - DNA, 20 bp, mouse
gatacataggcgtctggagg

SEQ ID NO: 552961 - DNA, 20 bp, mouse
ggaaatacataggcgtctgg

SEQ ID NO: 552962 - DNA, 20 bp, mouse
ggaattttgtcactgatgag

SEQ ID NO: 552963 - DNA, 20 bp, mouse
gctccaaaaacgcaaaattt

SEQ ID NO: 552964 - DNA, 20 bp, mouse
gtgtgtgaagcaaccagcaa

SEQ ID NO: 552965 - DNA, 20 bp, mouse
gccaagatgctaatcaatat

SEQ ID NO: 552966 - DNA, 20 bp, mouse
ggctatgaggaaccacacaa

SEQ ID NO: 552967 - DNA, 20 bp, mouse
ggctggagacccatgaggag

SEQ ID NO: 552968 - DNA, 20 bp, mouse
gcttgttagtatggccacag

SEQ ID NO: 552969 - DNA, 20 bp, mouse
ggatgatctacaactgcaag

SEQ ID NO: 552970 - DNA, 20 bp, mouse
ggaatactgtcaccgttgtg

SEQ ID NO: 552971 - DNA, 20 bp, mouse
gtaaaaatgagaagtttcgt

SEQ ID NO: 552972 - DNA, 20 bp, mouse
gccatactaacaaggaattt

SEQ ID NO: 552973 - DNA, 20 bp, mouse
gatctagctggagacccatg

SEQ ID NO: 552974 - DNA, 20 bp, mouse
gtatttttcactattctctt

SEQ ID NO: 552975 - DNA, 20 bp, mouse
ggagacccatgaggagtgga

SEQ ID NO: 552976 - DNA, 20 bp, mouse
ggaaaattgtcacccttgta

SEQ ID NO: 552977 - DNA, 20 bp, mouse
gtgattctctgactgttata

SEQ ID NO: 552978 - DNA, 20 bp, mouse
gactaataagccaacaactg

SEQ ID NO: 552979 - DNA, 20 bp, mouse
ggcacaattattgtaagaaa

SEQ ID NO: 552980 - DNA, 20 bp, mouse
gaaattctgatgctccaaga

SEQ ID NO: 552981 - DNA, 20 bp, mouse
ggtgtaggaaatctctaaaa

SEQ ID NO: 552982 - DNA, 20 bp, mouse
gtattctttgctttccttct

SEQ ID NO: 552983 - DNA, 20 bp, mouse
ggattcaagcctaacactag

SEQ ID NO: 552984 - DNA, 20 bp, mouse
gtcaagcctaacactagtgg

SEQ ID NO: 552985 - DNA, 20 bp, mouse
gtctttccaccactagtgtt

SEQ ID NO: 552986 - DNA, 20 bp, mouse
gggaacagaaggtttctttc

SEQ ID NO: 552987 - DNA, 20 bp, mouse
gaaaaaagtagcaagagctt

SEQ ID NO: 552988 - DNA, 20 bp, mouse
gtctatctggtcattgtatt

SEQ ID NO: 552989 - DNA, 20 bp, mouse
gtggacgtctccagaagcac

SEQ ID NO: 552990 - DNA, 20 bp, mouse
gacaagaacagtaagaataa

SEQ ID NO: 552991 - DNA, 20 bp, mouse
gtatggactgtgtacaggaa

SEQ ID NO: 552992 - DNA, 20 bp, mouse
gtatgaaactggagcagagc

SEQ ID NO: 552993 - DNA, 20 bp, mouse
ggctttgggtgcaatgactg

SEQ ID NO: 552994 - DNA, 20 bp, mouse
gtaggtctcagttatgaaac

SEQ ID NO: 552995 - DNA, 20 bp, mouse
gacaagctggctgagacata

SEQ ID NO: 552996 - DNA, 20 bp, mouse
gaaaatagtagctagagttt

SEQ ID NO: 552997 - DNA, 20 bp, mouse
gggaacagaaggttttcttt

SEQ ID NO: 552998 - DNA, 20 bp, mouse
gatctatctggtcattttat

SEQ ID NO: 552999 - DNA, 20 bp, mouse
gtggacgtctccagaagcac

SEQ ID NO: 553000 - DNA, 20 bp, mouse
gacaagaacagtaagaataa

SEQ ID NO: 553001 - DNA, 20 bp, mouse
gtatggactgtgtacaggaa

SEQ ID NO: 553002 - DNA, 20 bp, mouse
gtatgaaactggagcagagc

SEQ ID NO: 553003 - DNA, 20 bp, mouse
gtaggtctcagttatgaaac

SEQ ID NO: 553004 - DNA, 20 bp, mouse
gacaagctggctgagacata

SEQ ID NO: 553005 - DNA, 20 bp, mouse
ggaatagcagagatctaaaa

SEQ ID NO: 553006 - DNA, 20 bp, mouse
gatggaagagacctagtgag

SEQ ID NO: 553007 - DNA, 20 bp, mouse
gagtgcaaagagaaagatct

SEQ ID NO: 553008 - DNA, 20 bp, mouse
ggagcaggaaaaggaggata

SEQ ID NO: 553009 - DNA, 20 bp, mouse
ggtctcttccatgggcgaca

SEQ ID NO: 553010 - DNA, 20 bp, mouse
gcagaaagagcaggaaaagg

SEQ ID NO: 553011 - DNA, 20 bp, mouse
ggaagaggtcgatgaaggag

SEQ ID NO: 553012 - DNA, 20 bp, mouse
gaaaggaggatatggagctc

SEQ ID NO: 553013 - DNA, 20 bp, mouse
gtttatccttgtaggcttca

SEQ ID NO: 553014 - DNA, 20 bp, mouse
gaataacagatgagtagaag

SEQ ID NO: 553015 - DNA, 20 bp, mouse
gcgtctctgcactcagctgg

SEQ ID NO: 553016 - DNA, 20 bp, mouse
ggagcaggaaaaggaggata

SEQ ID NO: 553017 - DNA, 20 bp, mouse
gctcatcaggtctcttccat

SEQ ID NO: 553018 - DNA, 20 bp, mouse
ggtctcttccatgggcgaca

SEQ ID NO: 553019 - DNA, 20 bp, mouse
gcagaaagagcaggaaaagg

SEQ ID NO: 553020 - DNA, 20 bp, mouse
ggaagaggtcgatgaaggag

SEQ ID NO: 553021 - DNA, 20 bp, mouse
gaaaggaggatatggagctc

SEQ ID NO: 553022 - DNA, 20 bp, mouse
gtttatccttgtaggcttca

SEQ ID NO: 553023 - DNA, 20 bp, mouse
gaataacagatgagtagaag

SEQ ID NO: 553024 - DNA, 20 bp, mouse
gcgtctctgcactcagctgg

SEQ ID NO: 553025 - DNA, 20 bp, mouse
gaggtttcctagaaggatca

SEQ ID NO: 553026 - DNA, 20 bp, mouse
ggagtaggagaggtcaatca

SEQ ID NO: 553027 - DNA, 20 bp, mouse
ggacactgtggagctctgga

SEQ ID NO: 553028 - DNA, 20 bp, mouse
gtctctctccttgtcaccca

SEQ ID NO: 553029 - DNA, 20 bp, mouse
ggccatggctgctagtataa

SEQ ID NO: 553030 - DNA, 20 bp, mouse
gggagaggtcaatcacggag

SEQ ID NO: 553031 - DNA, 20 bp, mouse
gctgaagcagaaacttgcca

SEQ ID NO: 553032 - DNA, 20 bp, mouse
gggtacaataaccgtggagt

SEQ ID NO: 553033 - DNA, 20 bp, mouse
gtgggaaaccttagcatgat

SEQ ID NO: 553034 - DNA, 20 bp, mouse
gtgagctgcacaacccacaa

SEQ ID NO: 553035 - DNA, 20 bp, mouse
gtagaagaaaaaggacactg

SEQ ID NO: 553036 - DNA, 20 bp, mouse
gtgaacatgctgaagatgag

SEQ ID NO: 553037 - DNA, 20 bp, mouse
gaagatggtgatcaagtaca

SEQ ID NO: 553038 - DNA, 20 bp, mouse
ggaattctgaaacatctgtt

SEQ ID NO: 553039 - DNA, 20 bp, mouse
gtagttcaggggatgacata

SEQ ID NO: 553040 - DNA, 20 bp, mouse
gaccataattccaaagacat

SEQ ID NO: 553041 - DNA, 20 bp, mouse
gaatagaattagcagaccac

SEQ ID NO: 553042 - DNA, 20 bp, mouse
ggtttttagattccatttta

SEQ ID NO: 553043 - DNA, 20 bp, mouse
gagttgtcttctttcagtaa

SEQ ID NO: 553044 - DNA, 20 bp, mouse
gatgatcgttgtgtagttca

SEQ ID NO: 553045 - DNA, 20 bp, mouse
gtccattttatgggtgaatc

SEQ ID NO: 553046 - DNA, 20 bp, mouse
ggaatcctgacacaaccgtt

SEQ ID NO: 553047 - DNA, 20 bp, mouse
gatgttcatggtgaatctga

SEQ ID NO: 553048 - DNA, 20 bp, mouse
gtggagatgagagtcaaagt

SEQ ID NO: 553049 - DNA, 20 bp, mouse
ggttggtggccagaataatc

SEQ ID NO: 553050 - DNA, 20 bp, mouse
ggtgtcaggattcattctcc

SEQ ID NO: 553051 - DNA, 20 bp, mouse
gtaaaccaaacggttgtgtc

SEQ ID NO: 553052 - DNA, 20 bp, mouse
gggtggccagaataatcagg

SEQ ID NO: 553053 - DNA, 20 bp, mouse
gaccattaggatacaaagat

SEQ ID NO: 553054 - DNA, 20 bp, mouse
gtgctggtgaatatacaaac

SEQ ID NO: 553055 - DNA, 20 bp, mouse
gtatggaggatgtctgactc

SEQ ID NO: 553056 - DNA, 20 bp, mouse
gttaagattcatgtctaaca

SEQ ID NO: 553057 - DNA, 20 bp, mouse
gatcataagccattactcca

SEQ ID NO: 553058 - DNA, 20 bp, mouse
gacatgaatcttaaggaaag

SEQ ID NO: 553059 - DNA, 20 bp, mouse
gtatacttgattaccgtttc

SEQ ID NO: 553060 - DNA, 20 bp, mouse
ggaaaaagaacaaagatgaa

SEQ ID NO: 553061 - DNA, 20 bp, mouse
gaacaaagcaggcctggctg

SEQ ID NO: 553062 - DNA, 20 bp, mouse
gagatgaatggctgcagctc

SEQ ID NO: 553063 - DNA, 20 bp, mouse
gtatacaaacaaaagatcag

SEQ ID NO: 553064 - DNA, 20 bp, mouse
gttttggatatttttctaca

SEQ ID NO: 553065 - DNA, 20 bp, mouse
gacagaaactggggttcata

SEQ ID NO: 553066 - DNA, 20 bp, mouse
gggaagactccaaataagac

SEQ ID NO: 553067 - DNA, 20 bp, mouse
gttcgaatctccatacccca

SEQ ID NO: 553068 - DNA, 20 bp, mouse
gtcatcaacatcatgaagag

SEQ ID NO: 553069 - DNA, 20 bp, mouse
gaactacagcctgtcttatt

SEQ ID NO: 553070 - DNA, 20 bp, mouse
gtgctaagaaagtacattag

SEQ ID NO: 553071 - DNA, 20 bp, mouse
ggaaatgaagaaataccttg

SEQ ID NO: 553072 - DNA, 20 bp, mouse
gagattcgaatcaaaaattg

SEQ ID NO: 553073 - DNA, 20 bp, mouse
gccatcaccccacagagttt

SEQ ID NO: 553074 - DNA, 20 bp, mouse
gtctaggatacttagcaaga

SEQ ID NO: 553075 - DNA, 20 bp, mouse
gtaagacaggctgtagttct

SEQ ID NO: 553076 - DNA, 20 bp, mouse
gggaagactccaaataagac

SEQ ID NO: 553077 - DNA, 20 bp, mouse
gtcatcaacatcatgaagag

SEQ ID NO: 553078 - DNA, 20 bp, mouse
gaactacagcctgtcttatt

SEQ ID NO: 553079 - DNA, 20 bp, mouse
gttcgaatctccatacccca

SEQ ID NO: 553080 - DNA, 20 bp, mouse
ggaaatgaagaaataccttg

SEQ ID NO: 553081 - DNA, 20 bp, mouse
gagattcgaatcaaaaattg

SEQ ID NO: 553082 - DNA, 20 bp, mouse
gtaagacaggctgtagttct

SEQ ID NO: 553083 - DNA, 20 bp, mouse
gtctaggatacttagcaaga

SEQ ID NO: 553084 - DNA, 20 bp, mouse
gccatcaccccacagagttt

SEQ ID NO: 553085 - DNA, 20 bp, mouse
ggaagaaataccttggggta

SEQ ID NO: 553086 - DNA, 20 bp, mouse
gggaagactccaaaaagaac

SEQ ID NO: 553087 - DNA, 20 bp, mouse
gtcatcaacattatgaagcg

SEQ ID NO: 553088 - DNA, 20 bp, mouse
gatatctgatcacaatgttt

SEQ ID NO: 553089 - DNA, 20 bp, mouse
gcgtttgcaggattggaaaa

SEQ ID NO: 553090 - DNA, 20 bp, mouse
gaactacagcctgttctttt

SEQ ID NO: 553091 - DNA, 20 bp, mouse
gtgtgatcagatatatggac

SEQ ID NO: 553092 - DNA, 20 bp, mouse
gaagaacaggctgtagttct

SEQ ID NO: 553093 - DNA, 20 bp, mouse
gtctaggatacttatcaaga

SEQ ID NO: 553094 - DNA, 20 bp, mouse
gatgaatcccaaaatctgtg

SEQ ID NO: 553095 - DNA, 20 bp, mouse
gccatcaccccacagatttt

SEQ ID NO: 553096 - DNA, 20 bp, mouse
gaatagattgtcaaagacat

SEQ ID NO: 553097 - DNA, 20 bp, mouse
gggtgaccatgtacatcaac

SEQ ID NO: 553098 - DNA, 20 bp, mouse
ggagtagtccgtaacatatt

SEQ ID NO: 553099 - DNA, 20 bp, mouse
gttacggactactcaaacac

SEQ ID NO: 553100 - DNA, 20 bp, mouse
gatatttggaatgacagttg

SEQ ID NO: 553101 - DNA, 20 bp, mouse
gatcttcctgttgatgtaca

SEQ ID NO: 553102 - DNA, 20 bp, mouse
gagaataagaacatacagca

SEQ ID NO: 553103 - DNA, 20 bp, mouse
gatgggacttcttggtctca

SEQ ID NO: 553104 - DNA, 20 bp, mouse
gtcattagcgttttgaacat

SEQ ID NO: 553105 - DNA, 20 bp, mouse
gggaagatacaaaagatcac

SEQ ID NO: 553106 - DNA, 20 bp, mouse
gagaaaaaggccaaagataa

SEQ ID NO: 553107 - DNA, 20 bp, mouse
gtgcacatgaatcttaagga

SEQ ID NO: 553108 - DNA, 20 bp, mouse
gaggagaaaacactcaaaga

SEQ ID NO: 553109 - DNA, 20 bp, mouse
gataacaaatggctatgaag

SEQ ID NO: 553110 - DNA, 20 bp, mouse
ggtcagaataacacagaagc

SEQ ID NO: 553111 - DNA, 20 bp, mouse
gacagaagcagggattcatg

SEQ ID NO: 553112 - DNA, 20 bp, mouse
gagcttcagccctttatctt

SEQ ID NO: 553113 - DNA, 20 bp, mouse
gaacaaagcatccctggctc

SEQ ID NO: 553114 - DNA, 20 bp, mouse
gcaaatacatgcatagaaaa

SEQ ID NO: 553115 - DNA, 20 bp, mouse
gttaagattcatgtgcaaaa

SEQ ID NO: 553116 - DNA, 20 bp, mouse
ggtaatatgcagtagcaaca

SEQ ID NO: 553117 - DNA, 20 bp, mouse
gccaaaacaataacaaaatt

SEQ ID NO: 553118 - DNA, 20 bp, mouse
gtacctcagaggatgaacta

SEQ ID NO: 553119 - DNA, 20 bp, mouse
gtgggacaggcagcctgtat

SEQ ID NO: 553120 - DNA, 20 bp, mouse
gtacaaaacacacctgggac

SEQ ID NO: 553121 - DNA, 20 bp, mouse
gaaattcagaaatacctgat

SEQ ID NO: 553122 - DNA, 20 bp, mouse
gctgaagataaatgattcaa

SEQ ID NO: 553123 - DNA, 20 bp, mouse
gatgaactatggccaagtaa

SEQ ID NO: 553124 - DNA, 20 bp, mouse
gcttatacagatgtcagtaa

SEQ ID NO: 553125 - DNA, 20 bp, mouse
gggccatagttcatcctctg

SEQ ID NO: 553126 - DNA, 20 bp, mouse
ggaagaggaaaattccaaag

SEQ ID NO: 553127 - DNA, 20 bp, mouse
gaggcaatctgggtaactga

SEQ ID NO: 553128 - DNA, 20 bp, mouse
ggaccgtgtatctaagtgga

SEQ ID NO: 553129 - DNA, 20 bp, mouse
gaccaacaggctgtgtagca

SEQ ID NO: 553130 - DNA, 20 bp, mouse
gtaatgaccgtgtatctaag

SEQ ID NO: 553131 - DNA, 20 bp, mouse
gtgccatccacttagataca

SEQ ID NO: 553132 - DNA, 20 bp, mouse
gaacaaagtacatctgtgta

SEQ ID NO: 553133 - DNA, 20 bp, mouse
gttagcagaatacagatgct

SEQ ID NO: 553134 - DNA, 20 bp, mouse
gattttcctcttcatgtatc

SEQ ID NO: 553135 - DNA, 20 bp, mouse
ggttatttttcttggtggaa

SEQ ID NO: 553136 - DNA, 20 bp, mouse
gggaacagtccgaaaataat

SEQ ID NO: 553137 - DNA, 20 bp, mouse
gtaactctggatcatctgaa

SEQ ID NO: 553138 - DNA, 20 bp, mouse
gatatcagccacagatagat

SEQ ID NO: 553139 - DNA, 20 bp, mouse
gcactcagcactgatggtca

SEQ ID NO: 553140 - DNA, 20 bp, mouse
gtgtgaccaggtacataaac

SEQ ID NO: 553141 - DNA, 20 bp, mouse
gacaagtctcctaattaaca

SEQ ID NO: 553142 - DNA, 20 bp, mouse
ggactgtgtacctcagaggg

SEQ ID NO: 553143 - DNA, 20 bp, mouse
gggtggattccatgttaatt

SEQ ID NO: 553144 - DNA, 20 bp, mouse
ggatggtcagggttataatt

SEQ ID NO: 553145 - DNA, 20 bp, mouse
gtttctctccaatctatctg

SEQ ID NO: 553146 - DNA, 20 bp, mouse
gatatgaggagctccattgt

SEQ ID NO: 553147 - DNA, 20 bp, mouse
gcaagaagaggctaaatatg

SEQ ID NO: 553148 - DNA, 20 bp, mouse
gctaaccagtgatcctacaa

SEQ ID NO: 553149 - DNA, 20 bp, mouse
gattaggttggtaagcaaca

SEQ ID NO: 553150 - DNA, 20 bp, mouse
gtggaatggtagttgtgctt

SEQ ID NO: 553151 - DNA, 20 bp, mouse
gattagcagatcacagaagt

SEQ ID NO: 553152 - DNA, 20 bp, mouse
gtatatctggtcacaattct

SEQ ID NO: 553153 - DNA, 20 bp, mouse
ggaatgttcttcagcatatt

SEQ ID NO: 553154 - DNA, 20 bp, mouse
gttcacaatactaatgatca

SEQ ID NO: 553155 - DNA, 20 bp, mouse
gagctccattgtaggatcac

SEQ ID NO: 553156 - DNA, 20 bp, mouse
gcagtagagcccctcatctt

SEQ ID NO: 553157 - DNA, 20 bp, mouse
gagtctcatcagaataaagt

SEQ ID NO: 553158 - DNA, 20 bp, mouse
gtgggacagtggttgtactt

SEQ ID NO: 553159 - DNA, 20 bp, mouse
gactaggttgatcagcaaca

SEQ ID NO: 553160 - DNA, 20 bp, mouse
gcataaagaagccaaagatg

SEQ ID NO: 553161 - DNA, 20 bp, mouse
ggatgttcttcaacatgttt

SEQ ID NO: 553162 - DNA, 20 bp, mouse
gcatatctggttacaattgt

SEQ ID NO: 553163 - DNA, 20 bp, mouse
gttatgaatccccaattctg

SEQ ID NO: 553164 - DNA, 20 bp, mouse
gttcgcagtgctaatgatca

SEQ ID NO: 553165 - DNA, 20 bp, mouse
ggatgctatgatcctgtgtg

SEQ ID NO: 553166 - DNA, 20 bp, mouse
gttcagagtactcaacaaca

SEQ ID NO: 553167 - DNA, 20 bp, mouse
ggatgagatagacttgagag

SEQ ID NO: 553168 - DNA, 20 bp, mouse
gatgttggtgaacattcaga

SEQ ID NO: 553169 - DNA, 20 bp, mouse
gaggcatgctgtgtatgtga

SEQ ID NO: 553170 - DNA, 20 bp, mouse
gtatatctgatcaccacctt

SEQ ID NO: 553171 - DNA, 20 bp, mouse
gggagtcagagctaacagct

SEQ ID NO: 553172 - DNA, 20 bp, mouse
gattaaacagatgtcattaa

SEQ ID NO: 553173 - DNA, 20 bp, mouse
gacagatgtcattaaaggac

SEQ ID NO: 553174 - DNA, 20 bp, mouse
gattagcaagtttcctaagg

SEQ ID NO: 553175 - DNA, 20 bp, mouse
gcagcaatatcatcaaagtg

SEQ ID NO: 553176 - DNA, 20 bp, mouse
gagaacaaactgacaaagac

SEQ ID NO: 553177 - DNA, 20 bp, mouse
gtcagcaggacacaaaaaca

SEQ ID NO: 553178 - DNA, 20 bp, mouse
gcaaagacaggctgtagttt

SEQ ID NO: 553179 - DNA, 20 bp, mouse
gataagaaggtttcccagga

SEQ ID NO: 553180 - DNA, 20 bp, mouse
ggattataagaaggtttccc

SEQ ID NO: 553181 - DNA, 20 bp, mouse
gcagggacaatagaatcagc

SEQ ID NO: 553182 - DNA, 20 bp, mouse
gtcaacaacactaatgagca

SEQ ID NO: 553183 - DNA, 20 bp, mouse
gatatatctgatcaccatcc

SEQ ID NO: 553184 - DNA, 20 bp, mouse
gactttgatgcacagcctta

SEQ ID NO: 553185 - DNA, 20 bp, mouse
gtgaagatgggcatcagaga

SEQ ID NO: 553186 - DNA, 20 bp, mouse
gagaacaagtcgaaaaagag

SEQ ID NO: 553187 - DNA, 20 bp, mouse
gcaatattaaagcatataca

SEQ ID NO: 553188 - DNA, 20 bp, mouse
gaaagaggggttgcagttca

SEQ ID NO: 553189 - DNA, 20 bp, mouse
ggaattctgaaatacctgtt

SEQ ID NO: 553190 - DNA, 20 bp, mouse
gaccagagcatcacttatat

SEQ ID NO: 553191 - DNA, 20 bp, mouse
ggatcagggaaagtaatact

SEQ ID NO: 553192 - DNA, 20 bp, mouse
gtacagccagtataatgagt

SEQ ID NO: 553193 - DNA, 20 bp, mouse
gatgatggtgataaggtaca

SEQ ID NO: 553194 - DNA, 20 bp, mouse
gtggcaataccagaagtgta

SEQ ID NO: 553195 - DNA, 20 bp, mouse
gtaggcaaatgcataggaaa

SEQ ID NO: 553196 - DNA, 20 bp, mouse
gggaacagtccaaagaggat

SEQ ID NO: 553197 - DNA, 20 bp, mouse
gaagcaggaacagtccaaag

SEQ ID NO: 553198 - DNA, 20 bp, mouse
gaagttctggatcctctgag

SEQ ID NO: 553199 - DNA, 20 bp, mouse
gagcatcttaggaacagtgg

SEQ ID NO: 553200 - DNA, 20 bp, mouse
ggttcccagagactgtcact

SEQ ID NO: 553201 - DNA, 20 bp, mouse
gaggtgagcgtcagagacaa

SEQ ID NO: 553202 - DNA, 20 bp, mouse
gtgtcactaggtacataagc

SEQ ID NO: 553203 - DNA, 20 bp, mouse
ggtacctagtgacagtctct

SEQ ID NO: 553204 - DNA, 20 bp, mouse
gtgatttgttagaggctgaa

SEQ ID NO: 553205 - DNA, 20 bp, mouse
ggcaaatccatcagttacac

SEQ ID NO: 553206 - DNA, 20 bp, mouse
gcagggacaacagaatcagg

SEQ ID NO: 553207 - DNA, 20 bp, mouse
gtagcagggacaacagaatc

SEQ ID NO: 553208 - DNA, 20 bp, mouse
gtcaggaggatacagaaaca

SEQ ID NO: 553209 - DNA, 20 bp, mouse
gttcataaatctgatagagt

SEQ ID NO: 553210 - DNA, 20 bp, mouse
gcaagacaggctgcaatttt

SEQ ID NO: 553211 - DNA, 20 bp, mouse
gataagcatgttcccgaaaa

SEQ ID NO: 553212 - DNA, 20 bp, mouse
gatatctggttaccattttc

SEQ ID NO: 553213 - DNA, 20 bp, mouse
gttgttcttttctatatatc

SEQ ID NO: 553214 - DNA, 20 bp, mouse
gtgaactttgtcttaatatt

SEQ ID NO: 553215 - DNA, 20 bp, mouse
gtccacaatgctaattagca

SEQ ID NO: 553216 - DNA, 20 bp, mouse
gtaagtatatgaacaggaag

SEQ ID NO: 553217 - DNA, 20 bp, mouse
gggtgactaagtatatgaac

SEQ ID NO: 553218 - DNA, 20 bp, mouse
gatcataggccatcactgta

SEQ ID NO: 553219 - DNA, 20 bp, mouse
gatgtttcttgtcagtcttt

SEQ ID NO: 553220 - DNA, 20 bp, mouse
gatacttagtcaccatcctt

SEQ ID NO: 553221 - DNA, 20 bp, mouse
gaccagcatcttgatgactg

SEQ ID NO: 553222 - DNA, 20 bp, mouse
gagagtagaacacataagtt

SEQ ID NO: 553223 - DNA, 20 bp, mouse
gaatgatattataccttaat

SEQ ID NO: 553224 - DNA, 20 bp, mouse
ggccacagtcatcaagatgc

SEQ ID NO: 553225 - DNA, 20 bp, mouse
gtaacacaaacgttttgttt

SEQ ID NO: 553226 - DNA, 20 bp, mouse
gtcacaggtacactgcttat

SEQ ID NO: 553227 - DNA, 20 bp, mouse
gtatgaccaaacatctacag

SEQ ID NO: 553228 - DNA, 20 bp, mouse
ggcaagggcttagaatgact

SEQ ID NO: 553229 - DNA, 20 bp, mouse
gcaaacatctacagaggcaa

SEQ ID NO: 553230 - DNA, 20 bp, mouse
gggccatcacagccagcaat

SEQ ID NO: 553231 - DNA, 20 bp, mouse
gctcacaagactaatgaaaa

SEQ ID NO: 553232 - DNA, 20 bp, mouse
gattagtcttgtgagttcac

SEQ ID NO: 553233 - DNA, 20 bp, mouse
gggtatggatagcctattgc

SEQ ID NO: 553234 - DNA, 20 bp, mouse
gaaaagatgtcctagcctta

SEQ ID NO: 553235 - DNA, 20 bp, mouse
gagggtcctctgagagtcca

SEQ ID NO: 553236 - DNA, 20 bp, mouse
ggtgatggcgtatgacagat

SEQ ID NO: 553237 - DNA, 20 bp, mouse
gtgtatggacagtattctac

SEQ ID NO: 553238 - DNA, 20 bp, mouse
gatggcgtatgacagatggg

SEQ ID NO: 553239 - DNA, 20 bp, mouse
gtcaaaagatcctagcctta

SEQ ID NO: 553240 - DNA, 20 bp, mouse
gttcctctacaacctttcat

SEQ ID NO: 553241 - DNA, 20 bp, mouse
gacaaggattcagaatgact

SEQ ID NO: 553242 - DNA, 20 bp, mouse
gccttgtcggtgtagatatt

SEQ ID NO: 553243 - DNA, 20 bp, mouse
gatcagtctcattgattcac

SEQ ID NO: 553244 - DNA, 20 bp, mouse
gtcacaggtgcactgcttta

SEQ ID NO: 553245 - DNA, 20 bp, mouse
gtaagttatggatctgttgt

SEQ ID NO: 553246 - DNA, 20 bp, mouse
gtgtgattgatgaatatgtg

SEQ ID NO: 553247 - DNA, 20 bp, mouse
gtataaggtataaagtattc

SEQ ID NO: 553248 - DNA, 20 bp, mouse
gactgaattagaatctacaa

SEQ ID NO: 553249 - DNA, 20 bp, mouse
gcagtttctgtgttcacgac

SEQ ID NO: 553250 - DNA, 20 bp, mouse
ggttgtggagtaatcagtgg

SEQ ID NO: 553251 - DNA, 20 bp, mouse
gagaaatgttaaactagagc

SEQ ID NO: 553252 - DNA, 20 bp, mouse
gagagtgtttcagtcacctc

SEQ ID NO: 553253 - DNA, 20 bp, mouse
ggaggcaccaatttttgttc

SEQ ID NO: 553254 - DNA, 20 bp, mouse
gacatatacttttatctttc

SEQ ID NO: 553255 - DNA, 20 bp, mouse
gtccacttgacaatgaccag

SEQ ID NO: 553256 - DNA, 20 bp, mouse
gctctgagagaccaagtaac

SEQ ID NO: 553257 - DNA, 20 bp, mouse
gaaaaggtatcctagcccaa

SEQ ID NO: 553258 - DNA, 20 bp, mouse
gggccatcacagtcagtagt

SEQ ID NO: 553259 - DNA, 20 bp, mouse
ggccggggttcagaatgact

SEQ ID NO: 553260 - DNA, 20 bp, mouse
gccttggaattcctgttact

SEQ ID NO: 553261 - DNA, 20 bp, mouse
gtataatttaacaggtgcct

SEQ ID NO: 553262 - DNA, 20 bp, mouse
gtatgcagcctgcctaactc

SEQ ID NO: 553263 - DNA, 20 bp, mouse
gtagtatagagggcgacaaa

SEQ ID NO: 553264 - DNA, 20 bp, mouse
ggaggaccaaacgtctacac

SEQ ID NO: 553265 - DNA, 20 bp, mouse
gcccggcctgtgtagacgtt

SEQ ID NO: 553266 - DNA, 20 bp, mouse
gtgtgactaggtacacggac

SEQ ID NO: 553267 - DNA, 20 bp, mouse
gcatctcatggcactctccg

SEQ ID NO: 553268 - DNA, 20 bp, mouse
gattcccaagcactgtgact

SEQ ID NO: 553269 - DNA, 20 bp, mouse
gatatcaatcaaagataagt

SEQ ID NO: 553270 - DNA, 20 bp, mouse
gtgagtcaaagatgatgatc

SEQ ID NO: 553271 - DNA, 20 bp, mouse
gatccatacatacaaaaaat

SEQ ID NO: 553272 - DNA, 20 bp, mouse
gaatcaaagataagttggac

SEQ ID NO: 553273 - DNA, 20 bp, mouse
ggacatgattctaaatgtga

SEQ ID NO: 553274 - DNA, 20 bp, mouse
ggcagggtcatttcctatgc

SEQ ID NO: 553275 - DNA, 20 bp, mouse
ggagaatttaaaagatgtct

SEQ ID NO: 553276 - DNA, 20 bp, mouse
gagcagcgtgaccagataca

SEQ ID NO: 553277 - DNA, 20 bp, mouse
ggagaataggttgcaattca

SEQ ID NO: 553278 - DNA, 20 bp, mouse
gaataaaggacagattggag

SEQ ID NO: 553279 - DNA, 20 bp, mouse
gaataacagtgtagttgagg

SEQ ID NO: 553280 - DNA, 20 bp, mouse
gtatatagaatgccttacac

SEQ ID NO: 553281 - DNA, 20 bp, mouse
gtcagaagtgcacacagtcg

SEQ ID NO: 553282 - DNA, 20 bp, mouse
gagcagatacaaaagtcata

SEQ ID NO: 553283 - DNA, 20 bp, mouse
gatcaacagaacatgaatca

SEQ ID NO: 553284 - DNA, 20 bp, mouse
gaaattttgttataagtgtg

SEQ ID NO: 553285 - DNA, 20 bp, mouse
gataacaaaatttctcatcc

SEQ ID NO: 553286 - DNA, 20 bp, mouse
gttcatctgactactctagt

SEQ ID NO: 553287 - DNA, 20 bp, mouse
gactactctagtaggcatag

SEQ ID NO: 553288 - DNA, 20 bp, mouse
gtctaactctatatctatcc

SEQ ID NO: 553289 - DNA, 20 bp, mouse
gaaggctactctctgtaacc

SEQ ID NO: 553290 - DNA, 20 bp, mouse
gacaatttgggtaggtagta

SEQ ID NO: 553291 - DNA, 20 bp, mouse
gctgattactgaccattcta

SEQ ID NO: 553292 - DNA, 20 bp, mouse
gtgtatcatagagccgtagt

SEQ ID NO: 553293 - DNA, 20 bp, mouse
ggtcttcaaacctgacaatt

SEQ ID NO: 553294 - DNA, 20 bp, mouse
gtgtttcttcataacttaga

SEQ ID NO: 553295 - DNA, 20 bp, mouse
gatttggttttcaccaacta

SEQ ID NO: 553296 - DNA, 20 bp, mouse
ggtattatgaagacgaggaa

SEQ ID NO: 553297 - DNA, 20 bp, mouse
gaagtaagtattgaaaagga

SEQ ID NO: 553298 - DNA, 20 bp, mouse
gaggttctggttccttttgt

SEQ ID NO: 553299 - DNA, 20 bp, mouse
gttgaaaagcataatttatg

SEQ ID NO: 553300 - DNA, 20 bp, mouse
gtcttgttcgtgtaaggttc

SEQ ID NO: 553301 - DNA, 20 bp, mouse
ggagactttactttcaactt

SEQ ID NO: 553302 - DNA, 20 bp, mouse
gtcatggtattatgaagacg

SEQ ID NO: 553303 - DNA, 20 bp, mouse
gtttttatcttgttcgtgta

SEQ ID NO: 553304 - DNA, 20 bp, mouse
gatcaaagaagtaaatttcc

SEQ ID NO: 553305 - DNA, 20 bp, mouse
gatcctttagtaacagctta

SEQ ID NO: 553306 - DNA, 20 bp, mouse
gaatgactgaatagtgaagt

SEQ ID NO: 553307 - DNA, 20 bp, mouse
gttatgaatcctcaactaag

SEQ ID NO: 553308 - DNA, 20 bp, mouse
gacagagtctattgatgctg

SEQ ID NO: 553309 - DNA, 20 bp, mouse
ggtttgtggtcgctgtgctt

SEQ ID NO: 553310 - DNA, 20 bp, mouse
ggaaacagtccaaatagcat

SEQ ID NO: 553311 - DNA, 20 bp, mouse
gggttgatgctctggatatt

SEQ ID NO: 553312 - DNA, 20 bp, mouse
ggatattcaccaacatctta

SEQ ID NO: 553313 - DNA, 20 bp, mouse
gagcatgaaaaaataaatct

SEQ ID NO: 553314 - DNA, 20 bp, mouse
gaccaatgtcagaaaaggac

SEQ ID NO: 553315 - DNA, 20 bp, mouse
gagcatcaacccatgctatt

SEQ ID NO: 553316 - DNA, 20 bp, mouse
gcctatgggagagaacgatt

SEQ ID NO: 553317 - DNA, 20 bp, mouse
gttgagataactggacataa

SEQ ID NO: 553318 - DNA, 20 bp, mouse
gtcttatgactataaaacct

SEQ ID NO: 553319 - DNA, 20 bp, mouse
gagaaagaccttagagactg

SEQ ID NO: 553320 - DNA, 20 bp, mouse
gagaaaaggacaggttagat

SEQ ID NO: 553321 - DNA, 20 bp, mouse
gttctatttattgagataac

SEQ ID NO: 553322 - DNA, 20 bp, mouse
gtgagaaaatgtgtgcacct

SEQ ID NO: 553323 - DNA, 20 bp, mouse
ggtttgtggtcgctgtgttt

SEQ ID NO: 553324 - DNA, 20 bp, mouse
ggaaacagtccaaatagcat

SEQ ID NO: 553325 - DNA, 20 bp, mouse
gacatataccacagtctcta

SEQ ID NO: 553326 - DNA, 20 bp, mouse
gaaggaaccagaaccttaca

SEQ ID NO: 553327 - DNA, 20 bp, mouse
gcaagacaaaggagttactt

SEQ ID NO: 553328 - DNA, 20 bp, mouse
gctatgtattgtattaaagt

SEQ ID NO: 553329 - DNA, 20 bp, mouse
ggaggaagcatagaaagtaa

SEQ ID NO: 553330 - DNA, 20 bp, mouse
gctttgtcttgttccatgta

SEQ ID NO: 553331 - DNA, 20 bp, mouse
gaaataagtaagtgctgaaa

SEQ ID NO: 553332 - DNA, 20 bp, mouse
gtattcataatattgtaaga

SEQ ID NO: 553333 - DNA, 20 bp, mouse
gggaaataaacatgatactg

SEQ ID NO: 553334 - DNA, 20 bp, mouse
gggactcataggatgactat

SEQ ID NO: 553335 - DNA, 20 bp, mouse
gacaattttgagggactcat

SEQ ID NO: 553336 - DNA, 20 bp, mouse
ggaaataacccgaagagaat

SEQ ID NO: 553337 - DNA, 20 bp, mouse
ggacagccaggatgatgatc

SEQ ID NO: 553338 - DNA, 20 bp, mouse
ggaattctgagactagtgtt

SEQ ID NO: 553339 - DNA, 20 bp, mouse
gaactgcagcccattctctt

SEQ ID NO: 553340 - DNA, 20 bp, mouse
ggccatccatacatccaaaa

SEQ ID NO: 553341 - DNA, 20 bp, mouse
gggagtcagagttgacagcc

SEQ ID NO: 553342 - DNA, 20 bp, mouse
gagcaaagagataatctatg

SEQ ID NO: 553343 - DNA, 20 bp, mouse
gatcagagattctcatgaga

SEQ ID NO: 553344 - DNA, 20 bp, mouse
gacaatcatctttgggactg

SEQ ID NO: 553345 - DNA, 20 bp, mouse
ggatcaaatgactacatttt

SEQ ID NO: 553346 - DNA, 20 bp, mouse
gtggggccatggcccataca

SEQ ID NO: 553347 - DNA, 20 bp, mouse
gaggttccctgtatgggcca

SEQ ID NO: 553348 - DNA, 20 bp, mouse
gctatgtgatgggcttctct

SEQ ID NO: 553349 - DNA, 20 bp, mouse
ggcagtcattcttcttgggt

SEQ ID NO: 553350 - DNA, 20 bp, mouse
gacagtcaccatgtctcctc

SEQ ID NO: 553351 - DNA, 20 bp, mouse
ggcttatgaattttatctca

SEQ ID NO: 553352 - DNA, 20 bp, mouse
gttcatgaggttccctgtat

SEQ ID NO: 553353 - DNA, 20 bp, mouse
gaggatgaactctatcacag

SEQ ID NO: 553354 - DNA, 20 bp, mouse
gcttggcagtcattcttctt

SEQ ID NO: 553355 - DNA, 20 bp, mouse
gctacatggtgactgtggtt

SEQ ID NO: 553356 - DNA, 20 bp, mouse
gaaaacttgtaagcattttt

SEQ ID NO: 553357 - DNA, 20 bp, mouse
gaaaagaagtaaacatacct

SEQ ID NO: 553358 - DNA, 20 bp, mouse
ggccatggctgacagaatga

SEQ ID NO: 553359 - DNA, 20 bp, mouse
gatgtgatgggcttctctgg

SEQ ID NO: 553360 - DNA, 20 bp, mouse
ggtcattcttctcaggaaca

SEQ ID NO: 553361 - DNA, 20 bp, mouse
gatttttgggatgatagtgg

SEQ ID NO: 553362 - DNA, 20 bp, mouse
gttggtttgtcaggcctgca

SEQ ID NO: 553363 - DNA, 20 bp, mouse
gagcatttttgggatgatag

SEQ ID NO: 553364 - DNA, 20 bp, mouse
ggaatatcatctcacactca

SEQ ID NO: 553365 - DNA, 20 bp, mouse
gtctatgtgatgggcttctc

SEQ ID NO: 553366 - DNA, 20 bp, mouse
gatttttggggagatagtag

SEQ ID NO: 553367 - DNA, 20 bp, mouse
gaaaggagtaaacaaacctg

SEQ ID NO: 553368 - DNA, 20 bp, mouse
ggaacatcatctcacatcca

SEQ ID NO: 553369 - DNA, 20 bp, mouse
ggaatagcagaaatcgatta

SEQ ID NO: 553370 - DNA, 20 bp, mouse
gatctcacatccagggtgca

SEQ ID NO: 553371 - DNA, 20 bp, mouse
gacaactgtgccatgcaccc

SEQ ID NO: 553372 - DNA, 20 bp, mouse
gtgtttggtgtatatttaat

SEQ ID NO: 553373 - DNA, 20 bp, mouse
gtttgtttactccttttgtt

SEQ ID NO: 553374 - DNA, 20 bp, mouse
gtaaatatacaccaaacaaa

SEQ ID NO: 553375 - DNA, 20 bp, mouse
gtatatttaatgggttttgt

SEQ ID NO: 553376 - DNA, 20 bp, mouse
ggcagcgaacacctcctcag

SEQ ID NO: 553377 - DNA, 20 bp, mouse
gagacactcctagaggagaa

SEQ ID NO: 553378 - DNA, 20 bp, mouse
gctggtctgttaatccaaca

SEQ ID NO: 553379 - DNA, 20 bp, mouse
gtggtgacactatacaacag

SEQ ID NO: 553380 - DNA, 20 bp, mouse
ggggcttgatcacactgata

SEQ ID NO: 553381 - DNA, 20 bp, mouse
ggctggtggggtttgttctg

SEQ ID NO: 553382 - DNA, 20 bp, mouse
gaaaaggtatgaacacactt

SEQ ID NO: 553383 - DNA, 20 bp, mouse
gagcattttaggggtgagtg

SEQ ID NO: 553384 - DNA, 20 bp, mouse
gttggggctgtggcccatat

SEQ ID NO: 553385 - DNA, 20 bp, mouse
gtcttacatcctgtcagcaa

SEQ ID NO: 553386 - DNA, 20 bp, mouse
gagcaggcatgcatactcac

SEQ ID NO: 553387 - DNA, 20 bp, mouse
gcagctatatacatgcacaa

SEQ ID NO: 553388 - DNA, 20 bp, mouse
gtgactgttataggcaattt

SEQ ID NO: 553389 - DNA, 20 bp, mouse
ggggactgatcaccttaatt

SEQ ID NO: 553390 - DNA, 20 bp, mouse
gtctatgtgctgactgttat

SEQ ID NO: 553391 - DNA, 20 bp, mouse
gctggaattcaacccaatta

SEQ ID NO: 553392 - DNA, 20 bp, mouse
gatttttggcgtgaacacac

SEQ ID NO: 553393 - DNA, 20 bp, mouse
gtgctacgtgctggtgtcaa

SEQ ID NO: 553394 - DNA, 20 bp, mouse
gaattctgaatgctacgtgc

SEQ ID NO: 553395 - DNA, 20 bp, mouse
gaatggaagaaggctctaga

SEQ ID NO: 553396 - DNA, 20 bp, mouse
ggatatgaattggggaagaa

SEQ ID NO: 553397 - DNA, 20 bp, mouse
gctgctgtgtcaagccaagc

SEQ ID NO: 553398 - DNA, 20 bp, mouse
gttctcacagatatgaattg

SEQ ID NO: 553399 - DNA, 20 bp, mouse
gcatcaagaggcagacccga

SEQ ID NO: 553400 - DNA, 20 bp, mouse
gggagtctatatattctccg

SEQ ID NO: 553401 - DNA, 20 bp, mouse
gagttggggtgtatgttatg

SEQ ID NO: 553402 - DNA, 20 bp, mouse
gattggggaagaatggcttt

SEQ ID NO: 553403 - DNA, 20 bp, mouse
ggtagtacataggggtttgc

SEQ ID NO: 553404 - DNA, 20 bp, mouse
gctgcctcttgatgacagtt

SEQ ID NO: 553405 - DNA, 20 bp, mouse
ggtctatatattctccgtgg

SEQ ID NO: 553406 - DNA, 20 bp, mouse
gtggtaacttggtaaagtag

SEQ ID NO: 553407 - DNA, 20 bp, mouse
gggaatctacattgtatcca

SEQ ID NO: 553408 - DNA, 20 bp, mouse
gttgcctgctgatgacagtt

SEQ ID NO: 553409 - DNA, 20 bp, mouse
gattgcacacactggtagta

SEQ ID NO: 553410 - DNA, 20 bp, mouse
gcaccccaactgtcatcagc

SEQ ID NO: 553411 - DNA, 20 bp, mouse
gcttttcttacaggaaagaa

SEQ ID NO: 553412 - DNA, 20 bp, mouse
gctacattgtatccatggtg

SEQ ID NO: 553413 - DNA, 20 bp, mouse
ggtgtatgtgatgggatttt

SEQ ID NO: 553414 - DNA, 20 bp, mouse
gccaagaacaggaaaaagag

SEQ ID NO: 553415 - DNA, 20 bp, mouse
gatgcactcagcatgagaga

SEQ ID NO: 553416 - DNA, 20 bp, mouse
ggggattgacacagcagcca

SEQ ID NO: 553417 - DNA, 20 bp, mouse
gcagatatgacctagggaaa

SEQ ID NO: 553418 - DNA, 20 bp, mouse
gttcttaaagccatttccct

SEQ ID NO: 553419 - DNA, 20 bp, mouse
gaaaacccaccaacattcta

SEQ ID NO: 553420 - DNA, 20 bp, mouse
gatctatgtggtctccatgt

SEQ ID NO: 553421 - DNA, 20 bp, mouse
gtaacccctagaatgttggt

SEQ ID NO: 553422 - DNA, 20 bp, mouse
ggtcataacccctagaatgt

SEQ ID NO: 553423 - DNA, 20 bp, mouse
gcacacccatagtcatcaat

SEQ ID NO: 553424 - DNA, 20 bp, mouse
gatgcaaactatgtgggaca

SEQ ID NO: 553425 - DNA, 20 bp, mouse
gtctgcctattgatgactat

SEQ ID NO: 553426 - DNA, 20 bp, mouse
gctcagaatcccaaagaatg

SEQ ID NO: 553427 - DNA, 20 bp, mouse
gatccggtctcaaactacaa

SEQ ID NO: 553428 - DNA, 20 bp, mouse
gtctgaggaaccatgagttc

SEQ ID NO: 553429 - DNA, 20 bp, mouse
ggagagggggaaatcaattt

SEQ ID NO: 553430 - DNA, 20 bp, mouse
gggtttgtctccttggagag

SEQ ID NO: 553431 - DNA, 20 bp, mouse
gcttctgtgctgtcataaaa

SEQ ID NO: 553432 - DNA, 20 bp, mouse
gtccaaagccctcattcttt

SEQ ID NO: 553433 - DNA, 20 bp, mouse
gcgagtaacacagtgagtct

SEQ ID NO: 553434 - DNA, 20 bp, mouse
ggtcagtaaagtcacttatc

SEQ ID NO: 553435 - DNA, 20 bp, mouse
gtagaactgagatactgcag

SEQ ID NO: 553436 - DNA, 20 bp, mouse
gttgtttttgggaatctacg

SEQ ID NO: 553437 - DNA, 20 bp, mouse
gcgctcttcttcttgttttt

SEQ ID NO: 553438 - DNA, 20 bp, mouse
ggatctgatctaaggaaaaa

SEQ ID NO: 553439 - DNA, 20 bp, mouse
gtctctgtgatggggaactt

SEQ ID NO: 553440 - DNA, 20 bp, mouse
gctacgtggtctctgtgatg

SEQ ID NO: 553441 - DNA, 20 bp, mouse
gcacacccatagtcatcaat

SEQ ID NO: 553442 - DNA, 20 bp, mouse
gatgcaaactatgtgggaca

SEQ ID NO: 553443 - DNA, 20 bp, mouse
gtctgcctattgatgactat

SEQ ID NO: 553444 - DNA, 20 bp, mouse
gactatgggtgtgtatgtga

SEQ ID NO: 553445 - DNA, 20 bp, mouse
gtctcagcatgcaaactatg

SEQ ID NO: 553446 - DNA, 20 bp, mouse
gggttttggaaatgactctt

SEQ ID NO: 553447 - DNA, 20 bp, mouse
gcacacccatcatcatgaag

SEQ ID NO: 553448 - DNA, 20 bp, mouse
gtgagtcatgcactctgcat

SEQ ID NO: 553449 - DNA, 20 bp, mouse
gtctgccacttcatgatgat

SEQ ID NO: 553450 - DNA, 20 bp, mouse
ggatgggtgtggttgtgatg

SEQ ID NO: 553451 - DNA, 20 bp, mouse
gccaaaacccattctttctt

SEQ ID NO: 553452 - DNA, 20 bp, mouse
gaaactcactaacattttgg

SEQ ID NO: 553453 - DNA, 20 bp, mouse
gatatgacctaagaaagaat

SEQ ID NO: 553454 - DNA, 20 bp, mouse
gatggggtctgtgggtgctg

SEQ ID NO: 553455 - DNA, 20 bp, mouse
gtggttgtgatggggtctgt

SEQ ID NO: 553456 - DNA, 20 bp, mouse
gctcacttagacatgatgtt

SEQ ID NO: 553457 - DNA, 20 bp, mouse
gcaggtctgccacttgatga

SEQ ID NO: 553458 - DNA, 20 bp, mouse
gcactcccaccatcatcaag

SEQ ID NO: 553459 - DNA, 20 bp, mouse
ggtctgccacttgatgatgg

SEQ ID NO: 553460 - DNA, 20 bp, mouse
ggacatgatgttgggaagaa

SEQ ID NO: 553461 - DNA, 20 bp, mouse
gtgggtgccatggcacatac

SEQ ID NO: 553462 - DNA, 20 bp, mouse
gggtgggagtgtatgtgatg

SEQ ID NO: 553463 - DNA, 20 bp, mouse
gctgatgagacatggtaacc

SEQ ID NO: 553464 - DNA, 20 bp, mouse
gaatcagaacaatcagtccc

SEQ ID NO: 553465 - DNA, 20 bp, mouse
ggcagagatcaataaaggaa

SEQ ID NO: 553466 - DNA, 20 bp, mouse
ggtgatagattgaagatgga

SEQ ID NO: 553467 - DNA, 20 bp, mouse
gtagtgtgatagattgaaga

SEQ ID NO: 553468 - DNA, 20 bp, mouse
gtccctatttcatatctgca

SEQ ID NO: 553469 - DNA, 20 bp, mouse
ggtccttgcagatatgaaat

SEQ ID NO: 553470 - DNA, 20 bp, mouse
gcgaatttatcatcttattc

SEQ ID NO: 553471 - DNA, 20 bp, mouse
gaatagggaagaatggctgt

SEQ ID NO: 553472 - DNA, 20 bp, mouse
gtctctgtgatggggaacct

SEQ ID NO: 553473 - DNA, 20 bp, mouse
gatacactctgcatgagaga

SEQ ID NO: 553474 - DNA, 20 bp, mouse
ggatatgaaatagggaagaa

SEQ ID NO: 553475 - DNA, 20 bp, mouse
gctatgtggtctctgtgatg

SEQ ID NO: 553476 - DNA, 20 bp, mouse
ggcagaaatcaataaaagaa

SEQ ID NO: 553477 - DNA, 20 bp, mouse
gctgcctcttgatgacaggg

SEQ ID NO: 553478 - DNA, 20 bp, mouse
gaggtctgcctcttgatgac

SEQ ID NO: 553479 - DNA, 20 bp, mouse
gtctcacttagacatgacat

SEQ ID NO: 553480 - DNA, 20 bp, mouse
gcatcccccctgtcatcaag

SEQ ID NO: 553481 - DNA, 20 bp, mouse
gaggggggatgtatgtgatg

SEQ ID NO: 553482 - DNA, 20 bp, mouse
ggacatgacattggaaagaa

SEQ ID NO: 553483 - DNA, 20 bp, mouse
gaggcagacctgataggaca

SEQ ID NO: 553484 - DNA, 20 bp, mouse
gagcaatgactcttctgtga

SEQ ID NO: 553485 - DNA, 20 bp, mouse
gacagaagagtcattgctga

SEQ ID NO: 553486 - DNA, 20 bp, mouse
gattagtgttttgggagtaa

SEQ ID NO: 553487 - DNA, 20 bp, mouse
gtgatgatcatgtacagcag

SEQ ID NO: 553488 - DNA, 20 bp, mouse
ggatgatataaatggcaacg

SEQ ID NO: 553489 - DNA, 20 bp, mouse
ggccaattcagagtgctatt

SEQ ID NO: 553490 - DNA, 20 bp, mouse
ggcactctgaattggcaaaa

SEQ ID NO: 553491 - DNA, 20 bp, mouse
gttggttcatacttgatggg

SEQ ID NO: 553492 - DNA, 20 bp, mouse
gtggtgcaattgtccataca

SEQ ID NO: 553493 - DNA, 20 bp, mouse
gcatacttgatgggaggtat

SEQ ID NO: 553494 - DNA, 20 bp, mouse
gcatgttccctgatgatgtt

SEQ ID NO: 553495 - DNA, 20 bp, mouse
gcctgatcatacaccctgta

SEQ ID NO: 553496 - DNA, 20 bp, mouse
gaacagaacaacctgagtta

SEQ ID NO: 553497 - DNA, 20 bp, mouse
gacaaaggcagccgtaactc

SEQ ID NO: 553498 - DNA, 20 bp, mouse
gcattatggtgtcatctgtt

SEQ ID NO: 553499 - DNA, 20 bp, mouse
gtaaggatggcatataccaa

SEQ ID NO: 553500 - DNA, 20 bp, mouse
gatgcagccagtatgagcca

SEQ ID NO: 553501 - DNA, 20 bp, mouse
gcaagtgccatggctcatac

SEQ ID NO: 553502 - DNA, 20 bp, mouse
gatccgaggagacataagga

SEQ ID NO: 553503 - DNA, 20 bp, mouse
gttagcagggaacacatccg

SEQ ID NO: 553504 - DNA, 20 bp, mouse
gacacatccgaggagacata

SEQ ID NO: 553505 - DNA, 20 bp, mouse
gacagaagagtcattctcca

SEQ ID NO: 553506 - DNA, 20 bp, mouse
gcttaggagacataacaacc

SEQ ID NO: 553507 - DNA, 20 bp, mouse
gttagtgccacagctcacac

SEQ ID NO: 553508 - DNA, 20 bp, mouse
gggccagccattaatgtacc

SEQ ID NO: 553509 - DNA, 20 bp, mouse
gaacctggtacattaatggc

SEQ ID NO: 553510 - DNA, 20 bp, mouse
gtacattaatggctggccga

SEQ ID NO: 553511 - DNA, 20 bp, mouse
gtaacaacctggtacattaa

SEQ ID NO: 553512 - DNA, 20 bp, mouse
gactacacagctactgtaat

SEQ ID NO: 553513 - DNA, 20 bp, mouse
gttaacagacaacagatctt

SEQ ID NO: 553514 - DNA, 20 bp, mouse
gtttctattcttattcttgc

SEQ ID NO: 553515 - DNA, 20 bp, mouse
gcacatgatgcaaatgacta

SEQ ID NO: 553516 - DNA, 20 bp, mouse
gtaacagctttgtagagcag

SEQ ID NO: 553517 - DNA, 20 bp, mouse
gtctgtaagaataagtgtag

SEQ ID NO: 553518 - DNA, 20 bp, mouse
gacaaagctgttatgtcacc

SEQ ID NO: 553519 - DNA, 20 bp, mouse
gatattttgtacttatttga

SEQ ID NO: 553520 - DNA, 20 bp, mouse
gctcaatgcacaaaagacta

SEQ ID NO: 553521 - DNA, 20 bp, mouse
gttagtgccttattccatac

SEQ ID NO: 553522 - DNA, 20 bp, mouse
gaagcccatcagcattttgg

SEQ ID NO: 553523 - DNA, 20 bp, mouse
gtcaatagaaagcagatgcc

SEQ ID NO: 553524 - DNA, 20 bp, mouse
gactacacagtcactgtgat

SEQ ID NO: 553525 - DNA, 20 bp, mouse
gacaaagcccatcagcattt

SEQ ID NO: 553526 - DNA, 20 bp, mouse
gcagcagagagcagatctta

SEQ ID NO: 553527 - DNA, 20 bp, mouse
gtggggccatgactcacaca

SEQ ID NO: 553528 - DNA, 20 bp, mouse
gaaaactcatcaacattgtg

SEQ ID NO: 553529 - DNA, 20 bp, mouse
gacaagaagagaacaaacag

SEQ ID NO: 553530 - DNA, 20 bp, mouse
gtgactcatgcatccagcat

SEQ ID NO: 553531 - DNA, 20 bp, mouse
gagcacataacattcagagt

SEQ ID NO: 553532 - DNA, 20 bp, mouse
gatgcatccagcataggaga

SEQ ID NO: 553533 - DNA, 20 bp, mouse
ggtaactgagttcattttta

SEQ ID NO: 553534 - DNA, 20 bp, mouse
gttacttgatgggttttgct

SEQ ID NO: 553535 - DNA, 20 bp, mouse
gatgcgagtcatgaagcaaa

SEQ ID NO: 553536 - DNA, 20 bp, mouse
gcaccacagagaaatgacgc

SEQ ID NO: 553537 - DNA, 20 bp, mouse
gccagctggctacccctctc

SEQ ID NO: 553538 - DNA, 20 bp, mouse
gggtagccagctggagacaa

SEQ ID NO: 553539 - DNA, 20 bp, mouse
gggaataaaaaaattaaaaa

SEQ ID NO: 553540 - DNA, 20 bp, mouse
gtaaaaagggaagccagaga

SEQ ID NO: 553541 - DNA, 20 bp, mouse
ggctggcaagagggatggtg

SEQ ID NO: 553542 - DNA, 20 bp, mouse
gcatttccccaaagcagact

SEQ ID NO: 553543 - DNA, 20 bp, mouse
gagagtccgccagcgtaagg

SEQ ID NO: 553544 - DNA, 20 bp, mouse
gggaggtcagccaacatccg

SEQ ID NO: 553545 - DNA, 20 bp, mouse
gaagcagctggcaagaggga

SEQ ID NO: 553546 - DNA, 20 bp, mouse
ggtgtcctgagaagtagtca

SEQ ID NO: 553547 - DNA, 20 bp, mouse
ggtctctgtatctagttgga

SEQ ID NO: 553548 - DNA, 20 bp, mouse
gcagctggcaacacaggcga

SEQ ID NO: 553549 - DNA, 20 bp, mouse
gcttcatcttcttatctctg

SEQ ID NO: 553550 - DNA, 20 bp, mouse
gttcttatctctggggacga

SEQ ID NO: 553551 - DNA, 20 bp, mouse
gaaaggccatcactgctagc

SEQ ID NO: 553552 - DNA, 20 bp, mouse
gctacttctcaggacacaca

SEQ ID NO: 553553 - DNA, 20 bp, mouse
gctcaccctgactacttctc

SEQ ID NO: 553554 - DNA, 20 bp, mouse
gaggcgagggtggatgatgg

SEQ ID NO: 553555 - DNA, 20 bp, mouse
gctggcaacacaggcgaggg

SEQ ID NO: 553556 - DNA, 20 bp, mouse
gaatgactccaccacagtga

SEQ ID NO: 553557 - DNA, 20 bp, mouse
gtcacagatatgacctgaga

SEQ ID NO: 553558 - DNA, 20 bp, mouse
gccagaggccattccttctc

SEQ ID NO: 553559 - DNA, 20 bp, mouse
gtgtaagccattgctttata

SEQ ID NO: 553560 - DNA, 20 bp, mouse
gatgcaaattgtgtgggcta

SEQ ID NO: 553561 - DNA, 20 bp, mouse
gtgtacatgatggggtttgt

SEQ ID NO: 553562 - DNA, 20 bp, mouse
gtctcagcatgcaaattgtg

SEQ ID NO: 553563 - DNA, 20 bp, mouse
gagaataaactccttcactg

SEQ ID NO: 553564 - DNA, 20 bp, mouse
ggtggtggagtcattgccag

SEQ ID NO: 553565 - DNA, 20 bp, mouse
gataaactccttcactgtgg

SEQ ID NO: 553566 - DNA, 20 bp, mouse
ggatgatccacactcagtca

SEQ ID NO: 553567 - DNA, 20 bp, mouse
gctgcttctgtagaaatagt

SEQ ID NO: 553568 - DNA, 20 bp, mouse
gctgagtccattcttttcaa

SEQ ID NO: 553569 - DNA, 20 bp, mouse
gtcactgcattgggaaattt

SEQ ID NO: 553570 - DNA, 20 bp, mouse
gatgtgttaatcctactaga

SEQ ID NO: 553571 - DNA, 20 bp, mouse
gatacattgcatataggaaa

SEQ ID NO: 553572 - DNA, 20 bp, mouse
gtgctttgtgctgacgtcaa

SEQ ID NO: 553573 - DNA, 20 bp, mouse
gacaggggtatttggcgatc

SEQ ID NO: 553574 - DNA, 20 bp, mouse
gtgagtcatacattgcatat

SEQ ID NO: 553575 - DNA, 20 bp, mouse
gtcatcacattatataaaag

SEQ ID NO: 553576 - DNA, 20 bp, mouse
ggcctctgcaaatgtgtctt

SEQ ID NO: 553577 - DNA, 20 bp, mouse
ggaacacagtagagtagcag

SEQ ID NO: 553578 - DNA, 20 bp, mouse
gaggtatttgaagatcaggc

SEQ ID NO: 553579 - DNA, 20 bp, mouse
gtggcaaccgtgtacaagag

SEQ ID NO: 553580 - DNA, 20 bp, mouse
gaccaaagacacatttgcag

SEQ ID NO: 553581 - DNA, 20 bp, mouse
gtgtaatccactcttgtaca

SEQ ID NO: 553582 - DNA, 20 bp, mouse
gtgcatatgtaccaagcata

SEQ ID NO: 553583 - DNA, 20 bp, mouse
gaaggttcaaacacaattta

SEQ ID NO: 553584 - DNA, 20 bp, mouse
gaaagcagaagaaatatagc

SEQ ID NO: 553585 - DNA, 20 bp, mouse
gaaacacaatttaggggaca

SEQ ID NO: 553586 - DNA, 20 bp, mouse
gcactggagatcggactcct

SEQ ID NO: 553587 - DNA, 20 bp, mouse
gattagaaacaggatgaaga

SEQ ID NO: 553588 - DNA, 20 bp, mouse
ggaagaatgggttttgaaaa

SEQ ID NO: 553589 - DNA, 20 bp, mouse
gcacatacatcattagaaac

SEQ ID NO: 553590 - DNA, 20 bp, mouse
ggacaatattatacaagagt

SEQ ID NO: 553591 - DNA, 20 bp, mouse
gaaaatgtaacactcagaga

SEQ ID NO: 553592 - DNA, 20 bp, mouse
gcatgtatgaactaaacata

SEQ ID NO: 553593 - DNA, 20 bp, mouse
gagggtttgattagcttaat

SEQ ID NO: 553594 - DNA, 20 bp, mouse
gagaatactatttcctacag

SEQ ID NO: 553595 - DNA, 20 bp, mouse
gattctggtgggattaacca

SEQ ID NO: 553596 - DNA, 20 bp, mouse
gagttactatatacattaca

SEQ ID NO: 553597 - DNA, 20 bp, mouse
gaaacactgaagagtaacag

SEQ ID NO: 553598 - DNA, 20 bp, mouse
gtagcaatattatataagag

SEQ ID NO: 553599 - DNA, 20 bp, mouse
gtaactatgaccgggaattt

SEQ ID NO: 553600 - DNA, 20 bp, mouse
ggtatatagtaactatgacc

SEQ ID NO: 553601 - DNA, 20 bp, mouse
gaagaatggctttcggaaat

SEQ ID NO: 553602 - DNA, 20 bp, mouse
ggaatattatctcttatacg

SEQ ID NO: 553603 - DNA, 20 bp, mouse
gtgggtttggtaattctaat

SEQ ID NO: 553604 - DNA, 20 bp, mouse
ggaaagccattcttttctat

SEQ ID NO: 553605 - DNA, 20 bp, mouse
gattaccaaacccaaattcc

SEQ ID NO: 553606 - DNA, 20 bp, mouse
ggtacatcaccagaaagagt

SEQ ID NO: 553607 - DNA, 20 bp, mouse
gtaggaacaggggtatttgt

SEQ ID NO: 553608 - DNA, 20 bp, mouse
gcactgagttcatcttgatg

SEQ ID NO: 553609 - DNA, 20 bp, mouse
ggccctggaaaatgcttcct

SEQ ID NO: 553610 - DNA, 20 bp, mouse
ggtctatgcaggacaagtta

SEQ ID NO: 553611 - DNA, 20 bp, mouse
gcttctcttaaagaatctat

SEQ ID NO: 553612 - DNA, 20 bp, mouse
gaccaaggaagcattttcca

SEQ ID NO: 553613 - DNA, 20 bp, mouse
gacaggggtatttgtaggtc

SEQ ID NO: 553614 - DNA, 20 bp, mouse
gagattctttaagagaagaa

SEQ ID NO: 553615 - DNA, 20 bp, mouse
gtatgcaggacaagttaagg

SEQ ID NO: 553616 - DNA, 20 bp, mouse
gtcatagcagaaacagacta

SEQ ID NO: 553617 - DNA, 20 bp, mouse
gcagctgtggcctggatgat

SEQ ID NO: 553618 - DNA, 20 bp, mouse
gcagcttccagcacaggcga

SEQ ID NO: 553619 - DNA, 20 bp, mouse
gagaagggcagcttgagggt

SEQ ID NO: 553620 - DNA, 20 bp, mouse
gctcggtggttcccaaggac

SEQ ID NO: 553621 - DNA, 20 bp, mouse
gagggcagcttgagggtagg

SEQ ID NO: 553622 - DNA, 20 bp, mouse
gatgcactcggtggttccca

SEQ ID NO: 553623 - DNA, 20 bp, mouse
gagctgccagcttccagcac

SEQ ID NO: 553624 - DNA, 20 bp, mouse
ggtcaaaagacatcactgtc

SEQ ID NO: 553625 - DNA, 20 bp, mouse
gaaaagacatcactgtcagg

SEQ ID NO: 553626 - DNA, 20 bp, mouse
ggactttactgtggagtcac

SEQ ID NO: 553627 - DNA, 20 bp, mouse
gatgttcattcttggactgg

SEQ ID NO: 553628 - DNA, 20 bp, mouse
gataactacgtacttttctc

SEQ ID NO: 553629 - DNA, 20 bp, mouse
gctttttatgtacttatcat

SEQ ID NO: 553630 - DNA, 20 bp, mouse
gttcatgaaatccaagaaac

SEQ ID NO: 553631 - DNA, 20 bp, mouse
gtttttgggatagcaaggtc

SEQ ID NO: 553632 - DNA, 20 bp, mouse
gggtatgaatgttagtgaaa

SEQ ID NO: 553633 - DNA, 20 bp, mouse
gtaactgtgaaaaagagcac

SEQ ID NO: 553634 - DNA, 20 bp, mouse
gtagattgacataatttttt

SEQ ID NO: 553635 - DNA, 20 bp, mouse
gaatctacaatcctgtttct

SEQ ID NO: 553636 - DNA, 20 bp, mouse
ggactgaattcattctactg

SEQ ID NO: 553637 - DNA, 20 bp, mouse
gaaacagaagaaatagagct

SEQ ID NO: 553638 - DNA, 20 bp, mouse
ggggctggaaaatggttctt

SEQ ID NO: 553639 - DNA, 20 bp, mouse
gagatatcataaaaaagaat

SEQ ID NO: 553640 - DNA, 20 bp, mouse
gaaagaatggggctggaaaa

SEQ ID NO: 553641 - DNA, 20 bp, mouse
gacaacagcagtggggaatt

SEQ ID NO: 553642 - DNA, 20 bp, mouse
gtcataaaaaagaatggggc

SEQ ID NO: 553643 - DNA, 20 bp, mouse
gtgggtcatacatcccatgt

SEQ ID NO: 553644 - DNA, 20 bp, mouse
gtatacacaacaacagcagt

SEQ ID NO: 553645 - DNA, 20 bp, mouse
gacaggggtaactggagatc

SEQ ID NO: 553646 - DNA, 20 bp, mouse
ggattttactgtggattcac

SEQ ID NO: 553647 - DNA, 20 bp, mouse
gcgcatgaaggaaagcatag

SEQ ID NO: 553648 - DNA, 20 bp, mouse
gtataagtgtatttgaaagt

SEQ ID NO: 553649 - DNA, 20 bp, mouse
gatgttcacttttagactgg

SEQ ID NO: 553650 - DNA, 20 bp, mouse
gcttatgttcacttttagac

SEQ ID NO: 553651 - DNA, 20 bp, mouse
gattttgggatagcaaggac

SEQ ID NO: 553652 - DNA, 20 bp, mouse
gaaggaggccatacgcatga

SEQ ID NO: 553653 - DNA, 20 bp, mouse
gctatttctttgcaagatta

SEQ ID NO: 553654 - DNA, 20 bp, mouse
gatgcatgttaatgaaaagg

SEQ ID NO: 553655 - DNA, 20 bp, mouse
ggatatattttgggatagca

SEQ ID NO: 553656 - DNA, 20 bp, mouse
gcttcctaaaaagagacatt

SEQ ID NO: 553657 - DNA, 20 bp, mouse
gatttggtatatgtttcctg

SEQ ID NO: 553658 - DNA, 20 bp, mouse
gatgcccaatgtctcttttt

SEQ ID NO: 553659 - DNA, 20 bp, mouse
gtcttatcggtccttttcat

SEQ ID NO: 553660 - DNA, 20 bp, mouse
gggaacaagtaccaatgaaa

SEQ ID NO: 553661 - DNA, 20 bp, mouse
ggtacttgttccttttactc

SEQ ID NO: 553662 - DNA, 20 bp, mouse
gacttttttagcttctcccc

SEQ ID NO: 553663 - DNA, 20 bp, mouse
gtcatttcaaaaaggatatg

SEQ ID NO: 553664 - DNA, 20 bp, mouse
gtgtttttttccagagtaaa

SEQ ID NO: 553665 - DNA, 20 bp, mouse
gttgaaatgaccaagtattg

SEQ ID NO: 553666 - DNA, 20 bp, mouse
gttagaaaaattaggaacag

SEQ ID NO: 553667 - DNA, 20 bp, mouse
gacaggggcatttgaaggtc

SEQ ID NO: 553668 - DNA, 20 bp, mouse
gcttgaaggaagaatggctc

SEQ ID NO: 553669 - DNA, 20 bp, mouse
ggaagaatggctctggcaaa

SEQ ID NO: 553670 - DNA, 20 bp, mouse
gacacaacctgtgtggatca

SEQ ID NO: 553671 - DNA, 20 bp, mouse
ggaacattatttcttacatg

SEQ ID NO: 553672 - DNA, 20 bp, mouse
gtttatttgataacagcatt

SEQ ID NO: 553673 - DNA, 20 bp, mouse
gtaggaacaggggcatttga

SEQ ID NO: 553674 - DNA, 20 bp, mouse
gtggcaacactatacaagag

SEQ ID NO: 553675 - DNA, 20 bp, mouse
gataaattattagaaaaatt

SEQ ID NO: 553676 - DNA, 20 bp, mouse
ggactcagtaaatatttctt

SEQ ID NO: 553677 - DNA, 20 bp, mouse
gccagaaatataaagaacaa

SEQ ID NO: 553678 - DNA, 20 bp, mouse
gacaagggtatttgtagata

SEQ ID NO: 553679 - DNA, 20 bp, mouse
gattccccaatgcagtgact

SEQ ID NO: 553680 - DNA, 20 bp, mouse
ggtacctagtcactgcattg

SEQ ID NO: 553681 - DNA, 20 bp, mouse
ggaatagcagaagtctacaa

SEQ ID NO: 553682 - DNA, 20 bp, mouse
ggttgatgaactttataaca

SEQ ID NO: 553683 - DNA, 20 bp, mouse
gtaaagttcatcaacatttg

SEQ ID NO: 553684 - DNA, 20 bp, mouse
gtgacaagattatacagcag

SEQ ID NO: 553685 - DNA, 20 bp, mouse
gagattctctcagagaagaa

SEQ ID NO: 553686 - DNA, 20 bp, mouse
gtcagtaaatgtctctttgg

SEQ ID NO: 553687 - DNA, 20 bp, mouse
gaatgctaatgaatttcata

SEQ ID NO: 553688 - DNA, 20 bp, mouse
ggtgtttctggcaatgtacc

SEQ ID NO: 553689 - DNA, 20 bp, mouse
gacttcttacatggaatgta

SEQ ID NO: 553690 - DNA, 20 bp, mouse
gaaaacaagagaaatagagt

SEQ ID NO: 553691 - DNA, 20 bp, mouse
ggccagaaacacaaagaaca

SEQ ID NO: 553692 - DNA, 20 bp, mouse
ggaacacagaagaatagcaa

SEQ ID NO: 553693 - DNA, 20 bp, mouse
gatttcccaatgcagtgacc

SEQ ID NO: 553694 - DNA, 20 bp, mouse
gtgaaattcattagcatttg

SEQ ID NO: 553695 - DNA, 20 bp, mouse
gcccctgttctttgtgtttc

SEQ ID NO: 553696 - DNA, 20 bp, mouse
ggagtagcaaagatcaatga

SEQ ID NO: 553697 - DNA, 20 bp, mouse
gcaataataagcatgctgac

SEQ ID NO: 553698 - DNA, 20 bp, mouse
gtgagtcatgcacccctcat

SEQ ID NO: 553699 - DNA, 20 bp, mouse
gtggtgaccttatacagcag

SEQ ID NO: 553700 - DNA, 20 bp, mouse
gaaggtcaccatgtccccac

SEQ ID NO: 553701 - DNA, 20 bp, mouse
gatagtacatgggggtgtac

SEQ ID NO: 553702 - DNA, 20 bp, mouse
gtctacactgtcacagtggt

SEQ ID NO: 553703 - DNA, 20 bp, mouse
gataatctacactgtcacag

SEQ ID NO: 553704 - DNA, 20 bp, mouse
gatgcttattattgaaaatc

SEQ ID NO: 553705 - DNA, 20 bp, mouse
gttcagagataacaaaaaag

SEQ ID NO: 553706 - DNA, 20 bp, mouse
gatcttcggggtaataacag

SEQ ID NO: 553707 - DNA, 20 bp, mouse
ggttattaccccgaagatgt

SEQ ID NO: 553708 - DNA, 20 bp, mouse
ggcacctgcatgttttatgt

SEQ ID NO: 553709 - DNA, 20 bp, mouse
gcttcctacataaaacatgc

SEQ ID NO: 553710 - DNA, 20 bp, mouse
gtaaaacatgcaggtgcaaa

SEQ ID NO: 553711 - DNA, 20 bp, mouse
gtatatggcatgggtttaat

SEQ ID NO: 553712 - DNA, 20 bp, mouse
gtttgtctgttaatccagca

SEQ ID NO: 553713 - DNA, 20 bp, mouse
gtaccatccaggaacagatt

SEQ ID NO: 553714 - DNA, 20 bp, mouse
gaagttcaccaacatcttcg

SEQ ID NO: 553715 - DNA, 20 bp, mouse
gtaaagcaagggattgcaaa

SEQ ID NO: 553716 - DNA, 20 bp, mouse
gcaactggcgacataggtgg

SEQ ID NO: 553717 - DNA, 20 bp, mouse
gttctctgacaacccacaac

SEQ ID NO: 553718 - DNA, 20 bp, mouse
gccaagctatacctgccaac

SEQ ID NO: 553719 - DNA, 20 bp, mouse
gacctgccaactggcgacat

SEQ ID NO: 553720 - DNA, 20 bp, mouse
gtgccaactggcgacatagg

SEQ ID NO: 553721 - DNA, 20 bp, mouse
gaggtgggggttgattttgg

SEQ ID NO: 553722 - DNA, 20 bp, mouse
gcataggtgggggttgattt

SEQ ID NO: 553723 - DNA, 20 bp, mouse
gacattggagagtgaagcct

SEQ ID NO: 553724 - DNA, 20 bp, mouse
gatctccgtgtctagttggc

SEQ ID NO: 553725 - DNA, 20 bp, mouse
gagcaggaagaagaccacag

SEQ ID NO: 553726 - DNA, 20 bp, mouse
gagaggggttctgaaaaaag

SEQ ID NO: 553727 - DNA, 20 bp, mouse
gcagtgacaagatcccgagg

SEQ ID NO: 553728 - DNA, 20 bp, mouse
gaaagaatgacaacatatcg

SEQ ID NO: 553729 - DNA, 20 bp, mouse
ggatatagttgaaagaatag

SEQ ID NO: 553730 - DNA, 20 bp, mouse
gtcatggtcttctttttcac

SEQ ID NO: 553731 - DNA, 20 bp, mouse
gcttcagtgacaagatcccg

SEQ ID NO: 553732 - DNA, 20 bp, mouse
gaagaacaacctgctggatc

SEQ ID NO: 553733 - DNA, 20 bp, mouse
gttatatggtcttccccctc

SEQ ID NO: 553734 - DNA, 20 bp, mouse
gactcaggagttaagggctg

SEQ ID NO: 553735 - DNA, 20 bp, mouse
ggttactgacctgatccagc

SEQ ID NO: 553736 - DNA, 20 bp, mouse
gctagcatctcttctctagg

SEQ ID NO: 553737 - DNA, 20 bp, mouse
gtttttttttcatatgacaa

SEQ ID NO: 553738 - DNA, 20 bp, mouse
ggcaactgtgataataagaa

SEQ ID NO: 553739 - DNA, 20 bp, mouse
gtaatcttctgacatataat

SEQ ID NO: 553740 - DNA, 20 bp, mouse
gtagtagtaaggaaataaca

SEQ ID NO: 553741 - DNA, 20 bp, mouse
gttcagaaatatctgtgtat

SEQ ID NO: 553742 - DNA, 20 bp, mouse
gtctaatattacgatgataa

SEQ ID NO: 553743 - DNA, 20 bp, mouse
gtattatcacagttgccact

SEQ ID NO: 553744 - DNA, 20 bp, mouse
gatatgacaaaggtatatgc

SEQ ID NO: 553745 - DNA, 20 bp, mouse
gatcgtaatattagactatg

SEQ ID NO: 553746 - DNA, 20 bp, mouse
gtgttcagaattaggaaaac

SEQ ID NO: 553747 - DNA, 20 bp, mouse
gtacataggagtgtgaagag

SEQ ID NO: 553748 - DNA, 20 bp, mouse
gagaagccatgttcagaatt

SEQ ID NO: 553749 - DNA, 20 bp, mouse
gaatagccaaatttcagcag

SEQ ID NO: 553750 - DNA, 20 bp, mouse
gtgtgatagcatagatgcct

SEQ ID NO: 553751 - DNA, 20 bp, mouse
gtctatgctatcacagtggc

SEQ ID NO: 553752 - DNA, 20 bp, mouse
gaggataaactcagtaatga

SEQ ID NO: 553753 - DNA, 20 bp, mouse
gatattctgttaagccaacc

SEQ ID NO: 553754 - DNA, 20 bp, mouse
gagatcctggtagaagagaa

SEQ ID NO: 553755 - DNA, 20 bp, mouse
gagcatagatgcctaggaag

SEQ ID NO: 553756 - DNA, 20 bp, mouse
gtgtagatcttcatctacac

SEQ ID NO: 553757 - DNA, 20 bp, mouse
gatctatgtggttactatag

SEQ ID NO: 553758 - DNA, 20 bp, mouse
gacacatggaaattactccc

SEQ ID NO: 553759 - DNA, 20 bp, mouse
gtgagtcaagcagcctgtat

SEQ ID NO: 553760 - DNA, 20 bp, mouse
gtctacagaagaatgacaca

SEQ ID NO: 553761 - DNA, 20 bp, mouse
gctggtgacagaatttatcc

SEQ ID NO: 553762 - DNA, 20 bp, mouse
gtgacagaatttatcctgga

SEQ ID NO: 553763 - DNA, 20 bp, mouse
ggttactatagtggcaaatc

SEQ ID NO: 553764 - DNA, 20 bp, mouse
gacaaaattaattagcattt

SEQ ID NO: 553765 - DNA, 20 bp, mouse
gcagagttcagagcatggat

SEQ ID NO: 553766 - DNA, 20 bp, mouse
gtatatgtgatcacagtagt

SEQ ID NO: 553767 - DNA, 20 bp, mouse
gtgagtcatgcactccaaaa

SEQ ID NO: 553768 - DNA, 20 bp, mouse
gtcatttttgttattgcaga

SEQ ID NO: 553769 - DNA, 20 bp, mouse
gatatattgccagaaacaag

SEQ ID NO: 553770 - DNA, 20 bp, mouse
ggagtgaagttgagaactaa

SEQ ID NO: 553771 - DNA, 20 bp, mouse
gtactcactgggcttctttg

SEQ ID NO: 553772 - DNA, 20 bp, mouse
ggacaatgttgtccttctgt

SEQ ID NO: 553773 - DNA, 20 bp, mouse
gcattgtcatacgggttgta

SEQ ID NO: 553774 - DNA, 20 bp, mouse
ggaaggacaacattgtcata

SEQ ID NO: 553775 - DNA, 20 bp, mouse
gaacattgtcatgtcccaca

SEQ ID NO: 553776 - DNA, 20 bp, mouse
gttatctgtaaggaaaaggg

SEQ ID NO: 553777 - DNA, 20 bp, mouse
gggcatacatgtgattacag

SEQ ID NO: 553778 - DNA, 20 bp, mouse
gttctgaaatagctaaaagg

SEQ ID NO: 553779 - DNA, 20 bp, mouse
gttataaaatattatctgta

SEQ ID NO: 553780 - DNA, 20 bp, mouse
gtacatgtgattacagtggt

SEQ ID NO: 553781 - DNA, 20 bp, mouse
ggccttctgaaatagctaaa

SEQ ID NO: 553782 - DNA, 20 bp, mouse
gtgagtcatgcactccttaa

SEQ ID NO: 553783 - DNA, 20 bp, mouse
gatattatctgtaaggaaaa

SEQ ID NO: 553784 - DNA, 20 bp, mouse
gtaaggaaaagggagggcaa

SEQ ID NO: 553785 - DNA, 20 bp, mouse
gatgtatgcccagaaacaag

SEQ ID NO: 553786 - DNA, 20 bp, mouse
ggagaagcacaaaaagggca

SEQ ID NO: 553787 - DNA, 20 bp, mouse
gagggcacggcattgtcacc

SEQ ID NO: 553788 - DNA, 20 bp, mouse
gtgtcctgagaagcacaaaa

SEQ ID NO: 553789 - DNA, 20 bp, mouse
gaggcgggggtggattatgg

SEQ ID NO: 553790 - DNA, 20 bp, mouse
gggtctttgtggggccccag

SEQ ID NO: 553791 - DNA, 20 bp, mouse
gcataggcgggggtggatta

SEQ ID NO: 553792 - DNA, 20 bp, mouse
gtgcatcctgttgacagtaa

SEQ ID NO: 553793 - DNA, 20 bp, mouse
gaaaggccattactgtcaac

SEQ ID NO: 553794 - DNA, 20 bp, mouse
gaacaacatctggggaacac

SEQ ID NO: 553795 - DNA, 20 bp, mouse
ggaagctgatggtctttgtg

SEQ ID NO: 553796 - DNA, 20 bp, mouse
ggctgcagaatgattcccag

SEQ ID NO: 553797 - DNA, 20 bp, mouse
gggtgtaatgacagtggaat

SEQ ID NO: 553798 - DNA, 20 bp, mouse
gtccagaaatcttcaagtaa

SEQ ID NO: 553799 - DNA, 20 bp, mouse
gacagcagaaaaaaggccta

SEQ ID NO: 553800 - DNA, 20 bp, mouse
gatggcgtatgatcactacg

SEQ ID NO: 553801 - DNA, 20 bp, mouse
gatacgccataacagtcagg

SEQ ID NO: 553802 - DNA, 20 bp, mouse
gcggtctttgtggtcactga

SEQ ID NO: 553803 - DNA, 20 bp, mouse
gtgctagttgccttcaccct

SEQ ID NO: 553804 - DNA, 20 bp, mouse
gatcatacgccataacagtc

SEQ ID NO: 553805 - DNA, 20 bp, mouse
gatcacttattcggagtgca

SEQ ID NO: 553806 - DNA, 20 bp, mouse
gccagaaactttcaaagaat

SEQ ID NO: 553807 - DNA, 20 bp, mouse
gcagttgtgtttgtcttggt

SEQ ID NO: 553808 - DNA, 20 bp, mouse
gttctttgtgatcttcgtgg

SEQ ID NO: 553809 - DNA, 20 bp, mouse
gtttttctttgtgatcttcg

SEQ ID NO: 553810 - DNA, 20 bp, mouse
gtgacagcagtggggaacct

SEQ ID NO: 553811 - DNA, 20 bp, mouse
ggaatagcagagatcaacac

SEQ ID NO: 553812 - DNA, 20 bp, mouse
gctatgtggtgacagcagtg

SEQ ID NO: 553813 - DNA, 20 bp, mouse
ggtaacagttgtgtttgtct

SEQ ID NO: 553814 - DNA, 20 bp, mouse
gctttcaaagaatgggcact

SEQ ID NO: 553815 - DNA, 20 bp, mouse
gactagcagtgagcaaagtc

SEQ ID NO: 553816 - DNA, 20 bp, mouse
gtgggcatccctcatacaga

SEQ ID NO: 553817 - DNA, 20 bp, mouse
gctccacaccctctgtatga

SEQ ID NO: 553818 - DNA, 20 bp, mouse
gtcttgggagagctaacgga

SEQ ID NO: 553819 - DNA, 20 bp, mouse
gagcatcttgggagagctaa

SEQ ID NO: 553820 - DNA, 20 bp, mouse
gatgagcaagttccccacta

SEQ ID NO: 553821 - DNA, 20 bp, mouse
gggcaactggaaggttagag

SEQ ID NO: 553822 - DNA, 20 bp, mouse
gtaccttagagggaagcata

SEQ ID NO: 553823 - DNA, 20 bp, mouse
gtccgcatagcttcaagaca

SEQ ID NO: 553824 - DNA, 20 bp, mouse
gctacatcttcaccttagtg

SEQ ID NO: 553825 - DNA, 20 bp, mouse
ggattattgagtaccttaga

SEQ ID NO: 553826 - DNA, 20 bp, mouse
ggaccagagagcatggaaca

SEQ ID NO: 553827 - DNA, 20 bp, mouse
gttccttgttccatgctctc

SEQ ID NO: 553828 - DNA, 20 bp, mouse
gacattctgaaatagcaaaa

SEQ ID NO: 553829 - DNA, 20 bp, mouse
gtcatgtagggtgtatgttt

SEQ ID NO: 553830 - DNA, 20 bp, mouse
gattgaaaggcacttatgtt

SEQ ID NO: 553831 - DNA, 20 bp, mouse
gagtgcctttcaattgtttt

SEQ ID NO: 553832 - DNA, 20 bp, mouse
gagaatctgaccagagagca

SEQ ID NO: 553833 - DNA, 20 bp, mouse
gtctctggtcagattctgaa

SEQ ID NO: 553834 - DNA, 20 bp, mouse
gaactcctaaaacaattgaa

SEQ ID NO: 553835 - DNA, 20 bp, mouse
gttgttctgttaagccagag

SEQ ID NO: 553836 - DNA, 20 bp, mouse
gtggcagttgcagctctggt

SEQ ID NO: 553837 - DNA, 20 bp, mouse
gttggtctgttaaaccagag

SEQ ID NO: 553838 - DNA, 20 bp, mouse
gaaagtggcagttgcagctc

SEQ ID NO: 553839 - DNA, 20 bp, mouse
ggactgagaacatggaaaaa

SEQ ID NO: 553840 - DNA, 20 bp, mouse
ggatgctactgtaaagcagg

SEQ ID NO: 553841 - DNA, 20 bp, mouse
gcacttttcctcctatttct

SEQ ID NO: 553842 - DNA, 20 bp, mouse
ggtttcagaatgtttcatgc

SEQ ID NO: 553843 - DNA, 20 bp, mouse
gcatgatgctactgtaaagc

SEQ ID NO: 553844 - DNA, 20 bp, mouse
gcaggtagattccaagaaat

SEQ ID NO: 553845 - DNA, 20 bp, mouse
ggtagattccaagaaatagg

SEQ ID NO: 553846 - DNA, 20 bp, mouse
gtcactgtagtggggaattt

SEQ ID NO: 553847 - DNA, 20 bp, mouse
ggaacatagcatatggcaac

SEQ ID NO: 553848 - DNA, 20 bp, mouse
gctatgtggtcactgtagtg

SEQ ID NO: 553849 - DNA, 20 bp, mouse
gggagtctatattattggtg

SEQ ID NO: 553850 - DNA, 20 bp, mouse
gtctttggagtctatattat

SEQ ID NO: 553851 - DNA, 20 bp, mouse
ggcccagtcagaatgaactc

SEQ ID NO: 553852 - DNA, 20 bp, mouse
gacctgagttcattctgact

SEQ ID NO: 553853 - DNA, 20 bp, mouse
ggggaattgaacatagcata

SEQ ID NO: 553854 - DNA, 20 bp, mouse
gatatagactccaaagatca

SEQ ID NO: 553855 - DNA, 20 bp, mouse
gtgagccatgcatccagtgt

SEQ ID NO: 553856 - DNA, 20 bp, mouse
ggaaatcaatgatacctcag

SEQ ID NO: 553857 - DNA, 20 bp, mouse
gctaggaagataagaaatag

SEQ ID NO: 553858 - DNA, 20 bp, mouse
gtattcattttaccattcaa

SEQ ID NO: 553859 - DNA, 20 bp, mouse
gagatttataatccattgaa

SEQ ID NO: 553860 - DNA, 20 bp, mouse
ggttctctgttaacccagtg

SEQ ID NO: 553861 - DNA, 20 bp, mouse
gacccatgtattatttactc

SEQ ID NO: 553862 - DNA, 20 bp, mouse
gatcttcctagctgtatatt

SEQ ID NO: 553863 - DNA, 20 bp, mouse
gtagagtttccagaagacaa

SEQ ID NO: 553864 - DNA, 20 bp, mouse
ggatttcttccattgtcttc

SEQ ID NO: 553865 - DNA, 20 bp, mouse
gtagaggcaattggagctct

SEQ ID NO: 553866 - DNA, 20 bp, mouse
gggacttgtaaaggaatact

SEQ ID NO: 553867 - DNA, 20 bp, mouse
gccccttgaaggacttgtaa

SEQ ID NO: 553868 - DNA, 20 bp, mouse
gctccaatatgggataaact

SEQ ID NO: 553869 - DNA, 20 bp, mouse
gtcctttacaagtccttcaa

SEQ ID NO: 553870 - DNA, 20 bp, mouse
gaactccaagaaggttcgga

SEQ ID NO: 553871 - DNA, 20 bp, mouse
gggaccagtgcgaagaggac

SEQ ID NO: 553872 - DNA, 20 bp, mouse
gtgtggttagcggtaagaca

SEQ ID NO: 553873 - DNA, 20 bp, mouse
gtcggcacatgcccaagttt

SEQ ID NO: 553874 - DNA, 20 bp, mouse
ggatagaaactgtgcttaac

SEQ ID NO: 553875 - DNA, 20 bp, mouse
gagctgtggttagcctgagg

SEQ ID NO: 553876 - DNA, 20 bp, mouse
ggcgtctcaagtcatcttcc

SEQ ID NO: 553877 - DNA, 20 bp, mouse
gatgacttgagacgcagacc

SEQ ID NO: 553878 - DNA, 20 bp, mouse
gaaaggtactgttcccaatg

SEQ ID NO: 553879 - DNA, 20 bp, mouse
gtataccagtactaaataga

SEQ ID NO: 553880 - DNA, 20 bp, mouse
gcagagcttcacaactgttc

SEQ ID NO: 553881 - DNA, 20 bp, mouse
gtactaaatagatggctagt

SEQ ID NO: 553882 - DNA, 20 bp, mouse
gcaataatgtcatttgtaag

SEQ ID NO: 553883 - DNA, 20 bp, mouse
gtgacattattgctggaatt

SEQ ID NO: 553884 - DNA, 20 bp, mouse
gtactggtatatatttccca

SEQ ID NO: 553885 - DNA, 20 bp, mouse
gtgcaacattatagattttt

SEQ ID NO: 553886 - DNA, 20 bp, mouse
gtcactgtgacaggaaacgt

SEQ ID NO: 553887 - DNA, 20 bp, mouse
gagtgattagatagattcca

SEQ ID NO: 553888 - DNA, 20 bp, mouse
ggtcctccaatcagatctaa

SEQ ID NO: 553889 - DNA, 20 bp, mouse
gtctgttcatccttaatcac

SEQ ID NO: 553890 - DNA, 20 bp, mouse
gccccatgtactttttcgtc

SEQ ID NO: 553891 - DNA, 20 bp, mouse
gaacatgaagccagtgatta

SEQ ID NO: 553892 - DNA, 20 bp, mouse
ggggtcatatatttttgctg

SEQ ID NO: 553893 - DNA, 20 bp, mouse
gatttacaattctctgattt

SEQ ID NO: 553894 - DNA, 20 bp, mouse
gagaggggcagctggaattc

SEQ ID NO: 553895 - DNA, 20 bp, mouse
gattttaggaataacaactg

SEQ ID NO: 553896 - DNA, 20 bp, mouse
gtgtgcatcagttcacacag

SEQ ID NO: 553897 - DNA, 20 bp, mouse
gtatatctaatcactgtggt

SEQ ID NO: 553898 - DNA, 20 bp, mouse
gactgtagtcatgtcctatc

SEQ ID NO: 553899 - DNA, 20 bp, mouse
gacagtgtctgaattcttct

SEQ ID NO: 553900 - DNA, 20 bp, mouse
ggtctgaattcttcttggct

SEQ ID NO: 553901 - DNA, 20 bp, mouse
gtgagccatgcatccaaggt

SEQ ID NO: 553902 - DNA, 20 bp, mouse
gggaatatatctaatcactg

SEQ ID NO: 553903 - DNA, 20 bp, mouse
gatctcctaccttggatgca

SEQ ID NO: 553904 - DNA, 20 bp, mouse
gtacttcttcatcatttttg

SEQ ID NO: 553905 - DNA, 20 bp, mouse
ggaatggaggacatgacatc

SEQ ID NO: 553906 - DNA, 20 bp, mouse
ggaactcagtcactatgcaa

SEQ ID NO: 553907 - DNA, 20 bp, mouse
gaggatctaattggagaaca

SEQ ID NO: 553908 - DNA, 20 bp, mouse
gcagatagattgctacaaat

SEQ ID NO: 553909 - DNA, 20 bp, mouse
gtgctacaaataggagaaaa

SEQ ID NO: 553910 - DNA, 20 bp, mouse
gtggttacattgtaacgtag

SEQ ID NO: 553911 - DNA, 20 bp, mouse
gttctccaattagatcctga

SEQ ID NO: 553912 - DNA, 20 bp, mouse
gtaacgtagggggttacaaa

SEQ ID NO: 553913 - DNA, 20 bp, mouse
gtggggatgattgcattgat

SEQ ID NO: 553914 - DNA, 20 bp, mouse
gaaacaccggctttataatt

SEQ ID NO: 553915 - DNA, 20 bp, mouse
gttacagttccttgatttca

SEQ ID NO: 553916 - DNA, 20 bp, mouse
gccaaaggctgaagcaagat

SEQ ID NO: 553917 - DNA, 20 bp, mouse
gatgggcaccaactcctctc

SEQ ID NO: 553918 - DNA, 20 bp, mouse
ggacgtgtagcagatctcca

SEQ ID NO: 553919 - DNA, 20 bp, mouse
gacgaactcagtaaccagag

SEQ ID NO: 553920 - DNA, 20 bp, mouse
gcagggctgagaggatgcgg

SEQ ID NO: 553921 - DNA, 20 bp, mouse
ggcagcacctggtagcgcag

SEQ ID NO: 553922 - DNA, 20 bp, mouse
gtttggtcaagagagagggg

SEQ ID NO: 553923 - DNA, 20 bp, mouse
gctggttactgagttcgtgc

SEQ ID NO: 553924 - DNA, 20 bp, mouse
gaccgtctacctgctcactg

SEQ ID NO: 553925 - DNA, 20 bp, mouse
ggcagccagagcgcgagatg

SEQ ID NO: 553926 - DNA, 20 bp, mouse
gagaacttcatcacctaccc

SEQ ID NO: 553927 - DNA, 20 bp, mouse
ggttgccatctgtaacacct

SEQ ID NO: 553928 - DNA, 20 bp, mouse
gtctattttgtcatcatttt

SEQ ID NO: 553929 - DNA, 20 bp, mouse
gtatatctaatcactgtgtc

SEQ ID NO: 553930 - DNA, 20 bp, mouse
gctgtgaagaagaggaacag

SEQ ID NO: 553931 - DNA, 20 bp, mouse
ggaacacagtcactgtgcaa

SEQ ID NO: 553932 - DNA, 20 bp, mouse
gtactccttcaggataagaa

SEQ ID NO: 553933 - DNA, 20 bp, mouse
gtgagtcatgcatccagggt

SEQ ID NO: 553934 - DNA, 20 bp, mouse
ggactgaccaaagtcaatga

SEQ ID NO: 553935 - DNA, 20 bp, mouse
gatatattcctgtgaagaag

SEQ ID NO: 553936 - DNA, 20 bp, mouse
ggaattaaatcataccccag

SEQ ID NO: 553937 - DNA, 20 bp, mouse
gcaagaatgaactctgccac

SEQ ID NO: 553938 - DNA, 20 bp, mouse
gtaattcttccatggtcttc

SEQ ID NO: 553939 - DNA, 20 bp, mouse
gttacagttgttggaaactt

SEQ ID NO: 553940 - DNA, 20 bp, mouse
gttcattgagtgatagggga

SEQ ID NO: 553941 - DNA, 20 bp, mouse
gtatactttccagaagacca

SEQ ID NO: 553942 - DNA, 20 bp, mouse
gataggaagataaggaatag

SEQ ID NO: 553943 - DNA, 20 bp, mouse
ggactgacagcagtcaataa

SEQ ID NO: 553944 - DNA, 20 bp, mouse
gaaaattcattgagtgatag

SEQ ID NO: 553945 - DNA, 20 bp, mouse
gatagacagataggaagata

SEQ ID NO: 553946 - DNA, 20 bp, mouse
gtggctatattgtaaaccaa

SEQ ID NO: 553947 - DNA, 20 bp, mouse
gtctgctgtgccaaaaatga

SEQ ID NO: 553948 - DNA, 20 bp, mouse
gatcacctaccctgaatgct

SEQ ID NO: 553949 - DNA, 20 bp, mouse
gtgagccaagcattcagggt

SEQ ID NO: 553950 - DNA, 20 bp, mouse
gctgtgcaatggtttcctgc

SEQ ID NO: 553951 - DNA, 20 bp, mouse
ggaatggaggacatgccagc

SEQ ID NO: 553952 - DNA, 20 bp, mouse
ggttgccatctgtaacccct

SEQ ID NO: 553953 - DNA, 20 bp, mouse
gtctactttgccatcatttt

SEQ ID NO: 553954 - DNA, 20 bp, mouse
gtctatctgatcactgtgtc

SEQ ID NO: 553955 - DNA, 20 bp, mouse
gctgtgaagaagaggaacag

SEQ ID NO: 553956 - DNA, 20 bp, mouse
gggtaaggaatagaggcaac

SEQ ID NO: 553957 - DNA, 20 bp, mouse
gaacaaatagacagatagga

SEQ ID NO: 553958 - DNA, 20 bp, mouse
gtagctgtggtgtatggtat

SEQ ID NO: 553959 - DNA, 20 bp, mouse
gatcaacaaacagacttgat

SEQ ID NO: 553960 - DNA, 20 bp, mouse
gtgatggtagctgtggtgta

SEQ ID NO: 553961 - DNA, 20 bp, mouse
gtgtttgttgatggtagctg

SEQ ID NO: 553962 - DNA, 20 bp, mouse
gagaatgaactctgtcactg

SEQ ID NO: 553963 - DNA, 20 bp, mouse
gataggaaggtaaggaatag

SEQ ID NO: 553964 - DNA, 20 bp, mouse
gatagacagataggaaggta

SEQ ID NO: 553965 - DNA, 20 bp, mouse
gtgtaaacaaatagacagat

SEQ ID NO: 553966 - DNA, 20 bp, mouse
ggcaggggcagctgtagcgc

SEQ ID NO: 553967 - DNA, 20 bp, mouse
gtcacagtcataggaaacct

SEQ ID NO: 553968 - DNA, 20 bp, mouse
gcttctctgttaatccagtg

SEQ ID NO: 553969 - DNA, 20 bp, mouse
ggtgcaggtgagaagagaac

SEQ ID NO: 553970 - DNA, 20 bp, mouse
gatgctggagaaatttgtca

SEQ ID NO: 553971 - DNA, 20 bp, mouse
gtagtgggggtgtatagtgt

SEQ ID NO: 553972 - DNA, 20 bp, mouse
gaggcagactgtttcccctg

SEQ ID NO: 553973 - DNA, 20 bp, mouse
gattttgggcatgatgacac

SEQ ID NO: 553974 - DNA, 20 bp, mouse
gtggtaacattatatagcaa

SEQ ID NO: 553975 - DNA, 20 bp, mouse
gtacacccccactaccatcc

SEQ ID NO: 553976 - DNA, 20 bp, mouse
ggagataaaaaactgctcag

SEQ ID NO: 553977 - DNA, 20 bp, mouse
ggagctgggagacacagtct

SEQ ID NO: 553978 - DNA, 20 bp, mouse
gactagggtacaggcataga

SEQ ID NO: 553979 - DNA, 20 bp, mouse
gggtacaggcatagaagggc

SEQ ID NO: 553980 - DNA, 20 bp, mouse
ggagaaacccatatcaaata

SEQ ID NO: 553981 - DNA, 20 bp, mouse
gagttttttatctccatgaa

SEQ ID NO: 553982 - DNA, 20 bp, mouse
ggatgaccgagtaccgaaga

SEQ ID NO: 553983 - DNA, 20 bp, mouse
gaagtctgctaagtcccata

SEQ ID NO: 553984 - DNA, 20 bp, mouse
gacatttcccactagggtac

SEQ ID NO: 553985 - DNA, 20 bp, mouse
gaacttgtccgtatttgata

SEQ ID NO: 553986 - DNA, 20 bp, mouse
gagatagtctcaaagctatg

SEQ ID NO: 553987 - DNA, 20 bp, mouse
gaaaaatagacaatttacat

SEQ ID NO: 553988 - DNA, 20 bp, mouse
gctcggtacaaccaaggaaa

SEQ ID NO: 553989 - DNA, 20 bp, mouse
gatcccaaacacagagggtc

SEQ ID NO: 553990 - DNA, 20 bp, mouse
gtctacatcttcactctgat

SEQ ID NO: 553991 - DNA, 20 bp, mouse
gttccagaccctctgtgttt

SEQ ID NO: 553992 - DNA, 20 bp, mouse
gtgtgtttgggatgccgagc

SEQ ID NO: 553993 - DNA, 20 bp, mouse
gggaaacttattaatcttac

SEQ ID NO: 553994 - DNA, 20 bp, mouse
gtaattattgagtagcgtaa

SEQ ID NO: 553995 - DNA, 20 bp, mouse
ggaaacactcggtacaacca

SEQ ID NO: 553996 - DNA, 20 bp, mouse
gagaaaactgaatatcccat

SEQ ID NO: 553997 - DNA, 20 bp, mouse
gctgtggaaaggattcccat

SEQ ID NO: 553998 - DNA, 20 bp, mouse
ggtgcagcccagggacttca

SEQ ID NO: 553999 - DNA, 20 bp, mouse
ggtgacagtttgatttcctg

SEQ ID NO: 554000 - DNA, 20 bp, mouse
gtgaggtgtgggtatcgtag

SEQ ID NO: 554001 - DNA, 20 bp, mouse
gaaacaggaggtgcagccca

SEQ ID NO: 554002 - DNA, 20 bp, mouse
gtggtttccatgaagtccct

SEQ ID NO: 554003 - DNA, 20 bp, mouse
gttgaggccccatgaggtgt

SEQ ID NO: 554004 - DNA, 20 bp, mouse
ggcaccattgaggccccatg

SEQ ID NO: 554005 - DNA, 20 bp, mouse
gatgctcattgcagtggtgg

SEQ ID NO: 554006 - DNA, 20 bp, mouse
ggcccatgtcagagatagag

SEQ ID NO: 554007 - DNA, 20 bp, mouse
ggtgttgtttgtcatgttca

SEQ ID NO: 554008 - DNA, 20 bp, mouse
gatatctctcaggaaggggt

SEQ ID NO: 554009 - DNA, 20 bp, mouse
gatttcttctatcattgtat

SEQ ID NO: 554010 - DNA, 20 bp, mouse
gacctctctatctctgacat

SEQ ID NO: 554011 - DNA, 20 bp, mouse
gggaggtgactgcagtaaga

SEQ ID NO: 554012 - DNA, 20 bp, mouse
gtctctcaggaaggggtggg

SEQ ID NO: 554013 - DNA, 20 bp, mouse
gaacatgacaaacaacacta

SEQ ID NO: 554014 - DNA, 20 bp, mouse
gatgggtgtgtggagtcgtg

SEQ ID NO: 554015 - DNA, 20 bp, mouse
gaagtttcccagcaaggcac

SEQ ID NO: 554016 - DNA, 20 bp, mouse
gggtgtgtgtagtcttgggg

SEQ ID NO: 554017 - DNA, 20 bp, mouse
gcatgggtgtgtgtagtctt

SEQ ID NO: 554018 - DNA, 20 bp, mouse
gcagaaacctaagtcaaaga

SEQ ID NO: 554019 - DNA, 20 bp, mouse
ggttgaaaacagaaaaagca

SEQ ID NO: 554020 - DNA, 20 bp, mouse
ggtgagggaagttaggatgg

SEQ ID NO: 554021 - DNA, 20 bp, mouse
gaaagtgagggaagttagga

SEQ ID NO: 554022 - DNA, 20 bp, mouse
gcatatctctcaggatgggg

SEQ ID NO: 554023 - DNA, 20 bp, mouse
gctggaaagtgagggaagtt

SEQ ID NO: 554024 - DNA, 20 bp, mouse
gtgtcatatctctcaggatg

SEQ ID NO: 554025 - DNA, 20 bp, mouse
gacctctccatctttgactt

SEQ ID NO: 554026 - DNA, 20 bp, mouse
ggtttcagggatgcccagta

SEQ ID NO: 554027 - DNA, 20 bp, mouse
ggtgaggcaagttaggatag

SEQ ID NO: 554028 - DNA, 20 bp, mouse
gaacctctccatctttgaca

SEQ ID NO: 554029 - DNA, 20 bp, mouse
gtgtcatatctctcaggaca

SEQ ID NO: 554030 - DNA, 20 bp, mouse
gcaaaaacccatgtcaaaga

SEQ ID NO: 554031 - DNA, 20 bp, mouse
gtgggcatccctgaaacaga

SEQ ID NO: 554032 - DNA, 20 bp, mouse
gctccaggccctctgtttca

SEQ ID NO: 554033 - DNA, 20 bp, mouse
gtgacagaattcaccttact

SEQ ID NO: 554034 - DNA, 20 bp, mouse
gcatatctctcaggacaggg

SEQ ID NO: 554035 - DNA, 20 bp, mouse
gtctctcaggacagggtgga

SEQ ID NO: 554036 - DNA, 20 bp, mouse
gagaattgttcaggaagaaa

SEQ ID NO: 554037 - DNA, 20 bp, mouse
gttcaggaagaaatggctga

SEQ ID NO: 554038 - DNA, 20 bp, mouse
gtggtgacattatacctcaa

SEQ ID NO: 554039 - DNA, 20 bp, mouse
gtgtttatggatgataggtg

SEQ ID NO: 554040 - DNA, 20 bp, mouse
gtaggtggggtgtattgcat

SEQ ID NO: 554041 - DNA, 20 bp, mouse
gctacttgttcacggagctg

SEQ ID NO: 554042 - DNA, 20 bp, mouse
gatgcaaacagtatgaagtg

SEQ ID NO: 554043 - DNA, 20 bp, mouse
gtgccatctgtaaccccttg

SEQ ID NO: 554044 - DNA, 20 bp, mouse
gtgttacatgttgtctgcaa

SEQ ID NO: 554045 - DNA, 20 bp, mouse
ggtcttaccaagtctgttta

SEQ ID NO: 554046 - DNA, 20 bp, mouse
gatagcaggaaactactcca

SEQ ID NO: 554047 - DNA, 20 bp, mouse
gcgttactgcatagattccg

SEQ ID NO: 554048 - DNA, 20 bp, mouse
gtcctctgggaattccctgt

SEQ ID NO: 554049 - DNA, 20 bp, mouse
gtgcatagattccgaggaag

SEQ ID NO: 554050 - DNA, 20 bp, mouse
gatccaggtgcagacttgat

SEQ ID NO: 554051 - DNA, 20 bp, mouse
gtgtcacatgctggcagcta

SEQ ID NO: 554052 - DNA, 20 bp, mouse
gctatgcagtaacgatggta

SEQ ID NO: 554053 - DNA, 20 bp, mouse
ggttacagatggcaacgtat

SEQ ID NO: 554054 - DNA, 20 bp, mouse
gtatttggggtgtatagcat

SEQ ID NO: 554055 - DNA, 20 bp, mouse
gcatagcattgtatagcaag

SEQ ID NO: 554056 - DNA, 20 bp, mouse
gaaaactgtgtcatacattc

SEQ ID NO: 554057 - DNA, 20 bp, mouse
gatccaggaacaaacttgat

SEQ ID NO: 554058 - DNA, 20 bp, mouse
ggtcctatcaagtttgttcc

SEQ ID NO: 554059 - DNA, 20 bp, mouse
ggggaataatgacaatggac

SEQ ID NO: 554060 - DNA, 20 bp, mouse
gctggtttaacagacaaacc

SEQ ID NO: 554061 - DNA, 20 bp, mouse
gagattgaactcagttactc

SEQ ID NO: 554062 - DNA, 20 bp, mouse
gcccagaagaaaatgttcca

SEQ ID NO: 554063 - DNA, 20 bp, mouse
gtgttccaaggaaatctttc

SEQ ID NO: 554064 - DNA, 20 bp, mouse
gtaactgagttcaatcttgc

SEQ ID NO: 554065 - DNA, 20 bp, mouse
gatatttggagtatatatta

SEQ ID NO: 554066 - DNA, 20 bp, mouse
gatccaagaacagactcgat

SEQ ID NO: 554067 - DNA, 20 bp, mouse
gcataatattgtaaagcaag

SEQ ID NO: 554068 - DNA, 20 bp, mouse
ggtcctatcgagtctgttct

SEQ ID NO: 554069 - DNA, 20 bp, mouse
gttttaacattttcttctct

SEQ ID NO: 554070 - DNA, 20 bp, mouse
gtaaagcaaggggttaccga

SEQ ID NO: 554071 - DNA, 20 bp, mouse
gatgcagactgtgtgagatg

SEQ ID NO: 554072 - DNA, 20 bp, mouse
ggactgagttcatcctcgct

SEQ ID NO: 554073 - DNA, 20 bp, mouse
gtgagtcatgcattcaggat

SEQ ID NO: 554074 - DNA, 20 bp, mouse
gtttgtttgttaacccagcg

SEQ ID NO: 554075 - DNA, 20 bp, mouse
gatatttggagtatatatta

SEQ ID NO: 554076 - DNA, 20 bp, mouse
gttgccgagagaccaggtat

SEQ ID NO: 554077 - DNA, 20 bp, mouse
gaaaccattgccgagagacc

SEQ ID NO: 554078 - DNA, 20 bp, mouse
gatgagcatcaacccatacc

SEQ ID NO: 554079 - DNA, 20 bp, mouse
gaaaagcaccaattcaacaa

SEQ ID NO: 554080 - DNA, 20 bp, mouse
ggtccagtaactcagagaaa

SEQ ID NO: 554081 - DNA, 20 bp, mouse
gaggcatccagagaacgaga

SEQ ID NO: 554082 - DNA, 20 bp, mouse
gaagacaattcactctctgc

SEQ ID NO: 554083 - DNA, 20 bp, mouse
gatggatccatctcgttctc

SEQ ID NO: 554084 - DNA, 20 bp, mouse
ggtattgtatttcaagaagt

SEQ ID NO: 554085 - DNA, 20 bp, mouse
gtgccatttctctgagttac

SEQ ID NO: 554086 - DNA, 20 bp, mouse
ggtgagaactgagtaatatc

SEQ ID NO: 554087 - DNA, 20 bp, mouse
gtatatagtatagctttaat

SEQ ID NO: 554088 - DNA, 20 bp, mouse
gtataccccaaatatcattg

SEQ ID NO: 554089 - DNA, 20 bp, mouse
gtgttcctcaatgatatttg

SEQ ID NO: 554090 - DNA, 20 bp, mouse
gtacagcattgtaaagcaag

SEQ ID NO: 554091 - DNA, 20 bp, mouse
gattgaggaacagacttgaa

SEQ ID NO: 554092 - DNA, 20 bp, mouse
gatagattgctagaaagagg

SEQ ID NO: 554093 - DNA, 20 bp, mouse
ggactgagttcatcctcgct

SEQ ID NO: 554094 - DNA, 20 bp, mouse
gcagagaagaaaatgttaaa

SEQ ID NO: 554095 - DNA, 20 bp, mouse
gtttgtttgttaacccagcg

SEQ ID NO: 554096 - DNA, 20 bp, mouse
gacaggggcagctgcaactc

SEQ ID NO: 554097 - DNA, 20 bp, mouse
gctgcaactctggtttggtt

SEQ ID NO: 554098 - DNA, 20 bp, mouse
gaaattcgattatcatcgaa

SEQ ID NO: 554099 - DNA, 20 bp, mouse
ggtctgcttctggttcacag

SEQ ID NO: 554100 - DNA, 20 bp, mouse
gacagtgggagtttacactt

SEQ ID NO: 554101 - DNA, 20 bp, mouse
gctgttgaactttttgttag

SEQ ID NO: 554102 - DNA, 20 bp, mouse
gtgtgaccaggtagatgcca

SEQ ID NO: 554103 - DNA, 20 bp, mouse
gctcttccttggcatctacc

SEQ ID NO: 554104 - DNA, 20 bp, mouse
gtaatcgaatttatcttgac

SEQ ID NO: 554105 - DNA, 20 bp, mouse
gatgagaagataatggagtc

SEQ ID NO: 554106 - DNA, 20 bp, mouse
gattgcagaatgtcagatgt

SEQ ID NO: 554107 - DNA, 20 bp, mouse
gacagtctgcatgttaagag

SEQ ID NO: 554108 - DNA, 20 bp, mouse
gaaaaaagcatagctgtgtc

SEQ ID NO: 554109 - DNA, 20 bp, mouse
gaaaatgttggtgaactttt

SEQ ID NO: 554110 - DNA, 20 bp, mouse
gacagacaaaccagggctgc

SEQ ID NO: 554111 - DNA, 20 bp, mouse
gtattcagtatggctttgat

SEQ ID NO: 554112 - DNA, 20 bp, mouse
gatagctgtgtcaggcattc

SEQ ID NO: 554113 - DNA, 20 bp, mouse
gatatttggtgtattcagta

SEQ ID NO: 554114 - DNA, 20 bp, mouse
gggaatctatgtggtaacag

SEQ ID NO: 554115 - DNA, 20 bp, mouse
ggggaataatgacattggac

SEQ ID NO: 554116 - DNA, 20 bp, mouse
gcactcaactcatcacatct

SEQ ID NO: 554117 - DNA, 20 bp, mouse
gaacccctcaaggacaaata

SEQ ID NO: 554118 - DNA, 20 bp, mouse
gatcttggggattataacgg

SEQ ID NO: 554119 - DNA, 20 bp, mouse
gctggtctgttaacccctca

SEQ ID NO: 554120 - DNA, 20 bp, mouse
gaaagtgggatctggagccc

SEQ ID NO: 554121 - DNA, 20 bp, mouse
gagaggcaagtattatcagt

SEQ ID NO: 554122 - DNA, 20 bp, mouse
gtggaccatgcattcaggaa

SEQ ID NO: 554123 - DNA, 20 bp, mouse
gatgcttcagagtgatttcc

SEQ ID NO: 554124 - DNA, 20 bp, mouse
ggccatggctgttagcatgt

SEQ ID NO: 554125 - DNA, 20 bp, mouse
ggtctccatggcaggaaacc

SEQ ID NO: 554126 - DNA, 20 bp, mouse
gatatacagctgggctggaa

SEQ ID NO: 554127 - DNA, 20 bp, mouse
gtgtatatgggattcccacc

SEQ ID NO: 554128 - DNA, 20 bp, mouse
ggtgtgactatgtccagtga

SEQ ID NO: 554129 - DNA, 20 bp, mouse
ggggaatcccatatacagct

SEQ ID NO: 554130 - DNA, 20 bp, mouse
gaaaatgaggaattgcactt

SEQ ID NO: 554131 - DNA, 20 bp, mouse
ggagctgagaggcacagccc

SEQ ID NO: 554132 - DNA, 20 bp, mouse
ggtcacacgatctcttacca

SEQ ID NO: 554133 - DNA, 20 bp, mouse
ggatggccatcagaatgagt

SEQ ID NO: 554134 - DNA, 20 bp, mouse
gtggctgtggccacctggat

SEQ ID NO: 554135 - DNA, 20 bp, mouse
gtaaagtgaacttgaaaatg

SEQ ID NO: 554136 - DNA, 20 bp, mouse
ggtagctgcttcctgactaa

SEQ ID NO: 554137 - DNA, 20 bp, mouse
gccaagggcagattcattcc

SEQ ID NO: 554138 - DNA, 20 bp, mouse
gccacttaactgaatgccaa

SEQ ID NO: 554139 - DNA, 20 bp, mouse
gaataatgctgatgaaagaa

SEQ ID NO: 554140 - DNA, 20 bp, mouse
ggtcaggaagcagctactta

SEQ ID NO: 554141 - DNA, 20 bp, mouse
gggcaaagacataaaagacc

SEQ ID NO: 554142 - DNA, 20 bp, mouse
gaatctgtgaggcacaaccc

SEQ ID NO: 554143 - DNA, 20 bp, mouse
gtgcatctactgctttggat

SEQ ID NO: 554144 - DNA, 20 bp, mouse
gctgatgaaagaaaggaacc

SEQ ID NO: 554145 - DNA, 20 bp, mouse
gctcatggcacaggcagccc

SEQ ID NO: 554146 - DNA, 20 bp, mouse
gcatggagtccaggactggt

SEQ ID NO: 554147 - DNA, 20 bp, mouse
gcatttcttcatatggatta

SEQ ID NO: 554148 - DNA, 20 bp, mouse
gctcaggtacagcagcatga

SEQ ID NO: 554149 - DNA, 20 bp, mouse
gatggaaggtcaatgtagtc

SEQ ID NO: 554150 - DNA, 20 bp, mouse
gtgtttgacatttcttcata

SEQ ID NO: 554151 - DNA, 20 bp, mouse
gagtccaggactggtgggtg

SEQ ID NO: 554152 - DNA, 20 bp, mouse
gggtacagcagcatgatggg

SEQ ID NO: 554153 - DNA, 20 bp, mouse
gtgtgccacacagctgtgga

SEQ ID NO: 554154 - DNA, 20 bp, mouse
gcagcaggaacatggttcac

SEQ ID NO: 554155 - DNA, 20 bp, mouse
gatccaccctgatcaccgtc

SEQ ID NO: 554156 - DNA, 20 bp, mouse
gctatagggagaatgatcca

SEQ ID NO: 554157 - DNA, 20 bp, mouse
gtagggagaatgatccaagg

SEQ ID NO: 554158 - DNA, 20 bp, mouse
ggttattcttatatctctat

SEQ ID NO: 554159 - DNA, 20 bp, mouse
gctgattctgatggtaatca

SEQ ID NO: 554160 - DNA, 20 bp, mouse
gtacaaagagcatggtgtcc

SEQ ID NO: 554161 - DNA, 20 bp, mouse
gggagatagcccctcccctt

SEQ ID NO: 554162 - DNA, 20 bp, mouse
gatgacgttggtttccccaa

SEQ ID NO: 554163 - DNA, 20 bp, mouse
gcccaaaatgttgatgacgt

SEQ ID NO: 554164 - DNA, 20 bp, mouse
gatttacattctcactgtgc

SEQ ID NO: 554165 - DNA, 20 bp, mouse
ggcatggtgtccagggctgg

SEQ ID NO: 554166 - DNA, 20 bp, mouse
gtatttgctgcaggcaacaa

SEQ ID NO: 554167 - DNA, 20 bp, mouse
ggagggagacacattgccaa

SEQ ID NO: 554168 - DNA, 20 bp, mouse
gaagacaatatatttgctgc

SEQ ID NO: 554169 - DNA, 20 bp, mouse
gcaacccagacctggtccct

SEQ ID NO: 554170 - DNA, 20 bp, mouse
ggacacattgccaagggacc

SEQ ID NO: 554171 - DNA, 20 bp, mouse
gtagaagtgggtacagcagt

SEQ ID NO: 554172 - DNA, 20 bp, mouse
ggtcccaagaggatgaatgt

SEQ ID NO: 554173 - DNA, 20 bp, mouse
gcctgactgcagttcatcgt

SEQ ID NO: 554174 - DNA, 20 bp, mouse
gaatggcatcaacccagacc

SEQ ID NO: 554175 - DNA, 20 bp, mouse
gttgccaagggaccaggtct

SEQ ID NO: 554176 - DNA, 20 bp, mouse
ggatgagaagaaatgttaaa

SEQ ID NO: 554177 - DNA, 20 bp, mouse
gatgaaaaatcagtgtagtc

SEQ ID NO: 554178 - DNA, 20 bp, mouse
gagtccaggactggtggatg

SEQ ID NO: 554179 - DNA, 20 bp, mouse
gagacctgagaggaagaacg

SEQ ID NO: 554180 - DNA, 20 bp, mouse
gatccaccctgatcaccatc

SEQ ID NO: 554181 - DNA, 20 bp, mouse
gagagcatggagtccaggac

SEQ ID NO: 554182 - DNA, 20 bp, mouse
ggcatggagtccaggactgg

SEQ ID NO: 554183 - DNA, 20 bp, mouse
gcccaaagagcatggagtcc

SEQ ID NO: 554184 - DNA, 20 bp, mouse
gagtaagaatataaatcaca

SEQ ID NO: 554185 - DNA, 20 bp, mouse
gcttccccatccaccagtcc

SEQ ID NO: 554186 - DNA, 20 bp, mouse
gagagtggtaccccgagctg

SEQ ID NO: 554187 - DNA, 20 bp, mouse
gtggtaccccgagctgaggt

SEQ ID NO: 554188 - DNA, 20 bp, mouse
gtaagaaggagaggtgacat

SEQ ID NO: 554189 - DNA, 20 bp, mouse
gctgccagatgtgattatca

SEQ ID NO: 554190 - DNA, 20 bp, mouse
gtgtccttgataatcacatc

SEQ ID NO: 554191 - DNA, 20 bp, mouse
gcaaggaatgctaggaagag

SEQ ID NO: 554192 - DNA, 20 bp, mouse
ggctccaccggcccatgtac

SEQ ID NO: 554193 - DNA, 20 bp, mouse
ggacataggaaccagtacat

SEQ ID NO: 554194 - DNA, 20 bp, mouse
gtgtctcacttcattctggt

SEQ ID NO: 554195 - DNA, 20 bp, mouse
gaatagcagaagagatggtc

SEQ ID NO: 554196 - DNA, 20 bp, mouse
gctggagggtctgatgtaca

SEQ ID NO: 554197 - DNA, 20 bp, mouse
gcagtaccttaaccagtctg

SEQ ID NO: 554198 - DNA, 20 bp, mouse
ggaactggctcaccacagac

SEQ ID NO: 554199 - DNA, 20 bp, mouse
gtgcgcaaggaatgagacga

SEQ ID NO: 554200 - DNA, 20 bp, mouse
ggtggtgagccagttcttcc

SEQ ID NO: 554201 - DNA, 20 bp, mouse
gcccaggaagtggtacatag

SEQ ID NO: 554202 - DNA, 20 bp, mouse
ggaatgagacgatggttgag

SEQ ID NO: 554203 - DNA, 20 bp, mouse
gagggtcagagcccacagta

SEQ ID NO: 554204 - DNA, 20 bp, mouse
ggctcaccacagactggtta

SEQ ID NO: 554205 - DNA, 20 bp, mouse
gcataggggagcggagatga

SEQ ID NO: 554206 - DNA, 20 bp, mouse
ggggttggagaagacattct

SEQ ID NO: 554207 - DNA, 20 bp, mouse
gttagcgcttggaggcatga

SEQ ID NO: 554208 - DNA, 20 bp, mouse
gctgtagatagtgatttcta

SEQ ID NO: 554209 - DNA, 20 bp, mouse
gttctgcagagcaagagtgt

SEQ ID NO: 554210 - DNA, 20 bp, mouse
gtcagttccttagcgcttgg

SEQ ID NO: 554211 - DNA, 20 bp, mouse
gcccctggctcctctagctg

SEQ ID NO: 554212 - DNA, 20 bp, mouse
ggagccagggggcctttcac

SEQ ID NO: 554213 - DNA, 20 bp, mouse
gggaaagagacgcatcgaac

SEQ ID NO: 554214 - DNA, 20 bp, mouse
gagtggaggtctcagaggac

SEQ ID NO: 554215 - DNA, 20 bp, mouse
gttagggaacaaccatgcag

SEQ ID NO: 554216 - DNA, 20 bp, mouse
gagacccaggaggaagaacg

SEQ ID NO: 554217 - DNA, 20 bp, mouse
gtggccacgttcttcctcct

SEQ ID NO: 554218 - DNA, 20 bp, mouse
gaggaagaacgtggccacct

SEQ ID NO: 554219 - DNA, 20 bp, mouse
gctgggtctctctcaggtat

SEQ ID NO: 554220 - DNA, 20 bp, mouse
gaatccagcaaaccattccc

SEQ ID NO: 554221 - DNA, 20 bp, mouse
gctctcaggtatgggagctt

SEQ ID NO: 554222 - DNA, 20 bp, mouse
gctcgtccatcactgccccc

SEQ ID NO: 554223 - DNA, 20 bp, mouse
gctgagaaatggctatgtaa

SEQ ID NO: 554224 - DNA, 20 bp, mouse
gtgagttaagcaggcaccaa

SEQ ID NO: 554225 - DNA, 20 bp, mouse
ggtgtgcaaacgcgggtcag

SEQ ID NO: 554226 - DNA, 20 bp, mouse
gggaagaccggagagcaact

SEQ ID NO: 554227 - DNA, 20 bp, mouse
gatctttacacatttctcag

SEQ ID NO: 554228 - DNA, 20 bp, mouse
gtttacagctagaaacacct

SEQ ID NO: 554229 - DNA, 20 bp, mouse
ggctagaaacacctgggctc

SEQ ID NO: 554230 - DNA, 20 bp, mouse
gtcagaggagaatgagcata

SEQ ID NO: 554231 - DNA, 20 bp, mouse
gatgagaacaaattgacaaa

SEQ ID NO: 554232 - DNA, 20 bp, mouse
ggagaatcccagttgctctc

SEQ ID NO: 554233 - DNA, 20 bp, mouse
gtatgtaaatccccaagaag

SEQ ID NO: 554234 - DNA, 20 bp, mouse
gctcctgttgggattaactg

SEQ ID NO: 554235 - DNA, 20 bp, mouse
gctcctcagttaatcccaac

SEQ ID NO: 554236 - DNA, 20 bp, mouse
ggatcaaaggacatgagaaa

SEQ ID NO: 554237 - DNA, 20 bp, mouse
gttggatgccagggaaaccg

SEQ ID NO: 554238 - DNA, 20 bp, mouse
gtcatgtcctttgatctcct

SEQ ID NO: 554239 - DNA, 20 bp, mouse
gggtggtataccagatctct

SEQ ID NO: 554240 - DNA, 20 bp, mouse
gagtggtacccaggaagaag

SEQ ID NO: 554241 - DNA, 20 bp, mouse
gtcatcctcctcggtttccc

SEQ ID NO: 554242 - DNA, 20 bp, mouse
gcccagaatcaagaactcag

SEQ ID NO: 554243 - DNA, 20 bp, mouse
gtaggaaggctaagttgcaa

SEQ ID NO: 554244 - DNA, 20 bp, mouse
gaattttgggatgacagtgg

SEQ ID NO: 554245 - DNA, 20 bp, mouse
ggtggaagaaggcctgcagc

SEQ ID NO: 554246 - DNA, 20 bp, mouse
gtgctgggcagcacaagtct

SEQ ID NO: 554247 - DNA, 20 bp, mouse
ggctaggatgaaacagtcga

SEQ ID NO: 554248 - DNA, 20 bp, mouse
gacatcatggaataaattca

SEQ ID NO: 554249 - DNA, 20 bp, mouse
gatacatcctatgaaagata

SEQ ID NO: 554250 - DNA, 20 bp, mouse
gcattcttctgggatttgct

SEQ ID NO: 554251 - DNA, 20 bp, mouse
gaagcttccatatctttcat

SEQ ID NO: 554252 - DNA, 20 bp, mouse
ggactatgggatagcgcaat

SEQ ID NO: 554253 - DNA, 20 bp, mouse
gaatgaaagaagagtagaga

SEQ ID NO: 554254 - DNA, 20 bp, mouse
gatcttgggagtaatagctg

SEQ ID NO: 554255 - DNA, 20 bp, mouse
gtctatgttgtcacactcat

SEQ ID NO: 554256 - DNA, 20 bp, mouse
gtaacacatacaataaggtg

SEQ ID NO: 554257 - DNA, 20 bp, mouse
gttagggcttcaactgaact

SEQ ID NO: 554258 - DNA, 20 bp, mouse
gaatgatcgggatgtgttga

SEQ ID NO: 554259 - DNA, 20 bp, mouse
ggagatagagcaattatttc

SEQ ID NO: 554260 - DNA, 20 bp, mouse
gctatcatgtacaatgaaac

SEQ ID NO: 554261 - DNA, 20 bp, mouse
gttgtttctctgacaatttt

SEQ ID NO: 554262 - DNA, 20 bp, mouse
ggtaactaaaacacaatgca

SEQ ID NO: 554263 - DNA, 20 bp, mouse
ggagtttgaaggaaaaattg

SEQ ID NO: 554264 - DNA, 20 bp, mouse
gagctctagaaggagtttga

SEQ ID NO: 554265 - DNA, 20 bp, mouse
gtttgaaggaaaaattgggg

SEQ ID NO: 554266 - DNA, 20 bp, mouse
ggaagagttgcaatgaaaga

SEQ ID NO: 554267 - DNA, 20 bp, mouse
gacatcatggaatatgttca

SEQ ID NO: 554268 - DNA, 20 bp, mouse
gttccggacagcacaaatct

SEQ ID NO: 554269 - DNA, 20 bp, mouse
gaagcatccatctccatcat

SEQ ID NO: 554270 - DNA, 20 bp, mouse
gtgtaacatacatcccatga

SEQ ID NO: 554271 - DNA, 20 bp, mouse
gcaatgaaagaaggtagaga

SEQ ID NO: 554272 - DNA, 20 bp, mouse
gaagaaggtagagaaggctg

SEQ ID NO: 554273 - DNA, 20 bp, mouse
ggctaagatgaaggagtcaa

SEQ ID NO: 554274 - DNA, 20 bp, mouse
ggccatagcagctaagatga

SEQ ID NO: 554275 - DNA, 20 bp, mouse
gtgccaagatttgtgctgtc

SEQ ID NO: 554276 - DNA, 20 bp, mouse
ggagtaattattcctggtct

SEQ ID NO: 554277 - DNA, 20 bp, mouse
ggcacgtttcacccaagacc

SEQ ID NO: 554278 - DNA, 20 bp, mouse
gaagatagagtaattattcc

SEQ ID NO: 554279 - DNA, 20 bp, mouse
ggagttggaaggaaaaattc

SEQ ID NO: 554280 - DNA, 20 bp, mouse
gttgtttctcttacaattta

SEQ ID NO: 554281 - DNA, 20 bp, mouse
gtattatttctggcacactc

SEQ ID NO: 554282 - DNA, 20 bp, mouse
gatagagcagtatgtgttga

SEQ ID NO: 554283 - DNA, 20 bp, mouse
gctttcatatacactaaaac

SEQ ID NO: 554284 - DNA, 20 bp, mouse
gagggagctctaggaggagt

SEQ ID NO: 554285 - DNA, 20 bp, mouse
gtatgtgttgagggagctct

SEQ ID NO: 554286 - DNA, 20 bp, mouse
gacccagcaagtagataaca

SEQ ID NO: 554287 - DNA, 20 bp, mouse
gcgcagtggatgacagatag

SEQ ID NO: 554288 - DNA, 20 bp, mouse
gtgagagctgagtagcgcag

SEQ ID NO: 554289 - DNA, 20 bp, mouse
gctagaaccccacatctaaa

SEQ ID NO: 554290 - DNA, 20 bp, mouse
gtcatgactccttttagatg

SEQ ID NO: 554291 - DNA, 20 bp, mouse
gctacttgctgggtctctta

SEQ ID NO: 554292 - DNA, 20 bp, mouse
gcttcttaaaatacaagacc

SEQ ID NO: 554293 - DNA, 20 bp, mouse
gttagagagcaacaaagtat

SEQ ID NO: 554294 - DNA, 20 bp, mouse
ggatgtggggttctagtcag

SEQ ID NO: 554295 - DNA, 20 bp, mouse
gttctagtcagtgggtcatg

SEQ ID NO: 554296 - DNA, 20 bp, mouse
ggtcctgggagtgatggcag

SEQ ID NO: 554297 - DNA, 20 bp, mouse
gagtggctatgtaaatgact

SEQ ID NO: 554298 - DNA, 20 bp, mouse
gatcctgtgaaggagatgga

SEQ ID NO: 554299 - DNA, 20 bp, mouse
gtttacatagccactttagt

SEQ ID NO: 554300 - DNA, 20 bp, mouse
gtgcttggttcatacactat

SEQ ID NO: 554301 - DNA, 20 bp, mouse
ggtcgacagccatagcagcc

SEQ ID NO: 554302 - DNA, 20 bp, mouse
gtggctcaattactggtcta

SEQ ID NO: 554303 - DNA, 20 bp, mouse
gtaaatgccactgtaaatac

SEQ ID NO: 554304 - DNA, 20 bp, mouse
gtgataataggatagcgcag

SEQ ID NO: 554305 - DNA, 20 bp, mouse
gcaaaattttgcagtgtcct

SEQ ID NO: 554306 - DNA, 20 bp, mouse
gacaatgagactgaagtcaa

SEQ ID NO: 554307 - DNA, 20 bp, mouse
ggaaacactgaatatcatgt

SEQ ID NO: 554308 - DNA, 20 bp, mouse
gatgttggactccaaatccc

SEQ ID NO: 554309 - DNA, 20 bp, mouse
gtgagtatgggataacgaag

SEQ ID NO: 554310 - DNA, 20 bp, mouse
gcaaaggtttgtagcatctt

SEQ ID NO: 554311 - DNA, 20 bp, mouse
gtatctgtcttctactacaa

SEQ ID NO: 554312 - DNA, 20 bp, mouse
gataggagccagctaccatc

SEQ ID NO: 554313 - DNA, 20 bp, mouse
gtgttatctcctggcagcta

SEQ ID NO: 554314 - DNA, 20 bp, mouse
gcttttcgggacatgagtat

SEQ ID NO: 554315 - DNA, 20 bp, mouse
gaagacagatacatatcatt

SEQ ID NO: 554316 - DNA, 20 bp, mouse
gtagctatgacacaaggcaa

SEQ ID NO: 554317 - DNA, 20 bp, mouse
gtcttggtagctatgacaca

SEQ ID NO: 554318 - DNA, 20 bp, mouse
gtagctaccaagagtctaag

SEQ ID NO: 554319 - DNA, 20 bp, mouse
gggatgtcacataaataaca

SEQ ID NO: 554320 - DNA, 20 bp, mouse
gaagatgctgcagaatttca

SEQ ID NO: 554321 - DNA, 20 bp, mouse
gtctggagtcagtgttgata

SEQ ID NO: 554322 - DNA, 20 bp, mouse
gctaccccataatcatgtct

SEQ ID NO: 554323 - DNA, 20 bp, mouse
gcggcaagtctgtgttcagt

SEQ ID NO: 554324 - DNA, 20 bp, mouse
ggataaatcaataactttta

SEQ ID NO: 554325 - DNA, 20 bp, mouse
gtagctgtttcttatctcat

SEQ ID NO: 554326 - DNA, 20 bp, mouse
gatgactatcaagaatctga

SEQ ID NO: 554327 - DNA, 20 bp, mouse
gcagtcactggtcgcaaatg

SEQ ID NO: 554328 - DNA, 20 bp, mouse
gtctggagttagtgttaatg

SEQ ID NO: 554329 - DNA, 20 bp, mouse
ggtggtctatgtaacatcca

SEQ ID NO: 554330 - DNA, 20 bp, mouse
gggagttagtgttaatgagg

SEQ ID NO: 554331 - DNA, 20 bp, mouse
gcactgccataacagcgagg

SEQ ID NO: 554332 - DNA, 20 bp, mouse
gaagatgctacagaacttca

SEQ ID NO: 554333 - DNA, 20 bp, mouse
ggtctatgtaacatccatgg

SEQ ID NO: 554334 - DNA, 20 bp, mouse
gacacatcctgtatatgata

SEQ ID NO: 554335 - DNA, 20 bp, mouse
gggatgtgtaatacaattgt

SEQ ID NO: 554336 - DNA, 20 bp, mouse
ggaagttatctgtaatacca

SEQ ID NO: 554337 - DNA, 20 bp, mouse
ggttgtacttataagagcaa

SEQ ID NO: 554338 - DNA, 20 bp, mouse
gttataagagcaatggcata

SEQ ID NO: 554339 - DNA, 20 bp, mouse
gccacatctctctgtgttat

SEQ ID NO: 554340 - DNA, 20 bp, mouse
gctctgtgttattggttatt

SEQ ID NO: 554341 - DNA, 20 bp, mouse
gcacatctacaaaagacagt

SEQ ID NO: 554342 - DNA, 20 bp, mouse
gtaccaaggaagagaaactc

SEQ ID NO: 554343 - DNA, 20 bp, mouse
gacagattccaactgaccaa

SEQ ID NO: 554344 - DNA, 20 bp, mouse
gtgcctgagtttctcttcct

SEQ ID NO: 554345 - DNA, 20 bp, mouse
gtaataagtgtgtacagcaa

SEQ ID NO: 554346 - DNA, 20 bp, mouse
gaacagaactcaacttacaa

SEQ ID NO: 554347 - DNA, 20 bp, mouse
ggagatgatctgttaggccc

SEQ ID NO: 554348 - DNA, 20 bp, mouse
gctgatagagatgatctgtt

SEQ ID NO: 554349 - DNA, 20 bp, mouse
gacataccctctgagacata

SEQ ID NO: 554350 - DNA, 20 bp, mouse
ggtcacactgggaggcaact

SEQ ID NO: 554351 - DNA, 20 bp, mouse
gtactctccttatgtctcag

SEQ ID NO: 554352 - DNA, 20 bp, mouse
ggagaaaaggatctctttca

SEQ ID NO: 554353 - DNA, 20 bp, mouse
gcagagggtatgtgtgcatc

SEQ ID NO: 554354 - DNA, 20 bp, mouse
gaagaatcagactattgtaa

SEQ ID NO: 554355 - DNA, 20 bp, mouse
gtaatggagtttttcttcct

SEQ ID NO: 554356 - DNA, 20 bp, mouse
gtgccgaccggcccacccct

SEQ ID NO: 554357 - DNA, 20 bp, mouse
gacccctgggcgttagtgaa

SEQ ID NO: 554358 - DNA, 20 bp, mouse
ggcccttcactaacgcccag

SEQ ID NO: 554359 - DNA, 20 bp, mouse
gcgcccaggggtgggccggt

SEQ ID NO: 554360 - DNA, 20 bp, mouse
ggatgcggtggaagaggatg

SEQ ID NO: 554361 - DNA, 20 bp, mouse
gccgccggcacgcaggtccg

SEQ ID NO: 554362 - DNA, 20 bp, mouse
ggggagggcgatctgccgac

SEQ ID NO: 554363 - DNA, 20 bp, mouse
gggcacgcaggtccgcgggg

SEQ ID NO: 554364 - DNA, 20 bp, mouse
gtgccggcggatgacagtga

SEQ ID NO: 554365 - DNA, 20 bp, mouse
gcggcagatcgccctccccg

SEQ ID NO: 554366 - DNA, 20 bp, mouse
gctcgctgcggaggagaacc

SEQ ID NO: 554367 - DNA, 20 bp, mouse
ggcggtgagtgtagacaccc

SEQ ID NO: 554368 - DNA, 20 bp, mouse
gttaggctggagcagttaag

SEQ ID NO: 554369 - DNA, 20 bp, mouse
gagatttgaggtgctcgctg

SEQ ID NO: 554370 - DNA, 20 bp, mouse
gccagtaggccagcactgta

SEQ ID NO: 554371 - DNA, 20 bp, mouse
gagcggaaccccgaaaggtg

SEQ ID NO: 554372 - DNA, 20 bp, mouse
gaaaccagcggaaccccgaa

SEQ ID NO: 554373 - DNA, 20 bp, mouse
gtgagctgggccggcccgag

SEQ ID NO: 554374 - DNA, 20 bp, mouse
gaacaccagcgcccagagcc

SEQ ID NO: 554375 - DNA, 20 bp, mouse
gctgggcgctggtgttggct

SEQ ID NO: 554376 - DNA, 20 bp, mouse
gccaggggaaagcctctcga

SEQ ID NO: 554377 - DNA, 20 bp, mouse
gttatggttgaggagccttt

SEQ ID NO: 554378 - DNA, 20 bp, mouse
gctctcgagggcaggcgcca

SEQ ID NO: 554379 - DNA, 20 bp, mouse
gtacaagagatgcggcctta

SEQ ID NO: 554380 - DNA, 20 bp, mouse
gccgagggcccgtgagcgta

SEQ ID NO: 554381 - DNA, 20 bp, mouse
gtcctccacacagggcgata

SEQ ID NO: 554382 - DNA, 20 bp, mouse
gtctttaatttcctgcctaa

SEQ ID NO: 554383 - DNA, 20 bp, mouse
gacctcgcgcagaccatcca

SEQ ID NO: 554384 - DNA, 20 bp, mouse
gagttgcggctgaagatcaa

SEQ ID NO: 554385 - DNA, 20 bp, mouse
gaccatatcgccctgtgtgg

SEQ ID NO: 554386 - DNA, 20 bp, mouse
gcaacagaagctccgcacac

SEQ ID NO: 554387 - DNA, 20 bp, mouse
ggcacactggcagttggctg

SEQ ID NO: 554388 - DNA, 20 bp, mouse
gagaagcctaaaggtaacag

SEQ ID NO: 554389 - DNA, 20 bp, mouse
gttcactcttagcaggaatt

SEQ ID NO: 554390 - DNA, 20 bp, mouse
ggcctaaaggtaacaggggt

SEQ ID NO: 554391 - DNA, 20 bp, mouse
gtgaaaaactgaaacagtcg

SEQ ID NO: 554392 - DNA, 20 bp, mouse
ggatcaggctcgtcattcgc

SEQ ID NO: 554393 - DNA, 20 bp, mouse
gcatgtggcaagaagcctaa

SEQ ID NO: 554394 - DNA, 20 bp, mouse
gtgccacatgacttctgatc

SEQ ID NO: 554395 - DNA, 20 bp, mouse
gctcctgagttaactttata

SEQ ID NO: 554396 - DNA, 20 bp, mouse
gcagtgcgcgctcacggtga

SEQ ID NO: 554397 - DNA, 20 bp, mouse
gcggctgttggattccgctc

SEQ ID NO: 554398 - DNA, 20 bp, mouse
gaggaagccaccacccgagg

SEQ ID NO: 554399 - DNA, 20 bp, mouse
gcgctctgcacaaggacgag

SEQ ID NO: 554400 - DNA, 20 bp, mouse
gcgcagtcggagcagttcca

SEQ ID NO: 554401 - DNA, 20 bp, mouse
gtggcttcagtgcgcgctca

SEQ ID NO: 554402 - DNA, 20 bp, mouse
ggtggtggcttcctcctaag

SEQ ID NO: 554403 - DNA, 20 bp, mouse
gcgcgctcacggtgacggct

SEQ ID NO: 554404 - DNA, 20 bp, mouse
gacaaggacgagcggcgagg

SEQ ID NO: 554405 - DNA, 20 bp, mouse
gcctaagcggcgcttcctcc

SEQ ID NO: 554406 - DNA, 20 bp, mouse
ggtaactcagtgtgcagaca

SEQ ID NO: 554407 - DNA, 20 bp, mouse
gtctgcacactgagttactg

SEQ ID NO: 554408 - DNA, 20 bp, mouse
gaaacttcgctaaagaattt

SEQ ID NO: 554409 - DNA, 20 bp, mouse
ggtttcagggactgatgaat

SEQ ID NO: 554410 - DNA, 20 bp, mouse
ggcatttctgattcagttaa

SEQ ID NO: 554411 - DNA, 20 bp, mouse
ggacaaagggaaagaatctt

SEQ ID NO: 554412 - DNA, 20 bp, mouse
gtatcataaaagcgcaatcg

SEQ ID NO: 554413 - DNA, 20 bp, mouse
gaaactagagcaatctcaac

SEQ ID NO: 554414 - DNA, 20 bp, mouse
gttaagcaaaaagaccagca

SEQ ID NO: 554415 - DNA, 20 bp, mouse
ggggctgtcctttgaattac

SEQ ID NO: 554416 - DNA, 20 bp, mouse
gcttgttgtgggagtcggaa

SEQ ID NO: 554417 - DNA, 20 bp, mouse
ggtcgtcttgttgtgggagt

SEQ ID NO: 554418 - DNA, 20 bp, mouse
gtgggagtcggaagggtttc

SEQ ID NO: 554419 - DNA, 20 bp, mouse
gcgggaaacttgcagcttaa

SEQ ID NO: 554420 - DNA, 20 bp, mouse
gttaaaggtcgtcttgttgt

SEQ ID NO: 554421 - DNA, 20 bp, mouse
gcggaagggtttctggctgt

SEQ ID NO: 554422 - DNA, 20 bp, mouse
gtcaggtggttgcagagctt

SEQ ID NO: 554423 - DNA, 20 bp, mouse
gtctgctgcagtaatagccg

SEQ ID NO: 554424 - DNA, 20 bp, mouse
gcacctgatcagcaccacat

SEQ ID NO: 554425 - DNA, 20 bp, mouse
gaattggtactgaaatataa

SEQ ID NO: 554426 - DNA, 20 bp, mouse
gtccctgacgctggtggtag

SEQ ID NO: 554427 - DNA, 20 bp, mouse
gcagcgtcagggaatcaagt

SEQ ID NO: 554428 - DNA, 20 bp, mouse
gggtcctggtccagaaccag

SEQ ID NO: 554429 - DNA, 20 bp, mouse
gcgctgtagcacttgggcca

SEQ ID NO: 554430 - DNA, 20 bp, mouse
gctgctggatgaaatcgagg

SEQ ID NO: 554431 - DNA, 20 bp, mouse
gccggcaaggtcaccatcac

SEQ ID NO: 554432 - DNA, 20 bp, mouse
gcttgggccatggcagagga

SEQ ID NO: 554433 - DNA, 20 bp, mouse
gaccactaccaccagcgtca

SEQ ID NO: 554434 - DNA, 20 bp, mouse
gctgctgctggatgaaatcg

SEQ ID NO: 554435 - DNA, 20 bp, mouse
gtccttgcgccagaagatgg

SEQ ID NO: 554436 - DNA, 20 bp, mouse
gagtgtccatgaaagatgaa

SEQ ID NO: 554437 - DNA, 20 bp, mouse
ggagtgtagatctcaaataa

SEQ ID NO: 554438 - DNA, 20 bp, mouse
gaaagtgcacctggaatcgt

SEQ ID NO: 554439 - DNA, 20 bp, mouse
gtggaatcgtgggtctacaa

SEQ ID NO: 554440 - DNA, 20 bp, mouse
gtcttaacttcaaatgttat

SEQ ID NO: 554441 - DNA, 20 bp, mouse
gactcacctttcatctttca

SEQ ID NO: 554442 - DNA, 20 bp, mouse
gtagttcaagaatcgaatct

SEQ ID NO: 554443 - DNA, 20 bp, mouse
gaaggattgcgtggtcagca

SEQ ID NO: 554444 - DNA, 20 bp, mouse
gcaagaatcgaatctgggaa

SEQ ID NO: 554445 - DNA, 20 bp, mouse
ggggtctacaaaggattgcg

SEQ ID NO: 554446 - DNA, 20 bp, mouse
gggggtccaggaaagatgga

SEQ ID NO: 554447 - DNA, 20 bp, mouse
gccagggggtccaggaaaga

SEQ ID NO: 554448 - DNA, 20 bp, mouse
gcacaatcacaaactccagg

SEQ ID NO: 554449 - DNA, 20 bp, mouse
gatgttgcatctcacaaaca

SEQ ID NO: 554450 - DNA, 20 bp, mouse
gtagagacctgggtctacaa

SEQ ID NO: 554451 - DNA, 20 bp, mouse
gtagttccggcctcaaatct

SEQ ID NO: 554452 - DNA, 20 bp, mouse
gattgtgtacctagagacct

SEQ ID NO: 554453 - DNA, 20 bp, mouse
gctcaacttcacatatgtta

SEQ ID NO: 554454 - DNA, 20 bp, mouse
gccggcctcaaatctgggaa

SEQ ID NO: 554455 - DNA, 20 bp, mouse
ggtacacaatcacaaactcc

SEQ ID NO: 554456 - DNA, 20 bp, mouse
gcatggctcgagctggcggg

SEQ ID NO: 554457 - DNA, 20 bp, mouse
gtcgagctggcgggcggcac

SEQ ID NO: 554458 - DNA, 20 bp, mouse
ggcagccgcggcaggcgcac

SEQ ID NO: 554459 - DNA, 20 bp, mouse
gtgcaacagtaaccgagcca

SEQ ID NO: 554460 - DNA, 20 bp, mouse
ggccagctcgagccatggct

SEQ ID NO: 554461 - DNA, 20 bp, mouse
gaccgagccatggctcgagc

SEQ ID NO: 554462 - DNA, 20 bp, mouse
gggcgcacgggccgcgtcaa

SEQ ID NO: 554463 - DNA, 20 bp, mouse
ggcggcccgtgcgcctgccg

SEQ ID NO: 554464 - DNA, 20 bp, mouse
ggccccaggctcccttgacg

SEQ ID NO: 554465 - DNA, 20 bp, mouse
gaggagtccagtcttcacat

SEQ ID NO: 554466 - DNA, 20 bp, mouse
ggcactgtgcacccaggagg

SEQ ID NO: 554467 - DNA, 20 bp, mouse
gtgagcagccaccacctcct

SEQ ID NO: 554468 - DNA, 20 bp, mouse
gtatagtcacattcattggt

SEQ ID NO: 554469 - DNA, 20 bp, mouse
gactatagcactgtgcaccc

SEQ ID NO: 554470 - DNA, 20 bp, mouse
gctgctcaggtcctcagccc

SEQ ID NO: 554471 - DNA, 20 bp, mouse
gttagcacaggaccttgcct

SEQ ID NO: 554472 - DNA, 20 bp, mouse
gcattggtgggtgtctcttg

SEQ ID NO: 554473 - DNA, 20 bp, mouse
gctcagggccacttccaggt

SEQ ID NO: 554474 - DNA, 20 bp, mouse
gttccgtgctgctagcagag

SEQ ID NO: 554475 - DNA, 20 bp, mouse
gctaaactgagggaggatgg

SEQ ID NO: 554476 - DNA, 20 bp, mouse
gaagacgtcggcgccagagt

SEQ ID NO: 554477 - DNA, 20 bp, mouse
ggccatgtccgagcccactc

SEQ ID NO: 554478 - DNA, 20 bp, mouse
ggccagagtgggctcggaca

SEQ ID NO: 554479 - DNA, 20 bp, mouse
ggagcgggagctgtccagaa

SEQ ID NO: 554480 - DNA, 20 bp, mouse
gtcacccaaacagaagacgt

SEQ ID NO: 554481 - DNA, 20 bp, mouse
gggttggctgctcccgcaag

SEQ ID NO: 554482 - DNA, 20 bp, mouse
ggcgccgacgtcttctgttt

SEQ ID NO: 554483 - DNA, 20 bp, mouse
gagcgcgcccgcacaaccgg

SEQ ID NO: 554484 - DNA, 20 bp, mouse
gaggcatcgataggcggtgt

SEQ ID NO: 554485 - DNA, 20 bp, mouse
gggcagcgcgcccgcacaac

SEQ ID NO: 554486 - DNA, 20 bp, mouse
gtggccgacgctcctggtgg

SEQ ID NO: 554487 - DNA, 20 bp, mouse
gcactggccgacgctcctgg

SEQ ID NO: 554488 - DNA, 20 bp, mouse
ggcgagagcactgaacaagc

SEQ ID NO: 554489 - DNA, 20 bp, mouse
gcagtgctctcgctcggctt

SEQ ID NO: 554490 - DNA, 20 bp, mouse
gccgccgccaccaggagcgt

SEQ ID NO: 554491 - DNA, 20 bp, mouse
gcggccgccccgccacatcc

SEQ ID NO: 554492 - DNA, 20 bp, mouse
gcagcatggtccccacgcac

SEQ ID NO: 554493 - DNA, 20 bp, mouse
gcttcggctgctgcgagcag

SEQ ID NO: 554494 - DNA, 20 bp, mouse
ggcccaacaccgaagcctag

SEQ ID NO: 554495 - DNA, 20 bp, mouse
gggagcgtcggccagtgcgt

SEQ ID NO: 554496 - DNA, 20 bp, mouse
ggcgtcagcatcagccgtgt

SEQ ID NO: 554497 - DNA, 20 bp, mouse
gtgcagtatggcatcccaca

SEQ ID NO: 554498 - DNA, 20 bp, mouse
gaggtgagctcaccccaggg

SEQ ID NO: 554499 - DNA, 20 bp, mouse
ggctaacccagacccccctg

SEQ ID NO: 554500 - DNA, 20 bp, mouse
gtgcgaagtctcagggacac

SEQ ID NO: 554501 - DNA, 20 bp, mouse
gcgtcctcctgcttgcagta

SEQ ID NO: 554502 - DNA, 20 bp, mouse
gggccgagtgcgaagtctca

SEQ ID NO: 554503 - DNA, 20 bp, mouse
gggaaggcgcggtctttgaa

SEQ ID NO: 554504 - DNA, 20 bp, mouse
ggggatgccatactgcaagc

SEQ ID NO: 554505 - DNA, 20 bp, mouse
gcataggtgagctcacccca

SEQ ID NO: 554506 - DNA, 20 bp, mouse
gacttatatcacttaacaat

SEQ ID NO: 554507 - DNA, 20 bp, mouse
gcatttaatgcattacttgg

SEQ ID NO: 554508 - DNA, 20 bp, mouse
gaataggtacatgacatgca

SEQ ID NO: 554509 - DNA, 20 bp, mouse
gagtgtccttgtggtatgat

SEQ ID NO: 554510 - DNA, 20 bp, mouse
gcatgacatgcatgggattt

SEQ ID NO: 554511 - DNA, 20 bp, mouse
gaacatagcaagtgtccttg

SEQ ID NO: 554512 - DNA, 20 bp, mouse
gcacgtggctattacgaata

SEQ ID NO: 554513 - DNA, 20 bp, mouse
gaggggaaagctgcaactcc

SEQ ID NO: 554514 - DNA, 20 bp, mouse
gaatacccaggatacaggtc

SEQ ID NO: 554515 - DNA, 20 bp, mouse
gtgtgagataagcatcctta

SEQ ID NO: 554516 - DNA, 20 bp, mouse
ggatcatcatagtcagactg

SEQ ID NO: 554517 - DNA, 20 bp, mouse
gacttacttgatctagacac

SEQ ID NO: 554518 - DNA, 20 bp, mouse
gatcatagtcagactgaggt

SEQ ID NO: 554519 - DNA, 20 bp, mouse
gtagcaggcaaagaaactct

SEQ ID NO: 554520 - DNA, 20 bp, mouse
gtgttgaaagaactcatctt

SEQ ID NO: 554521 - DNA, 20 bp, mouse
gaatatccaggacacaggcc

SEQ ID NO: 554522 - DNA, 20 bp, mouse
gaagaactcatcttgggagg

SEQ ID NO: 554523 - DNA, 20 bp, mouse
gcattgcctggcctgtgtcc

SEQ ID NO: 554524 - DNA, 20 bp, mouse
gaccataatggataccaatc

SEQ ID NO: 554525 - DNA, 20 bp, mouse
gtgaaagaactcatcttggg

SEQ ID NO: 554526 - DNA, 20 bp, mouse
ggagctgagggacttacttg

SEQ ID NO: 554527 - DNA, 20 bp, mouse
gcaccaggcagagaaactct

SEQ ID NO: 554528 - DNA, 20 bp, mouse
gttcacagctcgccatattc

SEQ ID NO: 554529 - DNA, 20 bp, mouse
gactaggttgtgtggaatga

SEQ ID NO: 554530 - DNA, 20 bp, mouse
ggtggaatgagggatcctta

SEQ ID NO: 554531 - DNA, 20 bp, mouse
ggtgaggacatagctagact

SEQ ID NO: 554532 - DNA, 20 bp, mouse
gatagctagactaggttgtg

SEQ ID NO: 554533 - DNA, 20 bp, mouse
gcaaaacacacagaacacct

SEQ ID NO: 554534 - DNA, 20 bp, mouse
gaacacctaggatataggcc

SEQ ID NO: 554535 - DNA, 20 bp, mouse
gatccagctacttaaaatga

SEQ ID NO: 554536 - DNA, 20 bp, mouse
ggtcccagcaggcccacgaa

SEQ ID NO: 554537 - DNA, 20 bp, mouse
ggagcaatgaagcctttcgt

SEQ ID NO: 554538 - DNA, 20 bp, mouse
gaagcaggaggagtcccagc

SEQ ID NO: 554539 - DNA, 20 bp, mouse
gtcagcacaagtcttcataa

SEQ ID NO: 554540 - DNA, 20 bp, mouse
ggtttctcatttcctctctg

SEQ ID NO: 554541 - DNA, 20 bp, mouse
gtgaagatcaaaccccagag

SEQ ID NO: 554542 - DNA, 20 bp, mouse
gcttcataaaggaaagaagc

SEQ ID NO: 554543 - DNA, 20 bp, mouse
gagcctttcgtgggcctgct

SEQ ID NO: 554544 - DNA, 20 bp, mouse
gtctagtctcagtagaattg

SEQ ID NO: 554545 - DNA, 20 bp, mouse
gacagtacagaggtatctat

SEQ ID NO: 554546 - DNA, 20 bp, mouse
ggccattgggagggactcgg

SEQ ID NO: 554547 - DNA, 20 bp, mouse
gccgacaatgacccaggaag

SEQ ID NO: 554548 - DNA, 20 bp, mouse
gtgcgccattgggagggact

SEQ ID NO: 554549 - DNA, 20 bp, mouse
ggcgctgagacggccacggg

SEQ ID NO: 554550 - DNA, 20 bp, mouse
gagtccatgcgccattggga

SEQ ID NO: 554551 - DNA, 20 bp, mouse
gcctgctccgacaatgaccc

SEQ ID NO: 554552 - DNA, 20 bp, mouse
ggaagaggccctcagcaaca

SEQ ID NO: 554553 - DNA, 20 bp, mouse
gtcattgtcggagcaggaat

SEQ ID NO: 554554 - DNA, 20 bp, mouse
gcggagcaggaatcggactg

SEQ ID NO: 554555 - DNA, 20 bp, mouse
gcggaagtccatgcgccatt

SEQ ID NO: 554556 - DNA, 20 bp, mouse
gggttgcgcgtgccccaggg

SEQ ID NO: 554557 - DNA, 20 bp, mouse
ggcgcccaccaccatctcgg

SEQ ID NO: 554558 - DNA, 20 bp, mouse
gagggcggccgccgagatgg

SEQ ID NO: 554559 - DNA, 20 bp, mouse
gcccagggcggccgccgaga

SEQ ID NO: 554560 - DNA, 20 bp, mouse
gcaaggttgcgcgtgcccca

SEQ ID NO: 554561 - DNA, 20 bp, mouse
gaacgcgcccaccaccatct

SEQ ID NO: 554562 - DNA, 20 bp, mouse
ggtggtgggcgcgttcccca

SEQ ID NO: 554563 - DNA, 20 bp, mouse
gggaggaacggcgaggtcgg

SEQ ID NO: 554564 - DNA, 20 bp, mouse
gagaaagatcgggaatggaa

SEQ ID NO: 554565 - DNA, 20 bp, mouse
gcgcaaccttgctgactggg

SEQ ID NO: 554566 - DNA, 20 bp, mouse
gccacagtgagagaaaggct

SEQ ID NO: 554567 - DNA, 20 bp, mouse
gcatttctgacaggccccct

SEQ ID NO: 554568 - DNA, 20 bp, mouse
gttggtccacagtgagagaa

SEQ ID NO: 554569 - DNA, 20 bp, mouse
gcagctggtgccctacaaat

SEQ ID NO: 554570 - DNA, 20 bp, mouse
gtctgacaggcccccttggc

SEQ ID NO: 554571 - DNA, 20 bp, mouse
gaggtcacgccagcacatat

SEQ ID NO: 554572 - DNA, 20 bp, mouse
gctctcctgcatctccgagg

SEQ ID NO: 554573 - DNA, 20 bp, mouse
gcacctctcctgcatctccg

SEQ ID NO: 554574 - DNA, 20 bp, mouse
gagatcgctgatccaaacca

SEQ ID NO: 554575 - DNA, 20 bp, mouse
gcttacttaccatttctgac

SEQ ID NO: 554576 - DNA, 20 bp, mouse
gacagcttcggagcaagcgg

SEQ ID NO: 554577 - DNA, 20 bp, mouse
gggtccagatgcgagactcg

SEQ ID NO: 554578 - DNA, 20 bp, mouse
gcgcccactgggctactggg

SEQ ID NO: 554579 - DNA, 20 bp, mouse
ggctactgggaggacagctt

SEQ ID NO: 554580 - DNA, 20 bp, mouse
gcggagcaagcggaggaacc

SEQ ID NO: 554581 - DNA, 20 bp, mouse
ggctttctcgacgctccctg

SEQ ID NO: 554582 - DNA, 20 bp, mouse
ggtcctcccagtagcccagt

SEQ ID NO: 554583 - DNA, 20 bp, mouse
gaaccaggctacacctgctg

SEQ ID NO: 554584 - DNA, 20 bp, mouse
gggagggagagcacgaaaga

SEQ ID NO: 554585 - DNA, 20 bp, mouse
gggcgcgttctgcagaggtc

SEQ ID NO: 554586 - DNA, 20 bp, mouse
gcttagagagttaagcccgg

SEQ ID NO: 554587 - DNA, 20 bp, mouse
gctcggccagcgtgaaaagg

SEQ ID NO: 554588 - DNA, 20 bp, mouse
ggacgagccctgaagacccg

SEQ ID NO: 554589 - DNA, 20 bp, mouse
ggcagaatagacccagtcag

SEQ ID NO: 554590 - DNA, 20 bp, mouse
gtgccggcgtcagaagacgt

SEQ ID NO: 554591 - DNA, 20 bp, mouse
gttccccggctccccaagag

SEQ ID NO: 554592 - DNA, 20 bp, mouse
gggagcgcgtagtccggtgg

SEQ ID NO: 554593 - DNA, 20 bp, mouse
gcaagaccgaacgagagcac

SEQ ID NO: 554594 - DNA, 20 bp, mouse
ggtagcccggcgcttcccta

SEQ ID NO: 554595 - DNA, 20 bp, mouse
gctgtgtcccgggcgtccca

SEQ ID NO: 554596 - DNA, 20 bp, mouse
gggtacagcggagccctcag

SEQ ID NO: 554597 - DNA, 20 bp, mouse
ggcgaggctgaaaagagcgg

SEQ ID NO: 554598 - DNA, 20 bp, mouse
gagcaagactagagcggatt

SEQ ID NO: 554599 - DNA, 20 bp, mouse
ggaaaagagcggaggtacag

SEQ ID NO: 554600 - DNA, 20 bp, mouse
gagcggattcggctgctggt

SEQ ID NO: 554601 - DNA, 20 bp, mouse
ggagtctagaaggtgccctg

SEQ ID NO: 554602 - DNA, 20 bp, mouse
gtacctgcccagcctaactc

SEQ ID NO: 554603 - DNA, 20 bp, mouse
gagctgcaggacccagtcat

SEQ ID NO: 554604 - DNA, 20 bp, mouse
gaaggcacccgagttaggct

SEQ ID NO: 554605 - DNA, 20 bp, mouse
gagggaaaggcacccgagtt

SEQ ID NO: 554606 - DNA, 20 bp, mouse
ggcaatgtgccaagtctgac

SEQ ID NO: 554607 - DNA, 20 bp, mouse
gatgggtgctatcctcatag

SEQ ID NO: 554608 - DNA, 20 bp, mouse
gttctacagccatggcccaa

SEQ ID NO: 554609 - DNA, 20 bp, mouse
gcttacaggtgaacagacac

SEQ ID NO: 554610 - DNA, 20 bp, mouse
gccatggcccaaaggcttac

SEQ ID NO: 554611 - DNA, 20 bp, mouse
gtaggtgaagatgcttgcat

SEQ ID NO: 554612 - DNA, 20 bp, mouse
gctctggaacctgtcagact

SEQ ID NO: 554613 - DNA, 20 bp, mouse
gttgccggagccactgctgt

SEQ ID NO: 554614 - DNA, 20 bp, mouse
gctgtaggaacagggatctc

SEQ ID NO: 554615 - DNA, 20 bp, mouse
gcagtggctccggcaatgct

SEQ ID NO: 554616 - DNA, 20 bp, mouse
gggaccggaggtggtagtga

SEQ ID NO: 554617 - DNA, 20 bp, mouse
gaagcgggagatgtcaggag

SEQ ID NO: 554618 - DNA, 20 bp, mouse
gcgtctataagagggaccgg

SEQ ID NO: 554619 - DNA, 20 bp, mouse
ggtagtgagggcatcccaag

SEQ ID NO: 554620 - DNA, 20 bp, mouse
gatcccaagcgggagatgtc

SEQ ID NO: 554621 - DNA, 20 bp, mouse
gctataagagggaccggagg

SEQ ID NO: 554622 - DNA, 20 bp, mouse
gagtgtggccaccagcacta

SEQ ID NO: 554623 - DNA, 20 bp, mouse
gaatcgtctataagagggac

SEQ ID NO: 554624 - DNA, 20 bp, mouse
gggtactgaggcccatccca

SEQ ID NO: 554625 - DNA, 20 bp, mouse
gcaggtactgaaggcaacct

SEQ ID NO: 554626 - DNA, 20 bp, mouse
gcggcgcgccgtgagagaga

SEQ ID NO: 554627 - DNA, 20 bp, mouse
ggagccgggcggcccgaaca

SEQ ID NO: 554628 - DNA, 20 bp, mouse
gccgggcggcccgaacaggg

SEQ ID NO: 554629 - DNA, 20 bp, mouse
gcgccgtgagagagagggct

SEQ ID NO: 554630 - DNA, 20 bp, mouse
gccgggcacaatggcctgag

SEQ ID NO: 554631 - DNA, 20 bp, mouse
ggcgcggctcccgggcacaa

SEQ ID NO: 554632 - DNA, 20 bp, mouse
ggagggctcggtgagccggg

SEQ ID NO: 554633 - DNA, 20 bp, mouse
gcaccgagccctctctctca

SEQ ID NO: 554634 - DNA, 20 bp, mouse
gtgtactcggggaaccgtag

SEQ ID NO: 554635 - DNA, 20 bp, mouse
gtgaccaggaagaggtgggt

SEQ ID NO: 554636 - DNA, 20 bp, mouse
gcagcccaaagagcagctcc

SEQ ID NO: 554637 - DNA, 20 bp, mouse
gtccatgctcaggctctcag

SEQ ID NO: 554638 - DNA, 20 bp, mouse
gcgctctcatccatccagcc

SEQ ID NO: 554639 - DNA, 20 bp, mouse
gagcgggcagcaggtggacc

SEQ ID NO: 554640 - DNA, 20 bp, mouse
gaatgtccaatgaagcgcaa

SEQ ID NO: 554641 - DNA, 20 bp, mouse
gcaggccgcagggttaagga

SEQ ID NO: 554642 - DNA, 20 bp, mouse
ggtcttgtcaagcttaactc

SEQ ID NO: 554643 - DNA, 20 bp, mouse
gtgaaggagagtccatgctc

SEQ ID NO: 554644 - DNA, 20 bp, mouse
ggtatagagccggaagtctg

SEQ ID NO: 554645 - DNA, 20 bp, mouse
gcaaaggaatgagtgccacg

SEQ ID NO: 554646 - DNA, 20 bp, mouse
gaggcgctcatcctgaggta

SEQ ID NO: 554647 - DNA, 20 bp, mouse
gcctcgtctcgaagatagtg

SEQ ID NO: 554648 - DNA, 20 bp, mouse
gagtacgtgggtattagcag

SEQ ID NO: 554649 - DNA, 20 bp, mouse
gaaccacactgccctacctc

SEQ ID NO: 554650 - DNA, 20 bp, mouse
gtccgcttcccaggaaagtt

SEQ ID NO: 554651 - DNA, 20 bp, mouse
gtcctgggaagcggatttag

SEQ ID NO: 554652 - DNA, 20 bp, mouse
gacgtgggtattagcagagg

SEQ ID NO: 554653 - DNA, 20 bp, mouse
gtgctggtctcacacccccc

SEQ ID NO: 554654 - DNA, 20 bp, mouse
gctgcattgagagaattcat

SEQ ID NO: 554655 - DNA, 20 bp, mouse
gatgattctgataagtacgt

SEQ ID NO: 554656 - DNA, 20 bp, mouse
gagtggcgcgcggaaaacgg

SEQ ID NO: 554657 - DNA, 20 bp, mouse
ggcactgcgggcggtcgacc

SEQ ID NO: 554658 - DNA, 20 bp, mouse
gctgcgggcggtcgaccggg

SEQ ID NO: 554659 - DNA, 20 bp, mouse
ggaggactgcagctccgcac

SEQ ID NO: 554660 - DNA, 20 bp, mouse
gcgtccgagaggttgacgag

SEQ ID NO: 554661 - DNA, 20 bp, mouse
gcttgggcgagcactgcggg

SEQ ID NO: 554662 - DNA, 20 bp, mouse
gcgcacggtggagacggaca

SEQ ID NO: 554663 - DNA, 20 bp, mouse
gtcaggaacccggggagtca

SEQ ID NO: 554664 - DNA, 20 bp, mouse
ggcgagggacgaggcactac

SEQ ID NO: 554665 - DNA, 20 bp, mouse
gagtctgcgcccgcgatcgg

SEQ ID NO: 554666 - DNA, 20 bp, mouse
gcaggaacgtggacccatca

SEQ ID NO: 554667 - DNA, 20 bp, mouse
gggatcagcaaggtgcgccg

SEQ ID NO: 554668 - DNA, 20 bp, mouse
gctctcagcttgcctgtccc

SEQ ID NO: 554669 - DNA, 20 bp, mouse
ggaagaagctctgcctgttt

SEQ ID NO: 554670 - DNA, 20 bp, mouse
gagcaaggtgcgccggggac

SEQ ID NO: 554671 - DNA, 20 bp, mouse
ggcagggtagaggcagccac

SEQ ID NO: 554672 - DNA, 20 bp, mouse
gagtctggccgcccatccca

SEQ ID NO: 554673 - DNA, 20 bp, mouse
gcacagtggggaaattgctg

SEQ ID NO: 554674 - DNA, 20 bp, mouse
gtggggttgcatgcacagac

SEQ ID NO: 554675 - DNA, 20 bp, mouse
gcagggctgaacagctactc

SEQ ID NO: 554676 - DNA, 20 bp, mouse
gctagtcaatatcttatctt

SEQ ID NO: 554677 - DNA, 20 bp, mouse
gtatcttcggagcaggagct

SEQ ID NO: 554678 - DNA, 20 bp, mouse
ggtaagaggggctctagtga

SEQ ID NO: 554679 - DNA, 20 bp, mouse
gccccttctggctgccgcac

SEQ ID NO: 554680 - DNA, 20 bp, mouse
gtccacccaccaagactcag

SEQ ID NO: 554681 - DNA, 20 bp, mouse
gcttggggtctgctccggct

SEQ ID NO: 554682 - DNA, 20 bp, mouse
ggggggagcactgggaggta

SEQ ID NO: 554683 - DNA, 20 bp, mouse
gagggaagtgcctgagccct

SEQ ID NO: 554684 - DNA, 20 bp, mouse
gtgcttctcactctagcttg

SEQ ID NO: 554685 - DNA, 20 bp, mouse
ggaaggctgcggctgagaga

SEQ ID NO: 554686 - DNA, 20 bp, mouse
gccaccttagaagtacacgg

SEQ ID NO: 554687 - DNA, 20 bp, mouse
gctcccaccttagaagtaca

SEQ ID NO: 554688 - DNA, 20 bp, mouse
gcgccactctctgagtggaa

SEQ ID NO: 554689 - DNA, 20 bp, mouse
gactctctgagtggaaggga

SEQ ID NO: 554690 - DNA, 20 bp, mouse
ggcgcctccgtgtacttcta

SEQ ID NO: 554691 - DNA, 20 bp, mouse
gtacaagcagaggagaatat

SEQ ID NO: 554692 - DNA, 20 bp, mouse
gtgcttgctgcggactcggt

SEQ ID NO: 554693 - DNA, 20 bp, mouse
gctcttctctggttccacta

SEQ ID NO: 554694 - DNA, 20 bp, mouse
ggggagggggctacaagcag

SEQ ID NO: 554695 - DNA, 20 bp, mouse
gctcagagagtggcgctttg

SEQ ID NO: 554696 - DNA, 20 bp, mouse
gagctgtcccctgctctgac

SEQ ID NO: 554697 - DNA, 20 bp, mouse
gcaaaagcatctaaaaggta

SEQ ID NO: 554698 - DNA, 20 bp, mouse
ggcaggaactgggcagagaa

SEQ ID NO: 554699 - DNA, 20 bp, mouse
gctcttcaagaccaccccca

SEQ ID NO: 554700 - DNA, 20 bp, mouse
gggaaccaaaagcatctaaa

SEQ ID NO: 554701 - DNA, 20 bp, mouse
gtgcgcaggcggctttggga

SEQ ID NO: 554702 - DNA, 20 bp, mouse
gattcagcccggctgagatt

SEQ ID NO: 554703 - DNA, 20 bp, mouse
gagatgcttttggttccgtc

SEQ ID NO: 554704 - DNA, 20 bp, mouse
gttggaggcctcatgcccac

SEQ ID NO: 554705 - DNA, 20 bp, mouse
gatctaaaaggtaaggtcca

SEQ ID NO: 554706 - DNA, 20 bp, mouse
gcggcgaccgggcagctgga

SEQ ID NO: 554707 - DNA, 20 bp, mouse
gccgccagggaccagccggg

SEQ ID NO: 554708 - DNA, 20 bp, mouse
gggcgctgcggtcagctgag

SEQ ID NO: 554709 - DNA, 20 bp, mouse
gtggatgccgacgcccgcca

SEQ ID NO: 554710 - DNA, 20 bp, mouse
gcagccggggggcggcgacc

SEQ ID NO: 554711 - DNA, 20 bp, mouse
gtccccagcggactccatcc

SEQ ID NO: 554712 - DNA, 20 bp, mouse
ggcgcggcgactctccccag

SEQ ID NO: 554713 - DNA, 20 bp, mouse
ggcagctggacggtgacgcg

SEQ ID NO: 554714 - DNA, 20 bp, mouse
ggccaggatggagtccgctg

SEQ ID NO: 554715 - DNA, 20 bp, mouse
gctgcccggtcgccgccccc

SEQ ID NO: 554716 - DNA, 20 bp, mouse
ggcggcggcagcagcactag

SEQ ID NO: 554717 - DNA, 20 bp, mouse
gccggacgcaccggatccga

SEQ ID NO: 554718 - DNA, 20 bp, mouse
ggcaccggatccgaaggccg

SEQ ID NO: 554719 - DNA, 20 bp, mouse
ggatccgaaggccgaggcac

SEQ ID NO: 554720 - DNA, 20 bp, mouse
ggcagcggtggggcccccga

SEQ ID NO: 554721 - DNA, 20 bp, mouse
gcgcggccgcttggaacttg

SEQ ID NO: 554722 - DNA, 20 bp, mouse
gcggagcttcccgtgagcgg

SEQ ID NO: 554723 - DNA, 20 bp, mouse
ggggaggcccgagctcacca

SEQ ID NO: 554724 - DNA, 20 bp, mouse
ggcgggagaccggctcgagt

SEQ ID NO: 554725 - DNA, 20 bp, mouse
gccgctccgcaagttccaag

SEQ ID NO: 554726 - DNA, 20 bp, mouse
gctgcgggcggaaagaggga

SEQ ID NO: 554727 - DNA, 20 bp, mouse
ggcggctgcgggcggaaaga

SEQ ID NO: 554728 - DNA, 20 bp, mouse
gcgcagtgttgcctaggcag

SEQ ID NO: 554729 - DNA, 20 bp, mouse
ggaagggacaggctgatgag

SEQ ID NO: 554730 - DNA, 20 bp, mouse
gccacggatgggtcacgtga

SEQ ID NO: 554731 - DNA, 20 bp, mouse
gcacccacgcgcctgagagg

SEQ ID NO: 554732 - DNA, 20 bp, mouse
gcgcgccccttagctaggag

SEQ ID NO: 554733 - DNA, 20 bp, mouse
gtggatcagggacactggac

SEQ ID NO: 554734 - DNA, 20 bp, mouse
ggctgagggctggacagtca

SEQ ID NO: 554735 - DNA, 20 bp, mouse
gcggcggcgcagtgttgcct

SEQ ID NO: 554736 - DNA, 20 bp, mouse
ggacccagcgggaacagtta

SEQ ID NO: 554737 - DNA, 20 bp, mouse
gggtgggaccccatcctggg

SEQ ID NO: 554738 - DNA, 20 bp, mouse
gacgcgtctagaaggcccag

SEQ ID NO: 554739 - DNA, 20 bp, mouse
gtgccttgccacccaggatg

SEQ ID NO: 554740 - DNA, 20 bp, mouse
ggaagggacggcccaagcgc

SEQ ID NO: 554741 - DNA, 20 bp, mouse
gggacggcccaagcgcgggt

SEQ ID NO: 554742 - DNA, 20 bp, mouse
gcgcgggtgggaccccatcc

SEQ ID NO: 554743 - DNA, 20 bp, mouse
gcaggccccgctgaacccgg

SEQ ID NO: 554744 - DNA, 20 bp, mouse
gctgctctcaggatgaaggg

SEQ ID NO: 554745 - DNA, 20 bp, mouse
gcgccttgtatccccaagaa

SEQ ID NO: 554746 - DNA, 20 bp, mouse
gctgctccgcgcggcataca

SEQ ID NO: 554747 - DNA, 20 bp, mouse
gtatgccgcgcggagcaggg

SEQ ID NO: 554748 - DNA, 20 bp, mouse
ggcgaaggcgggtatccccg

SEQ ID NO: 554749 - DNA, 20 bp, mouse
gttcttcattctgacaatcc

SEQ ID NO: 554750 - DNA, 20 bp, mouse
ggtgatggcggatgagaggt

SEQ ID NO: 554751 - DNA, 20 bp, mouse
gcacatacggcggtattcat

SEQ ID NO: 554752 - DNA, 20 bp, mouse
gagctgctgggcagtcctcg

SEQ ID NO: 554753 - DNA, 20 bp, mouse
gagacgcgatcacaaacgcc

SEQ ID NO: 554754 - DNA, 20 bp, mouse
gctgtgtagtaatcgccaac

SEQ ID NO: 554755 - DNA, 20 bp, mouse
gccccgccccggcagctgct

SEQ ID NO: 554756 - DNA, 20 bp, mouse
gctcccggaggagccagacc

SEQ ID NO: 554757 - DNA, 20 bp, mouse
gtgtagccgtggtctcccgg

SEQ ID NO: 554758 - DNA, 20 bp, mouse
gtggctcctccgggagacca

SEQ ID NO: 554759 - DNA, 20 bp, mouse
gcgtccaggtctggctcctc

SEQ ID NO: 554760 - DNA, 20 bp, mouse
gtgttcctggagctccgggg

SEQ ID NO: 554761 - DNA, 20 bp, mouse
gtgttgtagccgtggtctcc

SEQ ID NO: 554762 - DNA, 20 bp, mouse
gtgcctggactgcaaagcgt

SEQ ID NO: 554763 - DNA, 20 bp, mouse
gaagtgttcctggagctccg

SEQ ID NO: 554764 - DNA, 20 bp, mouse
gtccaggcactggagtagct

SEQ ID NO: 554765 - DNA, 20 bp, mouse
gtcagctgactaagaactga

SEQ ID NO: 554766 - DNA, 20 bp, mouse
gccggggaggccagcgtcta

SEQ ID NO: 554767 - DNA, 20 bp, mouse
ggcgcaggttcggcttggac

SEQ ID NO: 554768 - DNA, 20 bp, mouse
ggccgcggaacaccccagaa

SEQ ID NO: 554769 - DNA, 20 bp, mouse
ggtctagggaaagagtcgac

SEQ ID NO: 554770 - DNA, 20 bp, mouse
ggcaaggccacgggtgtcgg

SEQ ID NO: 554771 - DNA, 20 bp, mouse
ggaacaccccagaacggccc

SEQ ID NO: 554772 - DNA, 20 bp, mouse
gtgggcgcgcaggttcggct

SEQ ID NO: 554773 - DNA, 20 bp, mouse
gaccatggcgggagatgacg

SEQ ID NO: 554774 - DNA, 20 bp, mouse
gcctgctgggcgcgcaggtt

SEQ ID NO: 554775 - DNA, 20 bp, mouse
ggccgttctggggtgttccg

SEQ ID NO: 554776 - DNA, 20 bp, mouse
gccgtgtctaaggtacgtgg

SEQ ID NO: 554777 - DNA, 20 bp, mouse
gcgtaccttagacacggagg

SEQ ID NO: 554778 - DNA, 20 bp, mouse
gaacaggcaccgcgaatctg

SEQ ID NO: 554779 - DNA, 20 bp, mouse
gaggaggtggccatagtccg

SEQ ID NO: 554780 - DNA, 20 bp, mouse
gaggacgcagcacattctgg

SEQ ID NO: 554781 - DNA, 20 bp, mouse
gtggagtgcgcatgcacacg

SEQ ID NO: 554782 - DNA, 20 bp, mouse
gaccttagacacggaggagg

SEQ ID NO: 554783 - DNA, 20 bp, mouse
ggccacctcctccgtgtcta

SEQ ID NO: 554784 - DNA, 20 bp, mouse
gcacacggggccgcggacta

SEQ ID NO: 554785 - DNA, 20 bp, mouse
gggcgctcgcctcagattcg

SEQ ID NO: 554786 - DNA, 20 bp, mouse
gcgccgacggtgaggaccga

SEQ ID NO: 554787 - DNA, 20 bp, mouse
ggaaggtggtgaacatcctt

SEQ ID NO: 554788 - DNA, 20 bp, mouse
gaggctcgtgcaggccgggt

SEQ ID NO: 554789 - DNA, 20 bp, mouse
gatccttcggtcctcaccgt

SEQ ID NO: 554790 - DNA, 20 bp, mouse
ggaggtaaggccggtctcgt

SEQ ID NO: 554791 - DNA, 20 bp, mouse
gggcgggtggacaatctgag

SEQ ID NO: 554792 - DNA, 20 bp, mouse
ggggctgcagtaggagcagc

SEQ ID NO: 554793 - DNA, 20 bp, mouse
gccggccgccgccgacggtg

SEQ ID NO: 554794 - DNA, 20 bp, mouse
gtgggagttgctgtgcgcgg

SEQ ID NO: 554795 - DNA, 20 bp, mouse
ggagctgctgtggacgaagc

SEQ ID NO: 554796 - DNA, 20 bp, mouse
gtgagtggcgcagggctgac

SEQ ID NO: 554797 - DNA, 20 bp, mouse
gtacgtgaaccacgcctgag

SEQ ID NO: 554798 - DNA, 20 bp, mouse
ggtggcgcagggctgaccgg

SEQ ID NO: 554799 - DNA, 20 bp, mouse
gcacttgggcctctcgacag

SEQ ID NO: 554800 - DNA, 20 bp, mouse
ggactgcaaagtggacactt

SEQ ID NO: 554801 - DNA, 20 bp, mouse
gctgcagagcagttggcctc

SEQ ID NO: 554802 - DNA, 20 bp, mouse
ggccctgcgccactcaggcg

SEQ ID NO: 554803 - DNA, 20 bp, mouse
gagcatggtcctctgtcgag

SEQ ID NO: 554804 - DNA, 20 bp, mouse
ggtactccccccaaacggaa

SEQ ID NO: 554805 - DNA, 20 bp, mouse
gtgcagaacagggtttgggt

SEQ ID NO: 554806 - DNA, 20 bp, mouse
gtccgcaaggccgagacgcg

SEQ ID NO: 554807 - DNA, 20 bp, mouse
ggccgagacgcggggcgagg

SEQ ID NO: 554808 - DNA, 20 bp, mouse
gtgcggagccgagtgtactg

SEQ ID NO: 554809 - DNA, 20 bp, mouse
ggagatccgcggccgaggaa

SEQ ID NO: 554810 - DNA, 20 bp, mouse
gccagcgatggagtcggagc

SEQ ID NO: 554811 - DNA, 20 bp, mouse
ggccgcctcgccccgcgtct

SEQ ID NO: 554812 - DNA, 20 bp, mouse
gaaggccgagacgcggggcg

SEQ ID NO: 554813 - DNA, 20 bp, mouse
gccttagttaaggagatccg

SEQ ID NO: 554814 - DNA, 20 bp, mouse
gtttcttccagcgatggagt

SEQ ID NO: 554815 - DNA, 20 bp, mouse
gagctctgttggatacactg

SEQ ID NO: 554816 - DNA, 20 bp, mouse
gaggcctgggaaaagatcat

SEQ ID NO: 554817 - DNA, 20 bp, mouse
gactcagagccaccaggcct

SEQ ID NO: 554818 - DNA, 20 bp, mouse
ggagaggcaagggcattacc

SEQ ID NO: 554819 - DNA, 20 bp, mouse
gcgtgtgcagcgccatgctg

SEQ ID NO: 554820 - DNA, 20 bp, mouse
gctccagaccagaatcccat

SEQ ID NO: 554821 - DNA, 20 bp, mouse
ggtgatgcttcggagtttgg

SEQ ID NO: 554822 - DNA, 20 bp, mouse
gggttcgcctatggtgaagt

SEQ ID NO: 554823 - DNA, 20 bp, mouse
gttgagccttctgccgatgt

SEQ ID NO: 554824 - DNA, 20 bp, mouse
gagcttccaacatcggcaga

SEQ ID NO: 554825 - DNA, 20 bp, mouse
ggttagcaagtcttgattag

SEQ ID NO: 554826 - DNA, 20 bp, mouse
gcctctgagtgtcctaagca

SEQ ID NO: 554827 - DNA, 20 bp, mouse
gtggacgtgagcacttaagg

SEQ ID NO: 554828 - DNA, 20 bp, mouse
ggtgctcacgtccaagtcct

SEQ ID NO: 554829 - DNA, 20 bp, mouse
gcatgtgcagtgccatgctt

SEQ ID NO: 554830 - DNA, 20 bp, mouse
gagttatctcttccaagccc

SEQ ID NO: 554831 - DNA, 20 bp, mouse
gctgcacatgattcttgtca

SEQ ID NO: 554832 - DNA, 20 bp, mouse
ggtgagcctcctgccgctgt

SEQ ID NO: 554833 - DNA, 20 bp, mouse
gacttggacgtgagcactta

SEQ ID NO: 554834 - DNA, 20 bp, mouse
ggcttgcttgccccacagca

SEQ ID NO: 554835 - DNA, 20 bp, mouse
gtcacgtccaagtcctgggc

SEQ ID NO: 554836 - DNA, 20 bp, mouse
gccatgctgaggatactcag

SEQ ID NO: 554837 - DNA, 20 bp, mouse
gcaccagggtatacacaagt

SEQ ID NO: 554838 - DNA, 20 bp, mouse
gggcatccccctgtctccaa

SEQ ID NO: 554839 - DNA, 20 bp, mouse
gagttatctcttcccagctc

SEQ ID NO: 554840 - DNA, 20 bp, mouse
gcagagcatgccatcaacat

SEQ ID NO: 554841 - DNA, 20 bp, mouse
gcgtgtgtagttccatgctg

SEQ ID NO: 554842 - DNA, 20 bp, mouse
gggccttgtagtgaggacct

SEQ ID NO: 554843 - DNA, 20 bp, mouse
gtgactcagaccctgattat

SEQ ID NO: 554844 - DNA, 20 bp, mouse
gtcatcgtggatgaatgcca

SEQ ID NO: 554845 - DNA, 20 bp, mouse
gatagggtcgcctatgttga

SEQ ID NO: 554846 - DNA, 20 bp, mouse
gctagccagaggacctactg

SEQ ID NO: 554847 - DNA, 20 bp, mouse
gggtcacaggacaattcccg

SEQ ID NO: 554848 - DNA, 20 bp, mouse
gttcccgcggcagccacagt

SEQ ID NO: 554849 - DNA, 20 bp, mouse
ggtcctctggctagagctac

SEQ ID NO: 554850 - DNA, 20 bp, mouse
gcagccttccggaagcggtg

SEQ ID NO: 554851 - DNA, 20 bp, mouse
gcttaccggccgccagctcc

SEQ ID NO: 554852 - DNA, 20 bp, mouse
gtggcggccggtaagctcga

SEQ ID NO: 554853 - DNA, 20 bp, mouse
gggaagtgcagccgcgactg

SEQ ID NO: 554854 - DNA, 20 bp, mouse
gcttggcagccttccggaag

SEQ ID NO: 554855 - DNA, 20 bp, mouse
ggaccacctgcggacaccta

SEQ ID NO: 554856 - DNA, 20 bp, mouse
gccagcttcaggagcccgtc

SEQ ID NO: 554857 - DNA, 20 bp, mouse
gactctgggaggagcatggg

SEQ ID NO: 554858 - DNA, 20 bp, mouse
gcaggagcccgtccggcttg

SEQ ID NO: 554859 - DNA, 20 bp, mouse
gaatagggagagcgcagaca

SEQ ID NO: 554860 - DNA, 20 bp, mouse
ggcgaaagtcggccacttcc

SEQ ID NO: 554861 - DNA, 20 bp, mouse
ggcgcagacagggcgaaagt

SEQ ID NO: 554862 - DNA, 20 bp, mouse
gcatgcgaaactgggactct

SEQ ID NO: 554863 - DNA, 20 bp, mouse
gtcggtgggagtattgggaa

SEQ ID NO: 554864 - DNA, 20 bp, mouse
gtcttacacctgtggtctcc

SEQ ID NO: 554865 - DNA, 20 bp, mouse
gaattgatttggggaattgt

SEQ ID NO: 554866 - DNA, 20 bp, mouse
gggagagagcccgagaaccc

SEQ ID NO: 554867 - DNA, 20 bp, mouse
gagctgtaacaaaccagcgg

SEQ ID NO: 554868 - DNA, 20 bp, mouse
gtgtaacaaaccagcggcgg

SEQ ID NO: 554869 - DNA, 20 bp, mouse
gcgcggtgagtccagacggg

SEQ ID NO: 554870 - DNA, 20 bp, mouse
gccgcgcggtgagtccagac

SEQ ID NO: 554871 - DNA, 20 bp, mouse
gtttgttacagctgctggag

SEQ ID NO: 554872 - DNA, 20 bp, mouse
gacagctgctggagcggccg

SEQ ID NO: 554873 - DNA, 20 bp, mouse
gcgcattcactcaaccctgg

SEQ ID NO: 554874 - DNA, 20 bp, mouse
ggagtgcgtgcatcaggcga

SEQ ID NO: 554875 - DNA, 20 bp, mouse
gcagacgggtggcatcggag

SEQ ID NO: 554876 - DNA, 20 bp, mouse
gatctctagcagagacggag

SEQ ID NO: 554877 - DNA, 20 bp, mouse
gaccgggctcgggagaatgg

SEQ ID NO: 554878 - DNA, 20 bp, mouse
ggtgctgctgtccagtctgt

SEQ ID NO: 554879 - DNA, 20 bp, mouse
ggccgctgccaggtttgggg

SEQ ID NO: 554880 - DNA, 20 bp, mouse
ggggacatctctagcagaga

SEQ ID NO: 554881 - DNA, 20 bp, mouse
ggtcatgggagggcaggtaa

SEQ ID NO: 554882 - DNA, 20 bp, mouse
gcgtcagacgcgcaggtaac

SEQ ID NO: 554883 - DNA, 20 bp, mouse
gtacctgcgcgtctgacggg

SEQ ID NO: 554884 - DNA, 20 bp, mouse
ggccgttgcctgtcatggga

SEQ ID NO: 554885 - DNA, 20 bp, mouse
gcggagaccaggcaccgaca

SEQ ID NO: 554886 - DNA, 20 bp, mouse
gccgcccggagcgcccaaca

SEQ ID NO: 554887 - DNA, 20 bp, mouse
gccgcccggagagacacgac

SEQ ID NO: 554888 - DNA, 20 bp, mouse
gcggcggcggagctcgtagg

SEQ ID NO: 554889 - DNA, 20 bp, mouse
ggctgaagcgctagccgtgt

SEQ ID NO: 554890 - DNA, 20 bp, mouse
gtagccgtgttgggcgctcc

SEQ ID NO: 554891 - DNA, 20 bp, mouse
ggctcgggctcggctagaga

SEQ ID NO: 554892 - DNA, 20 bp, mouse
gcccggggccggaggagtgg

SEQ ID NO: 554893 - DNA, 20 bp, mouse
gagccccgccgcgggaagga

SEQ ID NO: 554894 - DNA, 20 bp, mouse
gcacccgcggtgggaggcgg

SEQ ID NO: 554895 - DNA, 20 bp, mouse
ggctcgactgccgggaagga

SEQ ID NO: 554896 - DNA, 20 bp, mouse
gccgccgcctcggctcagag

SEQ ID NO: 554897 - DNA, 20 bp, mouse
ggcctgtgcaggcaccagag

SEQ ID NO: 554898 - DNA, 20 bp, mouse
ggctgtggacccgagctcgg

SEQ ID NO: 554899 - DNA, 20 bp, mouse
gcggccgctctgagccgagg

SEQ ID NO: 554900 - DNA, 20 bp, mouse
gagagctgtggacccgagct

SEQ ID NO: 554901 - DNA, 20 bp, mouse
gccgtgtggcaggacaagca

SEQ ID NO: 554902 - DNA, 20 bp, mouse
gtctgtgccaaggccttcag

SEQ ID NO: 554903 - DNA, 20 bp, mouse
gtcgacgccggctcagaaat

SEQ ID NO: 554904 - DNA, 20 bp, mouse
gctcgggtccacagctctat

SEQ ID NO: 554905 - DNA, 20 bp, mouse
gggcaggaatcggaactaca

SEQ ID NO: 554906 - DNA, 20 bp, mouse
gcgggagcccggagctgtag

SEQ ID NO: 554907 - DNA, 20 bp, mouse
gcccggagctgtagcggcag

SEQ ID NO: 554908 - DNA, 20 bp, mouse
ggagccggtggccgccgcgg

SEQ ID NO: 554909 - DNA, 20 bp, mouse
gcagtcccgcggccccagag

SEQ ID NO: 554910 - DNA, 20 bp, mouse
gcgcgcagcgatcatggaga

SEQ ID NO: 554911 - DNA, 20 bp, mouse
gtccctggctggccgagggg

SEQ ID NO: 554912 - DNA, 20 bp, mouse
ggggcggcccagagcacaga

SEQ ID NO: 554913 - DNA, 20 bp, mouse
gagcagtcccggctcggtgg

SEQ ID NO: 554914 - DNA, 20 bp, mouse
gcccgggcgcgcagcgatca

SEQ ID NO: 554915 - DNA, 20 bp, mouse
gcccagagcacagacggcgg

SEQ ID NO: 554916 - DNA, 20 bp, mouse
gctaaggaagctccagggag

SEQ ID NO: 554917 - DNA, 20 bp, mouse
gggagagctagcaggcgggt

SEQ ID NO: 554918 - DNA, 20 bp, mouse
gggagccccacggagttcac

SEQ ID NO: 554919 - DNA, 20 bp, mouse
gacaggagccgaccgctccc

SEQ ID NO: 554920 - DNA, 20 bp, mouse
ggccccgaactgagccggag

SEQ ID NO: 554921 - DNA, 20 bp, mouse
gggctcctgtgaactccgtg

SEQ ID NO: 554922 - DNA, 20 bp, mouse
ggcctgacctcaggactcgg

SEQ ID NO: 554923 - DNA, 20 bp, mouse
gtagcaggcgggtgggtgac

SEQ ID NO: 554924 - DNA, 20 bp, mouse
gtgaccggctgtgggtgggg

SEQ ID NO: 554925 - DNA, 20 bp, mouse
gccagggctagcgctctcgg

SEQ ID NO: 554926 - DNA, 20 bp, mouse
gacgcgcgcgccagaaatgt

SEQ ID NO: 554927 - DNA, 20 bp, mouse
gcaggaggcgtggtctagag

SEQ ID NO: 554928 - DNA, 20 bp, mouse
ggcgagcacgcaggtcagtg

SEQ ID NO: 554929 - DNA, 20 bp, mouse
gggtcagtgtggctcagggt

SEQ ID NO: 554930 - DNA, 20 bp, mouse
gctcgcgggcccggctcctg

SEQ ID NO: 554931 - DNA, 20 bp, mouse
gctccacagcagagatcccg

SEQ ID NO: 554932 - DNA, 20 bp, mouse
gcaggagcaaggagggcccc

SEQ ID NO: 554933 - DNA, 20 bp, mouse
gccgcgggtcaggagcaagg

SEQ ID NO: 554934 - DNA, 20 bp, mouse
gggcggaacccaaggatccg

SEQ ID NO: 554935 - DNA, 20 bp, mouse
ggatccgcgggtcaggagca

SEQ ID NO: 554936 - DNA, 20 bp, mouse
gagcacggcgggctgtaggt

SEQ ID NO: 554937 - DNA, 20 bp, mouse
gcgagcggcgagcagcacgg

SEQ ID NO: 554938 - DNA, 20 bp, mouse
gcggcgagcggcgagcagca

SEQ ID NO: 554939 - DNA, 20 bp, mouse
gggcgggctgtaggtcggag

SEQ ID NO: 554940 - DNA, 20 bp, mouse
gctgtaggtcggagaggcgc

SEQ ID NO: 554941 - DNA, 20 bp, mouse
gcttccgcttgggtgtcaga

SEQ ID NO: 554942 - DNA, 20 bp, mouse
ggcgttgattggccaggcgg

SEQ ID NO: 554943 - DNA, 20 bp, mouse
gcggtcgtccacactcccgg

SEQ ID NO: 554944 - DNA, 20 bp, mouse
gagtgtggacgaccgcggga

SEQ ID NO: 554945 - DNA, 20 bp, mouse
ggcgggccgcacttccgctt

SEQ ID NO: 554946 - DNA, 20 bp, mouse
gtgagtgacgagaagaatct

SEQ ID NO: 554947 - DNA, 20 bp, mouse
gcagttcaggttcctcccag

SEQ ID NO: 554948 - DNA, 20 bp, mouse
gctcggtgtgtctcaaaagt

SEQ ID NO: 554949 - DNA, 20 bp, mouse
gtgcattctcggcccctggg

SEQ ID NO: 554950 - DNA, 20 bp, mouse
gaactacttgtgcttcttga

SEQ ID NO: 554951 - DNA, 20 bp, mouse
gacctgccggcttccttgct

SEQ ID NO: 554952 - DNA, 20 bp, mouse
gtccaagcaaggaagccggc

SEQ ID NO: 554953 - DNA, 20 bp, mouse
gaagagatggagctcttatt

SEQ ID NO: 554954 - DNA, 20 bp, mouse
gacgtgaggagaatcagttc

SEQ ID NO: 554955 - DNA, 20 bp, mouse
gcaggggccgagaatgcatt

SEQ ID NO: 554956 - DNA, 20 bp, mouse
gtgagtacaaccagcacggt

SEQ ID NO: 554957 - DNA, 20 bp, mouse
gtctactcggatctatgcag

SEQ ID NO: 554958 - DNA, 20 bp, mouse
gggccgcctgggcccgcgag

SEQ ID NO: 554959 - DNA, 20 bp, mouse
gagcccctcgcgggcccagg

SEQ ID NO: 554960 - DNA, 20 bp, mouse
gcccccagaccagcccctga

SEQ ID NO: 554961 - DNA, 20 bp, mouse
gggccacagagccggcgtgg

SEQ ID NO: 554962 - DNA, 20 bp, mouse
gaataccagagggctgatcc

SEQ ID NO: 554963 - DNA, 20 bp, mouse
gctcgcctggatcagccctc

SEQ ID NO: 554964 - DNA, 20 bp, mouse
gtccgacccaggatatggag

SEQ ID NO: 554965 - DNA, 20 bp, mouse
gtaggagctccgctgctggg

SEQ ID NO: 554966 - DNA, 20 bp, mouse
gcgcgctggagaccacagct

SEQ ID NO: 554967 - DNA, 20 bp, mouse
gcgcaggctggaggaggctc

SEQ ID NO: 554968 - DNA, 20 bp, mouse
gggagaccacagctcggcac

SEQ ID NO: 554969 - DNA, 20 bp, mouse
gaccctggcgatacccgagt

SEQ ID NO: 554970 - DNA, 20 bp, mouse
gctccggaggcgcggaggac

SEQ ID NO: 554971 - DNA, 20 bp, mouse
gtggtctccagcgcggacag

SEQ ID NO: 554972 - DNA, 20 bp, mouse
gcggcgcggaggaccactgg

SEQ ID NO: 554973 - DNA, 20 bp, mouse
gctgcggcgcggaggaccac

SEQ ID NO: 554974 - DNA, 20 bp, mouse
gccgcagccccaggccccca

SEQ ID NO: 554975 - DNA, 20 bp, mouse
gcgccgcctgtgccgagctg

SEQ ID NO: 554976 - DNA, 20 bp, mouse
ggtgactcggagacagtctc

SEQ ID NO: 554977 - DNA, 20 bp, mouse
ggaagagctagccggtgact

SEQ ID NO: 554978 - DNA, 20 bp, mouse
gtctcaggcacagcagcgta

SEQ ID NO: 554979 - DNA, 20 bp, mouse
ggttctagcggccaggacaa

SEQ ID NO: 554980 - DNA, 20 bp, mouse
gagttctgtgaagagctagc

SEQ ID NO: 554981 - DNA, 20 bp, mouse
ggtgggaagtatctaccggt

SEQ ID NO: 554982 - DNA, 20 bp, mouse
gcagcagcgtacggatcaag

SEQ ID NO: 554983 - DNA, 20 bp, mouse
ggtaaaggcgctgagaatgg

SEQ ID NO: 554984 - DNA, 20 bp, mouse
gagaggtgggaagtatctac

SEQ ID NO: 554985 - DNA, 20 bp, mouse
gaggagaggtggagtgagac

SEQ ID NO: 554986 - DNA, 20 bp, mouse
gagctgggcggcggtggtag

SEQ ID NO: 554987 - DNA, 20 bp, mouse
gcagaaaggcggtgtcaggg

SEQ ID NO: 554988 - DNA, 20 bp, mouse
ggcccagaaaggcggtgtca

SEQ ID NO: 554989 - DNA, 20 bp, mouse
gcagcccggacggagagcac

SEQ ID NO: 554990 - DNA, 20 bp, mouse
gcggctcgcggcgcccagaa

SEQ ID NO: 554991 - DNA, 20 bp, mouse
gctcgcggcgcccagaaagg

SEQ ID NO: 554992 - DNA, 20 bp, mouse
gcgatgcggagccccagagg

SEQ ID NO: 554993 - DNA, 20 bp, mouse
gctgcgacgcgctcccagct

SEQ ID NO: 554994 - DNA, 20 bp, mouse
gctaccgctaccgctctcgg

SEQ ID NO: 554995 - DNA, 20 bp, mouse
gggagagcacaggcgagccg

SEQ ID NO: 554996 - DNA, 20 bp, mouse
gcccaagatggcgtccatcg

SEQ ID NO: 554997 - DNA, 20 bp, mouse
gtcattggcggctcccaaga

SEQ ID NO: 554998 - DNA, 20 bp, mouse
ggctgagacgaggtacgggt

SEQ ID NO: 554999 - DNA, 20 bp, mouse
ggcgtacggcggtctctcag

SEQ ID NO: 555000 - DNA, 20 bp, mouse
gcacaagggaacctcgcgta

SEQ ID NO: 555001 - DNA, 20 bp, mouse
gcatataggcgactgacgtc

SEQ ID NO: 555002 - DNA, 20 bp, mouse
ggggctgctctcctactaca

SEQ ID NO: 555003 - DNA, 20 bp, mouse
ggaagggatggcagtatcgt

SEQ ID NO: 555004 - DNA, 20 bp, mouse
gtagggtctgcgctgagacg

SEQ ID NO: 555005 - DNA, 20 bp, mouse
gggtgggcgtagtcccggtg

SEQ ID NO: 555006 - DNA, 20 bp, mouse
gccatggtgggcactctccg

SEQ ID NO: 555007 - DNA, 20 bp, mouse
gatcagcgacaggaccatgg

SEQ ID NO: 555008 - DNA, 20 bp, mouse
gatacctgagtcctaaacgg

SEQ ID NO: 555009 - DNA, 20 bp, mouse
gtccaggcagaggagagtaa

SEQ ID NO: 555010 - DNA, 20 bp, mouse
gcagctggagtatcagcgac

SEQ ID NO: 555011 - DNA, 20 bp, mouse
gtcctcagagtgaaaaaggc

SEQ ID NO: 555012 - DNA, 20 bp, mouse
ggagagtaagggatatctag

SEQ ID NO: 555013 - DNA, 20 bp, mouse
gcatttcctcagagtgaaaa

SEQ ID NO: 555014 - DNA, 20 bp, mouse
gctgggtcgggggtgagcat

SEQ ID NO: 555015 - DNA, 20 bp, mouse
gagacagattgctgggtcgg

SEQ ID NO: 555016 - DNA, 20 bp, mouse
gtggacgcgtaggggcctcc

SEQ ID NO: 555017 - DNA, 20 bp, mouse
gaaacccgcagggtagatga

SEQ ID NO: 555018 - DNA, 20 bp, mouse
gtagatgaaggaagaacccc

SEQ ID NO: 555019 - DNA, 20 bp, mouse
gggcaacgccgggaacagaa

SEQ ID NO: 555020 - DNA, 20 bp, mouse
gaaccgggctatggacgcgt

SEQ ID NO: 555021 - DNA, 20 bp, mouse
gatagtgccggaaacccgca

SEQ ID NO: 555022 - DNA, 20 bp, mouse
gccggagacaaggcccgcaa

SEQ ID NO: 555023 - DNA, 20 bp, mouse
gtgctaaatcacaaaccctg

SEQ ID NO: 555024 - DNA, 20 bp, mouse
gcatttagtgcggtgaggaa

SEQ ID NO: 555025 - DNA, 20 bp, mouse
ggtccgaaccgacatagtgc

SEQ ID NO: 555026 - DNA, 20 bp, mouse
ggcgcgggccaccctatcgg

SEQ ID NO: 555027 - DNA, 20 bp, mouse
ggaggcgcgggccaccctat

SEQ ID NO: 555028 - DNA, 20 bp, mouse
gaggcgcagtacaactctag

SEQ ID NO: 555029 - DNA, 20 bp, mouse
ggatccaaaccccaccgata

SEQ ID NO: 555030 - DNA, 20 bp, mouse
gacgccgcgaccagacggga

SEQ ID NO: 555031 - DNA, 20 bp, mouse
gaaccacggactccgagagg

SEQ ID NO: 555032 - DNA, 20 bp, mouse
gagaagccgcaggacgcaag

SEQ ID NO: 555033 - DNA, 20 bp, mouse
gggaaacgccgcgaccagac

SEQ ID NO: 555034 - DNA, 20 bp, mouse
ggccaaccacggactccgag

SEQ ID NO: 555035 - DNA, 20 bp, mouse
ggagaggagtgcgactcgca

SEQ ID NO: 555036 - DNA, 20 bp, mouse
gctcacgaccgggagccgtg

SEQ ID NO: 555037 - DNA, 20 bp, mouse
ggtcactcggcctcacgacc

SEQ ID NO: 555038 - DNA, 20 bp, mouse
gcaacccagaaccaagcgaa

SEQ ID NO: 555039 - DNA, 20 bp, mouse
gggccccgggcaccggtgag

SEQ ID NO: 555040 - DNA, 20 bp, mouse
gaccaagcgaagggactttc

SEQ ID NO: 555041 - DNA, 20 bp, mouse
gcttggttctgggttgttcg

SEQ ID NO: 555042 - DNA, 20 bp, mouse
ggggttgttcgtggtagtgc

SEQ ID NO: 555043 - DNA, 20 bp, mouse
gcaaccaaacgcacaatcag

SEQ ID NO: 555044 - DNA, 20 bp, mouse
gtatgtcacgaggtgccagg

SEQ ID NO: 555045 - DNA, 20 bp, mouse
gcacctcgtgacataacttc

SEQ ID NO: 555046 - DNA, 20 bp, mouse
ggcgcccgcagtttcctaag

SEQ ID NO: 555047 - DNA, 20 bp, mouse
gagcagtctccattcccctt

SEQ ID NO: 555048 - DNA, 20 bp, mouse
ggtgagcaaaagcttgggac

SEQ ID NO: 555049 - DNA, 20 bp, mouse
gaaagcaacggagtctctgt

SEQ ID NO: 555050 - DNA, 20 bp, mouse
gggacaggaaagacgtgcgc

SEQ ID NO: 555051 - DNA, 20 bp, mouse
gcattccccttaggaaactg

SEQ ID NO: 555052 - DNA, 20 bp, mouse
gttggtggtgagcaaaagct

SEQ ID NO: 555053 - DNA, 20 bp, mouse
gaggaccgccggcccaaggg

SEQ ID NO: 555054 - DNA, 20 bp, mouse
gtccgggcgcctgcgtagtg

SEQ ID NO: 555055 - DNA, 20 bp, mouse
gtcccacactgcaagacgtg

SEQ ID NO: 555056 - DNA, 20 bp, mouse
gacggtgagagactttgtca

SEQ ID NO: 555057 - DNA, 20 bp, mouse
gtgggatccccagggctaat

SEQ ID NO: 555058 - DNA, 20 bp, mouse
gggtgccctgctgcaagaac

SEQ ID NO: 555059 - DNA, 20 bp, mouse
gggcaagggtgggcagacgg

SEQ ID NO: 555060 - DNA, 20 bp, mouse
gtcagaggaacttggtcaca

SEQ ID NO: 555061 - DNA, 20 bp, mouse
gaggatgcccattagccctg

SEQ ID NO: 555062 - DNA, 20 bp, mouse
gtgggcctcgcacagcctct

SEQ ID NO: 555063 - DNA, 20 bp, mouse
gcatcgctggaggtgcaggg

SEQ ID NO: 555064 - DNA, 20 bp, mouse
gacactgactggtcctgagg

SEQ ID NO: 555065 - DNA, 20 bp, mouse
gtccgggcaaggctgtgggt

SEQ ID NO: 555066 - DNA, 20 bp, mouse
ggcgcgccgggaccagcccg

SEQ ID NO: 555067 - DNA, 20 bp, mouse
gctccgggagggccgaccgc

SEQ ID NO: 555068 - DNA, 20 bp, mouse
gtgcctgcaccgcggctcac

SEQ ID NO: 555069 - DNA, 20 bp, mouse
ggcgcgctctgcctgcaccg

SEQ ID NO: 555070 - DNA, 20 bp, mouse
gggtcggccctcccggagga

SEQ ID NO: 555071 - DNA, 20 bp, mouse
gctcccgcgcctgtgagccg

SEQ ID NO: 555072 - DNA, 20 bp, mouse
ggcagcgccggcccagcggg

SEQ ID NO: 555073 - DNA, 20 bp, mouse
ggaccgcgcgggtcacagga

SEQ ID NO: 555074 - DNA, 20 bp, mouse
gcggcagcaccacacaggca

SEQ ID NO: 555075 - DNA, 20 bp, mouse
gcggtccaggaacaagaaga

SEQ ID NO: 555076 - DNA, 20 bp, mouse
gtctggcccgtgcctctcag

SEQ ID NO: 555077 - DNA, 20 bp, mouse
gaagctgtgtcacccctgag

SEQ ID NO: 555078 - DNA, 20 bp, mouse
gacgagagggagaactagta

SEQ ID NO: 555079 - DNA, 20 bp, mouse
gtgtcacccctgagaggcac

SEQ ID NO: 555080 - DNA, 20 bp, mouse
ggtgtctgcatactgggtcc

SEQ ID NO: 555081 - DNA, 20 bp, mouse
ggcgccctgggatggtagaa

SEQ ID NO: 555082 - DNA, 20 bp, mouse
gagaagcccaaggcaggtag

SEQ ID NO: 555083 - DNA, 20 bp, mouse
ggtgggaagggcactcaaca

SEQ ID NO: 555084 - DNA, 20 bp, mouse
ggaagccgtgtctgcatact

SEQ ID NO: 555085 - DNA, 20 bp, mouse
gacagcccaagcgagagggt

SEQ ID NO: 555086 - DNA, 20 bp, mouse
gtcgccaggcgggtgagtac

SEQ ID NO: 555087 - DNA, 20 bp, mouse
ggtgaggccgaggaccggca

SEQ ID NO: 555088 - DNA, 20 bp, mouse
gccgaggaccggcaaggctc

SEQ ID NO: 555089 - DNA, 20 bp, mouse
gggcggcagcgcgggcacac

SEQ ID NO: 555090 - DNA, 20 bp, mouse
ggagttgcccaccaattagg

SEQ ID NO: 555091 - DNA, 20 bp, mouse
gtccggagcaggtcgccagg

SEQ ID NO: 555092 - DNA, 20 bp, mouse
gcccgcctggcgacctgctc

SEQ ID NO: 555093 - DNA, 20 bp, mouse
gctcggcctcacaggggaac

SEQ ID NO: 555094 - DNA, 20 bp, mouse
gccgcgcccgttcccctgtg

SEQ ID NO: 555095 - DNA, 20 bp, mouse
gggctccggagcaggtcgcc

SEQ ID NO: 555096 - DNA, 20 bp, mouse
ggcgagaacttgctggggag

SEQ ID NO: 555097 - DNA, 20 bp, mouse
gcccggcgggtagaactccg

SEQ ID NO: 555098 - DNA, 20 bp, mouse
gtctgaatctgaaccagtgc

SEQ ID NO: 555099 - DNA, 20 bp, mouse
ggtgccggcgagaacttgct

SEQ ID NO: 555100 - DNA, 20 bp, mouse
gggaggcaccagctacaaca

SEQ ID NO: 555101 - DNA, 20 bp, mouse
gagaaagggagccaggagcg

SEQ ID NO: 555102 - DNA, 20 bp, mouse
gttgttccgccgcggtccca

SEQ ID NO: 555103 - DNA, 20 bp, mouse
ggggcagagcgcgtctgtga

SEQ ID NO: 555104 - DNA, 20 bp, mouse
gctctgccctgggaccgcgg

SEQ ID NO: 555105 - DNA, 20 bp, mouse
gctgcggtgactccaagagt

SEQ ID NO: 555106 - DNA, 20 bp, mouse
gctgcagggccatcaccctc

SEQ ID NO: 555107 - DNA, 20 bp, mouse
gcagcgcgctcgcagccgga

SEQ ID NO: 555108 - DNA, 20 bp, mouse
gcgcggactgcgggtaaagt

SEQ ID NO: 555109 - DNA, 20 bp, mouse
ggaaccgagaacatgatctg

SEQ ID NO: 555110 - DNA, 20 bp, mouse
gggcgggacgcgggctggga

SEQ ID NO: 555111 - DNA, 20 bp, mouse
ggcagcctggggcgggacgc

SEQ ID NO: 555112 - DNA, 20 bp, mouse
gcgctccagactgagaacct

SEQ ID NO: 555113 - DNA, 20 bp, mouse
gaggtcatgaggtccaaact

SEQ ID NO: 555114 - DNA, 20 bp, mouse
gctacagcctggccctggaa

SEQ ID NO: 555115 - DNA, 20 bp, mouse
gctggggcgggacgcgggct

SEQ ID NO: 555116 - DNA, 20 bp, mouse
ggagtcggctgaagctggtc

SEQ ID NO: 555117 - DNA, 20 bp, mouse
gagacgcacaaactcgaggt

SEQ ID NO: 555118 - DNA, 20 bp, mouse
ggccgggctcgcctatgaaa

SEQ ID NO: 555119 - DNA, 20 bp, mouse
gtgtcggagtcggctgaagc

SEQ ID NO: 555120 - DNA, 20 bp, mouse
gctcgcaggcgccgtttcat

SEQ ID NO: 555121 - DNA, 20 bp, mouse
gtcataggcgagcccggcgg

SEQ ID NO: 555122 - DNA, 20 bp, mouse
gctacagacgcacaaactcg

SEQ ID NO: 555123 - DNA, 20 bp, mouse
gggcggaggctggatcgtgg

SEQ ID NO: 555124 - DNA, 20 bp, mouse
gtgctagctggggaacaacg

SEQ ID NO: 555125 - DNA, 20 bp, mouse
gcgaggtaggcgacctgagc

SEQ ID NO: 555126 - DNA, 20 bp, mouse
gagagtctccatgtccccgg

SEQ ID NO: 555127 - DNA, 20 bp, mouse
ggcattcgagcactaagaat

SEQ ID NO: 555128 - DNA, 20 bp, mouse
gagggctggccctaccgccg

SEQ ID NO: 555129 - DNA, 20 bp, mouse
gggccctaccgccggggaca

SEQ ID NO: 555130 - DNA, 20 bp, mouse
gacggcatgtgcacccaggg

SEQ ID NO: 555131 - DNA, 20 bp, mouse
gctccatgtccccggcggta

SEQ ID NO: 555132 - DNA, 20 bp, mouse
ggcgcccacccgacccatca

SEQ ID NO: 555133 - DNA, 20 bp, mouse
gtggttggtcgagagagtgt

SEQ ID NO: 555134 - DNA, 20 bp, mouse
gcggccgtgatgggtcgggt

SEQ ID NO: 555135 - DNA, 20 bp, mouse
gcgcaggctgctcgctccgg

SEQ ID NO: 555136 - DNA, 20 bp, mouse
ggttgcgcgcggatccggag

SEQ ID NO: 555137 - DNA, 20 bp, mouse
gatccgcgcgcaacccgatg

SEQ ID NO: 555138 - DNA, 20 bp, mouse
ggccgtgtggacagagtccg

SEQ ID NO: 555139 - DNA, 20 bp, mouse
gcggtcaaaccaggtaagag

SEQ ID NO: 555140 - DNA, 20 bp, mouse
gccacaccgctagaacgtcc

SEQ ID NO: 555141 - DNA, 20 bp, mouse
gcccggtgctcgagttcccg

SEQ ID NO: 555142 - DNA, 20 bp, mouse
gggcgctacacggagcgacc

SEQ ID NO: 555143 - DNA, 20 bp, mouse
gtcctcgggaactcgagcac

SEQ ID NO: 555144 - DNA, 20 bp, mouse
gtgtgcgtgtggggctcccg

SEQ ID NO: 555145 - DNA, 20 bp, mouse
ggctgcgcgtgcgggtctcc

SEQ ID NO: 555146 - DNA, 20 bp, mouse
gcggctgctgtcggaagcac

SEQ ID NO: 555147 - DNA, 20 bp, mouse
gcgcgtcccgagccatcccc

SEQ ID NO: 555148 - DNA, 20 bp, mouse
gcgccggccgaagccggaag

SEQ ID NO: 555149 - DNA, 20 bp, mouse
gtcccgagccatccccgggc

SEQ ID NO: 555150 - DNA, 20 bp, mouse
gtccggcccggggatggctc

SEQ ID NO: 555151 - DNA, 20 bp, mouse
ggaagagcgggtagcaggtc

SEQ ID NO: 555152 - DNA, 20 bp, mouse
gttacagtccggcccgggga

SEQ ID NO: 555153 - DNA, 20 bp, mouse
gaggtctggcagaggcgcac

SEQ ID NO: 555154 - DNA, 20 bp, mouse
ggctgcagggcggaggtcta

SEQ ID NO: 555155 - DNA, 20 bp, mouse
gccagatccggcaggtccgg

SEQ ID NO: 555156 - DNA, 20 bp, mouse
gcaggcaggactctaaagtt

SEQ ID NO: 555157 - DNA, 20 bp, mouse
gtcgcatcagggctaagttt

SEQ ID NO: 555158 - DNA, 20 bp, mouse
gtaagtttgggataagctgc

SEQ ID NO: 555159 - DNA, 20 bp, mouse
ggaaaactgataaagatctc

SEQ ID NO: 555160 - DNA, 20 bp, mouse
gcagaaagaaactcgcatca

SEQ ID NO: 555161 - DNA, 20 bp, mouse
gtaaattagaaagagataat

SEQ ID NO: 555162 - DNA, 20 bp, mouse
gtcttgatactagacatctg

SEQ ID NO: 555163 - DNA, 20 bp, mouse
gtgataaagatctctggatt

SEQ ID NO: 555164 - DNA, 20 bp, mouse
gtttccactccacagtagag

SEQ ID NO: 555165 - DNA, 20 bp, mouse
gaaatagttaagaaggatgt

SEQ ID NO: 555166 - DNA, 20 bp, mouse
gggcaggcagtgggggccac

SEQ ID NO: 555167 - DNA, 20 bp, mouse
gagcattcttagcttgccag

SEQ ID NO: 555168 - DNA, 20 bp, mouse
gcagagactgggatctggtc

SEQ ID NO: 555169 - DNA, 20 bp, mouse
gcttctttttgctagagtga

SEQ ID NO: 555170 - DNA, 20 bp, mouse
gaacctccctggattactaa

SEQ ID NO: 555171 - DNA, 20 bp, mouse
gttggaatcctgttctgcag

SEQ ID NO: 555172 - DNA, 20 bp, mouse
gaatgtacacagatggaaga

SEQ ID NO: 555173 - DNA, 20 bp, mouse
gtacattctaaatgaggtac

SEQ ID NO: 555174 - DNA, 20 bp, mouse
ggaagatgctgtctaatttg

SEQ ID NO: 555175 - DNA, 20 bp, mouse
gacagtttacagtttgcatg

SEQ ID NO: 555176 - DNA, 20 bp, mouse
gtgagtctggacacacggta

SEQ ID NO: 555177 - DNA, 20 bp, mouse
gaccggagtgaacagacaga

SEQ ID NO: 555178 - DNA, 20 bp, mouse
gccggtccccagcgcctgcc

SEQ ID NO: 555179 - DNA, 20 bp, mouse
ggagtcccgagatccaggct

SEQ ID NO: 555180 - DNA, 20 bp, mouse
gggatacctaggagcccata

SEQ ID NO: 555181 - DNA, 20 bp, mouse
gaggacggtaggccaagtgc

SEQ ID NO: 555182 - DNA, 20 bp, mouse
gggccagggccacacctctc

SEQ ID NO: 555183 - DNA, 20 bp, mouse
gggacctgccgggcaggcgc

SEQ ID NO: 555184 - DNA, 20 bp, mouse
gcaggctctactgctgagtc

SEQ ID NO: 555185 - DNA, 20 bp, mouse
gcgccatcctatggatacct

SEQ ID NO: 555186 - DNA, 20 bp, mouse
ggcagcgggaagaagctcgc

SEQ ID NO: 555187 - DNA, 20 bp, mouse
gatagggacgggagaggaca

SEQ ID NO: 555188 - DNA, 20 bp, mouse
gctggcaccctcctgagaca

SEQ ID NO: 555189 - DNA, 20 bp, mouse
gtctgtgagctgatagggac

SEQ ID NO: 555190 - DNA, 20 bp, mouse
ggacaggggctaccttacct

SEQ ID NO: 555191 - DNA, 20 bp, mouse
gaggtagcccctgtctcagg

SEQ ID NO: 555192 - DNA, 20 bp, mouse
gctgaaggagcagcttgctt

SEQ ID NO: 555193 - DNA, 20 bp, mouse
ggctccgaggcaaaggtgac

SEQ ID NO: 555194 - DNA, 20 bp, mouse
gtctcagagctccgaggcaa

SEQ ID NO: 555195 - DNA, 20 bp, mouse
gccgctaggccaacccgcca

SEQ ID NO: 555196 - DNA, 20 bp, mouse
gcagggctctgctcctaggt

SEQ ID NO: 555197 - DNA, 20 bp, mouse
ggaagaagcaagcatcgtct

SEQ ID NO: 555198 - DNA, 20 bp, mouse
gccaggattgcagccaccag

SEQ ID NO: 555199 - DNA, 20 bp, mouse
ggtggaggtgtgacccacct

SEQ ID NO: 555200 - DNA, 20 bp, mouse
ggattgcctggcaccctgat

SEQ ID NO: 555201 - DNA, 20 bp, mouse
gtgggtcacacctccactgg

SEQ ID NO: 555202 - DNA, 20 bp, mouse
gcaggcctgggacccagata

SEQ ID NO: 555203 - DNA, 20 bp, mouse
ggccaggctctctgattgcc

SEQ ID NO: 555204 - DNA, 20 bp, mouse
gtatgaaccgggggaatctg

SEQ ID NO: 555205 - DNA, 20 bp, mouse
ggggcatgcgggctcccatc

SEQ ID NO: 555206 - DNA, 20 bp, mouse
gtgtgtggttgagaagcccg

SEQ ID NO: 555207 - DNA, 20 bp, mouse
ggaagggagagagcacgcca

SEQ ID NO: 555208 - DNA, 20 bp, mouse
gaaacctcggatgctgtgtg

SEQ ID NO: 555209 - DNA, 20 bp, mouse
gctatgatggcatcttacaa

SEQ ID NO: 555210 - DNA, 20 bp, mouse
ggtaatgaaaccagcagtat

SEQ ID NO: 555211 - DNA, 20 bp, mouse
gcaaccacacacagcatccg

SEQ ID NO: 555212 - DNA, 20 bp, mouse
gttcaaatgaacacagttat

SEQ ID NO: 555213 - DNA, 20 bp, mouse
gtgagctctatctaaaacct

SEQ ID NO: 555214 - DNA, 20 bp, mouse
gtgaaaccagcagtatagga

SEQ ID NO: 555215 - DNA, 20 bp, mouse
gtggactgaaaccaaagtga

SEQ ID NO: 555216 - DNA, 20 bp, mouse
ggggaacacccataaggtat

SEQ ID NO: 555217 - DNA, 20 bp, mouse
gggagaaggattggcgataa

SEQ ID NO: 555218 - DNA, 20 bp, mouse
gtaatcatcccataccttat

SEQ ID NO: 555219 - DNA, 20 bp, mouse
ggaatctgtcagtgctgtcc

SEQ ID NO: 555220 - DNA, 20 bp, mouse
gccgtctctgaaagagaatt

SEQ ID NO: 555221 - DNA, 20 bp, mouse
gaatagacttaataccagag

SEQ ID NO: 555222 - DNA, 20 bp, mouse
gttcatttgtcattagacaa

SEQ ID NO: 555223 - DNA, 20 bp, mouse
gataaaactatgaatagaaa

SEQ ID NO: 555224 - DNA, 20 bp, mouse
ggcatgctaccgtggccaca

SEQ ID NO: 555225 - DNA, 20 bp, mouse
ggggacaaagaaaattctaa

SEQ ID NO: 555226 - DNA, 20 bp, mouse
gaggatgctgcgggagaaga

SEQ ID NO: 555227 - DNA, 20 bp, mouse
gagccgcccggggaccagac

SEQ ID NO: 555228 - DNA, 20 bp, mouse
gagcagggctcgaggcgcag

SEQ ID NO: 555229 - DNA, 20 bp, mouse
gggcatgccgcgatccccga

SEQ ID NO: 555230 - DNA, 20 bp, mouse
gcagactggaagatgcctgg

SEQ ID NO: 555231 - DNA, 20 bp, mouse
gaggagcctgaggatgctgc

SEQ ID NO: 555232 - DNA, 20 bp, mouse
gagcgtcccgcagaagctgg

SEQ ID NO: 555233 - DNA, 20 bp, mouse
gagggcgcgcccgggccccc

SEQ ID NO: 555234 - DNA, 20 bp, mouse
gttccagtctggtccccggg

SEQ ID NO: 555235 - DNA, 20 bp, mouse
ggcggctggcacctgactga

SEQ ID NO: 555236 - DNA, 20 bp, mouse
gattgtagccagctgagagt

SEQ ID NO: 555237 - DNA, 20 bp, mouse
gtgagtcctgccgaagctgg

SEQ ID NO: 555238 - DNA, 20 bp, mouse
ggaaggctggctgcaagtag

SEQ ID NO: 555239 - DNA, 20 bp, mouse
ggacaaagtcgggtgagtag

SEQ ID NO: 555240 - DNA, 20 bp, mouse
gggcagggttcttggagatg

SEQ ID NO: 555241 - DNA, 20 bp, mouse
gcggctggcattattcacca

SEQ ID NO: 555242 - DNA, 20 bp, mouse
gagcccggaaagaagtgatg

SEQ ID NO: 555243 - DNA, 20 bp, mouse
gccttctgtggggacaaagt

SEQ ID NO: 555244 - DNA, 20 bp, mouse
gtgttggtcccactctcagc

SEQ ID NO: 555245 - DNA, 20 bp, mouse
gctggagccactggcctcat

SEQ ID NO: 555246 - DNA, 20 bp, mouse
gcgcgctgcaacccaagagg

SEQ ID NO: 555247 - DNA, 20 bp, mouse
gtgggaccttaccaagacgg

SEQ ID NO: 555248 - DNA, 20 bp, mouse
gcagcgcggatcctccgtct

SEQ ID NO: 555249 - DNA, 20 bp, mouse
gatccgcgctgcaacccaag

SEQ ID NO: 555250 - DNA, 20 bp, mouse
gtcgcgggctccccacctct

SEQ ID NO: 555251 - DNA, 20 bp, mouse
gacctgggaccttaccaaga

SEQ ID NO: 555252 - DNA, 20 bp, mouse
ggagggaggaaagggcgtcg

SEQ ID NO: 555253 - DNA, 20 bp, mouse
gagtcaggcgctccaaggat

SEQ ID NO: 555254 - DNA, 20 bp, mouse
ggtctgcgaagccatggtcg

SEQ ID NO: 555255 - DNA, 20 bp, mouse
gcggatcctccgtcttggta

SEQ ID NO: 555256 - DNA, 20 bp, mouse
gcccggcacatagaaccaca

SEQ ID NO: 555257 - DNA, 20 bp, mouse
ggctagtcaaaacagcaaga

SEQ ID NO: 555258 - DNA, 20 bp, mouse
gggcaaagtgtaagaaaggt

SEQ ID NO: 555259 - DNA, 20 bp, mouse
gtccataaatacaccatgcc

SEQ ID NO: 555260 - DNA, 20 bp, mouse
gcactctttgcctgattcaa

SEQ ID NO: 555261 - DNA, 20 bp, mouse
gtggttctatgtgccgggca

SEQ ID NO: 555262 - DNA, 20 bp, mouse
gatataatgggaaatctgtc

SEQ ID NO: 555263 - DNA, 20 bp, mouse
ggatgaggagtgtgtctgta

SEQ ID NO: 555264 - DNA, 20 bp, mouse
ggccttgtggttctatgtgc

SEQ ID NO: 555265 - DNA, 20 bp, mouse
gataaaagaacccttgaatc

SEQ ID NO: 555266 - DNA, 20 bp, mouse
gacacaggcggaccattccg

SEQ ID NO: 555267 - DNA, 20 bp, mouse
gagaatgcaggaaaacacac

SEQ ID NO: 555268 - DNA, 20 bp, mouse
gacactggcacgatgaactg

SEQ ID NO: 555269 - DNA, 20 bp, mouse
gcatttcagagtacaggcag

SEQ ID NO: 555270 - DNA, 20 bp, mouse
gccgtggcagagaagaatgc

SEQ ID NO: 555271 - DNA, 20 bp, mouse
gtatgaacagtgcaaaacac

SEQ ID NO: 555272 - DNA, 20 bp, mouse
ggccccctgctgtccatcca

SEQ ID NO: 555273 - DNA, 20 bp, mouse
gtcccaacatggacacaggc

SEQ ID NO: 555274 - DNA, 20 bp, mouse
gccattgagctgtcccaaca

SEQ ID NO: 555275 - DNA, 20 bp, mouse
gggtaacgaacgccaggatt

SEQ ID NO: 555276 - DNA, 20 bp, mouse
ggggcagccaggagaagccg

SEQ ID NO: 555277 - DNA, 20 bp, mouse
gacctaaatgaaagaaaatt

SEQ ID NO: 555278 - DNA, 20 bp, mouse
gtcctggctgcccgggtgag

SEQ ID NO: 555279 - DNA, 20 bp, mouse
gagcatcgcgcaccgctcca

SEQ ID NO: 555280 - DNA, 20 bp, mouse
gggcgcattaaggtaaaata

SEQ ID NO: 555281 - DNA, 20 bp, mouse
gagcctggcgtccaggaggt

SEQ ID NO: 555282 - DNA, 20 bp, mouse
gaagccgctaaaatttgggg

SEQ ID NO: 555283 - DNA, 20 bp, mouse
gcggtttgtggttaaaaagg

SEQ ID NO: 555284 - DNA, 20 bp, mouse
ggttcccccccaaattttag

SEQ ID NO: 555285 - DNA, 20 bp, mouse
gaacagctttcgccctggag

SEQ ID NO: 555286 - DNA, 20 bp, mouse
gcttcggagtcgctacccag

SEQ ID NO: 555287 - DNA, 20 bp, mouse
gccggaagcgatcgccagtg

SEQ ID NO: 555288 - DNA, 20 bp, mouse
ggtgcggcgctgtttaaaga

SEQ ID NO: 555289 - DNA, 20 bp, mouse
ggcgactccgaaggtacgaa

SEQ ID NO: 555290 - DNA, 20 bp, mouse
gaggagggcaattaataacc

SEQ ID NO: 555291 - DNA, 20 bp, mouse
ggccgaggccacgggaccgg

SEQ ID NO: 555292 - DNA, 20 bp, mouse
gactccgaaggtacgaacgg

SEQ ID NO: 555293 - DNA, 20 bp, mouse
ggccctgcttccattgtgag

SEQ ID NO: 555294 - DNA, 20 bp, mouse
gtctccggcgggctgactgt

SEQ ID NO: 555295 - DNA, 20 bp, mouse
gcgaggaactcggggagtca

SEQ ID NO: 555296 - DNA, 20 bp, mouse
gtcttgctgggacacagtgg

SEQ ID NO: 555297 - DNA, 20 bp, mouse
gacccgaccgcccctcagac

SEQ ID NO: 555298 - DNA, 20 bp, mouse
gtccggtctgaggggcggtc

SEQ ID NO: 555299 - DNA, 20 bp, mouse
ggcgccgcccgacccaacgg

SEQ ID NO: 555300 - DNA, 20 bp, mouse
ggcgcgggcctcgcgggtgt

SEQ ID NO: 555301 - DNA, 20 bp, mouse
gcccgcgccgcccgacccaa

SEQ ID NO: 555302 - DNA, 20 bp, mouse
gggtctgcgctccggtctga

SEQ ID NO: 555303 - DNA, 20 bp, mouse
gctccggtcactatggtcag

SEQ ID NO: 555304 - DNA, 20 bp, mouse
ggtagagaccacaaccccag

SEQ ID NO: 555305 - DNA, 20 bp, mouse
gagcgagcgggtgccagggg

SEQ ID NO: 555306 - DNA, 20 bp, mouse
gctcctccaaccgtccccag

SEQ ID NO: 555307 - DNA, 20 bp, mouse
ggggcggcgctcgtctgagc

SEQ ID NO: 555308 - DNA, 20 bp, mouse
gagtgcagcgcgcggatggt

SEQ ID NO: 555309 - DNA, 20 bp, mouse
gtccaaccgtccccagcggc

SEQ ID NO: 555310 - DNA, 20 bp, mouse
gggactcgggcgtaggacgc

SEQ ID NO: 555311 - DNA, 20 bp, mouse
gctgcactcctgcttgcggg

SEQ ID NO: 555312 - DNA, 20 bp, mouse
gccgggctcgcagctataag

SEQ ID NO: 555313 - DNA, 20 bp, mouse
gcagcgcgcgggcggtccga

SEQ ID NO: 555314 - DNA, 20 bp, mouse
gcggccggggactcgggcgt

SEQ ID NO: 555315 - DNA, 20 bp, mouse
gctattcgcggctcctgacg

SEQ ID NO: 555316 - DNA, 20 bp, mouse
ggcctcagccggccaccggg

SEQ ID NO: 555317 - DNA, 20 bp, mouse
gagccggccaccgggcggag

SEQ ID NO: 555318 - DNA, 20 bp, mouse
gggacgacgcctggcgacag

SEQ ID NO: 555319 - DNA, 20 bp, mouse
gagcggcggccgcagagccg

SEQ ID NO: 555320 - DNA, 20 bp, mouse
gggaaccggcccgatcctgg

SEQ ID NO: 555321 - DNA, 20 bp, mouse
gcccagggcctgcagttggt

SEQ ID NO: 555322 - DNA, 20 bp, mouse
gcctgcgccgctccgcccgg

SEQ ID NO: 555323 - DNA, 20 bp, mouse
ggagccggagccgcagagcc

SEQ ID NO: 555324 - DNA, 20 bp, mouse
gggagcgtaagcgggacgag

SEQ ID NO: 555325 - DNA, 20 bp, mouse
gggcgctggccaaggagcgg

SEQ ID NO: 555326 - DNA, 20 bp, mouse
gtcgccggagggcgcctgag

SEQ ID NO: 555327 - DNA, 20 bp, mouse
ggaaagcgaaaacaaattct

SEQ ID NO: 555328 - DNA, 20 bp, mouse
ggagacccggaaacttgtgg

SEQ ID NO: 555329 - DNA, 20 bp, mouse
gccggagggcgcctgagggg

SEQ ID NO: 555330 - DNA, 20 bp, mouse
gggcgaggtggggagacgag

SEQ ID NO: 555331 - DNA, 20 bp, mouse
ggccgagaaccgaggaaacg

SEQ ID NO: 555332 - DNA, 20 bp, mouse
gaaacgcggagagaaagcca

SEQ ID NO: 555333 - DNA, 20 bp, mouse
ggtctccccacctcgccgga

SEQ ID NO: 555334 - DNA, 20 bp, mouse
gggcgccctccggcgaggtg

SEQ ID NO: 555335 - DNA, 20 bp, mouse
gtgtgaggcgagaaaagccc

SEQ ID NO: 555336 - DNA, 20 bp, mouse
gggtcggcgtcgggaggtgg

SEQ ID NO: 555337 - DNA, 20 bp, mouse
gccgggtcggcgtcgggagg

SEQ ID NO: 555338 - DNA, 20 bp, mouse
gtggccgggtcggcgtcggg

SEQ ID NO: 555339 - DNA, 20 bp, mouse
gggcggttcgttggccgggt

SEQ ID NO: 555340 - DNA, 20 bp, mouse
gccggccttggagggagaca

SEQ ID NO: 555341 - DNA, 20 bp, mouse
gtttgctgtggggtacttgg

SEQ ID NO: 555342 - DNA, 20 bp, mouse
ggcccgggcacagcaagcgg

SEQ ID NO: 555343 - DNA, 20 bp, mouse
ggaagtccagtgggacggta

SEQ ID NO: 555344 - DNA, 20 bp, mouse
gcaccggggcccccacaagg

SEQ ID NO: 555345 - DNA, 20 bp, mouse
gtcgttggccgggtcggcgt

SEQ ID NO: 555346 - DNA, 20 bp, mouse
ggcagcacaacctctccgag

SEQ ID NO: 555347 - DNA, 20 bp, mouse
gccacagctaccgctcggag

SEQ ID NO: 555348 - DNA, 20 bp, mouse
gccgtcccaaagaacgacaa

SEQ ID NO: 555349 - DNA, 20 bp, mouse
gaatgggagttcaagtctgg

SEQ ID NO: 555350 - DNA, 20 bp, mouse
ggaaaatgggagttcaagtc

SEQ ID NO: 555351 - DNA, 20 bp, mouse
gaagagctcaccaggagaga

SEQ ID NO: 555352 - DNA, 20 bp, mouse
ggactgccacagctaccgct

SEQ ID NO: 555353 - DNA, 20 bp, mouse
gacagttcaaatcgccagtc

SEQ ID NO: 555354 - DNA, 20 bp, mouse
ggtgtcagacatcttaccag

SEQ ID NO: 555355 - DNA, 20 bp, mouse
gctccatctcggcctcgagg

SEQ ID NO: 555356 - DNA, 20 bp, mouse
gggagatccgcacctcagga

SEQ ID NO: 555357 - DNA, 20 bp, mouse
gggccaggcgtcgggatcgg

SEQ ID NO: 555358 - DNA, 20 bp, mouse
gtgtcctctggtacctggac

SEQ ID NO: 555359 - DNA, 20 bp, mouse
ggcacacggggacatctccg

SEQ ID NO: 555360 - DNA, 20 bp, mouse
gccggggactgcaaataagg

SEQ ID NO: 555361 - DNA, 20 bp, mouse
ggcccagccccgcctcaagg

SEQ ID NO: 555362 - DNA, 20 bp, mouse
gacacgtcctggatccgtct

SEQ ID NO: 555363 - DNA, 20 bp, mouse
gccgggtgagggttgaggag

SEQ ID NO: 555364 - DNA, 20 bp, mouse
gtaagaggcgtccacaccca

SEQ ID NO: 555365 - DNA, 20 bp, mouse
gaaccgggagacgccgacat

SEQ ID NO: 555366 - DNA, 20 bp, mouse
gagccgacttccatcttccc

SEQ ID NO: 555367 - DNA, 20 bp, mouse
gagtcggctagcggcgactg

SEQ ID NO: 555368 - DNA, 20 bp, mouse
gtgcggcgctgcgggcggac

SEQ ID NO: 555369 - DNA, 20 bp, mouse
ggcttggccgggaggcgagt

SEQ ID NO: 555370 - DNA, 20 bp, mouse
gaggggctgcaggacgctgg

SEQ ID NO: 555371 - DNA, 20 bp, mouse
ggcgagcggaacagctgatc

SEQ ID NO: 555372 - DNA, 20 bp, mouse
gggcgcagccaggaaggcgg

SEQ ID NO: 555373 - DNA, 20 bp, mouse
ggcgactgcggcgctgcggg

SEQ ID NO: 555374 - DNA, 20 bp, mouse
ggaacagttcgggatctcgt

SEQ ID NO: 555375 - DNA, 20 bp, mouse
gggcgctgcgggcggaccgg

SEQ ID NO: 555376 - DNA, 20 bp, mouse
gccagccgctggagtcggag

SEQ ID NO: 555377 - DNA, 20 bp, mouse
gtcggagtggcgacccggtg

SEQ ID NO: 555378 - DNA, 20 bp, mouse
gtccgccggctcctccacac

SEQ ID NO: 555379 - DNA, 20 bp, mouse
ggcggctggttcaggatcgg

SEQ ID NO: 555380 - DNA, 20 bp, mouse
gccagcggctggttcaggat

SEQ ID NO: 555381 - DNA, 20 bp, mouse
gctgaaccagccgctggagt

SEQ ID NO: 555382 - DNA, 20 bp, mouse
ggagtggcgacccggtgtgg

SEQ ID NO: 555383 - DNA, 20 bp, mouse
ggagccaagccgggactgac

SEQ ID NO: 555384 - DNA, 20 bp, mouse
gcccggtgtggaggagccgg

SEQ ID NO: 555385 - DNA, 20 bp, mouse
gtggagtcggagtggcgacc

SEQ ID NO: 555386 - DNA, 20 bp, mouse
ggagcaagccggaggcggta

SEQ ID NO: 555387 - DNA, 20 bp, mouse
gaagacaagccactccgaca

SEQ ID NO: 555388 - DNA, 20 bp, mouse
ggcaatttaccttgtcggag

SEQ ID NO: 555389 - DNA, 20 bp, mouse
ggcgttcacatacccgggga

SEQ ID NO: 555390 - DNA, 20 bp, mouse
gcccggggagggcagtagaa

SEQ ID NO: 555391 - DNA, 20 bp, mouse
ggtgttcgagggacagagtt

SEQ ID NO: 555392 - DNA, 20 bp, mouse
gttcgagggacagagttagg

SEQ ID NO: 555393 - DNA, 20 bp, mouse
gctctctcggagcaagccgg

SEQ ID NO: 555394 - DNA, 20 bp, mouse
gacgggaagagggaagttga

SEQ ID NO: 555395 - DNA, 20 bp, mouse
gggcgaggccaggtcttgag

SEQ ID NO: 555396 - DNA, 20 bp, mouse
ggaggaaggttccgctctca

SEQ ID NO: 555397 - DNA, 20 bp, mouse
gtacgatacatacaaagtag

SEQ ID NO: 555398 - DNA, 20 bp, mouse
gttttattttttagtaacag

SEQ ID NO: 555399 - DNA, 20 bp, mouse
ggatacatacaaagtagagg

SEQ ID NO: 555400 - DNA, 20 bp, mouse
gtgctgagaaagcgcctctc

SEQ ID NO: 555401 - DNA, 20 bp, mouse
gtggaaaggtgaagactaca

SEQ ID NO: 555402 - DNA, 20 bp, mouse
gcgtcaaaaagttgccagag

SEQ ID NO: 555403 - DNA, 20 bp, mouse
gaaaaaataaaaatcgctag

SEQ ID NO: 555404 - DNA, 20 bp, mouse
gcgtccgcagagttgcacat

SEQ ID NO: 555405 - DNA, 20 bp, mouse
gccgcagagttgcacattgg

SEQ ID NO: 555406 - DNA, 20 bp, mouse
gggcgcaggcagtggagacg

SEQ ID NO: 555407 - DNA, 20 bp, mouse
ggcgtctctgccctgcagtc

SEQ ID NO: 555408 - DNA, 20 bp, mouse
gcctccaggagcaagcgact

SEQ ID NO: 555409 - DNA, 20 bp, mouse
gtgcaggccggcgcaggcag

SEQ ID NO: 555410 - DNA, 20 bp, mouse
ggctgatctgccggactgca

SEQ ID NO: 555411 - DNA, 20 bp, mouse
gaggagcaagcgactgggtc

SEQ ID NO: 555412 - DNA, 20 bp, mouse
gctggaggagagagcagtcg

SEQ ID NO: 555413 - DNA, 20 bp, mouse
gggcagtggagacggggctt

SEQ ID NO: 555414 - DNA, 20 bp, mouse
gacagtgcaaaggggaatgg

SEQ ID NO: 555415 - DNA, 20 bp, mouse
gaggctgtgcaggccggcgc

SEQ ID NO: 555416 - DNA, 20 bp, mouse
gagtcggccctggcagaggt

SEQ ID NO: 555417 - DNA, 20 bp, mouse
gcaggaagccgagtcggccc

SEQ ID NO: 555418 - DNA, 20 bp, mouse
gctggttgtgtccgagactg

SEQ ID NO: 555419 - DNA, 20 bp, mouse
gatcacccaagagcccacgt

SEQ ID NO: 555420 - DNA, 20 bp, mouse
gcggagccaggaagccgagt

SEQ ID NO: 555421 - DNA, 20 bp, mouse
ggccgagtcggccctggcag

SEQ ID NO: 555422 - DNA, 20 bp, mouse
gcccaggaggggcagtccca

SEQ ID NO: 555423 - DNA, 20 bp, mouse
gcttcctggctccgcagtct

SEQ ID NO: 555424 - DNA, 20 bp, mouse
gctgtctgctagctgggata

SEQ ID NO: 555425 - DNA, 20 bp, mouse
ggaaaataaactcccaggag

SEQ ID NO: 555426 - DNA, 20 bp, mouse
gcggtcggtctgcagtatgg

SEQ ID NO: 555427 - DNA, 20 bp, mouse
gggtctgcagtatggcggca

SEQ ID NO: 555428 - DNA, 20 bp, mouse
ggctagacacagcactcgca

SEQ ID NO: 555429 - DNA, 20 bp, mouse
gttccggtcggtctgcagta

SEQ ID NO: 555430 - DNA, 20 bp, mouse
gcagcgctccggtcttctca

SEQ ID NO: 555431 - DNA, 20 bp, mouse
gaggcgctaggtgagaactg

SEQ ID NO: 555432 - DNA, 20 bp, mouse
gagggttcgtgtccagactc

SEQ ID NO: 555433 - DNA, 20 bp, mouse
gtcccaggcggaagtagaac

SEQ ID NO: 555434 - DNA, 20 bp, mouse
gtaggtgagaactgaggtcc

SEQ ID NO: 555435 - DNA, 20 bp, mouse
ggggaaggcctgcttccggt

SEQ ID NO: 555436 - DNA, 20 bp, mouse
gttcctcctgaaacgtagag

SEQ ID NO: 555437 - DNA, 20 bp, mouse
gagcctctctacgtttcagg

SEQ ID NO: 555438 - DNA, 20 bp, mouse
gtcagcttgtccttgctgat

SEQ ID NO: 555439 - DNA, 20 bp, mouse
ggcttctcttgtattcccaa

SEQ ID NO: 555440 - DNA, 20 bp, mouse
gtgaaacgtagagaggctga

SEQ ID NO: 555441 - DNA, 20 bp, mouse
gcaaataagtggccaatcct

SEQ ID NO: 555442 - DNA, 20 bp, mouse
gaaactaggagaaaatactt

SEQ ID NO: 555443 - DNA, 20 bp, mouse
gacaagctgattttaatatt

SEQ ID NO: 555444 - DNA, 20 bp, mouse
gtgctccatggaagaatacc

SEQ ID NO: 555445 - DNA, 20 bp, mouse
gttaccaactgacctaggat

SEQ ID NO: 555446 - DNA, 20 bp, mouse
gccaggcagttgagatgggg

SEQ ID NO: 555447 - DNA, 20 bp, mouse
gcctggactatgtcattgct

SEQ ID NO: 555448 - DNA, 20 bp, mouse
gaaggcacctgtggaggaag

SEQ ID NO: 555449 - DNA, 20 bp, mouse
gctcaactgcctggtagctc

SEQ ID NO: 555450 - DNA, 20 bp, mouse
gagcatgaaaaccaccaggt

SEQ ID NO: 555451 - DNA, 20 bp, mouse
gaagacaaactgctatctcc

SEQ ID NO: 555452 - DNA, 20 bp, mouse
gtcatgcttgggcttcatct

SEQ ID NO: 555453 - DNA, 20 bp, mouse
gaaaagaaaggcacctgtgg

SEQ ID NO: 555454 - DNA, 20 bp, mouse
ggggcagtagttctccaacc

SEQ ID NO: 555455 - DNA, 20 bp, mouse
gagccccaggtttctctgct

SEQ ID NO: 555456 - DNA, 20 bp, mouse
gtcctcaaagaatctaagaa

SEQ ID NO: 555457 - DNA, 20 bp, mouse
gggattgcagactgcctcaa

SEQ ID NO: 555458 - DNA, 20 bp, mouse
gtctccactcctccctaagg

SEQ ID NO: 555459 - DNA, 20 bp, mouse
gcctgcttggtgtacttccc

SEQ ID NO: 555460 - DNA, 20 bp, mouse
gtgtacttcccaggagatgc

SEQ ID NO: 555461 - DNA, 20 bp, mouse
ggttacagtccctccccctt

SEQ ID NO: 555462 - DNA, 20 bp, mouse
gaggtaaaagttacgtccat

SEQ ID NO: 555463 - DNA, 20 bp, mouse
gaaagttacgtccataggtg

SEQ ID NO: 555464 - DNA, 20 bp, mouse
gcactcctccctaaggggga

SEQ ID NO: 555465 - DNA, 20 bp, mouse
gaggagacagtaagagcata

SEQ ID NO: 555466 - DNA, 20 bp, mouse
ggggacgccagtcgagctaa

SEQ ID NO: 555467 - DNA, 20 bp, mouse
gagctcgactggcgtccccg

SEQ ID NO: 555468 - DNA, 20 bp, mouse
gcagtcgagctaaaggacgc

SEQ ID NO: 555469 - DNA, 20 bp, mouse
gagggtgcagccaggtgcac

SEQ ID NO: 555470 - DNA, 20 bp, mouse
ggacttcgcgagcagccgcg

SEQ ID NO: 555471 - DNA, 20 bp, mouse
gcctggctgcaccctctctg

SEQ ID NO: 555472 - DNA, 20 bp, mouse
gcttaggacagagtgtacca

SEQ ID NO: 555473 - DNA, 20 bp, mouse
ggggttgaggcgcgggaata

SEQ ID NO: 555474 - DNA, 20 bp, mouse
gaagtgcgagctggacggac

SEQ ID NO: 555475 - DNA, 20 bp, mouse
gccgcgcctcaaccccgatc

SEQ ID NO: 555476 - DNA, 20 bp, mouse
gcgcgcgtgagaccacgccg

SEQ ID NO: 555477 - DNA, 20 bp, mouse
gtcataaggtggaatagaaa

SEQ ID NO: 555478 - DNA, 20 bp, mouse
ggagctcccggatgacaaaa

SEQ ID NO: 555479 - DNA, 20 bp, mouse
gcacgcgcgatttaaggcat

SEQ ID NO: 555480 - DNA, 20 bp, mouse
ggcaggctaggcgggaaggt

SEQ ID NO: 555481 - DNA, 20 bp, mouse
gcgagtaacctggagtgagg

SEQ ID NO: 555482 - DNA, 20 bp, mouse
gcaggttactcgcagcctcc

SEQ ID NO: 555483 - DNA, 20 bp, mouse
gtggtctcacgcgcgattta

SEQ ID NO: 555484 - DNA, 20 bp, mouse
gccggggaaaaagtttcata

SEQ ID NO: 555485 - DNA, 20 bp, mouse
gaaaaggcaccaggaaactt

SEQ ID NO: 555486 - DNA, 20 bp, mouse
gaagactgccgcagcgacgg

SEQ ID NO: 555487 - DNA, 20 bp, mouse
gtcggcccctccgggctccc

SEQ ID NO: 555488 - DNA, 20 bp, mouse
gagctgctttcggcccctcc

SEQ ID NO: 555489 - DNA, 20 bp, mouse
gccgaagactgccgcagcga

SEQ ID NO: 555490 - DNA, 20 bp, mouse
ggcagcagcgccggggagcc

SEQ ID NO: 555491 - DNA, 20 bp, mouse
ggctgcggcagtcttcgggc

SEQ ID NO: 555492 - DNA, 20 bp, mouse
gcaggtcaaaaatcaaggta

SEQ ID NO: 555493 - DNA, 20 bp, mouse
gcgagccggacgccagggcg

SEQ ID NO: 555494 - DNA, 20 bp, mouse
ggcgcaggggacaggtcact

SEQ ID NO: 555495 - DNA, 20 bp, mouse
gccacgggcggcgtcagaca

SEQ ID NO: 555496 - DNA, 20 bp, mouse
gtaccgaacgctggggtcgt

SEQ ID NO: 555497 - DNA, 20 bp, mouse
gtggcgaggaatttagtgtg

SEQ ID NO: 555498 - DNA, 20 bp, mouse
gggaaccttaccgaacgctg

SEQ ID NO: 555499 - DNA, 20 bp, mouse
gttccctcttcccggcaaga

SEQ ID NO: 555500 - DNA, 20 bp, mouse
gtcttcccggcaagatggcg

SEQ ID NO: 555501 - DNA, 20 bp, mouse
ggtcgcgtgagggcaccacc

SEQ ID NO: 555502 - DNA, 20 bp, mouse
gaaaccaggccaccaacccc

SEQ ID NO: 555503 - DNA, 20 bp, mouse
gaggccccgaagccatgcac

SEQ ID NO: 555504 - DNA, 20 bp, mouse
gagcatccccgcgctttgga

SEQ ID NO: 555505 - DNA, 20 bp, mouse
gctcctacgaccccagcgtt

SEQ ID NO: 555506 - DNA, 20 bp, mouse
gcaccggctaagaagagaga

SEQ ID NO: 555507 - DNA, 20 bp, mouse
ggcgccgagccgaagcccag

SEQ ID NO: 555508 - DNA, 20 bp, mouse
ggaaggcaaggcgagcggta

SEQ ID NO: 555509 - DNA, 20 bp, mouse
ggaccagaggcggtggagat

SEQ ID NO: 555510 - DNA, 20 bp, mouse
gagagagaaggcaaggcgag

SEQ ID NO: 555511 - DNA, 20 bp, mouse
gcacccggggccgaagatgg

SEQ ID NO: 555512 - DNA, 20 bp, mouse
gatgccagatccccgaccag

SEQ ID NO: 555513 - DNA, 20 bp, mouse
ggcaaggcgagcggtagggc

SEQ ID NO: 555514 - DNA, 20 bp, mouse
gtgcgagtgctggttgcccg

SEQ ID NO: 555515 - DNA, 20 bp, mouse
gccagatccccgaccagagg

SEQ ID NO: 555516 - DNA, 20 bp, mouse
gccgtggccgtggacgatgg

SEQ ID NO: 555517 - DNA, 20 bp, mouse
ggccccgtggccgtggacga

SEQ ID NO: 555518 - DNA, 20 bp, mouse
gtcagcgccgccatcgtcca

SEQ ID NO: 555519 - DNA, 20 bp, mouse
ggtggggcagcgcgggtggt

SEQ ID NO: 555520 - DNA, 20 bp, mouse
gtgctctgcaaaggtgaacc

SEQ ID NO: 555521 - DNA, 20 bp, mouse
gaatgtgcactgctctgcaa

SEQ ID NO: 555522 - DNA, 20 bp, mouse
gggtggagggcgtcaaggac

SEQ ID NO: 555523 - DNA, 20 bp, mouse
ggctgggagccccgtggccg

SEQ ID NO: 555524 - DNA, 20 bp, mouse
gatgacgccgcagggaactt

SEQ ID NO: 555525 - DNA, 20 bp, mouse
gacgggtctaccgtcatgct

SEQ ID NO: 555526 - DNA, 20 bp, mouse
gcccggagctgggagcccga

SEQ ID NO: 555527 - DNA, 20 bp, mouse
ggtggggcagcgcaggtcgt

SEQ ID NO: 555528 - DNA, 20 bp, mouse
ggctgggagcccgatggctg

SEQ ID NO: 555529 - DNA, 20 bp, mouse
ggggcagcgcaggtcgtggg

SEQ ID NO: 555530 - DNA, 20 bp, mouse
gagaaagaccaggtgcactt

SEQ ID NO: 555531 - DNA, 20 bp, mouse
gcgccatcttccacagccat

SEQ ID NO: 555532 - DNA, 20 bp, mouse
gggtggagggcgtcaaggat

SEQ ID NO: 555533 - DNA, 20 bp, mouse
gatgacgccgcagggaactc

SEQ ID NO: 555534 - DNA, 20 bp, mouse
gatgggtcgaccgtcatgct

SEQ ID NO: 555535 - DNA, 20 bp, mouse
ggagagcagagaccccacgt

SEQ ID NO: 555536 - DNA, 20 bp, mouse
gaggaggccttggacatacg

SEQ ID NO: 555537 - DNA, 20 bp, mouse
ggaagacagccagactaacc

SEQ ID NO: 555538 - DNA, 20 bp, mouse
gtcccggagccgtggactcc

SEQ ID NO: 555539 - DNA, 20 bp, mouse
gccgggaaacggtctttagg

SEQ ID NO: 555540 - DNA, 20 bp, mouse
gggacttccccgtatgtcca

SEQ ID NO: 555541 - DNA, 20 bp, mouse
gtctggctgtcttctagtat

SEQ ID NO: 555542 - DNA, 20 bp, mouse
ggctccgggaaacggtcttt

SEQ ID NO: 555543 - DNA, 20 bp, mouse
gacctggagtccacggctcc

SEQ ID NO: 555544 - DNA, 20 bp, mouse
gctcccgagccatgcaaggt

SEQ ID NO: 555545 - DNA, 20 bp, mouse
gcacagggagtcaacatctt

SEQ ID NO: 555546 - DNA, 20 bp, mouse
gggcagccgcaccagctatg

SEQ ID NO: 555547 - DNA, 20 bp, mouse
ggcagcggcgaccccatagc

SEQ ID NO: 555548 - DNA, 20 bp, mouse
gtccccaagctccttggctc

SEQ ID NO: 555549 - DNA, 20 bp, mouse
ggggccccagacgagttagt

SEQ ID NO: 555550 - DNA, 20 bp, mouse
gcgctgcagaccctgtcccg

SEQ ID NO: 555551 - DNA, 20 bp, mouse
ggccggagccaaggagcttg

SEQ ID NO: 555552 - DNA, 20 bp, mouse
gacccggcctccccgggaca

SEQ ID NO: 555553 - DNA, 20 bp, mouse
gtgcagaccctgtcccgggg

SEQ ID NO: 555554 - DNA, 20 bp, mouse
gagcagggaagggaacccga

SEQ ID NO: 555555 - DNA, 20 bp, mouse
gggtgcggctgccggagcca

SEQ ID NO: 555556 - DNA, 20 bp, mouse
gtgtcctctgaagtcagcta

SEQ ID NO: 555557 - DNA, 20 bp, mouse
gcctctgaagtcagctatgg

SEQ ID NO: 555558 - DNA, 20 bp, mouse
gtccggggcccggggagttt

SEQ ID NO: 555559 - DNA, 20 bp, mouse
ggaggctacgccctcttgaa

SEQ ID NO: 555560 - DNA, 20 bp, mouse
gagcgctgtgggccgagaac

SEQ ID NO: 555561 - DNA, 20 bp, mouse
ggctacgccctcttgaaagg

SEQ ID NO: 555562 - DNA, 20 bp, mouse
gaccaagatctgcaagacag

SEQ ID NO: 555563 - DNA, 20 bp, mouse
gacattaaaagaattggcgg

SEQ ID NO: 555564 - DNA, 20 bp, mouse
gcaaccggggtatcagaaag

SEQ ID NO: 555565 - DNA, 20 bp, mouse
gtggcggttacgtcagtccg

SEQ ID NO: 555566 - DNA, 20 bp, mouse
ggcgagccagctgctagggc

SEQ ID NO: 555567 - DNA, 20 bp, mouse
gggacaccagccctagcagc

SEQ ID NO: 555568 - DNA, 20 bp, mouse
gcacgtaggtccccagggga

SEQ ID NO: 555569 - DNA, 20 bp, mouse
ggttgccgtggtggatgaga

SEQ ID NO: 555570 - DNA, 20 bp, mouse
gtcatccaccacggcaactt

SEQ ID NO: 555571 - DNA, 20 bp, mouse
gagcaaaggctgcgcacaca

SEQ ID NO: 555572 - DNA, 20 bp, mouse
ggtagcccaagttgccgtgg

SEQ ID NO: 555573 - DNA, 20 bp, mouse
gctcagtgcaaaactcacgt

SEQ ID NO: 555574 - DNA, 20 bp, mouse
gttggtgcgagccagctgct

SEQ ID NO: 555575 - DNA, 20 bp, mouse
gaaactcacgtaggtcccca

SEQ ID NO: 555576 - DNA, 20 bp, mouse
ggagaagcgcgggactccgg

SEQ ID NO: 555577 - DNA, 20 bp, mouse
ggcgccgagctgcagagcga

SEQ ID NO: 555578 - DNA, 20 bp, mouse
gcgcccggccccaccgagag

SEQ ID NO: 555579 - DNA, 20 bp, mouse
gtaccaagagccatccgcgg

SEQ ID NO: 555580 - DNA, 20 bp, mouse
ggagccatccgcggcggggg

SEQ ID NO: 555581 - DNA, 20 bp, mouse
gctcttggtagcttccacgc

SEQ ID NO: 555582 - DNA, 20 bp, mouse
gcaagagccatccgcggcgg

SEQ ID NO: 555583 - DNA, 20 bp, mouse
gagaccccggagggtaggac

SEQ ID NO: 555584 - DNA, 20 bp, mouse
gcagagcgacggccacgagc

SEQ ID NO: 555585 - DNA, 20 bp, mouse
ggagctggaggcgaccacgc

SEQ ID NO: 555586 - DNA, 20 bp, mouse
ggccgcggcccagagaaccg

SEQ ID NO: 555587 - DNA, 20 bp, mouse
ggccgccgccgagcccccac

SEQ ID NO: 555588 - DNA, 20 bp, mouse
gcgtccggactcccccgaca

SEQ ID NO: 555589 - DNA, 20 bp, mouse
gtcggcccgggacggaccat

SEQ ID NO: 555590 - DNA, 20 bp, mouse
gccatcggccgccctgtcgg

SEQ ID NO: 555591 - DNA, 20 bp, mouse
ggccgccgagcccccacagg

SEQ ID NO: 555592 - DNA, 20 bp, mouse
gagagaaccgaggcgacggg

SEQ ID NO: 555593 - DNA, 20 bp, mouse
ggaaccgaggcgacgggcgg

SEQ ID NO: 555594 - DNA, 20 bp, mouse
gctcctccttcggcccggga

SEQ ID NO: 555595 - DNA, 20 bp, mouse
gcccagagaaccgaggcgac

SEQ ID NO: 555596 - DNA, 20 bp, mouse
gacaggggctctggaatcat

SEQ ID NO: 555597 - DNA, 20 bp, mouse
ggcttcaaatggactgggag

SEQ ID NO: 555598 - DNA, 20 bp, mouse
gccagagcccctgtgacatc

SEQ ID NO: 555599 - DNA, 20 bp, mouse
gaggtagcttcaaatggact

SEQ ID NO: 555600 - DNA, 20 bp, mouse
gcaaatcaatgacttacgaa

SEQ ID NO: 555601 - DNA, 20 bp, mouse
gatgatgatcataacatctg

SEQ ID NO: 555602 - DNA, 20 bp, mouse
ggacagagcttgagaagacg

SEQ ID NO: 555603 - DNA, 20 bp, mouse
ggtaagcaggtagcttcaaa

SEQ ID NO: 555604 - DNA, 20 bp, mouse
gtcaaaacacaggtaagtaa

SEQ ID NO: 555605 - DNA, 20 bp, mouse
ggcttgagaagacgtggtcg

SEQ ID NO: 555606 - DNA, 20 bp, mouse
gactcggtgggcgcccgcaa

SEQ ID NO: 555607 - DNA, 20 bp, mouse
ggtgcgcatgcgcactcggt

SEQ ID NO: 555608 - DNA, 20 bp, mouse
ggtgactgcagtgtgcaccc

SEQ ID NO: 555609 - DNA, 20 bp, mouse
gccacccctaccctgaaacc

SEQ ID NO: 555610 - DNA, 20 bp, mouse
gagtgtgcacccgggtttca

SEQ ID NO: 555611 - DNA, 20 bp, mouse
ggcccgcaaaggcttgtttc

SEQ ID NO: 555612 - DNA, 20 bp, mouse
gtgcacccgggtttcagggt

SEQ ID NO: 555613 - DNA, 20 bp, mouse
gagtgtggactgagtccatg

SEQ ID NO: 555614 - DNA, 20 bp, mouse
gtcagcgttaggagctctca

SEQ ID NO: 555615 - DNA, 20 bp, mouse
gaggatgccccctgtagggt

SEQ ID NO: 555616 - DNA, 20 bp, mouse
gagtagatctcgagctgtgg

SEQ ID NO: 555617 - DNA, 20 bp, mouse
gtggctgcttgtgtcgggta

SEQ ID NO: 555618 - DNA, 20 bp, mouse
gtggagtagatctcgagctg

SEQ ID NO: 555619 - DNA, 20 bp, mouse
ggtacaaggggccgagccag

SEQ ID NO: 555620 - DNA, 20 bp, mouse
gaggctgtgcaattatctct

SEQ ID NO: 555621 - DNA, 20 bp, mouse
gttggggtacggggtacaag

SEQ ID NO: 555622 - DNA, 20 bp, mouse
gccggacactagtaaccaaa

SEQ ID NO: 555623 - DNA, 20 bp, mouse
gaggccggttgcgaacgttg

SEQ ID NO: 555624 - DNA, 20 bp, mouse
gtttatctaccgtaaaaaga

SEQ ID NO: 555625 - DNA, 20 bp, mouse
gggttgcgaacgttggggta

SEQ ID NO: 555626 - DNA, 20 bp, mouse
gctgcgtgtcggcaggtgga

SEQ ID NO: 555627 - DNA, 20 bp, mouse
gccacccgaaccccaagcac

SEQ ID NO: 555628 - DNA, 20 bp, mouse
gacgtcagcgcgctgcgtgt

SEQ ID NO: 555629 - DNA, 20 bp, mouse
ggttcgggtggagggcggga

SEQ ID NO: 555630 - DNA, 20 bp, mouse
ggtcaagcgcggccccgagg

SEQ ID NO: 555631 - DNA, 20 bp, mouse
ggagccggccttaacctccg

SEQ ID NO: 555632 - DNA, 20 bp, mouse
gcgcgctgcgtgtcggcagg

SEQ ID NO: 555633 - DNA, 20 bp, mouse
gcagcgcgctgcgtgtcggc

SEQ ID NO: 555634 - DNA, 20 bp, mouse
gccaaggctgggccaagcgg

SEQ ID NO: 555635 - DNA, 20 bp, mouse
gctgccctggtccatcaaca

SEQ ID NO: 555636 - DNA, 20 bp, mouse
gcaggcagcaagcgagactg

SEQ ID NO: 555637 - DNA, 20 bp, mouse
gcccacgcgaggccttggta

SEQ ID NO: 555638 - DNA, 20 bp, mouse
gagactgagcaccatcgcca

SEQ ID NO: 555639 - DNA, 20 bp, mouse
gggcctcgcgtgggaaccca

SEQ ID NO: 555640 - DNA, 20 bp, mouse
gcgccagaacgggaagggaa

SEQ ID NO: 555641 - DNA, 20 bp, mouse
gctggggcaggccatggcga

SEQ ID NO: 555642 - DNA, 20 bp, mouse
ggtgcgggaatgctctctgt

SEQ ID NO: 555643 - DNA, 20 bp, mouse
gtcagtctgagatccgctgt

SEQ ID NO: 555644 - DNA, 20 bp, mouse
gtgagatccgctgtaggtga

SEQ ID NO: 555645 - DNA, 20 bp, mouse
gagcatcgccagaacgggaa

SEQ ID NO: 555646 - DNA, 20 bp, mouse
gtgtggtgcaacttccccgg

SEQ ID NO: 555647 - DNA, 20 bp, mouse
gcaggagccccgacagtcag

SEQ ID NO: 555648 - DNA, 20 bp, mouse
gtctctgaggccatccactg

SEQ ID NO: 555649 - DNA, 20 bp, mouse
gccggtggcaaggcaacttt

SEQ ID NO: 555650 - DNA, 20 bp, mouse
ggctatgccaaagaccccag

SEQ ID NO: 555651 - DNA, 20 bp, mouse
gccgaacctgagggtcctac

SEQ ID NO: 555652 - DNA, 20 bp, mouse
gggtcctacaggtaggtcct

SEQ ID NO: 555653 - DNA, 20 bp, mouse
gggctgggtcctgcgcactg

SEQ ID NO: 555654 - DNA, 20 bp, mouse
gacctgagggtcctacaggt

SEQ ID NO: 555655 - DNA, 20 bp, mouse
gcactgtggtgcaacttccc

SEQ ID NO: 555656 - DNA, 20 bp, mouse
gggagagcagacttctctgg

SEQ ID NO: 555657 - DNA, 20 bp, mouse
ggagaagtctgctctccagg

SEQ ID NO: 555658 - DNA, 20 bp, mouse
gttcactgcttgcatcctgg

SEQ ID NO: 555659 - DNA, 20 bp, mouse
ggtgccagttagctgagagg

SEQ ID NO: 555660 - DNA, 20 bp, mouse
gcagcgggtgtagaatcttg

SEQ ID NO: 555661 - DNA, 20 bp, mouse
gatagccaaggctgaagact

SEQ ID NO: 555662 - DNA, 20 bp, mouse
gccacacaggcgcaacctgg

SEQ ID NO: 555663 - DNA, 20 bp, mouse
gctctcgcaccacatagcca

SEQ ID NO: 555664 - DNA, 20 bp, mouse
ggccggggagaggcagaatg

SEQ ID NO: 555665 - DNA, 20 bp, mouse
ggtgccagcaaggagaggac

SEQ ID NO: 555666 - DNA, 20 bp, mouse
ggccagagttggaggttcgt

SEQ ID NO: 555667 - DNA, 20 bp, mouse
gagccatggtgggccagaag

SEQ ID NO: 555668 - DNA, 20 bp, mouse
ggagttggaggttcgttggt

SEQ ID NO: 555669 - DNA, 20 bp, mouse
gggtgggatctgggttagga

SEQ ID NO: 555670 - DNA, 20 bp, mouse
ggcagccgccgagccatggt

SEQ ID NO: 555671 - DNA, 20 bp, mouse
gaggttcgttggtgggatct

SEQ ID NO: 555672 - DNA, 20 bp, mouse
ggcagtggagtaccggccag

SEQ ID NO: 555673 - DNA, 20 bp, mouse
ggcacggcctctgtggtcaa

SEQ ID NO: 555674 - DNA, 20 bp, mouse
gaaagctgctctgatcaccc

SEQ ID NO: 555675 - DNA, 20 bp, mouse
gctggcccaccatggctcgg

SEQ ID NO: 555676 - DNA, 20 bp, mouse
gccgcccccgcgggaagccg

SEQ ID NO: 555677 - DNA, 20 bp, mouse
gacgagaggccgagagtgtg

SEQ ID NO: 555678 - DNA, 20 bp, mouse
ggtgcagcggccatggccca

SEQ ID NO: 555679 - DNA, 20 bp, mouse
gcttgtggaccgagctcctt

SEQ ID NO: 555680 - DNA, 20 bp, mouse
ggggcgcccgcacaagccca

SEQ ID NO: 555681 - DNA, 20 bp, mouse
gcgggccaagcgccggacca

SEQ ID NO: 555682 - DNA, 20 bp, mouse
ggcacagccccggcttcccg

SEQ ID NO: 555683 - DNA, 20 bp, mouse
gggcgctccagcagctcttg

SEQ ID NO: 555684 - DNA, 20 bp, mouse
gcgcgggggcggccatggtc

SEQ ID NO: 555685 - DNA, 20 bp, mouse
gggcacagtgggcaatcggg

SEQ ID NO: 555686 - DNA, 20 bp, mouse
gagtgtcaagaggagagacg

SEQ ID NO: 555687 - DNA, 20 bp, mouse
gaagaggagagacgaggcac

SEQ ID NO: 555688 - DNA, 20 bp, mouse
gtggcttctagagtgtcaag

SEQ ID NO: 555689 - DNA, 20 bp, mouse
gtggagtgggctgcttaatg

SEQ ID NO: 555690 - DNA, 20 bp, mouse
ggagccagttcctataagcc

SEQ ID NO: 555691 - DNA, 20 bp, mouse
gaccgacttggtagtctcgt

SEQ ID NO: 555692 - DNA, 20 bp, mouse
gttgcctggcttataggaac

SEQ ID NO: 555693 - DNA, 20 bp, mouse
ggctcggttgatgatcccaa

SEQ ID NO: 555694 - DNA, 20 bp, mouse
gctacagttgcctggcttat

SEQ ID NO: 555695 - DNA, 20 bp, mouse
gttcggatggtgggacagaa

SEQ ID NO: 555696 - DNA, 20 bp, mouse
ggcagcgacaaggcgacccg

SEQ ID NO: 555697 - DNA, 20 bp, mouse
gacccgcggtggccacgacg

SEQ ID NO: 555698 - DNA, 20 bp, mouse
gtggccacgacgcggagcag

SEQ ID NO: 555699 - DNA, 20 bp, mouse
gggtggtggtggcagcgaca

SEQ ID NO: 555700 - DNA, 20 bp, mouse
ggcgacaaggcgacccgcgg

SEQ ID NO: 555701 - DNA, 20 bp, mouse
gtccgcgtcgtggccaccgc

SEQ ID NO: 555702 - DNA, 20 bp, mouse
gtgcccggacccggtggtgg

SEQ ID NO: 555703 - DNA, 20 bp, mouse
gacggagcagcagcctgcca

SEQ ID NO: 555704 - DNA, 20 bp, mouse
gtgccaggtcccgacagtct

SEQ ID NO: 555705 - DNA, 20 bp, mouse
gagctcggcccggaaatagg

SEQ ID NO: 555706 - DNA, 20 bp, mouse
ggagcgcccagcctgggatg

SEQ ID NO: 555707 - DNA, 20 bp, mouse
gggtgtcaccgtgtcagcgg

SEQ ID NO: 555708 - DNA, 20 bp, mouse
ggccgcagtcaggctctccg

SEQ ID NO: 555709 - DNA, 20 bp, mouse
gtgcggcgagcgcccagcct

SEQ ID NO: 555710 - DNA, 20 bp, mouse
gtgcggaggcgaggaagaag

SEQ ID NO: 555711 - DNA, 20 bp, mouse
gctgacacggtgacaccacc

SEQ ID NO: 555712 - DNA, 20 bp, mouse
ggaggccgcctccgctgaca

SEQ ID NO: 555713 - DNA, 20 bp, mouse
ggcacacagccagtggctgg

SEQ ID NO: 555714 - DNA, 20 bp, mouse
ggtcaccgtgtcagcggagg

SEQ ID NO: 555715 - DNA, 20 bp, mouse
gagagcagacgcgcagaccc

SEQ ID NO: 555716 - DNA, 20 bp, mouse
gagcagcactcgtgagctgg

SEQ ID NO: 555717 - DNA, 20 bp, mouse
ggttgcagccagcaggaact

SEQ ID NO: 555718 - DNA, 20 bp, mouse
gtcgggtgggcgtctcccag

SEQ ID NO: 555719 - DNA, 20 bp, mouse
ggctgcatcagggtacctta

SEQ ID NO: 555720 - DNA, 20 bp, mouse
gaggccaagaagccatgcat

SEQ ID NO: 555721 - DNA, 20 bp, mouse
ggggtttctggattacaaga

SEQ ID NO: 555722 - DNA, 20 bp, mouse
gtaaccaggaactgtcgggt

SEQ ID NO: 555723 - DNA, 20 bp, mouse
ggactgcagagtctgctgtg

SEQ ID NO: 555724 - DNA, 20 bp, mouse
gcttgccgagggataaaagt

SEQ ID NO: 555725 - DNA, 20 bp, mouse
gagtggtagtctacgtgata

SEQ ID NO: 555726 - DNA, 20 bp, mouse
gcccccgctgcagtcactgg

SEQ ID NO: 555727 - DNA, 20 bp, mouse
gctcacctaggagcagccaa

SEQ ID NO: 555728 - DNA, 20 bp, mouse
gccgcccccgctgcagtcac

SEQ ID NO: 555729 - DNA, 20 bp, mouse
gcagcgtcggcagccccacg

SEQ ID NO: 555730 - DNA, 20 bp, mouse
gctctgttcaggctggactt

SEQ ID NO: 555731 - DNA, 20 bp, mouse
gggatccagagcacgaatta

SEQ ID NO: 555732 - DNA, 20 bp, mouse
ggaaatcggtgtgtttcctt

SEQ ID NO: 555733 - DNA, 20 bp, mouse
gcgccccgcttacctaatgt

SEQ ID NO: 555734 - DNA, 20 bp, mouse
gaccgttcctgctgagaaat

SEQ ID NO: 555735 - DNA, 20 bp, mouse
gcactggctggattctatgt

SEQ ID NO: 555736 - DNA, 20 bp, mouse
gggactgtgagcggggtaca

SEQ ID NO: 555737 - DNA, 20 bp, mouse
gccccgctcacagtccatga

SEQ ID NO: 555738 - DNA, 20 bp, mouse
gcagggtaggtagtacgcca

SEQ ID NO: 555739 - DNA, 20 bp, mouse
ggctgggtctcgagtgcagg

SEQ ID NO: 555740 - DNA, 20 bp, mouse
ggggttgcaaggtagggagt

SEQ ID NO: 555741 - DNA, 20 bp, mouse
gggtagtacgccagggtccg

SEQ ID NO: 555742 - DNA, 20 bp, mouse
gctcgtctccgcgctcggct

SEQ ID NO: 555743 - DNA, 20 bp, mouse
gagcgcgtggcctcggaccc

SEQ ID NO: 555744 - DNA, 20 bp, mouse
gcaacccgggaccttcacca

SEQ ID NO: 555745 - DNA, 20 bp, mouse
gagccttcatggactgtgag

SEQ ID NO: 555746 - DNA, 20 bp, mouse
gagtaaaaaggtacaactct

SEQ ID NO: 555747 - DNA, 20 bp, mouse
gccacaaagttacaggtgct

SEQ ID NO: 555748 - DNA, 20 bp, mouse
ggaaagaaagatctggactg

SEQ ID NO: 555749 - DNA, 20 bp, mouse
gatctcaggattgttacaga

SEQ ID NO: 555750 - DNA, 20 bp, mouse
gtatacttcactttgaactc

SEQ ID NO: 555751 - DNA, 20 bp, mouse
ggagtagtggatgccacaaa

SEQ ID NO: 555752 - DNA, 20 bp, mouse
gctttgtggttctgtttggg

SEQ ID NO: 555753 - DNA, 20 bp, mouse
gtgttacaatagcagtatga

SEQ ID NO: 555754 - DNA, 20 bp, mouse
ggctttctatacagttgaca

SEQ ID NO: 555755 - DNA, 20 bp, mouse
gtctaggtttgagctcttaa

SEQ ID NO: 555756 - DNA, 20 bp, mouse
ggcactgtgaccctggatac

SEQ ID NO: 555757 - DNA, 20 bp, mouse
gggacactttcccgtatcca

SEQ ID NO: 555758 - DNA, 20 bp, mouse
gtaacagtcctggacatgaa

SEQ ID NO: 555759 - DNA, 20 bp, mouse
ggttacagtaaaaaagctga

SEQ ID NO: 555760 - DNA, 20 bp, mouse
gtttgaaggactgacagagt

SEQ ID NO: 555761 - DNA, 20 bp, mouse
gaatccaagcatgggttcaa

SEQ ID NO: 555762 - DNA, 20 bp, mouse
gttcaaaggaaatctgacac

SEQ ID NO: 555763 - DNA, 20 bp, mouse
gctacacatgtagattaatg

SEQ ID NO: 555764 - DNA, 20 bp, mouse
gtcatttgctgtcacacagc

SEQ ID NO: 555765 - DNA, 20 bp, mouse
gtagctgattcagcagattg

SEQ ID NO: 555766 - DNA, 20 bp, mouse
gtacttcacaagctattcgt

SEQ ID NO: 555767 - DNA, 20 bp, mouse
gagcaccaatcactacacgg

SEQ ID NO: 555768 - DNA, 20 bp, mouse
ggcaagcaccaatcactaca

SEQ ID NO: 555769 - DNA, 20 bp, mouse
gtgctatttggacttcacaa

SEQ ID NO: 555770 - DNA, 20 bp, mouse
gcacataagcaggcatacaa

SEQ ID NO: 555771 - DNA, 20 bp, mouse
ggtcaccgccgtgtagtgat

SEQ ID NO: 555772 - DNA, 20 bp, mouse
gtataatattctgtaatcac

SEQ ID NO: 555773 - DNA, 20 bp, mouse
gtactcttacatcttaaatt

SEQ ID NO: 555774 - DNA, 20 bp, mouse
gtacaaaggaaggtaaacaa

SEQ ID NO: 555775 - DNA, 20 bp, mouse
gcacaagggtagacattaac

SEQ ID NO: 555776 - DNA, 20 bp, mouse
gacgtgaaggagttcatgta

SEQ ID NO: 555777 - DNA, 20 bp, mouse
gcaggcatcagtgtgtctgg

SEQ ID NO: 555778 - DNA, 20 bp, mouse
gagtgtgtctggaggacagc

SEQ ID NO: 555779 - DNA, 20 bp, mouse
gtgatgcctgggctacggat

SEQ ID NO: 555780 - DNA, 20 bp, mouse
gcctgggctacggatgggga

SEQ ID NO: 555781 - DNA, 20 bp, mouse
ggatggggacggggacgcaa

SEQ ID NO: 555782 - DNA, 20 bp, mouse
gcacactgatgcctgggcta

SEQ ID NO: 555783 - DNA, 20 bp, mouse
gctaagacacaagcaccagg

SEQ ID NO: 555784 - DNA, 20 bp, mouse
gaggaagaaatcagaactta

SEQ ID NO: 555785 - DNA, 20 bp, mouse
gaacttgcaactgtagggag

SEQ ID NO: 555786 - DNA, 20 bp, mouse
gactcgggcaccaggaacag

SEQ ID NO: 555787 - DNA, 20 bp, mouse
gctgcgctggtcccctccaa

SEQ ID NO: 555788 - DNA, 20 bp, mouse
gaccctgcgccactcggcat

SEQ ID NO: 555789 - DNA, 20 bp, mouse
ggaacagcggcggcagccct

SEQ ID NO: 555790 - DNA, 20 bp, mouse
gagcgcagcggggaggtgag

SEQ ID NO: 555791 - DNA, 20 bp, mouse
gagcggcggcagcccttgga

SEQ ID NO: 555792 - DNA, 20 bp, mouse
gtgtactgcgcaaaactggg

SEQ ID NO: 555793 - DNA, 20 bp, mouse
gggtgagaggtgcttcctag

SEQ ID NO: 555794 - DNA, 20 bp, mouse
gttggtgtccgctcccctct

SEQ ID NO: 555795 - DNA, 20 bp, mouse
gggaggggaccagcgcagcg

SEQ ID NO: 555796 - DNA, 20 bp, mouse
gagcttcaagggcaccgggt

SEQ ID NO: 555797 - DNA, 20 bp, mouse
gccgggtaggagtcttgtca

SEQ ID NO: 555798 - DNA, 20 bp, mouse
ggagtcttgtcaaggttcct

SEQ ID NO: 555799 - DNA, 20 bp, mouse
gtgtcaaggttcctaggcaa

SEQ ID NO: 555800 - DNA, 20 bp, mouse
gcaaggttcctaggcaaggg

SEQ ID NO: 555801 - DNA, 20 bp, mouse
gaagggtgacagagtcagct

SEQ ID NO: 555802 - DNA, 20 bp, mouse
gggctcagggaggcagtcaa

SEQ ID NO: 555803 - DNA, 20 bp, mouse
gcaccgggacagagctgtgg

SEQ ID NO: 555804 - DNA, 20 bp, mouse
ggctagctgaagagggtgga

SEQ ID NO: 555805 - DNA, 20 bp, mouse
ggaacctggctagctgaaga

SEQ ID NO: 555806 - DNA, 20 bp, mouse
gcccagactcctgcactctg

SEQ ID NO: 555807 - DNA, 20 bp, mouse
gaagaactgcctggtggcag

SEQ ID NO: 555808 - DNA, 20 bp, mouse
ggtggggaggtggaatactg

SEQ ID NO: 555809 - DNA, 20 bp, mouse
gctggggcacaagaactgcc

SEQ ID NO: 555810 - DNA, 20 bp, mouse
gtaactgggactaccaggag

SEQ ID NO: 555811 - DNA, 20 bp, mouse
ggtgcacagcgggcaaacac

SEQ ID NO: 555812 - DNA, 20 bp, mouse
gtgttgtgcagcctagttct

SEQ ID NO: 555813 - DNA, 20 bp, mouse
gtctgggcagaacttggtag

SEQ ID NO: 555814 - DNA, 20 bp, mouse
gtagcttgctccagttctca

SEQ ID NO: 555815 - DNA, 20 bp, mouse
ggcacagaggcctggagtgg

SEQ ID NO: 555816 - DNA, 20 bp, mouse
ggcggcagggagctagctag

SEQ ID NO: 555817 - DNA, 20 bp, mouse
ggcctgctggcagtgcgact

SEQ ID NO: 555818 - DNA, 20 bp, mouse
gcagcaggctgagggcggca

SEQ ID NO: 555819 - DNA, 20 bp, mouse
gtcctctcggggagacccgg

SEQ ID NO: 555820 - DNA, 20 bp, mouse
gcgcactgccagcaggctga

SEQ ID NO: 555821 - DNA, 20 bp, mouse
ggctagctagcggggactgc

SEQ ID NO: 555822 - DNA, 20 bp, mouse
ggaaggcgacagctcggctc

SEQ ID NO: 555823 - DNA, 20 bp, mouse
gcagtgcgactgggcagtag

SEQ ID NO: 555824 - DNA, 20 bp, mouse
gccggccagaggcaggacgg

SEQ ID NO: 555825 - DNA, 20 bp, mouse
gggaagctgggagagcgccg

SEQ ID NO: 555826 - DNA, 20 bp, mouse
gcagcccggcgacgaccctg

SEQ ID NO: 555827 - DNA, 20 bp, mouse
gaggtgagcgcgggtccgca

SEQ ID NO: 555828 - DNA, 20 bp, mouse
gcgggaggttctggaaacgc

SEQ ID NO: 555829 - DNA, 20 bp, mouse
gctaacagtaccggcaggaa

SEQ ID NO: 555830 - DNA, 20 bp, mouse
gcggcccggcctaacagtac

SEQ ID NO: 555831 - DNA, 20 bp, mouse
gacctcaccgccctaaccct

SEQ ID NO: 555832 - DNA, 20 bp, mouse
gtcccttcccagggttaggg

SEQ ID NO: 555833 - DNA, 20 bp, mouse
ggttagggcggtgaggtcag

SEQ ID NO: 555834 - DNA, 20 bp, mouse
gcgggcggagactgtgacga

SEQ ID NO: 555835 - DNA, 20 bp, mouse
ggcgacgccgcgggaggttc

SEQ ID NO: 555836 - DNA, 20 bp, mouse
gggacgacaagatcagacgt

SEQ ID NO: 555837 - DNA, 20 bp, mouse
ggcctgctttctggagaggt

SEQ ID NO: 555838 - DNA, 20 bp, mouse
gtagccacacggtactgtca

SEQ ID NO: 555839 - DNA, 20 bp, mouse
gttctgcctgctttctggag

SEQ ID NO: 555840 - DNA, 20 bp, mouse
ggggttcccccttatctcag

SEQ ID NO: 555841 - DNA, 20 bp, mouse
ggaaccctgacagtaccgtg

SEQ ID NO: 555842 - DNA, 20 bp, mouse
ggcctacctctccagaaagc

SEQ ID NO: 555843 - DNA, 20 bp, mouse
gtgatgagaggggatagcag

SEQ ID NO: 555844 - DNA, 20 bp, mouse
gaccgtgtggctatttctag

SEQ ID NO: 555845 - DNA, 20 bp, mouse
gctattgtctgcatctgtgc

SEQ ID NO: 555846 - DNA, 20 bp, mouse
ggaccctgcgatgggcccag

SEQ ID NO: 555847 - DNA, 20 bp, mouse
gccaggtgagggcgtctcca

SEQ ID NO: 555848 - DNA, 20 bp, mouse
ggcgcgacttgaccaggtga

SEQ ID NO: 555849 - DNA, 20 bp, mouse
gcgcccctgggcccatcgca

SEQ ID NO: 555850 - DNA, 20 bp, mouse
ggcgctcgggggagaccccg

SEQ ID NO: 555851 - DNA, 20 bp, mouse
gggacgcgcgaccctgcgat

SEQ ID NO: 555852 - DNA, 20 bp, mouse
ggcggctgcgcgacttgacc

SEQ ID NO: 555853 - DNA, 20 bp, mouse
gtgagggtgaggagtaactg

SEQ ID NO: 555854 - DNA, 20 bp, mouse
gcagagccagccgcgcccct

SEQ ID NO: 555855 - DNA, 20 bp, mouse
gagcctgcgctcgggcgcca

SEQ ID NO: 555856 - DNA, 20 bp, mouse
gggctaggcacagcaaagca

SEQ ID NO: 555857 - DNA, 20 bp, mouse
gaccctagccgcccaggcca

SEQ ID NO: 555858 - DNA, 20 bp, mouse
ggcatgtcggacgtctgcag

SEQ ID NO: 555859 - DNA, 20 bp, mouse
gtgcagcgggcggggcagtt

SEQ ID NO: 555860 - DNA, 20 bp, mouse
ggtcggacgtctgcagcggg

SEQ ID NO: 555861 - DNA, 20 bp, mouse
gggcgccgccgggacagcca

SEQ ID NO: 555862 - DNA, 20 bp, mouse
gtcctccgggccgccctctg

SEQ ID NO: 555863 - DNA, 20 bp, mouse
ggggccaccgtactcaagag

SEQ ID NO: 555864 - DNA, 20 bp, mouse
gaggcgacgagagcgcgcgt

SEQ ID NO: 555865 - DNA, 20 bp, mouse
gtgctgggtgccgcagaggg

SEQ ID NO: 555866 - DNA, 20 bp, mouse
gcctgaggctgagacagtcg

SEQ ID NO: 555867 - DNA, 20 bp, mouse
gcgcgacctgggcgccatgg

SEQ ID NO: 555868 - DNA, 20 bp, mouse
gagcggtggcgaccgtgcag

SEQ ID NO: 555869 - DNA, 20 bp, mouse
gtcagcctcaggccgctgca

SEQ ID NO: 555870 - DNA, 20 bp, mouse
ggccgagccagaaggaaccg

SEQ ID NO: 555871 - DNA, 20 bp, mouse
gcagcacgttgcccaagtac

SEQ ID NO: 555872 - DNA, 20 bp, mouse
gctgggcgcgcgcgcgacct

SEQ ID NO: 555873 - DNA, 20 bp, mouse
gggaggcctcaaatcttcag

SEQ ID NO: 555874 - DNA, 20 bp, mouse
gcggaagggcgatgctccgg

SEQ ID NO: 555875 - DNA, 20 bp, mouse
gggcgatgctccggtggtag

SEQ ID NO: 555876 - DNA, 20 bp, mouse
ggccatgagaccaagtccac

SEQ ID NO: 555877 - DNA, 20 bp, mouse
ggggagctccacatagtcag

SEQ ID NO: 555878 - DNA, 20 bp, mouse
gaacaggaatgatggcgtag

SEQ ID NO: 555879 - DNA, 20 bp, mouse
gatgggagcccagtgctcta

SEQ ID NO: 555880 - DNA, 20 bp, mouse
gggtatgtggggagccccag

SEQ ID NO: 555881 - DNA, 20 bp, mouse
gctgcctggaacctattccc

SEQ ID NO: 555882 - DNA, 20 bp, mouse
gtaaggctccatagagcact

SEQ ID NO: 555883 - DNA, 20 bp, mouse
gctgacagttgttggttctg

SEQ ID NO: 555884 - DNA, 20 bp, mouse
gagccaccaggccctggatg

SEQ ID NO: 555885 - DNA, 20 bp, mouse
gcatctctgaggcacccctg

SEQ ID NO: 555886 - DNA, 20 bp, mouse
gctcacgaatgctcagggac

SEQ ID NO: 555887 - DNA, 20 bp, mouse
gtagcactgccagggtagag

SEQ ID NO: 555888 - DNA, 20 bp, mouse
gcactgccagggtagagggg

SEQ ID NO: 555889 - DNA, 20 bp, mouse
gtggtcaagtttgggtccga

SEQ ID NO: 555890 - DNA, 20 bp, mouse
gtagagccacccctctaccc

SEQ ID NO: 555891 - DNA, 20 bp, mouse
gcaggcaagtggtcaagttt

SEQ ID NO: 555892 - DNA, 20 bp, mouse
gggatctgactgctgatccc

SEQ ID NO: 555893 - DNA, 20 bp, mouse
gtggcatagaaactcaagta

SEQ ID NO: 555894 - DNA, 20 bp, mouse
gtgatgtgaagtccaggttg

SEQ ID NO: 555895 - DNA, 20 bp, mouse
gtcacagagcacccatgtgt

SEQ ID NO: 555896 - DNA, 20 bp, mouse
ggcatcggtggcaggtaagc

SEQ ID NO: 555897 - DNA, 20 bp, mouse
ggggcgctgcgtcgcatcgg

SEQ ID NO: 555898 - DNA, 20 bp, mouse
ggaaggctgagtgctcgcca

SEQ ID NO: 555899 - DNA, 20 bp, mouse
gctggaggaaccgaatccca

SEQ ID NO: 555900 - DNA, 20 bp, mouse
gggatcagcagaccgattct

SEQ ID NO: 555901 - DNA, 20 bp, mouse
gtctgggcgctgcgtcgcat

SEQ ID NO: 555902 - DNA, 20 bp, mouse
ggcgacgcagcgcccagaat

SEQ ID NO: 555903 - DNA, 20 bp, mouse
gagccgagcttgacgacgga

SEQ ID NO: 555904 - DNA, 20 bp, mouse
gagtgagccgagcttgacga

SEQ ID NO: 555905 - DNA, 20 bp, mouse
gcctgctgcgcgactcctgg

SEQ ID NO: 555906 - DNA, 20 bp, mouse
gagcatggcggctcagaaga

SEQ ID NO: 555907 - DNA, 20 bp, mouse
gcagcgccggggcgagcctg

SEQ ID NO: 555908 - DNA, 20 bp, mouse
gacccttcctcgggccaagg

SEQ ID NO: 555909 - DNA, 20 bp, mouse
gacgtgccgcaggctcgccc

SEQ ID NO: 555910 - DNA, 20 bp, mouse
ggccgggcggatggcatcca

SEQ ID NO: 555911 - DNA, 20 bp, mouse
ggctctccaagaagccgctt

SEQ ID NO: 555912 - DNA, 20 bp, mouse
gagatggacgaagcagcgct

SEQ ID NO: 555913 - DNA, 20 bp, mouse
gcagatgagtctcacctaag

SEQ ID NO: 555914 - DNA, 20 bp, mouse
gtgctctgaccagagcgaga

SEQ ID NO: 555915 - DNA, 20 bp, mouse
ggccgccttggcccgaggaa

SEQ ID NO: 555916 - DNA, 20 bp, mouse
gagcaagcaagggagcggga

SEQ ID NO: 555917 - DNA, 20 bp, mouse
ggcgcgagcaagcaagggag

SEQ ID NO: 555918 - DNA, 20 bp, mouse
gaccgtgagtgcggcctcgg

SEQ ID NO: 555919 - DNA, 20 bp, mouse
gcttggagtcgaggctgaga

SEQ ID NO: 555920 - DNA, 20 bp, mouse
gtgaccaagtataagatggg

SEQ ID NO: 555921 - DNA, 20 bp, mouse
gctacagcctgtggctggga

SEQ ID NO: 555922 - DNA, 20 bp, mouse
ggtagcagtaggaagatgtc

SEQ ID NO: 555923 - DNA, 20 bp, mouse
gggactgagcagccatgcct

SEQ ID NO: 555924 - DNA, 20 bp, mouse
gtgccgagtgagccaccgag

SEQ ID NO: 555925 - DNA, 20 bp, mouse
gcttgctcgcgctttcctcg

SEQ ID NO: 555926 - DNA, 20 bp, mouse
ggcggttagtgctgagagtg

SEQ ID NO: 555927 - DNA, 20 bp, mouse
gtgcttccccttctccccgg

SEQ ID NO: 555928 - DNA, 20 bp, mouse
gagcaggaacccagagaccg

SEQ ID NO: 555929 - DNA, 20 bp, mouse
gtcaacggccgtggaaccgg

SEQ ID NO: 555930 - DNA, 20 bp, mouse
gccgggcggcaggaaggcct

SEQ ID NO: 555931 - DNA, 20 bp, mouse
gtggcggtgctgggtccggg

SEQ ID NO: 555932 - DNA, 20 bp, mouse
gcaggaaggcctcggtctct

SEQ ID NO: 555933 - DNA, 20 bp, mouse
gggaatcgacgcgtactcaa

SEQ ID NO: 555934 - DNA, 20 bp, mouse
gcgggcgggcgggtcggtct

SEQ ID NO: 555935 - DNA, 20 bp, mouse
gaggctggcggtgctgggtc

SEQ ID NO: 555936 - DNA, 20 bp, mouse
ggaacacaagcatccaggaa

SEQ ID NO: 555937 - DNA, 20 bp, mouse
gccgctagggtaagtgtatg

SEQ ID NO: 555938 - DNA, 20 bp, mouse
gtgcttgtgttcacccgcta

SEQ ID NO: 555939 - DNA, 20 bp, mouse
gcgggtgaacacaagcatcc

SEQ ID NO: 555940 - DNA, 20 bp, mouse
gttaaccacacggataggaa

SEQ ID NO: 555941 - DNA, 20 bp, mouse
gatcccttaaccacacggat

SEQ ID NO: 555942 - DNA, 20 bp, mouse
gccagcatggacacagtcag

SEQ ID NO: 555943 - DNA, 20 bp, mouse
gctcctacctgccccggtgg

SEQ ID NO: 555944 - DNA, 20 bp, mouse
ggcaaggtctacacagtcag

SEQ ID NO: 555945 - DNA, 20 bp, mouse
gtgatggccagggacataca

SEQ ID NO: 555946 - DNA, 20 bp, mouse
gctgggctggggcggagaca

SEQ ID NO: 555947 - DNA, 20 bp, mouse
gcgcagaggatcaaaaccaa

SEQ ID NO: 555948 - DNA, 20 bp, mouse
ggcagaacggacaagcgcag

SEQ ID NO: 555949 - DNA, 20 bp, mouse
ggggatgagaacctccccaa

SEQ ID NO: 555950 - DNA, 20 bp, mouse
gctgtggccagccgttgggg

SEQ ID NO: 555951 - DNA, 20 bp, mouse
ggctctgtggccagccgttg

SEQ ID NO: 555952 - DNA, 20 bp, mouse
ggaagagcagggccagcgct

SEQ ID NO: 555953 - DNA, 20 bp, mouse
gggaagcatagcccagggaa

SEQ ID NO: 555954 - DNA, 20 bp, mouse
gcatcgcctcagtcacatca

SEQ ID NO: 555955 - DNA, 20 bp, mouse
gctggccctgctcttctcga

SEQ ID NO: 555956 - DNA, 20 bp, mouse
gagcagcgcccggggcggga

SEQ ID NO: 555957 - DNA, 20 bp, mouse
ggaagggcgcctcgagacct

SEQ ID NO: 555958 - DNA, 20 bp, mouse
gtgcgacccggggcggagag

SEQ ID NO: 555959 - DNA, 20 bp, mouse
gccgggcgctgctggtcgaa

SEQ ID NO: 555960 - DNA, 20 bp, mouse
gcgactgcgcccaggtctcg

SEQ ID NO: 555961 - DNA, 20 bp, mouse
gcatttataccctcccgccc

SEQ ID NO: 555962 - DNA, 20 bp, mouse
ggccccgggggcccaaggcg

SEQ ID NO: 555963 - DNA, 20 bp, mouse
gcgggagggtataaatggag

SEQ ID NO: 555964 - DNA, 20 bp, mouse
gtgatggctgcgacccgggg

SEQ ID NO: 555965 - DNA, 20 bp, mouse
ggagggtataaatggagcgg

SEQ ID NO: 555966 - DNA, 20 bp, mouse
ggagcgagccagaggggcgg

SEQ ID NO: 555967 - DNA, 20 bp, mouse
ggctggggagcgagccagag

SEQ ID NO: 555968 - DNA, 20 bp, mouse
gtcctgcgcgggacagacgg

SEQ ID NO: 555969 - DNA, 20 bp, mouse
ggaggcgcccgggacgatcc

SEQ ID NO: 555970 - DNA, 20 bp, mouse
ggcaggaacccggagctcgc

SEQ ID NO: 555971 - DNA, 20 bp, mouse
ggggaaagaggcggtgtcat

SEQ ID NO: 555972 - DNA, 20 bp, mouse
gtgcggctgagagcccgcct

SEQ ID NO: 555973 - DNA, 20 bp, mouse
ggccaagcctggggagagca

SEQ ID NO: 555974 - DNA, 20 bp, mouse
gccgcctgcagtccataacc

SEQ ID NO: 555975 - DNA, 20 bp, mouse
gactgcaggcggcaggaacc

SEQ ID NO: 555976 - DNA, 20 bp, mouse
gcaggtccggagggactgac

SEQ ID NO: 555977 - DNA, 20 bp, mouse
ggacctgcggagagagcctc

SEQ ID NO: 555978 - DNA, 20 bp, mouse
gctctctccgcaggtccgga

SEQ ID NO: 555979 - DNA, 20 bp, mouse
gactgggtacggaccgagtg

SEQ ID NO: 555980 - DNA, 20 bp, mouse
ggtacggaccgagtgaggcg

SEQ ID NO: 555981 - DNA, 20 bp, mouse
gctgcaagccctcctgacat

SEQ ID NO: 555982 - DNA, 20 bp, mouse
ggagggcttgcagcacacta

SEQ ID NO: 555983 - DNA, 20 bp, mouse
gggctgccagtcagtccctc

SEQ ID NO: 555984 - DNA, 20 bp, mouse
ggctgatgctgaatgcagag

SEQ ID NO: 555985 - DNA, 20 bp, mouse
gagcctgaggctctctccgc

SEQ ID NO: 555986 - DNA, 20 bp, mouse
ggaacagaaggcaaccggaa

SEQ ID NO: 555987 - DNA, 20 bp, mouse
gctggggttcatgtctgcaa

SEQ ID NO: 555988 - DNA, 20 bp, mouse
ggaaggcaaccggaatggaa

SEQ ID NO: 555989 - DNA, 20 bp, mouse
gggacgcgtagcccagcgag

SEQ ID NO: 555990 - DNA, 20 bp, mouse
gagcgaccccagctactctt

SEQ ID NO: 555991 - DNA, 20 bp, mouse
gtcaactgccaagaacccgg

SEQ ID NO: 555992 - DNA, 20 bp, mouse
gcaggaaaggatgttaccaa

SEQ ID NO: 555993 - DNA, 20 bp, mouse
gcgcgtagcccagcgagcgg

SEQ ID NO: 555994 - DNA, 20 bp, mouse
ggcccgtgccgccgacctcc

SEQ ID NO: 555995 - DNA, 20 bp, mouse
ggtgaagccaaagagtagct

SEQ ID NO: 555996 - DNA, 20 bp, mouse
gaccggccccgggcacaaga

SEQ ID NO: 555997 - DNA, 20 bp, mouse
gccagtctgagcggcgatgg

SEQ ID NO: 555998 - DNA, 20 bp, mouse
gcggcgggccccagtctgag

SEQ ID NO: 555999 - DNA, 20 bp, mouse
gggaggcccagagcacggac

SEQ ID NO: 556000 - DNA, 20 bp, mouse
gggacccggagctcccggag

SEQ ID NO: 556001 - DNA, 20 bp, mouse
ggctcgagtcagggagatgg

SEQ ID NO: 556002 - DNA, 20 bp, mouse
gccgagccgggcccaggacc

SEQ ID NO: 556003 - DNA, 20 bp, mouse
gcccctcaccgggtcctcaa

SEQ ID NO: 556004 - DNA, 20 bp, mouse
gggttgggcggggaataacg

SEQ ID NO: 556005 - DNA, 20 bp, mouse
gggcccagagcacggacagg

SEQ ID NO: 556006 - DNA, 20 bp, mouse
ggaggtaagcagacccagag

SEQ ID NO: 556007 - DNA, 20 bp, mouse
gtaggtgaggtaggcgagga

SEQ ID NO: 556008 - DNA, 20 bp, mouse
gcaggtaaggctccatctgt

SEQ ID NO: 556009 - DNA, 20 bp, mouse
gaagcagacccagagaggca

SEQ ID NO: 556010 - DNA, 20 bp, mouse
gtaggcgaggagggcggacc

SEQ ID NO: 556011 - DNA, 20 bp, mouse
gctccatctgtaggtgaggt

SEQ ID NO: 556012 - DNA, 20 bp, mouse
gagagctcattgctcaggta

SEQ ID NO: 556013 - DNA, 20 bp, mouse
ggtgaggtaggcgaggaggg

SEQ ID NO: 556014 - DNA, 20 bp, mouse
gtctgtaggtgaggtaggcg

SEQ ID NO: 556015 - DNA, 20 bp, mouse
gaaggctccatctgtaggtg

SEQ ID NO: 556016 - DNA, 20 bp, mouse
gggaagagggctgggatccg

SEQ ID NO: 556017 - DNA, 20 bp, mouse
gcaaggtggagggagtttag

SEQ ID NO: 556018 - DNA, 20 bp, mouse
gaccgggaggcttacacctt

SEQ ID NO: 556019 - DNA, 20 bp, mouse
gttggcagcaccaaggtgga

SEQ ID NO: 556020 - DNA, 20 bp, mouse
gtctccctgggcagcacgag

SEQ ID NO: 556021 - DNA, 20 bp, mouse
gctcttagagactctagcct

SEQ ID NO: 556022 - DNA, 20 bp, mouse
gcaaacatctggatctccct

SEQ ID NO: 556023 - DNA, 20 bp, mouse
gtccaaaggtgtaagcctcc

SEQ ID NO: 556024 - DNA, 20 bp, mouse
gtaaacagtaccaggaccca

SEQ ID NO: 556025 - DNA, 20 bp, mouse
gcttgttcttatcagaggtg

SEQ ID NO: 556026 - DNA, 20 bp, mouse
gccggaggggagccccacga

SEQ ID NO: 556027 - DNA, 20 bp, mouse
gcagctgtagcagagggctt

SEQ ID NO: 556028 - DNA, 20 bp, mouse
ggaggggagccccacgaggg

SEQ ID NO: 556029 - DNA, 20 bp, mouse
gttggtgcggagagccggag

SEQ ID NO: 556030 - DNA, 20 bp, mouse
gcgctcgccgccgccctcgt

SEQ ID NO: 556031 - DNA, 20 bp, mouse
gccggagccactgtgctcta

SEQ ID NO: 556032 - DNA, 20 bp, mouse
gctgcaggcagcggtgattc

SEQ ID NO: 556033 - DNA, 20 bp, mouse
ggggagccccacgagggcgg

SEQ ID NO: 556034 - DNA, 20 bp, mouse
ggtgagagagccccacaccg

SEQ ID NO: 556035 - DNA, 20 bp, mouse
gccttagcaacaagctccgg

SEQ ID NO: 556036 - DNA, 20 bp, mouse
gcgcgggccgcaacaggcgg

SEQ ID NO: 556037 - DNA, 20 bp, mouse
gcctcgcgggccgcaacagg

SEQ ID NO: 556038 - DNA, 20 bp, mouse
gcccgcgaggcccagacact

SEQ ID NO: 556039 - DNA, 20 bp, mouse
ggccatggcggaacgcggag

SEQ ID NO: 556040 - DNA, 20 bp, mouse
gcggggcttacgcagactga

SEQ ID NO: 556041 - DNA, 20 bp, mouse
ggcagccgaggtggacgagg

SEQ ID NO: 556042 - DNA, 20 bp, mouse
gtcctcccctggccaggcca

SEQ ID NO: 556043 - DNA, 20 bp, mouse
gctcaggcttccccccgcgg

SEQ ID NO: 556044 - DNA, 20 bp, mouse
ggccatggcctggccagggg

SEQ ID NO: 556045 - DNA, 20 bp, mouse
gtgcccaggtgagcaacggg

SEQ ID NO: 556046 - DNA, 20 bp, mouse
ggggcggcggcgcggtcaca

SEQ ID NO: 556047 - DNA, 20 bp, mouse
gcccggagcgctcaacactc

SEQ ID NO: 556048 - DNA, 20 bp, mouse
ggccccaggccgccgaggga

SEQ ID NO: 556049 - DNA, 20 bp, mouse
ggagccgtccacctcccagg

SEQ ID NO: 556050 - DNA, 20 bp, mouse
gcggccccgccgtccctcgg

SEQ ID NO: 556051 - DNA, 20 bp, mouse
gctgcgcagcggacctcagg

SEQ ID NO: 556052 - DNA, 20 bp, mouse
ggcagcacgggggcgtacct

SEQ ID NO: 556053 - DNA, 20 bp, mouse
gcggacaaagcgcagcacgg

SEQ ID NO: 556054 - DNA, 20 bp, mouse
ggggagtccggcaggcccgc

SEQ ID NO: 556055 - DNA, 20 bp, mouse
ggcccgggacgcaggtgtca

SEQ ID NO: 556056 - DNA, 20 bp, mouse
gaccgccgcgcgtctctctg

SEQ ID NO: 556057 - DNA, 20 bp, mouse
ggcagccccagagagacgcg

SEQ ID NO: 556058 - DNA, 20 bp, mouse
gtcaagccaagagcatccgg

SEQ ID NO: 556059 - DNA, 20 bp, mouse
gtgctccggcgcccaggtag

SEQ ID NO: 556060 - DNA, 20 bp, mouse
gaagcccggccggcttcccg

SEQ ID NO: 556061 - DNA, 20 bp, mouse
ggagcaccggacaccatcag

SEQ ID NO: 556062 - DNA, 20 bp, mouse
gtagagcgtggagagagcgc

SEQ ID NO: 556063 - DNA, 20 bp, mouse
gtgggggttcggggagtcca

SEQ ID NO: 556064 - DNA, 20 bp, mouse
gggcggcccagcctcaagcc

SEQ ID NO: 556065 - DNA, 20 bp, mouse
gccccttgaggatgctaagg

SEQ ID NO: 556066 - DNA, 20 bp, mouse
ggagccagagcgcgccggag

SEQ ID NO: 556067 - DNA, 20 bp, mouse
ggcgtctggcgtctggattg

SEQ ID NO: 556068 - DNA, 20 bp, mouse
gtgcccagcccggctcaggt

SEQ ID NO: 556069 - DNA, 20 bp, mouse
ggggcagctctagaagtctg

SEQ ID NO: 556070 - DNA, 20 bp, mouse
gctcccgagccagagcgcgc

SEQ ID NO: 556071 - DNA, 20 bp, mouse
gcccccgctgggccaaacca

SEQ ID NO: 556072 - DNA, 20 bp, mouse
gtccgtggcagcgggcaggg

SEQ ID NO: 556073 - DNA, 20 bp, mouse
gcgggctgggcaccaagcag

SEQ ID NO: 556074 - DNA, 20 bp, mouse
gagagcccctcggacctgta

SEQ ID NO: 556075 - DNA, 20 bp, mouse
ggattggggctcggttctcg

SEQ ID NO: 556076 - DNA, 20 bp, mouse
gaagcggctgcggcgggtct

SEQ ID NO: 556077 - DNA, 20 bp, mouse
gccggggagctcggttggag

SEQ ID NO: 556078 - DNA, 20 bp, mouse
ggagctcggttggagcggaa

SEQ ID NO: 556079 - DNA, 20 bp, mouse
gtcgcggctggcggcagaag

SEQ ID NO: 556080 - DNA, 20 bp, mouse
gcagggccggggagctcggt

SEQ ID NO: 556081 - DNA, 20 bp, mouse
gccccagcgcggcctgacag

SEQ ID NO: 556082 - DNA, 20 bp, mouse
gcggttggagcggaacggga

SEQ ID NO: 556083 - DNA, 20 bp, mouse
ggctgcggcgggtctgggca

SEQ ID NO: 556084 - DNA, 20 bp, mouse
gagtcgcagcccggccgggg

SEQ ID NO: 556085 - DNA, 20 bp, mouse
gtgggacccgaggcgaacgg

SEQ ID NO: 556086 - DNA, 20 bp, mouse
gcctctcaggggccctcggt

SEQ ID NO: 556087 - DNA, 20 bp, mouse
ggcccggacccgggagtggt

SEQ ID NO: 556088 - DNA, 20 bp, mouse
ggggccctcggtgggttagg

SEQ ID NO: 556089 - DNA, 20 bp, mouse
ggatccccctaacccaccga

SEQ ID NO: 556090 - DNA, 20 bp, mouse
ggaggcggtggcccggaccc

SEQ ID NO: 556091 - DNA, 20 bp, mouse
gtcggagtcctaccactccc

SEQ ID NO: 556092 - DNA, 20 bp, mouse
gtaggactccgaactgagcg

SEQ ID NO: 556093 - DNA, 20 bp, mouse
ggatctggccacgctcagtt

SEQ ID NO: 556094 - DNA, 20 bp, mouse
ggaaggggcgctgcctacta

SEQ ID NO: 556095 - DNA, 20 bp, mouse
ggcactcaccgtgtcctctc

SEQ ID NO: 556096 - DNA, 20 bp, mouse
gcatcaagacaggctcatag

SEQ ID NO: 556097 - DNA, 20 bp, mouse
gtagtggcagcttggagact

SEQ ID NO: 556098 - DNA, 20 bp, mouse
gggagaccccaggtatgtag

SEQ ID NO: 556099 - DNA, 20 bp, mouse
gtccatcctctacatacctg

SEQ ID NO: 556100 - DNA, 20 bp, mouse
gacgggtcctggaagtgatc

SEQ ID NO: 556101 - DNA, 20 bp, mouse
gctacccaaggaatgaccgg

SEQ ID NO: 556102 - DNA, 20 bp, mouse
ggggtctccagatcacttcc

SEQ ID NO: 556103 - DNA, 20 bp, mouse
gcagaaggctagaagtcccc

SEQ ID NO: 556104 - DNA, 20 bp, mouse
ggagacttggacacgggtcc

SEQ ID NO: 556105 - DNA, 20 bp, mouse
gggaatggccgagcagcaga

SEQ ID NO: 556106 - DNA, 20 bp, mouse
ggtgtccccaaggagatctg

SEQ ID NO: 556107 - DNA, 20 bp, mouse
gtaggagcgtgccttctgat

SEQ ID NO: 556108 - DNA, 20 bp, mouse
gcggctccccagatctcctt

SEQ ID NO: 556109 - DNA, 20 bp, mouse
gcggcagccgggtgtcccca

SEQ ID NO: 556110 - DNA, 20 bp, mouse
gctcctggtcgggtcagctt

SEQ ID NO: 556111 - DNA, 20 bp, mouse
ggtggtaggtgtggagacac

SEQ ID NO: 556112 - DNA, 20 bp, mouse
ggagaacaggaaagcatccc

SEQ ID NO: 556113 - DNA, 20 bp, mouse
gtccctggatgaatgaaggt

SEQ ID NO: 556114 - DNA, 20 bp, mouse
ggctgacccgaccaggagac

SEQ ID NO: 556115 - DNA, 20 bp, mouse
gacgctcctacccggcagcc

SEQ ID NO: 556116 - DNA, 20 bp, mouse
ggcagcaggtgcttattcct

SEQ ID NO: 556117 - DNA, 20 bp, mouse
gtgcattccgtgctgctccc

SEQ ID NO: 556118 - DNA, 20 bp, mouse
ggatactggagccaggtcca

SEQ ID NO: 556119 - DNA, 20 bp, mouse
gggaatgcagccgcctatac

SEQ ID NO: 556120 - DNA, 20 bp, mouse
ggggagtagtctcagagagg

SEQ ID NO: 556121 - DNA, 20 bp, mouse
ggctgcgggaacggaccgtg

SEQ ID NO: 556122 - DNA, 20 bp, mouse
gttagggagtagtctcagag

SEQ ID NO: 556123 - DNA, 20 bp, mouse
gcggagggcttacctgcagc

SEQ ID NO: 556124 - DNA, 20 bp, mouse
ggggtctcaagatttgtgaa

SEQ ID NO: 556125 - DNA, 20 bp, mouse
gttgtgaagggtaggtgaga

SEQ ID NO: 556126 - DNA, 20 bp, mouse
ggacgcagatcgggatggag

SEQ ID NO: 556127 - DNA, 20 bp, mouse
gatgtggacgcagatcggga

SEQ ID NO: 556128 - DNA, 20 bp, mouse
gctggatgtggacgcagatc

SEQ ID NO: 556129 - DNA, 20 bp, mouse
ggacaggggatggacttcca

SEQ ID NO: 556130 - DNA, 20 bp, mouse
gggaggctaaggctgaaagc

SEQ ID NO: 556131 - DNA, 20 bp, mouse
gggacttccagggcaccaca

SEQ ID NO: 556132 - DNA, 20 bp, mouse
ggagaagaacaatcctaaga

SEQ ID NO: 556133 - DNA, 20 bp, mouse
gagctaccactgcacacatg

SEQ ID NO: 556134 - DNA, 20 bp, mouse
ggcaccacagggactgcatg

SEQ ID NO: 556135 - DNA, 20 bp, mouse
gcctctctgatggacatctc

SEQ ID NO: 556136 - DNA, 20 bp, mouse
gggccggcatgtctctacag

SEQ ID NO: 556137 - DNA, 20 bp, mouse
ggacatgccggcctaggatg

SEQ ID NO: 556138 - DNA, 20 bp, mouse
gctaggagctgtgttcctca

SEQ ID NO: 556139 - DNA, 20 bp, mouse
gacagtgggcagaggttccc

SEQ ID NO: 556140 - DNA, 20 bp, mouse
gccacacacacagcgctggt

SEQ ID NO: 556141 - DNA, 20 bp, mouse
gctctggctagtgctgggtt

SEQ ID NO: 556142 - DNA, 20 bp, mouse
gcactagccagaggtccccc

SEQ ID NO: 556143 - DNA, 20 bp, mouse
gcaaagcccccatcctaggc

SEQ ID NO: 556144 - DNA, 20 bp, mouse
gactacagatgaggcaccgt

SEQ ID NO: 556145 - DNA, 20 bp, mouse
gatcctctgtagagacatgc

SEQ ID NO: 556146 - DNA, 20 bp, mouse
gcaggcagcaggaagcccct

SEQ ID NO: 556147 - DNA, 20 bp, mouse
gtataaaggaaccagcccag

SEQ ID NO: 556148 - DNA, 20 bp, mouse
gcaaggcgcggtgatccacg

SEQ ID NO: 556149 - DNA, 20 bp, mouse
ggcaaggatggcccaaggcg

SEQ ID NO: 556150 - DNA, 20 bp, mouse
gggcgtgagtgggctgctcg

SEQ ID NO: 556151 - DNA, 20 bp, mouse
gggatgtccgcgggtgagag

SEQ ID NO: 556152 - DNA, 20 bp, mouse
gctcacgccgtgtgtgtggt

SEQ ID NO: 556153 - DNA, 20 bp, mouse
gacgataggccccacacctc

SEQ ID NO: 556154 - DNA, 20 bp, mouse
gtgctagagagataagccag

SEQ ID NO: 556155 - DNA, 20 bp, mouse
gcacccgcggacatccagcg

SEQ ID NO: 556156 - DNA, 20 bp, mouse
gagtagatggaatcccgggt

SEQ ID NO: 556157 - DNA, 20 bp, mouse
gagccagcgccccctctccg

SEQ ID NO: 556158 - DNA, 20 bp, mouse
gcagcgccccctctccgtgg

SEQ ID NO: 556159 - DNA, 20 bp, mouse
gaggtagtagatggaatccc

SEQ ID NO: 556160 - DNA, 20 bp, mouse
gttcctccctccacggagag

SEQ ID NO: 556161 - DNA, 20 bp, mouse
ggccccctctccgtggaggg

SEQ ID NO: 556162 - DNA, 20 bp, mouse
gccacacaggatgccagcca

SEQ ID NO: 556163 - DNA, 20 bp, mouse
ggggaggcgacactgttcga

SEQ ID NO: 556164 - DNA, 20 bp, mouse
gggtgcgtgacccttctgcc

SEQ ID NO: 556165 - DNA, 20 bp, mouse
gaaacgctggagtcaagggc

SEQ ID NO: 556166 - DNA, 20 bp, mouse
ggggtaaggactgctgacag

SEQ ID NO: 556167 - DNA, 20 bp, mouse
gggtgggattgaccagagac

SEQ ID NO: 556168 - DNA, 20 bp, mouse
gcctaggcaattactctggt

SEQ ID NO: 556169 - DNA, 20 bp, mouse
gccgtcctaggcaattactc

SEQ ID NO: 556170 - DNA, 20 bp, mouse
gtaatgagaagggagggtct

SEQ ID NO: 556171 - DNA, 20 bp, mouse
gcaggaagccccaccgtcct

SEQ ID NO: 556172 - DNA, 20 bp, mouse
ggcaattactctggtgggta

SEQ ID NO: 556173 - DNA, 20 bp, mouse
ggtaattgcctaggacggtg

SEQ ID NO: 556174 - DNA, 20 bp, mouse
ggcgctaacctcggacttct

SEQ ID NO: 556175 - DNA, 20 bp, mouse
gccctgtgcccagaagtccg

SEQ ID NO: 556176 - DNA, 20 bp, mouse
ggtcttggtagcagtcggag

SEQ ID NO: 556177 - DNA, 20 bp, mouse
ggtaagagcacagacagcgt

SEQ ID NO: 556178 - DNA, 20 bp, mouse
gtgaagtgggccgacgagaa

SEQ ID NO: 556179 - DNA, 20 bp, mouse
gaagacgcagaagactagac

SEQ ID NO: 556180 - DNA, 20 bp, mouse
gtctgcgtcttggtagcagt

SEQ ID NO: 556181 - DNA, 20 bp, mouse
gcggggaaaggggatgaagt

SEQ ID NO: 556182 - DNA, 20 bp, mouse
gagacgccggatccaaggac

SEQ ID NO: 556183 - DNA, 20 bp, mouse
gcgccatcgcgaccaggcga

SEQ ID NO: 556184 - DNA, 20 bp, mouse
ggggccgacgagaagggctc

SEQ ID NO: 556185 - DNA, 20 bp, mouse
ggagcgctgcgcgacctcgg

SEQ ID NO: 556186 - DNA, 20 bp, mouse
gtaagcgccgggccaaggct

SEQ ID NO: 556187 - DNA, 20 bp, mouse
gttgacgacaagcaaggcat

SEQ ID NO: 556188 - DNA, 20 bp, mouse
gcaccgtgacatgaatgaga

SEQ ID NO: 556189 - DNA, 20 bp, mouse
gtgggccagtacagcttacc

SEQ ID NO: 556190 - DNA, 20 bp, mouse
ggcagcgaggatgaacactc

SEQ ID NO: 556191 - DNA, 20 bp, mouse
gtgcccaaagggagtctagt

SEQ ID NO: 556192 - DNA, 20 bp, mouse
gcggtgtttgacgacaagca

SEQ ID NO: 556193 - DNA, 20 bp, mouse
ggtagcagcagtgagaaaga

SEQ ID NO: 556194 - DNA, 20 bp, mouse
gctaagtaagcgccgggcca

SEQ ID NO: 556195 - DNA, 20 bp, mouse
gttggaaaaccacgaaccag

SEQ ID NO: 556196 - DNA, 20 bp, mouse
gcggccgagatagcgagtga

SEQ ID NO: 556197 - DNA, 20 bp, mouse
ggcagcgagccgagagtcca

SEQ ID NO: 556198 - DNA, 20 bp, mouse
gatagcgagtgagggagcga

SEQ ID NO: 556199 - DNA, 20 bp, mouse
ggtgacagacggagctggag

SEQ ID NO: 556200 - DNA, 20 bp, mouse
ggagcgaggaggacccggag

SEQ ID NO: 556201 - DNA, 20 bp, mouse
gagacggagctggagcggcg

SEQ ID NO: 556202 - DNA, 20 bp, mouse
gtagggctcgagccccggaa

SEQ ID NO: 556203 - DNA, 20 bp, mouse
gcggtgacgtcagggcgttg

SEQ ID NO: 556204 - DNA, 20 bp, mouse
ggctccctcactcgctatct

SEQ ID NO: 556205 - DNA, 20 bp, mouse
ggcggggcggcggcggagtc

SEQ ID NO: 556206 - DNA, 20 bp, mouse
gggtgctggggcccgaggag

SEQ ID NO: 556207 - DNA, 20 bp, mouse
ggtcgctcgcttgatcccga

SEQ ID NO: 556208 - DNA, 20 bp, mouse
ggtccgtgcggggccctcag

SEQ ID NO: 556209 - DNA, 20 bp, mouse
gccggcgcgcgtcccctcct

SEQ ID NO: 556210 - DNA, 20 bp, mouse
ggagccgggcctcacaatac

SEQ ID NO: 556211 - DNA, 20 bp, mouse
gtcagcggctgcggcgtcgg

SEQ ID NO: 556212 - DNA, 20 bp, mouse
gccccacgatgcactcacac

SEQ ID NO: 556213 - DNA, 20 bp, mouse
gggggacgcgcgccggaacg

SEQ ID NO: 556214 - DNA, 20 bp, mouse
ggatcccgacggccgcgttc

SEQ ID NO: 556215 - DNA, 20 bp, mouse
ggcctagaggtcccaccccg

SEQ ID NO: 556216 - DNA, 20 bp, mouse
gctgcagggccagaaaactc

SEQ ID NO: 556217 - DNA, 20 bp, mouse
gtagcgccctccgtccgagg

SEQ ID NO: 556218 - DNA, 20 bp, mouse
gggtacctgtaaagccgaca

SEQ ID NO: 556219 - DNA, 20 bp, mouse
gtccggaagagaccacctac

SEQ ID NO: 556220 - DNA, 20 bp, mouse
ggtaaagccgacagggacca

SEQ ID NO: 556221 - DNA, 20 bp, mouse
gatctagcgccctccgtccg

SEQ ID NO: 556222 - DNA, 20 bp, mouse
ggtgttggcccgagaggtag

SEQ ID NO: 556223 - DNA, 20 bp, mouse
ggattgtccctggtccctgt

SEQ ID NO: 556224 - DNA, 20 bp, mouse
ggatttcctcctcggacgga

SEQ ID NO: 556225 - DNA, 20 bp, mouse
gacctctcgggccaacacaa

SEQ ID NO: 556226 - DNA, 20 bp, mouse
gtagtcgagtaacccttctg

SEQ ID NO: 556227 - DNA, 20 bp, mouse
gaaggccacgggctcctggg

SEQ ID NO: 556228 - DNA, 20 bp, mouse
gcagttaagaattggagctt

SEQ ID NO: 556229 - DNA, 20 bp, mouse
gttgaaaagtaacctcagaa

SEQ ID NO: 556230 - DNA, 20 bp, mouse
ggtcctcgatgaccctgaaa

SEQ ID NO: 556231 - DNA, 20 bp, mouse
gacacaaagagggcccacgc

SEQ ID NO: 556232 - DNA, 20 bp, mouse
gttcaatgatcagcgtgact

SEQ ID NO: 556233 - DNA, 20 bp, mouse
gcagaaggccacgggctcct

SEQ ID NO: 556234 - DNA, 20 bp, mouse
gccctgaaagggcttaggtg

SEQ ID NO: 556235 - DNA, 20 bp, mouse
gaaagggcttaggtgcgggg

SEQ ID NO: 556236 - DNA, 20 bp, mouse
gggacagagctgctcgctag

SEQ ID NO: 556237 - DNA, 20 bp, mouse
gagcccaaagggaaaaaaca

SEQ ID NO: 556238 - DNA, 20 bp, mouse
gaggcccgggagagcccaaa

SEQ ID NO: 556239 - DNA, 20 bp, mouse
ggaaaaaacagggctttcat

SEQ ID NO: 556240 - DNA, 20 bp, mouse
gagagctgctcgctaggggc

SEQ ID NO: 556241 - DNA, 20 bp, mouse
ggccctgtggccagagtcca

SEQ ID NO: 556242 - DNA, 20 bp, mouse
ggctttcatcggagcacgct

SEQ ID NO: 556243 - DNA, 20 bp, mouse
gtttccctttgggctctccc

SEQ ID NO: 556244 - DNA, 20 bp, mouse
gataatagaagacctcagtt

SEQ ID NO: 556245 - DNA, 20 bp, mouse
ggcctgagacacacctacca

SEQ ID NO: 556246 - DNA, 20 bp, mouse
gtgctgtgactgctcctccg

SEQ ID NO: 556247 - DNA, 20 bp, mouse
gagtcaccagtccgccccgg

SEQ ID NO: 556248 - DNA, 20 bp, mouse
gcgcggcgcggcggccagtg

SEQ ID NO: 556249 - DNA, 20 bp, mouse
gcgggaaccgcagtccgcac

SEQ ID NO: 556250 - DNA, 20 bp, mouse
gtgtgactgctcctccgggg

SEQ ID NO: 556251 - DNA, 20 bp, mouse
gcagagtcaccagtccgccc

SEQ ID NO: 556252 - DNA, 20 bp, mouse
gcggcggccagtgcggactg

SEQ ID NO: 556253 - DNA, 20 bp, mouse
gtcggcgctgtcattctccg

SEQ ID NO: 556254 - DNA, 20 bp, mouse
gcaagggctggcggccacga

SEQ ID NO: 556255 - DNA, 20 bp, mouse
gccccggcacggcagaaccg

SEQ ID NO: 556256 - DNA, 20 bp, mouse
gcaggtctctgagatgaagg

SEQ ID NO: 556257 - DNA, 20 bp, mouse
gttaggccctgagtccacag

SEQ ID NO: 556258 - DNA, 20 bp, mouse
gagatgggagagggcccgtg

SEQ ID NO: 556259 - DNA, 20 bp, mouse
gatggcagccagcagctctc

SEQ ID NO: 556260 - DNA, 20 bp, mouse
gccatctcgcttctctaaga

SEQ ID NO: 556261 - DNA, 20 bp, mouse
gtcagagacctgagagctgc

SEQ ID NO: 556262 - DNA, 20 bp, mouse
gtcagggcctaaggcagagc

SEQ ID NO: 556263 - DNA, 20 bp, mouse
ggagagggcccgtggggaag

SEQ ID NO: 556264 - DNA, 20 bp, mouse
gtgcagcccctgtggactca

SEQ ID NO: 556265 - DNA, 20 bp, mouse
gatgcctgggaccttctgtc

SEQ ID NO: 556266 - DNA, 20 bp, mouse
gcccaccctccgagatccag

SEQ ID NO: 556267 - DNA, 20 bp, mouse
gtagagccgctggatctcgg

SEQ ID NO: 556268 - DNA, 20 bp, mouse
gtgaagctccagagtacctt

SEQ ID NO: 556269 - DNA, 20 bp, mouse
gctggctacccaaggtactc

SEQ ID NO: 556270 - DNA, 20 bp, mouse
gatgaactgctggctaccca

SEQ ID NO: 556271 - DNA, 20 bp, mouse
gtcatagagccgctggatct

SEQ ID NO: 556272 - DNA, 20 bp, mouse
ggcatgtgcggcctgaaaca

SEQ ID NO: 556273 - DNA, 20 bp, mouse
gtccaggactgcccattggc

SEQ ID NO: 556274 - DNA, 20 bp, mouse
gcgccggccgcctaccccag

SEQ ID NO: 556275 - DNA, 20 bp, mouse
gcagggtggacagaaagcca

SEQ ID NO: 556276 - DNA, 20 bp, mouse
gtgctggctctcagtaagtg

SEQ ID NO: 556277 - DNA, 20 bp, mouse
gagtttgcactcaggatgcg

SEQ ID NO: 556278 - DNA, 20 bp, mouse
gcagctgttgtcctggagaa

SEQ ID NO: 556279 - DNA, 20 bp, mouse
gagcatggcagctgttgtcc

SEQ ID NO: 556280 - DNA, 20 bp, mouse
gtccactgctaggagagaat

SEQ ID NO: 556281 - DNA, 20 bp, mouse
ggaaatatgactttatttag

SEQ ID NO: 556282 - DNA, 20 bp, mouse
gttaacctggctctcaggac

SEQ ID NO: 556283 - DNA, 20 bp, mouse
gagatagggactcccacccc

SEQ ID NO: 556284 - DNA, 20 bp, mouse
gcatatttcttagtagcctt

SEQ ID NO: 556285 - DNA, 20 bp, mouse
gtggtatttccagtctccta

SEQ ID NO: 556286 - DNA, 20 bp, mouse
gcagaccgcgcgggaaaaaa

SEQ ID NO: 556287 - DNA, 20 bp, mouse
gcggctgtcgccattatccg

SEQ ID NO: 556288 - DNA, 20 bp, mouse
gagggcgaccacaggatcag

SEQ ID NO: 556289 - DNA, 20 bp, mouse
gctagaggagcagaccgcgc

SEQ ID NO: 556290 - DNA, 20 bp, mouse
gcttgggcgcgggaaaataa

SEQ ID NO: 556291 - DNA, 20 bp, mouse
gctgctagctctctgacgga

SEQ ID NO: 556292 - DNA, 20 bp, mouse
gaggatcagagggcgggaaa

SEQ ID NO: 556293 - DNA, 20 bp, mouse
gcgtcttggggaacccgatc

SEQ ID NO: 556294 - DNA, 20 bp, mouse
gcccgcaggcagccaaaaag

SEQ ID NO: 556295 - DNA, 20 bp, mouse
gatcagagggcgggaaaggg

SEQ ID NO: 556296 - DNA, 20 bp, mouse
gcggcagccgaagggagccg

SEQ ID NO: 556297 - DNA, 20 bp, mouse
gcctcactcaggcctcatgg

SEQ ID NO: 556298 - DNA, 20 bp, mouse
gagagcgtccggcagccgaa

SEQ ID NO: 556299 - DNA, 20 bp, mouse
gggacttaagggagagcgtc

SEQ ID NO: 556300 - DNA, 20 bp, mouse
gaccagcgaggaggtcggag

SEQ ID NO: 556301 - DNA, 20 bp, mouse
gtccggagggaccagcgagg

SEQ ID NO: 556302 - DNA, 20 bp, mouse
gcgggctgagggaccgtcgt

SEQ ID NO: 556303 - DNA, 20 bp, mouse
ggggcgcggaggaccgagca

SEQ ID NO: 556304 - DNA, 20 bp, mouse
gcggggggagcgggacttaa

SEQ ID NO: 556305 - DNA, 20 bp, mouse
ggcgcctcactcaggcctca

SEQ ID NO: 556306 - DNA, 20 bp, mouse
gggcctccgcggatctccac

SEQ ID NO: 556307 - DNA, 20 bp, mouse
gcaaagcgcacgtcgagcgg

SEQ ID NO: 556308 - DNA, 20 bp, mouse
gcgctgcctgtggagatccg

SEQ ID NO: 556309 - DNA, 20 bp, mouse
gaggctgtgggccttcgagt

SEQ ID NO: 556310 - DNA, 20 bp, mouse
gcgcacgtcgagcgggggag

SEQ ID NO: 556311 - DNA, 20 bp, mouse
gggtagccaacgaatcctgt

SEQ ID NO: 556312 - DNA, 20 bp, mouse
gggaggccgacaggattcgt

SEQ ID NO: 556313 - DNA, 20 bp, mouse
ggggcaaagcgcacgtcgag

SEQ ID NO: 556314 - DNA, 20 bp, mouse
ggagggcgtgacgaccccag

SEQ ID NO: 556315 - DNA, 20 bp, mouse
gtgcctgtggagatccgcgg

SEQ ID NO: 556316 - DNA, 20 bp, mouse
gtgtggtgcggacctcgggg

SEQ ID NO: 556317 - DNA, 20 bp, mouse
gcgaggctcgcgctcttagg

SEQ ID NO: 556318 - DNA, 20 bp, mouse
gtgctgtggtgcggacctcg

SEQ ID NO: 556319 - DNA, 20 bp, mouse
gggctcgcgctcttaggagg

SEQ ID NO: 556320 - DNA, 20 bp, mouse
gcaggtgggttgaggcgtcg

SEQ ID NO: 556321 - DNA, 20 bp, mouse
ggttgtccgcgcggccaggt

SEQ ID NO: 556322 - DNA, 20 bp, mouse
ggcggcgctgtgctgtggtg

SEQ ID NO: 556323 - DNA, 20 bp, mouse
gcgcggacaacgccgccccg

SEQ ID NO: 556324 - DNA, 20 bp, mouse
gggctgtgcgcagtcccggg

SEQ ID NO: 556325 - DNA, 20 bp, mouse
ggggcagcccgcgggtagag

SEQ ID NO: 556326 - DNA, 20 bp, mouse
ggcacactcaggcccacgta

SEQ ID NO: 556327 - DNA, 20 bp, mouse
gggcggcagcaaagacacag

SEQ ID NO: 556328 - DNA, 20 bp, mouse
ggagctgggtggctgcgctg

SEQ ID NO: 556329 - DNA, 20 bp, mouse
gcgcagccacccagctccca

SEQ ID NO: 556330 - DNA, 20 bp, mouse
gcccaaggcgcagcacactc

SEQ ID NO: 556331 - DNA, 20 bp, mouse
gctttgctgccgccctacgt

SEQ ID NO: 556332 - DNA, 20 bp, mouse
gagagctggggtagaaggag

SEQ ID NO: 556333 - DNA, 20 bp, mouse
gatagctagactgagagctg

SEQ ID NO: 556334 - DNA, 20 bp, mouse
ggcctgagtgtgctgcgcct

SEQ ID NO: 556335 - DNA, 20 bp, mouse
gagcagttgggacaaagccc

SEQ ID NO: 556336 - DNA, 20 bp, mouse
gtcgcgcgccggctgaggaa

SEQ ID NO: 556337 - DNA, 20 bp, mouse
gcgtgccgggcaagagacgc

SEQ ID NO: 556338 - DNA, 20 bp, mouse
gcgccggcgtggagacccga

SEQ ID NO: 556339 - DNA, 20 bp, mouse
gagccatcgggtctccacgc

SEQ ID NO: 556340 - DNA, 20 bp, mouse
gttgcccggcacgagtgctg

SEQ ID NO: 556341 - DNA, 20 bp, mouse
gcgggcaagagacgccggcg

SEQ ID NO: 556342 - DNA, 20 bp, mouse
ggccagcctccgcagccatc

SEQ ID NO: 556343 - DNA, 20 bp, mouse
ggcggaatggagctggtcgc

SEQ ID NO: 556344 - DNA, 20 bp, mouse
ggcaagtcctgggaagccgt

SEQ ID NO: 556345 - DNA, 20 bp, mouse
gtgtcaagcaggcaagtcct

SEQ ID NO: 556346 - DNA, 20 bp, mouse
gcagcgccggcgggagagaa

SEQ ID NO: 556347 - DNA, 20 bp, mouse
ggggttgtggccacgcgcag

SEQ ID NO: 556348 - DNA, 20 bp, mouse
gaagcagcccgccctgggtc

SEQ ID NO: 556349 - DNA, 20 bp, mouse
ggggcaggagccttcggcaa

SEQ ID NO: 556350 - DNA, 20 bp, mouse
gtggccacgcgcagcggcag

SEQ ID NO: 556351 - DNA, 20 bp, mouse
ggaaccccttgggccaggga

SEQ ID NO: 556352 - DNA, 20 bp, mouse
gaaggtctccgcccgaccca

SEQ ID NO: 556353 - DNA, 20 bp, mouse
gcagcccgccctgggtcggg

SEQ ID NO: 556354 - DNA, 20 bp, mouse
gcccttgggccagggagggg

SEQ ID NO: 556355 - DNA, 20 bp, mouse
ggtgaggcgcagaacccctt

SEQ ID NO: 556356 - DNA, 20 bp, mouse
gtgtggccgcaaactgtctg

SEQ ID NO: 556357 - DNA, 20 bp, mouse
gccaatgcacttactcccag

SEQ ID NO: 556358 - DNA, 20 bp, mouse
gtgtctggggtcttacgctg

SEQ ID NO: 556359 - DNA, 20 bp, mouse
gtcatagcatagctagggag

SEQ ID NO: 556360 - DNA, 20 bp, mouse
gcactgtgcgctaggtccca

SEQ ID NO: 556361 - DNA, 20 bp, mouse
ggtgctccgaggtactggaa

SEQ ID NO: 556362 - DNA, 20 bp, mouse
gggcagggtggctggaccct

SEQ ID NO: 556363 - DNA, 20 bp, mouse
ggcccggctcgctcccccca

SEQ ID NO: 556364 - DNA, 20 bp, mouse
gtaagaccccagacagtttg

SEQ ID NO: 556365 - DNA, 20 bp, mouse
gtactggaaaggtcttggca

SEQ ID NO: 556366 - DNA, 20 bp, mouse
gaaggaggaggctgcttcag

SEQ ID NO: 556367 - DNA, 20 bp, mouse
ggcagctgctgaggatgctc

SEQ ID NO: 556368 - DNA, 20 bp, mouse
gtgcccggagctcctcccag

SEQ ID NO: 556369 - DNA, 20 bp, mouse
gcagctaaaggcagaatcgt

SEQ ID NO: 556370 - DNA, 20 bp, mouse
gagccactgggaggagctcc

SEQ ID NO: 556371 - DNA, 20 bp, mouse
gctctctcgccatgaaccaa

SEQ ID NO: 556372 - DNA, 20 bp, mouse
gcgggttgctggaacaccgg

SEQ ID NO: 556373 - DNA, 20 bp, mouse
gggctcccagagccactggg

SEQ ID NO: 556374 - DNA, 20 bp, mouse
gggaggaacaggaattggca

SEQ ID NO: 556375 - DNA, 20 bp, mouse
gtgggggagatagtgtagag

SEQ ID NO: 556376 - DNA, 20 bp, mouse
ggcccgcgtaccgccctcag

SEQ ID NO: 556377 - DNA, 20 bp, mouse
gggcggcgcgagaccgctga

SEQ ID NO: 556378 - DNA, 20 bp, mouse
gcattggggattcaacatgg

SEQ ID NO: 556379 - DNA, 20 bp, mouse
gaccgctgagggcggtacgc

SEQ ID NO: 556380 - DNA, 20 bp, mouse
gaggccccggatgttcattg

SEQ ID NO: 556381 - DNA, 20 bp, mouse
gtggggattcaacatggcgg

SEQ ID NO: 556382 - DNA, 20 bp, mouse
gatggcggcggcagtagccg

SEQ ID NO: 556383 - DNA, 20 bp, mouse
gtagtgggcggcgaggagta

SEQ ID NO: 556384 - DNA, 20 bp, mouse
ggttcattggggattcaaca

SEQ ID NO: 556385 - DNA, 20 bp, mouse
gtacgcgggcacagagttct

SEQ ID NO: 556386 - DNA, 20 bp, mouse
ggcagcgacctgctcctgta

SEQ ID NO: 556387 - DNA, 20 bp, mouse
gtcgctgcctgagattctaa

SEQ ID NO: 556388 - DNA, 20 bp, mouse
ggctcgcgccctacaggagc

SEQ ID NO: 556389 - DNA, 20 bp, mouse
gggagctgctcgcgccctac

SEQ ID NO: 556390 - DNA, 20 bp, mouse
gagtgagctggggtgcacgg

SEQ ID NO: 556391 - DNA, 20 bp, mouse
gggcagaccacagcaggtgg

SEQ ID NO: 556392 - DNA, 20 bp, mouse
gcgcagcttgaacacaccgg

SEQ ID NO: 556393 - DNA, 20 bp, mouse
ggggcggggagagttagaag

SEQ ID NO: 556394 - DNA, 20 bp, mouse
gtccaagccgaggtagggcg

SEQ ID NO: 556395 - DNA, 20 bp, mouse
ggccggcttagtcacctgga

SEQ ID NO: 556396 - DNA, 20 bp, mouse
gtggctcccgcggcctctcg

SEQ ID NO: 556397 - DNA, 20 bp, mouse
gggcctctcggggctctccg

SEQ ID NO: 556398 - DNA, 20 bp, mouse
gggatccccgatcctccgcg

SEQ ID NO: 556399 - DNA, 20 bp, mouse
ggggcacccacctgccaagc

SEQ ID NO: 556400 - DNA, 20 bp, mouse
gggtgcccgaggccccgcgg

SEQ ID NO: 556401 - DNA, 20 bp, mouse
gcccgtgtgccggagcccat

SEQ ID NO: 556402 - DNA, 20 bp, mouse
gctctccgtggcttcccgct

SEQ ID NO: 556403 - DNA, 20 bp, mouse
ggcaggtcctaggagcctat

SEQ ID NO: 556404 - DNA, 20 bp, mouse
gcgatcctccgcggggcctc

SEQ ID NO: 556405 - DNA, 20 bp, mouse
gggcttcccgcttggcaggt

SEQ ID NO: 556406 - DNA, 20 bp, mouse
gagcagcggagaagcagatg

SEQ ID NO: 556407 - DNA, 20 bp, mouse
gtgacagccagccaccaggt

SEQ ID NO: 556408 - DNA, 20 bp, mouse
gcagcggacagtcctcctag

SEQ ID NO: 556409 - DNA, 20 bp, mouse
gtctccacgggcgcacgcca

SEQ ID NO: 556410 - DNA, 20 bp, mouse
gtgggtagcggctccagaag

SEQ ID NO: 556411 - DNA, 20 bp, mouse
gcccagccgtagtagttccc

SEQ ID NO: 556412 - DNA, 20 bp, mouse
gataacagatgtagcagcag

SEQ ID NO: 556413 - DNA, 20 bp, mouse
gagggcgtaggagatcaccc

SEQ ID NO: 556414 - DNA, 20 bp, mouse
gggtgctcctgcctacctgg

SEQ ID NO: 556415 - DNA, 20 bp, mouse
gtgcctagagaggatgcgaa

SEQ ID NO: 556416 - DNA, 20 bp, mouse
gctcggcaggaacatagtgg

SEQ ID NO: 556417 - DNA, 20 bp, mouse
gaggtccccgttcttcccag

SEQ ID NO: 556418 - DNA, 20 bp, mouse
gtggctcggcaggaacatag

SEQ ID NO: 556419 - DNA, 20 bp, mouse
gtagggccaagaggaacccc

SEQ ID NO: 556420 - DNA, 20 bp, mouse
gggtcacggggacccagcca

SEQ ID NO: 556421 - DNA, 20 bp, mouse
gtctcgtggaggctgtaggt

SEQ ID NO: 556422 - DNA, 20 bp, mouse
gagggcttcctagggccaag

SEQ ID NO: 556423 - DNA, 20 bp, mouse
gctagcgcgcggaacctgtg

SEQ ID NO: 556424 - DNA, 20 bp, mouse
gaacatagtgggggtgaact

SEQ ID NO: 556425 - DNA, 20 bp, mouse
ggcgcggaacctgtgtggct

SEQ ID NO: 556426 - DNA, 20 bp, mouse
gcggcccacgcgtgcttacc

SEQ ID NO: 556427 - DNA, 20 bp, mouse
gtacctggcagccgcagctc

SEQ ID NO: 556428 - DNA, 20 bp, mouse
gctgccaggtaagcacgcgt

SEQ ID NO: 556429 - DNA, 20 bp, mouse
gcctcggcgccggcagtccc

SEQ ID NO: 556430 - DNA, 20 bp, mouse
ggggagagcgtcgcgctatg

SEQ ID NO: 556431 - DNA, 20 bp, mouse
gccgagggaagccagagtac

SEQ ID NO: 556432 - DNA, 20 bp, mouse
ggccgcgccgagggaggatc

SEQ ID NO: 556433 - DNA, 20 bp, mouse
ggagtacaggagatgagtcc

SEQ ID NO: 556434 - DNA, 20 bp, mouse
gagtgagggacaacatggag

SEQ ID NO: 556435 - DNA, 20 bp, mouse
gcaggacccttgaggcccag

SEQ ID NO: 556436 - DNA, 20 bp, mouse
gaaggcaatggatttcccag

SEQ ID NO: 556437 - DNA, 20 bp, mouse
gtggtttgaagccttcccaa

SEQ ID NO: 556438 - DNA, 20 bp, mouse
gtctcctggtgagtggaggt

SEQ ID NO: 556439 - DNA, 20 bp, mouse
gagaaagaggcaaagcccct

SEQ ID NO: 556440 - DNA, 20 bp, mouse
ggggctttgcctctttctcc

SEQ ID NO: 556441 - DNA, 20 bp, mouse
gcaagcagtccttaatggac

SEQ ID NO: 556442 - DNA, 20 bp, mouse
gcagaccaagcagtccttaa

SEQ ID NO: 556443 - DNA, 20 bp, mouse
gaccttaggtttataatctt

SEQ ID NO: 556444 - DNA, 20 bp, mouse
gcggtcttgcctgtccatta

SEQ ID NO: 556445 - DNA, 20 bp, mouse
gctggcactgtgatactatt

SEQ ID NO: 556446 - DNA, 20 bp, mouse
ggccgcgcccggacaatacc

SEQ ID NO: 556447 - DNA, 20 bp, mouse
gcgcgggcgcgagggataca

SEQ ID NO: 556448 - DNA, 20 bp, mouse
gcccccaacggggaacctag

SEQ ID NO: 556449 - DNA, 20 bp, mouse
gagcgcgccgggtattgtcc

SEQ ID NO: 556450 - DNA, 20 bp, mouse
ggcgcgcacacgagcccacc

SEQ ID NO: 556451 - DNA, 20 bp, mouse
gacgccccaggcccccaacg

SEQ ID NO: 556452 - DNA, 20 bp, mouse
gtacagggaacgcgcagagg

SEQ ID NO: 556453 - DNA, 20 bp, mouse
gcggggcagggccgactcta

SEQ ID NO: 556454 - DNA, 20 bp, mouse
gggatacagggaacgcgcag

SEQ ID NO: 556455 - DNA, 20 bp, mouse
gctggggacgatgcccgccc

SEQ ID NO: 556456 - DNA, 20 bp, mouse
gccgcgccagccgggaacgt

SEQ ID NO: 556457 - DNA, 20 bp, mouse
gatcctggagaagggcacac

SEQ ID NO: 556458 - DNA, 20 bp, mouse
ggccgcgccggtggagacgg

SEQ ID NO: 556459 - DNA, 20 bp, mouse
ggcgaggcgcggagacgtca

SEQ ID NO: 556460 - DNA, 20 bp, mouse
ggtcgagttgagctccccac

SEQ ID NO: 556461 - DNA, 20 bp, mouse
ggcgctctcccggaggctcc

SEQ ID NO: 556462 - DNA, 20 bp, mouse
ggtgggccgccgggagcctc

SEQ ID NO: 556463 - DNA, 20 bp, mouse
ggtcacccaaggagataaaa

SEQ ID NO: 556464 - DNA, 20 bp, mouse
ggaccccggggacagcctaa

SEQ ID NO: 556465 - DNA, 20 bp, mouse
ggagataaaagggcacccgt

SEQ ID NO: 556466 - DNA, 20 bp, mouse
ggctgcccggagccccgcga

SEQ ID NO: 556467 - DNA, 20 bp, mouse
gagtgccccggccctggcag

SEQ ID NO: 556468 - DNA, 20 bp, mouse
ggcagtggcacaaatccccg

SEQ ID NO: 556469 - DNA, 20 bp, mouse
gagcccggcgcgctgctgcg

SEQ ID NO: 556470 - DNA, 20 bp, mouse
gggatactcactccatcgcg

SEQ ID NO: 556471 - DNA, 20 bp, mouse
gaccatgtaccccaaggcag

SEQ ID NO: 556472 - DNA, 20 bp, mouse
gagaggcagcgagcgacgca

SEQ ID NO: 556473 - DNA, 20 bp, mouse
gcctctgcgaagcgggtatc

SEQ ID NO: 556474 - DNA, 20 bp, mouse
gagccccgcagcagcgcgcc

SEQ ID NO: 556475 - DNA, 20 bp, mouse
gaggccaactcccccaagaa

SEQ ID NO: 556476 - DNA, 20 bp, mouse
ggtgtggccggagacaacac

SEQ ID NO: 556477 - DNA, 20 bp, mouse
gccaccccagacacttacgt

SEQ ID NO: 556478 - DNA, 20 bp, mouse
gagtaggcctagctctctag

SEQ ID NO: 556479 - DNA, 20 bp, mouse
ggagccgaggggagcacgag

SEQ ID NO: 556480 - DNA, 20 bp, mouse
gtcaaccaaggcccagtctg

SEQ ID NO: 556481 - DNA, 20 bp, mouse
gccagacacttacgtgggtg

SEQ ID NO: 556482 - DNA, 20 bp, mouse
gctgctgacaaggagcggag

SEQ ID NO: 556483 - DNA, 20 bp, mouse
gacacttacgtgggtgtggc

SEQ ID NO: 556484 - DNA, 20 bp, mouse
gcagaccccggtgttgtctc

SEQ ID NO: 556485 - DNA, 20 bp, mouse
ggccaagcctctagagagct

SEQ ID NO: 556486 - DNA, 20 bp, mouse
gccctccgcccgcctcctcg

SEQ ID NO: 556487 - DNA, 20 bp, mouse
ggcccgcgggaggacgcccc

SEQ ID NO: 556488 - DNA, 20 bp, mouse
ggaggacgccccgggagtcc

SEQ ID NO: 556489 - DNA, 20 bp, mouse
gagagctgcgggctagtcca

SEQ ID NO: 556490 - DNA, 20 bp, mouse
gccgggagccccgaggaggc

SEQ ID NO: 556491 - DNA, 20 bp, mouse
gagtccggggaagtgaagtg

SEQ ID NO: 556492 - DNA, 20 bp, mouse
gcgtgtgtgcgcaggagaag

SEQ ID NO: 556493 - DNA, 20 bp, mouse
gtcccggggcgtcctcccgc

SEQ ID NO: 556494 - DNA, 20 bp, mouse
ggctgactcagcagcgagag

SEQ ID NO: 556495 - DNA, 20 bp, mouse
gcactctggaagagtatggg

SEQ ID NO: 556496 - DNA, 20 bp, mouse
gcgaactgtcaggagcggag

SEQ ID NO: 556497 - DNA, 20 bp, mouse
gaattccgaactgtcaggag

SEQ ID NO: 556498 - DNA, 20 bp, mouse
gcagagcccatgcacagatg

SEQ ID NO: 556499 - DNA, 20 bp, mouse
gtaatgagggtgcactgggg

SEQ ID NO: 556500 - DNA, 20 bp, mouse
gtctggcctcatctgtgcat

SEQ ID NO: 556501 - DNA, 20 bp, mouse
gagcagaccagagtccacga

SEQ ID NO: 556502 - DNA, 20 bp, mouse
gaagagaattccgaactgtc

SEQ ID NO: 556503 - DNA, 20 bp, mouse
gctggtgaagggaagactcc

SEQ ID NO: 556504 - DNA, 20 bp, mouse
gaaggtgcgtccttggagag

SEQ ID NO: 556505 - DNA, 20 bp, mouse
gctgtccttgacttctagaa

SEQ ID NO: 556506 - DNA, 20 bp, mouse
ggaggctccgggtcccaggg

SEQ ID NO: 556507 - DNA, 20 bp, mouse
gaggaggccagcagcggccg

SEQ ID NO: 556508 - DNA, 20 bp, mouse
gggcgggcggagttagttgg

SEQ ID NO: 556509 - DNA, 20 bp, mouse
gggcggcgggcggagttagt

SEQ ID NO: 556510 - DNA, 20 bp, mouse
gcgggtcccagggcggggac

SEQ ID NO: 556511 - DNA, 20 bp, mouse
gtccctgcgccaggaagcca

SEQ ID NO: 556512 - DNA, 20 bp, mouse
ggcaccggtgaagaacgcgg

SEQ ID NO: 556513 - DNA, 20 bp, mouse
gccgcaggctcttcccggga

SEQ ID NO: 556514 - DNA, 20 bp, mouse
gaccggtgctgtgcccactg

SEQ ID NO: 556515 - DNA, 20 bp, mouse
ggacggaagcgggagcccgc

SEQ ID NO: 556516 - DNA, 20 bp, mouse
gttcctgtgaggaacccggg

SEQ ID NO: 556517 - DNA, 20 bp, mouse
gcgggcaccaacgaccgacc

SEQ ID NO: 556518 - DNA, 20 bp, mouse
ggactgggccggctcctgag

SEQ ID NO: 556519 - DNA, 20 bp, mouse
gagccccccgggttcctcac

SEQ ID NO: 556520 - DNA, 20 bp, mouse
ggccgaggcagggaacgcac

SEQ ID NO: 556521 - DNA, 20 bp, mouse
gtccttgcgcacgcgctctc

SEQ ID NO: 556522 - DNA, 20 bp, mouse
gtccagaggcgtgactctcg

SEQ ID NO: 556523 - DNA, 20 bp, mouse
gggacgcgacgcgtttccag

SEQ ID NO: 556524 - DNA, 20 bp, mouse
gggaagcagagtctgtagcg

SEQ ID NO: 556525 - DNA, 20 bp, mouse
gaccgcggaccggggaatcg

SEQ ID NO: 556526 - DNA, 20 bp, mouse
gacgatggagctagacagat

SEQ ID NO: 556527 - DNA, 20 bp, mouse
gggatgcctaggcgagaaca

SEQ ID NO: 556528 - DNA, 20 bp, mouse
gacacagcaacgggaaacga

SEQ ID NO: 556529 - DNA, 20 bp, mouse
gtcggtaccgagtgactgga

SEQ ID NO: 556530 - DNA, 20 bp, mouse
gctcggtaccgacacagcaa

SEQ ID NO: 556531 - DNA, 20 bp, mouse
gactggaggggagtgactgg

SEQ ID NO: 556532 - DNA, 20 bp, mouse
gagacagatgggcgcagttg

SEQ ID NO: 556533 - DNA, 20 bp, mouse
gtgtgtcggtaccgagtgac

SEQ ID NO: 556534 - DNA, 20 bp, mouse
gctggagcttggggaggtcc

SEQ ID NO: 556535 - DNA, 20 bp, mouse
gggtcactaacagtacctct

SEQ ID NO: 556536 - DNA, 20 bp, mouse
gtggaattcaaacgagtagg

SEQ ID NO: 556537 - DNA, 20 bp, mouse
ggaatttcccgcggagctga

SEQ ID NO: 556538 - DNA, 20 bp, mouse
ggcgtggaattcaaacgagt

SEQ ID NO: 556539 - DNA, 20 bp, mouse
gtaggttgagctagaggcgg

SEQ ID NO: 556540 - DNA, 20 bp, mouse
gcattaccaagatttctcca

SEQ ID NO: 556541 - DNA, 20 bp, mouse
gctagaggcgggggagtagt

SEQ ID NO: 556542 - DNA, 20 bp, mouse
gggttaggttgagctagagg

SEQ ID NO: 556543 - DNA, 20 bp, mouse
gcccagcgcaggggacggga

SEQ ID NO: 556544 - DNA, 20 bp, mouse
ggaaagcgccgtcagctccg

SEQ ID NO: 556545 - DNA, 20 bp, mouse
ggggaaactggaatttcccg

SEQ ID NO: 556546 - DNA, 20 bp, mouse
gactcgcgcaggcgcagagg

SEQ ID NO: 556547 - DNA, 20 bp, mouse
gccgccagcgaggacgacga

SEQ ID NO: 556548 - DNA, 20 bp, mouse
gcggcgagcgtctcaggaag

SEQ ID NO: 556549 - DNA, 20 bp, mouse
ggcgcgagccgacgagcgag

SEQ ID NO: 556550 - DNA, 20 bp, mouse
ggcgtggccatgaacagtgg

SEQ ID NO: 556551 - DNA, 20 bp, mouse
gaaaatggcataaacaagtc

SEQ ID NO: 556552 - DNA, 20 bp, mouse
gtaaacaagtcgggaggacc

SEQ ID NO: 556553 - DNA, 20 bp, mouse
gccgccgccaccatagacga

SEQ ID NO: 556554 - DNA, 20 bp, mouse
gcctttaaggacagcggaga

SEQ ID NO: 556555 - DNA, 20 bp, mouse
ggcggcccctttaaggacag

SEQ ID NO: 556556 - DNA, 20 bp, mouse
gcatcccagaatgtcaggtg

SEQ ID NO: 556557 - DNA, 20 bp, mouse
gatggagttaggctcagata

SEQ ID NO: 556558 - DNA, 20 bp, mouse
gcttccccacctgacattct

SEQ ID NO: 556559 - DNA, 20 bp, mouse
gtataatggtagactgtaaa

SEQ ID NO: 556560 - DNA, 20 bp, mouse
ggcaaagtaagtagagtcca

SEQ ID NO: 556561 - DNA, 20 bp, mouse
gctgagacttgtatatataa

SEQ ID NO: 556562 - DNA, 20 bp, mouse
gtgagcgatcggattcaaac

SEQ ID NO: 556563 - DNA, 20 bp, mouse
gactgacatcccagaatgtc

SEQ ID NO: 556564 - DNA, 20 bp, mouse
gaaagaggtaaccagttgaa

SEQ ID NO: 556565 - DNA, 20 bp, mouse
gatccgatcgctcactaccg

SEQ ID NO: 556566 - DNA, 20 bp, mouse
gagcggcccggctctctagg

SEQ ID NO: 556567 - DNA, 20 bp, mouse
gccctgccctggcgctccat

SEQ ID NO: 556568 - DNA, 20 bp, mouse
ggcgccgtcggggtccgggg

SEQ ID NO: 556569 - DNA, 20 bp, mouse
gcgccgaaggcctccggaag

SEQ ID NO: 556570 - DNA, 20 bp, mouse
gccgaccgcggctgaggtgg

SEQ ID NO: 556571 - DNA, 20 bp, mouse
gcgaaggcctccggaagagg

SEQ ID NO: 556572 - DNA, 20 bp, mouse
gcggctgttgcggatgggag

SEQ ID NO: 556573 - DNA, 20 bp, mouse
gagcggcggctgttgcggat

SEQ ID NO: 556574 - DNA, 20 bp, mouse
ggaggcggagagtgtgagac

SEQ ID NO: 556575 - DNA, 20 bp, mouse
ggccggcgcgcaaacaacga

SEQ ID NO: 556576 - DNA, 20 bp, mouse
gcgaggagaggtgaatactc

SEQ ID NO: 556577 - DNA, 20 bp, mouse
ggccgacgccatgaagatca

SEQ ID NO: 556578 - DNA, 20 bp, mouse
gacgccagccagggagggaa

SEQ ID NO: 556579 - DNA, 20 bp, mouse
gcgtcggcctaaggcgcgag

SEQ ID NO: 556580 - DNA, 20 bp, mouse
ggcccgccgcctgcaacctg

SEQ ID NO: 556581 - DNA, 20 bp, mouse
gcgcgcggcccagccagctc

SEQ ID NO: 556582 - DNA, 20 bp, mouse
gaggcgcgaggggtagcctc

SEQ ID NO: 556583 - DNA, 20 bp, mouse
gctcggacgccagccaggga

SEQ ID NO: 556584 - DNA, 20 bp, mouse
ggaggaggcctgagtcacgt

SEQ ID NO: 556585 - DNA, 20 bp, mouse
gccgccccacccggcctgag

SEQ ID NO: 556586 - DNA, 20 bp, mouse
gcggagcgtggagcgagtgg

SEQ ID NO: 556587 - DNA, 20 bp, mouse
ggggcggcgggaaggacgaa

SEQ ID NO: 556588 - DNA, 20 bp, mouse
gtggccgggcactttcaaaa

SEQ ID NO: 556589 - DNA, 20 bp, mouse
gagcgtggagcgagtggcgg

SEQ ID NO: 556590 - DNA, 20 bp, mouse
ggggagcggcggggacagtc

SEQ ID NO: 556591 - DNA, 20 bp, mouse
gtgagtcccgagaggctgtg

SEQ ID NO: 556592 - DNA, 20 bp, mouse
ggccatgcgcacagcctcac

SEQ ID NO: 556593 - DNA, 20 bp, mouse
gggctgtgcggcgacccgtg

SEQ ID NO: 556594 - DNA, 20 bp, mouse
ggttgcggaagatctcgtcg

SEQ ID NO: 556595 - DNA, 20 bp, mouse
ggcacactatgagtcccgag

SEQ ID NO: 556596 - DNA, 20 bp, mouse
gggccactccgagcgcgcag

SEQ ID NO: 556597 - DNA, 20 bp, mouse
gtaccccgcagggaccgcac

SEQ ID NO: 556598 - DNA, 20 bp, mouse
gtgtagccgagcgcgcaggg

SEQ ID NO: 556599 - DNA, 20 bp, mouse
ggagtggccggagggagtcc

SEQ ID NO: 556600 - DNA, 20 bp, mouse
ggggaaaaccgggttcccag

SEQ ID NO: 556601 - DNA, 20 bp, mouse
gtgcccctgcgcgctcggag

SEQ ID NO: 556602 - DNA, 20 bp, mouse
gtcgctcaggagatctccat

SEQ ID NO: 556603 - DNA, 20 bp, mouse
gccctcggctgcccgtcccg

SEQ ID NO: 556604 - DNA, 20 bp, mouse
gccagcgagatgagcagcag

SEQ ID NO: 556605 - DNA, 20 bp, mouse
gaatgaggcgcaggagacaa

SEQ ID NO: 556606 - DNA, 20 bp, mouse
gcgccctgcgtccctcccgg

SEQ ID NO: 556607 - DNA, 20 bp, mouse
gggtaaacagcccccctccc

SEQ ID NO: 556608 - DNA, 20 bp, mouse
gaaacagcccccctccccgg

SEQ ID NO: 556609 - DNA, 20 bp, mouse
gggccgcgcgccagagaggg

SEQ ID NO: 556610 - DNA, 20 bp, mouse
gcacctcctggagcagtcgg

SEQ ID NO: 556611 - DNA, 20 bp, mouse
gcggggccgcgcgccagaga

SEQ ID NO: 556612 - DNA, 20 bp, mouse
gctggcgggcgagaagctga

SEQ ID NO: 556613 - DNA, 20 bp, mouse
gccaggaggtggtgcatggg

SEQ ID NO: 556614 - DNA, 20 bp, mouse
gcctggctcgcaggacgaca

SEQ ID NO: 556615 - DNA, 20 bp, mouse
ggaggggggctgtttacctg

SEQ ID NO: 556616 - DNA, 20 bp, mouse
ggtcctagcacagagatgtg

SEQ ID NO: 556617 - DNA, 20 bp, mouse
gtcaggcagctagttttcag

SEQ ID NO: 556618 - DNA, 20 bp, mouse
gccctgctgcctgaccgcag

SEQ ID NO: 556619 - DNA, 20 bp, mouse
gctgtgctaggaccaagaaa

SEQ ID NO: 556620 - DNA, 20 bp, mouse
gtagcacagagatgtgaggc

SEQ ID NO: 556621 - DNA, 20 bp, mouse
gacttgaccatcttatccag

SEQ ID NO: 556622 - DNA, 20 bp, mouse
ggcaggggctctcggctcaa

SEQ ID NO: 556623 - DNA, 20 bp, mouse
ggccgagagcccctgcggtc

SEQ ID NO: 556624 - DNA, 20 bp, mouse
gcttatccaggggcagttcc

SEQ ID NO: 556625 - DNA, 20 bp, mouse
gcactgtacctggatcgctt

SEQ ID NO: 556626 - DNA, 20 bp, mouse
gcgcgggccagggaacgcca

SEQ ID NO: 556627 - DNA, 20 bp, mouse
ggaggaccctgagctagcca

SEQ ID NO: 556628 - DNA, 20 bp, mouse
ggaacgccatggctagctca

SEQ ID NO: 556629 - DNA, 20 bp, mouse
ggcgcctaaggccaggtctc

SEQ ID NO: 556630 - DNA, 20 bp, mouse
gtcagggtcctccagagacc

SEQ ID NO: 556631 - DNA, 20 bp, mouse
gcaccagcacccgcgggcca

SEQ ID NO: 556632 - DNA, 20 bp, mouse
ggcccaccaccagcacccgc

SEQ ID NO: 556633 - DNA, 20 bp, mouse
gtgctaaggcgcctaaggcc

SEQ ID NO: 556634 - DNA, 20 bp, mouse
ggccccgcccgcctctgcta

SEQ ID NO: 556635 - DNA, 20 bp, mouse
gggctcagtaggaaccggat

SEQ ID NO: 556636 - DNA, 20 bp, mouse
gggcttgtaaggtgagacta

SEQ ID NO: 556637 - DNA, 20 bp, mouse
gggatctggctgggcttgta

SEQ ID NO: 556638 - DNA, 20 bp, mouse
gagagccctcccactagaca

SEQ ID NO: 556639 - DNA, 20 bp, mouse
gtgagactaaggtcagactg

SEQ ID NO: 556640 - DNA, 20 bp, mouse
ggaggtgctaggatctggct

SEQ ID NO: 556641 - DNA, 20 bp, mouse
gcgaagccatgtctagtggg

SEQ ID NO: 556642 - DNA, 20 bp, mouse
gacctcgaagccatgtctag

SEQ ID NO: 556643 - DNA, 20 bp, mouse
ggacatggcttcgaggtgct

SEQ ID NO: 556644 - DNA, 20 bp, mouse
gggatgcgtactcgaatcca

SEQ ID NO: 556645 - DNA, 20 bp, mouse
gtgcatgcttgtggaagtag

SEQ ID NO: 556646 - DNA, 20 bp, mouse
ggcgtagacaaccctgtcac

SEQ ID NO: 556647 - DNA, 20 bp, mouse
ggcgcagcgaggcccagctc

SEQ ID NO: 556648 - DNA, 20 bp, mouse
gacaaccctgtcacaggacc

SEQ ID NO: 556649 - DNA, 20 bp, mouse
gtgggaacgcccctaatcca

SEQ ID NO: 556650 - DNA, 20 bp, mouse
gcccggaaaggaatcatcag

SEQ ID NO: 556651 - DNA, 20 bp, mouse
gatcttccgggtcctgtgac

SEQ ID NO: 556652 - DNA, 20 bp, mouse
gcctaatccagggagctccg

SEQ ID NO: 556653 - DNA, 20 bp, mouse
gagcgaggcccagctcgggc

SEQ ID NO: 556654 - DNA, 20 bp, mouse
ggatcaacgtgaccccggaa

SEQ ID NO: 556655 - DNA, 20 bp, mouse
gcggccgggcgcgtgaaact

SEQ ID NO: 556656 - DNA, 20 bp, mouse
ggccgccgaggcacacgagg

SEQ ID NO: 556657 - DNA, 20 bp, mouse
ggagcggcaacagagtcctg

SEQ ID NO: 556658 - DNA, 20 bp, mouse
gtgcctcggcggcgcttgag

SEQ ID NO: 556659 - DNA, 20 bp, mouse
gagcgccgccgaggcacacg

SEQ ID NO: 556660 - DNA, 20 bp, mouse
gcggcaacagagtcctgcgg

SEQ ID NO: 556661 - DNA, 20 bp, mouse
ggccgcctcgtgtgcctcgg

SEQ ID NO: 556662 - DNA, 20 bp, mouse
gcggcggcggatcccgagaa

SEQ ID NO: 556663 - DNA, 20 bp, mouse
gtgccgctcaagcgccgccg

SEQ ID NO: 556664 - DNA, 20 bp, mouse
gcagtcactttccgcggagt

SEQ ID NO: 556665 - DNA, 20 bp, mouse
ggcagccgcctcgtgtgcct

SEQ ID NO: 556666 - DNA, 20 bp, mouse
ggatccagccggagcagaag

SEQ ID NO: 556667 - DNA, 20 bp, mouse
gtcccagatctgcatccaca

SEQ ID NO: 556668 - DNA, 20 bp, mouse
gtggccggccccttctgctc

SEQ ID NO: 556669 - DNA, 20 bp, mouse
gagatctgggagacctcgca

SEQ ID NO: 556670 - DNA, 20 bp, mouse
gcgcgtggcctggatccagc

SEQ ID NO: 556671 - DNA, 20 bp, mouse
ggcatccacagggcattggc

SEQ ID NO: 556672 - DNA, 20 bp, mouse
gagtcgggcaccgagagtcc

SEQ ID NO: 556673 - DNA, 20 bp, mouse
gatctgcatccacagggcat

SEQ ID NO: 556674 - DNA, 20 bp, mouse
ggggagacctcgcagggcgt

SEQ ID NO: 556675 - DNA, 20 bp, mouse
gccacggcccacgccctgcg

SEQ ID NO: 556676 - DNA, 20 bp, mouse
ggaagatgctgagggctcaa

SEQ ID NO: 556677 - DNA, 20 bp, mouse
ggggctcaacggagatggat

SEQ ID NO: 556678 - DNA, 20 bp, mouse
gctcccttgggactgagggt

SEQ ID NO: 556679 - DNA, 20 bp, mouse
gaacccaccctcagtcccaa

SEQ ID NO: 556680 - DNA, 20 bp, mouse
gggagatggatgggaatccc

SEQ ID NO: 556681 - DNA, 20 bp, mouse
gcaagggaggccgcgatcct

SEQ ID NO: 556682 - DNA, 20 bp, mouse
gcccagctgcggagaccccc

SEQ ID NO: 556683 - DNA, 20 bp, mouse
ggatgggaatcccaggatcg

SEQ ID NO: 556684 - DNA, 20 bp, mouse
ggttagcgccgggacaggta

SEQ ID NO: 556685 - DNA, 20 bp, mouse
gctcacgcccccctcagggt

SEQ ID NO: 556686 - DNA, 20 bp, mouse
gcccaggctgggcaccgata

SEQ ID NO: 556687 - DNA, 20 bp, mouse
gcaccgataaggcggctcca

SEQ ID NO: 556688 - DNA, 20 bp, mouse
gaggctgggcaccgataagg

SEQ ID NO: 556689 - DNA, 20 bp, mouse
gttgacagttgacccaggct

SEQ ID NO: 556690 - DNA, 20 bp, mouse
gctccagggcttcaagagac

SEQ ID NO: 556691 - DNA, 20 bp, mouse
gagaagttgacagttgaccc

SEQ ID NO: 556692 - DNA, 20 bp, mouse
gagccctggagccgccttat

SEQ ID NO: 556693 - DNA, 20 bp, mouse
gggtggctgcgtgagcactg

SEQ ID NO: 556694 - DNA, 20 bp, mouse
gggctctgcaggcttcaccc

SEQ ID NO: 556695 - DNA, 20 bp, mouse
gaggcacccagggcccccgt

SEQ ID NO: 556696 - DNA, 20 bp, mouse
ggcgccatgttaggacgaag

SEQ ID NO: 556697 - DNA, 20 bp, mouse
gcatgttaggacgaagggga

SEQ ID NO: 556698 - DNA, 20 bp, mouse
gagcgctcgggcgccatgtt

SEQ ID NO: 556699 - DNA, 20 bp, mouse
gggaggagaagcgcttaaag

SEQ ID NO: 556700 - DNA, 20 bp, mouse
gagaagcgcttaaagcggcg

SEQ ID NO: 556701 - DNA, 20 bp, mouse
gggggcacgggtgcaggact

SEQ ID NO: 556702 - DNA, 20 bp, mouse
gtccaccgaggcgggaagga

SEQ ID NO: 556703 - DNA, 20 bp, mouse
ggcttaaagcggcggggcac

SEQ ID NO: 556704 - DNA, 20 bp, mouse
ggcacgccaatcacttacaa

SEQ ID NO: 556705 - DNA, 20 bp, mouse
gcacgccggccgggccccgg

SEQ ID NO: 556706 - DNA, 20 bp, mouse
gtggcccggagggataccag

SEQ ID NO: 556707 - DNA, 20 bp, mouse
gtgaggcggcgggctcggag

SEQ ID NO: 556708 - DNA, 20 bp, mouse
gatggcgccgggctcctcag

SEQ ID NO: 556709 - DNA, 20 bp, mouse
ggtatccctccgggccaaca

SEQ ID NO: 556710 - DNA, 20 bp, mouse
gataccaggggaagcgcttg

SEQ ID NO: 556711 - DNA, 20 bp, mouse
gcggcgggctcggagcggag

SEQ ID NO: 556712 - DNA, 20 bp, mouse
gagcggagcgggggccgaca

SEQ ID NO: 556713 - DNA, 20 bp, mouse
gccgcctcaagcgcttcccc

SEQ ID NO: 556714 - DNA, 20 bp, mouse
gggtcgcgttccagaaccga

SEQ ID NO: 556715 - DNA, 20 bp, mouse
gtcctgccggccggccctgt

SEQ ID NO: 556716 - DNA, 20 bp, mouse
ggcctcggctgtagagagtg

SEQ ID NO: 556717 - DNA, 20 bp, mouse
ggagatgtctgcgtaagtgg

SEQ ID NO: 556718 - DNA, 20 bp, mouse
gggaagtagcgccatattgg

SEQ ID NO: 556719 - DNA, 20 bp, mouse
gagtagcgccatattggcgg

SEQ ID NO: 556720 - DNA, 20 bp, mouse
gctgggaagtagcgccatat

SEQ ID NO: 556721 - DNA, 20 bp, mouse
gagcgcggccaccgccaata

SEQ ID NO: 556722 - DNA, 20 bp, mouse
ggagagaggtgcgctgaggt

SEQ ID NO: 556723 - DNA, 20 bp, mouse
gtccccactctctacagccg

SEQ ID NO: 556724 - DNA, 20 bp, mouse
gagtgaaaacaccacaaaac

SEQ ID NO: 556725 - DNA, 20 bp, mouse
ggatgcccttgcggagtgga

SEQ ID NO: 556726 - DNA, 20 bp, mouse
ggtctcttcggacccggcgg

SEQ ID NO: 556727 - DNA, 20 bp, mouse
gcacggcccgagggtctctt

SEQ ID NO: 556728 - DNA, 20 bp, mouse
gcccaggcaccgcccggagg

SEQ ID NO: 556729 - DNA, 20 bp, mouse
ggagttgggtgctgcgcctg

SEQ ID NO: 556730 - DNA, 20 bp, mouse
gggacatgcggctctggagt

SEQ ID NO: 556731 - DNA, 20 bp, mouse
gagggtggtccgccagacag

SEQ ID NO: 556732 - DNA, 20 bp, mouse
gagccgtgcgcgtcccccgg

SEQ ID NO: 556733 - DNA, 20 bp, mouse
gagagcagggaggaccgtaa

SEQ ID NO: 556734 - DNA, 20 bp, mouse
ggcgcaggtggccggtccag

SEQ ID NO: 556735 - DNA, 20 bp, mouse
gtccagagccgcatgtccga

SEQ ID NO: 556736 - DNA, 20 bp, mouse
gaatagcaacaataatctgg

SEQ ID NO: 556737 - DNA, 20 bp, mouse
ggaggacctctgaggaaaga

SEQ ID NO: 556738 - DNA, 20 bp, mouse
gcaggagtgctcacctatcc

SEQ ID NO: 556739 - DNA, 20 bp, mouse
gctcacctatcctggcagac

SEQ ID NO: 556740 - DNA, 20 bp, mouse
gggggcacaaagatccagac

SEQ ID NO: 556741 - DNA, 20 bp, mouse
ggactctaactcctagggaa

SEQ ID NO: 556742 - DNA, 20 bp, mouse
gagaaggttaagtacctgtc

SEQ ID NO: 556743 - DNA, 20 bp, mouse
gtaaaatagcaacaataatc

SEQ ID NO: 556744 - DNA, 20 bp, mouse
gtgaggagaggagttactga

SEQ ID NO: 556745 - DNA, 20 bp, mouse
gtgagtgtattgtgggtgat

SEQ ID NO: 556746 - DNA, 20 bp, mouse
gagactcccaggaatctcca

SEQ ID NO: 556747 - DNA, 20 bp, mouse
gactgctgctgagagccccg

SEQ ID NO: 556748 - DNA, 20 bp, mouse
ggagccccggggccgagcag

SEQ ID NO: 556749 - DNA, 20 bp, mouse
gcgcggccatggagattcct

SEQ ID NO: 556750 - DNA, 20 bp, mouse
gctgcggcggaggcagacgg

SEQ ID NO: 556751 - DNA, 20 bp, mouse
gctttcttgcacagactccc

SEQ ID NO: 556752 - DNA, 20 bp, mouse
gctcccactgctcggccccg

SEQ ID NO: 556753 - DNA, 20 bp, mouse
gcggctcccgcaggatgcac

SEQ ID NO: 556754 - DNA, 20 bp, mouse
gagcagtgggagagaggccg

SEQ ID NO: 556755 - DNA, 20 bp, mouse
ggcacacccggaacgtgcag

SEQ ID NO: 556756 - DNA, 20 bp, mouse
ggtctctgcgccctggaccc

SEQ ID NO: 556757 - DNA, 20 bp, mouse
gcagggcgcagagacgtgga

SEQ ID NO: 556758 - DNA, 20 bp, mouse
ggtgacagagcccgggtcca

SEQ ID NO: 556759 - DNA, 20 bp, mouse
ggagccgagagggaagacac

SEQ ID NO: 556760 - DNA, 20 bp, mouse
gcacaaccgcagcatgtcgg

SEQ ID NO: 556761 - DNA, 20 bp, mouse
gggcgcagagacgtggatgg

SEQ ID NO: 556762 - DNA, 20 bp, mouse
gcgagggtggcccagagacg

SEQ ID NO: 556763 - DNA, 20 bp, mouse
gtgcggttgtgacagagccc

SEQ ID NO: 556764 - DNA, 20 bp, mouse
ggcagagacgtggatggcgg

SEQ ID NO: 556765 - DNA, 20 bp, mouse
gtacagcgagaggctctccg

SEQ ID NO: 556766 - DNA, 20 bp, mouse
gagaatactcggttacaaac

SEQ ID NO: 556767 - DNA, 20 bp, mouse
ggtgggtgtgaatgggaatg

SEQ ID NO: 556768 - DNA, 20 bp, mouse
gtaaagttgccagatttcaa

SEQ ID NO: 556769 - DNA, 20 bp, mouse
gatctgatgttgagaatact

SEQ ID NO: 556770 - DNA, 20 bp, mouse
gcccagacacacaaccagta

SEQ ID NO: 556771 - DNA, 20 bp, mouse
gtaagtaagcccttgaaatc

SEQ ID NO: 556772 - DNA, 20 bp, mouse
gactggctttgctggccatt

SEQ ID NO: 556773 - DNA, 20 bp, mouse
ggcttcagcagtggccttac

SEQ ID NO: 556774 - DNA, 20 bp, mouse
gaacatcagatatcatgtct

SEQ ID NO: 556775 - DNA, 20 bp, mouse
gaaatctggcaactttatcc

SEQ ID NO: 556776 - DNA, 20 bp, mouse
gcggccgtccagagctgaag

SEQ ID NO: 556777 - DNA, 20 bp, mouse
gtccagagctgaagcggcgg

SEQ ID NO: 556778 - DNA, 20 bp, mouse
gccgtccagagctgaagcgg

SEQ ID NO: 556779 - DNA, 20 bp, mouse
ggccgggcctgagcagacgc

SEQ ID NO: 556780 - DNA, 20 bp, mouse
ggccgaagctcctggctcag

SEQ ID NO: 556781 - DNA, 20 bp, mouse
ggcccgcgtctgctcaggcc

SEQ ID NO: 556782 - DNA, 20 bp, mouse
gggtagccgtcggtgatgta

SEQ ID NO: 556783 - DNA, 20 bp, mouse
gtaccaggaccggccagtat

SEQ ID NO: 556784 - DNA, 20 bp, mouse
gagaatagcggagaaagatg

SEQ ID NO: 556785 - DNA, 20 bp, mouse
gacctccgccgcttcagctc

SEQ ID NO: 556786 - DNA, 20 bp, mouse
gagcggcggagggagagctc

SEQ ID NO: 556787 - DNA, 20 bp, mouse
gctccaccgtagcagagcgg

SEQ ID NO: 556788 - DNA, 20 bp, mouse
gcagctccaccgtagcagag

SEQ ID NO: 556789 - DNA, 20 bp, mouse
ggagctccggttggccgcaa

SEQ ID NO: 556790 - DNA, 20 bp, mouse
ggcggagggagagctccggt

SEQ ID NO: 556791 - DNA, 20 bp, mouse
ggcgtctcgccgcagcccgg

SEQ ID NO: 556792 - DNA, 20 bp, mouse
gtccctccgccgctctgcta

SEQ ID NO: 556793 - DNA, 20 bp, mouse
gtcgccgcagcccggaggac

SEQ ID NO: 556794 - DNA, 20 bp, mouse
gaccgtagcagagcggcgga

SEQ ID NO: 556795 - DNA, 20 bp, mouse
gccggccgcgcccgtcctcc

SEQ ID NO: 556796 - DNA, 20 bp, mouse
ggcaagagcagatccgagac

SEQ ID NO: 556797 - DNA, 20 bp, mouse
gtgggaggagtagcccgtct

SEQ ID NO: 556798 - DNA, 20 bp, mouse
ggcacctggagaacccagag

SEQ ID NO: 556799 - DNA, 20 bp, mouse
gcgcgggcccccaagcgcct

SEQ ID NO: 556800 - DNA, 20 bp, mouse
gcccgggctccgtggctcag

SEQ ID NO: 556801 - DNA, 20 bp, mouse
gactcctcccaggccagcgc

SEQ ID NO: 556802 - DNA, 20 bp, mouse
ggtctctacgccctatccac

SEQ ID NO: 556803 - DNA, 20 bp, mouse
ggtgcagttcccaggcgctt

SEQ ID NO: 556804 - DNA, 20 bp, mouse
gcccgggtgctacttgaaga

SEQ ID NO: 556805 - DNA, 20 bp, mouse
gaggcctcccctcttcacgt

SEQ ID NO: 556806 - DNA, 20 bp, mouse
gggacgcggcaaacaggtct

SEQ ID NO: 556807 - DNA, 20 bp, mouse
gcaaacaggtctgggctgag

SEQ ID NO: 556808 - DNA, 20 bp, mouse
gaggggcacgggacccagga

SEQ ID NO: 556809 - DNA, 20 bp, mouse
gtccaggaggccccacatag

SEQ ID NO: 556810 - DNA, 20 bp, mouse
ggggctctgagtattcccaa

SEQ ID NO: 556811 - DNA, 20 bp, mouse
gccacccggacgcggcaaac

SEQ ID NO: 556812 - DNA, 20 bp, mouse
gccaaggaatgtgctgggag

SEQ ID NO: 556813 - DNA, 20 bp, mouse
gcccaggctaggaccaggag

SEQ ID NO: 556814 - DNA, 20 bp, mouse
ggaggcggctgagaggcggg

SEQ ID NO: 556815 - DNA, 20 bp, mouse
gccggtgccaaggaatgtgc

SEQ ID NO: 556816 - DNA, 20 bp, mouse
ggcccggccccgggatctcc

SEQ ID NO: 556817 - DNA, 20 bp, mouse
gactgctcctggagatcccg

SEQ ID NO: 556818 - DNA, 20 bp, mouse
gcagccggacagttatgtag

SEQ ID NO: 556819 - DNA, 20 bp, mouse
gccatggagaaggaggacca

SEQ ID NO: 556820 - DNA, 20 bp, mouse
gtatgtaggggagcacctcc

SEQ ID NO: 556821 - DNA, 20 bp, mouse
gtgcgtgcggtgcccagtgg

SEQ ID NO: 556822 - DNA, 20 bp, mouse
gaggggagcacctcccggta

SEQ ID NO: 556823 - DNA, 20 bp, mouse
gggtgaggagaggtcaccaa

SEQ ID NO: 556824 - DNA, 20 bp, mouse
gtctcctcacccctaccggg

SEQ ID NO: 556825 - DNA, 20 bp, mouse
gatctgcgactccagcgcgg

SEQ ID NO: 556826 - DNA, 20 bp, mouse
gtcgggtgcagagccctcgg

SEQ ID NO: 556827 - DNA, 20 bp, mouse
ggagccctcggcggtcgggg

SEQ ID NO: 556828 - DNA, 20 bp, mouse
gggagctggagtcgggagtg

SEQ ID NO: 556829 - DNA, 20 bp, mouse
ggcgcctgacccgacctgta

SEQ ID NO: 556830 - DNA, 20 bp, mouse
ggagtcgggagtgcggctgg

SEQ ID NO: 556831 - DNA, 20 bp, mouse
ggacccccacccccacagtc

SEQ ID NO: 556832 - DNA, 20 bp, mouse
gctggagtcgggagtgcggc

SEQ ID NO: 556833 - DNA, 20 bp, mouse
gccaggtgcccggaacctag

SEQ ID NO: 556834 - DNA, 20 bp, mouse
gcctgacccgacctgtaggg

SEQ ID NO: 556835 - DNA, 20 bp, mouse
ggagcctccccgaccgccga

SEQ ID NO: 556836 - DNA, 20 bp, mouse
ggcggtggcgcggctgactg

SEQ ID NO: 556837 - DNA, 20 bp, mouse
gcggcgtcctcgccacgctc

SEQ ID NO: 556838 - DNA, 20 bp, mouse
gaggccgcgtagccaacctg

SEQ ID NO: 556839 - DNA, 20 bp, mouse
gccgcagcgcggccggccgc

SEQ ID NO: 556840 - DNA, 20 bp, mouse
ggctcgggtctctcagcccg

SEQ ID NO: 556841 - DNA, 20 bp, mouse
ggtggcgcggctgactgcgg

SEQ ID NO: 556842 - DNA, 20 bp, mouse
gggcgcgcgcgaggccaccg

SEQ ID NO: 556843 - DNA, 20 bp, mouse
ggagagacccgagcgtggcg

SEQ ID NO: 556844 - DNA, 20 bp, mouse
gcggctgactgcggcggtgg

SEQ ID NO: 556845 - DNA, 20 bp, mouse
ggcgcgcacaaaggctccga

SEQ ID NO: 556846 - DNA, 20 bp, mouse
gctcagtcgggactccgagg

SEQ ID NO: 556847 - DNA, 20 bp, mouse
gtgcctcgccgtcccctcct

SEQ ID NO: 556848 - DNA, 20 bp, mouse
ggtcttggcgcgctcggcgg

SEQ ID NO: 556849 - DNA, 20 bp, mouse
gcacggacagcgagggacgg

SEQ ID NO: 556850 - DNA, 20 bp, mouse
ggcgagcgccacacggcccc

SEQ ID NO: 556851 - DNA, 20 bp, mouse
gagggaggaggagcagcgac

SEQ ID NO: 556852 - DNA, 20 bp, mouse
gactgagcgcgagcgccaca

SEQ ID NO: 556853 - DNA, 20 bp, mouse
gcagcctccggccacctgtt

SEQ ID NO: 556854 - DNA, 20 bp, mouse
gcgccgagacgccgaacagg

SEQ ID NO: 556855 - DNA, 20 bp, mouse
ggcggcggcccggggccgtg

SEQ ID NO: 556856 - DNA, 20 bp, mouse
gggcgcgcggggccagagtt

SEQ ID NO: 556857 - DNA, 20 bp, mouse
ggcgcggggccagagttggg

SEQ ID NO: 556858 - DNA, 20 bp, mouse
gcgcgcgcgtcggaggagtt

SEQ ID NO: 556859 - DNA, 20 bp, mouse
gaggccgagggcgggaacgc

SEQ ID NO: 556860 - DNA, 20 bp, mouse
ggtcggccgggcgcaagcgg

SEQ ID NO: 556861 - DNA, 20 bp, mouse
gtcccctgcagccccacggg

SEQ ID NO: 556862 - DNA, 20 bp, mouse
gcgtcggaggagttgggagc

SEQ ID NO: 556863 - DNA, 20 bp, mouse
gagagcgccgcgcgcgtcgg

SEQ ID NO: 556864 - DNA, 20 bp, mouse
gccgccctcggcctcccgtg

SEQ ID NO: 556865 - DNA, 20 bp, mouse
gtcgctagggccaccgccag

SEQ ID NO: 556866 - DNA, 20 bp, mouse
ggtactgaggaacagctcac

SEQ ID NO: 556867 - DNA, 20 bp, mouse
ggaggctgcagcagagaatg

SEQ ID NO: 556868 - DNA, 20 bp, mouse
gcggctctagagttgtactg

SEQ ID NO: 556869 - DNA, 20 bp, mouse
gaggcgcagaaccgcgaggg

SEQ ID NO: 556870 - DNA, 20 bp, mouse
ggccaggccgcagaggactc

SEQ ID NO: 556871 - DNA, 20 bp, mouse
gagagccaaggaactaataa

SEQ ID NO: 556872 - DNA, 20 bp, mouse
gggctctagccactgcgcta

SEQ ID NO: 556873 - DNA, 20 bp, mouse
gtgacagtttattcttaccg

SEQ ID NO: 556874 - DNA, 20 bp, mouse
gagcagctaggtcagtcagc

SEQ ID NO: 556875 - DNA, 20 bp, mouse
gacccgggaagagcttgcgc

SEQ ID NO: 556876 - DNA, 20 bp, mouse
ggccgcacggcgcctcgtca

SEQ ID NO: 556877 - DNA, 20 bp, mouse
gtccgcggcggcctgagggt

SEQ ID NO: 556878 - DNA, 20 bp, mouse
gcgcagtgccggctgctccg

SEQ ID NO: 556879 - DNA, 20 bp, mouse
gagcagccggcactgcgctg

SEQ ID NO: 556880 - DNA, 20 bp, mouse
gtccgaccctcaggccgccg

SEQ ID NO: 556881 - DNA, 20 bp, mouse
gggctgcctgggcaccatgg

SEQ ID NO: 556882 - DNA, 20 bp, mouse
gctcgtcacggcacctgctg

SEQ ID NO: 556883 - DNA, 20 bp, mouse
ggccgtgacgaggcgccgtg

SEQ ID NO: 556884 - DNA, 20 bp, mouse
gaccggcacggggcgagcag

SEQ ID NO: 556885 - DNA, 20 bp, mouse
gcactggcagtccgaccctc

SEQ ID NO: 556886 - DNA, 20 bp, mouse
ggcctcagagagagtctccg

SEQ ID NO: 556887 - DNA, 20 bp, mouse
ggccgggcccgcgctcgcta

SEQ ID NO: 556888 - DNA, 20 bp, mouse
ggccgggcccgggcagacgt

SEQ ID NO: 556889 - DNA, 20 bp, mouse
gggcccgggcagacgttggg

SEQ ID NO: 556890 - DNA, 20 bp, mouse
gaagtgcccgaggcccaccg

SEQ ID NO: 556891 - DNA, 20 bp, mouse
ggccatgggacagtcagtgt

SEQ ID NO: 556892 - DNA, 20 bp, mouse
ggagtgcagaccgccccggt

SEQ ID NO: 556893 - DNA, 20 bp, mouse
gtccgcggagactctctctg

SEQ ID NO: 556894 - DNA, 20 bp, mouse
gcgcgccgcggggactccag

SEQ ID NO: 556895 - DNA, 20 bp, mouse
gtgcccgaggcccaccgggg

SEQ ID NO: 556896 - DNA, 20 bp, mouse
gatctcgagccgagtggaag

SEQ ID NO: 556897 - DNA, 20 bp, mouse
ggggacgcgccgcttccact

SEQ ID NO: 556898 - DNA, 20 bp, mouse
gtcggctcgagatcgggctc

SEQ ID NO: 556899 - DNA, 20 bp, mouse
gtcactaacccggacaggga

SEQ ID NO: 556900 - DNA, 20 bp, mouse
gcgagacggctgctttccgg

SEQ ID NO: 556901 - DNA, 20 bp, mouse
gcgctcgaaggcccgaggag

SEQ ID NO: 556902 - DNA, 20 bp, mouse
gtgggctccctgctgccgag

SEQ ID NO: 556903 - DNA, 20 bp, mouse
ggtcggcgcagaagttccag

SEQ ID NO: 556904 - DNA, 20 bp, mouse
ggggaaagtgagcctggagc

SEQ ID NO: 556905 - DNA, 20 bp, mouse
ggcagccgcttgcctccgct

SEQ ID NO: 556906 - DNA, 20 bp, mouse
ggtctgatggctagaggagg

SEQ ID NO: 556907 - DNA, 20 bp, mouse
ggtaagcaggccctgcatag

SEQ ID NO: 556908 - DNA, 20 bp, mouse
gaggatccttggagaagagc

SEQ ID NO: 556909 - DNA, 20 bp, mouse
gctctgatgcggcctttgga

SEQ ID NO: 556910 - DNA, 20 bp, mouse
ggagttgggacagccagctg

SEQ ID NO: 556911 - DNA, 20 bp, mouse
gtgatggagctctttaatca

SEQ ID NO: 556912 - DNA, 20 bp, mouse
gaggtgagtcatccttccaa

SEQ ID NO: 556913 - DNA, 20 bp, mouse
gcaggtctgatggctagagg

SEQ ID NO: 556914 - DNA, 20 bp, mouse
gcttccatgagactctgatg

SEQ ID NO: 556915 - DNA, 20 bp, mouse
gaataacctgtcaggtctga

SEQ ID NO: 556916 - DNA, 20 bp, mouse
gactagcggtggcttcgcgt

SEQ ID NO: 556917 - DNA, 20 bp, mouse
ggtcgggtgcgaggttcctg

SEQ ID NO: 556918 - DNA, 20 bp, mouse
gtgcgtgctgggtacacgtc

SEQ ID NO: 556919 - DNA, 20 bp, mouse
gagcccggcctctagcccca

SEQ ID NO: 556920 - DNA, 20 bp, mouse
gacagctagccgccactcgg

SEQ ID NO: 556921 - DNA, 20 bp, mouse
gggttcctgcggactagcgg

SEQ ID NO: 556922 - DNA, 20 bp, mouse
gagcggtggcttcgcgtggg

SEQ ID NO: 556923 - DNA, 20 bp, mouse
gcgaggttcctgcggactag

SEQ ID NO: 556924 - DNA, 20 bp, mouse
gggaaagtgcctccgagtgg

SEQ ID NO: 556925 - DNA, 20 bp, mouse
ggctctgcacagcatcctcc

SEQ ID NO: 556926 - DNA, 20 bp, mouse
gcgctgtgaacgcttctcgg

SEQ ID NO: 556927 - DNA, 20 bp, mouse
gctgtgggaggcgttctggg

SEQ ID NO: 556928 - DNA, 20 bp, mouse
gtgactcggagacctgcgag

SEQ ID NO: 556929 - DNA, 20 bp, mouse
ggctctgtgggaggcgttct

SEQ ID NO: 556930 - DNA, 20 bp, mouse
gagaagcgttcacagcgtcc

SEQ ID NO: 556931 - DNA, 20 bp, mouse
gcagcgtcccggccgaggcg

SEQ ID NO: 556932 - DNA, 20 bp, mouse
ggactagacccgcctcgcct

SEQ ID NO: 556933 - DNA, 20 bp, mouse
ggtcggcgcgaacggagagt

SEQ ID NO: 556934 - DNA, 20 bp, mouse
ggcaagcgttgctctgtggg

SEQ ID NO: 556935 - DNA, 20 bp, mouse
gccggcaagcgttgctctgt

SEQ ID NO: 556936 - DNA, 20 bp, mouse
gttctaggccggggttagag

SEQ ID NO: 556937 - DNA, 20 bp, mouse
gggttagagaggtcgggcca

SEQ ID NO: 556938 - DNA, 20 bp, mouse
gaggccggggttagagaggt

SEQ ID NO: 556939 - DNA, 20 bp, mouse
gccagctcatgggaagccgg

SEQ ID NO: 556940 - DNA, 20 bp, mouse
gtgcaaggttgggtacagcg

SEQ ID NO: 556941 - DNA, 20 bp, mouse
gcggcacccagaagccagta

SEQ ID NO: 556942 - DNA, 20 bp, mouse
gggcctagaaatcacttccg

SEQ ID NO: 556943 - DNA, 20 bp, mouse
gcgccccggaagtgatttct

SEQ ID NO: 556944 - DNA, 20 bp, mouse
ggggttgcgcgcatcctcgg

SEQ ID NO: 556945 - DNA, 20 bp, mouse
gcacggctacctatcccccg

SEQ ID NO: 556946 - DNA, 20 bp, mouse
ggcggcgcaaggcgaagtgg

SEQ ID NO: 556947 - DNA, 20 bp, mouse
ggcgcaaggcgaagtggagg

SEQ ID NO: 556948 - DNA, 20 bp, mouse
gctggcggcgcaaggcgaag

SEQ ID NO: 556949 - DNA, 20 bp, mouse
gcgccaggcgcgacgagtcc

SEQ ID NO: 556950 - DNA, 20 bp, mouse
gaggcagcttcggtgtctgg

SEQ ID NO: 556951 - DNA, 20 bp, mouse
gaagtgcgcctggcgccgca

SEQ ID NO: 556952 - DNA, 20 bp, mouse
gcgacgagtccaggcagctt

SEQ ID NO: 556953 - DNA, 20 bp, mouse
gaggcgaagtggaggtggcg

SEQ ID NO: 556954 - DNA, 20 bp, mouse
ggctcctcttcggaccgggt

SEQ ID NO: 556955 - DNA, 20 bp, mouse
gacctaccaccctccagtgg

SEQ ID NO: 556956 - DNA, 20 bp, mouse
gagcagcgtggggatgtcgg

SEQ ID NO: 556957 - DNA, 20 bp, mouse
gggccgccacgaaacagcac

SEQ ID NO: 556958 - DNA, 20 bp, mouse
gagatctgacgcaggcgcag

SEQ ID NO: 556959 - DNA, 20 bp, mouse
gctaggtgggcttgaggaca

SEQ ID NO: 556960 - DNA, 20 bp, mouse
gcgtggaccggcgtcagcct

SEQ ID NO: 556961 - DNA, 20 bp, mouse
ggtcctgtgctgtttcgtgg

SEQ ID NO: 556962 - DNA, 20 bp, mouse
ggggccccgctaaactcgag

SEQ ID NO: 556963 - DNA, 20 bp, mouse
gaagtgttcaaggaccacaa

SEQ ID NO: 556964 - DNA, 20 bp, mouse
gcgctaaactcgagaggtct

SEQ ID NO: 556965 - DNA, 20 bp, mouse
gagggccggaggagctcccg

SEQ ID NO: 556966 - DNA, 20 bp, mouse
gtagcggagcgcaccagcgg

SEQ ID NO: 556967 - DNA, 20 bp, mouse
gcgttagcggagcgcaccag

SEQ ID NO: 556968 - DNA, 20 bp, mouse
ggtgcgctccgctaacgtgt

SEQ ID NO: 556969 - DNA, 20 bp, mouse
gcagccggaccgggagagaa

SEQ ID NO: 556970 - DNA, 20 bp, mouse
gcggctctgcacgcttgcgg

SEQ ID NO: 556971 - DNA, 20 bp, mouse
gccgctgcagcacgagaagg

SEQ ID NO: 556972 - DNA, 20 bp, mouse
gggggaaaccgacacgttag

SEQ ID NO: 556973 - DNA, 20 bp, mouse
gctgccgctgcagcacgaga

SEQ ID NO: 556974 - DNA, 20 bp, mouse
gaatctatcctgagcggagg

SEQ ID NO: 556975 - DNA, 20 bp, mouse
gatcagtaatctatcctgag

SEQ ID NO: 556976 - DNA, 20 bp, mouse
gcaggcagaaggcctaaggt

SEQ ID NO: 556977 - DNA, 20 bp, mouse
ggacagcaggcataactgac

SEQ ID NO: 556978 - DNA, 20 bp, mouse
gttcccaggcagaaggccta

SEQ ID NO: 556979 - DNA, 20 bp, mouse
ggtcctgggcggcaacacat

SEQ ID NO: 556980 - DNA, 20 bp, mouse
gtatgcctgctgtccttccc

SEQ ID NO: 556981 - DNA, 20 bp, mouse
gggcagtccccggagctcca

SEQ ID NO: 556982 - DNA, 20 bp, mouse
gctgccatcagagtcctggg

SEQ ID NO: 556983 - DNA, 20 bp, mouse
gctgggcggcaacacatggg

SEQ ID NO: 556984 - DNA, 20 bp, mouse
ggctcatctggtatttctgg

SEQ ID NO: 556985 - DNA, 20 bp, mouse
gtcctccacccgagcgacgg

SEQ ID NO: 556986 - DNA, 20 bp, mouse
gcaggagcgaaaggaccgaa

SEQ ID NO: 556987 - DNA, 20 bp, mouse
ggaagacgccagcttgtgac

SEQ ID NO: 556988 - DNA, 20 bp, mouse
ggccagcttgtgacggggag

SEQ ID NO: 556989 - DNA, 20 bp, mouse
gcggaagtcgggaggttcga

SEQ ID NO: 556990 - DNA, 20 bp, mouse
gagaaggaaggcttccgtaa

SEQ ID NO: 556991 - DNA, 20 bp, mouse
ggagggtccccaggagcgaa

SEQ ID NO: 556992 - DNA, 20 bp, mouse
gccagcctgaggcaccgcgg

SEQ ID NO: 556993 - DNA, 20 bp, mouse
ggctagccgtggggtcgata

SEQ ID NO: 556994 - DNA, 20 bp, mouse
gcgtcccgccggctactcac

SEQ ID NO: 556995 - DNA, 20 bp, mouse
ggccgtggggtcgatatggt

SEQ ID NO: 556996 - DNA, 20 bp, mouse
ggtggggcccggcccgtgaa

SEQ ID NO: 556997 - DNA, 20 bp, mouse
gggacggcggcgcctttcac

SEQ ID NO: 556998 - DNA, 20 bp, mouse
gggccatggccgtcggactg

SEQ ID NO: 556999 - DNA, 20 bp, mouse
ggccatggcccaggccgcgg

SEQ ID NO: 557000 - DNA, 20 bp, mouse
gtccttccagcgaaacagtg

SEQ ID NO: 557001 - DNA, 20 bp, mouse
gagcggtctgccccaatcac

SEQ ID NO: 557002 - DNA, 20 bp, mouse
ggactgcgggcgcttcgtgg

SEQ ID NO: 557003 - DNA, 20 bp, mouse
gagcctcagtccgacggcca

SEQ ID NO: 557004 - DNA, 20 bp, mouse
gcacagacgcagcgacgaca

SEQ ID NO: 557005 - DNA, 20 bp, mouse
ggggtaaggacgccaacggt

SEQ ID NO: 557006 - DNA, 20 bp, mouse
gtcctgactgaactaggaag

SEQ ID NO: 557007 - DNA, 20 bp, mouse
gtcggtgcgggagatcctgg

SEQ ID NO: 557008 - DNA, 20 bp, mouse
gccctcgaccagcagcggga

SEQ ID NO: 557009 - DNA, 20 bp, mouse
gtctccccggaggatggtga

SEQ ID NO: 557010 - DNA, 20 bp, mouse
gcgcccctcaccatcctccg

SEQ ID NO: 557011 - DNA, 20 bp, mouse
gcagtcaggatggcagcgtc

SEQ ID NO: 557012 - DNA, 20 bp, mouse
gaagagccctcgaccagcag

SEQ ID NO: 557013 - DNA, 20 bp, mouse
gtgcagccgagggctagacc

SEQ ID NO: 557014 - DNA, 20 bp, mouse
gtggcgagcgcaaccgggag

SEQ ID NO: 557015 - DNA, 20 bp, mouse
gaggggcgcgaaggtcgggg

SEQ ID NO: 557016 - DNA, 20 bp, mouse
gcggcgtgggtagtaccccg

SEQ ID NO: 557017 - DNA, 20 bp, mouse
ggggatgcagctctccaaca

SEQ ID NO: 557018 - DNA, 20 bp, mouse
gtggggcggccaggactgat

SEQ ID NO: 557019 - DNA, 20 bp, mouse
gagtcccggagtccccggta

SEQ ID NO: 557020 - DNA, 20 bp, mouse
ggcgtggccgggaggagaca

SEQ ID NO: 557021 - DNA, 20 bp, mouse
gccgccagtcccggagtccc

SEQ ID NO: 557022 - DNA, 20 bp, mouse
gtcgctattgcacccggcgt

SEQ ID NO: 557023 - DNA, 20 bp, mouse
gtccaacagggcagcagcca

SEQ ID NO: 557024 - DNA, 20 bp, mouse
gtagcgacaactccataccg

SEQ ID NO: 557025 - DNA, 20 bp, mouse
ggtccgcagccagcacgtcg

SEQ ID NO: 557026 - DNA, 20 bp, mouse
gaggctctggaaggcgaggt

SEQ ID NO: 557027 - DNA, 20 bp, mouse
gcgccgcggcggcagagatc

SEQ ID NO: 557028 - DNA, 20 bp, mouse
gggcggcagagatcaggctc

SEQ ID NO: 557029 - DNA, 20 bp, mouse
gagagcagggctctacgctt

SEQ ID NO: 557030 - DNA, 20 bp, mouse
gttcaagagcgatggcgccg

SEQ ID NO: 557031 - DNA, 20 bp, mouse
gaggtgggaactcagtccgc

SEQ ID NO: 557032 - DNA, 20 bp, mouse
gagaccacagacacagtata

SEQ ID NO: 557033 - DNA, 20 bp, mouse
ggggccgagcattcagcctg

SEQ ID NO: 557034 - DNA, 20 bp, mouse
gtagaccggccgccactata

SEQ ID NO: 557035 - DNA, 20 bp, mouse
gtgctcggcccagtgtcaca

SEQ ID NO: 557036 - DNA, 20 bp, mouse
gctagctgaaggctcacgaa

SEQ ID NO: 557037 - DNA, 20 bp, mouse
gtgccctgcagaggactcta

SEQ ID NO: 557038 - DNA, 20 bp, mouse
gctagatgggatcccagact

SEQ ID NO: 557039 - DNA, 20 bp, mouse
gtcacgaagggtcgctagat

SEQ ID NO: 557040 - DNA, 20 bp, mouse
gtctcctggggcaagaggta

SEQ ID NO: 557041 - DNA, 20 bp, mouse
gtggctcgaggtgttccccg

SEQ ID NO: 557042 - DNA, 20 bp, mouse
gtgcttcctaactccagggt

SEQ ID NO: 557043 - DNA, 20 bp, mouse
gttggtcctaagctctagag

SEQ ID NO: 557044 - DNA, 20 bp, mouse
gcctaccaaaaactagctga

SEQ ID NO: 557045 - DNA, 20 bp, mouse
gagaaacaagttccaagtct

SEQ ID NO: 557046 - DNA, 20 bp, mouse
ggcctggagcggaagcacca

SEQ ID NO: 557047 - DNA, 20 bp, mouse
gcgctggctgcggagcacgg

SEQ ID NO: 557048 - DNA, 20 bp, mouse
gcctaggaggggagtgccag

SEQ ID NO: 557049 - DNA, 20 bp, mouse
ggaacgctggctgcggagca

SEQ ID NO: 557050 - DNA, 20 bp, mouse
gctccaggcgcagccgggtt

SEQ ID NO: 557051 - DNA, 20 bp, mouse
gaggcgcagccgggttaggt

SEQ ID NO: 557052 - DNA, 20 bp, mouse
ggaccatccgacaccaggaa

SEQ ID NO: 557053 - DNA, 20 bp, mouse
gggagcggaagcaccaaggc

SEQ ID NO: 557054 - DNA, 20 bp, mouse
gcgccgcgccccacctaacc

SEQ ID NO: 557055 - DNA, 20 bp, mouse
ggaggggaccatccgacacc

SEQ ID NO: 557056 - DNA, 20 bp, mouse
gggcccgggacgccccgcgg

SEQ ID NO: 557057 - DNA, 20 bp, mouse
gccagcctagagagtactca

SEQ ID NO: 557058 - DNA, 20 bp, mouse
ggagtactcacggcgacccc

SEQ ID NO: 557059 - DNA, 20 bp, mouse
gggcggagcggcaggccaag

SEQ ID NO: 557060 - DNA, 20 bp, mouse
ggggccgctcgtcccctccg

SEQ ID NO: 557061 - DNA, 20 bp, mouse
ggtcgccgtgagtactctct

SEQ ID NO: 557062 - DNA, 20 bp, mouse
gcgcagacgggtccttaacg

SEQ ID NO: 557063 - DNA, 20 bp, mouse
gagcggcccgggacgccccg

SEQ ID NO: 557064 - DNA, 20 bp, mouse
gtctaggctggcgtgtgggg

SEQ ID NO: 557065 - DNA, 20 bp, mouse
gctgcctgagggaccaagta

SEQ ID NO: 557066 - DNA, 20 bp, mouse
ggcaggggctgaaggcgaag

SEQ ID NO: 557067 - DNA, 20 bp, mouse
gaaacctctggccgaggcag

SEQ ID NO: 557068 - DNA, 20 bp, mouse
gtcccgggtgagagaggagg

SEQ ID NO: 557069 - DNA, 20 bp, mouse
gcctggtcccaggatccgag

SEQ ID NO: 557070 - DNA, 20 bp, mouse
gtggtttcggaagtgatccc

SEQ ID NO: 557071 - DNA, 20 bp, mouse
gaagtgatcccgggtgagag

SEQ ID NO: 557072 - DNA, 20 bp, mouse
gcagctgggcggtcacatct

SEQ ID NO: 557073 - DNA, 20 bp, mouse
gcagttaaaaatgaaacctc

SEQ ID NO: 557074 - DNA, 20 bp, mouse
gaaaatgaaacctctggccg

SEQ ID NO: 557075 - DNA, 20 bp, mouse
ggcaatgggggtagacagag

SEQ ID NO: 557076 - DNA, 20 bp, mouse
ggagcgtgcgaactactcac

SEQ ID NO: 557077 - DNA, 20 bp, mouse
gggcagagcaagacaggcgg

SEQ ID NO: 557078 - DNA, 20 bp, mouse
gagggcgacctgccaccgta

SEQ ID NO: 557079 - DNA, 20 bp, mouse
gcgaactactcaccgggtga

SEQ ID NO: 557080 - DNA, 20 bp, mouse
gggcggctctgcggagaaca

SEQ ID NO: 557081 - DNA, 20 bp, mouse
gagggtggagcggaatagag

SEQ ID NO: 557082 - DNA, 20 bp, mouse
ggctctgcggagaacaagga

SEQ ID NO: 557083 - DNA, 20 bp, mouse
gcgatcctgcaagaatagaa

SEQ ID NO: 557084 - DNA, 20 bp, mouse
gccttgagaggcctgaacct

SEQ ID NO: 557085 - DNA, 20 bp, mouse
gtagttcgcacgctcggcgg

SEQ ID NO: 557086 - DNA, 20 bp, mouse
gctgggtcactggacgaggt

SEQ ID NO: 557087 - DNA, 20 bp, mouse
gcaggctgggtgcaagcgga

SEQ ID NO: 557088 - DNA, 20 bp, mouse
gcactggaactgcgacccgg

SEQ ID NO: 557089 - DNA, 20 bp, mouse
gcagcctgggtcactggacg

SEQ ID NO: 557090 - DNA, 20 bp, mouse
gtcactggacgaggtgggtc

SEQ ID NO: 557091 - DNA, 20 bp, mouse
ggctgggtgcaagcggaggg

SEQ ID NO: 557092 - DNA, 20 bp, mouse
gagcagcgcagccaggacgc

SEQ ID NO: 557093 - DNA, 20 bp, mouse
gtgcacccagcctgggtcac

SEQ ID NO: 557094 - DNA, 20 bp, mouse
gacgggacaccgtgaagtcg

SEQ ID NO: 557095 - DNA, 20 bp, mouse
ggcccactggaactgcgacc

SEQ ID NO: 557096 - DNA, 20 bp, mouse
gtgctgctggtgagcatcgg

SEQ ID NO: 557097 - DNA, 20 bp, mouse
gagccaccctccaagtccag

SEQ ID NO: 557098 - DNA, 20 bp, mouse
gggtggccgctggacttgga

SEQ ID NO: 557099 - DNA, 20 bp, mouse
ggaagggcccagcgaatcta

SEQ ID NO: 557100 - DNA, 20 bp, mouse
gactgaagagcgcccgactc

SEQ ID NO: 557101 - DNA, 20 bp, mouse
gcttggagggtggctaggaa

SEQ ID NO: 557102 - DNA, 20 bp, mouse
gggccgctggacttggaggg

SEQ ID NO: 557103 - DNA, 20 bp, mouse
ggcaactcaatacctgagtc

SEQ ID NO: 557104 - DNA, 20 bp, mouse
gcatcggtggccgctggact

SEQ ID NO: 557105 - DNA, 20 bp, mouse
ggggccacgcaaggataact

SEQ ID NO: 557106 - DNA, 20 bp, mouse
gtgtggggatgtggccatgg

SEQ ID NO: 557107 - DNA, 20 bp, mouse
gaccaagggcgacttctgtg

SEQ ID NO: 557108 - DNA, 20 bp, mouse
gtggaagtgggagacccccc

SEQ ID NO: 557109 - DNA, 20 bp, mouse
gggatcgggagcctggaagt

SEQ ID NO: 557110 - DNA, 20 bp, mouse
gttctgtggggatgtggcca

SEQ ID NO: 557111 - DNA, 20 bp, mouse
gggcctaggggagagcacag

SEQ ID NO: 557112 - DNA, 20 bp, mouse
ggcgacatggggacactgag

SEQ ID NO: 557113 - DNA, 20 bp, mouse
gtaggaacagccgaggccgt

SEQ ID NO: 557114 - DNA, 20 bp, mouse
ggctccgcgtccagccgcca

SEQ ID NO: 557115 - DNA, 20 bp, mouse
ggacggaggcgacttgggag

SEQ ID NO: 557116 - DNA, 20 bp, mouse
gtatgtcctccgcgccacca

SEQ ID NO: 557117 - DNA, 20 bp, mouse
ggcgcgacaggagggctcat

SEQ ID NO: 557118 - DNA, 20 bp, mouse
gaccacggtcgcccaccccg

SEQ ID NO: 557119 - DNA, 20 bp, mouse
gagaaggacgagtctttctt

SEQ ID NO: 557120 - DNA, 20 bp, mouse
gtggcgccaaagggacgcag

SEQ ID NO: 557121 - DNA, 20 bp, mouse
ggcagggagcggacacacgg

SEQ ID NO: 557122 - DNA, 20 bp, mouse
gtagcctgagcgcgacagga

SEQ ID NO: 557123 - DNA, 20 bp, mouse
ggactcgtccttcttcatct

SEQ ID NO: 557124 - DNA, 20 bp, mouse
gatcttgggggcccgcgggg

SEQ ID NO: 557125 - DNA, 20 bp, mouse
gcgccctcctggccactccc

SEQ ID NO: 557126 - DNA, 20 bp, mouse
gggtcaccctctaagctagt

SEQ ID NO: 557127 - DNA, 20 bp, mouse
gtggagcccactagcttaga

SEQ ID NO: 557128 - DNA, 20 bp, mouse
gcaacgcagacaggttccgg

SEQ ID NO: 557129 - DNA, 20 bp, mouse
gcgggtagtggacctcagag

SEQ ID NO: 557130 - DNA, 20 bp, mouse
gctgggagctcacagtcagg

SEQ ID NO: 557131 - DNA, 20 bp, mouse
gaatagctcagggaccccac

SEQ ID NO: 557132 - DNA, 20 bp, mouse
ggacaggttccggaggtgga

SEQ ID NO: 557133 - DNA, 20 bp, mouse
gacctgggaccggtcaccag

SEQ ID NO: 557134 - DNA, 20 bp, mouse
gtccttgaatagaaacccag

SEQ ID NO: 557135 - DNA, 20 bp, mouse
gagcaacgtggctggatgtg

SEQ ID NO: 557136 - DNA, 20 bp, mouse
gtgagacttgcgccagcctg

SEQ ID NO: 557137 - DNA, 20 bp, mouse
gaacactcgccgccacccgg

SEQ ID NO: 557138 - DNA, 20 bp, mouse
gaaggctggtgtctcacccc

SEQ ID NO: 557139 - DNA, 20 bp, mouse
gccttcgaaaaacctccggg

SEQ ID NO: 557140 - DNA, 20 bp, mouse
gctggtgtctcaccccaggc

SEQ ID NO: 557141 - DNA, 20 bp, mouse
gcccagccccggccccagag

SEQ ID NO: 557142 - DNA, 20 bp, mouse
gtcgaaaaacctccgggtgg

SEQ ID NO: 557143 - DNA, 20 bp, mouse
gacccactacagagcctcgg

SEQ ID NO: 557144 - DNA, 20 bp, mouse
gcagccttcgaaaaacctcc

SEQ ID NO: 557145 - DNA, 20 bp, mouse
gaggtggagccggagcctgt

SEQ ID NO: 557146 - DNA, 20 bp, mouse
gagctttctgaggaaggtac

SEQ ID NO: 557147 - DNA, 20 bp, mouse
gttcagcagctttctgagga

SEQ ID NO: 557148 - DNA, 20 bp, mouse
gtgtctgttctgccaatatt

SEQ ID NO: 557149 - DNA, 20 bp, mouse
gtactctatggctattagta

SEQ ID NO: 557150 - DNA, 20 bp, mouse
ggtctatgagattgtaacaa

SEQ ID NO: 557151 - DNA, 20 bp, mouse
ggagagggtgacctgtcctt

SEQ ID NO: 557152 - DNA, 20 bp, mouse
gtcctggcttatttactcta

SEQ ID NO: 557153 - DNA, 20 bp, mouse
gctgatggttacttaagaag

SEQ ID NO: 557154 - DNA, 20 bp, mouse
gtttctcacttgagaggaga

SEQ ID NO: 557155 - DNA, 20 bp, mouse
gaccttcttcaagctcatta

SEQ ID NO: 557156 - DNA, 20 bp, mouse
gttcgtcactgaattcatgt

SEQ ID NO: 557157 - DNA, 20 bp, mouse
gagaaggcagcttgaggtaa

SEQ ID NO: 557158 - DNA, 20 bp, mouse
gcctttctctgttttgtgga

SEQ ID NO: 557159 - DNA, 20 bp, mouse
gatcatacatttggtttatc

SEQ ID NO: 557160 - DNA, 20 bp, mouse
gtcccacattatcatacatt

SEQ ID NO: 557161 - DNA, 20 bp, mouse
gcttgctctctatataaagc

SEQ ID NO: 557162 - DNA, 20 bp, mouse
gggcagcttgaggtaaagga

SEQ ID NO: 557163 - DNA, 20 bp, mouse
gataaagctggagaacagga

SEQ ID NO: 557164 - DNA, 20 bp, mouse
gtggtttattaaaaagaaaa

SEQ ID NO: 557165 - DNA, 20 bp, mouse
gaccaaatgtatgataatgt

SEQ ID NO: 557166 - DNA, 20 bp, mouse
gccaggggtcgcgagccggt

SEQ ID NO: 557167 - DNA, 20 bp, mouse
gcggcgggaaagagatccct

SEQ ID NO: 557168 - DNA, 20 bp, mouse
gggcgtacggcggcggccag

SEQ ID NO: 557169 - DNA, 20 bp, mouse
ggagcagaggcgcaagccaa

SEQ ID NO: 557170 - DNA, 20 bp, mouse
gccgtcgcgcgggtcttgtg

SEQ ID NO: 557171 - DNA, 20 bp, mouse
ggtcttgtgcggctgaggag

SEQ ID NO: 557172 - DNA, 20 bp, mouse
gccacgcacgctccggcgta

SEQ ID NO: 557173 - DNA, 20 bp, mouse
gcgcacgctccggcgtacgg

SEQ ID NO: 557174 - DNA, 20 bp, mouse
gacgctccggcgtacggcgg

SEQ ID NO: 557175 - DNA, 20 bp, mouse
ggcagccactcacctcgtag

SEQ ID NO: 557176 - DNA, 20 bp, mouse
gactgaaagaatagctgtgg

SEQ ID NO: 557177 - DNA, 20 bp, mouse
gcaaggggaaagggcgggaa

SEQ ID NO: 557178 - DNA, 20 bp, mouse
gctcaactgccggaatttca

SEQ ID NO: 557179 - DNA, 20 bp, mouse
gggccctctgaagcaagaag

SEQ ID NO: 557180 - DNA, 20 bp, mouse
gatcgcgtgagctatcatgt

SEQ ID NO: 557181 - DNA, 20 bp, mouse
gagggcctgccctgaaattc

SEQ ID NO: 557182 - DNA, 20 bp, mouse
gataattcttaggattggaa

SEQ ID NO: 557183 - DNA, 20 bp, mouse
gattcttaggattggaaagg

SEQ ID NO: 557184 - DNA, 20 bp, mouse
gcatataatgtaggatgtct

SEQ ID NO: 557185 - DNA, 20 bp, mouse
gtagcttgcaactcaactgc

SEQ ID NO: 557186 - DNA, 20 bp, mouse
gccaagccaggcacgagtgg

SEQ ID NO: 557187 - DNA, 20 bp, mouse
gttcccaagccaggcacgag

SEQ ID NO: 557188 - DNA, 20 bp, mouse
gaggctccgtgcgttcggaa

SEQ ID NO: 557189 - DNA, 20 bp, mouse
gcgggtggcagtagcagggt

SEQ ID NO: 557190 - DNA, 20 bp, mouse
gagccaggcacgagtggcgg

SEQ ID NO: 557191 - DNA, 20 bp, mouse
gcgctaggcggcccaagcta

SEQ ID NO: 557192 - DNA, 20 bp, mouse
gaacggaggaaagatggcag

SEQ ID NO: 557193 - DNA, 20 bp, mouse
gctccgtgcgttcggaacgg

SEQ ID NO: 557194 - DNA, 20 bp, mouse
gggcggccgaagcgagcggg

SEQ ID NO: 557195 - DNA, 20 bp, mouse
gaggcggcggccgaagcgag

SEQ ID NO: 557196 - DNA, 20 bp, mouse
gcaggtgagccggagcgtcc

SEQ ID NO: 557197 - DNA, 20 bp, mouse
gggacgcgcacgaccagccc

SEQ ID NO: 557198 - DNA, 20 bp, mouse
gactcgccggcctgagctgg

SEQ ID NO: 557199 - DNA, 20 bp, mouse
gcaggccggcgagtttgccg

SEQ ID NO: 557200 - DNA, 20 bp, mouse
gtgggacaaggagcgtggcg

SEQ ID NO: 557201 - DNA, 20 bp, mouse
gcggcgggagacaggagtcg

SEQ ID NO: 557202 - DNA, 20 bp, mouse
gaggagcgtggcggggatga

SEQ ID NO: 557203 - DNA, 20 bp, mouse
gcgggacccagcgccaggaa

SEQ ID NO: 557204 - DNA, 20 bp, mouse
gcagggactgcccccagctc

SEQ ID NO: 557205 - DNA, 20 bp, mouse
gagcggcggcagcaccacca

SEQ ID NO: 557206 - DNA, 20 bp, mouse
ggcgcagtccgggagagctc

SEQ ID NO: 557207 - DNA, 20 bp, mouse
ggtctgaccgggaagctgca

SEQ ID NO: 557208 - DNA, 20 bp, mouse
gcgggcctggagagtgtcct

SEQ ID NO: 557209 - DNA, 20 bp, mouse
gcagctgcctggcgccggag

SEQ ID NO: 557210 - DNA, 20 bp, mouse
gcgctcccaggacactctcc

SEQ ID NO: 557211 - DNA, 20 bp, mouse
gatcggatgaagttcacctt

SEQ ID NO: 557212 - DNA, 20 bp, mouse
gtctccaggcccgcgacccc

SEQ ID NO: 557213 - DNA, 20 bp, mouse
ggccggagaggcatagaggg

SEQ ID NO: 557214 - DNA, 20 bp, mouse
gaccgccggagaggcataga

SEQ ID NO: 557215 - DNA, 20 bp, mouse
gggcgccgccaccgccggag

SEQ ID NO: 557216 - DNA, 20 bp, mouse
ggccgggccgctccaagtgc

SEQ ID NO: 557217 - DNA, 20 bp, mouse
gccaagagagctcagggcgg

SEQ ID NO: 557218 - DNA, 20 bp, mouse
gcagccgcgtgccccaacgg

SEQ ID NO: 557219 - DNA, 20 bp, mouse
gcggcccgagggcgccagga

SEQ ID NO: 557220 - DNA, 20 bp, mouse
gccagagctgaggccgggta

SEQ ID NO: 557221 - DNA, 20 bp, mouse
gagcggcccggctcccctcc

SEQ ID NO: 557222 - DNA, 20 bp, mouse
gagtcagcaacgcagccccg

SEQ ID NO: 557223 - DNA, 20 bp, mouse
ggcccagccgcgtgccccaa

SEQ ID NO: 557224 - DNA, 20 bp, mouse
ggccggcgagttggcgaagt

SEQ ID NO: 557225 - DNA, 20 bp, mouse
ggcagtgcatatccatcggg

SEQ ID NO: 557226 - DNA, 20 bp, mouse
gtcacgacgggaggagactt

SEQ ID NO: 557227 - DNA, 20 bp, mouse
ggcgaagatcgggtgaggga

SEQ ID NO: 557228 - DNA, 20 bp, mouse
gcaccgcgaagatcgggtga

SEQ ID NO: 557229 - DNA, 20 bp, mouse
gtcactgcaccgcgaagatc

SEQ ID NO: 557230 - DNA, 20 bp, mouse
gagatccggagagttcccga

SEQ ID NO: 557231 - DNA, 20 bp, mouse
gggccgggccgcatcatcct

SEQ ID NO: 557232 - DNA, 20 bp, mouse
gctgcactcggtgtcacgac

SEQ ID NO: 557233 - DNA, 20 bp, mouse
gcagctggggctactggcaa

SEQ ID NO: 557234 - DNA, 20 bp, mouse
gcagatcggcccctcagctg

SEQ ID NO: 557235 - DNA, 20 bp, mouse
gggaggagctctccgagatc

SEQ ID NO: 557236 - DNA, 20 bp, mouse
gtgtgaagctctggaccccc

SEQ ID NO: 557237 - DNA, 20 bp, mouse
gaagctctggaccccctggc

SEQ ID NO: 557238 - DNA, 20 bp, mouse
ggctgcttcagtcctgccag

SEQ ID NO: 557239 - DNA, 20 bp, mouse
gtgcatagctgtaaagacag

SEQ ID NO: 557240 - DNA, 20 bp, mouse
gcttcacagagccttcactc

SEQ ID NO: 557241 - DNA, 20 bp, mouse
gaggctccagggtttgctgg

SEQ ID NO: 557242 - DNA, 20 bp, mouse
gtgaaggctctgtgaagctc

SEQ ID NO: 557243 - DNA, 20 bp, mouse
gtgctggtgagctacctgga

SEQ ID NO: 557244 - DNA, 20 bp, mouse
gccagaccaccagcaaaccc

SEQ ID NO: 557245 - DNA, 20 bp, mouse
gtatactggtgccatgtggg

SEQ ID NO: 557246 - DNA, 20 bp, mouse
gctggggcccgctcacaagt

SEQ ID NO: 557247 - DNA, 20 bp, mouse
gatcagctaccccagctcgg

SEQ ID NO: 557248 - DNA, 20 bp, mouse
gagctaccccagctcggcgg

SEQ ID NO: 557249 - DNA, 20 bp, mouse
gagctcggcgggggagcgga

SEQ ID NO: 557250 - DNA, 20 bp, mouse
ggtgatcagctaccccagct

SEQ ID NO: 557251 - DNA, 20 bp, mouse
gccccagctcggcgggggag

SEQ ID NO: 557252 - DNA, 20 bp, mouse
gctcctcggaccatcaggac

SEQ ID NO: 557253 - DNA, 20 bp, mouse
gaattattccgacttgtgag

SEQ ID NO: 557254 - DNA, 20 bp, mouse
gtacctgtcctgatggtccg

SEQ ID NO: 557255 - DNA, 20 bp, mouse
gtagcatggatactagcact

SEQ ID NO: 557256 - DNA, 20 bp, mouse
gcgttgacatttaaactctg

SEQ ID NO: 557257 - DNA, 20 bp, mouse
gagtagcagatctgacaacc

SEQ ID NO: 557258 - DNA, 20 bp, mouse
gtctcaaagccgcttctcgg

SEQ ID NO: 557259 - DNA, 20 bp, mouse
gtcaaggccggggccactcg

SEQ ID NO: 557260 - DNA, 20 bp, mouse
ggctacttccccccgagaag

SEQ ID NO: 557261 - DNA, 20 bp, mouse
ggaggggcgccgctactctt

SEQ ID NO: 557262 - DNA, 20 bp, mouse
gaagcggctttgagaagtgt

SEQ ID NO: 557263 - DNA, 20 bp, mouse
gccccagctcagggccagac

SEQ ID NO: 557264 - DNA, 20 bp, mouse
gggccggggccactcgggga

SEQ ID NO: 557265 - DNA, 20 bp, mouse
ggaacacacaggttgcacgt

SEQ ID NO: 557266 - DNA, 20 bp, mouse
ggagtggaaggaaggaccgg

SEQ ID NO: 557267 - DNA, 20 bp, mouse
ggagactagggcgagaggga

SEQ ID NO: 557268 - DNA, 20 bp, mouse
gaatttatcaggaggctcca

SEQ ID NO: 557269 - DNA, 20 bp, mouse
gcgtagagactagggcgaga

SEQ ID NO: 557270 - DNA, 20 bp, mouse
gctcctggagtcaatttatc

SEQ ID NO: 557271 - DNA, 20 bp, mouse
gtgtcttgtcgtagagacta

SEQ ID NO: 557272 - DNA, 20 bp, mouse
gggagggcggagttcagcag

SEQ ID NO: 557273 - DNA, 20 bp, mouse
gctagacagaagccctctca

SEQ ID NO: 557274 - DNA, 20 bp, mouse
gctggagtcaatttatcagg

SEQ ID NO: 557275 - DNA, 20 bp, mouse
ggctaagaagcacaggctcc

SEQ ID NO: 557276 - DNA, 20 bp, mouse
gccagcgtgcgcaggaatgg

SEQ ID NO: 557277 - DNA, 20 bp, mouse
gtctccagcgtgcgcaggaa

SEQ ID NO: 557278 - DNA, 20 bp, mouse
ggccgggtctcatcatcctg

SEQ ID NO: 557279 - DNA, 20 bp, mouse
gctggagacgaatccagagt

SEQ ID NO: 557280 - DNA, 20 bp, mouse
gtccccaggatgatgagacc

SEQ ID NO: 557281 - DNA, 20 bp, mouse
gcggagatggcaccctccag

SEQ ID NO: 557282 - DNA, 20 bp, mouse
gtgggtcccagtctccgcgt

SEQ ID NO: 557283 - DNA, 20 bp, mouse
gtcatcctggggaccgcgcc

SEQ ID NO: 557284 - DNA, 20 bp, mouse
ggtcggctggataaacctct

SEQ ID NO: 557285 - DNA, 20 bp, mouse
gcctccaggggagcgagcag

SEQ ID NO: 557286 - DNA, 20 bp, mouse
gcaccctcaggggcagaccc

SEQ ID NO: 557287 - DNA, 20 bp, mouse
ggggccttgggcaccctcag

SEQ ID NO: 557288 - DNA, 20 bp, mouse
gtgcctgggtctgcccctga

SEQ ID NO: 557289 - DNA, 20 bp, mouse
ggggcagacccaggcagaaa

SEQ ID NO: 557290 - DNA, 20 bp, mouse
gtcagaaggaagagacgcct

SEQ ID NO: 557291 - DNA, 20 bp, mouse
gctgcccctgagggtgccca

SEQ ID NO: 557292 - DNA, 20 bp, mouse
gctggcgatgccaggtggat

SEQ ID NO: 557293 - DNA, 20 bp, mouse
gtgcctgttgggaggatcca

SEQ ID NO: 557294 - DNA, 20 bp, mouse
gggccaggtatgtcacctag

SEQ ID NO: 557295 - DNA, 20 bp, mouse
ggatgggagcaaacttcaga

SEQ ID NO: 557296 - DNA, 20 bp, mouse
ggtctgtgccgggctgaaag

SEQ ID NO: 557297 - DNA, 20 bp, mouse
ggaggcgacaagagtgccaa

SEQ ID NO: 557298 - DNA, 20 bp, mouse
ggccttggcttcttcccggg

SEQ ID NO: 557299 - DNA, 20 bp, mouse
gacgttgtcagatccgagga

SEQ ID NO: 557300 - DNA, 20 bp, mouse
gggagggagcgagcaggcga

SEQ ID NO: 557301 - DNA, 20 bp, mouse
gcgagcaggcgagggctaga

SEQ ID NO: 557302 - DNA, 20 bp, mouse
gactcaagcctctttcagcc

SEQ ID NO: 557303 - DNA, 20 bp, mouse
ggtaaaaggaagtctgtgcc

SEQ ID NO: 557304 - DNA, 20 bp, mouse
gtgtcagatccgaggaggga

SEQ ID NO: 557305 - DNA, 20 bp, mouse
gttggcttcttcccgggagg

SEQ ID NO: 557306 - DNA, 20 bp, mouse
gtcgctgactgagaggacga

SEQ ID NO: 557307 - DNA, 20 bp, mouse
gcagccgctcgctgactgag

SEQ ID NO: 557308 - DNA, 20 bp, mouse
gtgtgagagcgcggtgacgg

SEQ ID NO: 557309 - DNA, 20 bp, mouse
gggctgtgagagcgcggtga

SEQ ID NO: 557310 - DNA, 20 bp, mouse
gctgagaggacgagggagcg

SEQ ID NO: 557311 - DNA, 20 bp, mouse
gcgcaagcggaacgactcgg

SEQ ID NO: 557312 - DNA, 20 bp, mouse
gcttctcccgaggccggcgg

SEQ ID NO: 557313 - DNA, 20 bp, mouse
gaggccggcgggggcagcaa

SEQ ID NO: 557314 - DNA, 20 bp, mouse
gcgggagaagagcccggccc

SEQ ID NO: 557315 - DNA, 20 bp, mouse
ggatgttccgaaaggcccgg

SEQ ID NO: 557316 - DNA, 20 bp, mouse
gagctctgcctactgcccgg

SEQ ID NO: 557317 - DNA, 20 bp, mouse
ggcgggtccgagtgcagctg

SEQ ID NO: 557318 - DNA, 20 bp, mouse
gggctgtgccgccgggcagt

SEQ ID NO: 557319 - DNA, 20 bp, mouse
gtaggcagagctacgacgct

SEQ ID NO: 557320 - DNA, 20 bp, mouse
gagagctacgacgctgggcg

SEQ ID NO: 557321 - DNA, 20 bp, mouse
ggctacgacgctgggcgcgg

SEQ ID NO: 557322 - DNA, 20 bp, mouse
gggctccgacatgatcgcgg

SEQ ID NO: 557323 - DNA, 20 bp, mouse
gcgcgcgcgcgacgaggcgg

SEQ ID NO: 557324 - DNA, 20 bp, mouse
gcgcgctccgggcctcggac

SEQ ID NO: 557325 - DNA, 20 bp, mouse
gaccctaagggaaaaatcag

SEQ ID NO: 557326 - DNA, 20 bp, mouse
gtgtcgccgctaggtaagtg

SEQ ID NO: 557327 - DNA, 20 bp, mouse
gctccagagtagtatctcac

SEQ ID NO: 557328 - DNA, 20 bp, mouse
gagccggtgagatactactc

SEQ ID NO: 557329 - DNA, 20 bp, mouse
gcgcgcaacaggtcacttcc

SEQ ID NO: 557330 - DNA, 20 bp, mouse
gggagggtgagagagcgcat

SEQ ID NO: 557331 - DNA, 20 bp, mouse
gtgggaagccacagcaccag

SEQ ID NO: 557332 - DNA, 20 bp, mouse
gaccggctcttcgctttcgc

SEQ ID NO: 557333 - DNA, 20 bp, mouse
gcgttgccatatgactccgg

SEQ ID NO: 557334 - DNA, 20 bp, mouse
gctgggtgggcgggaagttg

SEQ ID NO: 557335 - DNA, 20 bp, mouse
gaagtgcggctttctcgtcc

SEQ ID NO: 557336 - DNA, 20 bp, mouse
gcggcggttactgcgagtgt

SEQ ID NO: 557337 - DNA, 20 bp, mouse
gggttactgcgagtgttggc

SEQ ID NO: 557338 - DNA, 20 bp, mouse
gccgccagaagactacgggg

SEQ ID NO: 557339 - DNA, 20 bp, mouse
ggagcgtgcgagcgtggtaa

SEQ ID NO: 557340 - DNA, 20 bp, mouse
gactgcgagtgttggcggga

SEQ ID NO: 557341 - DNA, 20 bp, mouse
gtgcttcttacacaccgcgg

SEQ ID NO: 557342 - DNA, 20 bp, mouse
gaaggccgcggcccgccgag

SEQ ID NO: 557343 - DNA, 20 bp, mouse
ggactcgctccagaaaatgc

SEQ ID NO: 557344 - DNA, 20 bp, mouse
ggcaaactgagggtacacag

SEQ ID NO: 557345 - DNA, 20 bp, mouse
gggagcatcgaggacctgag

SEQ ID NO: 557346 - DNA, 20 bp, mouse
gtggcagcagctgggagtcg

SEQ ID NO: 557347 - DNA, 20 bp, mouse
gtagctgctagaggagcccc

SEQ ID NO: 557348 - DNA, 20 bp, mouse
gtcctagcgcaacgaagcag

SEQ ID NO: 557349 - DNA, 20 bp, mouse
gccctgtgtaagggtcgatg

SEQ ID NO: 557350 - DNA, 20 bp, mouse
gtggagcgtggaggacaaac

SEQ ID NO: 557351 - DNA, 20 bp, mouse
ggggctacatagcagatcct

SEQ ID NO: 557352 - DNA, 20 bp, mouse
gtcctcgctggctttgtctg

SEQ ID NO: 557353 - DNA, 20 bp, mouse
gctgctatctgatagaacaa

SEQ ID NO: 557354 - DNA, 20 bp, mouse
gttaagatgtggtaagaaga

SEQ ID NO: 557355 - DNA, 20 bp, mouse
gtctctaaaggtaaccatat

SEQ ID NO: 557356 - DNA, 20 bp, mouse
ggcgtggagtcgcagcgagt

SEQ ID NO: 557357 - DNA, 20 bp, mouse
gagtcgcagcgagtgggctg

SEQ ID NO: 557358 - DNA, 20 bp, mouse
gcgcagcgagtgggctgtgg

SEQ ID NO: 557359 - DNA, 20 bp, mouse
ggactccacgcccaccacgg

SEQ ID NO: 557360 - DNA, 20 bp, mouse
gcgtgagctccggggttcag

SEQ ID NO: 557361 - DNA, 20 bp, mouse
gcagagggttggtcggtcgg

SEQ ID NO: 557362 - DNA, 20 bp, mouse
ggctccggggttcagagggt

SEQ ID NO: 557363 - DNA, 20 bp, mouse
gggctcctcagaggcccgtg

SEQ ID NO: 557364 - DNA, 20 bp, mouse
gtgcgactccacgcccacca

SEQ ID NO: 557365 - DNA, 20 bp, mouse
ggcccggttgccaccgtggt

SEQ ID NO: 557366 - DNA, 20 bp, mouse
gccacttcgtggaggctcag

SEQ ID NO: 557367 - DNA, 20 bp, mouse
gtgacccgcagtaggtgctg

SEQ ID NO: 557368 - DNA, 20 bp, mouse
gctgctcatccacttcgtgg

SEQ ID NO: 557369 - DNA, 20 bp, mouse
gtgtctgtaggcatggtgag

SEQ ID NO: 557370 - DNA, 20 bp, mouse
gtccacatgctcatgtctgt

SEQ ID NO: 557371 - DNA, 20 bp, mouse
ggggctgctcatccacttcg

SEQ ID NO: 557372 - DNA, 20 bp, mouse
gtgggttccggacctcccaa

SEQ ID NO: 557373 - DNA, 20 bp, mouse
gtccgggtctgtgaggatca

SEQ ID NO: 557374 - DNA, 20 bp, mouse
gccggtctggagaccatcgt

SEQ ID NO: 557375 - DNA, 20 bp, mouse
gagacatgagcatgtggacc

SEQ ID NO: 557376 - DNA, 20 bp, mouse
gctggccgcggccgtctctc

SEQ ID NO: 557377 - DNA, 20 bp, mouse
gtttacggcagcactgggag

SEQ ID NO: 557378 - DNA, 20 bp, mouse
gagaggagcgctagcagccg

SEQ ID NO: 557379 - DNA, 20 bp, mouse
gggagcgctagcagccgtgg

SEQ ID NO: 557380 - DNA, 20 bp, mouse
gcggccacaggttggattta

SEQ ID NO: 557381 - DNA, 20 bp, mouse
ggcacctgccgccgggacaa

SEQ ID NO: 557382 - DNA, 20 bp, mouse
gcccgcccgggccgacacaa

SEQ ID NO: 557383 - DNA, 20 bp, mouse
gtcgcctggcggccacaggt

SEQ ID NO: 557384 - DNA, 20 bp, mouse
ggcgcgtccgcaccacgggg

SEQ ID NO: 557385 - DNA, 20 bp, mouse
ggctagcgctcctctggccg

SEQ ID NO: 557386 - DNA, 20 bp, mouse
gcacatgcagtgtgagcagg

SEQ ID NO: 557387 - DNA, 20 bp, mouse
gcagtcgctcacacatgatg

SEQ ID NO: 557388 - DNA, 20 bp, mouse
gtatctggacctcactgaaa

SEQ ID NO: 557389 - DNA, 20 bp, mouse
gtagcacatgcagtgtgagc

SEQ ID NO: 557390 - DNA, 20 bp, mouse
gtgtatgtggtgggcatgtt

SEQ ID NO: 557391 - DNA, 20 bp, mouse
gagaaggtagcagacctgtg

SEQ ID NO: 557392 - DNA, 20 bp, mouse
ggagggggctttgtgcaggt

SEQ ID NO: 557393 - DNA, 20 bp, mouse
gttcctggagaatttaacta

SEQ ID NO: 557394 - DNA, 20 bp, mouse
ggtagcagacctgtgtggaa

SEQ ID NO: 557395 - DNA, 20 bp, mouse
ggggatggacaactaccctc

SEQ ID NO: 557396 - DNA, 20 bp, mouse
gggagtttgcagagacacgg

SEQ ID NO: 557397 - DNA, 20 bp, mouse
gagatcacccccagccgtgg

SEQ ID NO: 557398 - DNA, 20 bp, mouse
ggcctgggctaaacaaaagc

SEQ ID NO: 557399 - DNA, 20 bp, mouse
gtgggctaaacaaaagcagg

SEQ ID NO: 557400 - DNA, 20 bp, mouse
ggccagatcacccccagccg

SEQ ID NO: 557401 - DNA, 20 bp, mouse
ggccagagtgatctcaaagg

SEQ ID NO: 557402 - DNA, 20 bp, mouse
gctcccggcgcttaaatctg

SEQ ID NO: 557403 - DNA, 20 bp, mouse
gcgggccagagtgatctcaa

SEQ ID NO: 557404 - DNA, 20 bp, mouse
gaccacagcctgagaggagg

SEQ ID NO: 557405 - DNA, 20 bp, mouse
gaggaggctgacggggctgc

SEQ ID NO: 557406 - DNA, 20 bp, mouse
gaggagaccccggcccccgg

SEQ ID NO: 557407 - DNA, 20 bp, mouse
gagagaggaggcccaagcgg

SEQ ID NO: 557408 - DNA, 20 bp, mouse
gcccccggcggcggagaaaa

SEQ ID NO: 557409 - DNA, 20 bp, mouse
ggcacccccacaggagaccc

SEQ ID NO: 557410 - DNA, 20 bp, mouse
ggccctggcgagcctcccgg

SEQ ID NO: 557411 - DNA, 20 bp, mouse
ggcactgaaggggagacccg

SEQ ID NO: 557412 - DNA, 20 bp, mouse
gggttcaccccggcactgaa

SEQ ID NO: 557413 - DNA, 20 bp, mouse
ggagacccggggtgccgcct

SEQ ID NO: 557414 - DNA, 20 bp, mouse
gccccccagctatggacgag

SEQ ID NO: 557415 - DNA, 20 bp, mouse
gcacggcccccgcccggagg

SEQ ID NO: 557416 - DNA, 20 bp, mouse
gggggtagagtggagtccga

SEQ ID NO: 557417 - DNA, 20 bp, mouse
gctgccgcttcccgaagcta

SEQ ID NO: 557418 - DNA, 20 bp, mouse
gagtgggaatcggggtagag
